United States Patent 7,618,814 (MICRORNA-RELATED NUCLEIC ACIDS AND USES THEREOF) - sequence listing, part 11

SEQ ID NO: 401002 - RNA, 32 nt, Human
cugacagaugcuuuugcuaauaccaaaauuga

SEQ ID NO: 401003 - RNA, 32 nt, Human
cugacagauggacagaaucucccguagaaagg

SEQ ID NO: 401004 - RNA, 32 nt, Human
cugacagauggcaggggagcaagagcaaguua

SEQ ID NO: 401005 - RNA, 21 nt, Human
cugacagcacaggacccugca

SEQ ID NO: 401006 - RNA, 17 nt, Human
cugacagcaccucagcu

SEQ ID NO: 401007 - RNA, 18 nt, Human
cugacagcaccugugucu

SEQ ID NO: 401008 - RNA, 20 nt, Human
cugacagcaccuugccgccu

SEQ ID NO: 401009 - RNA, 21 nt, Human
cugacagcagcaaaggcacca

SEQ ID NO: 401010 - RNA, 18 nt, Human
cugacagcagccagcuca

SEQ ID NO: 401011 - RNA, 32 nt, Human
cugacagcaggcaagcuucaguuugggcugug

SEQ ID NO: 401012 - RNA, 32 nt, Human
cugacagcaggccagggaagcagugaggccuu

SEQ ID NO: 401013 - RNA, 32 nt, Human
cugacagcaguuuuucauagccucacggauga

SEQ ID NO: 401014 - RNA, 18 nt, Human
cugacagcaugaacuuca

SEQ ID NO: 401015 - RNA, 32 nt, Human
cugacagcauguggugacaggugaugugaggg

SEQ ID NO: 401016 - RNA, 24 nt, Human
cugacagccaaggcagggcacugu

SEQ ID NO: 401017 - RNA, 32 nt, Human
cugacagccagccugccugcugggagccagga

SEQ ID NO: 401018 - RNA, 18 nt, Human
cugacagccccgggccca

SEQ ID NO: 401019 - RNA, 17 nt, Human
cugacagccgcggccuc

SEQ ID NO: 401020 - RNA, 18 nt, Human
cugacagcgccaguccca

SEQ ID NO: 401021 - RNA, 18 nt, Human
cugacagcgcccaccuca

SEQ ID NO: 401022 - RNA, 20 nt, Human
cugacagcggccugacuuca

SEQ ID NO: 401023 - RNA, 32 nt, Human
cugacagcuaucuccuccccuucuccaccaca

SEQ ID NO: 401024 - RNA, 32 nt, Human
cugacagcucacuggaacuuuucaucugcuug

SEQ ID NO: 401025 - RNA, 32 nt, Human
cugacagcuggugacagaugaagacggaagaa

SEQ ID NO: 401026 - RNA, 20 nt, Human
cugacagcuguccugagcua

SEQ ID NO: 401027 - RNA, 32 nt, Human
cugacagcugucgugcccgcagccucugaccu

SEQ ID NO: 401028 - RNA, 18 nt, Human
cugacagcuucagcccca

SEQ ID NO: 401029 - RNA, 32 nt, Human
cugacaggacagucccagcccuaggaaaugaa

SEQ ID NO: 401030 - RNA, 32 nt, Human
cugacaggagcagcagcuaucugucuuuugcu

SEQ ID NO: 401031 - RNA, 32 nt, Human
cugacaggagcaggagacgcugagggaaacag

SEQ ID NO: 401032 - RNA, 32 nt, Human
cugacaggagcgccaggcuccuugggccgccc

SEQ ID NO: 401033 - RNA, 32 nt, Human
cugacaggaguccaagaaugugcacugaggga

SEQ ID NO: 401034 - RNA, 32 nt, Human
cugacaggauuccaaaagccugcuguuugaag

SEQ ID NO: 401035 - RNA, 32 nt, Human
cugacaggcccacugaggacaugggagaggau

SEQ ID NO: 401036 - RNA, 32 nt, Human
cugacaggcccagauuuaggagucaugacgaa

SEQ ID NO: 401037 - RNA, 32 nt, Human
cugacaggcugacaguugggccauauggugcu

SEQ ID NO: 401038 - RNA, 32 nt, Human
cugacaggcuguugcugugccugcucacaccu

SEQ ID NO: 401039 - RNA, 32 nt, Human
cugacagggacgcuggccaacagggugguauu

SEQ ID NO: 401040 - RNA, 32 nt, Human
cugacagggcaccgucaccugacaacuccugc

SEQ ID NO: 401041 - RNA, 32 nt, Human
cugacagggcaugccuugucuccagugguucc

SEQ ID NO: 401042 - RNA, 21 nt, Human
cugacagggcugccuggccuc

SEQ ID NO: 401043 - RNA, 31 nt, Human
cugacaggguaagaagagugagucucaagag

SEQ ID NO: 401044 - RNA, 32 nt, Human
cugacagggucaccuccuccacagagagaauu

SEQ ID NO: 401045 - RNA, 32 nt, Human
cugacagggucuggcuugcccaggcuggagug

SEQ ID NO: 401046 - RNA, 32 nt, Human
cugacagggugaggcccaagccuggagcuuac

SEQ ID NO: 401047 - RNA, 32 nt, Human
cugacaggguuauuguagaacugacauccugg

SEQ ID NO: 401048 - RNA, 32 nt, Human
cugacaggugcuggaugccacaguucccugca

SEQ ID NO: 401049 - RNA, 32 nt, Human
cugacaggugguuacugaaucucucuaugaac

SEQ ID NO: 401050 - RNA, 32 nt, Human
cugacaguaguuugcaaaccagcagcuagcag

SEQ ID NO: 401051 - RNA, 32 nt, Human
cugacagucacuggaaugcuacuccaggccuu

SEQ ID NO: 401052 - RNA, 32 nt, Human
cugacagucauccugggagggucacaguccuc

SEQ ID NO: 401053 - RNA, 32 nt, Human
cugacaguccucuccaccuaguggcuguccag

SEQ ID NO: 401054 - RNA, 32 nt, Human
cugacagugacuccucucucuccagcgcugcc

SEQ ID NO: 401055 - RNA, 32 nt, Human
cugacaguggcagaagcucagcugacaaggac

SEQ ID NO: 401056 - RNA, 22 nt, Human
cugacaguggggccuggccuca

SEQ ID NO: 401057 - RNA, 32 nt, Human
cugacaguguggagaaaccaacaggcaaaacg

SEQ ID NO: 401058 - RNA, 29 nt, Human
cugacaguguuuuaggugccuggauauuu

SEQ ID NO: 401059 - RNA, 22 nt, Human
cugacaguuaaagcagaggacu

SEQ ID NO: 401060 - RNA, 18 nt, Human
cugacaguuucugaggca

SEQ ID NO: 401061 - RNA, 32 nt, Human
cugacauaggaagaugaaagagacugacuugu

SEQ ID NO: 401062 - RNA, 32 nt, Human
cugacauaguaaucccaaaggauuguguuacu

SEQ ID NO: 401063 - RNA, 32 nt, Human
cugacauauuaaagaucuccucuuuuaaacau

SEQ ID NO: 401064 - RNA, 32 nt, Human
cugacaucaggaguucgagaccagccuggcua

SEQ ID NO: 401065 - RNA, 32 nt, Human
cugacaucaggaguuugagaccagcuuggcca

SEQ ID NO: 401066 - RNA, 32 nt, Human
cugacaucauguccuucaacugcuccacaaga

SEQ ID NO: 401067 - RNA, 32 nt, Human
cugacauccauuguauauacuaguuucuuuca

SEQ ID NO: 401068 - RNA, 21 nt, Human
cugacaucccaaaaccaucuu

SEQ ID NO: 401069 - RNA, 32 nt, Human
cugacauccuccuucaggaacacggggagcag

SEQ ID NO: 401070 - RNA, 32 nt, Human
cugacauccugagacacugagaaauguccuga

SEQ ID NO: 401071 - RNA, 32 nt, Human
cugacaucucauccguuuguguuuccaaaagc

SEQ ID NO: 401072 - RNA, 25 nt, Human
cugacaucuuaacuacaaccucaug

SEQ ID NO: 401073 - RNA, 32 nt, Human
cugacaugccagcccccugccaccucagcccc

SEQ ID NO: 401074 - RNA, 32 nt, Human
cugacaugccagcccccugccaccucggcccc

SEQ ID NO: 401075 - RNA, 32 nt, Human
cugacaugcccagggcuccacucucaucuaau

SEQ ID NO: 401076 - RNA, 23 nt, Human
cugacaugcccucccuucucccu

SEQ ID NO: 401077 - RNA, 32 nt, Human
cugacaugcucacacacugucauacucacaca

SEQ ID NO: 401078 - RNA, 32 nt, Human
cugacaugggccaagaccaggaaggaagggcc

SEQ ID NO: 401079 - RNA, 32 nt, Human
cugacaugugcgaugcauccccauggagagac

SEQ ID NO: 401080 - RNA, 32 nt, Human
cugacauucagcugccuugcaguugcuuccuc

SEQ ID NO: 401081 - RNA, 32 nt, Human
cugacauuucaggcacuggcacagauacauug

SEQ ID NO: 401082 - RNA, 32 nt, Human
cugacauuucuucuagugaugaugguucacgu

SEQ ID NO: 401083 - RNA, 31 nt, Human
cugacauuugcuccuuuaccugugucuugag

SEQ ID NO: 401084 - RNA, 32 nt, Human
cugaccaaaaauucacugaccaaccaaccaaa

SEQ ID NO: 401085 - RNA, 32 nt, Human
cugaccaaaaccagagggcagucuaguccugg

SEQ ID NO: 401086 - RNA, 32 nt, Human
cugaccaaaacggagaaacccagucucuacug

SEQ ID NO: 401087 - RNA, 22 nt, Human
cugaccaaaauggagaaacccc

SEQ ID NO: 401088 - RNA, 24 nt, Human
cugaccaaaauggugaaaccccgu

SEQ ID NO: 401089 - RNA, 32 nt, Human
cugaccaaaauggugaaaccccgucucuacua

SEQ ID NO: 401090 - RNA, 24 nt, Human
cugaccaaaauggugaaacccugu

SEQ ID NO: 401091 - RNA, 32 nt, Human
cugaccaaaauggugaaacccugucucuacua

SEQ ID NO: 401092 - RNA, 32 nt, Human
cugaccaaaauggugaaaccuccucucuacua

SEQ ID NO: 401093 - RNA, 23 nt, Human
cugaccaaacauggcgaaacccc

SEQ ID NO: 401094 - RNA, 27 nt, Human
cugaccaacaacauggagaaaccccgu

SEQ ID NO: 401095 - RNA, 21 nt, Human
cugaccaacacgaugaaaccc

SEQ ID NO: 401096 - RNA, 24 nt, Human
cugaccaacacgaugaaacccugu

SEQ ID NO: 401097 - RNA, 22 nt, Human
cugaccaacacggagaaacccc

SEQ ID NO: 401098 - RNA, 22 nt, Human
cugaccaacacggagaaacccu

SEQ ID NO: 401099 - RNA, 21 nt, Human
cugaccaacacggugaaaccc

SEQ ID NO: 401100 - RNA, 32 nt, Human
cugaccaacacggugaaaccccaucucuacua

SEQ ID NO: 401101 - RNA, 24 nt, Human
cugaccaacacggugaaaccccgu

SEQ ID NO: 401102 - RNA, 32 nt, Human
cugaccaacacggugaaaccccgucucuacua

SEQ ID NO: 401103 - RNA, 22 nt, Human
cugaccaacacugagaaacccc

SEQ ID NO: 401104 - RNA, 21 nt, Human
cugaccaacauagugaaaccc

SEQ ID NO: 401105 - RNA, 22 nt, Human
cugaccaacauagugaaacccc

SEQ ID NO: 401106 - RNA, 32 nt, Human
cugaccaacauagugaaaccccaucucuacua

SEQ ID NO: 401107 - RNA, 32 nt, Human
cugaccaacauagugaaacccccgucucuacu

SEQ ID NO: 401108 - RNA, 24 nt, Human
cugaccaacaugaagaaacccugu

SEQ ID NO: 401109 - RNA, 21 nt, Human
cugaccaacaugacaaaaccc

SEQ ID NO: 401110 - RNA, 24 nt, Human
cugaccaacaugacaaaaccccgu

SEQ ID NO: 401111 - RNA, 32 nt, Human
cugaccaacaugaugaaacccccgucucuacu

SEQ ID NO: 401112 - RNA, 32 nt, Human
cugaccaacaugaugaaaccccguugcuacua

SEQ ID NO: 401113 - RNA, 22 nt, Human
cugaccaacaugaugaaaugcc

SEQ ID NO: 401114 - RNA, 24 nt, Human
cugaccaacaugaugaaaugccau

SEQ ID NO: 401115 - RNA, 32 nt, Human
cugaccaacaugcugaaacccagucucuacua

SEQ ID NO: 401116 - RNA, 24 nt, Human
cugaccaacauggaaaaacaccgu

SEQ ID NO: 401117 - RNA, 24 nt, Human
cugaccaacauggaaaaaccccgu

SEQ ID NO: 401118 - RNA, 32 nt, Human
cugaccaacauggaaaaaccccgucucuacua

SEQ ID NO: 401119 - RNA, 24 nt, Human
cugaccaacauggacaaaccccgu

SEQ ID NO: 401120 - RNA, 32 nt, Human
cugaccaacauggacaaaccccgucucuacua

SEQ ID NO: 401121 - RNA, 21 nt, Human
cugaccaacauggagaaaccc

SEQ ID NO: 401122 - RNA, 32 nt, Human
cugaccaacauggagaaacccaaucucuacua

SEQ ID NO: 401123 - RNA, 24 nt, Human
cugaccaacauggagaaacccagu

SEQ ID NO: 401124 - RNA, 32 nt, Human
cugaccaacauggagaaacccagucucuacug

SEQ ID NO: 401125 - RNA, 24 nt, Human
cugaccaacauggagaaacccauc

SEQ ID NO: 401126 - RNA, 22 nt, Human
cugaccaacauggagaaacccc

SEQ ID NO: 401127 - RNA, 32 nt, Human
cugaccaacauggagaaaccccaucuccacua

SEQ ID NO: 401128 - RNA, 32 nt, Human
cugaccaacauggagaaaccccaucucuacua

SEQ ID NO: 401129 - RNA, 32 nt, Human
cugaccaacauggagaaaccccaucucucccg

SEQ ID NO: 401130 - RNA, 32 nt, Human
cugaccaacauggagaaaccccaucuguacua

SEQ ID NO: 401131 - RNA, 32 nt, Human
cugaccaacauggagaaaccccauuucuacua

SEQ ID NO: 401132 - RNA, 32 nt, Human
cugaccaacauggagaaacccccaucucuacu

SEQ ID NO: 401133 - RNA, 24 nt, Human
cugaccaacauggagaaaccccgu

SEQ ID NO: 401134 - RNA, 32 nt, Human
cugaccaacauggagaaaccccgucccuacua

SEQ ID NO: 401135 - RNA, 32 nt, Human
cugaccaacauggagaaaccccgucucuacua

SEQ ID NO: 401136 - RNA, 32 nt, Human
cugaccaacauggagaaaccccgucucuauug

SEQ ID NO: 401137 - RNA, 32 nt, Human
cugaccaacauggagaaaccccgucucugcua

SEQ ID NO: 401138 - RNA, 32 nt, Human
cugaccaacauggagaaaccccgugucuacua

SEQ ID NO: 401139 - RNA, 32 nt, Human
cugaccaacauggagaaaccccugucucuguu

SEQ ID NO: 401140 - RNA, 32 nt, Human
cugaccaacauggagaaacccgucucuacuaa

SEQ ID NO: 401141 - RNA, 22 nt, Human
cugaccaacauggagaaacccu

SEQ ID NO: 401142 - RNA, 32 nt, Human
cugaccaacauggagaaacccuaucucuacua

SEQ ID NO: 401143 - RNA, 23 nt, Human
cugaccaacauggagaaacccug

SEQ ID NO: 401144 - RNA, 28 nt, Human
cugaccaacauggagaaacccugccucu

SEQ ID NO: 401145 - RNA, 24 nt, Human
cugaccaacauggagaaacccugu

SEQ ID NO: 401146 - RNA, 32 nt, Human
cugaccaacauggagaaacccugucucaacua

SEQ ID NO: 401147 - RNA, 32 nt, Human
cugaccaacauggagaaacccugucuccacua

SEQ ID NO: 401148 - RNA, 32 nt, Human
cugaccaacauggagaaacccugucucuacua

SEQ ID NO: 401149 - RNA, 32 nt, Human
cugaccaacauggagaaacccugucucuauua

SEQ ID NO: 401150 - RNA, 32 nt, Human
cugaccaacauggagaaaccucgucucuacua

SEQ ID NO: 401151 - RNA, 22 nt, Human
cugaccaacauggagaaacgcc

SEQ ID NO: 401152 - RNA, 32 nt, Human
cugaccaacauggagaaacgccaucucuacua

SEQ ID NO: 401153 - RNA, 22 nt, Human
cugaccaacauggagaaacucc

SEQ ID NO: 401154 - RNA, 32 nt, Human
cugaccaacauggagaaacuccaucucuacua

SEQ ID NO: 401155 - RNA, 32 nt, Human
cugaccaacauggagaaacuccgucucuacua

SEQ ID NO: 401156 - RNA, 24 nt, Human
cugaccaacauggagaaaucccgu

SEQ ID NO: 401157 - RNA, 32 nt, Human
cugaccaacauggagaaaucccgucucuacua

SEQ ID NO: 401158 - RNA, 32 nt, Human
cugaccaacauggagaaaugccaucucuacua

SEQ ID NO: 401159 - RNA, 24 nt, Human
cugaccaacauggagaagccccgu

SEQ ID NO: 401160 - RNA, 32 nt, Human
cugaccaacauggagaagccccgucucuacua

SEQ ID NO: 401161 - RNA, 32 nt, Human
cugaccaacauggagauauccugucucuacua

SEQ ID NO: 401162 - RNA, 32 nt, Human
cugaccaacauggauaaaucccaucucuacua

SEQ ID NO: 401163 - RNA, 24 nt, Human
cugaccaacauggauuaacccugu

SEQ ID NO: 401164 - RNA, 32 nt, Human
cugaccaacauggauuaacccugucucuacua

SEQ ID NO: 401165 - RNA, 24 nt, Human
cugaccaacauggcaaaacaucgu

SEQ ID NO: 401166 - RNA, 21 nt, Human
cugaccaacauggcaaaaccc

SEQ ID NO: 401167 - RNA, 22 nt, Human
cugaccaacauggcaaaacccc

SEQ ID NO: 401168 - RNA, 32 nt, Human
cugaccaacauggcaaaaccccgucucuacua

SEQ ID NO: 401169 - RNA, 24 nt, Human
cugaccaacauggcaaaacccugu

SEQ ID NO: 401170 - RNA, 28 nt, Human
cugaccaacauggcaaaacccugucucu

SEQ ID NO: 401171 - RNA, 32 nt, Human
cugaccaacauggcaaaacccugucucuacua

SEQ ID NO: 401172 - RNA, 32 nt, Human
cugaccaacauggccaaaaacugucucuacua

SEQ ID NO: 401173 - RNA, 21 nt, Human
cugaccaacauggcgaaaccc

SEQ ID NO: 401174 - RNA, 22 nt, Human
cugaccaacauggcgaaacccc

SEQ ID NO: 401175 - RNA, 32 nt, Human
cugaccaacauggcgaaaccccaucucuacua

SEQ ID NO: 401176 - RNA, 32 nt, Human
cugaccaacauggcgaaaccccauuucuacua

SEQ ID NO: 401177 - RNA, 24 nt, Human
cugaccaacauggcgaaaccccgu

SEQ ID NO: 401178 - RNA, 32 nt, Human
cugaccaacauggcgaaaccccgucucuacua

SEQ ID NO: 401179 - RNA, 32 nt, Human
cugaccaacauggcgaaaccccgucucuagca

SEQ ID NO: 401180 - RNA, 24 nt, Human
cugaccaacauggggauaccccgu

SEQ ID NO: 401181 - RNA, 32 nt, Human
cugaccaacauggggauaccccgucucuacua

SEQ ID NO: 401182 - RNA, 32 nt, Human
cugaccaacaugguaaaaccacaucucuacua

SEQ ID NO: 401183 - RNA, 21 nt, Human
cugaccaacaugguagaaccc

SEQ ID NO: 401184 - RNA, 24 nt, Human
cugaccaacaugguagaaccccgu

SEQ ID NO: 401185 - RNA, 22 nt, Human
cugaccaacauggugaaaaccc

SEQ ID NO: 401186 - RNA, 23 nt, Human
cugaccaacauggugaaaacccc

SEQ ID NO: 401187 - RNA, 32 nt, Human
cugaccaacauggugaaaaccccaucucuacu

SEQ ID NO: 401188 - RNA, 22 nt, Human
cugaccaacauggugaaacacc

SEQ ID NO: 401189 - RNA, 24 nt, Human
cugaccaacauggugaaacaccau

SEQ ID NO: 401190 - RNA, 32 nt, Human
cugaccaacauggugaaacaccaucucuacua

SEQ ID NO: 401191 - RNA, 24 nt, Human
cugaccaacauggugaaacacugu

SEQ ID NO: 401192 - RNA, 32 nt, Human
cugaccaacauggugaaacacugucucuacua

SEQ ID NO: 401193 - RNA, 21 nt, Human
cugaccaacauggugaaaccc

SEQ ID NO: 401194 - RNA, 22 nt, Human
cugaccaacauggugaaacccc

SEQ ID NO: 401195 - RNA, 32 nt, Human
cugaccaacauggugaaaccccaucucuacga

SEQ ID NO: 401196 - RNA, 32 nt, Human
cugaccaacauggugaaaccccaucucuacua

SEQ ID NO: 401197 - RNA, 32 nt, Human
cugaccaacauggugaaaccccaucucuacuu

SEQ ID NO: 401198 - RNA, 32 nt, Human
cugaccaacauggugaaaccccaucuguacua

SEQ ID NO: 401199 - RNA, 32 nt, Human
cugaccaacauggugaaaccccauuucuacua

SEQ ID NO: 401200 - RNA, 24 nt, Human
cugaccaacauggugaaaccccgu

SEQ ID NO: 401201 - RNA, 32 nt, Human
cugaccaacauggugaaaccccgucucuacaa

SEQ ID NO: 401202 - RNA, 32 nt, Human
cugaccaacauggugaaaccccgucucuacua

SEQ ID NO: 401203 - RNA, 32 nt, Human
cugaccaacauggugaaaccccgucuuuauua

SEQ ID NO: 401204 - RNA, 32 nt, Human
cugaccaacauggugaaaccccgugucuacua

SEQ ID NO: 401205 - RNA, 32 nt, Human
cugaccaacauggugaaaccccguuucuacua

SEQ ID NO: 401206 - RNA, 32 nt, Human
cugaccaacauggugaaaccccuucucuacgu

SEQ ID NO: 401207 - RNA, 22 nt, Human
cugaccaacauggugaaacccu

SEQ ID NO: 401208 - RNA, 32 nt, Human
cugaccaacauggugaaacccuacuaaaaaua

SEQ ID NO: 401209 - RNA, 24 nt, Human
cugaccaacauggugaaacccugu

SEQ ID NO: 401210 - RNA, 32 nt, Human
cugaccaacauggugaaacccugucucuacca

SEQ ID NO: 401211 - RNA, 32 nt, Human
cugaccaacauggugaaacccugucucuacga

SEQ ID NO: 401212 - RNA, 32 nt, Human
cugaccaacauggugaaacccugucucuacua

SEQ ID NO: 401213 - RNA, 32 nt, Human
cugaccaacauggugaaacccuguuucuacua

SEQ ID NO: 401214 - RNA, 22 nt, Human
cugaccaacauggugaaaccuc

SEQ ID NO: 401215 - RNA, 23 nt, Human
cugaccaacauggugaaaccuca

SEQ ID NO: 401216 - RNA, 32 nt, Human
cugaccaacauggugaaaccucaacucuacua

SEQ ID NO: 401217 - RNA, 24 nt, Human
cugaccaacauggugaaaccucau

SEQ ID NO: 401218 - RNA, 32 nt, Human
cugaccaacauggugaaaccucaucucuacua

SEQ ID NO: 401219 - RNA, 32 nt, Human
cugaccaacauggugaaaccucgucucugcua

SEQ ID NO: 401220 - RNA, 22 nt, Human
cugaccaacauggugaaacgcc

SEQ ID NO: 401221 - RNA, 24 nt, Human
cugaccaacauggugaaacgccau

SEQ ID NO: 401222 - RNA, 32 nt, Human
cugaccaacauggugaaacgccaucucuacua

SEQ ID NO: 401223 - RNA, 22 nt, Human
cugaccaacauggugaaacgcu

SEQ ID NO: 401224 - RNA, 24 nt, Human
cugaccaacauggugaaacgcuau

SEQ ID NO: 401225 - RNA, 20 nt, Human
cugaccaacauggugaaacu

SEQ ID NO: 401226 - RNA, 24 nt, Human
cugaccaacauggugaaacuaugu

SEQ ID NO: 401227 - RNA, 32 nt, Human
cugaccaacauggugaaacuaugucucuacua

SEQ ID NO: 401228 - RNA, 21 nt, Human
cugaccaacauggugaaacuc

SEQ ID NO: 401229 - RNA, 22 nt, Human
cugaccaacauggugaaacucc

SEQ ID NO: 401230 - RNA, 24 nt, Human
cugaccaacauggugaaacuccau

SEQ ID NO: 401231 - RNA, 32 nt, Human
cugaccaacauggugaaacuccaucucuacua

SEQ ID NO: 401232 - RNA, 24 nt, Human
cugaccaacauggugaaacucugu

SEQ ID NO: 401233 - RNA, 32 nt, Human
cugaccaacauggugaaacucuguucuacuaa

SEQ ID NO: 401234 - RNA, 32 nt, Human
cugaccaacauggugaaagcccguuucuacua

SEQ ID NO: 401235 - RNA, 19 nt, Human
cugaccaacauggugaaau

SEQ ID NO: 401236 - RNA, 21 nt, Human
cugaccaacauggugaaaucc

SEQ ID NO: 401237 - RNA, 32 nt, Human
cugaccaacauggugaaauccagucucuacuu

SEQ ID NO: 401238 - RNA, 32 nt, Human
cugaccaacauggugaaaucccgucucuauua

SEQ ID NO: 401239 - RNA, 24 nt, Human
cugaccaacauggugaaauccugu

SEQ ID NO: 401240 - RNA, 32 nt, Human
cugaccaacauggugaaauccugucucuacua

SEQ ID NO: 401241 - RNA, 32 nt, Human
cugaccaacauggugaaaugaaaccccaucuc

SEQ ID NO: 401242 - RNA, 21 nt, Human
cugaccaacauggugagaccc

SEQ ID NO: 401243 - RNA, 24 nt, Human
cugaccaacauggugagacccugu

SEQ ID NO: 401244 - RNA, 32 nt, Human
cugaccaacauggugagacccugucucuacua

SEQ ID NO: 401245 - RNA, 21 nt, Human
cugaccaacauggugaggccc

SEQ ID NO: 401246 - RNA, 22 nt, Human
cugaccaacauggugaggcccc

SEQ ID NO: 401247 - RNA, 32 nt, Human
cugaccaacgcgacauuccuccccucacgccu

SEQ ID NO: 401248 - RNA, 22 nt, Human
cugaccaacguggagaaacccc

SEQ ID NO: 401249 - RNA, 24 nt, Human
cugaccaacguggagaaaccccgu

SEQ ID NO: 401250 - RNA, 24 nt, Human
cugaccaacguggcgaaaccucgu

SEQ ID NO: 401251 - RNA, 22 nt, Human
cugaccaacguggugaaacccc

SEQ ID NO: 401252 - RNA, 32 nt, Human
cugaccaacguggugaaaccccaucucuacua

SEQ ID NO: 401253 - RNA, 24 nt, Human
cugaccaacguggugaaaccccgu

SEQ ID NO: 401254 - RNA, 32 nt, Human
cugaccaacguggugaaaccccgucucuacua

SEQ ID NO: 401255 - RNA, 24 nt, Human
cugaccaacguggugaaacccugu

SEQ ID NO: 401256 - RNA, 32 nt, Human
cugaccaacguggugaaacccugucucuacug

SEQ ID NO: 401257 - RNA, 24 nt, Human
cugaccaacguggugaaacuccgu

SEQ ID NO: 401258 - RNA, 32 nt, Human
cugaccaacguggugaaacuccgucucuacua

SEQ ID NO: 401259 - RNA, 24 nt, Human
cugaccaacguuaaguaaccccgu

SEQ ID NO: 401260 - RNA, 22 nt, Human
cugaccaagcacugcguucuca

SEQ ID NO: 401261 - RNA, 32 nt, Human
cugaccaaggagaaugacuacaagagagacaa

SEQ ID NO: 401262 - RNA, 22 nt, Human
cugaccaagguggugaaacccc

SEQ ID NO: 401263 - RNA, 32 nt, Human
cugaccaagguggugaaaccccaucucuaguu

SEQ ID NO: 401264 - RNA, 32 nt, Human
cugaccaagguggugaaaccccgucucuacua

SEQ ID NO: 401265 - RNA, 24 nt, Human
cugaccaauacggugaaagcccgu

SEQ ID NO: 401266 - RNA, 22 nt, Human
cugaccaauaugaugaaacccc

SEQ ID NO: 401267 - RNA, 32 nt, Human
cugaccaauaugaugaaaccccgucucuacua

SEQ ID NO: 401268 - RNA, 22 nt, Human
cugaccaauauggcaaaaccuc

SEQ ID NO: 401269 - RNA, 22 nt, Human
cugaccaauauggugaaacccc

SEQ ID NO: 401270 - RNA, 32 nt, Human
cugaccaauauggugaaaccccaucucuacua

SEQ ID NO: 401271 - RNA, 32 nt, Human
cugaccaauauggugaaaccccgucucuacua

SEQ ID NO: 401272 - RNA, 32 nt, Human
cugaccaauauggugaaaccccuucucuacua

SEQ ID NO: 401273 - RNA, 32 nt, Human
cugaccaauggcagaggacugccugaagagua

SEQ ID NO: 401274 - RNA, 22 nt, Human
cugaccaaugugauaaaacccc

SEQ ID NO: 401275 - RNA, 22 nt, Human
cugaccacacuccccucgcagc

SEQ ID NO: 401276 - RNA, 32 nt, Human
cugaccacagcccccaggggaggaugguacug

SEQ ID NO: 401277 - RNA, 32 nt, Human
cugaccacagccugcugagcaggaugacagga

SEQ ID NO: 401278 - RNA, 32 nt, Human
cugaccacagccuguggcugggaagggagaca

SEQ ID NO: 401279 - RNA, 32 nt, Human
cugaccacagcuggcagucaagccacagcugg

SEQ ID NO: 401280 - RNA, 24 nt, Human
cugaccaccauggagaaaccccgu

SEQ ID NO: 401281 - RNA, 32 nt, Human
cugaccacccacacucaaccucccucugaccu

SEQ ID NO: 401282 - RNA, 32 nt, Human
cugaccaccucuccaacagaagccuaguccug

SEQ ID NO: 401283 - RNA, 32 nt, Human
cugaccaccuucaucgagcuccugccucucug

SEQ ID NO: 401284 - RNA, 32 nt, Human
cugaccaccuugcacuauuggacuuuggaagg

SEQ ID NO: 401285 - RNA, 32 nt, Human
cugaccacugcaaucccagcgcccaaggaagg

SEQ ID NO: 401286 - RNA, 32 nt, Human
cugaccacugccccuccaacucccagggacuc

SEQ ID NO: 401287 - RNA, 32 nt, Human
cugaccacugccugggcuagggugucacuucc

SEQ ID NO: 401288 - RNA, 22 nt, Human
cugaccacuuaucaaacccauc

SEQ ID NO: 401289 - RNA, 32 nt, Human
cugaccagaggcaggaucccaccccacuugaa

SEQ ID NO: 401290 - RNA, 22 nt, Human
cugaccagauucccagucacca

SEQ ID NO: 401291 - RNA, 32 nt, Human
cugaccagcagaggugagagagcgagacaggu

SEQ ID NO: 401292 - RNA, 32 nt, Human
cugaccagccgugagcauguuuggaagggguc

SEQ ID NO: 401293 - RNA, 32 nt, Human
cugaccagccugaugaggcaagagccugcccc

SEQ ID NO: 401294 - RNA, 32 nt, Human
cugaccagccuggccggcuggcggagaaaagg

SEQ ID NO: 401295 - RNA, 32 nt, Human
cugaccagcugaguccuugagggcaguaaaga

SEQ ID NO: 401296 - RNA, 32 nt, Human
cugaccagcugcaaagccaaccccuaucauuu

SEQ ID NO: 401297 - RNA, 32 nt, Human
cugaccaggaagcacaaggcugagagccagug

SEQ ID NO: 401298 - RNA, 32 nt, Human
cugaccaggaguucgaggcugcagugagccga

SEQ ID NO: 401299 - RNA, 32 nt, Human
cugaccagggagggagaagcagguuuggagag

SEQ ID NO: 401300 - RNA, 32 nt, Human
cugaccaggucagcugcccuggccuugcaccc

SEQ ID NO: 401301 - RNA, 28 nt, Human
cugaccagguguagugccucaugccugu

SEQ ID NO: 401302 - RNA, 32 nt, Human
cugaccagugugcuauauaguuaaagcucauu

SEQ ID NO: 401303 - RNA, 22 nt, Human
cugaccaucauggugaaaccuc

SEQ ID NO: 401304 - RNA, 32 nt, Human
cugaccaucauggugaaaccucaucuccgcua

SEQ ID NO: 401305 - RNA, 32 nt, Human
cugaccauccagugacaugauccugaccuuua

SEQ ID NO: 401306 - RNA, 18 nt, Human
cugaccaucugcuuucca

SEQ ID NO: 401307 - RNA, 32 nt, Human
cugaccaucuuucucuuacuguccucuuuguc

SEQ ID NO: 401308 - RNA, 32 nt, Human
cugaccaugaagaggcaagagcacagacuuac

SEQ ID NO: 401309 - RNA, 32 nt, Human
cugaccaugagacacggcuugcagugggggug

SEQ ID NO: 401310 - RNA, 32 nt, Human
cugaccaugaggaaaccuaaggucaacaccgg

SEQ ID NO: 401311 - RNA, 31 nt, Human
cugaccaugucuauuauggaccacagcccca

SEQ ID NO: 401312 - RNA, 32 nt, Human
cugacccaagugaaaaugcucagaauuucaca

SEQ ID NO: 401313 - RNA, 32 nt, Human
cugacccacaucuggcaccggccugcgcucgu

SEQ ID NO: 401314 - RNA, 32 nt, Human
cugacccaccugagacagaggcugggacccac

SEQ ID NO: 401315 - RNA, 24 nt, Human
cugacccacucuuccuuccacuga

SEQ ID NO: 401316 - RNA, 32 nt, Human
cugacccacugcauuccagccuggcgacagag

SEQ ID NO: 401317 - RNA, 21 nt, Human
cugacccagaucucuggccca

SEQ ID NO: 401318 - RNA, 32 nt, Human
cugacccagcauccucugccuucuaggaagug

SEQ ID NO: 401319 - RNA, 32 nt, Human
cugacccagccagaguccagguuuccacagga

SEQ ID NO: 401320 - RNA, 22 nt, Human
cugacccagccugguccuuccu

SEQ ID NO: 401321 - RNA, 32 nt, Human
cugacccagcuccuccugugugccucccuggc

SEQ ID NO: 401322 - RNA, 32 nt, Human
cugacccaggagaacggaaagcagggacguga

SEQ ID NO: 401323 - RNA, 32 nt, Human
cugacccaggcgcgcccgcugcucgguggcag

SEQ ID NO: 401324 - RNA, 32 nt, Human
cugaccccaagagagggaggacccaggauccg

SEQ ID NO: 401325 - RNA, 32 nt, Human
cugaccccagcauuuccagagcagagccuaca

SEQ ID NO: 401326 - RNA, 32 nt, Human
cugaccccaggaucccagcccgugggagagaa

SEQ ID NO: 401327 - RNA, 32 nt, Human
cugaccccauccuccucucccuccaggagccc

SEQ ID NO: 401328 - RNA, 32 nt, Human
cugacccccaggagggugguauuaggaggugg

SEQ ID NO: 401329 - RNA, 32 nt, Human
cugacccccaucaaaucccaucaugcccacag

SEQ ID NO: 401330 - RNA, 32 nt, Human
cugacccccaucucccccuuccuuucccuccu

SEQ ID NO: 401331 - RNA, 32 nt, Human
cugacccccgcccuagaacuuuugccagugcc

SEQ ID NO: 401332 - RNA, 32 nt, Human
cugacccccugcccuugagaaacacaagaugg

SEQ ID NO: 401333 - RNA, 20 nt, Human
cugaccccgcagccuuggca

SEQ ID NO: 401334 - RNA, 19 nt, Human
cugaccccgcgccccccgg

SEQ ID NO: 401335 - RNA, 21 nt, Human
cugaccccuauucuucucccu

SEQ ID NO: 401336 - RNA, 24 nt, Human
cugaccccucaccugugccaagau

SEQ ID NO: 401337 - RNA, 32 nt, Human
cugaccccucagcugcucagccaggccccugc

SEQ ID NO: 401338 - RNA, 32 nt, Human
cugaccccuccaaggaaagaccaccuucuggg

SEQ ID NO: 401339 - RNA, 32 nt, Human
cugaccccucucuccaccccugggcuaugcag

SEQ ID NO: 401340 - RNA, 32 nt, Human
cugaccccugcaggauguuuuuccuaggcucc

SEQ ID NO: 401341 - RNA, 32 nt, Human
cugaccccugcucuaauugggaccugcugugu

SEQ ID NO: 401342 - RNA, 32 nt, Human
cugaccccugggagaggggcagugagaguuug

SEQ ID NO: 401343 - RNA, 22 nt, Human
cugaccccugugucuucucccu

SEQ ID NO: 401344 - RNA, 24 nt, Human
cugaccccuuccccaccccccggg

SEQ ID NO: 401345 - RNA, 32 nt, Human
cugaccccuucuguuuucugcaaggagcugcc

SEQ ID NO: 401346 - RNA, 19 nt, Human
cugaccccuuguccuuccc

SEQ ID NO: 401347 - RNA, 18 nt, Human
cugaccccuuuccuucuc

SEQ ID NO: 401348 - RNA, 32 nt, Human
cugacccgccggccucucccaccccagcagug

SEQ ID NO: 401349 - RNA, 18 nt, Human
cugacccgccugcugcug

SEQ ID NO: 401350 - RNA, 32 nt, Human
cugacccgggacucaccucccuacccuggccc

SEQ ID NO: 401351 - RNA, 32 nt, Human
cugacccguucccgggagcgugucuggguuug

SEQ ID NO: 401352 - RNA, 19 nt, Human
cugacccuagcugcugcug

SEQ ID NO: 401353 - RNA, 22 nt, Human
cugacccuagcugcugcugcug

SEQ ID NO: 401354 - RNA, 32 nt, Human
cugacccucacagaaagagagcucugagcagg

SEQ ID NO: 401355 - RNA, 32 nt, Human
cugacccucacuccuucuucugacccuuaauc

SEQ ID NO: 401356 - RNA, 32 nt, Human
cugacccuccaccgcagaaggaaggcagggag

SEQ ID NO: 401357 - RNA, 16 nt, Human
cugacccucccuccca

SEQ ID NO: 401358 - RNA, 32 nt, Human
cugacccucuccccacugcucauuuggauccc

SEQ ID NO: 401359 - RNA, 25 nt, Human
cugacccugaaccagaacccagcug

SEQ ID NO: 401360 - RNA, 32 nt, Human
cugacccugaguaguaggauuggaggagggaa

SEQ ID NO: 401361 - RNA, 32 nt, Human
cugacccugcaaggaagaaauacuucagaaag

SEQ ID NO: 401362 - RNA, 32 nt, Human
cugacccugcagcacuuucagcauaugcacau

SEQ ID NO: 401363 - RNA, 32 nt, Human
cugacccugcagcuggugcucugugucuucgc

SEQ ID NO: 401364 - RNA, 32 nt, Human
cugacccugccugcuaaaugccaguugcagcc

SEQ ID NO: 401365 - RNA, 32 nt, Human
cugacccugccuggagccaaccuggagaugca

SEQ ID NO: 401366 - RNA, 31 nt, Human
cugacccugcucucugggcugucucuaggga

SEQ ID NO: 401367 - RNA, 32 nt, Human
cugacccugcugcucuugccuucuaagcuacu

SEQ ID NO: 401368 - RNA, 19 nt, Human
cugacccugcuuccccaag

SEQ ID NO: 401369 - RNA, 19 nt, Human
cugacccuggcacccaggg

SEQ ID NO: 401370 - RNA, 19 nt, Human
cugacccuggcuuccaggg

SEQ ID NO: 401371 - RNA, 32 nt, Human
cugacccugggcaggugagugacggguguguc

SEQ ID NO: 401372 - RNA, 20 nt, Human
cugacccuggucuggucuca

SEQ ID NO: 401373 - RNA, 32 nt, Human
cugacccugucccacaucuuaaagcugugccu

SEQ ID NO: 401374 - RNA, 32 nt, Human
cugacccuguguaaccugcugucccggguccc

SEQ ID NO: 401375 - RNA, 19 nt, Human
cugacccuucccggcugcc

SEQ ID NO: 401376 - RNA, 32 nt, Human
cugaccgaaagaaaacccuuggggauaaguuu

SEQ ID NO: 401377 - RNA, 26 nt, Human
cugaccgcagagucuccagcaagcug

SEQ ID NO: 401378 - RNA, 32 nt, Human
cugaccgccaguccccugucaucgaguucugg

SEQ ID NO: 401379 - RNA, 32 nt, Human
cugaccgccgguccccugucaucgaguucugg

SEQ ID NO: 401380 - RNA, 32 nt, Human
cugaccggacuacagcucccagaagagccuug

SEQ ID NO: 401381 - RNA, 32 nt, Human
cugaccgggccaggccuggucuucccagcccu

SEQ ID NO: 401382 - RNA, 32 nt, Human
cugaccgguucugaaguaugggccuccggggu

SEQ ID NO: 401383 - RNA, 21 nt, Human
cugaccgucccgccagcacgc

SEQ ID NO: 401384 - RNA, 32 nt, Human
cugaccuacuucugccuggucugagaagccug

SEQ ID NO: 401385 - RNA, 32 nt, Human
cugaccuaggccaguccuggggcaggcgugcu

SEQ ID NO: 401386 - RNA, 32 nt, Human
cugaccucaaacuccugaccucaggugauccg

SEQ ID NO: 401387 - RNA, 32 nt, Human
cugaccucaaauaaucccagcacuuugggagg

SEQ ID NO: 401388 - RNA, 32 nt, Human
cugaccucaaaugacccacccaccucagccuc

SEQ ID NO: 401389 - RNA, 32 nt, Human
cugaccucaaaugauccacccaccucagccuc

SEQ ID NO: 401390 - RNA, 32 nt, Human
cugaccucaaaugauccacccaccucagucuc

SEQ ID NO: 401391 - RNA, 32 nt, Human
cugaccucaaaugauccgcccaccucggccuc

SEQ ID NO: 401392 - RNA, 32 nt, Human
cugaccucaagcaaucugcucgucuuagccuc

SEQ ID NO: 401393 - RNA, 32 nt, Human
cugaccucaagcaauuguccugccuccucaac

SEQ ID NO: 401394 - RNA, 32 nt, Human
cugaccucaagcaauuugcccaccucguucuc

SEQ ID NO: 401395 - RNA, 32 nt, Human
cugaccucaagccucagcuccagugggaccuu

SEQ ID NO: 401396 - RNA, 32 nt, Human
cugaccucaagcgauccacccaccucggccuc

SEQ ID NO: 401397 - RNA, 32 nt, Human
cugaccucaagcgaucugcccaccuccgucuc

SEQ ID NO: 401398 - RNA, 32 nt, Human
cugaccucaagcgaucugcccaccucggccuc

SEQ ID NO: 401399 - RNA, 32 nt, Human
cugaccucaaguaaucugcccaccucggccuc

SEQ ID NO: 401400 - RNA, 32 nt, Human
cugaccucaagugauccacccaccucagccuc

SEQ ID NO: 401401 - RNA, 32 nt, Human
cugaccucaagugauccacccaccucggccuc

SEQ ID NO: 401402 - RNA, 32 nt, Human
cugaccucaagugauccaccugccucagccuc

SEQ ID NO: 401403 - RNA, 32 nt, Human
cugaccucaagugauccucccaccucagccuc

SEQ ID NO: 401404 - RNA, 32 nt, Human
cugaccucaagugauccucccaccucagccug

SEQ ID NO: 401405 - RNA, 32 nt, Human
cugaccucaagugaucggcccaccucagccuc

SEQ ID NO: 401406 - RNA, 32 nt, Human
cugaccucaagugaucuacccaccucggcuuc

SEQ ID NO: 401407 - RNA, 32 nt, Human
cugaccucaagugaucugcccaccucagccuc

SEQ ID NO: 401408 - RNA, 32 nt, Human
cugaccucacacaauccuccugccuuagccuc

SEQ ID NO: 401409 - RNA, 32 nt, Human
cugaccucacagacugaccauuccaucccaca

SEQ ID NO: 401410 - RNA, 32 nt, Human
cugaccucacagaggcuugggggugaaagggu

SEQ ID NO: 401411 - RNA, 32 nt, Human
cugaccucacugccaccucuugcauugggauc

SEQ ID NO: 401412 - RNA, 32 nt, Human
cugaccucacugccugccuccucuaccccagg

SEQ ID NO: 401413 - RNA, 32 nt, Human
cugaccucagacucacuuccacccucaagugg

SEQ ID NO: 401414 - RNA, 32 nt, Human
cugaccucagaugguccacccaccucggcauc

SEQ ID NO: 401415 - RNA, 32 nt, Human
cugaccucagcccugcucacugugcccaggga

SEQ ID NO: 401416 - RNA, 32 nt, Human
cugaccucaggaguucgagaccagccugggca

SEQ ID NO: 401417 - RNA, 32 nt, Human
cugaccucaggcaauccacccaccucagccuc

SEQ ID NO: 401418 - RNA, 32 nt, Human
cugaccucaggcaaucugcccaccucagccuc

SEQ ID NO: 401419 - RNA, 32 nt, Human
cugaccucaggcgauccacccaccucagcguc

SEQ ID NO: 401420 - RNA, 32 nt, Human
cugaccucagggcucccagcucggggccugug

SEQ ID NO: 401421 - RNA, 32 nt, Human
cugaccucagguaacuuucacucucauacaua

SEQ ID NO: 401422 - RNA, 32 nt, Human
cugaccucagguaauccucccaccucagccuc

SEQ ID NO: 401423 - RNA, 19 nt, Human
cugaccucaggugagccac

SEQ ID NO: 401424 - RNA, 32 nt, Human
cugaccucaggugauacgcccaccucggccuc

SEQ ID NO: 401425 - RNA, 18 nt, Human
cugaccucaggugaucca

SEQ ID NO: 401426 - RNA, 32 nt, Human
cugaccucaggugauccacccaccucagccuc

SEQ ID NO: 401427 - RNA, 32 nt, Human
cugaccucaggugauccacccaccucggccuc

SEQ ID NO: 401428 - RNA, 32 nt, Human
cugaccucaggugauccacccaccucggcuuc

SEQ ID NO: 401429 - RNA, 32 nt, Human
cugaccucaggugauccgcccaccucagccuc

SEQ ID NO: 401430 - RNA, 32 nt, Human
cugaccucaggugauccgcccaccucggccuc

SEQ ID NO: 401431 - RNA, 32 nt, Human
cugaccucaggugauccgcccaccucggccuu

SEQ ID NO: 401432 - RNA, 32 nt, Human
cugaccucaggugauccgccuaccucagccuc

SEQ ID NO: 401433 - RNA, 32 nt, Human
cugaccucaggugauccguccaccucagccuc

SEQ ID NO: 401434 - RNA, 32 nt, Human
cugaccucaggugauccucccaccucggccuc

SEQ ID NO: 401435 - RNA, 32 nt, Human
cugaccucaggugauccucccgccucggccuc

SEQ ID NO: 401436 - RNA, 32 nt, Human
cugaccucaggugaucuacccaccucggccuc

SEQ ID NO: 401437 - RNA, 32 nt, Human
cugaccucaggugaucugcccaccucagccuc

SEQ ID NO: 401438 - RNA, 32 nt, Human
cugaccucaggugaucugcccaccucggccuc

SEQ ID NO: 401439 - RNA, 32 nt, Human
cugaccucaggugaucugcccaccucggcuuc

SEQ ID NO: 401440 - RNA, 32 nt, Human
cugaccucaggugaugcacccaccucagccuc

SEQ ID NO: 401441 - RNA, 32 nt, Human
cugaccucaggugauucacccaccucagcuuc

SEQ ID NO: 401442 - RNA, 32 nt, Human
cugaccucagguguuccacccaccucagccuu

SEQ ID NO: 401443 - RNA, 32 nt, Human
cugaccucagguguuccaccuaccucagccuc

SEQ ID NO: 401444 - RNA, 32 nt, Human
cugaccucagugccagagugacagagcugggc

SEQ ID NO: 401445 - RNA, 32 nt, Human
cugaccucaugauccaccucccucagccuccc

SEQ ID NO: 401446 - RNA, 32 nt, Human
cugaccucauguaauccacccaccucagccuc

SEQ ID NO: 401447 - RNA, 32 nt, Human
cugaccuccagugaucugcccaccucggccuc

SEQ ID NO: 401448 - RNA, 32 nt, Human
cugaccucccaucugccuucugagcaccagcu

SEQ ID NO: 401449 - RNA, 21 nt, Human
cugaccuccccgccagcugga

SEQ ID NO: 401450 - RNA, 20 nt, Human
cugaccuccccgcggggagg

SEQ ID NO: 401451 - RNA, 20 nt, Human
cugaccuccccgcugugggg

SEQ ID NO: 401452 - RNA, 16 nt, Human
cugaccuccccuccac

SEQ ID NO: 401453 - RNA, 22 nt, Human
cugaccucccucggccgugcgg

SEQ ID NO: 401454 - RNA, 32 nt, Human
cugaccuccggugauccacccaccucagccuc

SEQ ID NO: 401455 - RNA, 32 nt, Human
cugaccuccggugaucugcccaccucagucuc

SEQ ID NO: 401456 - RNA, 19 nt, Human
cugaccuccucuggccuca

SEQ ID NO: 401457 - RNA, 17 nt, Human
cugaccuccugauccac

SEQ ID NO: 401458 - RNA, 32 nt, Human
cugaccuccugccucuccuaaccucaguggcg

SEQ ID NO: 401459 - RNA, 20 nt, Human
cugaccuccuggacuguagg

SEQ ID NO: 401460 - RNA, 17 nt, Human
cugaccucgugagccac

SEQ ID NO: 401461 - RNA, 32 nt, Human
cugaccucgugauccugaccucggccucccaa

SEQ ID NO: 401462 - RNA, 22 nt, Human
cugaccucgugaucugcaccac

SEQ ID NO: 401463 - RNA, 32 nt, Human
cugaccucuaaccccggacgcacuuugauuuc

SEQ ID NO: 401464 - RNA, 32 nt, Human
cugaccucucaagggguggggguggggucaga

SEQ ID NO: 401465 - RNA, 32 nt, Human
cugaccucuccacuucuagcucucacugacau

SEQ ID NO: 401466 - RNA, 32 nt, Human
cugaccucucuccuccccuccuuccucucucc

SEQ ID NO: 401467 - RNA, 20 nt, Human
cugaccucucucuacugcca

SEQ ID NO: 401468 - RNA, 32 nt, Human
cugaccucucucuccacauuacccuuacaaaa

SEQ ID NO: 401469 - RNA, 32 nt, Human
cugaccucugaggggcugaggggugaggccag

SEQ ID NO: 401470 - RNA, 32 nt, Human
cugaccucugcagccucucucaucugccaauu

SEQ ID NO: 401471 - RNA, 21 nt, Human
cugaccucugcuccccgcgga

SEQ ID NO: 401472 - RNA, 32 nt, Human
cugaccucuggcuccuguccucuggcuccacc

SEQ ID NO: 401473 - RNA, 32 nt, Human
cugaccucuguggggugaggcagugcauggcc

SEQ ID NO: 401474 - RNA, 32 nt, Human
cugaccucuucauucuccuuuucaguauaacc

SEQ ID NO: 401475 - RNA, 32 nt, Human
cugaccugaggcgaucugcccaccucggccuc

SEQ ID NO: 401476 - RNA, 32 nt, Human
cugaccugaugaccagcucugugugaaacucc

SEQ ID NO: 401477 - RNA, 18 nt, Human
cugaccugcaacuugacu

SEQ ID NO: 401478 - RNA, 32 nt, Human
cugaccugcagccucucagggcgugcgaaguc

SEQ ID NO: 401479 - RNA, 32 nt, Human
cugaccugccaagagagagcuggggacugccu

SEQ ID NO: 401480 - RNA, 32 nt, Human
cugaccugcuggcgcucccuguccacugcacu

SEQ ID NO: 401481 - RNA, 32 nt, Human
cugaccuggaaauggccgccuucaaaggccaa

SEQ ID NO: 401482 - RNA, 32 nt, Human
cugaccuggaaccucugggagggcugcagagu

SEQ ID NO: 401483 - RNA, 32 nt, Human
cugaccuggaaggugaaggugaaggugagacc

SEQ ID NO: 401484 - RNA, 32 nt, Human
cugaccuggaaugaggccuaaccacaaucuuc

SEQ ID NO: 401485 - RNA, 32 nt, Human
cugaccuggagcuggccugugguaaaggccug

SEQ ID NO: 401486 - RNA, 32 nt, Human
cugaccuggcugcugcucuugcuucagagcca

SEQ ID NO: 401487 - RNA, 32 nt, Human
cugaccugggaauuugaaaacagcacacuaaa

SEQ ID NO: 401488 - RNA, 32 nt, Human
cugaccugggcuggcacugcugggggugagga

SEQ ID NO: 401489 - RNA, 24 nt, Human
cugaccuggggccccagcauccug

SEQ ID NO: 401490 - RNA, 32 nt, Human
cugaccugggggucaaggcaggaggacuccga

SEQ ID NO: 401491 - RNA, 32 nt, Human
cugaccugguggccgugguggagaugaugcag

SEQ ID NO: 401492 - RNA, 19 nt, Human
cugaccuguguuccuuccc

SEQ ID NO: 401493 - RNA, 32 nt, Human
cugaccuuaagugauccacccaccucggccuc

SEQ ID NO: 401494 - RNA, 32 nt, Human
cugaccuuagagaacguguccugggccagccc

SEQ ID NO: 401495 - RNA, 32 nt, Human
cugaccuuauuguugcucacacucuauguccc

SEQ ID NO: 401496 - RNA, 31 nt, Human
cugaccuucaucucugggcuuguuccgggaa

SEQ ID NO: 401497 - RNA, 32 nt, Human
cugaccuuccaagugacuuccuuggacuuuga

SEQ ID NO: 401498 - RNA, 32 nt, Human
cugaccuuccucagucugcagcucuuuucucc

SEQ ID NO: 401499 - RNA, 32 nt, Human
cugaccuucggcaguggcugggggacugcuuu

SEQ ID NO: 401500 - RNA, 32 nt, Human
cugaccuucucccucuucccuuccuccuccuc

SEQ ID NO: 401501 - RNA, 32 nt, Human
cugaccuucuccucagcuucauugugagaccu

SEQ ID NO: 401502 - RNA, 32 nt, Human
cugaccuucugagaggggccugccucacuucu

SEQ ID NO: 401503 - RNA, 18 nt, Human
cugaccuucugggaucuu

SEQ ID NO: 401504 - RNA, 32 nt, Human
cugaccuugagcucuugggcucaggugauccu

SEQ ID NO: 401505 - RNA, 32 nt, Human
cugaccuugauagggauacagcuuugauccaa

SEQ ID NO: 401506 - RNA, 32 nt, Human
cugaccuugcugggaagccucacccuucugcc

SEQ ID NO: 401507 - RNA, 32 nt, Human
cugaccuuggcacucgaacugaccucaagcuc

SEQ ID NO: 401508 - RNA, 32 nt, Human
cugaccuugggcagucuaguguuccugcauuc

SEQ ID NO: 401509 - RNA, 32 nt, Human
cugaccuuguccuacuucacugccuuugucug

SEQ ID NO: 401510 - RNA, 24 nt, Human
cugaccuugugauccacccaccuc

SEQ ID NO: 401511 - RNA, 25 nt, Human
cugaccuugugauccacccaccuca

SEQ ID NO: 401512 - RNA, 24 nt, Human
cugaccuugugauccacccaccuu

SEQ ID NO: 401513 - RNA, 24 nt, Human
cugaccuugugauccacccgccuc

SEQ ID NO: 401514 - RNA, 25 nt, Human
cugaccuugugauccacccgccuca

SEQ ID NO: 401515 - RNA, 24 nt, Human
cugaccuugugauccaccugccuu

SEQ ID NO: 401516 - RNA, 25 nt, Human
cugaccuugugauccgcccaccuca

SEQ ID NO: 401517 - RNA, 24 nt, Human
cugaccuugugauccgcccgccuc

SEQ ID NO: 401518 - RNA, 24 nt, Human
cugaccuugugauccgcccgccuu

SEQ ID NO: 401519 - RNA, 24 nt, Human
cugaccuugugauccgccugccuc

SEQ ID NO: 401520 - RNA, 24 nt, Human
cugaccuugugauccgccugccuu

SEQ ID NO: 401521 - RNA, 25 nt, Human
cugaccuugugauccgcucgccuca

SEQ ID NO: 401522 - RNA, 25 nt, Human
cugaccuugugaucugcccaccuca

SEQ ID NO: 401523 - RNA, 24 nt, Human
cugaccuugugaucugccugccuc

SEQ ID NO: 401524 - RNA, 24 nt, Human
cugaccuugugaucugccugccuu

SEQ ID NO: 401525 - RNA, 25 nt, Human
cugaccuugugaucugccugucuca

SEQ ID NO: 401526 - RNA, 25 nt, Human
cugaccuugugauuugcccgccuca

SEQ ID NO: 401527 - RNA, 32 nt, Human
cugaccuuucccugggcuucaaaggaaggcua

SEQ ID NO: 401528 - RNA, 19 nt, Human
cugaccuuucuccuguccu

SEQ ID NO: 401529 - RNA, 32 nt, Human
cugaccuuuucaucaauccuugcugacaaugu

SEQ ID NO: 401530 - RNA, 32 nt, Human
cugacgacacaagaucucagacuugugugauu

SEQ ID NO: 401531 - RNA, 32 nt, Human
cugacgacauguccaccaaaucugacgacucc

SEQ ID NO: 401532 - RNA, 32 nt, Human
cugacgagcacaggagggagguugaggugggg

SEQ ID NO: 401533 - RNA, 32 nt, Human
cugacgagcagucucaaauccacccacugccu

SEQ ID NO: 401534 - RNA, 32 nt, Human
cugacgaggcuggacuuccucgaguggccacu

SEQ ID NO: 401535 - RNA, 31 nt, Human
cugacgauggccucuguggcuucgugcgauu

SEQ ID NO: 401536 - RNA, 32 nt, Human
cugacgcaacccacguguaacugucagccggg

SEQ ID NO: 401537 - RNA, 32 nt, Human
cugacgcacacagccaguucucugcuucauau

SEQ ID NO: 401538 - RNA, 32 nt, Human
cugacgcacacgcuccuguugucauggcagac

SEQ ID NO: 401539 - RNA, 24 nt, Human
cugacgcacaggcuggagugcagu

SEQ ID NO: 401540 - RNA, 32 nt, Human
cugacgcacaggcuggagugcaguggcuccga

SEQ ID NO: 401541 - RNA, 19 nt, Human
cugacgcacgcgcacucca

SEQ ID NO: 401542 - RNA, 32 nt, Human
cugacgcagaauggaguugaggugggggcagc

SEQ ID NO: 401543 - RNA, 32 nt, Human
cugacgcagaugcaccagaaguaguaagugua

SEQ ID NO: 401544 - RNA, 32 nt, Human
cugacgcaggaacauggagcugauccaggaca

SEQ ID NO: 401545 - RNA, 32 nt, Human
cugacgcaucuucuuuuucugccuguagagau

SEQ ID NO: 401546 - RNA, 32 nt, Human
cugacgcaugccacagccugagugaauccuac

SEQ ID NO: 401547 - RNA, 17 nt, Human
cugacgccccgcugccg

SEQ ID NO: 401548 - RNA, 32 nt, Human
cugacgcccgagcaguggaggucccgcagaag

SEQ ID NO: 401549 - RNA, 32 nt, Human
cugacgcccuccauuucucuggcuccggcccc

SEQ ID NO: 401550 - RNA, 32 nt, Human
cugacgcccuugcccucuguguguccuuccuc

SEQ ID NO: 401551 - RNA, 32 nt, Human
cugacgccuacuggggcagggcagcaggcuuu

SEQ ID NO: 401552 - RNA, 32 nt, Human
cugacgccugagcugguagggguggagcaggu

SEQ ID NO: 401553 - RNA, 32 nt, Human
cugacgccuguaaucccagcacuuugggaggc

SEQ ID NO: 401554 - RNA, 19 nt, Human
cugacgcggauccggccuc

SEQ ID NO: 401555 - RNA, 32 nt, Human
cugacgcuccaggagcucacgcugucugcaga

SEQ ID NO: 401556 - RNA, 32 nt, Human
cugacgcugacaccuucucacugugaaacguc

SEQ ID NO: 401557 - RNA, 32 nt, Human
cugacgcugcagcccuggaccugcugggggcc

SEQ ID NO: 401558 - RNA, 32 nt, Human
cugacgcugcuccaggggaaagaaggaccagg

SEQ ID NO: 401559 - RNA, 18 nt, Human
cugacgcuggagaugcaa

SEQ ID NO: 401560 - RNA, 32 nt, Human
cugacgcuggugcuggaaccugcuggcaccuc

SEQ ID NO: 401561 - RNA, 32 nt, Human
cugacggacugcuucucauuugcacugaucac

SEQ ID NO: 401562 - RNA, 32 nt, Human
cugacggagccccagcuuaguggaggcugggc

SEQ ID NO: 401563 - RNA, 32 nt, Human
cugacggagccgcggcgccggcgaagucgcug

SEQ ID NO: 401564 - RNA, 22 nt, Human
cugacggccacuccugcugcug

SEQ ID NO: 401565 - RNA, 32 nt, Human
cugacggccagagggagggaaggguggucaca

SEQ ID NO: 401566 - RNA, 32 nt, Human
cugacggcccacuccaccuggagcuguccccu

SEQ ID NO: 401567 - RNA, 32 nt, Human
cugacggggguggacccccaucugcagaaguu

SEQ ID NO: 401568 - RNA, 32 nt, Human
cugacgggugggcucugccagagcccggguga

SEQ ID NO: 401569 - RNA, 32 nt, Human
cugacggugccggcaguggccguggagguggg

SEQ ID NO: 401570 - RNA, 32 nt, Human
cugacggugccuccucauguccccuuggagcg

SEQ ID NO: 401571 - RNA, 32 nt, Human
cugacguaccaaaaaguaagauauaguuuauu

SEQ ID NO: 401572 - RNA, 23 nt, Human
cugacguaggaggguugcuugag

SEQ ID NO: 401573 - RNA, 32 nt, Human
cugacgucaagcaaucccccagccucggccuc

SEQ ID NO: 401574 - RNA, 32 nt, Human
cugacgucaggaguucgagaccagccuagcca

SEQ ID NO: 401575 - RNA, 32 nt, Human
cugacgucaguaguuugagaccagccuggcca

SEQ ID NO: 401576 - RNA, 32 nt, Human
cugacgucccccaagagcacaugcagugagcc

SEQ ID NO: 401577 - RNA, 32 nt, Human
cugacguccggagucauuaaccaggaauguau

SEQ ID NO: 401578 - RNA, 32 nt, Human
cugacguggagguggauuggcugugccguggc

SEQ ID NO: 401579 - RNA, 32 nt, Human
cugacuaacaaugaagccuggaagagauucgu

SEQ ID NO: 401580 - RNA, 32 nt, Human
cugacuaacacagugaaaccccgacucuacua

SEQ ID NO: 401581 - RNA, 22 nt, Human
cugacuaacacggugaaacccc

SEQ ID NO: 401582 - RNA, 32 nt, Human
cugacuaacacggugaaaccccaucucuacua

SEQ ID NO: 401583 - RNA, 22 nt, Human
cugacuaacauggugaaacccc

SEQ ID NO: 401584 - RNA, 32 nt, Human
cugacuaacauggugaaaccccaucucuacua

SEQ ID NO: 401585 - RNA, 32 nt, Human
cugacuaaugcuuccuuugagaaaagcaccgu

SEQ ID NO: 401586 - RNA, 32 nt, Human
cugacuaccuggagcuguuugagugcagccuc

SEQ ID NO: 401587 - RNA, 32 nt, Human
cugacuagaggaaaacuuccaggccuuguuag

SEQ ID NO: 401588 - RNA, 32 nt, Human
cugacuagcugcagaaaguguggccaugccac

SEQ ID NO: 401589 - RNA, 32 nt, Human
cugacuaggcagcaaagacaggaguaucuucu

SEQ ID NO: 401590 - RNA, 32 nt, Human
cugacuagggaggguagcaccugccucagaua

SEQ ID NO: 401591 - RNA, 32 nt, Human
cugacuaguacagcugagaucuuggcuucuca

SEQ ID NO: 401592 - RNA, 32 nt, Human
cugacuagucucaaacuucuaggcucaagcga

SEQ ID NO: 401593 - RNA, 18 nt, Human
cugacuaguguggccuca

SEQ ID NO: 401594 - RNA, 32 nt, Human
cugacuauccuauucuauagaggggaauauau

SEQ ID NO: 401595 - RNA, 32 nt, Human
cugacucaacagcaagaaaaaugaacuugcca

SEQ ID NO: 401596 - RNA, 32 nt, Human
cugacucaauaugucagguuuaacucugccca

SEQ ID NO: 401597 - RNA, 32 nt, Human
cugacucacucaaacaaaauugcucacuuucc

SEQ ID NO: 401598 - RNA, 32 nt, Human
cugacucacuggcuucucacccaccaguggcu

SEQ ID NO: 401599 - RNA, 32 nt, Human
cugacucagccugucucccaccucccgggccu

SEQ ID NO: 401600 - RNA, 32 nt, Human
cugacucagcucgaggcggccuugccacauau

SEQ ID NO: 401601 - RNA, 32 nt, Human
cugacucauagagauaaaauucuuugaaagaa

SEQ ID NO: 401602 - RNA, 32 nt, Human
cugacucaucaguugagggcagcuccagugcc

SEQ ID NO: 401603 - RNA, 32 nt, Human
cugacucauggagccuugugcaaggagagcca

SEQ ID NO: 401604 - RNA, 32 nt, Human
cugacucauucuucuuggcugcagccucuucc

SEQ ID NO: 401605 - RNA, 31 nt, Human
cugacucauuuucaggagguugggggaaaag

SEQ ID NO: 401606 - RNA, 32 nt, Human
cugacuccaagcucugggguuuugccaugaau

SEQ ID NO: 401607 - RNA, 32 nt, Human
cugacuccaccugccaagagucugagccugca

SEQ ID NO: 401608 - RNA, 32 nt, Human
cugacuccagaaggcaccaggagcaugcgacu

SEQ ID NO: 401609 - RNA, 32 nt, Human
cugacuccagcagagucugugccaaugugggg

SEQ ID NO: 401610 - RNA, 32 nt, Human
cugacuccagccuguccaugcacggcuacaau

SEQ ID NO: 401611 - RNA, 32 nt, Human
cugacuccagccuugggcucagcagcacccgg

SEQ ID NO: 401612 - RNA, 32 nt, Human
cugacuccagcgaugguucuguccucgugccu

SEQ ID NO: 401613 - RNA, 32 nt, Human
cugacuccaggccugaaccccucccgugcugu

SEQ ID NO: 401614 - RNA, 32 nt, Human
cugacuccaggcgugaguauggggaaggauac

SEQ ID NO: 401615 - RNA, 32 nt, Human
cugacuccaugucccaggaccucauuuccagg

SEQ ID NO: 401616 - RNA, 32 nt, Human
cugacuccauuucucaaucugccuugcaguga

SEQ ID NO: 401617 - RNA, 20 nt, Human
cugacuccccuuucauuccc

SEQ ID NO: 401618 - RNA, 32 nt, Human
cugacucccuuagagcaaaggagagacagccc

SEQ ID NO: 401619 - RNA, 32 nt, Human
cugacuccucaccgucuucaccaacaugggaa

SEQ ID NO: 401620 - RNA, 32 nt, Human
cugacuccuccaggaccagccaugguguggag

SEQ ID NO: 401621 - RNA, 31 nt, Human
cugacuccuccucugaggccuguguuggccu

SEQ ID NO: 401622 - RNA, 32 nt, Human
cugacuccuggcccaagucucuuccuccuauc

SEQ ID NO: 401623 - RNA, 32 nt, Human
cugacuccugguggcaaggaucaucccuucua

SEQ ID NO: 401624 - RNA, 32 nt, Human
cugacuccuuccccaaacccagggaaaagagc

SEQ ID NO: 401625 - RNA, 32 nt, Human
cugacuccuuuagaaucaucucagucucucua

SEQ ID NO: 401626 - RNA, 32 nt, Human
cugacucuaggugcccuuggaggccagccagu

SEQ ID NO: 401627 - RNA, 32 nt, Human
cugacucuaguacaaacagacacauugacccu

SEQ ID NO: 401628 - RNA, 32 nt, Human
cugacucuaucacccaggcuggagugcagugu

SEQ ID NO: 401629 - RNA, 32 nt, Human
cugacucucauggaagaugguggaaggaaaau

SEQ ID NO: 401630 - RNA, 32 nt, Human
cugacucuccacuccuccucacuaaaaaggaa

SEQ ID NO: 401631 - RNA, 32 nt, Human
cugacucuccugacucuccaucgcucugucca

SEQ ID NO: 401632 - RNA, 32 nt, Human
cugacucugagccaggguucccccagggaacu

SEQ ID NO: 401633 - RNA, 32 nt, Human
cugacucugaggugggcagugagggaagcagc

SEQ ID NO: 401634 - RNA, 32 nt, Human
cugacucugcagcuccucaugcuggccuaucc

SEQ ID NO: 401635 - RNA, 32 nt, Human
cugacucugcucucuaaugagaacaaaguuag

SEQ ID NO: 401636 - RNA, 32 nt, Human
cugacucuggaagcagugguuuugaagucuua

SEQ ID NO: 401637 - RNA, 32 nt, Human
cugacucuggaaugaccacuguucauugaaaa

SEQ ID NO: 401638 - RNA, 32 nt, Human
cugacucugggcagcauuggugaugcuguauc

SEQ ID NO: 401639 - RNA, 32 nt, Human
cugacucugucacccaggcuggagugcagcag

SEQ ID NO: 401640 - RNA, 32 nt, Human
cugacucugucacccaggcuggagugcggugg

SEQ ID NO: 401641 - RNA, 32 nt, Human
cugacucuucaaggggcaacugcaggggcucg

SEQ ID NO: 401642 - RNA, 32 nt, Human
cugacucuuccucuucccagcggacggcugga

SEQ ID NO: 401643 - RNA, 16 nt, Human
cugacucuuccuuccc

SEQ ID NO: 401644 - RNA, 17 nt, Human
cugacucuugggaccuu

SEQ ID NO: 401645 - RNA, 18 nt, Human
cugacucuuguggccuca

SEQ ID NO: 401646 - RNA, 32 nt, Human
cugacucuuuucuauuucugacccaaagccua

SEQ ID NO: 401647 - RNA, 32 nt, Human
cugacugaaauagacaaaguaagagggaaagg

SEQ ID NO: 401648 - RNA, 32 nt, Human
cugacugaacuagagcuugcagugaaguguuc

SEQ ID NO: 401649 - RNA, 32 nt, Human
cugacugaagaugcaauccaaccaaagccauu

SEQ ID NO: 401650 - RNA, 32 nt, Human
cugacugaauaccacuuuuaaaggaaugugaa

SEQ ID NO: 401651 - RNA, 32 nt, Human
cugacugaccagguccgcagugaacagaggcg

SEQ ID NO: 401652 - RNA, 32 nt, Human
cugacugagacaauucuguccauguaaagauc

SEQ ID NO: 401653 - RNA, 32 nt, Human
cugacugcaaccacugccuccaggguucaagc

SEQ ID NO: 401654 - RNA, 32 nt, Human
cugacugcaaccuccaccuccuggguucaagc

SEQ ID NO: 401655 - RNA, 21 nt, Human
cugacugcaaccuccgccucc

SEQ ID NO: 401656 - RNA, 32 nt, Human
cugacugcaagcccuggcugaggccaaugcug

SEQ ID NO: 401657 - RNA, 32 nt, Human
cugacugcaaucugugccuccugggcucaagc

SEQ ID NO: 401658 - RNA, 32 nt, Human
cugacugcagaacugccgcucucaguggacag

SEQ ID NO: 401659 - RNA, 32 nt, Human
cugacugcagucugugccuccugggcucaagc

SEQ ID NO: 401660 - RNA, 32 nt, Human
cugacugcagugggcaggguauguagcugcuc

SEQ ID NO: 401661 - RNA, 32 nt, Human
cugacugcaguuacagaaucugaugaagcgag

SEQ ID NO: 401662 - RNA, 32 nt, Human
cugacugcauagcucuuuuucuugagaggcuc

SEQ ID NO: 401663 - RNA, 32 nt, Human
cugacugccacacauccgccauggugccacgg

SEQ ID NO: 401664 - RNA, 32 nt, Human
cugacugccccuguguuaccugggcagcucca

SEQ ID NO: 401665 - RNA, 32 nt, Human
cugacugccugauccuggagcgcaccccaucc

SEQ ID NO: 401666 - RNA, 17 nt, Human
cugacugcgacuucccu

SEQ ID NO: 401667 - RNA, 32 nt, Human
cugacugcggccgccuccggccaggacgcugg

SEQ ID NO: 401668 - RNA, 32 nt, Human
cugacugcucugcaaaccccagccgaggaccu

SEQ ID NO: 401669 - RNA, 32 nt, Human
cugacugcucugucuuccugccuucgucucgc

SEQ ID NO: 401670 - RNA, 32 nt, Human
cugacugcuguucaggcccgcacaaugucccg

SEQ ID NO: 401671 - RNA, 32 nt, Human
cugacuggagagcugggaauauggcauuugga

SEQ ID NO: 401672 - RNA, 32 nt, Human
cugacuggagcagagucauuugcuucagcagg

SEQ ID NO: 401673 - RNA, 32 nt, Human
cugacuggcagaggaagauugcagugacagcu

SEQ ID NO: 401674 - RNA, 32 nt, Human
cugacuggcaggcagaaagugcaacugacgag

SEQ ID NO: 401675 - RNA, 32 nt, Human
cugacuggccuccuuuuccuuugacuggacca

SEQ ID NO: 401676 - RNA, 32 nt, Human
cugacuggccuccuuuuccuuugacuggaccg

SEQ ID NO: 401677 - RNA, 20 nt, Human
cugacuggccuggucuuuuu

SEQ ID NO: 401678 - RNA, 32 nt, Human
cugacuggcucaaaggaacaggauggcaccca

SEQ ID NO: 401679 - RNA, 32 nt, Human
cugacugggccugcagcucccuucuccuggga

SEQ ID NO: 401680 - RNA, 32 nt, Human
cugacugggcuacaauccauuguucuuagucc

SEQ ID NO: 401681 - RNA, 32 nt, Human
cugacuggggacccagaccgggagcugagcga

SEQ ID NO: 401682 - RNA, 32 nt, Human
cugacuggggcguccgacuggagcucagccgc

SEQ ID NO: 401683 - RNA, 32 nt, Human
cugacugggggcaggggaagagacagggcaca

SEQ ID NO: 401684 - RNA, 32 nt, Human
cugacuggugcucuuccugugagcggauagag

SEQ ID NO: 401685 - RNA, 32 nt, Human
cugacuguauuucuuugcccuaccucacuaua

SEQ ID NO: 401686 - RNA, 17 nt, Human
cugacuguccucucccu

SEQ ID NO: 401687 - RNA, 32 nt, Human
cugacugugcagugggaguccugggggaaugg

SEQ ID NO: 401688 - RNA, 32 nt, Human
cugacuguggcuggcugagaucgcaggugccu

SEQ ID NO: 401689 - RNA, 32 nt, Human
cugacugugguucccagcuccagcccuaguca

SEQ ID NO: 401690 - RNA, 32 nt, Human
cugacuguuccuucuacugcuuuucaguuccc

SEQ ID NO: 401691 - RNA, 32 nt, Human
cugacuguugcccaggcuggaguguaauggcg

SEQ ID NO: 401692 - RNA, 32 nt, Human
cugacuucaaaugcucugccugccucggccuc

SEQ ID NO: 401693 - RNA, 32 nt, Human
cugacuucaagcaauucuccugccucagccuc

SEQ ID NO: 401694 - RNA, 32 nt, Human
cugacuucaagugaucugcccaccucugccuc

SEQ ID NO: 401695 - RNA, 32 nt, Human
cugacuucaggugauccacccaccucggccuu

SEQ ID NO: 401696 - RNA, 32 nt, Human
cugacuucauuuccuuagacaagacacagugu

SEQ ID NO: 401697 - RNA, 32 nt, Human
cugacuucauuugugccacacgcaugggcauu

SEQ ID NO: 401698 - RNA, 32 nt, Human
cugacuuccacauucuguugcauuuauuugcc

SEQ ID NO: 401699 - RNA, 20 nt, Human
cugacuuccacucuggcuca

SEQ ID NO: 401700 - RNA, 20 nt, Human
cugacuuccaucuccugccu

SEQ ID NO: 401701 - RNA, 32 nt, Human
cugacuuccauggaauggggcagcagggccug

SEQ ID NO: 401702 - RNA, 32 nt, Human
cugacuuccccagcaaggaucuucccacuucc

SEQ ID NO: 401703 - RNA, 32 nt, Human
cugacuucccugacaucucucuccaaauacgg

SEQ ID NO: 401704 - RNA, 32 nt, Human
cugacuucccugccaucucucuccaaauacgg

SEQ ID NO: 401705 - RNA, 32 nt, Human
cugacuuccgcugugucgucaucccccaggaa

SEQ ID NO: 401706 - RNA, 32 nt, Human
cugacuuccucacuaaccucuucacguguaac

SEQ ID NO: 401707 - RNA, 32 nt, Human
cugacuuccucacuauccucuucacauguaac

SEQ ID NO: 401708 - RNA, 32 nt, Human
cugacuuccugugcuccucuggccacagguaa

SEQ ID NO: 401709 - RNA, 32 nt, Human
cugacuucgggaugggaaguggagcccccgga

SEQ ID NO: 401710 - RNA, 32 nt, Human
cugacuucugucuaggcucauggaugccaccc

SEQ ID NO: 401711 - RNA, 32 nt, Human
cugacuucuuccuccuccuccuucccugacuc

SEQ ID NO: 401712 - RNA, 32 nt, Human
cugacuucuuuaagcaccuuucuaaauaccag

SEQ ID NO: 401713 - RNA, 31 nt, Human
cugacuugcacagaaauucuguugaagacag

SEQ ID NO: 401714 - RNA, 32 nt, Human
cugacuugccuaggucauugugcacacguggc

SEQ ID NO: 401715 - RNA, 32 nt, Human
cugacuugcucauuuagacuguucacggaguc

SEQ ID NO: 401716 - RNA, 32 nt, Human
cugacuuggaaaccggugggugcaaugcccga

SEQ ID NO: 401717 - RNA, 31 nt, Human
cugacuuggacaaucugccaggacagaagcu

SEQ ID NO: 401718 - RNA, 32 nt, Human
cugacuuggacccuuuccacaccagacuggca

SEQ ID NO: 401719 - RNA, 32 nt, Human
cugacuuggauugucuuucuuucauaucacua

SEQ ID NO: 401720 - RNA, 32 nt, Human
cugacuuggcuuccugugaucugcauucauga

SEQ ID NO: 401721 - RNA, 32 nt, Human
cugacuuguuguucuuggcacauguucuuauu

SEQ ID NO: 401722 - RNA, 32 nt, Human
cugacuuuagccucgugcugagccguguaucc

SEQ ID NO: 401723 - RNA, 18 nt, Human
cugacuuuaggugaucca

SEQ ID NO: 401724 - RNA, 32 nt, Human
cugacuuuauuuuccauguauuacaaaaggaa

SEQ ID NO: 401725 - RNA, 32 nt, Human
cugacuuucuguugucuaccucaggccuugug

SEQ ID NO: 401726 - RNA, 22 nt, Human
cugacuuugcacuuugguuaca

SEQ ID NO: 401727 - RNA, 32 nt, Human
cugacuuugcccacucaacacuucaacucugg

SEQ ID NO: 401728 - RNA, 32 nt, Human
cugacuuugccucuguccugccugguguggag

SEQ ID NO: 401729 - RNA, 32 nt, Human
cugacuuuguauccucuccuuuuagaggcuuu

SEQ ID NO: 401730 - RNA, 24 nt, Human
cugacuuugugauccacccgccuc

SEQ ID NO: 401731 - RNA, 32 nt, Human
cugacuuuuaauccuuacuuugcucuauuccc

SEQ ID NO: 401732 - RNA, 32 nt, Human
cugagaaaaauggaugguauuuucuuaaaauu

SEQ ID NO: 401733 - RNA, 32 nt, Human
cugagaaaagccuggaaaaaucacacuucuuu

SEQ ID NO: 401734 - RNA, 32 nt, Human
cugagaaaaggugagaaagagaauggagaguu

SEQ ID NO: 401735 - RNA, 32 nt, Human
cugagaaacagcccccaguccuccuccacuac

SEQ ID NO: 401736 - RNA, 32 nt, Human
cugagaaacaugaaucccacugggacagaugg

SEQ ID NO: 401737 - RNA, 32 nt, Human
cugagaaaccagaguuaaaaccucuuuggagc

SEQ ID NO: 401738 - RNA, 32 nt, Human
cugagaaacuggaucugaggaggcaggaaagg

SEQ ID NO: 401739 - RNA, 32 nt, Human
cugagaaacuugacaaguaucucuccauuuua

SEQ ID NO: 401740 - RNA, 32 nt, Human
cugagaaagaacagcugagugguuguucucag

SEQ ID NO: 401741 - RNA, 32 nt, Human
cugagaaagcuucagcauuucucuugcuaaca

SEQ ID NO: 401742 - RNA, 32 nt, Human
cugagaaaggaaaucauguucacugguagaag

SEQ ID NO: 401743 - RNA, 32 nt, Human
cugagaaaggaagcugcuuagagccagggggu

SEQ ID NO: 401744 - RNA, 32 nt, Human
cugagaaaggucauuucucccacacacgacaa

SEQ ID NO: 401745 - RNA, 22 nt, Human
cugagaaauagugcacuccaag

SEQ ID NO: 401746 - RNA, 31 nt, Human
cugagaaaucugguuaaaacacauuaauuau

SEQ ID NO: 401747 - RNA, 32 nt, Human
cugagaacaaucucuuauaccaccccacaaag

SEQ ID NO: 401748 - RNA, 32 nt, Human
cugagaacccacucacacccacccucaguggc

SEQ ID NO: 401749 - RNA, 32 nt, Human
cugagaacccagccagucaggaagucgcuacu

SEQ ID NO: 401750 - RNA, 32 nt, Human
cugagaacccagcgauaagggggcguucccaa

SEQ ID NO: 401751 - RNA, 19 nt, Human
cugagaaccccugccccca

SEQ ID NO: 401752 - RNA, 31 nt, Human
cugagaaccuuccaaaaacccgcccgaauuc

SEQ ID NO: 401753 - RNA, 32 nt, Human
cugagaacuauacaaccuuucccagacuccca

SEQ ID NO: 401754 - RNA, 32 nt, Human
cugagaacuccucauucccugacucuuagccc

SEQ ID NO: 401755 - RNA, 32 nt, Human
cugagaacugacccucacaucucccuuccuga

SEQ ID NO: 401756 - RNA, 32 nt, Human
cugagaagaaaaucguauguugucauucucug

SEQ ID NO: 401757 - RNA, 32 nt, Human
cugagaagaggaagaugaagaggaggaagagg

SEQ ID NO: 401758 - RNA, 32 nt, Human
cugagaagauucugauaacagaaacaaacaac

SEQ ID NO: 401759 - RNA, 32 nt, Human
cugagaagcagacucugcaucuguaaaaggcu

SEQ ID NO: 401760 - RNA, 30 nt, Human
cugagaagccucucacaagcucuuuagcca

SEQ ID NO: 401761 - RNA, 32 nt, Human
cugagaagcucccuaccucccugcccuucucc

SEQ ID NO: 401762 - RNA, 21 nt, Human
cugagaagcugggacuacagg

SEQ ID NO: 401763 - RNA, 32 nt, Human
cugagaaggaaaaaggagcccagcaagaagag

SEQ ID NO: 401764 - RNA, 32 nt, Human
cugagaaggccuggccccuuccugugcugagc

SEQ ID NO: 401765 - RNA, 32 nt, Human
cugagaagggcagaucuucugaggucaggagu

SEQ ID NO: 401766 - RNA, 32 nt, Human
cugagaagggccugagccccagggaccccuca

SEQ ID NO: 401767 - RNA, 24 nt, Human
cugagaagggcggaucacgagguc

SEQ ID NO: 401768 - RNA, 32 nt, Human
cugagaaguucaggaagauggaggaugaggau

SEQ ID NO: 401769 - RNA, 32 nt, Human
cugagaaucagcacacaccauauuucaaauau

SEQ ID NO: 401770 - RNA, 32 nt, Human
cugagaaucccagcuacucagaagguugagac

SEQ ID NO: 401771 - RNA, 32 nt, Human
cugagaaucccccaguuaagaugauuucccuu

SEQ ID NO: 401772 - RNA, 32 nt, Human
cugagaaucccgugcucuccucucuuuuggug

SEQ ID NO: 401773 - RNA, 32 nt, Human
cugagaaugaggcaguuugacacagaucacaa

SEQ ID NO: 401774 - RNA, 18 nt, Human
cugagaaugcaccaaaga

SEQ ID NO: 401775 - RNA, 32 nt, Human
cugagaaugccuaggccagcuccuuagacacc

SEQ ID NO: 401776 - RNA, 32 nt, Human
cugagaauggaugggagaggagaggaagaggg

SEQ ID NO: 401777 - RNA, 32 nt, Human
cugagacaacaaucagaauacagacuuuggau

SEQ ID NO: 401778 - RNA, 32 nt, Human
cugagacaccucagggcugcauucagcuuacc

SEQ ID NO: 401779 - RNA, 18 nt, Human
cugagacacgccccaaca

SEQ ID NO: 401780 - RNA, 32 nt, Human
cugagacacgcuugaagaguuccuggauggcc

SEQ ID NO: 401781 - RNA, 19 nt, Human
cugagacacuucuacaaca

SEQ ID NO: 401782 - RNA, 32 nt, Human
cugagacagacggaucaccugaggccaggaau

SEQ ID NO: 401783 - RNA, 32 nt, Human
cugagacagcaaccugccuggccugggaagcc

SEQ ID NO: 401784 - RNA, 23 nt, Human
cugagacagcagcccagggcagg

SEQ ID NO: 401785 - RNA, 32 nt, Human
cugagacagcucccagcacucauucauucauu

SEQ ID NO: 401786 - RNA, 19 nt, Human
cugagacaggacaggaagg

SEQ ID NO: 401787 - RNA, 24 nt, Human
cugagacaggagaagugcuugaac

SEQ ID NO: 401788 - RNA, 24 nt, Human
cugagacaggagaaucaccugaac

SEQ ID NO: 401789 - RNA, 24 nt, Human
cugagacaggagaaucacuugaac

SEQ ID NO: 401790 - RNA, 24 nt, Human
cugagacaggagaaucacuugagc

SEQ ID NO: 401791 - RNA, 24 nt, Human
cugagacaggagaaucccuugaac

SEQ ID NO: 401792 - RNA, 24 nt, Human
cugagacaggagaaucgcuugaac

SEQ ID NO: 401793 - RNA, 24 nt, Human
cugagacaggagaaucgcuugaau

SEQ ID NO: 401794 - RNA, 24 nt, Human
cugagacaggagaaucucuugaac

SEQ ID NO: 401795 - RNA, 24 nt, Human
cugagacaggagaauggcgugaau

SEQ ID NO: 401796 - RNA, 24 nt, Human
cugagacaggagaauggugugaac

SEQ ID NO: 401797 - RNA, 24 nt, Human
cugagacaggagaauugcuugaac

SEQ ID NO: 401798 - RNA, 32 nt, Human
cugagacaggagacuugcuugaaugugggagg

SEQ ID NO: 401799 - RNA, 24 nt, Human
cugagacaggagagucgcuugaac

SEQ ID NO: 401800 - RNA, 24 nt, Human
cugagacaggaggaucgcuugaac

SEQ ID NO: 401801 - RNA, 32 nt, Human
cugagacaggcagaucaccugaggucacgaau

SEQ ID NO: 401802 - RNA, 32 nt, Human
cugagacaggcagaucacuugaggucaggagu

SEQ ID NO: 401803 - RNA, 24 nt, Human
cugagacaggcggaucacgagguc

SEQ ID NO: 401804 - RNA, 32 nt, Human
cugagacagguggaucacuugaggucaggagu

SEQ ID NO: 401805 - RNA, 32 nt, Human
cugagacagugccaccaccagcaccucccaca

SEQ ID NO: 401806 - RNA, 32 nt, Human
cugagacagugggagagccugaagcagaaucc

SEQ ID NO: 401807 - RNA, 32 nt, Human
cugagacauagcagugccuggcccagcgggga

SEQ ID NO: 401808 - RNA, 32 nt, Human
cugagacauuacaaaguaucugccucaauuau

SEQ ID NO: 401809 - RNA, 32 nt, Human
cugagaccaagaagggagagcacaagacuaac

SEQ ID NO: 401810 - RNA, 32 nt, Human
cugagaccacgguccaauccagccuucuuccc

SEQ ID NO: 401811 - RNA, 32 nt, Human
cugagaccagaacuugcagccccucugcagau

SEQ ID NO: 401812 - RNA, 32 nt, Human
cugagaccagccugagcaacaugaugagaccc

SEQ ID NO: 401813 - RNA, 32 nt, Human
cugagaccagccuggccaacauggcaaaaccc

SEQ ID NO: 401814 - RNA, 32 nt, Human
cugagaccagccuggcuaacauggugaaaccc

SEQ ID NO: 401815 - RNA, 32 nt, Human
cugagaccagccuggcuuacauggugaaaccc

SEQ ID NO: 401816 - RNA, 23 nt, Human
cugagaccagccugggcaacaua

SEQ ID NO: 401817 - RNA, 32 nt, Human
cugagaccagccugggcaacauggugaaaccc

SEQ ID NO: 401818 - RNA, 20 nt, Human
cugagaccagcuauuacaac

SEQ ID NO: 401819 - RNA, 32 nt, Human
cugagaccagcuugggcaacaugguggagccc

SEQ ID NO: 401820 - RNA, 32 nt, Human
cugagaccaggagguugaggcugcagugagcc

SEQ ID NO: 401821 - RNA, 32 nt, Human
cugagaccaguccuggccaggguaguuaccag

SEQ ID NO: 401822 - RNA, 32 nt, Human
cugagaccaguugcuggugaaacugggccaau

SEQ ID NO: 401823 - RNA, 32 nt, Human
cugagaccauccuagccaacauggugaaaacc

SEQ ID NO: 401824 - RNA, 32 nt, Human
cugagaccauccuagccaacauggugaaaccc

SEQ ID NO: 401825 - RNA, 32 nt, Human
cugagaccauccuggccaacauggugaacacc

SEQ ID NO: 401826 - RNA, 32 nt, Human
cugagaccauccuggcuaacaccaugaugggc

SEQ ID NO: 401827 - RNA, 32 nt, Human
cugagaccauccuggcuaacacggugaaaccc

SEQ ID NO: 401828 - RNA, 32 nt, Human
cugagacccaggcugguguggacacaaggaag

SEQ ID NO: 401829 - RNA, 32 nt, Human
cugagacccgaaaagaccugggugcaagccuc

SEQ ID NO: 401830 - RNA, 32 nt, Human
cugagacccgugagcagcuacaagccgaagug

SEQ ID NO: 401831 - RNA, 32 nt, Human
cugagaccucaaacccuggcuccagugucaug

SEQ ID NO: 401832 - RNA, 32 nt, Human
cugagaccuccguccucugcuuuccgggcagc

SEQ ID NO: 401833 - RNA, 32 nt, Human
cugagaccugggaggaagcuggagaaaagaug

SEQ ID NO: 401834 - RNA, 32 nt, Human
cugagaccuuccaggcccugaggaaucccggg

SEQ ID NO: 401835 - RNA, 17 nt, Human
cugagacgacuacagca

SEQ ID NO: 401836 - RNA, 18 nt, Human
cugagacgagcacagggu

SEQ ID NO: 401837 - RNA, 32 nt, Human
cugagacgagcgggagcgcggagcagcagccu

SEQ ID NO: 401838 - RNA, 28 nt, Human
cugagacggcagagaccccaggauccca

SEQ ID NO: 401839 - RNA, 32 nt, Human
cugagacgggcagaucaccugagaucaggagu

SEQ ID NO: 401840 - RNA, 32 nt, Human
cugagacggguggauuaccugaggucaggacu

SEQ ID NO: 401841 - RNA, 32 nt, Human
cugagacuaacaauuggagacugaggccagag

SEQ ID NO: 401842 - RNA, 32 nt, Human
cugagacuaagaauugaagcaaugcaguuuua

SEQ ID NO: 401843 - RNA, 32 nt, Human
cugagacuaagaauugaaguaaugcaguuuua

SEQ ID NO: 401844 - RNA, 32 nt, Human
cugagacuauacaggugcaggccaccacucuu

SEQ ID NO: 401845 - RNA, 32 nt, Human
cugagacuccagccucuccuccuggggccacc

SEQ ID NO: 401846 - RNA, 32 nt, Human
cugagacucgguuuucucaucuguaaaauggg

SEQ ID NO: 401847 - RNA, 32 nt, Human
cugagacucucaccuuugcuuccaggggagag

SEQ ID NO: 401848 - RNA, 32 nt, Human
cugagacugcacuagggucuggggacacagaa

SEQ ID NO: 401849 - RNA, 22 nt, Human
cugagacugcaggcacgagcca

SEQ ID NO: 401850 - RNA, 32 nt, Human
cugagacugccuggcaacggcugaugccccag

SEQ ID NO: 401851 - RNA, 32 nt, Human
cugagacugggguugaggggacugacgggggc

SEQ ID NO: 401852 - RNA, 32 nt, Human
cugagacugugccauugcacuccagucggguu

SEQ ID NO: 401853 - RNA, 18 nt, Human
cugagacuguuacuacaa

SEQ ID NO: 401854 - RNA, 32 nt, Human
cugagacuuacgcccuguucccuuccugcccu

SEQ ID NO: 401855 - RNA, 32 nt, Human
cugagacuucaagaggcaaaauaauuuaccca

SEQ ID NO: 401856 - RNA, 32 nt, Human
cugagacuuccucugcaguugaugugguccug

SEQ ID NO: 401857 - RNA, 32 nt, Human
cugagacuugaaucaagucagcaacagagcaa

SEQ ID NO: 401858 - RNA, 32 nt, Human
cugagacuuggaccuuccccagccccugggcc

SEQ ID NO: 401859 - RNA, 32 nt, Human
cugagacuuucuacuuuaacaguuucacaguc

SEQ ID NO: 401860 - RNA, 31 nt, Human
cugagagaacaauguuucacuuaauaggagg

SEQ ID NO: 401861 - RNA, 32 nt, Human
cugagagaagcacagaaccuggcauucacugg

SEQ ID NO: 401862 - RNA, 23 nt, Human
cugagagaauccugagacauccc

SEQ ID NO: 401863 - RNA, 32 nt, Human
cugagagacaagauuccugggcccugccuucc

SEQ ID NO: 401864 - RNA, 32 nt, Human
cugagagaccaccacccuccaugccuccagcu

SEQ ID NO: 401865 - RNA, 32 nt, Human
cugagagaccauagggagguuggggcucacug

SEQ ID NO: 401866 - RNA, 19 nt, Human
cugagagacccuggccuca

SEQ ID NO: 401867 - RNA, 32 nt, Human
cugagagagacagaagccccagccccagaacc

SEQ ID NO: 401868 - RNA, 32 nt, Human
cugagagagccaccaaggaggagcaggggagc

SEQ ID NO: 401869 - RNA, 32 nt, Human
cugagagagcccagccugaugccagaacaaag

SEQ ID NO: 401870 - RNA, 32 nt, Human
cugagagaggaacucuguggggugggggccgu

SEQ ID NO: 401871 - RNA, 32 nt, Human
cugagagaguccacauccacagacuguuucau

SEQ ID NO: 401872 - RNA, 22 nt, Human
cugagagaugcacaacagucau

SEQ ID NO: 401873 - RNA, 20 nt, Human
cugagagauuaaaggaacag

SEQ ID NO: 401874 - RNA, 32 nt, Human
cugagagcacaucgccaggggaagaggacugu

SEQ ID NO: 401875 - RNA, 32 nt, Human
cugagagcaccacugaacuuagaccucucaac

SEQ ID NO: 401876 - RNA, 32 nt, Human
cugagagcacccagaggaccgaggacaggggc

SEQ ID NO: 401877 - RNA, 32 nt, Human
cugagagcaccgcugcacucgcggccggcgau

SEQ ID NO: 401878 - RNA, 32 nt, Human
cugagagcaguggcucacgccuguaaucccag

SEQ ID NO: 401879 - RNA, 32 nt, Human
cugagagcaguggcucaugccuguaaucccag

SEQ ID NO: 401880 - RNA, 32 nt, Human
cugagagcauccuggcaccugggagcgcaggu

SEQ ID NO: 401881 - RNA, 32 nt, Human
cugagagccacugaauuagaacaagggaacug

SEQ ID NO: 401882 - RNA, 32 nt, Human
cugagagcccccuuccucugagggccccaccu

SEQ ID NO: 401883 - RNA, 32 nt, Human
cugagagcccucuccucuggagcacacaccac

SEQ ID NO: 401884 - RNA, 32 nt, Human
cugagagccugcccacuguccagauccaguga

SEQ ID NO: 401885 - RNA, 32 nt, Human
cugagagcucagaagugagcaaaggagcuuaa

SEQ ID NO: 401886 - RNA, 32 nt, Human
cugagagcucagaggauuccugccaggccuca

SEQ ID NO: 401887 - RNA, 32 nt, Human
cugagagcucucucuucucuguuacaaaacga

SEQ ID NO: 401888 - RNA, 17 nt, Human
cugagagcucuggccuc

SEQ ID NO: 401889 - RNA, 32 nt, Human
cugagagcugcagagaugaccugcuggcagag

SEQ ID NO: 401890 - RNA, 32 nt, Human
cugagagcugccucucaaucccugucccaagc

SEQ ID NO: 401891 - RNA, 20 nt, Human
cugagagcugggacuacagg

SEQ ID NO: 401892 - RNA, 32 nt, Human
cugagagcuggucugcguuucccaggcgcggc

SEQ ID NO: 401893 - RNA, 32 nt, Human
cugagagcuguggguagggaagggcccaaguc

SEQ ID NO: 401894 - RNA, 32 nt, Human
cugagaggaaaaggaaaagggaagggagagaa

SEQ ID NO: 401895 - RNA, 32 nt, Human
cugagaggaaccuggacauggucccgggcauc

SEQ ID NO: 401896 - RNA, 32 nt, Human
cugagaggaaugcgcagcugaagagagaggug

SEQ ID NO: 401897 - RNA, 32 nt, Human
cugagaggacgcagcauagaaaaugcuuauga

SEQ ID NO: 401898 - RNA, 32 nt, Human
cugagaggagcguggcugucuccucucuccgc

SEQ ID NO: 401899 - RNA, 19 nt, Human
cugagaggaggagggcacu

SEQ ID NO: 401900 - RNA, 32 nt, Human
cugagaggcacuucacucacaggccuguggga

SEQ ID NO: 401901 - RNA, 24 nt, Human
cugagaggcagagguuacagugag

SEQ ID NO: 401902 - RNA, 24 nt, Human
cugagaggcagagguugcagugag

SEQ ID NO: 401903 - RNA, 22 nt, Human
cugagaggccggggcucaggga

SEQ ID NO: 401904 - RNA, 24 nt, Human
cugagaggcggagguugcagugag

SEQ ID NO: 401905 - RNA, 32 nt, Human
cugagaggcuacuuggaaaggcauuuucccag

SEQ ID NO: 401906 - RNA, 32 nt, Human
cugagaggcugacagaggcaggaugggugcaa

SEQ ID NO: 401907 - RNA, 32 nt, Human
cugagaggcugaggcaggagaauaacuggaau

SEQ ID NO: 401908 - RNA, 32 nt, Human
cugagagggaaaggaagguuggaauggcggau

SEQ ID NO: 401909 - RNA, 32 nt, Human
cugagagggcgguggagguggugaggaggauc

SEQ ID NO: 401910 - RNA, 32 nt, Human
cugagagggcugggccagaauuuuccugggcc

SEQ ID NO: 401911 - RNA, 31 nt, Human
cugagaggggagagagacuggagcuggcaag

SEQ ID NO: 401912 - RNA, 32 nt, Human
cugagaggucacagcucugccucacagcaccc

SEQ ID NO: 401913 - RNA, 32 nt, Human
cugagaggucaggaaggggaccucuuugaggg

SEQ ID NO: 401914 - RNA, 32 nt, Human
cugagaggugccgucuggcccuucccugcagg

SEQ ID NO: 401915 - RNA, 24 nt, Human
cugagagguggagguuacagugag

SEQ ID NO: 401916 - RNA, 24 nt, Human
cugagagguggagguugcagugag

SEQ ID NO: 401917 - RNA, 32 nt, Human
cugagagguggcuguuggucaggacgggaagc

SEQ ID NO: 401918 - RNA, 32 nt, Human
cugagaguaaaaagauuaugcugcaaagcuau

SEQ ID NO: 401919 - RNA, 32 nt, Human
cugagagucaaggcggaggucgcgguaagccg

SEQ ID NO: 401920 - RNA, 32 nt, Human
cugagaguccaaaauauauuuuuccagcccga

SEQ ID NO: 401921 - RNA, 32 nt, Human
cugagaguggagaugggggcgggggugguggu

SEQ ID NO: 401922 - RNA, 32 nt, Human
cugagaguggggguggcugggagcagcgcagc

SEQ ID NO: 401923 - RNA, 32 nt, Human
cugagagugucuuggggagaccuugcagaggg

SEQ ID NO: 401924 - RNA, 32 nt, Human
cugagagugugggcagcuucacgggggacgac

SEQ ID NO: 401925 - RNA, 32 nt, Human
cugagaguuaacuaacuugcccaaggucacac

SEQ ID NO: 401926 - RNA, 19 nt, Human
cugagaguuggaggcugcg

SEQ ID NO: 401927 - RNA, 32 nt, Human
cugagauaaaaauuugguucugggaaacugaa

SEQ ID NO: 401928 - RNA, 32 nt, Human
cugagauaaaacugagcagggugggaccagag

SEQ ID NO: 401929 - RNA, 32 nt, Human
cugagauaauuccaaugugcagucaggauuga

SEQ ID NO: 401930 - RNA, 18 nt, Human
cugagauagaauugugau

SEQ ID NO: 401931 - RNA, 32 nt, Human
cugagauaguaaacaagauggcuggccagguc

SEQ ID NO: 401932 - RNA, 32 nt, Human
cugagaucacuggcccacucgggccaggcggu

SEQ ID NO: 401933 - RNA, 27 nt, Human
cugagaucagaaguucgagaccagccu

SEQ ID NO: 401934 - RNA, 32 nt, Human
cugagaucagcccaaaucaaggugucccugug

SEQ ID NO: 401935 - RNA, 32 nt, Human
cugagaucaggaguucaagaccagccuggcca

SEQ ID NO: 401936 - RNA, 32 nt, Human
cugagaucaggaguucgagaccagccuggcca

SEQ ID NO: 401937 - RNA, 32 nt, Human
cugagaucaggaguucgagaccagccuggccc

SEQ ID NO: 401938 - RNA, 32 nt, Human
cugagaucaggaguucgggaccagccugggca

SEQ ID NO: 401939 - RNA, 32 nt, Human
cugagaucaggaguuugaggccagucuggcca

SEQ ID NO: 401940 - RNA, 32 nt, Human
cugagaucagugagcucugaucuccaagggaa

SEQ ID NO: 401941 - RNA, 32 nt, Human
cugagaucaugcugcuuucuucuucagaucug

SEQ ID NO: 401942 - RNA, 32 nt, Human
cugagauccacaaaguggagauagcaguagca

SEQ ID NO: 401943 - RNA, 32 nt, Human
cugagauccacgaggcagaggcagcaguagcg

SEQ ID NO: 401944 - RNA, 32 nt, Human
cugagauccagagagaugaugacuuugcccau

SEQ ID NO: 401945 - RNA, 32 nt, Human
cugagauccuucagguccccuggcccuuccuu

SEQ ID NO: 401946 - RNA, 19 nt, Human
cugagauccuugggaucuu

SEQ ID NO: 401947 - RNA, 32 nt, Human
cugagaucgagaguucaagaccagccuggcca

SEQ ID NO: 401948 - RNA, 32 nt, Human
cugagaucgcugcacuccagccugggcgacaa

SEQ ID NO: 401949 - RNA, 32 nt, Human
cugagaucguacccagccugggcaacagugcg

SEQ ID NO: 401950 - RNA, 32 nt, Human
cugagaucuacaaaugggaagcuugugagugg

SEQ ID NO: 401951 - RNA, 32 nt, Human
cugagaucugggaugugcacgaaugcuguucu

SEQ ID NO: 401952 - RNA, 32 nt, Human
cugagaugagacuucauggaaggggcuacaaa

SEQ ID NO: 401953 - RNA, 32 nt, Human
cugagaugagcagcagcgcagaggaggugccc

SEQ ID NO: 401954 - RNA, 32 nt, Human
cugagaugaugagucuguguugcuuuaagcca

SEQ ID NO: 401955 - RNA, 22 nt, Human
cugagaugauggaaauguucua

SEQ ID NO: 401956 - RNA, 32 nt, Human
cugagaugcagagcaggauggagggucugcuu

SEQ ID NO: 401957 - RNA, 32 nt, Human
cugagaugccuggcuacuuggcaccagggacu

SEQ ID NO: 401958 - RNA, 32 nt, Human
cugagaugcggaaagggucagagcagggcucg

SEQ ID NO: 401959 - RNA, 32 nt, Human
cugagaugcugugugauauguccuccuuacca

SEQ ID NO: 401960 - RNA, 32 nt, Human
cugagauggaaccuggccucaguuuaggaaca

SEQ ID NO: 401961 - RNA, 32 nt, Human
cugagauggaagcugucuugggcuuguugucu

SEQ ID NO: 401962 - RNA, 32 nt, Human
cugagauggagacagaaggaggggacuuauuu

SEQ ID NO: 401963 - RNA, 32 nt, Human
cugagauggaguuucacucuuguugcccaggc

SEQ ID NO: 401964 - RNA, 32 nt, Human
cugagauggcagugcacacacccuccccacca

SEQ ID NO: 401965 - RNA, 23 nt, Human
cugagaugggaggaucgcuugag

SEQ ID NO: 401966 - RNA, 32 nt, Human
cugagaugggcagaucacuugaggucaggagu

SEQ ID NO: 401967 - RNA, 24 nt, Human
cugagauggguggaucaccugaga

SEQ ID NO: 401968 - RNA, 32 nt, Human
cugagauggguggaucaccugagcucaggagu

SEQ ID NO: 401969 - RNA, 32 nt, Human
cugagauggucuggaggauucucucuagccgu

SEQ ID NO: 401970 - RNA, 32 nt, Human
cugagauguagaaaguuucucaaaggaaaagc

SEQ ID NO: 401971 - RNA, 18 nt, Human
cugagaugucagaucuca

SEQ ID NO: 401972 - RNA, 32 nt, Human
cugagaugugguccccaaggggccagaaauuc

SEQ ID NO: 401973 - RNA, 32 nt, Human
cugagauguguucuguccagcaggugcccgaa

SEQ ID NO: 401974 - RNA, 22 nt, Human
cugagauuacagacgugagcca

SEQ ID NO: 401975 - RNA, 22 nt, Human
cugagauuacaggcauaagcca

SEQ ID NO: 401976 - RNA, 22 nt, Human
cugagauuacaggcaugaacca

SEQ ID NO: 401977 - RNA, 22 nt, Human
cugagauuacaggcaugaccca

SEQ ID NO: 401978 - RNA, 22 nt, Human
cugagauuacaggcaugagcca

SEQ ID NO: 401979 - RNA, 22 nt, Human
cugagauuacaggcaugagcua

SEQ ID NO: 401980 - RNA, 22 nt, Human
cugagauuacaggccugagcca

SEQ ID NO: 401981 - RNA, 22 nt, Human
cugagauuacaggcgugagcca

SEQ ID NO: 401982 - RNA, 32 nt, Human
cugagauugcacuccagccugggcgacaggcu

SEQ ID NO: 401983 - RNA, 32 nt, Human
cugagauugccuggccaggcucacucacuacc

SEQ ID NO: 401984 - RNA, 32 nt, Human
cugagauugcgccacuguacuccugggcaaca

SEQ ID NO: 401985 - RNA, 32 nt, Human
cugagauugggaguucgagaccagccugucca

SEQ ID NO: 401986 - RNA, 32 nt, Human
cugagauuguaccaugcacuccagccugggua

SEQ ID NO: 401987 - RNA, 32 nt, Human
cugagauuguagagauugagugcucuggaccg

SEQ ID NO: 401988 - RNA, 24 nt, Human
cugagauugugccacugcacucca

SEQ ID NO: 401989 - RNA, 32 nt, Human
cugagauuugggguaugaaugaaagugugagu

SEQ ID NO: 401990 - RNA, 22 nt, Human
cugagauuuggugguucugcau

SEQ ID NO: 401991 - RNA, 32 nt, Human
cugagcaaaacagacaaaaauugaguugugaa

SEQ ID NO: 401992 - RNA, 32 nt, Human
cugagcaaaacccaugauucuucaagacagag

SEQ ID NO: 401993 - RNA, 21 nt, Human
cugagcaaaacguggcuuuca

SEQ ID NO: 401994 - RNA, 32 nt, Human
cugagcaaacagcgugaugacacucaccugua

SEQ ID NO: 401995 - RNA, 23 nt, Human
cugagcaacaaaagcaaaacucu

SEQ ID NO: 401996 - RNA, 21 nt, Human
cugagcaacaaagcaagaccc

SEQ ID NO: 401997 - RNA, 23 nt, Human
cugagcaacaagagcaaaacucc

SEQ ID NO: 401998 - RNA, 22 nt, Human
cugagcaacacagugagacccu

SEQ ID NO: 401999 - RNA, 24 nt, Human
cugagcaacagagcaaaaccccgu

SEQ ID NO: 402000 - RNA, 22 nt, Human
cugagcaacagagcaagacaca

SEQ ID NO: 402001 - RNA, 24 nt, Human
cugagcaacauaaugagacccugu

SEQ ID NO: 402002 - RNA, 24 nt, Human
cugagcaacauagcaaaacccugu

SEQ ID NO: 402003 - RNA, 24 nt, Human
cugagcaacauagcaagaugcugu

SEQ ID NO: 402004 - RNA, 21 nt, Human
cugagcaacauagcgagaccc

SEQ ID NO: 402005 - RNA, 21 nt, Human
cugagcaacauagcgagaccu

SEQ ID NO: 402006 - RNA, 21 nt, Human
cugagcaacauagugagaccc

SEQ ID NO: 402007 - RNA, 22 nt, Human
cugagcaacauagugagacccc

SEQ ID NO: 402008 - RNA, 24 nt, Human
cugagcaacauagugagacccugu

SEQ ID NO: 402009 - RNA, 21 nt, Human
cugagcaacauaucaaaaccc

SEQ ID NO: 402010 - RNA, 24 nt, Human
cugagcaacauaucaaaaccccgu

SEQ ID NO: 402011 - RNA, 24 nt, Human
cugagcaacaugaugaaacuccgu

SEQ ID NO: 402012 - RNA, 21 nt, Human
cugagcaacaugaugagaccc

SEQ ID NO: 402013 - RNA, 22 nt, Human
cugagcaacaugaugagacccc

SEQ ID NO: 402014 - RNA, 24 nt, Human
cugagcaacauggcgaaaccccgu

SEQ ID NO: 402015 - RNA, 32 nt, Human
cugagcaacauggcgaaaccccgucucuacua

SEQ ID NO: 402016 - RNA, 32 nt, Human
cugagcaacauggcgaaaccccgucuguaaua

SEQ ID NO: 402017 - RNA, 21 nt, Human
cugagcaacauggcgaaaccu

SEQ ID NO: 402018 - RNA, 22 nt, Human
cugagcaacauggcgaaaccuc

SEQ ID NO: 402019 - RNA, 32 nt, Human
cugagcaacauggcgaaaccucauaucuacaa

SEQ ID NO: 402020 - RNA, 21 nt, Human
cugagcaacaugguaaaaccc

SEQ ID NO: 402021 - RNA, 22 nt, Human
cugagcaacaugguaaaacccc

SEQ ID NO: 402022 - RNA, 32 nt, Human
cugagcaacaugguaaaaccccaucucuacca

SEQ ID NO: 402023 - RNA, 20 nt, Human
cugagcaacauggugaaacc

SEQ ID NO: 402024 - RNA, 24 nt, Human
cugagcaacauggugaaaccccgu

SEQ ID NO: 402025 - RNA, 32 nt, Human
cugagcaacauggugaaacccugucucuacca

SEQ ID NO: 402026 - RNA, 32 nt, Human
cugagcaacauggugagagcucaucucuacau

SEQ ID NO: 402027 - RNA, 23 nt, Human
cugagcaaccacauauugcuaca

SEQ ID NO: 402028 - RNA, 32 nt, Human
cugagcaaccccagcucugccucacaggcagg

SEQ ID NO: 402029 - RNA, 21 nt, Human
cugagcaagaucuugucucca

SEQ ID NO: 402030 - RNA, 23 nt, Human
cugagcaagggccugcacuucca

SEQ ID NO: 402031 - RNA, 23 nt, Human
cugagcaaggucugcagccccca

SEQ ID NO: 402032 - RNA, 32 nt, Human
cugagcaagucccggcccugcccucagcgagc

SEQ ID NO: 402033 - RNA, 19 nt, Human
cugagcaaucuugucucca

SEQ ID NO: 402034 - RNA, 32 nt, Human
cugagcaauguggugaaaccccaucucuacua

SEQ ID NO: 402035 - RNA, 32 nt, Human
cugagcacagcccagagccaauaaaagaucuu

SEQ ID NO: 402036 - RNA, 32 nt, Human
cugagcacaggaguuggaggcugcaguaagcc

SEQ ID NO: 402037 - RNA, 32 nt, Human
cugagcacagucaggggcugggcaucccagcu

SEQ ID NO: 402038 - RNA, 32 nt, Human
cugagcaccagcuggccaggaugggucuucaa

SEQ ID NO: 402039 - RNA, 32 nt, Human
cugagcaccgccagccaccggcaccaagaccg

SEQ ID NO: 402040 - RNA, 32 nt, Human
cugagcaccgugcagucggccucccaggccau

SEQ ID NO: 402041 - RNA, 20 nt, Human
cugagcaccuggucagucug

SEQ ID NO: 402042 - RNA, 32 nt, Human
cugagcaccuguggcccugggugcagguuaac

SEQ ID NO: 402043 - RNA, 32 nt, Human
cugagcacgguagggcagccuggugagagggg

SEQ ID NO: 402044 - RNA, 32 nt, Human
cugagcacuauauuuugcugggcuauaaaagg

SEQ ID NO: 402045 - RNA, 32 nt, Human
cugagcacuguggcucaugcuuguaaucccag

SEQ ID NO: 402046 - RNA, 32 nt, Human
cugagcacuuucugacagcaguggcccaccau

SEQ ID NO: 402047 - RNA, 32 nt, Human
cugagcagaagaacuggagaaagggaaccaca

SEQ ID NO: 402048 - RNA, 31 nt, Human
cugagcagacaccagcuucagaugcucgagg

SEQ ID NO: 402049 - RNA, 32 nt, Human
cugagcagacaggccaaccggaggacaggauu

SEQ ID NO: 402050 - RNA, 20 nt, Human
cugagcagacgcuggccuca

SEQ ID NO: 402051 - RNA, 32 nt, Human
cugagcagagaggcuggugaugaaaaggugaa

SEQ ID NO: 402052 - RNA, 22 nt, Human
cugagcagagcccucacuccca

SEQ ID NO: 402053 - RNA, 32 nt, Human
cugagcagagcugagccagccagaagaaaaag

SEQ ID NO: 402054 - RNA, 25 nt, Human
cugagcagaggcugggcauugccac

SEQ ID NO: 402055 - RNA, 21 nt, Human
cugagcagauggccaagcuca

SEQ ID NO: 402056 - RNA, 18 nt, Human
cugagcagcaacagcauc

SEQ ID NO: 402057 - RNA, 32 nt, Human
cugagcagccuccuaccuccccugccugagcc

SEQ ID NO: 402058 - RNA, 21 nt, Human
cugagcagcugggacuacagg

SEQ ID NO: 402059 - RNA, 21 nt, Human
cugagcagcugggauugcagg

SEQ ID NO: 402060 - RNA, 32 nt, Human
cugagcaggaagcgagcagaggcuccacaggc

SEQ ID NO: 402061 - RNA, 32 nt, Human
cugagcaggaagggggaggggccaugacuacg

SEQ ID NO: 402062 - RNA, 32 nt, Human
cugagcaggaagguggugguuccguggggaau

SEQ ID NO: 402063 - RNA, 32 nt, Human
cugagcaggcagcagccucugcucuguggcuc

SEQ ID NO: 402064 - RNA, 19 nt, Human
cugagcaggcagcugggug

SEQ ID NO: 402065 - RNA, 25 nt, Human
cugagcagggagaccaugccuccca

SEQ ID NO: 402066 - RNA, 32 nt, Human
cugagcagucugggagccuggagcagccccag

SEQ ID NO: 402067 - RNA, 32 nt, Human
cugagcaguguacacuguacccaguauguagc

SEQ ID NO: 402068 - RNA, 32 nt, Human
cugagcaguucugcaguaacaccugcuuaaaa

SEQ ID NO: 402069 - RNA, 23 nt, Human
cugagcaucacuccauugucaca

SEQ ID NO: 402070 - RNA, 32 nt, Human
cugagcaucgccagggcgggcggcagggcgcg

SEQ ID NO: 402071 - RNA, 32 nt, Human
cugagcaucuucucccaggaguaccagaaaca

SEQ ID NO: 402072 - RNA, 32 nt, Human
cugagcaugcuggugauuuucuguaaucccag

SEQ ID NO: 402073 - RNA, 32 nt, Human
cugagcaugguggcgugugccuguaaucucag

SEQ ID NO: 402074 - RNA, 32 nt, Human
cugagcaugguggcucacgccuguaaucccag

SEQ ID NO: 402075 - RNA, 32 nt, Human
cugagcaugguggcucaugccuguaaucccag

SEQ ID NO: 402076 - RNA, 32 nt, Human
cugagcauuaagacuucccuugcccauuccuc

SEQ ID NO: 402077 - RNA, 32 nt, Human
cugagcauucaccucaccauguuuacaaagaa

SEQ ID NO: 402078 - RNA, 32 nt, Human
cugagcauuucccagccccaguguccacaccu

SEQ ID NO: 402079 - RNA, 32 nt, Human
cugagccaaaagagcuuguuugcugggaggcg

SEQ ID NO: 402080 - RNA, 32 nt, Human
cugagccaaaagagcuuguuugcugggaggug

SEQ ID NO: 402081 - RNA, 32 nt, Human
cugagccaaagcucuggggcccugcauucccu

SEQ ID NO: 402082 - RNA, 32 nt, Human
cugagccaagcagaggcgggcagcuccuccuc

SEQ ID NO: 402083 - RNA, 32 nt, Human
cugagccacaccugcauggugcacggccugug

SEQ ID NO: 402084 - RNA, 32 nt, Human
cugagccacagcuuaaggucaguucugccuau

SEQ ID NO: 402085 - RNA, 32 nt, Human
cugagccacagcuucccgcugggaauaaugau

SEQ ID NO: 402086 - RNA, 21 nt, Human
cugagccacccaucauuguga

SEQ ID NO: 402087 - RNA, 32 nt, Human
cugagccaccgcgcccagucucuccccacguu

SEQ ID NO: 402088 - RNA, 21 nt, Human
cugagccaccggcgcauguga

SEQ ID NO: 402089 - RNA, 32 nt, Human
cugagccaccucagggauacagggucccccac

SEQ ID NO: 402090 - RNA, 32 nt, Human
cugagccaccucagggaugcagggucccccac

SEQ ID NO: 402091 - RNA, 32 nt, Human
cugagccaccucucucacuuucuuuaguugug

SEQ ID NO: 402092 - RNA, 32 nt, Human
cugagccaccuugcaggacguuuuccccaacc

SEQ ID NO: 402093 - RNA, 32 nt, Human
cugagccacgcagccccgccucuggggccgcc

SEQ ID NO: 402094 - RNA, 32 nt, Human
cugagccacugaggccagccucgugguuucca

SEQ ID NO: 402095 - RNA, 32 nt, Human
cugagccacugcacuccagccugggcaauaga

SEQ ID NO: 402096 - RNA, 32 nt, Human
cugagccacugcagggcagggcaggcaggggg

SEQ ID NO: 402097 - RNA, 32 nt, Human
cugagccagaagcaucacugcagugaaagucu

SEQ ID NO: 402098 - RNA, 32 nt, Human
cugagccagaaucacccagcuaagcugcuccc

SEQ ID NO: 402099 - RNA, 32 nt, Human
cugagccagauuucacucuccuuggugucggg

SEQ ID NO: 402100 - RNA, 32 nt, Human
cugagccagcacuuucuuucugaugaugcuug

SEQ ID NO: 402101 - RNA, 32 nt, Human
cugagccagcuccuugaggauguggccacuug

SEQ ID NO: 402102 - RNA, 32 nt, Human
cugagccaggaagcaccugggcuaagggagaa

SEQ ID NO: 402103 - RNA, 32 nt, Human
cugagccaggagacggcugagcacuggcccuc

SEQ ID NO: 402104 - RNA, 24 nt, Human
cugagccaggggcugccaguggga

SEQ ID NO: 402105 - RNA, 32 nt, Human
cugagccaguuccauguuaccgacuuaggcag

SEQ ID NO: 402106 - RNA, 32 nt, Human
cugagccauagauuuuuaaucuguaaaaggag

SEQ ID NO: 402107 - RNA, 32 nt, Human
cugagccauucucuccccuccucugcccugug

SEQ ID NO: 402108 - RNA, 32 nt, Human
cugagccauugcaggccucugccugcugcccc

SEQ ID NO: 402109 - RNA, 32 nt, Human
cugagcccaaagacauucggagguccuccaaa

SEQ ID NO: 402110 - RNA, 18 nt, Human
cugagcccaagccgguga

SEQ ID NO: 402111 - RNA, 32 nt, Human
cugagcccaagcuauccuccugccucagccuc

SEQ ID NO: 402112 - RNA, 32 nt, Human
cugagcccaagcucauugcuucuuccugacca

SEQ ID NO: 402113 - RNA, 32 nt, Human
cugagcccacagccccuccaacccccaaacca

SEQ ID NO: 402114 - RNA, 32 nt, Human
cugagcccacagcuuugaccacugugauccag

SEQ ID NO: 402115 - RNA, 32 nt, Human
cugagcccagaccccucacacagcgcuaccgg

SEQ ID NO: 402116 - RNA, 21 nt, Human
cugagcccaggagagcgggga

SEQ ID NO: 402117 - RNA, 32 nt, Human
cugagcccaggagcucaagauugcagugagcu

SEQ ID NO: 402118 - RNA, 32 nt, Human
cugagcccaggaggucaagacugcagugagcu

SEQ ID NO: 402119 - RNA, 32 nt, Human
cugagcccaggaggucaaggcuacagugagcc

SEQ ID NO: 402120 - RNA, 32 nt, Human
cugagcccaggagguggaggcugcagugagcc

SEQ ID NO: 402121 - RNA, 32 nt, Human
cugagcccaggagguggagguugcagugagcc

SEQ ID NO: 402122 - RNA, 32 nt, Human
cugagcccaggaguucaagaccagcuugugca

SEQ ID NO: 402123 - RNA, 32 nt, Human
cugagcccaggaguucgagaccagccugggca

SEQ ID NO: 402124 - RNA, 32 nt, Human
cugagcccaggaguucgaggcuguggugcacu

SEQ ID NO: 402125 - RNA, 32 nt, Human
cugagcccaggaguuuaaggcugcagugagcu

SEQ ID NO: 402126 - RNA, 32 nt, Human
cugagcccaggaguuugagacuacaguagcua

SEQ ID NO: 402127 - RNA, 32 nt, Human
cugagcccaggaguuugaggcuccagugagcu

SEQ ID NO: 402128 - RNA, 32 nt, Human
cugagcccaggaguuugaggguggagugagcu

SEQ ID NO: 402129 - RNA, 32 nt, Human
cugagcccagggaggucaaggcugcagugagc

SEQ ID NO: 402130 - RNA, 32 nt, Human
cugagcccagggguucuagaccagcuuaggca

SEQ ID NO: 402131 - RNA, 32 nt, Human
cugagcccaucucauuuagggaaacuacagag

SEQ ID NO: 402132 - RNA, 19 nt, Human
cugagccccacguggcagg

SEQ ID NO: 402133 - RNA, 32 nt, Human
cugagccccagaggcacccugggcacucccuc

SEQ ID NO: 402134 - RNA, 32 nt, Human
cugagccccagccgggaccgggaucggagccc

SEQ ID NO: 402135 - RNA, 20 nt, Human
cugagccccagcugcugaga

SEQ ID NO: 402136 - RNA, 32 nt, Human
cugagccccaggaggaguaggaguugggcagg

SEQ ID NO: 402137 - RNA, 32 nt, Human
cugagccccagggcagaggggaauggcaaaau

SEQ ID NO: 402138 - RNA, 32 nt, Human
cugagccccagucucugcucugcacaguggaa

SEQ ID NO: 402139 - RNA, 32 nt, Human
cugagccccaugccucccagcaaccagggccc

SEQ ID NO: 402140 - RNA, 32 nt, Human
cugagccccgggaggagagaucaaagcuuugg

SEQ ID NO: 402141 - RNA, 32 nt, Human
cugagccccucacccuuccacacucacgaacu

SEQ ID NO: 402142 - RNA, 18 nt, Human
cugagccccucccuccca

SEQ ID NO: 402143 - RNA, 32 nt, Human
cugagccccugccacaccccagccucugacuu

SEQ ID NO: 402144 - RNA, 19 nt, Human
cugagccccuggaugguga

SEQ ID NO: 402145 - RNA, 19 nt, Human
cugagcccgaaccugccag

SEQ ID NO: 402146 - RNA, 32 nt, Human
cugagcccuccaccaucgcccgcucucuacca

SEQ ID NO: 402147 - RNA, 21 nt, Human
cugagcccucccagggacccu

SEQ ID NO: 402148 - RNA, 32 nt, Human
cugagcccuccuggcccccgccuuccacgccc

SEQ ID NO: 402149 - RNA, 32 nt, Human
cugagcccucuuggcccugaggccuggcauug

SEQ ID NO: 402150 - RNA, 32 nt, Human
cugagcccugagccaccagcccugcagccugc

SEQ ID NO: 402151 - RNA, 32 nt, Human
cugagcccugagggauggaugucuccugaccc

SEQ ID NO: 402152 - RNA, 32 nt, Human
cugagcccugcacgcugggccuucagaauuaa

SEQ ID NO: 402153 - RNA, 32 nt, Human
cugagcccugcccucacuccacuccccucauc

SEQ ID NO: 402154 - RNA, 32 nt, Human
cugagcccugcucaugcugcuuggagcacaau

SEQ ID NO: 402155 - RNA, 32 nt, Human
cugagcccugcucccucugccacuguggacac

SEQ ID NO: 402156 - RNA, 32 nt, Human
cugagcccuggaacagggaggguguaggggag

SEQ ID NO: 402157 - RNA, 32 nt, Human
cugagcccuggaggucgaggcuacagugagcu

SEQ ID NO: 402158 - RNA, 32 nt, Human
cugagcccuggaguucgauacugcagugagcu

SEQ ID NO: 402159 - RNA, 32 nt, Human
cugagcccugguguguuuccagaucgauccug

SEQ ID NO: 402160 - RNA, 32 nt, Human
cugagcccuguuaucccucccccaugaccaca

SEQ ID NO: 402161 - RNA, 32 nt, Human
cugagcccuguuccugcucucccuccagggcu

SEQ ID NO: 402162 - RNA, 32 nt, Human
cugagcccuuccuggcaccccugcugcugaca

SEQ ID NO: 402163 - RNA, 32 nt, Human
cugagccgagggaagaacacccucuccggccc

SEQ ID NO: 402164 - RNA, 32 nt, Human
cugagccgauggggagggggaggaggaugcua

SEQ ID NO: 402165 - RNA, 32 nt, Human
cugagccgcgcuuuccccuccucccugggaug

SEQ ID NO: 402166 - RNA, 32 nt, Human
cugagccggaggggaauccggaagggacacgc

SEQ ID NO: 402167 - RNA, 32 nt, Human
cugagccgggcugaagcggggagccagacagc

SEQ ID NO: 402168 - RNA, 32 nt, Human
cugagccgggggaaucaccugagcccagggaa

SEQ ID NO: 402169 - RNA, 32 nt, Human
cugagccggguggaucgccugaggucaggagu

SEQ ID NO: 402170 - RNA, 32 nt, Human
cugagccguguuuccccucucccucccucucc

SEQ ID NO: 402171 - RNA, 32 nt, Human
cugagccuaucuggcugggaugguggaauuaa

SEQ ID NO: 402172 - RNA, 32 nt, Human
cugagccucacugaggggaaggccugggcuug

SEQ ID NO: 402173 - RNA, 19 nt, Human
cugagccucacugcugcug

SEQ ID NO: 402174 - RNA, 32 nt, Human
cugagccucaggagguugaggcugcagugagc

SEQ ID NO: 402175 - RNA, 32 nt, Human
cugagccucaggggagggagguugauagcuac

SEQ ID NO: 402176 - RNA, 32 nt, Human
cugagccucagucucccucccuuggggccuau

SEQ ID NO: 402177 - RNA, 32 nt, Human
cugagccuccagcgcgugccagccugggccgc

SEQ ID NO: 402178 - RNA, 32 nt, Human
cugagccuccgccuucccagcagcggcaccaa

SEQ ID NO: 402179 - RNA, 32 nt, Human
cugagccuccucuugaugcaagcucuaaaggg

SEQ ID NO: 402180 - RNA, 32 nt, Human
cugagccucgagcugcucucugucacugucuu

SEQ ID NO: 402181 - RNA, 16 nt, Human
cugagccucgcgguga

SEQ ID NO: 402182 - RNA, 32 nt, Human
cugagccucucagcagcccuccuuggguugaa

SEQ ID NO: 402183 - RNA, 24 nt, Human
cugagccucucgccugcccccgcc

SEQ ID NO: 402184 - RNA, 32 nt, Human
cugagccucuuugcucugccucuuggggcaag

SEQ ID NO: 402185 - RNA, 32 nt, Human
cugagccugaagagagggaacaagucagucag

SEQ ID NO: 402186 - RNA, 32 nt, Human
cugagccugagcaacauaaugagacccugucu

SEQ ID NO: 402187 - RNA, 32 nt, Human
cugagccugagcccgccccgagguccccgccc

SEQ ID NO: 402188 - RNA, 32 nt, Human
cugagccugaggacgagaagguuguuuccuac

SEQ ID NO: 402189 - RNA, 22 nt, Human
cugagccugagggccaaacaag

SEQ ID NO: 402190 - RNA, 32 nt, Human
cugagccugcagccgccccgcgccgugaccug

SEQ ID NO: 402191 - RNA, 32 nt, Human
cugagccugccucacaaccagucucugcgggc

SEQ ID NO: 402192 - RNA, 32 nt, Human
cugagccugccugcccggccgaguuuagaguu

SEQ ID NO: 402193 - RNA, 18 nt, Human
cugagccugccugcucug

SEQ ID NO: 402194 - RNA, 32 nt, Human
cugagccugccugcucugugccguggcuuucu

SEQ ID NO: 402195 - RNA, 32 nt, Human
cugagccugccugucugggcaccugcugcaac

SEQ ID NO: 402196 - RNA, 32 nt, Human
cugagccuggaacugacccuuccuucauccuc

SEQ ID NO: 402197 - RNA, 32 nt, Human
cugagccuggagauguagaggcugcaaugagc

SEQ ID NO: 402198 - RNA, 32 nt, Human
cugagccuggagauguagaggcugcagugagc

SEQ ID NO: 402199 - RNA, 32 nt, Human
cugagccugggaaguggaaguugcagugagcc

SEQ ID NO: 402200 - RNA, 32 nt, Human
cugagccugggcugcccauucaucucagcgac

SEQ ID NO: 402201 - RNA, 32 nt, Human
cugagccugguaggcugaggcugcagugagcc

SEQ ID NO: 402202 - RNA, 32 nt, Human
cugagccuggucggcugaggccaguccugucc

SEQ ID NO: 402203 - RNA, 32 nt, Human
cugagccuguggcuggcuggaaaaaggugaau

SEQ ID NO: 402204 - RNA, 32 nt, Human
cugagccuguucugaacagcuguaaccccaac

SEQ ID NO: 402205 - RNA, 32 nt, Human
cugagccuguucuuggucuuuuccaguuuauc

SEQ ID NO: 402206 - RNA, 32 nt, Human
cugagccuuaacaacauguuuuugcugcagau

SEQ ID NO: 402207 - RNA, 32 nt, Human
cugagccuuccagagagagcuauugugauaca

SEQ ID NO: 402208 - RNA, 32 nt, Human
cugagccuucugaugagacugcagccccagcu

SEQ ID NO: 402209 - RNA, 32 nt, Human
cugagccuucugaugagacugcagccccggcu

SEQ ID NO: 402210 - RNA, 32 nt, Human
cugagcgaaagaaggaaggacagacggaccug

SEQ ID NO: 402211 - RNA, 31 nt, Human
cugagcgcacaggcaggcaugccaagggggc

SEQ ID NO: 402212 - RNA, 32 nt, Human
cugagcgcagcuccagggaagccccagccccu

SEQ ID NO: 402213 - RNA, 32 nt, Human
cugagcgcaguggcucuugccuguaaucccag

SEQ ID NO: 402214 - RNA, 32 nt, Human
cugagcgccgguccucugggcccaguguucuu

SEQ ID NO: 402215 - RNA, 32 nt, Human
cugagcgccucccuccuggagcggcguccagc

SEQ ID NO: 402216 - RNA, 32 nt, Human
cugagcgccucuucccgcugcgcccgcaucag

SEQ ID NO: 402217 - RNA, 32 nt, Human
cugagcgcgguggcucacgccuguaaucccag

SEQ ID NO: 402218 - RNA, 32 nt, Human
cugagcggaugcacaggucacccauggcaggu

SEQ ID NO: 402219 - RNA, 32 nt, Human
cugagcgggaccugcgagcagcgcgggcggca

SEQ ID NO: 402220 - RNA, 32 nt, Human
cugagcgggaggugaaggcagagguggaggac

SEQ ID NO: 402221 - RNA, 32 nt, Human
cugagcgucacacccuguacuucauuucauau

SEQ ID NO: 402222 - RNA, 32 nt, Human
cugagcgucagaggacgagagcaggggccucc

SEQ ID NO: 402223 - RNA, 19 nt, Human
cugagcgucuccugggcca

SEQ ID NO: 402224 - RNA, 32 nt, Human
cugagcgucuuucugcucuccuuauccuguuc

SEQ ID NO: 402225 - RNA, 32 nt, Human
cugagcgugaugaucuagccuccaucaugaag

SEQ ID NO: 402226 - RNA, 32 nt, Human
cugagcgugguggcgggcgccuguaaucccag

SEQ ID NO: 402227 - RNA, 32 nt, Human
cugagcgugguggugugcaccuguaaucccag

SEQ ID NO: 402228 - RNA, 32 nt, Human
cugagcuaaagcgaucugcccaccucggccuc

SEQ ID NO: 402229 - RNA, 32 nt, Human
cugagcuaagggaugggguaccagguuagggg

SEQ ID NO: 402230 - RNA, 32 nt, Human
cugagcuagcagaagagaagaaaaugauugaa

SEQ ID NO: 402231 - RNA, 32 nt, Human
cugagcuauaugcacacucacaccucuuugcu

SEQ ID NO: 402232 - RNA, 32 nt, Human
cugagcuaugcagccuuggccugcugcgucuc

SEQ ID NO: 402233 - RNA, 32 nt, Human
cugagcuaugccaggauuuugugaaggcugag

SEQ ID NO: 402234 - RNA, 32 nt, Human
cugagcucaaaggauccucccaccucagccuc

SEQ ID NO: 402235 - RNA, 32 nt, Human
cugagcucaaaucucuguuacuccauuacugu

SEQ ID NO: 402236 - RNA, 32 nt, Human
cugagcucaagagguugaggcugcagugagcc

SEQ ID NO: 402237 - RNA, 32 nt, Human
cugagcucaagcaacccucccuccucagccuu

SEQ ID NO: 402238 - RNA, 32 nt, Human
cugagcucaagcaauccaccugccucagccua

SEQ ID NO: 402239 - RNA, 32 nt, Human
cugagcucaagcaauccucccaccucagccuc

SEQ ID NO: 402240 - RNA, 32 nt, Human
cugagcucaagcaauccucccaccucagccuu

SEQ ID NO: 402241 - RNA, 32 nt, Human
cugagcucaagcaauccucccgacucggcuuc

SEQ ID NO: 402242 - RNA, 32 nt, Human
cugagcucaagcaauccuccugccucagccuc

SEQ ID NO: 402243 - RNA, 32 nt, Human
cugagcucaagcaauccugcugccucaguucu

SEQ ID NO: 402244 - RNA, 32 nt, Human
cugagcucaagcaaucugccugcuucagccuc

SEQ ID NO: 402245 - RNA, 32 nt, Human
cugagcucaagcaauucucaugccucagccuc

SEQ ID NO: 402246 - RNA, 32 nt, Human
cugagcucaagcaguccaucugccucagccuc

SEQ ID NO: 402247 - RNA, 32 nt, Human
cugagcucaagcagucuucccaccuuggccuc

SEQ ID NO: 402248 - RNA, 32 nt, Human
cugagcucaagcaguucucccaccugggccuc

SEQ ID NO: 402249 - RNA, 32 nt, Human
cugagcucaagcgauccucccaccuuggccua

SEQ ID NO: 402250 - RNA, 32 nt, Human
cugagcucaagugauccacccaccucagccuc

SEQ ID NO: 402251 - RNA, 32 nt, Human
cugagcucaagugauccucccaccucagccuc

SEQ ID NO: 402252 - RNA, 32 nt, Human
cugagcucaagugauccuccuaccucagucuc

SEQ ID NO: 402253 - RNA, 32 nt, Human
cugagcucaagugaucuuccugccuuggcacc

SEQ ID NO: 402254 - RNA, 32 nt, Human
cugagcucacagacugacuugggcuccuacug

SEQ ID NO: 402255 - RNA, 32 nt, Human
cugagcucaccagcaaacagaagcaucaagcc

SEQ ID NO: 402256 - RNA, 32 nt, Human
cugagcucacccaggccagcaggugggguauc

SEQ ID NO: 402257 - RNA, 32 nt, Human
cugagcucacgcuggcucacacagcucuaggg

SEQ ID NO: 402258 - RNA, 32 nt, Human
cugagcucacugcaaccucugacucccagacu

SEQ ID NO: 402259 - RNA, 32 nt, Human
cugagcucacugcaaccucugccucccaaguu

SEQ ID NO: 402260 - RNA, 32 nt, Human
cugagcucagaugaucugcccaccucggccuc

SEQ ID NO: 402261 - RNA, 18 nt, Human
cugagcucagcuggcaga

SEQ ID NO: 402262 - RNA, 32 nt, Human
cugagcucaggaauucgagaccagccuggcca

SEQ ID NO: 402263 - RNA, 32 nt, Human
cugagcucaggagcuugagaccagccugggca

SEQ ID NO: 402264 - RNA, 32 nt, Human
cugagcucaggaguccaagaccagccugggca

SEQ ID NO: 402265 - RNA, 32 nt, Human
cugagcucaggaguucaagaccagccugggca

SEQ ID NO: 402266 - RNA, 32 nt, Human
cugagcucaggaguucgagaccagccagggca

SEQ ID NO: 402267 - RNA, 32 nt, Human
cugagcucaggaguuuaagaccagccugggca

SEQ ID NO: 402268 - RNA, 32 nt, Human
cugagcucaggaguuugagaccagccugacca

SEQ ID NO: 402269 - RNA, 32 nt, Human
cugagcucaggaguuugagaccagccugggca

SEQ ID NO: 402270 - RNA, 32 nt, Human
cugagcucaggaguuugagaccagccugucuc

SEQ ID NO: 402271 - RNA, 32 nt, Human
cugagcucaggcaauccgcccaccucagccuc

SEQ ID NO: 402272 - RNA, 32 nt, Human
cugagcucaggcaauccucccgccuuagccuc

SEQ ID NO: 402273 - RNA, 32 nt, Human
cugagcucaggcaaucugcccgccuuggccuc

SEQ ID NO: 402274 - RNA, 32 nt, Human
cugagcucaggcagucuacccaccucagccuc

SEQ ID NO: 402275 - RNA, 32 nt, Human
cugagcucaggugaucugcccaccucggccuc

SEQ ID NO: 402276 - RNA, 32 nt, Human
cugagcucaguccucuggaggaagccgcccag

SEQ ID NO: 402277 - RNA, 32 nt, Human
cugagcucaugucaugggcauguggugguuuc

SEQ ID NO: 402278 - RNA, 32 nt, Human
cugagcuccagacugcagcccgugcugaugac

SEQ ID NO: 402279 - RNA, 32 nt, Human
cugagcuccagcgaucagccuaccucaaccuc

SEQ ID NO: 402280 - RNA, 32 nt, Human
cugagcucccucugcccugccaguugucaguc

SEQ ID NO: 402281 - RNA, 32 nt, Human
cugagcuccuuucuuccucuagccaaacccug

SEQ ID NO: 402282 - RNA, 32 nt, Human
cugagcucgagccugugaccaccugugcugug

SEQ ID NO: 402283 - RNA, 21 nt, Human
cugagcucuugucauuuucca

SEQ ID NO: 402284 - RNA, 32 nt, Human
cugagcucuuucccugaaugaauccaaguaac

SEQ ID NO: 402285 - RNA, 32 nt, Human
cugagcucuuuuauuagcaccaugaaugugac

SEQ ID NO: 402286 - RNA, 32 nt, Human
cugagcugaagugccuugugaacccugcaaua

SEQ ID NO: 402287 - RNA, 32 nt, Human
cugagcugagccuuuuccaggggcagggccca

SEQ ID NO: 402288 - RNA, 32 nt, Human
cugagcugcacguuucuaagguagggaggagg

SEQ ID NO: 402289 - RNA, 32 nt, Human
cugagcugcagcaucugacucaucucagaaau

SEQ ID NO: 402290 - RNA, 16 nt, Human
cugagcugccaggcca

SEQ ID NO: 402291 - RNA, 32 nt, Human
cugagcugccaggccaagacccucccauugca

SEQ ID NO: 402292 - RNA, 32 nt, Human
cugagcugcccaggcuucacggagcgguguug

SEQ ID NO: 402293 - RNA, 32 nt, Human
cugagcugccccggagggagggaggaguuccc

SEQ ID NO: 402294 - RNA, 21 nt, Human
cugagcugccccucaaggggg

SEQ ID NO: 402295 - RNA, 20 nt, Human
cugagcugccccuggcuucc

SEQ ID NO: 402296 - RNA, 32 nt, Human
cugagcugcuguggccgggcugggcagugugc

SEQ ID NO: 402297 - RNA, 32 nt, Human
cugagcugcuucggggccaugcagcccuccug

SEQ ID NO: 402298 - RNA, 17 nt, Human
cugagcugcuucugcaa

SEQ ID NO: 402299 - RNA, 32 nt, Human
cugagcuggaaccagcauucauagagaagggg

SEQ ID NO: 402300 - RNA, 32 nt, Human
cugagcuggccuggcccauucaccucuugugg

SEQ ID NO: 402301 - RNA, 32 nt, Human
cugagcuggcugaagaucagggccagcgagcu

SEQ ID NO: 402302 - RNA, 32 nt, Human
cugagcugggagaguuggaggagguggcggcg

SEQ ID NO: 402303 - RNA, 32 nt, Human
cugagcugggaggagcagggugagggugggcg

SEQ ID NO: 402304 - RNA, 32 nt, Human
cugagcugggauuacaggcgccugccaccaug

SEQ ID NO: 402305 - RNA, 32 nt, Human
cugagcugggcagaucaccugaggucaggagu

SEQ ID NO: 402306 - RNA, 32 nt, Human
cugagcugggcaggacacaggcgagcucaggu

SEQ ID NO: 402307 - RNA, 32 nt, Human
cugagcugggcgcugccuuccuuucucauccc

SEQ ID NO: 402308 - RNA, 32 nt, Human
cugagcuggggaggucgaggcagcagugagcc

SEQ ID NO: 402309 - RNA, 32 nt, Human
cugagcugguggcacccuccccugggccggaa

SEQ ID NO: 402310 - RNA, 32 nt, Human
cugagcugguuaaaugauuucucuccaucuua

SEQ ID NO: 402311 - RNA, 32 nt, Human
cugagcuguaacaaagccucuuuaaaucggug

SEQ ID NO: 402312 - RNA, 32 nt, Human
cugagcuguggacugcagcuucaggacccuau

SEQ ID NO: 402313 - RNA, 32 nt, Human
cugagcuguggcacuagcagagcuaguagcca

SEQ ID NO: 402314 - RNA, 32 nt, Human
cugagcugugugagcucuucugcccaggcggg

SEQ ID NO: 402315 - RNA, 32 nt, Human
cugagcugugugauccugggcaagguagaggg

SEQ ID NO: 402316 - RNA, 32 nt, Human
cugagcuguucuguuucguauugcugcucugu

SEQ ID NO: 402317 - RNA, 32 nt, Human
cugagcuucccaaggaagcccccacccucugc

SEQ ID NO: 402318 - RNA, 32 nt, Human
cugagcuucguggagcucuucccgccgcugac

SEQ ID NO: 402319 - RNA, 32 nt, Human
cugagcuucuaggauccagcugugucaaccuu

SEQ ID NO: 402320 - RNA, 32 nt, Human
cugagcuuuaagaaauaacuauagugcaaagg

SEQ ID NO: 402321 - RNA, 32 nt, Human
cugagcuuucaccucugacucccuaacuccau

SEQ ID NO: 402322 - RNA, 32 nt, Human
cugagcuuucauaaccccaggguccuccagaa

SEQ ID NO: 402323 - RNA, 32 nt, Human
cugagcuuugccucugagcagcuguccuaguu

SEQ ID NO: 402324 - RNA, 32 nt, Human
cugagcuuugcuacccaaccagauuccucaua

SEQ ID NO: 402325 - RNA, 32 nt, Human
cugagcuuuuuaucuuacaccaugaagugaca

SEQ ID NO: 402326 - RNA, 24 nt, Human
cugaggaaagcagaucacaagguc

SEQ ID NO: 402327 - RNA, 32 nt, Human
cugaggaaaggagaguguggagaggggccugg

SEQ ID NO: 402328 - RNA, 32 nt, Human
cugaggaacagacgugugugagaggccuucag

SEQ ID NO: 402329 - RNA, 32 nt, Human
cugaggaacaugcucccucccucccucccaua

SEQ ID NO: 402330 - RNA, 24 nt, Human
cugaggaagaacauaagugcuaaa

SEQ ID NO: 402331 - RNA, 32 nt, Human
cugaggaagcccaacuccuaugagcuccucuc

SEQ ID NO: 402332 - RNA, 32 nt, Human
cugaggaaggagcuagggaaagagauagacac

SEQ ID NO: 402333 - RNA, 24 nt, Human
cugaggaaggcaaaucacaagguc

SEQ ID NO: 402334 - RNA, 32 nt, Human
cugaggaaggcagaagugaauuuggagaacua

SEQ ID NO: 402335 - RNA, 20 nt, Human
cugaggaagggcagagccag

SEQ ID NO: 402336 - RNA, 32 nt, Human
cugaggacaaguuugaaacugggaaggagaca

SEQ ID NO: 402337 - RNA, 32 nt, Human
cugaggacaauauuuaaaugacaggaagguau

SEQ ID NO: 402338 - RNA, 32 nt, Human
cugaggacacagaucccggggagcugugaggg

SEQ ID NO: 402339 - RNA, 32 nt, Human
cugaggacagaggaucacuugaggucaggagu

SEQ ID NO: 402340 - RNA, 32 nt, Human
cugaggacagccaggacuccagcuuuugcuga

SEQ ID NO: 402341 - RNA, 32 nt, Human
cugaggacagccgcgugcgcuucgccagcagc

SEQ ID NO: 402342 - RNA, 32 nt, Human
cugaggacaggaguucaagaccagccugggca

SEQ ID NO: 402343 - RNA, 32 nt, Human
cugaggaccagcuguggcugggccaggacaga

SEQ ID NO: 402344 - RNA, 32 nt, Human
cugaggaccaggcuugguugugagaaucccug

SEQ ID NO: 402345 - RNA, 32 nt, Human
cugaggaccugggccuguucugcuccuaggag

SEQ ID NO: 402346 - RNA, 32 nt, Human
cugaggacugauuucagagugacuacacacag

SEQ ID NO: 402347 - RNA, 32 nt, Human
cugaggacuggugacuggucugugauagaagc

SEQ ID NO: 402348 - RNA, 32 nt, Human
cugaggacuguacaaacaugaaggugugguau

SEQ ID NO: 402349 - RNA, 32 nt, Human
cugaggacuugaugaagugauccuuaaccccc

SEQ ID NO: 402350 - RNA, 32 nt, Human
cugaggagaaagccuuuccuucugcugcuacu

SEQ ID NO: 402351 - RNA, 32 nt, Human
cugaggagaacagaagcucugguaagcgaaug

SEQ ID NO: 402352 - RNA, 32 nt, Human
cugaggagacagaaggcagcaaacaaaaucau

SEQ ID NO: 402353 - RNA, 32 nt, Human
cugaggagacucugcccuuuuccaggcaccgc

SEQ ID NO: 402354 - RNA, 32 nt, Human
cugaggagagcaggaaaggcagugguggucuu

SEQ ID NO: 402355 - RNA, 32 nt, Human
cugaggagaugcugggacugagagugucaugg

SEQ ID NO: 402356 - RNA, 32 nt, Human
cugaggagcacgggaaaggcugugcuucugca

SEQ ID NO: 402357 - RNA, 22 nt, Human
cugaggagccuuccagcucuaa

SEQ ID NO: 402358 - RNA, 32 nt, Human
cugaggagcuaaaucugccucacuaaggaacg

SEQ ID NO: 402359 - RNA, 32 nt, Human
cugaggagcugccugccuucuuccaucugaga

SEQ ID NO: 402360 - RNA, 32 nt, Human
cugaggagcuggcccugccacuguggacugcc

SEQ ID NO: 402361 - RNA, 32 nt, Human
cugaggaggagaagccaaagaggaggaggcag

SEQ ID NO: 402362 - RNA, 32 nt, Human
cugaggaggagaaucacuugaaccuggaggca

SEQ ID NO: 402363 - RNA, 32 nt, Human
cugaggaggaggaggagaagcggaugagaucg

SEQ ID NO: 402364 - RNA, 32 nt, Human
cugaggaggaggaggaggcggaggaggcggug

SEQ ID NO: 402365 - RNA, 32 nt, Human
cugaggaggaggaggaggcgggggcggccaug

SEQ ID NO: 402366 - RNA, 32 nt, Human
cugaggaggagucuuccccuggggcugcgugc

SEQ ID NO: 402367 - RNA, 32 nt, Human
cugaggaggaguuuuuaauuguauuugcuaga

SEQ ID NO: 402368 - RNA, 32 nt, Human
cugaggaggauggggauaaaaggucugcaucu

SEQ ID NO: 402369 - RNA, 32 nt, Human
cugaggaggcaagaauugaaguugcugcagac

SEQ ID NO: 402370 - RNA, 32 nt, Human
cugaggaggccuugccugcagggucuuugucu

SEQ ID NO: 402371 - RNA, 32 nt, Human
cugaggaggcgaucaggagggagcuagcacug

SEQ ID NO: 402372 - RNA, 24 nt, Human
cugaggagggcggaucacaagguc

SEQ ID NO: 402373 - RNA, 24 nt, Human
cugaggaggguggaucacgagguc

SEQ ID NO: 402374 - RNA, 24 nt, Human
cugaggagguggagguugcaguga

SEQ ID NO: 402375 - RNA, 32 nt, Human
cugaggagguggagguugcagugagccgagau

SEQ ID NO: 402376 - RNA, 18 nt, Human
cugaggagugacuccaag

SEQ ID NO: 402377 - RNA, 32 nt, Human
cugaggagugggcaauggugcuucugugcuuu

SEQ ID NO: 402378 - RNA, 32 nt, Human
cugaggaguucaguugugaggaaagaaggcug

SEQ ID NO: 402379 - RNA, 32 nt, Human
cugaggauacagcucuucucagugucugaaca

SEQ ID NO: 402380 - RNA, 32 nt, Human
cugaggauauagaaauauguaacucagagucc

SEQ ID NO: 402381 - RNA, 32 nt, Human
cugaggaucaaauuucaacaugagauuuggag

SEQ ID NO: 402382 - RNA, 32 nt, Human
cugaggaucagcugcuggaggaggcggagagg

SEQ ID NO: 402383 - RNA, 23 nt, Human
cugaggaucagggcgggaccccg

SEQ ID NO: 402384 - RNA, 32 nt, Human
cugaggaucccaggaaccucccucgggccugc

SEQ ID NO: 402385 - RNA, 32 nt, Human
cugaggaucuguggcuugucucuguccugagg

SEQ ID NO: 402386 - RNA, 32 nt, Human
cugaggaugacccugacugaaaggcugcguga

SEQ ID NO: 402387 - RNA, 32 nt, Human
cugaggaugcugcuggcagccuggggaaggag

SEQ ID NO: 402388 - RNA, 32 nt, Human
cugaggauggccuggauucacgcccucuuguu

SEQ ID NO: 402389 - RNA, 32 nt, Human
cugaggaugggacgaugugcccagggagggac

SEQ ID NO: 402390 - RNA, 32 nt, Human
cugaggauggugggcaggaggccggcugcggg

SEQ ID NO: 402391 - RNA, 32 nt, Human
cugaggauguacaaaauucucauuuaauuuuc

SEQ ID NO: 402392 - RNA, 31 nt, Human
cugaggauguucaggcuggggcugcugguuu

SEQ ID NO: 402393 - RNA, 32 nt, Human
cugaggauguucuggaccucccccucuuaguc

SEQ ID NO: 402394 - RNA, 32 nt, Human
cugaggauucaggauggggugaaaggugguug

SEQ ID NO: 402395 - RNA, 32 nt, Human
cugaggauugcuagagugugccaagcucagau

SEQ ID NO: 402396 - RNA, 24 nt, Human
cugaggcaaaagaauugcuugaac

SEQ ID NO: 402397 - RNA, 23 nt, Human
cugaggcaaagggcagccugaac

SEQ ID NO: 402398 - RNA, 32 nt, Human
cugaggcaaagugucugcaucuucguccagcg

SEQ ID NO: 402399 - RNA, 32 nt, Human
cugaggcaacccccucggagccuguguuagug

SEQ ID NO: 402400 - RNA, 24 nt, Human
cugaggcaagaaaaucgcuugaac

SEQ ID NO: 402401 - RNA, 24 nt, Human
cugaggcaagagaaucacuggaac

SEQ ID NO: 402402 - RNA, 24 nt, Human
cugaggcaagagaaucacuugaac

SEQ ID NO: 402403 - RNA, 24 nt, Human
cugaggcaagagaaucauuugaac

SEQ ID NO: 402404 - RNA, 23 nt, Human
cugaggcaagagaaucgcuugaa

SEQ ID NO: 402405 - RNA, 24 nt, Human
cugaggcaagagaaucgcuugaac

SEQ ID NO: 402406 - RNA, 24 nt, Human
cugaggcaagagaaucgcuugaau

SEQ ID NO: 402407 - RNA, 23 nt, Human
cugaggcaagagaaucgcuugag

SEQ ID NO: 402408 - RNA, 24 nt, Human
cugaggcaagagaaucucuugaac

SEQ ID NO: 402409 - RNA, 24 nt, Human
cugaggcaagagaauuacuugagc

SEQ ID NO: 402410 - RNA, 24 nt, Human
cugaggcaagagaauugccugaac

SEQ ID NO: 402411 - RNA, 24 nt, Human
cugaggcaagagaauugcuugaac

SEQ ID NO: 402412 - RNA, 24 nt, Human
cugaggcaagagaauugcuuggac

SEQ ID NO: 402413 - RNA, 24 nt, Human
cugaggcaagagaguugcuugaac

SEQ ID NO: 402414 - RNA, 32 nt, Human
cugaggcaagcggaucauuugaggucaggagu

SEQ ID NO: 402415 - RNA, 32 nt, Human
cugaggcaaggaguuugagaccagcuuagcca

SEQ ID NO: 402416 - RNA, 32 nt, Human
cugaggcaaggugggaggugggauggggcagg

SEQ ID NO: 402417 - RNA, 32 nt, Human
cugaggcaagugaagcacuugaggucaggagu

SEQ ID NO: 402418 - RNA, 26 nt, Human
cugaggcaaguggauaacuugagguc

SEQ ID NO: 402419 - RNA, 32 nt, Human
cugaggcaaguggauaacuugaggucaugagu

SEQ ID NO: 402420 - RNA, 32 nt, Human
cugaggcaaguggaucacuugaggucaggagu

SEQ ID NO: 402421 - RNA, 23 nt, Human
cugaggcacagcagcacccgggc

SEQ ID NO: 402422 - RNA, 32 nt, Human
cugaggcacauggaccacuugaggucaagagu

SEQ ID NO: 402423 - RNA, 32 nt, Human
cugaggcacauggaccacuugaggucaggagu

SEQ ID NO: 402424 - RNA, 22 nt, Human
cugaggcaccgcggcugcgggc

SEQ ID NO: 402425 - RNA, 32 nt, Human
cugaggcaccugguuacgcuucaccucuuguu

SEQ ID NO: 402426 - RNA, 32 nt, Human
cugaggcacugaggcccuaccucaugccaaac

SEQ ID NO: 402427 - RNA, 21 nt, Human
cugaggcagaacugcuugaac

SEQ ID NO: 402428 - RNA, 24 nt, Human
cugaggcagaagaaccccuugaac

SEQ ID NO: 402429 - RNA, 24 nt, Human
cugaggcagaagaaucacuugaac

SEQ ID NO: 402430 - RNA, 22 nt, Human
cugaggcagaagaaucgcuuga

SEQ ID NO: 402431 - RNA, 24 nt, Human
cugaggcagaagaaucgcuugaac

SEQ ID NO: 402432 - RNA, 24 nt, Human
cugaggcagaagaaucgcuugagc

SEQ ID NO: 402433 - RNA, 24 nt, Human
cugaggcagaagaaucguuugaac

SEQ ID NO: 402434 - RNA, 24 nt, Human
cugaggcagaagaauggcaugaac

SEQ ID NO: 402435 - RNA, 24 nt, Human
cugaggcagaagaauggccugaac

SEQ ID NO: 402436 - RNA, 24 nt, Human
cugaggcagaagaauggcguaaac

SEQ ID NO: 402437 - RNA, 24 nt, Human
cugaggcagaagaauggcgugaac

SEQ ID NO: 402438 - RNA, 24 nt, Human
cugaggcagaagaauggcuugaac

SEQ ID NO: 402439 - RNA, 20 nt, Human
cugaggcagaagaauugaac

SEQ ID NO: 402440 - RNA, 22 nt, Human
cugaggcagaaggaucgcuuga

SEQ ID NO: 402441 - RNA, 24 nt, Human
cugaggcagaaggaucgcuugaac

SEQ ID NO: 402442 - RNA, 32 nt, Human
cugaggcagaaggauuaccugaggcaaggagu

SEQ ID NO: 402443 - RNA, 24 nt, Human
cugaggcagaaguauugcuugaac

SEQ ID NO: 402444 - RNA, 21 nt, Human
cugaggcagaauggcgugaac

SEQ ID NO: 402445 - RNA, 21 nt, Human
cugaggcagaauugcuugaac

SEQ ID NO: 402446 - RNA, 32 nt, Human
cugaggcagacaauggcuugaaccugggaggc

SEQ ID NO: 402447 - RNA, 21 nt, Human
cugaggcagacaggaaguguc

SEQ ID NO: 402448 - RNA, 21 nt, Human
cugaggcagagaauugcuuga

SEQ ID NO: 402449 - RNA, 32 nt, Human
cugaggcagagcuauccaggggaccugcagaa

SEQ ID NO: 402450 - RNA, 32 nt, Human
cugaggcagcacuuuuagauccuuugugagca

SEQ ID NO: 402451 - RNA, 32 nt, Human
cugaggcagccaaccuccggccccaggcaccg

SEQ ID NO: 402452 - RNA, 32 nt, Human
cugaggcagccagcagaucucagcagcccagu

SEQ ID NO: 402453 - RNA, 32 nt, Human
cugaggcagccaucugggucucugcuucccua

SEQ ID NO: 402454 - RNA, 24 nt, Human
cugaggcaggaaaaucacuugaac

SEQ ID NO: 402455 - RNA, 24 nt, Human
cugaggcaggaaaaucgcuugaac

SEQ ID NO: 402456 - RNA, 24 nt, Human
cugaggcaggaaaauggcgugaac

SEQ ID NO: 402457 - RNA, 24 nt, Human
cugaggcaggaaaauggugucaac

SEQ ID NO: 402458 - RNA, 23 nt, Human
cugaggcaggaaaauucuugaac

SEQ ID NO: 402459 - RNA, 24 nt, Human
cugaggcaggaaaauugcuugaac

SEQ ID NO: 402460 - RNA, 32 nt, Human
cugaggcaggaacccuggagguugagguugca

SEQ ID NO: 402461 - RNA, 24 nt, Human
cugaggcaggaagaucacuugaac

SEQ ID NO: 402462 - RNA, 24 nt, Human
cugaggcaggagaaaagugugaac

SEQ ID NO: 402463 - RNA, 24 nt, Human
cugaggcaggagaaacaccugagc

SEQ ID NO: 402464 - RNA, 24 nt, Human
cugaggcaggagaaaggcaugaau

SEQ ID NO: 402465 - RNA, 24 nt, Human
cugaggcaggagaaaucacuugaa

SEQ ID NO: 402466 - RNA, 24 nt, Human
cugaggcaggagaaaugcuugaac

SEQ ID NO: 402467 - RNA, 24 nt, Human
cugaggcaggagaaccgcuugaac

SEQ ID NO: 402468 - RNA, 24 nt, Human
cugaggcaggagaacggcgugaac

SEQ ID NO: 402469 - RNA, 24 nt, Human
cugaggcaggagaacuacuugaac

SEQ ID NO: 402470 - RNA, 24 nt, Human
cugaggcaggagaacugcuugaac

SEQ ID NO: 402471 - RNA, 24 nt, Human
cugaggcaggagaagggcgugaac

SEQ ID NO: 402472 - RNA, 24 nt, Human
cugaggcaggagaagggugggaac

SEQ ID NO: 402473 - RNA, 24 nt, Human
cugaggcaggagaauagccugaac

SEQ ID NO: 402474 - RNA, 24 nt, Human
cugaggcaggagaauagcgugaac

SEQ ID NO: 402475 - RNA, 24 nt, Human
cugaggcaggagaauagcuggaac

SEQ ID NO: 402476 - RNA, 24 nt, Human
cugaggcaggagaauagcuugaac

SEQ ID NO: 402477 - RNA, 24 nt, Human
cugaggcaggagaauagugugaac

SEQ ID NO: 402478 - RNA, 24 nt, Human
cugaggcaggagaauaucuugaac

SEQ ID NO: 402479 - RNA, 22 nt, Human
cugaggcaggagaauauggaac

SEQ ID NO: 402480 - RNA, 24 nt, Human
cugaggcaggagaaucaauugaac

SEQ ID NO: 402481 - RNA, 24 nt, Human
cugaggcaggagaaucacaugaac

SEQ ID NO: 402482 - RNA, 24 nt, Human
cugaggcaggagaaucacaugaau

SEQ ID NO: 402483 - RNA, 24 nt, Human
cugaggcaggagaaucaccugaac

SEQ ID NO: 402484 - RNA, 24 nt, Human
cugaggcaggagaaucacuagaac

SEQ ID NO: 402485 - RNA, 24 nt, Human
cugaggcaggagaaucacucgaac

SEQ ID NO: 402486 - RNA, 24 nt, Human
cugaggcaggagaaucacucggac

SEQ ID NO: 402487 - RNA, 22 nt, Human
cugaggcaggagaaucacuuga

SEQ ID NO: 402488 - RNA, 23 nt, Human
cugaggcaggagaaucacuugaa

SEQ ID NO: 402489 - RNA, 24 nt, Human
cugaggcaggagaaucacuugaac

SEQ ID NO: 402490 - RNA, 24 nt, Human
cugaggcaggagaaucacuugaau

SEQ ID NO: 402491 - RNA, 24 nt, Human
cugaggcaggagaaucacuugagc

SEQ ID NO: 402492 - RNA, 24 nt, Human
cugaggcaggagaaucacuuggac

SEQ ID NO: 402493 - RNA, 24 nt, Human
cugaggcaggagaaucaguugaac

SEQ ID NO: 402494 - RNA, 24 nt, Human
cugaggcaggagaaucaucugaac

SEQ ID NO: 402495 - RNA, 24 nt, Human
cugaggcaggagaaucauuugaac

SEQ ID NO: 402496 - RNA, 24 nt, Human
cugaggcaggagaaucccuugaac

SEQ ID NO: 402497 - RNA, 24 nt, Human
cugaggcaggagaaucgccugaac

SEQ ID NO: 402498 - RNA, 24 nt, Human
cugaggcaggagaaucgcgugaac

SEQ ID NO: 402499 - RNA, 24 nt, Human
cugaggcaggagaaucgcuagaac

SEQ ID NO: 402500 - RNA, 24 nt, Human
cugaggcaggagaaucgcuggaac

SEQ ID NO: 402501 - RNA, 22 nt, Human
cugaggcaggagaaucgcuuga

SEQ ID NO: 402502 - RNA, 23 nt, Human
cugaggcaggagaaucgcuugaa

SEQ ID NO: 402503 - RNA, 24 nt, Human
cugaggcaggagaaucgcuugaac

SEQ ID NO: 402504 - RNA, 24 nt, Human
cugaggcaggagaaucgcuugaau

SEQ ID NO: 402505 - RNA, 24 nt, Human
cugaggcaggagaaucgcuugagc

SEQ ID NO: 402506 - RNA, 24 nt, Human
cugaggcaggagaaucgcuuggac

SEQ ID NO: 402507 - RNA, 18 nt, Human
cugaggcaggagaaucgu

SEQ ID NO: 402508 - RNA, 24 nt, Human
cugaggcaggagaaucguuugaac

SEQ ID NO: 402509 - RNA, 22 nt, Human
cugaggcaggagaaucguuugc

SEQ ID NO: 402510 - RNA, 22 nt, Human
cugaggcaggagaaucucgaac

SEQ ID NO: 402511 - RNA, 23 nt, Human
cugaggcaggagaaucucuugaa

SEQ ID NO: 402512 - RNA, 24 nt, Human
cugaggcaggagaaucucuugaac

SEQ ID NO: 402513 - RNA, 24 nt, Human
cugaggcaggagaaugacaugaac

SEQ ID NO: 402514 - RNA, 24 nt, Human
cugaggcaggagaaugaugugaac

SEQ ID NO: 402515 - RNA, 24 nt, Human
cugaggcaggagaaugcugugaac

SEQ ID NO: 402516 - RNA, 24 nt, Human
cugaggcaggagaauggagugaac

SEQ ID NO: 402517 - RNA, 24 nt, Human
cugaggcaggagaauggcaugaac

SEQ ID NO: 402518 - RNA, 24 nt, Human
cugaggcaggagaauggcaugagc

SEQ ID NO: 402519 - RNA, 24 nt, Human
cugaggcaggagaauggccugaac

SEQ ID NO: 402520 - RNA, 24 nt, Human
cugaggcaggagaauggcgagaac

SEQ ID NO: 402521 - RNA, 24 nt, Human
cugaggcaggagaauggcgggaac

SEQ ID NO: 402522 - RNA, 24 nt, Human
cugaggcaggagaauggcguaaac

SEQ ID NO: 402523 - RNA, 23 nt, Human
cugaggcaggagaauggcgugaa

SEQ ID NO: 402524 - RNA, 24 nt, Human
cugaggcaggagaauggcgugaac

SEQ ID NO: 402525 - RNA, 24 nt, Human
cugaggcaggagaauggcgugaau

SEQ ID NO: 402526 - RNA, 24 nt, Human
cugaggcaggagaauggcucgaac

SEQ ID NO: 402527 - RNA, 24 nt, Human
cugaggcaggagaauggcuggaac

SEQ ID NO: 402528 - RNA, 24 nt, Human
cugaggcaggagaauggcuugaac

SEQ ID NO: 402529 - RNA, 24 nt, Human
cugaggcaggagaauggggagaac

SEQ ID NO: 402530 - RNA, 24 nt, Human
cugaggcaggagaaugguaugaac

SEQ ID NO: 402531 - RNA, 24 nt, Human
cugaggcaggagaauggugcgaac

SEQ ID NO: 402532 - RNA, 20 nt, Human
cugaggcaggagaauggugu

SEQ ID NO: 402533 - RNA, 24 nt, Human
cugaggcaggagaauggugugaac

SEQ ID NO: 402534 - RNA, 24 nt, Human
cugaggcaggagaaugguguggac

SEQ ID NO: 402535 - RNA, 24 nt, Human
cugaggcaggagaauguggugaac

SEQ ID NO: 402536 - RNA, 24 nt, Human
cugaggcaggagaauuacuugaac

SEQ ID NO: 402537 - RNA, 24 nt, Human
cugaggcaggagaauuccuugaac

SEQ ID NO: 402538 - RNA, 24 nt, Human
cugaggcaggagaauucuuugaac

SEQ ID NO: 402539 - RNA, 24 nt, Human
cugaggcaggagaauugauugaac

SEQ ID NO: 402540 - RNA, 24 nt, Human
cugaggcaggagaauugcaugaac

SEQ ID NO: 402541 - RNA, 24 nt, Human
cugaggcaggagaauugcgugaau

SEQ ID NO: 402542 - RNA, 22 nt, Human
cugaggcaggagaauugcugaa

SEQ ID NO: 402543 - RNA, 22 nt, Human
cugaggcaggagaauugcuuga

SEQ ID NO: 402544 - RNA, 23 nt, Human
cugaggcaggagaauugcuugaa

SEQ ID NO: 402545 - RNA, 24 nt, Human
cugaggcaggagaauugcuugaac

SEQ ID NO: 402546 - RNA, 24 nt, Human
cugaggcaggagaauugcuugaau

SEQ ID NO: 402547 - RNA, 24 nt, Human
cugaggcaggagaauugcuugagc

SEQ ID NO: 402548 - RNA, 24 nt, Human
cugaggcaggagaauugguugaac

SEQ ID NO: 402549 - RNA, 22 nt, Human
cugaggcaggagaauuguuuga

SEQ ID NO: 402550 - RNA, 24 nt, Human
cugaggcaggagaauuguuugaac

SEQ ID NO: 402551 - RNA, 24 nt, Human
cugaggcaggagacucgcuugaac

SEQ ID NO: 402552 - RNA, 24 nt, Human
cugaggcaggagacuggcgugaac

SEQ ID NO: 402553 - RNA, 24 nt, Human
cugaggcaggagaguagcgugaac

SEQ ID NO: 402554 - RNA, 24 nt, Human
cugaggcaggagagucacuugaac

SEQ ID NO: 402555 - RNA, 23 nt, Human
cugaggcaggagagugcuugaac

SEQ ID NO: 402556 - RNA, 24 nt, Human
cugaggcaggagaguggugugaac

SEQ ID NO: 402557 - RNA, 23 nt, Human
cugaggcaggagaucgcuggaac

SEQ ID NO: 402558 - RNA, 24 nt, Human
cugaggcaggagauucgccugaac

SEQ ID NO: 402559 - RNA, 24 nt, Human
cugaggcaggagauucgcuugaac

SEQ ID NO: 402560 - RNA, 24 nt, Human
cugaggcaggagcauugcuugaac

SEQ ID NO: 402561 - RNA, 32 nt, Human
cugaggcaggaggaucaccugaggucaggagu

SEQ ID NO: 402562 - RNA, 23 nt, Human
cugaggcaggaggaucacgugag

SEQ ID NO: 402563 - RNA, 24 nt, Human
cugaggcaggaggaucacgugagc

SEQ ID NO: 402564 - RNA, 24 nt, Human
cugaggcaggaggaucacuugaac

SEQ ID NO: 402565 - RNA, 32 nt, Human
cugaggcaggaggaucacuugaggucaggagu

SEQ ID NO: 402566 - RNA, 32 nt, Human
cugaggcaggaggaucauuugaggucaggagu

SEQ ID NO: 402567 - RNA, 24 nt, Human
cugaggcaggaggaucgcuugaac

SEQ ID NO: 402568 - RNA, 24 nt, Human
cugaggcaggaggauggcgugaac

SEQ ID NO: 402569 - RNA, 24 nt, Human
cugaggcaggaggauggugugaac

SEQ ID NO: 402570 - RNA, 24 nt, Human
cugaggcaggaggauugcucgaac

SEQ ID NO: 402571 - RNA, 32 nt, Human
cugaggcaggaggugcagcguguggagugaga

SEQ ID NO: 402572 - RNA, 32 nt, Human
cugaggcaggcagagcauuugaggucaggagu

SEQ ID NO: 402573 - RNA, 32 nt, Human
cugaggcaggcagaucacaugaggucaggagu

SEQ ID NO: 402574 - RNA, 32 nt, Human
cugaggcaggcagaucaccugaggccaggagu

SEQ ID NO: 402575 - RNA, 32 nt, Human
cugaggcaggcagaucaccugaggucaggagu

SEQ ID NO: 402576 - RNA, 32 nt, Human
cugaggcaggcagaucaccugaggucgggagc

SEQ ID NO: 402577 - RNA, 32 nt, Human
cugaggcaggcagaucaccugauaucaagagu

SEQ ID NO: 402578 - RNA, 22 nt, Human
cugaggcaggcagaucaccugg

SEQ ID NO: 402579 - RNA, 32 nt, Human
cugaggcaggcagaucaccuggggucaggagu

SEQ ID NO: 402580 - RNA, 24 nt, Human
cugaggcaggcagaucacgagguc

SEQ ID NO: 402581 - RNA, 32 nt, Human
cugaggcaggcagaucacgaggucaggaguuc

SEQ ID NO: 402582 - RNA, 26 nt, Human
cugaggcaggcagaucacgugagguc

SEQ ID NO: 402583 - RNA, 32 nt, Human
cugaggcaggcagaucacgugaggucaggagu

SEQ ID NO: 402584 - RNA, 23 nt, Human
cugaggcaggcagaucacuuagg

SEQ ID NO: 402585 - RNA, 32 nt, Human
cugaggcaggcagaucacuugaggucaggagu

SEQ ID NO: 402586 - RNA, 32 nt, Human
cugaggcaggcagaucagcugaggucaggagu

SEQ ID NO: 402587 - RNA, 32 nt, Human
cugaggcaggcagaucaucugaggucaggagu

SEQ ID NO: 402588 - RNA, 32 nt, Human
cugaggcaggcagaucaucugaggucaggcgu

SEQ ID NO: 402589 - RNA, 24 nt, Human
cugaggcaggcagaucaugagguc

SEQ ID NO: 402590 - RNA, 32 nt, Human
cugaggcaggcagaucaugaggucaagagauc

SEQ ID NO: 402591 - RNA, 32 nt, Human
cugaggcaggccaaucaccugaggucgggagu

SEQ ID NO: 402592 - RNA, 21 nt, Human
cugaggcaggccacccagguc

SEQ ID NO: 402593 - RNA, 32 nt, Human
cugaggcaggcggacacuugagcccagggguu

SEQ ID NO: 402594 - RNA, 24 nt, Human
cugaggcaggcggauagcaugagc

SEQ ID NO: 402595 - RNA, 24 nt, Human
cugaggcaggcggaucacaagguc

SEQ ID NO: 402596 - RNA, 24 nt, Human
cugaggcaggcggaucacaggguc

SEQ ID NO: 402597 - RNA, 32 nt, Human
cugaggcaggcggaucaccugaagucagaagu

SEQ ID NO: 402598 - RNA, 32 nt, Human
cugaggcaggcggaucaccugaggucaggagu

SEQ ID NO: 402599 - RNA, 32 nt, Human
cugaggcaggcggaucaccugaggucgggagu

SEQ ID NO: 402600 - RNA, 24 nt, Human
cugaggcaggcggaucacgagguc

SEQ ID NO: 402601 - RNA, 32 nt, Human
cugaggcaggcggaucacuugaggucaggagu

SEQ ID NO: 402602 - RNA, 24 nt, Human
cugaggcaggcggaucaugagguc

SEQ ID NO: 402603 - RNA, 32 nt, Human
cugaggcaggcgggucaccugaggucaggagu

SEQ ID NO: 402604 - RNA, 32 nt, Human
cugaggcaggcugaucacuugaggucaggagu

SEQ ID NO: 402605 - RNA, 23 nt, Human
cugaggcagggaaguccccaggc

SEQ ID NO: 402606 - RNA, 32 nt, Human
cugaggcagggugagggggcaagggacauacc

SEQ ID NO: 402607 - RNA, 32 nt, Human
cugaggcagggugggagccugggcugggcuca

SEQ ID NO: 402608 - RNA, 32 nt, Human
cugaggcaggguggggacacccacgggugagc

SEQ ID NO: 402609 - RNA, 32 nt, Human
cugaggcagguagcucaccugagucaggagcu

SEQ ID NO: 402610 - RNA, 24 nt, Human
cugaggcaggucgaucacgagguc

SEQ ID NO: 402611 - RNA, 18 nt, Human
cugaggcagguggaucac

SEQ ID NO: 402612 - RNA, 24 nt, Human
cugaggcagguggaucacaagguc

SEQ ID NO: 402613 - RNA, 32 nt, Human
cugaggcagguggaucaccugaggucagcagu

SEQ ID NO: 402614 - RNA, 32 nt, Human
cugaggcagguggaucaccugaggucaggaau

SEQ ID NO: 402615 - RNA, 32 nt, Human
cugaggcagguggaucaccugaggucaggagu

SEQ ID NO: 402616 - RNA, 32 nt, Human
cugaggcagguggaucaccugaggucgggagu

SEQ ID NO: 402617 - RNA, 32 nt, Human
cugaggcagguggaucaccugagguuaggagu

SEQ ID NO: 402618 - RNA, 24 nt, Human
cugaggcagguggaucacgagguc

SEQ ID NO: 402619 - RNA, 21 nt, Human
cugaggcagguggaucacugg

SEQ ID NO: 402620 - RNA, 32 nt, Human
cugaggcagguggaucacuugaggucaggagc

SEQ ID NO: 402621 - RNA, 32 nt, Human
cugaggcagguggaucacuugaggucaggagu

SEQ ID NO: 402622 - RNA, 32 nt, Human
cugaggcagguggaucauuugaggucaggagu

SEQ ID NO: 402623 - RNA, 18 nt, Human
cugaggcagguggaucgc

SEQ ID NO: 402624 - RNA, 32 nt, Human
cugaggcagguggaucgccugaggucaggagu

SEQ ID NO: 402625 - RNA, 32 nt, Human
cugaggcagguggauugccugaggucaguagu

SEQ ID NO: 402626 - RNA, 32 nt, Human
cugaggcagguggcucacuugaggucaggaau

SEQ ID NO: 402627 - RNA, 32 nt, Human
cugaggcaguaagucccuuggcauuacugcuu

SEQ ID NO: 402628 - RNA, 24 nt, Human
cugaggcaguagaauggcaugaac

SEQ ID NO: 402629 - RNA, 32 nt, Human
cugaggcagucuguccuugagacuaacaaagu

SEQ ID NO: 402630 - RNA, 32 nt, Human
cugaggcaguggggaagacagagcagaaugag

SEQ ID NO: 402631 - RNA, 32 nt, Human
cugaggcauagagcagauaagaaaaugaaugu

SEQ ID NO: 402632 - RNA, 23 nt, Human
cugaggcaucggccaguccaggc

SEQ ID NO: 402633 - RNA, 32 nt, Human
cugaggccaagaguucaagaccaacuuggaca

SEQ ID NO: 402634 - RNA, 20 nt, Human
cugaggccaauccaggggga

SEQ ID NO: 402635 - RNA, 32 nt, Human
cugaggccacacagcuuguaaguggccaacca

SEQ ID NO: 402636 - RNA, 32 nt, Human
cugaggccacccagaggcagcagagcauucag

SEQ ID NO: 402637 - RNA, 32 nt, Human
cugaggccaccuggccccaccugcuccucagg

SEQ ID NO: 402638 - RNA, 32 nt, Human
cugaggccacgagcuccuggguagcugugauc

SEQ ID NO: 402639 - RNA, 32 nt, Human
cugaggccacugcacccuuucucggggaagau

SEQ ID NO: 402640 - RNA, 32 nt, Human
cugaggccacugcuauuucccaagagaagagc

SEQ ID NO: 402641 - RNA, 32 nt, Human
cugaggccagaaguucgagaccagccuuggcc

SEQ ID NO: 402642 - RNA, 32 nt, Human
cugaggccagaucauacagggucuccaaugca

SEQ ID NO: 402643 - RNA, 20 nt, Human
cugaggccagccccgagcca

SEQ ID NO: 402644 - RNA, 32 nt, Human
cugaggccagccuccuggaagcugaccuuaaa

SEQ ID NO: 402645 - RNA, 32 nt, Human
cugaggccagcgucacacucccucucugcucu

SEQ ID NO: 402646 - RNA, 21 nt, Human
cugaggccaggaauucaagac

SEQ ID NO: 402647 - RNA, 32 nt, Human
cugaggccaggaauucaagaccaaccuggcca

SEQ ID NO: 402648 - RNA, 21 nt, Human
cugaggccaggaguucaagac

SEQ ID NO: 402649 - RNA, 32 nt, Human
cugaggccaggaguucaagaccagccugacca

SEQ ID NO: 402650 - RNA, 32 nt, Human
cugaggccaggaguucaagaccagccuggcca

SEQ ID NO: 402651 - RNA, 32 nt, Human
cugaggccaggaguucaagaccagccuggcua

SEQ ID NO: 402652 - RNA, 32 nt, Human
cugaggccaggaguucacaaccagccugguca

SEQ ID NO: 402653 - RNA, 32 nt, Human
cugaggccaggaguucgagaccagccugccaa

SEQ ID NO: 402654 - RNA, 32 nt, Human
cugaggccaggaguucgagaccagccuggcca

SEQ ID NO: 402655 - RNA, 32 nt, Human
cugaggccaggaguucgagaccagccuggcua

SEQ ID NO: 402656 - RNA, 32 nt, Human
cugaggccaggaguucgagaccagccuggcug

SEQ ID NO: 402657 - RNA, 32 nt, Human
cugaggccaggaguucgagaccagccugggca

SEQ ID NO: 402658 - RNA, 32 nt, Human
cugaggccaggaguuugacaccagccugggca

SEQ ID NO: 402659 - RNA, 32 nt, Human
cugaggccagggaagguggaggaaggaagcca

SEQ ID NO: 402660 - RNA, 32 nt, Human
cugaggccagggguuugagaccagccugagca

SEQ ID NO: 402661 - RNA, 32 nt, Human
cugaggccauggaugaaggccuacucgggaag

SEQ ID NO: 402662 - RNA, 32 nt, Human
cugaggcccacugucuaccuugccagauccuc

SEQ ID NO: 402663 - RNA, 19 nt, Human
cugaggccccagcuucccu

SEQ ID NO: 402664 - RNA, 32 nt, Human
cugaggccccaggcacacgcuggguccugucc

SEQ ID NO: 402665 - RNA, 32 nt, Human
cugaggccccggcccccgccccugggacgccg

SEQ ID NO: 402666 - RNA, 32 nt, Human
cugaggcccgggcgcuggcugcagcucacguc

SEQ ID NO: 402667 - RNA, 32 nt, Human
cugaggcccggggaguugggggcagccaggau

SEQ ID NO: 402668 - RNA, 32 nt, Human
cugaggcccucaccagaagcucaucagaagca

SEQ ID NO: 402669 - RNA, 32 nt, Human
cugaggcccugauccgggcgggccuucaggau

SEQ ID NO: 402670 - RNA, 32 nt, Human
cugaggcccuggguccuggugcuggaaggcag

SEQ ID NO: 402671 - RNA, 32 nt, Human
cugaggccgaugcuaaggagauagugucucga

SEQ ID NO: 402672 - RNA, 32 nt, Human
cugaggccggcagaucacuugaggucaggagu

SEQ ID NO: 402673 - RNA, 32 nt, Human
cugaggccgggaauuugagaccagcccggaca

SEQ ID NO: 402674 - RNA, 32 nt, Human
cugaggccgguggaucaccugggaucaggagu

SEQ ID NO: 402675 - RNA, 32 nt, Human
cugaggccucgucuccugauaggaccauguau

SEQ ID NO: 402676 - RNA, 18 nt, Human
cugaggccucuggaccca

SEQ ID NO: 402677 - RNA, 32 nt, Human
cugaggccugagugaguguuuggccgaggccu

SEQ ID NO: 402678 - RNA, 32 nt, Human
cugaggccuggacccacccaucuuugucccug

SEQ ID NO: 402679 - RNA, 32 nt, Human
cugaggccuguccccucaguucccaggugcca

SEQ ID NO: 402680 - RNA, 32 nt, Human
cugaggccuguggaggaggugaguguagccag

SEQ ID NO: 402681 - RNA, 32 nt, Human
cugaggccuucucaaacuuuacucuaagucuc

SEQ ID NO: 402682 - RNA, 32 nt, Human
cugaggccuuugcccuugcuuugcgggucagu

SEQ ID NO: 402683 - RNA, 32 nt, Human
cugaggccuuugcugugaacugcaguguuuca

SEQ ID NO: 402684 - RNA, 32 nt, Human
cugaggcgaguggaucaccugaggucaggagu

SEQ ID NO: 402685 - RNA, 32 nt, Human
cugaggcgaguggaucacuugaggucaggagu

SEQ ID NO: 402686 - RNA, 32 nt, Human
cugaggcgcacacccaugcagccccugauguu

SEQ ID NO: 402687 - RNA, 32 nt, Human
cugaggcgccgggaccggcugcagagacaggc

SEQ ID NO: 402688 - RNA, 32 nt, Human
cugaggcgcguggaucaccugaggucagaagu

SEQ ID NO: 402689 - RNA, 32 nt, Human
cugaggcggauggaucaccugaggucaggagu

SEQ ID NO: 402690 - RNA, 32 nt, Human
cugaggcggauggaucacuugaggucagggga

SEQ ID NO: 402691 - RNA, 32 nt, Human
cugaggcggcauggaucucagcgagcuggaga

SEQ ID NO: 402692 - RNA, 22 nt, Human
cugaggcggccggaucacaagg

SEQ ID NO: 402693 - RNA, 32 nt, Human
cugaggcggcgcugugugugugaagcguaccu

SEQ ID NO: 402694 - RNA, 32 nt, Human
cugaggcggcugggccuagggugcagcgggcg

SEQ ID NO: 402695 - RNA, 24 nt, Human
cugaggcgggagaauagcaugaac

SEQ ID NO: 402696 - RNA, 24 nt, Human
cugaggcgggagaauggcgugaac

SEQ ID NO: 402697 - RNA, 24 nt, Human
cugaggcgggaggaucacaagguc

SEQ ID NO: 402698 - RNA, 22 nt, Human
cugaggcgggaggaucacuuga

SEQ ID NO: 402699 - RNA, 32 nt, Human
cugaggcgggaugaucaccugaggucaggagu

SEQ ID NO: 402700 - RNA, 32 nt, Human
cugaggcgggcaaaacacuugaggucagacgu

SEQ ID NO: 402701 - RNA, 21 nt, Human
cugaggcgggcagaucacaag

SEQ ID NO: 402702 - RNA, 24 nt, Human
cugaggcgggcagaucacaagguc

SEQ ID NO: 402703 - RNA, 32 nt, Human
cugaggcgggcagaucaccugagaucgggagu

SEQ ID NO: 402704 - RNA, 32 nt, Human
cugaggcgggcagaucaccugaggccaggagu

SEQ ID NO: 402705 - RNA, 32 nt, Human
cugaggcgggcagaucaccugaggucaagagu

SEQ ID NO: 402706 - RNA, 32 nt, Human
cugaggcgggcagaucaccugaggucaggagu

SEQ ID NO: 402707 - RNA, 24 nt, Human
cugaggcgggcagaucacgagguc

SEQ ID NO: 402708 - RNA, 24 nt, Human
cugaggcgggcagaucacuugaga

SEQ ID NO: 402709 - RNA, 32 nt, Human
cugaggcgggcagaucaucugaggucaggagu

SEQ ID NO: 402710 - RNA, 32 nt, Human
cugaggcgggcagauugcuugaggucaggagu

SEQ ID NO: 402711 - RNA, 32 nt, Human
cugaggcgggcccugugcugggggugguagaa

SEQ ID NO: 402712 - RNA, 32 nt, Human
cugaggcgggcggaacaccugaggucaggugu

SEQ ID NO: 402713 - RNA, 32 nt, Human
cugaggcgggcggauagcuugaggucaggagu

SEQ ID NO: 402714 - RNA, 24 nt, Human
cugaggcgggcggaucacaagguc

SEQ ID NO: 402715 - RNA, 24 nt, Human
cugaggcgggcggaucaccagguc

SEQ ID NO: 402716 - RNA, 32 nt, Human
cugaggcgggcggaucaccugaggucaagagu

SEQ ID NO: 402717 - RNA, 32 nt, Human
cugaggcgggcggaucaccugaggucaggagu

SEQ ID NO: 402718 - RNA, 32 nt, Human
cugaggcgggcggaucaccugaggucgggagu

SEQ ID NO: 402719 - RNA, 32 nt, Human
cugaggcgggcggaucaccugagguugggagu

SEQ ID NO: 402720 - RNA, 32 nt, Human
cugaggcgggcggaucaccugagucaggaguu

SEQ ID NO: 402721 - RNA, 24 nt, Human
cugaggcgggcggaucacgagguc

SEQ ID NO: 402722 - RNA, 24 nt, Human
cugaggcgggcggaucacuagguc

SEQ ID NO: 402723 - RNA, 24 nt, Human
cugaggcggggagaucacaagguc

SEQ ID NO: 402724 - RNA, 24 nt, Human
cugaggcggguagaucacaagguc

SEQ ID NO: 402725 - RNA, 24 nt, Human
cugaggcgggugaaucacgagguc

SEQ ID NO: 402726 - RNA, 24 nt, Human
cugaggcggguggaucacaagcuc

SEQ ID NO: 402727 - RNA, 24 nt, Human
cugaggcggguggaucacaagguc

SEQ ID NO: 402728 - RNA, 32 nt, Human
cugaggcggguggaucaccugaggccaggugu

SEQ ID NO: 402729 - RNA, 32 nt, Human
cugaggcggguggaucaccugaggucaggagc

SEQ ID NO: 402730 - RNA, 32 nt, Human
cugaggcggguggaucaccugaggucaggagu

SEQ ID NO: 402731 - RNA, 32 nt, Human
cugaggcggguggaucaccugaggucaggauu

SEQ ID NO: 402732 - RNA, 32 nt, Human
cugaggcggguggaucaccugaggucgggagu

SEQ ID NO: 402733 - RNA, 32 nt, Human
cugaggcggguggaucaccugagguuaggagu

SEQ ID NO: 402734 - RNA, 24 nt, Human
cugaggcggguggaucacgagguc

SEQ ID NO: 402735 - RNA, 24 nt, Human
cugaggcggguggaucacuagguc

SEQ ID NO: 402736 - RNA, 32 nt, Human
cugaggcggguggaucacuugaggucagaagu

SEQ ID NO: 402737 - RNA, 32 nt, Human
cugaggcggguggaucacuugaggucaggagu

SEQ ID NO: 402738 - RNA, 32 nt, Human
cugaggcgggugggucaccugagguugggagu

SEQ ID NO: 402739 - RNA, 32 nt, Human
cugaggcggguugaucaccugaggucaggagu

SEQ ID NO: 402740 - RNA, 32 nt, Human
cugaggcuacagcugcuaucacaugccgaacu

SEQ ID NO: 402741 - RNA, 32 nt, Human
cugaggcuaggaguucgagaccagcuugggca

SEQ ID NO: 402742 - RNA, 32 nt, Human
cugaggcuaggaguugcagaccagccuggcca

SEQ ID NO: 402743 - RNA, 32 nt, Human
cugaggcucaaggaauuucgagguagaacaau

SEQ ID NO: 402744 - RNA, 20 nt, Human
cugaggcucagcccugagcu

SEQ ID NO: 402745 - RNA, 32 nt, Human
cugaggcucagguugucauuugcucaaaucac

SEQ ID NO: 402746 - RNA, 32 nt, Human
cugaggcucaucugccuucuccuggucacccu

SEQ ID NO: 402747 - RNA, 32 nt, Human
cugaggcuccacugaagcuauggcauaauuug

SEQ ID NO: 402748 - RNA, 32 nt, Human
cugaggcugauggagcugccuccagggcuagg

SEQ ID NO: 402749 - RNA, 32 nt, Human
cugaggcugcacaggccagggcucgggcaugu

SEQ ID NO: 402750 - RNA, 17 nt, Human
cugaggcugccccggcc

SEQ ID NO: 402751 - RNA, 32 nt, Human
cugaggcugcgaggugggaccugcugcugugc

SEQ ID NO: 402752 - RNA, 32 nt, Human
cugaggcuggacaauggugugaacccaggagg

SEQ ID NO: 402753 - RNA, 20 nt, Human
cugaggcuggagugcaguga

SEQ ID NO: 402754 - RNA, 20 nt, Human
cugaggcuggagugcagugg

SEQ ID NO: 402755 - RNA, 32 nt, Human
cugaggcuggcagaucacuugaggucaggagu

SEQ ID NO: 402756 - RNA, 32 nt, Human
cugaggcuggcguaucaccugagguugggagu

SEQ ID NO: 402757 - RNA, 32 nt, Human
cugaggcugggcagaggugggugagaagaggg

SEQ ID NO: 402758 - RNA, 32 nt, Human
cugaggcugggccugacccugcuccuuacccc

SEQ ID NO: 402759 - RNA, 32 nt, Human
cugaggcugggggaucaccugaggucaggagu

SEQ ID NO: 402760 - RNA, 32 nt, Human
cugaggcuggguuuggugcauguggguugagg

SEQ ID NO: 402761 - RNA, 32 nt, Human
cugaggcugucucagaugaaugcaguugagag

SEQ ID NO: 402762 - RNA, 32 nt, Human
cugaggcuguggucacagcggagguguggagc

SEQ ID NO: 402763 - RNA, 32 nt, Human
cugaggcugugucacuggcauguccuuaaccu

SEQ ID NO: 402764 - RNA, 32 nt, Human
cugaggcuguuuuuggcuguuuucccucugcu

SEQ ID NO: 402765 - RNA, 32 nt, Human
cugaggcuucacugcagcggccuccacccacc

SEQ ID NO: 402766 - RNA, 32 nt, Human
cugaggcuucuccccucucaacuugcuguuga

SEQ ID NO: 402767 - RNA, 32 nt, Human
cugaggcuugcuuggcuuguguccaugcuuaa

SEQ ID NO: 402768 - RNA, 32 nt, Human
cugaggcuugugccacugggccuuucugauuu

SEQ ID NO: 402769 - RNA, 32 nt, Human
cugaggcuuuucucccccucuuaaugccuuug

SEQ ID NO: 402770 - RNA, 32 nt, Human
cugagggaaacagcuggcaaugugacaaaagu

SEQ ID NO: 402771 - RNA, 32 nt, Human
cugagggaaaggcucguagcugguggguuccg

SEQ ID NO: 402772 - RNA, 32 nt, Human
cugagggaacaucaguggcccuccagucaggu

SEQ ID NO: 402773 - RNA, 32 nt, Human
cugagggaaccaggauuccucccuccuaccag

SEQ ID NO: 402774 - RNA, 22 nt, Human
cugagggaagaugccuaguaga

SEQ ID NO: 402775 - RNA, 22 nt, Human
cugagggaagggacgcaggguc

SEQ ID NO: 402776 - RNA, 32 nt, Human
cugagggaagggaggaaggggcggggagagcg

SEQ ID NO: 402777 - RNA, 32 nt, Human
cugagggaaggugagggagugggaagggggau

SEQ ID NO: 402778 - RNA, 32 nt, Human
cugagggaagucugccuggugaggcuggcagg

SEQ ID NO: 402779 - RNA, 20 nt, Human
cugagggaccaacugggccc

SEQ ID NO: 402780 - RNA, 32 nt, Human
cugagggaccugacuuccccugcuccaggccu

SEQ ID NO: 402781 - RNA, 32 nt, Human
cugagggacuccuguguacuucacaucacuga

SEQ ID NO: 402782 - RNA, 32 nt, Human
cugagggacugugccugcugugcacucacagc

SEQ ID NO: 402783 - RNA, 32 nt, Human
cugagggagagggagaggggacccgaggcuga

SEQ ID NO: 402784 - RNA, 32 nt, Human
cugagggagauggugacaaguucaaggccugc

SEQ ID NO: 402785 - RNA, 32 nt, Human
cugagggagaugguggcagggccauucuuugu

SEQ ID NO: 402786 - RNA, 32 nt, Human
cugagggagccagaccucuggcccagaaagcc

SEQ ID NO: 402787 - RNA, 24 nt, Human
cugagggaggagaauggcgugaac

SEQ ID NO: 402788 - RNA, 32 nt, Human
cugagggaggcagaagaaagaaauccaagccu

SEQ ID NO: 402789 - RNA, 32 nt, Human
cugagggaggcggaucacuugaggucaggagu

SEQ ID NO: 402790 - RNA, 32 nt, Human
cugagggagggagaggaggggagccaagacac

SEQ ID NO: 402791 - RNA, 32 nt, Human
cugagggaggggagugggagucucagcaaucu

SEQ ID NO: 402792 - RNA, 32 nt, Human
cugagggaggggcaggagagcagugaggagcu

SEQ ID NO: 402793 - RNA, 32 nt, Human
cugagggaggggcgcuggccacaugucacuga

SEQ ID NO: 402794 - RNA, 32 nt, Human
cugagggagugaggugccaugacagcagccac

SEQ ID NO: 402795 - RNA, 32 nt, Human
cugagggagugggcacgugagcacauaauggc

SEQ ID NO: 402796 - RNA, 32 nt, Human
cugagggagugggcaugugagcacauaauggc

SEQ ID NO: 402797 - RNA, 19 nt, Human
cugagggauagagccugag

SEQ ID NO: 402798 - RNA, 32 nt, Human
cugagggauggaaaguucuuccugcuaugaau

SEQ ID NO: 402799 - RNA, 22 nt, Human
cugagggcacacaagggccaga

SEQ ID NO: 402800 - RNA, 32 nt, Human
cugagggcacacacaguggagagagcacagga

SEQ ID NO: 402801 - RNA, 30 nt, Human
cugagggcacucgcuuugcuccugucagua

SEQ ID NO: 402802 - RNA, 32 nt, Human
cugagggcagaagaaauugcuagaagucagaa

SEQ ID NO: 402803 - RNA, 32 nt, Human
cugagggcagccauguucuguaccaaaaacag

SEQ ID NO: 402804 - RNA, 32 nt, Human
cugagggcaggagucugagaccagccuggcca

SEQ ID NO: 402805 - RNA, 32 nt, Human
cugagggcaggcagaggguagacacacagcca

SEQ ID NO: 402806 - RNA, 32 nt, Human
cugagggcaggcgggcagcugcagggaggaga

SEQ ID NO: 402807 - RNA, 32 nt, Human
cugagggcaucaucuuccucaucugggaggcc

SEQ ID NO: 402808 - RNA, 20 nt, Human
cugagggccaggagcagcag

SEQ ID NO: 402809 - RNA, 32 nt, Human
cugagggcccuauaggcccaccuugcuggaaa

SEQ ID NO: 402810 - RNA, 32 nt, Human
cugagggcgggaaaggguggucacugggucag

SEQ ID NO: 402811 - RNA, 32 nt, Human
cugagggcuaaauugggaucucagccugcccu

SEQ ID NO: 402812 - RNA, 32 nt, Human
cugagggcuagaggacagagaaagagaauaga

SEQ ID NO: 402813 - RNA, 21 nt, Human
cugagggcucauccugggcca

SEQ ID NO: 402814 - RNA, 32 nt, Human
cugagggcuccucgggaauggaaagggcuucu

SEQ ID NO: 402815 - RNA, 32 nt, Human
cugagggcuccugggaggccugugggagccuc

SEQ ID NO: 402816 - RNA, 20 nt, Human
cugagggcuggaggagggca

SEQ ID NO: 402817 - RNA, 30 nt, Human
cugagggcuggcagaugugagggcaggaca

SEQ ID NO: 402818 - RNA, 32 nt, Human
cugagggcuggcagaugugagggcaggacacc

SEQ ID NO: 402819 - RNA, 32 nt, Human
cugagggcugugccaggaugacugucucaugc

SEQ ID NO: 402820 - RNA, 32 nt, Human
cugagggcugugucacaggccauguucacuua

SEQ ID NO: 402821 - RNA, 32 nt, Human
cugaggggaagagaggaaggaggggcgggcuc

SEQ ID NO: 402822 - RNA, 32 nt, Human
cugaggggaaggcauugcucuaccucucccug

SEQ ID NO: 402823 - RNA, 32 nt, Human
cugaggggaccaggaugggagaaugaggagua

SEQ ID NO: 402824 - RNA, 32 nt, Human
cugaggggagcucagaucagaucuaucaucac

SEQ ID NO: 402825 - RNA, 32 nt, Human
cugaggggaggcaccuccaggcaggccaggcu

SEQ ID NO: 402826 - RNA, 32 nt, Human
cugaggggcaccugggcuaggggcuugggacu

SEQ ID NO: 402827 - RNA, 32 nt, Human
cugaggggccaaggucaagaccaaccuccauc

SEQ ID NO: 402828 - RNA, 32 nt, Human
cugaggggcccaggagcaccucauguuuucug

SEQ ID NO: 402829 - RNA, 32 nt, Human
cugaggggcggggcguguagccagccaggugc

SEQ ID NO: 402830 - RNA, 32 nt, Human
cugaggggcugcagcuggggauagggggccca

SEQ ID NO: 402831 - RNA, 32 nt, Human
cugagggggaggcgcagggucaggaggggagg

SEQ ID NO: 402832 - RNA, 22 nt, Human
cugagggguagaaggggccaga

SEQ ID NO: 402833 - RNA, 32 nt, Human
cugaggggucuugggggcucuaggccggccac

SEQ ID NO: 402834 - RNA, 32 nt, Human
cugaggggugcauuaaggaaacuaaaagcacc

SEQ ID NO: 402835 - RNA, 32 nt, Human
cugaggguacgugccaucaucucuccagccca

SEQ ID NO: 402836 - RNA, 32 nt, Human
cugaggguagcugcuuugcugaagaccucaca

SEQ ID NO: 402837 - RNA, 17 nt, Human
cugagggucacuccaag

SEQ ID NO: 402838 - RNA, 31 nt, Human
cugagggucauucaucccaugcccaguuccc

SEQ ID NO: 402839 - RNA, 32 nt, Human
cugaggguccucaggguggaggacagguuugg

SEQ ID NO: 402840 - RNA, 32 nt, Human
cugaggguccugcugcuggccccaccaaauac

SEQ ID NO: 402841 - RNA, 19 nt, Human
cugagggucucuggccccg

SEQ ID NO: 402842 - RNA, 32 nt, Human
cugagggucugucucauccugcagcuggacag

SEQ ID NO: 402843 - RNA, 32 nt, Human
cugagggugaagauggaugacagaugcuaccc

SEQ ID NO: 402844 - RNA, 32 nt, Human
cugagggugagguguggaagggacagggggag

SEQ ID NO: 402845 - RNA, 32 nt, Human
cugagggugcagccagggcacagcagcggcgg

SEQ ID NO: 402846 - RNA, 32 nt, Human
cugagggugcuguccccaccucugguggaaag

SEQ ID NO: 402847 - RNA, 32 nt, Human
cugagggugggauggagaagagggcacugcug

SEQ ID NO: 402848 - RNA, 32 nt, Human
cugaggguggggaagcgcagggccaagcgcgc

SEQ ID NO: 402849 - RNA, 32 nt, Human
cugaggguggggagggagagagagggagggag

SEQ ID NO: 402850 - RNA, 32 nt, Human
cugagggugggggagagagaggcguggucccc

SEQ ID NO: 402851 - RNA, 32 nt, Human
cugaggguuaagaccuuagaacugggucuagc

SEQ ID NO: 402852 - RNA, 32 nt, Human
cugaggguuaggcuggagugacaguuuccgcc

SEQ ID NO: 402853 - RNA, 32 nt, Human
cugaggguucugccuagagagcucccacagaa

SEQ ID NO: 402854 - RNA, 32 nt, Human
cugaggguugacugacuggagagcucaagugc

SEQ ID NO: 402855 - RNA, 32 nt, Human
cugaggguuuugcuuuggauuuuucauaccua

SEQ ID NO: 402856 - RNA, 32 nt, Human
cugagguaacugucauuagaaaagguuucuua

SEQ ID NO: 402857 - RNA, 32 nt, Human
cugagguaaggaguuugagaccagccuggcca

SEQ ID NO: 402858 - RNA, 32 nt, Human
cugagguacagaggaagugauguccuugacaa

SEQ ID NO: 402859 - RNA, 32 nt, Human
cugagguagcuugaccugcuuucaccuggaau

SEQ ID NO: 402860 - RNA, 24 nt, Human
cugagguaggagaauggcgugaac

SEQ ID NO: 402861 - RNA, 32 nt, Human
cugagguaggcagaucacuugaggucaggagu

SEQ ID NO: 402862 - RNA, 32 nt, Human
cugagguagggaguucgagaccagccugacca

SEQ ID NO: 402863 - RNA, 32 nt, Human
cugagguagguggaaaaccugaggucaggagu

SEQ ID NO: 402864 - RNA, 32 nt, Human
cugagguagguggaucaccugaggucaggagu

SEQ ID NO: 402865 - RNA, 31 nt, Human
cugagguaguuucaguccaucacaguucauc

SEQ ID NO: 402866 - RNA, 32 nt, Human
cugagguauaucugcugccuuagaagacacaa

SEQ ID NO: 402867 - RNA, 32 nt, Human
cugaggucaagaaaugagauagugggagcaaa

SEQ ID NO: 402868 - RNA, 21 nt, Human
cugaggucaagaguucaagac

SEQ ID NO: 402869 - RNA, 32 nt, Human
cugaggucaagaguucaagaccagccugacca

SEQ ID NO: 402870 - RNA, 32 nt, Human
cugaggucaagaguucaagaccagccugacga

SEQ ID NO: 402871 - RNA, 32 nt, Human
cugaggucaagaguucaagaccagccuggcca

SEQ ID NO: 402872 - RNA, 32 nt, Human
cugaggucaagaguucaagaccggccuggcca

SEQ ID NO: 402873 - RNA, 32 nt, Human
cugaggucaagaguucgagaccagccuagcua

SEQ ID NO: 402874 - RNA, 32 nt, Human
cugaggucaagaguucgagaccagccugacca

SEQ ID NO: 402875 - RNA, 32 nt, Human
cugaggucaagaguuugagaccagccuggcca

SEQ ID NO: 402876 - RNA, 32 nt, Human
cugaggucaauaguucgagaccagccuggcca

SEQ ID NO: 402877 - RNA, 32 nt, Human
cugaggucacaaguucaagaccagccuggcaa

SEQ ID NO: 402878 - RNA, 32 nt, Human
cugaggucacccuggagguagcagguaagagc

SEQ ID NO: 402879 - RNA, 21 nt, Human
cugaggucacgaguucaagac

SEQ ID NO: 402880 - RNA, 32 nt, Human
cugaggucacgaguucaagaccagccuggcca

SEQ ID NO: 402881 - RNA, 32 nt, Human
cugaggucacgaguucgagaccagccugacca

SEQ ID NO: 402882 - RNA, 32 nt, Human
cugaggucacugcaaccuccaccucccggguu

SEQ ID NO: 402883 - RNA, 21 nt, Human
cugaggucagaaguucaagac

SEQ ID NO: 402884 - RNA, 32 nt, Human
cugaggucagaaguucaagaccagccuggcca

SEQ ID NO: 402885 - RNA, 32 nt, Human
cugaggucagaaguucaagaccagccuggcuc

SEQ ID NO: 402886 - RNA, 32 nt, Human
cugaggucagaaguucaagaccauccuggcua

SEQ ID NO: 402887 - RNA, 32 nt, Human
cugaggucagaaguuugagaccagccugacca

SEQ ID NO: 402888 - RNA, 32 nt, Human
cugaggucagaaguuugagaccagccuggcca

SEQ ID NO: 402889 - RNA, 32 nt, Human
cugaggucagaauuucgagaccagccuggcca

SEQ ID NO: 402890 - RNA, 32 nt, Human
cugaggucagcagcucccagacuccuuugccc

SEQ ID NO: 402891 - RNA, 32 nt, Human
cugaggucagcaguccaagaccacccuggcca

SEQ ID NO: 402892 - RNA, 32 nt, Human
cugaggucagcaguuaaagaccagccugacca

SEQ ID NO: 402893 - RNA, 32 nt, Human
cugaggucagcaguucaaaaucagccuggcca

SEQ ID NO: 402894 - RNA, 21 nt, Human
cugaggucagcaguucaagac

SEQ ID NO: 402895 - RNA, 32 nt, Human
cugaggucagcaguucaagaccagccugacca

SEQ ID NO: 402896 - RNA, 32 nt, Human
cugaggucagcaguucgagaccagccuggcca

SEQ ID NO: 402897 - RNA, 32 nt, Human
cugaggucagcaguucgagaccagccugguca

SEQ ID NO: 402898 - RNA, 32 nt, Human
cugaggucagcaguuugagaccagccuggcca

SEQ ID NO: 402899 - RNA, 32 nt, Human
cugaggucaggaaucgaaaaccagccugacca

SEQ ID NO: 402900 - RNA, 21 nt, Human
cugaggucaggaauucaagac

SEQ ID NO: 402901 - RNA, 32 nt, Human
cugaggucaggaauucaagaccacccuggcca

SEQ ID NO: 402902 - RNA, 32 nt, Human
cugaggucaggaauucaagaccagccuggcca

SEQ ID NO: 402903 - RNA, 21 nt, Human
cugaggucaggaauuugagac

SEQ ID NO: 402904 - RNA, 32 nt, Human
cugaggucaggaauuugagaccagccuggcca

SEQ ID NO: 402905 - RNA, 21 nt, Human
cugaggucaggacuucaagac

SEQ ID NO: 402906 - RNA, 32 nt, Human
cugaggucaggacuucaagaccagccuggcca

SEQ ID NO: 402907 - RNA, 32 nt, Human
cugaggucaggagaucaagaccagccuggcca

SEQ ID NO: 402908 - RNA, 32 nt, Human
cugaggucaggagaucgagaccagccuggcca

SEQ ID NO: 402909 - RNA, 21 nt, Human
cugaggucaggagcucaagac

SEQ ID NO: 402910 - RNA, 32 nt, Human
cugaggucaggagcucaagaccagccugacca

SEQ ID NO: 402911 - RNA, 32 nt, Human
cugaggucaggagcucaagaccagccuggcua

SEQ ID NO: 402912 - RNA, 32 nt, Human
cugaggucaggagcuccagaccagccuggcca

SEQ ID NO: 402913 - RNA, 32 nt, Human
cugaggucaggagcucgagaccagccuggcca

SEQ ID NO: 402914 - RNA, 32 nt, Human
cugaggucaggagcucgagaccagccuggccg

SEQ ID NO: 402915 - RNA, 21 nt, Human
cugaggucaggaguccaagac

SEQ ID NO: 402916 - RNA, 32 nt, Human
cugaggucaggaguccaagaccagccuggcca

SEQ ID NO: 402917 - RNA, 32 nt, Human
cugaggucaggaguuaaacaccagccugacaa

SEQ ID NO: 402918 - RNA, 32 nt, Human
cugaggucaggaguuaaagaccagccuggcca

SEQ ID NO: 402919 - RNA, 32 nt, Human
cugaggucaggaguuagagaccagccugggcc

SEQ ID NO: 402920 - RNA, 32 nt, Human
cugaggucaggaguucaaaaccagccuggcca

SEQ ID NO: 402921 - RNA, 20 nt, Human
cugaggucaggaguucaaga

SEQ ID NO: 402922 - RNA, 21 nt, Human
cugaggucaggaguucaagac

SEQ ID NO: 402923 - RNA, 32 nt, Human
cugaggucaggaguucaagaccaaccugacua

SEQ ID NO: 402924 - RNA, 32 nt, Human
cugaggucaggaguucaagaccaaucugacua

SEQ ID NO: 402925 - RNA, 32 nt, Human
cugaggucaggaguucaagaccagccuagcca

SEQ ID NO: 402926 - RNA, 32 nt, Human
cugaggucaggaguucaagaccagccucaaca

SEQ ID NO: 402927 - RNA, 32 nt, Human
cugaggucaggaguucaagaccagccugacca

SEQ ID NO: 402928 - RNA, 32 nt, Human
cugaggucaggaguucaagaccagccugaccc

SEQ ID NO: 402929 - RNA, 32 nt, Human
cugaggucaggaguucaagaccagccugccca

SEQ ID NO: 402930 - RNA, 32 nt, Human
cugaggucaggaguucaagaccagccuggcca

SEQ ID NO: 402931 - RNA, 32 nt, Human
cugaggucaggaguucaagaccagccuggccg

SEQ ID NO: 402932 - RNA, 32 nt, Human
cugaggucaggaguucaagaccagccuggcua

SEQ ID NO: 402933 - RNA, 32 nt, Human
cugaggucaggaguucaagaccagccugguca

SEQ ID NO: 402934 - RNA, 32 nt, Human
cugaggucaggaguucaagaccagccugucca

SEQ ID NO: 402935 - RNA, 32 nt, Human
cugaggucaggaguucaagaccagccuugcca

SEQ ID NO: 402936 - RNA, 32 nt, Human
cugaggucaggaguucaagaccagcuuggcca

SEQ ID NO: 402937 - RNA, 32 nt, Human
cugaggucaggaguucaagaccagucuggcca

SEQ ID NO: 402938 - RNA, 32 nt, Human
cugaggucaggaguucaagaccauccuggcca

SEQ ID NO: 402939 - RNA, 32 nt, Human
cugaggucaggaguucaauaccagccuggcca

SEQ ID NO: 402940 - RNA, 32 nt, Human
cugaggucaggaguucacgaccagccuggcca

SEQ ID NO: 402941 - RNA, 32 nt, Human
cugaggucaggaguucaggaccagccugacca

SEQ ID NO: 402942 - RNA, 32 nt, Human
cugaggucaggaguuccagaccagccuggcca

SEQ ID NO: 402943 - RNA, 32 nt, Human
cugaggucaggaguucgaaaccagccugacca

SEQ ID NO: 402944 - RNA, 32 nt, Human
cugaggucaggaguucgaaaccagccuggcca

SEQ ID NO: 402945 - RNA, 32 nt, Human
cugaggucaggaguucgaaaccagccuuccca

SEQ ID NO: 402946 - RNA, 20 nt, Human
cugaggucaggaguucgaga

SEQ ID NO: 402947 - RNA, 21 nt, Human
cugaggucaggaguucgagac

SEQ ID NO: 402948 - RNA, 32 nt, Human
cugaggucaggaguucgagaccagccucaaca

SEQ ID NO: 402949 - RNA, 32 nt, Human
cugaggucaggaguucgagaccagccucgcca

SEQ ID NO: 402950 - RNA, 32 nt, Human
cugaggucaggaguucgagaccagccugacca

SEQ ID NO: 402951 - RNA, 32 nt, Human
cugaggucaggaguucgagaccagccugaucg

SEQ ID NO: 402952 - RNA, 32 nt, Human
cugaggucaggaguucgagaccagccugccua

SEQ ID NO: 402953 - RNA, 32 nt, Human
cugaggucaggaguucgagaccagccuggcca

SEQ ID NO: 402954 - RNA, 32 nt, Human
cugaggucaggaguucgagaccagccuggcua

SEQ ID NO: 402955 - RNA, 32 nt, Human
cugaggucaggaguucgagaccagccugggag

SEQ ID NO: 402956 - RNA, 32 nt, Human
cugaggucaggaguucgagaccagccugguca

SEQ ID NO: 402957 - RNA, 32 nt, Human
cugaggucaggaguucgagaccagcuuagcca

SEQ ID NO: 402958 - RNA, 32 nt, Human
cugaggucaggaguucgcaaccagccuggcca

SEQ ID NO: 402959 - RNA, 32 nt, Human
cugaggucaggaguucuagaccagccugacca

SEQ ID NO: 402960 - RNA, 32 nt, Human
cugaggucaggaguucuagaccagccugaccg

SEQ ID NO: 402961 - RNA, 32 nt, Human
cugaggucaggaguucuagaccagccuggcca

SEQ ID NO: 402962 - RNA, 32 nt, Human
cugaggucaggaguucuagaccagccugggca

SEQ ID NO: 402963 - RNA, 32 nt, Human
cugaggucaggaguuggagaccagccugacca

SEQ ID NO: 402964 - RNA, 32 nt, Human
cugaggucaggaguuggagaccagccuggcca

SEQ ID NO: 402965 - RNA, 21 nt, Human
cugaggucaggaguuuaagac

SEQ ID NO: 402966 - RNA, 32 nt, Human
cugaggucaggaguuuaagaccagccugacca

SEQ ID NO: 402967 - RNA, 32 nt, Human
cugaggucaggaguuuaagaccagccuggcca

SEQ ID NO: 402968 - RNA, 32 nt, Human
cugaggucaggaguuugaaaccagccuggcca

SEQ ID NO: 402969 - RNA, 32 nt, Human
cugaggucaggaguuugagaccagccuagaca

SEQ ID NO: 402970 - RNA, 32 nt, Human
cugaggucaggaguuugagaccagccuaguca

SEQ ID NO: 402971 - RNA, 32 nt, Human
cugaggucaggaguuugagaccagccucacca

SEQ ID NO: 402972 - RNA, 32 nt, Human
cugaggucaggaguuugagaccagccuccugg

SEQ ID NO: 402973 - RNA, 32 nt, Human
cugaggucaggaguuugagaccagccucgcca

SEQ ID NO: 402974 - RNA, 32 nt, Human
cugaggucaggaguuugagaccagccugacau

SEQ ID NO: 402975 - RNA, 32 nt, Human
cugaggucaggaguuugagaccagccugacca

SEQ ID NO: 402976 - RNA, 32 nt, Human
cugaggucaggaguuugagaccagccugccca

SEQ ID NO: 402977 - RNA, 32 nt, Human
cugaggucaggaguuugagaccagccuggaca

SEQ ID NO: 402978 - RNA, 32 nt, Human
cugaggucaggaguuugagaccagccuggcca

SEQ ID NO: 402979 - RNA, 32 nt, Human
cugaggucaggaguuugagaccagccuggcua

SEQ ID NO: 402980 - RNA, 32 nt, Human
cugaggucaggaguuugagaccagccugggca

SEQ ID NO: 402981 - RNA, 32 nt, Human
cugaggucaggaguuugagaccagccugguca

SEQ ID NO: 402982 - RNA, 32 nt, Human
cugaggucaggaguuugagaccagccuugaca

SEQ ID NO: 402983 - RNA, 32 nt, Human
cugaggucaggaguuugagaccagcuuggcca

SEQ ID NO: 402984 - RNA, 32 nt, Human
cugaggucaggaguuugauaccagccugacca

SEQ ID NO: 402985 - RNA, 32 nt, Human
cugaggucaggaguuugauaccagccuggcca

SEQ ID NO: 402986 - RNA, 32 nt, Human
cugaggucaggaguuugugaccagccugacca

SEQ ID NO: 402987 - RNA, 32 nt, Human
cugaggucaggaguuugugaccagccuggcca

SEQ ID NO: 402988 - RNA, 32 nt, Human
cugaggucaggaguuuuagaccagccuggcca

SEQ ID NO: 402989 - RNA, 32 nt, Human
cugaggucaggauuuugagaccagccugacca

SEQ ID NO: 402990 - RNA, 32 nt, Human
cugaggucaggcaaucugcccaccucagccuc

SEQ ID NO: 402991 - RNA, 21 nt, Human
cugaggucaggcguucaagac

SEQ ID NO: 402992 - RNA, 32 nt, Human
cugaggucaggcguucaagaccagccuggcca

SEQ ID NO: 402993 - RNA, 32 nt, Human
cugaggucaggcguucaauaccagccuggcca

SEQ ID NO: 402994 - RNA, 32 nt, Human
cugaggucaggcguuugagaccagccuggcca

SEQ ID NO: 402995 - RNA, 32 nt, Human
cugaggucaggggcucaagaccagccuggcca

SEQ ID NO: 402996 - RNA, 21 nt, Human
cugaggucagggguucaagac

SEQ ID NO: 402997 - RNA, 32 nt, Human
cugaggucagggguucaagaccagccuggcca

SEQ ID NO: 402998 - RNA, 32 nt, Human
cugaggucagggguuccagaccagccuggcca

SEQ ID NO: 402999 - RNA, 32 nt, Human
cugaggucagggguucgacaccagccuggcca

SEQ ID NO: 403000 - RNA, 32 nt, Human
cugaggucagggguucgagaccagccuggcca

SEQ ID NO: 403001 - RNA, 32 nt, Human
cugaggucaguaguucaagaccacccuggcca

SEQ ID NO: 403002 - RNA, 32 nt, Human
cugaggucaugaguucgagaccagccuggcca

SEQ ID NO: 403003 - RNA, 32 nt, Human
cugagguccagccaccaccaggcugagcagug

SEQ ID NO: 403004 - RNA, 32 nt, Human
cugaggucccugcaagugcacagggaggagag

SEQ ID NO: 403005 - RNA, 32 nt, Human
cugagguccggaguucgagaccagccuggcca

SEQ ID NO: 403006 - RNA, 32 nt, Human
cugagguccugggaaggacaugaauuuugggg

SEQ ID NO: 403007 - RNA, 32 nt, Human
cugaggucgaaaguuugagaccagccuggccc

SEQ ID NO: 403008 - RNA, 32 nt, Human
cugaggucggaaguucgagaccagccugacca

SEQ ID NO: 403009 - RNA, 32 nt, Human
cugaggucggcggacugccugaggucaggaau

SEQ ID NO: 403010 - RNA, 24 nt, Human
cugaggucggcggaucacaggguc

SEQ ID NO: 403011 - RNA, 32 nt, Human
cugaggucgggaauucgagaccagccugacca

SEQ ID NO: 403012 - RNA, 32 nt, Human
cugaggucgggagcgcgagaccagccugacca

SEQ ID NO: 403013 - RNA, 32 nt, Human
cugaggucgggagcucgagaccagccugacca

SEQ ID NO: 403014 - RNA, 21 nt, Human
cugaggucgggaguucaagac

SEQ ID NO: 403015 - RNA, 32 nt, Human
cugaggucgggaguucaagaccagccugacca

SEQ ID NO: 403016 - RNA, 32 nt, Human
cugaggucgggaguucaagaccagccugauga

SEQ ID NO: 403017 - RNA, 32 nt, Human
cugaggucgggaguucaagaccagccuggcca

SEQ ID NO: 403018 - RNA, 32 nt, Human
cugaggucgggaguucacaaccagccugacca

SEQ ID NO: 403019 - RNA, 32 nt, Human
cugaggucgggaguuccagaccagccuggcca

SEQ ID NO: 403020 - RNA, 32 nt, Human
cugaggucgggaguucgaaaccagccugacca

SEQ ID NO: 403021 - RNA, 32 nt, Human
cugaggucgggaguucgagaccagccugacca

SEQ ID NO: 403022 - RNA, 32 nt, Human
cugaggucgggaguucgagaccagccuggcca

SEQ ID NO: 403023 - RNA, 32 nt, Human
cugaggucgggaguucgagaccagccuuacca

SEQ ID NO: 403024 - RNA, 32 nt, Human
cugaggucgggaguucuagaccagccugacca

SEQ ID NO: 403025 - RNA, 32 nt, Human
cugaggucgggaguuggagaccagccugacca

SEQ ID NO: 403026 - RNA, 32 nt, Human
cugaggucgggaguuugagaccagccugacca

SEQ ID NO: 403027 - RNA, 32 nt, Human
cugaggucgggaguuugagaccagccuggcca

SEQ ID NO: 403028 - RNA, 32 nt, Human
cugaggucgggauuuugagaccagccugacca

SEQ ID NO: 403029 - RNA, 32 nt, Human
cugaggucuagaaaggaggaguugagagcagg

SEQ ID NO: 403030 - RNA, 32 nt, Human
cugaggucucucuuggccuggaagaauaacac

SEQ ID NO: 403031 - RNA, 32 nt, Human
cugaggucucuuccagcccucagucugagguu

SEQ ID NO: 403032 - RNA, 32 nt, Human
cugaggucuggaguucaagaccagccuggcca

SEQ ID NO: 403033 - RNA, 32 nt, Human
cugaggucuggaguuugagaccagccuggcca

SEQ ID NO: 403034 - RNA, 32 nt, Human
cugaggucuuccaugacuugccuagucuccca

SEQ ID NO: 403035 - RNA, 32 nt, Human
cugaggugaauagcagucacagagccaucaaa

SEQ ID NO: 403036 - RNA, 32 nt, Human
cugaggugacagccucacagggucugguacca

SEQ ID NO: 403037 - RNA, 32 nt, Human
cugaggugagagaucuuuugagcccaggaauu

SEQ ID NO: 403038 - RNA, 32 nt, Human
cugaggugaggaguucaagaccagccugccca

SEQ ID NO: 403039 - RNA, 24 nt, Human
cugaggugaguggauuacaagguc

SEQ ID NO: 403040 - RNA, 32 nt, Human
cugaggugcagcaugucuagacugggagcccu

SEQ ID NO: 403041 - RNA, 32 nt, Human
cugaggugccccucuguccuccagcagggcac

SEQ ID NO: 403042 - RNA, 32 nt, Human
cugagguggacggaucaccugaggucaggagu

SEQ ID NO: 403043 - RNA, 24 nt, Human
cugagguggacggaucacgagguc

SEQ ID NO: 403044 - RNA, 32 nt, Human
cugagguggacggaucauuugaggucaggagu

SEQ ID NO: 403045 - RNA, 32 nt, Human
cugagguggcuucucauuaaccccuuaggacu

SEQ ID NO: 403046 - RNA, 23 nt, Human
cugaggugggagaaucgcuugag

SEQ ID NO: 403047 - RNA, 32 nt, Human
cugaggugggaggaucaccugaggucgggagu

SEQ ID NO: 403048 - RNA, 24 nt, Human
cugaggugggaggaucacuugaga

SEQ ID NO: 403049 - RNA, 23 nt, Human
cugaggugggaggaucgcuugag

SEQ ID NO: 403050 - RNA, 24 nt, Human
cugaggugggcaaaucacaagguc

SEQ ID NO: 403051 - RNA, 32 nt, Human
cugaggugggcaaaucaccugaggucaggagu

SEQ ID NO: 403052 - RNA, 24 nt, Human
cugaggugggcagaucacaagguc

SEQ ID NO: 403053 - RNA, 24 nt, Human
cugaggugggcagaucaccugaga

SEQ ID NO: 403054 - RNA, 32 nt, Human
cugaggugggcagaucaccugagaucgggagu

SEQ ID NO: 403055 - RNA, 32 nt, Human
cugaggugggcagaucaccugaggucaggaau

SEQ ID NO: 403056 - RNA, 32 nt, Human
cugaggugggcagaucaccugagguugggagu

SEQ ID NO: 403057 - RNA, 24 nt, Human
cugaggugggcagaucacgagguc

SEQ ID NO: 403058 - RNA, 32 nt, Human
cugaggugggcagaucacuugaggucaggagu

SEQ ID NO: 403059 - RNA, 32 nt, Human
cugaggugggcagaucaguugaggucaggagu

SEQ ID NO: 403060 - RNA, 32 nt, Human
cugaggugggcauaucaccugaggucagcagu

SEQ ID NO: 403061 - RNA, 24 nt, Human
cugaggugggcgaaucacaagguc

SEQ ID NO: 403062 - RNA, 32 nt, Human
cugaggugggcgcaucaccugaggucaggagu

SEQ ID NO: 403063 - RNA, 24 nt, Human
cugaggugggcggaucacaaguuc

SEQ ID NO: 403064 - RNA, 32 nt, Human
cugaggugggcggaucaccugaggucaggagc

SEQ ID NO: 403065 - RNA, 32 nt, Human
cugaggugggcggaucaccugaggucaggagu

SEQ ID NO: 403066 - RNA, 32 nt, Human
cugaggugggcggaucaccugaguucaggagu

SEQ ID NO: 403067 - RNA, 24 nt, Human
cugaggugggcggaucacgagguc

SEQ ID NO: 403068 - RNA, 32 nt, Human
cugaggugggcggaucacuugaggucaggagu

SEQ ID NO: 403069 - RNA, 32 nt, Human
cugagguggggaaagcaagcaccuacaugaca

SEQ ID NO: 403070 - RNA, 24 nt, Human
cugagguggguggaucacaagguc

SEQ ID NO: 403071 - RNA, 23 nt, Human
cugagguggguggaucacagguc

SEQ ID NO: 403072 - RNA, 24 nt, Human
cugagguggguggaucaccagguc

SEQ ID NO: 403073 - RNA, 32 nt, Human
cugagguggguggaucaccugaagucagaagu

SEQ ID NO: 403074 - RNA, 32 nt, Human
cugagguggguggaucaccugagaccagcuug

SEQ ID NO: 403075 - RNA, 32 nt, Human
cugagguggguggaucaccugaggucaggagc

SEQ ID NO: 403076 - RNA, 32 nt, Human
cugagguggguggaucaccugaggucaggagu

SEQ ID NO: 403077 - RNA, 32 nt, Human
cugagguggguggaucacuugaggucaggagc

SEQ ID NO: 403078 - RNA, 32 nt, Human
cugagguggguggaucacuugaggucaggagu

SEQ ID NO: 403079 - RNA, 32 nt, Human
cugagguggguggaucagcugaggucaggagu

SEQ ID NO: 403080 - RNA, 32 nt, Human
cugagguggguggaucaucugaggucaggagu

SEQ ID NO: 403081 - RNA, 32 nt, Human
cugagguggguggaucgccugaggucgggggu

SEQ ID NO: 403082 - RNA, 31 nt, Human
cugagguggguggaugccgaggugaguggau

SEQ ID NO: 403083 - RNA, 32 nt, Human
cugagguggguggauuacuugaggucaggagu

SEQ ID NO: 403084 - RNA, 32 nt, Human
cugagguggguggauugccugaggucaggagu

SEQ ID NO: 403085 - RNA, 32 nt, Human
cugagguggguguaucaccugaaguccggagu

SEQ ID NO: 403086 - RNA, 32 nt, Human
cugagguggguguaucaccugaggucgggagu

SEQ ID NO: 403087 - RNA, 32 nt, Human
cugagguggguguaucacuugaggucaggagu

SEQ ID NO: 403088 - RNA, 32 nt, Human
cugaggugguaggaggacgacccuggaaaugg

SEQ ID NO: 403089 - RNA, 32 nt, Human
cugaggugguaggaucaccugaggucaggagu

SEQ ID NO: 403090 - RNA, 32 nt, Human
cugagguggugaggagagacugaaggcuuugc

SEQ ID NO: 403091 - RNA, 22 nt, Human
cugagguguacauaguccuucc

SEQ ID NO: 403092 - RNA, 32 nt, Human
cugaggugucaaguccugccuuuccuuucauc

SEQ ID NO: 403093 - RNA, 32 nt, Human
cugagguguccuggaaaggccuggaaggugca

SEQ ID NO: 403094 - RNA, 31 nt, Human
cugagguguuagaaaacuugaucuguggugu

SEQ ID NO: 403095 - RNA, 32 nt, Human
cugagguuaagaguucaagaccagccuggcca

SEQ ID NO: 403096 - RNA, 32 nt, Human
cugagguuacaggcaccaugagccaggacacc

SEQ ID NO: 403097 - RNA, 32 nt, Human
cugagguuagaaguuugagaccagccuggcca

SEQ ID NO: 403098 - RNA, 32 nt, Human
cugagguuaggacuucaagaccagccuggcca

SEQ ID NO: 403099 - RNA, 32 nt, Human
cugagguuaggaguucaagaccagccugauca

SEQ ID NO: 403100 - RNA, 32 nt, Human
cugagguuaggaguucaagaccagccuggcca

SEQ ID NO: 403101 - RNA, 32 nt, Human
cugagguuaggaguuccagaccagccuggcca

SEQ ID NO: 403102 - RNA, 32 nt, Human
cugagguuaggaguucgagaccagccugacca

SEQ ID NO: 403103 - RNA, 32 nt, Human
cugagguuaggaguucgagaccagccugccca

SEQ ID NO: 403104 - RNA, 32 nt, Human
cugagguuaggaguucgagaccagccuggcca

SEQ ID NO: 403105 - RNA, 32 nt, Human
cugagguuaggaguuugagaccagccugacca

SEQ ID NO: 403106 - RNA, 32 nt, Human
cugagguuaggaguuugagaccagccuggcca

SEQ ID NO: 403107 - RNA, 32 nt, Human
cugagguuagugugcuuggaggcugcaggacg

SEQ ID NO: 403108 - RNA, 32 nt, Human
cugagguucugcuguugaguccuggguggcug

SEQ ID NO: 403109 - RNA, 32 nt, Human
cugagguugcagugagcugagaucaggcacuu

SEQ ID NO: 403110 - RNA, 32 nt, Human
cugagguuggcgacugucuacacuccuccccc

SEQ ID NO: 403111 - RNA, 32 nt, Human
cugagguugggaguuaaagaccagccugaccg

SEQ ID NO: 403112 - RNA, 32 nt, Human
cugagguugggaguucaagaccagccugacca

SEQ ID NO: 403113 - RNA, 32 nt, Human
cugagguugggaguucaagaccagccuggcca

SEQ ID NO: 403114 - RNA, 32 nt, Human
cugagguugggaguucaagaccagccugguca

SEQ ID NO: 403115 - RNA, 32 nt, Human
cugagguugggaguucgagaccagccugacca

SEQ ID NO: 403116 - RNA, 32 nt, Human
cugagguugggaguucgaggccagccugacca

SEQ ID NO: 403117 - RNA, 32 nt, Human
cugagguugggauuugcuguguuccugggcag

SEQ ID NO: 403118 - RNA, 32 nt, Human
cugagguuggggucaaugccuccugggcaccc

SEQ ID NO: 403119 - RNA, 32 nt, Human
cugagguugguucagaggccagccugcauagc

SEQ ID NO: 403120 - RNA, 32 nt, Human
cugagguuuaccuggaucuggcuacugaggcu

SEQ ID NO: 403121 - RNA, 32 nt, Human
cugagguuuuagaagcuaggaggcaggaaaau

SEQ ID NO: 403122 - RNA, 32 nt, Human
cugaguaaacacucaauaaauggugauuguua

SEQ ID NO: 403123 - RNA, 31 nt, Human
cugaguaaaggagacacucagaugcuacuca

SEQ ID NO: 403124 - RNA, 22 nt, Human
cugaguaacauggugaaacccc

SEQ ID NO: 403125 - RNA, 32 nt, Human
cugaguaacauggugaaaccccaucucuacga

SEQ ID NO: 403126 - RNA, 21 nt, Human
cugaguaacugggacuacagg

SEQ ID NO: 403127 - RNA, 32 nt, Human
cugaguacaguacucuuugucauuucauauug

SEQ ID NO: 403128 - RNA, 32 nt, Human
cugaguacaguccuggggguaaggggaugaca

SEQ ID NO: 403129 - RNA, 32 nt, Human
cugaguaccauccuggaugaaucuagaaggua

SEQ ID NO: 403130 - RNA, 32 nt, Human
cugaguaccucuccaccauccuccagucguug

SEQ ID NO: 403131 - RNA, 32 nt, Human
cugaguaccugacuucucaggacugacaccua

SEQ ID NO: 403132 - RNA, 21 nt, Human
cugaguaccugggacuacagg

SEQ ID NO: 403133 - RNA, 32 nt, Human
cugaguacugagaacccagaggacagagccca

SEQ ID NO: 403134 - RNA, 32 nt, Human
cugaguacugagccacugugcccaggcugugg

SEQ ID NO: 403135 - RNA, 32 nt, Human
cugaguacugccucaucugcugugcugugcug

SEQ ID NO: 403136 - RNA, 32 nt, Human
cugaguagagaccacaccacugcacuccugcc

SEQ ID NO: 403137 - RNA, 21 nt, Human
cugaguagaugggacuacagg

SEQ ID NO: 403138 - RNA, 21 nt, Human
cugaguagccgggacuacagg

SEQ ID NO: 403139 - RNA, 21 nt, Human
cugaguagcuaggacuacagg

SEQ ID NO: 403140 - RNA, 21 nt, Human
cugaguagcuaggacugcagg

SEQ ID NO: 403141 - RNA, 21 nt, Human
cugaguagcuaggacuguagg

SEQ ID NO: 403142 - RNA, 21 nt, Human
cugaguagcugagacuacagg

SEQ ID NO: 403143 - RNA, 32 nt, Human
cugaguagcugcagaggccuuggguccaggcu

SEQ ID NO: 403144 - RNA, 21 nt, Human
cugaguagcugcgacuacagg

SEQ ID NO: 403145 - RNA, 21 nt, Human
cugaguagcuggaacuacagg

SEQ ID NO: 403146 - RNA, 20 nt, Human
cugaguagcuggaacugcag

SEQ ID NO: 403147 - RNA, 21 nt, Human
cugaguagcugggaccacagg

SEQ ID NO: 403148 - RNA, 21 nt, Human
cugaguagcugggaccauagg

SEQ ID NO: 403149 - RNA, 21 nt, Human
cugaguagcugggacgacagg

SEQ ID NO: 403150 - RNA, 21 nt, Human
cugaguagcugggacuaaagg

SEQ ID NO: 403151 - RNA, 20 nt, Human
cugaguagcugggacuacag

SEQ ID NO: 403152 - RNA, 21 nt, Human
cugaguagcugggacuacagg

SEQ ID NO: 403153 - RNA, 21 nt, Human
cugaguagcugggacuagagg

SEQ ID NO: 403154 - RNA, 21 nt, Human
cugaguagcugggacuauagg

SEQ ID NO: 403155 - RNA, 20 nt, Human
cugaguagcugggacugcag

SEQ ID NO: 403156 - RNA, 21 nt, Human
cugaguagcugggacugcagg

SEQ ID NO: 403157 - RNA, 21 nt, Human
cugaguagcugggaguacagg

SEQ ID NO: 403158 - RNA, 21 nt, Human
cugaguagcugggaucacagg

SEQ ID NO: 403159 - RNA, 21 nt, Human
cugaguagcugggauuacagg

SEQ ID NO: 403160 - RNA, 21 nt, Human
cugaguagcugggauugcagg

SEQ ID NO: 403161 - RNA, 21 nt, Human
cugaguagcuggggcuacagg

SEQ ID NO: 403162 - RNA, 32 nt, Human
cugaguaggaaggcaucuccugacuuucacuc

SEQ ID NO: 403163 - RNA, 32 nt, Human
cugaguagguggacaaauauccucacuuucua

SEQ ID NO: 403164 - RNA, 32 nt, Human
cugaguaguuaucacugugucugccucuguua

SEQ ID NO: 403165 - RNA, 32 nt, Human
cugaguaguuucagcaguuucaaaugacugag

SEQ ID NO: 403166 - RNA, 32 nt, Human
cugagucaaggugggagcagggucgguagcuu

SEQ ID NO: 403167 - RNA, 32 nt, Human
cugagucacagccaccuccccaccuccccgca

SEQ ID NO: 403168 - RNA, 32 nt, Human
cugagucaccacugacuguugcccugggcaua

SEQ ID NO: 403169 - RNA, 32 nt, Human
cugagucacccgaggagguggcagugcaagac

SEQ ID NO: 403170 - RNA, 20 nt, Human
cugagucacggucugugagg

SEQ ID NO: 403171 - RNA, 32 nt, Human
cugagucacuugucuaaaaaguagccucaggu

SEQ ID NO: 403172 - RNA, 32 nt, Human
cugagucagaaacucuggaauagggcccccgc

SEQ ID NO: 403173 - RNA, 32 nt, Human
cugagucaggacaccuggcuucuugaaaaguu

SEQ ID NO: 403174 - RNA, 32 nt, Human
cugagucaggagguugaggcugcagugagcua

SEQ ID NO: 403175 - RNA, 32 nt, Human
cugagucauagaggauacagacuugcccaaag

SEQ ID NO: 403176 - RNA, 32 nt, Human
cugagucauuuaguagcugccugggugaucaa

SEQ ID NO: 403177 - RNA, 32 nt, Human
cugagucauuuauuuuccuuagcuuuuuccac

SEQ ID NO: 403178 - RNA, 32 nt, Human
cugagucauuuugccaaugucgucuucaguuu

SEQ ID NO: 403179 - RNA, 32 nt, Human
cugaguccaaacccuugugccucccaguucuu

SEQ ID NO: 403180 - RNA, 32 nt, Human
cugaguccaggaggucgaggcugcagugagcc

SEQ ID NO: 403181 - RNA, 21 nt, Human
cugaguccauauacuugucua

SEQ ID NO: 403182 - RNA, 32 nt, Human
cugagucccacacauucucugagaccacagca

SEQ ID NO: 403183 - RNA, 32 nt, Human
cugagucccaggcugagccucagucucccucc

SEQ ID NO: 403184 - RNA, 23 nt, Human
cugaguccccaaaccugcacuag

SEQ ID NO: 403185 - RNA, 22 nt, Human
cugagucccucacagagacuca

SEQ ID NO: 403186 - RNA, 32 nt, Human
cugaguccgacaaccauugggguggggcugca

SEQ ID NO: 403187 - RNA, 32 nt, Human
cugaguccggagcagacugagccaccuaagag

SEQ ID NO: 403188 - RNA, 32 nt, Human
cugaguccuaucucucucugauguuccccagu

SEQ ID NO: 403189 - RNA, 32 nt, Human
cugaguccucaggugacuggggacuuggaacc

SEQ ID NO: 403190 - RNA, 32 nt, Human
cugaguccuccacucgcaucucccuccccugc

SEQ ID NO: 403191 - RNA, 32 nt, Human
cugaguccucugcaugaguucugcaccccaag

SEQ ID NO: 403192 - RNA, 32 nt, Human
cugaguccugggugccguauguguaugcggca

SEQ ID NO: 403193 - RNA, 32 nt, Human
cugaguccuugaaucacuagguuuugcuaucu

SEQ ID NO: 403194 - RNA, 32 nt, Human
cugagucgcacagucucucccacccgaaugcc

SEQ ID NO: 403195 - RNA, 32 nt, Human
cugagucgggauggagcugccugcugugaacc

SEQ ID NO: 403196 - RNA, 32 nt, Human
cugagucgggcggaucacaugaggucaggagu

SEQ ID NO: 403197 - RNA, 32 nt, Human
cugagucgggcuggagaagcugggcagccugg

SEQ ID NO: 403198 - RNA, 32 nt, Human
cugagucuaagaguuugagaccagccugggca

SEQ ID NO: 403199 - RNA, 32 nt, Human
cugagucucacgcugcagcccagagcuaggac

SEQ ID NO: 403200 - RNA, 32 nt, Human
cugagucucccaggacccccuuuggagaugcc

SEQ ID NO: 403201 - RNA, 32 nt, Human
cugagucucccaggcccccuugaucuguaccc

SEQ ID NO: 403202 - RNA, 32 nt, Human
cugagucuccucuucugcuccuagccaccagu

SEQ ID NO: 403203 - RNA, 32 nt, Human
cugagucucguggccgccccuggaccagugau

SEQ ID NO: 403204 - RNA, 32 nt, Human
cugagucucugccucugccucucccuuccaag

SEQ ID NO: 403205 - RNA, 32 nt, Human
cugagucugcgguucucgccugggcagucuug

SEQ ID NO: 403206 - RNA, 32 nt, Human
cugagucuggcccagcagaggcugcaacugga

SEQ ID NO: 403207 - RNA, 32 nt, Human
cugagucugggacuucugccuccauggcuggu

SEQ ID NO: 403208 - RNA, 32 nt, Human
cugagucugggcuccgcaccucccuggggacc

SEQ ID NO: 403209 - RNA, 32 nt, Human
cugagucugguccauugcuaccccaauucucu

SEQ ID NO: 403210 - RNA, 32 nt, Human
cugagucugugagcuucuuacauggcuccaaa

SEQ ID NO: 403211 - RNA, 32 nt, Human
cugagucuguggacacuguggaaagcuuugaa

SEQ ID NO: 403212 - RNA, 32 nt, Human
cugagucuucuccaagcaaaacaacuccacuu

SEQ ID NO: 403213 - RNA, 32 nt, Human
cugagucuuggcacgaguguccuggccaggac

SEQ ID NO: 403214 - RNA, 32 nt, Human
cugagucuuggugagcagacaugggaauccga

SEQ ID NO: 403215 - RNA, 32 nt, Human
cugagucuuguccuugccugauucccaucugc

SEQ ID NO: 403216 - RNA, 32 nt, Human
cugagucuuuauuuggaaaaugguuuccagcu

SEQ ID NO: 403217 - RNA, 32 nt, Human
cugagucuuuuucugucuauccaucuguuuau

SEQ ID NO: 403218 - RNA, 32 nt, Human
cugagugacguaggcucugagauagcugucca

SEQ ID NO: 403219 - RNA, 32 nt, Human
cugagugacuggagacagggaugauggagagu

SEQ ID NO: 403220 - RNA, 32 nt, Human
cugagugagccagcugggcuccugggucuagu

SEQ ID NO: 403221 - RNA, 32 nt, Human
cugagugagccccagcccgccccugcaguucc

SEQ ID NO: 403222 - RNA, 32 nt, Human
cugagugaggagugcccaggagagauggugaa

SEQ ID NO: 403223 - RNA, 32 nt, Human
cugagugaugcaugagguagguguuccgagua

SEQ ID NO: 403224 - RNA, 32 nt, Human
cugagugaugcaugagguagguguucugagua

SEQ ID NO: 403225 - RNA, 32 nt, Human
cugagugcacacaccacaguguaaauuaugcc

SEQ ID NO: 403226 - RNA, 32 nt, Human
cugagugcaccaggcuguacccguuagauccu

SEQ ID NO: 403227 - RNA, 32 nt, Human
cugagugcagugagccaagaccaugccauuac

SEQ ID NO: 403228 - RNA, 32 nt, Human
cugagugcaguggcagaaucauagcucagugc

SEQ ID NO: 403229 - RNA, 32 nt, Human
cugagugccagcaucuuccagcaccagaggag

SEQ ID NO: 403230 - RNA, 32 nt, Human
cugagugcccagggugucuccucugcccagag

SEQ ID NO: 403231 - RNA, 32 nt, Human
cugagugccccagggagggcaggcugggugag

SEQ ID NO: 403232 - RNA, 32 nt, Human
cugagugccgguccccuggacccacuguuguu

SEQ ID NO: 403233 - RNA, 32 nt, Human
cugagugccuggcuuugugagacacuguacaa

SEQ ID NO: 403234 - RNA, 32 nt, Human
cugagugccuguccccuggacccacuguuguc

SEQ ID NO: 403235 - RNA, 32 nt, Human
cugagugccuuuuucuccuuaaggaggccugc

SEQ ID NO: 403236 - RNA, 32 nt, Human
cugagugcgguggcuuacaccuguaaucccag

SEQ ID NO: 403237 - RNA, 32 nt, Human
cugagugcuacuugaagauauguagagauucc

SEQ ID NO: 403238 - RNA, 32 nt, Human
cugagugcugcacaucaugggcucugucugug

SEQ ID NO: 403239 - RNA, 32 nt, Human
cugagugcugggaggaggcugcaguacuccug

SEQ ID NO: 403240 - RNA, 32 nt, Human
cugagugcuguggcucacaccuguaaucccag

SEQ ID NO: 403241 - RNA, 32 nt, Human
cugaguggaagagagcgcagcccggccaccgg

SEQ ID NO: 403242 - RNA, 32 nt, Human
cugaguggagccaggcuggcccagagcugaga

SEQ ID NO: 403243 - RNA, 32 nt, Human
cugaguggagggagccacugagcacagcaagg

SEQ ID NO: 403244 - RNA, 32 nt, Human
cugaguggauggaucacuugaggucaggaguu

SEQ ID NO: 403245 - RNA, 32 nt, Human
cugaguggccacugccaagcugcggggaaggg

SEQ ID NO: 403246 - RNA, 17 nt, Human
cugaguggcccuggaca

SEQ ID NO: 403247 - RNA, 32 nt, Human
cugaguggccuggaacuuguuuaaaguguuua

SEQ ID NO: 403248 - RNA, 32 nt, Human
cugaguggcugccaaggcacucacagaaucau

SEQ ID NO: 403249 - RNA, 21 nt, Human
cugaguggcugggacugcagg

SEQ ID NO: 403250 - RNA, 32 nt, Human
cugaguggcugggacugcaggagcaugccauc

SEQ ID NO: 403251 - RNA, 32 nt, Human
cugagugggaugaccgcuugagcccaggauuu

SEQ ID NO: 403252 - RNA, 32 nt, Human
cugagugggccggggaggcugggagccggcgg

SEQ ID NO: 403253 - RNA, 32 nt, Human
cugagugggcugggaucucguguccucaaagu

SEQ ID NO: 403254 - RNA, 32 nt, Human
cugaguggggagagguugggcagugagugagg

SEQ ID NO: 403255 - RNA, 32 nt, Human
cugaguggggcagaucacuugaggucaggagu

SEQ ID NO: 403256 - RNA, 32 nt, Human
cugagugggugggccaccuccugcggcaggua

SEQ ID NO: 403257 - RNA, 32 nt, Human
cugaguggucaggagccaguuucuccagcccc

SEQ ID NO: 403258 - RNA, 32 nt, Human
cugaguguccggcacacagaagacauuagaga

SEQ ID NO: 403259 - RNA, 32 nt, Human
cugagugucggcaucagcacugagcuagacau

SEQ ID NO: 403260 - RNA, 32 nt, Human
cugagugugaugaagguguauguugggaggga

SEQ ID NO: 403261 - RNA, 32 nt, Human
cugagugugcacaagcagugaagaggauccag

SEQ ID NO: 403262 - RNA, 32 nt, Human
cugagugugccuguaaucucagcacuuugagg

SEQ ID NO: 403263 - RNA, 32 nt, Human
cugaguguggugaguggagcauuuucccuggc

SEQ ID NO: 403264 - RNA, 32 nt, Human
cugaguguggugcuggggaaggcaugugcuug

SEQ ID NO: 403265 - RNA, 32 nt, Human
cugagugugguggcgcaugccuguaaucccag

SEQ ID NO: 403266 - RNA, 32 nt, Human
cugagugugguggcucacaccuguaaucccag

SEQ ID NO: 403267 - RNA, 32 nt, Human
cugagugugguggcucaugccuguaaucccag

SEQ ID NO: 403268 - RNA, 32 nt, Human
cugagugugguggcucaugccuguaauuccag

SEQ ID NO: 403269 - RNA, 32 nt, Human
cugagugugugaagacagggagagccaggccc

SEQ ID NO: 403270 - RNA, 32 nt, Human
cugaguguuggagcuuggcugaagacauguuu

SEQ ID NO: 403271 - RNA, 32 nt, Human
cugaguguuugcugugcuccaggcucaguaca

SEQ ID NO: 403272 - RNA, 32 nt, Human
cugaguguuuuuauuaauuacuuuuuggcuau

SEQ ID NO: 403273 - RNA, 32 nt, Human
cugaguuaaagcaguuuacuagacucagcuug

SEQ ID NO: 403274 - RNA, 32 nt, Human
cugaguuaucuagaugaucccugagauuugaa

SEQ ID NO: 403275 - RNA, 18 nt, Human
cugaguucaaagcaggug

SEQ ID NO: 403276 - RNA, 32 nt, Human
cugaguucaagaccagccugggcaacguggug

SEQ ID NO: 403277 - RNA, 32 nt, Human
cugaguucaagcaauccuucugucucagucuc

SEQ ID NO: 403278 - RNA, 32 nt, Human
cugaguucaagcaguccuccugcuucaacaua

SEQ ID NO: 403279 - RNA, 32 nt, Human
cugaguucaagccauucuccuaccucagccuc

SEQ ID NO: 403280 - RNA, 32 nt, Human
cugaguucaagucauucuccugccucagccuc

SEQ ID NO: 403281 - RNA, 32 nt, Human
cugaguucaagugauuccugugccucagucuc

SEQ ID NO: 403282 - RNA, 32 nt, Human
cugaguucacgccauucuacugccucagccuc

SEQ ID NO: 403283 - RNA, 32 nt, Human
cugaguucacgugcuaaagucauuucacugua

SEQ ID NO: 403284 - RNA, 32 nt, Human
cugaguucaggaguucaagaccagccuggcca

SEQ ID NO: 403285 - RNA, 32 nt, Human
cugaguucaggaguucgagaccagccuggcca

SEQ ID NO: 403286 - RNA, 32 nt, Human
cugaguucaggaguucgagaccagccugggcg

SEQ ID NO: 403287 - RNA, 32 nt, Human
cugaguucaggaguuugagaccagccugggca

SEQ ID NO: 403288 - RNA, 32 nt, Human
cugaguuccagaaaaaucaacuacauuaaaau

SEQ ID NO: 403289 - RNA, 32 nt, Human
cugaguuccagagagggaggacccuggggugg

SEQ ID NO: 403290 - RNA, 32 nt, Human
cugaguucccacucaccuguguagagugccau

SEQ ID NO: 403291 - RNA, 32 nt, Human
cugaguuccggggugcaaugggggagggaggg

SEQ ID NO: 403292 - RNA, 32 nt, Human
cugaguuccuaaugcucagaacauggaugaga

SEQ ID NO: 403293 - RNA, 32 nt, Human
cugaguuccucccuccugggaagcuggguugg

SEQ ID NO: 403294 - RNA, 32 nt, Human
cugaguucgagaccagccuaaccaacauggag

SEQ ID NO: 403295 - RNA, 32 nt, Human
cugaguucgggaguucaagaccagccugacca

SEQ ID NO: 403296 - RNA, 32 nt, Human
cugaguucuaacuccuugguugcuuaaaagua

SEQ ID NO: 403297 - RNA, 32 nt, Human
cugaguucuggaccuacccccacgugguguaa

SEQ ID NO: 403298 - RNA, 32 nt, Human
cugaguucuggucaaagaaagaaaguuuagaa

SEQ ID NO: 403299 - RNA, 32 nt, Human
cugaguugaugggaccaacagggcuuugcucc

SEQ ID NO: 403300 - RNA, 32 nt, Human
cugaguugggcagaucaccugagaucaggagu

SEQ ID NO: 403301 - RNA, 32 nt, Human
cugaguugggcggaucacuugaggucaggaau

SEQ ID NO: 403302 - RNA, 32 nt, Human
cugaguuggguacagggcuggggaggaaucag

SEQ ID NO: 403303 - RNA, 31 nt, Human
cugaguuggguggaaggugcugagagugugg

SEQ ID NO: 403304 - RNA, 32 nt, Human
cugaguuuagagucugcaaggcuugacaacca

SEQ ID NO: 403305 - RNA, 32 nt, Human
cugaguuuccaaaaucaaagauuugaccuuaa

SEQ ID NO: 403306 - RNA, 32 nt, Human
cugaguuuccccuggccaaggcugcagacaag

SEQ ID NO: 403307 - RNA, 32 nt, Human
cugaguuuccuugucucuacaaaggaguuagu

SEQ ID NO: 403308 - RNA, 32 nt, Human
cugaguuucgcuguuccagucuggaccucuuu

SEQ ID NO: 403309 - RNA, 31 nt, Human
cugaguuugaaggauguuuauauaggguagg

SEQ ID NO: 403310 - RNA, 32 nt, Human
cugaguuugcgggacugcccugagaugcuaca

SEQ ID NO: 403311 - RNA, 32 nt, Human
cugaguuugguucauuuauuccagcugcaaua

SEQ ID NO: 403312 - RNA, 32 nt, Human
cugaguuuguacaggcaaguccugggcugggu

SEQ ID NO: 403313 - RNA, 32 nt, Human
cugaguuuguagaaaguggcagaugcuguucu

SEQ ID NO: 403314 - RNA, 32 nt, Human
cugaguuuucagagugugaggaagggagggac

SEQ ID NO: 403315 - RNA, 32 nt, Human
cugaguuuugacuccaaucagugauaccagac

SEQ ID NO: 403316 - RNA, 32 nt, Human
cugaguuuugccaaauguuaaagggagaagag

SEQ ID NO: 403317 - RNA, 32 nt, Human
cugauaaaggaaugacuagaguaguacaccua

SEQ ID NO: 403318 - RNA, 32 nt, Human
cugauaaaggacagagugaaccucaagggguu

SEQ ID NO: 403319 - RNA, 32 nt, Human
cugauaaauauucacacuugaaccauaguuac

SEQ ID NO: 403320 - RNA, 32 nt, Human
cugauaacuggugaagccuacagccauccgcc

SEQ ID NO: 403321 - RNA, 32 nt, Human
cugauaagaacccaggguggagagggagacuc

SEQ ID NO: 403322 - RNA, 23 nt, Human
cugcccuguugcucugcccugca

SEQ ID NO: 403323 - RNA, 31 nt, Human
cugcccuguuggcagaggccugugucugugc

SEQ ID NO: 403324 - RNA, 32 nt, Human
cugcccuuaauugacacuccuauuuauuucau

SEQ ID NO: 403325 - RNA, 26 nt, Human
cugcccuuaucaaccugggucccuca

SEQ ID NO: 403326 - RNA, 18 nt, Human
cugcccuucacugggcca

SEQ ID NO: 403327 - RNA, 32 nt, Human
cugcccuuccaaggagcuucugcugcugcucc

SEQ ID NO: 403328 - RNA, 32 nt, Human
cugcccuuccugggcccugccucuccaugccu

SEQ ID NO: 403329 - RNA, 18 nt, Human
cugcccuuccugucucca

SEQ ID NO: 403330 - RNA, 32 nt, Human
cugcccuucgcuucuguccucccuggcuucuc

SEQ ID NO: 403331 - RNA, 32 nt, Human
cugcccuucgcuugaggcaaaaggacucuugu

SEQ ID NO: 403332 - RNA, 32 nt, Human
cugcccuucuccacuccucucuuggauccgcc

SEQ ID NO: 403333 - RNA, 32 nt, Human
cugcccuucuccccacucccaucugauuuacu

SEQ ID NO: 403334 - RNA, 32 nt, Human
cugcccuucuccguuccagccuggacagagaa

SEQ ID NO: 403335 - RNA, 32 nt, Human
cugcccuucucuccucccucucaucccagaga

SEQ ID NO: 403336 - RNA, 32 nt, Human
cugcccuucucuugcugccuccugggcagggc

SEQ ID NO: 403337 - RNA, 32 nt, Human
cugcccuucugcccucuccccucccugccccu

SEQ ID NO: 403338 - RNA, 19 nt, Human
cugcccuucugcugagcca

SEQ ID NO: 403339 - RNA, 32 nt, Human
cugcccuucuuugcacgaagccuggccucuug

SEQ ID NO: 403340 - RNA, 32 nt, Human
cugcccuugcuggcccugcccuucccacaggu

SEQ ID NO: 403341 - RNA, 19 nt, Human
cugcccuuggcccugcaag

SEQ ID NO: 403342 - RNA, 32 nt, Human
cugcccuuggucguuccugagugugggccaag

SEQ ID NO: 403343 - RNA, 27 nt, Human
cugcccuuuagucguuuuuguuuugua

SEQ ID NO: 403344 - RNA, 32 nt, Human
cugcccuuucucuccgcuccagccucucccca

SEQ ID NO: 403345 - RNA, 32 nt, Human
cugcccuuucugaaaaggaccccacaggugau

SEQ ID NO: 403346 - RNA, 23 nt, Human
cugccgaacccuccucucacagg

SEQ ID NO: 403347 - RNA, 32 nt, Human
cugccgaagagguggagccaggcaggggccac

SEQ ID NO: 403348 - RNA, 18 nt, Human
cugccgacaccugggcca

SEQ ID NO: 403349 - RNA, 32 nt, Human
cugccgacucccagcccggccaaaaagacaaa

SEQ ID NO: 403350 - RNA, 18 nt, Human
cugccgacucucccgggc

SEQ ID NO: 403351 - RNA, 32 nt, Human
cugccgagcagccaaggcccuguccuuucuug

SEQ ID NO: 403352 - RNA, 32 nt, Human
cugccgagcaggcuccugccaucccccauggg

SEQ ID NO: 403353 - RNA, 32 nt, Human
cugccgagccucugccuccacucucauucaga

SEQ ID NO: 403354 - RNA, 21 nt, Human
cugccgaggcccacugggcca

SEQ ID NO: 403355 - RNA, 20 nt, Human
cugccgaggcuucugggcca

SEQ ID NO: 403356 - RNA, 32 nt, Human
cugccgaguagcugggauuacaggcaugcgcc

SEQ ID NO: 403357 - RNA, 20 nt, Human
cugccgcaugguccugggcc

SEQ ID NO: 403358 - RNA, 24 nt, Human
cugccgcccaaacuggagugcagu

SEQ ID NO: 403359 - RNA, 32 nt, Human
cugccgcccaaacuggagugcaguggcacaau

SEQ ID NO: 403360 - RNA, 32 nt, Human
cugccgcccacacugcagcagccacauccaua

SEQ ID NO: 403361 - RNA, 24 nt, Human
cugccgcccaggcgggagugcagu

SEQ ID NO: 403362 - RNA, 32 nt, Human
cugccgcccaggcgggagugcaguggcagugg

SEQ ID NO: 403363 - RNA, 23 nt, Human
cugccgcccaggcuagagugcag

SEQ ID NO: 403364 - RNA, 24 nt, Human
cugccgcccaggcuagagugcagu

SEQ ID NO: 403365 - RNA, 32 nt, Human
cugccgcccaggcuagagugcaguggcacgac

SEQ ID NO: 403366 - RNA, 24 nt, Human
cugccgcccaggcuggacugcagu

SEQ ID NO: 403367 - RNA, 32 nt, Human
cugccgcccaggcuggacugcagugacacaau

SEQ ID NO: 403368 - RNA, 24 nt, Human
cugccgcccaggcuggagugcagu

SEQ ID NO: 403369 - RNA, 32 nt, Human
cugccgcccaggcuggagugcaguggcgcgau

SEQ ID NO: 403370 - RNA, 17 nt, Human
cugccgccccucgggcc

SEQ ID NO: 403371 - RNA, 18 nt, Human
cugccgccccuugggcua

SEQ ID NO: 403372 - RNA, 20 nt, Human
cugccgcccgagcccggguc

SEQ ID NO: 403373 - RNA, 32 nt, Human
cugccgcccggauccccgccuccugggcggau

SEQ ID NO: 403374 - RNA, 21 nt, Human
cugccgcccgggacccgggcu

SEQ ID NO: 403375 - RNA, 18 nt, Human
cugccgcccucccgggcc

SEQ ID NO: 403376 - RNA, 32 nt, Human
cugccgcccugccgcccugccgcccugccgcc

SEQ ID NO: 403377 - RNA, 32 nt, Human
cugccgcccugccuggcacccacgcuggcucu

SEQ ID NO: 403378 - RNA, 32 nt, Human
cugccgcccugugggagccgcagagccugacg

SEQ ID NO: 403379 - RNA, 22 nt, Human
cugccgccgacaccgccgggcc

SEQ ID NO: 403380 - RNA, 22 nt, Human
cugccgccgccgccaccgccac

SEQ ID NO: 403381 - RNA, 18 nt, Human
cugccgccgccgccgccg

SEQ ID NO: 403382 - RNA, 23 nt, Human
cugccgccuaccccgcccgccac

SEQ ID NO: 403383 - RNA, 20 nt, Human
cugccgccuccuccugggcu

SEQ ID NO: 403384 - RNA, 19 nt, Human
cugccgccucgccgcggcc

SEQ ID NO: 403385 - RNA, 18 nt, Human
cugccgccucuccgagcu

SEQ ID NO: 403386 - RNA, 32 nt, Human
cugccgccucucgccucacgcccccagagaag

SEQ ID NO: 403387 - RNA, 32 nt, Human
cugccgccucuugggacugggggugacggauu

SEQ ID NO: 403388 - RNA, 17 nt, Human
cugccgccugcugggcc

SEQ ID NO: 403389 - RNA, 32 nt, Human
cugccgccugggaaucaggauuccuucuuccc

SEQ ID NO: 403390 - RNA, 21 nt, Human
cugccgccugggccccgggcc

SEQ ID NO: 403391 - RNA, 32 nt, Human
cugccgccugggcugucagcacuuuggcagca

SEQ ID NO: 403392 - RNA, 20 nt, Human
cugccgccugguucugagcc

SEQ ID NO: 403393 - RNA, 19 nt, Human
cugccgcgagcucgggcca

SEQ ID NO: 403394 - RNA, 21 nt, Human
cugccgcgccguccucgaguu

SEQ ID NO: 403395 - RNA, 20 nt, Human
cugccgcgccucggcuccug

SEQ ID NO: 403396 - RNA, 32 nt, Human
cugccgcgcuccugccuccugccccagcaggu

SEQ ID NO: 403397 - RNA, 32 nt, Human
cugccgcggaggcagcggcggcagcggcucuc

SEQ ID NO: 403398 - RNA, 20 nt, Human
cugccgcggccccucgggcu

SEQ ID NO: 403399 - RNA, 20 nt, Human
cugccgcggcgccuugaguc

SEQ ID NO: 403400 - RNA, 32 nt, Human
cugccgcggggcucucugggccgguucccugc

SEQ ID NO: 403401 - RNA, 19 nt, Human
cugccgcgggucccgggcc

SEQ ID NO: 403402 - RNA, 20 nt, Human
cugccgcggucgcuccgagc

SEQ ID NO: 403403 - RNA, 20 nt, Human
cugccgcgugcgccugggcc

SEQ ID NO: 403404 - RNA, 21 nt, Human
cugccgcguuaguuccgagcu

SEQ ID NO: 403405 - RNA, 23 nt, Human
cugccgcguuccgcgccccggcc

SEQ ID NO: 403406 - RNA, 18 nt, Human
cugccgcuacccucggcc

SEQ ID NO: 403407 - RNA, 19 nt, Human
cugccgcuaucgccuggcc

SEQ ID NO: 403408 - RNA, 19 nt, Human
cugccgcucaccuugugcu

SEQ ID NO: 403409 - RNA, 20 nt, Human
cugccgcuccaccgcagcca

SEQ ID NO: 403410 - RNA, 23 nt, Human
cugccgcuccccaccccugagcc

SEQ ID NO: 403411 - RNA, 21 nt, Human
cugccgcucccgccccgggcu

SEQ ID NO: 403412 - RNA, 17 nt, Human
cugccgcucccggagcc

SEQ ID NO: 403413 - RNA, 19 nt, Human
cugccgcucccuccagcca

SEQ ID NO: 403414 - RNA, 20 nt, Human
cugccgcuccgaacugagcc

SEQ ID NO: 403415 - RNA, 17 nt, Human
cugccgcucgagggacc

SEQ ID NO: 403416 - RNA, 18 nt, Human
cugccgcucgaguagcca

SEQ ID NO: 403417 - RNA, 21 nt, Human
cugccgcucgcugccccgggc

SEQ ID NO: 403418 - RNA, 16 nt, Human
cugccgcucggccagc

SEQ ID NO: 403419 - RNA, 20 nt, Human
cugccgcucgggaagaggcg

SEQ ID NO: 403420 - RNA, 20 nt, Human
cugccgcucgggacugagcc

SEQ ID NO: 403421 - RNA, 18 nt, Human
cugccgcucuccuggggc

SEQ ID NO: 403422 - RNA, 32 nt, Human
cugccgcucucuggcccuaagugcugagcugc

SEQ ID NO: 403423 - RNA, 16 nt, Human
cugccgcucugcagcc

SEQ ID NO: 403424 - RNA, 32 nt, Human
cugccgcugaaggccccagucuggacucucug

SEQ ID NO: 403425 - RNA, 32 nt, Human
cugccgcugagagggccucuccccugcagcaa

SEQ ID NO: 403426 - RNA, 21 nt, Human
cugccgcugagggcccgagcc

SEQ ID NO: 403427 - RNA, 32 nt, Human
cugccgcugcaagucugagcugccucagcugu

SEQ ID NO: 403428 - RNA, 19 nt, Human
cugccgcugcaugcggcca

SEQ ID NO: 403429 - RNA, 19 nt, Human
cugccgcugccacacugcc

SEQ ID NO: 403430 - RNA, 23 nt, Human
cugccgcugccaugcuuugaguc

SEQ ID NO: 403431 - RNA, 20 nt, Human
cugccgcugccgggcgggcc

SEQ ID NO: 403432 - RNA, 19 nt, Human
cugccgcugccucaggcua

SEQ ID NO: 403433 - RNA, 32 nt, Human
cugccgcugcgcagcgggaaggaagcuaagau

SEQ ID NO: 403434 - RNA, 21 nt, Human
cugccgcuggaacuccggguc

SEQ ID NO: 403435 - RNA, 18 nt, Human
cugccgcuggcccugggc

SEQ ID NO: 403436 - RNA, 19 nt, Human
cugccgcuggcuuugggcu

SEQ ID NO: 403437 - RNA, 24 nt, Human
cugccgcugugugggccugggcua

SEQ ID NO: 403438 - RNA, 32 nt, Human
cugccgcuucaaucuccugggcucaaaugauc

SEQ ID NO: 403439 - RNA, 21 nt, Human
cugccgcuuccaccugggcca

SEQ ID NO: 403440 - RNA, 19 nt, Human
cugccgcuugcaccugcag

SEQ ID NO: 403441 - RNA, 17 nt, Human
cugccgcuugccuugcc

SEQ ID NO: 403442 - RNA, 19 nt, Human
cugccgcuugcucuaugcc

SEQ ID NO: 403443 - RNA, 20 nt, Human
cugccgcuuguccuuguguc

SEQ ID NO: 403444 - RNA, 32 nt, Human
cugccggaaagaggagcggcaggagggggcgu

SEQ ID NO: 403445 - RNA, 32 nt, Human
cugccggagaccucccuucccugggccccuuc

SEQ ID NO: 403446 - RNA, 32 nt, Human
cugccggagagaaggggaggaggacuccagcu

SEQ ID NO: 403447 - RNA, 32 nt, Human
cugccggagccgugguggcagccccgggagga

SEQ ID NO: 403448 - RNA, 32 nt, Human
cugccggaggagccccaccuucugcuacuauu

SEQ ID NO: 403449 - RNA, 19 nt, Human
cugccggaggcugcuccug

SEQ ID NO: 403450 - RNA, 32 nt, Human
cugccggaggcugggcuuccuccucuguucuu

SEQ ID NO: 403451 - RNA, 20 nt, Human
cugccggaugccccgaggcg

SEQ ID NO: 403452 - RNA, 32 nt, Human
cugccggcacaguggaccuggcccaacccuca

SEQ ID NO: 403453 - RNA, 16 nt, Human
cugccggcaccgagcu

SEQ ID NO: 403454 - RNA, 32 nt, Human
cugccggcaccucugaucaagugccuagaggg

SEQ ID NO: 403455 - RNA, 32 nt, Human
cugccggcaucuggaggggaggcugggcugca

SEQ ID NO: 403456 - RNA, 32 nt, Human
cugccggcccaccugcagcccggacgccugcc

SEQ ID NO: 403457 - RNA, 32 nt, Human
cugccggcccagcugcaggggcuuaacagaag

SEQ ID NO: 403458 - RNA, 32 nt, Human
cugccggccccuaggacagagcagggaccuca

SEQ ID NO: 403459 - RNA, 19 nt, Human
cugccggccucccgggcca

SEQ ID NO: 403460 - RNA, 20 nt, Human
cugccggcgccaccugggcc

SEQ ID NO: 403461 - RNA, 17 nt, Human
cugccggcgccucgguc

SEQ ID NO: 403462 - RNA, 20 nt, Human
cugccggcgccuugucugca

SEQ ID NO: 403463 - RNA, 16 nt, Human
cugccggcggggcagu

SEQ ID NO: 403464 - RNA, 32 nt, Human
cugccggcucccgcccagccuguguggaaagg

SEQ ID NO: 403465 - RNA, 17 nt, Human
cugccggcuccuugagc

SEQ ID NO: 403466 - RNA, 17 nt, Human
cugccggcucgugggcc

SEQ ID NO: 403467 - RNA, 20 nt, Human
cugccggcugcgcucgggcc

SEQ ID NO: 403468 - RNA, 22 nt, Human
cugccgggaccuccagccugca

SEQ ID NO: 403469 - RNA, 32 nt, Human
cugccgggaccugaggccuccacuggcgacuu

SEQ ID NO: 403470 - RNA, 20 nt, Human
cugccgggacucaccgagcu

SEQ ID NO: 403471 - RNA, 32 nt, Human
cugccgggacuggagcgcgccguccgccgcgg

SEQ ID NO: 403472 - RNA, 32 nt, Human
cugccgggagcugcuccuaugauggaguugug

SEQ ID NO: 403473 - RNA, 32 nt, Human
cugccgggaucuuccaggaggaaagcgaaguu

SEQ ID NO: 403474 - RNA, 18 nt, Human
cugccgggcaggucacug

SEQ ID NO: 403475 - RNA, 23 nt, Human
cugccgggcaggucacugugcug

SEQ ID NO: 403476 - RNA, 32 nt, Human
cugccgggcuaaggcgugcagagcaggcgagg

SEQ ID NO: 403477 - RNA, 20 nt, Human
cugccgggcugccccgagcc

SEQ ID NO: 403478 - RNA, 17 nt, Human
cugccgggcugccucug

SEQ ID NO: 403479 - RNA, 32 nt, Human
cugccggggaggaggaggaggaggaagaggag

SEQ ID NO: 403480 - RNA, 32 nt, Human
cugccggggccagggcugccauggucuccuug

SEQ ID NO: 403481 - RNA, 20 nt, Human
cugccgggggccuugucucc

SEQ ID NO: 403482 - RNA, 31 nt, Human
cugccggguguuugcugcacagcaggcuccg

SEQ ID NO: 403483 - RNA, 32 nt, Human
cugccggguuucucccugcggcuccuggguug

SEQ ID NO: 403484 - RNA, 19 nt, Human
cugccggucaccuugagcu

SEQ ID NO: 403485 - RNA, 16 nt, Human
cugccgguccccgagc

SEQ ID NO: 403486 - RNA, 18 nt, Human
cugccgguggcccgagcc

SEQ ID NO: 403487 - RNA, 32 nt, Human
cugccgguuucuccaguucuggggacaguggu

SEQ ID NO: 403488 - RNA, 32 nt, Human
cugccguacucgggcgcgaccugcuggugcgc

SEQ ID NO: 403489 - RNA, 32 nt, Human
cugccgucagccagcagagagagggagcugca

SEQ ID NO: 403490 - RNA, 32 nt, Human
cugccgucauccaggcuggacaguucagugau

SEQ ID NO: 403491 - RNA, 17 nt, Human
cugccguccauagcagg

SEQ ID NO: 403492 - RNA, 32 nt, Human
cugccgucccaccacacguggccucugcgccc

SEQ ID NO: 403493 - RNA, 32 nt, Human
cugccguccccgcugcugugcauuggguuaaa

SEQ ID NO: 403494 - RNA, 32 nt, Human
cugccguccuucucuugcacugccuucugcgc

SEQ ID NO: 403495 - RNA, 19 nt, Human
cugccgucgccgccgccgc

SEQ ID NO: 403496 - RNA, 20 nt, Human
cugccgucggucuccgggcc

SEQ ID NO: 403497 - RNA, 19 nt, Human
cugccgucucucccgggcu

SEQ ID NO: 403498 - RNA, 32 nt, Human
cugccgucugacuugagucccugcugcugcag

SEQ ID NO: 403499 - RNA, 32 nt, Human
cugccgucuguggagccucugggcggccuucu

SEQ ID NO: 403500 - RNA, 19 nt, Human
cugccgucuuccucgagcu

SEQ ID NO: 403501 - RNA, 32 nt, Human
cugccgugcaucucccugugcccucuugcugc

SEQ ID NO: 403502 - RNA, 23 nt, Human
cugccgugccggacccccgagcc

SEQ ID NO: 403503 - RNA, 31 nt, Human
cugccgugccucucugaggucaggcugugcu

SEQ ID NO: 403504 - RNA, 30 nt, Human
cugccgugcuagcaaucagggagacuccgu

SEQ ID NO: 403505 - RNA, 32 nt, Human
cugccguggaguuugcugggggagacacaugu

SEQ ID NO: 403506 - RNA, 32 nt, Human
cugccgugggccugagaccaaggcccccgggc

SEQ ID NO: 403507 - RNA, 22 nt, Human
cugccgugggcucucauugcca

SEQ ID NO: 403508 - RNA, 32 nt, Human
cugccguguauuuccuccccagggaguggggc

SEQ ID NO: 403509 - RNA, 22 nt, Human
cugccgugucaggccucgagcc

SEQ ID NO: 403510 - RNA, 32 nt, Human
cugccguguucuguuucucucugaccgccggu

SEQ ID NO: 403511 - RNA, 32 nt, Human
cugccguguugucaguuuccugaggccucccc

SEQ ID NO: 403512 - RNA, 19 nt, Human
cugccguguugucugggcu

SEQ ID NO: 403513 - RNA, 32 nt, Human
cugccguucaugguggucuuucagguuaucuu

SEQ ID NO: 403514 - RNA, 32 nt, Human
cugccguuccaacuugcccaucagagacccgg

SEQ ID NO: 403515 - RNA, 19 nt, Human
cugccguucgccgccggcc

SEQ ID NO: 403516 - RNA, 20 nt, Human
cugccguugggcuccggguc

SEQ ID NO: 403517 - RNA, 19 nt, Human
cugccguugucacaggcca

SEQ ID NO: 403518 - RNA, 32 nt, Human
cugccguuguguuaguggcauccaggucuccg

SEQ ID NO: 403519 - RNA, 20 nt, Human
cugccguuugccacucucca

SEQ ID NO: 403520 - RNA, 23 nt, Human
cugccguuugccacucuccagca

SEQ ID NO: 403521 - RNA, 22 nt, Human
cugccguuugccgcugccggcc

SEQ ID NO: 403522 - RNA, 32 nt, Human
cugccuaaaguccucaaucagccucuccaacu

SEQ ID NO: 403523 - RNA, 32 nt, Human
cugccuaacagugccucacaaggcuugggggc

SEQ ID NO: 403524 - RNA, 32 nt, Human
cugccuaacauggugaaaccccgucuccacua

SEQ ID NO: 403525 - RNA, 32 nt, Human
cugccuaagacugucuuaccuuauguuaagga

SEQ ID NO: 403526 - RNA, 32 nt, Human
cugccuaaggacuucuuuaauuuuggaauuuu

SEQ ID NO: 403527 - RNA, 32 nt, Human
cugccuaaggguggugaugguggggagugguu

SEQ ID NO: 403528 - RNA, 19 nt, Human
cugccuaaggucagcauca

SEQ ID NO: 403529 - RNA, 32 nt, Human
cugccuaauuuucucacccacauucgcugaag

SEQ ID NO: 403530 - RNA, 32 nt, Human
cugccuacacccagguaucuuucacagccagu

SEQ ID NO: 403531 - RNA, 32 nt, Human
cugccuacagagugccuggcacuugggacuuc

SEQ ID NO: 403532 - RNA, 32 nt, Human
cugccuaccugaggagcuuucuuuggaaacca

SEQ ID NO: 403533 - RNA, 20 nt, Human
cugccuaccugccugagcca

SEQ ID NO: 403534 - RNA, 32 nt, Human
cugccuacgaugugccugggggccugggcuga

SEQ ID NO: 403535 - RNA, 32 nt, Human
cugccuagcaagugaagaucuguugagaaacu

SEQ ID NO: 403536 - RNA, 19 nt, Human
cugccuagccaggcuggca

SEQ ID NO: 403537 - RNA, 32 nt, Human
cugccuagccugggcuggaguccuugcuuugc

SEQ ID NO: 403538 - RNA, 32 nt, Human
cugccuaggaugacgcugcggcuucugguggc

SEQ ID NO: 403539 - RNA, 20 nt, Human
cugccuaggcauccagcuca

SEQ ID NO: 403540 - RNA, 32 nt, Human
cugccuaggccgcagcagcauuuccuuccuaa

SEQ ID NO: 403541 - RNA, 20 nt, Human
cugccuaggugccugugcug

SEQ ID NO: 403542 - RNA, 32 nt, Human
cugccuauagccccagcuacuugggaggcuga

SEQ ID NO: 403543 - RNA, 32 nt, Human
cugccuaucacacgcagccaucagcccacaaa

SEQ ID NO: 403544 - RNA, 23 nt, Human
cugccuaucugaggaccuguacc

SEQ ID NO: 403545 - RNA, 32 nt, Human
cugccuaucuggaccccugccuagguggaugg

SEQ ID NO: 403546 - RNA, 32 nt, Human
cugccuaucuucugccuuucacuugcauccaa

SEQ ID NO: 403547 - RNA, 32 nt, Human
cugccuaugauguugaggaaguucuauaaguu

SEQ ID NO: 403548 - RNA, 32 nt, Human
cugccuauuacuguauucucuacuucuaaaua

SEQ ID NO: 403549 - RNA, 20 nt, Human
cugccuauugcagagcagca

SEQ ID NO: 403550 - RNA, 32 nt, Human
cugccuauugggaagaacauggcuucaaggau

SEQ ID NO: 403551 - RNA, 32 nt, Human
cugccucaaaccaccccucccccagaugguac

SEQ ID NO: 403552 - RNA, 32 nt, Human
cugccucaacaucuaucucugcugccaaugua

SEQ ID NO: 403553 - RNA, 32 nt, Human
cugccucaacaucuuccgagugggcuacgaug

SEQ ID NO: 403554 - RNA, 22 nt, Human
cugccucaacucugucuccagg

SEQ ID NO: 403555 - RNA, 32 nt, Human
cugccucaagaaggggcucagagcagagacuu

SEQ ID NO: 403556 - RNA, 32 nt, Human
cugccucaagcagauaagguggaauccacaac

SEQ ID NO: 403557 - RNA, 23 nt, Human
cugccucaaggucccucccgagg

SEQ ID NO: 403558 - RNA, 32 nt, Human
cugccucacaacaaccuccuuggacucagcuu

SEQ ID NO: 403559 - RNA, 24 nt, Human
cugccucacaacagccuccacagg

SEQ ID NO: 403560 - RNA, 32 nt, Human
cugccucacaacauggcaaguacaguacuuug

SEQ ID NO: 403561 - RNA, 23 nt, Human
cugccucacacagccucuucagg

SEQ ID NO: 403562 - RNA, 24 nt, Human
cugccucacacuggccucucuagg

SEQ ID NO: 403563 - RNA, 22 nt, Human
cugccucacagcagacucucca

SEQ ID NO: 403564 - RNA, 22 nt, Human
cugccucacagcggacucucca

SEQ ID NO: 403565 - RNA, 32 nt, Human
cugccucacagcugugcgagcucugcccuccu

SEQ ID NO: 403566 - RNA, 32 nt, Human
cugccucacagcuuuaucuuuguauuugcccc

SEQ ID NO: 403567 - RNA, 23 nt, Human
cugccucacaguggacccuccag

SEQ ID NO: 403568 - RNA, 32 nt, Human
cugccucaccaucauccucccuuccucaucau

SEQ ID NO: 403569 - RNA, 21 nt, Human
cugccucaccgucugccuugc

SEQ ID NO: 403570 - RNA, 31 nt, Human
cugccucaccucucugggccaguuuccccau

SEQ ID NO: 403571 - RNA, 32 nt, Human
cugccucaccuugccgcugggagcccaggcuc

SEQ ID NO: 403572 - RNA, 18 nt, Human
cugccucacucccgagcu

SEQ ID NO: 403573 - RNA, 32 nt, Human
cugccucacucgccuuccgccugcuggacgcu

SEQ ID NO: 403574 - RNA, 32 nt, Human
cugccucacugcaccugccaaggcugcccugg

SEQ ID NO: 403575 - RNA, 19 nt, Human
cugccucacugcugggcca

SEQ ID NO: 403576 - RNA, 32 nt, Human
cugccucacuugcuuccgccuccuggacaaua

SEQ ID NO: 403577 - RNA, 32 nt, Human
cugccucagaacugucucuccugggcccagca

SEQ ID NO: 403578 - RNA, 32 nt, Human
cugccucagacuccugaguaucugggaccaca

SEQ ID NO: 403579 - RNA, 32 nt, Human
cugccucagaucuccuaccucuccuuaagucu

SEQ ID NO: 403580 - RNA, 22 nt, Human
cugccucagcauccaccccgca

SEQ ID NO: 403581 - RNA, 21 nt, Human
cugccucagccacgcuuucca

SEQ ID NO: 403582 - RNA, 32 nt, Human
cugccucagccaguggcacaggagacuccaag

SEQ ID NO: 403583 - RNA, 21 nt, Human
cugccucagcccagcucugca

SEQ ID NO: 403584 - RNA, 20 nt, Human
cugccucagccccacuccag

SEQ ID NO: 403585 - RNA, 27 nt, Human
cugccucagccgggguccgucuuagca

SEQ ID NO: 403586 - RNA, 24 nt, Human
cugccucagccucccaagcuuuca

SEQ ID NO: 403587 - RNA, 20 nt, Human
cugccucagccuccuaaagu

SEQ ID NO: 403588 - RNA, 32 nt, Human
cugccucagccuccuauauagcagagaacaga

SEQ ID NO: 403589 - RNA, 20 nt, Human
cugccucagccugcugagua

SEQ ID NO: 403590 - RNA, 24 nt, Human
cugccucagccuuugcacauggua

SEQ ID NO: 403591 - RNA, 32 nt, Human
cugccucagcuacucaagaggcugaggcagga

SEQ ID NO: 403592 - RNA, 32 nt, Human
cugccucagcuacucaggaggcugagguagua

SEQ ID NO: 403593 - RNA, 32 nt, Human
cugccucagcuacucgggaggcugaggcaaga

SEQ ID NO: 403594 - RNA, 20 nt, Human
cugccucagcuccauuuugc

SEQ ID NO: 403595 - RNA, 21 nt, Human
cugccucagcuccugucuugc

SEQ ID NO: 403596 - RNA, 32 nt, Human
cugccucagcucucacagcagugucuuccccg

SEQ ID NO: 403597 - RNA, 32 nt, Human
cugccucagcugugaucucugcaugucuaaca

SEQ ID NO: 403598 - RNA, 32 nt, Human
cugccucagcuguguggccaugugggggcagc

SEQ ID NO: 403599 - RNA, 32 nt, Human
cugccucaggagaaagaauagucuucauguuu

SEQ ID NO: 403600 - RNA, 26 nt, Human
cugccucaggcuccaaaauugcucag

SEQ ID NO: 403601 - RNA, 32 nt, Human
cugccucagggugcaaaugccaaccaagauuc

SEQ ID NO: 403602 - RNA, 18 nt, Human
cugccucagucugggcca

SEQ ID NO: 403603 - RNA, 24 nt, Human
cugccucagucuuuucugacuggc

SEQ ID NO: 403604 - RNA, 32 nt, Human
cugccucaguuaccuuacuuugcccauggguc

SEQ ID NO: 403605 - RNA, 32 nt, Human
cugccucauccucugugccugauagcccuggu

SEQ ID NO: 403606 - RNA, 20 nt, Human
cugccucauccugccuuagu

SEQ ID NO: 403607 - RNA, 32 nt, Human
cugccucaugcagucugacccacccagugagg

SEQ ID NO: 403608 - RNA, 32 nt, Human
cugccucaugccacuauuguggaucaccggcc

SEQ ID NO: 403609 - RNA, 32 nt, Human
cugccucauugccaccuccaccugcaggaagg

SEQ ID NO: 403610 - RNA, 32 nt, Human
cugccucauugucuuguuagaucucugcuuag

SEQ ID NO: 403611 - RNA, 32 nt, Human
cugccuccaaagugcugggauuacaggcccga

SEQ ID NO: 403612 - RNA, 32 nt, Human
cugccuccaaggacacagaaggaugccaguug

SEQ ID NO: 403613 - RNA, 32 nt, Human
cugccuccaccacccccaucuacugauagcca

SEQ ID NO: 403614 - RNA, 32 nt, Human
cugccuccacccuccuccucuucaccaggugc

SEQ ID NO: 403615 - RNA, 32 nt, Human
cugccuccagaagagaugcagagagcuguggg

SEQ ID NO: 403616 - RNA, 18 nt, Human
cugccuccagggcuccug

SEQ ID NO: 403617 - RNA, 32 nt, Human
cugccuccauccugguuuccccaaagccccag

SEQ ID NO: 403618 - RNA, 32 nt, Human
cugccuccaucuuuccaagcaccggggcgaaa

SEQ ID NO: 403619 - RNA, 32 nt, Human
cugccucccaaggugcuggauuacagguguaa

SEQ ID NO: 403620 - RNA, 32 nt, Human
cugccucccacggaaaagauaaggucuucuga

SEQ ID NO: 403621 - RNA, 32 nt, Human
cugccucccacugacccagacccacuuccucc

SEQ ID NO: 403622 - RNA, 21 nt, Human
cugccucccagaacugugaca

SEQ ID NO: 403623 - RNA, 32 nt, Human
cugccucccagagcaaggcuccugucacucca

SEQ ID NO: 403624 - RNA, 24 nt, Human
cugccucccagccuucucuccagg

SEQ ID NO: 403625 - RNA, 32 nt, Human
cugccucccagcucaguauuuaaacaucaucu

SEQ ID NO: 403626 - RNA, 18 nt, Human
cugccucccaggcaggug

SEQ ID NO: 403627 - RNA, 32 nt, Human
cugccucccaggggcauuuccaugacuugcag

SEQ ID NO: 403628 - RNA, 32 nt, Human
cugccucccaucuggcccuuuggacaacuggc

SEQ ID NO: 403629 - RNA, 32 nt, Human
cugccuccccaaagugcugggauuacaggcgu

SEQ ID NO: 403630 - RNA, 32 nt, Human
cugccuccccacccuccccauggcccacccau

SEQ ID NO: 403631 - RNA, 18 nt, Human
cugccuccccagcaugcu

SEQ ID NO: 403632 - RNA, 31 nt, Human
cugccuccccaguuguccacagcaggggccu

SEQ ID NO: 403633 - RNA, 18 nt, Human
cugccuccccauuccuug

SEQ ID NO: 403634 - RNA, 19 nt, Human
cugccucccccaguccuua

SEQ ID NO: 403635 - RNA, 32 nt, Human
cugccuccccucccccgacccuccugccuucc

SEQ ID NO: 403636 - RNA, 32 nt, Human
cugccuccccuccucagaaugccagcaacaac

SEQ ID NO: 403637 - RNA, 32 nt, Human
cugccuccccuccucccguccaccccagaggg

SEQ ID NO: 403638 - RNA, 32 nt, Human
cugccuccccugcagccagggucugggcaggg

SEQ ID NO: 403639 - RNA, 31 nt, Human
cugccuccccuuccucgcccuguguccucuc

SEQ ID NO: 403640 - RNA, 32 nt, Human
cugccuccccuuccucuucuuguuuuggugaa

SEQ ID NO: 403641 - RNA, 16 nt, Human
cugccuccccuuccuu

SEQ ID NO: 403642 - RNA, 32 nt, Human
cugccuccccuucucccugccuccagaauguu

SEQ ID NO: 403643 - RNA, 32 nt, Human
cugccucccgauggaagaucugauggacgugg

SEQ ID NO: 403644 - RNA, 21 nt, Human
cugccucccggcacuguggca

SEQ ID NO: 403645 - RNA, 32 nt, Human
cugccucccuaaguugcugggauuacaggugu

SEQ ID NO: 403646 - RNA, 21 nt, Human
cugccucccucccagcuugca

SEQ ID NO: 403647 - RNA, 32 nt, Human
cugccucccuccggcagcaccagcacgaguga

SEQ ID NO: 403648 - RNA, 32 nt, Human
cugccucccuccuuuccaucuuggugucuucc

SEQ ID NO: 403649 - RNA, 32 nt, Human
cugccucccucugcugucaccuugcucagcca

SEQ ID NO: 403650 - RNA, 32 nt, Human
cugccucccugaaacccaucagccuggauggu

SEQ ID NO: 403651 - RNA, 32 nt, Human
cugccucccugccugcuucgcccuggacucgu

SEQ ID NO: 403652 - RNA, 32 nt, Human
cugccucccuggccuccauccaugcagacaag

SEQ ID NO: 403653 - RNA, 18 nt, Human
cugccucccugggauuuu

SEQ ID NO: 403654 - RNA, 32 nt, Human
cugccucccuuaccccuccccuccacuucgcu

SEQ ID NO: 403655 - RNA, 32 nt, Human
cugccucccuucuuauucuuccuugcugcacg

SEQ ID NO: 403656 - RNA, 32 nt, Human
cugccucccuuucuuccuuccuuuuuaaaauu

SEQ ID NO: 403657 - RNA, 26 nt, Human
cugccucccuuucuuucugccuuuca

SEQ ID NO: 403658 - RNA, 32 nt, Human
cugccuccgaguagcugggacuacagguguga

SEQ ID NO: 403659 - RNA, 32 nt, Human
cugccuccgccacccuccuggaauauggccua

SEQ ID NO: 403660 - RNA, 32 nt, Human
cugccuccgccagccugugagcuguuuccaug

SEQ ID NO: 403661 - RNA, 32 nt, Human
cugccuccgcccguguguccgucaagggugcc

SEQ ID NO: 403662 - RNA, 21 nt, Human
cugccuccgucgcggcuccug

SEQ ID NO: 403663 - RNA, 32 nt, Human
cugccuccguuucccuagcccugggccugugc

SEQ ID NO: 403664 - RNA, 32 nt, Human
cugccuccuaaagugcugggauucugggccuu

SEQ ID NO: 403665 - RNA, 32 nt, Human
cugccuccuaggcuggaagccauggucccgaa

SEQ ID NO: 403666 - RNA, 32 nt, Human
cugccuccucaagugggucccugaucuccaag

SEQ ID NO: 403667 - RNA, 32 nt, Human
cugccuccucaguucugcaaguaguuuaguag

SEQ ID NO: 403668 - RNA, 18 nt, Human
cugccuccuccacucagc

SEQ ID NO: 403669 - RNA, 19 nt, Human
cugccuccucccugcucua

SEQ ID NO: 403670 - RNA, 32 nt, Human
cugccuccucccuugaccacagccugguuuac

SEQ ID NO: 403671 - RNA, 32 nt, Human
cugccuccucccuuuucccuccccacauuuug

SEQ ID NO: 403672 - RNA, 32 nt, Human
cugccuccuccucccuuucucccuugugggga

SEQ ID NO: 403673 - RNA, 32 nt, Human
cugccuccuccuccuccaccugcucuccuccc

SEQ ID NO: 403674 - RNA, 32 nt, Human
cugccuccuccuccuccucuuggcucuauugg

SEQ ID NO: 403675 - RNA, 32 nt, Human
cugccuccuccuggcugaagcuguuugucagg

SEQ ID NO: 403676 - RNA, 21 nt, Human
cugccuccucuaaggcaggug

SEQ ID NO: 403677 - RNA, 32 nt, Human
cugccuccucuaccccaggaggcucuuaucuc

SEQ ID NO: 403678 - RNA, 32 nt, Human
cugccuccucuccaguggugaagacccagccu

SEQ ID NO: 403679 - RNA, 25 nt, Human
cugccuccucuccccaccagcacca

SEQ ID NO: 403680 - RNA, 18 nt, Human
cugccuccucuccugcaa

SEQ ID NO: 403681 - RNA, 32 nt, Human
cugccuccugaaggaagcccuccuggacugcu

SEQ ID NO: 403682 - RNA, 32 nt, Human
cugccuccugcaagguggaggguggggcuugg

SEQ ID NO: 403683 - RNA, 32 nt, Human
cugccuccugcaggaugacuuagaaaucuagu

SEQ ID NO: 403684 - RNA, 19 nt, Human
cugccuccugccggcuccu

SEQ ID NO: 403685 - RNA, 32 nt, Human
cugccuccugccuccccugccugccuccugcc

SEQ ID NO: 403686 - RNA, 32 nt, Human
cugccuccugccuccccugccugccugggacc

SEQ ID NO: 403687 - RNA, 24 nt, Human
cugccuccugccuuuucuuuugua

SEQ ID NO: 403688 - RNA, 32 nt, Human
cugccuccuggaacuccuggcucaaucgaucc

SEQ ID NO: 403689 - RNA, 22 nt, Human
cugccuccuggccagcugccca

SEQ ID NO: 403690 - RNA, 32 nt, Human
cugccuccuggccucaggaucucccuggggca

SEQ ID NO: 403691 - RNA, 32 nt, Human
cugccuccugggagaaggagcuuucaaggagu

SEQ ID NO: 403692 - RNA, 32 nt, Human
cugccuccugggagcccagaacuugcaguaac

SEQ ID NO: 403693 - RNA, 32 nt, Human
cugccuccugggcuauuccucuccacccagaa

SEQ ID NO: 403694 - RNA, 20 nt, Human
cugccuccuucacauuuccu

SEQ ID NO: 403695 - RNA, 19 nt, Human
cugccuccuuccugagcca

SEQ ID NO: 403696 - RNA, 32 nt, Human
cugccuccuugccucccugccucccucccucc

SEQ ID NO: 403697 - RNA, 17 nt, Human
cugccuccuuucuucug

SEQ ID NO: 403698 - RNA, 32 nt, Human
cugccuccuuugagggacugggggacuugggg

SEQ ID NO: 403699 - RNA, 32 nt, Human
cugccucgagguuaugaucuagcaccagcauu

SEQ ID NO: 403700 - RNA, 22 nt, Human
cugccucgcaauugccuuugua

SEQ ID NO: 403701 - RNA, 19 nt, Human
cugccucgcgcccguagcc

SEQ ID NO: 403702 - RNA, 18 nt, Human
cugccucggaggcugcug

SEQ ID NO: 403703 - RNA, 32 nt, Human
cugccucggcaaccccgggcccugagggcagg

SEQ ID NO: 403704 - RNA, 24 nt, Human
cugccucggccuugcgccugugua

SEQ ID NO: 403705 - RNA, 32 nt, Human
cugccucggccuuucaaagugcugggauuaca

SEQ ID NO: 403706 - RNA, 32 nt, Human
cugccucgggcagaggagggcuacccuggggc

SEQ ID NO: 403707 - RNA, 23 nt, Human
cugccucggggccaccccuugca

SEQ ID NO: 403708 - RNA, 32 nt, Human
cugccucggggcgcagcgcugaggucacccug

SEQ ID NO: 403709 - RNA, 32 nt, Human
cugccucgugagccucccagagcccaggccuc

SEQ ID NO: 403710 - RNA, 32 nt, Human
cugccucuaagcugcucuaaaguccagacuau

SEQ ID NO: 403711 - RNA, 32 nt, Human
cugccucuacccaaccagggccccggggccug

SEQ ID NO: 403712 - RNA, 32 nt, Human
cugccucuacugucucuccauagcccuggugg

SEQ ID NO: 403713 - RNA, 32 nt, Human
cugccucuagcugagugccuccuggguuuccu

SEQ ID NO: 403714 - RNA, 32 nt, Human
cugccucuaguccccaaggccucucucugccu

SEQ ID NO: 403715 - RNA, 32 nt, Human
cugccucuagugcagaccagagccuugcagag

SEQ ID NO: 403716 - RNA, 32 nt, Human
cugccucucaaaggccugcacgggccuggccu

SEQ ID NO: 403717 - RNA, 32 nt, Human
cugccucucaacaaccucuuuggacucagugc

SEQ ID NO: 403718 - RNA, 32 nt, Human
cugccucuccacugcuagauggaaccuggaau

SEQ ID NO: 403719 - RNA, 32 nt, Human
cugccucucccuaacacaggaguuggagggag

SEQ ID NO: 403720 - RNA, 32 nt, Human
cugccucucccugggcucugcagccauggcaa

SEQ ID NO: 403721 - RNA, 32 nt, Human
cugccucuccgccaccuccaccgcggcuuauc

SEQ ID NO: 403722 - RNA, 32 nt, Human
cugccucuccucucugggacaggcugggaccu

SEQ ID NO: 403723 - RNA, 32 nt, Human
cugccucuccugggcauggcuguuagcuguuc

SEQ ID NO: 403724 - RNA, 32 nt, Human
cugccucucucccaacauguuuccagcaagua

SEQ ID NO: 403725 - RNA, 32 nt, Human
cugccucucuggggagaugcuggaggucucgg

SEQ ID NO: 403726 - RNA, 32 nt, Human
cugccucucuucaaccccacaggccagagugc

SEQ ID NO: 403727 - RNA, 18 nt, Human
cugccucucuuccgaguc

SEQ ID NO: 403728 - RNA, 32 nt, Human
cugccucugcacccccucccacccccagcaca

SEQ ID NO: 403729 - RNA, 32 nt, Human
cugccucugcccacccuuccccaggccucugc

SEQ ID NO: 403730 - RNA, 19 nt, Human
cugccucugcccugggcca

SEQ ID NO: 403731 - RNA, 32 nt, Human
cugccucugccucauauucuuguuaggccagg

SEQ ID NO: 403732 - RNA, 32 nt, Human
cugccucugccucuacuaacuuccuuugucuc

SEQ ID NO: 403733 - RNA, 32 nt, Human
cugccucugccugggcugcagccgcacuaagc

SEQ ID NO: 403734 - RNA, 20 nt, Human
cugccucugccuggggucuu

SEQ ID NO: 403735 - RNA, 32 nt, Human
cugccucugcuccucugcccuucuuauagcca

SEQ ID NO: 403736 - RNA, 32 nt, Human
cugccucugcugcacacacaggcaccagcagg

SEQ ID NO: 403737 - RNA, 32 nt, Human
cugccucugcugccccauaccccacacacuca

SEQ ID NO: 403738 - RNA, 22 nt, Human
cugccucugcuuccagcuuugu

SEQ ID NO: 403739 - RNA, 23 nt, Human
cugccucugcuuccagcuuugua

SEQ ID NO: 403740 - RNA, 19 nt, Human
cugccucugcuugcugcug

SEQ ID NO: 403741 - RNA, 32 nt, Human
cugccucugggaacugggacagugggagagac

SEQ ID NO: 403742 - RNA, 32 nt, Human
cugccucugggagcuuuggcgucugugacuaa

SEQ ID NO: 403743 - RNA, 32 nt, Human
cugccucuggggaagagagggaagagaaagca

SEQ ID NO: 403744 - RNA, 32 nt, Human
cugccucuggggcuuuucugaagaaacccacc

SEQ ID NO: 403745 - RNA, 32 nt, Human
cugccucuggggucgagggucuggguggaagg

SEQ ID NO: 403746 - RNA, 21 nt, Human
cugccucugguuccugcauca

SEQ ID NO: 403747 - RNA, 32 nt, Human
cugccucuguaggcuccaccucugggggcagg

SEQ ID NO: 403748 - RNA, 32 nt, Human
cugccucugucgcccaggcuggagugcagugg

SEQ ID NO: 403749 - RNA, 21 nt, Human
cugccucuguucucagcguca

SEQ ID NO: 403750 - RNA, 32 nt, Human
cugccucuuaagucucaugcugccucacauag

SEQ ID NO: 403751 - RNA, 32 nt, Human
cugccucuuacccguaaaaccccaacuucucu

SEQ ID NO: 403752 - RNA, 25 nt, Human
cugccucuuagacuucugcuuucca

SEQ ID NO: 403753 - RNA, 32 nt, Human
cugccucuuccucgacguucucuccccuucuc

SEQ ID NO: 403754 - RNA, 32 nt, Human
cugccucuuccugccucuccccacccugccca

SEQ ID NO: 403755 - RNA, 31 nt, Human
cugccucuucggcugccuguguuuaaccucc

SEQ ID NO: 403756 - RNA, 32 nt, Human
cugccucuucggcugccuguguuuaaccucca

SEQ ID NO: 403757 - RNA, 32 nt, Human
cugccucuucuccccacccauccuggcgggcg

SEQ ID NO: 403758 - RNA, 19 nt, Human
cugccucuucugcaagcua

SEQ ID NO: 403759 - RNA, 32 nt, Human
cugccucuuucccuccuccucucccucccucc

SEQ ID NO: 403760 - RNA, 21 nt, Human
cugccucuuucuccuuuccag

SEQ ID NO: 403761 - RNA, 32 nt, Human
cugccucuuuuccaacucuucuuccaacacaa

SEQ ID NO: 403762 - RNA, 27 nt, Human
cugccucuuuucuccugucccuccagg

SEQ ID NO: 403763 - RNA, 32 nt, Human
cugccugaacccaggaggcagagguugcggug

SEQ ID NO: 403764 - RNA, 32 nt, Human
cugccugaagagcagaggugaggaccugggac

SEQ ID NO: 403765 - RNA, 32 nt, Human
cugccugaauguaaccugcuagcucuccgaag

SEQ ID NO: 403766 - RNA, 22 nt, Human
cugccugacaaggucagcauca

SEQ ID NO: 403767 - RNA, 32 nt, Human
cugccugacacugagccccaccucuccaaguc

SEQ ID NO: 403768 - RNA, 32 nt, Human
cugccugacagugacaaugacaucccaguuac

SEQ ID NO: 403769 - RNA, 32 nt, Human
cugccugaccaacaugcugaaacccagucucu

SEQ ID NO: 403770 - RNA, 32 nt, Human
cugccugaccaacauggugaaaccccgucucu

SEQ ID NO: 403771 - RNA, 32 nt, Human
cugccugacccaccucagagccugcuuugcau

SEQ ID NO: 403772 - RNA, 22 nt, Human
cugccugacccacuguugcaga

SEQ ID NO: 403773 - RNA, 18 nt, Human
cugccugacuccuuggag

SEQ ID NO: 403774 - RNA, 32 nt, Human
cugccugacuuaggagucagagcccggcaggg

SEQ ID NO: 403775 - RNA, 17 nt, Human
cugccugagagcaggug

SEQ ID NO: 403776 - RNA, 32 nt, Human
cugccugagccaaacccagucuugucaauagc

SEQ ID NO: 403777 - RNA, 32 nt, Human
cugccugagcuuccuuccccagcuuugcugcc

SEQ ID NO: 403778 - RNA, 32 nt, Human
cugccugaggagcuccaggccugggugcggga

SEQ ID NO: 403779 - RNA, 32 nt, Human
cugccugaguagcugggacuacaggcaugcac

SEQ ID NO: 403780 - RNA, 20 nt, Human
cugccugagucccucgagcc

SEQ ID NO: 403781 - RNA, 32 nt, Human
cugccugauccugccccugccugaccccgcca

SEQ ID NO: 403782 - RNA, 32 nt, Human
cugccugauggugccugugcuugggggagcuu

SEQ ID NO: 403783 - RNA, 32 nt, Human
cugccugcaccccgguccucagccugggcucc

SEQ ID NO: 403784 - RNA, 32 nt, Human
cugccugcacccugcccauggggaagauugua

SEQ ID NO: 403785 - RNA, 21 nt, Human
cugccugcaccuuccugcggc

SEQ ID NO: 403786 - RNA, 20 nt, Human
cugccugcacucccuggccu

SEQ ID NO: 403787 - RNA, 22 nt, Human
cugccugcacugcgguugucca

SEQ ID NO: 403788 - RNA, 32 nt, Human
cugccugcacuuccgcagccagcacgcuccac

SEQ ID NO: 403789 - RNA, 32 nt, Human
cugccugcagaagucccaagacccuagugaaa

SEQ ID NO: 403790 - RNA, 32 nt, Human
cugccugcagaggcgcccuuuucagcugcugc

SEQ ID NO: 403791 - RNA, 19 nt, Human
cugccugcagccugggcca

SEQ ID NO: 403792 - RNA, 32 nt, Human
cugccugccaauggcccugaauccagcuuagg

SEQ ID NO: 403793 - RNA, 23 nt, Human
cugccugccagcggccugcccug

SEQ ID NO: 403794 - RNA, 23 nt, Human
cugccugccagcuucugccuuca

SEQ ID NO: 403795 - RNA, 32 nt, Human
cugccugcccacaucccugccuccuggaaucc

SEQ ID NO: 403796 - RNA, 19 nt, Human
cugccugcccaccccgugc

SEQ ID NO: 403797 - RNA, 20 nt, Human
cugccugcccagacuagcug

SEQ ID NO: 403798 - RNA, 19 nt, Human
cugccugcccagccaugcu

SEQ ID NO: 403799 - RNA, 23 nt, Human
cugccugcccagucccuucacug

SEQ ID NO: 403800 - RNA, 22 nt, Human
cugccugcccaucucagugcug

SEQ ID NO: 403801 - RNA, 19 nt, Human
cugccugccccacauuucc

SEQ ID NO: 403802 - RNA, 20 nt, Human
cugccugccccacugugcug

SEQ ID NO: 403803 - RNA, 32 nt, Human
cugccugcccccgccccugccuccucucgcug

SEQ ID NO: 403804 - RNA, 32 nt, Human
cugccugcccccucccccuucuccugggaccc

SEQ ID NO: 403805 - RNA, 32 nt, Human
cugccugccccugagaugcggaaagggucaga

SEQ ID NO: 403806 - RNA, 20 nt, Human
cugccugcccgccaccgugc

SEQ ID NO: 403807 - RNA, 32 nt, Human
cugccugcccgcccgcucacacgcucacccgc

SEQ ID NO: 403808 - RNA, 23 nt, Human
cugccugcccuccagacugucug

SEQ ID NO: 403809 - RNA, 23 nt, Human
cugccugcccucugccgaugcug

SEQ ID NO: 403810 - RNA, 32 nt, Human
cugccugcccugccccuccagggggccaugag

SEQ ID NO: 403811 - RNA, 22 nt, Human
cugccugcccugcccugugcug

SEQ ID NO: 403812 - RNA, 32 nt, Human
cugccugcccugccuacugagaagacuaccgg

SEQ ID NO: 403813 - RNA, 21 nt, Human
cugccugcccuggccuugcug

SEQ ID NO: 403814 - RNA, 19 nt, Human
cugccugcccuguccuucc

SEQ ID NO: 403815 - RNA, 19 nt, Human
cugccugcccuucuaggaa

SEQ ID NO: 403816 - RNA, 32 nt, Human
cugccugccgccgccgccuccaccauuguaua

SEQ ID NO: 403817 - RNA, 22 nt, Human
cugccugccgccugccugccug

SEQ ID NO: 403818 - RNA, 32 nt, Human
cugccugccgcugcaccugccugccgcugcag

SEQ ID NO: 403819 - RNA, 24 nt, Human
cugccugccggggguuccugcagc

SEQ ID NO: 403820 - RNA, 32 nt, Human
cugccugccuccaugggaucugucuuuauauu

SEQ ID NO: 403821 - RNA, 23 nt, Human
cugccugccucccucccugucug

SEQ ID NO: 403822 - RNA, 32 nt, Human
cugccugccuccgucucuuucucccucagauc

SEQ ID NO: 403823 - RNA, 18 nt, Human
cugccugccuccugcagg

SEQ ID NO: 403824 - RNA, 32 nt, Human
cugccugccucggggacacuagugacaguaua

SEQ ID NO: 403825 - RNA, 32 nt, Human
cugccugccucuguaggcuccaccucuggggg

SEQ ID NO: 403826 - RNA, 24 nt, Human
cugccugccugcaucacugcacug

SEQ ID NO: 403827 - RNA, 32 nt, Human
cugccugccugccucuccaccacaugcuuuuu

SEQ ID NO: 403828 - RNA, 32 nt, Human
cugccugccugccugccugccugccugccugu

SEQ ID NO: 403829 - RNA, 32 nt, Human
cugccugccugccugccugccugccugucugc

SEQ ID NO: 403830 - RNA, 23 nt, Human
cugccugccugcggccugcccug

SEQ ID NO: 403831 - RNA, 22 nt, Human
cugccugccugcggccugucug

SEQ ID NO: 403832 - RNA, 32 nt, Human
cugccugccuggaaagaugagaacacuguugc

SEQ ID NO: 403833 - RNA, 21 nt, Human
cugccugccuggcccacgcug

SEQ ID NO: 403834 - RNA, 22 nt, Human
cugccugccuugccuuggggca

SEQ ID NO: 403835 - RNA, 32 nt, Human
cugccugcgccugagcagugcugaggagaugc

SEQ ID NO: 403836 - RNA, 21 nt, Human
cugccugcggcgucccugugc

SEQ ID NO: 403837 - RNA, 32 nt, Human
cugccugcgguuuuguguauguguguaugugu

SEQ ID NO: 403838 - RNA, 22 nt, Human
cugccugcuacgcaccgugcug

SEQ ID NO: 403839 - RNA, 32 nt, Human
cugccugcucaagugggucccugaccccugug

SEQ ID NO: 403840 - RNA, 22 nt, Human
cugccugcucaccccugggcug

SEQ ID NO: 403841 - RNA, 21 nt, Human
cugccugcucccauccugugu

SEQ ID NO: 403842 - RNA, 20 nt, Human
cugccugcuccuccuguguu

SEQ ID NO: 403843 - RNA, 21 nt, Human
cugccugcucucccugcguug

SEQ ID NO: 403844 - RNA, 19 nt, Human
cugccugcucugugccgug

SEQ ID NO: 403845 - RNA, 19 nt, Human
cugccugcugcccugacca

SEQ ID NO: 403846 - RNA, 19 nt, Human
cugccugcugcccugagcc

SEQ ID NO: 403847 - RNA, 32 nt, Human
cugccugcugcuauugcaauucccaggaucuc

SEQ ID NO: 403848 - RNA, 32 nt, Human
cugccugcugggagguuaggucggggcugccc

SEQ ID NO: 403849 - RNA, 18 nt, Human
cugccugcuguugagcca

SEQ ID NO: 403850 - RNA, 32 nt, Human
cugccugcuguugcagccuggcuggguuuauu

SEQ ID NO: 403851 - RNA, 32 nt, Human
cugccugcuguuggcaacccuccuggacuagg

SEQ ID NO: 403852 - RNA, 17 nt, Human
cugccugcuucccguaa

SEQ ID NO: 403853 - RNA, 17 nt, Human
cugccugcuucgcccug

SEQ ID NO: 403854 - RNA, 32 nt, Human
cugccugcuucucacccagcugccucggcgcu

SEQ ID NO: 403855 - RNA, 32 nt, Human
cugccugcuucucccaucccugccuucuggcc

SEQ ID NO: 403856 - RNA, 31 nt, Human
cugccugcuucucgccugccugugucugcug

SEQ ID NO: 403857 - RNA, 21 nt, Human
cugccuggaacaccagcagca

SEQ ID NO: 403858 - RNA, 32 nt, Human
cugccuggaaccuggcucgugcugugaccaga

SEQ ID NO: 403859 - RNA, 19 nt, Human
cugccuggaaucaucacca

SEQ ID NO: 403860 - RNA, 21 nt, Human
cugccuggaaucccagcacca

SEQ ID NO: 403861 - RNA, 32 nt, Human
cugccuggaauccgaagguggaggacaggcag

SEQ ID NO: 403862 - RNA, 32 nt, Human
cugccuggacaucagucuggaagcugugcauu

SEQ ID NO: 403863 - RNA, 32 nt, Human
cugccuggacccagaugcucccagaaucaaua

SEQ ID NO: 403864 - RNA, 22 nt, Human
cugccuggacccugggcugcca

SEQ ID NO: 403865 - RNA, 32 nt, Human
cugccuggacccugggcugccagaugcaggaa

SEQ ID NO: 403866 - RNA, 17 nt, Human
cugccuggaccugcagg

SEQ ID NO: 403867 - RNA, 32 nt, Human
cugccuggacuuuugcgauggacucuuugggg

SEQ ID NO: 403868 - RNA, 32 nt, Human
cugccuggagaaaagugucugcuccuagccaa

SEQ ID NO: 403869 - RNA, 32 nt, Human
cugccuggagaagggagagauucagguccucc

SEQ ID NO: 403870 - RNA, 32 nt, Human
cugccuggagaccagugggcccagggggaagg

SEQ ID NO: 403871 - RNA, 32 nt, Human
cugccuggagccaggcacagggacaggucccc

SEQ ID NO: 403872 - RNA, 32 nt, Human
cugccuggagcguuucuagcaagugagagaga

SEQ ID NO: 403873 - RNA, 32 nt, Human
cugccuggagcuguuuaauuuggagcuucccg

SEQ ID NO: 403874 - RNA, 20 nt, Human
cugccuggagcuguuuccau

SEQ ID NO: 403875 - RNA, 32 nt, Human
cugccuggaggcaggaaggagaggcagggcag

SEQ ID NO: 403876 - RNA, 21 nt, Human
cugccuggaggcccugagcca

SEQ ID NO: 403877 - RNA, 32 nt, Human
cugccuggaggcucuguauuugcucccgugga

SEQ ID NO: 403878 - RNA, 32 nt, Human
cugccuggagggcagggagugggagccaauga

SEQ ID NO: 403879 - RNA, 32 nt, Human
cugccuggagugacccugggcggggaccccug

SEQ ID NO: 403880 - RNA, 32 nt, Human
cugccuggagugcugugcuguguuuaaucagg

SEQ ID NO: 403881 - RNA, 32 nt, Human
cugccuggaugaggaccggcagagggaggaag

SEQ ID NO: 403882 - RNA, 32 nt, Human
cugccuggcaacauuuauauuucuuauucaga

SEQ ID NO: 403883 - RNA, 22 nt, Human
cugccuggcaagcccaguauca

SEQ ID NO: 403884 - RNA, 16 nt, Human
cugccuggcaccagca

SEQ ID NO: 403885 - RNA, 18 nt, Human
cugccuggcacugagcca

SEQ ID NO: 403886 - RNA, 18 nt, Human
cugccuggcagaagauca

SEQ ID NO: 403887 - RNA, 32 nt, Human
cugccuggcauuggcccuguggccaucuuccc

SEQ ID NO: 403888 - RNA, 32 nt, Human
cugccuggccaacaugaugaaacccugucucu

SEQ ID NO: 403889 - RNA, 32 nt, Human
cugccuggccaacauggugaaaccccaucucu

SEQ ID NO: 403890 - RNA, 24 nt, Human
cugccuggccaagcagcagcauca

SEQ ID NO: 403891 - RNA, 18 nt, Human
cugccuggcccagguaca

SEQ ID NO: 403892 - RNA, 20 nt, Human
cugccuggcccauagacauc

SEQ ID NO: 403893 - RNA, 20 nt, Human
cugccuggccccuggccauc

SEQ ID NO: 403894 - RNA, 19 nt, Human
cugccuggccccuuaacau

SEQ ID NO: 403895 - RNA, 19 nt, Human
cugccuggcccgcuccauc

SEQ ID NO: 403896 - RNA, 19 nt, Human
cugccuggcccuccccaca

SEQ ID NO: 403897 - RNA, 17 nt, Human
cugccuggcccugcuca

SEQ ID NO: 403898 - RNA, 18 nt, Human
cugccuggcccugggcca

SEQ ID NO: 403899 - RNA, 17 nt, Human
cugccuggccgcccauc

SEQ ID NO: 403900 - RNA, 20 nt, Human
cugccuggccucuagcuuca

SEQ ID NO: 403901 - RNA, 30 nt, Human
cugccuggccucucccucgugcuccucaag

SEQ ID NO: 403902 - RNA, 30 nt, Human
cugccuggccucuccucacuccuggcaccc

SEQ ID NO: 403903 - RNA, 18 nt, Human
cugccuggccucugcuca

SEQ ID NO: 403904 - RNA, 20 nt, Human
cugccuggccuucagcccca

SEQ ID NO: 403905 - RNA, 17 nt, Human
cugccuggccuugagcc

SEQ ID NO: 403906 - RNA, 19 nt, Human
cugccuggcgcucuggcca

SEQ ID NO: 403907 - RNA, 32 nt, Human
cugccuggcgggccccaugcacccaacggcgc

SEQ ID NO: 403908 - RNA, 22 nt, Human
cugccuggcuagucccugccug

SEQ ID NO: 403909 - RNA, 17 nt, Human
cugccuggcucagccuc

SEQ ID NO: 403910 - RNA, 20 nt, Human
cugccuggcucccacacagc

SEQ ID NO: 403911 - RNA, 21 nt, Human
cugccuggcucccuaggaauc

SEQ ID NO: 403912 - RNA, 21 nt, Human
cugccuggcucccugucuuca

SEQ ID NO: 403913 - RNA, 22 nt, Human
cugccuggcucccugucuucau

SEQ ID NO: 403914 - RNA, 23 nt, Human
cugccuggcucccuuucucagca

SEQ ID NO: 403915 - RNA, 18 nt, Human
cugccuggcuccggcauc

SEQ ID NO: 403916 - RNA, 19 nt, Human
cugccuggcuccugcccca

SEQ ID NO: 403917 - RNA, 32 nt, Human
cugccuggcuccugccccaagugccuugcuuu

SEQ ID NO: 403918 - RNA, 19 nt, Human
cugccuggcucugauauca

SEQ ID NO: 403919 - RNA, 32 nt, Human
cugccuggcugacugccuugcuagaaacauaa

SEQ ID NO: 403920 - RNA, 21 nt, Human
cugccuggcugacuuacagca

SEQ ID NO: 403921 - RNA, 19 nt, Human
cugccuggcugagcacauc

SEQ ID NO: 403922 - RNA, 19 nt, Human
cugccuggcugcgagcaca

SEQ ID NO: 403923 - RNA, 21 nt, Human
cugccuggcuggcuccgggcc

SEQ ID NO: 403924 - RNA, 20 nt, Human
cugccuggcuguccugccca

SEQ ID NO: 403925 - RNA, 21 nt, Human
cugccuggcuucaaagcuuca

SEQ ID NO: 403926 - RNA, 32 nt, Human
cugccugggaaacaggcuucauucagcacagc

SEQ ID NO: 403927 - RNA, 32 nt, Human
cugccugggaacacgugugcacaugcgcacuc

SEQ ID NO: 403928 - RNA, 32 nt, Human
cugccugggaaccugggcugugaguccugcuc

SEQ ID NO: 403929 - RNA, 24 nt, Human
cugccugggacuuccccagcauua

SEQ ID NO: 403930 - RNA, 17 nt, Human
cugccugggcagcaaca

SEQ ID NO: 403931 - RNA, 32 nt, Human
cugccugggcaggccauguuggggagacucca

SEQ ID NO: 403932 - RNA, 32 nt, Human
cugccugggcaguucuagggcuggagggcagg

SEQ ID NO: 403933 - RNA, 18 nt, Human
cugccugggcccagcauc

SEQ ID NO: 403934 - RNA, 32 nt, Human
cugccugggcccucccugucgucccaaagccc

SEQ ID NO: 403935 - RNA, 32 nt, Human
cugccuggggaacugugaggccagcuauauca

SEQ ID NO: 403936 - RNA, 20 nt, Human
cugccuggggaggcaaauca

SEQ ID NO: 403937 - RNA, 32 nt, Human
cugccuggggcccaaguugcagugagcagggu

SEQ ID NO: 403938 - RNA, 22 nt, Human
cugccuggggccucggcugccu

SEQ ID NO: 403939 - RNA, 32 nt, Human
cugccuggggcuggcccugcucagacaaaucu

SEQ ID NO: 403940 - RNA, 32 nt, Human
cugccugggucagauaguggccagcaggccag

SEQ ID NO: 403941 - RNA, 20 nt, Human
cugccugggucuucagcuca

SEQ ID NO: 403942 - RNA, 32 nt, Human
cugccuggguguuacauggcccagggaaccca

SEQ ID NO: 403943 - RNA, 18 nt, Human
cugccuggucaaccauca

SEQ ID NO: 403944 - RNA, 32 nt, Human
cugccuggucagaacaagccccgaggugcaga

SEQ ID NO: 403945 - RNA, 17 nt, Human
cugccuggugagcauca

SEQ ID NO: 403946 - RNA, 19 nt, Human
cugccuggugcccagcaca

SEQ ID NO: 403947 - RNA, 32 nt, Human
cugccugguggagggagccgugggcgugggga

SEQ ID NO: 403948 - RNA, 32 nt, Human
cugccugguguguccucagcucccagggcugc

SEQ ID NO: 403949 - RNA, 32 nt, Human
cugccugguuuuaagauucucagucuguugcc

SEQ ID NO: 403950 - RNA, 20 nt, Human
cugccuguaccaggcugccu

SEQ ID NO: 403951 - RNA, 32 nt, Human
cugccuguauauguuuugugaaaugguccugu

SEQ ID NO: 403952 - RNA, 32 nt, Human
cugccugucagccucuugccuccuaaacgugu

SEQ ID NO: 403953 - RNA, 21 nt, Human
cugccuguccagagcugacca

SEQ ID NO: 403954 - RNA, 32 nt, Human
cugccuguccagccuggcucccuuccugggcc

SEQ ID NO: 403955 - RNA, 32 nt, Human
cugccugucccaggacccuaugguaaugaaca

SEQ ID NO: 403956 - RNA, 32 nt, Human
cugccuguccccaucccacagagggcaaggag

SEQ ID NO: 403957 - RNA, 32 nt, Human
cugccugucuuggggguugguggaggguggag

SEQ ID NO: 403958 - RNA, 32 nt, Human
cugccugugagcagucccucuggaaagaaaca

SEQ ID NO: 403959 - RNA, 32 nt, Human
cugccugugcacugcaagcugugucuacucag

SEQ ID NO: 403960 - RNA, 32 nt, Human
cugccugugcaggauccggagcccagcagcac

SEQ ID NO: 403961 - RNA, 32 nt, Human
cugccugugcaucuucucgcacugagauuuug

SEQ ID NO: 403962 - RNA, 21 nt, Human
cugccugugcccgcugcgcug

SEQ ID NO: 403963 - RNA, 32 nt, Human
cugccugugcucagguccucagcuccauggga

SEQ ID NO: 403964 - RNA, 24 nt, Human
cugccugugcucugccucgggcca

SEQ ID NO: 403965 - RNA, 21 nt, Human
cugccuguggagcuccugugc

SEQ ID NO: 403966 - RNA, 32 nt, Human
cugccuguggccaugacccugccucucccagg

SEQ ID NO: 403967 - RNA, 21 nt, Human
cugccuguggcccccgagcca

SEQ ID NO: 403968 - RNA, 32 nt, Human
cugccugugggaugucagcguucugguaucug

SEQ ID NO: 403969 - RNA, 32 nt, Human
cugccuguggguccccauugcccagcuuuugc

SEQ ID NO: 403970 - RNA, 32 nt, Human
cugccugugggucucaauugcccagcuccggc

SEQ ID NO: 403971 - RNA, 32 nt, Human
cugccugugggucuucauugcccagcuccugc

SEQ ID NO: 403972 - RNA, 21 nt, Human
cugccugugguuuucagcuca

SEQ ID NO: 403973 - RNA, 32 nt, Human
cugccugugucacccugucccacugaggucag

SEQ ID NO: 403974 - RNA, 32 nt, Human
cugccuguguccaugucagacuuugagcugau

SEQ ID NO: 403975 - RNA, 32 nt, Human
cugccuguguccuguguuccccacagggagag

SEQ ID NO: 403976 - RNA, 23 nt, Human
cugccugugugcccuucuccagg

SEQ ID NO: 403977 - RNA, 32 nt, Human
cugccugugugugcuguggcuuugaacuguaa

SEQ ID NO: 403978 - RNA, 21 nt, Human
cugccugugugugugcaagug

SEQ ID NO: 403979 - RNA, 20 nt, Human
cugccuguugaguagcauca

SEQ ID NO: 403980 - RNA, 32 nt, Human
cugccuguuuccuccaccuccacccccacccc

SEQ ID NO: 403981 - RNA, 32 nt, Human
cugccuguuuccuccccaccagccuccucccc

SEQ ID NO: 403982 - RNA, 32 nt, Human
cugccuguuucuucccccuccucuaagcuacu

SEQ ID NO: 403983 - RNA, 31 nt, Human
cugccuuacagcuagagcaagaguguguaau

SEQ ID NO: 403984 - RNA, 32 nt, Human
cugccuuagucucaguuugugugucuuaauua

SEQ ID NO: 403985 - RNA, 28 nt, Human
cugccuuauaauguagaugagcaacucu

SEQ ID NO: 403986 - RNA, 24 nt, Human
cugccuuaucuaaaucaccagaga

SEQ ID NO: 403987 - RNA, 24 nt, Human
cugccuuaucucugugcaccaaga

SEQ ID NO: 403988 - RNA, 21 nt, Human
cugccuuaucuuaaccaagga

SEQ ID NO: 403989 - RNA, 32 nt, Human
cugccuuaucuugccccucuaccuggcucugu

SEQ ID NO: 403990 - RNA, 32 nt, Human
cugccuuaugucccuuccuuguggacuucaca

SEQ ID NO: 403991 - RNA, 17 nt, Human
cugccuucaaacaggug

SEQ ID NO: 403992 - RNA, 32 nt, Human
cugccuucaaucaucccuccucuugcaggucu

SEQ ID NO: 403993 - RNA, 32 nt, Human
cugccuucaaucuucagggacugcagggaaga

SEQ ID NO: 403994 - RNA, 32 nt, Human
cugccuucaggaaauggacaggucaguuuguu

SEQ ID NO: 403995 - RNA, 23 nt, Human
cugccuucaggacucugccuuca

SEQ ID NO: 403996 - RNA, 32 nt, Human
cugccuucaugaagaaaagacagaggcagaaa

SEQ ID NO: 403997 - RNA, 32 nt, Human
cugccuucaugcccaggacaccagcugggucc

SEQ ID NO: 403998 - RNA, 32 nt, Human
cugccuuccaacuaccacucucccagauguga

SEQ ID NO: 403999 - RNA, 32 nt, Human
cugccuuccagccacaucgccugagauugaca

SEQ ID NO: 404000 - RNA, 32 nt, Human
cugccuuccccaagcauccagccuggggaugg

SEQ ID NO: 404001 - RNA, 21 nt, Human
cugccuucccgcgcuccggug

SEQ ID NO: 404002 - RNA, 32 nt, Human
cugccuucccuucacaccuuccugccccagau

SEQ ID NO: 404003 - RNA, 32 nt, Human
cugccuuccuacccucucuaauggccccucca

SEQ ID NO: 404004 - RNA, 32 nt, Human
cugccuuccuagcagauguggugagcccaucc

SEQ ID NO: 404005 - RNA, 22 nt, Human
cugccuuccugcuucugggcua

SEQ ID NO: 404006 - RNA, 32 nt, Human
cugccuuccugugcccagaaaggaaggggcua

SEQ ID NO: 404007 - RNA, 32 nt, Human
cugccuucgcguugcuggggugcagugagacu

SEQ ID NO: 404008 - RNA, 32 nt, Human
cugccuucuaguuuuuagucucagaccagacc

SEQ ID NO: 404009 - RNA, 32 nt, Human
cugccuucucaaggaguccacagucuggagga

SEQ ID NO: 404010 - RNA, 32 nt, Human
cugccuucuccuccauuucucugcucagaagg

SEQ ID NO: 404011 - RNA, 32 nt, Human
cugccuucuccucucugggccuuuguuuccuu

SEQ ID NO: 404012 - RNA, 32 nt, Human
cugccuucucggaucggauccagcacauccag

SEQ ID NO: 404013 - RNA, 32 nt, Human
cugccuucucguggcccugugugagcacaugu

SEQ ID NO: 404014 - RNA, 32 nt, Human
cugccuucucuccuggcaggcgcugccuuuuc

SEQ ID NO: 404015 - RNA, 32 nt, Human
cugccuucucuucaucccaacauuccugaugu

SEQ ID NO: 404016 - RNA, 32 nt, Human
cugccuucugaccuuuuccuugauucaacaaa

SEQ ID NO: 404017 - RNA, 32 nt, Human
cugccuucugaugcuggacuggccuugcuucu

SEQ ID NO: 404018 - RNA, 24 nt, Human
cugccuucugcccucugcccugca

SEQ ID NO: 404019 - RNA, 19 nt, Human
cugccuucugcccuggguc

SEQ ID NO: 404020 - RNA, 18 nt, Human
cugccuucuguccuggcc

SEQ ID NO: 404021 - RNA, 32 nt, Human
cugccuucuguggagcauggcacccacaggcu

SEQ ID NO: 404022 - RNA, 23 nt, Human
cugccuucuuccucccuccacgg

SEQ ID NO: 404023 - RNA, 20 nt, Human
cugccuucuuguuccagcua

SEQ ID NO: 404024 - RNA, 23 nt, Human
cugccuugaccacuuuccccagg

SEQ ID NO: 404025 - RNA, 18 nt, Human
cugccuugacccugcagg

SEQ ID NO: 404026 - RNA, 19 nt, Human
cugccuugauucagcauca

SEQ ID NO: 404027 - RNA, 24 nt, Human
cugccuugauuucccucucccagg

SEQ ID NO: 404028 - RNA, 25 nt, Human
cugccuugcacaggcccuucccagg

SEQ ID NO: 404029 - RNA, 22 nt, Human
cugccuugcaucguuccgaguc

SEQ ID NO: 404030 - RNA, 32 nt, Human
cugccuugcccaggggugggauggcacugaag

SEQ ID NO: 404031 - RNA, 18 nt, Human
cugccuugccggccccug

SEQ ID NO: 404032 - RNA, 32 nt, Human
cugccuuggagacagaaugacagcuguggcaa

SEQ ID NO: 404033 - RNA, 32 nt, Human
cugccuuggagcacgcauugcugguggcagga

SEQ ID NO: 404034 - RNA, 19 nt, Human
cugccuuggcaucccaaag

SEQ ID NO: 404035 - RNA, 23 nt, Human
cugccuuggccuccuggcugcuu

SEQ ID NO: 404036 - RNA, 20 nt, Human
cugccuuggccuggccuugu

SEQ ID NO: 404037 - RNA, 32 nt, Human
cugccuuggcugcuacagcuuuuucacuccac

SEQ ID NO: 404038 - RNA, 21 nt, Human
cugccuuggcuuucugaugca

SEQ ID NO: 404039 - RNA, 32 nt, Human
cugccuugggcccagcccuggccucuggcuua

SEQ ID NO: 404040 - RNA, 19 nt, Human
cugccuuggucccugagcc

SEQ ID NO: 404041 - RNA, 28 nt, Human
cugccuuggugggcaguucugccuucca

SEQ ID NO: 404042 - RNA, 32 nt, Human
cugccuuguacccugagcugcaucaccuccua

SEQ ID NO: 404043 - RNA, 32 nt, Human
cugccuugucagccucugacccucaucucuca

SEQ ID NO: 404044 - RNA, 18 nt, Human
cugccuuguccuggcaag

SEQ ID NO: 404045 - RNA, 32 nt, Human
cugccuugugaguggccugcugccucaccucc

SEQ ID NO: 404046 - RNA, 20 nt, Human
cugccuuguguccugagcca

SEQ ID NO: 404047 - RNA, 19 nt, Human
cugccuuguuuccugccag

SEQ ID NO: 404048 - RNA, 32 nt, Human
cugccuuguuuggccucacuguaucccaccca

SEQ ID NO: 404049 - RNA, 32 nt, Human
cugccuuuaaaauccuuccucuuucuuccucc

SEQ ID NO: 404050 - RNA, 32 nt, Human
cugccuuucaaagcucucucccccaugaccca

SEQ ID NO: 404051 - RNA, 23 nt, Human
cugccuuucauaaucaccaggga

SEQ ID NO: 404052 - RNA, 23 nt, Human
cugccuuucauugcaacacggug

SEQ ID NO: 404053 - RNA, 32 nt, Human
cugccuuucccaaagugguuagguuuggaaaa

SEQ ID NO: 404054 - RNA, 19 nt, Human
cugccuuucccacucucca

SEQ ID NO: 404055 - RNA, 17 nt, Human
cugccuuucccugcagg

SEQ ID NO: 404056 - RNA, 24 nt, Human
cugccuuuccgcggccuccgcgaa

SEQ ID NO: 404057 - RNA, 32 nt, Human
cugccuuuccucuaucagagaaguugauccau

SEQ ID NO: 404058 - RNA, 32 nt, Human
cugccuuuccugggggcaaaaggggcaggugg

SEQ ID NO: 404059 - RNA, 32 nt, Human
cugccuuucucuuccuccaucaggcccuguau

SEQ ID NO: 404060 - RNA, 32 nt, Human
cugccuuucuggcagcaggcaggaagccgcaa

SEQ ID NO: 404061 - RNA, 32 nt, Human
cugccuuugaagcgcagcccucuguggcccgc

SEQ ID NO: 404062 - RNA, 32 nt, Human
cugccuuugagcagggagucucacauguuuaa

SEQ ID NO: 404063 - RNA, 32 nt, Human
cugccuuugagcuucuccucugcuccaacaga

SEQ ID NO: 404064 - RNA, 32 nt, Human
cugccuuugcaccccuucccccaaacccuauc

SEQ ID NO: 404065 - RNA, 32 nt, Human
cugccuuugcauccuguccuccagccacccuu

SEQ ID NO: 404066 - RNA, 32 nt, Human
cugccuuugccugguccuccagguugcugggg

SEQ ID NO: 404067 - RNA, 25 nt, Human
cugccuuugcuuuuaucgcuuugca

SEQ ID NO: 404068 - RNA, 32 nt, Human
cugccuuuggacugcucugacuuuagcaucag

SEQ ID NO: 404069 - RNA, 32 nt, Human
cugccuuugguaucaucuuccucuguccuuac

SEQ ID NO: 404070 - RNA, 32 nt, Human
cugccuuugugagccuccgggagcagguaacc

SEQ ID NO: 404071 - RNA, 32 nt, Human
cugccuuuguuaggcagauuuggaggggaggc

SEQ ID NO: 404072 - RNA, 32 nt, Human
cugccuuuucauuuucaucuuuucuugcugcu

SEQ ID NO: 404073 - RNA, 32 nt, Human
cugccuuuuccucugugacaugccugccugcc

SEQ ID NO: 404074 - RNA, 19 nt, Human
cugccuuuucuccggguca

SEQ ID NO: 404075 - RNA, 20 nt, Human
cugccuuuugccuccugcaa

SEQ ID NO: 404076 - RNA, 31 nt, Human
cugccuuuugucucuggguuuuguucucagc

SEQ ID NO: 404077 - RNA, 32 nt, Human
cugccuuuuucaccaccucuaauuucagcuuc

SEQ ID NO: 404078 - RNA, 32 nt, Human
cugcgaaagagcagaaaacaggaccaggaaca

SEQ ID NO: 404079 - RNA, 32 nt, Human
cugcgaacagccauugcacuccagccugggca

SEQ ID NO: 404080 - RNA, 32 nt, Human
cugcgaacauucuugcacacaugcccugguac

SEQ ID NO: 404081 - RNA, 32 nt, Human
cugcgaacucuugaacaccauacuuuagcaau

SEQ ID NO: 404082 - RNA, 32 nt, Human
cugcgaaggggcccugaacggccgucgcccuc

SEQ ID NO: 404083 - RNA, 32 nt, Human
cugcgaaguaaucugcaaucucuuuuguucuu

SEQ ID NO: 404084 - RNA, 20 nt, Human
cugcgaaguccgcggcugcc

SEQ ID NO: 404085 - RNA, 32 nt, Human
cugcgaauagccacugcacuccagccugggca

SEQ ID NO: 404086 - RNA, 32 nt, Human
cugcgaccagagacuggaggugacccuugccc

SEQ ID NO: 404087 - RNA, 32 nt, Human
cugcgacccacugucuuuggaauccaccccag

SEQ ID NO: 404088 - RNA, 32 nt, Human
cugcgacccuggaagcgggagccgccgcgagc

SEQ ID NO: 404089 - RNA, 32 nt, Human
cugcgaccucccugcccugccgccacaugcag

SEQ ID NO: 404090 - RNA, 32 nt, Human
cugcgacggggucuccaugagcacagaggcug

SEQ ID NO: 404091 - RNA, 32 nt, Human
cugcgacucuuagaacacuugcuuugaaggau

SEQ ID NO: 404092 - RNA, 32 nt, Human
cugcgagaaaacuugcaugugugcacaaagau

SEQ ID NO: 404093 - RNA, 24 nt, Human
cugcgagacauggcaaaacccugu

SEQ ID NO: 404094 - RNA, 16 nt, Human
cugcgagacccaaggc

SEQ ID NO: 404095 - RNA, 21 nt, Human
cugcgagacuucaggccgcuu

SEQ ID NO: 404096 - RNA, 32 nt, Human
cugcgagagagggagacacccggaggagcagg

SEQ ID NO: 404097 - RNA, 32 nt, Human
cugcgagagcuuccagugaccuucuuugccca

SEQ ID NO: 404098 - RNA, 32 nt, Human
cugcgagaggugcucaucaucaugcccauuuu

SEQ ID NO: 404099 - RNA, 32 nt, Human
cugcgagcacugaaaccuacuuagucuuuccc

SEQ ID NO: 404100 - RNA, 32 nt, Human
cugcgagccaggauuccugauccagagacaac

SEQ ID NO: 404101 - RNA, 23 nt, Human
cugcgagcccggccccugcuguu

SEQ ID NO: 404102 - RNA, 32 nt, Human
cugcgagccugcacucacuucauccucagcag

SEQ ID NO: 404103 - RNA, 23 nt, Human
cugcgagcuuggccccucugcug

SEQ ID NO: 404104 - RNA, 32 nt, Human
cugcgagggccccagccagggcagcuuucagg

SEQ ID NO: 404105 - RNA, 32 nt, Human
cugcgagggccucaaggagcagaggaaggggc

SEQ ID NO: 404106 - RNA, 32 nt, Human
cugcgaggggaaggaaaagggaggcagcgcga

SEQ ID NO: 404107 - RNA, 32 nt, Human
cugcgaggggcugugcugugccaggggaggcc

SEQ ID NO: 404108 - RNA, 32 nt, Human
cugcgagguuucuucucaucaccagcucagcu

SEQ ID NO: 404109 - RNA, 32 nt, Human
cugcgagucugggaacagaucuguuuuucacu

SEQ ID NO: 404110 - RNA, 32 nt, Human
cugcgagugguuucuugugcacuggcaccaag

SEQ ID NO: 404111 - RNA, 32 nt, Human
cugcgauacagcccuggagcucagucagccac

SEQ ID NO: 404112 - RNA, 32 nt, Human
cugcgaucacgugccugggaggaggagcugag

SEQ ID NO: 404113 - RNA, 32 nt, Human
cugcgaucucagcucacugcaaccuccgccuc

SEQ ID NO: 404114 - RNA, 32 nt, Human
cugcgcaaaaugcagccucuaagagcuggagg

SEQ ID NO: 404115 - RNA, 32 nt, Human
cugcgcaaaauguggaggaaaauucauuacca

SEQ ID NO: 404116 - RNA, 32 nt, Human
cugcgcaaaggguuucaccaaggauggagaaa

SEQ ID NO: 404117 - RNA, 24 nt, Human
cugcgcaacauggcgaaaccccgu

SEQ ID NO: 404118 - RNA, 32 nt, Human
cugcgcaacauggcgaaaccccgucucuacaa

SEQ ID NO: 404119 - RNA, 32 nt, Human
cugcgcacacacagcagucugucacgaggcug

SEQ ID NO: 404120 - RNA, 21 nt, Human
cugcgcaccaaggaauggaga

SEQ ID NO: 404121 - RNA, 32 nt, Human
cugcgcacugccuguuccuccugggugucacu

SEQ ID NO: 404122 - RNA, 24 nt, Human
cugcgcagaccagcuucugcagga

SEQ ID NO: 404123 - RNA, 22 nt, Human
cugcgcagcccggggauggaga

SEQ ID NO: 404124 - RNA, 32 nt, Human
cugcgcagccugggaggaggcguggauccugg

SEQ ID NO: 404125 - RNA, 31 nt, Human
cugcgcaggagagucagagggggaagaguua

SEQ ID NO: 404126 - RNA, 32 nt, Human
cugcgcaggcgcggaccaaagcgaucucuucu

SEQ ID NO: 404127 - RNA, 32 nt, Human
cugcgcagggccagugccuggcauguguccca

SEQ ID NO: 404128 - RNA, 32 nt, Human
cugcgcagucaccauggcgaugcauuucaucu

SEQ ID NO: 404129 - RNA, 32 nt, Human
cugcgcagugaagaaaaugaguagcagcucau

SEQ ID NO: 404130 - RNA, 32 nt, Human
cugcgcaugcaagcccugcuguguggcugucg

SEQ ID NO: 404131 - RNA, 32 nt, Human
cugcgccaaugccccugccucuagugcacucc

SEQ ID NO: 404132 - RNA, 32 nt, Human
cugcgccacaguuugguccagaggagggagga

SEQ ID NO: 404133 - RNA, 19 nt, Human
cugcgccaccgcgcuccag

SEQ ID NO: 404134 - RNA, 32 nt, Human
cugcgccaccgcgcuccagccugggugacaga

SEQ ID NO: 404135 - RNA, 32 nt, Human
cugcgccacggcacuccagccugggcgacaga

SEQ ID NO: 404136 - RNA, 32 nt, Human
cugcgccacugcacuccagccugggcaacaga

SEQ ID NO: 404137 - RNA, 32 nt, Human
cugcgccacugcacuccagucugggacaacag

SEQ ID NO: 404138 - RNA, 32 nt, Human
cugcgccaucuccaucagagcugcaucucucu

SEQ ID NO: 404139 - RNA, 32 nt, Human
cugcgccauggacgagccacccuucagcgagg

SEQ ID NO: 404140 - RNA, 32 nt, Human
cugcgccauugcacuccagcccgggcaacaag

SEQ ID NO: 404141 - RNA, 32 nt, Human
cugcgcccaaugggcccuccgucuggccuccc

SEQ ID NO: 404142 - RNA, 32 nt, Human
cugcgcccacuaucaucccugcuccagcugcc

SEQ ID NO: 404143 - RNA, 32 nt, Human
cugcgcccagccauuaugaaugucaauauuga

SEQ ID NO: 404144 - RNA, 19 nt, Human
cugcgcccccauccucuca

SEQ ID NO: 404145 - RNA, 32 nt, Human
cugcgccccucaggccagcaguugagguccau

SEQ ID NO: 404146 - RNA, 17 nt, Human
cugcgccccuccgagua

SEQ ID NO: 404147 - RNA, 18 nt, Human
cugcgccccucgccccag

SEQ ID NO: 404148 - RNA, 32 nt, Human
cugcgccccugcccagcgugcucugggugcuc

SEQ ID NO: 404149 - RNA, 17 nt, Human
cugcgccccuggcuggg

SEQ ID NO: 404150 - RNA, 32 nt, Human
cugcgcccgcagcucugugggccccgcaccca

SEQ ID NO: 404151 - RNA, 32 nt, Human
cugcgcccgcgccuccccuugcgcaccguggc

SEQ ID NO: 404152 - RNA, 32 nt, Human
cugcgcccuagugccccugcugggcaguggcg

SEQ ID NO: 404153 - RNA, 32 nt, Human
cugcgcccucgccucagaccucucgggcgagc

SEQ ID NO: 404154 - RNA, 32 nt, Human
cugcgcccucuccuauaaagcagacgccgcgc

SEQ ID NO: 404155 - RNA, 32 nt, Human
cugcgcccugcacuucguacuuuccgagaguu

SEQ ID NO: 404156 - RNA, 32 nt, Human
cugcgcccugggacagcggagagauggcuucu

SEQ ID NO: 404157 - RNA, 18 nt, Human
cugcgcccugggcuccag

SEQ ID NO: 404158 - RNA, 32 nt, Human
cugcgcccuuaacugcauccagccuggggcug

SEQ ID NO: 404159 - RNA, 19 nt, Human
cugcgccgcccgcgccccg

SEQ ID NO: 404160 - RNA, 32 nt, Human
cugcgccggaaggaggcuguuagcgugcugga

SEQ ID NO: 404161 - RNA, 32 nt, Human
cugcgccggagcaggggcauggucuaguggcc

SEQ ID NO: 404162 - RNA, 32 nt, Human
cugcgccgucccucguuccauggcccaguccu

SEQ ID NO: 404163 - RNA, 32 nt, Human
cugcgccgucuccccaguccccaaaccccagu

SEQ ID NO: 404164 - RNA, 32 nt, Human
cugcgccuaagcugggccacaaccgccaguca

SEQ ID NO: 404165 - RNA, 18 nt, Human
cugcgccucacccuccag

SEQ ID NO: 404166 - RNA, 32 nt, Human
cugcgccuccacuaugcucucccuccgugucc

SEQ ID NO: 404167 - RNA, 32 nt, Human
cugcgccuccacugcagugccugggcuccccu

SEQ ID NO: 404168 - RNA, 32 nt, Human
cugcgccuccugucauuucccugcugggcucu

SEQ ID NO: 404169 - RNA, 32 nt, Human
cugcgccucucgucguggccuccuggacucaa

SEQ ID NO: 404170 - RNA, 32 nt, Human
cugcgccugccugauguuguuucuuuauuccu

SEQ ID NO: 404171 - RNA, 32 nt, Human
cugcgccugccuggcugccugugcaggugccc

SEQ ID NO: 404172 - RNA, 19 nt, Human
cugcgccugcugccuccag

SEQ ID NO: 404173 - RNA, 32 nt, Human
cugcgccugcugccuccagcccugaggauggc

SEQ ID NO: 404174 - RNA, 32 nt, Human
cugcgccuguaaucccagcacuuugggaggcc

SEQ ID NO: 404175 - RNA, 32 nt, Human
cugcgccuguaaucccagcuacccaggaggcu

SEQ ID NO: 404176 - RNA, 20 nt, Human
cugcgccuucugggucucug

SEQ ID NO: 404177 - RNA, 32 nt, Human
cugcgcgaggguguaggaaggaaagcccagga

SEQ ID NO: 404178 - RNA, 18 nt, Human
cugcgcgcagcccgggcc

SEQ ID NO: 404179 - RNA, 19 nt, Human
cugcgcgcccgccucggcc

SEQ ID NO: 404180 - RNA, 32 nt, Human
cugcgcgccgcgggcacuucuccugggcucuc

SEQ ID NO: 404181 - RNA, 32 nt, Human
cugcgcgccggguccuggaggccgaggccgcu

SEQ ID NO: 404182 - RNA, 31 nt, Human
cugcgcgccuacgcgggaccuguguccgaaa

SEQ ID NO: 404183 - RNA, 20 nt, Human
cugcgcgccucgcuugagcu

SEQ ID NO: 404184 - RNA, 32 nt, Human
cugcgcggaggcugcuacacacaugcagaagu

SEQ ID NO: 404185 - RNA, 32 nt, Human
cugcgcggcauggaggguggugugaguuccuc

SEQ ID NO: 404186 - RNA, 32 nt, Human
cugcgcggccucucccccaacucugcucuguu

SEQ ID NO: 404187 - RNA, 26 nt, Human
cugcgcuaguucggccucugccgcug

SEQ ID NO: 404188 - RNA, 32 nt, Human
cugcgcucaggugauccuccagcuucagcuac

SEQ ID NO: 404189 - RNA, 32 nt, Human
cugcgcucauuucauccucuggcuuccucacu

SEQ ID NO: 404190 - RNA, 32 nt, Human
cugcgcuccaagaaaugccuggagucucacgc

SEQ ID NO: 404191 - RNA, 32 nt, Human
cugcgcuccagccuggacaacacagugagacu

SEQ ID NO: 404192 - RNA, 32 nt, Human
cugcgcuccagccuggcagacagagggaagau

SEQ ID NO: 404193 - RNA, 32 nt, Human
cugcgcuccagccugggcaacagagcgagacu

SEQ ID NO: 404194 - RNA, 32 nt, Human
cugcgcuccagccugggcaacagagugagacu

SEQ ID NO: 404195 - RNA, 32 nt, Human
cugcgcuccagccugggcgacagagugguauu

SEQ ID NO: 404196 - RNA, 32 nt, Human
cugcgcuccagccugggugacagagugagacu

SEQ ID NO: 404197 - RNA, 32 nt, Human
cugcgcucccuggagcgagcuggugaggaggg

SEQ ID NO: 404198 - RNA, 32 nt, Human
cugcgcucuccgccgcgcucuaccuccauuag

SEQ ID NO: 404199 - RNA, 32 nt, Human
cugcgcucucucccuucuccccucaccccgcc

SEQ ID NO: 404200 - RNA, 32 nt, Human
cugcgcugcacuccucugcccuggggccaccu

SEQ ID NO: 404201 - RNA, 32 nt, Human
cugcgcugcagaggcacuccacccugggcacg

SEQ ID NO: 404202 - RNA, 32 nt, Human
cugcgcugcagccugggcaacacagugagacc

SEQ ID NO: 404203 - RNA, 32 nt, Human
cugcgcugcgcagggcgcuaggaggcauuguc

SEQ ID NO: 404204 - RNA, 18 nt, Human
cugcgcugcgcuccggcc

SEQ ID NO: 404205 - RNA, 32 nt, Human
cugcgcugcuccuggcucacagcgcuccgggc

SEQ ID NO: 404206 - RNA, 32 nt, Human
cugcgcugggaggggugggggcggugccauug

SEQ ID NO: 404207 - RNA, 32 nt, Human
cugcgcugggcgcgcggaggccuaggcgggaa

SEQ ID NO: 404208 - RNA, 32 nt, Human
cugcgcugggcugaagggagggaaaggcggcu

SEQ ID NO: 404209 - RNA, 32 nt, Human
cugcgcugggugcugaggccacugcugucaau

SEQ ID NO: 404210 - RNA, 32 nt, Human
cugcgcuuccuugaguguggcuucccacuuuu

SEQ ID NO: 404211 - RNA, 32 nt, Human
cugcggaaagcaggccaggggucuccacaggg

SEQ ID NO: 404212 - RNA, 32 nt, Human
cugcggaaaucaacagccccagagccacuugg

SEQ ID NO: 404213 - RNA, 32 nt, Human
cugcggaagacagggccccugugucauaguca

SEQ ID NO: 404214 - RNA, 32 nt, Human
cugcggacaccagcuccucucuccgccgucac

SEQ ID NO: 404215 - RNA, 26 nt, Human
cugcggacuccauggcccuuccugga

SEQ ID NO: 404216 - RNA, 32 nt, Human
cugcggagagcagcagcagagcugaguaauga

SEQ ID NO: 404217 - RNA, 32 nt, Human
cugcggagagugaguggagagaggagaggcaa

SEQ ID NO: 404218 - RNA, 32 nt, Human
cugcggagccauccugaggcuuugacaucuau

SEQ ID NO: 404219 - RNA, 32 nt, Human
cugcggagcuuuccaccucgccugccuugggc

SEQ ID NO: 404220 - RNA, 32 nt, Human
cugcggaggagaagcaggaggagggaggagga

SEQ ID NO: 404221 - RNA, 19 nt, Human
cugcggaggauggcaggug

SEQ ID NO: 404222 - RNA, 18 nt, Human
cugcggaggcaacggcag

SEQ ID NO: 404223 - RNA, 32 nt, Human
cugcggaguauuccugggcauggugcugggca

SEQ ID NO: 404224 - RNA, 32 nt, Human
cugcggagucauaucucauucaugcugcagcc

SEQ ID NO: 404225 - RNA, 32 nt, Human
cugcggagugcgcugcgccgcccagcccuguc

SEQ ID NO: 404226 - RNA, 32 nt, Human
cugcggauggugcugcuguccccagccucucu

SEQ ID NO: 404227 - RNA, 32 nt, Human
cugcggcagagcccaggcuggggaagugaacu

SEQ ID NO: 404228 - RNA, 18 nt, Human
cugcggcaggacugcaga

SEQ ID NO: 404229 - RNA, 32 nt, Human
cugcggcaggcagagcuggugggggcaggggu

SEQ ID NO: 404230 - RNA, 32 nt, Human
cugcggcaggcggaucacuugaggucaggagu

SEQ ID NO: 404231 - RNA, 32 nt, Human
cugcggcagugcaggggugcuugcugagauga

SEQ ID NO: 404232 - RNA, 32 nt, Human
cugcggcagugcugggguggcaccaggugggc

SEQ ID NO: 404233 - RNA, 19 nt, Human
cugcggccaccggccggca

SEQ ID NO: 404234 - RNA, 32 nt, Human
cugcggccacugcaggaccuggaggugggacu

SEQ ID NO: 404235 - RNA, 32 nt, Human
cugcggccacugcaugugagagaauccugcaa

SEQ ID NO: 404236 - RNA, 32 nt, Human
cugcggccagggaggugcggagcagcuucgga

SEQ ID NO: 404237 - RNA, 22 nt, Human
cugcggccagucccuggugccc

SEQ ID NO: 404238 - RNA, 32 nt, Human
cugcggcccaauccaaggugggguggaagcuu

SEQ ID NO: 404239 - RNA, 32 nt, Human
cugcggcccagcgagcggcccagaugcaggcc

SEQ ID NO: 404240 - RNA, 24 nt, Human
cugcggcccggggcuggagcgcag

SEQ ID NO: 404241 - RNA, 32 nt, Human
cugcggcccuagcgacccucaggcuucuuccc

SEQ ID NO: 404242 - RNA, 32 nt, Human
cugcggcccuggaaagcgauggagguggcggc

SEQ ID NO: 404243 - RNA, 18 nt, Human
cugcggccgcccugggcc

SEQ ID NO: 404244 - RNA, 32 nt, Human
cugcggccucaaacuccggggcucaggcaguc

SEQ ID NO: 404245 - RNA, 32 nt, Human
cugcggccucaaacuccugggcucaagugauc

SEQ ID NO: 404246 - RNA, 32 nt, Human
cugcggccuccaccaaccccgcggcccagacc

SEQ ID NO: 404247 - RNA, 32 nt, Human
cugcggccucccaagcagcagcaacagcagcc

SEQ ID NO: 404248 - RNA, 32 nt, Human
cugcggccugcccugcaugcaggauggcccug

SEQ ID NO: 404249 - RNA, 32 nt, Human
cugcggccugcucucaggguggggugacuauu

SEQ ID NO: 404250 - RNA, 32 nt, Human
cugcggccuuucucaucuccuuuuccugcguu

SEQ ID NO: 404251 - RNA, 19 nt, Human
cugcggcgcaggcacucca

SEQ ID NO: 404252 - RNA, 18 nt, Human
cugcggcgccggcuccug

SEQ ID NO: 404253 - RNA, 32 nt, Human
cugcggcgccgggcauuucuccgcagcucggc

SEQ ID NO: 404254 - RNA, 20 nt, Human
cugcggcgcggggcaaggug

SEQ ID NO: 404255 - RNA, 32 nt, Human
cugcggcgggcggaucaccugaggucaggagu

SEQ ID NO: 404256 - RNA, 32 nt, Human
cugcggcggggcuguccucgcggacugacugg

SEQ ID NO: 404257 - RNA, 32 nt, Human
cugcggcgggguagaggcggaggcggagucga

SEQ ID NO: 404258 - RNA, 19 nt, Human
cugcggcuccacugaguca

SEQ ID NO: 404259 - RNA, 32 nt, Human
cugcggcuccaggacuuucugcagaaugugcc

SEQ ID NO: 404260 - RNA, 32 nt, Human
cugcggcuccauccucggcuccugggcaccgu

SEQ ID NO: 404261 - RNA, 32 nt, Human
cugcggcuccgaaagggucagaggguacccga

SEQ ID NO: 404262 - RNA, 19 nt, Human
cugcggcuccgcugggcca

SEQ ID NO: 404263 - RNA, 19 nt, Human
cugcggcuccuccugcagg

SEQ ID NO: 404264 - RNA, 32 nt, Human
cugcggcucuuggagaaagcgugagcaggggg

SEQ ID NO: 404265 - RNA, 23 nt, Human
cugcggcugcagaggcgcugcag

SEQ ID NO: 404266 - RNA, 18 nt, Human
cugcggcugcuccgggcu

SEQ ID NO: 404267 - RNA, 32 nt, Human
cugcggcugcuccugcucacaauaaagccggg

SEQ ID NO: 404268 - RNA, 19 nt, Human
cugcggcugcuucgaguca

SEQ ID NO: 404269 - RNA, 32 nt, Human
cugcggcugugccucuuccuccccaugcugac

SEQ ID NO: 404270 - RNA, 32 nt, Human
cugcggcuguggcaaggccuguuucugcgcug

SEQ ID NO: 404271 - RNA, 22 nt, Human
cugcggcuguugccgccgggcu

SEQ ID NO: 404272 - RNA, 32 nt, Human
cugcggcuucugugcgaggcugggcagccagc

SEQ ID NO: 404273 - RNA, 22 nt, Human
cugcggcuuguugaggugcaau

SEQ ID NO: 404274 - RNA, 32 nt, Human
cugcgggaagcagggacaguggagagggcgcu

SEQ ID NO: 404275 - RNA, 32 nt, Human
cugcgggaaguuaagaggcaccagaggacagu

SEQ ID NO: 404276 - RNA, 32 nt, Human
cugcgggaaugagggagucagauaaagaacaa

SEQ ID NO: 404277 - RNA, 32 nt, Human
cugcgggacacacagacacgccuacgauuaga

SEQ ID NO: 404278 - RNA, 21 nt, Human
cugcgggacccuccccggcag

SEQ ID NO: 404279 - RNA, 32 nt, Human
cugcgggagagggcgagcaugaacuggcccgg

SEQ ID NO: 404280 - RNA, 32 nt, Human
cugcgggagauuuaaaccugcaagaaaggagg

SEQ ID NO: 404281 - RNA, 32 nt, Human
cugcgggagccacaggaagugaagagcuuccg

SEQ ID NO: 404282 - RNA, 32 nt, Human
cugcgggaggagaccugguccaggaucaagga

SEQ ID NO: 404283 - RNA, 32 nt, Human
cugcgggaggcaggggaugcaugggugucccc

SEQ ID NO: 404284 - RNA, 32 nt, Human
cugcgggaguacuggguccugagggagagcug

SEQ ID NO: 404285 - RNA, 32 nt, Human
cugcgggagucagacagccuagaaccgucgug

SEQ ID NO: 404286 - RNA, 32 nt, Human
cugcgggcagagcacagcgccgccgcggcccu

SEQ ID NO: 404287 - RNA, 32 nt, Human
cugcgggcccagcuccugccucccaguggccu

SEQ ID NO: 404288 - RNA, 20 nt, Human
cugcgggcgagcagcaggug

SEQ ID NO: 404289 - RNA, 24 nt, Human
cugcgggcguccugggaagggaga

SEQ ID NO: 404290 - RNA, 32 nt, Human
cugcgggcuaggcagccaggagcucuguccgc

SEQ ID NO: 404291 - RNA, 32 nt, Human
cugcgggcuccccucaggcucugcuucgugac

SEQ ID NO: 404292 - RNA, 20 nt, Human
cugcgggcuccucugcauca

SEQ ID NO: 404293 - RNA, 32 nt, Human
cugcgggcuccuggcugcuggagcugagcggg

SEQ ID NO: 404294 - RNA, 32 nt, Human
cugcgggcugggaacucucguccucggucccc

SEQ ID NO: 404295 - RNA, 32 nt, Human
cugcgggcuugcugggggagaacucuaacugu

SEQ ID NO: 404296 - RNA, 32 nt, Human
cugcggggauccagagcgcacagggagugcac

SEQ ID NO: 404297 - RNA, 32 nt, Human
cugcggggcccugaugcccccacccaccucgg

SEQ ID NO: 404298 - RNA, 22 nt, Human
cugcggggcgguagcuccggcg

SEQ ID NO: 404299 - RNA, 32 nt, Human
cugcggggcuggcucgacccagcuugaggucu

SEQ ID NO: 404300 - RNA, 32 nt, Human
cugcgggggaggaggagggucugaagguggga

SEQ ID NO: 404301 - RNA, 32 nt, Human
cugcgggggccuuggagcuccugcucuucucc

SEQ ID NO: 404302 - RNA, 32 nt, Human
cugcggguggacuggcccgcugccucggagag

SEQ ID NO: 404303 - RNA, 31 nt, Human
cugcggguuggccucgggccugucucucucu

SEQ ID NO: 404304 - RNA, 32 nt, Human
cugcgguacugaggaagcggcaggaggagaug

SEQ ID NO: 404305 - RNA, 32 nt, Human
cugcggucacacacacggucucagucacguga

SEQ ID NO: 404306 - RNA, 19 nt, Human
cugcggucagcugcgucca

SEQ ID NO: 404307 - RNA, 32 nt, Human
cugcggucgagaguuugagaccagcuugacca

SEQ ID NO: 404308 - RNA, 32 nt, Human
cugcggucggagugggagggccagucugcacc

SEQ ID NO: 404309 - RNA, 32 nt, Human
cugcggucguucccucggcuguggaccgggcg

SEQ ID NO: 404310 - RNA, 32 nt, Human
cugcggucuuuuuacucguucuaucugaugag

SEQ ID NO: 404311 - RNA, 24 nt, Human
cugcggugaaguugaggcuuauaa

SEQ ID NO: 404312 - RNA, 32 nt, Human
cugcggugagcuaugaucgcgccacugcacuc

SEQ ID NO: 404313 - RNA, 32 nt, Human
cugcggugagggugugagccccgggcugaugg

SEQ ID NO: 404314 - RNA, 32 nt, Human
cugcggugaucugacuuuaauuuaccacgacu

SEQ ID NO: 404315 - RNA, 32 nt, Human
cugcgguggcugcugcuccacccuggacucug

SEQ ID NO: 404316 - RNA, 32 nt, Human
cugcggugggacuccggagcagcguacaccgc

SEQ ID NO: 404317 - RNA, 32 nt, Human
cugcggugucugcugcuacucuccgagcuucg

SEQ ID NO: 404318 - RNA, 32 nt, Human
cugcgguuaaaguggcuggaguggagucuugg

SEQ ID NO: 404319 - RNA, 32 nt, Human
cugcgguucaaaaguacgaucacucaggaagg

SEQ ID NO: 404320 - RNA, 32 nt, Human
cugcgguuccaggagaacuguuugugccccuu

SEQ ID NO: 404321 - RNA, 32 nt, Human
cugcgguugucaaggauucagagcagauguga

SEQ ID NO: 404322 - RNA, 32 nt, Human
cugcguaagaagaaauauauguggugaaaugu

SEQ ID NO: 404323 - RNA, 32 nt, Human
cugcguacaaacauccaaaaguucaacaacac

SEQ ID NO: 404324 - RNA, 32 nt, Human
cugcguccaacagccugugacucuucccugga

SEQ ID NO: 404325 - RNA, 22 nt, Human
cugcgucccaaccugccucuca

SEQ ID NO: 404326 - RNA, 18 nt, Human
cugcgucccccuucgguc

SEQ ID NO: 404327 - RNA, 20 nt, Human
cugcguccccugccccggcc

SEQ ID NO: 404328 - RNA, 32 nt, Human
cugcgucccgcgucuggguucucagcuauuuc

SEQ ID NO: 404329 - RNA, 32 nt, Human
cugcguccucagggaaggcagaagggcaggca

SEQ ID NO: 404330 - RNA, 32 nt, Human
cugcguccuccccuccccggcccucccacagc

SEQ ID NO: 404331 - RNA, 32 nt, Human
cugcguccugcaggagcauugcgcuuaaacua

SEQ ID NO: 404332 - RNA, 32 nt, Human
cugcguccuucggucucugcucccgggacccg

SEQ ID NO: 404333 - RNA, 32 nt, Human
cugcgucguucuguccuuccgaacgcacacuu

SEQ ID NO: 404334 - RNA, 32 nt, Human
cugcgucucccucucugcagccuguguaagcu

SEQ ID NO: 404335 - RNA, 32 nt, Human
cugcgucuuaggagccugggaaagcacuucga

SEQ ID NO: 404336 - RNA, 32 nt, Human
cugcgucuucucucaauuccagucaucucagu

SEQ ID NO: 404337 - RNA, 32 nt, Human
cugcgugaauauacuaaaaagcauugaauggc

SEQ ID NO: 404338 - RNA, 32 nt, Human
cugcgugagaccagaaagcugggagcccugcg

SEQ ID NO: 404339 - RNA, 32 nt, Human
cugcgugagggggcagaggcgagguggaggcg

SEQ ID NO: 404340 - RNA, 32 nt, Human
cugcgugagucuuauuuauucucugaaacaca

SEQ ID NO: 404341 - RNA, 32 nt, Human
cugcgugcacacuggcugaaugcauuaguuaa

SEQ ID NO: 404342 - RNA, 32 nt, Human
cugcgugcacguccagccugaccgguugauua

SEQ ID NO: 404343 - RNA, 32 nt, Human
cugcgugcccugcugucaccgcggagcugaag

SEQ ID NO: 404344 - RNA, 32 nt, Human
cugcgugccuccugccugucugaguccaaccu

SEQ ID NO: 404345 - RNA, 20 nt, Human
cugcgugccucgccccgggc

SEQ ID NO: 404346 - RNA, 32 nt, Human
cugcgugccugggggccgugucccuguccagg

SEQ ID NO: 404347 - RNA, 32 nt, Human
cugcgugcucccuccagacucccuggcugcgg

SEQ ID NO: 404348 - RNA, 21 nt, Human
cugcgugcugcugccgggcca

SEQ ID NO: 404349 - RNA, 23 nt, Human
cugcguggccuggggcugccgug

SEQ ID NO: 404350 - RNA, 32 nt, Human
cugcguggcugcagccaaaacaaagaacuggg

SEQ ID NO: 404351 - RNA, 32 nt, Human
cugcgugggacccucuucucuggaaaccuaau

SEQ ID NO: 404352 - RNA, 32 nt, Human
cugcgugggcagggcugcagugggguccaggu

SEQ ID NO: 404353 - RNA, 32 nt, Human
cugcguggucaccaaccgauucgaccaguuau

SEQ ID NO: 404354 - RNA, 32 nt, Human
cugcguggucgcugccuccugcagaguggcca

SEQ ID NO: 404355 - RNA, 32 nt, Human
cugcguggugagugagggggagagagaagaga

SEQ ID NO: 404356 - RNA, 32 nt, Human
cugcguggugcugucccaugucacuugaacug

SEQ ID NO: 404357 - RNA, 32 nt, Human
cugcgugucaguuugugucugucucggggaau

SEQ ID NO: 404358 - RNA, 32 nt, Human
cugcgugugaaaagcugugauuucauuucuua

SEQ ID NO: 404359 - RNA, 32 nt, Human
cugcgugugcgguacuguggaggcggcggggc

SEQ ID NO: 404360 - RNA, 32 nt, Human
cugcguguggguaugaccucugccugguggcu

SEQ ID NO: 404361 - RNA, 32 nt, Human
cugcguguggucagacccaauuacacuguggc

SEQ ID NO: 404362 - RNA, 32 nt, Human
cugcgugugguggcucacaccuguaaucccaa

SEQ ID NO: 404363 - RNA, 32 nt, Human
cugcgugugguggcucaugccuguaaucccaa

SEQ ID NO: 404364 - RNA, 19 nt, Human
cugcgugugguuuuggcaa

SEQ ID NO: 404365 - RNA, 32 nt, Human
cugcgugugugaacagaaacaggccugccgau

SEQ ID NO: 404366 - RNA, 32 nt, Human
cugcguuauggacgccaagggaagaaauacaa

SEQ ID NO: 404367 - RNA, 32 nt, Human
cugcguuccuccuuuccccucuccuuuggaua

SEQ ID NO: 404368 - RNA, 32 nt, Human
cugcguucuccucaucugccucuuccugggcg

SEQ ID NO: 404369 - RNA, 23 nt, Human
cugcguugcccaggcuggucuca

SEQ ID NO: 404370 - RNA, 32 nt, Human
cugcguuggaaagacugaagaggcuggagugc

SEQ ID NO: 404371 - RNA, 32 nt, Human
cugcguuggcugcccaacugcucugucccccg

SEQ ID NO: 404372 - RNA, 31 nt, Human
cugcguuggcuucucccuggggacggggcuc

SEQ ID NO: 404373 - RNA, 32 nt, Human
cugcguugucccauccagccuccacucguguc

SEQ ID NO: 404374 - RNA, 32 nt, Human
cugcguuguggccgugaagugggagcucuccu

SEQ ID NO: 404375 - RNA, 20 nt, Human
cugcguuuccccguuuccau

SEQ ID NO: 404376 - RNA, 32 nt, Human
cugcguuuccucacucucacauaccagcgggc

SEQ ID NO: 404377 - RNA, 32 nt, Human
cugcuaaaaauaagaaaaauuagccaggagug

SEQ ID NO: 404378 - RNA, 32 nt, Human
cugcuaaaaauacaaaaacuagccaggcaugg

SEQ ID NO: 404379 - RNA, 32 nt, Human
cugcuaaaaauacaaaaauagcugggcguggu

SEQ ID NO: 404380 - RNA, 32 nt, Human
cugcuaaaaauacaaaaauuagccagaugugg

SEQ ID NO: 404381 - RNA, 32 nt, Human
cugcuaaaaauacaaaaauuagccaggcaugg

SEQ ID NO: 404382 - RNA, 32 nt, Human
cugcuaaaaauacaaaaauuagccgggcgugg

SEQ ID NO: 404383 - RNA, 32 nt, Human
cugcuaaaaauacaaaaauuagccgggugugg

SEQ ID NO: 404384 - RNA, 32 nt, Human
cugcuaaaaauacaaaaauuagcugggcuugg

SEQ ID NO: 404385 - RNA, 32 nt, Human
cugcuaaaaauacaaaaauuagcugggugcag

SEQ ID NO: 404386 - RNA, 32 nt, Human
cugcuaaaaauacaaaaauuagcugggugugg

SEQ ID NO: 404387 - RNA, 32 nt, Human
cugcuaaaaauacaaaauuagcugggcguggu

SEQ ID NO: 404388 - RNA, 32 nt, Human
cugcuaaaaauacaaaauuuagcugggcaugg

SEQ ID NO: 404389 - RNA, 29 nt, Human
cugcuaaaaauacaaaauuuagcugggua

SEQ ID NO: 404390 - RNA, 32 nt, Human
cugcuaaaacugaagcaccacugugugagcaa

SEQ ID NO: 404391 - RNA, 32 nt, Human
cugcuaaacauccuacaauccccaguucagcc

SEQ ID NO: 404392 - RNA, 32 nt, Human
cugcuaaagugggaagaaggagaacuugaagc

SEQ ID NO: 404393 - RNA, 32 nt, Human
cugcuaaauagggcuccucucuccucucucuc

SEQ ID NO: 404394 - RNA, 32 nt, Human
cugcuaacagccagagugucccagaagcuuuu

SEQ ID NO: 404395 - RNA, 32 nt, Human
cugcuaacagcccagcacccagauaaagccag

SEQ ID NO: 404396 - RNA, 32 nt, Human
cugcuaacagccgccuguauguuucaauaaau

SEQ ID NO: 404397 - RNA, 32 nt, Human
cugcuaacaucacuccaguuuagauggaucuu

SEQ ID NO: 404398 - RNA, 32 nt, Human
cugcuaaccccaaauauuaauagaauugguuu

SEQ ID NO: 404399 - RNA, 32 nt, Human
cugcuaacccuggaaucaaguucacaaccauu

SEQ ID NO: 404400 - RNA, 32 nt, Human
cugcuaaccucuuggaauucacugaaccagcu

SEQ ID NO: 404401 - RNA, 32 nt, Human
cugcuaacgaucucugugacucugugccaaac

SEQ ID NO: 404402 - RNA, 32 nt, Human
cugcuaacgggcuuguguucugcuccauacuu

SEQ ID NO: 404403 - RNA, 20 nt, Human
cugcuaagaccaucacugaa

SEQ ID NO: 404404 - RNA, 22 nt, Human
cugcuaagagcuaaacuaacaa

SEQ ID NO: 404405 - RNA, 32 nt, Human
cugcuaagaggaagaagauguagggagguauu

SEQ ID NO: 404406 - RNA, 32 nt, Human
cugcuaagauaguggcuuuggagguucuggaa

SEQ ID NO: 404407 - RNA, 32 nt, Human
cugcuaagcacccagcagguuggggccuggga

SEQ ID NO: 404408 - RNA, 32 nt, Human
cugcuaagcuuggauuuaacugaaucauauau

SEQ ID NO: 404409 - RNA, 32 nt, Human
cugcuaaggaagagaaagcccaugugugcaca

SEQ ID NO: 404410 - RNA, 32 nt, Human
cugcuaaggcagcaaagauggaggaagaguca

SEQ ID NO: 404411 - RNA, 32 nt, Human
cugcuaagggcuuccaaacauugccugcaccc

SEQ ID NO: 404412 - RNA, 32 nt, Human
cugcuaaucugucaaccugucuugggcagaaa

SEQ ID NO: 404413 - RNA, 32 nt, Human
cugcuaaugccaccacuaccccugccaucacu

SEQ ID NO: 404414 - RNA, 31 nt, Human
cugcuaauggcaucaucaccucuggcucuuc

SEQ ID NO: 404415 - RNA, 32 nt, Human
cugcuaauuuuucugccaaaaguauucuaauu

SEQ ID NO: 404416 - RNA, 32 nt, Human
cugcuacaacauucuaauaaaggcucauuuaa

SEQ ID NO: 404417 - RNA, 32 nt, Human
cugcuacaaggcucugaguguuugucccucac

SEQ ID NO: 404418 - RNA, 32 nt, Human
cugcuacacauccucgugcuuuuuaccucagu

SEQ ID NO: 404419 - RNA, 32 nt, Human
cugcuacacucgucccccuccugccucaucuu

SEQ ID NO: 404420 - RNA, 32 nt, Human
cugcuacagcuccagccccuccugggccuccc

SEQ ID NO: 404421 - RNA, 32 nt, Human
cugcuacagcuucuuggcuggcucugaaggcu

SEQ ID NO: 404422 - RNA, 22 nt, Human
cugcuacaggaccaccugcugc

SEQ ID NO: 404423 - RNA, 32 nt, Human
cugcuacaggcgcaagcagccaccuucugcag

SEQ ID NO: 404424 - RNA, 32 nt, Human
cugcuacauaauuugggugaaguuuccuucug

SEQ ID NO: 404425 - RNA, 32 nt, Human
cugcuacauguagggcaaucugucuuuaagua

SEQ ID NO: 404426 - RNA, 32 nt, Human
cugcuacauuucuugguucccugacugggaaa

SEQ ID NO: 404427 - RNA, 32 nt, Human
cugcuaccaaaacacuagacagugccaagugc

SEQ ID NO: 404428 - RNA, 32 nt, Human
cugcuaccacaguaaccagcagaccuccagga

SEQ ID NO: 404429 - RNA, 32 nt, Human
cugcuaccaccaggacacagugaggagguggu

SEQ ID NO: 404430 - RNA, 22 nt, Human
cugcuaccccaguuccaucugu

SEQ ID NO: 404431 - RNA, 32 nt, Human
cugcuaccgggcuacaaacccaggcagggugg

SEQ ID NO: 404432 - RNA, 32 nt, Human
cugcuaccucgcgcuaggccagcuccaggagg

SEQ ID NO: 404433 - RNA, 32 nt, Human
cugcuaccuguucuugggccucaggcucugca

SEQ ID NO: 404434 - RNA, 31 nt, Human
cugcuacucaaaauguccuguugaagaggga

SEQ ID NO: 404435 - RNA, 32 nt, Human
cugcuacucccaggguaaggggauacacauuu

SEQ ID NO: 404436 - RNA, 23 nt, Human
cugcuacucuguccuuacugcug

SEQ ID NO: 404437 - RNA, 32 nt, Human
cugcuacugauucuuaguuugcuuugauauuu

SEQ ID NO: 404438 - RNA, 32 nt, Human
cugcuacugcccagguuaaccugcacuuugca

SEQ ID NO: 404439 - RNA, 32 nt, Human
cugcuacugcugccgcugcugcucuguggcca

SEQ ID NO: 404440 - RNA, 32 nt, Human
cugcuacuggaugccaucauuggcccccgacu

SEQ ID NO: 404441 - RNA, 32 nt, Human
cugcuacugggcuuuacauggugacagacauu

SEQ ID NO: 404442 - RNA, 32 nt, Human
cugcuacuggugcugcucaccgucuuccuccu

SEQ ID NO: 404443 - RNA, 32 nt, Human
cugcuacuuggaaggcugagacaggaaaauug

SEQ ID NO: 404444 - RNA, 32 nt, Human
cugcuacuuuggggaguugauggccaggaaag

SEQ ID NO: 404445 - RNA, 32 nt, Human
cugcuagaaauacaaaaauuggcugggcgcgg

SEQ ID NO: 404446 - RNA, 32 nt, Human
cugcuagaacagucucauagcugcaguucagc

SEQ ID NO: 404447 - RNA, 32 nt, Human
cugcuagaagugaaagagacacaucagaccua

SEQ ID NO: 404448 - RNA, 32 nt, Human
cugcuagaccaaggagcccuucugcuggcccu

SEQ ID NO: 404449 - RNA, 32 nt, Human
cugcuagacucccuccuccuccaaaucugggc

SEQ ID NO: 404450 - RNA, 32 nt, Human
cugcuagagcccagaccuggugaggacaggcc

SEQ ID NO: 404451 - RNA, 32 nt, Human
cugcuagaucaguauguguccaugacugaccc

SEQ ID NO: 404452 - RNA, 32 nt, Human
cugcuagcagaugcuccuccccuggaccauug

SEQ ID NO: 404453 - RNA, 32 nt, Human
cugcuagcagccaggcuguggagaggaggcgg

SEQ ID NO: 404454 - RNA, 32 nt, Human
cugcuagcaggaggcaccuggccuccgcuggu

SEQ ID NO: 404455 - RNA, 21 nt, Human
cugcuagccccaggccuuuca

SEQ ID NO: 404456 - RNA, 32 nt, Human
cugcuagcccuaggaaggccaggagcccagua

SEQ ID NO: 404457 - RNA, 32 nt, Human
cugcuagccucaaccuccuggggcaggggacg

SEQ ID NO: 404458 - RNA, 21 nt, Human
cugcuagcugccccccgagcc

SEQ ID NO: 404459 - RNA, 32 nt, Human
cugcuaggcauaauuaucaaaaauucauuuuu

SEQ ID NO: 404460 - RNA, 32 nt, Human
cugcuaggcccagguguauugugauuauuuga

SEQ ID NO: 404461 - RNA, 24 nt, Human
cugcuagggaaccccucacugcca

SEQ ID NO: 404462 - RNA, 32 nt, Human
cugcuaguccucaugcaacucaguccccagaa

SEQ ID NO: 404463 - RNA, 32 nt, Human
cugcuagucuaugggguccuuacaaagacauu

SEQ ID NO: 404464 - RNA, 32 nt, Human
cugcuagugggguggugcuggggaagguugac

SEQ ID NO: 404465 - RNA, 32 nt, Human
cugcuaguuagaaagguuuggagggaugacuu

SEQ ID NO: 404466 - RNA, 32 nt, Human
cugcuauaaacacagacccccuugucuuugcc

SEQ ID NO: 404467 - RNA, 32 nt, Human
cugcuauaucaauuuguguagauaugucuguc

SEQ ID NO: 404468 - RNA, 32 nt, Human
cugcuaucaguggggaaaauggaggcccaaga

SEQ ID NO: 404469 - RNA, 32 nt, Human
cugcuauccuccccuuggaaucuaccgccacu

SEQ ID NO: 404470 - RNA, 22 nt, Human
cugcuauccugccucugggcca

SEQ ID NO: 404471 - RNA, 32 nt, Human
cugcuaucucuagaggcaagucugccacgaga

SEQ ID NO: 404472 - RNA, 32 nt, Human
cugcuaucugcagcuccuaggugcuuuccuca

SEQ ID NO: 404473 - RNA, 32 nt, Human
cugcuaugaaaggaauaaaaccuacacacaag

SEQ ID NO: 404474 - RNA, 32 nt, Human
cugcuaugcagggggagagcacaggacuggcc

SEQ ID NO: 404475 - RNA, 32 nt, Human
cugcuaugggagaagcaggcuggggcuugaag

SEQ ID NO: 404476 - RNA, 32 nt, Human
cugcuaugucucucuucugucuuauucucaag

SEQ ID NO: 404477 - RNA, 18 nt, Human
cugcuauuaucagcauca

SEQ ID NO: 404478 - RNA, 32 nt, Human
cugcuauuaugauguuuugcaaaggaaaauaa

SEQ ID NO: 404479 - RNA, 32 nt, Human
cugcuauucauuuugccugaugccaucauuuu

SEQ ID NO: 404480 - RNA, 32 nt, Human
cugcuauugaagaacuucccaaaacuucuuua

SEQ ID NO: 404481 - RNA, 32 nt, Human
cugcuauugacuucucugaauugaagauuuac

SEQ ID NO: 404482 - RNA, 32 nt, Human
cugcuauugcucccaagggcucagagaaggcg

SEQ ID NO: 404483 - RNA, 32 nt, Human
cugcuauuggugauuucugcugccuuuuacuc

SEQ ID NO: 404484 - RNA, 32 nt, Human
cugcuauuucccaagcuggagugcaguggugc

SEQ ID NO: 404485 - RNA, 32 nt, Human
cugcuauuuucauccuccuugugguugcuuuu

SEQ ID NO: 404486 - RNA, 32 nt, Human
cugcucaaacaggccaucagcauccgggacca

SEQ ID NO: 404487 - RNA, 32 nt, Human
cugcucaacaggcguuauuccuaaaguggcuu

SEQ ID NO: 404488 - RNA, 32 nt, Human
cugcucaaccucuugcaggagggagcacacga

SEQ ID NO: 404489 - RNA, 32 nt, Human
cugcucaaggagugggaaguggggcuauaggc

SEQ ID NO: 404490 - RNA, 32 nt, Human
cugcucaagugggucccugaccccugugccuc

SEQ ID NO: 404491 - RNA, 32 nt, Human
cugcucaaguuuucuuugaaaaggagggcugg

SEQ ID NO: 404492 - RNA, 32 nt, Human
cugcucaaucugacugguauagcaggacaguu

SEQ ID NO: 404493 - RNA, 32 nt, Human
cugcucaaugaccgccaggaacugaccugcug

SEQ ID NO: 404494 - RNA, 32 nt, Human
cugcucaauggacacccccagcccagacccgu

SEQ ID NO: 404495 - RNA, 32 nt, Human
cugcucacaagccuguuccuucuuccauugua

SEQ ID NO: 404496 - RNA, 21 nt, Human
cugcucacaccugggccucuc

SEQ ID NO: 404497 - RNA, 32 nt, Human
cugcucacagcccagcaguaugagauauucuc

SEQ ID NO: 404498 - RNA, 32 nt, Human
cugcucacagccuucuacauggugcuacugcu

SEQ ID NO: 404499 - RNA, 32 nt, Human
cugcucaccacagccuggagagggcacaccac

SEQ ID NO: 404500 - RNA, 32 nt, Human
cugcucaccacugucuuccuggguuugcagcu

SEQ ID NO: 404501 - RNA, 32 nt, Human
cugcucaccaggccuagaacaccagaagucgg

SEQ ID NO: 404502 - RNA, 23 nt, Human
cugcucacccaucugugcaggug

SEQ ID NO: 404503 - RNA, 18 nt, Human
cugcucaccccugccuca

SEQ ID NO: 404504 - RNA, 32 nt, Human
cugcucacccgccucuugccccuucuaggggc

SEQ ID NO: 404505 - RNA, 22 nt, Human
cugcucacccuucugucuugca

SEQ ID NO: 404506 - RNA, 32 nt, Human
cugcucaccgcaaccuccgccucccagguuca

SEQ ID NO: 404507 - RNA, 32 nt, Human
cugcucaccgcaaccuccgccuuccagguuca

SEQ ID NO: 404508 - RNA, 32 nt, Human
cugcucaccuccucugcccucuacccuccugu

SEQ ID NO: 404509 - RNA, 32 nt, Human
cugcucaccugggccacccucucuccaggacu

SEQ ID NO: 404510 - RNA, 32 nt, Human
cugcucacgaguucagggcuccugggcggccg

SEQ ID NO: 404511 - RNA, 32 nt, Human
cugcucacggggacccgcucaggcuggaggcc

SEQ ID NO: 404512 - RNA, 32 nt, Human
cugcucacggguauuaaagaacuccgcguugu

SEQ ID NO: 404513 - RNA, 21 nt, Human
cugcucacgucucugccgccu

SEQ ID NO: 404514 - RNA, 32 nt, Human
cugcucacuacaaccucugccucccagguuca

SEQ ID NO: 404515 - RNA, 32 nt, Human
cugcucacuagccuggcuccaugagguccuuu

SEQ ID NO: 404516 - RNA, 32 nt, Human
cugcucacucucugcugaccuccggcucccug

SEQ ID NO: 404517 - RNA, 32 nt, Human
cugcucacucuuuuccugcucccaggcucgcc

SEQ ID NO: 404518 - RNA, 32 nt, Human
cugcucacugacaucuuaauugccugcagaaa

SEQ ID NO: 404519 - RNA, 32 nt, Human
cugcucacugcaaccuccgccucccagguuca

SEQ ID NO: 404520 - RNA, 32 nt, Human
cugcucacugcaaccuccgccucccggguuca

SEQ ID NO: 404521 - RNA, 32 nt, Human
cugcucacugcaaccucugccuccuggguuua

SEQ ID NO: 404522 - RNA, 32 nt, Human
cugcucacugcaagcucagccucucggguuca

SEQ ID NO: 404523 - RNA, 32 nt, Human
cugcucacugcaagcuccgccaucuggguuca

SEQ ID NO: 404524 - RNA, 32 nt, Human
cugcucacugcaagcuccgccucccggguuca

SEQ ID NO: 404525 - RNA, 32 nt, Human
cugcucacugcaagcuccgccuccuggguuca

SEQ ID NO: 404526 - RNA, 32 nt, Human
cugcucacugcagccuccaccuccugggcuca

SEQ ID NO: 404527 - RNA, 32 nt, Human
cugcucacugcucacacgcugccuccucagca

SEQ ID NO: 404528 - RNA, 32 nt, Human
cugcucacuguaaccucugccuccuggguuca

SEQ ID NO: 404529 - RNA, 32 nt, Human
cugcucagaaacuacaauccucagagugaaau

SEQ ID NO: 404530 - RNA, 19 nt, Human
cugcucagaagagcaggug

SEQ ID NO: 404531 - RNA, 32 nt, Human
cugcucagaagccagaacacagcaccugugac

SEQ ID NO: 404532 - RNA, 32 nt, Human
cugcucagaauuuggagggagggagcaguacc

SEQ ID NO: 404533 - RNA, 32 nt, Human
cugcucagacaggaacugcaggacagaagugg

SEQ ID NO: 404534 - RNA, 18 nt, Human
cugcucagaggucaggaa

SEQ ID NO: 404535 - RNA, 32 nt, Human
cugcucagcaaaugucagcagguccagaagca

SEQ ID NO: 404536 - RNA, 32 nt, Human
cugcucagcaccauuucauucuggaccuggga

SEQ ID NO: 404537 - RNA, 32 nt, Human
cugcucagccaagaaggagcgggguggcgcag

SEQ ID NO: 404538 - RNA, 30 nt, Human
cugcucagcuuccagucagaaaggacagug

SEQ ID NO: 404539 - RNA, 32 nt, Human
cugcucagcuucuucuuucauucuaauccuug

SEQ ID NO: 404540 - RNA, 32 nt, Human
cugcucaggagacugaggcaggagaaucacuu

SEQ ID NO: 404541 - RNA, 32 nt, Human
cugcucaggaggcugaggcaggagaaucgcuu

SEQ ID NO: 404542 - RNA, 32 nt, Human
cugcucaggaggcugaggcaggagaauggcgu

SEQ ID NO: 404543 - RNA, 32 nt, Human
cugcucaggaggcugaggcaggagaauugauu

SEQ ID NO: 404544 - RNA, 32 nt, Human
cugcucaggaggcugaggcaggagaauugcuu

SEQ ID NO: 404545 - RNA, 32 nt, Human
cugcucaggagugggcucagagucuagcaaau

SEQ ID NO: 404546 - RNA, 32 nt, Human
cugcucaggccccuucagcuacugccacuucg

SEQ ID NO: 404547 - RNA, 32 nt, Human
cugcucaggccuucucucuggcugccaguugu

SEQ ID NO: 404548 - RNA, 32 nt, Human
cugcucaggcuggagugcaguggugcaaucac

SEQ ID NO: 404549 - RNA, 32 nt, Human
cugcucaggcugggaggcagagggcacaaacc

SEQ ID NO: 404550 - RNA, 32 nt, Human
cugcucaggggaggggagggaucaggcgauga

SEQ ID NO: 404551 - RNA, 32 nt, Human
cugcucaguagagacucacucagcauuaugac

SEQ ID NO: 404552 - RNA, 32 nt, Human
cugcucagucauuuuggagaaauaacaauuuu

SEQ ID NO: 404553 - RNA, 32 nt, Human
cugcucagucgcaggcuccagaugucugcuuc

SEQ ID NO: 404554 - RNA, 32 nt, Human
cugcucagugagagcagugaaagcuaacagcu

SEQ ID NO: 404555 - RNA, 32 nt, Human
cugcucagugaugcuggaaguccuucgcgucu

SEQ ID NO: 404556 - RNA, 32 nt, Human
cugcucagugcaaccucugccucccaggauca

SEQ ID NO: 404557 - RNA, 32 nt, Human
cugcucaguucgccaaggacuuuuccauugac

SEQ ID NO: 404558 - RNA, 32 nt, Human
cugcucaucaaauugcugugauagugaauuau

SEQ ID NO: 404559 - RNA, 32 nt, Human
cugcucaucccuccuucuuuaguaucuuuacg

SEQ ID NO: 404560 - RNA, 32 nt, Human
cugcucaucugaccacugggcaccuuagugcc

SEQ ID NO: 404561 - RNA, 32 nt, Human
cugcucaugaggagccuuaguggagauuccag

SEQ ID NO: 404562 - RNA, 31 nt, Human
cugcucauggcagaggaagcagcuguguucg

SEQ ID NO: 404563 - RNA, 32 nt, Human
cugcucauuuuaaaagcacuucuucuuguauu

SEQ ID NO: 404564 - RNA, 32 nt, Human
cugcuccaaaacucgcccaggucuccagcucu

SEQ ID NO: 404565 - RNA, 32 nt, Human
cugcuccaaaucaaggucuccgccucuuagaa

SEQ ID NO: 404566 - RNA, 32 nt, Human
cugcuccaacgaggaaaacccauuuuugacgu

SEQ ID NO: 404567 - RNA, 24 nt, Human
cugcuccaacuaucaauagucagg

SEQ ID NO: 404568 - RNA, 32 nt, Human
cugcuccaacuuccugcugacagggggcuuag

SEQ ID NO: 404569 - RNA, 32 nt, Human
cugcuccaagaagaugggaggaaggggagccc

SEQ ID NO: 404570 - RNA, 21 nt, Human
cugcuccaagaaggaagcagu

SEQ ID NO: 404571 - RNA, 32 nt, Human
cugcuccaauaccaccaccuuguccacuccca

SEQ ID NO: 404572 - RNA, 32 nt, Human
cugcuccacauccaggcagccugggugaccac

SEQ ID NO: 404573 - RNA, 23 nt, Human
cugcuccaccguggagguccagg

SEQ ID NO: 404574 - RNA, 32 nt, Human
cugcuccaccuucucucucugcccucaccucu

SEQ ID NO: 404575 - RNA, 27 nt, Human
cugcuccacugccuuccucuagugcag

SEQ ID NO: 404576 - RNA, 32 nt, Human
cugcuccacugucugcagcccagauccuguug

SEQ ID NO: 404577 - RNA, 21 nt, Human
cugcuccagaaguugccuugu

SEQ ID NO: 404578 - RNA, 32 nt, Human
cugcuccagagacaaagguggggagggugcug

SEQ ID NO: 404579 - RNA, 23 nt, Human
cugcuccagcagccgggccugca

SEQ ID NO: 404580 - RNA, 32 nt, Human
cugcuccagcaguccccaccacaggccccguu

SEQ ID NO: 404581 - RNA, 23 nt, Human
cugcuccagcaugagcucuugua

SEQ ID NO: 404582 - RNA, 21 nt, Human
cugcuccagccuuggccucuc

SEQ ID NO: 404583 - RNA, 22 nt, Human
cugcuccagcuccagaccuugu

SEQ ID NO: 404584 - RNA, 22 nt, Human
cugcuccagcugccaacuuugc

SEQ ID NO: 404585 - RNA, 32 nt, Human
cugcuccaggaaauugccaagcauuuugauga

SEQ ID NO: 404586 - RNA, 28 nt, Human
cugcuccaggaagcugccuccucugggc

SEQ ID NO: 404587 - RNA, 32 nt, Human
cugcuccaggacugcuaugagagucccuucau

SEQ ID NO: 404588 - RNA, 32 nt, Human
cugcuccaggaggcccagccuguguggcccug

SEQ ID NO: 404589 - RNA, 21 nt, Human
cugcuccaggcacagugcagg

SEQ ID NO: 404590 - RNA, 32 nt, Human
cugcuccaggcaggucagagcagugcaggggg

SEQ ID NO: 404591 - RNA, 32 nt, Human
cugcuccaggccauggcacuccuauccugguu

SEQ ID NO: 404592 - RNA, 32 nt, Human
cugcuccaggcucacucccaaaacagacccag

SEQ ID NO: 404593 - RNA, 23 nt, Human
cugcuccaggcuguagccgcagg

SEQ ID NO: 404594 - RNA, 32 nt, Human
cugcuccagggaggcuuuagccccaagaaggu

SEQ ID NO: 404595 - RNA, 22 nt, Human
cugcuccaggugauagugcggg

SEQ ID NO: 404596 - RNA, 32 nt, Human
cugcuccaggugggagaugugcgcgugucucc

SEQ ID NO: 404597 - RNA, 32 nt, Human
cugcuccagguuuuuguugaaauguggcuuca

SEQ ID NO: 404598 - RNA, 32 nt, Human
cugcuccagucaccccggccucuugcaagaga

SEQ ID NO: 404599 - RNA, 32 nt, Human
cugcuccagugucaucucugcaaagaaggucc

SEQ ID NO: 404600 - RNA, 32 nt, Human
cugcuccauaucuguuucaauuuuaagaaagc

SEQ ID NO: 404601 - RNA, 32 nt, Human
cugcuccaucacaaccuccuuccccaggaaaa

SEQ ID NO: 404602 - RNA, 32 nt, Human
cugcuccaucacugcugagccucuccccaucu

SEQ ID NO: 404603 - RNA, 20 nt, Human
cugcuccaucagggaugcag

SEQ ID NO: 404604 - RNA, 32 nt, Human
cugcuccaucagggaugcagugggcggaacua

SEQ ID NO: 404605 - RNA, 28 nt, Human
cugcucccaagugcaaccucugucugac

SEQ ID NO: 404606 - RNA, 32 nt, Human
cugcucccaaucaugcaggucuccacugcugc

SEQ ID NO: 404607 - RNA, 32 nt, Human
cugcucccacugucuguguucuccucacuguu

SEQ ID NO: 404608 - RNA, 32 nt, Human
cugcucccagagaccuugccacacugaaucuc

SEQ ID NO: 404609 - RNA, 32 nt, Human
cugcucccagagaccuugccacacugaauguc

SEQ ID NO: 404610 - RNA, 32 nt, Human
cugcucccagcaaccucuacauccaggaauga

SEQ ID NO: 404611 - RNA, 32 nt, Human
cugcucccagcccccuccuccuggggcccuca

SEQ ID NO: 404612 - RNA, 32 nt, Human
cugcucccagccgccccaggaccucccagcuc

SEQ ID NO: 404613 - RNA, 32 nt, Human
cugcucccaggagccagugacaugaggugcag

SEQ ID NO: 404614 - RNA, 32 nt, Human
cugcucccaggccaguaagggaaauagaaaaa

SEQ ID NO: 404615 - RNA, 32 nt, Human
cugcucccagugcuguccccaggcugcaguuc

SEQ ID NO: 404616 - RNA, 21 nt, Human
cugcucccaucgucccgagcc

SEQ ID NO: 404617 - RNA, 32 nt, Human
cugcuccccagagggcugccugcugugcacuu

SEQ ID NO: 404618 - RNA, 32 nt, Human
cugcuccccagcccauggacaggagauccugg

SEQ ID NO: 404619 - RNA, 32 nt, Human
cugcuccccagcccggggcaggggcgggggcc

SEQ ID NO: 404620 - RNA, 32 nt, Human
cugcuccccaggcuugagugagugugugccug

SEQ ID NO: 404621 - RNA, 32 nt, Human
cugcuccccaguagcugcaaccacaggugcac

SEQ ID NO: 404622 - RNA, 32 nt, Human
cugcucccccagggcagcaccauguggccccu

SEQ ID NO: 404623 - RNA, 19 nt, Human
cugcuccccccucagcauc

SEQ ID NO: 404624 - RNA, 32 nt, Human
cugcucccccuccaccuuccaccaugagugga

SEQ ID NO: 404625 - RNA, 32 nt, Human
cugcucccccuucaccuuccgccuuuacugua

SEQ ID NO: 404626 - RNA, 32 nt, Human
cugcuccccgccgucugcucccucuccacucu

SEQ ID NO: 404627 - RNA, 32 nt, Human
cugcuccccucaggcccguccugcugccauuc

SEQ ID NO: 404628 - RNA, 32 nt, Human
cugcuccccugagauucguccuucagccccau

SEQ ID NO: 404629 - RNA, 32 nt, Human
cugcuccccugcccucagagcucugcugagga

SEQ ID NO: 404630 - RNA, 32 nt, Human
cugcuccccugggaccuccugucucacccucu

SEQ ID NO: 404631 - RNA, 32 nt, Human
cugcucccgaacugcugaccucagaucaucug

SEQ ID NO: 404632 - RNA, 32 nt, Human
cugcucccgccccuugcugugugggcucaauc

SEQ ID NO: 404633 - RNA, 32 nt, Human
cugcucccggaaaugcaaaugagacuccugga

SEQ ID NO: 404634 - RNA, 32 nt, Human
cugcucccgggcucacucaaggagacugcggc

SEQ ID NO: 404635 - RNA, 32 nt, Human
cugcucccuaacccuacccucacuuucguccc

SEQ ID NO: 404636 - RNA, 32 nt, Human
cugcucccuaaccuuucgccgaauggggcaga

SEQ ID NO: 404637 - RNA, 32 nt, Human
cugcucccucauggcaccuccacgcaaacagc

SEQ ID NO: 404638 - RNA, 32 nt, Human
cugcucccucauucucuccccaccacucucuu

SEQ ID NO: 404639 - RNA, 32 nt, Human
cugcucccuccagaauggaacucaagcugguu

SEQ ID NO: 404640 - RNA, 32 nt, Human
cugcucccuccagguguccaccugguaugggc

SEQ ID NO: 404641 - RNA, 32 nt, Human
cugcucccucuccauagccagcuccucaggcc

SEQ ID NO: 404642 - RNA, 32 nt, Human
cugcucccucugauccuccaucagggccagau

SEQ ID NO: 404643 - RNA, 32 nt, Human
cugcucccugcaaccuccaccucccggguuca

SEQ ID NO: 404644 - RNA, 32 nt, Human
cugcucccugcucccggcucugaggcugcccc

SEQ ID NO: 404645 - RNA, 32 nt, Human
cugcucccugggaggcaggcuccagaagcacc

SEQ ID NO: 404646 - RNA, 32 nt, Human
cugcucccugguguaauucucguguccaagaa

SEQ ID NO: 404647 - RNA, 32 nt, Human
cugcucccuguauuaugugaacagucuuauuc

SEQ ID NO: 404648 - RNA, 32 nt, Human
cugcucccuucccuccguuccuuucggacccu

SEQ ID NO: 404649 - RNA, 32 nt, Human
cugcucccuuucucccucucuuccucccucuu

SEQ ID NO: 404650 - RNA, 32 nt, Human
cugcucccuuucuccucacuggccuuucuuuc

SEQ ID NO: 404651 - RNA, 32 nt, Human
cugcuccgaggagcuggccugauguccucggg

SEQ ID NO: 404652 - RNA, 21 nt, Human
cugcuccgcgugcguagcagu

SEQ ID NO: 404653 - RNA, 32 nt, Human
cugcuccggagggagaggugagcucagggcag

SEQ ID NO: 404654 - RNA, 21 nt, Human
cugcuccggccgucguuugca

SEQ ID NO: 404655 - RNA, 24 nt, Human
cugcuccggccuccggggccuugc

SEQ ID NO: 404656 - RNA, 16 nt, Human
cugcuccgggcuccug

SEQ ID NO: 404657 - RNA, 32 nt, Human
cugcuccguggacugcagucggcaugccagga

SEQ ID NO: 404658 - RNA, 17 nt, Human
cugcuccguggcuccug

SEQ ID NO: 404659 - RNA, 32 nt, Human
cugcuccuacagccggcgauccacucccggcu

SEQ ID NO: 404660 - RNA, 32 nt, Human
cugcuccuaccugcagcacccccagcuccgac

SEQ ID NO: 404661 - RNA, 32 nt, Human
cugcuccuagaggcccagccucugugacuccg

SEQ ID NO: 404662 - RNA, 32 nt, Human
cugcuccuagccugugcucugccagcagcaca

SEQ ID NO: 404663 - RNA, 32 nt, Human
cugcuccuaucucuccaaaccccauacccuuc

SEQ ID NO: 404664 - RNA, 32 nt, Human
cugcuccucacacugcagcugcugggccgugg

SEQ ID NO: 404665 - RNA, 32 nt, Human
cugcuccucagaauccuggugccuugaaguuc

SEQ ID NO: 404666 - RNA, 32 nt, Human
cugcuccucaugggaagaugucucagagccuu

SEQ ID NO: 404667 - RNA, 32 nt, Human
cugcuccuccacuauaagucuaauguucugac

SEQ ID NO: 404668 - RNA, 32 nt, Human
cugcuccuccagcugcugcaccugccucuccg

SEQ ID NO: 404669 - RNA, 18 nt, Human
cugcuccuccccugagcc

SEQ ID NO: 404670 - RNA, 32 nt, Human
cugcuccuccgagccuuugagaaggaucgcuu

SEQ ID NO: 404671 - RNA, 18 nt, Human
cugcuccuccuaucccau

SEQ ID NO: 404672 - RNA, 32 nt, Human
cugcuccuccuccucugacucggaaccugaag

SEQ ID NO: 404673 - RNA, 32 nt, Human
cugcuccuccugccuugucugccuggcaaguu

SEQ ID NO: 404674 - RNA, 32 nt, Human
cugcuccuccugggcauuggcuccagcggagu

SEQ ID NO: 404675 - RNA, 32 nt, Human
cugcuccuccuuggacaguugcagcacucaaa

SEQ ID NO: 404676 - RNA, 32 nt, Human
cugcuccucgccuggcucuugauguccaagga

SEQ ID NO: 404677 - RNA, 32 nt, Human
cugcuccucuacucagccgaugcucggguuuc

SEQ ID NO: 404678 - RNA, 32 nt, Human
cugcuccucuacucuugggucgagaucccuuu

SEQ ID NO: 404679 - RNA, 32 nt, Human
cugcuccucuacuggugaugggcuaauaaagc

SEQ ID NO: 404680 - RNA, 32 nt, Human
cugcuccucuaggcuggccccuuguccacccc

SEQ ID NO: 404681 - RNA, 32 nt, Human
cugcuccucucggccccuccuccugggccgcc

SEQ ID NO: 404682 - RNA, 32 nt, Human
cugcuccucucuguccugccucaggccuaaga

SEQ ID NO: 404683 - RNA, 32 nt, Human
cugcuccucugagcuucuccugcuccucucug

SEQ ID NO: 404684 - RNA, 32 nt, Human
cugcuccucugcaaccugccccucuuuuucuu

SEQ ID NO: 404685 - RNA, 32 nt, Human
cugcuccucugccacugaugcccugucagucc

SEQ ID NO: 404686 - RNA, 32 nt, Human
cugcuccucugccccgaaaccacuggcuggcc

SEQ ID NO: 404687 - RNA, 32 nt, Human
cugcuccucuucacccugaccccucugcagga

SEQ ID NO: 404688 - RNA, 32 nt, Human
cugcuccugaaugacuacuggguacauaacga

SEQ ID NO: 404689 - RNA, 32 nt, Human
cugcuccugcagcagucccaugccccacacuc

SEQ ID NO: 404690 - RNA, 32 nt, Human
cugcuccugcagcagucccgugccccacacuc

SEQ ID NO: 404691 - RNA, 32 nt, Human
cugcuccugcagcgcccugcacagcucugcuc

SEQ ID NO: 404692 - RNA, 32 nt, Human
cugcuccugcagcugccuuuucugccaucagc

SEQ ID NO: 404693 - RNA, 32 nt, Human
cugcuccugccugcauguucucucuguuguug

SEQ ID NO: 404694 - RNA, 32 nt, Human
cugcuccugccugcccuggcccugaggcucca

SEQ ID NO: 404695 - RNA, 32 nt, Human
cugcuccugccuggcgcucuggccaggcucgg

SEQ ID NO: 404696 - RNA, 19 nt, Human
cugcuccugcgccccgggc

SEQ ID NO: 404697 - RNA, 32 nt, Human
cugcuccugcuccuccccuucgggcccccucc

SEQ ID NO: 404698 - RNA, 32 nt, Human
cugcuccugcucucucuccuccagcgacccua

SEQ ID NO: 404699 - RNA, 32 nt, Human
cugcuccugcugcagggacacugagcuggcua

SEQ ID NO: 404700 - RNA, 32 nt, Human
cugcuccugcuggcacuucgcuucuguggccu

SEQ ID NO: 404701 - RNA, 23 nt, Human
cugcuccuggcuaaccccagcaa

SEQ ID NO: 404702 - RNA, 32 nt, Human
cugcuccugucacagaccacacaugucugaau

SEQ ID NO: 404703 - RNA, 32 nt, Human
cugcuccugugaggacaacagccugggccucg

SEQ ID NO: 404704 - RNA, 32 nt, Human
cugcuccuguggccuccagccucagcgaccga

SEQ ID NO: 404705 - RNA, 32 nt, Human
cugcuccuuacccagcaucuggaguacaggac

SEQ ID NO: 404706 - RNA, 32 nt, Human
cugcuccuucacccucacccugaggccccagg

SEQ ID NO: 404707 - RNA, 32 nt, Human
cugcuccuucacugcugacccagaggggcugc

SEQ ID NO: 404708 - RNA, 32 nt, Human
cugcuccuucaugugaucccagggggcagaga

SEQ ID NO: 404709 - RNA, 32 nt, Human
cugcuccuuccuccucuagguccaggccccag

SEQ ID NO: 404710 - RNA, 21 nt, Human
cugcuccuuccugggcccuca

SEQ ID NO: 404711 - RNA, 32 nt, Human
cugcuccuugcagccaugcuccugggcaaccc

SEQ ID NO: 404712 - RNA, 32 nt, Human
cugcuccuugcagccggaagcaguaaguggua

SEQ ID NO: 404713 - RNA, 32 nt, Human
cugcuccuugcguaccacagggauuaauccug

SEQ ID NO: 404714 - RNA, 32 nt, Human
cugcuccuugggccugcagggacucaagaucc

SEQ ID NO: 404715 - RNA, 23 nt, Human
cugcuccuugugcagcucuggua

SEQ ID NO: 404716 - RNA, 16 nt, Human
cugcucgcgccgugcc

SEQ ID NO: 404717 - RNA, 32 nt, Human
cugcucgcuguucccauguccucucuccagcu

SEQ ID NO: 404718 - RNA, 32 nt, Human
cugcucggaaggcugaagcaggggaauggcgu

SEQ ID NO: 404719 - RNA, 32 nt, Human
cugcucggacacucaacaugggggugggugca

SEQ ID NO: 404720 - RNA, 32 nt, Human
cugcucggaggcagaggcagcaagaggcggcg

SEQ ID NO: 404721 - RNA, 32 nt, Human
cugcucggagugaacaggcggccaggaaagaa

SEQ ID NO: 404722 - RNA, 32 nt, Human
cugcucgggaggcagaggcaggagaauggcgu

SEQ ID NO: 404723 - RNA, 32 nt, Human
cugcucgggaggcuaaggcaggagaauugcuu

SEQ ID NO: 404724 - RNA, 32 nt, Human
cugcucgggaggcugagcaggaggauggcuug

SEQ ID NO: 404725 - RNA, 32 nt, Human
cugcucgggaggcugaggcaggagaauagcau

SEQ ID NO: 404726 - RNA, 32 nt, Human
cugcucgggaggcugaggcaggagaaucacuu

SEQ ID NO: 404727 - RNA, 32 nt, Human
cugcucgggaggcugaggcaggagaaucgcuu

SEQ ID NO: 404728 - RNA, 32 nt, Human
cugcucgggaggcugaggcaggagaaucucuu

SEQ ID NO: 404729 - RNA, 32 nt, Human
cugcucgggaggcugaggcaggagaauggcau

SEQ ID NO: 404730 - RNA, 32 nt, Human
cugcucgggaggcugaggcaggagaauggugu

SEQ ID NO: 404731 - RNA, 32 nt, Human
cugcucgggaggcugaggcaggagaauugcuu

SEQ ID NO: 404732 - RNA, 32 nt, Human
cugcucgggaggcugaggcaggagaauuguug

SEQ ID NO: 404733 - RNA, 32 nt, Human
cugcucgggaggcugaggcaggggaaucgcuu

SEQ ID NO: 404734 - RNA, 32 nt, Human
cugcucgggagggugaggcaggagaauggcau

SEQ ID NO: 404735 - RNA, 32 nt, Human
cugcucgggagguugaugcaggagaaucacuu

SEQ ID NO: 404736 - RNA, 32 nt, Human
cugcucgggggaagcccagugggauuugcauc

SEQ ID NO: 404737 - RNA, 32 nt, Human
cugcucggugcuggugaacaccucuugcaggc

SEQ ID NO: 404738 - RNA, 32 nt, Human
cugcucguggacugugcuggugcaucacggau

SEQ ID NO: 404739 - RNA, 32 nt, Human
cugcucguucuugccgagggugcagugguggc

SEQ ID NO: 404740 - RNA, 32 nt, Human
cugcucuacacacuggugucuccugcggaagg

SEQ ID NO: 404741 - RNA, 32 nt, Human
cugcucuacaucuggccucugccaauggaaau

SEQ ID NO: 404742 - RNA, 32 nt, Human
cugcucuacugcuuccccuccugucuccaguu

SEQ ID NO: 404743 - RNA, 21 nt, Human
cugcucuagcagcaaggcagu

SEQ ID NO: 404744 - RNA, 24 nt, Human
cugcucuagccgcugcucaggcca

SEQ ID NO: 404745 - RNA, 24 nt, Human
cugcucuagcugcccacagaugcc

SEQ ID NO: 404746 - RNA, 22 nt, Human
cugcucuagcugccgucaguca

SEQ ID NO: 404747 - RNA, 20 nt, Human
cugcucuagcuugagcagcu

SEQ ID NO: 404748 - RNA, 24 nt, Human
cugcucuaggaccugggccucuca

SEQ ID NO: 404749 - RNA, 32 nt, Human
cugcucuagggaaaccuucaaaagcaauaaaa

SEQ ID NO: 404750 - RNA, 32 nt, Human
cugcucuauuucuuucuccuugcccucugaaa

SEQ ID NO: 404751 - RNA, 32 nt, Human
cugcucucaaacuccugaccucaggugauccg

SEQ ID NO: 404752 - RNA, 32 nt, Human
cugcucucaagugauccuccugccucagccuc

SEQ ID NO: 404753 - RNA, 32 nt, Human
cugcucucagagccagaaaaugcugacagccu

SEQ ID NO: 404754 - RNA, 32 nt, Human
cugcucucagagguggaagagcaaggcuggaa

SEQ ID NO: 404755 - RNA, 32 nt, Human
cugcucucagcagccaccggggauggaggaac

SEQ ID NO: 404756 - RNA, 32 nt, Human
cugcucucagcaguuugaucgauggacuaagg

SEQ ID NO: 404757 - RNA, 23 nt, Human
cugcucucagcuugugccuugua

SEQ ID NO: 404758 - RNA, 32 nt, Human
cugcucuccagccugagcgacagagcgagacu

SEQ ID NO: 404759 - RNA, 32 nt, Human
cugcucuccagccuggguggcagagcgagacc

SEQ ID NO: 404760 - RNA, 23 nt, Human
cugcucuccaguaccugcugcug

SEQ ID NO: 404761 - RNA, 32 nt, Human
cugcucuccaguaccugcugcugaucuguuuc

SEQ ID NO: 404762 - RNA, 32 nt, Human
cugcucuccauagcaagguucuagggcucuuc

SEQ ID NO: 404763 - RNA, 32 nt, Human
cugcucucccagagggaaggucuugcuguuug

SEQ ID NO: 404764 - RNA, 32 nt, Human
cugcucuccccaggauggggucagaggagaca

SEQ ID NO: 404765 - RNA, 32 nt, Human
cugcucucccgaggaagaugcucugcaggaaa

SEQ ID NO: 404766 - RNA, 32 nt, Human
cugcucuccuucuuaagaagggugggaggcac

SEQ ID NO: 404767 - RNA, 22 nt, Human
cugcucuccuugcccugggcca

SEQ ID NO: 404768 - RNA, 32 nt, Human
cugcucucgaacuccugaccucaggugaucca

SEQ ID NO: 404769 - RNA, 32 nt, Human
cugcucucgaacuccugaccucaucguccacc

SEQ ID NO: 404770 - RNA, 32 nt, Human
cugcucucgaacuccugaccucaugauccgcc

SEQ ID NO: 404771 - RNA, 32 nt, Human
cugcucucggcaccuggggcuccaugcuuacc

SEQ ID NO: 404772 - RNA, 32 nt, Human
cugcucucgugccauuugagaggcugcugccc

SEQ ID NO: 404773 - RNA, 32 nt, Human
cugcucucuacccagcccaucuugccuccaug

SEQ ID NO: 404774 - RNA, 32 nt, Human
cugcucucucaacaucacauacagcuucagcu

SEQ ID NO: 404775 - RNA, 32 nt, Human
cugcucucucaugaaacaagagcuagaaacuc

SEQ ID NO: 404776 - RNA, 32 nt, Human
cugcucucuccacuucucugcuuauauugucu

SEQ ID NO: 404777 - RNA, 32 nt, Human
cugcucucuccucucucagucucuccuuuucu

SEQ ID NO: 404778 - RNA, 32 nt, Human
cugcucucucucugaagucugcuuucugagag

SEQ ID NO: 404779 - RNA, 32 nt, Human
cugcucucuggccaacggcuucacaccuuccc

SEQ ID NO: 404780 - RNA, 32 nt, Human
cugcucucuggccuccagccucccagcagcau

SEQ ID NO: 404781 - RNA, 32 nt, Human
cugcucucugugggucuaugagucagcagcaa

SEQ ID NO: 404782 - RNA, 32 nt, Human
cugcucucuucucuccccucugucccucuuca

SEQ ID NO: 404783 - RNA, 32 nt, Human
cugcucucuugccacacugaaggcuagagaag

SEQ ID NO: 404784 - RNA, 18 nt, Human
cugcucucuuggggacuu

SEQ ID NO: 404785 - RNA, 23 nt, Human
cugcucugacccucugcccugca

SEQ ID NO: 404786 - RNA, 32 nt, Human
cugcucugacccuuggccucaggcuuggcccu

SEQ ID NO: 404787 - RNA, 24 nt, Human
cugcucugacugcguccuccccag

SEQ ID NO: 404788 - RNA, 32 nt, Human
cugcucugagaggcacuucacucacaggccug

SEQ ID NO: 404789 - RNA, 32 nt, Human
cugcucugagcaccuccacaccccacugccuc

SEQ ID NO: 404790 - RNA, 21 nt, Human
cugcucugagcccuuccccag

SEQ ID NO: 404791 - RNA, 32 nt, Human
cugcucugagccucacagccgggaggugacag

SEQ ID NO: 404792 - RNA, 22 nt, Human
cugcucugagccugcccagggg

SEQ ID NO: 404793 - RNA, 22 nt, Human
cugcucugagcucucucuugca

SEQ ID NO: 404794 - RNA, 32 nt, Human
cugcucugaggguggguccaggcagacaugug

SEQ ID NO: 404795 - RNA, 32 nt, Human
cugcucugaguauuuaguaaccaacacugcgu

SEQ ID NO: 404796 - RNA, 32 nt, Human
cugcucugaucacuacgugcugugaagggcac

SEQ ID NO: 404797 - RNA, 32 nt, Human
cugcucugaugccgaaggggaggcagaaagug

SEQ ID NO: 404798 - RNA, 32 nt, Human
cugcucugcaaccuuucucuucucacgggucu

SEQ ID NO: 404799 - RNA, 23 nt, Human
cugcucugcagcacacccguggg

SEQ ID NO: 404800 - RNA, 22 nt, Human
cugcucugccacugccccaggg

SEQ ID NO: 404801 - RNA, 22 nt, Human
cugcucugccagcccgcugagg

SEQ ID NO: 404802 - RNA, 24 nt, Human
cugcucugccaguccagcugaggg

SEQ ID NO: 404803 - RNA, 32 nt, Human
cugcucugcccaggagguggcguccagcaguc

SEQ ID NO: 404804 - RNA, 24 nt, Human
cugcucugccccuagcuccagggg

SEQ ID NO: 404805 - RNA, 32 nt, Human
cugcucugccggggucaucuccugggucaucg

SEQ ID NO: 404806 - RNA, 32 nt, Human
cugcucugccuccugaggcagguuuucagaga

SEQ ID NO: 404807 - RNA, 31 nt, Human
cugcucugccucucugaaccucgguuucuuc

SEQ ID NO: 404808 - RNA, 22 nt, Human
cugcucugccugagcaucaggg

SEQ ID NO: 404809 - RNA, 32 nt, Human
cugcucugcggaguuccucuucccagcgaagg

SEQ ID NO: 404810 - RNA, 32 nt, Human
cugcucugcuacaccagggcugccucaggcca

SEQ ID NO: 404811 - RNA, 19 nt, Human
cugcucugcucccgggcua

SEQ ID NO: 404812 - RNA, 22 nt, Human
cugcucugcucgccucggauca

SEQ ID NO: 404813 - RNA, 19 nt, Human
cugcucugcugccccggcc

SEQ ID NO: 404814 - RNA, 22 nt, Human
cugcucugcugccugcccgggg

SEQ ID NO: 404815 - RNA, 22 nt, Human
cugcucugcugccuguccuggg

SEQ ID NO: 404816 - RNA, 32 nt, Human
cugcucuggaagagaggcaguagcaaagagau

SEQ ID NO: 404817 - RNA, 32 nt, Human
cugcucuggaagccaaggugggaggauugucu

SEQ ID NO: 404818 - RNA, 32 nt, Human
cugcucuggacugaaagugaugcaucaugacg

SEQ ID NO: 404819 - RNA, 32 nt, Human
cugcucuggagaggcagggugggauagggaac

SEQ ID NO: 404820 - RNA, 32 nt, Human
cugcucuggagggagugagcaggaugcuguga

SEQ ID NO: 404821 - RNA, 32 nt, Human
cugcucuggagugggggagguugguggaccau

SEQ ID NO: 404822 - RNA, 32 nt, Human
cugcucuggauagcagauccgcuggcucccag

SEQ ID NO: 404823 - RNA, 32 nt, Human
cugcucuggccaaaccuucucucugcugacug

SEQ ID NO: 404824 - RNA, 32 nt, Human
cugcucuggcuuuugccuucuugaugccagcc

SEQ ID NO: 404825 - RNA, 32 nt, Human
cugcucugggagguguuggaguucacuguuga

SEQ ID NO: 404826 - RNA, 32 nt, Human
cugcucugggcccuggccuccuucccuucuug

SEQ ID NO: 404827 - RNA, 32 nt, Human
cugcucugggcugugaagggguggagcaggca

SEQ ID NO: 404828 - RNA, 22 nt, Human
cugcucuggggccagcccaggg

SEQ ID NO: 404829 - RNA, 20 nt, Human
cugcucugggggugucuggg

SEQ ID NO: 404830 - RNA, 25 nt, Human
cugcucuggguggccucugccuugc

SEQ ID NO: 404831 - RNA, 32 nt, Human
cugcucuggucccuccaaaagccgacgaaucc

SEQ ID NO: 404832 - RNA, 32 nt, Human
cugcucuggugugugaaggucgguggguuaac

SEQ ID NO: 404833 - RNA, 19 nt, Human
cugcucuguccucugugaa

SEQ ID NO: 404834 - RNA, 32 nt, Human
cugcucuguccucugugaacacacaggaggcc

SEQ ID NO: 404835 - RNA, 32 nt, Human
cugcucugucuacauuuauuuguacccacacg

SEQ ID NO: 404836 - RNA, 32 nt, Human
cugcucugucugcgacaccaagauccagcugg

SEQ ID NO: 404837 - RNA, 32 nt, Human
cugcucugugccguggcuuucucaguuagucc

SEQ ID NO: 404838 - RNA, 22 nt, Human
cugcucugugcuccccacucca

SEQ ID NO: 404839 - RNA, 22 nt, Human
cugcucuguguuugggccucuc

SEQ ID NO: 404840 - RNA, 32 nt, Human
cugcucuguucucccucuacauuucucugcag

SEQ ID NO: 404841 - RNA, 32 nt, Human
cugcucuguucuucccccuccuuaggccccag

SEQ ID NO: 404842 - RNA, 23 nt, Human
cugcucuucagcuccugcuccca

SEQ ID NO: 404843 - RNA, 32 nt, Human
cugcucuuccacccuuuuccucuuccgcugug

SEQ ID NO: 404844 - RNA, 32 nt, Human
cugcucuucccccacauuaauaccuuuuccuu

SEQ ID NO: 404845 - RNA, 32 nt, Human
cugcucuucugcguuaagugggagacaauguc

SEQ ID NO: 404846 - RNA, 32 nt, Human
cugcucuucuuccuccaauccugggucucagu

SEQ ID NO: 404847 - RNA, 32 nt, Human
cugcucuucuucgccuccuuuauuuaauucau

SEQ ID NO: 404848 - RNA, 32 nt, Human
cugcucuugaacuccugaccucagguaaucca

SEQ ID NO: 404849 - RNA, 32 nt, Human
cugcucuugaacuccugaccucagguaaucga

SEQ ID NO: 404850 - RNA, 32 nt, Human
cugcucuugaacuccugaccucaggugauccg

SEQ ID NO: 404851 - RNA, 32 nt, Human
cugcucuugaagguguauuacaucagguuuuc

SEQ ID NO: 404852 - RNA, 20 nt, Human
cugcucuugcaucugggcca

SEQ ID NO: 404853 - RNA, 32 nt, Human
cugcucuugcccagggagcaucccuucucucu

SEQ ID NO: 404854 - RNA, 32 nt, Human
cugcucuugggaacagccagaguaagauugga

SEQ ID NO: 404855 - RNA, 32 nt, Human
cugcucuuuccacuugcccuguguucuuuccc

SEQ ID NO: 404856 - RNA, 32 nt, Human
cugcucuuucugccucugggcucauguaucug

SEQ ID NO: 404857 - RNA, 32 nt, Human
cugcucuuuggcgcaguacuccaggcuauaga

SEQ ID NO: 404858 - RNA, 32 nt, Human
cugcucuuuucccaucuuuccaauacuuucuu

SEQ ID NO: 404859 - RNA, 32 nt, Human
cugcucuuuuucugcugucacugucaaucugc

SEQ ID NO: 404860 - RNA, 19 nt, Human
cugcugaaaaauucagcaa

SEQ ID NO: 404861 - RNA, 32 nt, Human
cugcugaaacaccucccaggggcuccaccugu

SEQ ID NO: 404862 - RNA, 32 nt, Human
cugcugaaaccaggaauccaggucaggcccga

SEQ ID NO: 404863 - RNA, 23 nt, Human
cugcugaaacucucguugaguca

SEQ ID NO: 404864 - RNA, 23 nt, Human
cugcugaaacuuguuccaccuca

SEQ ID NO: 404865 - RNA, 32 nt, Human
cugcugaagaacauguugcucaaggagaugcc

SEQ ID NO: 404866 - RNA, 32 nt, Human
cugcugaagacugacggggcccaggguccgcu

SEQ ID NO: 404867 - RNA, 32 nt, Human
cugcugaagccaucuccuugccgacaaacaca

SEQ ID NO: 404868 - RNA, 22 nt, Human
cugcugaagcccugcugaguca

SEQ ID NO: 404869 - RNA, 32 nt, Human
cugcugaaggcugugguggaccgggcuggauc

SEQ ID NO: 404870 - RNA, 32 nt, Human
cugcugaaguaaagcagaaaguacugcauagu

SEQ ID NO: 404871 - RNA, 32 nt, Human
cugcugaaucugucuguucaguuugucaagga

SEQ ID NO: 404872 - RNA, 32 nt, Human
cugcugaauggcggagcuaaaauagcuauaac

SEQ ID NO: 404873 - RNA, 32 nt, Human
cugcugaaugugccgcugacucagcugugcug

SEQ ID NO: 404874 - RNA, 32 nt, Human
cugcugacaaacccuucuuaguuccuucaauu

SEQ ID NO: 404875 - RNA, 32 nt, Human
cugcugacaaauaauuccugagguucuccaca

SEQ ID NO: 404876 - RNA, 32 nt, Human
cugcugacacuggauucaugaaccagggggau

SEQ ID NO: 404877 - RNA, 32 nt, Human
cugcugacagguuugguggcacugcugguuac

SEQ ID NO: 404878 - RNA, 32 nt, Human
cugcugaccagaaauguugccccuaaguucuu

SEQ ID NO: 404879 - RNA, 32 nt, Human
cugcugaccaugugugaagaccagccucacag

SEQ ID NO: 404880 - RNA, 32 nt, Human
cugcugacccaggguuuccccuuccccuuccc

SEQ ID NO: 404881 - RNA, 19 nt, Human
cugcugacccccugggcca

SEQ ID NO: 404882 - RNA, 18 nt, Human
cugcugaccccugagcca

SEQ ID NO: 404883 - RNA, 32 nt, Human
cugcugaccuccagcaccccgcacuugcucau

SEQ ID NO: 404884 - RNA, 32 nt, Human
cugcugaccucggcugcuccucucacagaccc

SEQ ID NO: 404885 - RNA, 32 nt, Human
cugcugaccuugcugggaacacucugaggaca

SEQ ID NO: 404886 - RNA, 23 nt, Human
cugcugacgagucccuuccugga

SEQ ID NO: 404887 - RNA, 32 nt, Human
cugcugacguacuguggauguagaguauaaaa

SEQ ID NO: 404888 - RNA, 21 nt, Human
cugcugacuaaacacuuucaa

SEQ ID NO: 404889 - RNA, 32 nt, Human
cugcugacuucugcccuucaccccugucauuc

SEQ ID NO: 404890 - RNA, 32 nt, Human
cugcugacuugcaguuuaaggggaaucuauuc

SEQ ID NO: 404891 - RNA, 32 nt, Human
cugcugacuuuccuaaccaaaacaacuuccuu

SEQ ID NO: 404892 - RNA, 32 nt, Human
cugcugagacccuucccagggaggagccaccc

SEQ ID NO: 404893 - RNA, 32 nt, Human
cugcugagcagcccggcucuuaacagagaugc

SEQ ID NO: 404894 - RNA, 32 nt, Human
cugcugagcaggagggagaggaaggggguccu

SEQ ID NO: 404895 - RNA, 21 nt, Human
cugcugagccgcccccgggcc

SEQ ID NO: 404896 - RNA, 18 nt, Human
cugcugagcugggucuuc

SEQ ID NO: 404897 - RNA, 32 nt, Human
cugcugaggaagaccaaagcagcacucguugc

SEQ ID NO: 404898 - RNA, 32 nt, Human
cugcugaggaaggauaggcuguggaaauuagg

SEQ ID NO: 404899 - RNA, 23 nt, Human
cugcugaggaccccgcugagcca

SEQ ID NO: 404900 - RNA, 31 nt, Human
cugcugaggagaccuggugcagggacuaauc

SEQ ID NO: 404901 - RNA, 32 nt, Human
cugcugaggaggaggaagaggacacugaaggc

SEQ ID NO: 404902 - RNA, 32 nt, Human
cugcugaggcggagacugcagugagcugagau

SEQ ID NO: 404903 - RNA, 32 nt, Human
cugcugagggaccuuggagagcucaggauggc

SEQ ID NO: 404904 - RNA, 32 nt, Human
cugcugagguggagacugcagugagcugagau

SEQ ID NO: 404905 - RNA, 32 nt, Human
cugcugagguucuagaauagaagggcugccaa

SEQ ID NO: 404906 - RNA, 32 nt, Human
cugcugaguagcugggacuacaggcacaugcc

SEQ ID NO: 404907 - RNA, 32 nt, Human
cugcugaguagcugggauugcagguguguacc

SEQ ID NO: 404908 - RNA, 22 nt, Human
cugcugagucaacccaauaguu

SEQ ID NO: 404909 - RNA, 32 nt, Human
cugcugaguuacugaaagaccuuuuggaccac

SEQ ID NO: 404910 - RNA, 32 nt, Human
cugcugaguucccuuguucuagcuagcagcac

SEQ ID NO: 404911 - RNA, 32 nt, Human
cugcugaguucugcgggaguuugcugagcaac

SEQ ID NO: 404912 - RNA, 32 nt, Human
cugcugauaaagccucagguccagauaaagau

SEQ ID NO: 404913 - RNA, 32 nt, Human
cugcugaucacucuuucaugccuguguaucca

SEQ ID NO: 404914 - RNA, 19 nt, Human
cugcugaucucccugagcc

SEQ ID NO: 404915 - RNA, 32 nt, Human
cugcugaucugugccacugaacuccaguucuu

SEQ ID NO: 404916 - RNA, 18 nt, Human
cugcugauguccugacca

SEQ ID NO: 404917 - RNA, 32 nt, Human
cugcugauguuggggugaaaccaccuggagug

SEQ ID NO: 404918 - RNA, 32 nt, Human
cugcugauuccucagaauggcuucuggaccuu

SEQ ID NO: 404919 - RNA, 32 nt, Human
cugcugauuguacuuuccccuccugagccccg

SEQ ID NO: 404920 - RNA, 32 nt, Human
cugcugcaaaacuccaggcuucccaggguugg

SEQ ID NO: 404921 - RNA, 32 nt, Human
cugcugcaacacuuagggcuugagagcaccug

SEQ ID NO: 404922 - RNA, 32 nt, Human
cugcugcaacaucuucuccuccaggaaggcuu

SEQ ID NO: 404923 - RNA, 32 nt, Human
cugcugcaacccugacagccgucucccaggcc

SEQ ID NO: 404924 - RNA, 32 nt, Human
cugcugcaacuaagucagcaacacaguuucuc

SEQ ID NO: 404925 - RNA, 32 nt, Human
cugcugcaagagccauaacuuugaggcauuuu

SEQ ID NO: 404926 - RNA, 32 nt, Human
cugcugcaaucaaggugguucuggugcggggg

SEQ ID NO: 404927 - RNA, 20 nt, Human
cugcugcacacgcuagcaua

SEQ ID NO: 404928 - RNA, 32 nt, Human
cugcugcaccaccaccaucaccacgcuccccu

SEQ ID NO: 404929 - RNA, 32 nt, Human
cugcugcaccacugcccugccuucgggcugcu

SEQ ID NO: 404930 - RNA, 32 nt, Human
cugcugcacugcccuccgcccuucccugacac

SEQ ID NO: 404931 - RNA, 32 nt, Human
cugcugcagacccucgggaucgucgcuggaaa

SEQ ID NO: 404932 - RNA, 32 nt, Human
cugcugcagagggagccuguguuugcaaaacc

SEQ ID NO: 404933 - RNA, 32 nt, Human
cugcugcagcacgccugugcucugugcuugcc

SEQ ID NO: 404934 - RNA, 32 nt, Human
cugcugcagcccagggcucucugggcagcuga

SEQ ID NO: 404935 - RNA, 32 nt, Human
cugcugcagccccguguuggccaugucgucac

SEQ ID NO: 404936 - RNA, 19 nt, Human
cugcugcagcuccugggcc

SEQ ID NO: 404937 - RNA, 22 nt, Human
cugcugcaggaacccugggcca

SEQ ID NO: 404938 - RNA, 32 nt, Human
cugcugcaggcaggaaggcaugugaguguacg

SEQ ID NO: 404939 - RNA, 32 nt, Human
cugcugcagggagggcagaggcauugcugaga

SEQ ID NO: 404940 - RNA, 32 nt, Human
cugcugcagggccuuccugccuggacagaguu

SEQ ID NO: 404941 - RNA, 32 nt, Human
cugcugcagggugcugccugagggguccuggg

SEQ ID NO: 404942 - RNA, 32 nt, Human
cugcugcaggucacacagcaaugcagcucagg

SEQ ID NO: 404943 - RNA, 20 nt, Human
cugcugcaguaacugagcca

SEQ ID NO: 404944 - RNA, 32 nt, Human
cugcugcaguacggagccucaggcggacagau

SEQ ID NO: 404945 - RNA, 19 nt, Human
cugcugcagucccgggaca

SEQ ID NO: 404946 - RNA, 32 nt, Human
cugcugcaguguggggcugaccccaaugcugc

SEQ ID NO: 404947 - RNA, 32 nt, Human
cugcugcauacacugaagggccacgaaguaca

SEQ ID NO: 404948 - RNA, 19 nt, Human
cugcugcaucgaguccuua

SEQ ID NO: 404949 - RNA, 32 nt, Human
cugcugcaugucuggagggaccaaggaaagug

SEQ ID NO: 404950 - RNA, 24 nt, Human
cugcugcaugugugcccugagcca

SEQ ID NO: 404951 - RNA, 20 nt, Human
cugcugcauuccccaucugu

SEQ ID NO: 404952 - RNA, 22 nt, Human
cugcugccaccgccgccgccac

SEQ ID NO: 404953 - RNA, 32 nt, Human
cugcugccaccucaugccccuccuggcaugau

SEQ ID NO: 404954 - RNA, 32 nt, Human
cugcugccaccucuccugggccuguguccuuu

SEQ ID NO: 404955 - RNA, 32 nt, Human
cugcugccaccucuuguucucucccccguucc

SEQ ID NO: 404956 - RNA, 32 nt, Human
cugcugccaccugcgccagcccuaccuuccac

SEQ ID NO: 404957 - RNA, 20 nt, Human
cugcugccagacacugcgac

SEQ ID NO: 404958 - RNA, 32 nt, Human
cugcugccagaucucccagcuguacagggcug

SEQ ID NO: 404959 - RNA, 32 nt, Human
cugcugccagccugugucugugcagucccccu

SEQ ID NO: 404960 - RNA, 18 nt, Human
cugcugccagcggggcag

SEQ ID NO: 404961 - RNA, 21 nt, Human
cugcugccaggcaccaugaca

SEQ ID NO: 404962 - RNA, 32 nt, Human
cugcugccaguucuggcucaaauguggcacaa

SEQ ID NO: 404963 - RNA, 21 nt, Human
cugcugccauacauuguaaca

SEQ ID NO: 404964 - RNA, 32 nt, Human
cugcugccauacucccccuuggcucccccugu

SEQ ID NO: 404965 - RNA, 21 nt, Human
cugcugccaucugccccggcu

SEQ ID NO: 404966 - RNA, 24 nt, Human
cugcugcccaagcuggaguggcag

SEQ ID NO: 404967 - RNA, 32 nt, Human
cugcugcccaagcuggaguggcaguggcauga

SEQ ID NO: 404968 - RNA, 21 nt, Human
cugcugcccaauaaaccuguc

SEQ ID NO: 404969 - RNA, 24 nt, Human
cugcugcccaaucuccaucuguca

SEQ ID NO: 404970 - RNA, 32 nt, Human
cugcugcccaccaauggagaaucccaauguug

SEQ ID NO: 404971 - RNA, 32 nt, Human
cugcugcccacccucugcucccugggaugggc

SEQ ID NO: 404972 - RNA, 18 nt, Human
cugcugcccaccugugac

SEQ ID NO: 404973 - RNA, 19 nt, Human
cugcugcccagagaccuua

SEQ ID NO: 404974 - RNA, 22 nt, Human
cugcugcccaggaguggccagu

SEQ ID NO: 404975 - RNA, 24 nt, Human
cugcugcccaggcuagagugcagu

SEQ ID NO: 404976 - RNA, 32 nt, Human
cugcugcccaggcuagagugcaguggcgugau

SEQ ID NO: 404977 - RNA, 32 nt, Human
cugcugcccaggcuggaaugcaguggugccau

SEQ ID NO: 404978 - RNA, 24 nt, Human
cugcugcccaggcuggaguacagu

SEQ ID NO: 404979 - RNA, 32 nt, Human
cugcugcccaggcuggaguacagugaugugau

SEQ ID NO: 404980 - RNA, 32 nt, Human
cugcugcccaggcuggaguacaguggcacaau

SEQ ID NO: 404981 - RNA, 24 nt, Human
cugcugcccaggcuggagugcagu

SEQ ID NO: 404982 - RNA, 32 nt, Human
cugcugcccaggcuggagugcaguggcacgau

SEQ ID NO: 404983 - RNA, 32 nt, Human
cugcugcccaggcuggagugcaguggugcaau

SEQ ID NO: 404984 - RNA, 19 nt, Human
cugcugcccaggcugugca

SEQ ID NO: 404985 - RNA, 20 nt, Human
cugcugcccaggcugugcag

SEQ ID NO: 404986 - RNA, 21 nt, Human
cugcugcccagggaagcgcag

SEQ ID NO: 404987 - RNA, 22 nt, Human
cugcugcccaggggcuuccagu

SEQ ID NO: 404988 - RNA, 32 nt, Human
cugcugcccagguuggagugcaguggcacgau

SEQ ID NO: 404989 - RNA, 19 nt, Human
cugcugccccagccugaca

SEQ ID NO: 404990 - RNA, 20 nt, Human
cugcugcccccagcuggagg

SEQ ID NO: 404991 - RNA, 22 nt, Human
cugcugccccccgacaugugac

SEQ ID NO: 404992 - RNA, 32 nt, Human
cugcugcccccugccacacagggggccgggcc

SEQ ID NO: 404993 - RNA, 23 nt, Human
cugcugccccgugggcugugcca

SEQ ID NO: 404994 - RNA, 32 nt, Human
cugcugccccuaccuguuccugaggccucauu

SEQ ID NO: 404995 - RNA, 23 nt, Human
cugcugccccucccagccugcca

SEQ ID NO: 404996 - RNA, 32 nt, Human
cugcugccccucccucucucucccucucucuc

SEQ ID NO: 404997 - RNA, 31 nt, Human
cugcugccccuugcuuugccuguguuugcug

SEQ ID NO: 404998 - RNA, 32 nt, Human
cugcugcccgagagcagggaccagaaccugcc

SEQ ID NO: 404999 - RNA, 23 nt, Human
cugcugcccgcuccccggcgcca

SEQ ID NO: 405000 - RNA, 19 nt, Human
cugcugcccggcucgggcc

SEQ ID NO: 405001 - RNA, 32 nt, Human
cugcugcccgggggucuccuucaggcucuuug

SEQ ID NO: 405002 - RNA, 19 nt, Human
cugcugcccuccacgugca

SEQ ID NO: 405003 - RNA, 32 nt, Human
cugcugcccucccccuccucuccaccaucguc

SEQ ID NO: 405004 - RNA, 32 nt, Human
cugcugcccuccuccuggccucccagguuuca

SEQ ID NO: 405005 - RNA, 32 nt, Human
cugcugcccuccugucgagaaugacugccagg

SEQ ID NO: 405006 - RNA, 21 nt, Human
cugcugcccugaccugaguca

SEQ ID NO: 405007 - RNA, 32 nt, Human
cugcugcccugagcagagucaucaugucuucu

SEQ ID NO: 405008 - RNA, 32 nt, Human
cugcugcccugagcccuuccuucaggccagca

SEQ ID NO: 405009 - RNA, 31 nt, Human
cugcugcccuucucugggcauguucugaaug

SEQ ID NO: 405010 - RNA, 32 nt, Human
cugcugcccuugacuggugcucaggggaccac

SEQ ID NO: 405011 - RNA, 21 nt, Human
cugcugcccuuuacugugaca

SEQ ID NO: 405012 - RNA, 21 nt, Human
cugcugccgacuaacugugca

SEQ ID NO: 405013 - RNA, 32 nt, Human
cugcugccgcugccuccuccuggguaaggggc

SEQ ID NO: 405014 - RNA, 19 nt, Human
cugcugccggaccugagcc

SEQ ID NO: 405015 - RNA, 32 nt, Human
cugcugccuagcaauuuccaucuuagccacac

SEQ ID NO: 405016 - RNA, 23 nt, Human
cugcugccuaggcugagugcagu

SEQ ID NO: 405017 - RNA, 32 nt, Human
cugcugccucaacuuccugggcucaagugacc

SEQ ID NO: 405018 - RNA, 22 nt, Human
cugcugccucagcuccaagaca

SEQ ID NO: 405019 - RNA, 20 nt, Human
cugcugccucccacugaaca

SEQ ID NO: 405020 - RNA, 32 nt, Human
cugcugccuccccuaagaaucuuccuugcccu

SEQ ID NO: 405021 - RNA, 32 nt, Human
cugcugccuccccugcagccagggucugggca

SEQ ID NO: 405022 - RNA, 19 nt, Human
cugcugccuccccugugac

SEQ ID NO: 405023 - RNA, 22 nt, Human
cugcugccucggaacugugaca

SEQ ID NO: 405024 - RNA, 32 nt, Human
cugcugccucucggagaggcacgagggucccg

SEQ ID NO: 405025 - RNA, 32 nt, Human
cugcugccucucucccuccacucagcucccag

SEQ ID NO: 405026 - RNA, 20 nt, Human
cugcugccucuggcaagaca

SEQ ID NO: 405027 - RNA, 32 nt, Human
cugcugccugcaccugccccagggcacagagu

SEQ ID NO: 405028 - RNA, 18 nt, Human
cugcugccugcccgggcu

SEQ ID NO: 405029 - RNA, 32 nt, Human
cugcugccugccgccaucaugucuacugcaaa

SEQ ID NO: 405030 - RNA, 20 nt, Human
cugcugccugccgccgugac

SEQ ID NO: 405031 - RNA, 20 nt, Human
cugcugccugcggcuggaca

SEQ ID NO: 405032 - RNA, 19 nt, Human
cugcugccugcuccagaca

SEQ ID NO: 405033 - RNA, 19 nt, Human
cugcugccugcuuugugca

SEQ ID NO: 405034 - RNA, 20 nt, Human
cugcugccuggaccuauaca

SEQ ID NO: 405035 - RNA, 18 nt, Human
cugcugccuggcaugaca

SEQ ID NO: 405036 - RNA, 32 nt, Human
cugcugccuggugucuugcugaucaucacccu

SEQ ID NO: 405037 - RNA, 32 nt, Human
cugcugccuucccacaacauuaaacucuccuu

SEQ ID NO: 405038 - RNA, 24 nt, Human
cugcugccuuccugcugugaggug

SEQ ID NO: 405039 - RNA, 32 nt, Human
cugcugccuucuccuccauuucucugcucaga

SEQ ID NO: 405040 - RNA, 20 nt, Human
cugcugccuugcuucagcca

SEQ ID NO: 405041 - RNA, 32 nt, Human
cugcugccuuucuagccugcccaggaugcagg

SEQ ID NO: 405042 - RNA, 32 nt, Human
cugcugcgaucuguucuucugccgcucugucu

SEQ ID NO: 405043 - RNA, 32 nt, Human
cugcugcgaugccucugccucaucucacacug

SEQ ID NO: 405044 - RNA, 31 nt, Human
cugcugcgcaguucucccauccugggacggc

SEQ ID NO: 405045 - RNA, 32 nt, Human
cugcugcgccuugagcagcugugucuuguccc

SEQ ID NO: 405046 - RNA, 32 nt, Human
cugcugcgcgcagcuggcugggcucaggcgcg

SEQ ID NO: 405047 - RNA, 32 nt, Human
cugcugcggaggcgaagccaggaagcgcugcu

SEQ ID NO: 405048 - RNA, 32 nt, Human
cugcugcggcccaagagucacugugaaggacc

SEQ ID NO: 405049 - RNA, 23 nt, Human
cugcugcggcccagccccgagcc

SEQ ID NO: 405050 - RNA, 17 nt, Human
cugcugcggccccgggc

SEQ ID NO: 405051 - RNA, 19 nt, Human
cugcugcggccgggcucug

SEQ ID NO: 405052 - RNA, 23 nt, Human
cugcugcggcgcggcgaggcgag

SEQ ID NO: 405053 - RNA, 20 nt, Human
cugcugcggcugugggcgag

SEQ ID NO: 405054 - RNA, 32 nt, Human
cugcugcguggaggcagccaugggaaggagcc

SEQ ID NO: 405055 - RNA, 21 nt, Human
cugcugcguguucgcgggcca

SEQ ID NO: 405056 - RNA, 18 nt, Human
cugcugcuacccaagcca

SEQ ID NO: 405057 - RNA, 19 nt, Human
cugcugcuaccucgcgcua

SEQ ID NO: 405058 - RNA, 20 nt, Human
cugcugcuacuacccgagcc

SEQ ID NO: 405059 - RNA, 20 nt, Human
cugcugcuacucuccgagcu

SEQ ID NO: 405060 - RNA, 20 nt, Human
cugcugcuacucuguagcca

SEQ ID NO: 405061 - RNA, 22 nt, Human
cugcugcuagcugccuugggcc

SEQ ID NO: 405062 - RNA, 18 nt, Human
cugcugcuaggcgagcca

SEQ ID NO: 405063 - RNA, 32 nt, Human
cugcugcuagggccuccagccagggcaugucu

SEQ ID NO: 405064 - RNA, 20 nt, Human
cugcugcuauucuccgagcu

SEQ ID NO: 405065 - RNA, 20 nt, Human
cugcugcucacaccugggcc

SEQ ID NO: 405066 - RNA, 18 nt, Human
cugcugcucaccucagcu

SEQ ID NO: 405067 - RNA, 20 nt, Human
cugcugcucacucugaucca

SEQ ID NO: 405068 - RNA, 18 nt, Human
cugcugcucacucuggcc

SEQ ID NO: 405069 - RNA, 32 nt, Human
cugcugcucaggcuggagugcaguggugcaau

SEQ ID NO: 405070 - RNA, 17 nt, Human
cugcugcucaucgaguc

SEQ ID NO: 405071 - RNA, 20 nt, Human
cugcugcuccaaugggucca

SEQ ID NO: 405072 - RNA, 20 nt, Human
cugcugcuccaccacgggcc

SEQ ID NO: 405073 - RNA, 17 nt, Human
cugcugcuccacgagcu

SEQ ID NO: 405074 - RNA, 32 nt, Human
cugcugcucccaggcuggggcugugcugcagg

SEQ ID NO: 405075 - RNA, 22 nt, Human
cugcugcucccucagacugggg

SEQ ID NO: 405076 - RNA, 20 nt, Human
cugcugcuccgccugcguca

SEQ ID NO: 405077 - RNA, 32 nt, Human
cugcugcuccuccuccuuucccagcccgccgc

SEQ ID NO: 405078 - RNA, 19 nt, Human
cugcugcuccuccugagcc

SEQ ID NO: 405079 - RNA, 21 nt, Human
cugcugcuccugcccccaccu

SEQ ID NO: 405080 - RNA, 22 nt, Human
cugcugcuccugcuccuggguu

SEQ ID NO: 405081 - RNA, 32 nt, Human
cugcugcuccugcucucccucucccuccucca

SEQ ID NO: 405082 - RNA, 18 nt, Human
cugcugcuccugcuggcc

SEQ ID NO: 405083 - RNA, 32 nt, Human
cugcugcuccuuccucugacccugacucugcc

SEQ ID NO: 405084 - RNA, 19 nt, Human
cugcugcucgccagaagcc

SEQ ID NO: 405085 - RNA, 21 nt, Human
cugcugcucgccccgucguua

SEQ ID NO: 405086 - RNA, 20 nt, Human
cugcugcucgcucaccugcc

SEQ ID NO: 405087 - RNA, 18 nt, Human
cugcugcucggccggccg

SEQ ID NO: 405088 - RNA, 19 nt, Human
cugcugcucggcuggacca

SEQ ID NO: 405089 - RNA, 22 nt, Human
cugcugcucggguucugaggca

SEQ ID NO: 405090 - RNA, 18 nt, Human
cugcugcucgucgcgccg

SEQ ID NO: 405091 - RNA, 19 nt, Human
cugcugcucgucucaggcu

SEQ ID NO: 405092 - RNA, 20 nt, Human
cugcugcucucauggugcca

SEQ ID NO: 405093 - RNA, 32 nt, Human
cugcugcucucugauccuaaagccugagcuag

SEQ ID NO: 405094 - RNA, 32 nt, Human
cugcugcucugaggggagaggggugggucucc

SEQ ID NO: 405095 - RNA, 32 nt, Human
cugcugcucugggaaccaccucucugcucucc

SEQ ID NO: 405096 - RNA, 20 nt, Human
cugcugcucugggagggcca

SEQ ID NO: 405097 - RNA, 20 nt, Human
cugcugcucuguuuugggcc

SEQ ID NO: 405098 - RNA, 17 nt, Human
cugcugcucuuggagcc

SEQ ID NO: 405099 - RNA, 32 nt, Human
cugcugcugaaggugucugcacacaucaccga

SEQ ID NO: 405100 - RNA, 32 nt, Human
cugcugcugaccugaucaccucuggcuuuguc

SEQ ID NO: 405101 - RNA, 23 nt, Human
cugcugcugacucugugcagcug

SEQ ID NO: 405102 - RNA, 32 nt, Human
cugcugcugacucugugcagcugcgcaccugu

SEQ ID NO: 405103 - RNA, 23 nt, Human
cugcugcugcaccuccugggcca

SEQ ID NO: 405104 - RNA, 17 nt, Human
cugcugcugcaggagcc

SEQ ID NO: 405105 - RNA, 32 nt, Human
cugcugcugcaggagcccccaggcgagguucg

SEQ ID NO: 405106 - RNA, 17 nt, Human
cugcugcugcaugagcu

SEQ ID NO: 405107 - RNA, 17 nt, Human
cugcugcugcccaagcc

SEQ ID NO: 405108 - RNA, 18 nt, Human
cugcugcugcccugcgcu

SEQ ID NO: 405109 - RNA, 18 nt, Human
cugcugcugccuccagcu

SEQ ID NO: 405110 - RNA, 32 nt, Human
cugcugcugccuggauccugaugcugagacaa

SEQ ID NO: 405111 - RNA, 32 nt, Human
cugcugcugccuggccacugcucccuaagcca

SEQ ID NO: 405112 - RNA, 32 nt, Human
cugcugcugccuguagccagggugaccagugg

SEQ ID NO: 405113 - RNA, 18 nt, Human
cugcugcugcgggaguca

SEQ ID NO: 405114 - RNA, 17 nt, Human
cugcugcugcggggcca

SEQ ID NO: 405115 - RNA, 18 nt, Human
cugcugcugcucccggcc

SEQ ID NO: 405116 - RNA, 32 nt, Human
cugcugcugcucccuuccuucuucuguccugu

SEQ ID NO: 405117 - RNA, 32 nt, Human
cugcugcugcugcugccugcggcccggggcug

SEQ ID NO: 405118 - RNA, 32 nt, Human
cugcugcugcugcugcucagggcuucgugccc

SEQ ID NO: 405119 - RNA, 32 nt, Human
cugcugcugcugcugcucgucgcgccggggca

SEQ ID NO: 405120 - RNA, 32 nt, Human
cugcugcugcugcugcugcuaaucuucagggc

SEQ ID NO: 405121 - RNA, 32 nt, Human
cugcugcugcugcugcugcugcaaacuguacu

SEQ ID NO: 405122 - RNA, 32 nt, Human
cugcugcugcugguuuucauccaguugggaaa

SEQ ID NO: 405123 - RNA, 32 nt, Human
cugcugcugcuguauacacuugagugcuccca

SEQ ID NO: 405124 - RNA, 32 nt, Human
cugcugcugcuuccgguggccccuggggugga

SEQ ID NO: 405125 - RNA, 20 nt, Human
cugcugcugcuucugaggca

SEQ ID NO: 405126 - RNA, 19 nt, Human
cugcugcugcuuggaguua

SEQ ID NO: 405127 - RNA, 20 nt, Human
cugcugcuggccucuggguc

SEQ ID NO: 405128 - RNA, 16 nt, Human
cugcugcuggcgagcc

SEQ ID NO: 405129 - RNA, 23 nt, Human
cugcugcuggcggcacucgggcc

SEQ ID NO: 405130 - RNA, 19 nt, Human
cugcugcuggcuguggcua

SEQ ID NO: 405131 - RNA, 19 nt, Human
cugcugcuguccuguggcc

SEQ ID NO: 405132 - RNA, 19 nt, Human
cugcugcugugugaagcca

SEQ ID NO: 405133 - RNA, 22 nt, Human
cugcugcuuagaacuguggaca

SEQ ID NO: 405134 - RNA, 32 nt, Human
cugcugcuucagccuaccucucccucugcuga

SEQ ID NO: 405135 - RNA, 19 nt, Human
cugcugcuuccagggagcc

SEQ ID NO: 405136 - RNA, 19 nt, Human
cugcugcuucccuggcgcu

SEQ ID NO: 405137 - RNA, 18 nt, Human
cugcugcuuccugaagcc

SEQ ID NO: 405138 - RNA, 32 nt, Human
cugcugcuucuccaagcuuucagacaagaaug

SEQ ID NO: 405139 - RNA, 20 nt, Human
cugcugcuucugcccgagcc

SEQ ID NO: 405140 - RNA, 32 nt, Human
cugcugcuucugcugcuucuccagaaaauccc

SEQ ID NO: 405141 - RNA, 18 nt, Human
cugcugcuugcaucagcc

SEQ ID NO: 405142 - RNA, 19 nt, Human
cugcugcuugccagacaca

SEQ ID NO: 405143 - RNA, 19 nt, Human
cugcugcuugcugucgcca

SEQ ID NO: 405144 - RNA, 20 nt, Human
cugcugcuugcuucccgucc

SEQ ID NO: 405145 - RNA, 20 nt, Human
cugcugcuugcuucuaggca

SEQ ID NO: 405146 - RNA, 32 nt, Human
cugcugcuugguggugccagccccuuguccac

SEQ ID NO: 405147 - RNA, 19 nt, Human
cugcugcuuguccccagcc

SEQ ID NO: 405148 - RNA, 17 nt, Human
cugcugcuugucccgcc

SEQ ID NO: 405149 - RNA, 19 nt, Human
cugcugcuuguccuguuca

SEQ ID NO: 405150 - RNA, 32 nt, Human
cugcugcuugugguagaaauugcugccacagc

SEQ ID NO: 405151 - RNA, 20 nt, Human
cugcugcuuguucugauguu

SEQ ID NO: 405152 - RNA, 18 nt, Human
cugcugcuuucgcagcca

SEQ ID NO: 405153 - RNA, 17 nt, Human
cugcugcuuucugagcc

SEQ ID NO: 405154 - RNA, 19 nt, Human
cugcugcuuugcagaguca

SEQ ID NO: 405155 - RNA, 32 nt, Human
cugcugcuuuugcugcucaugcugcuuguugu

SEQ ID NO: 405156 - RNA, 32 nt, Human
cugcugcuuuuugccugugccugcugggaagu

SEQ ID NO: 405157 - RNA, 32 nt, Human
cugcuggaaaaauuaucuauuucuccauuacc

SEQ ID NO: 405158 - RNA, 32 nt, Human
cugcuggaaagccacacgcggcagaggagagc

SEQ ID NO: 405159 - RNA, 32 nt, Human
cugcuggaaaucucccccuuggcacagccaga

SEQ ID NO: 405160 - RNA, 22 nt, Human
cugcuggaacugcugggcgagg

SEQ ID NO: 405161 - RNA, 32 nt, Human
cugcuggaagacagugaggacuucaaucuuuc

SEQ ID NO: 405162 - RNA, 32 nt, Human
cugcuggaagagguggagaagcuguuagaaca

SEQ ID NO: 405163 - RNA, 32 nt, Human
cugcuggacaacaagcccgaccaccacuuccu

SEQ ID NO: 405164 - RNA, 32 nt, Human
cugcuggacaagggguaggagcugcuggaaca

SEQ ID NO: 405165 - RNA, 32 nt, Human
cugcuggaccacaugacaccagucccauucuu

SEQ ID NO: 405166 - RNA, 32 nt, Human
cugcuggacucacagccuugacuuuaauccuc

SEQ ID NO: 405167 - RNA, 32 nt, Human
cugcuggacuugaggcagagccugcagcagcu

SEQ ID NO: 405168 - RNA, 32 nt, Human
cugcuggagagggagaggcugcuggaagaggu

SEQ ID NO: 405169 - RNA, 32 nt, Human
cugcuggagagggagaggcugcuggacgaggu

SEQ ID NO: 405170 - RNA, 32 nt, Human
cugcuggagagggggccccgggcgcgaggcgg

SEQ ID NO: 405171 - RNA, 32 nt, Human
cugcuggagaugggguucuuaccaggaugggc

SEQ ID NO: 405172 - RNA, 32 nt, Human
cugcuggagccagcgaggggugccugcagccg

SEQ ID NO: 405173 - RNA, 32 nt, Human
cugcuggagccaggccuuccuccugggcgccu

SEQ ID NO: 405174 - RNA, 17 nt, Human
cugcuggagccccgagc

SEQ ID NO: 405175 - RNA, 32 nt, Human
cugcuggaggaugggacagcugugcugggucu

SEQ ID NO: 405176 - RNA, 32 nt, Human
cugcuggaggcccugguguugggaacagcugc

SEQ ID NO: 405177 - RNA, 32 nt, Human
cugcuggagggcccugaacccugcacugcgug

SEQ ID NO: 405178 - RNA, 32 nt, Human
cugcuggagguggagucaggugccucccagcc

SEQ ID NO: 405179 - RNA, 20 nt, Human
cugcuggagguggggcgagg

SEQ ID NO: 405180 - RNA, 32 nt, Human
cugcuggagugucugggauugguagcucucuc

SEQ ID NO: 405181 - RNA, 24 nt, Human
cugcuggauaaccagacugugaca

SEQ ID NO: 405182 - RNA, 32 nt, Human
cugcuggaugcagcagcggcugggcuuggucc

SEQ ID NO: 405183 - RNA, 22 nt, Human
cugcuggaugugcugugcaggu

SEQ ID NO: 405184 - RNA, 32 nt, Human
cugcuggcaaacccaguuccugccucagccag

SEQ ID NO: 405185 - RNA, 32 nt, Human
cugcuggcaauuuggggguggggagggggagg

SEQ ID NO: 405186 - RNA, 32 nt, Human
cugcuggcacuucuccccucccuggcccuucu

SEQ ID NO: 405187 - RNA, 32 nt, Human
cugcuggcagccccaagggaucugccauuugu

SEQ ID NO: 405188 - RNA, 32 nt, Human
cugcuggcagccuggggaaggagccaguuuuu

SEQ ID NO: 405189 - RNA, 32 nt, Human
cugcuggcaggaacugaccaguucuguccuug

SEQ ID NO: 405190 - RNA, 32 nt, Human
cugcuggcagggaaacugucuuccuuuucucc

SEQ ID NO: 405191 - RNA, 32 nt, Human
cugcuggcaucgccugcuuucucuccaguggc

SEQ ID NO: 405192 - RNA, 32 nt, Human
cugcuggcauguuguauucaagaguggcagaa

SEQ ID NO: 405193 - RNA, 32 nt, Human
cugcuggccaaccuggcucagggggacagccu

SEQ ID NO: 405194 - RNA, 32 nt, Human
cugcuggccacacugcacuagcaaguuugcca

SEQ ID NO: 405195 - RNA, 32 nt, Human
cugcuggccacugucgaugagaggcaggcucc

SEQ ID NO: 405196 - RNA, 19 nt, Human
cugcuggccaggcccgagg

SEQ ID NO: 405197 - RNA, 19 nt, Human
cugcuggccagugagaggc

SEQ ID NO: 405198 - RNA, 22 nt, Human
cugcuggcccaggucccugugc

SEQ ID NO: 405199 - RNA, 18 nt, Human
cugcuggccgcccugagc

SEQ ID NO: 405200 - RNA, 32 nt, Human
cugcuggccggagcuguagcugugcugguggc

SEQ ID NO: 405201 - RNA, 32 nt, Human
cugcuggccuagaagcagagugcacccucgug

SEQ ID NO: 405202 - RNA, 22 nt, Human
cugcuggccucagcuccggguu

SEQ ID NO: 405203 - RNA, 32 nt, Human
cugcuggccucggugggcucugacugcggggc

SEQ ID NO: 405204 - RNA, 32 nt, Human
cugcuggccuggagaccagggugccugcgggc

SEQ ID NO: 405205 - RNA, 23 nt, Human
cugcuggccuugcugcagaagug

SEQ ID NO: 405206 - RNA, 31 nt, Human
cugcuggcgagggagagaugggugggccaug

SEQ ID NO: 405207 - RNA, 32 nt, Human
cugcuggcggauagcaagacucuguggaguuu

SEQ ID NO: 405208 - RNA, 32 nt, Human
cugcuggcucaaagcugggacuacaugaaagu

SEQ ID NO: 405209 - RNA, 32 nt, Human
cugcuggcucaggggcaucccaccuccgggcu

SEQ ID NO: 405210 - RNA, 21 nt, Human
cugcuggcucuccugugguca

SEQ ID NO: 405211 - RNA, 20 nt, Human
cugcuggcucuucugcccaa

SEQ ID NO: 405212 - RNA, 32 nt, Human
cugcuggcucuucuucugaaucuuauguucau

SEQ ID NO: 405213 - RNA, 32 nt, Human
cugcuggcucuuuccugccacugccaacacga

SEQ ID NO: 405214 - RNA, 32 nt, Human
cugcuggcugagaaggagguguguggcuccgg

SEQ ID NO: 405215 - RNA, 32 nt, Human
cugcuggcugccucucugcuccaccuugugac

SEQ ID NO: 405216 - RNA, 32 nt, Human
cugcuggcuggaggggaugcagggguagugua

SEQ ID NO: 405217 - RNA, 32 nt, Human
cugcuggcuggcagaggagaaggcagucguuu

SEQ ID NO: 405218 - RNA, 32 nt, Human
cugcuggcuggcgugcgugaacagguguggac

SEQ ID NO: 405219 - RNA, 24 nt, Human
cugcuggcuguguccaugcaggug

SEQ ID NO: 405220 - RNA, 32 nt, Human
cugcuggcuuggccucaaggugccuccacccc

SEQ ID NO: 405221 - RNA, 32 nt, Human
cugcugggaaacagcaaucuuccuuaauagca

SEQ ID NO: 405222 - RNA, 32 nt, Human
cugcugggaagggaagggaauggggagaaggg

SEQ ID NO: 405223 - RNA, 32 nt, Human
cugcugggacuccggcccugcguccgcucagc

SEQ ID NO: 405224 - RNA, 32 nt, Human
cugcugggagagauggagaagcuagaaggcaa

SEQ ID NO: 405225 - RNA, 32 nt, Human
cugcugggaguuuucugccacacagauuugcg

SEQ ID NO: 405226 - RNA, 32 nt, Human
cugcugggcaagugccgccagggccgggaccc

SEQ ID NO: 405227 - RNA, 24 nt, Human
cugcugggcaggccccgucuccag

SEQ ID NO: 405228 - RNA, 18 nt, Human
cugcugggccccgagcca

SEQ ID NO: 405229 - RNA, 20 nt, Human
cugcugggccccuccuccau

SEQ ID NO: 405230 - RNA, 17 nt, Human
cugcugggcccugagcu

SEQ ID NO: 405231 - RNA, 32 nt, Human
cugcugggccggaaggugguggucguacgcug

SEQ ID NO: 405232 - RNA, 32 nt, Human
cugcugggccuuggaagagagaggguccuggc

SEQ ID NO: 405233 - RNA, 32 nt, Human
cugcugggcgagcagggcaggugcaggccgcc

SEQ ID NO: 405234 - RNA, 32 nt, Human
cugcugggcucaagcaauccaccuggcugggc

SEQ ID NO: 405235 - RNA, 32 nt, Human
cugcugggcuccaagcccugggccaggcugcc

SEQ ID NO: 405236 - RNA, 32 nt, Human
cugcuggggaaagggagagggcccuauaagcc

SEQ ID NO: 405237 - RNA, 32 nt, Human
cugcuggggaagcccuguguucccagggcuuu

SEQ ID NO: 405238 - RNA, 32 nt, Human
cugcuggggaggcagagacccugcaauggcca

SEQ ID NO: 405239 - RNA, 32 nt, Human
cugcuggggaggcugaaguaggaggaucauuu

SEQ ID NO: 405240 - RNA, 32 nt, Human
cugcuggggaggcugaggcaggagaauggcug

SEQ ID NO: 405241 - RNA, 32 nt, Human
cugcuggggagguggagacgggugccgggaga

SEQ ID NO: 405242 - RNA, 32 nt, Human
cugcuggggauggugccagcugugccuuggcu

SEQ ID NO: 405243 - RNA, 32 nt, Human
cugcuggggccccacaggugaggcagaacagc

SEQ ID NO: 405244 - RNA, 32 nt, Human
cugcuggggcccugcuuguuggccugaccccu

SEQ ID NO: 405245 - RNA, 32 nt, Human
cugcuggggccuccacaccugccucaucacgg

SEQ ID NO: 405246 - RNA, 32 nt, Human
cugcugggggaugucugacuagcucucaugga

SEQ ID NO: 405247 - RNA, 32 nt, Human
cugcugggguaccuggaugagcacacagaaga

SEQ ID NO: 405248 - RNA, 32 nt, Human
cugcuggguagagaacacagaggacagggcau

SEQ ID NO: 405249 - RNA, 32 nt, Human
cugcugggucaccaggagaauggacccuuccu

SEQ ID NO: 405250 - RNA, 32 nt, Human
cugcugggucaccaggagaauggacgcuuccu

SEQ ID NO: 405251 - RNA, 32 nt, Human
cugcuggguccuggggagaugcaggcucuguu

SEQ ID NO: 405252 - RNA, 32 nt, Human
cugcugggugaggggcacccagcuccagaggc

SEQ ID NO: 405253 - RNA, 32 nt, Human
cugcuggguggugcuuucucuugcacaccacu

SEQ ID NO: 405254 - RNA, 32 nt, Human
cugcuggguuagcuuuccacagacauaaauau

SEQ ID NO: 405255 - RNA, 32 nt, Human
cugcuggguuuccugacuguagccacaucucu

SEQ ID NO: 405256 - RNA, 32 nt, Human
cugcuggguuuugccagaaugaagacaccgug

SEQ ID NO: 405257 - RNA, 32 nt, Human
cugcugguauuagcucugccuccuuuuggguc

SEQ ID NO: 405258 - RNA, 32 nt, Human
cugcuggucacuggucuuggucuggaguuaua

SEQ ID NO: 405259 - RNA, 32 nt, Human
cugcuggucccaggucggcacacacauccuca

SEQ ID NO: 405260 - RNA, 19 nt, Human
cugcugguccugugucaca

SEQ ID NO: 405261 - RNA, 32 nt, Human
cugcugguccuugcaggcaaagcuacagccag

SEQ ID NO: 405262 - RNA, 32 nt, Human
cugcuggucucgaacuccuuaccucaggugau

SEQ ID NO: 405263 - RNA, 32 nt, Human
cugcuggucucugccaucaucaccgucagccu

SEQ ID NO: 405264 - RNA, 32 nt, Human
cugcuggucucuucucuccucuuccauaagaa

SEQ ID NO: 405265 - RNA, 20 nt, Human
cugcuggucuuucugaguca

SEQ ID NO: 405266 - RNA, 21 nt, Human
cugcuggugaacuccaucuca

SEQ ID NO: 405267 - RNA, 32 nt, Human
cugcuggugcaguccagccuaguacugacacc

SEQ ID NO: 405268 - RNA, 32 nt, Human
cugcuggugcugcugcucgucauccuggccag

SEQ ID NO: 405269 - RNA, 32 nt, Human
cugcuggugcugcugcugcugcugcugcccac

SEQ ID NO: 405270 - RNA, 32 nt, Human
cugcugguggccacaugggugcugguggcagg

SEQ ID NO: 405271 - RNA, 32 nt, Human
cugcuggugggagcaggaaggagcagugcccc

SEQ ID NO: 405272 - RNA, 32 nt, Human
cugcugguguccuccaggccugggugggcggg

SEQ ID NO: 405273 - RNA, 32 nt, Human
cugcugguguguggggucaguuccagcagaug

SEQ ID NO: 405274 - RNA, 32 nt, Human
cugcugguuccaggaccucgcuuuccaucugu

SEQ ID NO: 405275 - RNA, 17 nt, Human
cugcugguuccccgagc

SEQ ID NO: 405276 - RNA, 21 nt, Human
cugcugguugcugagcaagug

SEQ ID NO: 405277 - RNA, 23 nt, Human
cugcugguugcugagcaagugua

SEQ ID NO: 405278 - RNA, 32 nt, Human
cugcugguuguagguccuuggcuggucgggcc

SEQ ID NO: 405279 - RNA, 32 nt, Human
cugcugguuucugugcgggcucuugucaggau

SEQ ID NO: 405280 - RNA, 20 nt, Human
cugcuguacaagcccagcaa

SEQ ID NO: 405281 - RNA, 32 nt, Human
cugcuguacaucuuauuuauuuucuccagagg

SEQ ID NO: 405282 - RNA, 23 nt, Human
cugcuguaguccuuucugccuug

SEQ ID NO: 405283 - RNA, 32 nt, Human
cugcuguauaaauaacaacuugaacaugaaau

SEQ ID NO: 405284 - RNA, 32 nt, Human
cugcugucacagucucauuuguucuuccaacu

SEQ ID NO: 405285 - RNA, 31 nt, Human
cugcugucacucaaugauggggagcccuacc

SEQ ID NO: 405286 - RNA, 32 nt, Human
cugcugucacugagcgggacucaggccaagag

SEQ ID NO: 405287 - RNA, 32 nt, Human
cugcugucacugucucucuccugcugccuugu

SEQ ID NO: 405288 - RNA, 32 nt, Human
cugcugucagaagucucugggcuccaacuggu

SEQ ID NO: 405289 - RNA, 32 nt, Human
cugcugucagaccuucuuccacagcaaaugag

SEQ ID NO: 405290 - RNA, 32 nt, Human
cugcugucagugcuuuccagucucagcauggu

SEQ ID NO: 405291 - RNA, 32 nt, Human
cugcugucauugucacaggaugccauucucca

SEQ ID NO: 405292 - RNA, 24 nt, Human
cugcugucauuucuccacuugcca

SEQ ID NO: 405293 - RNA, 32 nt, Human
cugcugucauuucuuggggccucucaagaggc

SEQ ID NO: 405294 - RNA, 23 nt, Human
cugcuguccaacauccagcgcug

SEQ ID NO: 405295 - RNA, 32 nt, Human
cugcuguccacagauaaaccagugccauuaga

SEQ ID NO: 405296 - RNA, 23 nt, Human
cugcuguccaccaggcagcugug

SEQ ID NO: 405297 - RNA, 32 nt, Human
cugcuguccagcuucccaggugcaguggguug

SEQ ID NO: 405298 - RNA, 18 nt, Human
cugcuguccaguccccag

SEQ ID NO: 405299 - RNA, 23 nt, Human
cugcuguccaucaaggcccugug

SEQ ID NO: 405300 - RNA, 19 nt, Human
cugcuguccccacugcuca

SEQ ID NO: 405301 - RNA, 32 nt, Human
cugcugucccuuguacaguuuucugucacugg

SEQ ID NO: 405302 - RNA, 20 nt, Human
cugcuguccuaugugcaggu

SEQ ID NO: 405303 - RNA, 32 nt, Human
cugcuguccucagaggaggaggaggaggaggc

SEQ ID NO: 405304 - RNA, 32 nt, Human
cugcuguccuccuugccuucucccucuucucu

SEQ ID NO: 405305 - RNA, 32 nt, Human
cugcuguccugggaugccucuccagccacugg

SEQ ID NO: 405306 - RNA, 21 nt, Human
cugcuguccuguccccgagcc

SEQ ID NO: 405307 - RNA, 32 nt, Human
cugcugucucagagccaucuggaugagugucc

SEQ ID NO: 405308 - RNA, 22 nt, Human
cugcugucucaugucuugguca

SEQ ID NO: 405309 - RNA, 32 nt, Human
cugcugucucccaugauggugugguacagcga

SEQ ID NO: 405310 - RNA, 32 nt, Human
cugcugucucuccgcuccgccaccccgaaccc

SEQ ID NO: 405311 - RNA, 18 nt, Human
cugcugucucuuggggcu

SEQ ID NO: 405312 - RNA, 32 nt, Human
cugcugugaaaagugaagguugcccuguggag

SEQ ID NO: 405313 - RNA, 32 nt, Human
cugcugugaacugcuuucccucggaauguuuc

SEQ ID NO: 405314 - RNA, 32 nt, Human
cugcugugaagacccaauuaaagcuuucacau

SEQ ID NO: 405315 - RNA, 32 nt, Human
cugcugugaaguuaacauugccaggacgauuc

SEQ ID NO: 405316 - RNA, 32 nt, Human
cugcugugaauaaacacagaaguggagcuggg

SEQ ID NO: 405317 - RNA, 32 nt, Human
cugcugugaccaccccagcugcagagucagug

SEQ ID NO: 405318 - RNA, 31 nt, Human
cugcugugaccccagcaccuuccucaggaug

SEQ ID NO: 405319 - RNA, 32 nt, Human
cugcugugaccuucauucauucccaggagaag

SEQ ID NO: 405320 - RNA, 32 nt, Human
cugcugugacgcuucucggugcggaugcagug

SEQ ID NO: 405321 - RNA, 31 nt, Human
cugcugugacuuccuccugccaggggauuug

SEQ ID NO: 405322 - RNA, 32 nt, Human
cugcugugagcagaugcuuccacccccgagau

SEQ ID NO: 405323 - RNA, 32 nt, Human
cugcugugagccaccugccuguggagugcuga

SEQ ID NO: 405324 - RNA, 32 nt, Human
cugcugugagccuggcaucgccaugggcacug

SEQ ID NO: 405325 - RNA, 32 nt, Human
cugcugugagcucuggccgcugccuuccaggg

SEQ ID NO: 405326 - RNA, 32 nt, Human
cugcugugaucacucuggaggcuggucagucu

SEQ ID NO: 405327 - RNA, 32 nt, Human
cugcugugcaccugacggcuccugcaggugug

SEQ ID NO: 405328 - RNA, 32 nt, Human
cugcugugcacugcagccguucccaggcagug

SEQ ID NO: 405329 - RNA, 32 nt, Human
cugcugugcagaggagggauacacuuaggggc

SEQ ID NO: 405330 - RNA, 32 nt, Human
cugcugugcccagccuccauguuuuaauauca

SEQ ID NO: 405331 - RNA, 32 nt, Human
cugcugugcccaggacguggguucagcguggg

SEQ ID NO: 405332 - RNA, 18 nt, Human
cugcugugcccccgagcu

SEQ ID NO: 405333 - RNA, 18 nt, Human
cugcugugcccucgggcu

SEQ ID NO: 405334 - RNA, 32 nt, Human
cugcugugccuucaguacccagccagguucuc

SEQ ID NO: 405335 - RNA, 32 nt, Human
cugcugugccuuucuggcaggguuuugugggg

SEQ ID NO: 405336 - RNA, 32 nt, Human
cugcugugcguucugagggagggagaccucgg

SEQ ID NO: 405337 - RNA, 30 nt, Human
cugcugugcuagcaaucagcgagacuccau

SEQ ID NO: 405338 - RNA, 30 nt, Human
cugcugugcuagcaaucagcgagacuccgu

SEQ ID NO: 405339 - RNA, 30 nt, Human
cugcugugcuagcaaucagugagacuccgu

SEQ ID NO: 405340 - RNA, 32 nt, Human
cugcugugcuccuguggcagugauggggccug

SEQ ID NO: 405341 - RNA, 32 nt, Human
cugcugugcucucccuucucgccaucauacug

SEQ ID NO: 405342 - RNA, 32 nt, Human
cugcugugcucuggaaaguaacugcagccacc

SEQ ID NO: 405343 - RNA, 32 nt, Human
cugcugugcugagacuguggccuggucuuggu

SEQ ID NO: 405344 - RNA, 32 nt, Human
cugcugugcuuccagagguggcgugaugccuc

SEQ ID NO: 405345 - RNA, 32 nt, Human
cugcuguggagcuaggugcuucccccuucccc

SEQ ID NO: 405346 - RNA, 32 nt, Human
cugcuguggcaaagauggccacgcugguguuu

SEQ ID NO: 405347 - RNA, 32 nt, Human
cugcuguggccacccagugcucugccuaccug

SEQ ID NO: 405348 - RNA, 32 nt, Human
cugcuguggccccaacccuuccucccucccca

SEQ ID NO: 405349 - RNA, 32 nt, Human
cugcuguggccuccagcuuggcugguuuugca

SEQ ID NO: 405350 - RNA, 32 nt, Human
cugcuguggcugcucagcugccuccuuuuacc

SEQ ID NO: 405351 - RNA, 32 nt, Human
cugcugugggcccaggacaggaggcugagaag

SEQ ID NO: 405352 - RNA, 32 nt, Human
cugcugugggcccucuggaauugugcuccuca

SEQ ID NO: 405353 - RNA, 32 nt, Human
cugcugugggccugaugcugccauggucccug

SEQ ID NO: 405354 - RNA, 24 nt, Human
cugcuguggggucugcccuggcca

SEQ ID NO: 405355 - RNA, 32 nt, Human
cugcuguggugaggauucagcaagauaaucca

SEQ ID NO: 405356 - RNA, 32 nt, Human
cugcuguguccucagcuggguggagaagaggc

SEQ ID NO: 405357 - RNA, 32 nt, Human
cugcugugucgcccaacacuucccagggugcu

SEQ ID NO: 405358 - RNA, 22 nt, Human
cugcugugucugcccuggggca

SEQ ID NO: 405359 - RNA, 29 nt, Human
cugcugugucuguguguugugggggaagg

SEQ ID NO: 405360 - RNA, 32 nt, Human
cugcugugugccaggcuuugugcugagugcug

SEQ ID NO: 405361 - RNA, 20 nt, Human
cugcuguuaaaguugcaggu

SEQ ID NO: 405362 - RNA, 26 nt, Human
cugcuguuaaccaugcugugcaugug

SEQ ID NO: 405363 - RNA, 19 nt, Human
cugcuguuaacccgugagg

SEQ ID NO: 405364 - RNA, 21 nt, Human
cugcuguuacugcuuugauca

SEQ ID NO: 405365 - RNA, 32 nt, Human
cugcuguuacuuuucugcuaccacuauuuuug

SEQ ID NO: 405366 - RNA, 20 nt, Human
cugcuguuaucguuuagcca

SEQ ID NO: 405367 - RNA, 19 nt, Human
cugcuguuaugcagagcca

SEQ ID NO: 405368 - RNA, 32 nt, Human
cugcuguucaaucaagagucuugguagauaag

SEQ ID NO: 405369 - RNA, 32 nt, Human
cugcuguucaccauucauuccagaccugggcc

SEQ ID NO: 405370 - RNA, 20 nt, Human
cugcuguucagcaacagcca

SEQ ID NO: 405371 - RNA, 17 nt, Human
cugcuguucaggagcca

SEQ ID NO: 405372 - RNA, 24 nt, Human
cugcuguuccagccucugcaggug

SEQ ID NO: 405373 - RNA, 21 nt, Human
cugcuguuccaguucugguca

SEQ ID NO: 405374 - RNA, 21 nt, Human
cugcuguucccaggccaccug

SEQ ID NO: 405375 - RNA, 17 nt, Human
cugcuguuccgugagcc

SEQ ID NO: 405376 - RNA, 20 nt, Human
cugcuguucgcuucgucagc

SEQ ID NO: 405377 - RNA, 32 nt, Human
cugcuguucuccacuucucaccugccauccac

SEQ ID NO: 405378 - RNA, 22 nt, Human
cugcuguucuucccccugggcc

SEQ ID NO: 405379 - RNA, 32 nt, Human
cugcuguugauagcaggaaaccaccugcuggg

SEQ ID NO: 405380 - RNA, 32 nt, Human
cugcuguugcccagcuggacagcuagaguuau

SEQ ID NO: 405381 - RNA, 20 nt, Human
cugcuguugcccguucuucc

SEQ ID NO: 405382 - RNA, 32 nt, Human
cugcuguugccucccuucucaggcuggugcug

SEQ ID NO: 405383 - RNA, 32 nt, Human
cugcuguugcuacccaaauuuucauuucucca

SEQ ID NO: 405384 - RNA, 32 nt, Human
cugcuguugcugccaccuaccuucccugcuuu

SEQ ID NO: 405385 - RNA, 20 nt, Human
cugcuguugcuucugggcca

SEQ ID NO: 405386 - RNA, 19 nt, Human
cugcuguuggcaugagcca

SEQ ID NO: 405387 - RNA, 19 nt, Human
cugcuguuggccgaggcca

SEQ ID NO: 405388 - RNA, 20 nt, Human
cugcuguuggcugcaccagg

SEQ ID NO: 405389 - RNA, 32 nt, Human
cugcuguuggcugcgccagggugcggcucccu

SEQ ID NO: 405390 - RNA, 19 nt, Human
cugcuguuuccauggguua

SEQ ID NO: 405391 - RNA, 32 nt, Human
cugcuguuucugcugggacgucugacuccagu

SEQ ID NO: 405392 - RNA, 20 nt, Human
cugcuguuugccacccagcc

SEQ ID NO: 405393 - RNA, 20 nt, Human
cugcuguuugccccucaguc

SEQ ID NO: 405394 - RNA, 19 nt, Human
cugcuguuugcucugaucc

SEQ ID NO: 405395 - RNA, 32 nt, Human
cugcuguuugguucuucuccauccucaauuuu

SEQ ID NO: 405396 - RNA, 19 nt, Human
cugcuguuugguuuggcca

SEQ ID NO: 405397 - RNA, 21 nt, Human
cugcuguuuguucugcaagug

SEQ ID NO: 405398 - RNA, 32 nt, Human
cugcuguuuugguuguugcugcuggaaagcaa

SEQ ID NO: 405399 - RNA, 32 nt, Human
cugcuuaaaaauacugaauuuaccuucacaaa

SEQ ID NO: 405400 - RNA, 32 nt, Human
cugcuuaaacucaagauggaaaguccagucca

SEQ ID NO: 405401 - RNA, 32 nt, Human
cugcuuaaagaaugcccuuuaugaugcacuga

SEQ ID NO: 405402 - RNA, 24 nt, Human
cugcuuaaagugaggaguucaaga

SEQ ID NO: 405403 - RNA, 32 nt, Human
cugcuuaaccuuucagcuucuccaggccccca

SEQ ID NO: 405404 - RNA, 24 nt, Human
cugcuuaagcucaggaguuugaga

SEQ ID NO: 405405 - RNA, 21 nt, Human
cugcuuaagcuggcccacaaa

SEQ ID NO: 405406 - RNA, 32 nt, Human
cugcuuacacuuucucuccaucaccaaauccu

SEQ ID NO: 405407 - RNA, 32 nt, Human
cugcuuacauauaguguguauguauguauaua

SEQ ID NO: 405408 - RNA, 32 nt, Human
cugcuuaccagccuggcuggccgugcucuggg

SEQ ID NO: 405409 - RNA, 32 nt, Human
cugcuuacccggccuggcugcugacaggcguu

SEQ ID NO: 405410 - RNA, 32 nt, Human
cugcuuacgcccagauuuucuucaaucacauc

SEQ ID NO: 405411 - RNA, 21 nt, Human
cugcuuacucugcccugggcc

SEQ ID NO: 405412 - RNA, 32 nt, Human
cugcuuacuguccugccuucuaaccacccuuu

SEQ ID NO: 405413 - RNA, 32 nt, Human
cugcuuagagcccuuaaaaagacuugaaaguu

SEQ ID NO: 405414 - RNA, 20 nt, Human
cugcuuagcccggcgggcgc

SEQ ID NO: 405415 - RNA, 21 nt, Human
cugcuuagcugccuugagcua

SEQ ID NO: 405416 - RNA, 32 nt, Human
cugcuuaggcuguacugcaguggcgcgauccc

SEQ ID NO: 405417 - RNA, 24 nt, Human
cugcuuaggugcacagcuguucaa

SEQ ID NO: 405418 - RNA, 32 nt, Human
cugcuuauauuuggccacuaaguggccuccua

SEQ ID NO: 405419 - RNA, 32 nt, Human
cugcuuauggccugggugucauggcacagcuu

SEQ ID NO: 405420 - RNA, 32 nt, Human
cugcuuauuaagaugauucauuucauuuccac

SEQ ID NO: 405421 - RNA, 32 nt, Human
cugcuuauuggauccugacaucaggaauagcu

SEQ ID NO: 405422 - RNA, 32 nt, Human
cugcuuauuuauacuagcguaggcaacacuug

SEQ ID NO: 405423 - RNA, 32 nt, Human
cugcuucaagcuauucucccaccucauccucc

SEQ ID NO: 405424 - RNA, 32 nt, Human
cugcuucaauauguuauucaauguuaauguuu

SEQ ID NO: 405425 - RNA, 32 nt, Human
cugcuucacccccaacuuggcuggagaagaaa

SEQ ID NO: 405426 - RNA, 22 nt, Human
cugcuucacccucccucucagg

SEQ ID NO: 405427 - RNA, 32 nt, Human
cugcuucagauggaaaagggaggcaggguggg

SEQ ID NO: 405428 - RNA, 32 nt, Human
cugcuucagauuuugcuuuuguucguuuugcc

SEQ ID NO: 405429 - RNA, 22 nt, Human
cugcuucagccuuucccugugc

SEQ ID NO: 405430 - RNA, 32 nt, Human
cugcuucagcugcgagccugacagacauggga

SEQ ID NO: 405431 - RNA, 21 nt, Human
cugcuucaggcccccgccuug

SEQ ID NO: 405432 - RNA, 20 nt, Human
cugcuucaggcugcugagca

SEQ ID NO: 405433 - RNA, 32 nt, Human
cugcuucauaucucucccuucuuuaccuucau

SEQ ID NO: 405434 - RNA, 32 nt, Human
cugcuucauccagacagcccagggugacuuug

SEQ ID NO: 405435 - RNA, 32 nt, Human
cugcuucauccaggaggggccucaggaagagg

SEQ ID NO: 405436 - RNA, 32 nt, Human
cugcuucaucccucucaaguauggcucagcua

SEQ ID NO: 405437 - RNA, 20 nt, Human
cugcuucauccucagcagca

SEQ ID NO: 405438 - RNA, 32 nt, Human
cugcuucaugccaaggcugggcuuuggguccc

SEQ ID NO: 405439 - RNA, 32 nt, Human
cugcuuccaaagugcccgccgugagugagcuc

SEQ ID NO: 405440 - RNA, 32 nt, Human
cugcuuccaauuuucuggaauacaugaaauau

SEQ ID NO: 405441 - RNA, 32 nt, Human
cugcuuccaccaggguggaggcuucuaggucu

SEQ ID NO: 405442 - RNA, 20 nt, Human
cugcuuccacguggcugcca

SEQ ID NO: 405443 - RNA, 24 nt, Human
cugcuuccagcccuuccccccgca

SEQ ID NO: 405444 - RNA, 32 nt, Human
cugcuuccagccucuggugccaacacaguugc

SEQ ID NO: 405445 - RNA, 32 nt, Human
cugcuuccagugggccugggcccaggacugga

SEQ ID NO: 405446 - RNA, 28 nt, Human
cugcuuccauguggcuuuuccuuuugua

SEQ ID NO: 405447 - RNA, 32 nt, Human
cugcuuccauuucuccccaccucacucucacc

SEQ ID NO: 405448 - RNA, 32 nt, Human
cugcuucccacugugcacccgcccagagaagc

SEQ ID NO: 405449 - RNA, 32 nt, Human
cugcuucccagaggagcagcucuccccaggca

SEQ ID NO: 405450 - RNA, 32 nt, Human
cugcuucccagccagaaacagcagggagcugc

SEQ ID NO: 405451 - RNA, 32 nt, Human
cugcuuccccuagggugauauuuccuuccucc

SEQ ID NO: 405452 - RNA, 32 nt, Human
cugcuuccccuucaccauuccccacauucugc

SEQ ID NO: 405453 - RNA, 32 nt, Human
cugcuucccucaucacaccacacucacaugca

SEQ ID NO: 405454 - RNA, 32 nt, Human
cugcuucccuggaagcuucaggaagcucagcc

SEQ ID NO: 405455 - RNA, 18 nt, Human
cugcuucccuucagucuc

SEQ ID NO: 405456 - RNA, 32 nt, Human
cugcuuccucaagcucuucugcuagugcccug

SEQ ID NO: 405457 - RNA, 32 nt, Human
cugcuuccugcugccgcucugcagccuggacc

SEQ ID NO: 405458 - RNA, 32 nt, Human
cugcuuccuggaaauuggagcacacagucagg

SEQ ID NO: 405459 - RNA, 32 nt, Human
cugcuuccuggaccagaugcaagacugucucc

SEQ ID NO: 405460 - RNA, 32 nt, Human
cugcuuccugggcauagccauggaacccugcc

SEQ ID NO: 405461 - RNA, 32 nt, Human
cugcuuccuuagucggaaguguuuucaacuaa

SEQ ID NO: 405462 - RNA, 18 nt, Human
cugcuuccuucagcauca

SEQ ID NO: 405463 - RNA, 32 nt, Human
cugcuuccuuucucucuccugccucuccucug

SEQ ID NO: 405464 - RNA, 21 nt, Human
cugcuucgcaggcuccgagcc

SEQ ID NO: 405465 - RNA, 32 nt, Human
cugcuucgcaguaaaguuuccagccugggccc

SEQ ID NO: 405466 - RNA, 32 nt, Human
cugcuucuaagaucagugcuugagacauguug

SEQ ID NO: 405467 - RNA, 32 nt, Human
cugcuucuacccacuuuuauuuuucccaggag

SEQ ID NO: 405468 - RNA, 32 nt, Human
cugcuucuacuccuucuuccugggcaaggaac

SEQ ID NO: 405469 - RNA, 32 nt, Human
cugcuucuagucaaagcuuucucucuagugau

SEQ ID NO: 405470 - RNA, 32 nt, Human
cugcuucucaacaaccucuuuggacucagugc

SEQ ID NO: 405471 - RNA, 20 nt, Human
cugcuucucagccccgggcc

SEQ ID NO: 405472 - RNA, 32 nt, Human
cugcuucucagucaugaacguggccauggccc

SEQ ID NO: 405473 - RNA, 32 nt, Human
cugcuucuccaucuccacuguggacucucagc

SEQ ID NO: 405474 - RNA, 18 nt, Human
cugcuucuccccugggcu

SEQ ID NO: 405475 - RNA, 32 nt, Human
cugcuucuccccugggcugcugugggcugggu

SEQ ID NO: 405476 - RNA, 19 nt, Human
cugcuucuccucugcuugu

SEQ ID NO: 405477 - RNA, 32 nt, Human
cugcuucugccaggaccacaccgagggugccc

SEQ ID NO: 405478 - RNA, 21 nt, Human
cugcuucugcgccagaguguu

SEQ ID NO: 405479 - RNA, 32 nt, Human
cugcuucugcuccagccccuuugccucugucc

SEQ ID NO: 405480 - RNA, 32 nt, Human
cugcuucuggaaaccucugccugcugcccugg

SEQ ID NO: 405481 - RNA, 32 nt, Human
cugcuucuggagaggccccaggaagcuuccaa

SEQ ID NO: 405482 - RNA, 32 nt, Human
cugcuucuggcugaguguguuuccugucacca

SEQ ID NO: 405483 - RNA, 32 nt, Human
cugcuucugggagaccucggggaguuuuugcu

SEQ ID NO: 405484 - RNA, 32 nt, Human
cugcuucuggugaggccucaggaagcuuccac

SEQ ID NO: 405485 - RNA, 32 nt, Human
cugcuucugguuuuuaguuugccuuugaauuu

SEQ ID NO: 405486 - RNA, 32 nt, Human
cugcuucuguaauccuagcuaguugggaggcu

SEQ ID NO: 405487 - RNA, 32 nt, Human
cugcuucuguggaagugagcaugguugggcag

SEQ ID NO: 405488 - RNA, 32 nt, Human
cugcuucuuccaccaucccuucgacuuaguuu

SEQ ID NO: 405489 - RNA, 32 nt, Human
cugcuucuuccucucucugccuaaggguggug

SEQ ID NO: 405490 - RNA, 32 nt, Human
cugcuucuuccugggcugucauccccucaucc

SEQ ID NO: 405491 - RNA, 32 nt, Human
cugcuucuucuccagcuuggaaaaacaauagg

SEQ ID NO: 405492 - RNA, 32 nt, Human
cugcuucuuuauagucccuucccuuuuuauua

SEQ ID NO: 405493 - RNA, 24 nt, Human
cugcuugaaaccaggaguuugaga

SEQ ID NO: 405494 - RNA, 24 nt, Human
cugcuugaacccaggaggaggagg

SEQ ID NO: 405495 - RNA, 24 nt, Human
cugcuugaacccaggaggcagagg

SEQ ID NO: 405496 - RNA, 32 nt, Human
cugcuugaacccaggaggcagagguugcagug

SEQ ID NO: 405497 - RNA, 24 nt, Human
cugcuugaacccaggagguggagg

SEQ ID NO: 405498 - RNA, 24 nt, Human
cugcuugaacccaggaguucaaga

SEQ ID NO: 405499 - RNA, 24 nt, Human
cugcuugaacucaggaguucaaga

SEQ ID NO: 405500 - RNA, 24 nt, Human
cugcuugaagccagaaguucaaga

SEQ ID NO: 405501 - RNA, 32 nt, Human
cugcuugacaacaucugagugcagccguuuga

SEQ ID NO: 405502 - RNA, 20 nt, Human
cugcuugaccacuggcccag

SEQ ID NO: 405503 - RNA, 32 nt, Human
cugcuugagagggaagaagggguguuuagcau

SEQ ID NO: 405504 - RNA, 24 nt, Human
cugcuugagcccaggaggucaagg

SEQ ID NO: 405505 - RNA, 24 nt, Human
cugcuugagcccaggagguggagg

SEQ ID NO: 405506 - RNA, 24 nt, Human
cugcuugagcccaggaguucaaga

SEQ ID NO: 405507 - RNA, 32 nt, Human
cugcuugagcccaggaguucaagaccagccug

SEQ ID NO: 405508 - RNA, 24 nt, Human
cugcuugagcccaggaguucaggg

SEQ ID NO: 405509 - RNA, 24 nt, Human
cugcuugagcccaggaguuugaga

SEQ ID NO: 405510 - RNA, 32 nt, Human
cugcuugagcucaggagguugaggcugcagag

SEQ ID NO: 405511 - RNA, 20 nt, Human
cugcuugagcucaggaguuc

SEQ ID NO: 405512 - RNA, 24 nt, Human
cugcuugagcucaggaguucgaga

SEQ ID NO: 405513 - RNA, 24 nt, Human
cugcuugaggccaggaguuugaga

SEQ ID NO: 405514 - RNA, 24 nt, Human
cugcuugaggccgggaguuggaga

SEQ ID NO: 405515 - RNA, 32 nt, Human
cugcuugagggagggaauagaaaggggcaggg

SEQ ID NO: 405516 - RNA, 32 nt, Human
cugcuugagggcugauagcucugccuuacccu

SEQ ID NO: 405517 - RNA, 24 nt, Human
cugcuugaguccaggaauuugaga

SEQ ID NO: 405518 - RNA, 32 nt, Human
cugcuugauccucagauguggagggagguagg

SEQ ID NO: 405519 - RNA, 20 nt, Human
cugcuugauugcccuggcca

SEQ ID NO: 405520 - RNA, 32 nt, Human
cugcuugcagucuccaauguaggcaguguaaa

SEQ ID NO: 405521 - RNA, 18 nt, Human
cugcuugcagucugcaag

SEQ ID NO: 405522 - RNA, 32 nt, Human
cugcuugcauucauccccuccuccucaucucu

SEQ ID NO: 405523 - RNA, 32 nt, Human
cugcuugccauccugccagaacaggcccucaa

SEQ ID NO: 405524 - RNA, 32 nt, Human
cugcuugccugauguguguaucaucgguggga

SEQ ID NO: 405525 - RNA, 32 nt, Human
cugcuugccugggaggcuacacuuuccuuucc

SEQ ID NO: 405526 - RNA, 21 nt, Human
cugcuugcuagagaacuguga

SEQ ID NO: 405527 - RNA, 32 nt, Human
cugcuugcugccgccgcgcuccugggugauca

SEQ ID NO: 405528 - RNA, 32 nt, Human
cugcuugcugccugcccugcccuccgaugcag

SEQ ID NO: 405529 - RNA, 32 nt, Human
cugcuugcugccugucugcuuuccuugguggc

SEQ ID NO: 405530 - RNA, 32 nt, Human
cugcuugcugcucuccuugcuuggcauagccu

SEQ ID NO: 405531 - RNA, 32 nt, Human
cugcuugcugggacagucaccaggguuggggg

SEQ ID NO: 405532 - RNA, 32 nt, Human
cugcuugcugucugagaugaggguuccuaaac

SEQ ID NO: 405533 - RNA, 18 nt, Human
cugcuugcugucugcaag

SEQ ID NO: 405534 - RNA, 32 nt, Human
cugcuugcuguugccucacgccaggccccguc

SEQ ID NO: 405535 - RNA, 21 nt, Human
cugcuugcuuccucccuuccc

SEQ ID NO: 405536 - RNA, 32 nt, Human
cugcuuggaaguggccuccccaggugccuuug

SEQ ID NO: 405537 - RNA, 32 nt, Human
cugcuuggagguggcugaguugggggcccuag

SEQ ID NO: 405538 - RNA, 32 nt, Human
cugcuuggauggcugaggcaggagaaucgcuu

SEQ ID NO: 405539 - RNA, 32 nt, Human
cugcuuggcacagucucugccugcuugcucuc

SEQ ID NO: 405540 - RNA, 32 nt, Human
cugcuuggcacccugcgagcaccagcucccuu

SEQ ID NO: 405541 - RNA, 32 nt, Human
cugcuuggccagaccuuggcugugccuccugc

SEQ ID NO: 405542 - RNA, 22 nt, Human
cugcuuggcccccacagcacug

SEQ ID NO: 405543 - RNA, 32 nt, Human
cugcuugggacccucugggcaugcagcagcag

SEQ ID NO: 405544 - RNA, 32 nt, Human
cugcuugggaggcacagguccugggacaugaa

SEQ ID NO: 405545 - RNA, 32 nt, Human
cugcuugggaggcagaggcaggagaauugcuu

SEQ ID NO: 405546 - RNA, 32 nt, Human
cugcuugggaggcugaggcagagaauugcuug

SEQ ID NO: 405547 - RNA, 32 nt, Human
cugcuugggaggcugaggcaggagaaucacuu

SEQ ID NO: 405548 - RNA, 32 nt, Human
cugcuugggaggcugaggcaggagaaucgcuu

SEQ ID NO: 405549 - RNA, 32 nt, Human
cugcuugggaggcugaggcaggagaauggcuu

SEQ ID NO: 405550 - RNA, 32 nt, Human
cugcuugggaggcugaggcaggagaauucguu

SEQ ID NO: 405551 - RNA, 32 nt, Human
cugcuugggaggcugagggcaggagaauugcu

SEQ ID NO: 405552 - RNA, 32 nt, Human
cugcuugggaggcugagguaggaggaucacuu

SEQ ID NO: 405553 - RNA, 32 nt, Human
cugcuugggaggcugaggugaggaucacuuga

SEQ ID NO: 405554 - RNA, 32 nt, Human
cugcuugggaggcugaggugggaggaucacuu

SEQ ID NO: 405555 - RNA, 32 nt, Human
cugcuugggaggcugagguugcaggaucgcuu

SEQ ID NO: 405556 - RNA, 32 nt, Human
cugcuugggauguguucuuuggcagcuuguga

SEQ ID NO: 405557 - RNA, 32 nt, Human
cugcuugggcgccgugcgguggugacugagcu

SEQ ID NO: 405558 - RNA, 32 nt, Human
cugcuugggcuucauccuccucagaucuucug

SEQ ID NO: 405559 - RNA, 32 nt, Human
cugcuuggggaggaagacgaagaggcacugca

SEQ ID NO: 405560 - RNA, 22 nt, Human
cugcuuggggcccacagcacug

SEQ ID NO: 405561 - RNA, 32 nt, Human
cugcuuggggccucuuucuggaaaccagauca

SEQ ID NO: 405562 - RNA, 32 nt, Human
cugcuuggucaagguuugugccccacuacaga

SEQ ID NO: 405563 - RNA, 32 nt, Human
cugcuugguuucuggggaggccuccggaagcu

SEQ ID NO: 405564 - RNA, 32 nt, Human
cugcuugucaucugcaugucuacucagcauuu

SEQ ID NO: 405565 - RNA, 32 nt, Human
cugcuugucccuggcugugcugccucaggcac

SEQ ID NO: 405566 - RNA, 32 nt, Human
cugcuuguccuucagcccaugcccagcagaua

SEQ ID NO: 405567 - RNA, 32 nt, Human
cugcuugucuguuccugacucugguucucacu

SEQ ID NO: 405568 - RNA, 32 nt, Human
cugcuugugcaggagccuguguacacagggcc

SEQ ID NO: 405569 - RNA, 32 nt, Human
cugcuugugcuuccagcuuaagggacaggcac

SEQ ID NO: 405570 - RNA, 32 nt, Human
cugcuuguguugcucagagucacggaaucugu

SEQ ID NO: 405571 - RNA, 32 nt, Human
cugcuuguguuggagugcagagggugcacaga

SEQ ID NO: 405572 - RNA, 32 nt, Human
cugcuuguuacauuuuucucccuuuucuuggg

SEQ ID NO: 405573 - RNA, 32 nt, Human
cugcuuguucucucaccccuaacccuaguagu

SEQ ID NO: 405574 - RNA, 32 nt, Human
cugcuuguuggccugaccccucccucaccagg

SEQ ID NO: 405575 - RNA, 30 nt, Human
cugcuuguuuuuauaaauacauuuuauugg

SEQ ID NO: 405576 - RNA, 32 nt, Human
cugcuuuaaaacaaaaccaaacaaaacuuuaa

SEQ ID NO: 405577 - RNA, 23 nt, Human
cugcuuuaaccaccccaucugca

SEQ ID NO: 405578 - RNA, 22 nt, Human
cugcuuuaagccucugucuuca

SEQ ID NO: 405579 - RNA, 32 nt, Human
cugcuuuaaguaauaugguagccacauuuuga

SEQ ID NO: 405580 - RNA, 32 nt, Human
cugcuuuagaagcuucucccuccuggugauua

SEQ ID NO: 405581 - RNA, 24 nt, Human
cugcuuuagccuccuauguuugca

SEQ ID NO: 405582 - RNA, 32 nt, Human
cugcuuuagggaggcucuggcaggagguccuc

SEQ ID NO: 405583 - RNA, 32 nt, Human
cugcuuuauauaaaccuuacauuuauauagug

SEQ ID NO: 405584 - RNA, 32 nt, Human
cugcuuuaucucuccuugcucuucucaccucu

SEQ ID NO: 405585 - RNA, 32 nt, Human
cugcuuuauugucucugugacugaaaguuaga

SEQ ID NO: 405586 - RNA, 32 nt, Human
cugcuuucaagcaccacacccacccagaugac

SEQ ID NO: 405587 - RNA, 28 nt, Human
cugcuuucaagugcuggaacauuaaguu

SEQ ID NO: 405588 - RNA, 32 nt, Human
cugcuuucagccccaccuggacagaggcuuac

SEQ ID NO: 405589 - RNA, 32 nt, Human
cugcuuucaugcugucaguagggaugaucaug

SEQ ID NO: 405590 - RNA, 32 nt, Human
cugcuuuccacuguggguaccuggugaucagg

SEQ ID NO: 405591 - RNA, 32 nt, Human
cugcuuuccagggauguguccagugcccuggg

SEQ ID NO: 405592 - RNA, 32 nt, Human
cugcuuucccaggagggugaagauggugcugu

SEQ ID NO: 405593 - RNA, 32 nt, Human
cugcuuuccccagggugacaucguagccaaau

SEQ ID NO: 405594 - RNA, 32 nt, Human
cugcuuuccccugaccuccacugacaucuacg

SEQ ID NO: 405595 - RNA, 32 nt, Human
cugcuuucccucagcacucuugcccuuugagg

SEQ ID NO: 405596 - RNA, 18 nt, Human
cugcuuucccuccgagcc

SEQ ID NO: 405597 - RNA, 20 nt, Human
cugcuuucccucuccugccu

SEQ ID NO: 405598 - RNA, 32 nt, Human
cugcuuuccgugucuucaguucuguccaagcc

SEQ ID NO: 405599 - RNA, 32 nt, Human
cugcuuuccuacucuccuuuuaucucacucua

SEQ ID NO: 405600 - RNA, 32 nt, Human
cugcuuuccucaauguguucuucacccgugag

SEQ ID NO: 405601 - RNA, 32 nt, Human
cugcuuuccuccucccugacugcccagcgagc

SEQ ID NO: 405602 - RNA, 20 nt, Human
cugcuuuccugaugcucugg

SEQ ID NO: 405603 - RNA, 23 nt, Human
cugcuuuccuguggacucuggug

SEQ ID NO: 405604 - RNA, 32 nt, Human
cugcuuuccuuuccuuuacucaaugccguccu

SEQ ID NO: 405605 - RNA, 32 nt, Human
cugcuuucgacgagaaagacccuucggugaga

SEQ ID NO: 405606 - RNA, 32 nt, Human
cugcuuucuaagccagugagguugaggugaga

SEQ ID NO: 405607 - RNA, 21 nt, Human
cugcuuucucacucagcauca

SEQ ID NO: 405608 - RNA, 32 nt, Human
cugcuuucucagacccucaucugucaccccca

SEQ ID NO: 405609 - RNA, 32 nt, Human
cugcuuucuccccucccuucuugacucucugu

SEQ ID NO: 405610 - RNA, 32 nt, Human
cugcuuucuccucuaaaucuuggucucuuguu

SEQ ID NO: 405611 - RNA, 32 nt, Human
cugcuuucuccucugugccauccacucccacc

SEQ ID NO: 405612 - RNA, 32 nt, Human
cugcuuucucuuguuugugcuuuugcuguuuc

SEQ ID NO: 405613 - RNA, 32 nt, Human
cugcuuucucuuucucuuucucugugucucag

SEQ ID NO: 405614 - RNA, 32 nt, Human
cugcuuucugcauucuucucuccacaugccuc

SEQ ID NO: 405615 - RNA, 32 nt, Human
cugcuuucuggggaacaguaagguucaggcca

SEQ ID NO: 405616 - RNA, 32 nt, Human
cugcuuucuuaagaccaguuguucacacuuug

SEQ ID NO: 405617 - RNA, 32 nt, Human
cugcuuucuucuggaaguucagaaggaaaccu

SEQ ID NO: 405618 - RNA, 32 nt, Human
cugcuuucuuucuccuucuacuaugcuggauc

SEQ ID NO: 405619 - RNA, 32 nt, Human
cugcuuucuuugcuuucucuucucaccuuugg

SEQ ID NO: 405620 - RNA, 32 nt, Human
cugcuuugacccccagacuuugcuccaucuau

SEQ ID NO: 405621 - RNA, 22 nt, Human
cugcuuugaccgaaugcucugg

SEQ ID NO: 405622 - RNA, 32 nt, Human
cugcuuugcagugguuucagaggcagaucuga

SEQ ID NO: 405623 - RNA, 21 nt, Human
cugcuuugcauccucuccagg

SEQ ID NO: 405624 - RNA, 32 nt, Human
cugcuuugcauucuucaaaaccauuccugaua

SEQ ID NO: 405625 - RNA, 19 nt, Human
cugcuuugcugccgagcca

SEQ ID NO: 405626 - RNA, 24 nt, Human
cugcuuugcugccuucccuuugca

SEQ ID NO: 405627 - RNA, 32 nt, Human
cugcuuugcuuggugguagggcaggagagcaa

SEQ ID NO: 405628 - RNA, 32 nt, Human
cugcuuuggaaaacauauuuucucugugcuag

SEQ ID NO: 405629 - RNA, 32 nt, Human
cugcuuuggagcaaaucucuucuguuuagaga

SEQ ID NO: 405630 - RNA, 32 nt, Human
cugcuuuggaggguaaaguggggaagaaaucg

SEQ ID NO: 405631 - RNA, 21 nt, Human
cugcuuuggccuuuccuugua

SEQ ID NO: 405632 - RNA, 32 nt, Human
cugcuuuggggagggggaggggagaguaucau

SEQ ID NO: 405633 - RNA, 32 nt, Human
cugcuuugggggaaucuccuccccuaccacca

SEQ ID NO: 405634 - RNA, 32 nt, Human
cugcuuugucuccucuauccugggcuuuuguu

SEQ ID NO: 405635 - RNA, 32 nt, Human
cugcuuuguggacaccgcaggaaguuccucgg

SEQ ID NO: 405636 - RNA, 32 nt, Human
cugcuuuguguuccucucccagcuccaucucu

SEQ ID NO: 405637 - RNA, 32 nt, Human
cugcuuuguuuauccccucuuaguaccugcag

SEQ ID NO: 405638 - RNA, 32 nt, Human
cugcuuuuaauacaccacuucuuucuuucugc

SEQ ID NO: 405639 - RNA, 32 nt, Human
cugcuuuucaaaagcagaguacugcagggucg

SEQ ID NO: 405640 - RNA, 32 nt, Human
cugcuuuucaucugagucaccauuuacuccaa

SEQ ID NO: 405641 - RNA, 32 nt, Human
cugcuuuuccaaaacugguacuuacgugaacu

SEQ ID NO: 405642 - RNA, 32 nt, Human
cugcuuuuccacccucacccuucauucuucua

SEQ ID NO: 405643 - RNA, 32 nt, Human
cugcuuuuccucaaccuuuccuaccagauucc

SEQ ID NO: 405644 - RNA, 32 nt, Human
cugcuuuuccucagauccguucuuucucugug

SEQ ID NO: 405645 - RNA, 32 nt, Human
cugcuuuuccuccaggcuguucugguguccgc

SEQ ID NO: 405646 - RNA, 32 nt, Human
cugcuuuucucccaccccuccuagcaccccca

SEQ ID NO: 405647 - RNA, 32 nt, Human
cugcuuuucucccuccccuuccuuccugcagg

SEQ ID NO: 405648 - RNA, 32 nt, Human
cugcuuuucuuucugcuucaaacacacaguuc

SEQ ID NO: 405649 - RNA, 32 nt, Human
cugcuuuugagccucagaccccagggcagcau

SEQ ID NO: 405650 - RNA, 32 nt, Human
cugcuuuugagugagauggucccagaggccug

SEQ ID NO: 405651 - RNA, 32 nt, Human
cugcuuuugccuggccgcccuagccgcuggcu

SEQ ID NO: 405652 - RNA, 32 nt, Human
cugcuuuuucaaauucuugcuggucuuagcag

SEQ ID NO: 405653 - RNA, 32 nt, Human
cugcuuuuucagcuucuccaucgccugccuuc

SEQ ID NO: 405654 - RNA, 32 nt, Human
cugcuuuuuccucuccccacuggccuaaaugg

SEQ ID NO: 405655 - RNA, 32 nt, Human
cugcuuuuucuuucuuucuuccccuuuuccaa

SEQ ID NO: 405656 - RNA, 32 nt, Human
cugcuuuuugggauaucuaacugcuaaggagg

SEQ ID NO: 405657 - RNA, 23 nt, Human
cuggaaaaaaucacacugucagg

SEQ ID NO: 405658 - RNA, 32 nt, Human
cuggaaaaaccugggcagugggaggcucagcu

SEQ ID NO: 405659 - RNA, 32 nt, Human
cuggaaaaaugagagaagugggaaagaagcaa

SEQ ID NO: 405660 - RNA, 21 nt, Human
cuggaaaacaccccucugcug

SEQ ID NO: 405661 - RNA, 22 nt, Human
cuggaaaacaccuugucugcau

SEQ ID NO: 405662 - RNA, 32 nt, Human
cuggaaaaccagccauuccuccucccugcagu

SEQ ID NO: 405663 - RNA, 32 nt, Human
cuggaaaagaugaccagacucccaccgcccag

SEQ ID NO: 405664 - RNA, 32 nt, Human
cuggaaaagcagcccccauuuccucggguacc

SEQ ID NO: 405665 - RNA, 21 nt, Human
cuggaaaagcugggguaguug

SEQ ID NO: 405666 - RNA, 21 nt, Human
cuggaaaaggagcuucaguau

SEQ ID NO: 405667 - RNA, 32 nt, Human
cuggaaaaggcucuuguugcuguaauuuagag

SEQ ID NO: 405668 - RNA, 23 nt, Human
cuggaaaaguauccagagucuca

SEQ ID NO: 405669 - RNA, 21 nt, Human
cuggaaaaguugugccugagu

SEQ ID NO: 405670 - RNA, 32 nt, Human
cuggaaaauggugccugguucacagcucccgu

SEQ ID NO: 405671 - RNA, 32 nt, Human
cuggaaaauguggugaaauccugucucuauuu

SEQ ID NO: 405672 - RNA, 18 nt, Human
cuggaaacaacucuggca

SEQ ID NO: 405673 - RNA, 32 nt, Human
cuggaaacaagaaaguucugcuuagcagaaau

SEQ ID NO: 405674 - RNA, 32 nt, Human
cuggaaacacccuuccggaacccuucggggaa

SEQ ID NO: 405675 - RNA, 32 nt, Human
cuggaaacagcccagcucucucaaaaaggguc

SEQ ID NO: 405676 - RNA, 21 nt, Human
cuggaaaccaagccccacugc

SEQ ID NO: 405677 - RNA, 18 nt, Human
cuggaaaccaccaccaaa

SEQ ID NO: 405678 - RNA, 32 nt, Human
cuggaaaccaugagccucauggauuccaggca

SEQ ID NO: 405679 - RNA, 22 nt, Human
cuggaaacccagcuccacccug

SEQ ID NO: 405680 - RNA, 32 nt, Human
cuggaaaccuuaaucuccugaaguuaagucaa

SEQ ID NO: 405681 - RNA, 19 nt, Human
cuggaaacggagcauucca

SEQ ID NO: 405682 - RNA, 25 nt, Human
cuggaaacggauggccucuacgcug

SEQ ID NO: 405683 - RNA, 24 nt, Human
cuggaaagaacccuucccugcagu

SEQ ID NO: 405684 - RNA, 32 nt, Human
cuggaaagagauuggagagggagaagaagagg

SEQ ID NO: 405685 - RNA, 32 nt, Human
cuggaaagagggaagacuugauccucagcccc

SEQ ID NO: 405686 - RNA, 32 nt, Human
cuggaaagagugagaaccugggagugaaaggg

SEQ ID NO: 405687 - RNA, 32 nt, Human
cuggaaagauaauagaauagcugauucuuaca

SEQ ID NO: 405688 - RNA, 19 nt, Human
cuggaaagauccaggugga

SEQ ID NO: 405689 - RNA, 32 nt, Human
cuggaaagcaggcccaggaaugacagacaggg

SEQ ID NO: 405690 - RNA, 32 nt, Human
cuggaaagccccucccuuccuguccuucugug

SEQ ID NO: 405691 - RNA, 32 nt, Human
cuggaaagccugggcggguggauugggacccc

SEQ ID NO: 405692 - RNA, 32 nt, Human
cuggaaagcugaggugggagaaucgcuugagu

SEQ ID NO: 405693 - RNA, 32 nt, Human
cuggaaaggacacucagagcagcuccaagaca

SEQ ID NO: 405694 - RNA, 31 nt, Human
cuggaaaggcacuugccucugcacuuuucua

SEQ ID NO: 405695 - RNA, 32 nt, Human
cuggaaaggcucuggaacugaagguuccaggu

SEQ ID NO: 405696 - RNA, 32 nt, Human
cuggaaagucugcugcuucuccaagcuuucag

SEQ ID NO: 405697 - RNA, 19 nt, Human
cuggaaagugauugccaua

SEQ ID NO: 405698 - RNA, 22 nt, Human
cuggaaagugccaucuuuugaa

SEQ ID NO: 405699 - RNA, 32 nt, Human
cuggaaaguucugcaaggccucagcuacagaa

SEQ ID NO: 405700 - RNA, 32 nt, Human
cuggaaaguuugaacagucagcagaagaaaca

SEQ ID NO: 405701 - RNA, 32 nt, Human
cuggaaaguuugcagaaguggaaggagcagaa

SEQ ID NO: 405702 - RNA, 32 nt, Human
cuggaaauaacaugugagaaguacuuagaaua

SEQ ID NO: 405703 - RNA, 32 nt, Human
cuggaaaucauauugaaugauauuucuauauc

SEQ ID NO: 405704 - RNA, 32 nt, Human
cuggaaauccacccagcucugugucccagcag

SEQ ID NO: 405705 - RNA, 32 nt, Human
cuggaaaucggcugggcauggaagcacaugcc

SEQ ID NO: 405706 - RNA, 32 nt, Human
cuggaaaucuaaguucauacugguuuaauuaa

SEQ ID NO: 405707 - RNA, 21 nt, Human
cuggaaaugaccuggggcuuu

SEQ ID NO: 405708 - RNA, 32 nt, Human
cuggaaaugagguugugggguguaaagggaag

SEQ ID NO: 405709 - RNA, 32 nt, Human
cuggaaaugccucugggcugcugugcaaaagc

SEQ ID NO: 405710 - RNA, 32 nt, Human
cuggaaauucuuuggaauaauugaugacaucu

SEQ ID NO: 405711 - RNA, 32 nt, Human
cuggaaauugcugcuggagccuggugaagugu

SEQ ID NO: 405712 - RNA, 32 nt, Human
cuggaaauuuucuuuggggcagagaagagcau

SEQ ID NO: 405713 - RNA, 23 nt, Human
cuggaacaagccuucuucuguug

SEQ ID NO: 405714 - RNA, 21 nt, Human
cuggaacacaggccagggagg

SEQ ID NO: 405715 - RNA, 32 nt, Human
cuggaacacuaaugaggaaacugcacuguuuu

SEQ ID NO: 405716 - RNA, 32 nt, Human
cuggaacacugccuuaacaccugggcuaaguc

SEQ ID NO: 405717 - RNA, 21 nt, Human
cuggaacagccccacuggagu

SEQ ID NO: 405718 - RNA, 32 nt, Human
cuggaacaggaucaagcaggcccaggguguau

SEQ ID NO: 405719 - RNA, 32 nt, Human
cuggaacaggccugggcacuugugcacccaug

SEQ ID NO: 405720 - RNA, 32 nt, Human
cuggaacauccugggauauaacaacuggaugc

SEQ ID NO: 405721 - RNA, 32 nt, Human
cuggaacauccuuguucucugccaggaugcag

SEQ ID NO: 405722 - RNA, 32 nt, Human
cuggaacaugccacuugguuggaagauggaug

SEQ ID NO: 405723 - RNA, 32 nt, Human
cuggaacauggaggcccugcccggggcugggg

SEQ ID NO: 405724 - RNA, 28 nt, Human
cuggaaccaagugcugaacucucacauc

SEQ ID NO: 405725 - RNA, 32 nt, Human
cuggaaccacugcgccgccuggagguggcagc

SEQ ID NO: 405726 - RNA, 32 nt, Human
cuggaaccagcaggaggaaacaugggggauac

SEQ ID NO: 405727 - RNA, 32 nt, Human
cuggaaccagggagguagagguugcagugagc

SEQ ID NO: 405728 - RNA, 22 nt, Human
cuggaacccaacaguucaugga

SEQ ID NO: 405729 - RNA, 32 nt, Human
cuggaacccagaaggucaaggcugcaaugagc

SEQ ID NO: 405730 - RNA, 32 nt, Human
cuggaacccagaagguggagguugcagugagc

SEQ ID NO: 405731 - RNA, 32 nt, Human
cuggaacccaggaggcaaagguugcagugagc

SEQ ID NO: 405732 - RNA, 32 nt, Human
cuggaacccaggaggcagaggucgcagugagu

SEQ ID NO: 405733 - RNA, 32 nt, Human
cuggaacccaggagguggagguugcagugagc

SEQ ID NO: 405734 - RNA, 20 nt, Human
cuggaaccccacagaucacc

SEQ ID NO: 405735 - RNA, 20 nt, Human
cuggaacccccgcacccacc

SEQ ID NO: 405736 - RNA, 32 nt, Human
cuggaaccccucuucaguguaggaagucugaa

SEQ ID NO: 405737 - RNA, 32 nt, Human
cuggaacccggaagcggcagcgcggcgcgacc

SEQ ID NO: 405738 - RNA, 32 nt, Human
cuggaacccggaagguggagguugcagugagc

SEQ ID NO: 405739 - RNA, 32 nt, Human
cuggaacccgggaggcagagguugcagugagc

SEQ ID NO: 405740 - RNA, 32 nt, Human
cuggaacccgggaggcggagguugccgugagu

SEQ ID NO: 405741 - RNA, 32 nt, Human
cuggaacccgggaggcggauguugcggugagc

SEQ ID NO: 405742 - RNA, 32 nt, Human
cuggaacccgggagguagaggcugcagugagc

SEQ ID NO: 405743 - RNA, 32 nt, Human
cuggaacccgggagguggagguuguggugagc

SEQ ID NO: 405744 - RNA, 32 nt, Human
cuggaacccucugagcaacuugcucugaccua

SEQ ID NO: 405745 - RNA, 32 nt, Human
cuggaacccugccucaucuguuccugccagac

SEQ ID NO: 405746 - RNA, 32 nt, Human
cuggaacccuggaagggagggaggcccauggg

SEQ ID NO: 405747 - RNA, 32 nt, Human
cuggaaccucaggccuagacuagguugccuuu

SEQ ID NO: 405748 - RNA, 32 nt, Human
cuggaaccucuucuuccccucuuccagagcuu

SEQ ID NO: 405749 - RNA, 21 nt, Human
cuggaaccugagccagguggg

SEQ ID NO: 405750 - RNA, 32 nt, Human
cuggaaccugccugcucccucucccagaccag

SEQ ID NO: 405751 - RNA, 32 nt, Human
cuggaaccugggaaguggaagcugcagugagc

SEQ ID NO: 405752 - RNA, 32 nt, Human
cuggaaccugggagccggaggcugcagugagc

SEQ ID NO: 405753 - RNA, 32 nt, Human
cuggaaccugggaggcggagguugcagugaac

SEQ ID NO: 405754 - RNA, 32 nt, Human
cuggaaccugggagguggaggcugcagugaac

SEQ ID NO: 405755 - RNA, 32 nt, Human
cuggaaccugggauguggagguugcagugagc

SEQ ID NO: 405756 - RNA, 22 nt, Human
cuggaacgcuggccucccugca

SEQ ID NO: 405757 - RNA, 32 nt, Human
cuggaacgugagccaggaggcccggaccggcc

SEQ ID NO: 405758 - RNA, 32 nt, Human
cuggaacguguuccuaucacucuggcugguug

SEQ ID NO: 405759 - RNA, 26 nt, Human
cuggaacuaaccaguccuugauguug

SEQ ID NO: 405760 - RNA, 26 nt, Human
cuggaacucaccaguccuugauguug

SEQ ID NO: 405761 - RNA, 32 nt, Human
cuggaacucacucucagccacagggagcugca

SEQ ID NO: 405762 - RNA, 32 nt, Human
cuggaacucaggaggcagagguugcagugagc

SEQ ID NO: 405763 - RNA, 32 nt, Human
cuggaacucaggccuuucucuccugguccuga

SEQ ID NO: 405764 - RNA, 32 nt, Human
cuggaacuccagaagcagaauccuuugcuaaa

SEQ ID NO: 405765 - RNA, 32 nt, Human
cuggaacuccauagaaugauguuugcaaacca

SEQ ID NO: 405766 - RNA, 21 nt, Human
cuggaacucccagacguccca

SEQ ID NO: 405767 - RNA, 32 nt, Human
cuggaacucugaguccuccuaugaaccucugu

SEQ ID NO: 405768 - RNA, 32 nt, Human
cuggaacugcaacuccagcguccucagcaccc

SEQ ID NO: 405769 - RNA, 21 nt, Human
cuggaacugcagcccacggcg

SEQ ID NO: 405770 - RNA, 22 nt, Human
cuggaacugcugaggucccacc

SEQ ID NO: 405771 - RNA, 32 nt, Human
cuggaacugcuggcuggguugcugcuggucau

SEQ ID NO: 405772 - RNA, 20 nt, Human
cuggaacuguuugggaccuu

SEQ ID NO: 405773 - RNA, 22 nt, Human
cuggaacuuaaguuauaccuua

SEQ ID NO: 405774 - RNA, 32 nt, Human
cuggaacuuccagauucagagaaucugauuua

SEQ ID NO: 405775 - RNA, 32 nt, Human
cuggaacuucugccuccaccucgcuggggagc

SEQ ID NO: 405776 - RNA, 22 nt, Human
cuggaagaaaaaggagcgcagg

SEQ ID NO: 405777 - RNA, 19 nt, Human
cuggaagaaaaggacugca

SEQ ID NO: 405778 - RNA, 23 nt, Human
cuggaagaaacuuuggcuguagg

SEQ ID NO: 405779 - RNA, 32 nt, Human
cuggaagaaagcaacaaagauugagaagccau

SEQ ID NO: 405780 - RNA, 32 nt, Human
cuggaagaacaacagggaagacauccaucauu

SEQ ID NO: 405781 - RNA, 32 nt, Human
cuggaagaagagccccuccuuccuucaagcca

SEQ ID NO: 405782 - RNA, 23 nt, Human
cuggaagaagggcucuagggagg

SEQ ID NO: 405783 - RNA, 32 nt, Human
cuggaagaaguuaagacucuuggaggggcgcg

SEQ ID NO: 405784 - RNA, 32 nt, Human
cuggaagacagagaaaacuugccuuucaguau

SEQ ID NO: 405785 - RNA, 19 nt, Human
cuggaagaccuggaggaag

SEQ ID NO: 405786 - RNA, 23 nt, Human
cuggaagacuaugugcacugaag

SEQ ID NO: 405787 - RNA, 32 nt, Human
cuggaagacuccaaggccgcuugucuuugaga

SEQ ID NO: 405788 - RNA, 32 nt, Human
cuggaagacuuggccuuccgcucugacgcagg

SEQ ID NO: 405789 - RNA, 32 nt, Human
cuggaagagaaacaauaaauagagacuuuagc

SEQ ID NO: 405790 - RNA, 32 nt, Human
cuggaagagaaggaacagggagcagagagacc

SEQ ID NO: 405791 - RNA, 32 nt, Human
cuggaagagcagcuccagguagggggccaugu

SEQ ID NO: 405792 - RNA, 32 nt, Human
cuggaagagccaagucauccacucaggucuuc

SEQ ID NO: 405793 - RNA, 32 nt, Human
cuggaagagcuagaccgcaggagccgcgccgu

SEQ ID NO: 405794 - RNA, 32 nt, Human
cuggaagaggaggaggaggagaggcggcgggg

SEQ ID NO: 405795 - RNA, 21 nt, Human
cuggaagaggccgcccugcag

SEQ ID NO: 405796 - RNA, 32 nt, Human
cuggaagaggcggcagaggcaacaguguuuag

SEQ ID NO: 405797 - RNA, 32 nt, Human
cuggaagagggagggauccuccccagggccuc

SEQ ID NO: 405798 - RNA, 32 nt, Human
cuggaagaucacuugaaccugggaagcagagu

SEQ ID NO: 405799 - RNA, 32 nt, Human
cuggaagaugcaucuaaugagcuaaacagcau

SEQ ID NO: 405800 - RNA, 32 nt, Human
cuggaagauguggggugcugggugagaggcau

SEQ ID NO: 405801 - RNA, 32 nt, Human
cuggaagauguuuuaagaagcauuuuaaaugu

SEQ ID NO: 405802 - RNA, 32 nt, Human
cuggaagauuuugguguugguggagaauacaa

SEQ ID NO: 405803 - RNA, 32 nt, Human
cuggaagcaaagugccuaucagcagcguugcg

SEQ ID NO: 405804 - RNA, 24 nt, Human
cuggaagcacaauuaggucaggga

SEQ ID NO: 405805 - RNA, 32 nt, Human
cuggaagcacacuggcuaucugcggaaggacu

SEQ ID NO: 405806 - RNA, 24 nt, Human
cuggaagcacauugcugagggagg

SEQ ID NO: 405807 - RNA, 32 nt, Human
cuggaagcagcaagaggaaccaguagcugugg

SEQ ID NO: 405808 - RNA, 32 nt, Human
cuggaagcagcacaucauuagcuuuaugacug

SEQ ID NO: 405809 - RNA, 32 nt, Human
cuggaagcaggugcuacaacaugugaggcauu

SEQ ID NO: 405810 - RNA, 24 nt, Human
cuggaagcauuuguuucuacuuug

SEQ ID NO: 405811 - RNA, 20 nt, Human
cuggaagccaaggugggagg

SEQ ID NO: 405812 - RNA, 21 nt, Human
cuggaagccagaggccaugga

SEQ ID NO: 405813 - RNA, 32 nt, Human
cuggaagccagccagggcacugcccggcccgu

SEQ ID NO: 405814 - RNA, 19 nt, Human
cuggaagccagcugggcca

SEQ ID NO: 405815 - RNA, 32 nt, Human
cuggaagccaggggacuccagccugggcgggg

SEQ ID NO: 405816 - RNA, 21 nt, Human
cuggaagcccaaaggacucug

SEQ ID NO: 405817 - RNA, 24 nt, Human
cuggaagcccagccccuacugcug

SEQ ID NO: 405818 - RNA, 18 nt, Human
cuggaagcccaggacugc

SEQ ID NO: 405819 - RNA, 24 nt, Human
cuggaagcccaugaaccaucgcug

SEQ ID NO: 405820 - RNA, 22 nt, Human
cuggaagccccgcagccacugc

SEQ ID NO: 405821 - RNA, 26 nt, Human
cuggaagccccuuuguucuucuguug

SEQ ID NO: 405822 - RNA, 21 nt, Human
cuggaagccgagcgcccccuc

SEQ ID NO: 405823 - RNA, 24 nt, Human
cuggaagccucccaacuauucuug

SEQ ID NO: 405824 - RNA, 19 nt, Human
cuggaagccucccccacgc

SEQ ID NO: 405825 - RNA, 23 nt, Human
cuggaagccuccgguagcugcug

SEQ ID NO: 405826 - RNA, 24 nt, Human
cuggaagccucuguccucuuguug

SEQ ID NO: 405827 - RNA, 18 nt, Human
cuggaagccugcacucca

SEQ ID NO: 405828 - RNA, 32 nt, Human
cuggaagccugcacuccagcuucgaguggaac

SEQ ID NO: 405829 - RNA, 22 nt, Human
cuggaagccuucucugacugcu

SEQ ID NO: 405830 - RNA, 21 nt, Human
cuggaagcgcauccggggagg

SEQ ID NO: 405831 - RNA, 32 nt, Human
cuggaagcgguacuguaucucucuccaaggcc

SEQ ID NO: 405832 - RNA, 32 nt, Human
cuggaagcuaauggccuguugcuccugacaga

SEQ ID NO: 405833 - RNA, 32 nt, Human
cuggaagcuacaccaagcuucagagugguccu

SEQ ID NO: 405834 - RNA, 22 nt, Human
cuggaagcuccagcugcugcug

SEQ ID NO: 405835 - RNA, 32 nt, Human
cuggaagcugaugaaaggauugaauaauggag

SEQ ID NO: 405836 - RNA, 22 nt, Human
cuggaagcugcccuuuguucug

SEQ ID NO: 405837 - RNA, 32 nt, Human
cuggaagcuggagaggaugaugaagaagacga

SEQ ID NO: 405838 - RNA, 23 nt, Human
cuggaagcugggucucuuuguug

SEQ ID NO: 405839 - RNA, 32 nt, Human
cuggaagcuguggcucacaccuguaaucccag

SEQ ID NO: 405840 - RNA, 32 nt, Human
cuggaagcugugggggaaggaguugacaggug

SEQ ID NO: 405841 - RNA, 32 nt, Human
cuggaagcuucaucugcccaaaggagucugcc

SEQ ID NO: 405842 - RNA, 32 nt, Human
cuggaaggaaacacgcggaucugaacagcagu

SEQ ID NO: 405843 - RNA, 32 nt, Human
cuggaaggaagcuucccuguuggagaaaucac

SEQ ID NO: 405844 - RNA, 32 nt, Human
cuggaaggagaaagauguggaguggagaaaau

SEQ ID NO: 405845 - RNA, 32 nt, Human
cuggaaggagagaaggaagcgggaagugugcu

SEQ ID NO: 405846 - RNA, 32 nt, Human
cuggaaggaguauggcccugccuacaccuuga

SEQ ID NO: 405847 - RNA, 32 nt, Human
cuggaaggagugaacaagagccaggagaccag

SEQ ID NO: 405848 - RNA, 32 nt, Human
cuggaaggauagccucgcuucccaggugcagc

SEQ ID NO: 405849 - RNA, 24 nt, Human
cuggaaggcagaaguugcagugag

SEQ ID NO: 405850 - RNA, 24 nt, Human
cuggaaggcagagauugcagugag

SEQ ID NO: 405851 - RNA, 20 nt, Human
cuggaaggcagagguugcag

SEQ ID NO: 405852 - RNA, 23 nt, Human
cuggaaggcagagguugcaguga

SEQ ID NO: 405853 - RNA, 24 nt, Human
cuggaaggcagagguugcagugag

SEQ ID NO: 405854 - RNA, 32 nt, Human
cuggaaggcaucugcaacuccaaguccaugca

SEQ ID NO: 405855 - RNA, 24 nt, Human
cuggaaggcggagguugcagugag

SEQ ID NO: 405856 - RNA, 18 nt, Human
cuggaaggcucacaggca

SEQ ID NO: 405857 - RNA, 32 nt, Human
cuggaaggcucugcagagaugacugggcuggg

SEQ ID NO: 405858 - RNA, 32 nt, Human
cuggaaggcugagguggguggaucaccugaag

SEQ ID NO: 405859 - RNA, 32 nt, Human
cuggaaggcuggugcuacucuuccugccuuag

SEQ ID NO: 405860 - RNA, 32 nt, Human
cuggaaggcuuagaugcauuggcuccauccaa

SEQ ID NO: 405861 - RNA, 32 nt, Human
cuggaagggaaaggaaggaaccuggggucauu

SEQ ID NO: 405862 - RNA, 32 nt, Human
cuggaagggaaaggggaggaagauggagggag

SEQ ID NO: 405863 - RNA, 32 nt, Human
cuggaagggagguggagguccaguaagggccu

SEQ ID NO: 405864 - RNA, 32 nt, Human
cuggaagggccugaggauuacagugaaacuga

SEQ ID NO: 405865 - RNA, 32 nt, Human
cuggaagggcugggagggagagcccugggagc

SEQ ID NO: 405866 - RNA, 32 nt, Human
cuggaaggggagacagagguggaggguggcac

SEQ ID NO: 405867 - RNA, 17 nt, Human
cuggaaggggagcggug

SEQ ID NO: 405868 - RNA, 32 nt, Human
cuggaaggguggaaggagagaguggccagaac

SEQ ID NO: 405869 - RNA, 21 nt, Human
cuggaagguccuuccugcagu

SEQ ID NO: 405870 - RNA, 24 nt, Human
cuggaaggucgcugcccagggagg

SEQ ID NO: 405871 - RNA, 32 nt, Human
cuggaaggugccugcaggacugugagugaugu

SEQ ID NO: 405872 - RNA, 32 nt, Human
cuggaagguggaagagcagguaacaucagagc

SEQ ID NO: 405873 - RNA, 24 nt, Human
cuggaagguggaaguugcagugag

SEQ ID NO: 405874 - RNA, 32 nt, Human
cuggaagucaccuuuggcaagcuguaugcuug

SEQ ID NO: 405875 - RNA, 22 nt, Human
cuggaaguccagcacccaggga

SEQ ID NO: 405876 - RNA, 21 nt, Human
cuggaaguccagccucuauug

SEQ ID NO: 405877 - RNA, 32 nt, Human
cuggaaguccccgggagccucuccuugccugg

SEQ ID NO: 405878 - RNA, 23 nt, Human
cuggaagucuagagucuuuguug

SEQ ID NO: 405879 - RNA, 32 nt, Human
cuggaagucuucacacuggaguugcuguucca

SEQ ID NO: 405880 - RNA, 32 nt, Human
cuggaagugcaugguccaucaugggcgggagg

SEQ ID NO: 405881 - RNA, 32 nt, Human
cuggaagugcaugucuguguucuggcuccgau

SEQ ID NO: 405882 - RNA, 32 nt, Human
cuggaagugcccagaaugggaggcacggaagc

SEQ ID NO: 405883 - RNA, 32 nt, Human
cuggaaguggagaggauccuucugcuuuaauc

SEQ ID NO: 405884 - RNA, 32 nt, Human
cuggaagugggauuugaaaugcagccaagaag

SEQ ID NO: 405885 - RNA, 32 nt, Human
cuggaagugguggugcauaccuguagucccag

SEQ ID NO: 405886 - RNA, 29 nt, Human
cuggaaguguuacuggugccuggaacuga

SEQ ID NO: 405887 - RNA, 18 nt, Human
cuggaaguuagcacucua

SEQ ID NO: 405888 - RNA, 31 nt, Human
cuggaaguugagagagcaaauaaagaccuga

SEQ ID NO: 405889 - RNA, 32 nt, Human
cuggaaguuguuggaccagcaggguugguuga

SEQ ID NO: 405890 - RNA, 32 nt, Human
cuggaauaaccagucaagguagugucagaaga

SEQ ID NO: 405891 - RNA, 32 nt, Human
cuggaauacuaucaaacuaccagcaaugaauu

SEQ ID NO: 405892 - RNA, 32 nt, Human
cuggaauagaguggacugaggaagaugcggcc

SEQ ID NO: 405893 - RNA, 32 nt, Human
cuggaauagugaguugggaggauggggagaca

SEQ ID NO: 405894 - RNA, 32 nt, Human
cuggaauaugaagagacaugagauggugguag

SEQ ID NO: 405895 - RNA, 32 nt, Human
cuggaauaugggaaaauuaauuugggcuuagu

SEQ ID NO: 405896 - RNA, 32 nt, Human
cuggaaucauuuucuuucucucugccagggac

SEQ ID NO: 405897 - RNA, 32 nt, Human
cuggaauccaguuucaggauuaagggagggcu

SEQ ID NO: 405898 - RNA, 32 nt, Human
cuggaaucccaaggccagacagccuggaguuu

SEQ ID NO: 405899 - RNA, 23 nt, Human
cuggaauccuggauaacugcagg

SEQ ID NO: 405900 - RNA, 32 nt, Human
cuggaauccuggcagggauuccugucaaggac

SEQ ID NO: 405901 - RNA, 32 nt, Human
cuggaauccuggccagaugaggacccucuccg

SEQ ID NO: 405902 - RNA, 25 nt, Human
cuggaaucuauuggugcugcugcau

SEQ ID NO: 405903 - RNA, 32 nt, Human
cuggaaucucugggacauuuuugaggcauuug

SEQ ID NO: 405904 - RNA, 32 nt, Human
cuggaaucugaccuuacucuagcaggaguuuu

SEQ ID NO: 405905 - RNA, 32 nt, Human
cuggaaucuuccagauuucaguguuuuaaaau

SEQ ID NO: 405906 - RNA, 24 nt, Human
cuggaaugacgcgguccagggagg

SEQ ID NO: 405907 - RNA, 22 nt, Human
cuggaaugaucaacucauucca

SEQ ID NO: 405908 - RNA, 32 nt, Human
cuggaaugcaaagaagguggaaggaaaggauc

SEQ ID NO: 405909 - RNA, 32 nt, Human
cuggaaugcaauggcucacugcagccucaacc

SEQ ID NO: 405910 - RNA, 21 nt, Human
cuggaaugcacagcucaggga

SEQ ID NO: 405911 - RNA, 32 nt, Human
cuggaaugcagugacaucaucacagcucacug

SEQ ID NO: 405912 - RNA, 32 nt, Human
cuggaauggaaaccacuuacauuguucuacaa

SEQ ID NO: 405913 - RNA, 32 nt, Human
cuggaauggaaaggagaauucagguuaaagug

SEQ ID NO: 405914 - RNA, 32 nt, Human
cuggaaugggcgggaguggcagaagaguugug

SEQ ID NO: 405915 - RNA, 18 nt, Human
cuggaauggggcacucca

SEQ ID NO: 405916 - RNA, 32 nt, Human
cuggaaugggugucccagcaagagaugcugga

SEQ ID NO: 405917 - RNA, 21 nt, Human
cuggaaugugcauuccugcca

SEQ ID NO: 405918 - RNA, 30 nt, Human
cuggaaugugccagacucugaggcacccag

SEQ ID NO: 405919 - RNA, 18 nt, Human
cuggaauguguccauuga

SEQ ID NO: 405920 - RNA, 22 nt, Human
cuggaauuacaagcaugagcca

SEQ ID NO: 405921 - RNA, 22 nt, Human
cuggaauuacaggcaugagcca

SEQ ID NO: 405922 - RNA, 22 nt, Human
cuggaauuacaggccugagcca

SEQ ID NO: 405923 - RNA, 22 nt, Human
cuggaauuacaggcgugagcca

SEQ ID NO: 405924 - RNA, 22 nt, Human
cuggaauuacuggcaugagcca

SEQ ID NO: 405925 - RNA, 32 nt, Human
cuggaauuaguuggcagagaaaaugcugccua

SEQ ID NO: 405926 - RNA, 22 nt, Human
cuggaauuccaaagugaccuua

SEQ ID NO: 405927 - RNA, 18 nt, Human
cugggaccccggggccac

SEQ ID NO: 405928 - RNA, 32 nt, Human
cugggacccgggcuuugaagccaccuccaggg

SEQ ID NO: 405929 - RNA, 32 nt, Human
cugggacccucaccccaugucauucauucagu

SEQ ID NO: 405930 - RNA, 32 nt, Human
cugggacccuccaggagccccgggauugaagg

SEQ ID NO: 405931 - RNA, 24 nt, Human
cugggacccucccgcagaguccca

SEQ ID NO: 405932 - RNA, 32 nt, Human
cugggacccucuccacagaggggauguggucc

SEQ ID NO: 405933 - RNA, 32 nt, Human
cugggacccuuuccuuccuucccuggcuugua

SEQ ID NO: 405934 - RNA, 22 nt, Human
cugggaccgcaggcacacauca

SEQ ID NO: 405935 - RNA, 20 nt, Human
cugggaccgccacuacaaca

SEQ ID NO: 405936 - RNA, 18 nt, Human
cugggaccgccaguugca

SEQ ID NO: 405937 - RNA, 32 nt, Human
cugggaccgggagacagcccacaggccagagu

SEQ ID NO: 405938 - RNA, 19 nt, Human
cugggaccuauacagaaca

SEQ ID NO: 405939 - RNA, 32 nt, Human
cugggaccucaagggccuucugucagccuugc

SEQ ID NO: 405940 - RNA, 32 nt, Human
cugggaccuccggacugggaggggagcagagu

SEQ ID NO: 405941 - RNA, 32 nt, Human
cugggaccucgagggaacucucugcuugaugc

SEQ ID NO: 405942 - RNA, 32 nt, Human
cugggaccugagcucuggagggcaggccaccu

SEQ ID NO: 405943 - RNA, 32 nt, Human
cugggaccugcagcucugccuuugcuggcugg

SEQ ID NO: 405944 - RNA, 32 nt, Human
cugggaccuggccauccucugccagucagauu

SEQ ID NO: 405945 - RNA, 32 nt, Human
cugggaccugggacagcagcugggagaccuga

SEQ ID NO: 405946 - RNA, 32 nt, Human
cugggaccuguaaucccagcuacuugggaggc

SEQ ID NO: 405947 - RNA, 32 nt, Human
cugggaccugucguaacagucacccacucugc

SEQ ID NO: 405948 - RNA, 32 nt, Human
cugggaccuucccagucuccccagaguccgug

SEQ ID NO: 405949 - RNA, 32 nt, Human
cugggaccuugauccugccugcccggccgccc

SEQ ID NO: 405950 - RNA, 32 nt, Human
cugggacgcaguugggagugcaaagggcuggc

SEQ ID NO: 405951 - RNA, 22 nt, Human
cugggacgcuccucccuccaca

SEQ ID NO: 405952 - RNA, 18 nt, Human
cugggacggcccaaaagg

SEQ ID NO: 405953 - RNA, 18 nt, Human
cugggacggcgggugcgg

SEQ ID NO: 405954 - RNA, 32 nt, Human
cugggacggcugagcugggcagcuggaagugg

SEQ ID NO: 405955 - RNA, 32 nt, Human
cugggacgggagguggagaguuugcagagccg

SEQ ID NO: 405956 - RNA, 32 nt, Human
cugggacgggugagaguuuaagagcaccucau

SEQ ID NO: 405957 - RNA, 19 nt, Human
cugggacuaagccaaggga

SEQ ID NO: 405958 - RNA, 19 nt, Human
cugggacuacaccaccaca

SEQ ID NO: 405959 - RNA, 32 nt, Human
cugggacuacaggcacccaccaugaugccagg

SEQ ID NO: 405960 - RNA, 22 nt, Human
cugggacuacaggcacgagcca

SEQ ID NO: 405961 - RNA, 22 nt, Human
cugggacuacaggcaugagcca

SEQ ID NO: 405962 - RNA, 22 nt, Human
cugggacuacaggcgugagcca

SEQ ID NO: 405963 - RNA, 32 nt, Human
cugggacuacaggugugcgcacaugccaggcu

SEQ ID NO: 405964 - RNA, 32 nt, Human
cugggacuacaguuucgugugccaccaugccu

SEQ ID NO: 405965 - RNA, 32 nt, Human
cugggacuagaggcacgcaccaccgcgccuuu

SEQ ID NO: 405966 - RNA, 17 nt, Human
cugggacuagcacagca

SEQ ID NO: 405967 - RNA, 32 nt, Human
cugggacuagcacagcaucacuucuaccacuu

SEQ ID NO: 405968 - RNA, 31 nt, Human
cugggacucaauaauacacuugggaauauuc

SEQ ID NO: 405969 - RNA, 20 nt, Human
cugggacucagaacccaaca

SEQ ID NO: 405970 - RNA, 32 nt, Human
cugggacucuggaagcugcuucccuacuggga

SEQ ID NO: 405971 - RNA, 32 nt, Human
cugggacugagacccaggccuggcaggaccgu

SEQ ID NO: 405972 - RNA, 32 nt, Human
cugggacugcagcuucgccagguggccuuccu

SEQ ID NO: 405973 - RNA, 22 nt, Human
cugggacugcaggcaugagcca

SEQ ID NO: 405974 - RNA, 32 nt, Human
cugggacugcagggguguuccaccacacccag

SEQ ID NO: 405975 - RNA, 32 nt, Human
cugggacugcaggugcaugcacuaccaugccc

SEQ ID NO: 405976 - RNA, 32 nt, Human
cugggacugcucucgcuccggcugccacucuc

SEQ ID NO: 405977 - RNA, 32 nt, Human
cugggacugggagugucugcuccucugagcca

SEQ ID NO: 405978 - RNA, 32 nt, Human
cugggacuguaaacaugacagccgcacuucac

SEQ ID NO: 405979 - RNA, 32 nt, Human
cugggacuguuggacagcaucuacccaaccca

SEQ ID NO: 405980 - RNA, 32 nt, Human
cugggacuguuguuugcccagccugggcugca

SEQ ID NO: 405981 - RNA, 32 nt, Human
cugggacuuccuggauccuccucuucuuauaa

SEQ ID NO: 405982 - RNA, 32 nt, Human
cugggacuucuuucuuuuucacuuaauuuuaa

SEQ ID NO: 405983 - RNA, 32 nt, Human
cugggacuugacuugcuaccaacaacugcugu

SEQ ID NO: 405984 - RNA, 32 nt, Human
cugggagaaaacuuagcaaauccaucagcagg

SEQ ID NO: 405985 - RNA, 32 nt, Human
cugggagaaaccaaggcugaagagucagguug

SEQ ID NO: 405986 - RNA, 26 nt, Human
cugggagaacagagcaucugcugcug

SEQ ID NO: 405987 - RNA, 32 nt, Human
cugggagaacuccaaugcugaauggagaaggg

SEQ ID NO: 405988 - RNA, 23 nt, Human
cugggagaaggaggcuacaguga

SEQ ID NO: 405989 - RNA, 32 nt, Human
cugggagaaggcgggcuuccugccuggagcug

SEQ ID NO: 405990 - RNA, 20 nt, Human
cugggagaaggcugcagcca

SEQ ID NO: 405991 - RNA, 19 nt, Human
cugggagaaggucuccaag

SEQ ID NO: 405992 - RNA, 32 nt, Human
cugggagaagugaccucuuuauuuuugaagau

SEQ ID NO: 405993 - RNA, 32 nt, Human
cugggagacagaaaacauguuucccuacaccu

SEQ ID NO: 405994 - RNA, 32 nt, Human
cugggagacagagcuacagcugggacagcucc

SEQ ID NO: 405995 - RNA, 23 nt, Human
cugggagacagagguugcaauga

SEQ ID NO: 405996 - RNA, 21 nt, Human
cugggagacagagguugcagu

SEQ ID NO: 405997 - RNA, 24 nt, Human
cugggagacagagguugcagugag

SEQ ID NO: 405998 - RNA, 32 nt, Human
cugggagaccgaggaagggggauugauugagg

SEQ ID NO: 405999 - RNA, 24 nt, Human
cugggagacggagguugcagugag

SEQ ID NO: 406000 - RNA, 32 nt, Human
cugggagacgggagucaagauggcuugguuuc

SEQ ID NO: 406001 - RNA, 32 nt, Human
cugggagagaacacagggagccagccgugggc

SEQ ID NO: 406002 - RNA, 32 nt, Human
cugggagagagcaagagaggaccuugggcccc

SEQ ID NO: 406003 - RNA, 32 nt, Human
cugggagagauggacucuguccucagcaacac

SEQ ID NO: 406004 - RNA, 32 nt, Human
cugggagagccaguccacggagccaaagcugg

SEQ ID NO: 406005 - RNA, 32 nt, Human
cugggagaggaagagagcaggacaaggcagac

SEQ ID NO: 406006 - RNA, 32 nt, Human
cugggagagggagauagcacuggagaaggucc

SEQ ID NO: 406007 - RNA, 17 nt, Human
cugggagagggaggaag

SEQ ID NO: 406008 - RNA, 32 nt, Human
cugggagaggguguugaguucacugugccagc

SEQ ID NO: 406009 - RNA, 32 nt, Human
cugggagaucagugagccuuuuguagucuucc

SEQ ID NO: 406010 - RNA, 23 nt, Human
cugggagauggaaguugcaguga

SEQ ID NO: 406011 - RNA, 24 nt, Human
cugggagauggagauugcagugag

SEQ ID NO: 406012 - RNA, 24 nt, Human
cugggagauggagguugcagugag

SEQ ID NO: 406013 - RNA, 23 nt, Human
cugggagauuccuaaggaaucau

SEQ ID NO: 406014 - RNA, 21 nt, Human
cugggagcaaaaacuagaaug

SEQ ID NO: 406015 - RNA, 32 nt, Human
cugggagcaaagcgcugagggagcucgguacg

SEQ ID NO: 406016 - RNA, 32 nt, Human
cugggagcaaaguggccugaaaccagagaaaa

SEQ ID NO: 406017 - RNA, 31 nt, Human
cugggagcacaaugcccacaucaucuuaaga

SEQ ID NO: 406018 - RNA, 24 nt, Human
cugggagcaccugucuguugcaga

SEQ ID NO: 406019 - RNA, 32 nt, Human
cugggagcacuggggcgggauccugccacagu

SEQ ID NO: 406020 - RNA, 32 nt, Human
cugggagcagcacugaaagaauuugaacugac

SEQ ID NO: 406021 - RNA, 32 nt, Human
cugggagcagcccagacccuccugaggagcag

SEQ ID NO: 406022 - RNA, 23 nt, Human
cugggagcaggaaauagcuccca

SEQ ID NO: 406023 - RNA, 21 nt, Human
cugggagcaggccuuccuccc

SEQ ID NO: 406024 - RNA, 32 nt, Human
cugggagcauaaaggugaccugaaggaugucc

SEQ ID NO: 406025 - RNA, 25 nt, Human
cugggagcaucauucuccugcuuug

SEQ ID NO: 406026 - RNA, 19 nt, Human
cugggagccauuccugcua

SEQ ID NO: 406027 - RNA, 20 nt, Human
cugggagcccagagcugcug

SEQ ID NO: 406028 - RNA, 32 nt, Human
cugggagccgagauagaagcuccugucgccgc

SEQ ID NO: 406029 - RNA, 32 nt, Human
cugggagccggaggggcugaaagggaaaugga

SEQ ID NO: 406030 - RNA, 24 nt, Human
cugggagccugagagcacugucug

SEQ ID NO: 406031 - RNA, 32 nt, Human
cugggagccugagccccacaccugccgggcag

SEQ ID NO: 406032 - RNA, 32 nt, Human
cugggagccuggccucagcaaggggccuuccu

SEQ ID NO: 406033 - RNA, 32 nt, Human
cugggagccuuucccacccccuucccugcuga

SEQ ID NO: 406034 - RNA, 22 nt, Human
cugggagcgaccagcagcccca

SEQ ID NO: 406035 - RNA, 32 nt, Human
cugggagcgcuaugggagacuggggcuuauuu

SEQ ID NO: 406036 - RNA, 32 nt, Human
cugggagcguagccacgucugcuccaaggugg

SEQ ID NO: 406037 - RNA, 32 nt, Human
cugggagcguuccuggcccccuccagugcaaa

SEQ ID NO: 406038 - RNA, 32 nt, Human
cugggagcucaagugauccuccugccucaguc

SEQ ID NO: 406039 - RNA, 21 nt, Human
cugggagcucagacuuagcug

SEQ ID NO: 406040 - RNA, 20 nt, Human
cugggagcucaggcugcugc

SEQ ID NO: 406041 - RNA, 32 nt, Human
cugggagcuccugguuagcaagugagaucucu

SEQ ID NO: 406042 - RNA, 23 nt, Human
cugggagcucguuaacuaugcug

SEQ ID NO: 406043 - RNA, 32 nt, Human
cugggagcucugacucagggaggccugaaacc

SEQ ID NO: 406044 - RNA, 32 nt, Human
cugggagcucugcuuugcauucccuuuauaaa

SEQ ID NO: 406045 - RNA, 22 nt, Human
cugggagcugaggcuccuguug

SEQ ID NO: 406046 - RNA, 28 nt, Human
cugggagcugcuggugcugcugcugcug

SEQ ID NO: 406047 - RNA, 32 nt, Human
cugggagcuggcaggguccuuccagacagucu

SEQ ID NO: 406048 - RNA, 32 nt, Human
cugggagcugggcaaggagauccucccguggc

SEQ ID NO: 406049 - RNA, 32 nt, Human
cugggagcugucaccuccacuccuaggcuuuu

SEQ ID NO: 406050 - RNA, 32 nt, Human
cugggagcugugaaagggaucccuguccuugg

SEQ ID NO: 406051 - RNA, 32 nt, Human
cugggagcuguggacgggagucaccagguggu

SEQ ID NO: 406052 - RNA, 32 nt, Human
cugggagcuuccaagcccuugagguccagcug

SEQ ID NO: 406053 - RNA, 31 nt, Human
cugggagcuucucuugggccugcugggucug

SEQ ID NO: 406054 - RNA, 21 nt, Human
cugggagcuuggccucuggcu

SEQ ID NO: 406055 - RNA, 32 nt, Human
cugggaggaaaacugagaccuccugguacccg

SEQ ID NO: 406056 - RNA, 32 nt, Human
cugggaggacgccagcccaggccaggucaccc

SEQ ID NO: 406057 - RNA, 32 nt, Human
cugggaggacguggagaggacagugaacuucc

SEQ ID NO: 406058 - RNA, 23 nt, Human
cugggaggagacauugucuucag

SEQ ID NO: 406059 - RNA, 32 nt, Human
cugggaggagagaagaaagcggggauggugca

SEQ ID NO: 406060 - RNA, 32 nt, Human
cugggaggaggaugagauccgcagggaccgag

SEQ ID NO: 406061 - RNA, 32 nt, Human
cugggaggagggaaggaggaaugagaaagcgg

SEQ ID NO: 406062 - RNA, 32 nt, Human
cugggaggagguggaggaggaggaagaggaga

SEQ ID NO: 406063 - RNA, 32 nt, Human
cugggaggaguguuugcacuguggaaauuggu

SEQ ID NO: 406064 - RNA, 24 nt, Human
cugggaggcaaagguugcagugag

SEQ ID NO: 406065 - RNA, 23 nt, Human
cugggaggcaaagguugcgguga

SEQ ID NO: 406066 - RNA, 32 nt, Human
cugggaggcaacagcggggucugcagacaccc

SEQ ID NO: 406067 - RNA, 32 nt, Human
cugggaggcaacagcggggucugcagacgccc

SEQ ID NO: 406068 - RNA, 24 nt, Human
cugggaggcagaaguugcagugag

SEQ ID NO: 406069 - RNA, 24 nt, Human
cugggaggcagagauugcagugag

SEQ ID NO: 406070 - RNA, 20 nt, Human
cugggaggcagagcuugcag

SEQ ID NO: 406071 - RNA, 23 nt, Human
cugggaggcagagcuugcaguga

SEQ ID NO: 406072 - RNA, 24 nt, Human
cugggaggcagagcuugcagugag

SEQ ID NO: 406073 - RNA, 21 nt, Human
cugggaggcagagggugcagu

SEQ ID NO: 406074 - RNA, 24 nt, Human
cugggaggcagagguuacaaugag

SEQ ID NO: 406075 - RNA, 24 nt, Human
cugggaggcagagguuacagugag

SEQ ID NO: 406076 - RNA, 20 nt, Human
cugggaggcagagguugcag

SEQ ID NO: 406077 - RNA, 21 nt, Human
cugggaggcagagguugcagu

SEQ ID NO: 406078 - RNA, 22 nt, Human
cugggaggcagagguugcagug

SEQ ID NO: 406079 - RNA, 23 nt, Human
cugggaggcagagguugcaguga

SEQ ID NO: 406080 - RNA, 24 nt, Human
cugggaggcagagguugcagugag

SEQ ID NO: 406081 - RNA, 23 nt, Human
cugggaggcagagguugcuguga

SEQ ID NO: 406082 - RNA, 24 nt, Human
cugggaggcagagguugcugugag

SEQ ID NO: 406083 - RNA, 32 nt, Human
cugggaggcagagguuguagcgagccaagauc

SEQ ID NO: 406084 - RNA, 24 nt, Human
cugggaggcagagguuucagugag

SEQ ID NO: 406085 - RNA, 23 nt, Human
cugggaggcagaguuugccguga

SEQ ID NO: 406086 - RNA, 24 nt, Human
cugggaggcagauguugcagugag

SEQ ID NO: 406087 - RNA, 32 nt, Human
cugggaggcaggaagaccacggcggaggagaa

SEQ ID NO: 406088 - RNA, 32 nt, Human
cugggaggcaggcaggcaugcaugugggccuc

SEQ ID NO: 406089 - RNA, 32 nt, Human
cugggaggcagguuuggaggcugcagugggac

SEQ ID NO: 406090 - RNA, 22 nt, Human
cugggaggcaucugcuacaguc

SEQ ID NO: 406091 - RNA, 32 nt, Human
cugggaggccaaggagagagaaucacuugagg

SEQ ID NO: 406092 - RNA, 32 nt, Human
cugggaggccaaggcaaaagaaucacuugagc

SEQ ID NO: 406093 - RNA, 32 nt, Human
cugggaggccaaggcagguggaucaccugagg

SEQ ID NO: 406094 - RNA, 32 nt, Human
cugggaggccaaggcagguggaucacuugagg

SEQ ID NO: 406095 - RNA, 32 nt, Human
cugggaggcccaggcagguggaucgccugagg

SEQ ID NO: 406096 - RNA, 19 nt, Human
cugggaggccccugugagg

SEQ ID NO: 406097 - RNA, 32 nt, Human
cugggaggccgagaagaacuugcgugugcugg

SEQ ID NO: 406098 - RNA, 32 nt, Human
cugggaggccgaggcaggaggaucccuuuagc

SEQ ID NO: 406099 - RNA, 32 nt, Human
cugggaggccgaggcaggcagauuauuugagc

SEQ ID NO: 406100 - RNA, 32 nt, Human
cugggaggccgaggcaggcggaucacgagguc

SEQ ID NO: 406101 - RNA, 32 nt, Human
cugggaggccgaggcagguggaucacucugag

SEQ ID NO: 406102 - RNA, 32 nt, Human
cugggaggccgaggcagguggaucacuugagg

SEQ ID NO: 406103 - RNA, 32 nt, Human
cugggaggccgaggcgggaagaucacuugagg

SEQ ID NO: 406104 - RNA, 32 nt, Human
cugggaggccgaggcgggcagaucacuugaga

SEQ ID NO: 406105 - RNA, 32 nt, Human
cugggaggccgaggcggguggaucaccugagg

SEQ ID NO: 406106 - RNA, 32 nt, Human
cugggaggccgagguggguggaucaugagguc

SEQ ID NO: 406107 - RNA, 32 nt, Human
cugggaggccuugaacccucagccucuuccuu

SEQ ID NO: 406108 - RNA, 24 nt, Human
cugggaggcgaagauugcagugag

SEQ ID NO: 406109 - RNA, 24 nt, Human
cugggaggcgaagguugcagugag

SEQ ID NO: 406110 - RNA, 32 nt, Human
cugggaggcgcuguggauggcagcggggcgcu

SEQ ID NO: 406111 - RNA, 24 nt, Human
cugggaggcggaaguugcagugag

SEQ ID NO: 406112 - RNA, 24 nt, Human
cugggaggcggagaguacagugag

SEQ ID NO: 406113 - RNA, 23 nt, Human
cugggaggcggagauugcaguga

SEQ ID NO: 406114 - RNA, 24 nt, Human
cugggaggcggagauugcagugag

SEQ ID NO: 406115 - RNA, 23 nt, Human
cugggaggcggagcuuacaguga

SEQ ID NO: 406116 - RNA, 23 nt, Human
cugggaggcggagcuugcaauga

SEQ ID NO: 406117 - RNA, 21 nt, Human
cugggaggcggagcuugcagu

SEQ ID NO: 406118 - RNA, 24 nt, Human
cugggaggcggagcuugcagugag

SEQ ID NO: 406119 - RNA, 24 nt, Human
cugggaggcggagcuugcggugag

SEQ ID NO: 406120 - RNA, 32 nt, Human
cugggaggcggaggagguugcagugaacugag

SEQ ID NO: 406121 - RNA, 24 nt, Human
cugggaggcggaggcugcagugag

SEQ ID NO: 406122 - RNA, 24 nt, Human
cugggaggcggagguugcaaugag

SEQ ID NO: 406123 - RNA, 24 nt, Human
cugggaggcggagguugcagcgag

SEQ ID NO: 406124 - RNA, 21 nt, Human
cugggaggcggagguugcagu

SEQ ID NO: 406125 - RNA, 22 nt, Human
cugggaggcggagguugcagug

SEQ ID NO: 406126 - RNA, 23 nt, Human
cugggaggcggagguugcaguga

SEQ ID NO: 406127 - RNA, 24 nt, Human
cugggaggcggagguugcagugag

SEQ ID NO: 406128 - RNA, 24 nt, Human
cugggaggcggagguugccgugag

SEQ ID NO: 406129 - RNA, 24 nt, Human
cugggaggcggagguugcggugag

SEQ ID NO: 406130 - RNA, 24 nt, Human
cugggaggcggagguugcugugag

SEQ ID NO: 406131 - RNA, 32 nt, Human
cugggaggcuacacuuuccuuuccagaagacu

SEQ ID NO: 406132 - RNA, 32 nt, Human
cugggaggcucugaggcaacagugggggccug

SEQ ID NO: 406133 - RNA, 32 nt, Human
cugggaggcugaggaaggagaaucgcuugaag

SEQ ID NO: 406134 - RNA, 32 nt, Human
cugggaggcugaggcaggagaaucacuugaac

SEQ ID NO: 406135 - RNA, 32 nt, Human
cugggaggcugaggcaggagaaucauuugcau

SEQ ID NO: 406136 - RNA, 32 nt, Human
cugggaggcugaggcaggagaaucgcuugaac

SEQ ID NO: 406137 - RNA, 32 nt, Human
cugggaggcugaggcaggagaaucucuugaaa

SEQ ID NO: 406138 - RNA, 32 nt, Human
cugggaggcugaggcaggagaauggcgugaac

SEQ ID NO: 406139 - RNA, 32 nt, Human
cugggaggcugaggcaggagaauugcuggaac

SEQ ID NO: 406140 - RNA, 32 nt, Human
cugggaggcugaggcaggagaauugcuugaac

SEQ ID NO: 406141 - RNA, 32 nt, Human
cugggaggcugaggcaggaggaucacuugagc

SEQ ID NO: 406142 - RNA, 32 nt, Human
cugggaggcugaggcaggaggaucacuugagg

SEQ ID NO: 406143 - RNA, 32 nt, Human
cugggaggcugaggcgggagaaucaccugagc

SEQ ID NO: 406144 - RNA, 32 nt, Human
cugggaggcugaggcggguggaucacgagguc

SEQ ID NO: 406145 - RNA, 32 nt, Human
cugggaggcugaggcggguggaucacuugaag

SEQ ID NO: 406146 - RNA, 32 nt, Human
cugggaggcugaggugggagaaucgcuuaacc

SEQ ID NO: 406147 - RNA, 32 nt, Human
cugggaggcugcagagggugcugggagccccu

SEQ ID NO: 406148 - RNA, 32 nt, Human
cugggaggcugcuggauaggagaggggucacg

SEQ ID NO: 406149 - RNA, 32 nt, Human
cugggagggaagggaauggagcucuggguuug

SEQ ID NO: 406150 - RNA, 32 nt, Human
cugggagggagggagagaacauucagcagcag

SEQ ID NO: 406151 - RNA, 32 nt, Human
cugggagggcagcagggcuacccugagcugag

SEQ ID NO: 406152 - RNA, 32 nt, Human
cugggagggcaggcaggcaaaggggagaccag

SEQ ID NO: 406153 - RNA, 32 nt, Human
cugggagggcggagguugcagugagccaggau

SEQ ID NO: 406154 - RNA, 32 nt, Human
cugggagggcuggccaugagguccccacuuuc

SEQ ID NO: 406155 - RNA, 32 nt, Human
cugggaggggagagaagagaaggagggaagga

SEQ ID NO: 406156 - RNA, 32 nt, Human
cugggaggggcugaguguacuugguggaggca

SEQ ID NO: 406157 - RNA, 32 nt, Human
cugggaggggcugugaggggcuggcaccucag

SEQ ID NO: 406158 - RNA, 32 nt, Human
cugggagggggaggaggaggagcucacacccu

SEQ ID NO: 406159 - RNA, 32 nt, Human
cugggagggugaggaugcaugagccaugauua

SEQ ID NO: 406160 - RNA, 24 nt, Human
cugggagguagaaguugcagugag

SEQ ID NO: 406161 - RNA, 24 nt, Human
cugggagguagagguugcagugag

SEQ ID NO: 406162 - RNA, 32 nt, Human
cugggagguccaggcugcaaugagccaagauc

SEQ ID NO: 406163 - RNA, 32 nt, Human
cugggaggugaguuagacagcccaggggacca

SEQ ID NO: 406164 - RNA, 24 nt, Human
cugggagguggaaguugcagugag

SEQ ID NO: 406165 - RNA, 24 nt, Human
cugggagguggagauugcagugag

SEQ ID NO: 406166 - RNA, 23 nt, Human
cugggagguggagcuugcaguga

SEQ ID NO: 406167 - RNA, 24 nt, Human
cugggagguggagcuugcagugag

SEQ ID NO: 406168 - RNA, 24 nt, Human
cugggagguggaggcuacagugag

SEQ ID NO: 406169 - RNA, 23 nt, Human
cugggagguggaggcugcaguga

SEQ ID NO: 406170 - RNA, 24 nt, Human
cugggagguggaggcugcagugag

SEQ ID NO: 406171 - RNA, 24 nt, Human
cugggagguggagguugcaaugag

SEQ ID NO: 406172 - RNA, 24 nt, Human
cugggagguggagguugcagcgag

SEQ ID NO: 406173 - RNA, 32 nt, Human
cugggagguggagguugcagcgagccaagauc

SEQ ID NO: 406174 - RNA, 21 nt, Human
cugggagguggagguugcagu

SEQ ID NO: 406175 - RNA, 23 nt, Human
cugggagguggagguugcaguga

SEQ ID NO: 406176 - RNA, 24 nt, Human
cugggagguggagguugcagugag

SEQ ID NO: 406177 - RNA, 32 nt, Human
cugggagguugaagcagaauugcuugaaccca

SEQ ID NO: 406178 - RNA, 32 nt, Human
cugggaguauuuccuccaccuggagggaggca

SEQ ID NO: 406179 - RNA, 23 nt, Human
cugggagucacaaaccugcucug

SEQ ID NO: 406180 - RNA, 32 nt, Human
cugggagucacacagcuccuguguagccgccu

SEQ ID NO: 406181 - RNA, 17 nt, Human
cugggaguccagggagg

SEQ ID NO: 406182 - RNA, 32 nt, Human
cugggagucccuccuagacuccugggccccau

SEQ ID NO: 406183 - RNA, 18 nt, Human
cugggagucgggggccac

SEQ ID NO: 406184 - RNA, 24 nt, Human
cugggagucugcagcuuccuguug

SEQ ID NO: 406185 - RNA, 32 nt, Human
cugggagucugccuguugcaggacgcacuagc

SEQ ID NO: 406186 - RNA, 32 nt, Human
cugggagugagcagggcagggugggggcaggg

SEQ ID NO: 406187 - RNA, 32 nt, Human
cugggagugaggcggcggaggagccaggugag

SEQ ID NO: 406188 - RNA, 32 nt, Human
cugggagugcuaugggagacuggggucuauuu

SEQ ID NO: 406189 - RNA, 26 nt, Human
cugggaguggaaucccugucuccaca

SEQ ID NO: 406190 - RNA, 32 nt, Human
cugggaguggcuggcccugcuggcccugccuc

SEQ ID NO: 406191 - RNA, 32 nt, Human
cugggagugguggcauaggccuguaauuccag

SEQ ID NO: 406192 - RNA, 32 nt, Human
cugggagugguggcucaugccuguaaucccag

SEQ ID NO: 406193 - RNA, 32 nt, Human
cugggagugguggcucaugccuguaaucccug

SEQ ID NO: 406194 - RNA, 32 nt, Human
cugggagugguggugcaugccuguaaucccag

SEQ ID NO: 406195 - RNA, 32 nt, Human
cugggaguuacuuagaauucaugaagauuuua

SEQ ID NO: 406196 - RNA, 32 nt, Human
cugggaguuggagauuugaagccagucaucuc

SEQ ID NO: 406197 - RNA, 32 nt, Human
cugggaguuugagaccagccugggcaacauag

SEQ ID NO: 406198 - RNA, 32 nt, Human
cugggauaagcagcucagucacaggcagaaga

SEQ ID NO: 406199 - RNA, 21 nt, Human
cugggauaagcugcccuggca

SEQ ID NO: 406200 - RNA, 32 nt, Human
cugggauagacugaggcuuugggugugucugu

SEQ ID NO: 406201 - RNA, 32 nt, Human
cugggauaggggcagaggaggcgaggaggccg

SEQ ID NO: 406202 - RNA, 32 nt, Human
cugggauauggcugcccaggagacagaccacu

SEQ ID NO: 406203 - RNA, 32 nt, Human
cugggaucaagaaggggacagcgccaccucuu

SEQ ID NO: 406204 - RNA, 32 nt, Human
cugggaucaagcaauccuuccaccuugcccuc

SEQ ID NO: 406205 - RNA, 22 nt, Human
cugggaucacagacgugagcca

SEQ ID NO: 406206 - RNA, 22 nt, Human
cugggaucacaggcaugaacca

SEQ ID NO: 406207 - RNA, 22 nt, Human
cugggaucacaggcaugagcca

SEQ ID NO: 406208 - RNA, 22 nt, Human
cugggaucacaggcgugagcca

SEQ ID NO: 406209 - RNA, 32 nt, Human
cugggaucacaggugucagccauugcacccag

SEQ ID NO: 406210 - RNA, 31 nt, Human
cugggaucaccaaggauuguuggagagucca

SEQ ID NO: 406211 - RNA, 32 nt, Human
cugggaucacccaccugaugguggugacuugu

SEQ ID NO: 406212 - RNA, 32 nt, Human
cugggaucacccaugagaugugagugaggaag

SEQ ID NO: 406213 - RNA, 18 nt, Human
cugggaucaccccacuca

SEQ ID NO: 406214 - RNA, 32 nt, Human
cugggaucacugggacacugucuuaugaaggu

SEQ ID NO: 406215 - RNA, 32 nt, Human
cugggaucaggcaacccucucaccucagccuc

SEQ ID NO: 406216 - RNA, 32 nt, Human
cugggaucaggcccaagaauuugcauuuuuaa

SEQ ID NO: 406217 - RNA, 32 nt, Human
cugggaucauagaugccugccaccacacccga

SEQ ID NO: 406218 - RNA, 32 nt, Human
cugggauccagcgagcgacaugguaaugagcu

SEQ ID NO: 406219 - RNA, 32 nt, Human
cugggaucccagggggagggugcagaugaggg

SEQ ID NO: 406220 - RNA, 32 nt, Human
cugggaucgagcccuucucccugcaggugucc

SEQ ID NO: 406221 - RNA, 32 nt, Human
cugggaucggaggccgugagccucccgccccu

SEQ ID NO: 406222 - RNA, 32 nt, Human
cugggaucgguggcucaugccuguaauccuag

SEQ ID NO: 406223 - RNA, 32 nt, Human
cugggaucucaaggagcuuuaaagucuuaaug

SEQ ID NO: 406224 - RNA, 32 nt, Human
cugggaucucaucaucauccuuagucaagcag

SEQ ID NO: 406225 - RNA, 32 nt, Human
cugggaucucgaggcggggccucugccggacc

SEQ ID NO: 406226 - RNA, 32 nt, Human
cugggaucucuacuaggaugcuggcagcccag

SEQ ID NO: 406227 - RNA, 32 nt, Human
cugggaucucuuccuuuuucauuaaagacaau

SEQ ID NO: 406228 - RNA, 32 nt, Human
cugggaugaaaguacacuugaacucuuuuuac

SEQ ID NO: 406229 - RNA, 32 nt, Human
cugggaugagcccgccugagugccccacagca

SEQ ID NO: 406230 - RNA, 32 nt, Human
cugggaugagugccagccugagccugcauggu

SEQ ID NO: 406231 - RNA, 32 nt, Human
cugggaugcaggaacaaaagaaggaaauguug

SEQ ID NO: 406232 - RNA, 24 nt, Human
cugggaugccucaugagucacuga

SEQ ID NO: 406233 - RNA, 32 nt, Human
cugggaugccucgggcccucagugcagguucg

SEQ ID NO: 406234 - RNA, 32 nt, Human
cugggaugcgcaagacuccacagcagcagagg

SEQ ID NO: 406235 - RNA, 32 nt, Human
cugggaugcucaggggacagagaggcagaggg

SEQ ID NO: 406236 - RNA, 31 nt, Human
cugggaugcuuucucccugccauugucucuu

SEQ ID NO: 406237 - RNA, 32 nt, Human
cugggauggaaagagaguugauugaaucccgg

SEQ ID NO: 406238 - RNA, 32 nt, Human
cugggauggauggccugguucaucugcaucag

SEQ ID NO: 406239 - RNA, 32 nt, Human
cugggauggcugcuucccaacuccaccuccag

SEQ ID NO: 406240 - RNA, 32 nt, Human
cugggaugggaggcuuacauggugaugccugu

SEQ ID NO: 406241 - RNA, 32 nt, Human
cugggaugggauccccaaagcuguggcaaaau

SEQ ID NO: 406242 - RNA, 23 nt, Human
cugggaugggggaugcaucugca

SEQ ID NO: 406243 - RNA, 24 nt, Human
cugggaugguccuggacccuugaa

SEQ ID NO: 406244 - RNA, 31 nt, Human
cugggaugucaacugccuacagauguuuauu

SEQ ID NO: 406245 - RNA, 32 nt, Human
cugggaugugcauccugcucccugaacccuuc

SEQ ID NO: 406246 - RNA, 22 nt, Human
cugggauuacaaacauaagcca

SEQ ID NO: 406247 - RNA, 22 nt, Human
cugggauuacaagcaccagcca

SEQ ID NO: 406248 - RNA, 22 nt, Human
cugggauuacaagcauaagcca

SEQ ID NO: 406249 - RNA, 22 nt, Human
cugggauuacaagcaugagcca

SEQ ID NO: 406250 - RNA, 22 nt, Human
cugggauuacaagcgugagcca

SEQ ID NO: 406251 - RNA, 22 nt, Human
cugggauuacagacacgagcca

SEQ ID NO: 406252 - RNA, 22 nt, Human
cugggauuacagacaugaacca

SEQ ID NO: 406253 - RNA, 22 nt, Human
cugggauuacagacaugagcca

SEQ ID NO: 406254 - RNA, 22 nt, Human
cugggauuacagacgugagcca

SEQ ID NO: 406255 - RNA, 32 nt, Human
cugggauuacagccacugcacccagccuaauc

SEQ ID NO: 406256 - RNA, 22 nt, Human
cugggauuacaggcacaaacca

SEQ ID NO: 406257 - RNA, 22 nt, Human
cugggauuacaggcaccagcca

SEQ ID NO: 406258 - RNA, 22 nt, Human
cugggauuacaggcacgagcca

SEQ ID NO: 406259 - RNA, 32 nt, Human
cugggauuacaggcacgugacaccaggcccag

SEQ ID NO: 406260 - RNA, 22 nt, Human
cugggauuacaggcaucagcca

SEQ ID NO: 406261 - RNA, 22 nt, Human
cugggauuacaggcaugaacca

SEQ ID NO: 406262 - RNA, 21 nt, Human
cugggauuacaggcaugacca

SEQ ID NO: 406263 - RNA, 22 nt, Human
cugggauuacaggcaugaccca

SEQ ID NO: 406264 - RNA, 19 nt, Human
cugggauuacaggcaugag

SEQ ID NO: 406265 - RNA, 20 nt, Human
cugggauuacaggcaugagc

SEQ ID NO: 406266 - RNA, 22 nt, Human
cugggauuacaggcaugagcca

SEQ ID NO: 406267 - RNA, 22 nt, Human
cugggauuacaggcaugagcua

SEQ ID NO: 406268 - RNA, 22 nt, Human
cugggauuacaggccugagcca

SEQ ID NO: 406269 - RNA, 22 nt, Human
cugggauuacaggcgcaaacca

SEQ ID NO: 406270 - RNA, 22 nt, Human
cugggauuacaggcgcaagcca

SEQ ID NO: 406271 - RNA, 19 nt, Human
cugggauuacaggcgcgag

SEQ ID NO: 406272 - RNA, 22 nt, Human
cugggauuacaggcgcgagcca

SEQ ID NO: 406273 - RNA, 22 nt, Human
cugggauuacaggcguaagcca

SEQ ID NO: 406274 - RNA, 22 nt, Human
cugggauuacaggcgugaacca

SEQ ID NO: 406275 - RNA, 19 nt, Human
cugggauuacaggcgugag

SEQ ID NO: 406276 - RNA, 22 nt, Human
cugggauuacaggcgugagcca

SEQ ID NO: 406277 - RNA, 22 nt, Human
cugggauuacaggcuuaagcca

SEQ ID NO: 406278 - RNA, 32 nt, Human
cugggauuacaggcuucagccaccacacccag

SEQ ID NO: 406279 - RNA, 22 nt, Human
cugggauuacaggcuugagcca

SEQ ID NO: 406280 - RNA, 19 nt, Human
cugggauuacaggugugag

SEQ ID NO: 406281 - RNA, 22 nt, Human
cugggauuacagucaugagcca

SEQ ID NO: 406282 - RNA, 22 nt, Human
cugggauuaccagcauaagcca

SEQ ID NO: 406283 - RNA, 22 nt, Human
cugggauuaccggcaugagcca

SEQ ID NO: 406284 - RNA, 22 nt, Human
cugggauuacgggcaugagcca

SEQ ID NO: 406285 - RNA, 19 nt, Human
cugggauuacgggcgugag

SEQ ID NO: 406286 - RNA, 22 nt, Human
cugggauuacuagcaugagcca

SEQ ID NO: 406287 - RNA, 22 nt, Human
cugggauuacuggcaugagcca

SEQ ID NO: 406288 - RNA, 19 nt, Human
cugggauuauaggcgugag

SEQ ID NO: 406289 - RNA, 32 nt, Human
cugggauuccacccucagagucagaugcccuu

SEQ ID NO: 406290 - RNA, 22 nt, Human
cugggauuccaggcaugagcca

SEQ ID NO: 406291 - RNA, 19 nt, Human
cugggauuccaggcgugag

SEQ ID NO: 406292 - RNA, 21 nt, Human
cugggauucccacgcccacca

SEQ ID NO: 406293 - RNA, 19 nt, Human
cugggauuccugggcccuu

SEQ ID NO: 406294 - RNA, 22 nt, Human
cugggauugcaggcaugagcca

SEQ ID NO: 406295 - RNA, 32 nt, Human
cugggauugcaggugcaugccaccaugccugg

SEQ ID NO: 406296 - RNA, 32 nt, Human
cugggauugcaggugcgagccaccggguccag

SEQ ID NO: 406297 - RNA, 32 nt, Human
cugggauugccuggguucccuuuggagaagaa

SEQ ID NO: 406298 - RNA, 32 nt, Human
cugggauugggaagaugauuacucacaccugg

SEQ ID NO: 406299 - RNA, 32 nt, Human
cugggauuguugggaauucucucccuaauuca

SEQ ID NO: 406300 - RNA, 23 nt, Human
cugggauuuacaggcaugagcca

SEQ ID NO: 406301 - RNA, 19 nt, Human
cugggauuuccugggcuuu

SEQ ID NO: 406302 - RNA, 18 nt, Human
cugggauuucugacaaca

SEQ ID NO: 406303 - RNA, 32 nt, Human
cugggcaaaaagggcaaaacuccgucucaaaa

SEQ ID NO: 406304 - RNA, 32 nt, Human
cugggcaaaauggugaaaccaugucucuacaa

SEQ ID NO: 406305 - RNA, 32 nt, Human
cugggcaaacauuugaguauucuuggucuucc

SEQ ID NO: 406306 - RNA, 32 nt, Human
cugggcaaacuacucccuacuuaagggaauag

SEQ ID NO: 406307 - RNA, 32 nt, Human
cugggcaaaggguuuucaggaugaggagguca

SEQ ID NO: 406308 - RNA, 32 nt, Human
cugggcaacaacccuaggucaggagguucugu

SEQ ID NO: 406309 - RNA, 32 nt, Human
cugggcaacaagagcaagacucugucucaaaa

SEQ ID NO: 406310 - RNA, 21 nt, Human
cugggcaacacagcaagaccc

SEQ ID NO: 406311 - RNA, 24 nt, Human
cugggcaacacagcaagacccauc

SEQ ID NO: 406312 - RNA, 32 nt, Human
cugggcaacacagcaagacccaucucuacaag

SEQ ID NO: 406313 - RNA, 22 nt, Human
cugggcaacacagcaagacccu

SEQ ID NO: 406314 - RNA, 24 nt, Human
cugggcaacacagcaagacccugu

SEQ ID NO: 406315 - RNA, 24 nt, Human
cugggcaacacaguaagacccugu

SEQ ID NO: 406316 - RNA, 32 nt, Human
cugggcaacacgaugaaaccccaucucuacua

SEQ ID NO: 406317 - RNA, 24 nt, Human
cugggcaacacgaugaaacuccgu

SEQ ID NO: 406318 - RNA, 20 nt, Human
cugggcaacacggugaaacc

SEQ ID NO: 406319 - RNA, 22 nt, Human
cugggcaacacggugaaacccc

SEQ ID NO: 406320 - RNA, 32 nt, Human
cugggcaacacggugaaaccccaucucuauua

SEQ ID NO: 406321 - RNA, 24 nt, Human
cugggcaacacggugaaaccccgu

SEQ ID NO: 406322 - RNA, 32 nt, Human
cugggcaacacggugaaaccccgucucuacua

SEQ ID NO: 406323 - RNA, 18 nt, Human
cugggcaacagagcaagg

SEQ ID NO: 406324 - RNA, 24 nt, Human
cugggcaacagagugaaacccugu

SEQ ID NO: 406325 - RNA, 32 nt, Human
cugggcaacagagugaaaccugucccuguuuu

SEQ ID NO: 406326 - RNA, 32 nt, Human
cugggcaacagcuuggcagccgugcggagccc

SEQ ID NO: 406327 - RNA, 23 nt, Human
cugggcaacaggcaaaacccugu

SEQ ID NO: 406328 - RNA, 24 nt, Human
cugggcaacauaaugagacccugu

SEQ ID NO: 406329 - RNA, 21 nt, Human
cugggcaacauaaugagaccu

SEQ ID NO: 406330 - RNA, 24 nt, Human
cugggcaacauagcaaaacccugu

SEQ ID NO: 406331 - RNA, 21 nt, Human
cugggcaacauagcaaaaccu

SEQ ID NO: 406332 - RNA, 24 nt, Human
cugggcaacauagcaaaauccugu

SEQ ID NO: 406333 - RNA, 21 nt, Human
cugggcaacauagcaagaccc

SEQ ID NO: 406334 - RNA, 24 nt, Human
cugggcaacauagcaagaccccgu

SEQ ID NO: 406335 - RNA, 24 nt, Human
cugggcaacauagcaagacccugu

SEQ ID NO: 406336 - RNA, 24 nt, Human
cugggcaacauagcgagacccugu

SEQ ID NO: 406337 - RNA, 24 nt, Human
cugggcaacauaguaagacccugu

SEQ ID NO: 406338 - RNA, 24 nt, Human
cugggcaacauagugaaacccugu

SEQ ID NO: 406339 - RNA, 32 nt, Human
cugggcaacauagugaaacccugucucuacua

SEQ ID NO: 406340 - RNA, 32 nt, Human
cugggcaacauagugaaaccgucuccacaaau

SEQ ID NO: 406341 - RNA, 30 nt, Human
cugggcaacauagugaaaccuggucucugc

SEQ ID NO: 406342 - RNA, 22 nt, Human
cugggcaacauagugaagcccc

SEQ ID NO: 406343 - RNA, 20 nt, Human
cugggcaacauagugagacc

SEQ ID NO: 406344 - RNA, 22 nt, Human
cugggcaacauagugagacccc

SEQ ID NO: 406345 - RNA, 24 nt, Human
cugggcaacauagugagacccugu

SEQ ID NO: 406346 - RNA, 21 nt, Human
cugggcaacauagugagaccu

SEQ ID NO: 406347 - RNA, 24 nt, Human
cugggcaacauagugagaccuugu

SEQ ID NO: 406348 - RNA, 24 nt, Human
cugggcaacauagugauaccuugu

SEQ ID NO: 406349 - RNA, 20 nt, Human
cugggcaacaugaugaaacc

SEQ ID NO: 406350 - RNA, 22 nt, Human
cugggcaacaugaugaaacccc

SEQ ID NO: 406351 - RNA, 32 nt, Human
cugggcaacaugaugaaaccccaucuccacug

SEQ ID NO: 406352 - RNA, 24 nt, Human
cugggcaacauggagaaaccccgu

SEQ ID NO: 406353 - RNA, 32 nt, Human
cugggcaacauggagaaaccccguuucuacua

SEQ ID NO: 406354 - RNA, 32 nt, Human
cugggcaacauggagagaccccuguucugcca

SEQ ID NO: 406355 - RNA, 32 nt, Human
cugggcaacauggagagaccccuucucuacua

SEQ ID NO: 406356 - RNA, 22 nt, Human
cugggcaacauggcaaaaaccc

SEQ ID NO: 406357 - RNA, 32 nt, Human
cugggcaacauggcaaaaacccaccucuacaa

SEQ ID NO: 406358 - RNA, 22 nt, Human
cugggcaacauggcaaaacacc

SEQ ID NO: 406359 - RNA, 24 nt, Human
cugggcaacauggcaaaacaccgu

SEQ ID NO: 406360 - RNA, 32 nt, Human
cugggcaacauggcaaaacaccgucucuacaa

SEQ ID NO: 406361 - RNA, 20 nt, Human
cugggcaacauggcaaaacc

SEQ ID NO: 406362 - RNA, 21 nt, Human
cugggcaacauggcaaaaccc

SEQ ID NO: 406363 - RNA, 22 nt, Human
cugggcaacauggcaaaacccc

SEQ ID NO: 406364 - RNA, 32 nt, Human
cugggcaacauggcaaaaccccaucucuacaa

SEQ ID NO: 406365 - RNA, 32 nt, Human
cugggcaacauggcaaaaccccauuucuacaa

SEQ ID NO: 406366 - RNA, 24 nt, Human
cugggcaacauggcaaaacccugu

SEQ ID NO: 406367 - RNA, 32 nt, Human
cugggcaacauggcaaaacccugucucuacaa

SEQ ID NO: 406368 - RNA, 32 nt, Human
cugggcaacauggcaaaacccuguuucuacac

SEQ ID NO: 406369 - RNA, 32 nt, Human
cugggcaacauggcaaaacucagucuguacaa

SEQ ID NO: 406370 - RNA, 31 nt, Human
cugggcaacauggcaaaacuuugucucucuu

SEQ ID NO: 406371 - RNA, 24 nt, Human
cugggcaacauggcaaaauccugu

SEQ ID NO: 406372 - RNA, 32 nt, Human
cugggcaacauggcaaaauccugucucuauaa

SEQ ID NO: 406373 - RNA, 32 nt, Human
cugggcaacauggcaaaugccgucucugcaaa

SEQ ID NO: 406374 - RNA, 21 nt, Human
cugggcaacauggcaagaccc

SEQ ID NO: 406375 - RNA, 22 nt, Human
cugggcaacauggcaagacccc

SEQ ID NO: 406376 - RNA, 24 nt, Human
cugggcaacauggcaagacccugu

SEQ ID NO: 406377 - RNA, 32 nt, Human
cugggcaacauggcaagacccugucucuacua

SEQ ID NO: 406378 - RNA, 32 nt, Human
cugggcaacauggcaagacccugucucuuuaa

SEQ ID NO: 406379 - RNA, 32 nt, Human
cugggcaacauggccagaccuccucucuacaa

SEQ ID NO: 406380 - RNA, 21 nt, Human
cugggcaacauggcgaaaacc

SEQ ID NO: 406381 - RNA, 25 nt, Human
cugggcaacauggcgaaaacccauc

SEQ ID NO: 406382 - RNA, 32 nt, Human
cugggcaacauggcgaaaacccaucucuacaa

SEQ ID NO: 406383 - RNA, 20 nt, Human
cugggcaacauggcgaaacc

SEQ ID NO: 406384 - RNA, 21 nt, Human
cugggcaacauggcgaaaccc

SEQ ID NO: 406385 - RNA, 22 nt, Human
cugggcaacauggcgaaacccc

SEQ ID NO: 406386 - RNA, 32 nt, Human
cugggcaacauggcgaaaccccauuucuacua

SEQ ID NO: 406387 - RNA, 24 nt, Human
cugggcaacauggcgaaaccccgu

SEQ ID NO: 406388 - RNA, 22 nt, Human
cugggcaacauggcgaaacccu

SEQ ID NO: 406389 - RNA, 32 nt, Human
cugggcaacauggcgaaacccuaucucuacaa

SEQ ID NO: 406390 - RNA, 24 nt, Human
cugggcaacauggcgaaacccugu

SEQ ID NO: 406391 - RNA, 30 nt, Human
cugggcaacauggcgaaacccugucuccac

SEQ ID NO: 406392 - RNA, 32 nt, Human
cugggcaacauggcgaaacccugucucuacua

SEQ ID NO: 406393 - RNA, 32 nt, Human
cugggcaacauggcgagaccccaucucuacua

SEQ ID NO: 406394 - RNA, 24 nt, Human
cugggcaacauggcgagacccugu

SEQ ID NO: 406395 - RNA, 32 nt, Human
cugggcaacauggcgagacccugucucuacaa

SEQ ID NO: 406396 - RNA, 32 nt, Human
cugggcaacauggcgagauccugucucugcaa

SEQ ID NO: 406397 - RNA, 32 nt, Human
cugggcaacauggcgaggccucugucucuaca

SEQ ID NO: 406398 - RNA, 20 nt, Human
cugggcaacauggcuaaacc

SEQ ID NO: 406399 - RNA, 24 nt, Human
cugggcaacauggcuaaaccccgu

SEQ ID NO: 406400 - RNA, 32 nt, Human
cugggcaacauggcuaaaccccgucucuacaa

SEQ ID NO: 406401 - RNA, 32 nt, Human
cugggcaacauggggaaaccccagcucuacaa

SEQ ID NO: 406402 - RNA, 32 nt, Human
cugggcaacauggggaaacuccaucucuacaa

SEQ ID NO: 406403 - RNA, 32 nt, Human
cugggcaacauggggagacccagucucuacaa

SEQ ID NO: 406404 - RNA, 32 nt, Human
cugggcaacaugguaaaacccugucucuacca

SEQ ID NO: 406405 - RNA, 32 nt, Human
cugggcaacaugguaaaacucugucucucuaa

SEQ ID NO: 406406 - RNA, 32 nt, Human
cugggcaacaugguaagaccccuucucuaccc

SEQ ID NO: 406407 - RNA, 20 nt, Human
cugggcaacauggugaaacc

SEQ ID NO: 406408 - RNA, 21 nt, Human
cugggcaacauggugaaaccc

SEQ ID NO: 406409 - RNA, 24 nt, Human
cugggcaacauggugaaacccagu

SEQ ID NO: 406410 - RNA, 32 nt, Human
cugggcaacauggugaaacccaguuucuacaa

SEQ ID NO: 406411 - RNA, 22 nt, Human
cugggcaacauggugaaacccc

SEQ ID NO: 406412 - RNA, 32 nt, Human
cugggcaacauggugaaaccccagcucuccua

SEQ ID NO: 406413 - RNA, 32 nt, Human
cugggcaacauggugaaaccccaucuccacca

SEQ ID NO: 406414 - RNA, 30 nt, Human
cugggcaacauggugaaaccccaucucuac

SEQ ID NO: 406415 - RNA, 32 nt, Human
cugggcaacauggugaaaccccaucucuacaa

SEQ ID NO: 406416 - RNA, 32 nt, Human
cugggcaacauggugaaaccccaucucuacua

SEQ ID NO: 406417 - RNA, 24 nt, Human
cugggcaacauggugaaaccccgu

SEQ ID NO: 406418 - RNA, 32 nt, Human
cugggcaacauggugaaaccccguccccacug

SEQ ID NO: 406419 - RNA, 32 nt, Human
cugggcaacauggugaaaccccgucucuacca

SEQ ID NO: 406420 - RNA, 32 nt, Human
cugggcaacauggugaaaccccgucucuaccc

SEQ ID NO: 406421 - RNA, 32 nt, Human
cugggcaacauggugaaaccccgucucuacua

SEQ ID NO: 406422 - RNA, 32 nt, Human
cugggcaacauggugaaaccccugucucuaca

SEQ ID NO: 406423 - RNA, 32 nt, Human
cugggcaacauggugaaaccccuucucuacua

SEQ ID NO: 406424 - RNA, 24 nt, Human
cugggcaacauggugaaacccggu

SEQ ID NO: 406425 - RNA, 24 nt, Human
cugggcaacauggugaaacccguc

SEQ ID NO: 406426 - RNA, 32 nt, Human
cugggcaacauggugaaacccgucucuaccaa

SEQ ID NO: 406427 - RNA, 22 nt, Human
cugggcaacauggugaaacccu

SEQ ID NO: 406428 - RNA, 32 nt, Human
cugggcaacauggugaaacccuaucuccguga

SEQ ID NO: 406429 - RNA, 24 nt, Human
cugggcaacauggugaaacccugu

SEQ ID NO: 406430 - RNA, 32 nt, Human
cugggcaacauggugaaacccugucgguacaa

SEQ ID NO: 406431 - RNA, 32 nt, Human
cugggcaacauggugaaacccugucucaaaaa

SEQ ID NO: 406432 - RNA, 28 nt, Human
cugggcaacauggugaaacccugucucu

SEQ ID NO: 406433 - RNA, 32 nt, Human
cugggcaacauggugaaacccugucucuacca

SEQ ID NO: 406434 - RNA, 32 nt, Human
cugggcaacauggugaaacccugucucuacua

SEQ ID NO: 406435 - RNA, 32 nt, Human
cugggcaacauggugaaacccugucucuacug

SEQ ID NO: 406436 - RNA, 32 nt, Human
cugggcaacauggugaaacccugucuuuacaa

SEQ ID NO: 406437 - RNA, 32 nt, Human
cugggcaacauggugaaacccuguuucuacaa

SEQ ID NO: 406438 - RNA, 32 nt, Human
cugggcaacauggugaaacccuguuucuauaa

SEQ ID NO: 406439 - RNA, 21 nt, Human
cugggcaacauggugaaaccu

SEQ ID NO: 406440 - RNA, 22 nt, Human
cugggcaacauggugaaaccuc

SEQ ID NO: 406441 - RNA, 32 nt, Human
cugggcaacauggugaaaccucaucucuacaa

SEQ ID NO: 406442 - RNA, 24 nt, Human
cugggcaacauggugaaaccucgu

SEQ ID NO: 406443 - RNA, 32 nt, Human
cugggcaacauggugaaaccucgucucuacua

SEQ ID NO: 406444 - RNA, 32 nt, Human
cugggcaacauggugaaaccugucucuacaaa

SEQ ID NO: 406445 - RNA, 24 nt, Human
cugggcaacauggugaaaccuugu

SEQ ID NO: 406446 - RNA, 32 nt, Human
cugggcaacauggugaaaccuugucucuacau

SEQ ID NO: 406447 - RNA, 32 nt, Human
cugggcaacauggugaaaccuugucucuacua

SEQ ID NO: 406448 - RNA, 24 nt, Human
cugggcaacauggugaaacuccgu

SEQ ID NO: 406449 - RNA, 32 nt, Human
cugggcaacauggugaaacugucucuaucaaa

SEQ ID NO: 406450 - RNA, 21 nt, Human
cugggcaacauggugaaagcc

SEQ ID NO: 406451 - RNA, 24 nt, Human
cugggcaacauggugaaagcccgu

SEQ ID NO: 406452 - RNA, 32 nt, Human
cugggcaacauggugaaagcccgucucuaccg

SEQ ID NO: 406453 - RNA, 20 nt, Human
cugggcaacauggugaaauc

SEQ ID NO: 406454 - RNA, 22 nt, Human
cugggcaacauggugaaauccc

SEQ ID NO: 406455 - RNA, 32 nt, Human
cugggcaacauggugaaaucccaugucuacua

SEQ ID NO: 406456 - RNA, 24 nt, Human
cugggcaacauggugaaaucccgu

SEQ ID NO: 406457 - RNA, 32 nt, Human
cugggcaacauggugaaaucccgucaccacaa

SEQ ID NO: 406458 - RNA, 32 nt, Human
cugggcaacauggugaaauccugccucuaaaa

SEQ ID NO: 406459 - RNA, 24 nt, Human
cugggcaacauggugaaauccugu

SEQ ID NO: 406460 - RNA, 32 nt, Human
cugggcaacauggugaaauccugucucuacca

SEQ ID NO: 406461 - RNA, 22 nt, Human
cugggcaacauggugaagcccc

SEQ ID NO: 406462 - RNA, 32 nt, Human
cugggcaacauggugaagccccaucucuacaa

SEQ ID NO: 406463 - RNA, 31 nt, Human
cugggcaacauggugaagccucauaucuacc

SEQ ID NO: 406464 - RNA, 32 nt, Human
cugggcaacauggugaccucccgucucucucg

SEQ ID NO: 406465 - RNA, 20 nt, Human
cugggcaacauggugagacc

SEQ ID NO: 406466 - RNA, 32 nt, Human
cugggcaacauggugagaccaauugacuguag

SEQ ID NO: 406467 - RNA, 22 nt, Human
cugggcaacauggugagacccc

SEQ ID NO: 406468 - RNA, 32 nt, Human
cugggcaacauggugagaccccaucucuacaa

SEQ ID NO: 406469 - RNA, 32 nt, Human
cugggcaacauggugagaccccaucucuauuu

SEQ ID NO: 406470 - RNA, 24 nt, Human
cugggcaacauggugagaccccgu

SEQ ID NO: 406471 - RNA, 32 nt, Human
cugggcaacauggugagaccccgucucuacaa

SEQ ID NO: 406472 - RNA, 32 nt, Human
cugggcaacauggugagacccucgucucuaca

SEQ ID NO: 406473 - RNA, 24 nt, Human
cugggcaacauggugagacccugu

SEQ ID NO: 406474 - RNA, 32 nt, Human
cugggcaacauggugagacucugccucuacaa

SEQ ID NO: 406475 - RNA, 30 nt, Human
cugggcaacauggugagauuucaucucuac

SEQ ID NO: 406476 - RNA, 32 nt, Human
cugggcaacaugguggaacccugucucuaaaa

SEQ ID NO: 406477 - RNA, 21 nt, Human
cugggcaacccugucucuaca

SEQ ID NO: 406478 - RNA, 32 nt, Human
cugggcaacguagagauccccaucucuaugaa

SEQ ID NO: 406479 - RNA, 22 nt, Human
cugggcaacguggugaaacccc

SEQ ID NO: 406480 - RNA, 32 nt, Human
cugggcaacguggugaaaccccaucucuacaa

SEQ ID NO: 406481 - RNA, 32 nt, Human
cugggcaacguggugaaacccugucucuacua

SEQ ID NO: 406482 - RNA, 32 nt, Human
cugggcaacuggacagaucugggagccagcag

SEQ ID NO: 406483 - RNA, 20 nt, Human
cugggcaagauggugaaacc

SEQ ID NO: 406484 - RNA, 22 nt, Human
cugggcaagauggugaaacccc

SEQ ID NO: 406485 - RNA, 32 nt, Human
cugggcaagauggugaaaccccaucucuacug

SEQ ID NO: 406486 - RNA, 32 nt, Human
cugggcaagcagagagugccugggacaggacu

SEQ ID NO: 406487 - RNA, 25 nt, Human
cugggcaagggguagggcucucugg

SEQ ID NO: 406488 - RNA, 32 nt, Human
cugggcaagucacuuaaccucuuuaggccucc

SEQ ID NO: 406489 - RNA, 20 nt, Human
cugggcaauauagugaaacc

SEQ ID NO: 406490 - RNA, 22 nt, Human
cugggcaauauagugaaacccc

SEQ ID NO: 406491 - RNA, 32 nt, Human
cugggcaauauagugaaaccccaucucuuaaa

SEQ ID NO: 406492 - RNA, 21 nt, Human
cugggcaauauggcaaaaccc

SEQ ID NO: 406493 - RNA, 22 nt, Human
cugggcaauauggcaaaacccc

SEQ ID NO: 406494 - RNA, 32 nt, Human
cugggcaaugcgggaggcagagccaggccucc

SEQ ID NO: 406495 - RNA, 19 nt, Human
cugggcacaagugauccuc

SEQ ID NO: 406496 - RNA, 32 nt, Human
cugggcacagauuccacccaggaacuaaggcu

SEQ ID NO: 406497 - RNA, 32 nt, Human
cugggcacagauucugguggcucccugcuggc

SEQ ID NO: 406498 - RNA, 32 nt, Human
cugggcacaggcugggaucagggcagugagcg

SEQ ID NO: 406499 - RNA, 32 nt, Human
cugggcacauccucuccucucuccuucucucu

SEQ ID NO: 406500 - RNA, 32 nt, Human
cugggcaccaaggaaacuaacagcuuucucaa

SEQ ID NO: 406501 - RNA, 32 nt, Human
cugggcaccacccuccccaggcugggugugga

SEQ ID NO: 406502 - RNA, 24 nt, Human
cugggcaccauggugaaaccucgu

SEQ ID NO: 406503 - RNA, 32 nt, Human
cugggcaccauggugaaaccucgucuuuacca

SEQ ID NO: 406504 - RNA, 22 nt, Human
cugggcaccauggugagacccc

SEQ ID NO: 406505 - RNA, 32 nt, Human
cugggcaccauggugagaccccaucucuauua

SEQ ID NO: 406506 - RNA, 32 nt, Human
cugggcacccaccccauccucuaccugccaca

SEQ ID NO: 406507 - RNA, 19 nt, Human
cugggcacccgguuccagg

SEQ ID NO: 406508 - RNA, 32 nt, Human
cugggcaccgagcuucacccugggugggucuc

SEQ ID NO: 406509 - RNA, 21 nt, Human
cugggcaccuaggauucgagu

SEQ ID NO: 406510 - RNA, 32 nt, Human
cugggcaccugccuggugauauccacaagagc

SEQ ID NO: 406511 - RNA, 32 nt, Human
cugggcaccugcugcaaccaugcagcuacccu

SEQ ID NO: 406512 - RNA, 19 nt, Human
cugggcaccuggauccagg

SEQ ID NO: 406513 - RNA, 32 nt, Human
cugggcaccuggcaccuggccugcagaugcug

SEQ ID NO: 406514 - RNA, 22 nt, Human
cugggcaccuggccucguccgg

SEQ ID NO: 406515 - RNA, 22 nt, Human
cugggcaccuggcugucccagg

SEQ ID NO: 406516 - RNA, 32 nt, Human
cugggcacggugccucaugccuguaaucccag

SEQ ID NO: 406517 - RNA, 32 nt, Human
cugggcacggugccucaugccuguaauccuag

SEQ ID NO: 406518 - RNA, 22 nt, Human
cugggcacguugcuguugcugc

SEQ ID NO: 406519 - RNA, 32 nt, Human
cugggcacucauuucaaaucaugaaaugcuac

SEQ ID NO: 406520 - RNA, 32 nt, Human
cugggcacucuggcucaagccuguaaucccag

SEQ ID NO: 406521 - RNA, 32 nt, Human
cugggcacugaaucagaggagcagaguuauuu

SEQ ID NO: 406522 - RNA, 31 nt, Human
cugggcacugggcugcagguuggagaggcag

SEQ ID NO: 406523 - RNA, 32 nt, Human
cugggcacuguacuuuagccugggcgacagag

SEQ ID NO: 406524 - RNA, 32 nt, Human
cugggcacuguggcucacgccuguaaucucag

SEQ ID NO: 406525 - RNA, 32 nt, Human
cugggcacuguggcucacuccuguaaucucag

SEQ ID NO: 406526 - RNA, 32 nt, Human
cugggcagaagaaucacuugaggauaggaguu

SEQ ID NO: 406527 - RNA, 32 nt, Human
cugggcagaagcaggaggaucauuugagccca

SEQ ID NO: 406528 - RNA, 25 nt, Human
cugggcagacaggcagagggccaga

SEQ ID NO: 406529 - RNA, 32 nt, Human
cugggcagacaggcagagggccagagcagagg

SEQ ID NO: 406530 - RNA, 32 nt, Human
cugggcagacaggcauugagcuggcaggaagu

SEQ ID NO: 406531 - RNA, 32 nt, Human
cugggcagagagcagagggggucaugcaguga

SEQ ID NO: 406532 - RNA, 32 nt, Human
cugggcagagcuggccuggcucugaguggcca

SEQ ID NO: 406533 - RNA, 32 nt, Human
cugggcagagggcagagugaggccaccuggcg

SEQ ID NO: 406534 - RNA, 32 nt, Human
cugggcagaggggagagagggcaggacaggcc

SEQ ID NO: 406535 - RNA, 32 nt, Human
cugggcagagguggaggagacacugaagcgac

SEQ ID NO: 406536 - RNA, 32 nt, Human
cugggcagaguucaucuucuugaccuuuggcc

SEQ ID NO: 406537 - RNA, 32 nt, Human
cugggcagcacugugaaaccaacauuucuuca

SEQ ID NO: 406538 - RNA, 32 nt, Human
cugggcagcagcugugucuggcuuccuuacuu

SEQ ID NO: 406539 - RNA, 24 nt, Human
cugggcagcaugacaaaacccugu

SEQ ID NO: 406540 - RNA, 24 nt, Human
cugggcagcauggugaaacccugu

SEQ ID NO: 406541 - RNA, 32 nt, Human
cugggcagcauggugaaacccuguaucuacaa

SEQ ID NO: 406542 - RNA, 25 nt, Human
cugggcagcauuggugaugcuguau

SEQ ID NO: 406543 - RNA, 32 nt, Human
cugggcagccagggcagccaggacggcaccaa

SEQ ID NO: 406544 - RNA, 22 nt, Human
cugggcagccccaggggccagg

SEQ ID NO: 406545 - RNA, 32 nt, Human
cugggcagccuccuccgauggcccacuccccg

SEQ ID NO: 406546 - RNA, 21 nt, Human
cugggcagccuggcaaaaccc

SEQ ID NO: 406547 - RNA, 32 nt, Human
cugggcagccuggcacaagugaagaagaaggc

SEQ ID NO: 406548 - RNA, 32 nt, Human
cugggcagccugucugggaagggagccaggau

SEQ ID NO: 406549 - RNA, 32 nt, Human
cugggcagcguagucauccacagaucaggaga

SEQ ID NO: 406550 - RNA, 32 nt, Human
cugggcagcuccuucagcguugccugcuuccu

SEQ ID NO: 406551 - RNA, 32 nt, Human
cugggcagcuggaggcgcaggagccugugccc

SEQ ID NO: 406552 - RNA, 32 nt, Human
cugggcagcuucuguuccugcacaacaguuau

SEQ ID NO: 406553 - RNA, 32 nt, Human
cugggcaggaagcuggcugagccccaagaccc

SEQ ID NO: 406554 - RNA, 32 nt, Human
cugggcaggagugcucucaccacgaggcugcu

SEQ ID NO: 406555 - RNA, 32 nt, Human
cugggcaggagugcuggugaggagguggagcc

SEQ ID NO: 406556 - RNA, 32 nt, Human
cugggcaggcuggauguggugguguaccccac

SEQ ID NO: 406557 - RNA, 32 nt, Human
cugggcaggcuucucuguagaaccccaggggc

SEQ ID NO: 406558 - RNA, 32 nt, Human
cugggcagggaugauggcagagccaggcuguu

SEQ ID NO: 406559 - RNA, 32 nt, Human
cugggcagggccuggccugacugagugggauu

SEQ ID NO: 406560 - RNA, 32 nt, Human
cugggcaggggcccugcaccacagcucuccag

SEQ ID NO: 406561 - RNA, 32 nt, Human
cugggcaggggguccaggugggccacacaggg

SEQ ID NO: 406562 - RNA, 32 nt, Human
cugggcagggucuugaggcagccacugugaug

SEQ ID NO: 406563 - RNA, 32 nt, Human
cugggcaggugccccucacacccccaggaugu

SEQ ID NO: 406564 - RNA, 32 nt, Human
cugggcaguaauuggggcaugggaugggcaug

SEQ ID NO: 406565 - RNA, 32 nt, Human
cugggcaguagaggaagaaaugcuagccugga

SEQ ID NO: 406566 - RNA, 32 nt, Human
cugggcagucuccggcgagggcaaggagcggu

SEQ ID NO: 406567 - RNA, 22 nt, Human
cugggcagucuugggggccaga

SEQ ID NO: 406568 - RNA, 20 nt, Human
cugggcagugccagggcuua

SEQ ID NO: 406569 - RNA, 32 nt, Human
cugggcagugccucggacugccucggacagaa

SEQ ID NO: 406570 - RNA, 32 nt, Human
cugggcagugccugugacaacguagagcgcgu

SEQ ID NO: 406571 - RNA, 32 nt, Human
cugggcaguguggaggucguuggagucacuuc

SEQ ID NO: 406572 - RNA, 32 nt, Human
cugggcauaacagcaggagcucauccucugug

SEQ ID NO: 406573 - RNA, 32 nt, Human
cugggcauaguagcucaugccuguaaucccaa

SEQ ID NO: 406574 - RNA, 32 nt, Human
cugggcauaguggcaggcaccuguaaucccag

SEQ ID NO: 406575 - RNA, 32 nt, Human
cugggcauagugguucaugccuguaaucccag

SEQ ID NO: 406576 - RNA, 32 nt, Human
cugggcauaguugcacguaccuguagucccag

SEQ ID NO: 406577 - RNA, 32 nt, Human
cugggcauauccaccaccucccucaccaacau

SEQ ID NO: 406578 - RNA, 22 nt, Human
cugggcaucaggcagggugcag

SEQ ID NO: 406579 - RNA, 32 nt, Human
cugggcaucccagcuaugcagaagcugaagca

SEQ ID NO: 406580 - RNA, 32 nt, Human
cugggcaucccuuugugggugggcagagcccu

SEQ ID NO: 406581 - RNA, 32 nt, Human
cugggcaucgcugaggcccugagcaucccagg

SEQ ID NO: 406582 - RNA, 32 nt, Human
cugggcaucuuccuugacuuacuccucucucc

SEQ ID NO: 406583 - RNA, 32 nt, Human
cugggcaucuucugcacuuucucugcauuugu

SEQ ID NO: 406584 - RNA, 26 nt, Human
cugggcaugacaggagggggaccacu

SEQ ID NO: 406585 - RNA, 32 nt, Human
cugggcaugaugacgggugccuguaaucccag

SEQ ID NO: 406586 - RNA, 32 nt, Human
cugggcaugauggcaggcaccuguaaucccag

SEQ ID NO: 406587 - RNA, 32 nt, Human
cugggcaugauggccccagccuguaaucccag

SEQ ID NO: 406588 - RNA, 32 nt, Human
cugggcaugccuguaaucccagaauuuuggga

SEQ ID NO: 406589 - RNA, 20 nt, Human
cugggcaugcuggggcaugc

SEQ ID NO: 406590 - RNA, 32 nt, Human
cugggcaugcuggggcaugcccauagucccag

SEQ ID NO: 406591 - RNA, 32 nt, Human
cugggcauggaggcucacaccuguaaucccaa

SEQ ID NO: 406592 - RNA, 32 nt, Human
cugggcauggaggcucaugccuguaauccuag

SEQ ID NO: 406593 - RNA, 32 nt, Human
cugggcauggcgguucaugccuguaaucccag

SEQ ID NO: 406594 - RNA, 32 nt, Human
cugggcaugggagagaaacgggcuggggagug

SEQ ID NO: 406595 - RNA, 32 nt, Human
cugggcaugggggcucacaccuguaaucccag

SEQ ID NO: 406596 - RNA, 32 nt, Human
cugggcauggugacucacgccuguaauccccc

SEQ ID NO: 406597 - RNA, 32 nt, Human
cugggcaugguggcaaaugccuguaauaccag

SEQ ID NO: 406598 - RNA, 32 nt, Human
cugggcaugguggcaagagccuguaaucucag

SEQ ID NO: 406599 - RNA, 32 nt, Human
cugggcaugguggcacaugccuguaaucccag

SEQ ID NO: 406600 - RNA, 32 nt, Human
cugggcaugguggcacaugccuguaauccuag

SEQ ID NO: 406601 - RNA, 32 nt, Human
cugggcaugguggcacaugccuguaaucucag

SEQ ID NO: 406602 - RNA, 32 nt, Human
cugggcaugguggcacccaucuguaguccuaa

SEQ ID NO: 406603 - RNA, 32 nt, Human
cugggcaugguggcacgcgccuguaauaccag

SEQ ID NO: 406604 - RNA, 32 nt, Human
cugggcaugguggcaggcaccuguaaucccag

SEQ ID NO: 406605 - RNA, 32 nt, Human
cugggcaugguggcaggcgccuguaaucccag

SEQ ID NO: 406606 - RNA, 32 nt, Human
cugggcaugguggcaguugccuguaauccuag

SEQ ID NO: 406607 - RNA, 32 nt, Human
cugggcaugguggcauauaccuguaaccccaa

SEQ ID NO: 406608 - RNA, 32 nt, Human
cugggcaugguggcaugcgccuguaaucccag

SEQ ID NO: 406609 - RNA, 32 nt, Human
cugggcaugguggcaugugccuguaaucccag

SEQ ID NO: 406610 - RNA, 32 nt, Human
cugggcaugguggccggcgccuguaaucccag

SEQ ID NO: 406611 - RNA, 32 nt, Human
cugggcaugguggcgcacaccuguaaucucag

SEQ ID NO: 406612 - RNA, 32 nt, Human
cugggcaugguggcgcacgccuguaaugccag

SEQ ID NO: 406613 - RNA, 32 nt, Human
cugggcaugguggcgcauaccuguaaucccag

SEQ ID NO: 406614 - RNA, 32 nt, Human
cugggcaugguggcgcaugccuguaaucccag

SEQ ID NO: 406615 - RNA, 32 nt, Human
cugggcaugguggcgcaugccuguaauccuag

SEQ ID NO: 406616 - RNA, 32 nt, Human
cugggcaugguggcgcgugccuguaaucccag

SEQ ID NO: 406617 - RNA, 32 nt, Human
cugggcaugguggcgggcgccuguaaucccag

SEQ ID NO: 406618 - RNA, 32 nt, Human
cugggcaugguggcgggugccuguaaucccag

SEQ ID NO: 406619 - RNA, 32 nt, Human
cugggcaugguggcgugcaccuguaaucccag

SEQ ID NO: 406620 - RNA, 32 nt, Human
cugggcaugguggcucacaccuguaaucacug

SEQ ID NO: 406621 - RNA, 32 nt, Human
cugggcaugguggcucacaccuguaaucccaa

SEQ ID NO: 406622 - RNA, 32 nt, Human
cugggcaugguggcucacaccuguaaucccag

SEQ ID NO: 406623 - RNA, 32 nt, Human
cugggcaugguggcucacaccuguaaucucag

SEQ ID NO: 406624 - RNA, 32 nt, Human
cugggcaugguggcucacaccuguaauucuag

SEQ ID NO: 406625 - RNA, 32 nt, Human
cugggcaugguggcucacgccuguaaucccag

SEQ ID NO: 406626 - RNA, 32 nt, Human
cugggcaugguggcucacgccuguaaucucag

SEQ ID NO: 406627 - RNA, 32 nt, Human
cugggcaugguggcucacgccuguaauuccag

SEQ ID NO: 406628 - RNA, 32 nt, Human
cugggcaugguggcucaggccuguaaucccag

SEQ ID NO: 406629 - RNA, 32 nt, Human
cugggcaugguggcucauaccuguaaucccag

SEQ ID NO: 406630 - RNA, 32 nt, Human
cugggcaugguggcucaugacuauaguaguuc

SEQ ID NO: 406631 - RNA, 32 nt, Human
cugggcaugguggcucaugcacaccuguaauc

SEQ ID NO: 406632 - RNA, 32 nt, Human
cugggcaugguggcucaugccuauaaucccag

SEQ ID NO: 406633 - RNA, 32 nt, Human
cugggcaugguggcucaugccuauaguaguuc

SEQ ID NO: 406634 - RNA, 32 nt, Human
cugggcaugguggcucaugccuguaaucccag

SEQ ID NO: 406635 - RNA, 32 nt, Human
cugggcaugguggcucaugccuguaauccuag

SEQ ID NO: 406636 - RNA, 32 nt, Human
cugggcaugguggcucaugccugugaucgcag

SEQ ID NO: 406637 - RNA, 32 nt, Human
cugggcaugguggcuuacgccuguaaucccag

SEQ ID NO: 406638 - RNA, 32 nt, Human
cugggcaugguggcuuaugccuguaaucccag

SEQ ID NO: 406639 - RNA, 32 nt, Human
cugggcaugguggugcacaccuguaaucccag

SEQ ID NO: 406640 - RNA, 32 nt, Human
cugggcaugguggugcaugccuguaaucccag

SEQ ID NO: 406641 - RNA, 32 nt, Human
cugggcaugguggugcaugccuguaauuccag

SEQ ID NO: 406642 - RNA, 32 nt, Human
cugggcaugguggugcgugccuguaaucccag

SEQ ID NO: 406643 - RNA, 32 nt, Human
cugggcaugguggugggcgccuguaaucccag

SEQ ID NO: 406644 - RNA, 32 nt, Human
cugggcaugguggugggugccuguaaucccag

SEQ ID NO: 406645 - RNA, 22 nt, Human
cugggcaugguggugugcugcg

SEQ ID NO: 406646 - RNA, 32 nt, Human
cugggcaugguggugugugccuguaaucccag

SEQ ID NO: 406647 - RNA, 32 nt, Human
cugggcaugguggugugugccuguaaucccgg

SEQ ID NO: 406648 - RNA, 32 nt, Human
cugggcaugguggugugugccuguaaugccag

SEQ ID NO: 406649 - RNA, 32 nt, Human
cugggcauggugguucacaccuguaaucccgg

SEQ ID NO: 406650 - RNA, 32 nt, Human
cugggcauggugguucaugccuguaaucccag

SEQ ID NO: 406651 - RNA, 32 nt, Human
cugggcaugguuuugguugccauuccauaggu

SEQ ID NO: 406652 - RNA, 32 nt, Human
cugggcauguagucccagcuacucgggaggcu

SEQ ID NO: 406653 - RNA, 32 nt, Human
cugggcauguccuggguggauuccuccuuucu

SEQ ID NO: 406654 - RNA, 32 nt, Human
cugggcauguuggcaugcaccuguaaucccag

SEQ ID NO: 406655 - RNA, 32 nt, Human
cugggcauuauggcaggcaccuguaaucccag

SEQ ID NO: 406656 - RNA, 24 nt, Human
cugggcauuuucugccuaugcugg

SEQ ID NO: 406657 - RNA, 32 nt, Human
cugggccaacuacucaaccucucugugccucg

SEQ ID NO: 406658 - RNA, 32 nt, Human
cugggccacagcccugccgcggagcggcggau

SEQ ID NO: 406659 - RNA, 32 nt, Human
cugggccacagcuacuucaucaacugggauaa

SEQ ID NO: 406660 - RNA, 32 nt, Human
cugggccacccacuugcuggacagucugagcc

SEQ ID NO: 406661 - RNA, 32 nt, Human
cugggccacugcaccccaccaggacggcagga

SEQ ID NO: 406662 - RNA, 18 nt, Human
cugggccacugcacucca

SEQ ID NO: 406663 - RNA, 32 nt, Human
cugggccacugcacuccagccuggaugacaga

SEQ ID NO: 406664 - RNA, 32 nt, Human
cugggccagaacugagcgcuguggggagcgcg

SEQ ID NO: 406665 - RNA, 32 nt, Human
cugggccagagaaccaccauuccauaagcagc

SEQ ID NO: 406666 - RNA, 21 nt, Human
cugggccagagccccugcugu

SEQ ID NO: 406667 - RNA, 32 nt, Human
cugggccagcagcagggaggagaggggaaggu

SEQ ID NO: 406668 - RNA, 32 nt, Human
cugggccagcagcugcugugcucaauuucucg

SEQ ID NO: 406669 - RNA, 32 nt, Human
cugggccagcagugucauaggaguggaggggg

SEQ ID NO: 406670 - RNA, 19 nt, Human
cugggccagcccugcagcc

SEQ ID NO: 406671 - RNA, 32 nt, Human
cugggccagccuggcccugcagggcagagcac

SEQ ID NO: 406672 - RNA, 32 nt, Human
cugggccagcuauggggguggcagaggucucu

SEQ ID NO: 406673 - RNA, 32 nt, Human
cugggccagcugccggcacacagcuaggcaga

SEQ ID NO: 406674 - RNA, 32 nt, Human
cugggccagcugguccaggaucugcacggccu

SEQ ID NO: 406675 - RNA, 32 nt, Human
cugggccaggaggagcugaggcugcagacccc

SEQ ID NO: 406676 - RNA, 32 nt, Human
cugggccaggcuucaguucaggccuguugcuu

SEQ ID NO: 406677 - RNA, 32 nt, Human
cugggccagguaaccugagggcaggggagagg

SEQ ID NO: 406678 - RNA, 32 nt, Human
cugggccagucaccccucccccagcccaccca

SEQ ID NO: 406679 - RNA, 32 nt, Human
cugggccaucaacugugaauucucagcaccag

SEQ ID NO: 406680 - RNA, 32 nt, Human
cugggccaugaucugggacuucucggaacccg

SEQ ID NO: 406681 - RNA, 23 nt, Human
cugggcccaaaggcccagggagg

SEQ ID NO: 406682 - RNA, 32 nt, Human
cugggcccaagcaauucucccaccucagccuc

SEQ ID NO: 406683 - RNA, 32 nt, Human
cugggcccaagugauccuuccaccucagucuc

SEQ ID NO: 406684 - RNA, 32 nt, Human
cugggcccacacugcugccuucucccaggacg

SEQ ID NO: 406685 - RNA, 32 nt, Human
cugggcccacagacaggaaaugaccugaccuc

SEQ ID NO: 406686 - RNA, 32 nt, Human
cugggcccacauucugccccaagcagaagcug

SEQ ID NO: 406687 - RNA, 19 nt, Human
cugggcccaccuccucuca

SEQ ID NO: 406688 - RNA, 22 nt, Human
cugggcccagaggcugggcccc

SEQ ID NO: 406689 - RNA, 32 nt, Human
cugggcccagcaccaaggugaugggacucucc

SEQ ID NO: 406690 - RNA, 32 nt, Human
cugggcccaggagcgagccugcagaccgggcg

SEQ ID NO: 406691 - RNA, 32 nt, Human
cugggcccaggaguucgaggugcaguuuggca

SEQ ID NO: 406692 - RNA, 32 nt, Human
cugggcccaggccaggaggggcccugcccaug

SEQ ID NO: 406693 - RNA, 16 nt, Human
cugggcccagugcccu

SEQ ID NO: 406694 - RNA, 32 nt, Human
cugggcccauguuagggucugcauaaugaucc

SEQ ID NO: 406695 - RNA, 32 nt, Human
cugggcccccacccggccuggguaggaugagc

SEQ ID NO: 406696 - RNA, 19 nt, Human
cugggcccccuacccugcc

SEQ ID NO: 406697 - RNA, 32 nt, Human
cugggcccccuucuccauaugccuccaaaaac

SEQ ID NO: 406698 - RNA, 32 nt, Human
cugggcccccuugcuccuccauccucauucuc

SEQ ID NO: 406699 - RNA, 32 nt, Human
cugggccccucaggggaagcugcuaggggaag

SEQ ID NO: 406700 - RNA, 22 nt, Human
cugggccccugacaggcgcugg

SEQ ID NO: 406701 - RNA, 32 nt, Human
cugggccccugccccuuccacccugugcuuag

SEQ ID NO: 406702 - RNA, 32 nt, Human
cugggcccuacagccucacuuccccagccuca

SEQ ID NO: 406703 - RNA, 32 nt, Human
cugggcccucaaggggcaggcggugagccugg

SEQ ID NO: 406704 - RNA, 32 nt, Human
cugggcccuccaggccaagagucucagcuggc

SEQ ID NO: 406705 - RNA, 32 nt, Human
cugggcccuccuuccuccuggugcuaauuugg

SEQ ID NO: 406706 - RNA, 27 nt, Human
cugggcccugcucaccccuuguugcug

SEQ ID NO: 406707 - RNA, 32 nt, Human
cugggcccugcucaccccuuguugcugggcuu

SEQ ID NO: 406708 - RNA, 32 nt, Human
cugggcccugcucccugcccuccugggcagcc

SEQ ID NO: 406709 - RNA, 32 nt, Human
cugggcccugcugcucuagccccagccaccag

SEQ ID NO: 406710 - RNA, 32 nt, Human
cugggcccuguuucccccuccucggcccccga

SEQ ID NO: 406711 - RNA, 32 nt, Human
cugggcccuucccagcagcagaaucuguugag

SEQ ID NO: 406712 - RNA, 32 nt, Human
cugggcccuuggauacucuucucccaucuccc

SEQ ID NO: 406713 - RNA, 32 nt, Human
cugggcccuuggucuggacugaauugcccaag

SEQ ID NO: 406714 - RNA, 32 nt, Human
cugggcccuuucuccugucuccgccacucccu

SEQ ID NO: 406715 - RNA, 32 nt, Human
cugggcccuuucucuuuuuccagccaguuucc

SEQ ID NO: 406716 - RNA, 32 nt, Human
cugggccgacuccuccccuccuggcagucagg

SEQ ID NO: 406717 - RNA, 32 nt, Human
cugggccgcaacuuccgagccucccagggcgc

SEQ ID NO: 406718 - RNA, 16 nt, Human
cugggccgcagugccu

SEQ ID NO: 406719 - RNA, 32 nt, Human
cugggccgcgggucugagggaugaggaggggc

SEQ ID NO: 406720 - RNA, 32 nt, Human
cugggccggcgccgggcgcagcugccucuccg

SEQ ID NO: 406721 - RNA, 32 nt, Human
cugggccgggaucagaugggaagcagaagcuc

SEQ ID NO: 406722 - RNA, 32 nt, Human
cugggccgggcugggagccaggcgggcggcug

SEQ ID NO: 406723 - RNA, 32 nt, Human
cugggccguggggagaagaagcucucauacgc

SEQ ID NO: 406724 - RNA, 32 nt, Human
cugggccuaggccacaggggcagggagaagag

SEQ ID NO: 406725 - RNA, 32 nt, Human
cugggccucagagggccaugagcuuggccagg

SEQ ID NO: 406726 - RNA, 32 nt, Human
cugggccucagugugcccaucuguaaaggggc

SEQ ID NO: 406727 - RNA, 32 nt, Human
cugggccuccaaagcccauccuugggguuccc

SEQ ID NO: 406728 - RNA, 32 nt, Human
cugggccuccacuucagccuagugaacaaaac

SEQ ID NO: 406729 - RNA, 32 nt, Human
cugggccuccagggcgucguaccucugugaga

SEQ ID NO: 406730 - RNA, 32 nt, Human
cugggccuccagguggcuucuuugguugcugg

SEQ ID NO: 406731 - RNA, 32 nt, Human
cugggccuccugacuccuggcccagaguucuu

SEQ ID NO: 406732 - RNA, 32 nt, Human
cugggccucugcagagagaccuccaugcccag

SEQ ID NO: 406733 - RNA, 32 nt, Human
cugggccucugccucauccugacucccccugc

SEQ ID NO: 406734 - RNA, 32 nt, Human
cugggccucugcgugcaaaccccagccucccu

SEQ ID NO: 406735 - RNA, 20 nt, Human
cugggccugagcuugccaca

SEQ ID NO: 406736 - RNA, 32 nt, Human
cugggccugagggacugugccugcugugcacu

SEQ ID NO: 406737 - RNA, 32 nt, Human
cugggccugaggugcgugccucccgggcccuc

SEQ ID NO: 406738 - RNA, 20 nt, Human
cugggccugcacggcugccu

SEQ ID NO: 406739 - RNA, 32 nt, Human
cugggccugcagcucccuucuccugggacuua

SEQ ID NO: 406740 - RNA, 32 nt, Human
cugggccugcccccucuaucuccugauggguu

SEQ ID NO: 406741 - RNA, 32 nt, Human
cugggccugcuccccgcuuccuccccuucagu

SEQ ID NO: 406742 - RNA, 32 nt, Human
cugggccuggcuuuguugaugauggcuuuccu

SEQ ID NO: 406743 - RNA, 32 nt, Human
cugggccugggcugagugguuuacaugucuuc

SEQ ID NO: 406744 - RNA, 32 nt, Human
cugggccuggggacccgagguugggcggggcg

SEQ ID NO: 406745 - RNA, 32 nt, Human
cugggccugggggugaagggaaguguuuauua

SEQ ID NO: 406746 - RNA, 32 nt, Human
cugggccuggugcugcugguggugcugcugcu

SEQ ID NO: 406747 - RNA, 32 nt, Human
cugggccugguggcucuugccuguaauuccag

SEQ ID NO: 406748 - RNA, 32 nt, Human
cugggccugucgaaggaugacagggaugugcu

SEQ ID NO: 406749 - RNA, 32 nt, Human
cugggccuguuuucucccuccugacccugcau

SEQ ID NO: 406750 - RNA, 32 nt, Human
cugggccuucaccaagcaagucccuucagacu

SEQ ID NO: 406751 - RNA, 32 nt, Human
cugggccuuccaccauuuccuccgcgccugag

SEQ ID NO: 406752 - RNA, 32 nt, Human
cugggccuuccaggaugcagggggcuggaccc

SEQ ID NO: 406753 - RNA, 32 nt, Human
cugggccuuccugguccccuccuuggcugcgg

SEQ ID NO: 406754 - RNA, 32 nt, Human
cugggccuucgucuuguucacacugagugucc

SEQ ID NO: 406755 - RNA, 19 nt, Human
cugggccuucuggguuuuu

SEQ ID NO: 406756 - RNA, 24 nt, Human
cugggccuugccgggagggguacu

SEQ ID NO: 406757 - RNA, 32 nt, Human
cugggccuugccuccaugucccaggugagccu

SEQ ID NO: 406758 - RNA, 32 nt, Human
cugggccuugggcuggcugugugaucuugggc

SEQ ID NO: 406759 - RNA, 32 nt, Human
cugggccuuuccagagaacugcagaccucacu

SEQ ID NO: 406760 - RNA, 32 nt, Human
cugggccuuucccuuuuccauucagauaauca

SEQ ID NO: 406761 - RNA, 32 nt, Human
cugggccuuugaggacacagaucagaagaaag

SEQ ID NO: 406762 - RNA, 21 nt, Human
cugggccuuugcacugcaaca

SEQ ID NO: 406763 - RNA, 32 nt, Human
cugggcgaaccagcuccgcuccggaggggucu

SEQ ID NO: 406764 - RNA, 32 nt, Human
cugggcgacaagagcaagacucugucucagaa

SEQ ID NO: 406765 - RNA, 24 nt, Human
cugggcgacacggugaaaccccgu

SEQ ID NO: 406766 - RNA, 32 nt, Human
cugggcgacacggugaaaccccgucccuacua

SEQ ID NO: 406767 - RNA, 32 nt, Human
cugggcgacaggagcaagacucugucucaaaa

SEQ ID NO: 406768 - RNA, 21 nt, Human
cugggcgagcuggugcuggau

SEQ ID NO: 406769 - RNA, 32 nt, Human
cugggcgagguggcucaugccuguaaucucag

SEQ ID NO: 406770 - RNA, 32 nt, Human
cugggcgaguagcugguacuacaggugcgugc

SEQ ID NO: 406771 - RNA, 32 nt, Human
cugggcgaugacgcuccuggcccaggaguggg

SEQ ID NO: 406772 - RNA, 32 nt, Human
cugggcgcaauggcucacgccuguaauccuag

SEQ ID NO: 406773 - RNA, 32 nt, Human
cugggcgcaccuuuagcagguggacuccgugg

SEQ ID NO: 406774 - RNA, 32 nt, Human
cugggcgcagacuucaccuucuggaccuucuc

SEQ ID NO: 406775 - RNA, 32 nt, Human
cugggcgcagcggcucacgccuguaaucccag

SEQ ID NO: 406776 - RNA, 32 nt, Human
cugggcgcaggcuggggacccagauggaauuc

SEQ ID NO: 406777 - RNA, 19 nt, Human
cugggcgcagggggcuacu

SEQ ID NO: 406778 - RNA, 20 nt, Human
cugggcgccaggugcugugc

SEQ ID NO: 406779 - RNA, 32 nt, Human
cugggcgccaugucucacuccuguaauaccag

SEQ ID NO: 406780 - RNA, 21 nt, Human
cugggcgccccaaccgggucc

SEQ ID NO: 406781 - RNA, 22 nt, Human
cugggcgccccucggugcugca

SEQ ID NO: 406782 - RNA, 32 nt, Human
cugggcgcccguucccagcauccuccuuggca

SEQ ID NO: 406783 - RNA, 18 nt, Human
cugggcgccgacugcaga

SEQ ID NO: 406784 - RNA, 28 nt, Human
cugggcgccugggcugccucuucgcggg

SEQ ID NO: 406785 - RNA, 32 nt, Human
cugggcgccuggucaccagggcugcuuuuaac

SEQ ID NO: 406786 - RNA, 32 nt, Human
cugggcgcgauggcucacaccuguaaucccag

SEQ ID NO: 406787 - RNA, 32 nt, Human
cugggcgcgguggcgcaugccuguaaucccag

SEQ ID NO: 406788 - RNA, 32 nt, Human
cugggcgcgguggcucaaaccuguaaucccag

SEQ ID NO: 406789 - RNA, 32 nt, Human
cugggcgcgguggcucacaccuguaaucccag

SEQ ID NO: 406790 - RNA, 32 nt, Human
cugggcgcgguggcucacaccuguaaucucaa

SEQ ID NO: 406791 - RNA, 32 nt, Human
cugggcgcgguggcucacgccuguaaucccag

SEQ ID NO: 406792 - RNA, 32 nt, Human
cugggcgcgguggcucacgccuguaauccuag

SEQ ID NO: 406793 - RNA, 32 nt, Human
cugggcgcgguggcucacuccuguaaucccag

SEQ ID NO: 406794 - RNA, 32 nt, Human
cugggcgcgguggcucaugccuguaaucaauc

SEQ ID NO: 406795 - RNA, 32 nt, Human
cugggcgcgguggcucaugccuguaaucccag

SEQ ID NO: 406796 - RNA, 32 nt, Human
cugggcgcgguggcucuugccuguaaucccag

SEQ ID NO: 406797 - RNA, 32 nt, Human
cugggcgcgguggcuuacaccuguaauuccag

SEQ ID NO: 406798 - RNA, 32 nt, Human
cugggcgcuguggcucacaccuguaaucccaa

SEQ ID NO: 406799 - RNA, 24 nt, Human
cugggcgcuuggagugcaguggug

SEQ ID NO: 406800 - RNA, 32 nt, Human
cugggcggagagaaggagagccggucagauuc

SEQ ID NO: 406801 - RNA, 32 nt, Human
cugggcggaggcggaagcggaaguggcgagaa

SEQ ID NO: 406802 - RNA, 32 nt, Human
cugggcggaggugggguuggucuggaagaagg

SEQ ID NO: 406803 - RNA, 32 nt, Human
cugggcggccauguggacagagcugggagggc

SEQ ID NO: 406804 - RNA, 20 nt, Human
cugggcggccccagagcccc

SEQ ID NO: 406805 - RNA, 32 nt, Human
cugggcggccugcgcagaugggccacagaagg

SEQ ID NO: 406806 - RNA, 32 nt, Human
cugggcggcugaggcaggagaauggcgugaac

SEQ ID NO: 406807 - RNA, 32 nt, Human
cugggcggggcggcuggccgggcagaggggcu

SEQ ID NO: 406808 - RNA, 32 nt, Human
cugggcguaguggcucacaccuguaaucccag

SEQ ID NO: 406809 - RNA, 32 nt, Human
cugggcgucugaggcccugauccgggcgggcc

SEQ ID NO: 406810 - RNA, 18 nt, Human
cugggcgucugggaccuu

SEQ ID NO: 406811 - RNA, 32 nt, Human
cugggcgugauggcgagcgccuguaauccagc

SEQ ID NO: 406812 - RNA, 22 nt, Human
cugggcgugccugugucugcac

SEQ ID NO: 406813 - RNA, 32 nt, Human
cugggcgugcuagagguugcagcaugagacuu

SEQ ID NO: 406814 - RNA, 32 nt, Human
cugggcguggcggcucacgccuguaaucccag

SEQ ID NO: 406815 - RNA, 32 nt, Human
cugggcguggcggcucaugccuguaaucccag

SEQ ID NO: 406816 - RNA, 32 nt, Human
cugggcgugggggcucaugccuguaaucccag

SEQ ID NO: 406817 - RNA, 32 nt, Human
cugggcguggugacucacaccuguaaucccag

SEQ ID NO: 406818 - RNA, 32 nt, Human
cugggcguggugauucacgccuguaaucccag

SEQ ID NO: 406819 - RNA, 32 nt, Human
cugggcgugguggcacacaccuguaaucccag

SEQ ID NO: 406820 - RNA, 32 nt, Human
cugggcgugguggcacacgccuguaaucccag

SEQ ID NO: 406821 - RNA, 32 nt, Human
cugggcgugguggcacauaccuguaaugccag

SEQ ID NO: 406822 - RNA, 32 nt, Human
cugggcgugguggcacaugccuguaaucccag

SEQ ID NO: 406823 - RNA, 32 nt, Human
cugggcgugguggcacgcgccuguaaucccag

SEQ ID NO: 406824 - RNA, 32 nt, Human
cugggcgugguggcacgugccuguaaucccag

SEQ ID NO: 406825 - RNA, 32 nt, Human
cugggcgugguggcaggcaccuguaaucccac

SEQ ID NO: 406826 - RNA, 32 nt, Human
cugggcgugguggcaggcaccuguaaucccag

SEQ ID NO: 406827 - RNA, 32 nt, Human
cugggcgugguggcgagcaccuguaaucucag

SEQ ID NO: 406828 - RNA, 32 nt, Human
cugggcgugguggcgcaugccuguaaucccag

SEQ ID NO: 406829 - RNA, 32 nt, Human
cugggcgugguggcgcaugccuguaauccuag

SEQ ID NO: 406830 - RNA, 32 nt, Human
cugggcgugguggcggacgccuguaaucccag

SEQ ID NO: 406831 - RNA, 32 nt, Human
cugggcgugguggcgggcaccuguaaucccag

SEQ ID NO: 406832 - RNA, 32 nt, Human
cugggcgugguggcgggcgccuguaaucccag

SEQ ID NO: 406833 - RNA, 32 nt, Human
cugggcgugguggcgugcaccuguaaucccag

SEQ ID NO: 406834 - RNA, 32 nt, Human
cugggcgugguggcgugugccuguaaucccag

SEQ ID NO: 406835 - RNA, 32 nt, Human
cugggcgugguggcucacaccuguaaucccag

SEQ ID NO: 406836 - RNA, 32 nt, Human
cugggcgugguggcucacaccuguaauuucag

SEQ ID NO: 406837 - RNA, 32 nt, Human
cugggcgugguggcucaccccuguaaucgcag

SEQ ID NO: 406838 - RNA, 32 nt, Human
cugggcgugguggcucacgccuguaaucccag

SEQ ID NO: 406839 - RNA, 32 nt, Human
cugggcgugguggcucacuccuguaaucccag

SEQ ID NO: 406840 - RNA, 32 nt, Human
cugggcgugguggcucaugccuguaaucccag

SEQ ID NO: 406841 - RNA, 32 nt, Human
cugggcgugguggcucaugccuguaaucccgg

SEQ ID NO: 406842 - RNA, 32 nt, Human
cugggcgugguggcucaugccuguaaucucag

SEQ ID NO: 406843 - RNA, 32 nt, Human
cugggcgugguggcucaugccuguagucccag

SEQ ID NO: 406844 - RNA, 32 nt, Human
cugggcgugguggcucaugccugugauccuag

SEQ ID NO: 406845 - RNA, 32 nt, Human
cugggcgugguggcucucgccuguaaucccag

SEQ ID NO: 406846 - RNA, 32 nt, Human
cugggcgugguggcuuaugccuguaaucccag

SEQ ID NO: 406847 - RNA, 32 nt, Human
cugggcguggugguacaugccuguaaucccag

SEQ ID NO: 406848 - RNA, 32 nt, Human
cugggcgugguggugagugccuguaaucccag

SEQ ID NO: 406849 - RNA, 32 nt, Human
cugggcgugguggugcacaccuguaaucucag

SEQ ID NO: 406850 - RNA, 32 nt, Human
cugggcgugguggugcaugccuguaaucccac

SEQ ID NO: 406851 - RNA, 32 nt, Human
cugggcgugguggugcaugccuguaaucccag

SEQ ID NO: 406852 - RNA, 32 nt, Human
cugggcgugguggugcaugccuguaaucccau

SEQ ID NO: 406853 - RNA, 32 nt, Human
cugggcgugguggugcgcaccuguaaucucag

SEQ ID NO: 406854 - RNA, 32 nt, Human
cugggcguggugguggauaccuguaaucccag

SEQ ID NO: 406855 - RNA, 32 nt, Human
cugggcgugguggugggcaccuguaaucccag

SEQ ID NO: 406856 - RNA, 32 nt, Human
cugggcguggugguggguaccuguaaucccag

SEQ ID NO: 406857 - RNA, 32 nt, Human
cugggcgugguggugggugccuguaaucccag

SEQ ID NO: 406858 - RNA, 32 nt, Human
cugggcguggugguuggcgccuguaaucccag

SEQ ID NO: 406859 - RNA, 32 nt, Human
cugggcguggugguuugcgccuguaaucccag

SEQ ID NO: 406860 - RNA, 32 nt, Human
cugggcgugguugcucacgccuguaaucccag

SEQ ID NO: 406861 - RNA, 32 nt, Human
cugggcguguuggcacacaccuguaaucccag

SEQ ID NO: 406862 - RNA, 32 nt, Human
cugggcguguuggcacgcgccuguaaucccag

SEQ ID NO: 406863 - RNA, 32 nt, Human
cugggcguuugcagaugguguagaagccagcc

SEQ ID NO: 406864 - RNA, 32 nt, Human
cugggcuaaccagcccacagagcucacauucc

SEQ ID NO: 406865 - RNA, 32 nt, Human
cugggcuacaguuacccuccuaccucggcuuc

SEQ ID NO: 406866 - RNA, 32 nt, Human
cugggcuagaccagauuugggggccaggaggg

SEQ ID NO: 406867 - RNA, 32 nt, Human
cugggcuaggaagaggaggugcagcccagacu

SEQ ID NO: 406868 - RNA, 32 nt, Human
cugggcuagggacgaggaaggagcagccacaa

SEQ ID NO: 406869 - RNA, 32 nt, Human
cugggcuagggagguggcuggagcuucugccc

SEQ ID NO: 406870 - RNA, 32 nt, Human
cugggcuauggcuccuuccugguuugggagcc

SEQ ID NO: 406871 - RNA, 32 nt, Human
cugggcuaugggaaguggggaugcagauggcc

SEQ ID NO: 406872 - RNA, 32 nt, Human
cugggcuauuggcugcucccaauccuugcccc

SEQ ID NO: 406873 - RNA, 32 nt, Human
cugggcucaaaugacccaccuaccucagccuc

SEQ ID NO: 406874 - RNA, 32 nt, Human
cugggcucaaaugauccucccaccucagccuc

SEQ ID NO: 406875 - RNA, 32 nt, Human
cugggcucaaaugauccuuccaccucagccuc

SEQ ID NO: 406876 - RNA, 32 nt, Human
cugggcucaacggauccuuccaccucagccuc

SEQ ID NO: 406877 - RNA, 32 nt, Human
cugggcucaagacauccuccugcuucagccuc

SEQ ID NO: 406878 - RNA, 32 nt, Human
cugggcucaagagauccucccacuucagccuc

SEQ ID NO: 406879 - RNA, 32 nt, Human
cugggcucaagagauugucccaccucagccua

SEQ ID NO: 406880 - RNA, 32 nt, Human
cugggcucaagcaacccucccaccucccaugc

SEQ ID NO: 406881 - RNA, 32 nt, Human
cugggcucaagcaacccucccaccuuagccuc

SEQ ID NO: 406882 - RNA, 32 nt, Human
cugggcucaagcaacccucccgccucccugcu

SEQ ID NO: 406883 - RNA, 32 nt, Human
cugggcucaagcaacccugccaccucagccuu

SEQ ID NO: 406884 - RNA, 32 nt, Human
cugggcucaagcaaucagcccaccucugccuc

SEQ ID NO: 406885 - RNA, 32 nt, Human
cugggcucaagcaauccacccaccucugccuc

SEQ ID NO: 406886 - RNA, 32 nt, Human
cugggcucaagcaauccaccugcuucagccuu

SEQ ID NO: 406887 - RNA, 32 nt, Human
cugggcucaagcaauccucacaccucagccuc

SEQ ID NO: 406888 - RNA, 32 nt, Human
cugggcucaagcaauccucccaccucagcccg

SEQ ID NO: 406889 - RNA, 32 nt, Human
cugggcucaagcaauccucccaccucagccua

SEQ ID NO: 406890 - RNA, 32 nt, Human
cugggcucaagcaauccucccaccucagccuc

SEQ ID NO: 406891 - RNA, 32 nt, Human
cugggcucaagcaauccucccaccucccagug

SEQ ID NO: 406892 - RNA, 32 nt, Human
cugggcucaagcaauccucccaccuuggccuc

SEQ ID NO: 406893 - RNA, 32 nt, Human
cugggcucaagcaauccucccaccuuggcuuc

SEQ ID NO: 406894 - RNA, 32 nt, Human
cugggcucaagcaauccucccaccuuggucuc

SEQ ID NO: 406895 - RNA, 32 nt, Human
cugggcucaagcaauccucccacuucagccuc

SEQ ID NO: 406896 - RNA, 32 nt, Human
cugggcucaagcaauccucccgcuucagccuc

SEQ ID NO: 406897 - RNA, 32 nt, Human
cugggcucaagcaauccucccuccucagccuc

SEQ ID NO: 406898 - RNA, 32 nt, Human
cugggcucaagcaauccuccugccucagccuc

SEQ ID NO: 406899 - RNA, 32 nt, Human
cugggcucaagcaauccuccugccucagccuu

SEQ ID NO: 406900 - RNA, 32 nt, Human
cugggcucaagcaauccuccugccucagcuuc

SEQ ID NO: 406901 - RNA, 32 nt, Human
cugggcucaagcaauccuccugccucggccuc

SEQ ID NO: 406902 - RNA, 32 nt, Human
cugggcucaagcaauccuccugccucggcuuc

SEQ ID NO: 406903 - RNA, 32 nt, Human
cugggcucaagcaauccucucaccgcagccuc

SEQ ID NO: 406904 - RNA, 32 nt, Human
cugggcucaagcaauccucucaccucagccuc

SEQ ID NO: 406905 - RNA, 32 nt, Human
cugggcucaagcaauccucucaucuccaccuc

SEQ ID NO: 406906 - RNA, 32 nt, Human
cugggcucaagcaaucugccagccucagccuc

SEQ ID NO: 406907 - RNA, 32 nt, Human
cugggcucaagcaaucugcccgccucugccuc

SEQ ID NO: 406908 - RNA, 32 nt, Human
cugggcucaagcaaucuucccaccucagccuc

SEQ ID NO: 406909 - RNA, 32 nt, Human
cugggcucaagcaauucacucgccucggccuc

SEQ ID NO: 406910 - RNA, 32 nt, Human
cugggcucaagcaauucaucugccucaaccuc

SEQ ID NO: 406911 - RNA, 32 nt, Human
cugggcucaagcaauucucaugucucagccuc

SEQ ID NO: 406912 - RNA, 32 nt, Human
cugggcucaagcaauucucccaccucagccuc

SEQ ID NO: 406913 - RNA, 32 nt, Human
cugggcucaagcaauucuuccaccucagccuc

SEQ ID NO: 406914 - RNA, 32 nt, Human
cugggcucaagcaauucuucugccucagccuc

SEQ ID NO: 406915 - RNA, 32 nt, Human
cugggcucaagcaauugucccuccucagccuc

SEQ ID NO: 406916 - RNA, 32 nt, Human
cugggcucaagcaauuuuccugccuugggccu

SEQ ID NO: 406917 - RNA, 32 nt, Human
cugggcucaagcacucugcccaccucagccuc

SEQ ID NO: 406918 - RNA, 32 nt, Human
cugggcucaagcagucaucccaccucagccuc

SEQ ID NO: 406919 - RNA, 32 nt, Human
cugggcucaagcaguccucccaccccagccuc

SEQ ID NO: 406920 - RNA, 32 nt, Human
cugggcucaagcaguccucccaccucagucuc

SEQ ID NO: 406921 - RNA, 32 nt, Human
cugggcucaagcaguccucccaccuuggccuc

SEQ ID NO: 406922 - RNA, 32 nt, Human
cugggcucaagcagucuacccaccucagccuc

SEQ ID NO: 406923 - RNA, 32 nt, Human
cugggcucaagcaguucucccaccucagccuc

SEQ ID NO: 406924 - RNA, 32 nt, Human
cugggcucaagccauccucccgccacagccuc

SEQ ID NO: 406925 - RNA, 32 nt, Human
cugggcucaagccauccucccuccucagccuc

SEQ ID NO: 406926 - RNA, 32 nt, Human
cugggcucaagccauccuccugccucagccuc

SEQ ID NO: 406927 - RNA, 32 nt, Human
cugggcucaagccuuccucccaccugaaccuc

SEQ ID NO: 406928 - RNA, 32 nt, Human
cugggcucaagcgagccucccaccucggucuu

SEQ ID NO: 406929 - RNA, 32 nt, Human
cugggcucaagcgauccuccacccucagccuc

SEQ ID NO: 406930 - RNA, 32 nt, Human
cugggcucaagcgauccucccaccucagccuc

SEQ ID NO: 406931 - RNA, 32 nt, Human
cugggcucaagcgauccucccaccucagcuuc

SEQ ID NO: 406932 - RNA, 32 nt, Human
cugggcucaagcgauccucccaucucagccuc

SEQ ID NO: 406933 - RNA, 32 nt, Human
cugggcucaagcgauccuccccgcucagccuc

SEQ ID NO: 406934 - RNA, 32 nt, Human
cugggcucaagcgauccucccuccucggccuc

SEQ ID NO: 406935 - RNA, 32 nt, Human
cugggcucaagcgauccucccuucuuggccuc

SEQ ID NO: 406936 - RNA, 32 nt, Human
cugggcucaagcgaucugcccaccucagucuc

SEQ ID NO: 406937 - RNA, 32 nt, Human
cugggcucaagggauccucccaucucagccuc

SEQ ID NO: 406938 - RNA, 32 nt, Human
cugggcucaagggauccucccaucucagcuuc

SEQ ID NO: 406939 - RNA, 32 nt, Human
cugggcucaagggauccugccaccucagcuaa

SEQ ID NO: 406940 - RNA, 32 nt, Human
cugggcucaaguaauccucccaccccagccuc

SEQ ID NO: 406941 - RNA, 32 nt, Human
cugggcucaaguaauccuccugccugagccuc

SEQ ID NO: 406942 - RNA, 32 nt, Human
cugggcucaagugaucaucccaccucagccuc

SEQ ID NO: 406943 - RNA, 32 nt, Human
cugggcucaagugauccucccaccucagccuc

SEQ ID NO: 406944 - RNA, 32 nt, Human
cugggcucaagugauccucccaccucagcuuc

SEQ ID NO: 406945 - RNA, 32 nt, Human
cugggcucaagugauccucccaccucugccuc

SEQ ID NO: 406946 - RNA, 32 nt, Human
cugggcucaagugauccucccacuucaccuuc

SEQ ID NO: 406947 - RNA, 32 nt, Human
cugggcucaagugauccucccgcuucagccuc

SEQ ID NO: 406948 - RNA, 32 nt, Human
cugggcucaagugauccucccuccucagccuc

SEQ ID NO: 406949 - RNA, 32 nt, Human
cugggcucaagugauccuccugccugggccug

SEQ ID NO: 406950 - RNA, 32 nt, Human
cugggcucaagugauccuuccaccucagccuc

SEQ ID NO: 406951 - RNA, 32 nt, Human
cugggcucaagugauucucccaccucagccuc

SEQ ID NO: 406952 - RNA, 32 nt, Human
cugggcucaagugauucucccaccuugaccuc

SEQ ID NO: 406953 - RNA, 32 nt, Human
cugggcucaagugcuucucccaccucagccuc

SEQ ID NO: 406954 - RNA, 32 nt, Human
cugggcucacacaauccuuccaccucagcauc

SEQ ID NO: 406955 - RNA, 32 nt, Human
cugggcucacaccauucuccugccucagccuc

SEQ ID NO: 406956 - RNA, 32 nt, Human
cugggcucacugcaaccuccgccucccugguu

SEQ ID NO: 406957 - RNA, 32 nt, Human
cugggcucacugcaaccuccuccuccuggauu

SEQ ID NO: 406958 - RNA, 32 nt, Human
cugggcucacugcaaccucugccucccggguu

SEQ ID NO: 406959 - RNA, 32 nt, Human
cugggcucagacggcuggcuucugccuacccg

SEQ ID NO: 406960 - RNA, 20 nt, Human
cugggcucagagccagccca

SEQ ID NO: 406961 - RNA, 32 nt, Human
cugggcucagaggcccccggucagccugccca

SEQ ID NO: 406962 - RNA, 32 nt, Human
cugggcucagaugguccuccugccucagcuuc

SEQ ID NO: 406963 - RNA, 26 nt, Human
cugggcucagcaugaguucagggagg

SEQ ID NO: 406964 - RNA, 32 nt, Human
cugggcucagccaagcucccacucaccucauc

SEQ ID NO: 406965 - RNA, 32 nt, Human
cugggcucagccacucccuccagucucaagua

SEQ ID NO: 406966 - RNA, 32 nt, Human
cugggcucaggcaauccuccugccucagccuc

SEQ ID NO: 406967 - RNA, 32 nt, Human
cugggcucaggcgcuucucccaccuuggccuc

SEQ ID NO: 406968 - RNA, 32 nt, Human
cugggcucagggagggagggcgguggacaaua

SEQ ID NO: 406969 - RNA, 32 nt, Human
cugggcucaggugauccucccgccugagccuc

SEQ ID NO: 406970 - RNA, 32 nt, Human
cugggcucaggugauucucccaucucagccuc

SEQ ID NO: 406971 - RNA, 32 nt, Human
cugggcucaugcaauccuccugccuuggccuc

SEQ ID NO: 406972 - RNA, 32 nt, Human
cugggcucaugcugggauugugcagugcuccu

SEQ ID NO: 406973 - RNA, 32 nt, Human
cugggcucaugugauccucccaccucagccuc

SEQ ID NO: 406974 - RNA, 32 nt, Human
cugggcucauucuucuuggcucaccaacccug

SEQ ID NO: 406975 - RNA, 32 nt, Human
cugggcucauugcaaccucugccucccggguu

SEQ ID NO: 406976 - RNA, 32 nt, Human
cugggcuccacuuggcuccucucacuucccag

SEQ ID NO: 406977 - RNA, 21 nt, Human
cugggcuccagagggcacuca

SEQ ID NO: 406978 - RNA, 22 nt, Human
cugggcuccagcagcaucagca

SEQ ID NO: 406979 - RNA, 32 nt, Human
cugggcuccagccauggaggguggacuggaga

SEQ ID NO: 406980 - RNA, 32 nt, Human
cugggcuccagccugggcgacagagugagagu

SEQ ID NO: 406981 - RNA, 32 nt, Human
cugggcuccaggaguggaggcuggucugggcu

SEQ ID NO: 406982 - RNA, 32 nt, Human
cugggcucccacacguccccaaaggagagcag

SEQ ID NO: 406983 - RNA, 21 nt, Human
cugggcucccaccucccgccu

SEQ ID NO: 406984 - RNA, 32 nt, Human
cugggcucccaccucccgccuuccgccgcucu

SEQ ID NO: 406985 - RNA, 32 nt, Human
cugggcucccagagagacccugaguuucaaau

SEQ ID NO: 406986 - RNA, 32 nt, Human
cugggcucccagcacgcucucuccccacaucg

SEQ ID NO: 406987 - RNA, 22 nt, Human
cugggcuccgaggccagcgcca

SEQ ID NO: 406988 - RNA, 32 nt, Human
cugggcuccugccccgccccuggcuagcagcg

SEQ ID NO: 406989 - RNA, 32 nt, Human
cugggcuccuggggcucagccuagugaacugc

SEQ ID NO: 406990 - RNA, 32 nt, Human
cugggcuccugggucuaguggggauuuguaga

SEQ ID NO: 406991 - RNA, 32 nt, Human
cugggcucgagcaauucucccaccucagccua

SEQ ID NO: 406992 - RNA, 32 nt, Human
cugggcucgggugauccucccaccucggccuc

SEQ ID NO: 406993 - RNA, 20 nt, Human
cugggcucuacucccugcag

SEQ ID NO: 406994 - RNA, 32 nt, Human
cugggcucuaggcugaggguccuugaacagac

SEQ ID NO: 406995 - RNA, 32 nt, Human
cugggcucucagggacccccugggucggcuuc

SEQ ID NO: 406996 - RNA, 32 nt, Human
cugggcucuccugaugccgcaggcugggccac

SEQ ID NO: 406997 - RNA, 19 nt, Human
cugggcucucuugggcuuu

SEQ ID NO: 406998 - RNA, 32 nt, Human
cugggcucugccugucuggugccuggaggugu

SEQ ID NO: 406999 - RNA, 32 nt, Human
cugggcucugcugcccuggaccccucuauuua

SEQ ID NO: 407000 - RNA, 32 nt, Human
cugggcucugcuuccuccgccugcugccugga

SEQ ID NO: 407001 - RNA, 32 nt, Human
cugggcucuggccucuacucucuccucccucu

SEQ ID NO: 407002 - RNA, 32 nt, Human
cugggcucugugggcucccccugggcucugug

SEQ ID NO: 407003 - RNA, 32 nt, Human
cugggcugagaacccagcgauaagggggcguu

SEQ ID NO: 407004 - RNA, 32 nt, Human
cugggcugcaccugcaagcucuaugccauucg

SEQ ID NO: 407005 - RNA, 32 nt, Human
cugggcugcagcuugggagagcuccaguaaca

SEQ ID NO: 407006 - RNA, 32 nt, Human
cugggcugcccaggggugugauguggagcugg

SEQ ID NO: 407007 - RNA, 31 nt, Human
cugggcugccucucuaggcuucgcuguucau

SEQ ID NO: 407008 - RNA, 31 nt, Human
cugggcugccucuucgcggggugucccgagc

SEQ ID NO: 407009 - RNA, 32 nt, Human
cugggcugccugggugagaugcuggggccugg

SEQ ID NO: 407010 - RNA, 32 nt, Human
cugggcugccuuguagagaugcagccugccca

SEQ ID NO: 407011 - RNA, 32 nt, Human
cugggcugcgcggccccagccugggcacccug

SEQ ID NO: 407012 - RNA, 32 nt, Human
cugggcugcugcauacugcuaaauggcaccuc

SEQ ID NO: 407013 - RNA, 18 nt, Human
cugggcugcuuggggcuu

SEQ ID NO: 407014 - RNA, 32 nt, Human
cugggcuggagcggcggcgccgccauguccga

SEQ ID NO: 407015 - RNA, 32 nt, Human
cugggcuggaggaggagcuggaagaggccgug

SEQ ID NO: 407016 - RNA, 32 nt, Human
cugggcuggagugagguggaaggauguuugcu

SEQ ID NO: 407017 - RNA, 32 nt, Human
cugggcuggagugcaguggcaugaucucagcu

SEQ ID NO: 407018 - RNA, 32 nt, Human
cugggcuggagugcaguggcccaagcuacgcu

SEQ ID NO: 407019 - RNA, 32 nt, Human
cugggcuggagugcaguggugcaaucaugguu

SEQ ID NO: 407020 - RNA, 32 nt, Human
cugggcuggagugcgauggcaugaucucggcu

SEQ ID NO: 407021 - RNA, 32 nt, Human
cugggcuggcauuggucacaccaggccuaaga

SEQ ID NO: 407022 - RNA, 32 nt, Human
cugggcuggcugcaggcugagcuaaagaggcg

SEQ ID NO: 407023 - RNA, 29 nt, Human
cugggcuggcugcugacgucccccucccu

SEQ ID NO: 407024 - RNA, 32 nt, Human
cugggcuggcuggaacuagccuaagacugaaa

SEQ ID NO: 407025 - RNA, 29 nt, Human
cugggcuggcuguguucauccccgcugca

SEQ ID NO: 407026 - RNA, 32 nt, Human
cugggcugggaacaggaaggggacuaaaaugc

SEQ ID NO: 407027 - RNA, 21 nt, Human
cugggcugggaaccagggagg

SEQ ID NO: 407028 - RNA, 32 nt, Human
cugggcugggaccccucugccuccagggcgcg

SEQ ID NO: 407029 - RNA, 32 nt, Human
cugggcugggagaaggguguuccaggccugug

SEQ ID NO: 407030 - RNA, 32 nt, Human
cugggcugggagaaggugcuugggcuucugcg

SEQ ID NO: 407031 - RNA, 31 nt, Human
cugggcugggagagaagauggggaagugugu

SEQ ID NO: 407032 - RNA, 32 nt, Human
cugggcugggagcaguggcucacaccuguaau

SEQ ID NO: 407033 - RNA, 21 nt, Human
cugggcugggccccagggagg

SEQ ID NO: 407034 - RNA, 32 nt, Human
cugggcugggcugcggaagcucugccugccaa

SEQ ID NO: 407035 - RNA, 32 nt, Human
cugggcugggcuggggcuaggagggcagcagg

SEQ ID NO: 407036 - RNA, 32 nt, Human
cugggcugggcugugaugaagcugagcagagu

SEQ ID NO: 407037 - RNA, 32 nt, Human
cugggcugggcugugguggggugggggacaac

SEQ ID NO: 407038 - RNA, 32 nt, Human
cugggcuggggaggggguagugacaguggcag

SEQ ID NO: 407039 - RNA, 32 nt, Human
cugggcugggggcagagagggagagccggucc

SEQ ID NO: 407040 - RNA, 32 nt, Human
cugggcugggggcgcaccacgugcucacagca

SEQ ID NO: 407041 - RNA, 32 nt, Human
cugggcuggguccucaacauugccaaggugcu

SEQ ID NO: 407042 - RNA, 31 nt, Human
cugggcuggguggagguguggcugggcuggg

SEQ ID NO: 407043 - RNA, 32 nt, Human
cugggcuguagugcacugugcugauccacuaa

SEQ ID NO: 407044 - RNA, 32 nt, Human
cugggcugucccugucccucugcuggggaccg

SEQ ID NO: 407045 - RNA, 32 nt, Human
cugggcugugagaauaguggugaauuugauua

SEQ ID NO: 407046 - RNA, 32 nt, Human
cugggcugugcguccacuggggacuggggaug

SEQ ID NO: 407047 - RNA, 32 nt, Human
cugggcugugcucuccccuguuuacccgaugu

SEQ ID NO: 407048 - RNA, 32 nt, Human
cugggcuguggaggugggcaugugggccccug

SEQ ID NO: 407049 - RNA, 32 nt, Human
cugggcuguggcucagagaccuggggguggag

SEQ ID NO: 407050 - RNA, 32 nt, Human
cugggcuguggcuucaagcuuuggaaacauga

SEQ ID NO: 407051 - RNA, 32 nt, Human
cugggcuguugguggagguuguacugugguac

SEQ ID NO: 407052 - RNA, 32 nt, Human
cugggcuuaagcagucuucccaccucagccuc

SEQ ID NO: 407053 - RNA, 32 nt, Human
cugggcuuaagggauccuucuaccucagccuc

SEQ ID NO: 407054 - RNA, 32 nt, Human
cugggcuuaagugacccucccaccucagucuc

SEQ ID NO: 407055 - RNA, 32 nt, Human
cugggcuuaagugauccucccaccucagucuc

SEQ ID NO: 407056 - RNA, 32 nt, Human
cugggcuuagggaaggagagaccuuauuccaa

SEQ ID NO: 407057 - RNA, 32 nt, Human
cugggcuuauacuagcuccugacuuaggaaga

SEQ ID NO: 407058 - RNA, 32 nt, Human
cugggcuuaugggauccuccugccucagcuuc

SEQ ID NO: 407059 - RNA, 32 nt, Human
cugggcuucaguuuucucaucuguaaaaucag

SEQ ID NO: 407060 - RNA, 32 nt, Human
cugggcuucauacuggccuuccucuacaaugg

SEQ ID NO: 407061 - RNA, 32 nt, Human
cugggcuucccagcucagucuauagcuagcau

SEQ ID NO: 407062 - RNA, 32 nt, Human
cugggcuucucaggcuagagggucugcacaug

SEQ ID NO: 407063 - RNA, 32 nt, Human
cugggcuucuuucuccccagagggcccucugc

SEQ ID NO: 407064 - RNA, 32 nt, Human
cugggcuuggaaggaaaacaccuuuccaaagc

SEQ ID NO: 407065 - RNA, 32 nt, Human
cugggcuuggagcugcucauggagaaagugcc

SEQ ID NO: 407066 - RNA, 32 nt, Human
cugggcuuggcgaggcugcagcgcggccaccg

SEQ ID NO: 407067 - RNA, 32 nt, Human
cugggcuuggcuuauggguacaacuuucagua

SEQ ID NO: 407068 - RNA, 32 nt, Human
cugggcuugguggcucacaccuguaauuccag

SEQ ID NO: 407069 - RNA, 32 nt, Human
cugggcuugguggcucacgccuguaaucccag

SEQ ID NO: 407070 - RNA, 32 nt, Human
cugggcuugguggcucaugccuauaauccuag

SEQ ID NO: 407071 - RNA, 32 nt, Human
cugggcuugguggcuggcgccuguaaucccag

SEQ ID NO: 407072 - RNA, 32 nt, Human
cugggcuuggugguucacaccuguaauccuag

SEQ ID NO: 407073 - RNA, 32 nt, Human
cugggcuugucuguucccuccugagccugagc

SEQ ID NO: 407074 - RNA, 32 nt, Human
cugggcuuuaaugcagaggccauguccuuguc

SEQ ID NO: 407075 - RNA, 32 nt, Human
cugggcuuucaccuugaagcauggucagcagc

SEQ ID NO: 407076 - RNA, 32 nt, Human
cugggcuuucacugcuacccauaucccagccc

SEQ ID NO: 407077 - RNA, 32 nt, Human
cugggcuuugagguagagguugggguuuauga

SEQ ID NO: 407078 - RNA, 32 nt, Human
cugggcuuugggaaguuugcugugcuuuggaa

SEQ ID NO: 407079 - RNA, 32 nt, Human
cuggggaaaggagagaccauggugugaaugua

SEQ ID NO: 407080 - RNA, 18 nt, Human
cuggggaacaacaccugg

SEQ ID NO: 407081 - RNA, 24 nt, Human
cuggggaacauaaugagacccauc

SEQ ID NO: 407082 - RNA, 32 nt, Human
cuggggaagaggacugugugagaggggcgccu

SEQ ID NO: 407083 - RNA, 32 nt, Human
cuggggaagcagcugcagcaggagggagacgg

SEQ ID NO: 407084 - RNA, 32 nt, Human
cuggggaagcaggucucaauucugaauagcca

SEQ ID NO: 407085 - RNA, 21 nt, Human
cuggggaaggaaaacaggcuc

SEQ ID NO: 407086 - RNA, 19 nt, Human
cuggggaaggacugcaaca

SEQ ID NO: 407087 - RNA, 32 nt, Human
cuggggaaggcaucuaacuaguagccugcuac

SEQ ID NO: 407088 - RNA, 32 nt, Human
cuggggaaggcaugugcuuggaggcagcccug

SEQ ID NO: 407089 - RNA, 32 nt, Human
cuggggaagggaggggagacuaugugugagcu

SEQ ID NO: 407090 - RNA, 32 nt, Human
cuggggaagggcccacugccaacucccucugc

SEQ ID NO: 407091 - RNA, 32 nt, Human
cuggggaagugggagggaugugaugcuggaga

SEQ ID NO: 407092 - RNA, 32 nt, Human
cuggggaaguuguguguugugcagucaguaaa

SEQ ID NO: 407093 - RNA, 32 nt, Human
cuggggaauguaacagugggguugugguuggu

SEQ ID NO: 407094 - RNA, 32 nt, Human
cuggggaauucugaggaggaaauaaauugcag

SEQ ID NO: 407095 - RNA, 32 nt, Human
cuggggaauugagacaagccucugccauaguu

SEQ ID NO: 407096 - RNA, 32 nt, Human
cuggggacacaacaaugacugaggcagccugg

SEQ ID NO: 407097 - RNA, 32 nt, Human
cuggggacacaccacucacacgcacagucacc

SEQ ID NO: 407098 - RNA, 32 nt, Human
cuggggacaccaggaucuucuuugugaacccu

SEQ ID NO: 407099 - RNA, 25 nt, Human
cuggggacacggacuucugcugcug

SEQ ID NO: 407100 - RNA, 32 nt, Human
cuggggacagaaguagagaaaacacuuguguc

SEQ ID NO: 407101 - RNA, 32 nt, Human
cuggggacaggaaggagcaggagcuaagcagg

SEQ ID NO: 407102 - RNA, 32 nt, Human
cuggggacaugcugagggccaugguggcuucu

SEQ ID NO: 407103 - RNA, 32 nt, Human
cuggggacaugguccauggugcaacccacagc

SEQ ID NO: 407104 - RNA, 32 nt, Human
cuggggaccacaguccugauguggacgcaggg

SEQ ID NO: 407105 - RNA, 32 nt, Human
cuggggaccagcacagcaccugaagccaugug

SEQ ID NO: 407106 - RNA, 32 nt, Human
cuggggaccaugggcuccaggaucaagcagaa

SEQ ID NO: 407107 - RNA, 32 nt, Human
cuggggacccacccuccuucccuuucugguug

SEQ ID NO: 407108 - RNA, 32 nt, Human
cuggggaccccaaccucagaggcagcuucaag

SEQ ID NO: 407109 - RNA, 32 nt, Human
cuggggaccgcagcagggcugcagucacaucc

SEQ ID NO: 407110 - RNA, 32 nt, Human
cuggggaccucagagauucucuccagcggcag

SEQ ID NO: 407111 - RNA, 32 nt, Human
cuggggaccuggcugaguuuuucccuugccug

SEQ ID NO: 407112 - RNA, 32 nt, Human
cuggggaccuguacacuagcaggaugggucuu

SEQ ID NO: 407113 - RNA, 32 nt, Human
cuggggacuccagauuuuccccaaacuugcuu

SEQ ID NO: 407114 - RNA, 19 nt, Human
cuggggacuccuggguuuu

SEQ ID NO: 407115 - RNA, 32 nt, Human
cuggggacucugcugucccugggcuugcaucc

SEQ ID NO: 407116 - RNA, 32 nt, Human
cuggggacugagcccccaggagggccagcaug

SEQ ID NO: 407117 - RNA, 18 nt, Human
cuggggacugcugagccc

SEQ ID NO: 407118 - RNA, 32 nt, Human
cuggggacuggaggggaacguggagcuccuuc

SEQ ID NO: 407119 - RNA, 32 nt, Human
cuggggacuggcauccuuccacugacuuugau

SEQ ID NO: 407120 - RNA, 32 nt, Human
cuggggagaaacaguagucaaagcuuucugaa

SEQ ID NO: 407121 - RNA, 32 nt, Human
cuggggagaacagcauucgagcugccgggugg

SEQ ID NO: 407122 - RNA, 32 nt, Human
cuggggagaagcaggaugggauugaugggcag

SEQ ID NO: 407123 - RNA, 32 nt, Human
cuggggagacgggguuucgccauguuugccag

SEQ ID NO: 407124 - RNA, 32 nt, Human
cuggggagagaagggugaccaggcgaggaggg

SEQ ID NO: 407125 - RNA, 32 nt, Human
cuggggagagguaggaaggaaccaggcccuca

SEQ ID NO: 407126 - RNA, 32 nt, Human
cuggggagagguggaggcugacagcugagacg

SEQ ID NO: 407127 - RNA, 32 nt, Human
cuggggagagugaaggagucagaaugccuuaa

SEQ ID NO: 407128 - RNA, 32 nt, Human
cuggggagauggaggcugcagugagcuauaau

SEQ ID NO: 407129 - RNA, 32 nt, Human
cuggggagcacucacuucacuugugugggugu

SEQ ID NO: 407130 - RNA, 32 nt, Human
cuggggagccagggauucagaacucacagugc

SEQ ID NO: 407131 - RNA, 32 nt, Human
cuggggagccagggcuaugggagcagcuuuuu

SEQ ID NO: 407132 - RNA, 19 nt, Human
cuggggagcccgggcgccg

SEQ ID NO: 407133 - RNA, 32 nt, Human
cuggggagccggaggcccugcccgacuccuug

SEQ ID NO: 407134 - RNA, 18 nt, Human
cuggggagccugggcccc

SEQ ID NO: 407135 - RNA, 19 nt, Human
cuggggagccuguccuucc

SEQ ID NO: 407136 - RNA, 25 nt, Human
cuggggagcguuggugaugcuguau

SEQ ID NO: 407137 - RNA, 32 nt, Human
cuggggagcuccaaggcugcagccaggagccc

SEQ ID NO: 407138 - RNA, 19 nt, Human
cuggggagcuccugggacc

SEQ ID NO: 407139 - RNA, 32 nt, Human
cuggggagcugcauccuuuugagcuggcugca

SEQ ID NO: 407140 - RNA, 32 nt, Human
cuggggaggaagaggaugagggccucgcuccu

SEQ ID NO: 407141 - RNA, 32 nt, Human
cuggggaggaagaggcuugggcugcagaugca

SEQ ID NO: 407142 - RNA, 32 nt, Human
cuggggaggaggaagcggacagaggaagcugu

SEQ ID NO: 407143 - RNA, 32 nt, Human
cuggggaggaggcggaggcagcggcuggagga

SEQ ID NO: 407144 - RNA, 32 nt, Human
cuggggaggaguccaccaaccuagccacaggg

SEQ ID NO: 407145 - RNA, 32 nt, Human
cuggggaggcagaggugacagugagcugagau

SEQ ID NO: 407146 - RNA, 24 nt, Human
cuggggaggcagagguugcaguga

SEQ ID NO: 407147 - RNA, 32 nt, Human
cuggggaggcagagguugcagugagacaagau

SEQ ID NO: 407148 - RNA, 32 nt, Human
cuggggaggcagagguugcaguggcccgagac

SEQ ID NO: 407149 - RNA, 32 nt, Human
cuggggaggcagaguccucgcguggucuccug

SEQ ID NO: 407150 - RNA, 31 nt, Human
cuggggaggcagcuagauaccaaaccauucu

SEQ ID NO: 407151 - RNA, 32 nt, Human
cuggggaggggcugcuggcaucaaguggguag

SEQ ID NO: 407152 - RNA, 32 nt, Human
cuggggaggggcugguaggagggagggugggc

SEQ ID NO: 407153 - RNA, 32 nt, Human
cuggggagguuagauguguguuucaggcuugg

SEQ ID NO: 407154 - RNA, 32 nt, Human
cuggggagguugggagcugagcuguucucauc

SEQ ID NO: 407155 - RNA, 32 nt, Human
cuggggagucucucaaugccagguugucaccc

SEQ ID NO: 407156 - RNA, 32 nt, Human
cuggggagucugcuggaggccugggauggagu

SEQ ID NO: 407157 - RNA, 32 nt, Human
cuggggagugugaggagaggguggcaucagga

SEQ ID NO: 407158 - RNA, 32 nt, Human
cuggggauaacaguguaacacauuugagaucu

SEQ ID NO: 407159 - RNA, 32 nt, Human
cuggggauaccugccugucaccucagggcauc

SEQ ID NO: 407160 - RNA, 32 nt, Human
cuggggaucaaauuucaacaugagguuugggu

SEQ ID NO: 407161 - RNA, 32 nt, Human
cuggggaucacagaaccugcagauuggaucgu

SEQ ID NO: 407162 - RNA, 32 nt, Human
cuggggaucaccccauuggcugaagaugagac

SEQ ID NO: 407163 - RNA, 32 nt, Human
cuggggaucagggucugggcucugucagccgc

SEQ ID NO: 407164 - RNA, 32 nt, Human
cuggggaucccaggaacccuggucaggugagg

SEQ ID NO: 407165 - RNA, 32 nt, Human
cuggggaucucgcucaccaccaccucccuccg

SEQ ID NO: 407166 - RNA, 32 nt, Human
cuggggaugaggaaauuaauaaagguacaguc

SEQ ID NO: 407167 - RNA, 26 nt, Human
cuggggaugcuuggucucuucugcug

SEQ ID NO: 407168 - RNA, 32 nt, Human
cuggggauggaugcucugaccacagcagcugu

SEQ ID NO: 407169 - RNA, 32 nt, Human
cuggggcaaaaauauaacucuagcuguauuuc

SEQ ID NO: 407170 - RNA, 32 nt, Human
cuggggcaaccaggacuuucucgggcacccaa

SEQ ID NO: 407171 - RNA, 32 nt, Human
cuggggcaacgccucguccugcagagggagcc

SEQ ID NO: 407172 - RNA, 32 nt, Human
cuggggcaaggaaggagccaggauggccuggg

SEQ ID NO: 407173 - RNA, 22 nt, Human
cuggggcacccuggcuggccag

SEQ ID NO: 407174 - RNA, 32 nt, Human
cuggggcacggcagcgucuaagccacaagccg

SEQ ID NO: 407175 - RNA, 20 nt, Human
cuggggcacucugcuggcua

SEQ ID NO: 407176 - RNA, 32 nt, Human
cuggggcacuggagccuggcccccaggacaug

SEQ ID NO: 407177 - RNA, 32 nt, Human
cuggggcacuggcugccuggcugccuccugga

SEQ ID NO: 407178 - RNA, 32 nt, Human
cuggggcagagcaucugugggguggggucuuc

SEQ ID NO: 407179 - RNA, 32 nt, Human
cuggggcagagccuggguggucagaggccggg

SEQ ID NO: 407180 - RNA, 32 nt, Human
cuggggcagagcuggaagaggaaaggucuugg

SEQ ID NO: 407181 - RNA, 32 nt, Human
cuggggcagaggaggaaagcaagaggacagac

SEQ ID NO: 407182 - RNA, 20 nt, Human
cuggggcagagggcgccuga

SEQ ID NO: 407183 - RNA, 32 nt, Human
cuggggcagagugagagcaggaccagcgggca

SEQ ID NO: 407184 - RNA, 31 nt, Human
cuggggcagaugucuccccugccacuccuca

SEQ ID NO: 407185 - RNA, 18 nt, Human
cuggggcagcagcagugg

SEQ ID NO: 407186 - RNA, 32 nt, Human
cuggggcagcaguggacacagagcaugagcgu

SEQ ID NO: 407187 - RNA, 21 nt, Human
cuggggcagccucugggccca

SEQ ID NO: 407188 - RNA, 32 nt, Human
cuggggcagccuggcucagguuuauugauuuu

SEQ ID NO: 407189 - RNA, 32 nt, Human
cuggggcagcucccagccucuucccaugcugg

SEQ ID NO: 407190 - RNA, 32 nt, Human
cuggggcagcuguccccaucaggccaagagcg

SEQ ID NO: 407191 - RNA, 32 nt, Human
cuggggcaggaaggccacugaggccagggaga

SEQ ID NO: 407192 - RNA, 24 nt, Human
cuggggcaggagaauggcaugaac

SEQ ID NO: 407193 - RNA, 23 nt, Human
cuggggcaggaggaucacuugag

SEQ ID NO: 407194 - RNA, 21 nt, Human
cuggggcaggaggaucgcuug

SEQ ID NO: 407195 - RNA, 32 nt, Human
cuggggcaggaggcagcucuucacguucaucc

SEQ ID NO: 407196 - RNA, 32 nt, Human
cuggggcaggcaggaggcagugggcuucaugg

SEQ ID NO: 407197 - RNA, 32 nt, Human
cuggggcaggcagggcagggucugugaagcuu

SEQ ID NO: 407198 - RNA, 32 nt, Human
cuggggcaggccucccucagggccaggggcga

SEQ ID NO: 407199 - RNA, 32 nt, Human
cuggggcagggacugugcugagugucugaggc

SEQ ID NO: 407200 - RNA, 32 nt, Human
cuggggcagggagccagguacagagcagauuu

SEQ ID NO: 407201 - RNA, 32 nt, Human
cuggggcagggccugaggcaagaggugggagg

SEQ ID NO: 407202 - RNA, 32 nt, Human
cuggggcagggggcagcuccucaaguggaacc

SEQ ID NO: 407203 - RNA, 32 nt, Human
cuggggcagguagaucacuugaggucaggaga

SEQ ID NO: 407204 - RNA, 32 nt, Human
cuggggcagguguggcaauggaccacagaaac

SEQ ID NO: 407205 - RNA, 32 nt, Human
cuggggcagugagggaaugggagcagcugugg

SEQ ID NO: 407206 - RNA, 32 nt, Human
cuggggcauccucaucccagggcucucugcug

SEQ ID NO: 407207 - RNA, 31 nt, Human
cuggggcaucuccuucuuaugccaaggggcg

SEQ ID NO: 407208 - RNA, 32 nt, Human
cuggggcaucuggcuggugccugcugccaugg

SEQ ID NO: 407209 - RNA, 32 nt, Human
cuggggcauggagcacgcugcccagcccuggc

SEQ ID NO: 407210 - RNA, 21 nt, Human
cuggggcaugggguaggggug

SEQ ID NO: 407211 - RNA, 20 nt, Human
cuggggccaaacuggagccc

SEQ ID NO: 407212 - RNA, 31 nt, Human
cuggggccaaggcaguauacauuccucugac

SEQ ID NO: 407213 - RNA, 20 nt, Human
cuggggccaaggggcagcag

SEQ ID NO: 407214 - RNA, 32 nt, Human
cuggggccaagugauccucccaccucagccuc

SEQ ID NO: 407215 - RNA, 19 nt, Human
cuggggccacagcccugcc

SEQ ID NO: 407216 - RNA, 32 nt, Human
cuggggccacccuuccuggaacucagagagga

SEQ ID NO: 407217 - RNA, 32 nt, Human
cuggggccaccugagccgcccgccucgucccc

SEQ ID NO: 407218 - RNA, 32 nt, Human
cuggggccaccugcaagccccauuccauuccu

SEQ ID NO: 407219 - RNA, 32 nt, Human
cuggggccaccuuugugcagcuucgaggacag

SEQ ID NO: 407220 - RNA, 32 nt, Human
cuggggccacugcucugccgcggagauaaguc

SEQ ID NO: 407221 - RNA, 32 nt, Human
cuggggccacugcucugcugcggagauaaguc

SEQ ID NO: 407222 - RNA, 32 nt, Human
cuggggccacugcugaccuggcuggaugcauc

SEQ ID NO: 407223 - RNA, 32 nt, Human
cuggggccagccagggcaggagaggugugaaa

SEQ ID NO: 407224 - RNA, 32 nt, Human
cuggggccagggacauccugugcagaagcucu

SEQ ID NO: 407225 - RNA, 32 nt, Human
cuggggccagggguagcugagcuuaaaggccc

SEQ ID NO: 407226 - RNA, 23 nt, Human
cuggggccagggguucagggagg

SEQ ID NO: 407227 - RNA, 32 nt, Human
cuggggccaguucuucuguuucaccuagaauu

SEQ ID NO: 407228 - RNA, 32 nt, Human
cuggggccaugaaggcagaagguuuagccucu

SEQ ID NO: 407229 - RNA, 32 nt, Human
cuggggccauugagcccagccuccagggcccg

SEQ ID NO: 407230 - RNA, 32 nt, Human
cuggggcccagagggaccuugagucagaaaug

SEQ ID NO: 407231 - RNA, 18 nt, Human
cuggggcccagccccaaa

SEQ ID NO: 407232 - RNA, 32 nt, Human
cuggggcccagccugccugccgcaccccugug

SEQ ID NO: 407233 - RNA, 32 nt, Human
cuggggcccaggaaguggggaagaguagguuc

SEQ ID NO: 407234 - RNA, 32 nt, Human
cuggggcccaggagacacggucccaggcacug

SEQ ID NO: 407235 - RNA, 32 nt, Human
cuggggcccaggaggaucugggcugguuuguc

SEQ ID NO: 407236 - RNA, 32 nt, Human
cuggggccccugcggccucuggccccagacug

SEQ ID NO: 407237 - RNA, 18 nt, Human
cuggggcccgggcugcgc

SEQ ID NO: 407238 - RNA, 32 nt, Human
cuggggcccggguguccuccuguggucugaug

SEQ ID NO: 407239 - RNA, 32 nt, Human
cuggggcccucacccuccucuguggucaagau

SEQ ID NO: 407240 - RNA, 23 nt, Human
cuggggcccucccacucuccaca

SEQ ID NO: 407241 - RNA, 32 nt, Human
cuggggcccuggacucugccuuagcucccacc

SEQ ID NO: 407242 - RNA, 32 nt, Human
cuggggcccuggaggaaggagaggucucugag

SEQ ID NO: 407243 - RNA, 22 nt, Human
cuggggcccuguagccaaaagg

SEQ ID NO: 407244 - RNA, 32 nt, Human
cuggggccgacgggcggcaggaaggggcucgg

SEQ ID NO: 407245 - RNA, 18 nt, Human
cuggggccgccagugcgc

SEQ ID NO: 407246 - RNA, 32 nt, Human
cuggggccggaggcggggugugagugggugug

SEQ ID NO: 407247 - RNA, 32 nt, Human
cuggggccucacuuccccuccucccccuuccc

SEQ ID NO: 407248 - RNA, 32 nt, Human
cuggggccuccagccccucacacugcuguucc

SEQ ID NO: 407249 - RNA, 32 nt, Human
cuggggccucccaagagacacagagaugcggg

SEQ ID NO: 407250 - RNA, 32 nt, Human
cuggggccucggauaccugcugcccagagcag

SEQ ID NO: 407251 - RNA, 32 nt, Human
cuggggccucuccuguugaauggcuaggcacc

SEQ ID NO: 407252 - RNA, 32 nt, Human
cuggggccugaggcagggagaaugagaggcca

SEQ ID NO: 407253 - RNA, 32 nt, Human
cuggggccugcagggugccaggaucugggaga

SEQ ID NO: 407254 - RNA, 32 nt, Human
cuggggccugcauaagaaaacuuaucucauua

SEQ ID NO: 407255 - RNA, 21 nt, Human
cuggggccugccgccccggga

SEQ ID NO: 407256 - RNA, 32 nt, Human
cuggggccugcucuucucuggcagaguggccc

SEQ ID NO: 407257 - RNA, 32 nt, Human
cuggggccugcugacugcccagucccggcuuc

SEQ ID NO: 407258 - RNA, 18 nt, Human
cuggggccugggauccuu

SEQ ID NO: 407259 - RNA, 32 nt, Human
cuggggccugugaauaaagcugcagaaccccc

SEQ ID NO: 407260 - RNA, 20 nt, Human
cuggggccugugucagccgc

SEQ ID NO: 407261 - RNA, 32 nt, Human
cuggggccuuccuggcucuggcccagaaagug

SEQ ID NO: 407262 - RNA, 32 nt, Human
cuggggccuucgcaagucugauguuccaggac

SEQ ID NO: 407263 - RNA, 32 nt, Human
cuggggccuuucuucuccuuguaggggucucu

SEQ ID NO: 407264 - RNA, 32 nt, Human
cuggggcgaacagaacuucuuccucccaaaca

SEQ ID NO: 407265 - RNA, 25 nt, Human
cuggggcgaacgagguucagggagg

SEQ ID NO: 407266 - RNA, 32 nt, Human
cuggggcgauguuugcagucaagaccauucuu

SEQ ID NO: 407267 - RNA, 32 nt, Human
cuggggcgcaugaaggugggggugaugccgaa

SEQ ID NO: 407268 - RNA, 32 nt, Human
cuggggcgccgagcggacaggaacgcagcacg

SEQ ID NO: 407269 - RNA, 32 nt, Human
cuggggcgcuacaguaccuggagcugggcagu

SEQ ID NO: 407270 - RNA, 22 nt, Human
cuggggcgcugcuccccacagu

SEQ ID NO: 407271 - RNA, 20 nt, Human
cuggggcggccacgcacucc

SEQ ID NO: 407272 - RNA, 32 nt, Human
cuggggcggcggugcuggagguugcggcggcg

SEQ ID NO: 407273 - RNA, 32 nt, Human
cuggggcggggacuucugucugccuguacuuc

SEQ ID NO: 407274 - RNA, 32 nt, Human
cuggggcggggacuucugucugccugugcucc

SEQ ID NO: 407275 - RNA, 32 nt, Human
cuggggcgggguggucaggagacagauucuag

SEQ ID NO: 407276 - RNA, 32 nt, Human
cuggggcuacagcugcugcugccucuucuaau

SEQ ID NO: 407277 - RNA, 32 nt, Human
cuggggcuacagcuucugccuccucaccuggc

SEQ ID NO: 407278 - RNA, 32 nt, Human
cuggggcuacuggugucagccuggugguagug

SEQ ID NO: 407279 - RNA, 32 nt, Human
cuggggcuagagguggaggaggcaguccuggg

SEQ ID NO: 407280 - RNA, 32 nt, Human
cuggggcuagggucacagccccuaacucauaa

SEQ ID NO: 407281 - RNA, 32 nt, Human
cuggggcuaucccuuuuuaggcccuuaccaug

SEQ ID NO: 407282 - RNA, 23 nt, Human
cuggggcucagaccccuguggga

SEQ ID NO: 407283 - RNA, 20 nt, Human
cuggggcucagcccugagcu

SEQ ID NO: 407284 - RNA, 21 nt, Human
cuggggcucagcucugagcua

SEQ ID NO: 407285 - RNA, 32 nt, Human
cuggggcucaggcuggugugggaugcagccgg

SEQ ID NO: 407286 - RNA, 32 nt, Human
cuggggcuccaacuggguacagccugggugca

SEQ ID NO: 407287 - RNA, 32 nt, Human
cuggggcuccaaugcagcgagcugugcccgag

SEQ ID NO: 407288 - RNA, 32 nt, Human
cuggggcuccccucugagcggcugcggcuccu

SEQ ID NO: 407289 - RNA, 18 nt, Human
cuggggcucccugaguca

SEQ ID NO: 407290 - RNA, 31 nt, Human
cuggggcuccucucugggucccugcucuuuc

SEQ ID NO: 407291 - RNA, 18 nt, Human
cuggggcuccugggauuu

SEQ ID NO: 407292 - RNA, 18 nt, Human
cuggggcucggggccccu

SEQ ID NO: 407293 - RNA, 32 nt, Human
cuggggcucucaccuccacauguggguagaag

SEQ ID NO: 407294 - RNA, 32 nt, Human
cuggggcugacacccaggcccgagcgccugcg

SEQ ID NO: 407295 - RNA, 32 nt, Human
cuggggcugagcuggagguggggaugagagca

SEQ ID NO: 407296 - RNA, 32 nt, Human
cuggggcugagguugggggaggggugggcggc

SEQ ID NO: 407297 - RNA, 32 nt, Human
cuggggcugauguuccagccucguggcguggg

SEQ ID NO: 407298 - RNA, 32 nt, Human
cuggggcugcaagcugcugaagccagggcaug

SEQ ID NO: 407299 - RNA, 18 nt, Human
cuggggcugcaccacaca

SEQ ID NO: 407300 - RNA, 32 nt, Human
cuggggcugccaggaacugcccuucagaaccu

SEQ ID NO: 407301 - RNA, 32 nt, Human
cuggggcugcuccccuaacccuacuuugcuuc

SEQ ID NO: 407302 - RNA, 32 nt, Human
cuggggcuggaaaccauccaucaaggucucua

SEQ ID NO: 407303 - RNA, 32 nt, Human
cuggggcuggcgccuccuccagccuggcaucu

SEQ ID NO: 407304 - RNA, 32 nt, Human
cuggggcugggcagagaggguaagcugaucuc

SEQ ID NO: 407305 - RNA, 32 nt, Human
cuggggcugugggcaggggaccugugugcccc

SEQ ID NO: 407306 - RNA, 32 nt, Human
cuggggcuuagauuucucaggucaugcugccu

SEQ ID NO: 407307 - RNA, 32 nt, Human
cuggggcuucauguguggccugcagucauguu

SEQ ID NO: 407308 - RNA, 32 nt, Human
cuggggcuucugcuuuggccagaccugggcca

SEQ ID NO: 407309 - RNA, 32 nt, Human
cuggggcuucuugggccugagaucuugagaga

SEQ ID NO: 407310 - RNA, 32 nt, Human
cugggggaaaccagcuucuugccagccacagc

SEQ ID NO: 407311 - RNA, 32 nt, Human
cugggggaacagagacuggagauguuugugaa

SEQ ID NO: 407312 - RNA, 32 nt, Human
cugggggaacugcugucccauuuuccacagca

SEQ ID NO: 407313 - RNA, 32 nt, Human
cugggggaagaggaggaggagggccgaucguc

SEQ ID NO: 407314 - RNA, 32 nt, Human
cugggggaagcucggggagaccagguggacug

SEQ ID NO: 407315 - RNA, 32 nt, Human
cugggggaaugguauuccaaguggagggaaca

SEQ ID NO: 407316 - RNA, 32 nt, Human
cugggggacaagcagaaguggaagagaucuuu

SEQ ID NO: 407317 - RNA, 32 nt, Human
cugggggacugaggcugcagugagccaugauu

SEQ ID NO: 407318 - RNA, 32 nt, Human
cugggggagacguuucugccacccugggugau

SEQ ID NO: 407319 - RNA, 32 nt, Human
cugggggagaggaguguggaaggguuggggga

SEQ ID NO: 407320 - RNA, 32 nt, Human
cugggggagagggaagguacagagagcggcaa

SEQ ID NO: 407321 - RNA, 32 nt, Human
cugggggagaggggcgggcgccgcgcugccuu

SEQ ID NO: 407322 - RNA, 32 nt, Human
cugggggagaggguugccagggagacucagcu

SEQ ID NO: 407323 - RNA, 32 nt, Human
cugggggagaugcuguccauguuucuaggggu

SEQ ID NO: 407324 - RNA, 32 nt, Human
cugggggagauggcggggaaagaggcaaggag

SEQ ID NO: 407325 - RNA, 32 nt, Human
cugggggagcagccuggacugcagcucucaga

SEQ ID NO: 407326 - RNA, 32 nt, Human
cugggggagcagcugagggaaagggaauuuaa

SEQ ID NO: 407327 - RNA, 32 nt, Human
cugggggagccaccccucggccauucccucca

SEQ ID NO: 407328 - RNA, 19 nt, Human
cugggggagcggggcgcgg

SEQ ID NO: 407329 - RNA, 32 nt, Human
cugggggaggaggagagaaggaaggggugggg

SEQ ID NO: 407330 - RNA, 32 nt, Human
cugggggaggcaggaagcuccucagauuuucu

SEQ ID NO: 407331 - RNA, 32 nt, Human
cugggggaggcaguggcggcuggaguagguag

SEQ ID NO: 407332 - RNA, 32 nt, Human
cugggggaggcccucugugaaugggucucucc

SEQ ID NO: 407333 - RNA, 32 nt, Human
cugggggaggcugagggugagggaacagccug

SEQ ID NO: 407334 - RNA, 32 nt, Human
cugggggaggggaagggugggucuagacauac

SEQ ID NO: 407335 - RNA, 32 nt, Human
cugggggaggggccuggucacugugaacacau

SEQ ID NO: 407336 - RNA, 32 nt, Human
cugggggaggggcgggggucaccauggccgag

SEQ ID NO: 407337 - RNA, 21 nt, Human
cugggggaggguucagggcag

SEQ ID NO: 407338 - RNA, 32 nt, Human
cugggggauccuggcaucuuuacuggacugga

SEQ ID NO: 407339 - RNA, 32 nt, Human
cugggggauuccuagaagcccuucccagacag

SEQ ID NO: 407340 - RNA, 32 nt, Human
cugggggcacacacaugcaggcggcguggucu

SEQ ID NO: 407341 - RNA, 32 nt, Human
cugggggcagccacccucccgccugucggccc

SEQ ID NO: 407342 - RNA, 32 nt, Human
cugggggcagccagggucgcagugagcccggg

SEQ ID NO: 407343 - RNA, 32 nt, Human
cugggggcagcccuuccccugccuaguccccg

SEQ ID NO: 407344 - RNA, 21 nt, Human
cugggggcagccucuguggga

SEQ ID NO: 407345 - RNA, 21 nt, Human
cugggggcagccugccugcug

SEQ ID NO: 407346 - RNA, 32 nt, Human
cugggggcaggagggcccuaccugauuggugc

SEQ ID NO: 407347 - RNA, 32 nt, Human
cugggggcagggcagcacagggaauauuuuug

SEQ ID NO: 407348 - RNA, 32 nt, Human
cugggggcagggcaggggaggucuggauguga

SEQ ID NO: 407349 - RNA, 32 nt, Human
cugggggcaggguggaguggagggggagcuac

SEQ ID NO: 407350 - RNA, 32 nt, Human
cugggggcaguggcaggagccuuacuuuuguc

SEQ ID NO: 407351 - RNA, 22 nt, Human
cugggggcaugucucuugcugu

SEQ ID NO: 407352 - RNA, 32 nt, Human
cugggggccacagccucugcaugggcccagag

SEQ ID NO: 407353 - RNA, 32 nt, Human
cugggggccacuucuuggccaggucaaaguau

SEQ ID NO: 407354 - RNA, 32 nt, Human
cugggggccaggcuggaggcagggauggggac

SEQ ID NO: 407355 - RNA, 20 nt, Human
cugggggccagggagcagca

SEQ ID NO: 407356 - RNA, 23 nt, Human
cugggggcccagcagagccugcu

SEQ ID NO: 407357 - RNA, 22 nt, Human
cugggggcccagccugccuuug

SEQ ID NO: 407358 - RNA, 21 nt, Human
cugggggcccagcuccggugc

SEQ ID NO: 407359 - RNA, 32 nt, Human
cugggggcccaggauguagauauuguacaaag

SEQ ID NO: 407360 - RNA, 21 nt, Human
cugggggcccgcgggcuggug

SEQ ID NO: 407361 - RNA, 23 nt, Human
cugggggcccggacggcugcugc

SEQ ID NO: 407362 - RNA, 28 nt, Human
cugggggcccuacugcuuccuggugcug

SEQ ID NO: 407363 - RNA, 32 nt, Human
cugggggcccucaggacuaggacagggugagc

SEQ ID NO: 407364 - RNA, 21 nt, Human
cugggggcccuggguacgcug

SEQ ID NO: 407365 - RNA, 25 nt, Human
cugggggcccuguaggcugcuguug

SEQ ID NO: 407366 - RNA, 32 nt, Human
cugggggccgaguccuugaauguggcuucagg

SEQ ID NO: 407367 - RNA, 32 nt, Human
cugggggccgugucccuguccaggccucagag

SEQ ID NO: 407368 - RNA, 32 nt, Human
cugggggccucccagccccggagccucauaga

SEQ ID NO: 407369 - RNA, 32 nt, Human
cugggggccuggaagcugcgagggcccaguga

SEQ ID NO: 407370 - RNA, 32 nt, Human
cugggggccuugagugaaaggcagcaguggga

SEQ ID NO: 407371 - RNA, 32 nt, Human
cugggggcgagcagccuaccagaugucgauuu

SEQ ID NO: 407372 - RNA, 32 nt, Human
cugggggcgagcccuggcgggggccagguccg

SEQ ID NO: 407373 - RNA, 32 nt, Human
cugggggcgcgcccuggauagacagagaagaa

SEQ ID NO: 407374 - RNA, 32 nt, Human
cugggggcggggcaggggcagguguagccucu

SEQ ID NO: 407375 - RNA, 23 nt, Human
cugggggcggugggagccccgcg

SEQ ID NO: 407376 - RNA, 32 nt, Human
cugggggcgugcagcugggcccaggggcugug

SEQ ID NO: 407377 - RNA, 32 nt, Human
cugggggcuagcaguccacugagaacuucaug

SEQ ID NO: 407378 - RNA, 32 nt, Human
cugggggcuccggagagcagcaggaagcacuc

SEQ ID NO: 407379 - RNA, 32 nt, Human
cugggggcucucugggguggucucagcucagu

SEQ ID NO: 407380 - RNA, 21 nt, Human
cugggggcugaggagcagcag

SEQ ID NO: 407381 - RNA, 22 nt, Human
cugggggcugcagccugcucug

SEQ ID NO: 407382 - RNA, 24 nt, Human
cugggggcugccacuugcuggcug

SEQ ID NO: 407383 - RNA, 27 nt, Human
cugggggcugccagucuccuguagcug

SEQ ID NO: 407384 - RNA, 32 nt, Human
cugggggcugccgagccaccaugcuugccuga

SEQ ID NO: 407385 - RNA, 32 nt, Human
cugggggcuggaaguccaagaucaagguguua

SEQ ID NO: 407386 - RNA, 32 nt, Human
cugggggcuggccucagucucugucccaucgc

SEQ ID NO: 407387 - RNA, 32 nt, Human
  misc_feature (31)..(31): n is a, c, g or u
cugggggcugggaaggagaggccgacccaung

SEQ ID NO: 407388 - RNA, 32 nt, Human
cugggggcugggacuaaagaaauggguguccc

SEQ ID NO: 407389 - RNA, 32 nt, Human
cugggggcuucucaggauuccacagcccaaau

SEQ ID NO: 407390 - RNA, 19 nt, Human
cuggggggccugcugggca

SEQ ID NO: 407391 - RNA, 18 nt, Human
cuggggggcucucaggga

SEQ ID NO: 407392 - RNA, 22 nt, Human
cugggggguauaaauccgggua

SEQ ID NO: 407393 - RNA, 32 nt, Human
cuggggguaaagcccucagaucccaggguaca

SEQ ID NO: 407394 - RNA, 32 nt, Human
cuggggguagaccgggccucaccagcuuccug

SEQ ID NO: 407395 - RNA, 23 nt, Human
cuggggguagacgggcucgaaug

SEQ ID NO: 407396 - RNA, 32 nt, Human
cuggggguagggagaugaagagccaagaugcu

SEQ ID NO: 407397 - RNA, 32 nt, Human
cuggggguaggguggggguggggagaacacuu

SEQ ID NO: 407398 - RNA, 22 nt, Human
cuggggguccgcugccugcugc

SEQ ID NO: 407399 - RNA, 32 nt, Human
cuggggguccuggacgccgccucggcaucccc

SEQ ID NO: 407400 - RNA, 23 nt, Human
cugggggucucagcccacugcug

SEQ ID NO: 407401 - RNA, 32 nt, Human
cugggggucugcaggucacugcagaggagcgg

SEQ ID NO: 407402 - RNA, 32 nt, Human
cugggggugagcacacagcaaaacgggguggg

SEQ ID NO: 407403 - RNA, 32 nt, Human
cugggggugagggagaaggaggagagagccca

SEQ ID NO: 407404 - RNA, 32 nt, Human
cuggggguggacaucugaccccaagggggcug

SEQ ID NO: 407405 - RNA, 32 nt, Human
cuggggguggcgcgcggccaggagcacgcaug

SEQ ID NO: 407406 - RNA, 32 nt, Human
cuggggguggcggcacgguccgggaggugguc

SEQ ID NO: 407407 - RNA, 32 nt, Human
cugggggugggggcggggacagaggaaggaaa

SEQ ID NO: 407408 - RNA, 32 nt, Human
cugggggugggguggaaaaugcuggccaucug

SEQ ID NO: 407409 - RNA, 32 nt, Human
cugggggugggguggggucauggguuuuguug

SEQ ID NO: 407410 - RNA, 32 nt, Human
cugggggugguagcacauaccuguaaucccag

SEQ ID NO: 407411 - RNA, 25 nt, Human
cuggggguucuuucuuccucugcug

SEQ ID NO: 407412 - RNA, 32 nt, Human
cuggggguugggggcugugucucuccaucccu

SEQ ID NO: 407413 - RNA, 32 nt, Human
cuggggguuggggguggugggggucggggccu

SEQ ID NO: 407414 - RNA, 32 nt, Human
cuggggguuuaagcucugccccuuccccauga

SEQ ID NO: 407415 - RNA, 32 nt, Human
cugggguaaaaaggaugaaaguuugagaaugc

SEQ ID NO: 407416 - RNA, 32 nt, Human
cugggguacagguuuggggagggggaagagaa

SEQ ID NO: 407417 - RNA, 32 nt, Human
cugggguagcacauagaaggcacauggcucag

SEQ ID NO: 407418 - RNA, 22 nt, Human
cugggguagcuccugccugcuc

SEQ ID NO: 407419 - RNA, 32 nt, Human
cugggguagggagacaggaaguagcaagcuuc

SEQ ID NO: 407420 - RNA, 32 nt, Human
cugggguagggagcagggcugggcaggcauuc

SEQ ID NO: 407421 - RNA, 32 nt, Human
cugggguagggaggaagagggugccggggaag

SEQ ID NO: 407422 - RNA, 32 nt, Human
cugggguagggugggggcgugcgagguuggau

SEQ ID NO: 407423 - RNA, 32 nt, Human
cugggguauauucaggcucauccacgcagcug

SEQ ID NO: 407424 - RNA, 32 nt, Human
cuggggucaagaaggaaaaugugugugagcau

SEQ ID NO: 407425 - RNA, 21 nt, Human
cuggggucaccuguguccuuu

SEQ ID NO: 407426 - RNA, 21 nt, Human
cuggggucagacugugccccg

SEQ ID NO: 407427 - RNA, 32 nt, Human
cuggggucagagaacccccaccaggaggguga

SEQ ID NO: 407428 - RNA, 25 nt, Human
cuggggucagcagaguucaaaacga

SEQ ID NO: 407429 - RNA, 24 nt, Human
cuggggucaggaaccucagaggag

SEQ ID NO: 407430 - RNA, 24 nt, Human
cuggggucaggaauauuugcaaga

SEQ ID NO: 407431 - RNA, 32 nt, Human
cuggggucaggaggaggcuggcuguagguaaa

SEQ ID NO: 407432 - RNA, 32 nt, Human
cuggggucaggaguucaaaaccagccuggcca

SEQ ID NO: 407433 - RNA, 21 nt, Human
cuggggucaggaguucaagac

SEQ ID NO: 407434 - RNA, 32 nt, Human
cuggggucaggaguucaagaccagccugccca

SEQ ID NO: 407435 - RNA, 32 nt, Human
cuggggucaggaguucgagaccagccugacca

SEQ ID NO: 407436 - RNA, 32 nt, Human
cuggggucaggaguuugagaccagccuggcca

SEQ ID NO: 407437 - RNA, 32 nt, Human
cuggggucaggauuucgagaccagccuggcca

SEQ ID NO: 407438 - RNA, 31 nt, Human
cuggggucagugagagaaaugggaaugguag

SEQ ID NO: 407439 - RNA, 32 nt, Human
cugggguccagcgcugcccccaccucaacucc

SEQ ID NO: 407440 - RNA, 32 nt, Human
cugggguccucauccuccuuguuggucuacuc

SEQ ID NO: 407441 - RNA, 32 nt, Human
cugggguccuccuauucuuuagguuuaauuuu

SEQ ID NO: 407442 - RNA, 32 nt, Human
cugggguccugccucuuucacuugcugaucug

SEQ ID NO: 407443 - RNA, 32 nt, Human
cugggguccuugagacagaggcaggacccucg

SEQ ID NO: 407444 - RNA, 32 nt, Human
cuggggucgccugggccacaggcacagcagcu

SEQ ID NO: 407445 - RNA, 32 nt, Human
cuggggucggggccagugcucuucucggagcu

SEQ ID NO: 407446 - RNA, 32 nt, Human
cuggggucucugagcaguggggagcgggggcu

SEQ ID NO: 407447 - RNA, 32 nt, Human
cuggggucucugcugcauuugugucaucuugu

SEQ ID NO: 407448 - RNA, 32 nt, Human
cuggggucucuuccucuccaggccuugccguc

SEQ ID NO: 407449 - RNA, 32 nt, Human
cuggggucuggcacagaggaggagcucucaaa

SEQ ID NO: 407450 - RNA, 32 nt, Human
cuggggucuggcuaccgcuaggaggcugagca

SEQ ID NO: 407451 - RNA, 32 nt, Human
cuggggugaaggccacugagagccagcaagug

SEQ ID NO: 407452 - RNA, 32 nt, Human
cuggggugagccacagacuacuguagacacgg

SEQ ID NO: 407453 - RNA, 22 nt, Human
cuggggugagggaguuagggag

SEQ ID NO: 407454 - RNA, 32 nt, Human
cuggggugaggguggcacccaggcagcugcau

SEQ ID NO: 407455 - RNA, 32 nt, Human
cuggggugagguggggagggaggcugcagggg

SEQ ID NO: 407456 - RNA, 32 nt, Human
cuggggugccuguagucccagcuacucgggag

SEQ ID NO: 407457 - RNA, 32 nt, Human
cugggguggaaccugguauggagggauuaacu

SEQ ID NO: 407458 - RNA, 32 nt, Human
cugggguggaaguaucuccugaggucaggagu

SEQ ID NO: 407459 - RNA, 32 nt, Human
cugggguggaagugggguaggggaagaggagg

SEQ ID NO: 407460 - RNA, 32 nt, Human
cugggguggcagagggcgagaggcucugugcu

SEQ ID NO: 407461 - RNA, 32 nt, Human
cugggguggccacugcagcaccugccacugcc

SEQ ID NO: 407462 - RNA, 32 nt, Human
cugggguggccccuccuguccucagggaucag

SEQ ID NO: 407463 - RNA, 32 nt, Human
cugggguggccuggcccuccuggcuguugcga

SEQ ID NO: 407464 - RNA, 32 nt, Human
cugggguggcuaggcaggaguggcguggggcc

SEQ ID NO: 407465 - RNA, 20 nt, Human
cuggggugggagaaggaagc

SEQ ID NO: 407466 - RNA, 32 nt, Human
cuggggugggagaaggaagcaggacagagcug

SEQ ID NO: 407467 - RNA, 20 nt, Human
cuggggugggaugaggaggc

SEQ ID NO: 407468 - RNA, 32 nt, Human
cuggggugggcgacagacaggagggcucccug

SEQ ID NO: 407469 - RNA, 32 nt, Human
cugggguggguauaccuggggcuggucuuagg

SEQ ID NO: 407470 - RNA, 31 nt, Human
cugggguggguggaaggggcaggaggguggc

SEQ ID NO: 407471 - RNA, 32 nt, Human
cugggguggugacagugccuggagaaugggug

SEQ ID NO: 407472 - RNA, 32 nt, Human
cuggggugucaccaagcaaggcuaccgcuguc

SEQ ID NO: 407473 - RNA, 32 nt, Human
cuggggugugaggacucugugcacaccuuaga

SEQ ID NO: 407474 - RNA, 32 nt, Human
cugggguucucugugugcaaagcuguccuuuu

SEQ ID NO: 407475 - RNA, 32 nt, Human
cugggguucuguuucaagcucagugcacaccu

SEQ ID NO: 407476 - RNA, 32 nt, Human
cugggguugcaaagucacuggccacauccagc

SEQ ID NO: 407477 - RNA, 32 nt, Human
cugggguuggccuccaucaccuccaggugaug

SEQ ID NO: 407478 - RNA, 32 nt, Human
cugggguugggagcuugggcaggccagcuuca

SEQ ID NO: 407479 - RNA, 17 nt, Human
cugggguuuccugcaag

SEQ ID NO: 407480 - RNA, 20 nt, Human
cugggguuucuggaugggaa

SEQ ID NO: 407481 - RNA, 17 nt, Human
cugggguuugggggaag

SEQ ID NO: 407482 - RNA, 32 nt, Human
cuggguaaaugacuaggugguaagguucugcc

SEQ ID NO: 407483 - RNA, 32 nt, Human
cuggguaaauguggauuaagggaaacaaacau

SEQ ID NO: 407484 - RNA, 32 nt, Human
cuggguaacaggcagagguugaaauaguuuga

SEQ ID NO: 407485 - RNA, 32 nt, Human
cuggguaacaggcagagguuggaacaguuugg

SEQ ID NO: 407486 - RNA, 32 nt, Human
cuggguaacagugguuaccaaugaggcaauac

SEQ ID NO: 407487 - RNA, 24 nt, Human
cuggguaacauggcaaaauccugu

SEQ ID NO: 407488 - RNA, 22 nt, Human
cuggguaacauggugaaauccc

SEQ ID NO: 407489 - RNA, 32 nt, Human
cuggguaacauggugaaaucccauaucuacaa

SEQ ID NO: 407490 - RNA, 32 nt, Human
cuggguaaccaccgaucagcacagcugucccc

SEQ ID NO: 407491 - RNA, 32 nt, Human
cuggguaaccuugagcuauguaugacacaacu

SEQ ID NO: 407492 - RNA, 32 nt, Human
cuggguaacuuccugauguugccauggcauuu

SEQ ID NO: 407493 - RNA, 21 nt, Human
cuggguaauauggcaaaaccc

SEQ ID NO: 407494 - RNA, 32 nt, Human
cuggguaccaaggacacaggcacagcagagcc

SEQ ID NO: 407495 - RNA, 24 nt, Human
cuggguaccugguccccacugcug

SEQ ID NO: 407496 - RNA, 32 nt, Human
cuggguacgcucagggagcaaaccugguuaag

SEQ ID NO: 407497 - RNA, 32 nt, Human
cuggguacuauguagagaagacagcugaggau

SEQ ID NO: 407498 - RNA, 32 nt, Human
cuggguacuuugugggucucucuuucgucggu

SEQ ID NO: 407499 - RNA, 32 nt, Human
cuggguagagggaugggaaggaagggacccuu

SEQ ID NO: 407500 - RNA, 24 nt, Human
cuggguagcagguuccuucuguug

SEQ ID NO: 407501 - RNA, 30 nt, Human
cuggguagccucucugagcugguuuccugc

SEQ ID NO: 407502 - RNA, 21 nt, Human
cuggguagcugggacuacagg

SEQ ID NO: 407503 - RNA, 21 nt, Human
cuggguagcugggauuacagg

SEQ ID NO: 407504 - RNA, 32 nt, Human
cuggguagggcugugcugaggggcugggcggg

SEQ ID NO: 407505 - RNA, 32 nt, Human
cuggguagguaaccuuccccugaaguccugcc

SEQ ID NO: 407506 - RNA, 22 nt, Human
cuggguagucacugccucccca

SEQ ID NO: 407507 - RNA, 32 nt, Human
cuggguagucuaccauuuacuucaccccaagu

SEQ ID NO: 407508 - RNA, 32 nt, Human
cuggguauggugcugggcuguugggagccgaa

SEQ ID NO: 407509 - RNA, 32 nt, Human
cuggguaugguggcacacgccuguaaucccag

SEQ ID NO: 407510 - RNA, 32 nt, Human
cuggguaugguggcacauaccuguagucccag

SEQ ID NO: 407511 - RNA, 32 nt, Human
cuggguaugguggcucaugccaguaauugcag

SEQ ID NO: 407512 - RNA, 32 nt, Human
cuggguaugguggcucaugccuguaaucccag

SEQ ID NO: 407513 - RNA, 32 nt, Human
cuggguauguuuuggaagugagugucacuacu

SEQ ID NO: 407514 - RNA, 32 nt, Human
cuggguauucuuuucaauccaucaaaggcucc

SEQ ID NO: 407515 - RNA, 32 nt, Human
cuggguauuguccuccuacaaggaagauccuc

SEQ ID NO: 407516 - RNA, 32 nt, Human
cugggucaaaggaccagucugcagagggaucc

SEQ ID NO: 407517 - RNA, 32 nt, Human
cugggucacccaggccacaaggccaugguuaa

SEQ ID NO: 407518 - RNA, 32 nt, Human
cugggucagaccugagguuggggaaggcgacu

SEQ ID NO: 407519 - RNA, 22 nt, Human
cugggucagagguguuccaggc

SEQ ID NO: 407520 - RNA, 32 nt, Human
cugggucaggcagcuguugugauuguuaguau

SEQ ID NO: 407521 - RNA, 32 nt, Human
cugggucaggguggggucaaguccagccuuga

SEQ ID NO: 407522 - RNA, 32 nt, Human
cugggucaucugccagccucccuacccccuug

SEQ ID NO: 407523 - RNA, 32 nt, Human
cugggucaugccauccuacaccaaauuccugu

SEQ ID NO: 407524 - RNA, 32 nt, Human
cugggucauuuuuagggugagguguagggggu

SEQ ID NO: 407525 - RNA, 32 nt, Human
cuggguccaagcaauuauugugccucagccuc

SEQ ID NO: 407526 - RNA, 32 nt, Human
cuggguccagccuugaucagugacagcgaagg

SEQ ID NO: 407527 - RNA, 32 nt, Human
cuggguccagcuagcagccacugggaaucaga

SEQ ID NO: 407528 - RNA, 32 nt, Human
cugggucccagcgauucuccugccucagccuc

SEQ ID NO: 407529 - RNA, 32 nt, Human
cugggucccaggagccuuaacaaggcauugag

SEQ ID NO: 407530 - RNA, 32 nt, Human
cugggucccauaacaucagaagugguugccga

SEQ ID NO: 407531 - RNA, 32 nt, Human
cuggguccccaguguucgcugugugugcguuu

SEQ ID NO: 407532 - RNA, 32 nt, Human
cuggguccccaucccuguugugguguauuugu

SEQ ID NO: 407533 - RNA, 32 nt, Human
cuggguccccgaggaggaggggacuggggucc

SEQ ID NO: 407534 - RNA, 32 nt, Human
cuggguccccuccuuucuuucacuuucagccc

SEQ ID NO: 407535 - RNA, 32 nt, Human
cugggucccuccucucaccucucccucgauca

SEQ ID NO: 407536 - RNA, 32 nt, Human
cugggucccugccuacacucguccugccugca

SEQ ID NO: 407537 - RNA, 32 nt, Human
cugggucccugccuccgcucugccccugggug

SEQ ID NO: 407538 - RNA, 32 nt, Human
cugggucccuuaggggccuugccaaggggacc

SEQ ID NO: 407539 - RNA, 32 nt, Human
cugggucccuuucagcggccucuagggcagga

SEQ ID NO: 407540 - RNA, 32 nt, Human
cuggguccgugccagcacaaucugccaaaguu

SEQ ID NO: 407541 - RNA, 32 nt, Human
cuggguccuagucccagcucuuccaugggauc

SEQ ID NO: 407542 - RNA, 32 nt, Human
cuggguccucuucugcccccagugcccuuccc

SEQ ID NO: 407543 - RNA, 32 nt, Human
cuggguccugagggagagcugcagugagaagu

SEQ ID NO: 407544 - RNA, 32 nt, Human
cuggguccuggagccuggaggaggaaugaggu

SEQ ID NO: 407545 - RNA, 32 nt, Human
cuggguccuuucucccuccgucugcuuccuuc

SEQ ID NO: 407546 - RNA, 32 nt, Human
cugggucgauggggucggauucugccaguuuc

SEQ ID NO: 407547 - RNA, 32 nt, Human
cugggucggggacacggugaagaggcuccagc

SEQ ID NO: 407548 - RNA, 32 nt, Human
cugggucggguggaggcugcugggucuguuuc

SEQ ID NO: 407549 - RNA, 32 nt, Human
cugggucgguggcggaggcugaggagaaggag

SEQ ID NO: 407550 - RNA, 32 nt, Human
cugggucuacagcccugagccccuccggcccc

SEQ ID NO: 407551 - RNA, 32 nt, Human
cugggucuagaaugggaacuggagaggacccu

SEQ ID NO: 407552 - RNA, 32 nt, Human
cugggucucagaugcaaccucagaccugauac

SEQ ID NO: 407553 - RNA, 32 nt, Human
cugggucucccgaguggcugggauuauaggcg

SEQ ID NO: 407554 - RNA, 32 nt, Human
cugggucucuuuccuauauaagaaauagaaau

SEQ ID NO: 407555 - RNA, 16 nt, Human
cugggucugcagcagc

SEQ ID NO: 407556 - RNA, 32 nt, Human
cugggucugcguucccuccccugggccugacu

SEQ ID NO: 407557 - RNA, 32 nt, Human
cugggucugcugucugagcagcuccuggcucc

SEQ ID NO: 407558 - RNA, 32 nt, Human
cugggucuggacuggcucuggcggauccccgc

SEQ ID NO: 407559 - RNA, 32 nt, Human
cugggucuggccagggcuuccucaaauacaug

SEQ ID NO: 407560 - RNA, 32 nt, Human
cugggucugguccaggugaggggcagggggca

SEQ ID NO: 407561 - RNA, 32 nt, Human
cugggucuuagagcagcacuguucuuuucccc

SEQ ID NO: 407562 - RNA, 32 nt, Human
cugggucuuagagcauguguguauucagucag

SEQ ID NO: 407563 - RNA, 32 nt, Human
cugggucuuggagacguggagaagaggaaugc

SEQ ID NO: 407564 - RNA, 32 nt, Human
cugggucuuucacccaggcuggagugcagugc

SEQ ID NO: 407565 - RNA, 20 nt, Human
cugggugaaggcuuugcuga

SEQ ID NO: 407566 - RNA, 32 nt, Human
cugggugaauccagcugacauguugugaggac

SEQ ID NO: 407567 - RNA, 32 nt, Human
cugggugacaagagcaagacuccgugucaaaa

SEQ ID NO: 407568 - RNA, 32 nt, Human
cugggugacacuccagccugggugacaaagga

SEQ ID NO: 407569 - RNA, 22 nt, Human
cugggugacagagcaaaacccu

SEQ ID NO: 407570 - RNA, 32 nt, Human
cugggugacagagcgagacuuaucucauaaau

SEQ ID NO: 407571 - RNA, 24 nt, Human
cugggugacauagcaagacccugu

SEQ ID NO: 407572 - RNA, 24 nt, Human
cugggugacauggugagaccuugu

SEQ ID NO: 407573 - RNA, 28 nt, Human
cugggugacauggugagaccuugucucc

SEQ ID NO: 407574 - RNA, 32 nt, Human
cugggugacucagagagggaagagauucagcc

SEQ ID NO: 407575 - RNA, 32 nt, Human
cugggugagauuaaggugcagggccugggggc

SEQ ID NO: 407576 - RNA, 24 nt, Human
cugggugagcuuuaggugcugcac

SEQ ID NO: 407577 - RNA, 32 nt, Human
cugggugaggcggcucacaccuguaaucccag

SEQ ID NO: 407578 - RNA, 32 nt, Human
cugggugagguggcucaugccuguaaucccag

SEQ ID NO: 407579 - RNA, 32 nt, Human
cugggugaguuagugccagauggaauuuaaag

SEQ ID NO: 407580 - RNA, 32 nt, Human
cugggugauacagaaugaauucuacacuuacu

SEQ ID NO: 407581 - RNA, 32 nt, Human
cugggugcaagcaauuauccugccucagccuc

SEQ ID NO: 407582 - RNA, 32 nt, Human
cugggugcaaugcaucacaccuguaaucccag

SEQ ID NO: 407583 - RNA, 32 nt, Human
cugggugcaauggcucacaccuguuaauccca

SEQ ID NO: 407584 - RNA, 32 nt, Human
cugggugcagaggcucauuccuguaaucccag

SEQ ID NO: 407585 - RNA, 17 nt, Human
cugggugcaggcucccu

SEQ ID NO: 407586 - RNA, 32 nt, Human
cugggugcaguggcucacaccuguaauaccag

SEQ ID NO: 407587 - RNA, 32 nt, Human
cugggugcaguggcucacaccuguaaucccag

SEQ ID NO: 407588 - RNA, 32 nt, Human
cugggugcaguggcucacaccuguaauccuag

SEQ ID NO: 407589 - RNA, 32 nt, Human
cugggugcaguggcucacaccuguaaucucaa

SEQ ID NO: 407590 - RNA, 32 nt, Human
cugggugcaguggcucacgccuguaauaucaa

SEQ ID NO: 407591 - RNA, 32 nt, Human
cugggugcaguggcucacgccuguaaucccaa

SEQ ID NO: 407592 - RNA, 32 nt, Human
cugggugcaguggcucacgccuguaaucccag

SEQ ID NO: 407593 - RNA, 32 nt, Human
cugggugcaguggcucaggccuguaaucccaa

SEQ ID NO: 407594 - RNA, 32 nt, Human
cugggugcaguggcucauaccuguaaucccag

SEQ ID NO: 407595 - RNA, 32 nt, Human
cugggugcaguggcucaugcccguaaucucag

SEQ ID NO: 407596 - RNA, 32 nt, Human
cugggugcaguggcucaugccuauaaucccag

SEQ ID NO: 407597 - RNA, 32 nt, Human
cugggugcaguggcucaugccuauaaucuuag

SEQ ID NO: 407598 - RNA, 32 nt, Human
cugggugcaguggcucaugccuguaaucccaa

SEQ ID NO: 407599 - RNA, 32 nt, Human
cugggugcaguggcucaugccuguaaucccag

SEQ ID NO: 407600 - RNA, 32 nt, Human
cugggugcaguggcucaugccuguaauuccaa

SEQ ID NO: 407601 - RNA, 32 nt, Human
cugggugcaguggcucgcaccuguaaucccag

SEQ ID NO: 407602 - RNA, 32 nt, Human
cugggugcaguggcucuugccuguaaucccag

SEQ ID NO: 407603 - RNA, 32 nt, Human
cugggugcagugguauauaccuguagucccag

SEQ ID NO: 407604 - RNA, 32 nt, Human
cugggugcagugguucacaccuguaauugcag

SEQ ID NO: 407605 - RNA, 32 nt, Human
cugggugcauucagucucucugccucugccug

SEQ ID NO: 407606 - RNA, 19 nt, Human
cugggugccagcuucgcca

SEQ ID NO: 407607 - RNA, 32 nt, Human
cugggugcccugcuggagguguggcugacuuu

SEQ ID NO: 407608 - RNA, 32 nt, Human
cugggugcccugggcccugccugcugccgugu

SEQ ID NO: 407609 - RNA, 23 nt, Human
cugggugccgcagaccaaacgcc

SEQ ID NO: 407610 - RNA, 32 nt, Human
cugggugccguggcucacaccuguaaucugag

SEQ ID NO: 407611 - RNA, 32 nt, Human
cugggugccguggcucacgccuguaaucccag

SEQ ID NO: 407612 - RNA, 32 nt, Human
cugggugccgugggucacgccuguaaucccag

SEQ ID NO: 407613 - RNA, 21 nt, Human
cugggugccuccuccuguccu

SEQ ID NO: 407614 - RNA, 32 nt, Human
cugggugccugaagcuauagugcaaugguucc

SEQ ID NO: 407615 - RNA, 32 nt, Human
cugggugccugccuggggcuuggggcucugua

SEQ ID NO: 407616 - RNA, 32 nt, Human
cugggugccuggguccgguggcugcaaagauc

SEQ ID NO: 407617 - RNA, 32 nt, Human
cugggugcgauggcucacgccuguaaucccgg

SEQ ID NO: 407618 - RNA, 32 nt, Human
cugggugcgauggugggugccuguaaucccag

SEQ ID NO: 407619 - RNA, 21 nt, Human
cugggugcgcugcugcugcug

SEQ ID NO: 407620 - RNA, 32 nt, Human
cugggugcgguagcucauaccuguaaucccag

SEQ ID NO: 407621 - RNA, 32 nt, Human
cugggugcggugacucaugccuguaaucccag

SEQ ID NO: 407622 - RNA, 32 nt, Human
cugggugcggugacucgcaccuguaaucccag

SEQ ID NO: 407623 - RNA, 32 nt, Human
cugggugcggugccucaugccuguaaucccag

SEQ ID NO: 407624 - RNA, 32 nt, Human
cugggugcgguggcacaugccuguaaucccag

SEQ ID NO: 407625 - RNA, 32 nt, Human
cugggugcgguggcucacaccuguaaucccag

SEQ ID NO: 407626 - RNA, 32 nt, Human
cugggugcgguggcucacgccuguaaucccaa

SEQ ID NO: 407627 - RNA, 32 nt, Human
cugggugcgguggcucacgccuguaaucccag

SEQ ID NO: 407628 - RNA, 32 nt, Human
cugggugcgguggcucaugcacguaaucccaa

SEQ ID NO: 407629 - RNA, 32 nt, Human
cugggugcgguggcucaugccuguaauccaac

SEQ ID NO: 407630 - RNA, 32 nt, Human
cugggugcgguggcucaugccuguaaucccag

SEQ ID NO: 407631 - RNA, 32 nt, Human
cugggugcgguggcucaugccuguaauccuag

SEQ ID NO: 407632 - RNA, 32 nt, Human
cugggugcgguggcucaugccugugaucccag

SEQ ID NO: 407633 - RNA, 32 nt, Human
cugggugcgguggcucaugucuguaaucccag

SEQ ID NO: 407634 - RNA, 32 nt, Human
cugggugcggugucucacaccuguaaucccag

SEQ ID NO: 407635 - RNA, 32 nt, Human
cugggugcggugucucaugccuguaaucccag

SEQ ID NO: 407636 - RNA, 32 nt, Human
cugggugcuacuuauagacccaaucagaauac

SEQ ID NO: 407637 - RNA, 32 nt, Human
cugggugcucacugggacccuggaaaggucua

SEQ ID NO: 407638 - RNA, 32 nt, Human
cugggugcucauggaaucagcugcugcccugc

SEQ ID NO: 407639 - RNA, 32 nt, Human
cugggugcucccuggaagauggaucuugccuu

SEQ ID NO: 407640 - RNA, 32 nt, Human
cugggugcuccuggcccuaauugugcacccug

SEQ ID NO: 407641 - RNA, 32 nt, Human
cugggugcuguaccaggcagggugcugggcau

SEQ ID NO: 407642 - RNA, 32 nt, Human
cugggugcuguggcucacgccuguaaucccag

SEQ ID NO: 407643 - RNA, 32 nt, Human
cugggugcuguggcucaugccuguaaucccag

SEQ ID NO: 407644 - RNA, 32 nt, Human
cugggugcuuuuccuccaguuugcuggcuggc

SEQ ID NO: 407645 - RNA, 32 nt, Human
cuggguggaaggccaugaaccaggcugucgaa

SEQ ID NO: 407646 - RNA, 32 nt, Human
cuggguggacacuuaggagcugccuggacugc

SEQ ID NO: 407647 - RNA, 32 nt, Human
cuggguggacuuugggaccugcuuugugagcc

SEQ ID NO: 407648 - RNA, 32 nt, Human
cuggguggagagcugacccaggaagggcugca

SEQ ID NO: 407649 - RNA, 32 nt, Human
cuggguggaggaagaagugguggagccucagg

SEQ ID NO: 407650 - RNA, 32 nt, Human
cuggguggaggggccuuugugaggcuggaccc

SEQ ID NO: 407651 - RNA, 32 nt, Human
cuggguggaguggcucauaccuguaaucccag

SEQ ID NO: 407652 - RNA, 32 nt, Human
cuggguggcacugaggugaugaugacacuauu

SEQ ID NO: 407653 - RNA, 32 nt, Human
cuggguggcagaggagauaaacagccaugugc

SEQ ID NO: 407654 - RNA, 24 nt, Human
cuggguggcaugugacaggccuga

SEQ ID NO: 407655 - RNA, 32 nt, Human
cuggguggccccauccuaccaggcccugaggu

SEQ ID NO: 407656 - RNA, 32 nt, Human
cuggguggcccugccauauucuuccucccgcc

SEQ ID NO: 407657 - RNA, 25 nt, Human
cuggguggccgaaaucaccaggguc

SEQ ID NO: 407658 - RNA, 30 nt, Human
cuggguggccucuccaagcccugguggugc

SEQ ID NO: 407659 - RNA, 19 nt, Human
cuggguggcucuggggcca

SEQ ID NO: 407660 - RNA, 32 nt, Human
cuggguggcuuccagacggaccgggcagcccc

SEQ ID NO: 407661 - RNA, 32 nt, Human
cugggugggaaugugacuugagcccagaguga

SEQ ID NO: 407662 - RNA, 32 nt, Human
cugggugggagcggggaguccuggugagaccc

SEQ ID NO: 407663 - RNA, 32 nt, Human
cugggugggaggcugucacacugugguggagg

SEQ ID NO: 407664 - RNA, 17 nt, Human
cugggugggcagagguu

SEQ ID NO: 407665 - RNA, 32 nt, Human
cugggugggcaggacacguggugggggccacu

SEQ ID NO: 407666 - RNA, 32 nt, Human
cugggugggcaggcacccggaggaggagcagc

SEQ ID NO: 407667 - RNA, 18 nt, Human
cugggugggccacaggga

SEQ ID NO: 407668 - RNA, 23 nt, Human
cugggugggcuggggcggaagug

SEQ ID NO: 407669 - RNA, 32 nt, Human
cugggugggcuucaggcuggggcugcagacuc

SEQ ID NO: 407670 - RNA, 32 nt, Human
cuggguggggacugggcugugcccagggccuc

SEQ ID NO: 407671 - RNA, 32 nt, Human
cuggguggggagguguggguucccugggccaa

SEQ ID NO: 407672 - RNA, 21 nt, Human
cuggguggggcagaggccagg

SEQ ID NO: 407673 - RNA, 22 nt, Human
cugggugggggacagagccaga

SEQ ID NO: 407674 - RNA, 32 nt, Human
cugggugggguggggugguucaaauggaugac

SEQ ID NO: 407675 - RNA, 32 nt, Human
cuggguggguagggggcugcuugaguguggcc

SEQ ID NO: 407676 - RNA, 20 nt, Human
cugggugggugaaaggggcc

SEQ ID NO: 407677 - RNA, 32 nt, Human
cugggugggugaggggcgcgcggauccggaga

SEQ ID NO: 407678 - RNA, 32 nt, Human
cuggguggguggggaugccuguuuacacuagc

SEQ ID NO: 407679 - RNA, 32 nt, Human
cuggguggucggccucacaugggaaggagaug

SEQ ID NO: 407680 - RNA, 32 nt, Human
cuggguggugaggcccuguggugaggagcagg

SEQ ID NO: 407681 - RNA, 32 nt, Human
cuggguguaaacuugauuuucuuuauugagau

SEQ ID NO: 407682 - RNA, 32 nt, Human
cuggguguaacggcggaugccuguaaucccag

SEQ ID NO: 407683 - RNA, 32 nt, Human
cuggguguaguggaugccagucuuguugcugu

SEQ ID NO: 407684 - RNA, 32 nt, Human
cuggguguaguggcuuaugccuguaaucccag

SEQ ID NO: 407685 - RNA, 32 nt, Human
cuggguguaguggugcacaccuguaaucccag

SEQ ID NO: 407686 - RNA, 32 nt, Human
cugggugucacguuuucagccaaacaucuaaa

SEQ ID NO: 407687 - RNA, 32 nt, Human
cugggugucgcucuccccuccugcaggucagc

SEQ ID NO: 407688 - RNA, 32 nt, Human
cugggugucugggaacugccucccucaucugu

SEQ ID NO: 407689 - RNA, 32 nt, Human
cugggugucuggugccuggaacagacuucccu

SEQ ID NO: 407690 - RNA, 32 nt, Human
cugggugugagaugggaccaggaaucuuauuu

SEQ ID NO: 407691 - RNA, 32 nt, Human
cugggugugauggcacacaucuauagucccag

SEQ ID NO: 407692 - RNA, 32 nt, Human
cugggugugauggcgcaugccuguaaucccag

SEQ ID NO: 407693 - RNA, 32 nt, Human
cugggugugauggcucacgccuguaaucccag

SEQ ID NO: 407694 - RNA, 32 nt, Human
cugggugugauggcucaugcccauaaucccag

SEQ ID NO: 407695 - RNA, 32 nt, Human
cugggugugaugggcaccgaggccaaccccuc

SEQ ID NO: 407696 - RNA, 32 nt, Human
cugggugugcgaguguccaucuguccacaugg

SEQ ID NO: 407697 - RNA, 32 nt, Human
cugggugugcuggugcaugccuguaaucucag

SEQ ID NO: 407698 - RNA, 22 nt, Human
cugggugugcuggugcuggcgc

SEQ ID NO: 407699 - RNA, 32 nt, Human
cuggguguggaggcucacaccuguaaucucag

SEQ ID NO: 407700 - RNA, 26 nt, Human
cuggguguggcccggugguggugcac

SEQ ID NO: 407701 - RNA, 32 nt, Human
cuggguguggucuccacuggggauugggcccc

SEQ ID NO: 407702 - RNA, 32 nt, Human
cuggguguggugccacaugccuguaauuccag

SEQ ID NO: 407703 - RNA, 32 nt, Human
cugggugugguggcacacaccuguaaucccag

SEQ ID NO: 407704 - RNA, 32 nt, Human
cugggugugguggcacaugccuguaauaucag

SEQ ID NO: 407705 - RNA, 32 nt, Human
cugggugugguggcacaugccuguaaucccag

SEQ ID NO: 407706 - RNA, 32 nt, Human
cugggugugguggcacaugccuguaaucgcag

SEQ ID NO: 407707 - RNA, 32 nt, Human
cugggugugguggcacgugccuguaaucucag

SEQ ID NO: 407708 - RNA, 32 nt, Human
cugggugugguggcgcauaccugugguuccag

SEQ ID NO: 407709 - RNA, 32 nt, Human
cugggugugguggcgcaugccuguaaucccag

SEQ ID NO: 407710 - RNA, 32 nt, Human
cugggugugguggcgcaugccuguaauccuag

SEQ ID NO: 407711 - RNA, 32 nt, Human
cugggugugguggcgcgugccuguaaucccag

SEQ ID NO: 407712 - RNA, 32 nt, Human
cugggugugguggcucacaccuguaaucccag

SEQ ID NO: 407713 - RNA, 32 nt, Human
cugggugugguggcucacgccuguaaucccag

SEQ ID NO: 407714 - RNA, 32 nt, Human
cugggugugguggcucacgccuguaaucccua

SEQ ID NO: 407715 - RNA, 32 nt, Human
cugggugugguggcucacgccuguaauccuag

SEQ ID NO: 407716 - RNA, 32 nt, Human
cugggugugguggcucacgccuguaaucgcgg

SEQ ID NO: 407717 - RNA, 32 nt, Human
cugggugugguggcucauaccuguaaucccag

SEQ ID NO: 407718 - RNA, 32 nt, Human
cugggugugguggcucaugcauguaaucccag

SEQ ID NO: 407719 - RNA, 32 nt, Human
cugggugugguggcucaugccuguaaucccag

SEQ ID NO: 407720 - RNA, 32 nt, Human
cugggugugguggugcaugccuguaaucccag

SEQ ID NO: 407721 - RNA, 32 nt, Human
cugggugugguggugcgugccuguaaucccaa

SEQ ID NO: 407722 - RNA, 32 nt, Human
cuggguguguuggcacgugccuguaaucccag

SEQ ID NO: 407723 - RNA, 32 nt, Human
cuggguguuggggguagugggaggagaacggu

SEQ ID NO: 407724 - RNA, 32 nt, Human
cuggguguuguggugcgcaccuguaauuccag

SEQ ID NO: 407725 - RNA, 32 nt, Human
cuggguguuguucaaaguuucuccccauguga

SEQ ID NO: 407726 - RNA, 32 nt, Human
cuggguuaacaguaaauauacacuuuacauuc

SEQ ID NO: 407727 - RNA, 32 nt, Human
cuggguuaggaacagacggaucagggcuucua

SEQ ID NO: 407728 - RNA, 32 nt, Human
cuggguuauccaggucccauugagugguuuuc

SEQ ID NO: 407729 - RNA, 32 nt, Human
cuggguucaaacaauucucaugccucagccuc

SEQ ID NO: 407730 - RNA, 32 nt, Human
cuggguucaaacaauucuccugccucagccuc

SEQ ID NO: 407731 - RNA, 32 nt, Human
cuggguucaaaccauucuccugccucagccuc

SEQ ID NO: 407732 - RNA, 32 nt, Human
cuggguucaaacgauucuccugccucagccuc

SEQ ID NO: 407733 - RNA, 32 nt, Human
cuggguucaaacgauuguccugccucagccuc

SEQ ID NO: 407734 - RNA, 32 nt, Human
cuggguucaaacucugcauccuucucuaacaa

SEQ ID NO: 407735 - RNA, 32 nt, Human
cuggguucaagaaauccucccaccuugccucc

SEQ ID NO: 407736 - RNA, 32 nt, Human
cuggguucaagaaauucuccugccuuagccuc

SEQ ID NO: 407737 - RNA, 26 nt, Human
cuggguucaagagauccauccuccca

SEQ ID NO: 407738 - RNA, 32 nt, Human
cuggguucaagcaaaucuccugccucagccuc

SEQ ID NO: 407739 - RNA, 32 nt, Human
cuggguucaagcaagucuccugccucagccuc

SEQ ID NO: 407740 - RNA, 32 nt, Human
cuggguucaagcaauccucccaccucggccuc

SEQ ID NO: 407741 - RNA, 32 nt, Human
cuggguucaagcaauccucccaccugugccuc

SEQ ID NO: 407742 - RNA, 32 nt, Human
cuggguucaagcaauccuccugccucagccuc

SEQ ID NO: 407743 - RNA, 32 nt, Human
cuggguucaagcaauccuccugccuuauccuc

SEQ ID NO: 407744 - RNA, 32 nt, Human
cuggguucaagcaauucuaccucagucuccug

SEQ ID NO: 407745 - RNA, 32 nt, Human
cuggguucaagcaauucucaugccucaguccc

SEQ ID NO: 407746 - RNA, 32 nt, Human
cuggguucaagcaauucucaugccucugccuc

SEQ ID NO: 407747 - RNA, 32 nt, Human
cuggguucaagcaauucuccagccucagccuc

SEQ ID NO: 407748 - RNA, 32 nt, Human
cuggguucaagcaauucuccagccucugccuc

SEQ ID NO: 407749 - RNA, 32 nt, Human
cuggguucaagcaauucucccaccucagcugg

SEQ ID NO: 407750 - RNA, 32 nt, Human
cuggguucaagcaauucuccuaccucagccuc

SEQ ID NO: 407751 - RNA, 32 nt, Human
cuggguucaagcaauucuccuaccucagcuuc

SEQ ID NO: 407752 - RNA, 32 nt, Human
cuggguucaagcaauucuccugccgcagccuc

SEQ ID NO: 407753 - RNA, 32 nt, Human
cuggguucaagcaauucuccugccucagccuc

SEQ ID NO: 407754 - RNA, 32 nt, Human
cuggguucaagcaauucuccugccucagcuuc

SEQ ID NO: 407755 - RNA, 32 nt, Human
cuggguucaagcaauucuccugccucaggcuc

SEQ ID NO: 407756 - RNA, 32 nt, Human
cuggguucaagcaauucuccugccuuagccuc

SEQ ID NO: 407757 - RNA, 32 nt, Human
cuggguucaagcaauucuccugucucagccuc

SEQ ID NO: 407758 - RNA, 32 nt, Human
cuggguucaagcaauucuccuucuucagccuc

SEQ ID NO: 407759 - RNA, 32 nt, Human
cuggguucaagcaauucucugccucagccucc

SEQ ID NO: 407760 - RNA, 32 nt, Human
cuggguucaagcaauucucuggggcagcaguu

SEQ ID NO: 407761 - RNA, 32 nt, Human
cuggguucaagcaauucuguggcuucagccuc

SEQ ID NO: 407762 - RNA, 32 nt, Human
cuggguucaagcaauucuucugacucagccuc

SEQ ID NO: 407763 - RNA, 32 nt, Human
cuggguucaagcaauucuucugccucagccuc

SEQ ID NO: 407764 - RNA, 32 nt, Human
cuggguucaagcaauucuucugccucagccuu

SEQ ID NO: 407765 - RNA, 32 nt, Human
cuggguucaagcaauucuugugccucagccuc

SEQ ID NO: 407766 - RNA, 32 nt, Human
cuggguucaagcaauuguccugccccagccuc

SEQ ID NO: 407767 - RNA, 32 nt, Human
cuggguucaagcaauuuuccugccucagccuc

SEQ ID NO: 407768 - RNA, 32 nt, Human
cuggguucaagcaauuuucuugccucagccuc

SEQ ID NO: 407769 - RNA, 32 nt, Human
cuggguucaagcagucuuccugccuuggccuc

SEQ ID NO: 407770 - RNA, 32 nt, Human
cuggguucaagcaguucucccgccucagccuc

SEQ ID NO: 407771 - RNA, 32 nt, Human
cuggguucaagcaguucuccugccucagccuc

SEQ ID NO: 407772 - RNA, 32 nt, Human
cuggguucaagcaguucucgugccgcagccuc

SEQ ID NO: 407773 - RNA, 32 nt, Human
cuggguucaagcaguucucgugccucccugag

SEQ ID NO: 407774 - RNA, 32 nt, Human
cuggguucaagcaguucucuugccucagccuc

SEQ ID NO: 407775 - RNA, 32 nt, Human
cuggguucaagcaguucuuccccaucagccuc

SEQ ID NO: 407776 - RNA, 32 nt, Human
cuggguucaagcauuucuccugccucagccuc

SEQ ID NO: 407777 - RNA, 32 nt, Human
cuggguucaagccauccucccaccucagccuc

SEQ ID NO: 407778 - RNA, 32 nt, Human
cuggguucaagccauucucugccucagccuuc

SEQ ID NO: 407779 - RNA, 32 nt, Human
cuggguucaagcgauccucccacuucagccuu

SEQ ID NO: 407780 - RNA, 32 nt, Human
cuggguucaagcgauccuccugccucagcccc

SEQ ID NO: 407781 - RNA, 32 nt, Human
cuggguucaagcgauucacccaccucagccuc

SEQ ID NO: 407782 - RNA, 32 nt, Human
cuggguucaagcgauuccugugccucggccuu

SEQ ID NO: 407783 - RNA, 32 nt, Human
cuggguucaagcgauucucccaccccagccuc

SEQ ID NO: 407784 - RNA, 32 nt, Human
cuggguucaagcgauucuccuaccucagccuc

SEQ ID NO: 407785 - RNA, 32 nt, Human
cuggguucaagcgauucuccuaccucagcuuc

SEQ ID NO: 407786 - RNA, 32 nt, Human
cuggguucaagcgauucuccugccucugccuc

SEQ ID NO: 407787 - RNA, 32 nt, Human
cuggguucaagcgauucucgugccucagccuc

SEQ ID NO: 407788 - RNA, 32 nt, Human
cuggguucaagcgauucuugugccucaaccuc

SEQ ID NO: 407789 - RNA, 32 nt, Human
cuggguucaagcgauucuugugccucagccuc

SEQ ID NO: 407790 - RNA, 32 nt, Human
cuggguucaagcgcuucuccugccucagccuc

SEQ ID NO: 407791 - RNA, 32 nt, Human
cuggguucaagggauccucccaccucagccuc

SEQ ID NO: 407792 - RNA, 32 nt, Human
cuggguucaagggauccucccgccucagccuc

SEQ ID NO: 407793 - RNA, 32 nt, Human
cuggguucaaguaacccucccaccucagcuuu

SEQ ID NO: 407794 - RNA, 32 nt, Human
cuggguucaaguaauccucccaccucagccuc

SEQ ID NO: 407795 - RNA, 32 nt, Human
cuggguucaaguaauucuccugccucagcuuu

SEQ ID NO: 407796 - RNA, 32 nt, Human
cuggguucaagugacccucccaccucagccuc

SEQ ID NO: 407797 - RNA, 32 nt, Human
cuggguucaagugacucuugugccucagccuc

SEQ ID NO: 407798 - RNA, 32 nt, Human
cuggguucaagugauccucccaccucagcuuc

SEQ ID NO: 407799 - RNA, 32 nt, Human
cuggguucaagugauucucccaccucaaccuc

SEQ ID NO: 407800 - RNA, 32 nt, Human
cuggguucacacacaagcugagaugagaagag

SEQ ID NO: 407801 - RNA, 32 nt, Human
cuggguucacaccauucuccugccucagccuc

SEQ ID NO: 407802 - RNA, 32 nt, Human
cuggguucacaucauucuccugccucagccuc

SEQ ID NO: 407803 - RNA, 32 nt, Human
cuggguucacgcaauucuccugccucagccuc

SEQ ID NO: 407804 - RNA, 32 nt, Human
cuggguucacgccauccuccugccucggccuc

SEQ ID NO: 407805 - RNA, 32 nt, Human
cuggguucacgccauucucccaccucagcuuc

SEQ ID NO: 407806 - RNA, 32 nt, Human
cuggguucacgccauucucccgccucagccuc

SEQ ID NO: 407807 - RNA, 32 nt, Human
cuggguucacgccauucuccugccucagccuc

SEQ ID NO: 407808 - RNA, 32 nt, Human
cuggguucacgccauucuccugccucagcuac

SEQ ID NO: 407809 - RNA, 32 nt, Human
cuggguucacgccauucuccugccucagcuuc

SEQ ID NO: 407810 - RNA, 32 nt, Human
cuggguucacucccacuucauccuggcugaaa

SEQ ID NO: 407811 - RNA, 32 nt, Human
cuggguucacugcaaccuccgccucuuggguu

SEQ ID NO: 407812 - RNA, 32 nt, Human
cuggguucacugcaaccucugccuccagguuc

SEQ ID NO: 407813 - RNA, 32 nt, Human
cuggguucacugcaaccucugccuccugggcu

SEQ ID NO: 407814 - RNA, 32 nt, Human
cuggguucaggcaauucucccaccucagccuc

SEQ ID NO: 407815 - RNA, 32 nt, Human
cuggguucaggugauucuccuaccucagccuc

SEQ ID NO: 407816 - RNA, 32 nt, Human
cuggguucaguauuuccuggcacagcacuuug

SEQ ID NO: 407817 - RNA, 32 nt, Human
cuggguucaugccauucuccugccucagccuc

SEQ ID NO: 407818 - RNA, 32 nt, Human
cuggguucaugccauucuccugccucagucuc

SEQ ID NO: 407819 - RNA, 32 nt, Human
cuggguucaugccauucuccugccucggccuu

SEQ ID NO: 407820 - RNA, 32 nt, Human
cuggguucaugccauucuccugcuucagccuc

SEQ ID NO: 407821 - RNA, 32 nt, Human
cuggguucaugccauuuuccugccucagccuc

SEQ ID NO: 407822 - RNA, 32 nt, Human
cuggguucauuucugcccucaucugcugugca

SEQ ID NO: 407823 - RNA, 32 nt, Human
cuggguuccagcaauucuccugccucagccuc

SEQ ID NO: 407824 - RNA, 32 nt, Human
cuggguuccaucucugucuccagccugcccac

SEQ ID NO: 407825 - RNA, 32 nt, Human
cuggguucgaacgauucuccugccucagccuc

SEQ ID NO: 407826 - RNA, 32 nt, Human
cuggguucgagcgauucuccuaccucagccuc

SEQ ID NO: 407827 - RNA, 32 nt, Human
cuggguucgagugauucuccugccucagccuc

SEQ ID NO: 407828 - RNA, 32 nt, Human
cuggguucgggugauucuccugccucagccuc

SEQ ID NO: 407829 - RNA, 22 nt, Human
cuggguucuagucccugcucug

SEQ ID NO: 407830 - RNA, 32 nt, Human
cuggguucuccccaagacuaaguucuuuccca

SEQ ID NO: 407831 - RNA, 32 nt, Human
cuggguucucugugcugggcaggcucucgugg

SEQ ID NO: 407832 - RNA, 32 nt, Human
cuggguucugcagagcuggagcucgucccugu

SEQ ID NO: 407833 - RNA, 32 nt, Human
cuggguucugugagcagagagguccauccuac

SEQ ID NO: 407834 - RNA, 32 nt, Human
cuggguucuuccacagcacaaacacaccucaa

SEQ ID NO: 407835 - RNA, 32 nt, Human
cuggguucuugggagagaggggaagagucggg

SEQ ID NO: 407836 - RNA, 32 nt, Human
cuggguugaagcaauucuucugccucagccuc

SEQ ID NO: 407837 - RNA, 32 nt, Human
cuggguugaagcgauucuugugccucagcuuc

SEQ ID NO: 407838 - RNA, 32 nt, Human
cuggguuggaaacacuuggcucucucaugagu

SEQ ID NO: 407839 - RNA, 32 nt, Human
cuggguuggcgggcuggcaggcuguagccgag

SEQ ID NO: 407840 - RNA, 32 nt, Human
cuggguugggauuacaggcgugagccaccgcg

SEQ ID NO: 407841 - RNA, 32 nt, Human
cuggguugggcugguggauguggggccuggga

SEQ ID NO: 407842 - RNA, 32 nt, Human
cuggguuggggaggcagggagcuagggcaggg

SEQ ID NO: 407843 - RNA, 32 nt, Human
cuggguugggggcucccuuagccgggccccca

SEQ ID NO: 407844 - RNA, 32 nt, Human
cuggguuggggugcuuucugcccagugggucu

SEQ ID NO: 407845 - RNA, 32 nt, Human
cuggguuggguccuggcgaaacagucuagagg

SEQ ID NO: 407846 - RNA, 32 nt, Human
cuggguuuaagcaauucuccugccucagccuc

SEQ ID NO: 407847 - RNA, 28 nt, Human
cuggguuuaagccauucuccuaccucag

SEQ ID NO: 407848 - RNA, 22 nt, Human
cuggguuuacaggcaugagcca

SEQ ID NO: 407849 - RNA, 32 nt, Human
cuggguuuagucucaauuuugguuaucuuugu

SEQ ID NO: 407850 - RNA, 32 nt, Human
cuggguuucagcaauucuccugccucagccuc

SEQ ID NO: 407851 - RNA, 32 nt, Human
cuggguuucaugagcuuggacagcaaggugga

SEQ ID NO: 407852 - RNA, 32 nt, Human
cuggguuuccuugagugucauauguccuagaa

SEQ ID NO: 407853 - RNA, 32 nt, Human
cuggguuucuagucauccuuuuuaagcugcaa

SEQ ID NO: 407854 - RNA, 32 nt, Human
cuggguuucugacuuuuuauuuggccaaugag

SEQ ID NO: 407855 - RNA, 32 nt, Human
cuggguuugagcaauccucccaccucagccuc

SEQ ID NO: 407856 - RNA, 32 nt, Human
cuggguuugagccucguucugccguuuacuag

SEQ ID NO: 407857 - RNA, 32 nt, Human
cuggguuugggcaguggagaggggacuuggau

SEQ ID NO: 407858 - RNA, 32 nt, Human
cuggguuuguaguggagugggguuguaacuug

SEQ ID NO: 407859 - RNA, 32 nt, Human
cuggguuuuaccacugcacgaccaucuggcuc

SEQ ID NO: 407860 - RNA, 32 nt, Human
cuggguuuuggagccucccuucugccuuggcu

SEQ ID NO: 407861 - RNA, 32 nt, Human
cuggguuuuguagcauuuuuauuaauauggug

SEQ ID NO: 407862 - RNA, 32 nt, Human
cugguaaaaauguucuccccuucuguggauug

SEQ ID NO: 407863 - RNA, 32 nt, Human
cugguaaaacccaggaaguaugcaguacgucu

SEQ ID NO: 407864 - RNA, 32 nt, Human
cugguaaaagccucuauuacgacuguaaguaa

SEQ ID NO: 407865 - RNA, 32 nt, Human
cugguaaaagccucuauuacgacuguuaaguu

SEQ ID NO: 407866 - RNA, 32 nt, Human
cugguaaacccagcugggagguuucuaggcag

SEQ ID NO: 407867 - RNA, 32 nt, Human
cugguaaagcagcggccagggggagccgugag

SEQ ID NO: 407868 - RNA, 32 nt, Human
cugguaaagccgaacuccuaaccucaggugcc

SEQ ID NO: 407869 - RNA, 32 nt, Human
cugguaaauguaggagagaauuaagaaucugu

SEQ ID NO: 407870 - RNA, 32 nt, Human
cugguaacacacaguugugaaaagccaguguu

SEQ ID NO: 407871 - RNA, 21 nt, Human
cugguaacagcuuuuguggga

SEQ ID NO: 407872 - RNA, 21 nt, Human
cugguaacaggauuugcugug

SEQ ID NO: 407873 - RNA, 32 nt, Human
cugguaacaggcugggugcaauggcucacacc

SEQ ID NO: 407874 - RNA, 32 nt, Human
cugguaacauaaaagcaguucaguggcccaga

SEQ ID NO: 407875 - RNA, 32 nt, Human
cugguaacauuuccuuggacauggagcucucu

SEQ ID NO: 407876 - RNA, 32 nt, Human
cugguaaccaucauaguaauaauuguucaaac

SEQ ID NO: 407877 - RNA, 31 nt, Human
cugguaacugcgguuucagccaacacucuuc

SEQ ID NO: 407878 - RNA, 32 nt, Human
cugguaagggcugagccgugggcacaggauac

SEQ ID NO: 407879 - RNA, 32 nt, Human
cugguaaggucaugggggaagggagaugagag

SEQ ID NO: 407880 - RNA, 32 nt, Human
cugguaaguaugugcuuuucuguggggguggg

SEQ ID NO: 407881 - RNA, 32 nt, Human
cugguaagucgcguuccuccccuaccccgccc

SEQ ID NO: 407882 - RNA, 32 nt, Human
cugguaaucccagcuacucagguggcugaggc

SEQ ID NO: 407883 - RNA, 32 nt, Human
cugguaaucccagcuacucaugaggcugaggc

SEQ ID NO: 407884 - RNA, 32 nt, Human
cugguaaugccagcaaccaaucagacaccacc

SEQ ID NO: 407885 - RNA, 32 nt, Human
cugguacagaaggcagaguugguacggcuguc

SEQ ID NO: 407886 - RNA, 32 nt, Human
cugguacaugccaccaggccuggccaaguuuu

SEQ ID NO: 407887 - RNA, 32 nt, Human
cugguaccaaauaguugggauuaccgaagagu

SEQ ID NO: 407888 - RNA, 32 nt, Human
cugguaccaacuccucuauugcaggguauggu

SEQ ID NO: 407889 - RNA, 32 nt, Human
cugguaccaguucuguaccauaugagaaaguu

SEQ ID NO: 407890 - RNA, 32 nt, Human
cugguacccagccugccuaacaagggagaauu

SEQ ID NO: 407891 - RNA, 32 nt, Human
cugguacccaggccuggagcagcgguacaggc

SEQ ID NO: 407892 - RNA, 32 nt, Human
cugguacccuguggggcaaccucuccaguucc

SEQ ID NO: 407893 - RNA, 32 nt, Human
cugguaccuccccuccauuauagcucucuccu

SEQ ID NO: 407894 - RNA, 32 nt, Human
cugguaccucuugcaacucucuucuaaggauc

SEQ ID NO: 407895 - RNA, 32 nt, Human
cugguacgcuggcugcuaccucccucacucuu

SEQ ID NO: 407896 - RNA, 32 nt, Human
cugguacggccuugucuucaggucucgaggcc

SEQ ID NO: 407897 - RNA, 31 nt, Human
cugguacggguggaaugggggugagacacca

SEQ ID NO: 407898 - RNA, 32 nt, Human
cugguacucaggcuggagugcgguggugugau

SEQ ID NO: 407899 - RNA, 32 nt, Human
cugguacucccaggaggcugcgggucgaugcu

SEQ ID NO: 407900 - RNA, 32 nt, Human
cugguacucccccagcccucaguuuucaguca

SEQ ID NO: 407901 - RNA, 32 nt, Human
cugguacucucaguguguucuggucaucuugu

SEQ ID NO: 407902 - RNA, 32 nt, Human
cugguacuggcucuuuucuccucuuuccuugc

SEQ ID NO: 407903 - RNA, 32 nt, Human
cugguacugggugggcaccugggagccacagg

SEQ ID NO: 407904 - RNA, 32 nt, Human
cugguacuuggcucucagccuggaguggcagc

SEQ ID NO: 407905 - RNA, 32 nt, Human
cugguacuuguccacccugccuccucuguucu

SEQ ID NO: 407906 - RNA, 22 nt, Human
cugguagaaggaagagaggcaa

SEQ ID NO: 407907 - RNA, 23 nt, Human
cugguagacaccaagcugcugug

SEQ ID NO: 407908 - RNA, 32 nt, Human
cugguagagacaggguuucaccaugcuagcaa

SEQ ID NO: 407909 - RNA, 32 nt, Human
cugguagagagucggccgggugcacuggcuca

SEQ ID NO: 407910 - RNA, 23 nt, Human
cugguagagccacaucugaugug

SEQ ID NO: 407911 - RNA, 24 nt, Human
cugguagagccugggcuugcugug

SEQ ID NO: 407912 - RNA, 21 nt, Human
cugguagaggcucuagcugug

SEQ ID NO: 407913 - RNA, 32 nt, Human
cugguagcagccugucacuccagacuguccuc

SEQ ID NO: 407914 - RNA, 32 nt, Human
cugguagccauuuaauuccucccccuaccccc

SEQ ID NO: 407915 - RNA, 32 nt, Human
cugguagcugagacugcaugcccagcuccaaa

SEQ ID NO: 407916 - RNA, 32 nt, Human
cugguagcugggauuacagggaaggaaaauag

SEQ ID NO: 407917 - RNA, 32 nt, Human
cugguagcuuccucuucaacagccacuuccgu

SEQ ID NO: 407918 - RNA, 32 nt, Human
cugguaggagagagacaggacagacccgcuuu

SEQ ID NO: 407919 - RNA, 32 nt, Human
cugguaggccgaggcaggagaaucacuugaac

SEQ ID NO: 407920 - RNA, 32 nt, Human
cugguaggcugaugccgcguccacuacuagga

SEQ ID NO: 407921 - RNA, 32 nt, Human
cugguaggguaagggagagggacccugccggu

SEQ ID NO: 407922 - RNA, 32 nt, Human
cugguagggucugccuguuggaaaguguaccu

SEQ ID NO: 407923 - RNA, 32 nt, Human
cugguagugauguauauuuuacauuugucauu

SEQ ID NO: 407924 - RNA, 21 nt, Human
cugguaguuuuuuggcaccuu

SEQ ID NO: 407925 - RNA, 32 nt, Human
cugguauaaaaacaccaaagaaggagguugcu

SEQ ID NO: 407926 - RNA, 21 nt, Human
cugguauaaccucuggcucca

SEQ ID NO: 407927 - RNA, 32 nt, Human
cugguauccagaaaccugaguggacauugggu

SEQ ID NO: 407928 - RNA, 32 nt, Human
cugguaucuuucagaguguaaaguaucuugga

SEQ ID NO: 407929 - RNA, 32 nt, Human
cugguaugagcaggaggaacaaaggaaagggg

SEQ ID NO: 407930 - RNA, 32 nt, Human
cugguaugcuggcaguggugauggugacaaca

SEQ ID NO: 407931 - RNA, 32 nt, Human
cugguaugcuuuccucucuuuuuaaaggaacu

SEQ ID NO: 407932 - RNA, 32 nt, Human
cugguauggcuauucuugaaggccagguuuua

SEQ ID NO: 407933 - RNA, 32 nt, Human
cugguaugugccaggccuacuguaaaccccaa

SEQ ID NO: 407934 - RNA, 32 nt, Human
cugguauguuaacucuuggauuucuccaaggu

SEQ ID NO: 407935 - RNA, 32 nt, Human
cugguauuccugagccucucccagcuccacuu

SEQ ID NO: 407936 - RNA, 18 nt, Human
cugguauucuuggguuuu

SEQ ID NO: 407937 - RNA, 22 nt, Human
cugguauuucuuuugguaucuu

SEQ ID NO: 407938 - RNA, 32 nt, Human
cugguauuugcuuuaacuaccugcugcuugua

SEQ ID NO: 407939 - RNA, 24 nt, Human
cuggucaacauagugaaaccccgu

SEQ ID NO: 407940 - RNA, 32 nt, Human
cuggucaacauagugaaaccccgucucuaaua

SEQ ID NO: 407941 - RNA, 24 nt, Human
cuggucaacaugaugaaacccugu

SEQ ID NO: 407942 - RNA, 32 nt, Human
cuggucaacaugaugaaacccugucuacuaaa

SEQ ID NO: 407943 - RNA, 32 nt, Human
cuggucaacauggcaaaacccugucucuacaa

SEQ ID NO: 407944 - RNA, 25 nt, Human
cuggucaacauggcaaaagcccauc

SEQ ID NO: 407945 - RNA, 32 nt, Human
cuggucaacauggcaaaagcccaucucuacua

SEQ ID NO: 407946 - RNA, 21 nt, Human
cuggucaacauggcgaaaccc

SEQ ID NO: 407947 - RNA, 22 nt, Human
cuggucaacauggcgaaacccc

SEQ ID NO: 407948 - RNA, 32 nt, Human
cuggucaacauggcgaaaccccaucucuacua

SEQ ID NO: 407949 - RNA, 32 nt, Human
cuggucaacauggcgaaaccccaucucuacug

SEQ ID NO: 407950 - RNA, 24 nt, Human
cuggucaacauggcgaaacccugu

SEQ ID NO: 407951 - RNA, 32 nt, Human
cuggucaacauggcgaaacccugucucuacaa

SEQ ID NO: 407952 - RNA, 32 nt, Human
cuggucaacauggcgaaacccugucucuacua

SEQ ID NO: 407953 - RNA, 24 nt, Human
cuggucaacauggcgaaaucccgu

SEQ ID NO: 407954 - RNA, 32 nt, Human
cuggucaacauggcgaaaucccgucucuacua

SEQ ID NO: 407955 - RNA, 21 nt, Human
cuggucaacaugguaaaaccc

SEQ ID NO: 407956 - RNA, 22 nt, Human
cuggucaacaugguaaaacccc

SEQ ID NO: 407957 - RNA, 32 nt, Human
cuggucaacaugguaaaaccccauuucugcua

SEQ ID NO: 407958 - RNA, 21 nt, Human
cuggucaacauggugaaaccc

SEQ ID NO: 407959 - RNA, 32 nt, Human
cuggucaacauggugaaacccagccucuacua

SEQ ID NO: 407960 - RNA, 22 nt, Human
cuggucaacauggugaaacccc

SEQ ID NO: 407961 - RNA, 32 nt, Human
cuggucaacauggugaaaccccaucuccacua

SEQ ID NO: 407962 - RNA, 32 nt, Human
cuggucaacauggugaaaccccaucucuacua

SEQ ID NO: 407963 - RNA, 32 nt, Human
cuggucaacauggugaaacccccuaucuacua

SEQ ID NO: 407964 - RNA, 24 nt, Human
cuggucaacauggugaaaccccgu

SEQ ID NO: 407965 - RNA, 32 nt, Human
cuggucaacauggugaaaccccgucuccacua

SEQ ID NO: 407966 - RNA, 32 nt, Human
cuggucaacauggugaaaccccgucucuacua

SEQ ID NO: 407967 - RNA, 32 nt, Human
cuggucaacauggugaaaccccuucucuacua

SEQ ID NO: 407968 - RNA, 24 nt, Human
cuggucaacauggugaaacccugu

SEQ ID NO: 407969 - RNA, 32 nt, Human
cuggucaacauggugaaacccugucccuacua

SEQ ID NO: 407970 - RNA, 32 nt, Human
cuggucaacauggugaaacccugucucuacua

SEQ ID NO: 407971 - RNA, 32 nt, Human
cuggucaacauggugaaacccugucucuagua

SEQ ID NO: 407972 - RNA, 32 nt, Human
cuggucaacauggugaaacccugucucuccua

SEQ ID NO: 407973 - RNA, 32 nt, Human
cuggucaacauggugaaacccugucucugcua

SEQ ID NO: 407974 - RNA, 32 nt, Human
cuggucaacauggugaaaccuugucucuacua

SEQ ID NO: 407975 - RNA, 32 nt, Human
cuggucaacauggugaaacucugucucuacuc

SEQ ID NO: 407976 - RNA, 32 nt, Human
cuggucaacauggugaaacugugucucuacua

SEQ ID NO: 407977 - RNA, 32 nt, Human
cuggucaacauggugaaaucuugucucuagua

SEQ ID NO: 407978 - RNA, 24 nt, Human
cuggucaacuugguaaaaccccgu

SEQ ID NO: 407979 - RNA, 32 nt, Human
cuggucaacuuggugaaaacacguaucuacua

SEQ ID NO: 407980 - RNA, 32 nt, Human
cuggucaagagcaguguccaugugcguuucug

SEQ ID NO: 407981 - RNA, 32 nt, Human
cuggucaagauggugaaaccccaucucuacua

SEQ ID NO: 407982 - RNA, 32 nt, Human
cuggucaagcuccccucacucuguuuccuggu

SEQ ID NO: 407983 - RNA, 32 nt, Human
cuggucaaggcagaggaggagaggaggaaagg

SEQ ID NO: 407984 - RNA, 22 nt, Human
cuggucaauauggugaaacccc

SEQ ID NO: 407985 - RNA, 32 nt, Human
cuggucaauauggugaaaccccaucucuacua

SEQ ID NO: 407986 - RNA, 32 nt, Human
cuggucacagagucuccugggcacagguuaua

SEQ ID NO: 407987 - RNA, 20 nt, Human
cuggucacagcacccuugaa

SEQ ID NO: 407988 - RNA, 32 nt, Human
cuggucaccaggccacagcccaaggcagagcu

SEQ ID NO: 407989 - RNA, 32 nt, Human
cuggucaccccaggcuugagaacaggugacca

SEQ ID NO: 407990 - RNA, 32 nt, Human
cuggucacccuccaucucugaggguauggggg

SEQ ID NO: 407991 - RNA, 32 nt, Human
cuggucacgggagggaaugaaaaaugccagcg

SEQ ID NO: 407992 - RNA, 25 nt, Human
cuggucacucugcccucugcugcug

SEQ ID NO: 407993 - RNA, 32 nt, Human
cuggucacugacugcuuacucuaccuuagcug

SEQ ID NO: 407994 - RNA, 32 nt, Human
cuggucacugcaaccucugccuccuggguuca

SEQ ID NO: 407995 - RNA, 32 nt, Human
cuggucacugcaguguaccccacuuucccgac

SEQ ID NO: 407996 - RNA, 32 nt, Human
cuggucacugcuggcccuagcauuggacccua

SEQ ID NO: 407997 - RNA, 32 nt, Human
cuggucacuuugaggucucugaagggaagggc

SEQ ID NO: 407998 - RNA, 16 nt, Human
cuggucagaaagggaa

SEQ ID NO: 407999 - RNA, 32 nt, Human
cuggucagaagugugccugucggcggggagag

SEQ ID NO: 408000 - RNA, 32 nt, Human
cuggucagacuggcuggcgugucacucagccg

SEQ ID NO: 408001 - RNA, 32 nt, Human
cuggucagagagaccucauccugcucuuuugu

SEQ ID NO: 408002 - RNA, 32 nt, Human
cuggucagaggagaggaugcugugagggacag

SEQ ID NO: 408003 - RNA, 32 nt, Human
cuggucagcagcacaaagacagagccaggcag

SEQ ID NO: 408004 - RNA, 24 nt, Human
cuggucagcauggcaaaaccccgu

SEQ ID NO: 408005 - RNA, 22 nt, Human
cuggucagcauggugaaacgcc

SEQ ID NO: 408006 - RNA, 32 nt, Human
cuggucagcauggugaaacgccaucccuacua

SEQ ID NO: 408007 - RNA, 32 nt, Human
cuggucagccugcaguaccucuaccuccagga

SEQ ID NO: 408008 - RNA, 30 nt, Human
cuggucagcuugcucagauagaucuguguu

SEQ ID NO: 408009 - RNA, 32 nt, Human
cuggucaggcccaggcugagugagaugagcug

SEQ ID NO: 408010 - RNA, 32 nt, Human
cuggucagggagaacccagcuugggcagagug

SEQ ID NO: 408011 - RNA, 32 nt, Human
cuggucagggcugaguacaguccuggggguaa

SEQ ID NO: 408012 - RNA, 19 nt, Human
cuggucaguagaaagggaa

SEQ ID NO: 408013 - RNA, 32 nt, Human
cuggucaguccugucugaucgaggccucgccu

SEQ ID NO: 408014 - RNA, 32 nt, Human
cuggucauccccucagucuguagcccuuuugu

SEQ ID NO: 408015 - RNA, 32 nt, Human
cuggucauccugagccccuccuggccucaggg

SEQ ID NO: 408016 - RNA, 32 nt, Human
cuggucauccuugggugaccuggagcuggugc

SEQ ID NO: 408017 - RNA, 32 nt, Human
cuggucaugguggcucaugccuauaaucccaa

SEQ ID NO: 408018 - RNA, 32 nt, Human
cuggucauggugguauguaccuguaguuccag

SEQ ID NO: 408019 - RNA, 23 nt, Human
cuggucauugcuggugucuucug

SEQ ID NO: 408020 - RNA, 32 nt, Human
cugguccaccccaggucccugguuugcccacc

SEQ ID NO: 408021 - RNA, 32 nt, Human
cugguccaccccguccugacccccucugccug

SEQ ID NO: 408022 - RNA, 32 nt, Human
cugguccaccucacuccuccaugggcuucuug

SEQ ID NO: 408023 - RNA, 32 nt, Human
cugguccacuccucauccuggugucuucagcu

SEQ ID NO: 408024 - RNA, 20 nt, Human
cugguccacugaaccuggaa

SEQ ID NO: 408025 - RNA, 32 nt, Human
cugguccagaagacagaggguacaacaguggc

SEQ ID NO: 408026 - RNA, 32 nt, Human
cugguccagagagaaagagacagcaccugccc

SEQ ID NO: 408027 - RNA, 20 nt, Human
cugguccagccagggaucuu

SEQ ID NO: 408028 - RNA, 31 nt, Human
cugguccaugcuucugaaccugugucugcca

SEQ ID NO: 408029 - RNA, 19 nt, Human
cugguccauucauuuucca

SEQ ID NO: 408030 - RNA, 32 nt, Human
cuggucccacagauaccacugcugcucccgcc

SEQ ID NO: 408031 - RNA, 32 nt, Human
cuggucccaccaccuggcaucucuccacuccc

SEQ ID NO: 408032 - RNA, 32 nt, Human
cuggucccagaacccaaggggaagacaugcug

SEQ ID NO: 408033 - RNA, 32 nt, Human
cuggucccagcacaccuggaaaguucugcaag

SEQ ID NO: 408034 - RNA, 32 nt, Human
cuggucccagcagguaugggcagguugcuuga

SEQ ID NO: 408035 - RNA, 32 nt, Human
cuggucccagggaggccucucugcccuauggg

SEQ ID NO: 408036 - RNA, 32 nt, Human
cuggucccaucuucugcccgcuccuccaggaa

SEQ ID NO: 408037 - RNA, 23 nt, Human
cugguccccagccccugcuacug

SEQ ID NO: 408038 - RNA, 32 nt, Human
cugguccccaggaagugguggugguugauggc

SEQ ID NO: 408039 - RNA, 32 nt, Human
cugguccccagucucagacucucagcucuuca

SEQ ID NO: 408040 - RNA, 32 nt, Human
cuggucccccuggucugugugcucugagccgu

SEQ ID NO: 408041 - RNA, 18 nt, Human
cugguccccuccaccaaa

SEQ ID NO: 408042 - RNA, 32 nt, Human
cugguccccugccucuacugccggcgccugcg

SEQ ID NO: 408043 - RNA, 32 nt, Human
cugguccccuugagucaucaccagcuucccca

SEQ ID NO: 408044 - RNA, 32 nt, Human
cuggucccuaccucucugcugugucuucaugu

SEQ ID NO: 408045 - RNA, 32 nt, Human
cuggucccucugcacagcuccaaccaacagga

SEQ ID NO: 408046 - RNA, 32 nt, Human
cuggucccugcucuucagugggucaucugugu

SEQ ID NO: 408047 - RNA, 32 nt, Human
cuggucccugcugucccugccuggcugaacga

SEQ ID NO: 408048 - RNA, 32 nt, Human
cuggucccugggaggucacugcuucaaaagga

SEQ ID NO: 408049 - RNA, 32 nt, Human
cuggucccuuuucagcaagauucauguuaucc

SEQ ID NO: 408050 - RNA, 21 nt, Human
cugguccgaggagugugcuca

SEQ ID NO: 408051 - RNA, 32 nt, Human
cugguccgcugcuccccaccuaccagggucgg

SEQ ID NO: 408052 - RNA, 32 nt, Human
cugguccuaagagugaaggaaagcaggcguag

SEQ ID NO: 408053 - RNA, 32 nt, Human
cugguccuacuuccugccccucuccaggccca

SEQ ID NO: 408054 - RNA, 20 nt, Human
cugguccucacaggggccuu

SEQ ID NO: 408055 - RNA, 32 nt, Human
cugguccuccagggcacugacuuugcccuuuu

SEQ ID NO: 408056 - RNA, 32 nt, Human
cugguccugcagauguguagcacuuuguaguu

SEQ ID NO: 408057 - RNA, 32 nt, Human
cugguccugcagccuuucucgccgucagcgcc

SEQ ID NO: 408058 - RNA, 32 nt, Human
cugguccugccucacuggacagccucuccgcg

SEQ ID NO: 408059 - RNA, 32 nt, Human
cugguccugcugcuggcugccucucugcucca

SEQ ID NO: 408060 - RNA, 32 nt, Human
cugguccugcuggcuuugauuucucugggucu

SEQ ID NO: 408061 - RNA, 32 nt, Human
cugguccugcugucuugguuuugucuuggcuc

SEQ ID NO: 408062 - RNA, 32 nt, Human
cugguccugcuguuuccuccagucucacugca

SEQ ID NO: 408063 - RNA, 32 nt, Human
cugguccuggccuggggcagagccuguguguu

SEQ ID NO: 408064 - RNA, 32 nt, Human
cugguccuggcuuuauggaacaccauguuuuu

SEQ ID NO: 408065 - RNA, 32 nt, Human
cugguccugggaaagaaagugggaaaagcuuu

SEQ ID NO: 408066 - RNA, 32 nt, Human
cugguccuuauuuacuccucugccuuccauug

SEQ ID NO: 408067 - RNA, 32 nt, Human
cugguccuuuuuaaacuacuaguuuuaaaaac

SEQ ID NO: 408068 - RNA, 32 nt, Human
cuggucgcacagcuggucaugggugagugugg

SEQ ID NO: 408069 - RNA, 32 nt, Human
cuggucgcgguggcucacaccuguaaucccag

SEQ ID NO: 408070 - RNA, 32 nt, Human
cuggucgggcugggacccuuugccccuuagga

SEQ ID NO: 408071 - RNA, 18 nt, Human
cuggucggggcugucugg

SEQ ID NO: 408072 - RNA, 32 nt, Human
cuggucgggggccugggcuggugcuucauggu

SEQ ID NO: 408073 - RNA, 32 nt, Human
cuggucguggacugugguugggggagguggga

SEQ ID NO: 408074 - RNA, 32 nt, Human
cuggucguugcacuccagccugucgcugugca

SEQ ID NO: 408075 - RNA, 32 nt, Human
cuggucguuggugacagcgaggcuuccgcgcu

SEQ ID NO: 408076 - RNA, 32 nt, Human
cuggucuaagcugcucaagauucaggagacag

SEQ ID NO: 408077 - RNA, 32 nt, Human
cuggucuacauggugaaaccccaucucaacua

SEQ ID NO: 408078 - RNA, 32 nt, Human
cuggucuagucuccuuuuagagaugagaaaac

SEQ ID NO: 408079 - RNA, 32 nt, Human
cuggucuaugaaaaucucuagaugggcuccac

SEQ ID NO: 408080 - RNA, 32 nt, Human
cuggucucaaaacuggccacugccucagccac

SEQ ID NO: 408081 - RNA, 32 nt, Human
cuggucucaaacuccugaccucaaggaucugu

SEQ ID NO: 408082 - RNA, 32 nt, Human
cuggucucaaacuccugaccucaggcaaucug

SEQ ID NO: 408083 - RNA, 32 nt, Human
cuggucucaaacuccugaccucaggcgaucca

SEQ ID NO: 408084 - RNA, 32 nt, Human
cuggucucaaacuccugaccucaggcgauccg

SEQ ID NO: 408085 - RNA, 32 nt, Human
cuggucucaaacuccugagcucaggccaucug

SEQ ID NO: 408086 - RNA, 23 nt, Human
cuggucucaaacuccugggcuca

SEQ ID NO: 408087 - RNA, 32 nt, Human
cuggucucaaacugcugacuucaggugaucca

SEQ ID NO: 408088 - RNA, 32 nt, Human
cuggucucaagcaaucugcccgccucggccuc

SEQ ID NO: 408089 - RNA, 32 nt, Human
cuggucucaagcaguccucccaccucagccuc

SEQ ID NO: 408090 - RNA, 32 nt, Human
cuggucucaagccauucucccaccucuguccu

SEQ ID NO: 408091 - RNA, 18 nt, Human
cuggucucaagcggcaga

SEQ ID NO: 408092 - RNA, 32 nt, Human
cuggucucacugcaaccucuaccucccagguu

SEQ ID NO: 408093 - RNA, 32 nt, Human
cuggucucauccagcagaagcuaucuuaaauc

SEQ ID NO: 408094 - RNA, 32 nt, Human
cuggucuccaacuccugaccucagauggucca

SEQ ID NO: 408095 - RNA, 32 nt, Human
cuggucuccaacuccugaccucaggcgaucca

SEQ ID NO: 408096 - RNA, 32 nt, Human
cuggucuccagaaaaagaacacauacacauau

SEQ ID NO: 408097 - RNA, 18 nt, Human
cuggucuccagaggaccu

SEQ ID NO: 408098 - RNA, 32 nt, Human
cuggucuccagaggaccuugguguuugcucuc

SEQ ID NO: 408099 - RNA, 32 nt, Human
cuggucuccagcuccugagcucaggccaucca

SEQ ID NO: 408100 - RNA, 32 nt, Human
cuggucucccggagccagguggagucucgcuc

SEQ ID NO: 408101 - RNA, 18 nt, Human
cuggucucccuggguuuu

SEQ ID NO: 408102 - RNA, 18 nt, Human
cuggucuccguggcacuu

SEQ ID NO: 408103 - RNA, 32 nt, Human
cuggucuccuccagcuccuucuuucugcaaca

SEQ ID NO: 408104 - RNA, 32 nt, Human
cuggucuccucuagccuguuuguuguggggug

SEQ ID NO: 408105 - RNA, 32 nt, Human
cuggucuccugggagagaggggugagggaugu

SEQ ID NO: 408106 - RNA, 32 nt, Human
cuggucucgaacucccgaccucuggugaucug

SEQ ID NO: 408107 - RNA, 32 nt, Human
cuggucucgaacuccugaccucaaguggucca

SEQ ID NO: 408108 - RNA, 32 nt, Human
cuggucucgaacuccugaccucaaguggucua

SEQ ID NO: 408109 - RNA, 32 nt, Human
cuggucucgaacuccugaccucaggcaaucca

SEQ ID NO: 408110 - RNA, 32 nt, Human
cuggucucgaacuccugaccucaggcgaucca

SEQ ID NO: 408111 - RNA, 27 nt, Human
cuggucucgaacuccugaccucaggug

SEQ ID NO: 408112 - RNA, 32 nt, Human
cuggucucgaacuccugaccucaguugaucca

SEQ ID NO: 408113 - RNA, 32 nt, Human
cuggucucgaacuccugaccucaguugauccg

SEQ ID NO: 408114 - RNA, 32 nt, Human
cuggucucgaacuccugaccucaugagccgcc

SEQ ID NO: 408115 - RNA, 32 nt, Human
cuggucucgaacuccugaccucaugaucugcc

SEQ ID NO: 408116 - RNA, 32 nt, Human
cuggucucgaacuccugaccucaugauuugcc

SEQ ID NO: 408117 - RNA, 32 nt, Human
cuggucucgaacuccugaccucgggauccacc

SEQ ID NO: 408118 - RNA, 32 nt, Human
cuggucucgaacuccugaccucgugauuggcc

SEQ ID NO: 408119 - RNA, 23 nt, Human
cuggucucgaacuccugggcuca

SEQ ID NO: 408120 - RNA, 32 nt, Human
cuggucucgaacucuggaccucagaucuugua

SEQ ID NO: 408121 - RNA, 32 nt, Human
cuggucucgaauuccuggccucaacgaucguc

SEQ ID NO: 408122 - RNA, 32 nt, Human
cuggucucggucugcugacgucagggucagcu

SEQ ID NO: 408123 - RNA, 19 nt, Human
cuggucucgucugggaccu

SEQ ID NO: 408124 - RNA, 32 nt, Human
cuggucucucccaccugguuggaaaugucguu

SEQ ID NO: 408125 - RNA, 18 nt, Human
cuggucucucuagggccu

SEQ ID NO: 408126 - RNA, 32 nt, Human
cuggucucugucccucugccuccccggaagaa

SEQ ID NO: 408127 - RNA, 18 nt, Human
cuggucucuugcgguccu

SEQ ID NO: 408128 - RNA, 18 nt, Human
cuggucucuuggugccuu

SEQ ID NO: 408129 - RNA, 32 nt, Human
cuggucugaaguucugggauguuuucaguuug

SEQ ID NO: 408130 - RNA, 32 nt, Human
cuggucugaaucuggaguaauuaaugccaccc

SEQ ID NO: 408131 - RNA, 19 nt, Human
cuggucugacuuaugcuua

SEQ ID NO: 408132 - RNA, 32 nt, Human
cuggucugagcagcgcuuccagagccagaacu

SEQ ID NO: 408133 - RNA, 32 nt, Human
cuggucugaggggcaacugagucugcgggaga

SEQ ID NO: 408134 - RNA, 32 nt, Human
cuggucugcacuccccugcggccugcugcugg

SEQ ID NO: 408135 - RNA, 32 nt, Human
cuggucugcaucagaggcuggggccuggggcg

SEQ ID NO: 408136 - RNA, 32 nt, Human
cuggucugcugcugcaggcuucaucuaaaacu

SEQ ID NO: 408137 - RNA, 32 nt, Human
cuggucuggaaccccuggccucgggugaucca

SEQ ID NO: 408138 - RNA, 23 nt, Human
cuggucuggaaccccugggcuca

SEQ ID NO: 408139 - RNA, 32 nt, Human
cuggucuggaacuccuggccuccagucauuug

SEQ ID NO: 408140 - RNA, 23 nt, Human
cuggucuggaacuucugaguuca

SEQ ID NO: 408141 - RNA, 32 nt, Human
cuggucuggccuggccguguggugaugaggcu

SEQ ID NO: 408142 - RNA, 32 nt, Human
cuggucuggcugggacuuuccauuucuaaauc

SEQ ID NO: 408143 - RNA, 32 nt, Human
cuggucugggggcagagguggcaugcagggcu

SEQ ID NO: 408144 - RNA, 23 nt, Human
cuggucuuaaacuccugggcuca

SEQ ID NO: 408145 - RNA, 17 nt, Human
cuggucuuagggauuuu

SEQ ID NO: 408146 - RNA, 18 nt, Human
cuggucuucacugacuuu

SEQ ID NO: 408147 - RNA, 18 nt, Human
cuggucuuccaagacuuu

SEQ ID NO: 408148 - RNA, 18 nt, Human
cuggucuucucacacuuu

SEQ ID NO: 408149 - RNA, 19 nt, Human
cuggucuucuggucuccuu

SEQ ID NO: 408150 - RNA, 32 nt, Human
cuggucuucuguacucaggggcuggucuccca

SEQ ID NO: 408151 - RNA, 32 nt, Human
cuggucuugaacccuugaccucaggucaucca

SEQ ID NO: 408152 - RNA, 32 nt, Human
cuggucuugaacuccugaccucaacuggucca

SEQ ID NO: 408153 - RNA, 32 nt, Human
cuggucuugaacuccugaccucaaguggucca

SEQ ID NO: 408154 - RNA, 23 nt, Human
cuggucuugaacuccugggcuca

SEQ ID NO: 408155 - RNA, 32 nt, Human
cuggucuugaacucucgaccucaggaaaccug

SEQ ID NO: 408156 - RNA, 32 nt, Human
cuggucuugaacugggcuuaggcuccacugcc

SEQ ID NO: 408157 - RNA, 32 nt, Human
cuggucuuggacuccugaccucaugcuccacc

SEQ ID NO: 408158 - RNA, 32 nt, Human
cuggucuugggacuucucagccuccauaauca

SEQ ID NO: 408159 - RNA, 32 nt, Human
cuggucuugugaacuccuggccucaggugauc

SEQ ID NO: 408160 - RNA, 32 nt, Human
cuggucuuguggaauugggagcuugggaaugg

SEQ ID NO: 408161 - RNA, 32 nt, Human
cuggucuuuaacuccugaccucagguguucca

SEQ ID NO: 408162 - RNA, 18 nt, Human
cuggucuuuaaugaucuu

SEQ ID NO: 408163 - RNA, 22 nt, Human
cuggucuuuagccccacugcug

SEQ ID NO: 408164 - RNA, 32 nt, Human
cuggucuuuauuccucccucaugagcacaggg

SEQ ID NO: 408165 - RNA, 32 nt, Human
cuggucuuucuccuugacacagacagaagagg

SEQ ID NO: 408166 - RNA, 16 nt, Human
cuggucuuuuguccuu

SEQ ID NO: 408167 - RNA, 18 nt, Human
cuggucuuuuucuaccuu

SEQ ID NO: 408168 - RNA, 24 nt, Human
cuggugaacauggcgaaaccccgu

SEQ ID NO: 408169 - RNA, 32 nt, Human
cuggugaagagacaauucaagccuuagugacu

SEQ ID NO: 408170 - RNA, 32 nt, Human
cuggugaagaggaggaagaagagguguggaca

SEQ ID NO: 408171 - RNA, 32 nt, Human
cuggugaagauguggagaaaagggaacccuua

SEQ ID NO: 408172 - RNA, 20 nt, Human
cuggugaagggacccgggca

SEQ ID NO: 408173 - RNA, 32 nt, Human
cuggugaaguggguggagcaucagcguuugcu

SEQ ID NO: 408174 - RNA, 32 nt, Human
cuggugaaugagagagccccagccugacccaa

SEQ ID NO: 408175 - RNA, 32 nt, Human
cuggugacacguggcuguacauucagcacagc

SEQ ID NO: 408176 - RNA, 32 nt, Human
cuggugacagaacaugcagcaaggggacaucu

SEQ ID NO: 408177 - RNA, 24 nt, Human
cuggugacccagcgaaaccagcuu

SEQ ID NO: 408178 - RNA, 32 nt, Human
cuggugacccuccaagaugccccugcccucag

SEQ ID NO: 408179 - RNA, 32 nt, Human
cuggugaccgagaagagagcagagccacugcc

SEQ ID NO: 408180 - RNA, 32 nt, Human
cuggugaccugggguccugggcugggauagcu

SEQ ID NO: 408181 - RNA, 32 nt, Human
cuggugacuaaggaaggacuacagaggcuuug

SEQ ID NO: 408182 - RNA, 32 nt, Human
cuggugacuagagcuguggccaugaaggugga

SEQ ID NO: 408183 - RNA, 32 nt, Human
cuggugacuaguacauguauuucuccauaagc

SEQ ID NO: 408184 - RNA, 32 nt, Human
cuggugacuauacaguuugaaauacuauuuuu

SEQ ID NO: 408185 - RNA, 32 nt, Human
cuggugacugucccuucgacacggaccugcuu

SEQ ID NO: 408186 - RNA, 32 nt, Human
cuggugagagaggagucagguggccuucccac

SEQ ID NO: 408187 - RNA, 32 nt, Human
cuggugagcuugggccugcucuccuuuccauc

SEQ ID NO: 408188 - RNA, 18 nt, Human
cuggugaggagggcgcag

SEQ ID NO: 408189 - RNA, 32 nt, Human
cuggugagggacugggucauggagacugcagu

SEQ ID NO: 408190 - RNA, 31 nt, Human
cuggugagggcgacugggugggugaagcacc

SEQ ID NO: 408191 - RNA, 32 nt, Human
cuggugagggcuggagccaaggagaacacagu

SEQ ID NO: 408192 - RNA, 32 nt, Human
cuggugaggugcagagagucccucuaguggcc

SEQ ID NO: 408193 - RNA, 32 nt, Human
cuggugagguggaaauuccagcaagaauagag

SEQ ID NO: 408194 - RNA, 32 nt, Human
cuggugagucaccacuucagggcuuuacuccg

SEQ ID NO: 408195 - RNA, 32 nt, Human
cuggugaucucucagcaggccaaggccagaca

SEQ ID NO: 408196 - RNA, 32 nt, Human
cuggugaugguggagggugagagggugccguu

SEQ ID NO: 408197 - RNA, 32 nt, Human
cuggugaugucacaucuuggcagggguggagg

SEQ ID NO: 408198 - RNA, 32 nt, Human
cuggugauguuggaacauuaaugauggaacau

SEQ ID NO: 408199 - RNA, 32 nt, Human
cuggugcaaccagcaagucuuccaguaugaau

SEQ ID NO: 408200 - RNA, 32 nt, Human
cuggugcaccuugcuggcacggugccucagga

SEQ ID NO: 408201 - RNA, 32 nt, Human
cuggugcagacaccaaggcugcccagugguac

SEQ ID NO: 408202 - RNA, 32 nt, Human
cuggugcagcagcaucuugucacugcacaaca

SEQ ID NO: 408203 - RNA, 24 nt, Human
cuggugcagcagccucuggugcug

SEQ ID NO: 408204 - RNA, 32 nt, Human
cuggugcagccuacauggcacaggauauuucc

SEQ ID NO: 408205 - RNA, 32 nt, Human
cuggugcagggacuccagugaguagggcuggu

SEQ ID NO: 408206 - RNA, 32 nt, Human
cuggugcauccuaggucauccaagagugagcg

SEQ ID NO: 408207 - RNA, 32 nt, Human
cuggugcauggaauuggaaccauaggucuuag

SEQ ID NO: 408208 - RNA, 32 nt, Human
cuggugccaaaaaggcuggggaccacugcccu

SEQ ID NO: 408209 - RNA, 32 nt, Human
cuggugccaaagccucgcuuuggguggcccaa

SEQ ID NO: 408210 - RNA, 18 nt, Human
cuggugccaaauggggca

SEQ ID NO: 408211 - RNA, 32 nt, Human
cuggugccaagcucacuccugcuucucucugc

SEQ ID NO: 408212 - RNA, 32 nt, Human
cuggugccacagaucuggagguaugauagguc

SEQ ID NO: 408213 - RNA, 32 nt, Human
cuggugccaccugagcacucagagcugagcga

SEQ ID NO: 408214 - RNA, 32 nt, Human
cuggugccaggguggguguccaugugcacccg

SEQ ID NO: 408215 - RNA, 32 nt, Human
cuggugcccagccugugcccucgcaggucuug

SEQ ID NO: 408216 - RNA, 32 nt, Human
cuggugcccaggcuggagugggcgccaucuug

SEQ ID NO: 408217 - RNA, 32 nt, Human
cuggugcccagguggaggugcaguggggguaa

SEQ ID NO: 408218 - RNA, 32 nt, Human
cuggugcccgagccucucagggccagaccaga

SEQ ID NO: 408219 - RNA, 23 nt, Human
cuggugcccggcccuuggugcug

SEQ ID NO: 408220 - RNA, 22 nt, Human
cuggugcccugcgucccgggau

SEQ ID NO: 408221 - RNA, 32 nt, Human
cuggugccgggaggguggagguagauguaccu

SEQ ID NO: 408222 - RNA, 32 nt, Human
cuggugccuaucugccuggaggcaaaggccug

SEQ ID NO: 408223 - RNA, 32 nt, Human
cuggugccucaggccuuucuccacuccccuug

SEQ ID NO: 408224 - RNA, 32 nt, Human
cuggugccugugugggucagcccagcccucca

SEQ ID NO: 408225 - RNA, 32 nt, Human
cuggugccuugaucuuggacuucccagccucu

SEQ ID NO: 408226 - RNA, 32 nt, Human
cuggugccuuucuucccaccucgcuugccugu

SEQ ID NO: 408227 - RNA, 31 nt, Human
cuggugcgacuucucccugcgcuagcgaggc

SEQ ID NO: 408228 - RNA, 32 nt, Human
cuggugcggcggugcuggagguugcggcggcg

SEQ ID NO: 408229 - RNA, 23 nt, Human
cuggugcguuugggcuuggugug

SEQ ID NO: 408230 - RNA, 32 nt, Human
cuggugcuauucugccaaguuaucgagcuccu

SEQ ID NO: 408231 - RNA, 32 nt, Human
cuggugcucacugggaccccauaugucugcgu

SEQ ID NO: 408232 - RNA, 32 nt, Human
cuggugcucagcuaugucaauggucuuccccc

SEQ ID NO: 408233 - RNA, 20 nt, Human
cuggugcucggucccgggcc

SEQ ID NO: 408234 - RNA, 32 nt, Human
cuggugcucguacacguccugaggcagccgcc

SEQ ID NO: 408235 - RNA, 32 nt, Human
cuggugcugaauaaaggguguugcugucaugg

SEQ ID NO: 408236 - RNA, 32 nt, Human
cuggugcugagccucugcucccaccgggugaa

SEQ ID NO: 408237 - RNA, 32 nt, Human
cuggugcugccucccgcacaaggagaccugga

SEQ ID NO: 408238 - RNA, 32 nt, Human
cuggugcugcugcuggguggcugcuccgggcg

SEQ ID NO: 408239 - RNA, 22 nt, Human
cuggugcugcugguggugcugc

SEQ ID NO: 408240 - RNA, 32 nt, Human
cuggugcuggagcaguuccucacuauccugcc

SEQ ID NO: 408241 - RNA, 32 nt, Human
cuggugcugggcaccaaugagaagcucaucug

SEQ ID NO: 408242 - RNA, 24 nt, Human
cuggugcugugacuccugcugcug

SEQ ID NO: 408243 - RNA, 32 nt, Human
cuggugcuguggauagucuuucccucuccccu

SEQ ID NO: 408244 - RNA, 32 nt, Human
cuggugcuguuagagcacuucugcucugcccu

SEQ ID NO: 408245 - RNA, 32 nt, Human
cuggugcuuagagacuaucaacucccuccuuu

SEQ ID NO: 408246 - RNA, 32 nt, Human
cugguggaagcaugugcagggagaccauauca

SEQ ID NO: 408247 - RNA, 32 nt, Human
cugguggacacccagccccagcucugccugaa

SEQ ID NO: 408248 - RNA, 32 nt, Human
cugguggacaggcugcaucaucccaugaacag

SEQ ID NO: 408249 - RNA, 32 nt, Human
cugguggagcuggugcggcugaaggagcuggc

SEQ ID NO: 408250 - RNA, 32 nt, Human
cugguggaggagcugggcuucucuccaaggac

SEQ ID NO: 408251 - RNA, 32 nt, Human
cugguggaggcggccugucaauucagccuugu

SEQ ID NO: 408252 - RNA, 32 nt, Human
cugguggaggcugcugugggacggucaggcca

SEQ ID NO: 408253 - RNA, 32 nt, Human
cugguggaggggcggcggcuguuccgcguggg

SEQ ID NO: 408254 - RNA, 32 nt, Human
cugguggcaaagcuaucaccauuuaaugucuu

SEQ ID NO: 408255 - RNA, 32 nt, Human
cugguggcacucuccugaccucacgcugccaa

SEQ ID NO: 408256 - RNA, 32 nt, Human
cugguggcagaggccuguaaucccagcuacuu

SEQ ID NO: 408257 - RNA, 32 nt, Human
cugguggcagcuauguuuaagagaccagcguc

SEQ ID NO: 408258 - RNA, 32 nt, Human
cugguggcaggcaccuguaaucccagcuacuu

SEQ ID NO: 408259 - RNA, 32 nt, Human
cugguggcaggcaccuguaaucccagcugccc

SEQ ID NO: 408260 - RNA, 32 nt, Human
cugguggcaguugcagaugagaaaugcuuaca

SEQ ID NO: 408261 - RNA, 32 nt, Human
cugguggccacugcuacagcugguccacagag

SEQ ID NO: 408262 - RNA, 32 nt, Human
cugguggccaggaaguuucagguugaagggaa

SEQ ID NO: 408263 - RNA, 22 nt, Human
cugguggcccccauucuuacca

SEQ ID NO: 408264 - RNA, 32 nt, Human
cugguggcccugcuucuucccauugaaacuac

SEQ ID NO: 408265 - RNA, 32 nt, Human
cugguggcccugugccugggcccugggcugau

SEQ ID NO: 408266 - RNA, 19 nt, Human
cugguggccgccgcugcug

SEQ ID NO: 408267 - RNA, 32 nt, Human
cugguggccggcgccuccuuccucgcguuccg

SEQ ID NO: 408268 - RNA, 32 nt, Human
cugguggccuguacaggcccagcacugguugg

SEQ ID NO: 408269 - RNA, 32 nt, Human
cugguggcgcugaagggaaggagccagugagc

SEQ ID NO: 408270 - RNA, 32 nt, Human
cugguggcuagagagaaaaguagaaaaccaga

SEQ ID NO: 408271 - RNA, 32 nt, Human
cugguggcucaugccuguaauccagcacuuug

SEQ ID NO: 408272 - RNA, 32 nt, Human
cugguggcuggaagccacccugcuuuagauca

SEQ ID NO: 408273 - RNA, 21 nt, Human
cugguggcuggagcaggggug

SEQ ID NO: 408274 - RNA, 32 nt, Human
cugguggcuguauuagcuaggaaagguuugua

SEQ ID NO: 408275 - RNA, 32 nt, Human
cugguggcuguuggcagcagauucaggugccu

SEQ ID NO: 408276 - RNA, 32 nt, Human
cugguggcuuucaaacuucagaccaugaucug

SEQ ID NO: 408277 - RNA, 32 nt, Human
cuggugggaagacagcuggaaaggcugggagg

SEQ ID NO: 408278 - RNA, 32 nt, Human
cuggugggaaggagggagggagggcggugacu

SEQ ID NO: 408279 - RNA, 32 nt, Human
cuggugggagcccgccucgcaccagcugcacc

SEQ ID NO: 408280 - RNA, 32 nt, Human
cuggugggagccucuggcugcaucugugcagc

SEQ ID NO: 408281 - RNA, 32 nt, Human
cuggugggagguaauugaaucauuggggcagu

SEQ ID NO: 408282 - RNA, 32 nt, Human
cuggugggaucugaggcacucucucgaaugcc

SEQ ID NO: 408283 - RNA, 32 nt, Human
cuggugggcaccaagagccaauggaguagacc

SEQ ID NO: 408284 - RNA, 32 nt, Human
cuggugggcaggggccaucuccccacuccgcu

SEQ ID NO: 408285 - RNA, 32 nt, Human
cuggugggccccgggcccucagccucucuugu

SEQ ID NO: 408286 - RNA, 32 nt, Human
cuggugggcggaucgccugagaucaggaguuc

SEQ ID NO: 408287 - RNA, 32 nt, Human
cuggugggcuguucagcuuccugcugcugggg

SEQ ID NO: 408288 - RNA, 32 nt, Human
cugguggggacucaggcugggugcagccucca

SEQ ID NO: 408289 - RNA, 32 nt, Human
cugguggggaggcaggcuggugguggagucau

SEQ ID NO: 408290 - RNA, 32 nt, Human
cugguggggcaguggaggauugaggagauauu

SEQ ID NO: 408291 - RNA, 32 nt, Human
cugguggggccaagggaggcccagggggccga

SEQ ID NO: 408292 - RNA, 32 nt, Human
cugguggggccacuggugggugccagggacag

SEQ ID NO: 408293 - RNA, 32 nt, Human
cuggugggggagaagggggugggugcugcuug

SEQ ID NO: 408294 - RNA, 32 nt, Human
cugguggggucguggggugugaauggugggcg

SEQ ID NO: 408295 - RNA, 32 nt, Human
cugguggggugaguguuagcuggcuaggguug

SEQ ID NO: 408296 - RNA, 32 nt, Human
cugguggguggugggagucugggggacccagc

SEQ ID NO: 408297 - RNA, 32 nt, Human
cuggugggugguguccugaagcugcuggagcc

SEQ ID NO: 408298 - RNA, 32 nt, Human
cuggugguccagccugugaugggcaggccuag

SEQ ID NO: 408299 - RNA, 22 nt, Human
cuggugguccaggcucugguga

SEQ ID NO: 408300 - RNA, 32 nt, Human
cuggugguccuccuccuccucacucuucuugc

SEQ ID NO: 408301 - RNA, 32 nt, Human
cugguggucuagugaguggugccugggaugga

SEQ ID NO: 408302 - RNA, 32 nt, Human
cugguggucugaggacacacagaggguggggg

SEQ ID NO: 408303 - RNA, 32 nt, Human
cugguggugccaaggccuuccucugucuccau

SEQ ID NO: 408304 - RNA, 23 nt, Human
cuggugguucacacaucauccca

SEQ ID NO: 408305 - RNA, 32 nt, Human
cuggugguugccucccguccugggcaggcugc

SEQ ID NO: 408306 - RNA, 32 nt, Human
cuggugguuucugcccugcagaugucuaacac

SEQ ID NO: 408307 - RNA, 32 nt, Human
cugguguauaccauaaccgaugugcuggagcu

SEQ ID NO: 408308 - RNA, 32 nt, Human
cugguguaugcacugcucacggaccccauguu

SEQ ID NO: 408309 - RNA, 32 nt, Human
cugguguauguagcaguucuuaaaucagcagu

SEQ ID NO: 408310 - RNA, 32 nt, Human
cuggugucacauggggccuggccacgcccucc

SEQ ID NO: 408311 - RNA, 32 nt, Human
cuggugucacccaggcuggagugcaguggugu

SEQ ID NO: 408312 - RNA, 32 nt, Human
cuggugucacccuggauaggcaagggauaacu

SEQ ID NO: 408313 - RNA, 32 nt, Human
cuggugucacgccaggaggcuguggcugcugu

SEQ ID NO: 408314 - RNA, 20 nt, Human
cuggugucaggucugucugg

SEQ ID NO: 408315 - RNA, 32 nt, Human
cuggugucauuuggagagaaugcggggcucau

SEQ ID NO: 408316 - RNA, 32 nt, Human
cuggugucauuuucugugaauguggucaggua

SEQ ID NO: 408317 - RNA, 32 nt, Human
cugguguccacacaucgucuuccaucuuugca

SEQ ID NO: 408318 - RNA, 24 nt, Human
cugguguccaggcuggagugcagu

SEQ ID NO: 408319 - RNA, 32 nt, Human
cuggugucccacuccauugucacuaacguccg

SEQ ID NO: 408320 - RNA, 32 nt, Human
cugguguccccagucaagcccaugaagcccau

SEQ ID NO: 408321 - RNA, 19 nt, Human
cuggugucccugucuccau

SEQ ID NO: 408322 - RNA, 32 nt, Human
cugguguccugagacucugcccucuucccaca

SEQ ID NO: 408323 - RNA, 32 nt, Human
cugguguccuuauuaaaaguggagauuuggac

SEQ ID NO: 408324 - RNA, 32 nt, Human
cuggugucucaggagcaggggucugugucuac

SEQ ID NO: 408325 - RNA, 32 nt, Human
cuggugucucuuccucuuccuauaaaggcacu

SEQ ID NO: 408326 - RNA, 32 nt, Human
cuggugucuguagguggacccggucucccaca

SEQ ID NO: 408327 - RNA, 24 nt, Human
cuggugucuucagcuucucugcug

SEQ ID NO: 408328 - RNA, 32 nt, Human
cuggugucuucagcuucucugcugccauguuc

SEQ ID NO: 408329 - RNA, 32 nt, Human
cuggugugagccacugugucuggccagaaaag

SEQ ID NO: 408330 - RNA, 32 nt, Human
cuggugugagggcagaccagggccagguagac

SEQ ID NO: 408331 - RNA, 32 nt, Human
cuggugugcagccuggccaacauggugaaacc

SEQ ID NO: 408332 - RNA, 32 nt, Human
cuggugugcgcuggccuuggccuaguccccag

SEQ ID NO: 408333 - RNA, 32 nt, Human
cuggugugcucaccccucccuagucaccucca

SEQ ID NO: 408334 - RNA, 32 nt, Human
cuggugugcucugacaucaugaccucaaaucu

SEQ ID NO: 408335 - RNA, 32 nt, Human
cugguguggaaccagggagcugugggaagcca

SEQ ID NO: 408336 - RNA, 32 nt, Human
cugguguggaggucgagguggggagggggagg

SEQ ID NO: 408337 - RNA, 32 nt, Human
cuggugugggaggcgauggggguuggguggug

SEQ ID NO: 408338 - RNA, 32 nt, Human
cugguguggggaggcggccgggccaagcgggg

SEQ ID NO: 408339 - RNA, 22 nt, Human
cuggugugucucacacaaugcc

SEQ ID NO: 408340 - RNA, 32 nt, Human
cuggugugucugcagugcagguggcuccugga

SEQ ID NO: 408341 - RNA, 24 nt, Human
cugguguguggagguggcgggagg

SEQ ID NO: 408342 - RNA, 32 nt, Human
cugguguguggccucucuccccucucucuuuu

SEQ ID NO: 408343 - RNA, 32 nt, Human
cugguguguugugauccagggaaugaaaagaa

SEQ ID NO: 408344 - RNA, 19 nt, Human
cugguguuaggugugcaaa

SEQ ID NO: 408345 - RNA, 32 nt, Human
cugguguuccagcugaggcagggggauuuggu

SEQ ID NO: 408346 - RNA, 32 nt, Human
cugguguucccccuauagauucaauuucucca

SEQ ID NO: 408347 - RNA, 32 nt, Human
cugguguucccguucccaucugacaggcucuc

SEQ ID NO: 408348 - RNA, 32 nt, Human
cugguguuccucauuccucccaccuucccgug

SEQ ID NO: 408349 - RNA, 32 nt, Human
cugguguucugcaaaacuuggacaggggcaaa

SEQ ID NO: 408350 - RNA, 32 nt, Human
cugguguucugcagucaucuccccuccuggcg

SEQ ID NO: 408351 - RNA, 32 nt, Human
cugguguugggaacagcugcggggaggguagg

SEQ ID NO: 408352 - RNA, 32 nt, Human
cugguguugucuuucugccaucagagaaggga

SEQ ID NO: 408353 - RNA, 32 nt, Human
cugguguuugguuuuuccaccagccuuuguua

SEQ ID NO: 408354 - RNA, 32 nt, Human
cugguguuuguugagcagaaacagugagucuc

SEQ ID NO: 408355 - RNA, 23 nt, Human
cugguuaacacggugaaaccccg

SEQ ID NO: 408356 - RNA, 32 nt, Human
cugguuaacacggugaaaccccgacucuacua

SEQ ID NO: 408357 - RNA, 32 nt, Human
cugguuaacacggugaaacccugucucuacaa

SEQ ID NO: 408358 - RNA, 22 nt, Human
cugguuaacauggugaaacacc

SEQ ID NO: 408359 - RNA, 32 nt, Human
cugguuaacauggugaaacaccaucucuagua

SEQ ID NO: 408360 - RNA, 24 nt, Human
cugguuaacauggugaaacccugu

SEQ ID NO: 408361 - RNA, 32 nt, Human
cugguuaacauggugaaacccugucuguacua

SEQ ID NO: 408362 - RNA, 32 nt, Human
cugguuaagagucucacuagggccaaggcagg

SEQ ID NO: 408363 - RNA, 32 nt, Human
cugguuaauuccaucaagcucagaguuaaaag

SEQ ID NO: 408364 - RNA, 32 nt, Human
cugguuacacagucuucugggguccaaaucca

SEQ ID NO: 408365 - RNA, 32 nt, Human
cugguuacacuaaccugauacugaccuguuca

SEQ ID NO: 408366 - RNA, 32 nt, Human
cugguuacagcugagaagcccauaccaguauu

SEQ ID NO: 408367 - RNA, 20 nt, Human
cugguuacggcuggcuccug

SEQ ID NO: 408368 - RNA, 32 nt, Human
cugguuacguggacuguggagcuggucucuug

SEQ ID NO: 408369 - RNA, 32 nt, Human
cugguuagggcugaggaccccaagauaggcug

SEQ ID NO: 408370 - RNA, 32 nt, Human
cugguuauuuucaccagcaucucucaacaguc

SEQ ID NO: 408371 - RNA, 32 nt, Human
cugguucaaccccuucuccagaccgugucagc

SEQ ID NO: 408372 - RNA, 32 nt, Human
cugguucacaacagcacaaagugucuuucauu

SEQ ID NO: 408373 - RNA, 32 nt, Human
cugguucacaggcuuagugauggagauaugac

SEQ ID NO: 408374 - RNA, 32 nt, Human
cugguucacauucagcuccagugcaguucaag

SEQ ID NO: 408375 - RNA, 32 nt, Human
cugguucaccucuuuguucucuagacucuuaa

SEQ ID NO: 408376 - RNA, 32 nt, Human
cugguucacugcacccucugccucccagguuc

SEQ ID NO: 408377 - RNA, 22 nt, Human
cugguucacuuacugcacucca

SEQ ID NO: 408378 - RNA, 32 nt, Human
cugguucagagugcucucccaccaccagagac

SEQ ID NO: 408379 - RNA, 32 nt, Human
cugguucagggugguggggugggagcuacuag

SEQ ID NO: 408380 - RNA, 32 nt, Human
cugguucaguggcuugagcucugugagcagcu

SEQ ID NO: 408381 - RNA, 32 nt, Human
cugguucaugccuuugacaagcauuuuugugc

SEQ ID NO: 408382 - RNA, 32 nt, Human
cugguucauguuuucaucaaucuaaggugcaa

SEQ ID NO: 408383 - RNA, 32 nt, Human
cugguuccaguggcagauggggcacuggccag

SEQ ID NO: 408384 - RNA, 32 nt, Human
cugguuccaguucuguagccauucagguccag

SEQ ID NO: 408385 - RNA, 32 nt, Human
cugguuccaguuucacagcuaccugcagaggc

SEQ ID NO: 408386 - RNA, 19 nt, Human
cugguuccccaaccacaga

SEQ ID NO: 408387 - RNA, 32 nt, Human
cugguucccccacaguagguguuuucacauaa

SEQ ID NO: 408388 - RNA, 32 nt, Human
cugguucccugccuuugugccaacccauacuu

SEQ ID NO: 408389 - RNA, 32 nt, Human
cugguucccuggcaggcuggagggcaggagcu

SEQ ID NO: 408390 - RNA, 32 nt, Human
cugguuccuaguuucugauuauucggggaugg

SEQ ID NO: 408391 - RNA, 32 nt, Human
cugguuccucucccuugguuauggccgcuaau

SEQ ID NO: 408392 - RNA, 32 nt, Human
cugguuccugcaacccacuuuuaggucuccca

SEQ ID NO: 408393 - RNA, 32 nt, Human
cugguuccugccaccaccaccuccccaggccg

SEQ ID NO: 408394 - RNA, 32 nt, Human
cugguuccuggcugccugccucuugcacagaa

SEQ ID NO: 408395 - RNA, 32 nt, Human
cugguuccuuucuccccaugccugccuucugc

SEQ ID NO: 408396 - RNA, 32 nt, Human
cugguuccuuucucuuccuucuguaagucagc

SEQ ID NO: 408397 - RNA, 18 nt, Human
cugguucgccggcuucug

SEQ ID NO: 408398 - RNA, 32 nt, Human
cugguucggcucuagggccucagucuggagug

SEQ ID NO: 408399 - RNA, 32 nt, Human
cugguucgucuguguguggugugaccaauggu

SEQ ID NO: 408400 - RNA, 32 nt, Human
cugguucuagucaauucugaaccaccaccccc

SEQ ID NO: 408401 - RNA, 32 nt, Human
cugguucuccauccccauguguuucaggugga

SEQ ID NO: 408402 - RNA, 32 nt, Human
cugguucucccagguggauuuugcuggaauuc

SEQ ID NO: 408403 - RNA, 32 nt, Human
cugguucucccauccauggcaugaggccccga

SEQ ID NO: 408404 - RNA, 32 nt, Human
cugguucucugaggagcgcucaguugcaucug

SEQ ID NO: 408405 - RNA, 18 nt, Human
cugguucucugggguccu

SEQ ID NO: 408406 - RNA, 32 nt, Human
cugguucugcagcuggaccgaccucauucauc

SEQ ID NO: 408407 - RNA, 32 nt, Human
cugguucugcauuccccaccaccucccaggau

SEQ ID NO: 408408 - RNA, 32 nt, Human
cugguucugcuuuccaaugccugcuucccaau

SEQ ID NO: 408409 - RNA, 32 nt, Human
cugguucugggcaggcaguggcaggggcuccc

SEQ ID NO: 408410 - RNA, 32 nt, Human
cugguucuguaacccaguagcugugacguucc

SEQ ID NO: 408411 - RNA, 32 nt, Human
cugguucuguuucccaggcuggagugcagugg

SEQ ID NO: 408412 - RNA, 32 nt, Human
cugguucuuagagaggugcuccagcucuguga

SEQ ID NO: 408413 - RNA, 32 nt, Human
cugguucuuauuucuuuugauucggacgaggu

SEQ ID NO: 408414 - RNA, 32 nt, Human
cugguucuuccucuugggcuuucagcccagac

SEQ ID NO: 408415 - RNA, 32 nt, Human
cugguucuuggcugauguucuguaucuuaaca

SEQ ID NO: 408416 - RNA, 32 nt, Human
cugguugacaucagacccaacccaugaaggcu

SEQ ID NO: 408417 - RNA, 32 nt, Human
cugguugagugggaugauaaugggagaacuua

SEQ ID NO: 408418 - RNA, 32 nt, Human
cugguugcacgcuggggaucccggaccucgau

SEQ ID NO: 408419 - RNA, 32 nt, Human
cugguugcaguugaaaugaccugaaauguagc

SEQ ID NO: 408420 - RNA, 32 nt, Human
cugguugccucggaguuggauccuacagugua

SEQ ID NO: 408421 - RNA, 32 nt, Human
cugguugccuggacacccucucccucugucca

SEQ ID NO: 408422 - RNA, 24 nt, Human
cugguugcuguagcuccugccgga

SEQ ID NO: 408423 - RNA, 32 nt, Human
cugguugcuguuguggagaagguggcguuucc

SEQ ID NO: 408424 - RNA, 32 nt, Human
cugguuggcgucgccuugaaaucccaggccgu

SEQ ID NO: 408425 - RNA, 32 nt, Human
cugguugggaaaugacaccaggaagcccagug

SEQ ID NO: 408426 - RNA, 20 nt, Human
cugguugggaccccacccuc

SEQ ID NO: 408427 - RNA, 32 nt, Human
cugguugggaccccacccuccuaucauggccc

SEQ ID NO: 408428 - RNA, 32 nt, Human
cugguugggagggaaagcauccccguuuuugc

SEQ ID NO: 408429 - RNA, 32 nt, Human
cugguuggucugucugucuguccuuguccuug

SEQ ID NO: 408430 - RNA, 32 nt, Human
cugguuggugcuuuguuuaugguaguaguuuu

SEQ ID NO: 408431 - RNA, 19 nt, Human
cugguugucuuccugccag

SEQ ID NO: 408432 - RNA, 32 nt, Human
cugguugugacagggggcccagagccaccccg

SEQ ID NO: 408433 - RNA, 32 nt, Human
cugguugugguggcacacaccuguaaucccag

SEQ ID NO: 408434 - RNA, 32 nt, Human
cugguuguugggggcuggaggcgggagguccc

SEQ ID NO: 408435 - RNA, 32 nt, Human
cugguuguuuaugcaagagcugguuguuuaaa

SEQ ID NO: 408436 - RNA, 32 nt, Human
cugguuuaagcaucauagccuaugaugauaaa

SEQ ID NO: 408437 - RNA, 32 nt, Human
cugguuuaaguuguucccccucccucugaaaa

SEQ ID NO: 408438 - RNA, 32 nt, Human
cugguuuaaguuguucccccucccucugagaa

SEQ ID NO: 408439 - RNA, 32 nt, Human
cugguuuaaugccaccaacaacuguacaaggu

SEQ ID NO: 408440 - RNA, 32 nt, Human
cugguuuauucucuacgagcuacuucuuagau

SEQ ID NO: 408441 - RNA, 20 nt, Human
cugguuuauuuugggauuuu

SEQ ID NO: 408442 - RNA, 23 nt, Human
cugguuucaaccuccuggccuca

SEQ ID NO: 408443 - RNA, 32 nt, Human
cugguuucaagcaacucuucugccucagcauc

SEQ ID NO: 408444 - RNA, 32 nt, Human
cugguuucaagcaauccuccuaccucagcuuc

SEQ ID NO: 408445 - RNA, 32 nt, Human
cugguuucaagcgauccucccaccucggccuc

SEQ ID NO: 408446 - RNA, 32 nt, Human
cugguuucaagcgauccucccacuucagccuu

SEQ ID NO: 408447 - RNA, 32 nt, Human
cugguuucagcugggggcucucaccagcccuc

SEQ ID NO: 408448 - RNA, 32 nt, Human
cugguuucagggauguggcuguccucagaauc

SEQ ID NO: 408449 - RNA, 18 nt, Human
cugguuuccuggaauguu

SEQ ID NO: 408450 - RNA, 18 nt, Human
cugguuuccuggcagccu

SEQ ID NO: 408451 - RNA, 18 nt, Human
cugguuuccugggauuca

SEQ ID NO: 408452 - RNA, 32 nt, Human
cugguuucucagaauccaaagaucacauauuc

SEQ ID NO: 408453 - RNA, 32 nt, Human
cugguuucucauuccuuaaagcagugguucgc

SEQ ID NO: 408454 - RNA, 32 nt, Human
cugguuucuccacccacaguuccucuuacaga

SEQ ID NO: 408455 - RNA, 32 nt, Human
cugguuucuccauguuggucaggcuggucuca

SEQ ID NO: 408456 - RNA, 32 nt, Human
cugguuucuccucuuggcccuggccuacagac

SEQ ID NO: 408457 - RNA, 32 nt, Human
cugguuucucucccucuccaagcaucuguaag

SEQ ID NO: 408458 - RNA, 19 nt, Human
cugguuucucugggacuuu

SEQ ID NO: 408459 - RNA, 32 nt, Human
cuguggcggcucccaggcccugcccaccuggg

SEQ ID NO: 408460 - RNA, 32 nt, Human
cuguggcggugcaguggcaaaggauccagaua

SEQ ID NO: 408461 - RNA, 18 nt, Human
cuguggcuaaaguuucca

SEQ ID NO: 408462 - RNA, 32 nt, Human
cuguggcuagccacugugcuccagccugggca

SEQ ID NO: 408463 - RNA, 32 nt, Human
cuguggcucaugccaugccaugaagugccuag

SEQ ID NO: 408464 - RNA, 32 nt, Human
cuguggcucauuuugauugaguuccucauuca

SEQ ID NO: 408465 - RNA, 32 nt, Human
cuguggcuccagcugcucaaagacgagccuuc

SEQ ID NO: 408466 - RNA, 32 nt, Human
cuguggcuccaucugcccagcuugccugccuc

SEQ ID NO: 408467 - RNA, 16 nt, Human
cuguggcuccugcagg

SEQ ID NO: 408468 - RNA, 21 nt, Human
cuguggcucucccguugcaga

SEQ ID NO: 408469 - RNA, 32 nt, Human
cuguggcucugaggcccugaauacagaagggu

SEQ ID NO: 408470 - RNA, 32 nt, Human
cuguggcucugaggccuucacuuagagcuguc

SEQ ID NO: 408471 - RNA, 32 nt, Human
cuguggcucuucccuucuguccuccgaggggc

SEQ ID NO: 408472 - RNA, 32 nt, Human
cuguggcugacagggugcuuccuacgguuuuu

SEQ ID NO: 408473 - RNA, 20 nt, Human
cuguggcugagcucacccag

SEQ ID NO: 408474 - RNA, 20 nt, Human
cuguggcugagcuuacccag

SEQ ID NO: 408475 - RNA, 32 nt, Human
cuguggcugagggagagcagcggcggcgggga

SEQ ID NO: 408476 - RNA, 21 nt, Human
cuguggcugaugcggauucag

SEQ ID NO: 408477 - RNA, 21 nt, Human
cuguggcugauuuggucccag

SEQ ID NO: 408478 - RNA, 21 nt, Human
cuguggcugcacuggccccag

SEQ ID NO: 408479 - RNA, 20 nt, Human
cuguggcugcagacucccag

SEQ ID NO: 408480 - RNA, 32 nt, Human
cuguggcugcagcugcugcagcugcugugacc

SEQ ID NO: 408481 - RNA, 32 nt, Human
cuguggcugccuccccuccacggccuccaggg

SEQ ID NO: 408482 - RNA, 32 nt, Human
cuguggcugccugcaccccaggaaaggagggg

SEQ ID NO: 408483 - RNA, 18 nt, Human
cuguggcugccuugggcc

SEQ ID NO: 408484 - RNA, 32 nt, Human
cuguggcugcguuggaaacugacaucaaggaa

SEQ ID NO: 408485 - RNA, 32 nt, Human
cuguggcugcugcugacuagggcugcauggga

SEQ ID NO: 408486 - RNA, 32 nt, Human
cuguggcugcuucuggaagugcuggaagcauc

SEQ ID NO: 408487 - RNA, 20 nt, Human
cuguggcuggcaugccccag

SEQ ID NO: 408488 - RNA, 32 nt, Human
cuguggcugggaagggagacagaggcggcggc

SEQ ID NO: 408489 - RNA, 32 nt, Human
cuguggcugggccuuccucucccuuuaugacg

SEQ ID NO: 408490 - RNA, 32 nt, Human
cuguggcugucauucucccagggcagaacccu

SEQ ID NO: 408491 - RNA, 17 nt, Human
cuguggcuguccuucca

SEQ ID NO: 408492 - RNA, 32 nt, Human
cuguggcuucaguccugcgucugcaccacaca

SEQ ID NO: 408493 - RNA, 32 nt, Human
cuguggcuucagugguguguaagcagguggaa

SEQ ID NO: 408494 - RNA, 32 nt, Human
cuguggcuuccucugugcucuaccuuuuuauu

SEQ ID NO: 408495 - RNA, 32 nt, Human
cuguggcuucuccagccuuucucccucacauc

SEQ ID NO: 408496 - RNA, 32 nt, Human
cuguggcuucuggaccccuccucugccccgca

SEQ ID NO: 408497 - RNA, 32 nt, Human
cuguggcuugcauuuccuacugcuuucuacgu

SEQ ID NO: 408498 - RNA, 32 nt, Human
cuguggcuuggcaguggccccgugacugguga

SEQ ID NO: 408499 - RNA, 32 nt, Human
cuguggcuuuaacugacauauuucuguagcau

SEQ ID NO: 408500 - RNA, 23 nt, Human
cuguggcuuuucuggaauggaau

SEQ ID NO: 408501 - RNA, 32 nt, Human
cugugggaaccacacaucuugccacaacaccc

SEQ ID NO: 408502 - RNA, 18 nt, Human
cugugggaaggggugcag

SEQ ID NO: 408503 - RNA, 32 nt, Human
cugugggaaugagggggucagauaaagaacaa

SEQ ID NO: 408504 - RNA, 32 nt, Human
cugugggaccuggccucaaacucaccaaaucg

SEQ ID NO: 408505 - RNA, 32 nt, Human
cugugggacugaggagcacagagcagagagca

SEQ ID NO: 408506 - RNA, 32 nt, Human
cugugggacugaggagcgcagagcagagagca

SEQ ID NO: 408507 - RNA, 32 nt, Human
cugugggagaccagcggagugggagggagacg

SEQ ID NO: 408508 - RNA, 32 nt, Human
cugugggagagggaagaggaggcugggccucg

SEQ ID NO: 408509 - RNA, 32 nt, Human
cugugggagagggagguggucgggagagugca

SEQ ID NO: 408510 - RNA, 32 nt, Human
cugugggagaggggacacuggaggaguggcug

SEQ ID NO: 408511 - RNA, 32 nt, Human
cugugggaggaaggaggcaggcugugguggga

SEQ ID NO: 408512 - RNA, 32 nt, Human
cugugggaggagaaggggaaguauguuuuggg

SEQ ID NO: 408513 - RNA, 32 nt, Human
cugugggaggccaaggcaggcagaucaccuga

SEQ ID NO: 408514 - RNA, 32 nt, Human
cugugggaggccaaggccagaggauugcuuga

SEQ ID NO: 408515 - RNA, 32 nt, Human
cugugggaggccgaggcaggaggaucacgagg

SEQ ID NO: 408516 - RNA, 18 nt, Human
cugugggaggccggucgg

SEQ ID NO: 408517 - RNA, 32 nt, Human
cugugggaggcggaggcgggaggaucaugagg

SEQ ID NO: 408518 - RNA, 32 nt, Human
cugugggaggcugaggcggguggaucaucuga

SEQ ID NO: 408519 - RNA, 32 nt, Human
cugugggaggcugaggugggaggaucaccuga

SEQ ID NO: 408520 - RNA, 32 nt, Human
cugugggaggcugagguggguggaucaccagg

SEQ ID NO: 408521 - RNA, 32 nt, Human
cugugggagggcccuguagaccacaucagggu

SEQ ID NO: 408522 - RNA, 32 nt, Human
cugugggagggccugccccugcccccaccucc

SEQ ID NO: 408523 - RNA, 32 nt, Human
cugugggagggugagugggugaggccgagccu

SEQ ID NO: 408524 - RNA, 32 nt, Human
cugugggagguggcgggaacagggguguggga

SEQ ID NO: 408525 - RNA, 32 nt, Human
cugugggaguaguucuggagcugagguggaag

SEQ ID NO: 408526 - RNA, 25 nt, Human
cugugggaucaacugcacauccacu

SEQ ID NO: 408527 - RNA, 32 nt, Human
cugugggaugagcuccagcauggggugaggua

SEQ ID NO: 408528 - RNA, 32 nt, Human
cugugggauggggacagcauuccugcacaucc

SEQ ID NO: 408529 - RNA, 32 nt, Human
cugugggauggggcuugggaguugcagugaau

SEQ ID NO: 408530 - RNA, 32 nt, Human
cugugggcaaagugccugccucugaccucauc

SEQ ID NO: 408531 - RNA, 32 nt, Human
cugugggcaacagugucucccgcucuggaaga

SEQ ID NO: 408532 - RNA, 32 nt, Human
cugugggcaaugcuggaggcugugcauccuac

SEQ ID NO: 408533 - RNA, 32 nt, Human
cugugggcaccacuugacuauccaaccugacc

SEQ ID NO: 408534 - RNA, 32 nt, Human
cugugggcagcucgggggcugaaagcugggaa

SEQ ID NO: 408535 - RNA, 32 nt, Human
cugugggcaggaaacgccgccacaggcucugc

SEQ ID NO: 408536 - RNA, 18 nt, Human
cugugggcagguggucag

SEQ ID NO: 408537 - RNA, 32 nt, Human
cugugggcaucaggcuguggggcggcaucccu

SEQ ID NO: 408538 - RNA, 32 nt, Human
cugugggcauggucaaaggcucaaaccuuuau

SEQ ID NO: 408539 - RNA, 21 nt, Human
cugugggccacucgcugcaga

SEQ ID NO: 408540 - RNA, 19 nt, Human
cugugggccgggcgcggug

SEQ ID NO: 408541 - RNA, 32 nt, Human
cugugggccucucuccaggaccacagcugcca

SEQ ID NO: 408542 - RNA, 32 nt, Human
cugugggccuggaagaugggaggaggggcuug

SEQ ID NO: 408543 - RNA, 32 nt, Human
cugugggccuucccauccaccccaccacaacu

SEQ ID NO: 408544 - RNA, 32 nt, Human
cugugggccuuucugucccaccccugucagca

SEQ ID NO: 408545 - RNA, 32 nt, Human
cugugggcggggucuuggggaugaggaggggu

SEQ ID NO: 408546 - RNA, 32 nt, Human
cugugggcuacucagccaggguacagugggag

SEQ ID NO: 408547 - RNA, 32 nt, Human
cugugggcucagaaacugcuagguaaaagaau

SEQ ID NO: 408548 - RNA, 32 nt, Human
cugugggcugaagugcucugagguccuaaaua

SEQ ID NO: 408549 - RNA, 32 nt, Human
cugugggcuggcagggcaaccauaccauacuc

SEQ ID NO: 408550 - RNA, 32 nt, Human
cugugggcuggcugcacuggccucugcggugg

SEQ ID NO: 408551 - RNA, 32 nt, Human
cugugggcuguggucacgugcucccagaagac

SEQ ID NO: 408552 - RNA, 32 nt, Human
cuguggggaagggaggugggcugagagguaga

SEQ ID NO: 408553 - RNA, 32 nt, Human
cuguggggaagggcugaugcagguguggaguc

SEQ ID NO: 408554 - RNA, 19 nt, Human
cuguggggagacacugcag

SEQ ID NO: 408555 - RNA, 32 nt, Human
cuguggggaggaaccauaaacccagcccucac

SEQ ID NO: 408556 - RNA, 32 nt, Human
cuguggggaggaggaggaagaagaggaggagg

SEQ ID NO: 408557 - RNA, 32 nt, Human
cuguggggagugcagggccagauggggacucc

SEQ ID NO: 408558 - RNA, 32 nt, Human
cuguggggauuuccuuccccugcuccaucagc

SEQ ID NO: 408559 - RNA, 32 nt, Human
cuguggggcgggcuucccagggugcucaugcc

SEQ ID NO: 408560 - RNA, 32 nt, Human
cuguggggcugcugcccucuguguuccuacgc

SEQ ID NO: 408561 - RNA, 32 nt, Human
cuguggggcugguacaggaggcucauggaauu

SEQ ID NO: 408562 - RNA, 32 nt, Human
cuguggggcuuggugaguguuucguggccucu

SEQ ID NO: 408563 - RNA, 32 nt, Human
cugugggggaggaggaggggaucgccggggag

SEQ ID NO: 408564 - RNA, 32 nt, Human
cugugggggcaugagggagaaaaggccauugg

SEQ ID NO: 408565 - RNA, 32 nt, Human
cugugggggccaccccuccacccccaccccca

SEQ ID NO: 408566 - RNA, 23 nt, Human
cugugggggcuauacaguuccag

SEQ ID NO: 408567 - RNA, 32 nt, Human
cuguggggguaggccugcugauucagaggguc

SEQ ID NO: 408568 - RNA, 32 nt, Human
cuguggggguauggggcuccagugaguuagcc

SEQ ID NO: 408569 - RNA, 32 nt, Human
cugugggggucagacuccugaggcucucccuu

SEQ ID NO: 408570 - RNA, 32 nt, Human
cuguggggguuuggguuugagggaagggagca

SEQ ID NO: 408571 - RNA, 32 nt, Human
cuguggggucauuacccucugccuccuggaag

SEQ ID NO: 408572 - RNA, 29 nt, Human
cuguggggucuguguguguagugagagug

SEQ ID NO: 408573 - RNA, 32 nt, Human
cuguggggugacgcuucagggcagagcugccu

SEQ ID NO: 408574 - RNA, 32 nt, Human
cuguggggugcugguggagcagcugaugucgu

SEQ ID NO: 408575 - RNA, 32 nt, Human
cugugggguguccugcucacgguuucauggau

SEQ ID NO: 408576 - RNA, 32 nt, Human
cuguggguagagcucagaugaccuagggagaa

SEQ ID NO: 408577 - RNA, 32 nt, Human
cuguggguccacuuccuucaucggccaccuuc

SEQ ID NO: 408578 - RNA, 25 nt, Human
cugugggucccaguccccacugcug

SEQ ID NO: 408579 - RNA, 32 nt, Human
cugugggucucaggaccugggucugggcuggg

SEQ ID NO: 408580 - RNA, 32 nt, Human
cugugggucugcaccagguacuccaggccagc

SEQ ID NO: 408581 - RNA, 32 nt, Human
cugugggucugucggugccgagggcaggaugg

SEQ ID NO: 408582 - RNA, 32 nt, Human
cugugggucuugcucaauacuguucauaccug

SEQ ID NO: 408583 - RNA, 25 nt, Human
cugugggugaauggauguguguuga

SEQ ID NO: 408584 - RNA, 32 nt, Human
cugugggugagccaggccaacauugguguccc

SEQ ID NO: 408585 - RNA, 32 nt, Human
cugugggugagggaagccagaaugacacaaag

SEQ ID NO: 408586 - RNA, 32 nt, Human
cugugggugaugugcugggccccugguucacu

SEQ ID NO: 408587 - RNA, 32 nt, Human
cugugggugcagcucuuccagaaaguauuagg

SEQ ID NO: 408588 - RNA, 32 nt, Human
cuguggguggaggaacugggcacugggagcgu

SEQ ID NO: 408589 - RNA, 32 nt, Human
cuguggguggaggacuccugccuuuccuguuu

SEQ ID NO: 408590 - RNA, 32 nt, Human
cugugggugggcccuuucuccauagucugccg

SEQ ID NO: 408591 - RNA, 32 nt, Human
cuguggguggggaggagggaaggguccucaga

SEQ ID NO: 408592 - RNA, 32 nt, Human
cugugggugggguggagggugaaauucuuggu

SEQ ID NO: 408593 - RNA, 31 nt, Human
cugugggugugggggcccugggugaaugcug

SEQ ID NO: 408594 - RNA, 32 nt, Human
cugugguagacaggcugugacacuaguguugc

SEQ ID NO: 408595 - RNA, 32 nt, Human
cugugguagagcucgggccagcuguaguucau

SEQ ID NO: 408596 - RNA, 32 nt, Human
cugugguaggaggcagggagaguaagacaugc

SEQ ID NO: 408597 - RNA, 32 nt, Human
cugugguagguggaucacuugaggucaggagu

SEQ ID NO: 408598 - RNA, 32 nt, Human
cugugguaguccucccaagcugugcugggaag

SEQ ID NO: 408599 - RNA, 32 nt, Human
cugugguauauacuuucuccuacucuagcaaa

SEQ ID NO: 408600 - RNA, 32 nt, Human
cuguggucaagaguucaagaccagccuggcca

SEQ ID NO: 408601 - RNA, 31 nt, Human
cuguggucaaugucuuccauuucccggaguu

SEQ ID NO: 408602 - RNA, 32 nt, Human
cuguggucacauuucaaaggccagaucuuucc

SEQ ID NO: 408603 - RNA, 32 nt, Human
cuguggucaccuuuguguuagcaagugugugg

SEQ ID NO: 408604 - RNA, 32 nt, Human
cuguggucaggaguuugagaccagccuggcca

SEQ ID NO: 408605 - RNA, 32 nt, Human
cuguggucagguaggcugggcugugaacagca

SEQ ID NO: 408606 - RNA, 32 nt, Human
cuguggucaguguggcugcauagcaguggauu

SEQ ID NO: 408607 - RNA, 32 nt, Human
cugugguccacucaggagguuaacugcaguca

SEQ ID NO: 408608 - RNA, 24 nt, Human
cugugguccaggcaggagugcagu

SEQ ID NO: 408609 - RNA, 22 nt, Human
cuguggucccagcuacucggga

SEQ ID NO: 408610 - RNA, 32 nt, Human
cuguggucccagcuacucgggaggcuuagaca

SEQ ID NO: 408611 - RNA, 32 nt, Human
cuguggucccagcugcucggaaggcugaagca

SEQ ID NO: 408612 - RNA, 32 nt, Human
cuguggucccaucugacucaaaggacauauac

SEQ ID NO: 408613 - RNA, 32 nt, Human
cugugguccuuggggcuuagggagaggaggga

SEQ ID NO: 408614 - RNA, 32 nt, Human
cuguggucgcuggccgagaucgccacgucgga

SEQ ID NO: 408615 - RNA, 32 nt, Human
cuguggucuaacuccaccggcucuuccugcac

SEQ ID NO: 408616 - RNA, 32 nt, Human
cuguggucuaggggaauccugccugccccaug

SEQ ID NO: 408617 - RNA, 32 nt, Human
cuguggucucaagaaauggugaaaugccugag

SEQ ID NO: 408618 - RNA, 23 nt, Human
cuguggucuccagccaccccuac

SEQ ID NO: 408619 - RNA, 32 nt, Human
cuguggucuccucugcaaagcauuuuaauuaa

SEQ ID NO: 408620 - RNA, 32 nt, Human
cuguggucucuagggcucugcagcagcagugg

SEQ ID NO: 408621 - RNA, 32 nt, Human
cuguggucucugcucuggcuguguuucagccc

SEQ ID NO: 408622 - RNA, 32 nt, Human
cuguggucugcauguccauguuugggacauuc

SEQ ID NO: 408623 - RNA, 21 nt, Human
cuguggucugcccacccccca

SEQ ID NO: 408624 - RNA, 32 nt, Human
cuguggucugguguuccagcugaggcaggggg

SEQ ID NO: 408625 - RNA, 32 nt, Human
cuguggucugucaggacugauggccagcagcu

SEQ ID NO: 408626 - RNA, 32 nt, Human
cuguggucuguccucacaugugcacugguaac

SEQ ID NO: 408627 - RNA, 32 nt, Human
cuguggugcagagcuaguuccucuccagcuca

SEQ ID NO: 408628 - RNA, 32 nt, Human
cugugguggaggagaaggaaagguacagggcg

SEQ ID NO: 408629 - RNA, 32 nt, Human
cugugguggcaccauggccuuggcccugcuac

SEQ ID NO: 408630 - RNA, 32 nt, Human
cugugguggccagcuacucaggaggcugaggc

SEQ ID NO: 408631 - RNA, 32 nt, Human
cuguggugggcuccggugcacugugggaugga

SEQ ID NO: 408632 - RNA, 32 nt, Human
cugugguggugaggagagacucuggagcaacc

SEQ ID NO: 408633 - RNA, 32 nt, Human
cuguggugguuccacuuuaauacugaaacacc

SEQ ID NO: 408634 - RNA, 32 nt, Human
cuguggugucauggauagcuggcugucugcca

SEQ ID NO: 408635 - RNA, 32 nt, Human
cugugguguccagcagcauccggcuucauggg

SEQ ID NO: 408636 - RNA, 32 nt, Human
cuguggugucugcuuauuuuuguauuugugcu

SEQ ID NO: 408637 - RNA, 32 nt, Human
cuguggugugaaagguggccagccugguucuc

SEQ ID NO: 408638 - RNA, 32 nt, Human
cugugguuacccacgaggcaguacuuacuauc

SEQ ID NO: 408639 - RNA, 32 nt, Human
cugugguuaguguaauaaaacauguuccuuau

SEQ ID NO: 408640 - RNA, 18 nt, Human
cugugguuauccugcaag

SEQ ID NO: 408641 - RNA, 20 nt, Human
cugugguucaccaccagccc

SEQ ID NO: 408642 - RNA, 32 nt, Human
cugugguugcugcuccccggcuuucacagaca

SEQ ID NO: 408643 - RNA, 31 nt, Human
cugugguuggaggaaagaugagugaagggau

SEQ ID NO: 408644 - RNA, 32 nt, Human
cugugguuuaacuguuuucuuguauauggaua

SEQ ID NO: 408645 - RNA, 32 nt, Human
cugugguuucucuugauuucugaggaucucag

SEQ ID NO: 408646 - RNA, 20 nt, Human
cugugguuuucucugggcca

SEQ ID NO: 408647 - RNA, 32 nt, Human
cugugguuuuguuuccagagaacucagauugc

SEQ ID NO: 408648 - RNA, 32 nt, Human
cuguguaaaccagcaugcugucugccauaaua

SEQ ID NO: 408649 - RNA, 32 nt, Human
cuguguaaaccaguuacuuuccagagaacaaa

SEQ ID NO: 408650 - RNA, 32 nt, Human
cuguguaaagcauguaacuagauauugcuuug

SEQ ID NO: 408651 - RNA, 32 nt, Human
cuguguaacaaaccugcauguucugcacaugg

SEQ ID NO: 408652 - RNA, 32 nt, Human
cuguguaaccaccaccaccuguguaaccacca

SEQ ID NO: 408653 - RNA, 32 nt, Human
cuguguaauuggccugggcugcaugggcugcu

SEQ ID NO: 408654 - RNA, 19 nt, Human
cuguguacacaccaugccc

SEQ ID NO: 408655 - RNA, 32 nt, Human
cuguguacacagaaaccggcaccugccagaca

SEQ ID NO: 408656 - RNA, 32 nt, Human
cuguguacagcaucguucuuugcugaggccuc

SEQ ID NO: 408657 - RNA, 31 nt, Human
cuguguaccagaaucaguuguuggagaaaau

SEQ ID NO: 408658 - RNA, 32 nt, Human
cuguguaccaggcacuguggaaagcaccacau

SEQ ID NO: 408659 - RNA, 32 nt, Human
cuguguaccugacaaaacaccacaucucacuc

SEQ ID NO: 408660 - RNA, 32 nt, Human
cuguguacuuacagggugacccagggaucccu

SEQ ID NO: 408661 - RNA, 32 nt, Human
cuguguacuuugaauuauuuugcaguuaugua

SEQ ID NO: 408662 - RNA, 32 nt, Human
cuguguagacacuaaaaguauuacacaaaauc

SEQ ID NO: 408663 - RNA, 32 nt, Human
cuguguagaguggauugagaaaagaauugggu

SEQ ID NO: 408664 - RNA, 32 nt, Human
cuguguagaugccacuguaaauccagggccua

SEQ ID NO: 408665 - RNA, 32 nt, Human
cuguguagcauccucagugcaaaacccagcuc

SEQ ID NO: 408666 - RNA, 32 nt, Human
cuguguagcuuuguucauugcauuuauuaaac

SEQ ID NO: 408667 - RNA, 32 nt, Human
cuguguaggagcuaaagcaggucuccagggag

SEQ ID NO: 408668 - RNA, 32 nt, Human
cuguguaguuggagggcagggagccugagcca

SEQ ID NO: 408669 - RNA, 32 nt, Human
cuguguauacacacaaacacauauacauaagu

SEQ ID NO: 408670 - RNA, 24 nt, Human
cuguguauauaaauccacaugcac

SEQ ID NO: 408671 - RNA, 32 nt, Human
cuguguauccuuuuuccucuggcucuacacuu

SEQ ID NO: 408672 - RNA, 32 nt, Human
cuguguaucuagcucaagguuuauaacacacc

SEQ ID NO: 408673 - RNA, 32 nt, Human
cuguguaucugcaaagccucugccucagucuc

SEQ ID NO: 408674 - RNA, 18 nt, Human
cuguguaugcccugcaag

SEQ ID NO: 408675 - RNA, 20 nt, Human
cuguguauggaccuguggcu

SEQ ID NO: 408676 - RNA, 32 nt, Human
cuguguauucaaauucaaacagagaugguuug

SEQ ID NO: 408677 - RNA, 20 nt, Human
cuguguauucgccccacuca

SEQ ID NO: 408678 - RNA, 26 nt, Human
cuguguauuuacuuaauuucuuauua

SEQ ID NO: 408679 - RNA, 20 nt, Human
cuguguauuugccccacuca

SEQ ID NO: 408680 - RNA, 32 nt, Human
cugugucaacaacaggaaacuauuuguauuug

SEQ ID NO: 408681 - RNA, 32 nt, Human
cugugucaagaagcauugaaugcugagcggga

SEQ ID NO: 408682 - RNA, 32 nt, Human
cugugucaauggagauggccucugcugacuca

SEQ ID NO: 408683 - RNA, 32 nt, Human
cugugucacacaggcuggagugcaguggcgug

SEQ ID NO: 408684 - RNA, 32 nt, Human
cugugucacaugcagauucucaugcauucacg

SEQ ID NO: 408685 - RNA, 32 nt, Human
cugugucaccaaggcuggagggcaauagcaug

SEQ ID NO: 408686 - RNA, 25 nt, Human
cugugucaccaggauggagugcagu

SEQ ID NO: 408687 - RNA, 32 nt, Human
cugugucaccaggauggagugcaguggcauga

SEQ ID NO: 408688 - RNA, 32 nt, Human
cugugucacccacuccugggugcgugcagacc

SEQ ID NO: 408689 - RNA, 32 nt, Human
cugugucacccagacuggaaugcagugacaca

SEQ ID NO: 408690 - RNA, 32 nt, Human
cugugucacccaggcugccaggcuggagugga

SEQ ID NO: 408691 - RNA, 26 nt, Human
cugugucacccaggcuggagugcagu

SEQ ID NO: 408692 - RNA, 32 nt, Human
cugugucacccaggcuggagugcaguggcaca

SEQ ID NO: 408693 - RNA, 32 nt, Human
cugugucacccaggcuggagugcaguggcgca

SEQ ID NO: 408694 - RNA, 32 nt, Human
cugugucacccaggcuggagugcaguggugca

SEQ ID NO: 408695 - RNA, 26 nt, Human
cugugucaccuaggcuggagugcagu

SEQ ID NO: 408696 - RNA, 32 nt, Human
cugugucaccuaggcuggagugcaguggcaca

SEQ ID NO: 408697 - RNA, 32 nt, Human
cugugucacuccugccacuguuccaccauaga

SEQ ID NO: 408698 - RNA, 32 nt, Human
cugugucacuggcugccuccacucccacuucc

SEQ ID NO: 408699 - RNA, 32 nt, Human
cugugucagcaacagcagcuccaaggacaguu

SEQ ID NO: 408700 - RNA, 32 nt, Human
cugugucagcacaagggacuggcacacacaga

SEQ ID NO: 408701 - RNA, 32 nt, Human
cugugucagcccagcucugccucgcagccccc

SEQ ID NO: 408702 - RNA, 32 nt, Human
cugugucagcuccuacauagcauuagucuuuc

SEQ ID NO: 408703 - RNA, 32 nt, Human
cugugucauccagagcuggagugcagcggcac

SEQ ID NO: 408704 - RNA, 32 nt, Human
cugugucaugcaggcuggagugaagucgugug

SEQ ID NO: 408705 - RNA, 32 nt, Human
cugugucaugcaggcuggagugcaguggcaug

SEQ ID NO: 408706 - RNA, 32 nt, Human
cugugucauugcacuccagccugggcgacaag

SEQ ID NO: 408707 - RNA, 32 nt, Human
cuguguccaaauucagcagaaguggaaugaca

SEQ ID NO: 408708 - RNA, 19 nt, Human
cuguguccacaaaacuacc

SEQ ID NO: 408709 - RNA, 20 nt, Human
cuguguccacagucuccuca

SEQ ID NO: 408710 - RNA, 32 nt, Human
cuguguccacagugauuagccucgucuuucag

SEQ ID NO: 408711 - RNA, 32 nt, Human
cuguguccacuaaaaauacaaaauuagccggg

SEQ ID NO: 408712 - RNA, 32 nt, Human
cuguguccaggucccauccuaaagcuaccuag

SEQ ID NO: 408713 - RNA, 32 nt, Human
cugugucccacccuuccuagcuuugugcccgg

SEQ ID NO: 408714 - RNA, 24 nt, Human
cugugucccaggcuggagugcagu

SEQ ID NO: 408715 - RNA, 32 nt, Human
cugugucccaggcuggagugcaguggcacagu

SEQ ID NO: 408716 - RNA, 32 nt, Human
cugugucccagguuucacagggcucaggguua

SEQ ID NO: 408717 - RNA, 23 nt, Human
cuguguccccaaccaaaaucuca

SEQ ID NO: 408718 - RNA, 18 nt, Human
cuguguccccacagaucu

SEQ ID NO: 408719 - RNA, 21 nt, Human
cuguguccccaccaaaucuca

SEQ ID NO: 408720 - RNA, 18 nt, Human
cuguguccccaccaaauu

SEQ ID NO: 408721 - RNA, 21 nt, Human
cuguguccccacccaaaucuc

SEQ ID NO: 408722 - RNA, 22 nt, Human
cuguguccccacccaaaucuca

SEQ ID NO: 408723 - RNA, 21 nt, Human
cuguguccccacccaagucuc

SEQ ID NO: 408724 - RNA, 21 nt, Human
cuguguccccaccgucuuuca

SEQ ID NO: 408725 - RNA, 22 nt, Human
cuguguccccaccuaaaacuca

SEQ ID NO: 408726 - RNA, 22 nt, Human
cuguguccccacucagaucuca

SEQ ID NO: 408727 - RNA, 20 nt, Human
cuguguccccacuuccucca

SEQ ID NO: 408728 - RNA, 18 nt, Human
cuguguccccagcacuua

SEQ ID NO: 408729 - RNA, 17 nt, Human
cuguguccccagcaucu

SEQ ID NO: 408730 - RNA, 22 nt, Human
cuguguccccauccaaauauca

SEQ ID NO: 408731 - RNA, 32 nt, Human
cuguguccccaucugagggccugguaugcaau

SEQ ID NO: 408732 - RNA, 22 nt, Human
cuguguccccaugcaaaucuca

SEQ ID NO: 408733 - RNA, 20 nt, Human
cuguguccccaugcugccuc

SEQ ID NO: 408734 - RNA, 24 nt, Human
cugugucccccaccuccacccuca

SEQ ID NO: 408735 - RNA, 22 nt, Human
cugugucccccacuuccacuca

SEQ ID NO: 408736 - RNA, 32 nt, Human
cugugucccccaggcuggagugcaguggcaca

SEQ ID NO: 408737 - RNA, 32 nt, Human
cuguguccccucuccuccccugugccagugcc

SEQ ID NO: 408738 - RNA, 22 nt, Human
cuguguccccucugcccccuca

SEQ ID NO: 408739 - RNA, 32 nt, Human
cuguguccccugcagcuccagccccgggcugc

SEQ ID NO: 408740 - RNA, 19 nt, Human
cugugucccuccacugccu

SEQ ID NO: 408741 - RNA, 19 nt, Human
cugugucccugaacaucca

SEQ ID NO: 408742 - RNA, 32 nt, Human
cugugucccugauuuugcugugcaaauauaaa

SEQ ID NO: 408743 - RNA, 32 nt, Human
cugugucccugggggccccugaugcuuucucc

SEQ ID NO: 408744 - RNA, 32 nt, Human
cuguguccgcagcugcugccacucugggcugc

SEQ ID NO: 408745 - RNA, 20 nt, Human
cuguguccucagccauccca

SEQ ID NO: 408746 - RNA, 32 nt, Human
cuguguccuccaccaugcacucaccccuagcc

SEQ ID NO: 408747 - RNA, 32 nt, Human
cuguguccucccaucuauccugucuuuccuuu

SEQ ID NO: 408748 - RNA, 32 nt, Human
cuguguccuccccuccccggcccucccacagc

SEQ ID NO: 408749 - RNA, 20 nt, Human
cuguguccugacaccaccuc

SEQ ID NO: 408750 - RNA, 20 nt, Human
cuguguccugagcacacaag

SEQ ID NO: 408751 - RNA, 22 nt, Human
cuguguccugcccucccaucca

SEQ ID NO: 408752 - RNA, 32 nt, Human
cuguguccuggacggguggacuuagcuaggga

SEQ ID NO: 408753 - RNA, 22 nt, Human
cuguguccuggauuccauucca

SEQ ID NO: 408754 - RNA, 32 nt, Human
cuguguccuucucuuugcaggagaagggacag

SEQ ID NO: 408755 - RNA, 32 nt, Human
cuguguccuucucuuuguucagugaagccaau

SEQ ID NO: 408756 - RNA, 32 nt, Human
cuguguccuugcacuccuaucuggagauauca

SEQ ID NO: 408757 - RNA, 20 nt, Human
cuguguccuuuuaucucuca

SEQ ID NO: 408758 - RNA, 32 nt, Human
cugugucgauacaauaaucgacuugcagaaca

SEQ ID NO: 408759 - RNA, 32 nt, Human
cugugucgcaccuggcaccugcucgggagcgc

SEQ ID NO: 408760 - RNA, 32 nt, Human
cugugucgccaaggcuggagugcaguggugcg

SEQ ID NO: 408761 - RNA, 26 nt, Human
cugugucgcccaagcuagagugcagu

SEQ ID NO: 408762 - RNA, 32 nt, Human
cugugucgcccagacuggagugcagugguggg

SEQ ID NO: 408763 - RNA, 32 nt, Human
cugugucgcccaggcuggagugcaaguggcau

SEQ ID NO: 408764 - RNA, 32 nt, Human
cugugucgcccaggcuggagugcagugagcug

SEQ ID NO: 408765 - RNA, 32 nt, Human
cugugucgcccaggcuggagugcaguggcgug

SEQ ID NO: 408766 - RNA, 32 nt, Human
cugugucgccuaggcuggagugcaguggcgug

SEQ ID NO: 408767 - RNA, 22 nt, Human
cugugucgcugccugggaucuu

SEQ ID NO: 408768 - RNA, 23 nt, Human
cugugucgcuguccccaguccca

SEQ ID NO: 408769 - RNA, 17 nt, Human
cugugucgucccccauc

SEQ ID NO: 408770 - RNA, 32 nt, Human
cugugucuagaggaagccagagacagaaauag

SEQ ID NO: 408771 - RNA, 32 nt, Human
cugugucuaucccugucugugugucucuguua

SEQ ID NO: 408772 - RNA, 32 nt, Human
cugugucucaccagccuggagaugucugcugu

SEQ ID NO: 408773 - RNA, 24 nt, Human
cugugucucaggcuggaguacagu

SEQ ID NO: 408774 - RNA, 32 nt, Human
cugugucucaggcuggaguacaguggugcaau

SEQ ID NO: 408775 - RNA, 32 nt, Human
cugugucuccacacaucuccccauaugcuucc

SEQ ID NO: 408776 - RNA, 32 nt, Human
cugugucuccauccaaaucucaucuuaaauug

SEQ ID NO: 408777 - RNA, 32 nt, Human
cugugucucccaggccacugggugcucucugc

SEQ ID NO: 408778 - RNA, 32 nt, Human
cugugucuccccucagacuggggcucccugag

SEQ ID NO: 408779 - RNA, 32 nt, Human
cugugucuccccucagacugggguuccccaag

SEQ ID NO: 408780 - RNA, 32 nt, Human
cugugucuccccucagccuggggcucccugag

SEQ ID NO: 408781 - RNA, 32 nt, Human
cugugucuccccucaggcuggggcuccuugag

SEQ ID NO: 408782 - RNA, 22 nt, Human
cugugucucugaccccuucuca

SEQ ID NO: 408783 - RNA, 32 nt, Human
cugugucucuucucagggacaggcugguccag

SEQ ID NO: 408784 - RNA, 32 nt, Human
cugugucucuuuauuuaugcugugccauucaa

SEQ ID NO: 408785 - RNA, 32 nt, Human
cugugucugcuccaaauguagacagcaauugu

SEQ ID NO: 408786 - RNA, 32 nt, Human
cugugucugcugguggcugcugaggccuuggu

SEQ ID NO: 408787 - RNA, 32 nt, Human
cugugucugggaacuaccugcccagcuguuuu

SEQ ID NO: 408788 - RNA, 32 nt, Human
cugugucuggguccacacacccuucaggaagg

SEQ ID NO: 408789 - RNA, 32 nt, Human
cugugucugguggugauucucagacaccauca

SEQ ID NO: 408790 - RNA, 20 nt, Human
cugugucugucucccccuca

SEQ ID NO: 408791 - RNA, 32 nt, Human
cugugucuucacucgccccgagguggguggag

SEQ ID NO: 408792 - RNA, 18 nt, Human
cugugucuucuggggucu

SEQ ID NO: 408793 - RNA, 18 nt, Human
cugugugaaacccucuca

SEQ ID NO: 408794 - RNA, 23 nt, Human
cugugugaagauuuuuagcugua

SEQ ID NO: 408795 - RNA, 23 nt, Human
cugugugaaggugaaagugcagu

SEQ ID NO: 408796 - RNA, 32 nt, Human
cugugugaaugagccccaggagcagggcagua

SEQ ID NO: 408797 - RNA, 32 nt, Human
cugugugaccuuaggcuggagugcaauggcau

SEQ ID NO: 408798 - RNA, 32 nt, Human
cugugugacuccaggucccaggaaccuugccu

SEQ ID NO: 408799 - RNA, 32 nt, Human
cugugugagagauucuucauuucugcuuucug

SEQ ID NO: 408800 - RNA, 19 nt, Human
cugugugagaucugugcug

SEQ ID NO: 408801 - RNA, 18 nt, Human
cugugugagcaggguguu

SEQ ID NO: 408802 - RNA, 32 nt, Human
cugugugagccaccacacccagccugggucuc

SEQ ID NO: 408803 - RNA, 32 nt, Human
cugugugagguagcagugggcacuuuucauug

SEQ ID NO: 408804 - RNA, 32 nt, Human
cugugugaucugaucuuuaccuucccuuccuu

SEQ ID NO: 408805 - RNA, 32 nt, Human
cugugugaugcugucuccucuccagggacaag

SEQ ID NO: 408806 - RNA, 32 nt, Human
cugugugauucaguaggguuugagacuuagcu

SEQ ID NO: 408807 - RNA, 32 nt, Human
cugugugcaccaaggcccaucugacccauaua

SEQ ID NO: 408808 - RNA, 22 nt, Human
cugugugcaggcccugccugga

SEQ ID NO: 408809 - RNA, 32 nt, Human
cugugugcagugagcaauuuuugugucagaaa

SEQ ID NO: 408810 - RNA, 32 nt, Human
cugugugcaguggauccacauagcuaauauga

SEQ ID NO: 408811 - RNA, 32 nt, Human
cugugugccaugacauagcaggaaaggccagg

SEQ ID NO: 408812 - RNA, 32 nt, Human
cugugugcccacugaagagaugaagaauaaaa

SEQ ID NO: 408813 - RNA, 32 nt, Human
cugugugccccacuccagccuggggaccccac

SEQ ID NO: 408814 - RNA, 32 nt, Human
cugugugccccagggaaaucguuucaucuuuc

SEQ ID NO: 408815 - RNA, 32 nt, Human
cugugugccuccggaagacaccaccuuucccu

SEQ ID NO: 408816 - RNA, 32 nt, Human
cugugugccugcaccaccccacugccuuccuu

SEQ ID NO: 408817 - RNA, 24 nt, Human
cugugugccugcucccugcugcug

SEQ ID NO: 408818 - RNA, 32 nt, Human
cugugugccugggggaguuuuccucuauacau

SEQ ID NO: 408819 - RNA, 32 nt, Human
cugugugcucagggcacaugcacacagacauu

SEQ ID NO: 408820 - RNA, 32 nt, Human
cugugugcucaguccagcaccauggggaagcg

SEQ ID NO: 408821 - RNA, 32 nt, Human
cugugugcuccuccuuggugccuggccuggca

SEQ ID NO: 408822 - RNA, 32 nt, Human
cugugugcucugcuaccuguucaucagcucua

SEQ ID NO: 408823 - RNA, 32 nt, Human
cugugugcuggcuggacuccucgggacaagcc

SEQ ID NO: 408824 - RNA, 32 nt, Human
cugugugcugugugugccccaggcucuguuga

SEQ ID NO: 408825 - RNA, 20 nt, Human
cuguguggaaugucaccuca

SEQ ID NO: 408826 - RNA, 32 nt, Human
cuguguggagccaccacuccuagccacagcug

SEQ ID NO: 408827 - RNA, 32 nt, Human
cuguguggaggugaguggaguggggcaggugg

SEQ ID NO: 408828 - RNA, 32 nt, Human
cuguguggagugugcuguguacacaucugcuu

SEQ ID NO: 408829 - RNA, 20 nt, Human
cuguguggaugcugcagcug

SEQ ID NO: 408830 - RNA, 32 nt, Human
cuguguggauggagcagcaggagccagugagu

SEQ ID NO: 408831 - RNA, 32 nt, Human
cuguguggcaaaacugccuccuacggcggcuc

SEQ ID NO: 408832 - RNA, 32 nt, Human
cuguguggcaggaagccggcagggaagggccu

SEQ ID NO: 408833 - RNA, 32 nt, Human
cuguguggcauggcucacgccuguaaucccag

SEQ ID NO: 408834 - RNA, 32 nt, Human
cuguguggccaagaagaguugaggaaagauua

SEQ ID NO: 408835 - RNA, 32 nt, Human
cuguguggcccaggcuggagugcaguggcgca

SEQ ID NO: 408836 - RNA, 32 nt, Human
cuguguggcccuuuacagaaaaaguuuucuaa

SEQ ID NO: 408837 - RNA, 32 nt, Human
cuguguggccuagguuggagugcaauggcgca

SEQ ID NO: 408838 - RNA, 32 nt, Human
cuguguggccuucuguaagucccugcccucuc

SEQ ID NO: 408839 - RNA, 32 nt, Human
cuguguggcugccccugccacuccaggcacag

SEQ ID NO: 408840 - RNA, 32 nt, Human
cuguguggcuugcuuccagucuggccuguccu

SEQ ID NO: 408841 - RNA, 32 nt, Human
cugugugggaaaugcugaaagcaccaggagga

SEQ ID NO: 408842 - RNA, 32 nt, Human
cugugugggagaaucacuugagccugggaggu

SEQ ID NO: 408843 - RNA, 32 nt, Human
cugugugggagggcgaggcgggggagccugga

SEQ ID NO: 408844 - RNA, 32 nt, Human
cugugugggagggcgaggcgggggauccugga

SEQ ID NO: 408845 - RNA, 32 nt, Human
cugugugggcuuggugucggugcuccaguucc

SEQ ID NO: 408846 - RNA, 32 nt, Human
cuguguggggaagcaaaaggcaaggguguagu

SEQ ID NO: 408847 - RNA, 32 nt, Human
cugugugggguucagucagccugcugaaauug

SEQ ID NO: 408848 - RNA, 32 nt, Human
cugugugggguugaacucggagccaaaaagug

SEQ ID NO: 408849 - RNA, 32 nt, Human
cuguguggguagagaccauccuuucccugcau

SEQ ID NO: 408850 - RNA, 32 nt, Human
cugugugggugagagaagggacuagacuccua

SEQ ID NO: 408851 - RNA, 19 nt, Human
cuguguggucaacugcagu

SEQ ID NO: 408852 - RNA, 32 nt, Human
cuguguggucugggccagucucugccaugucc

SEQ ID NO: 408853 - RNA, 32 nt, Human
cugugugguguuucaccaacuucggccuaugg

SEQ ID NO: 408854 - RNA, 20 nt, Human
cugugugguugcccgggcca

SEQ ID NO: 408855 - RNA, 32 nt, Human
cugugugguuggucaaggagggaugugaggga

SEQ ID NO: 408856 - RNA, 32 nt, Human
cuguguguaagccugugugaguuguguguaug

SEQ ID NO: 408857 - RNA, 32 nt, Human
cuguguguacauguacaugcauuuuucuaggg

SEQ ID NO: 408858 - RNA, 32 nt, Human
cuguguguagugagugcuucauguguggaaua

SEQ ID NO: 408859 - RNA, 32 nt, Human
cuguguguaguggccucugauugcuugggguu

SEQ ID NO: 408860 - RNA, 32 nt, Human
cuguguguaugacugugugacugugugggagc

SEQ ID NO: 408861 - RNA, 32 nt, Human
cuguguguccugggagcugccugcucccggcc

SEQ ID NO: 408862 - RNA, 32 nt, Human
cugugugucuaugacugugauggguguagcug

SEQ ID NO: 408863 - RNA, 32 nt, Human
cugugugucuucucccccuccucgggugaucc

SEQ ID NO: 408864 - RNA, 19 nt, Human
cugugugucuugggaucuu

SEQ ID NO: 408865 - RNA, 32 nt, Human
cugugugugaagauugggggagaggauguaaa

SEQ ID NO: 408866 - RNA, 32 nt, Human
cugugugugaggaacagucacuacccacuggc

SEQ ID NO: 408867 - RNA, 32 nt, Human
cugugugugcaggcaacguccacccaugcugc

SEQ ID NO: 408868 - RNA, 31 nt, Human
cugugugugcccucugggcucugaguacccc

SEQ ID NO: 408869 - RNA, 32 nt, Human
cugugugugccugggagugaccucacagcugc

SEQ ID NO: 408870 - RNA, 32 nt, Human
cuguguguggaaggcagaagcuagcgguugua

SEQ ID NO: 408871 - RNA, 21 nt, Human
cuguguguggcgggggcgcgg

SEQ ID NO: 408872 - RNA, 32 nt, Human
cuguguguggugaagaccacgccacaccaccc

SEQ ID NO: 408873 - RNA, 19 nt, Human
cuguguguguccugggcca

SEQ ID NO: 408874 - RNA, 32 nt, Human
cugugugugugccucuguuggugaggaugugu

SEQ ID NO: 408875 - RNA, 32 nt, Human
cuguguguguggguauguauguguguauguau

SEQ ID NO: 408876 - RNA, 32 nt, Human
cuguguguguugaccacgucucugcugugaau

SEQ ID NO: 408877 - RNA, 32 nt, Human
cuguguguuaucucugccccacagcagccccu

SEQ ID NO: 408878 - RNA, 32 nt, Human
cuguguguucuuucucuggcauugauuccucu

SEQ ID NO: 408879 - RNA, 32 nt, Human
cuguguguugggauugagucugugccacgugu

SEQ ID NO: 408880 - RNA, 32 nt, Human
cuguguguuugucaucauccucaucucaccau

SEQ ID NO: 408881 - RNA, 32 nt, Human
cuguguuacacaaaguccuuguuuuaacuuag

SEQ ID NO: 408882 - RNA, 32 nt, Human
cuguguuacuagugccugguauguaguaggug

SEQ ID NO: 408883 - RNA, 32 nt, Human
cuguguuagccaggcuggucucgaucuccuga

SEQ ID NO: 408884 - RNA, 32 nt, Human
cuguguucaccaccaccaucagacucaccauu

SEQ ID NO: 408885 - RNA, 20 nt, Human
cuguguucacguggcuccug

SEQ ID NO: 408886 - RNA, 32 nt, Human
cuguguucacugucccauuugagaauucuaag

SEQ ID NO: 408887 - RNA, 32 nt, Human
cuguguucagaaugugguauuggcucuggccc

SEQ ID NO: 408888 - RNA, 32 nt, Human
cuguguucaggauguugaagugcagugucaga

SEQ ID NO: 408889 - RNA, 32 nt, Human
cuguguucaguuaucugguuugagcaaauaaa

SEQ ID NO: 408890 - RNA, 32 nt, Human
cuguguuccagaggaccugaugccaaggggua

SEQ ID NO: 408891 - RNA, 32 nt, Human
cuguguuccugagcuuguccaagucucuuucc

SEQ ID NO: 408892 - RNA, 22 nt, Human
cuguguuccugguccuggguuc

SEQ ID NO: 408893 - RNA, 32 nt, Human
cuguguucuagcgaccacuuguuuuucuuuuu

SEQ ID NO: 408894 - RNA, 22 nt, Human
cuguguucucccaacccuugga

SEQ ID NO: 408895 - RNA, 32 nt, Human
cuguguucucccaggucugggauucuaaguga

SEQ ID NO: 408896 - RNA, 32 nt, Human
cuguguucucccuuuguccucauacagucguc

SEQ ID NO: 408897 - RNA, 32 nt, Human
cuguguucucugaucuaggccuucccagagga

SEQ ID NO: 408898 - RNA, 22 nt, Human
cuguguucugcguuuggucuca

SEQ ID NO: 408899 - RNA, 32 nt, Human
cuguguugaacaaacaggugcuccaggcuuug

SEQ ID NO: 408900 - RNA, 32 nt, Human
cuguguugaacagaugucugucucccuagugu

SEQ ID NO: 408901 - RNA, 32 nt, Human
cuguguugccaaggcuggagugcaggccgcga

SEQ ID NO: 408902 - RNA, 23 nt, Human
cuguguugcccagacaagucuca

SEQ ID NO: 408903 - RNA, 32 nt, Human
cuguguugcccagccugggugucaauaauuau

SEQ ID NO: 408904 - RNA, 32 nt, Human
cuguguugcccagccuggucuugaauugggcu

SEQ ID NO: 408905 - RNA, 32 nt, Human
cuguguugcccaggcuaauaucgaaugcuugg

SEQ ID NO: 408906 - RNA, 25 nt, Human
cuguguugcccaggcuagagugcag

SEQ ID NO: 408907 - RNA, 32 nt, Human
cuguguugcccaggcuagagugcagcagugac

SEQ ID NO: 408908 - RNA, 26 nt, Human
cuguguugcccaggcuagagugcagu

SEQ ID NO: 408909 - RNA, 32 nt, Human
cuguguugcccaggcuagagugcaguggugcc

SEQ ID NO: 408910 - RNA, 32 nt, Human
cuguguugcccaggcuggagugcaaauggcuu

SEQ ID NO: 408911 - RNA, 26 nt, Human
cuguguugcccaggcuggagugcaau

SEQ ID NO: 408912 - RNA, 32 nt, Human
cuguguugcccaggcuggagugcaauggcgca

SEQ ID NO: 408913 - RNA, 26 nt, Human
cuguguugcccaggcuggagugcagu

SEQ ID NO: 408914 - RNA, 32 nt, Human
cuguguugcccaggcuggagugcaguagcuau

SEQ ID NO: 408915 - RNA, 32 nt, Human
cuguguugcccaggcuggagugcaguagugca

SEQ ID NO: 408916 - RNA, 32 nt, Human
cuguguugcccaggcuggagugcaguggccug

SEQ ID NO: 408917 - RNA, 32 nt, Human
cuguguugcccaggcuggagugcaguggugug

SEQ ID NO: 408918 - RNA, 32 nt, Human
cuguguugcccaggcuggagugcgguggcuau

SEQ ID NO: 408919 - RNA, 23 nt, Human
cuguguugcccaggcuggucuca

SEQ ID NO: 408920 - RNA, 32 nt, Human
cuguguugcggaaguucucacugugaacuuua

SEQ ID NO: 408921 - RNA, 32 nt, Human
cuguguugcucaggcuggagugcaguggugug

SEQ ID NO: 408922 - RNA, 18 nt, Human
cuguguugcugggauuuu

SEQ ID NO: 408923 - RNA, 32 nt, Human
cuguguuggaacuagcgagugguggagucucu

SEQ ID NO: 408924 - RNA, 32 nt, Human
cuguguuggccaggcuggucuugaaugccuga

SEQ ID NO: 408925 - RNA, 32 nt, Human
cuguguuggcuacaaaccugcacccugggacc

SEQ ID NO: 408926 - RNA, 32 nt, Human
cuguguugggcaagaccucuucccucugggcc

SEQ ID NO: 408927 - RNA, 32 nt, Human
cuguguugggguguugggggaagcugggcauc

SEQ ID NO: 408928 - RNA, 32 nt, Human
cuguguugguacccucgugugcucugagcuaa

SEQ ID NO: 408929 - RNA, 32 nt, Human
cuguguuguaccacugcacuccagccugggug

SEQ ID NO: 408930 - RNA, 32 nt, Human
cuguguuguccaggcuggagugcaauggugug

SEQ ID NO: 408931 - RNA, 26 nt, Human
cuguguuguccaggcuggagugcagu

SEQ ID NO: 408932 - RNA, 32 nt, Human
cuguguuguccaggcuggagugcaguggugug

SEQ ID NO: 408933 - RNA, 32 nt, Human
cuguguugucucugugccagauguggcaagau

SEQ ID NO: 408934 - RNA, 32 nt, Human
cuguguugugauucccuucucuucaacgguuu

SEQ ID NO: 408935 - RNA, 32 nt, Human
cuguguuguuuucccuggaugaaaauaucagu

SEQ ID NO: 408936 - RNA, 32 nt, Human
cuguguuuauucuucucuuuauuuauuuaagu

SEQ ID NO: 408937 - RNA, 32 nt, Human
cuguguuucagccucaguugguugcaccguua

SEQ ID NO: 408938 - RNA, 22 nt, Human
cuguguuucaggauacuucccu

SEQ ID NO: 408939 - RNA, 32 nt, Human
cuguguuucccaaguauacgcuguucuuucgc

SEQ ID NO: 408940 - RNA, 32 nt, Human
cuguguuucgccacugcacaccagccugggug

SEQ ID NO: 408941 - RNA, 32 nt, Human
cuguguuucucuugauuccgugacacccgguu

SEQ ID NO: 408942 - RNA, 32 nt, Human
cuguguuugaauccaagucaccuguguucucu

SEQ ID NO: 408943 - RNA, 32 nt, Human
cuguguuugcuccccuuccccuuccuucuuug

SEQ ID NO: 408944 - RNA, 32 nt, Human
cuguguuuggcuuccaggaauuacaugaacga

SEQ ID NO: 408945 - RNA, 32 nt, Human
cuguguuuguaguguggaaguuggugacuguu

SEQ ID NO: 408946 - RNA, 23 nt, Human
cuguguuuuaaaaaugauugaaa

SEQ ID NO: 408947 - RNA, 32 nt, Human
cuguguuuuagcuaauguagcauauguaauug

SEQ ID NO: 408948 - RNA, 32 nt, Human
cuguguuuuccucaggggcuguccucagaaca

SEQ ID NO: 408949 - RNA, 19 nt, Human
cuguguuuucugguacuuu

SEQ ID NO: 408950 - RNA, 32 nt, Human
cuguguuuugagccacagaagguugugugugu

SEQ ID NO: 408951 - RNA, 32 nt, Human
cuguuaaaaagaaagugagcaguguuagcuua

SEQ ID NO: 408952 - RNA, 32 nt, Human
cuguuaaaaauacaaaauuagccaggcguggu

SEQ ID NO: 408953 - RNA, 32 nt, Human
cuguuaaaacuuaccugcuaggaaugcuagau

SEQ ID NO: 408954 - RNA, 32 nt, Human
cuguuaaacucauuuauugagucaccuuuuuc

SEQ ID NO: 408955 - RNA, 32 nt, Human
cuguuaaacugagguuggggguuuccagggaa

SEQ ID NO: 408956 - RNA, 32 nt, Human
cuguuaaagauuuaugccagagccuugcagga

SEQ ID NO: 408957 - RNA, 32 nt, Human
cuguuaaagcagcugggagggagucuguaccc

SEQ ID NO: 408958 - RNA, 32 nt, Human
cuguuaacagucugggacauccgguauaguaa

SEQ ID NO: 408959 - RNA, 32 nt, Human
cuguuaacagugcugcaagaacaaagguggag

SEQ ID NO: 408960 - RNA, 32 nt, Human
cuguuaaccaaggagcaaaggaaaguauauuu

SEQ ID NO: 408961 - RNA, 32 nt, Human
cuguuaagcccuugaaauauagcuagugugac

SEQ ID NO: 408962 - RNA, 32 nt, Human
cuguuaaguccucagguuuggcccagauucca

SEQ ID NO: 408963 - RNA, 32 nt, Human
cuguuaauacuuuuguacacucucacuacagu

SEQ ID NO: 408964 - RNA, 32 nt, Human
cuguuaaugcgggcagcaccuacagcaacuug

SEQ ID NO: 408965 - RNA, 32 nt, Human
cuguuacaaaggagaugagguugugggagaac

SEQ ID NO: 408966 - RNA, 24 nt, Human
cuguuacacccguuucgugaagcu

SEQ ID NO: 408967 - RNA, 32 nt, Human
cuguuacagaggucuccagagccuucucucuc

SEQ ID NO: 408968 - RNA, 32 nt, Human
cuguuacagcacucuguucugcuggaccacuu

SEQ ID NO: 408969 - RNA, 32 nt, Human
cuguuacagugcagcagcagugacggaggaaa

SEQ ID NO: 408970 - RNA, 32 nt, Human
cuguuacauauguauacaugugccauguuggu

SEQ ID NO: 408971 - RNA, 32 nt, Human
cuguuacauguagggcaaucugucuuuaagua

SEQ ID NO: 408972 - RNA, 32 nt, Human
cuguuaccagcucugcagaugugcacauaucu

SEQ ID NO: 408973 - RNA, 32 nt, Human
cuguuaccauccuacucccccuucccaagcua

SEQ ID NO: 408974 - RNA, 32 nt, Human
cuguuaccaugaacaaacauugccagaauuaa

SEQ ID NO: 408975 - RNA, 24 nt, Human
cuguuacccagauuggagugcagu

SEQ ID NO: 408976 - RNA, 32 nt, Human
cuguuacccagauuggagugcaguggcgcgau

SEQ ID NO: 408977 - RNA, 32 nt, Human
cuguuacccagcuccuggaggcaguggcugua

SEQ ID NO: 408978 - RNA, 24 nt, Human
cuguuacccaggccggagugcagu

SEQ ID NO: 408979 - RNA, 32 nt, Human
cuguuacccaggccggagugcaguggcgcagu

SEQ ID NO: 408980 - RNA, 32 nt, Human
cuguuacccaggcuagagugcaauggcgugau

SEQ ID NO: 408981 - RNA, 32 nt, Human
cuguuacccaggcuagagugcaguggcgcgau

SEQ ID NO: 408982 - RNA, 24 nt, Human
cuguuacccaggcuagaguguagu

SEQ ID NO: 408983 - RNA, 32 nt, Human
cuguuacccaggcuagaguguaguggcaugau

SEQ ID NO: 408984 - RNA, 24 nt, Human
cuguuacccaggcuccagugcagu

SEQ ID NO: 408985 - RNA, 24 nt, Human
cuguuacccaggcuggaauacagu

SEQ ID NO: 408986 - RNA, 24 nt, Human
cuguuacccaggcuggaaugcagu

SEQ ID NO: 408987 - RNA, 32 nt, Human
cuguuacccaggcuggaaugcaguggcgcaau

SEQ ID NO: 408988 - RNA, 24 nt, Human
cuguuacccaggcuggaggacagu

SEQ ID NO: 408989 - RNA, 32 nt, Human
cuguuacccaggcuggaggacagugaugugau

SEQ ID NO: 408990 - RNA, 22 nt, Human
cuguuacccaggcuggagugca

SEQ ID NO: 408991 - RNA, 24 nt, Human
cuguuacccaggcuggagugcaau

SEQ ID NO: 408992 - RNA, 32 nt, Human
cuguuacccaggcuggagugcaauggagugau

SEQ ID NO: 408993 - RNA, 32 nt, Human
cuguuacccaggcuggagugcaauggcgcaaa

SEQ ID NO: 408994 - RNA, 24 nt, Human
cuguuacccaggcuggagugcagu

SEQ ID NO: 408995 - RNA, 32 nt, Human
cuguuacccaggcuggagugcagugacacaau

SEQ ID NO: 408996 - RNA, 32 nt, Human
cuguuacccaggcuggagugcaguggcaugau

SEQ ID NO: 408997 - RNA, 32 nt, Human
cuguuacccaggcuggagugcagugggugauc

SEQ ID NO: 408998 - RNA, 32 nt, Human
cuguuacccaggcuggagugcaguggugcgau

SEQ ID NO: 408999 - RNA, 32 nt, Human
cuguuacccaggcuggagugcaguggugcuau

SEQ ID NO: 409000 - RNA, 32 nt, Human
cuguuacccaggcuggagugcaguggugugau

SEQ ID NO: 409001 - RNA, 32 nt, Human
cuguuacccaggcuggaguguaguggugccau

SEQ ID NO: 409002 - RNA, 24 nt, Human
cuguuacccaugcuggaguacggu

SEQ ID NO: 409003 - RNA, 32 nt, Human
cuguuacccaugcuggaguacgguggcgagau

SEQ ID NO: 409004 - RNA, 32 nt, Human
cuguuaccccucuccaucuuaccaaguugaaa

SEQ ID NO: 409005 - RNA, 32 nt, Human
cuguuaccuggaccagguagaagugagcuacu

SEQ ID NO: 409006 - RNA, 24 nt, Human
cuguuaccuuuuuguuccuuacca

SEQ ID NO: 409007 - RNA, 32 nt, Human
cuguuacgaggggagaaagugggacuccucca

SEQ ID NO: 409008 - RNA, 32 nt, Human
cuguuacucaacaaaauuuugcagagaugaag

SEQ ID NO: 409009 - RNA, 32 nt, Human
cuguuacucccccucacccacucccuccuucc

SEQ ID NO: 409010 - RNA, 32 nt, Human
cuguuacugugcaucucugggcauggccugug

SEQ ID NO: 409011 - RNA, 32 nt, Human
cuguuacuugaaugccuucccugagggaagag

SEQ ID NO: 409012 - RNA, 21 nt, Human
cuguuacuuucuuucugggca

SEQ ID NO: 409013 - RNA, 22 nt, Human
cuguuagaagaacuugguugcu

SEQ ID NO: 409014 - RNA, 22 nt, Human
cuguuagaucuccuguuuguuu

SEQ ID NO: 409015 - RNA, 32 nt, Human
cuguuagauggaggaauauggugacccacuau

SEQ ID NO: 409016 - RNA, 32 nt, Human
cuguuagauguccucagaagucaguugcaaau

SEQ ID NO: 409017 - RNA, 21 nt, Human
cuguuagcccucagaguccca

SEQ ID NO: 409018 - RNA, 32 nt, Human
cuguuagccuauugcucaagcacuacagaaug

SEQ ID NO: 409019 - RNA, 32 nt, Human
cuguuagccucugagauguguggugugagccc

SEQ ID NO: 409020 - RNA, 32 nt, Human
cuguuagccugauucuacuguacaauguagaa

SEQ ID NO: 409021 - RNA, 32 nt, Human
cuguuagcuaggggaaaggcccugccaauguu

SEQ ID NO: 409022 - RNA, 32 nt, Human
cuguuagcugagagugcgggcaagacauaaac

SEQ ID NO: 409023 - RNA, 32 nt, Human
cuguuagcuguucugccuucugggugagcugg

SEQ ID NO: 409024 - RNA, 32 nt, Human
cuguuaggaaccaggcuacagagcaggaguug

SEQ ID NO: 409025 - RNA, 32 nt, Human
cuguuagucaucugugcuuucuuuaccaacug

SEQ ID NO: 409026 - RNA, 32 nt, Human
cuguuagugccagugagcaauacuguugugca

SEQ ID NO: 409027 - RNA, 32 nt, Human
cuguuauauacccaaugccuagaagaggaccu

SEQ ID NO: 409028 - RNA, 32 nt, Human
cuguuaucaggacuugaggccugagacacagc

SEQ ID NO: 409029 - RNA, 24 nt, Human
cuguuauccaggcuggaaugcggu

SEQ ID NO: 409030 - RNA, 32 nt, Human
cuguuauccaggcuggagugcagaggcacagu

SEQ ID NO: 409031 - RNA, 24 nt, Human
cuguuauccaggcuggugugcagu

SEQ ID NO: 409032 - RNA, 32 nt, Human
cuguuauccaggcuggugugcagugauacaau

SEQ ID NO: 409033 - RNA, 32 nt, Human
cuguuaucucuggugcuggccucugccccucc

SEQ ID NO: 409034 - RNA, 32 nt, Human
cuguuaucugggggagaggaguguggaagggu

SEQ ID NO: 409035 - RNA, 32 nt, Human
cuguuaucuguguccauuuccaaaacuugcac

SEQ ID NO: 409036 - RNA, 32 nt, Human
cuguuaugaacauguguguacaaguauuugug

SEQ ID NO: 409037 - RNA, 32 nt, Human
cuguuaugacacccagaaaugucucaggacgu

SEQ ID NO: 409038 - RNA, 32 nt, Human
cuguuaugucaccuccacaucucagaccaaag

SEQ ID NO: 409039 - RNA, 32 nt, Human
cuguuaugucugcagggcaucaaggggcaggu

SEQ ID NO: 409040 - RNA, 32 nt, Human
cuguuauuaccaggaggaagagaaagaggaca

SEQ ID NO: 409041 - RNA, 32 nt, Human
cuguuauucauuuauccuguacaaucaucugu

SEQ ID NO: 409042 - RNA, 32 nt, Human
cuguuauucccggcgaaggaagugccaaacuc

SEQ ID NO: 409043 - RNA, 32 nt, Human
cuguuauucucaaucuuuauagaaacgauucu

SEQ ID NO: 409044 - RNA, 32 nt, Human
cuguuauugugaugagucuuugguuuaacauc

SEQ ID NO: 409045 - RNA, 32 nt, Human
cuguuauuucucuuuuccuugaucuggagcca

SEQ ID NO: 409046 - RNA, 32 nt, Human
cuguuauuuuccuuccucucuggcagggcacu

SEQ ID NO: 409047 - RNA, 32 nt, Human
cuguuauuuugaaagggcaucuuuugauuuuu

SEQ ID NO: 409048 - RNA, 32 nt, Human
cuguucaaagagacauuuguucaaucucugug

SEQ ID NO: 409049 - RNA, 31 nt, Human
cuguucaacacagcaaugaccaaagcaaccc

SEQ ID NO: 409050 - RNA, 32 nt, Human
cuguucaacaucaccaguucugcccuggcagc

SEQ ID NO: 409051 - RNA, 21 nt, Human
cuguucaacauggcgaaaccc

SEQ ID NO: 409052 - RNA, 22 nt, Human
cuguucaacauggcgaaacccc

SEQ ID NO: 409053 - RNA, 32 nt, Human
cuguucaacauggcgaaaccccauucuaccaa

SEQ ID NO: 409054 - RNA, 32 nt, Human
cuguucaauaagccaaagacccuggugccccg

SEQ ID NO: 409055 - RNA, 32 nt, Human
cuguucaauauggugcccguaaccuccaaagc

SEQ ID NO: 409056 - RNA, 32 nt, Human
cuguucacacacacaguuugagacuccaagcc

SEQ ID NO: 409057 - RNA, 32 nt, Human
cuguucaccggguguccucagagcuguggccu

SEQ ID NO: 409058 - RNA, 32 nt, Human
cuguucacgucucuccccagugggcuccuaag

SEQ ID NO: 409059 - RNA, 32 nt, Human
cuguucacucacuguaaauuuugaggacccag

SEQ ID NO: 409060 - RNA, 32 nt, Human
cuguucacugaccucgaccaagccgcgaccgc

SEQ ID NO: 409061 - RNA, 32 nt, Human
cuguucagacacagccauccuucagugucauc

SEQ ID NO: 409062 - RNA, 32 nt, Human
cuguucagcaaacuaaccagcauucccuacag

SEQ ID NO: 409063 - RNA, 32 nt, Human
cuguucagcaaacuaaccagcauucccuauag

SEQ ID NO: 409064 - RNA, 32 nt, Human
cuguucagccaagagugguggcacgcuugggu

SEQ ID NO: 409065 - RNA, 32 nt, Human
cuguucagcccagcauucagcucuuuggagga

SEQ ID NO: 409066 - RNA, 32 nt, Human
cuguucaggggacagaugcaagcuguggggag

SEQ ID NO: 409067 - RNA, 32 nt, Human
cuguucaguguugcaggaaccuuuucuugggg

SEQ ID NO: 409068 - RNA, 32 nt, Human
cuguucauaugguuuaugaagggaggcaauua

SEQ ID NO: 409069 - RNA, 32 nt, Human
cuguucauccaaguuuuaaguccuccacccug

SEQ ID NO: 409070 - RNA, 32 nt, Human
cuguucauccauucuguucucccuuggggugg

SEQ ID NO: 409071 - RNA, 32 nt, Human
cuguucaucggcuucagccaguucucggacuc

SEQ ID NO: 409072 - RNA, 17 nt, Human
cuguucaucucugcaag

SEQ ID NO: 409073 - RNA, 32 nt, Human
cuguucaugacagcuacuaaccuggagacagu

SEQ ID NO: 409074 - RNA, 32 nt, Human
cuguucaugggagaaaauggcuuaacagucug

SEQ ID NO: 409075 - RNA, 32 nt, Human
cuguuccaaagccagggcuggggcugccaaaa

SEQ ID NO: 409076 - RNA, 32 nt, Human
cuguuccaaucacccacagcaggccugucagu

SEQ ID NO: 409077 - RNA, 32 nt, Human
cuguuccacacguguucacuggagccagguga

SEQ ID NO: 409078 - RNA, 32 nt, Human
cuguuccaccuccccucagacuaucuuucagc

SEQ ID NO: 409079 - RNA, 32 nt, Human
cuguuccacugcacccuggacuauggcaccag

SEQ ID NO: 409080 - RNA, 32 nt, Human
cuguuccacuugcacacacgcacacacucaug

SEQ ID NO: 409081 - RNA, 32 nt, Human
cuguuccacuuguaccuguccagcccugcccu

SEQ ID NO: 409082 - RNA, 32 nt, Human
cuguuccacuuucuuguaaugccugcaccagu

SEQ ID NO: 409083 - RNA, 32 nt, Human
cuguuccagcacccuucucccagcugcauucc

SEQ ID NO: 409084 - RNA, 22 nt, Human
cuguuccagccugcccucuuca

SEQ ID NO: 409085 - RNA, 25 nt, Human
cuguuccagucacauugccaucacu

SEQ ID NO: 409086 - RNA, 22 nt, Human
cuguuccagucacccccuucca

SEQ ID NO: 409087 - RNA, 32 nt, Human
cuguuccauacauaaaaggagagggguuguug

SEQ ID NO: 409088 - RNA, 32 nt, Human
cuguuccauaugcucgcaaucucagcuauuug

SEQ ID NO: 409089 - RNA, 24 nt, Human
cuguuccaucaguugccauccacu

SEQ ID NO: 409090 - RNA, 32 nt, Human
cuguucccaagaagguuuaagcauauguaaca

SEQ ID NO: 409091 - RNA, 32 nt, Human
cuguucccaagccucagaacucuugagcugug

SEQ ID NO: 409092 - RNA, 32 nt, Human
cuguucccagaacaggacgacagugaaaagaa

SEQ ID NO: 409093 - RNA, 32 nt, Human
cuguucccagaagaggccuggggagcagcuuu

SEQ ID NO: 409094 - RNA, 32 nt, Human
cuguucccagccccagccuuucuaagccauug

SEQ ID NO: 409095 - RNA, 31 nt, Human
cuguucccaggcaccaccacagcaggugcug

SEQ ID NO: 409096 - RNA, 22 nt, Human
cuguucccaggcccugccugga

SEQ ID NO: 409097 - RNA, 32 nt, Human
cuguucccaguguauucaacaggucacugaag

SEQ ID NO: 409098 - RNA, 32 nt, Human
cuguucccaucacccaccucuggagcuuacac

SEQ ID NO: 409099 - RNA, 32 nt, Human
cuguucccauccuccacagucucccaucccac

SEQ ID NO: 409100 - RNA, 32 nt, Human
cuguuccccaccccuucccuugcuggccauuc

SEQ ID NO: 409101 - RNA, 32 nt, Human
cuguuccccacccuaccucagcuggggucagg

SEQ ID NO: 409102 - RNA, 24 nt, Human
cuguuccccaggccggagugcagu

SEQ ID NO: 409103 - RNA, 32 nt, Human
cuguuccccaggccggagugcagugguacgau

SEQ ID NO: 409104 - RNA, 32 nt, Human
cuguuccccgacaccaagacccuggcgcagcg

SEQ ID NO: 409105 - RNA, 32 nt, Human
cuguuccccgaccucagacccugggcuuccga

SEQ ID NO: 409106 - RNA, 32 nt, Human
cuguuccccuccacugccaaguccucauuuuc

SEQ ID NO: 409107 - RNA, 32 nt, Human
cuguucccuccaggccuuggucuucaugguaa

SEQ ID NO: 409108 - RNA, 32 nt, Human
cuguucccuccccaaacccuaucccuccuacc

SEQ ID NO: 409109 - RNA, 32 nt, Human
cuguucccuccccuccccuuccuguccuuuca

SEQ ID NO: 409110 - RNA, 32 nt, Human
cuguucccuccccucuuuuguuccucccuaga

SEQ ID NO: 409111 - RNA, 32 nt, Human
cuguucccucccugcugaccugggacagucgc

SEQ ID NO: 409112 - RNA, 32 nt, Human
cuguucccugcagucugugcugugugucuggg

SEQ ID NO: 409113 - RNA, 32 nt, Human
cuguucccugcucccucgcuggcaagccccac

SEQ ID NO: 409114 - RNA, 19 nt, Human
cuguuccgcugcagccccg

SEQ ID NO: 409115 - RNA, 24 nt, Human
cuguuccgggccuuuggcuuugca

SEQ ID NO: 409116 - RNA, 21 nt, Human
cuguuccguuggcccugggcc

SEQ ID NO: 409117 - RNA, 32 nt, Human
cuguuccuaagaccucagguuacccaguguag

SEQ ID NO: 409118 - RNA, 23 nt, Human
cuguuccuagguaugucaccacg

SEQ ID NO: 409119 - RNA, 32 nt, Human
cuguuccuccacugcuugcccauagggcugcc

SEQ ID NO: 409120 - RNA, 32 nt, Human
cuguuccuccuaaaacaauccugacuuuuauu

SEQ ID NO: 409121 - RNA, 32 nt, Human
cuguuccucuccccaucucuauuuuucaacau

SEQ ID NO: 409122 - RNA, 32 nt, Human
cuguuccucuguuccucucuucuccugccccc

SEQ ID NO: 409123 - RNA, 32 nt, Human
cuguuccugaagucugugccccacuucuccau

SEQ ID NO: 409124 - RNA, 32 nt, Human
cuguuccugaggcugcccucuccagucccagg

SEQ ID NO: 409125 - RNA, 32 nt, Human
cuguuccugcauucacccacuggccuuuccca

SEQ ID NO: 409126 - RNA, 32 nt, Human
cuguuccugcgagggccaccuccucaggaaga

SEQ ID NO: 409127 - RNA, 32 nt, Human
cuguuccugcucaucaugaagauccccgcgau

SEQ ID NO: 409128 - RNA, 32 nt, Human
cuguuccuggacugcugcuggcuggcgaggag

SEQ ID NO: 409129 - RNA, 32 nt, Human
cuguuccuguccucccugugcaggguauccug

SEQ ID NO: 409130 - RNA, 32 nt, Human
cuguuccugucuuugcucacacccucacagcu

SEQ ID NO: 409131 - RNA, 32 nt, Human
cuguuccuguuaauguguuucuccccaugguc

SEQ ID NO: 409132 - RNA, 18 nt, Human
cuguuccuuccccgagcc

SEQ ID NO: 409133 - RNA, 32 nt, Human
cuguuccuuccccgagccccugccccggcucc

SEQ ID NO: 409134 - RNA, 32 nt, Human
cuguucgacagucagccgcaucuucuuuugcg

SEQ ID NO: 409135 - RNA, 32 nt, Human
cuguucgcucuccgccccuccuugccucccca

SEQ ID NO: 409136 - RNA, 32 nt, Human
cuguucgcugcccgaguauggagcugcugugu

SEQ ID NO: 409137 - RNA, 32 nt, Human
cuguucggcugguuccugccagcucgaggaca

SEQ ID NO: 409138 - RNA, 32 nt, Human
cuguucgggaggcugaggcaggagaaucacuu

SEQ ID NO: 409139 - RNA, 32 nt, Human
cuguucgggcuggggcauaccuguaccccagc

SEQ ID NO: 409140 - RNA, 32 nt, Human
cuguucggggacccugugagccuucuggccgg

SEQ ID NO: 409141 - RNA, 32 nt, Human
cuguucgugcaguuugcuggguguucccgcug

SEQ ID NO: 409142 - RNA, 32 nt, Human
cuguucgugccugucccugcucugccucccac

SEQ ID NO: 409143 - RNA, 24 nt, Human
cuguucguucugaaugucuucacg

SEQ ID NO: 409144 - RNA, 32 nt, Human
cuguucuaaaaauguuuaaaagaaacucaaua

SEQ ID NO: 409145 - RNA, 27 nt, Human
cuguucuaaauccaguguuugacccuu

SEQ ID NO: 409146 - RNA, 21 nt, Human
cuguucuaagcucugccuugc

SEQ ID NO: 409147 - RNA, 32 nt, Human
cuguucuaaggcaggaaauacaagcaugagca

SEQ ID NO: 409148 - RNA, 32 nt, Human
cuguucuaaugugccauguugcagugaucuga

SEQ ID NO: 409149 - RNA, 32 nt, Human
cuguucuacagucagccgcaucuucuuuugca

SEQ ID NO: 409150 - RNA, 32 nt, Human
cuguucuacaucuggcccuuggagcaggccgg

SEQ ID NO: 409151 - RNA, 32 nt, Human
cuguucuacccguuccaaaagccaauggcugc

SEQ ID NO: 409152 - RNA, 32 nt, Human
cuguucuauaaauaucuauaaauacucauaua

SEQ ID NO: 409153 - RNA, 32 nt, Human
cuguucuauaagguucagguguuuucaaguug

SEQ ID NO: 409154 - RNA, 32 nt, Human
cuguucucagcucugucaucugcagggcuucu

SEQ ID NO: 409155 - RNA, 32 nt, Human
cuguucucagcucugucaucugcggggcuucu

SEQ ID NO: 409156 - RNA, 32 nt, Human
cuguucucauucuccuucccaccaacauccau

SEQ ID NO: 409157 - RNA, 17 nt, Human
cuguucucauucugcaa

SEQ ID NO: 409158 - RNA, 32 nt, Human
cuguucuccacuccugacuucucccagccucg

SEQ ID NO: 409159 - RNA, 32 nt, Human
cuguucuccagaauccaggccaaaaaguucac

SEQ ID NO: 409160 - RNA, 32 nt, Human
cuguucuccaguguaggaacacugcugcuuca

SEQ ID NO: 409161 - RNA, 16 nt, Human
cuguucucccugcagg

SEQ ID NO: 409162 - RNA, 32 nt, Human
cuguucuccggcaucacaaagcagagaaaaca

SEQ ID NO: 409163 - RNA, 32 nt, Human
cuguucuccucaucuccagccucaguaguugg

SEQ ID NO: 409164 - RNA, 32 nt, Human
cuguucuccugcggccucccaggcugggcuuu

SEQ ID NO: 409165 - RNA, 32 nt, Human
cuguucucuaacuguggagugaauggaaauuc

SEQ ID NO: 409166 - RNA, 32 nt, Human
cuguucucuacuccugacuucuccuaggcuug

SEQ ID NO: 409167 - RNA, 24 nt, Human
cuguucucuccaugcccuggguca

SEQ ID NO: 409168 - RNA, 18 nt, Human
cuguucucuccccaguca

SEQ ID NO: 409169 - RNA, 32 nt, Human
cuguucucuccccucacauccuccugcccagc

SEQ ID NO: 409170 - RNA, 19 nt, Human
cuguucucuccuugaguca

SEQ ID NO: 409171 - RNA, 20 nt, Human
cuguucucugcccugcgcca

SEQ ID NO: 409172 - RNA, 19 nt, Human
cuguucucugccuugacca

SEQ ID NO: 409173 - RNA, 32 nt, Human
cuguucucuuccacucuccuugcuacccagaa

SEQ ID NO: 409174 - RNA, 32 nt, Human
cuguucucuuucccugaacucucccccagguu

SEQ ID NO: 409175 - RNA, 32 nt, Human
cuguucucuuucuggaacuccuuuuauucaga

SEQ ID NO: 409176 - RNA, 32 nt, Human
cuguucucuuuuucuagcuuccacaucagcuu

SEQ ID NO: 409177 - RNA, 32 nt, Human
cuguucugaaaccaucugauuggcuuucugag

SEQ ID NO: 409178 - RNA, 32 nt, Human
cuguucugaaagggauggccacaaguucuuuc

SEQ ID NO: 409179 - RNA, 32 nt, Human
cuguucugaaggcaccuccucaccucagaaac

SEQ ID NO: 409180 - RNA, 32 nt, Human
cuguucugagaucucuuuauuccugaauaaug

SEQ ID NO: 409181 - RNA, 32 nt, Human
cuguucugagcugccccuugcccacacacccc

SEQ ID NO: 409182 - RNA, 32 nt, Human
cuguucugcaacuccauccuccugugucacug

SEQ ID NO: 409183 - RNA, 32 nt, Human
cuguucugcuucccuguuccccuccacugcca

SEQ ID NO: 409184 - RNA, 32 nt, Human
cuguucuggaugagagaugagagcagaccggc

SEQ ID NO: 409185 - RNA, 32 nt, Human
cuguucuggcaaggaaggcucacggguucuga

SEQ ID NO: 409186 - RNA, 32 nt, Human
cuguucuguagguuguuucuccauguucuugu

SEQ ID NO: 409187 - RNA, 32 nt, Human
cuguucuguaucuugcucuguuugcuugauac

SEQ ID NO: 409188 - RNA, 23 nt, Human
cuguucuguauuccccauaucca

SEQ ID NO: 409189 - RNA, 32 nt, Human
cuguucugucuucauugacaggauuugcuugu

SEQ ID NO: 409190 - RNA, 32 nt, Human
cuguucugugucugcugcuuuugcuuaagauu

SEQ ID NO: 409191 - RNA, 32 nt, Human
cuguucuguucuguucuccuaauaccaucucg

SEQ ID NO: 409192 - RNA, 32 nt, Human
cuguucuuacugguugacauuuugaucacucu

SEQ ID NO: 409193 - RNA, 24 nt, Human
cuguucuuagcaagaugcgcacug

SEQ ID NO: 409194 - RNA, 26 nt, Human
cuguucuucacacugccccccaugcc

SEQ ID NO: 409195 - RNA, 32 nt, Human
cuguucuucccaacucuccucccuagcuagag

SEQ ID NO: 409196 - RNA, 32 nt, Human
cuguucuuccuauuucuggcugccucagccuu

SEQ ID NO: 409197 - RNA, 32 nt, Human
cuguucuuccucuacguuuauccuggcaugug

SEQ ID NO: 409198 - RNA, 32 nt, Human
cuguucuucucccagccucugcccuccuucug

SEQ ID NO: 409199 - RNA, 32 nt, Human
cuguucuucucuuccuccuucagcacugaauc

SEQ ID NO: 409200 - RNA, 32 nt, Human
cuguucuugaacagauacuaugucuauaacuc

SEQ ID NO: 409201 - RNA, 32 nt, Human
cuguucuugaagcugggcugucucucuccaug

SEQ ID NO: 409202 - RNA, 32 nt, Human
cuguucuugacccaccuccuucaaacucggau

SEQ ID NO: 409203 - RNA, 32 nt, Human
cuguucuugcacugcuauaaagaacuaccuga

SEQ ID NO: 409204 - RNA, 32 nt, Human
cuguucuugguacuguuuccuccucuguuccc

SEQ ID NO: 409205 - RNA, 32 nt, Human
cuguugaacagcuaucacguugaaccacguga

SEQ ID NO: 409206 - RNA, 32 nt, Human
cuguugaacugucuuccaaccugccauggcag

SEQ ID NO: 409207 - RNA, 32 nt, Human
cuguugaacuucuuucuguuaugagaggauuu

SEQ ID NO: 409208 - RNA, 32 nt, Human
cuguugaagcaccuccacagaccugggccggg

SEQ ID NO: 409209 - RNA, 32 nt, Human
cuguugaaucacaacaaaauuagauuuguaca

SEQ ID NO: 409210 - RNA, 32 nt, Human
cuguugacaaguugguuugagggagaaaacuu

SEQ ID NO: 409211 - RNA, 32 nt, Human
cuguugaccaaggagaggucacauucuuuuca

SEQ ID NO: 409212 - RNA, 32 nt, Human
cuguugaccagccugguuucauaccgaaaaga

SEQ ID NO: 409213 - RNA, 24 nt, Human
cuguugaccaggcuggagugaagu

SEQ ID NO: 409214 - RNA, 32 nt, Human
cuguugaccaggcuggagugaaguggugugau

SEQ ID NO: 409215 - RNA, 24 nt, Human
cuguugaccaggcuggagugcagu

SEQ ID NO: 409216 - RNA, 32 nt, Human
cuguugaccaggcuggagugcaguggugagau

SEQ ID NO: 409217 - RNA, 32 nt, Human
cuguugaccaugaauuucuuagcaauaggaau

SEQ ID NO: 409218 - RNA, 23 nt, Human
cuguugacccauuucgugaccua

SEQ ID NO: 409219 - RNA, 32 nt, Human
cuguugacccgcacuuuaaagcuuuuguuugc

SEQ ID NO: 409220 - RNA, 32 nt, Human
cuguugacccuguucaggccucggugaaggcu

SEQ ID NO: 409221 - RNA, 32 nt, Human
cuguugacuagagagacagucuguccuggacc

SEQ ID NO: 409222 - RNA, 32 nt, Human
cuguugacucacuggagggacccugcucaggc

SEQ ID NO: 409223 - RNA, 32 nt, Human
cuguugacucccuguugucauacaugaggcuu

SEQ ID NO: 409224 - RNA, 19 nt, Human
cuguugacugcccccaccu

SEQ ID NO: 409225 - RNA, 21 nt, Human
cuguugagcugguucuccagg

SEQ ID NO: 409226 - RNA, 32 nt, Human
cuguugaggccacccugguggcaccaaagccc

SEQ ID NO: 409227 - RNA, 32 nt, Human
cuguugagggccuggggaaaccauggcaaagu

SEQ ID NO: 409228 - RNA, 32 nt, Human
cuguugagucccugugcaccuucagaaccaca

SEQ ID NO: 409229 - RNA, 32 nt, Human
cuguugagucgagaggaaugagauugggguca

SEQ ID NO: 409230 - RNA, 32 nt, Human
cuguugauagccccagacauacccacagcauu

SEQ ID NO: 409231 - RNA, 32 nt, Human
cuguugaucucaggguacuuucugggauugcu

SEQ ID NO: 409232 - RNA, 32 nt, Human
cuguugaugucacauccuuugacccuggucug

SEQ ID NO: 409233 - RNA, 32 nt, Human
cuguugcaaucagaauaaacucacuucuugcc

SEQ ID NO: 409234 - RNA, 32 nt, Human
cuguugcagacaaugcauaggagugaaugaga

SEQ ID NO: 409235 - RNA, 32 nt, Human
cuguugcagggugugauggagaacaaagcuau

SEQ ID NO: 409236 - RNA, 32 nt, Human
cuguugccaaaauuaauuuacagugccuuacc

SEQ ID NO: 409237 - RNA, 32 nt, Human
cuguugccaaccuaaaacauuucccuuuggaa

SEQ ID NO: 409238 - RNA, 23 nt, Human
cuguugccaaggcuagagcacag

SEQ ID NO: 409239 - RNA, 24 nt, Human
cuguugccaaggcuggaaugcagu

SEQ ID NO: 409240 - RNA, 32 nt, Human
cuguugccaaggcuggaaugcaguggcgagau

SEQ ID NO: 409241 - RNA, 24 nt, Human
cuguugccaaggcuggagugcagu

SEQ ID NO: 409242 - RNA, 32 nt, Human
cuguugccaaggcuggagugcaguggaacgau

SEQ ID NO: 409243 - RNA, 32 nt, Human
cuguugccaccugggcacgcagcacccucaag

SEQ ID NO: 409244 - RNA, 21 nt, Human
cuguugccacuagaauguagu

SEQ ID NO: 409245 - RNA, 32 nt, Human
cuguugccacugcacucuggccugggcaacag

SEQ ID NO: 409246 - RNA, 22 nt, Human
cuguugccagacuggagugcag

SEQ ID NO: 409247 - RNA, 23 nt, Human
cuguugccagacuggagugcagu

SEQ ID NO: 409248 - RNA, 23 nt, Human
cuguugccaggccagagugcagu

SEQ ID NO: 409249 - RNA, 23 nt, Human
cuguugccaggcuagagugcagu

SEQ ID NO: 409250 - RNA, 23 nt, Human
cuguugccaggcuggaaugcagu

SEQ ID NO: 409251 - RNA, 23 nt, Human
cuguugccaggcuggaaugccgu

SEQ ID NO: 409252 - RNA, 23 nt, Human
cuguugccaggcuggagggcagu

SEQ ID NO: 409253 - RNA, 23 nt, Human
cuguugccaggcuggagugcagu

SEQ ID NO: 409254 - RNA, 23 nt, Human
cuguugccaggcuggggugcagu

SEQ ID NO: 409255 - RNA, 32 nt, Human
cuguugccaggggagcacggaggcagaucuga

SEQ ID NO: 409256 - RNA, 22 nt, Human
cuguugccaguauagaugcagu

SEQ ID NO: 409257 - RNA, 32 nt, Human
cuguugccaucagggugcacacagcaggugca

SEQ ID NO: 409258 - RNA, 32 nt, Human
cuguugccauggugaugguguagcccucccac

SEQ ID NO: 409259 - RNA, 24 nt, Human
cuguugcccaagcuggaaugcagu

SEQ ID NO: 409260 - RNA, 24 nt, Human
cuguugcccaagcuggaguacagu

SEQ ID NO: 409261 - RNA, 32 nt, Human
cuguugcccaagcuggaguacaguagugcaau

SEQ ID NO: 409262 - RNA, 24 nt, Human
cuguugcccaagcuggagugaagu

SEQ ID NO: 409263 - RNA, 32 nt, Human
cuguugcccaagcuggagugaagugguacaau

SEQ ID NO: 409264 - RNA, 24 nt, Human
cuguugcccaagcuggagugcagu

SEQ ID NO: 409265 - RNA, 24 nt, Human
cuguugcccaagcuugagggcagu

SEQ ID NO: 409266 - RNA, 24 nt, Human
cuguugcccaagguagagugcagu

SEQ ID NO: 409267 - RNA, 22 nt, Human
cuguugcccaaguuggagugca

SEQ ID NO: 409268 - RNA, 24 nt, Human
cuguugcccaaguuggagugcaau

SEQ ID NO: 409269 - RNA, 32 nt, Human
cuguugcccaaguuggagugcaaucuuggcuc

SEQ ID NO: 409270 - RNA, 24 nt, Human
cuguugcccaaguuggagugcagu

SEQ ID NO: 409271 - RNA, 32 nt, Human
cuguugcccaaguuggagugcaguggcaugau

SEQ ID NO: 409272 - RNA, 32 nt, Human
cuguugcccaaucuuaacauuuuugagcugca

SEQ ID NO: 409273 - RNA, 24 nt, Human
cuguugcccacauuggagugcagu

SEQ ID NO: 409274 - RNA, 32 nt, Human
cuguugcccacauuggagugcaguggcacgau

SEQ ID NO: 409275 - RNA, 24 nt, Human
cuguugcccacgcaggagugcagu

SEQ ID NO: 409276 - RNA, 32 nt, Human
cuguugcccacgcaggagugcaguggcaugcu

SEQ ID NO: 409277 - RNA, 22 nt, Human
cuguugcccagacuagaguaca

SEQ ID NO: 409278 - RNA, 24 nt, Human
cuguugcccagacuagagugcagu

SEQ ID NO: 409279 - RNA, 24 nt, Human
cuguugcccagacuggagugcagu

SEQ ID NO: 409280 - RNA, 32 nt, Human
cuguugcccagacuggagugcaguggcacgau

SEQ ID NO: 409281 - RNA, 32 nt, Human
cuguugcccagacuggagugcaguggcgugau

SEQ ID NO: 409282 - RNA, 32 nt, Human
cuguugcccagacuggagugcagugguguaau

SEQ ID NO: 409283 - RNA, 32 nt, Human
cuguugcccagacuggagugcaguggugugau

SEQ ID NO: 409284 - RNA, 32 nt, Human
cuguugcccagccuggagugcaauggcacaau

SEQ ID NO: 409285 - RNA, 32 nt, Human
cuguugcccagccuggagugcaguggcauuau

SEQ ID NO: 409286 - RNA, 32 nt, Human
cuguugcccagccuggagugcagugugucauc

SEQ ID NO: 409287 - RNA, 23 nt, Human
cuguugcccagcuggagugcagu

SEQ ID NO: 409288 - RNA, 24 nt, Human
cuguugcccaggagggagugcagu

SEQ ID NO: 409289 - RNA, 32 nt, Human
cuguugcccaggagggagugcaguggugcaac

SEQ ID NO: 409290 - RNA, 24 nt, Human
cuguugcccaggauggagugcagu

SEQ ID NO: 409291 - RNA, 32 nt, Human
cuguugcccaggauggagugcaguggugagau

SEQ ID NO: 409292 - RNA, 24 nt, Human
cuguugcccaggcaagagugcagu

SEQ ID NO: 409293 - RNA, 24 nt, Human
cuguugcccaggcaggaguacagu

SEQ ID NO: 409294 - RNA, 24 nt, Human
cuguugcccaggcaguagugcagu

SEQ ID NO: 409295 - RNA, 32 nt, Human
cuguugcccaggcuacagugcaauggcaugau

SEQ ID NO: 409296 - RNA, 23 nt, Human
cuguugcccaggcuagagcgcag

SEQ ID NO: 409297 - RNA, 32 nt, Human
cuguugcccaggcuagagcgcaggggcacaau

SEQ ID NO: 409298 - RNA, 22 nt, Human
cuguugcccaggcuagagugca

SEQ ID NO: 409299 - RNA, 32 nt, Human
cuguugcccaggcuagagugcaauggcacaau

SEQ ID NO: 409300 - RNA, 32 nt, Human
cuguugcccaggcuagagugcacuggugguca

SEQ ID NO: 409301 - RNA, 24 nt, Human
cuguugcccaggcuagagugcagu

SEQ ID NO: 409302 - RNA, 32 nt, Human
cuguugcccaggcuagagugcaguggcaugau

SEQ ID NO: 409303 - RNA, 32 nt, Human
cuguugcccaggcuagagugcaguggugcaau

SEQ ID NO: 409304 - RNA, 32 nt, Human
cuguugcccaggcuccagugcaguggugugau

SEQ ID NO: 409305 - RNA, 32 nt, Human
cuguugcccaggcucuagugcaauggcacgau

SEQ ID NO: 409306 - RNA, 24 nt, Human
cuguugcccaggcugaagugcagu

SEQ ID NO: 409307 - RNA, 32 nt, Human
cuguugcccaggcugaagugcaguggggcgcu

SEQ ID NO: 409308 - RNA, 32 nt, Human
cuguugcccaggcugaagugcaguggugcgau

SEQ ID NO: 409309 - RNA, 32 nt, Human
cuguugcccaggcugaagugcaguggugugau

SEQ ID NO: 409310 - RNA, 24 nt, Human
cuguugcccaggcugaaguguagu

SEQ ID NO: 409311 - RNA, 32 nt, Human
cuguugcccaggcugaaguguaguggcacaau

SEQ ID NO: 409312 - RNA, 32 nt, Human
cuguugcccaggcugagguacaguggcgugau

SEQ ID NO: 409313 - RNA, 24 nt, Human
cuguugcccaggcugcagugcagu

SEQ ID NO: 409314 - RNA, 32 nt, Human
cuguugcccaggcugcagugcaguggugccau

SEQ ID NO: 409315 - RNA, 32 nt, Human
cuguugcccaggcugcagugcaguggugugau

SEQ ID NO: 409316 - RNA, 22 nt, Human
cuguugcccaggcugcuggagu

SEQ ID NO: 409317 - RNA, 27 nt, Human
cuguugcccaggcugcuggagugccgu

SEQ ID NO: 409318 - RNA, 23 nt, Human
cuguugcccaggcuggaauacag

SEQ ID NO: 409319 - RNA, 24 nt, Human
cuguugcccaggcuggaauacagu

SEQ ID NO: 409320 - RNA, 32 nt, Human
cuguugcccaggcuggaauacaguggcacgau

SEQ ID NO: 409321 - RNA, 24 nt, Human
cuguugcccaggcuggaaugcagu

SEQ ID NO: 409322 - RNA, 32 nt, Human
cuguugcccaggcuggaaugcagugauacgau

SEQ ID NO: 409323 - RNA, 32 nt, Human
cuguugcccaggcuggaaugcaguggcacaau

SEQ ID NO: 409324 - RNA, 32 nt, Human
cuguugcccaggcuggaaugcaguggcgugau

SEQ ID NO: 409325 - RNA, 32 nt, Human
cuguugcccaggcuggaaugcagugguacgcu

SEQ ID NO: 409326 - RNA, 32 nt, Human
cuguugcccaggcuggaaugcaguggugugcu

SEQ ID NO: 409327 - RNA, 32 nt, Human
cuguugcccaggcuggacuacaguggcacaau

SEQ ID NO: 409328 - RNA, 24 nt, Human
cuguugcccaggcuggacugcagu

SEQ ID NO: 409329 - RNA, 32 nt, Human
cuguugcccaggcuggacugcaguggcgugau

SEQ ID NO: 409330 - RNA, 24 nt, Human
cuguugcccaggcuggagagcagu

SEQ ID NO: 409331 - RNA, 32 nt, Human
cuguugcccaggcuggagagcaguggcgcgau

SEQ ID NO: 409332 - RNA, 32 nt, Human
cuguugcccaggcuggagagcaguggugcaau

SEQ ID NO: 409333 - RNA, 24 nt, Human
cuguugcccaggcuggagggcagu

SEQ ID NO: 409334 - RNA, 32 nt, Human
cuguugcccaggcuggaguaaagggcaguggc

SEQ ID NO: 409335 - RNA, 22 nt, Human
cuguugcccaggcuggaguaca

SEQ ID NO: 409336 - RNA, 24 nt, Human
cuguugcccaggcuggaguacaau

SEQ ID NO: 409337 - RNA, 32 nt, Human
cuguugcccaggcuggaguacaauggcgugau

SEQ ID NO: 409338 - RNA, 24 nt, Human
cuguugcccaggcuggaguacagu

SEQ ID NO: 409339 - RNA, 32 nt, Human
cuguugcccaggcuggaguacaguggcacaau

SEQ ID NO: 409340 - RNA, 32 nt, Human
cuguugcccaggcuggaguacaguggcacgau

SEQ ID NO: 409341 - RNA, 32 nt, Human
cuguugcccaggcuggaguacaguggcgugau

SEQ ID NO: 409342 - RNA, 32 nt, Human
cuguugcccaggcuggaguacaguggucacug

SEQ ID NO: 409343 - RNA, 32 nt, Human
cuguugcccaggcuggaguacauuggugugau

SEQ ID NO: 409344 - RNA, 32 nt, Human
cuguugcccaggcuggaguacauuugccugau

SEQ ID NO: 409345 - RNA, 24 nt, Human
cuguugcccaggcuggaguauagu

SEQ ID NO: 409346 - RNA, 27 nt, Human
cuguugcccaggcuggaguauaguagu

SEQ ID NO: 409347 - RNA, 32 nt, Human
cuguugcccaggcuggaguauaguagugcagu

SEQ ID NO: 409348 - RNA, 32 nt, Human
cuguugcccaggcuggaguccaguggcauggu

SEQ ID NO: 409349 - RNA, 22 nt, Human
cuguugcccaggcuggagugca

SEQ ID NO: 409350 - RNA, 24 nt, Human
cuguugcccaggcuggagugcaau

SEQ ID NO: 409351 - RNA, 32 nt, Human
cuguugcccaggcuggagugcaaugacacagu

SEQ ID NO: 409352 - RNA, 32 nt, Human
cuguugcccaggcuggagugcaauggcacaau

SEQ ID NO: 409353 - RNA, 32 nt, Human
cuguugcccaggcuggagugcaauggcacauc

SEQ ID NO: 409354 - RNA, 32 nt, Human
cuguugcccaggcuggagugcaauggcacgau

SEQ ID NO: 409355 - RNA, 32 nt, Human
cuguugcccaggcuggagugcaauggcaugau

SEQ ID NO: 409356 - RNA, 32 nt, Human
cuguugcccaggcuggagugcaauggcgcguu

SEQ ID NO: 409357 - RNA, 32 nt, Human
cuguugcccaggcuggagugcaauggugcgau

SEQ ID NO: 409358 - RNA, 32 nt, Human
cuguugcccaggcuggagugcacuggcuugau

SEQ ID NO: 409359 - RNA, 23 nt, Human
cuguugcccaggcuggagugcag

SEQ ID NO: 409360 - RNA, 32 nt, Human
cuguugcccaggcuggagugcagaggugcgau

SEQ ID NO: 409361 - RNA, 32 nt, Human
cuguugcccaggcuggagugcagcggcaugau

SEQ ID NO: 409362 - RNA, 32 nt, Human
cuguugcccaggcuggagugcagggacaccuc

SEQ ID NO: 409363 - RNA, 32 nt, Human
cuguugcccaggcuggagugcaggggcacgau

SEQ ID NO: 409364 - RNA, 32 nt, Human
cuguugcccaggcuggagugcaggggcguaau

SEQ ID NO: 409365 - RNA, 24 nt, Human
cuguugcccaggcuggagugcagu

SEQ ID NO: 409366 - RNA, 32 nt, Human
cuguugcccaggcuggagugcaguagcacgau

SEQ ID NO: 409367 - RNA, 32 nt, Human
cuguugcccaggcuggagugcagucgcacaau

SEQ ID NO: 409368 - RNA, 32 nt, Human
cuguugcccaggcuggagugcagugacgcgau

SEQ ID NO: 409369 - RNA, 32 nt, Human
cuguugcccaggcuggagugcagugacgugau

SEQ ID NO: 409370 - RNA, 32 nt, Human
cuguugcccaggcuggagugcagugaugugau

SEQ ID NO: 409371 - RNA, 26 nt, Human
cuguugcccaggcuggagugcagugg

SEQ ID NO: 409372 - RNA, 32 nt, Human
cuguugcccaggcuggagugcaguggagcaau

SEQ ID NO: 409373 - RNA, 32 nt, Human
cuguugcccaggcuggagugcaguggcacaau

SEQ ID NO: 409374 - RNA, 32 nt, Human
cuguugcccaggcuggagugcaguggcaccau

SEQ ID NO: 409375 - RNA, 32 nt, Human
cuguugcccaggcuggagugcaguggcacgau

SEQ ID NO: 409376 - RNA, 32 nt, Human
cuguugcccaggcuggagugcaguggcaugau

SEQ ID NO: 409377 - RNA, 32 nt, Human
cuguugcccaggcuggagugcaguggcauuau

SEQ ID NO: 409378 - RNA, 32 nt, Human
cuguugcccaggcuggagugcaguggcgaaau

SEQ ID NO: 409379 - RNA, 32 nt, Human
cuguugcccaggcuggagugcaguggcgcaau

SEQ ID NO: 409380 - RNA, 32 nt, Human
cuguugcccaggcuggagugcaguggcgccau

SEQ ID NO: 409381 - RNA, 32 nt, Human
cuguugcccaggcuggagugcaguggcgcgau

SEQ ID NO: 409382 - RNA, 32 nt, Human
cuguugcccaggcuggagugcaguggcgcggu

SEQ ID NO: 409383 - RNA, 32 nt, Human
cuguugcccaggcuggagugcaguggcgcuau

SEQ ID NO: 409384 - RNA, 32 nt, Human
cuguugcccaggcuggagugcaguggcgugau

SEQ ID NO: 409385 - RNA, 32 nt, Human
cuguugcccaggcuggagugcagugggaugau

SEQ ID NO: 409386 - RNA, 32 nt, Human
cuguugcccaggcuggagugcagugguaugau

SEQ ID NO: 409387 - RNA, 32 nt, Human
cuguugcccaggcuggagugcaguggugagau

SEQ ID NO: 409388 - RNA, 32 nt, Human
cuguugcccaggcuggagugcaguggugcaau

SEQ ID NO: 409389 - RNA, 32 nt, Human
cuguugcccaggcuggagugcaguggugccau

SEQ ID NO: 409390 - RNA, 32 nt, Human
cuguugcccaggcuggagugcaguggugcgau

SEQ ID NO: 409391 - RNA, 32 nt, Human
cuguugcccaggcuggagugcaguggugggaa

SEQ ID NO: 409392 - RNA, 32 nt, Human
cuguugcccaggcuggagugcagugguguaau

SEQ ID NO: 409393 - RNA, 32 nt, Human
cuguugcccaggcuggagugcaguggugugau

SEQ ID NO: 409394 - RNA, 32 nt, Human
cuguugcccaggcuggagugcagugucacaau

SEQ ID NO: 409395 - RNA, 32 nt, Human
cuguugcccaggcuggagugcagugucccgau

SEQ ID NO: 409396 - RNA, 32 nt, Human
cuguugcccaggcuggagugcauugaugugau

SEQ ID NO: 409397 - RNA, 22 nt, Human
cuguugcccaggcuggagugcg

SEQ ID NO: 409398 - RNA, 24 nt, Human
cuguugcccaggcuggagugcgau

SEQ ID NO: 409399 - RNA, 32 nt, Human
cuguugcccaggcuggagugcgauggcaugau

SEQ ID NO: 409400 - RNA, 24 nt, Human
cuguugcccaggcuggagugcggu

SEQ ID NO: 409401 - RNA, 32 nt, Human
cuguugcccaggcuggagugcgguggacucuu

SEQ ID NO: 409402 - RNA, 32 nt, Human
cuguugcccaggcuggagugcgguggcaugau

SEQ ID NO: 409403 - RNA, 32 nt, Human
cuguugcccaggcuggagugcgguggugcgau

SEQ ID NO: 409404 - RNA, 32 nt, Human
cuguugcccaggcuggaguguaauggcgccau

SEQ ID NO: 409405 - RNA, 32 nt, Human
cuguugcccaggcuggaguguaauggugcaau

SEQ ID NO: 409406 - RNA, 23 nt, Human
cuguugcccaggcuggaguguag

SEQ ID NO: 409407 - RNA, 24 nt, Human
cuguugcccaggcuggaguguagu

SEQ ID NO: 409408 - RNA, 32 nt, Human
cuguugcccaggcuggaguguagugguaugau

SEQ ID NO: 409409 - RNA, 32 nt, Human
cuguugcccaggcuggaguguaguggugcgau

SEQ ID NO: 409410 - RNA, 32 nt, Human
cuguugcccaggcuggaguguaguggugugau

SEQ ID NO: 409411 - RNA, 32 nt, Human
cuguugcccaggcuggaguguagugguguguu

SEQ ID NO: 409412 - RNA, 32 nt, Human
cuguugcccaggcuggaguucagcggugcaau

SEQ ID NO: 409413 - RNA, 20 nt, Human
cuguugcccaggcuggccug

SEQ ID NO: 409414 - RNA, 24 nt, Human
cuguugcccaggcuggcgugcagu

SEQ ID NO: 409415 - RNA, 32 nt, Human
cuguugcccaggcuggcgugcaguggugcgau

SEQ ID NO: 409416 - RNA, 32 nt, Human
cuguugcccaggcugggugcagcggugcgauc

SEQ ID NO: 409417 - RNA, 24 nt, Human
cuguugcccaggcuguagugcagu

SEQ ID NO: 409418 - RNA, 32 nt, Human
cuguugcccaggcuguagugcaguggugcgau

SEQ ID NO: 409419 - RNA, 32 nt, Human
cuguugcccaggguggagugcagcggugcgau

SEQ ID NO: 409420 - RNA, 24 nt, Human
cuguugcccaggguggagugcagu

SEQ ID NO: 409421 - RNA, 32 nt, Human
cuguugcccaggguggagugcaguggcaugau

SEQ ID NO: 409422 - RNA, 19 nt, Human
cuguugcccagguccugca

SEQ ID NO: 409423 - RNA, 26 nt, Human
cuguugcccagguucuagagugcagu

SEQ ID NO: 409424 - RNA, 24 nt, Human
cuguugcccagguuggagugcagu

SEQ ID NO: 409425 - RNA, 32 nt, Human
cuguugcccagguuggagugcaguggcacgau

SEQ ID NO: 409426 - RNA, 32 nt, Human
cuguugcccagguuggagugcaguggcacuga

SEQ ID NO: 409427 - RNA, 32 nt, Human
cuguugcccagguuggagugcaguggcggggg

SEQ ID NO: 409428 - RNA, 23 nt, Human
cuguugcccagucuggaguacag

SEQ ID NO: 409429 - RNA, 32 nt, Human
cuguugcccagucuggagugcaguggcgcagu

SEQ ID NO: 409430 - RNA, 24 nt, Human
cuguugcccagucuggaguucagu

SEQ ID NO: 409431 - RNA, 24 nt, Human
cuguugcccaugcuggagggcagu

SEQ ID NO: 409432 - RNA, 22 nt, Human
cuguugcccaugcuggagugca

SEQ ID NO: 409433 - RNA, 32 nt, Human
cuguugcccaugcuggagugcaauggcacgau

SEQ ID NO: 409434 - RNA, 32 nt, Human
cuguugcccaugcuggagugcaguggcgugau

SEQ ID NO: 409435 - RNA, 32 nt, Human
cuguugcccaugcuggagugcauuggcacaau

SEQ ID NO: 409436 - RNA, 24 nt, Human
cuguugcccauucuggagugcagu

SEQ ID NO: 409437 - RNA, 32 nt, Human
cuguugcccauucuggagugcaguggugugau

SEQ ID NO: 409438 - RNA, 24 nt, Human
cuguugccccagcuugagugcagu

SEQ ID NO: 409439 - RNA, 25 nt, Human
cuguugccccaggcuggagugcagu

SEQ ID NO: 409440 - RNA, 21 nt, Human
cuguugcccccuucagugcag

SEQ ID NO: 409441 - RNA, 32 nt, Human
cuguugcccgggcuggaguacaauggcaugau

SEQ ID NO: 409442 - RNA, 23 nt, Human
cuguugcccgggcuggagugcag

SEQ ID NO: 409443 - RNA, 32 nt, Human
cuguugcccgggcuggagugcagcggcgugau

SEQ ID NO: 409444 - RNA, 32 nt, Human
cuguugcccgggcuggagugcaguggugugau

SEQ ID NO: 409445 - RNA, 24 nt, Human
cuguugcccucacuagagugcagu

SEQ ID NO: 409446 - RNA, 32 nt, Human
cuguugcccugagugcccacucccaggcccuc

SEQ ID NO: 409447 - RNA, 24 nt, Human
cuguugcccuggcuggacugcagu

SEQ ID NO: 409448 - RNA, 32 nt, Human
cuguugcccuggcuggaguacaguggcaugau

SEQ ID NO: 409449 - RNA, 24 nt, Human
cuguugcccuggcuggaguucagu

SEQ ID NO: 409450 - RNA, 32 nt, Human
cuguugccuagacuggagugcaauggcgugau

SEQ ID NO: 409451 - RNA, 24 nt, Human
cuguugccuaggccagagugcagu

SEQ ID NO: 409452 - RNA, 23 nt, Human
cuguugccuaggcggaguacagu

SEQ ID NO: 409453 - RNA, 32 nt, Human
cuguugccuaggcgggagugcaguggcaucau

SEQ ID NO: 409454 - RNA, 32 nt, Human
cuguugccuaggcuggaggacaguggcacaau

SEQ ID NO: 409455 - RNA, 24 nt, Human
cuguugccuaggcuggaguacagu

SEQ ID NO: 409456 - RNA, 32 nt, Human
cuguugccuaggcuggaguacaguggcaagau

SEQ ID NO: 409457 - RNA, 32 nt, Human
cuguugccuaggcuggaguacaguggccugau

SEQ ID NO: 409458 - RNA, 32 nt, Human
cuguugccuaggcuggaguacaguggugcagu

SEQ ID NO: 409459 - RNA, 32 nt, Human
cuguugccuaggcuggagugaaaguggcgcaa

SEQ ID NO: 409460 - RNA, 24 nt, Human
cuguugccuaggcuggagugcagu

SEQ ID NO: 409461 - RNA, 32 nt, Human
cuguugccuaggcuggagugcagugaggcaau

SEQ ID NO: 409462 - RNA, 32 nt, Human
cuguugccuaggcuggagugcaguggcgcaau

SEQ ID NO: 409463 - RNA, 32 nt, Human
cuguugccuaggcuggagugcaguggcgcgau

SEQ ID NO: 409464 - RNA, 32 nt, Human
cuguugccuaguuuuguacauggaucucauuu

SEQ ID NO: 409465 - RNA, 22 nt, Human
cuguugccuggacaguuacagu

SEQ ID NO: 409466 - RNA, 32 nt, Human
cuguugccugggagcuugguacuuucccucca

SEQ ID NO: 409467 - RNA, 24 nt, Human
cuguugccugggcuggaaugcagu

SEQ ID NO: 409468 - RNA, 32 nt, Human
cuguugccugggcuggagaacaguggcaccau

SEQ ID NO: 409469 - RNA, 24 nt, Human
cuguugccugggcuggagugcagu

SEQ ID NO: 409470 - RNA, 32 nt, Human
cuguugccugggcuggagugcagugccacgau

SEQ ID NO: 409471 - RNA, 32 nt, Human
cuguugccugggcuggagugcaguggcaugau

SEQ ID NO: 409472 - RNA, 32 nt, Human
cuguugccugggcuggagugcaguggcccaag

SEQ ID NO: 409473 - RNA, 32 nt, Human
cuguugccugggcuggagugcaguggcgugau

SEQ ID NO: 409474 - RNA, 32 nt, Human
cuguugccuugaacuccugggcucaagugauc

SEQ ID NO: 409475 - RNA, 32 nt, Human
cuguugccuugacaugucguugcucagugccu

SEQ ID NO: 409476 - RNA, 22 nt, Human
cuguugccuugaccuccuaggc

SEQ ID NO: 409477 - RNA, 32 nt, Human
cuguugccuuucuuuccugcuguccuuuccug

SEQ ID NO: 409478 - RNA, 32 nt, Human
cuguugcgcugcccuggccucggcauucgagg

SEQ ID NO: 409479 - RNA, 18 nt, Human
cuguugcuagaccgagcc

SEQ ID NO: 409480 - RNA, 23 nt, Human
cuguugcuaggcuggagugcagu

SEQ ID NO: 409481 - RNA, 24 nt, Human
cuguugcucaagcuggaguggagu

SEQ ID NO: 409482 - RNA, 32 nt, Human
cuguugcucaagcuggaguggaguggcacgau

SEQ ID NO: 409483 - RNA, 31 nt, Human
cuguugcucaauguuaccacagcaggcuuuc

SEQ ID NO: 409484 - RNA, 32 nt, Human
cuguugcucaggcuggagugcaguggcaccau

SEQ ID NO: 409485 - RNA, 24 nt, Human
cuguugcucaggcuggauugcagu

SEQ ID NO: 409486 - RNA, 32 nt, Human
cuguugcucaggcuggauugcaguggcgugau

SEQ ID NO: 409487 - RNA, 18 nt, Human
cuguugcuccuggccuca

SEQ ID NO: 409488 - RNA, 22 nt, Human
cuguugcucgaagacugugaca

SEQ ID NO: 409489 - RNA, 21 nt, Human
cuguugcucgccuucagguca

SEQ ID NO: 409490 - RNA, 32 nt, Human
cuguugcucgugggugcuguguuuacucuccc

SEQ ID NO: 409491 - RNA, 19 nt, Human
cuguugcucuccuggcgcu

SEQ ID NO: 409492 - RNA, 17 nt, Human
cuguugcucucggagcc

SEQ ID NO: 409493 - RNA, 32 nt, Human
cuguugcucuggaagucagguggguuuccuga

SEQ ID NO: 409494 - RNA, 19 nt, Human
cuguugcucugucccggcu

SEQ ID NO: 409495 - RNA, 24 nt, Human
cuguugcugaggcuggagugcagu

SEQ ID NO: 409496 - RNA, 23 nt, Human
cuguugcugaucuguaguacagu

SEQ ID NO: 409497 - RNA, 32 nt, Human
cuguugcugcaagcucagugaaguggggcacu

SEQ ID NO: 409498 - RNA, 32 nt, Human
cuguugcugcacuccagccugagugacagagu

SEQ ID NO: 409499 - RNA, 32 nt, Human
cuguugcugcacuuccgcuucucucccagcga

SEQ ID NO: 409500 - RNA, 32 nt, Human
cuguugcugcagcucugacuugcuuuuuccug

SEQ ID NO: 409501 - RNA, 17 nt, Human
cuguugcugcgccgagc

SEQ ID NO: 409502 - RNA, 21 nt, Human
cuguugcuggcaucccgagcu

SEQ ID NO: 409503 - RNA, 18 nt, Human
cuguugcugucggaguca

SEQ ID NO: 409504 - RNA, 32 nt, Human
cuguugcugugccugcucacaccugcuccugc

SEQ ID NO: 409505 - RNA, 32 nt, Human
cuguugcuuagguuuagaaacgaggcauguau

SEQ ID NO: 409506 - RNA, 19 nt, Human
cuguugcuucugugagcca

SEQ ID NO: 409507 - RNA, 19 nt, Human
cuguugcuugcccugugcc

SEQ ID NO: 409508 - RNA, 24 nt, Human
cuguugcuugggcugcaaugcagu

SEQ ID NO: 409509 - RNA, 32 nt, Human
cuguuggaaaccugggcagcccucucaguggc

SEQ ID NO: 409510 - RNA, 32 nt, Human
cuguuggaaauuagaaggacagagccaaauau

SEQ ID NO: 409511 - RNA, 32 nt, Human
cuguuggaagcaguagagugcuuccagggagg

SEQ ID NO: 409512 - RNA, 32 nt, Human
cuguuggacaccugccuucucauguggacauc

SEQ ID NO: 409513 - RNA, 22 nt, Human
cuguuggagaugucccgggcca

SEQ ID NO: 409514 - RNA, 32 nt, Human
cuguuggagauuuaagaauucuaccaccuaua

SEQ ID NO: 409515 - RNA, 32 nt, Human
cuguuggagcauggaggagcuggaggagaugg

SEQ ID NO: 409516 - RNA, 32 nt, Human
cuguuggaugcacauaauccauuugcacugca

SEQ ID NO: 409517 - RNA, 32 nt, Human
cuguuggcagaggccugugucugugccacacc

SEQ ID NO: 409518 - RNA, 32 nt, Human
cuguuggcagcgccaucaccauguccuuaaac

SEQ ID NO: 409519 - RNA, 32 nt, Human
cuguuggcaggaacuccaagugcccaggccuc

SEQ ID NO: 409520 - RNA, 32 nt, Human
cuguuggccagacacuaugcugggcagucaag

SEQ ID NO: 409521 - RNA, 24 nt, Human
cuguuggccaggcuggaaugcagu

SEQ ID NO: 409522 - RNA, 32 nt, Human
cuguuggccaggcuggaaugcaguggcacaau

SEQ ID NO: 409523 - RNA, 23 nt, Human
cuguuggccaggcuggagugcag

SEQ ID NO: 409524 - RNA, 24 nt, Human
cuguuggccaggcuggagugcagu

SEQ ID NO: 409525 - RNA, 32 nt, Human
cuguuggccaggcuggagugcaguaaguggca

SEQ ID NO: 409526 - RNA, 32 nt, Human
cuguuggccagguaauugcugcagagggagaa

SEQ ID NO: 409527 - RNA, 32 nt, Human
cuguuggccccagcugcacucgcagggccuuc

SEQ ID NO: 409528 - RNA, 32 nt, Human
cuguuggccgaggacaggauggggcaggacag

SEQ ID NO: 409529 - RNA, 32 nt, Human
cuguuggccucgggggcgcgccgccgcggaga

SEQ ID NO: 409530 - RNA, 32 nt, Human
cuguuggccugccuuuguuccugcagggugca

SEQ ID NO: 409531 - RNA, 32 nt, Human
cuguuggccugucagcaaucccugggaccucu

SEQ ID NO: 409532 - RNA, 32 nt, Human
cuguuggccuugguuugcacagagcggguagg

SEQ ID NO: 409533 - RNA, 32 nt, Human
cuguuggcucccgugucugcugacugagggca

SEQ ID NO: 409534 - RNA, 21 nt, Human
cuguuggcucugcuuugagcu

SEQ ID NO: 409535 - RNA, 32 nt, Human
cuguuggcugcucucccaaguggcccaggcug

SEQ ID NO: 409536 - RNA, 32 nt, Human
cuguuggcuggaagcugcccuuuguucuguac

SEQ ID NO: 409537 - RNA, 32 nt, Human
cuguuggcuuucucuucugcagcaacagguca

SEQ ID NO: 409538 - RNA, 32 nt, Human
cuguugggaaggcaugguugguuuugaaaugu

SEQ ID NO: 409539 - RNA, 32 nt, Human
cuguugggaccaccccaguggagcuccuggag

SEQ ID NO: 409540 - RNA, 32 nt, Human
cuguugggacucaaggacuuugcugcuguuuu

SEQ ID NO: 409541 - RNA, 32 nt, Human
cuguugggagagaccagacggaauccagccuc

SEQ ID NO: 409542 - RNA, 32 nt, Human
cuguugggaggcaguuugcagucuccagggac

SEQ ID NO: 409543 - RNA, 32 nt, Human
cuguugggcccaggucuugagcucuuuuggcu

SEQ ID NO: 409544 - RNA, 32 nt, Human
cuguuggggaccccucguguccccacgccaga

SEQ ID NO: 409545 - RNA, 32 nt, Human
cuguuggggacuugauuucuucucagguuuug

SEQ ID NO: 409546 - RNA, 32 nt, Human
cuguuggggauaccaccuccuggcagagcccu

SEQ ID NO: 409547 - RNA, 32 nt, Human
cuguuggggcagaagagacgggaccagcugcu

SEQ ID NO: 409548 - RNA, 32 nt, Human
cuguuggggccaggauuuucccuggucagaug

SEQ ID NO: 409549 - RNA, 32 nt, Human
cuguuggggccccagccguaguggcuuagagg

SEQ ID NO: 409550 - RNA, 32 nt, Human
cuguuggggcuuccacagcccuccucucccaa

SEQ ID NO: 409551 - RNA, 32 nt, Human
cuguuggggguuucccuguguggaccaugggg

SEQ ID NO: 409552 - RNA, 32 nt, Human
cuguuggguagcggaagagagaucaaagggaa

SEQ ID NO: 409553 - RNA, 31 nt, Human
cuguugggucaguggagaugggugaggagca

SEQ ID NO: 409554 - RNA, 20 nt, Human
cuguugggugcuuccugcaa

SEQ ID NO: 409555 - RNA, 21 nt, Human
cuguuggucccucugaccuca

SEQ ID NO: 409556 - RNA, 32 nt, Human
cuguuggucuuacuaaggauguuuuuaccagc

SEQ ID NO: 409557 - RNA, 32 nt, Human
cuguuggugcaggaauaagggaaaggcccaag

SEQ ID NO: 409558 - RNA, 32 nt, Human
cuguuggugcugcuacugccccggcuggauug

SEQ ID NO: 409559 - RNA, 32 nt, Human
cuguugguggugguagcaagauuucauagggg

SEQ ID NO: 409560 - RNA, 23 nt, Human
cuguuggugucuccuugguccuu

SEQ ID NO: 409561 - RNA, 32 nt, Human
cuguugguugaacuaugcugaagagggaaagu

SEQ ID NO: 409562 - RNA, 32 nt, Human
cuguugguuucugcugguuguagguccuuggc

SEQ ID NO: 409563 - RNA, 32 nt, Human
cuguuguacgagcucccugaaccauuguucag

SEQ ID NO: 409564 - RNA, 32 nt, Human
cuguuguacuucugaaaucagaccugugugaa

SEQ ID NO: 409565 - RNA, 20 nt, Human
cuguuguagcggugagcuga

SEQ ID NO: 409566 - RNA, 32 nt, Human
cuguuguaggggaaugggcuuucaaagaagug

SEQ ID NO: 409567 - RNA, 32 nt, Human
cuguuguaucuauauuucacauguggaaacuu

SEQ ID NO: 409568 - RNA, 22 nt, Human
cuguuguauuuaaugaugguaa

SEQ ID NO: 409569 - RNA, 27 nt, Human
cuguugucacccaggcuggagugcagu

SEQ ID NO: 409570 - RNA, 32 nt, Human
cuguugucacccaggcuggagugcaguggugu

SEQ ID NO: 409571 - RNA, 31 nt, Human
cuguugucagucccugggccugagucccugg

SEQ ID NO: 409572 - RNA, 32 nt, Human
cuguugucauucaaucuagugccuccuugagg

SEQ ID NO: 409573 - RNA, 25 nt, Human
cuguuguccaaggcuggaguguagu

SEQ ID NO: 409574 - RNA, 24 nt, Human
cuguuguccaggauggagugcagu

SEQ ID NO: 409575 - RNA, 32 nt, Human
cuguuguccaggauggagugcagugguugauc

SEQ ID NO: 409576 - RNA, 24 nt, Human
cuguuguccaggcuagagugcagu

SEQ ID NO: 409577 - RNA, 24 nt, Human
cuguuguccaggcuggagggcagu

SEQ ID NO: 409578 - RNA, 22 nt, Human
cuguuguccaggcuggagugca

SEQ ID NO: 409579 - RNA, 24 nt, Human
cuguuguccaggcuggagugcaau

SEQ ID NO: 409580 - RNA, 32 nt, Human
cuguuguccaggcuggagugcaauggcaguug

SEQ ID NO: 409581 - RNA, 23 nt, Human
cuguuguccaggcuggagugcag

SEQ ID NO: 409582 - RNA, 32 nt, Human
cuguuguccaggcuggagugcagcgauauggu

SEQ ID NO: 409583 - RNA, 24 nt, Human
cuguuguccaggcuggagugcagu

SEQ ID NO: 409584 - RNA, 32 nt, Human
cuguuguccaggcuggagugcaguggcaccau

SEQ ID NO: 409585 - RNA, 32 nt, Human
cuguuguccaggcuggagugcaguggcacgaa

SEQ ID NO: 409586 - RNA, 32 nt, Human
cuguugucccagcuguuccguaggcugaggca

SEQ ID NO: 409587 - RNA, 32 nt, Human
cuguuguccccacuaccaucucccucucucag

SEQ ID NO: 409588 - RNA, 32 nt, Human
cuguugucgccuaggcuggagugcaaugaugc

SEQ ID NO: 409589 - RNA, 32 nt, Human
cuguugucucacuccugagggcuccugcagua

SEQ ID NO: 409590 - RNA, 27 nt, Human
cuguugucucccaggcuggagugcagu

SEQ ID NO: 409591 - RNA, 32 nt, Human
cuguugucucccaggcuggagugcaguggcgu

SEQ ID NO: 409592 - RNA, 32 nt, Human
cuguugucucugcucuucccucuccuggcugu

SEQ ID NO: 409593 - RNA, 32 nt, Human
cuguugucugcauucgugcccugggugccucu

SEQ ID NO: 409594 - RNA, 32 nt, Human
cuguugucuuaaugccauuucauuucacaugg

SEQ ID NO: 409595 - RNA, 32 nt, Human
cuguugugauuguuaguauugagcuguugccu

SEQ ID NO: 409596 - RNA, 32 nt, Human
cuguugugcagcuucuccaccuccugguagag

SEQ ID NO: 409597 - RNA, 24 nt, Human
cuguugugcaggcuggagugcagu

SEQ ID NO: 409598 - RNA, 32 nt, Human
cuguugugcaggcuggagugcaguggcacagu

SEQ ID NO: 409599 - RNA, 24 nt, Human
cuguugugcaggcuguagugcagu

SEQ ID NO: 409600 - RNA, 32 nt, Human
cuguuguggggaaaccaccuccauguaaccca

SEQ ID NO: 409601 - RNA, 32 nt, Human
cuguuguguagacugcagacauccauaccuca

SEQ ID NO: 409602 - RNA, 32 nt, Human
cuguugugugugugcaugccuugggcacaaac

SEQ ID NO: 409603 - RNA, 32 nt, Human
cuguuguguuccaugugcuuucaccucugccu

SEQ ID NO: 409604 - RNA, 32 nt, Human
cuguuguguuguggugccauccucuucccagu

SEQ ID NO: 409605 - RNA, 32 nt, Human
cuguuguuaaguggaggaaaguaguuguuaau

SEQ ID NO: 409606 - RNA, 32 nt, Human
cuguuguucagcuaugcuacagaagaggaugu

SEQ ID NO: 409607 - RNA, 32 nt, Human
cuguuguucauugcugcaucccccacaccgag

SEQ ID NO: 409608 - RNA, 32 nt, Human
cuguuguuccuucauauaaugccuugagaaau

SEQ ID NO: 409609 - RNA, 17 nt, Human
cuguuguucuagagcca

SEQ ID NO: 409610 - RNA, 32 nt, Human
cuguuguugcaguccagccuaguacugacacc

SEQ ID NO: 409611 - RNA, 32 nt, Human
cuguuguugcccaggcuggagugcaauagcac

SEQ ID NO: 409612 - RNA, 32 nt, Human
cuguuguugcccaggcuggagugcaauggcac

SEQ ID NO: 409613 - RNA, 32 nt, Human
cuguuguugcccaggcuggagugcaauggcgc

SEQ ID NO: 409614 - RNA, 32 nt, Human
cuguuguugcccaggcuggagugcaauggcgu

SEQ ID NO: 409615 - RNA, 32 nt, Human
cuguuguugcccaggcuggagugcaguggcgu

SEQ ID NO: 409616 - RNA, 32 nt, Human
cuguuguugcugugguggagugaugcaguggg

SEQ ID NO: 409617 - RNA, 32 nt, Human
cuguuguuggagacaugacaaucauuuucauc

SEQ ID NO: 409618 - RNA, 32 nt, Human
cuguuguuggcuggagaggaagguguggggug

SEQ ID NO: 409619 - RNA, 20 nt, Human
cuguuguuggucuggggcca

SEQ ID NO: 409620 - RNA, 32 nt, Human
cuguuguuguucacuuuccucauaaaaauugu

SEQ ID NO: 409621 - RNA, 32 nt, Human
cuguuguuuauggccuuugucuugucccucag

SEQ ID NO: 409622 - RNA, 20 nt, Human
cuguuguuuccugggaucuu

SEQ ID NO: 409623 - RNA, 32 nt, Human
cuguuguuucucaaauaaauguuuaauauuaa

SEQ ID NO: 409624 - RNA, 32 nt, Human
cuguuguuugcugccauuggcaugaaauggcc

SEQ ID NO: 409625 - RNA, 18 nt, Human
cuguuguuuuggggccuu

SEQ ID NO: 409626 - RNA, 32 nt, Human
cuguuuaaagaacuugcucucagagaagcacu

SEQ ID NO: 409627 - RNA, 24 nt, Human
cuguuuaacacggggaaaccccgu

SEQ ID NO: 409628 - RNA, 32 nt, Human
cuguuuaauacugauaaacaaaauguaaaggu

SEQ ID NO: 409629 - RNA, 32 nt, Human
cuguuuacaaaaagcuggccugggagcagaag

SEQ ID NO: 409630 - RNA, 32 nt, Human
cuguuuacacacccugccaaugccuuagcacu

SEQ ID NO: 409631 - RNA, 32 nt, Human
cuguuuacagccuggucuacugaguaagccca

SEQ ID NO: 409632 - RNA, 32 nt, Human
cuguuuacagcuuugaggccuugguggauggg

SEQ ID NO: 409633 - RNA, 32 nt, Human
cuguuuaccaugucagcuucagccugggggcu

SEQ ID NO: 409634 - RNA, 18 nt, Human
cuguuuacuugucuccau

SEQ ID NO: 409635 - RNA, 32 nt, Human
cuguuuacuuucuaucaggaagcaucuccauu

SEQ ID NO: 409636 - RNA, 32 nt, Human
cuguuuagccacauggugagaccguggugaaa

SEQ ID NO: 409637 - RNA, 30 nt, Human
cuguuuagccucuuugguuucuguacaacu

SEQ ID NO: 409638 - RNA, 32 nt, Human
cuguuuagcuuccucuugcuucccaaagauuu

SEQ ID NO: 409639 - RNA, 32 nt, Human
cuguuuagcuucuuccuccauuggaguuuauu

SEQ ID NO: 409640 - RNA, 32 nt, Human
cuguuuaggaaggugaaauacauucacugucu

SEQ ID NO: 409641 - RNA, 32 nt, Human
cuguuuaggaguuagggugaaagagaaaaugu

SEQ ID NO: 409642 - RNA, 32 nt, Human
cuguuuauaaucugaagauauauuucacuuuu

SEQ ID NO: 409643 - RNA, 32 nt, Human
cuguuuaucugaaggcuccuacccagagauuc

SEQ ID NO: 409644 - RNA, 32 nt, Human
cuguuuauucuguuucacccuacuccuccagu

SEQ ID NO: 409645 - RNA, 32 nt, Human
cuguuucaaacuaaagcucccaccucgaacau

SEQ ID NO: 409646 - RNA, 32 nt, Human
cuguuucaccucaggcugaggauguucuggac

SEQ ID NO: 409647 - RNA, 32 nt, Human
cuguuucagagugacucagaagaaaaagaagc

SEQ ID NO: 409648 - RNA, 32 nt, Human
cuguuucagccaugcaaagcaggguauaaaau

SEQ ID NO: 409649 - RNA, 23 nt, Human
cuguuucagcccagcccaucuca

SEQ ID NO: 409650 - RNA, 32 nt, Human
cuguuucagggaguuaaugacacacuugucca

SEQ ID NO: 409651 - RNA, 32 nt, Human
cuguuucaucucccauucaucucccuccuccc

SEQ ID NO: 409652 - RNA, 32 nt, Human
cuguuucauucacaugggauguuuucaauugg

SEQ ID NO: 409653 - RNA, 32 nt, Human
cuguuuccaagaggagguaaggaaguguuuau

SEQ ID NO: 409654 - RNA, 32 nt, Human
cuguuucccaaagcuuauguaagagcuuuucc

SEQ ID NO: 409655 - RNA, 24 nt, Human
cuguuucccaggcugaagugcagu

SEQ ID NO: 409656 - RNA, 32 nt, Human
cuguuucccaggcugaagugcaguggcaugaa

SEQ ID NO: 409657 - RNA, 32 nt, Human
cuguuucccaggcuggagugcacaaacauggc

SEQ ID NO: 409658 - RNA, 24 nt, Human
cuguuucccaggcuggagugcagu

SEQ ID NO: 409659 - RNA, 32 nt, Human
cuguuucccaggcuggagugcaguggcgcuau

SEQ ID NO: 409660 - RNA, 32 nt, Human
cuguuucccaggcuggagugcaguggugggau

SEQ ID NO: 409661 - RNA, 24 nt, Human
cuguuucccaggcuggaguguagu

SEQ ID NO: 409662 - RNA, 32 nt, Human
cuguuucccaggcuggaguguagugauacagu

SEQ ID NO: 409663 - RNA, 24 nt, Human
cuguuucccagguuggaguauagu

SEQ ID NO: 409664 - RNA, 32 nt, Human
cuguuucccuaggagagcacuuggagauggca

SEQ ID NO: 409665 - RNA, 32 nt, Human
cuguuucccugguuuucuuuuguacuccucuc

SEQ ID NO: 409666 - RNA, 32 nt, Human
cuguuuccuaaaggaugugugaacgggagaug

SEQ ID NO: 409667 - RNA, 32 nt, Human
cuguuuccucaagccuaacugaacauguaaaa

SEQ ID NO: 409668 - RNA, 32 nt, Human
cuguuuccucaccuucucuccccuuuccaugc

SEQ ID NO: 409669 - RNA, 32 nt, Human
cuguuuccucaggacucaguccugggcucucu

SEQ ID NO: 409670 - RNA, 32 nt, Human
cuguuuccuccaccuccacccccaccccuuaa

SEQ ID NO: 409671 - RNA, 32 nt, Human
cuguuuccucuccggugcaauccccuguccuu

SEQ ID NO: 409672 - RNA, 32 nt, Human
cuguuuccucuuguugaaugccuuagaacagu

SEQ ID NO: 409673 - RNA, 32 nt, Human
cuguuuccugaacacagaccucuuucuugugc

SEQ ID NO: 409674 - RNA, 32 nt, Human
cuguuuccugagcagugaugugcugcucuucu

SEQ ID NO: 409675 - RNA, 32 nt, Human
cuguuuccugcucucucccucugcauaucuuc

SEQ ID NO: 409676 - RNA, 32 nt, Human
cuguuuccuggccucagagcuuccuggggacc

SEQ ID NO: 409677 - RNA, 20 nt, Human
cuguuuccuuuuccucuccc

SEQ ID NO: 409678 - RNA, 32 nt, Human
cuguuucgaggcagaagccagacuaauuuuca

SEQ ID NO: 409679 - RNA, 32 nt, Human
cuguuucguguguacaguugcugcuguaauuu

SEQ ID NO: 409680 - RNA, 32 nt, Human
cuguuucuagacccucucugaucaaaccagag

SEQ ID NO: 409681 - RNA, 32 nt, Human
cuguuucuaggaucuuucucuccggcaagggg

SEQ ID NO: 409682 - RNA, 32 nt, Human
cuguuucuagguuuagaaguucagaggugacu

SEQ ID NO: 409683 - RNA, 32 nt, Human
cuguuucucaaccuuauccaucauuucugaca

SEQ ID NO: 409684 - RNA, 32 nt, Human
cuguuucuccccuagacucugggccuggccau

SEQ ID NO: 409685 - RNA, 32 nt, Human
cuguuucuccccuccgacuggggcucccugag

SEQ ID NO: 409686 - RNA, 32 nt, Human
cuguuucuccucaguuccccugugcagauggg

SEQ ID NO: 409687 - RNA, 32 nt, Human
cuguuucucucuccuccuuccaccuccccucc

SEQ ID NO: 409688 - RNA, 32 nt, Human
cuguuucucucugagcugagcagccaccaugg

SEQ ID NO: 409689 - RNA, 32 nt, Human
cuguuucugaaagcccuggaucucuuugcacc

SEQ ID NO: 409690 - RNA, 32 nt, Human
cuguuucugcauucugccacgagagcuagguc

SEQ ID NO: 409691 - RNA, 32 nt, Human
cuguuucugccuggucauccugagccccuccu

SEQ ID NO: 409692 - RNA, 32 nt, Human
cuguuucuggaaauguucuuuagaugguggca

SEQ ID NO: 409693 - RNA, 32 nt, Human
cuguuucugggcagugcaggaagucccagccc

SEQ ID NO: 409694 - RNA, 32 nt, Human
cuguuucuucccacccugucuucuccccuagg

SEQ ID NO: 409695 - RNA, 32 nt, Human
cuguuucuucucuuggugaaauaauaaaaugc

SEQ ID NO: 409696 - RNA, 32 nt, Human
cuguuucuucuuugugcuucccgugugccucc

SEQ ID NO: 409697 - RNA, 32 nt, Human
cuguuucuugagccaggucuucuguccaugca

SEQ ID NO: 409698 - RNA, 32 nt, Human
cuguuucuuuuuccuuuuccccuaguucuuac

SEQ ID NO: 409699 - RNA, 32 nt, Human
cuguuugaauggggugaaaaacagcaaaauua

SEQ ID NO: 409700 - RNA, 32 nt, Human
cuguuugacuccacucuuacugccuucuuaau

SEQ ID NO: 409701 - RNA, 30 nt, Human
cuguuugacuccagucuuacugccuucuua

SEQ ID NO: 409702 - RNA, 32 nt, Human
cuguuugacuccagucuuacugccuucuuaau

SEQ ID NO: 409703 - RNA, 32 nt, Human
cuguuugacuucucugcugaagugauuuccag

SEQ ID NO: 409704 - RNA, 32 nt, Human
cuguuugagaggcagaugcugaaggaggagcg

SEQ ID NO: 409705 - RNA, 32 nt, Human
cuguuugagauucucaaaggagcgagcauguc

SEQ ID NO: 409706 - RNA, 32 nt, Human
cuguuugagcaaugcagugccugcugcccgug

SEQ ID NO: 409707 - RNA, 32 nt, Human
cuguuugagcuucgggggagagcccagcacug

SEQ ID NO: 409708 - RNA, 32 nt, Human
cuguuugagcuucuuuuccugaccugaguuuu

SEQ ID NO: 409709 - RNA, 32 nt, Human
cuguuugaggcagaggugauggacuccggggg

SEQ ID NO: 409710 - RNA, 18 nt, Human
cuguuugagucuugcaag

SEQ ID NO: 409711 - RNA, 32 nt, Human
cuguuugcagaugcauuaucagugcaugcaaa

SEQ ID NO: 409712 - RNA, 32 nt, Human
cuguuugcagcacaauauaacuuuacauucuu

SEQ ID NO: 409713 - RNA, 32 nt, Human
cuguuugccacuucauuucauuuccuugagua

SEQ ID NO: 409714 - RNA, 32 nt, Human
cuguuugccaguauugccaucuccuguaaauu

SEQ ID NO: 409715 - RNA, 32 nt, Human
cuguuugccguggcuguccaugaguuuggcca

SEQ ID NO: 409716 - RNA, 32 nt, Human
cuguuugccuuucgugaacacauucuugguaa

SEQ ID NO: 409717 - RNA, 32 nt, Human
cuguuugcucaaucguggucucccucucccuc

SEQ ID NO: 409718 - RNA, 18 nt, Human
cuguuugcucuccugcaa

SEQ ID NO: 409719 - RNA, 32 nt, Human
cuguuugcuggaagauauacaagacuuuugag

SEQ ID NO: 409720 - RNA, 32 nt, Human
cuguuugcugugccauuucucaugccaggagu

SEQ ID NO: 409721 - RNA, 32 nt, Human
cuguuugcuguugcucggagacucgcccugua

SEQ ID NO: 409722 - RNA, 32 nt, Human
cuguuugcuuuugguaaugugauguugauguu

SEQ ID NO: 409723 - RNA, 31 nt, Human
cuguuuggagagacucagccaucaugccaga

SEQ ID NO: 409724 - RNA, 19 nt, Human
cuguuuggaggcacuccag

SEQ ID NO: 409725 - RNA, 32 nt, Human
cuguuuggcccaggccugggccaugacggaug

SEQ ID NO: 409726 - RNA, 24 nt, Human
cuguuuggccucucuauccucucu

SEQ ID NO: 409727 - RNA, 32 nt, Human
cuguuugggaaaauacguugagggagagaaga

SEQ ID NO: 409728 - RNA, 32 nt, Human
cuguuugggaagcagcagucucuccuucagau

SEQ ID NO: 409729 - RNA, 22 nt, Human
cuguuugggagcucucugcaag

SEQ ID NO: 409730 - RNA, 32 nt, Human
cuguuugggaggcugaggcaggaggaucgcuu

SEQ ID NO: 409731 - RNA, 32 nt, Human
cuguuugggaggcugaggcagguggaucaccu

SEQ ID NO: 409732 - RNA, 32 nt, Human
cuguuuggggaucguccuguccauccauguaa

SEQ ID NO: 409733 - RNA, 32 nt, Human
cuguuugggggucuaucucuccaucccucugu

SEQ ID NO: 409734 - RNA, 32 nt, Human
cuguuugggucugaggugcauggaacauucug

SEQ ID NO: 409735 - RNA, 20 nt, Human
cuguuuggucagcugagcca

SEQ ID NO: 409736 - RNA, 32 nt, Human
cuguuugucccauccacucuugaagcugggga

SEQ ID NO: 409737 - RNA, 32 nt, Human
cuguuugucuucauauagaacaggggcuucug

SEQ ID NO: 409738 - RNA, 32 nt, Human
cuguuugucuucuccccaggguucagucccuc

SEQ ID NO: 409739 - RNA, 32 nt, Human
cuguuugucuucuucuccgucuucuucuccug

SEQ ID NO: 409740 - RNA, 32 nt, Human
cuguuugugaagcuacauuacugugugaguug

SEQ ID NO: 409741 - RNA, 32 nt, Human
cuguuugugacuggcccuguccuggcaucagu

SEQ ID NO: 409742 - RNA, 32 nt, Human
cuguuugugcuuaaauggcacagcauuugguc

SEQ ID NO: 409743 - RNA, 32 nt, Human
cuguuuguuccugggagaauucugagcacaga

SEQ ID NO: 409744 - RNA, 32 nt, Human
cuguuuguucucugccuguugccgaccugaug

SEQ ID NO: 409745 - RNA, 32 nt, Human
cuguuuguuuuuaaaaagcaaaucuuucugua

SEQ ID NO: 409746 - RNA, 32 nt, Human
cuguuuuaccuccucccuaaucuuaaauaaca

SEQ ID NO: 409747 - RNA, 32 nt, Human
cuguuuuacuggaccccgccucccagccccag

SEQ ID NO: 409748 - RNA, 32 nt, Human
cuguuuuagagaaagcaccugauuauugugug

SEQ ID NO: 409749 - RNA, 32 nt, Human
cuguuuuaggugagccaugcacacaaugugaa

SEQ ID NO: 409750 - RNA, 32 nt, Human
cuguuuuauaaacugcugcuauuuggaaaccc

SEQ ID NO: 409751 - RNA, 32 nt, Human
cuguuuuaucaucuguagcuucauccuauccg

SEQ ID NO: 409752 - RNA, 32 nt, Human
cuguuuuaugugcacacauuaggcauugagac

SEQ ID NO: 409753 - RNA, 22 nt, Human
cuguuuucaaacacuucacuga

SEQ ID NO: 409754 - RNA, 32 nt, Human
cuguuuucacauuugaacuuuauggguuuugg

SEQ ID NO: 409755 - RNA, 32 nt, Human
cuguuuucagccccucccuggaauagugaguu

SEQ ID NO: 409756 - RNA, 32 nt, Human
cuguuuucagucucuauguguacagcaguauu

SEQ ID NO: 409757 - RNA, 32 nt, Human
cuguuuucauuuccuguuggaaauauuauccu

SEQ ID NO: 409758 - RNA, 32 nt, Human
cuguuuucauuuucacggcugucucacugggg

SEQ ID NO: 409759 - RNA, 32 nt, Human
cuguuuuccagccugggcaauacagugagacc

SEQ ID NO: 409760 - RNA, 32 nt, Human
cuguuuucccugacacaccugaggcagcuucc

SEQ ID NO: 409761 - RNA, 32 nt, Human
cuguuuucccuguagcagauaacagaaccuac

SEQ ID NO: 409762 - RNA, 18 nt, Human
cuguuuuccuggcaucuu

SEQ ID NO: 409763 - RNA, 32 nt, Human
cuguuuuccuuuccucuaaccccucuccucca

SEQ ID NO: 409764 - RNA, 32 nt, Human
cuguuuucucucuguuacacacuaacaucaau

SEQ ID NO: 409765 - RNA, 32 nt, Human
cuguuuucucuuuauuugcuuauauguuaaua

SEQ ID NO: 409766 - RNA, 32 nt, Human
cuguuuucugugugugcccauuuccuugacag

SEQ ID NO: 409767 - RNA, 20 nt, Human
cuguuuucuugccccaguca

SEQ ID NO: 409768 - RNA, 32 nt, Human
cuguuuucuuuccuuuuguuguugguuuuaaa

SEQ ID NO: 409769 - RNA, 32 nt, Human
cuguuuugaacccacagcaguggagauuugua

SEQ ID NO: 409770 - RNA, 32 nt, Human
cuguuuugauuuugcugaagggagagguggug

SEQ ID NO: 409771 - RNA, 22 nt, Human
cuguuuugcacuugccugcaag

SEQ ID NO: 409772 - RNA, 32 nt, Human
cuguuuugcucuaauccuccauuaagcgagca

SEQ ID NO: 409773 - RNA, 32 nt, Human
cuguuuuggaaaggauagccauuagcaugacu

SEQ ID NO: 409774 - RNA, 32 nt, Human
cuguuuuggauguuuugugucucuccagcuac

SEQ ID NO: 409775 - RNA, 26 nt, Human
cuguuuuggcucucagcaccuaccuc

SEQ ID NO: 409776 - RNA, 32 nt, Human
cuguuuuggguucugcauugagccaaauaugu

SEQ ID NO: 409777 - RNA, 32 nt, Human
cuguuuuguauaccccuccccugacccugcuc

SEQ ID NO: 409778 - RNA, 32 nt, Human
cuguuuuguauacuuguuuucaguuuucauuu

SEQ ID NO: 409779 - RNA, 31 nt, Human
cuguuuuguaugucuuuacacuuuaaguaaa

SEQ ID NO: 409780 - RNA, 32 nt, Human
cuguuuugugaaacacacacucugccauuuca

SEQ ID NO: 409781 - RNA, 32 nt, Human
cuguuuuguucuagccacacuggcagcuguua

SEQ ID NO: 409782 - RNA, 32 nt, Human
cuguuuuguucuaguaacaauuuuggaaugaa

SEQ ID NO: 409783 - RNA, 19 nt, Human
cuguuuuguuuuucugcaa

SEQ ID NO: 409784 - RNA, 32 nt, Human
cuguuuuguuuuucuuacccuuuuggacauuu

SEQ ID NO: 409785 - RNA, 32 nt, Human
cuguuuuuaaugugaaggccaagcaggcccug

SEQ ID NO: 409786 - RNA, 32 nt, Human
cuguuuuuaauuuaucacauacaccagaacuu

SEQ ID NO: 409787 - RNA, 32 nt, Human
cuguuuuuacauuuacugaauaagauuugagu

SEQ ID NO: 409788 - RNA, 32 nt, Human
cuguuuuuacuucuuagauuuuuaacuagguu

SEQ ID NO: 409789 - RNA, 32 nt, Human
cuguuuuuaggaaguauccacugcuaaguguu

SEQ ID NO: 409790 - RNA, 32 nt, Human
cuguuuuuaucaguggaggcuaaccuaaaauu

SEQ ID NO: 409791 - RNA, 30 nt, Human
cuguuuuucaauaaaaccagaguugaaggc

SEQ ID NO: 409792 - RNA, 32 nt, Human
cuguuuuuggcugugagacuagcacuaaggau

SEQ ID NO: 409793 - RNA, 32 nt, Human
cuguuuuugugagcccuuacacaggaagauau

SEQ ID NO: 409794 - RNA, 20 nt, Human
cuguuuuuguucuugaguca

SEQ ID NO: 409795 - RNA, 32 nt, Human
cuuaaaaacagugugcaaauggcagcuagagg

SEQ ID NO: 409796 - RNA, 32 nt, Human
cuuaaaaagacacaaguuuucuuuuugaucuc

SEQ ID NO: 409797 - RNA, 32 nt, Human
cuuaaaaagacuugaaaguucacugggacuca

SEQ ID NO: 409798 - RNA, 31 nt, Human
cuuaaaaagagaccuugaacuggaaaggguc

SEQ ID NO: 409799 - RNA, 32 nt, Human
cuuaaaaagcucccugcauucuugccuugccc

SEQ ID NO: 409800 - RNA, 32 nt, Human
cuuaaaaagucauagauuugugcugcugccag

SEQ ID NO: 409801 - RNA, 24 nt, Human
cuuaaaaagugcugggauuaaagg

SEQ ID NO: 409802 - RNA, 32 nt, Human
cuuaaaaagugcugggauuaaaggcgugagcc

SEQ ID NO: 409803 - RNA, 32 nt, Human
cuuaaaaauggugauugaagcaaaauauguaa

SEQ ID NO: 409804 - RNA, 32 nt, Human
cuuaaaacacuugcaaacauuuuauucaguug

SEQ ID NO: 409805 - RNA, 32 nt, Human
cuuaaaacagaccaaaaaugucagcuuucaga

SEQ ID NO: 409806 - RNA, 26 nt, Human
cuuaaaacaugagauuuuucuugcaa

SEQ ID NO: 409807 - RNA, 32 nt, Human
cuuaaaaccagcccaggcaacauggcaaaacc

SEQ ID NO: 409808 - RNA, 32 nt, Human
cuuaaaaccagcugucguuucucccuuagcuu

SEQ ID NO: 409809 - RNA, 32 nt, Human
cuuaaaacugagaacaugaaauaacaaccacu

SEQ ID NO: 409810 - RNA, 32 nt, Human
cuuaaaacuguaacuggccuuucucuuaccuu

SEQ ID NO: 409811 - RNA, 32 nt, Human
cuuaaaacuguacucuggccuacuuuucuauu

SEQ ID NO: 409812 - RNA, 32 nt, Human
cuuaaaagacuccaccaucucccuucucaucu

SEQ ID NO: 409813 - RNA, 32 nt, Human
cuuaaaagagagaccuguauuggagaauauuu

SEQ ID NO: 409814 - RNA, 32 nt, Human
cuuaaaagaguuuguuaaagugaagacuggag

SEQ ID NO: 409815 - RNA, 32 nt, Human
cuuaaaagauacgugccggggccagguguggu

SEQ ID NO: 409816 - RNA, 32 nt, Human
cuuaaaaggaagcgcgagcaccucgagcucag

SEQ ID NO: 409817 - RNA, 32 nt, Human
cuuaaaaggagagaagaaaguguagauaguua

SEQ ID NO: 409818 - RNA, 32 nt, Human
cuuaaaaggcaaacucaugaacagggccagug

SEQ ID NO: 409819 - RNA, 24 nt, Human
cuuaaaaguguuaauaaaaccaga

SEQ ID NO: 409820 - RNA, 32 nt, Human
cuuaaaauacaaauauuagcugggcaugauga

SEQ ID NO: 409821 - RNA, 32 nt, Human
cuuaaaauccagguuguugaaaagacuuugua

SEQ ID NO: 409822 - RNA, 32 nt, Human
cuuaaaauccugcucuggccggauuccagacu

SEQ ID NO: 409823 - RNA, 32 nt, Human
cuuaaaaucggcugcuuccuggacuugccccc

SEQ ID NO: 409824 - RNA, 32 nt, Human
cuuaaaaucucguuuucucuucuuccuucuuu

SEQ ID NO: 409825 - RNA, 32 nt, Human
cuuaaaaugcuuuaguuuccaucagguucaag

SEQ ID NO: 409826 - RNA, 32 nt, Human
cuuaaaauggaggcacaaagcccagcccuguc

SEQ ID NO: 409827 - RNA, 32 nt, Human
cuuaaaauuacuuggcuuuuuccaaaugcuuc

SEQ ID NO: 409828 - RNA, 32 nt, Human
cuuaaacaaaacaaacacaaaaacuuuuaaag

SEQ ID NO: 409829 - RNA, 32 nt, Human
cuuaaacaaagcaguauauaauaacuuuauug

SEQ ID NO: 409830 - RNA, 32 nt, Human
cuuaaacacagguccacguugugucaagaacc

SEQ ID NO: 409831 - RNA, 32 nt, Human
cuuaaacacaugcacauauagguaugacacuu

SEQ ID NO: 409832 - RNA, 32 nt, Human
cuuaaacacaugccucacaaacaucuacuuuc

SEQ ID NO: 409833 - RNA, 32 nt, Human
cuuaaacagaagcagaggcuaauucaguguca

SEQ ID NO: 409834 - RNA, 32 nt, Human
cuuaaacaugauccuucucuccucauucuuca

SEQ ID NO: 409835 - RNA, 32 nt, Human
cuuaaacaugggaggcggagguugcagugagc

SEQ ID NO: 409836 - RNA, 32 nt, Human
cuuaaacauguggcuugcucaguguuuaauug

SEQ ID NO: 409837 - RNA, 32 nt, Human
cuuaaaccaggaaggcagagauugcagugagc

SEQ ID NO: 409838 - RNA, 32 nt, Human
cuuaaaccauuucuaaaccucuaucuuagcag

SEQ ID NO: 409839 - RNA, 32 nt, Human
cuuaaacccaggaggcaaaggcugcagugagc

SEQ ID NO: 409840 - RNA, 32 nt, Human
cuuaaacccaggaggcggagguugcagugagc

SEQ ID NO: 409841 - RNA, 32 nt, Human
cuuaaacccaggaggcggagguugcagugagu

SEQ ID NO: 409842 - RNA, 32 nt, Human
cuuaaacccaggaggcggugguuguaggaagc

SEQ ID NO: 409843 - RNA, 32 nt, Human
cuuaaacccaggagguggagguugaaaugagc

SEQ ID NO: 409844 - RNA, 32 nt, Human
cuuaaacccaggagguggagguugcagugagc

SEQ ID NO: 409845 - RNA, 32 nt, Human
cuuaaacccaggaguucaagaccagccugggu

SEQ ID NO: 409846 - RNA, 32 nt, Human
cuuaaacccaggcggcagagguugcagugagc

SEQ ID NO: 409847 - RNA, 32 nt, Human
cuuaaacccagggcaucaggaugugcuugggc

SEQ ID NO: 409848 - RNA, 32 nt, Human
cuuaaacccagguggcggagguugcagugagc

SEQ ID NO: 409849 - RNA, 32 nt, Human
cuuaaacccgggaggcagaggcugcagagagc

SEQ ID NO: 409850 - RNA, 32 nt, Human
cuuaaacccgggaggcggagguugcagugagc

SEQ ID NO: 409851 - RNA, 32 nt, Human
cuuaaacccgggaggugaaggaugcagugagc

SEQ ID NO: 409852 - RNA, 32 nt, Human
cuuaaacccucuauuuccuaaaauauuguucc

SEQ ID NO: 409853 - RNA, 32 nt, Human
cuuaaacccuggaggcagagguugcagugagc

SEQ ID NO: 409854 - RNA, 32 nt, Human
cuuaaaccuaugugacaaaccgcccauuauuu

SEQ ID NO: 409855 - RNA, 32 nt, Human
cuuaaaccugagaggcagagguuacagugagc

SEQ ID NO: 409856 - RNA, 32 nt, Human
cuuaaaccugagagguggagguuacagugagu

SEQ ID NO: 409857 - RNA, 32 nt, Human
cuuaaaccugagagguggagguugcaguugag

SEQ ID NO: 409858 - RNA, 32 nt, Human
cuuaaaccugggagacggagguugcagugagc

SEQ ID NO: 409859 - RNA, 32 nt, Human
cuuaaaccugggaggcagaggugagcugagau

SEQ ID NO: 409860 - RNA, 32 nt, Human
cuuaaaccugggaggcggagaguacagugagc

SEQ ID NO: 409861 - RNA, 32 nt, Human
cuuaaaccugggagguggagguugcagugacc

SEQ ID NO: 409862 - RNA, 32 nt, Human
cuuaaaccugggauguggagguugcagugaac

SEQ ID NO: 409863 - RNA, 32 nt, Human
cuuaaaccuuguccaccucuugauauuuuagg

SEQ ID NO: 409864 - RNA, 32 nt, Human
cuuaaacuccagaaaaugaagaaaaaugaggu

SEQ ID NO: 409865 - RNA, 32 nt, Human
cuuaaacucgggagguagagguugcagugagc

SEQ ID NO: 409866 - RNA, 32 nt, Human
cuuaaacugcugcagugcucaaggagauggaa

SEQ ID NO: 409867 - RNA, 32 nt, Human
cuuaaacuucaucagaacauucauacgggaga

SEQ ID NO: 409868 - RNA, 32 nt, Human
cuuaaagaaacagcuuucaagugccuuucugc

SEQ ID NO: 409869 - RNA, 32 nt, Human
cuuaaagaacaacagucuuuucuucaggacuc

SEQ ID NO: 409870 - RNA, 32 nt, Human
cuuaaagaauccaaggagacagauguuguauc

SEQ ID NO: 409871 - RNA, 32 nt, Human
cuuaaagacauaaaucacaggugcaaagccau

SEQ ID NO: 409872 - RNA, 32 nt, Human
cuuaaagacucucgagaaaagccacguggggg

SEQ ID NO: 409873 - RNA, 32 nt, Human
cuuaaagagcugggaaccuuugcucaaagcuc

SEQ ID NO: 409874 - RNA, 32 nt, Human
cuuaaagaggcgguuagcaccuauuagacgua

SEQ ID NO: 409875 - RNA, 32 nt, Human
cuuaaagagguuaaagagguggagaaagagaa

SEQ ID NO: 409876 - RNA, 32 nt, Human
cuuaaagaguacauucugccuugcuguaguga

SEQ ID NO: 409877 - RNA, 32 nt, Human
cuuaaagauaugucccagggcaagacaacagg

SEQ ID NO: 409878 - RNA, 32 nt, Human
cuuaaagaugccuuucccaacccuccauucau

SEQ ID NO: 409879 - RNA, 32 nt, Human
cuuaaagcaaacuaagaccagagggaggauua

SEQ ID NO: 409880 - RNA, 32 nt, Human
cuuaaagcaauccugaagaaccagagagcgaa

SEQ ID NO: 409881 - RNA, 32 nt, Human
cuuaaagccccaggauuagauggaugccuuaa

SEQ ID NO: 409882 - RNA, 32 nt, Human
cuuaaagcucacuucaaauucuucuuugagaa

SEQ ID NO: 409883 - RNA, 32 nt, Human
cuuaaagcuucuccugugaacuucuuagggaa

SEQ ID NO: 409884 - RNA, 32 nt, Human
cuuaaagcuucuuguccauggcuuuuguuuga

SEQ ID NO: 409885 - RNA, 32 nt, Human
cuuaaaggagcuauguaacaagcccauauugu

SEQ ID NO: 409886 - RNA, 32 nt, Human
cuuaaaggauucacuagacucagaggcccuuc

SEQ ID NO: 409887 - RNA, 32 nt, Human
cuuaaaggcacaaauucuccuugaagaccuuc

SEQ ID NO: 409888 - RNA, 32 nt, Human
cuuaaaggccaccugcuauacaguuguuaaau

SEQ ID NO: 409889 - RNA, 32 nt, Human
cuuaaagggcaaguagacuuugcaacaugcuc

SEQ ID NO: 409890 - RNA, 32 nt, Human
cuuaaagggcugacuuuaguuccuucauggua

SEQ ID NO: 409891 - RNA, 32 nt, Human
cuuaaagguucugaaguaaaggcuuguuaagu

SEQ ID NO: 409892 - RNA, 32 nt, Human
cuuaaagucuguuuuuagacuucauggucauu

SEQ ID NO: 409893 - RNA, 23 nt, Human
cuuaaagugauucuccugccuca

SEQ ID NO: 409894 - RNA, 32 nt, Human
cuuaaaguggcuuucaacuucaagaugaagga

SEQ ID NO: 409895 - RNA, 32 nt, Human
cuuaaaguuuauaagaggcauauugccuuaaa

SEQ ID NO: 409896 - RNA, 32 nt, Human
cuuaaaucagaacuugcauaagaaagagaaug

SEQ ID NO: 409897 - RNA, 32 nt, Human
cuuaaauccaggaggcaaagguugcagugagc

SEQ ID NO: 409898 - RNA, 32 nt, Human
cuuaaauccaggaggcggagguugcagugagc

SEQ ID NO: 409899 - RNA, 32 nt, Human
cuuaaauccuucugucuuccugacugaaugaa

SEQ ID NO: 409900 - RNA, 32 nt, Human
cuuaaaucuccucuuuggaauucugcugauuc

SEQ ID NO: 409901 - RNA, 32 nt, Human
cuuaaaucugucuucugcucaguuucuggucc

SEQ ID NO: 409902 - RNA, 32 nt, Human
cuuaaaugaccuacaggguugcagugacagua

SEQ ID NO: 409903 - RNA, 32 nt, Human
cuuaaaugacucuucugccucagccucaccaa

SEQ ID NO: 409904 - RNA, 32 nt, Human
cuuaaaugaggugagagugaagagacuagagc

SEQ ID NO: 409905 - RNA, 32 nt, Human
cuuaaaugauaccucauugauauauugcacua

SEQ ID NO: 409906 - RNA, 32 nt, Human
cuuaaaugcccaggcuugaugggauaaaaugu

SEQ ID NO: 409907 - RNA, 32 nt, Human
cuuaaauggaggaucacuugaggccuagccuu

SEQ ID NO: 409908 - RNA, 32 nt, Human
cuuaaauuagcacuaaccuccacuuccuucuc

SEQ ID NO: 409909 - RNA, 32 nt, Human
cuuaaauucccggccuccucuucacuaguagg

SEQ ID NO: 409910 - RNA, 32 nt, Human
cuuaaauucuaauaggacucaggcuuggaagg

SEQ ID NO: 409911 - RNA, 32 nt, Human
cuuaaauuuucuggaauauccauguuucagag

SEQ ID NO: 409912 - RNA, 32 nt, Human
cuuaacaaagccuuugcuuuguuaucaaaugg

SEQ ID NO: 409913 - RNA, 32 nt, Human
cuuaacaaaugagacacauucacugggcaucu

SEQ ID NO: 409914 - RNA, 32 nt, Human
cuuaacaacuccaggagcccugucagcugccc

SEQ ID NO: 409915 - RNA, 32 nt, Human
cuuaacacaaauguguauaugugcacacaggg

SEQ ID NO: 409916 - RNA, 32 nt, Human
cuuaacacacagauuccucuuaaaugccaccu

SEQ ID NO: 409917 - RNA, 32 nt, Human
cuuaacaccuggcaacagucuccccucauccu

SEQ ID NO: 409918 - RNA, 32 nt, Human
cuuaacagauuucugcuggcugcuauuauagg

SEQ ID NO: 409919 - RNA, 32 nt, Human
cuuaacaggaaguuuaguuuguuaugcacuuu

SEQ ID NO: 409920 - RNA, 32 nt, Human
cuuaacaggagggcagagggcaggggacagac

SEQ ID NO: 409921 - RNA, 32 nt, Human
cuuaacaggucuuuaaauugggcaguucugaa

SEQ ID NO: 409922 - RNA, 32 nt, Human
cuuaacauacccucaaacugaggcuuaaagua

SEQ ID NO: 409923 - RNA, 32 nt, Human
cuuaacauaugaaaauccuuaauuucuacugc

SEQ ID NO: 409924 - RNA, 32 nt, Human
cuuaacauauuaucuuguuagauuuguuacca

SEQ ID NO: 409925 - RNA, 32 nt, Human
cuuaacauuaaacucuucuaacuuucuucuuu

SEQ ID NO: 409926 - RNA, 32 nt, Human
cuuaacauugcagcuuucucuccaucugcaga

SEQ ID NO: 409927 - RNA, 32 nt, Human
cuuaacauuucuuccauggccccacaccaugg

SEQ ID NO: 409928 - RNA, 32 nt, Human
cuuaaccaagaaguaaauaugaccucaguguc

SEQ ID NO: 409929 - RNA, 32 nt, Human
cuuaacccaagggagcacaggucccaccucca

SEQ ID NO: 409930 - RNA, 32 nt, Human
cuuaacccagaaccugguggcccaagugcuca

SEQ ID NO: 409931 - RNA, 32 nt, Human
cuuaaccccaggaggacagagacccugaggca

SEQ ID NO: 409932 - RNA, 32 nt, Human
cuuaacccgccugaagcaauagccauggaagu

SEQ ID NO: 409933 - RNA, 32 nt, Human
cuuaaccucuucaagccccaauuuccucaacc

SEQ ID NO: 409934 - RNA, 32 nt, Human
cuuaaccugaugcuaauuuucaggguucucca

SEQ ID NO: 409935 - RNA, 32 nt, Human
cuuaaccugcagcuucguuuaauguagcucuu

SEQ ID NO: 409936 - RNA, 32 nt, Human
cuuaaccugcuguuggccuuugauucugggcc

SEQ ID NO: 409937 - RNA, 32 nt, Human
cuuaaccuuuuauuuccuguccuuccuugaaa

SEQ ID NO: 409938 - RNA, 32 nt, Human
cuuaacucacugcaaccuccgcuucccaggua

SEQ ID NO: 409939 - RNA, 32 nt, Human
cuuaacucaugccaacuccacccuacauggcu

SEQ ID NO: 409940 - RNA, 32 nt, Human
cuuaacucaugccaagcaucucagcuuggggu

SEQ ID NO: 409941 - RNA, 32 nt, Human
cuuaacucugcagcuuucaagcucaucuguua

SEQ ID NO: 409942 - RNA, 31 nt, Human
cuuaacucuucaaaugacuguugaaagagaa

SEQ ID NO: 409943 - RNA, 32 nt, Human
cuuaacugccaagagcagguccuggaguuccc

SEQ ID NO: 409944 - RNA, 32 nt, Human
cuuaacugcuuuguaccacacagcaguagaug

SEQ ID NO: 409945 - RNA, 32 nt, Human
cuuaacuguccacccuuacuaccugugggauc

SEQ ID NO: 409946 - RNA, 32 nt, Human
cuuaacuuagcuguuucccuacuucugugacu

SEQ ID NO: 409947 - RNA, 32 nt, Human
cuuaacuucuggguuugcuauuacaaauccua

SEQ ID NO: 409948 - RNA, 32 nt, Human
cuuaacuugcagaaggcuuguuaacaauuguu

SEQ ID NO: 409949 - RNA, 31 nt, Human
cuuaacuugggguccaucaccccaggggguc

SEQ ID NO: 409950 - RNA, 32 nt, Human
cuuaacuuuucuguaccucuucuguuuuugua

SEQ ID NO: 409951 - RNA, 32 nt, Human
cuuaagaaaaagagguuucaguuggcugauag

SEQ ID NO: 409952 - RNA, 32 nt, Human
cuuaagaaaaaggaaaacacagcuccccagac

SEQ ID NO: 409953 - RNA, 32 nt, Human
cuuaagaaaauacaaaauuaggaacaggccuu

SEQ ID NO: 409954 - RNA, 32 nt, Human
cuuaagaaaaugccuuuuacucagggaaucuc

SEQ ID NO: 409955 - RNA, 32 nt, Human
cuuaagaaaggcugguuaccaucggaguuuac

SEQ ID NO: 409956 - RNA, 32 nt, Human
cuuaagaacacccuugucucagucccacucag

SEQ ID NO: 409957 - RNA, 32 nt, Human
cuuaagaaccaggcaaccucugccuucuuccc

SEQ ID NO: 409958 - RNA, 32 nt, Human
cuuaagaaccauugauuuaauguaauagggaa

SEQ ID NO: 409959 - RNA, 32 nt, Human
cuuaagaagaccucuggcuuuccuggaacaca

SEQ ID NO: 409960 - RNA, 32 nt, Human
cuuaagaagccgccugggucaguggcuacgca

SEQ ID NO: 409961 - RNA, 32 nt, Human
cuuaagaagggacggggccccacgcugcgcac

SEQ ID NO: 409962 - RNA, 32 nt, Human
cuuaagaauaaucacugugaccaacuuacagu

SEQ ID NO: 409963 - RNA, 32 nt, Human
cuuaagaauccuggccgaggucagccuccucc

SEQ ID NO: 409964 - RNA, 32 nt, Human
cuuaagaauucagucuaaauuagcaaccagga

SEQ ID NO: 409965 - RNA, 32 nt, Human
cuuaagaccagccugggcaacauaauaagacc

SEQ ID NO: 409966 - RNA, 32 nt, Human
cuuaagaccagccugggcaacauaaugagacc

SEQ ID NO: 409967 - RNA, 32 nt, Human
cuuaagaccuacuguucuaaagcucugacauu

SEQ ID NO: 409968 - RNA, 32 nt, Human
cuuaagacuguagcgucgacuccugccggaau

SEQ ID NO: 409969 - RNA, 32 nt, Human
cuuaagagcacuaaccccucccugguuugaag

SEQ ID NO: 409970 - RNA, 32 nt, Human
cuuaagaggaagagguuaagcuguaaaguagu

SEQ ID NO: 409971 - RNA, 32 nt, Human
cuuaagaggagauguagaaaaauguguacaau

SEQ ID NO: 409972 - RNA, 32 nt, Human
cuuaagagucauccagcucuugcucagugaag

SEQ ID NO: 409973 - RNA, 32 nt, Human
cuuaagaguccuuucucagcauauuauucugc

SEQ ID NO: 409974 - RNA, 32 nt, Human
cuuaagaguuguggaagagaagaaaaagaaaa

SEQ ID NO: 409975 - RNA, 32 nt, Human
cuuaagaguuugugcccuuaaaccagacuccc

SEQ ID NO: 409976 - RNA, 32 nt, Human
cuuaagauaaagauuguacuugacaguuuagu

SEQ ID NO: 409977 - RNA, 32 nt, Human
cuuaagauaauuaugugaggccacuugguagc

SEQ ID NO: 409978 - RNA, 21 nt, Human
cuuaagaucaggaguucgaga

SEQ ID NO: 409979 - RNA, 32 nt, Human
cuuaagcaaacagugaauucaccuccaccuca

SEQ ID NO: 409980 - RNA, 22 nt, Human
cuuaagcaauccucccaccuua

SEQ ID NO: 409981 - RNA, 32 nt, Human
cuuaagcagguaaagcagucacugugaagaaa

SEQ ID NO: 409982 - RNA, 32 nt, Human
cuuaagccaaaugguguuccaaguugguugcu

SEQ ID NO: 409983 - RNA, 32 nt, Human
cuuaagccacacacauuguugcugcuaugacu

SEQ ID NO: 409984 - RNA, 32 nt, Human
cuuaagcccaccucccccucuuguugccuucg

SEQ ID NO: 409985 - RNA, 32 nt, Human
cuuaagcccagaaggcagagguuguagugagc

SEQ ID NO: 409986 - RNA, 32 nt, Human
cuuaagcccaggaaguugagaccgcagagagc

SEQ ID NO: 409987 - RNA, 32 nt, Human
cuuaagcccaggaauucgaaaucagccuaggc

SEQ ID NO: 409988 - RNA, 32 nt, Human
cuuaagcccaggagacagagguugcagugagc

SEQ ID NO: 409989 - RNA, 32 nt, Human
cuuaagcccaggagcucaagucccaccugggc

SEQ ID NO: 409990 - RNA, 32 nt, Human
cuuaagcccaggagcuuaagaccagccugggc

SEQ ID NO: 409991 - RNA, 32 nt, Human
cuuaagcccaggagguucaggcugcaguaagg

SEQ ID NO: 409992 - RNA, 32 nt, Human
cuuaagcccaggagucugagaccagccugggc

SEQ ID NO: 409993 - RNA, 32 nt, Human
cuuaagcccaggaguucaagaccaaccuggac

SEQ ID NO: 409994 - RNA, 32 nt, Human
cuuaagcccaggaguucaagaccagccugggc

SEQ ID NO: 409995 - RNA, 32 nt, Human
cuuaagcccaggaguucgagaucagccuggac

SEQ ID NO: 409996 - RNA, 32 nt, Human
cuuaagcccaggaguuugagaccagcuugggc

SEQ ID NO: 409997 - RNA, 32 nt, Human
cuuaagcccaggaguuugagucuguaaugcac

SEQ ID NO: 409998 - RNA, 32 nt, Human
cuuaagccccagaaagccaaaaagaacaugua

SEQ ID NO: 409999 - RNA, 32 nt, Human
cuuaagcccgggaggcagaaccugcagugagc

SEQ ID NO: 410000 - RNA, 32 nt, Human
cuuaagccgcagcugcuauagauagcacugcc

SEQ ID NO: 410001 - RNA, 32 nt, Human
cuuaagccugggaggcaauggcugcaguaaac

SEQ ID NO: 410002 - RNA, 32 nt, Human
cuuaagccugggaggcagagguugcagugagc

SEQ ID NO: 410003 - RNA, 32 nt, Human
cuuaagccuuagaacaaagucaugcagaugcc

SEQ ID NO: 410004 - RNA, 32 nt, Human
cuuaagccuuaguaugaaaaacugaggauuua

SEQ ID NO: 410005 - RNA, 32 nt, Human
cuuaagcgacuugccauuugaguuacaucacc

SEQ ID NO: 410006 - RNA, 32 nt, Human
cuuaagcgggcagagguggauugagcacuaug

SEQ ID NO: 410007 - RNA, 21 nt, Human
cuuaagcucaggaguucaagg

SEQ ID NO: 410008 - RNA, 32 nt, Human
cuuaagcucccccagcucuuuccagaaaacau

SEQ ID NO: 410009 - RNA, 32 nt, Human
cuuaagcucucuaauccuccuccucagagugc

SEQ ID NO: 410010 - RNA, 32 nt, Human
cuuaagcugcuggcugggcaaguguucauuga

SEQ ID NO: 410011 - RNA, 32 nt, Human
cuuaagcuuccugagguugcaccagaagcaga

SEQ ID NO: 410012 - RNA, 32 nt, Human
cuuaagcuugcuggaaacugugggaggaugug

SEQ ID NO: 410013 - RNA, 32 nt, Human
cuuaaggaagagacccugugagucugacaaua

SEQ ID NO: 410014 - RNA, 32 nt, Human
cuuaaggaaggaauuaagaaaagggaaaaagc

SEQ ID NO: 410015 - RNA, 32 nt, Human
cuuaaggacugcuucugcccucugccugccag

SEQ ID NO: 410016 - RNA, 32 nt, Human
cuuaaggaugcugagggcauggggccaggacc

SEQ ID NO: 410017 - RNA, 32 nt, Human
cuuaaggccaggaguucaagaccaccuggcca

SEQ ID NO: 410018 - RNA, 32 nt, Human
cuuaaggccaggaguucgagaccagccugggc

SEQ ID NO: 410019 - RNA, 32 nt, Human
cuuaaggccaggaguuugagaccagcuugggc

SEQ ID NO: 410020 - RNA, 20 nt, Human
cuuaaggcugggugcagugg

SEQ ID NO: 410021 - RNA, 32 nt, Human
cuuaagggaaggucaagagggagaugggcaag

SEQ ID NO: 410022 - RNA, 32 nt, Human
cuuaagggacaggcacagcagaggugagagug

SEQ ID NO: 410023 - RNA, 32 nt, Human
cuuaagggaggcggcggcagcgcggcgguggg

SEQ ID NO: 410024 - RNA, 32 nt, Human
cuuaaggggugacuugccugagcucuaucacc

SEQ ID NO: 410025 - RNA, 22 nt, Human
cuuaagggucagugguggaaag

SEQ ID NO: 410026 - RNA, 32 nt, Human
cuuaagggucuguuucucagcaucauggaugc

SEQ ID NO: 410027 - RNA, 32 nt, Human
cuuaaggguguuuuuguuuguuuuaaucagcc

SEQ ID NO: 410028 - RNA, 32 nt, Human
cuuaaggguuacaggcaggcugcacacagcag

SEQ ID NO: 410029 - RNA, 20 nt, Human
cuuaaggguucuguaguguu

SEQ ID NO: 410030 - RNA, 32 nt, Human
cuuaaggguugcauacuuuuauuggaguaaau

SEQ ID NO: 410031 - RNA, 32 nt, Human
cuuaaggucaucuugaaauuugccaaauauau

SEQ ID NO: 410032 - RNA, 19 nt, Human
cuuaaguacccugccucca

SEQ ID NO: 410033 - RNA, 32 nt, Human
cuuaaguaucuuucccuuccuucucuacccuc

SEQ ID NO: 410034 - RNA, 32 nt, Human
cuuaaguauucaacacaaacuuucuaauaucu

SEQ ID NO: 410035 - RNA, 31 nt, Human
cuuaagucaauaaauaaauguaaggaagucc

SEQ ID NO: 410036 - RNA, 32 nt, Human
cuuaagucacccaucuuccaguaagcaguuua

SEQ ID NO: 410037 - RNA, 32 nt, Human
cuuaagucauucucugccugcauccagccccu

SEQ ID NO: 410038 - RNA, 32 nt, Human
cuuaaguccaggaguucaagaccagccugggu

SEQ ID NO: 410039 - RNA, 32 nt, Human
cuuaagucuacaggggcuggugaccucuuuuu

SEQ ID NO: 410040 - RNA, 32 nt, Human
cuuaagucugggagguugaggcugcagugagc

SEQ ID NO: 410041 - RNA, 32 nt, Human
cuuaagugaaggagugggggaggaagaagcau

SEQ ID NO: 410042 - RNA, 32 nt, Human
cuuaaguggcagaauauaauucccaagcuuuu

SEQ ID NO: 410043 - RNA, 32 nt, Human
cuuaaguggucaggaagguaggugcuucccuu

SEQ ID NO: 410044 - RNA, 32 nt, Human
cuuaaguuauugugcucuuuucuguuauguau

SEQ ID NO: 410045 - RNA, 32 nt, Human
cuuaaguuguuccucuguuaucaugccugaau

SEQ ID NO: 410046 - RNA, 26 nt, Human
cuuaauaaauauuuuaucaaaauguc

SEQ ID NO: 410047 - RNA, 32 nt, Human
cuuaauaaauggccucauuugaucaucaugug

SEQ ID NO: 410048 - RNA, 32 nt, Human
cuuaauacuguugccagccccaaagacuguca

SEQ ID NO: 410049 - RNA, 32 nt, Human
cuuaauauacagguaucccagcuuugggcaca

SEQ ID NO: 410050 - RNA, 32 nt, Human
cuuaauaucgacuuucuuuuguaccagguuuu

SEQ ID NO: 410051 - RNA, 32 nt, Human
cuuaauaucugacacuguuacucucauaugca

SEQ ID NO: 410052 - RNA, 32 nt, Human
cuuaauauucuuuaaagggcaugggaauuuag

SEQ ID NO: 410053 - RNA, 32 nt, Human
cuuaaucaaccagcgguuucccagcaggacaa

SEQ ID NO: 410054 - RNA, 32 nt, Human
cuuaaucaaccccagcccauguccccuguuca

SEQ ID NO: 410055 - RNA, 32 nt, Human
cuuaaucaacugcuugaugaaggaggcaaaac

SEQ ID NO: 410056 - RNA, 32 nt, Human
cuuaaucaagagcuggaguucaaugaguccua

SEQ ID NO: 410057 - RNA, 32 nt, Human
cuuaaucacugcauuaauauuugguugcauag

SEQ ID NO: 410058 - RNA, 32 nt, Human
cuuaaucauacaguaagcugaccuggaaauga

SEQ ID NO: 410059 - RNA, 32 nt, Human
cuuaaucauugauccaggaauauuucaaccag

SEQ ID NO: 410060 - RNA, 32 nt, Human
cuuaaucccgggaaagaggaacaggagugcca

SEQ ID NO: 410061 - RNA, 32 nt, Human
cuuaauccuaaaccaaccugugaauggaucau

SEQ ID NO: 410062 - RNA, 31 nt, Human
cuuaauccugagagagaaaauuaaguacugu

SEQ ID NO: 410063 - RNA, 32 nt, Human
cuuaaucggugcuuuauggaggccaguguaac

SEQ ID NO: 410064 - RNA, 32 nt, Human
cuuaaucguggccucccugggguggguggggu

SEQ ID NO: 410065 - RNA, 32 nt, Human
cuuaaucuagggcauguccauuccaaggucuc

SEQ ID NO: 410066 - RNA, 32 nt, Human
cuuaaucuccucuaugcuaucuccucuaaucu

SEQ ID NO: 410067 - RNA, 32 nt, Human
cuuaaucuccucuucuuucauccucagcuuca

SEQ ID NO: 410068 - RNA, 32 nt, Human
cuuaaucugcagcagcucacaggcugggggug

SEQ ID NO: 410069 - RNA, 32 nt, Human
cuuaaucugccuggcguccccucccucugucu

SEQ ID NO: 410070 - RNA, 32 nt, Human
cuuaaucuggaucagacucacccuggacuaau

SEQ ID NO: 410071 - RNA, 32 nt, Human
cuuaaucuugguagugccugccuuugaaacag

SEQ ID NO: 410072 - RNA, 32 nt, Human
cuuaaucuuuaucugcugaauaaaugagucca

SEQ ID NO: 410073 - RNA, 32 nt, Human
cuuaaugaaaagagaacggagaggaggugugg

SEQ ID NO: 410074 - RNA, 32 nt, Human
cuuaaugaaaccaguggaugugcuuaacguaa

SEQ ID NO: 410075 - RNA, 32 nt, Human
cuuaaugaaugcauuuuauuuaucucaauuuu

SEQ ID NO: 410076 - RNA, 32 nt, Human
cuuaaugauuauuuuuauuacuuacuguuguu

SEQ ID NO: 410077 - RNA, 32 nt, Human
cuuaaugcacacauaagacgcccuaagauaac

SEQ ID NO: 410078 - RNA, 32 nt, Human
cuuaaugcucagccacauucccuugcuggaca

SEQ ID NO: 410079 - RNA, 32 nt, Human
cuuaaugcucaucagagaguucauacagggga

SEQ ID NO: 410080 - RNA, 23 nt, Human
cuuaauggacuggacucuugcca

SEQ ID NO: 410081 - RNA, 32 nt, Human
cuuaaugguaaauccuucauuuaaagauagug

SEQ ID NO: 410082 - RNA, 32 nt, Human
cuuaauggucacccuaaaaacacccacauaug

SEQ ID NO: 410083 - RNA, 32 nt, Human
cuuaauguaauucaggacuccaaccaagagga

SEQ ID NO: 410084 - RNA, 32 nt, Human
cuuaauguagauaucuuuaucauucugaauug

SEQ ID NO: 410085 - RNA, 25 nt, Human
cuuaaugucucaaaauaaaaccaga

SEQ ID NO: 410086 - RNA, 32 nt, Human
cuuaauguguguguuuuuacuugcauaucugu

SEQ ID NO: 410087 - RNA, 32 nt, Human
cuuaauguuuucuuuaaauggcucacuuuugu

SEQ ID NO: 410088 - RNA, 32 nt, Human
cuuaauuacaauaucugauauuuuuacagucu

SEQ ID NO: 410089 - RNA, 32 nt, Human
cuuaauuacucaauaaacuugcugguguucug

SEQ ID NO: 410090 - RNA, 32 nt, Human
cuuaauuagagaugauuucuggaacauucagu

SEQ ID NO: 410091 - RNA, 32 nt, Human
cuuaauuaguaaaauauaaucauuuuuaguaa

SEQ ID NO: 410092 - RNA, 32 nt, Human
cuuaauuauagucuggcgugaucauguagaau

SEQ ID NO: 410093 - RNA, 32 nt, Human
cuuaauucaggcucaggcugaagaacugaccc

SEQ ID NO: 410094 - RNA, 32 nt, Human
cuuaauucagucaagacucccuuugggaauuc

SEQ ID NO: 410095 - RNA, 32 nt, Human
cuuaauucaucuaaucccuccuguuugucuca

SEQ ID NO: 410096 - RNA, 32 nt, Human
cuuaauucauuuccuggacaaacuuccuccaa

SEQ ID NO: 410097 - RNA, 30 nt, Human
cuuaauucccaaucccauuccugggcuagc

SEQ ID NO: 410098 - RNA, 32 nt, Human
cuuaauucccauuuaccagcaguuaacucaug

SEQ ID NO: 410099 - RNA, 32 nt, Human
cuuaauuccuguaaucccagcauuuugagagg

SEQ ID NO: 410100 - RNA, 32 nt, Human
cuuaauucucugcaacacuuugaggacauuua

SEQ ID NO: 410101 - RNA, 32 nt, Human
cuuaauugaaauauuugcucucugccauaauu

SEQ ID NO: 410102 - RNA, 32 nt, Human
cuuaauugaaggccaccuucucacagguuuca

SEQ ID NO: 410103 - RNA, 32 nt, Human
cuuaauugagcucuaggguggcugguuaguau

SEQ ID NO: 410104 - RNA, 32 nt, Human
cuuaauugggaaaaggaggaguaagagcaggc

SEQ ID NO: 410105 - RNA, 32 nt, Human
cuuaauuuaagcuuucuagaaagcuuuggaag

SEQ ID NO: 410106 - RNA, 32 nt, Human
cuuaauuucacucaagguucauugggcucugc

SEQ ID NO: 410107 - RNA, 32 nt, Human
cuuaauuucgcuuugugcaucuuccccuccag

SEQ ID NO: 410108 - RNA, 24 nt, Human
cuuaauuugaauaauaaaaccaga

SEQ ID NO: 410109 - RNA, 32 nt, Human
cuuaauuuuaaacugcggaauguggccucugc

SEQ ID NO: 410110 - RNA, 32 nt, Human
cuuaauuuuagccuaaauauuucuccacauuu

SEQ ID NO: 410111 - RNA, 32 nt, Human
cuuaauuuuaugaaccucucccucuucuuccu

SEQ ID NO: 410112 - RNA, 32 nt, Human
cuuaauuuuccucuuggucacucccauucuug

SEQ ID NO: 410113 - RNA, 32 nt, Human
cuuacaaaagauguuuauguccaccauuaucu

SEQ ID NO: 410114 - RNA, 32 nt, Human
cuuacaaacagcuuacaguuacuugggcuacu

SEQ ID NO: 410115 - RNA, 32 nt, Human
cuuacaaacuaaaucagugugcugcuagaggg

SEQ ID NO: 410116 - RNA, 32 nt, Human
cuuacaaacuccagaggccauauucaaaacag

SEQ ID NO: 410117 - RNA, 32 nt, Human
cuuacaaagaccccacagaaguaaaggcaaua

SEQ ID NO: 410118 - RNA, 32 nt, Human
cuuacaaagugcugggaugacaggcaugagcc

SEQ ID NO: 410119 - RNA, 32 nt, Human
cuuacaacucaucaaagcugugagccaguuaa

SEQ ID NO: 410120 - RNA, 32 nt, Human
cuuacaagaggauuguaaaauggaccaaucag

SEQ ID NO: 410121 - RNA, 32 nt, Human
cuuacaagagguggagcaugcagaugagcagg

SEQ ID NO: 410122 - RNA, 32 nt, Human
cuuacaagugagaacaugcaguauuuaguuuu

SEQ ID NO: 410123 - RNA, 32 nt, Human
cuuacaauaagaaagaauauguuugugggaaa

SEQ ID NO: 410124 - RNA, 32 nt, Human
cuuacaauuauuucacaucuguggcaagguaa

SEQ ID NO: 410125 - RNA, 32 nt, Human
cuuacaauuuucccucuucacuugguucuugu

SEQ ID NO: 410126 - RNA, 32 nt, Human
cuuacacaaaccuagauguuauauguauuuuu

SEQ ID NO: 410127 - RNA, 32 nt, Human
cuuacacaaggggugcaggauuugaauucugu

SEQ ID NO: 410128 - RNA, 32 nt, Human
cuuacacacaaacacacauacucccacauacu

SEQ ID NO: 410129 - RNA, 32 nt, Human
cuuacacacaugcacacacaaauaugcacaga

SEQ ID NO: 410130 - RNA, 32 nt, Human
cuuacacacccacacacauacacauuucaugc

SEQ ID NO: 410131 - RNA, 32 nt, Human
cuuacacacgcacuuuaccacccggucauucc

SEQ ID NO: 410132 - RNA, 32 nt, Human
cuuacaccaguaaucccagcacuuugggaggc

SEQ ID NO: 410133 - RNA, 32 nt, Human
cuuacaccaugaucuugaacuuuccagccucc

SEQ ID NO: 410134 - RNA, 32 nt, Human
cuuacacccugggcagccuccuccgauggccc

SEQ ID NO: 410135 - RNA, 32 nt, Human
cuuacacccuugucccacccccagcagcucac

SEQ ID NO: 410136 - RNA, 32 nt, Human
cuuacaccuaccuuuaucaccauucguucaug

SEQ ID NO: 410137 - RNA, 32 nt, Human
cuuacaccuauaaucccagcacuuugggaggc

SEQ ID NO: 410138 - RNA, 32 nt, Human
cuuacaccuguaaccccagcacuuugggaggc

SEQ ID NO: 410139 - RNA, 32 nt, Human
cuuacaccuguaagcccagcacuuugggaggc

SEQ ID NO: 410140 - RNA, 24 nt, Human
cuuacaccuguaaucccaacacuu

SEQ ID NO: 410141 - RNA, 32 nt, Human
cuuacaccuguaaucccaacacuuugggaagc

SEQ ID NO: 410142 - RNA, 32 nt, Human
cuuacaccuguaaucccaaugcuuugggagac

SEQ ID NO: 410143 - RNA, 32 nt, Human
cuuacaccuguaaucccagcacuuugggaggc

SEQ ID NO: 410144 - RNA, 32 nt, Human
cuuacaccuguaaucccaguacuuugggaggc

SEQ ID NO: 410145 - RNA, 32 nt, Human
cuuacaccuguaauccuaguacuuugggaggc

SEQ ID NO: 410146 - RNA, 32 nt, Human
cuuacaccuguaaucgcagcauuuugggaggc

SEQ ID NO: 410147 - RNA, 32 nt, Human
cuuacaccuguaaucugagcgcuuugggaggc

SEQ ID NO: 410148 - RNA, 32 nt, Human
cuuacaccuguaauuccagcacuuugggacgc

SEQ ID NO: 410149 - RNA, 32 nt, Human
cuuacaccuguagucccaggcacuuugggagg

SEQ ID NO: 410150 - RNA, 32 nt, Human
cuuacaccugugaucccagcacuuugggaggc

SEQ ID NO: 410151 - RNA, 32 nt, Human
cuuacacgauggaguugaagaggcagagaaaa

SEQ ID NO: 410152 - RNA, 32 nt, Human
cuuacacugaaauccaaaauagucauguuucu

SEQ ID NO: 410153 - RNA, 32 nt, Human
cuuacacugcauucauuaacaucucaaucuca

SEQ ID NO: 410154 - RNA, 32 nt, Human
cuuacacugugguguccagcagcauccggcuu

SEQ ID NO: 410155 - RNA, 32 nt, Human
cuuacacuguugcaucacaagggacucaccca

SEQ ID NO: 410156 - RNA, 32 nt, Human
cuuacagagaagagaagagggagucagcccau

SEQ ID NO: 410157 - RNA, 32 nt, Human
cuuacagagugcuagccucuuccuucaggacu

SEQ ID NO: 410158 - RNA, 32 nt, Human
cuuacagaugcucucagaacaguuccaagaau

SEQ ID NO: 410159 - RNA, 32 nt, Human
cuuacagcaaacugcagauauggaguuggaac

SEQ ID NO: 410160 - RNA, 32 nt, Human
cuuacagcacagacuagguguugaaggcaggu

SEQ ID NO: 410161 - RNA, 32 nt, Human
cuuacagcauugaggucacacagcuguccucg

SEQ ID NO: 410162 - RNA, 32 nt, Human
cuuacagccagaggaaccagcacuccaucacu

SEQ ID NO: 410163 - RNA, 32 nt, Human
cuuacagccccaauggcccccaaaaagccaga

SEQ ID NO: 410164 - RNA, 32 nt, Human
cuuacagcugggucguaaaaugaacaagccug

SEQ ID NO: 410165 - RNA, 32 nt, Human
cuuacagcuuucucacaugaguugcuucacau

SEQ ID NO: 410166 - RNA, 22 nt, Human
cuuacaggaaccggcagcagcu

SEQ ID NO: 410167 - RNA, 32 nt, Human
cuuacaggaaggaggaggggaagcaguggaug

SEQ ID NO: 410168 - RNA, 32 nt, Human
cuuacaggcccaggacuggagcuuucucuggc

SEQ ID NO: 410169 - RNA, 31 nt, Human
cuuacagggcuaggcaguaccaaaguaacug

SEQ ID NO: 410170 - RNA, 32 nt, Human
cuuacaggugugagccacagugcccagcuuuu

SEQ ID NO: 410171 - RNA, 22 nt, Human
cuuacaguaacccccaccccuu

SEQ ID NO: 410172 - RNA, 32 nt, Human
cuuacagucccugucauauuaccaacagaggc

SEQ ID NO: 410173 - RNA, 32 nt, Human
cuuacagugagcugagauugcgccacuguacu

SEQ ID NO: 410174 - RNA, 16 nt, Human
cuuacaguggguccag

SEQ ID NO: 410175 - RNA, 32 nt, Human
cuuacaguuuauuagcccuugauuucagcuga

SEQ ID NO: 410176 - RNA, 32 nt, Human
cuuacaguuuccauugccaacaacagccaucc

SEQ ID NO: 410177 - RNA, 32 nt, Human
cuuacauagacuuccugaaugugucuucuuca

SEQ ID NO: 410178 - RNA, 32 nt, Human
cuuacaucaccgccacuacugcagcucagugc

SEQ ID NO: 410179 - RNA, 32 nt, Human
cuuacauccccucccuucccccuccucguucc

SEQ ID NO: 410180 - RNA, 32 nt, Human
cuuacaucuaaauuuuguuucuguuaccuaaa

SEQ ID NO: 410181 - RNA, 32 nt, Human
cuuacaucuguaaucccagcacuuugggaggc

SEQ ID NO: 410182 - RNA, 32 nt, Human
cuuacaugagauucucauuuguaggaggaugu

SEQ ID NO: 410183 - RNA, 32 nt, Human
cuuacaugagggugaggaaggagaagcccagc

SEQ ID NO: 410184 - RNA, 31 nt, Human
cuuacauggacuucuuugccuuuuaaagugu

SEQ ID NO: 410185 - RNA, 32 nt, Human
cuuacaugggaucaaauacuugagauuaguac

SEQ ID NO: 410186 - RNA, 32 nt, Human
cuuacaugucaucuuaacaucucuuugaggaa

SEQ ID NO: 410187 - RNA, 32 nt, Human
cuuacauguucccaaaacaaugguguggugaa

SEQ ID NO: 410188 - RNA, 32 nt, Human
cuuacauucuucauguggauguggccaguguc

SEQ ID NO: 410189 - RNA, 32 nt, Human
cuuacauuucccuuggaggguucagagauuaa

SEQ ID NO: 410190 - RNA, 24 nt, Human
cuuacauuuugauuccccccuccc

SEQ ID NO: 410191 - RNA, 32 nt, Human
cuuaccaacaugaugaaaccaucucuucuaaa

SEQ ID NO: 410192 - RNA, 32 nt, Human
cuuaccaacauggagaaaccccaucucuacua

SEQ ID NO: 410193 - RNA, 32 nt, Human
cuuaccaaggggaauguuugccucugccucug

SEQ ID NO: 410194 - RNA, 32 nt, Human
cuuaccaauuuccaaguagaaauuauccauua

SEQ ID NO: 410195 - RNA, 32 nt, Human
cuuaccacacacccuuccugcugcuccucuuc

SEQ ID NO: 410196 - RNA, 32 nt, Human
cuuaccacacauauacauagagaggacugcac

SEQ ID NO: 410197 - RNA, 32 nt, Human
cuuaccacuaaacuguugugcauggugcuuuu

SEQ ID NO: 410198 - RNA, 32 nt, Human
cuuaccacuguuaaaacaacaaaaagacuaaa

SEQ ID NO: 410199 - RNA, 32 nt, Human
cuuaccagagcugaaaaugaaaaagagaacag

SEQ ID NO: 410200 - RNA, 32 nt, Human
cuuaccagaggcauuacugagcuaaaucuuuc

SEQ ID NO: 410201 - RNA, 32 nt, Human
cuuaccagauugccaggacuaagccaucccaa

SEQ ID NO: 410202 - RNA, 32 nt, Human
cuuaccagcccauagccuaccagccugcccuc

SEQ ID NO: 410203 - RNA, 32 nt, Human
cuuaccaggccgcggcuaccccgccguccccc

SEQ ID NO: 410204 - RNA, 32 nt, Human
cuuaccaggcuuuuugucucaguguguucagg

SEQ ID NO: 410205 - RNA, 31 nt, Human
cuuaccauggaaaauuccgagaagacugaag

SEQ ID NO: 410206 - RNA, 32 nt, Human
cuuaccauuuugcuagggugugcaaugcccac

SEQ ID NO: 410207 - RNA, 23 nt, Human
cuuacccaagcuggagugcagug

SEQ ID NO: 410208 - RNA, 32 nt, Human
cuuacccacgaggcuuugcgguggcuguuggc

SEQ ID NO: 410209 - RNA, 32 nt, Human
cuuacccacugccugcccagacuuucuaucca

SEQ ID NO: 410210 - RNA, 23 nt, Human
cuuacccaggcugagugcagugg

SEQ ID NO: 410211 - RNA, 32 nt, Human
cuuacccaugaucuaugauuccaucugaaggg

SEQ ID NO: 410212 - RNA, 32 nt, Human
cuuacccauuacuuggauauuugcuacgaucc

SEQ ID NO: 410213 - RNA, 32 nt, Human
cuuaccccaccccacgcuccagccugacccuc

SEQ ID NO: 410214 - RNA, 32 nt, Human
cuuaccccaccccucagcucagccugguaugg

SEQ ID NO: 410215 - RNA, 32 nt, Human
cuuaccccaguucccaaacacaggaagugauu

SEQ ID NO: 410216 - RNA, 32 nt, Human
cuuacccccagccaccaccugccccgccucgu

SEQ ID NO: 410217 - RNA, 32 nt, Human
cuuaccccucugccccuagccuaggaguguga

SEQ ID NO: 410218 - RNA, 32 nt, Human
cuuaccccugcuggcccuugcaaggcgcgacc

SEQ ID NO: 410219 - RNA, 32 nt, Human
cuuaccccuguaaucccagcacuuugggaggc

SEQ ID NO: 410220 - RNA, 32 nt, Human
cuuacccugccucuguguuucggugagagucu

SEQ ID NO: 410221 - RNA, 32 nt, Human
cuuacccugccuuccugccuccagagucugag

SEQ ID NO: 410222 - RNA, 32 nt, Human
cuuacccugggcuggagaguugguuucagguu

SEQ ID NO: 410223 - RNA, 32 nt, Human
cuuacccuggggugggaacccaggagguggag

SEQ ID NO: 410224 - RNA, 32 nt, Human
cuuacccugucugagccuuacugucuucagug

SEQ ID NO: 410225 - RNA, 32 nt, Human
cuuacccugugccuggccagcgugaugugcag

SEQ ID NO: 410226 - RNA, 32 nt, Human
cuuacccuguucuggaaucgcugccagacugu

SEQ ID NO: 410227 - RNA, 32 nt, Human
cuuacccuuuuggagcuugaagcauaaggaag

SEQ ID NO: 410228 - RNA, 32 nt, Human
cuuaccgaaggggccacccucuggccuccugc

SEQ ID NO: 410229 - RNA, 32 nt, Human
cuuaccuaaaaagguuuagcaauuuggggaua

SEQ ID NO: 410230 - RNA, 32 nt, Human
cuuaccuaaauguuaaccaagcagaggugaca

SEQ ID NO: 410231 - RNA, 32 nt, Human
cuuaccuacaauaacuuuuauuuuggaauuga

SEQ ID NO: 410232 - RNA, 32 nt, Human
cuuaccuacaauauucauuucaaacugcuaaa

SEQ ID NO: 410233 - RNA, 32 nt, Human
cuuaccuauuuccucagauccccagcuuucuc

SEQ ID NO: 410234 - RNA, 32 nt, Human
cuuaccucacauaagccauuugcccacugugc

SEQ ID NO: 410235 - RNA, 32 nt, Human
cuuaccucaccucccuccauuuacauuagggc

SEQ ID NO: 410236 - RNA, 32 nt, Human
cuuaccucagcagcuuccauggcaggcuuguu

SEQ ID NO: 410237 - RNA, 32 nt, Human
cuuaccucauucuuacuauccaaaagccaccu

SEQ ID NO: 410238 - RNA, 32 nt, Human
cuuaccucauuuuucucccaggccuaggagcu

SEQ ID NO: 410239 - RNA, 32 nt, Human
cuuaccucccaaauugcuuuauuguauuaacu

SEQ ID NO: 410240 - RNA, 32 nt, Human
cuuaccucucugacaguuacagugaucuuugu

SEQ ID NO: 410241 - RNA, 32 nt, Human
cuuaccucugccaagagccuccagaugugccu

SEQ ID NO: 410242 - RNA, 32 nt, Human
cuuaccucuucacaacacuugugugcaaagau

SEQ ID NO: 410243 - RNA, 32 nt, Human
cuuaccugacacaagaggaauaagaauggagc

SEQ ID NO: 410244 - RNA, 32 nt, Human
cuuaccugccuguauuugugccccauuuuuaa

SEQ ID NO: 410245 - RNA, 32 nt, Human
cuuaccugcugugcccaccugcucucugucuc

SEQ ID NO: 410246 - RNA, 32 nt, Human
cuuaccuggaggaagaaugugccuucaggcca

SEQ ID NO: 410247 - RNA, 32 nt, Human
cuuaccuggcccagcccugccucccucagcca

SEQ ID NO: 410248 - RNA, 32 nt, Human
cuuaccugggaggcagaggguguuaugggagg

SEQ ID NO: 410249 - RNA, 31 nt, Human
cuuaccuggguggacagcagugaaucuccac

SEQ ID NO: 410250 - RNA, 32 nt, Human
cuuaccuguaggacucaaagggagccaggacc

SEQ ID NO: 410251 - RNA, 32 nt, Human
cuuaccuguagucccagcuacuugggaagcag

SEQ ID NO: 410252 - RNA, 32 nt, Human
cuuaccugugaagcuugaggccacucaaguuc

SEQ ID NO: 410253 - RNA, 32 nt, Human
cuuaccugugcaggucuccugaugcaggucuc

SEQ ID NO: 410254 - RNA, 32 nt, Human
cuuaccuuaccgcuuggacucugguggcuccc

SEQ ID NO: 410255 - RNA, 32 nt, Human
cuuaccuuaccuccgucucauccuuaacucac

SEQ ID NO: 410256 - RNA, 22 nt, Human
cuuaccuucaguggcuagacag

SEQ ID NO: 410257 - RNA, 32 nt, Human
cuuaccuuccuuucucuuuccuaacuuaaaaa

SEQ ID NO: 410258 - RNA, 32 nt, Human
cuuaccuugaacugaaggccacuugaguuggg

SEQ ID NO: 410259 - RNA, 32 nt, Human
cuuaccuuucagacuucauuaaacuuaugacc

SEQ ID NO: 410260 - RNA, 32 nt, Human
cuuaccuuucaucauucauuccuuccuuuaga

SEQ ID NO: 410261 - RNA, 32 nt, Human
cuuacgacccucccugcagggcugggcuuuug

SEQ ID NO: 410262 - RNA, 32 nt, Human
cuuacgaggagacuuggucacugugaaggaga

SEQ ID NO: 410263 - RNA, 32 nt, Human
cuuacgcccaggcuggaaugaaguggcaugau

SEQ ID NO: 410264 - RNA, 32 nt, Human
cuuacgccuauaaucccagcacuuugggaggc

SEQ ID NO: 410265 - RNA, 32 nt, Human
cuuacgccuguaaucccaauacuuugggaggc

SEQ ID NO: 410266 - RNA, 32 nt, Human
cuuacgccuguaaucccagcacuuugagaggc

SEQ ID NO: 410267 - RNA, 32 nt, Human
cuuacgccuguaaucccagcacuuugggacgc

SEQ ID NO: 410268 - RNA, 32 nt, Human
cuuacgccuguaaucccagcacuuugggaggc

SEQ ID NO: 410269 - RNA, 32 nt, Human
cuuacgccuguaaucccagcgcuuugggaggc

SEQ ID NO: 410270 - RNA, 32 nt, Human
cuuacgccuguaaucccaggacuuugggaggc

SEQ ID NO: 410271 - RNA, 32 nt, Human
cuuacgccuguaauccuagcacuuugggaggc

SEQ ID NO: 410272 - RNA, 32 nt, Human
cuuacgccuguaaucucagcacuuugggaggc

SEQ ID NO: 410273 - RNA, 32 nt, Human
cuuacgccuguaauuccagcacuuugggaggc

SEQ ID NO: 410274 - RNA, 32 nt, Human
cuuacgccuguuaucccagcacuuugggaggu

SEQ ID NO: 410275 - RNA, 32 nt, Human
cuuacgcuuguagucccagcacuuugggaggc

SEQ ID NO: 410276 - RNA, 32 nt, Human
cuuacggacugcaaccuucaaauucagcugug

SEQ ID NO: 410277 - RNA, 32 nt, Human
cuuacggaguuucgcucuuauugcccagacua

SEQ ID NO: 410278 - RNA, 32 nt, Human
cuuacggcaauuuagguuucucauuuuucuuu

SEQ ID NO: 410279 - RNA, 32 nt, Human
cuuacgggagcuugguaaugcagguggugaag

SEQ ID NO: 410280 - RNA, 32 nt, Human
cuuacgggagggauggagggaggcaggcuggg

SEQ ID NO: 410281 - RNA, 32 nt, Human
cuuacgugcccccagcccacugccuccaaguc

SEQ ID NO: 410282 - RNA, 32 nt, Human
cuuacguggagagugcacugaccuguagguca

SEQ ID NO: 410283 - RNA, 32 nt, Human
cuuacguucaggcucuccugugcccagagaga

SEQ ID NO: 410284 - RNA, 31 nt, Human
cuuacguucuuucagcaugcuccuuaaaacc

SEQ ID NO: 410285 - RNA, 32 nt, Human
cuuacguuucucauagaugaucaagaguuggc

SEQ ID NO: 410286 - RNA, 32 nt, Human
cuuacuaaaaauacaaaaauuagccaggugug

SEQ ID NO: 410287 - RNA, 32 nt, Human
cuuacuaauagggauguuaaaaguaacaaaac

SEQ ID NO: 410288 - RNA, 32 nt, Human
cuuacuacugcacuccugcuuuugugggaaaa

SEQ ID NO: 410289 - RNA, 32 nt, Human
cuuacuauucaacaaacucucaguuggccccc

SEQ ID NO: 410290 - RNA, 32 nt, Human
cuuacucagcugaugucacagugcagacaucc

SEQ ID NO: 410291 - RNA, 32 nt, Human
cuuacucauccugucugguugcuauguuuaaa

SEQ ID NO: 410292 - RNA, 32 nt, Human
cuuacucaucuucuagccuuaugaccaggaac

SEQ ID NO: 410293 - RNA, 32 nt, Human
cuuacucauguguacacaacuagugagaaucc

SEQ ID NO: 410294 - RNA, 32 nt, Human
cuuacucauucuauaccagcagccagcauaca

SEQ ID NO: 410295 - RNA, 32 nt, Human
cuuacucauugcucucucaucuugccuccagu

SEQ ID NO: 410296 - RNA, 32 nt, Human
cuuacuccaaggcugggcucuacucccauguu

SEQ ID NO: 410297 - RNA, 32 nt, Human
cuuacuccacuucgcuucucugcuccagguuc

SEQ ID NO: 410298 - RNA, 32 nt, Human
cuuacucccagggcuguguaagaaaagucaua

SEQ ID NO: 410299 - RNA, 32 nt, Human
cuuacucccucguacaugcacaaauacacacu

SEQ ID NO: 410300 - RNA, 32 nt, Human
cuuacucccuuccaaucucuguucagugcaaa

SEQ ID NO: 410301 - RNA, 32 nt, Human
cuuacuccgcuccccucuuuucccucccucuc

SEQ ID NO: 410302 - RNA, 32 nt, Human
cuuacuccguagcccaggcuggagugcagugg

SEQ ID NO: 410303 - RNA, 32 nt, Human
cuuacuccguugcccaggcuggaguacaaugg

SEQ ID NO: 410304 - RNA, 21 nt, Human
cuuacuccuccucaaggaguc

SEQ ID NO: 410305 - RNA, 32 nt, Human
cuuacuccuuuuccucuauaaaaccaaaacuu

SEQ ID NO: 410306 - RNA, 32 nt, Human
cuuacucggauggccucccugccccucugcug

SEQ ID NO: 410307 - RNA, 32 nt, Human
cuuacucugcaccuccccacucucuucccauu

SEQ ID NO: 410308 - RNA, 32 nt, Human
cuuacucugcaggguuuaauguaggacaagca

SEQ ID NO: 410309 - RNA, 32 nt, Human
cuuacucugccacuaauuuauuuccuuguugc

SEQ ID NO: 410310 - RNA, 32 nt, Human
cuuacucugucacccaggcuagagugcaaugg

SEQ ID NO: 410311 - RNA, 32 nt, Human
cuuacucugucacccaggcuagagugcagugg

SEQ ID NO: 410312 - RNA, 32 nt, Human
cuuacucugucacccaggcuggagugcaaugg

SEQ ID NO: 410313 - RNA, 32 nt, Human
cuuacucugucacccaggcuggagugcagugg

SEQ ID NO: 410314 - RNA, 32 nt, Human
cuuacucugucacccaggcuguagugcagugg

SEQ ID NO: 410315 - RNA, 32 nt, Human
cuuacucugucgcccaggcuggacugcagugg

SEQ ID NO: 410316 - RNA, 32 nt, Human
cuuacucugucgcccaggcuggaguacaaugg

SEQ ID NO: 410317 - RNA, 32 nt, Human
cuuacucugucgcccaggcuggagugcaguga

SEQ ID NO: 410318 - RNA, 32 nt, Human
cuuacucugucgcccaggcuggagugcagugg

SEQ ID NO: 410319 - RNA, 32 nt, Human
cuuacucugucgcccaggcuggaguguagugg

SEQ ID NO: 410320 - RNA, 32 nt, Human
cuuacucugucucccaggcugcuggagugcag

SEQ ID NO: 410321 - RNA, 32 nt, Human
cuuacucuguugcccaggcuggagugcagggg

SEQ ID NO: 410322 - RNA, 32 nt, Human
cuuacucuguugcccaggcuggagugcagugg

SEQ ID NO: 410323 - RNA, 32 nt, Human
cuuacucuguugcccaggcuggaguguagugg

SEQ ID NO: 410324 - RNA, 32 nt, Human
cuuacucuguuucccaggcuggagugcacaaa

SEQ ID NO: 410325 - RNA, 32 nt, Human
cuuacucuuguuucuccuccgccgaggcacug

SEQ ID NO: 410326 - RNA, 32 nt, Human
cuuacucuuucaauuuuacuggcuccacuguu

SEQ ID NO: 410327 - RNA, 32 nt, Human
cuuacugaguccuaauuuccacuguggccaga

SEQ ID NO: 410328 - RNA, 32 nt, Human
cuuacugaucuuuguauauuacauacaugcuu

SEQ ID NO: 410329 - RNA, 28 nt, Human
cuuacugauuaaaaugucaauguaaucu

SEQ ID NO: 410330 - RNA, 32 nt, Human
cuuacugcaaccuccaccuccuggguucaagu

SEQ ID NO: 410331 - RNA, 32 nt, Human
cuuacugcaaccuccgccuccuggguucaagc

SEQ ID NO: 410332 - RNA, 32 nt, Human
cuuacugcaagcuccgccuccuggguucacgc

SEQ ID NO: 410333 - RNA, 32 nt, Human
cuuacugcaagcucugccuccuggguucaagc

SEQ ID NO: 410334 - RNA, 32 nt, Human
cuuacugcacccucaaccuccugggcucaagc

SEQ ID NO: 410335 - RNA, 32 nt, Human
cuuacugcagccucaaccuccugggcucaggu

SEQ ID NO: 410336 - RNA, 32 nt, Human
cuuacugcaggugggcacccacaugccuaagc

SEQ ID NO: 410337 - RNA, 32 nt, Human
cuuacugcauccaugauccuccugccucagcc

SEQ ID NO: 410338 - RNA, 32 nt, Human
cuuacugcccacagaaccuccagguuccucug

SEQ ID NO: 410339 - RNA, 32 nt, Human
cuuacugcccaggugacuugugcauugcuuua

SEQ ID NO: 410340 - RNA, 32 nt, Human
cuuacuggacuuggcccugccugaugccaagc

SEQ ID NO: 410341 - RNA, 32 nt, Human
cuuacugggauacagauuuuugcucagaaaug

SEQ ID NO: 410342 - RNA, 32 nt, Human
cuuacugggcucaggccacauaauuggacucu

SEQ ID NO: 410343 - RNA, 32 nt, Human
cuuacuggggaaaaggaugggagugggggcuc

SEQ ID NO: 410344 - RNA, 32 nt, Human
cuuacugggggccacgucccaccccucagaua

SEQ ID NO: 410345 - RNA, 21 nt, Human
cuuacuggguugacuggaaag

SEQ ID NO: 410346 - RNA, 32 nt, Human
cuuacuguccaggucacaugcccacaaaguca

SEQ ID NO: 410347 - RNA, 32 nt, Human
cuuacugugcuaguagauuuuaguagauauug

SEQ ID NO: 410348 - RNA, 32 nt, Human
cuuacugugguggugaccagugugcuucuuaa

SEQ ID NO: 410349 - RNA, 32 nt, Human
cuuacuguguguuugcuggagcuuucacucag

SEQ ID NO: 410350 - RNA, 32 nt, Human
cuuacuguuccugagcaugggagggaauagaa

SEQ ID NO: 410351 - RNA, 31 nt, Human
cuuacuguuucacguguaccugugucaucuu

SEQ ID NO: 410352 - RNA, 32 nt, Human
cuuacuuaaaaggcauuaaggaggcauuuacu

SEQ ID NO: 410353 - RNA, 32 nt, Human
cuuacuuaaaccagucccagacaccuagacac

SEQ ID NO: 410354 - RNA, 32 nt, Human
cuuacuuacucccauuuucccuucgauauaug

SEQ ID NO: 410355 - RNA, 32 nt, Human
cuuacuuagcuccuggcagagggugagugggg

SEQ ID NO: 410356 - RNA, 32 nt, Human
cuuacuuaggugugggggaagcaccauaacuu

SEQ ID NO: 410357 - RNA, 22 nt, Human
cuuacuuaguuuuucucuuccu

SEQ ID NO: 410358 - RNA, 32 nt, Human
cuuacuuaucucuguugcuuucugggguccua

SEQ ID NO: 410359 - RNA, 32 nt, Human
cuuacuucacaucuuggucuuccccuagaguu

SEQ ID NO: 410360 - RNA, 32 nt, Human
cuuacuuccgaguagccauauuucaaguguuc

SEQ ID NO: 410361 - RNA, 32 nt, Human
cuuacuuccucuugucccuuuucauaucuugg

SEQ ID NO: 410362 - RNA, 32 nt, Human
cuuacuucuccagcaacacucuucaguacaua

SEQ ID NO: 410363 - RNA, 32 nt, Human
cuuacuucuguuuuaaacuuuggguaccaaac

SEQ ID NO: 410364 - RNA, 32 nt, Human
cuuacuucuuuuucccccuccuccccuccuuu

SEQ ID NO: 410365 - RNA, 32 nt, Human
cuuacuugaaugaaagucugauauuugcugau

SEQ ID NO: 410366 - RNA, 32 nt, Human
cuuacuugaucauuugauggaaucuaggcuaa

SEQ ID NO: 410367 - RNA, 32 nt, Human
cuuacuugccaaggcaagaucuagagggaacc

SEQ ID NO: 410368 - RNA, 32 nt, Human
cuuacuuggcuccagcccuccagcugcagccc

SEQ ID NO: 410369 - RNA, 32 nt, Human
cuuacuugguugcugaacaucuugccaccucc

SEQ ID NO: 410370 - RNA, 32 nt, Human
cuuacuuuacccacuggaagcugcucagcccu

SEQ ID NO: 410371 - RNA, 32 nt, Human
cuuacuuugacccccaggcuggagugcagugg

SEQ ID NO: 410372 - RNA, 21 nt, Human
cuuacuuugaucuguuuguca

SEQ ID NO: 410373 - RNA, 32 nt, Human
cuuacuuuggacuagggguacauucuuacaaa

SEQ ID NO: 410374 - RNA, 32 nt, Human
cuuagaaaaagcuuuccugaaucccucugacg

SEQ ID NO: 410375 - RNA, 32 nt, Human
cuuagaaaacaacagcuauucuaagaaguguc

SEQ ID NO: 410376 - RNA, 32 nt, Human
cuuagaaaaccagcucagcacugccugcuccc

SEQ ID NO: 410377 - RNA, 32 nt, Human
cuuagaaaagccccagcauggccgggcauggu

SEQ ID NO: 410378 - RNA, 32 nt, Human
cuuagaaaagugcaagaagacaggcaugucuu

SEQ ID NO: 410379 - RNA, 32 nt, Human
cuuagaaauacaucugcuuguuuauugagaaa

SEQ ID NO: 410380 - RNA, 32 nt, Human
cuuagaaauuccaggaacacaauuaggauauu

SEQ ID NO: 410381 - RNA, 32 nt, Human
cuuagaacacaaacagaauauugcaaaugcau

SEQ ID NO: 410382 - RNA, 32 nt, Human
cuuagaaccaacaacauuugaagauuuugcag

SEQ ID NO: 410383 - RNA, 32 nt, Human
cuuagaaccugaccagauguggcucggagggg

SEQ ID NO: 410384 - RNA, 32 nt, Human
cuuagaaccuggacagcccgacugccucaacu

SEQ ID NO: 410385 - RNA, 32 nt, Human
cuuagaacgguaagaaaccaugagcacucaca

SEQ ID NO: 410386 - RNA, 32 nt, Human
cuuagaagaagaaagaaagagggaaagagaaa

SEQ ID NO: 410387 - RNA, 32 nt, Human
cuuagaagagugaggccagggaagguggggcg

SEQ ID NO: 410388 - RNA, 32 nt, Human
cuuagaagcacauguacauacauggaccucau

SEQ ID NO: 410389 - RNA, 20 nt, Human
cuuagaagccggaggaaaau

SEQ ID NO: 410390 - RNA, 32 nt, Human
cuuagaagccuccccugacuucacugugcuuc

SEQ ID NO: 410391 - RNA, 32 nt, Human
cuuagaagcugcuaucuugacugagguuuuaa

SEQ ID NO: 410392 - RNA, 32 nt, Human
cuuagaaggagaaagacagagacacaucaggg

SEQ ID NO: 410393 - RNA, 32 nt, Human
cuuagaaggggaugagucagauuuuuacagag

SEQ ID NO: 410394 - RNA, 23 nt, Human
cuuagaauacaucaaagaauuca

SEQ ID NO: 410395 - RNA, 32 nt, Human
cuuagaaugccacagucccccaacccuccaca

SEQ ID NO: 410396 - RNA, 32 nt, Human
cuuagaauuccccucuggagggcuauggccuc

SEQ ID NO: 410397 - RNA, 32 nt, Human
cuuagaauucuucugagugaaguaugagaaaa

SEQ ID NO: 410398 - RNA, 32 nt, Human
cuuagaauucuuuauugguggcccuacuaugg

SEQ ID NO: 410399 - RNA, 32 nt, Human
cuuagacacacagcuggcaagcagcggaaagg

SEQ ID NO: 410400 - RNA, 32 nt, Human
cuuagacacuuugagcaagauuguggcaguuu

SEQ ID NO: 410401 - RNA, 32 nt, Human
cuuagacagcacaacauacccacucggauauc

SEQ ID NO: 410402 - RNA, 20 nt, Human
cuuagacagccccaggguga

SEQ ID NO: 410403 - RNA, 32 nt, Human
cuuagacauaucucucauuuuucauuuuguug

SEQ ID NO: 410404 - RNA, 32 nt, Human
cuuagacauuagugagaaagaaaaagaucgcu

SEQ ID NO: 410405 - RNA, 32 nt, Human
cuuagacauucagagggugaaccaccaucccu

SEQ ID NO: 410406 - RNA, 32 nt, Human
cuuagaccacccagacuagucaaguaucuucu

SEQ ID NO: 410407 - RNA, 32 nt, Human
cuuagaccagcuccugaguucucucucuuucu

SEQ ID NO: 410408 - RNA, 32 nt, Human
cuuagaccagcuucccuucccuucuggggcug

SEQ ID NO: 410409 - RNA, 32 nt, Human
cuuagacccgggaggcagagguugcagugagc

SEQ ID NO: 410410 - RNA, 32 nt, Human
cuuagacgggaggcuguguccgugggugugca

SEQ ID NO: 410411 - RNA, 32 nt, Human
cuuagacuugacuucugugaguuuagaccugc

SEQ ID NO: 410412 - RNA, 32 nt, Human
cuuagagauggaauguaacuuugcuuacaaaa

SEQ ID NO: 410413 - RNA, 32 nt, Human
cuuagagaugggcugaaaguuaaguccaccaa

SEQ ID NO: 410414 - RNA, 32 nt, Human
cuuagagcaguuucguuuucucaguuggaugc

SEQ ID NO: 410415 - RNA, 32 nt, Human
cuuagagccugaguugcuccacaggaauccag

SEQ ID NO: 410416 - RNA, 32 nt, Human
cuuagagccugcuauucuuuuagacauaggga

SEQ ID NO: 410417 - RNA, 32 nt, Human
cuuagaggacaguguuggccuuuggagucggg

SEQ ID NO: 410418 - RNA, 32 nt, Human
cuuagaggccagccuuggacacuugcugcccc

SEQ ID NO: 410419 - RNA, 32 nt, Human
cuuagaggcugcagcacuucauuuuucaguua

SEQ ID NO: 410420 - RNA, 32 nt, Human
cuuagagggagcuguguuuuggugaccucuga

SEQ ID NO: 410421 - RNA, 32 nt, Human
cuuagagguaagaaauagaauuauaauguuac

SEQ ID NO: 410422 - RNA, 32 nt, Human
cuuagaggucgaggcaggcggaucacuugagg

SEQ ID NO: 410423 - RNA, 32 nt, Human
cuuagagucugcagcccagagccacaugcaaa

SEQ ID NO: 410424 - RNA, 32 nt, Human
cuuagaguuaaaggagggggugcuggccaaga

SEQ ID NO: 410425 - RNA, 32 nt, Human
cuuagaguugucuaaguugggugcaaauuuuc

SEQ ID NO: 410426 - RNA, 32 nt, Human
cuuagauaguacagugaguugugacccuccaa

SEQ ID NO: 410427 - RNA, 32 nt, Human
cuuagauaugacacuaaaggcauaauucauua

SEQ ID NO: 410428 - RNA, 32 nt, Human
cuuagauauuggcacacacaaggaacaacugu

SEQ ID NO: 410429 - RNA, 32 nt, Human
cuuagaucauagauuggaccugguuuuguuuu

SEQ ID NO: 410430 - RNA, 32 nt, Human
cuuagaucaugccaccaugccacugcacucca

SEQ ID NO: 410431 - RNA, 32 nt, Human
cuuagaugcauucagugggacagcuuugcugg

SEQ ID NO: 410432 - RNA, 32 nt, Human
cuuagauggaaauguaucuuaugaauagagac

SEQ ID NO: 410433 - RNA, 32 nt, Human
cuuagaugugaugauggauguacaacugcgug

SEQ ID NO: 410434 - RNA, 32 nt, Human
cuuagauguuuucuugcuguuccuugucucuu

SEQ ID NO: 410435 - RNA, 32 nt, Human
cuuagauucccaggaacugggaaaugcaguca

SEQ ID NO: 410436 - RNA, 32 nt, Human
cuuagcaaaugugccauuuucacacaacuucu

SEQ ID NO: 410437 - RNA, 32 nt, Human
cuuagcaaccacagagucagugaccucgucug

SEQ ID NO: 410438 - RNA, 32 nt, Human
cuuagcaagucuugccuuaucuauggagcucg

SEQ ID NO: 410439 - RNA, 32 nt, Human
cuuagcaauaaaugcuuuucuaaugccuuuug

SEQ ID NO: 410440 - RNA, 32 nt, Human
cuuagcacaagaaaccagaucuccucucuccu

SEQ ID NO: 410441 - RNA, 32 nt, Human
cuuagcacaucacugcacacacaguauucuga

SEQ ID NO: 410442 - RNA, 32 nt, Human
cuuagcacaugccucgcguucuucccagaaag

SEQ ID NO: 410443 - RNA, 32 nt, Human
cuuagcaccagcugucccaccuccaggguccu

SEQ ID NO: 410444 - RNA, 31 nt, Human
cuuagcacuuagcacugccuaccucaucaug

SEQ ID NO: 410445 - RNA, 31 nt, Human
cuuagcagaaacuucuuuucauucuuccaaa

SEQ ID NO: 410446 - RNA, 32 nt, Human
cuuagcagccaagaacagcaugucacccagaa

SEQ ID NO: 410447 - RNA, 32 nt, Human
cuuagcagccccgcagcuggugcucugccccg

SEQ ID NO: 410448 - RNA, 32 nt, Human
cuuagcaggagcagauuuuucccagaagcugc

SEQ ID NO: 410449 - RNA, 32 nt, Human
cuuagcaggucuaccagccacagucucugcac

SEQ ID NO: 410450 - RNA, 32 nt, Human
cuuagcauugggaagacagagggcaaggaggc

SEQ ID NO: 410451 - RNA, 32 nt, Human
cuuagccaaggccacaucugggaagaguggag

SEQ ID NO: 410452 - RNA, 32 nt, Human
cuuagccaaucaccaccucauugggugaaagu

SEQ ID NO: 410453 - RNA, 32 nt, Human
cuuagccacaugggaggugcucaguaaaggag

SEQ ID NO: 410454 - RNA, 32 nt, Human
cuuagccaccucuacacauucuaggcuuucug

SEQ ID NO: 410455 - RNA, 32 nt, Human
cuuagccacguguauguauucuuuuugaaaaa

SEQ ID NO: 410456 - RNA, 32 nt, Human
cuuagccagcugggacaggagugggugagggg

SEQ ID NO: 410457 - RNA, 32 nt, Human
cuuagccaggaggccgaggucccucaguccuc

SEQ ID NO: 410458 - RNA, 32 nt, Human
cuuagccaguaaucugcccaugaugaucccug

SEQ ID NO: 410459 - RNA, 32 nt, Human
cuuagccaugugaagguggauuggucgccauc

SEQ ID NO: 410460 - RNA, 32 nt, Human
cuuagcccagcucagggguggggaagaggcga

SEQ ID NO: 410461 - RNA, 32 nt, Human
cuuagcccagcugaccccagacccucuccccu

SEQ ID NO: 410462 - RNA, 32 nt, Human
cuuagcccaguggaccuguggcuucucugagg

SEQ ID NO: 410463 - RNA, 32 nt, Human
cuuagccccagggcacucagaaacccgggcgc

SEQ ID NO: 410464 - RNA, 32 nt, Human
cuuagccccucagaacagggagucccaggacc

SEQ ID NO: 410465 - RNA, 18 nt, Human
cuuagcccgccgcugccg

SEQ ID NO: 410466 - RNA, 32 nt, Human
cuuagcccugagccugcacuuccuguucaggu

SEQ ID NO: 410467 - RNA, 32 nt, Human
cuuagcccugcucacccuagaccuaugcgcuu

SEQ ID NO: 410468 - RNA, 32 nt, Human
cuuagcccuuguaauccuagcacuuugggagg

SEQ ID NO: 410469 - RNA, 32 nt, Human
cuuagccguccaggcuagagugcaguagugcg

SEQ ID NO: 410470 - RNA, 32 nt, Human
cuuagccuccacccuccuccugccacccuugu

SEQ ID NO: 410471 - RNA, 20 nt, Human
cuuagccuccccaacuccca

SEQ ID NO: 410472 - RNA, 32 nt, Human
cuuagccuccuaaagugcugggauuauaggca

SEQ ID NO: 410473 - RNA, 32 nt, Human
cuuagccugcacuccaaccuggcaauuuugcc

SEQ ID NO: 410474 - RNA, 32 nt, Human
cuuagccugccuuagccagggcucagagauga

SEQ ID NO: 410475 - RNA, 32 nt, Human
cuuagccugcugcuacccacugcugaaacucc

SEQ ID NO: 410476 - RNA, 32 nt, Human
cuuagccuggaugcccaccccugcugccgcca

SEQ ID NO: 410477 - RNA, 32 nt, Human
cuuagccugggaacuggcaaugggggagacau

SEQ ID NO: 410478 - RNA, 31 nt, Human
cuuagccugggcgacagagcgagaccacauc

SEQ ID NO: 410479 - RNA, 24 nt, Human
cuuagccugggugacagagugaga

SEQ ID NO: 410480 - RNA, 32 nt, Human
cuuagccugggugacagagugagacccuaucu

SEQ ID NO: 410481 - RNA, 32 nt, Human
cuuagccugguggcaguggugagggagugagg

SEQ ID NO: 410482 - RNA, 32 nt, Human
cuuagccugucaggagcagggagcuugcgggg

SEQ ID NO: 410483 - RNA, 32 nt, Human
cuuagcgagaucugguuguuuaaaagugugua

SEQ ID NO: 410484 - RNA, 32 nt, Human
cuuagcgccacacccauuuaaaugcacaagca

SEQ ID NO: 410485 - RNA, 32 nt, Human
cuuagcuaaucagauugaaggaagacaugugu

SEQ ID NO: 410486 - RNA, 32 nt, Human
cuuagcuacugaggcauagggagaggaaguua

SEQ ID NO: 410487 - RNA, 24 nt, Human
cuuagcucaccgcaaccuccaccu

SEQ ID NO: 410488 - RNA, 32 nt, Human
cuuagcucacuacaaccucugccucccagguu

SEQ ID NO: 410489 - RNA, 32 nt, Human
cuuagcucacuacaacuucugccucccaggcu

SEQ ID NO: 410490 - RNA, 32 nt, Human
cuuagcucacugcaacccccgccucccggguu

SEQ ID NO: 410491 - RNA, 32 nt, Human
cuuagcucacugcaaccuccaccucccagguu

SEQ ID NO: 410492 - RNA, 32 nt, Human
cuuagcucacugcaaccuccaccucccggguu

SEQ ID NO: 410493 - RNA, 32 nt, Human
cuuagcucacugcaaccuccgccuccuggguu

SEQ ID NO: 410494 - RNA, 32 nt, Human
cuuagcucacugcaaccucugcuuccuggguu

SEQ ID NO: 410495 - RNA, 32 nt, Human
cuuagcucacugcaagcuccgccucccagguu

SEQ ID NO: 410496 - RNA, 32 nt, Human
cuuagcucacugcagccuccaccucccaggcu

SEQ ID NO: 410497 - RNA, 32 nt, Human
cuuagcucagagaauaugggguccuuacuugu

SEQ ID NO: 410498 - RNA, 32 nt, Human
cuuagcucucugcaaccucugccucccagguu

SEQ ID NO: 410499 - RNA, 32 nt, Human
cuuagcucugcucucuaguggcuguccccaua

SEQ ID NO: 410500 - RNA, 32 nt, Human
cuuagcucuguggguaggaaggggcccuagaa

SEQ ID NO: 410501 - RNA, 16 nt, Human
cuuagcucuucuugga

SEQ ID NO: 410502 - RNA, 32 nt, Human
cuuagcugaaggccacaccaccagcgaagugc

SEQ ID NO: 410503 - RNA, 32 nt, Human
cuuagcugacucuggugcucucuacagguggc

SEQ ID NO: 410504 - RNA, 32 nt, Human
cuuagcugccaucuugcuuuucuuuggacaac

SEQ ID NO: 410505 - RNA, 19 nt, Human
cuuagcuggagugcggugg

SEQ ID NO: 410506 - RNA, 32 nt, Human
cuuagcuggcccguugguuuucugagcagggg

SEQ ID NO: 410507 - RNA, 29 nt, Human
cuuagcuggcugccaugucuccugccugu

SEQ ID NO: 410508 - RNA, 32 nt, Human
cuuagcugggagaaagagagagcuucuguugc

SEQ ID NO: 410509 - RNA, 32 nt, Human
cuuagcugggcuguaaagaugaaggcaucaaa

SEQ ID NO: 410510 - RNA, 18 nt, Human
cuuagcugggugcagugg

SEQ ID NO: 410511 - RNA, 32 nt, Human
cuuagcugggugugguggugugaucuguaguu

SEQ ID NO: 410512 - RNA, 32 nt, Human
cuuagcugguuugggagcuuugcuuuccaagu

SEQ ID NO: 410513 - RNA, 32 nt, Human
cuuagcugugugacugauuauaggcaaguucu

SEQ ID NO: 410514 - RNA, 32 nt, Human
cuuagcuugggugucccugaaagcagagcuug

SEQ ID NO: 410515 - RNA, 32 nt, Human
cuuagcuuucugucugugaaugucuauauagu

SEQ ID NO: 410516 - RNA, 32 nt, Human
cuuagcuuuggcgcccuggacccacuuucucu

SEQ ID NO: 410517 - RNA, 32 nt, Human
cuuagcuuugguacugacaguuuucuuuugcc

SEQ ID NO: 410518 - RNA, 32 nt, Human
cuuagcuuuucugaauucugcaguauuuucua

SEQ ID NO: 410519 - RNA, 32 nt, Human
cuuaggaaacugaauguaacaaaaacccagga

SEQ ID NO: 410520 - RNA, 32 nt, Human
cuuaggaaaggaguuagggucucagugccucc

SEQ ID NO: 410521 - RNA, 32 nt, Human
cuuaggaacuucuucacugaacucaaggagga

SEQ ID NO: 410522 - RNA, 32 nt, Human
cuuaggaagaccgaggugggcagaucacuuga

SEQ ID NO: 410523 - RNA, 32 nt, Human
cuuaggaagcaguccuugagaaggcauguucc

SEQ ID NO: 410524 - RNA, 32 nt, Human
cuuaggaccccgcagggcggguuuccaggccu

SEQ ID NO: 410525 - RNA, 32 nt, Human
cuuaggacccuccgugaacagaugauagaggg

SEQ ID NO: 410526 - RNA, 32 nt, Human
cuuaggacgccaaugaaaaggaagagaaaaua

SEQ ID NO: 410527 - RNA, 32 nt, Human
cuuaggagcucucacaggauguguucagcaua

SEQ ID NO: 410528 - RNA, 32 nt, Human
cuuaggagcuuuucacacauuucuuucaaaug

SEQ ID NO: 410529 - RNA, 32 nt, Human
cuuaggaggggguggccuugaggcagagccgu

SEQ ID NO: 410530 - RNA, 32 nt, Human
cuuaggagggguaaugguggaguuggcaucuu

SEQ ID NO: 410531 - RNA, 24 nt, Human
cuuaggagguugaggcugcaguga

SEQ ID NO: 410532 - RNA, 32 nt, Human
cuuaggagguugaggcugcagugagcugugcu

SEQ ID NO: 410533 - RNA, 32 nt, Human
cuuaggagguugaggcugggaggaucacuuga

SEQ ID NO: 410534 - RNA, 32 nt, Human
cuuaggagucuugggucggaggacggggcuag

SEQ ID NO: 410535 - RNA, 31 nt, Human
cuuaggauauucuaauugcauuuaaaagaac

SEQ ID NO: 410536 - RNA, 32 nt, Human
cuuaggcaacauagcaagaccccaucucaaaa

SEQ ID NO: 410537 - RNA, 32 nt, Human
cuuaggcaccuugcacaggccuucucguuuau

SEQ ID NO: 410538 - RNA, 32 nt, Human
cuuaggcagcaaccuccacauucccacaggcc

SEQ ID NO: 410539 - RNA, 32 nt, Human
cuuaggcaguucagagagaacaauucuaauaa

SEQ ID NO: 410540 - RNA, 32 nt, Human
cuuaggcauagccauaggugaggacuucucua

SEQ ID NO: 410541 - RNA, 32 nt, Human
cuuaggcauucuaagucacaggaugagacagg

SEQ ID NO: 410542 - RNA, 32 nt, Human
cuuaggcauucuaucuuugcucaaauuguuga

SEQ ID NO: 410543 - RNA, 32 nt, Human
cuuaggcauuggggaguuuuagauggacuaau

SEQ ID NO: 410544 - RNA, 32 nt, Human
cuuaggcauuuuccuguguggcggaauaagaa

SEQ ID NO: 410545 - RNA, 32 nt, Human
cuuaggccccugucauucccacccucacucuu

SEQ ID NO: 410546 - RNA, 32 nt, Human
cuuaggccucccaacuucuccccaggccaagu

SEQ ID NO: 410547 - RNA, 32 nt, Human
cuuaggccugcucuuuacuagggaucuuaugu

SEQ ID NO: 410548 - RNA, 32 nt, Human
cuuaggcgccucuuugggaaaggaaaguggau

SEQ ID NO: 410549 - RNA, 32 nt, Human
cuuaggcuaggaauucaagaccagccuggcca

SEQ ID NO: 410550 - RNA, 32 nt, Human
cuuaggcuccacugcccucacaccucuaggcc

SEQ ID NO: 410551 - RNA, 32 nt, Human
cuuaggcugcagcuugccacuccugggcuggg

SEQ ID NO: 410552 - RNA, 32 nt, Human
cuuaggcuggacacuucucucccucauccguu

SEQ ID NO: 410553 - RNA, 20 nt, Human
cuuaggcuggagugcagugg

SEQ ID NO: 410554 - RNA, 32 nt, Human
cuuaggcuggccagacuucagcuguuccuuug

SEQ ID NO: 410555 - RNA, 32 nt, Human
cuuaggcuggggucccugaggguggggcugug

SEQ ID NO: 410556 - RNA, 31 nt, Human
cuuaggcuuauacaucuacauuuaaaagcau

SEQ ID NO: 410557 - RNA, 22 nt, Human
cuuaggcuuccuucucauuucc

SEQ ID NO: 410558 - RNA, 32 nt, Human
cuuaggcuugaaaggugaagagcaggaauucu

SEQ ID NO: 410559 - RNA, 20 nt, Human
cuuaggcuuugauugcugaa

SEQ ID NO: 410560 - RNA, 32 nt, Human
cuuagggaaauguuagguucagaacuaaagug

SEQ ID NO: 410561 - RNA, 32 nt, Human
cuuagggacagaauuaccccagccucuugagc

SEQ ID NO: 410562 - RNA, 32 nt, Human
cuuagggagcuuccccagcccuaaaggcaccg

SEQ ID NO: 410563 - RNA, 32 nt, Human
cuuagggaggcagaguggaggaagugagagga

SEQ ID NO: 410564 - RNA, 32 nt, Human
cuuagggaggccaaggcgggcagaucaccuga

SEQ ID NO: 410565 - RNA, 32 nt, Human
cuuagggaggcuaagauaggaggaucacuuga

SEQ ID NO: 410566 - RNA, 32 nt, Human
cuuagggaggcugagccagguggagccacuug

SEQ ID NO: 410567 - RNA, 32 nt, Human
cuuagggaggcugaggugggcagaucaccuga

SEQ ID NO: 410568 - RNA, 32 nt, Human
cuuagggaggcugggggaaaagguuagauuuu

SEQ ID NO: 410569 - RNA, 32 nt, Human
cuuagggagggagggaggacauggacagggcc

SEQ ID NO: 410570 - RNA, 19 nt, Human
cuuagggauccacaugcca

SEQ ID NO: 410571 - RNA, 32 nt, Human
cuuagggaugguuccuggaaguggacacauuu

SEQ ID NO: 410572 - RNA, 32 nt, Human
cuuagggcacaagccuuagcaaaugauugauu

SEQ ID NO: 410573 - RNA, 32 nt, Human
cuuagggcaguggaugccgccuuugcuucugu

SEQ ID NO: 410574 - RNA, 32 nt, Human
cuuagggcaucaggaacagugcuacuuacugg

SEQ ID NO: 410575 - RNA, 32 nt, Human
cuuagggccagauuccccucucuaguccccuu

SEQ ID NO: 410576 - RNA, 32 nt, Human
cuuagggcccugggugggcaagucugggcccu

SEQ ID NO: 410577 - RNA, 32 nt, Human
cuuagggccugcuguggaggcagcggcggacg

SEQ ID NO: 410578 - RNA, 32 nt, Human
cuuaggggaaaaggaaccaaauuugggauggu

SEQ ID NO: 410579 - RNA, 32 nt, Human
cuuaggggaggaagaauugucauagagggaag

SEQ ID NO: 410580 - RNA, 32 nt, Human
cuuaggggcagaaacaauccguucacuauuua

SEQ ID NO: 410581 - RNA, 32 nt, Human
cuuaggggugaugaggaagugggagcucaggg

SEQ ID NO: 410582 - RNA, 32 nt, Human
cuuagggguuggagguggcagauaaaagagga

SEQ ID NO: 410583 - RNA, 32 nt, Human
cuuaggguaggggaagugugcugaggugggcc

SEQ ID NO: 410584 - RNA, 32 nt, Human
cuuagggucugucuugcauguauuacaaccag

SEQ ID NO: 410585 - RNA, 32 nt, Human
cuuagggugaaaggaaggcagcuuguauugag

SEQ ID NO: 410586 - RNA, 32 nt, Human
cuuaggguggcugaggcaggcagaucaccugg

SEQ ID NO: 410587 - RNA, 32 nt, Human
cuuaggguguccuccccacagagcagauacuu

SEQ ID NO: 410588 - RNA, 32 nt, Human
cuuagguaaagaagagaaagagaaagcaaauu

SEQ ID NO: 410589 - RNA, 25 nt, Human
cuuagguaaggaauggaaccuuucc

SEQ ID NO: 410590 - RNA, 32 nt, Human
cuuagguacaucuucuuuguauccauugggag

SEQ ID NO: 410591 - RNA, 32 nt, Human
cuuagguaggagugaugccacuuuaaaaggag

SEQ ID NO: 410592 - RNA, 31 nt, Human
cuuagguaguuucaggcuuccagcccagccc

SEQ ID NO: 410593 - RNA, 32 nt, Human
cuuaggucacgaguuugagaccagccugacca

SEQ ID NO: 410594 - RNA, 20 nt, Human
cuuaggucaggaguucgaga

SEQ ID NO: 410595 - RNA, 32 nt, Human
cuuaggucaggaguucgagaccagccuggcca

SEQ ID NO: 410596 - RNA, 32 nt, Human
cuuaggucaggaguuugagaccagccugacca

SEQ ID NO: 410597 - RNA, 32 nt, Human
cuuaggucaggaguuugagaccagccuggcca

SEQ ID NO: 410598 - RNA, 32 nt, Human
cuuagguccagccuguucacacugcaccucag

SEQ ID NO: 410599 - RNA, 32 nt, Human
cuuagguccuuugaccgagguccugcaggugg

SEQ ID NO: 410600 - RNA, 32 nt, Human
cuuaggucucacucaaggggugaugacgggag

SEQ ID NO: 410601 - RNA, 32 nt, Human
cuuaggucuccuccucccgaacucuaaaccug

SEQ ID NO: 410602 - RNA, 32 nt, Human
cuuaggucuuccuguggcucccucucuccugg

SEQ ID NO: 410603 - RNA, 32 nt, Human
cuuaggugaguccuuugcaucucugaggcccu

SEQ ID NO: 410604 - RNA, 32 nt, Human
cuuaggugggcggggcuccugagggagcucca

SEQ ID NO: 410605 - RNA, 32 nt, Human
cuuagguguaauaguauuuaagacugaaagaa

SEQ ID NO: 410606 - RNA, 31 nt, Human
cuuagguguggcuucuuuauauuacugaaac

SEQ ID NO: 410607 - RNA, 32 nt, Human
cuuagguucugcucuguuucuuugccagguga

SEQ ID NO: 410608 - RNA, 32 nt, Human
cuuagguugggacuuaggugggccagaggggc

SEQ ID NO: 410609 - RNA, 32 nt, Human
cuuaguaaauugauacauccauuuuucuuaug

SEQ ID NO: 410610 - RNA, 32 nt, Human
cuuaguaauccaagacagcaaagugacauuaa

SEQ ID NO: 410611 - RNA, 32 nt, Human
cuuaguagaaaucucugaaggcagcagccauc

SEQ ID NO: 410612 - RNA, 32 nt, Human
cuuaguagccugggggauguccagagacuagg

SEQ ID NO: 410613 - RNA, 21 nt, Human
cuuaguagcugggauuacagg

SEQ ID NO: 410614 - RNA, 32 nt, Human
cuuaguaggcagggaaagugagggccucaggg

SEQ ID NO: 410615 - RNA, 32 nt, Human
cuuaguaucaacuggcuaacaauggugaccca

SEQ ID NO: 410616 - RNA, 32 nt, Human
cuuagucacaaaccccacauuauuccaguuug

SEQ ID NO: 410617 - RNA, 32 nt, Human
cuuagucacagagagaaauaagaggagguugu

SEQ ID NO: 410618 - RNA, 32 nt, Human
cuuagucacccagacuagaggucaguggcagg

SEQ ID NO: 410619 - RNA, 32 nt, Human
cuuagucaccccuccaugggccuggugcuaag

SEQ ID NO: 410620 - RNA, 32 nt, Human
cuuagucacugcaggcccaggcgggcaggugg

SEQ ID NO: 410621 - RNA, 32 nt, Human
cuuagucaguguuguguccuccacucaggcug

SEQ ID NO: 410622 - RNA, 32 nt, Human
cuuagucauaccauccaucccuggugaaagag

SEQ ID NO: 410623 - RNA, 32 nt, Human
cuuaguccucaagcucccaaccugcugucccu

SEQ ID NO: 410624 - RNA, 32 nt, Human
cuuaguccucaccucuuccuugucuuuuagau

SEQ ID NO: 410625 - RNA, 32 nt, Human
cuuaguccugcuccuuucaauuccauccugua

SEQ ID NO: 410626 - RNA, 32 nt, Human
cuuagucguuggaggcuggagcgcaauggccc

SEQ ID NO: 410627 - RNA, 32 nt, Human
cuuagucuacgagccaggaugacagggacagc

SEQ ID NO: 410628 - RNA, 32 nt, Human
cuuagucucugugcuccaagaggucaaauuuu

SEQ ID NO: 410629 - RNA, 32 nt, Human
cuuagucuucauuuccauucuucugcccauga

SEQ ID NO: 410630 - RNA, 32 nt, Human
cuuagugaaagcagauccuguacuaggaugug

SEQ ID NO: 410631 - RNA, 32 nt, Human
cuuagugagccagggaaccaggcuccagacca

SEQ ID NO: 410632 - RNA, 32 nt, Human
cuuagugccaggagggcacagcaggggagccc

SEQ ID NO: 410633 - RNA, 21 nt, Human
cuuagugccuuacccuguccu

SEQ ID NO: 410634 - RNA, 32 nt, Human
cuuagugcuaacgucaagaccaaaccuguagg

SEQ ID NO: 410635 - RNA, 32 nt, Human
cuuaguggcaggugccuguaaucccagcuacu

SEQ ID NO: 410636 - RNA, 32 nt, Human
cuuaguggcgggcgccuguaaucacagcuacu

SEQ ID NO: 410637 - RNA, 32 nt, Human
cuuagugggaaagugaggcagggucuugcaga

SEQ ID NO: 410638 - RNA, 32 nt, Human
cuuagugggaucauaauagcagucuucuugcu

SEQ ID NO: 410639 - RNA, 32 nt, Human
cuuagugggcacuucacagagggucauucccu

SEQ ID NO: 410640 - RNA, 32 nt, Human
cuuaguguaccaccccugccuugagcuugugg

SEQ ID NO: 410641 - RNA, 32 nt, Human
cuuagugugcaagaaaagccacugggggaaga

SEQ ID NO: 410642 - RNA, 32 nt, Human
cuuaguuaauggaagacugagagcagaacagg

SEQ ID NO: 410643 - RNA, 32 nt, Human
cuuaguucccccaagggccaguagauccuaaa

SEQ ID NO: 410644 - RNA, 32 nt, Human
cuuaguuggagagaggggugugggaggaagcu

SEQ ID NO: 410645 - RNA, 32 nt, Human
cuuaguuggcagggguucaguccaaauggaag

SEQ ID NO: 410646 - RNA, 32 nt, Human
cuuaguuguguuagagucuuccagcaugggac

SEQ ID NO: 410647 - RNA, 32 nt, Human
cuuaguuucacuguuugccagcacagaccuuu

SEQ ID NO: 410648 - RNA, 32 nt, Human
cuuaguuuccacugccuccugugacgugaggc

SEQ ID NO: 410649 - RNA, 32 nt, Human
cuuaguuucucagacuuguugucuauuaucug

SEQ ID NO: 410650 - RNA, 32 nt, Human
cuuaguuucuugggagcaacagcacguaucag

SEQ ID NO: 410651 - RNA, 32 nt, Human
cuuaguuugcucaaaagaguccugguuauucc

SEQ ID NO: 410652 - RNA, 32 nt, Human
cuuaguuuucauuuuauuguucugugucuugu

SEQ ID NO: 410653 - RNA, 32 nt, Human
cuuaguuuucccucucugucuucauaaugagc

SEQ ID NO: 410654 - RNA, 32 nt, Human
cuuauaaaaagagacacaagagcuugcucucu

SEQ ID NO: 410655 - RNA, 32 nt, Human
cuuauaaaaccagcucuggcauaugacuaaaa

SEQ ID NO: 410656 - RNA, 23 nt, Human
cuuauaaaagagacacaccacau

SEQ ID NO: 410657 - RNA, 32 nt, Human
cuuauaaccuaaaagucuccagucuggggcag

SEQ ID NO: 410658 - RNA, 32 nt, Human
cuuauaaccuguguguuuuccacagucccugc

SEQ ID NO: 410659 - RNA, 32 nt, Human
cuuauaacucacuugucuucauucauaauuuu

SEQ ID NO: 410660 - RNA, 32 nt, Human
cuuauaagaagagacauggggccaggugcagu

SEQ ID NO: 410661 - RNA, 32 nt, Human
cuuauaagaagaggaaaagacacaaggaaugu

SEQ ID NO: 410662 - RNA, 32 nt, Human
cuuauaagaagaggagauuaggucacagacau

SEQ ID NO: 410663 - RNA, 32 nt, Human
cuuauaaucccagcuacucugggggccaaggc

SEQ ID NO: 410664 - RNA, 32 nt, Human
cuuauaaucccagcuacuugggaggcugaggc

SEQ ID NO: 410665 - RNA, 32 nt, Human
cuuauaaugccaccuaucccuguaagcuaaac

SEQ ID NO: 410666 - RNA, 32 nt, Human
cuuauacaacagcaaacccugaugugacauuc

SEQ ID NO: 410667 - RNA, 22 nt, Human
cuuauacaagauaccauuuaca

SEQ ID NO: 410668 - RNA, 23 nt, Human
cuuauacacaugguucucucaua

SEQ ID NO: 410669 - RNA, 24 nt, Human
cuuauacaucucaaacucuucucu

SEQ ID NO: 410670 - RNA, 32 nt, Human
cuuauaccaaaaauagaggugcagagauguug

SEQ ID NO: 410671 - RNA, 32 nt, Human
cuuauacccagaggaaaauacacaccugggga

SEQ ID NO: 410672 - RNA, 32 nt, Human
cuuauacccccagccacucaggaggcugaugc

SEQ ID NO: 410673 - RNA, 32 nt, Human
cuuauaccuguaauccuagcacuuugggaggc

SEQ ID NO: 410674 - RNA, 32 nt, Human
cuuauacucccuucauuaaaucuauuaucugg

SEQ ID NO: 410675 - RNA, 32 nt, Human
cuuauacugcaacugugucuccuaggggacag

SEQ ID NO: 410676 - RNA, 32 nt, Human
cuuauacugccacuucuggacugccuuucaac

SEQ ID NO: 410677 - RNA, 32 nt, Human
cuuauacuuaagugaaaaacauggggaagggg

SEQ ID NO: 410678 - RNA, 32 nt, Human
cuuauacuucaguuguucagucagauuggacc

SEQ ID NO: 410679 - RNA, 32 nt, Human
cuuauagagcugcaaaacacacacaugcguau

SEQ ID NO: 410680 - RNA, 32 nt, Human
cuuauagaugaggcaacugagguucagggaua

SEQ ID NO: 410681 - RNA, 32 nt, Human
cuuauaggaauugacccacaagaaaugaaagc

SEQ ID NO: 410682 - RNA, 32 nt, Human
cuuauaggagaggugggcuccacccacaaaaa

SEQ ID NO: 410683 - RNA, 32 nt, Human
cuuauaggauucaagaaauggaaggaugauuc

SEQ ID NO: 410684 - RNA, 32 nt, Human
cuuauaggugaggacuccauccuccuguucca

SEQ ID NO: 410685 - RNA, 32 nt, Human
cuuauagguugauugcccacaggucaaacugu

SEQ ID NO: 410686 - RNA, 32 nt, Human
cuuauagucagcaacagguauccacggggagg

SEQ ID NO: 410687 - RNA, 32 nt, Human
cuuauaguuuucugaucuguguuagaaguguu

SEQ ID NO: 410688 - RNA, 32 nt, Human
cuuauauaaagagacccagagagcuccaucac

SEQ ID NO: 410689 - RNA, 32 nt, Human
cuuauaucauugugucugagggccagauauga

SEQ ID NO: 410690 - RNA, 32 nt, Human
cuuauaugaauaaaugaaauuacaugccaagg

SEQ ID NO: 410691 - RNA, 32 nt, Human
cuuauaugagugaggcucccagcuugggugug

SEQ ID NO: 410692 - RNA, 32 nt, Human
cuuauaugcugccagccucacccuccacaccu

SEQ ID NO: 410693 - RNA, 32 nt, Human
cuuauauuccaguaggagaaaaagcaaaaaua

SEQ ID NO: 410694 - RNA, 32 nt, Human
cuuauauucugaaaguuauucuucucacuggu

SEQ ID NO: 410695 - RNA, 32 nt, Human
cuuauauuugcagggaagaaagagugacgcac

SEQ ID NO: 410696 - RNA, 32 nt, Human
cuuauauuuuauuagaugauuugcuuccuaua

SEQ ID NO: 410697 - RNA, 32 nt, Human
cuuaucaacuuccucuagguguuuccacucca

SEQ ID NO: 410698 - RNA, 32 nt, Human
cuuaucaaggguugaaggaagggagccauccu

SEQ ID NO: 410699 - RNA, 32 nt, Human
cuuaucaaguggguuuguaguaaugagugcug

SEQ ID NO: 410700 - RNA, 32 nt, Human
cuuaucaauagugccaucauccacugcccuga

SEQ ID NO: 410701 - RNA, 32 nt, Human
cuuaucacauaagagagaugagaaagcuuuua

SEQ ID NO: 410702 - RNA, 32 nt, Human
cuuaucacauggucaaguaccuugccaaauaa

SEQ ID NO: 410703 - RNA, 26 nt, Human
cuuaucaccacccuccucuuuucugc

SEQ ID NO: 410704 - RNA, 32 nt, Human
cuuaucaccucuccccagcaagugcuggaccc

SEQ ID NO: 410705 - RNA, 32 nt, Human
cuuaucacgcgauggcauccacuguggaagga

SEQ ID NO: 410706 - RNA, 32 nt, Human
cuuaucacugcaccucuugccaaagugcgguc

SEQ ID NO: 410707 - RNA, 32 nt, Human
cuuaucagccugggcaacacagugagacucca

SEQ ID NO: 410708 - RNA, 32 nt, Human
cuuaucagggcuaguuuaaacaaauguguaua

SEQ ID NO: 410709 - RNA, 32 nt, Human
cuuaucauaugugcagcacaucaugucucagc

SEQ ID NO: 410710 - RNA, 32 nt, Human
cuuaucauugaaggcaggcccaggacagccug

SEQ ID NO: 410711 - RNA, 32 nt, Human
cuuauccaaauacccaaccugugaagaugaga

SEQ ID NO: 410712 - RNA, 32 nt, Human
cuuauccacaaaguacuccucacuuuucaauu

SEQ ID NO: 410713 - RNA, 32 nt, Human
cuuauccaccugcugaaggccuggcccccuga

SEQ ID NO: 410714 - RNA, 32 nt, Human
cuuauccagauagauccaaagcucaugucucu

SEQ ID NO: 410715 - RNA, 32 nt, Human
cuuaucccagcuccaaagacagucuccagacc

SEQ ID NO: 410716 - RNA, 32 nt, Human
cuuaucccccuccaaaaauaagccauugcaca

SEQ ID NO: 410717 - RNA, 32 nt, Human
cuuauccccuuuuccucugucuuccaaaugcg

SEQ ID NO: 410718 - RNA, 32 nt, Human
cuuaucccuugaauuuucaauauuguggaauc

SEQ ID NO: 410719 - RNA, 32 nt, Human
cuuauccguuaaggcuggaggcacaugugggu

SEQ ID NO: 410720 - RNA, 32 nt, Human
cuuauccuccuuccuggcgggggugggccgug

SEQ ID NO: 410721 - RNA, 32 nt, Human
cuuauccugagccaccuccucuccccgcuugc

SEQ ID NO: 410722 - RNA, 32 nt, Human
cuuauccugcaacuaaccauccuugagcccag

SEQ ID NO: 410723 - RNA, 32 nt, Human
cuuauccuguggaggagguggcuuccagcagg

SEQ ID NO: 410724 - RNA, 32 nt, Human
cuuauccuguucucugaagauguuuugugacc

SEQ ID NO: 410725 - RNA, 32 nt, Human
cuuauccuguucucuuauccuuauccccucca

SEQ ID NO: 410726 - RNA, 32 nt, Human
cuuauccuuugguauacucgggggauugguuc

SEQ ID NO: 410727 - RNA, 32 nt, Human
cuuaucgaauuguuuaaaauuggucagugacu

SEQ ID NO: 410728 - RNA, 32 nt, Human
cuuaucgcaaacugcuggagggugaggagauc

SEQ ID NO: 410729 - RNA, 32 nt, Human
cuuaucggaacaagccccuccuccuggggcug

SEQ ID NO: 410730 - RNA, 32 nt, Human
cuuaucuaaacccagcaaaacagauucaaagc

SEQ ID NO: 410731 - RNA, 32 nt, Human
cuuaucuacccaauugcagccaaccaagugag

SEQ ID NO: 410732 - RNA, 32 nt, Human
cuuaucuauggacauuccaaaacauuuaccau

SEQ ID NO: 410733 - RNA, 32 nt, Human
cuuaucuauuccugaaauucuuuuaugugauu

SEQ ID NO: 410734 - RNA, 32 nt, Human
cuuaucucagcuguacaugcucugccugugga

SEQ ID NO: 410735 - RNA, 32 nt, Human
cuuaucucauuucucaacaguucauugcucaa

SEQ ID NO: 410736 - RNA, 32 nt, Human
cuuaucuccaauaaacaucuauguuaaaucca

SEQ ID NO: 410737 - RNA, 32 nt, Human
cuuaucucccugcacauuggaaaugaauuaca

SEQ ID NO: 410738 - RNA, 32 nt, Human
cuuaucuccgcgccucccuuuucacuucugga

SEQ ID NO: 410739 - RNA, 32 nt, Human
cuuaucucucucuguggcgauggcuaugcuuc

SEQ ID NO: 410740 - RNA, 32 nt, Human
cuuaucucugccuccuuccuccuccuucccag

SEQ ID NO: 410741 - RNA, 32 nt, Human
cuuaucugaaaggacucaagucuuccacugca

SEQ ID NO: 410742 - RNA, 31 nt, Human
cuuaucugacuucucauuuuguaucagaggc

SEQ ID NO: 410743 - RNA, 32 nt, Human
cuuaucugcaucugcugaccucaaccuugacu

SEQ ID NO: 410744 - RNA, 19 nt, Human
cuuaucugcccaucccucu

SEQ ID NO: 410745 - RNA, 32 nt, Human
cuuaucuggaggaggaagagaagcaggagaga

SEQ ID NO: 410746 - RNA, 32 nt, Human
cuuaucuggcugcuuuagcuccagugcuacaa

SEQ ID NO: 410747 - RNA, 32 nt, Human
cuuaucuggcugugcuuuucacuuugggacaa

SEQ ID NO: 410748 - RNA, 32 nt, Human
cuuaucugggcccaaccucuccuuaauaacca

SEQ ID NO: 410749 - RNA, 32 nt, Human
cuuaucugggccuucucacucagggacucucu

SEQ ID NO: 410750 - RNA, 25 nt, Human
cuuaucuggugcauucuccccaccc

SEQ ID NO: 410751 - RNA, 21 nt, Human
cuuaucuguauuuucacuuua

SEQ ID NO: 410752 - RNA, 32 nt, Human
cuuaucugucacugaaaacuuggugaaauuuu

SEQ ID NO: 410753 - RNA, 32 nt, Human
cuuaucugugaugaaguggccugggagcacca

SEQ ID NO: 410754 - RNA, 32 nt, Human
cuuaucuguuuccccuuccuugucagcaucgg

SEQ ID NO: 410755 - RNA, 32 nt, Human
cuuaugaacagcuucagaauucuguagggggu

SEQ ID NO: 410756 - RNA, 32 nt, Human
cuuaugaccagugagaacucucucccuggucu

SEQ ID NO: 410757 - RNA, 32 nt, Human
cuuaugacuccccuccccaacccccucaucua

SEQ ID NO: 410758 - RNA, 32 nt, Human
cuuaugcaaguuggggccaggauaggggaggg

SEQ ID NO: 410759 - RNA, 18 nt, Human
cuuaugcaauaagauaaa

SEQ ID NO: 410760 - RNA, 32 nt, Human
cuuaugcacaauaagcucauuagauucuaguu

SEQ ID NO: 410761 - RNA, 32 nt, Human
cuuaugcacagaacuuguaccauuugaaucug

SEQ ID NO: 410762 - RNA, 32 nt, Human
cuuaugcacaggcuuguguuggggaacuaagg

SEQ ID NO: 410763 - RNA, 32 nt, Human
cuuaugccaucccggcagcgaggcugggcugg

SEQ ID NO: 410764 - RNA, 32 nt, Human
cuuaugccauuuucuacacugugcuucaugag

SEQ ID NO: 410765 - RNA, 32 nt, Human
cuuaugcccacgcuggagugcagugagccgag

SEQ ID NO: 410766 - RNA, 32 nt, Human
cuuaugcccccaccccucccucaacaauauga

SEQ ID NO: 410767 - RNA, 32 nt, Human
cuuaugccuaggagguugaggcugcagugagc

SEQ ID NO: 410768 - RNA, 32 nt, Human
cuuaugccuauaauccuagcacuuugggaggc

SEQ ID NO: 410769 - RNA, 32 nt, Human
cuuaugccuauaauccuagcacuuugggaggu

SEQ ID NO: 410770 - RNA, 18 nt, Human
cuuaugccuguaauccca

SEQ ID NO: 410771 - RNA, 32 nt, Human
cuuaugccuguaaucccacuuugggaggccaa

SEQ ID NO: 410772 - RNA, 32 nt, Human
cuuaugccuguaaucccagcacucugggaggc

SEQ ID NO: 410773 - RNA, 32 nt, Human
cuuaugccuguaaucccagcacuuggggaagc

SEQ ID NO: 410774 - RNA, 32 nt, Human
cuuaugccuguaaucccagcacuuugcaggcc

SEQ ID NO: 410775 - RNA, 32 nt, Human
cuuaugccuguaaucccagcacuuuggaaggc

SEQ ID NO: 410776 - RNA, 32 nt, Human
cuuaugccuguaaucccagcacuuugggaggc

SEQ ID NO: 410777 - RNA, 32 nt, Human
cuuaugccuguaaucccagcacuuugggugac

SEQ ID NO: 410778 - RNA, 32 nt, Human
cuuaugccuguaaucccagcaugcugggaggc

SEQ ID NO: 410779 - RNA, 32 nt, Human
cuuaugccuguaaucccgguacuuugggaggc

SEQ ID NO: 410780 - RNA, 32 nt, Human
cuuaugccuguaaucccugcacuuugggaagc

SEQ ID NO: 410781 - RNA, 32 nt, Human
cuuaugccuguaauccuagaacuuugggaggc

SEQ ID NO: 410782 - RNA, 32 nt, Human
cuuaugccuguaauccuagcgcuuugggaggc

SEQ ID NO: 410783 - RNA, 28 nt, Human
cuuaugccugugucugccccaaauggag

SEQ ID NO: 410784 - RNA, 32 nt, Human
cuuaugcugagauguugaacuuaaacuuuaug

SEQ ID NO: 410785 - RNA, 32 nt, Human
cuuaugcuuguaaucccaacacuuagggaguc

SEQ ID NO: 410786 - RNA, 32 nt, Human
cuuaugcuuguaaucccagaacuuugggaauc

SEQ ID NO: 410787 - RNA, 32 nt, Human
cuuaugcuuguaaucccagcacuuugggaggc

SEQ ID NO: 410788 - RNA, 32 nt, Human
cuuauggaaaaauacacacgcaauagcuagga

SEQ ID NO: 410789 - RNA, 32 nt, Human
cuuauggacucugccuugcuuugcuuauguuu

SEQ ID NO: 410790 - RNA, 32 nt, Human
cuuauggacugagaaagggagaacaugguagg

SEQ ID NO: 410791 - RNA, 32 nt, Human
cuuauggagccccucccauggagcucucuucc

SEQ ID NO: 410792 - RNA, 32 nt, Human
cuuauggagccuggauuuuucccacugcucua

SEQ ID NO: 410793 - RNA, 32 nt, Human
cuuaugggagucuuguauaucuuccaggcaug

SEQ ID NO: 410794 - RNA, 32 nt, Human
cuuaugguagauggcuuccuggaaucaaaaug

SEQ ID NO: 410795 - RNA, 32 nt, Human
cuuaugguagcagauuggggaaaaugaagcag

SEQ ID NO: 410796 - RNA, 32 nt, Human
cuuaugguuguaggauucagggguuaauggaa

SEQ ID NO: 410797 - RNA, 32 nt, Human
cuuauguaaccugucuggugaguuuguuugga

SEQ ID NO: 410798 - RNA, 32 nt, Human
cuuauguagacagugagggcucagggaggcuc

SEQ ID NO: 410799 - RNA, 32 nt, Human
cuuauguagggagggggcaaguaugaaguaag

SEQ ID NO: 410800 - RNA, 32 nt, Human
cuuaugucuaaaacaguggugaugaguaaggc

SEQ ID NO: 410801 - RNA, 32 nt, Human
cuuaugucuguaaucccagcacuuuugagagg

SEQ ID NO: 410802 - RNA, 32 nt, Human
cuuaugugaccccugagggguggggcugugag

SEQ ID NO: 410803 - RNA, 32 nt, Human
cuuaugugccucccccaggcucccugcuuucu

SEQ ID NO: 410804 - RNA, 32 nt, Human
cuuauguguguucugagccucaaaacccccuu

SEQ ID NO: 410805 - RNA, 32 nt, Human
cuuauguuaugcuuuaaucauaaguggaaugg

SEQ ID NO: 410806 - RNA, 32 nt, Human
cuuauguuuaggcacagcuauuuauaggggaa

SEQ ID NO: 410807 - RNA, 32 nt, Human
cuuauguuuugucaccuugcugagcuugcuua

SEQ ID NO: 410808 - RNA, 32 nt, Human
cuuauuaaaauggaaauccuggagaauaguag

SEQ ID NO: 410809 - RNA, 31 nt, Human
cuuauuaaacaaugccauuucuugaccacuu

SEQ ID NO: 410810 - RNA, 32 nt, Human
cuuauuaaggcccacuguuuuacuggggccca

SEQ ID NO: 410811 - RNA, 32 nt, Human
cuuauuaauaaaacacacaaugccuagcuggg

SEQ ID NO: 410812 - RNA, 32 nt, Human
cuuauuacaauaaaauuaguggcacuuuauuc

SEQ ID NO: 410813 - RNA, 32 nt, Human
cuuauuacaucuuuauugugcagacccucucc

SEQ ID NO: 410814 - RNA, 32 nt, Human
cuuauuacccugacaaauaguuuuagacagau

SEQ ID NO: 410815 - RNA, 32 nt, Human
cuuauuagcacugcaaaagcuccugagaauuu

SEQ ID NO: 410816 - RNA, 32 nt, Human
cuuauuagucugugucagauucugagcaauca

SEQ ID NO: 410817 - RNA, 32 nt, Human
cuuauucaaagacuagguuauuuucaacuggg

SEQ ID NO: 410818 - RNA, 32 nt, Human
cuuauucaagcacauacugcauuuuucuuagu

SEQ ID NO: 410819 - RNA, 32 nt, Human
cuuauucagcagcagaguuggugacuuugaca

SEQ ID NO: 410820 - RNA, 32 nt, Human
cuuauucaugcuuucuccuuuuucuaccuuuu

SEQ ID NO: 410821 - RNA, 32 nt, Human
cuuauuccaaaauuaaauggcagcagcagagg

SEQ ID NO: 410822 - RNA, 28 nt, Human
cuuauuccaagugcauuuuucuuauuua

SEQ ID NO: 410823 - RNA, 32 nt, Human
cuuauuccacuucgguagaggauuucuaguuu

SEQ ID NO: 410824 - RNA, 32 nt, Human
cuuauucccaggcuggagugcaaugucgugau

SEQ ID NO: 410825 - RNA, 32 nt, Human
cuuauucccugaggcucccuugacucaggacu

SEQ ID NO: 410826 - RNA, 32 nt, Human
cuuauuccuuaaauuccacucuuuuaacacua

SEQ ID NO: 410827 - RNA, 21 nt, Human
cuuauuccuucucugccucca

SEQ ID NO: 410828 - RNA, 26 nt, Human
cuuauucuauugacagacauggugua

SEQ ID NO: 410829 - RNA, 32 nt, Human
cuuauucucccauuaggcagcugaggaccgag

SEQ ID NO: 410830 - RNA, 32 nt, Human
cuuauucucccauugggcagcugaggaccgag

SEQ ID NO: 410831 - RNA, 32 nt, Human
cuuauucuguaacgguuuguggccaaguuuug

SEQ ID NO: 410832 - RNA, 32 nt, Human
cuuauucugucuggccucgcuuuccuuuugcc

SEQ ID NO: 410833 - RNA, 32 nt, Human
cuuauucuguuaauguaaacuuuugaagaucu

SEQ ID NO: 410834 - RNA, 32 nt, Human
cuuauucuugcagcccaauauggagaugcaga

SEQ ID NO: 410835 - RNA, 32 nt, Human
cuuauugaauacaagcccugaucuuccaucuc

SEQ ID NO: 410836 - RNA, 32 nt, Human
cuuauugaggcccuguaccuucugcugugugu

SEQ ID NO: 410837 - RNA, 31 nt, Human
cuuauugaguaaccuguuuccuacggaaugu

SEQ ID NO: 410838 - RNA, 32 nt, Human
cuuauugauaaauaucugaaacagaaggccaa

SEQ ID NO: 410839 - RNA, 32 nt, Human
cuuauugccaggugaugcugccucucugugga

SEQ ID NO: 410840 - RNA, 32 nt, Human
cuuauugcccaggcuggagugcagugacgagg

SEQ ID NO: 410841 - RNA, 32 nt, Human
cuuauugcccaggcuggagugcaguggcacaa

SEQ ID NO: 410842 - RNA, 32 nt, Human
cuuauugcccaggcuggagugcaguggcguga

SEQ ID NO: 410843 - RNA, 32 nt, Human
cuuauugcugugcucugggcuugggggcggcu

SEQ ID NO: 410844 - RNA, 32 nt, Human
cuuauuggaacaaccacugagcuacggagagc

SEQ ID NO: 410845 - RNA, 32 nt, Human
cuuauuggauuccucucugucuucuuggaguu

SEQ ID NO: 410846 - RNA, 32 nt, Human
cuuauugggccuugccucaggaguuccucugu

SEQ ID NO: 410847 - RNA, 32 nt, Human
cuuauugggccuugccucaggaguugcugguu

SEQ ID NO: 410848 - RNA, 32 nt, Human
cuuauugguagagggcucugaagagccaaaac

SEQ ID NO: 410849 - RNA, 32 nt, Human
cuuauuggugagagagaaaauccgugcauugu

SEQ ID NO: 410850 - RNA, 32 nt, Human
cuuauugguuugccauccuuguucauuacaac

SEQ ID NO: 410851 - RNA, 32 nt, Human
cuuauuguacauguuggaaccaggacaugaga

SEQ ID NO: 410852 - RNA, 32 nt, Human
cuuauugucacacuguguauguuuucagcauu

SEQ ID NO: 410853 - RNA, 32 nt, Human
cuuauuguucugacauuauguaaaggugguau

SEQ ID NO: 410854 - RNA, 18 nt, Human
cuuauuuaaacucuguug

SEQ ID NO: 410855 - RNA, 32 nt, Human
cuuauuuaagagacgcuggagaucucugagga

SEQ ID NO: 410856 - RNA, 32 nt, Human
cuuauuuaagcuucguaccacugcuaucuccc

SEQ ID NO: 410857 - RNA, 32 nt, Human
cuuauuuacaaacccugugaguucuuuuugua

SEQ ID NO: 410858 - RNA, 32 nt, Human
cuuauuuacuaaaaauacaaaaacuuagccgg

SEQ ID NO: 410859 - RNA, 20 nt, Human
cuuauuuauuccuuccagca

SEQ ID NO: 410860 - RNA, 24 nt, Human
cuuauuuauucuacauccuuggca

SEQ ID NO: 410861 - RNA, 32 nt, Human
cuuauuuauugggaugugagccccagggggcc

SEQ ID NO: 410862 - RNA, 32 nt, Human
cuuauuucaaaaagauuucuuauuaccgacua

SEQ ID NO: 410863 - RNA, 32 nt, Human
cuuauuucacagguuauacagcagagcggguu

SEQ ID NO: 410864 - RNA, 22 nt, Human
cuuauuuccaccccccaccccc

SEQ ID NO: 410865 - RNA, 32 nt, Human
cuuauuuccauagccagucaaggauucuaacg

SEQ ID NO: 410866 - RNA, 32 nt, Human
cuuauuuccuucagaaugauccccauccccca

SEQ ID NO: 410867 - RNA, 24 nt, Human
cuuauuucuuuuuuaaggggaaaa

SEQ ID NO: 410868 - RNA, 32 nt, Human
cuuauuugaaggccagcccacacccagcuacu

SEQ ID NO: 410869 - RNA, 32 nt, Human
cuuauuugagauacaugauucucuuagaaucc

SEQ ID NO: 410870 - RNA, 32 nt, Human
cuuauuugcucacacgggguauuuuaggcagg

SEQ ID NO: 410871 - RNA, 32 nt, Human
cuuauuugcucucaggcuuugguuuacaauga

SEQ ID NO: 410872 - RNA, 32 nt, Human
cuuauuuggaaauuguggcugcagagaagaag

SEQ ID NO: 410873 - RNA, 23 nt, Human
cuuauuuggccuucaucuuggca

SEQ ID NO: 410874 - RNA, 32 nt, Human
cuuauuuggggauuuuucuucuagaaaucaaa

SEQ ID NO: 410875 - RNA, 24 nt, Human
cuuauuuguuuagauccuuuugua

SEQ ID NO: 410876 - RNA, 32 nt, Human
cuuauuuuaaaccaaauuuuaauuucuguguc

SEQ ID NO: 410877 - RNA, 32 nt, Human
cuuauuuuaguauacguauaaauaucaguauu

SEQ ID NO: 410878 - RNA, 24 nt, Human
cuuauuuuauuuuauuuucuucaa

SEQ ID NO: 410879 - RNA, 32 nt, Human
cuuauuuuccuccuccuccuuggccuacucaa

SEQ ID NO: 410880 - RNA, 32 nt, Human
cuuauuuugaacaaugcagacaguacuugcca

SEQ ID NO: 410881 - RNA, 32 nt, Human
cuuauuuugcauucucaaugguguuuuuaagg

SEQ ID NO: 410882 - RNA, 32 nt, Human
cuuauuuuuccugucucugucuuccaaccccc

SEQ ID NO: 410883 - RNA, 32 nt, Human
cuucaaaaauaagcccuguagcucuuuacggu

SEQ ID NO: 410884 - RNA, 32 nt, Human
cuucaaacacaacugcuacaacauucuaauaa

SEQ ID NO: 410885 - RNA, 32 nt, Human
cuucaaacaugcccucaggcuuggggaugccc

SEQ ID NO: 410886 - RNA, 32 nt, Human
cuucaaaccagacucugugcugcuucugcuuu

SEQ ID NO: 410887 - RNA, 32 nt, Human
cuucaaacccacccccuuuccuuccagccuuu

SEQ ID NO: 410888 - RNA, 32 nt, Human
cuucaaacuggcgaugucaaggguuccaaguc

SEQ ID NO: 410889 - RNA, 32 nt, Human
cuucaaagccaagguacagggugauaacuugu

SEQ ID NO: 410890 - RNA, 32 nt, Human
cuucaaagccagccugagccacauagugagac

SEQ ID NO: 410891 - RNA, 32 nt, Human
cuucaaagccauugaacccacagagcuguguu

SEQ ID NO: 410892 - RNA, 32 nt, Human
cuucaaaggaagagcaauggcugcagcagcag

SEQ ID NO: 410893 - RNA, 32 nt, Human
cuucaaaggauuuuggaaaagaaacaauaugc

SEQ ID NO: 410894 - RNA, 32 nt, Human
cuucaaaggcagaauuuagagagauugaggau

SEQ ID NO: 410895 - RNA, 32 nt, Human
cuucaaagucaaggucccuugaucccaaaagu

SEQ ID NO: 410896 - RNA, 32 nt, Human
cuucaaagucuuuuuccuucucuccuuccuau

SEQ ID NO: 410897 - RNA, 24 nt, Human
cuucaaagugguucaucuuggucu

SEQ ID NO: 410898 - RNA, 32 nt, Human
cuucaaaguugaguuuucaucuuugacuccaa

SEQ ID NO: 410899 - RNA, 32 nt, Human
cuucaaauaaaucagcuucucuccaagauaaa

SEQ ID NO: 410900 - RNA, 32 nt, Human
cuucaaauauccauauuaaccacuauuuuuca

SEQ ID NO: 410901 - RNA, 23 nt, Human
cuucaaauccaccucguccuucc

SEQ ID NO: 410902 - RNA, 32 nt, Human
cuucaaaugagaucugacagugccccacugcc

SEQ ID NO: 410903 - RNA, 32 nt, Human
cuucaaaugcugugcagccaucuugccucaac

SEQ ID NO: 410904 - RNA, 32 nt, Human
cuucaaauuauugaccuggacaggguccaagu

SEQ ID NO: 410905 - RNA, 32 nt, Human
cuucaaauuggcuauuccucuugcaaaugaac

SEQ ID NO: 410906 - RNA, 32 nt, Human
cuucaacacagcaagcccaaugcacccagcua

SEQ ID NO: 410907 - RNA, 32 nt, Human
cuucaacacagcuggauccucuguguggcagc

SEQ ID NO: 410908 - RNA, 32 nt, Human
cuucaacacuccccucuccaggucacacccuc

SEQ ID NO: 410909 - RNA, 27 nt, Human
cuucaacagcccccuucucuccuuuuu

SEQ ID NO: 410910 - RNA, 32 nt, Human
cuucaacaguggccugaugacacuccugucuu

SEQ ID NO: 410911 - RNA, 32 nt, Human
cuucaaccagggaggcagagguugcagugagc

SEQ ID NO: 410912 - RNA, 32 nt, Human
cuucaacccacuggagucagcaggcccagugc

SEQ ID NO: 410913 - RNA, 32 nt, Human
cuucaacccaggaggcagaggcuacagugagc

SEQ ID NO: 410914 - RNA, 32 nt, Human
cuucaacccauggagaacaagccucaacuaac

SEQ ID NO: 410915 - RNA, 32 nt, Human
cuucaaccucggaggcggagguugcagugagc

SEQ ID NO: 410916 - RNA, 32 nt, Human
cuucaaccugcccuugaaccggggucuggagc

SEQ ID NO: 410917 - RNA, 32 nt, Human
cuucaaccugggagauggagguugcagugagc

SEQ ID NO: 410918 - RNA, 32 nt, Human
cuucaaccugggaggcagagguugcagugagc

SEQ ID NO: 410919 - RNA, 32 nt, Human
cuucaaccugggagguagagguugcagugagc

SEQ ID NO: 410920 - RNA, 32 nt, Human
cuucaaccugggagguugaggcugcagugagc

SEQ ID NO: 410921 - RNA, 32 nt, Human
cuucaacgugagaaggaaaggggccagggguc

SEQ ID NO: 410922 - RNA, 32 nt, Human
cuucaacucccaucuuuccccaagaagucaga

SEQ ID NO: 410923 - RNA, 19 nt, Human
cuucaacuccugggcucaa

SEQ ID NO: 410924 - RNA, 32 nt, Human
cuucaacuccuugguccccuguugucuggguc

SEQ ID NO: 410925 - RNA, 28 nt, Human
cuucaacugagugcugcacaucaugggc

SEQ ID NO: 410926 - RNA, 32 nt, Human
cuucaagaaagcuuccgagguaagaauuuuau

SEQ ID NO: 410927 - RNA, 32 nt, Human
cuucaagaaucagaagaaagccaaggugcugg

SEQ ID NO: 410928 - RNA, 32 nt, Human
cuucaagaaucgaguuacccaccagaacccua

SEQ ID NO: 410929 - RNA, 32 nt, Human
cuucaagaccagccuaggcaacauggugaaac

SEQ ID NO: 410930 - RNA, 32 nt, Human
cuucaagaccagccuggccaacauggugaaac

SEQ ID NO: 410931 - RNA, 32 nt, Human
cuucaagaccuucacugcucugccucagugga

SEQ ID NO: 410932 - RNA, 32 nt, Human
cuucaagagaaagaccagaagagaaggcaaaa

SEQ ID NO: 410933 - RNA, 32 nt, Human
cuucaagagaacacacucagugcuuguuuuua

SEQ ID NO: 410934 - RNA, 32 nt, Human
cuucaagaucauaccacuggacuaagaacuuu

SEQ ID NO: 410935 - RNA, 32 nt, Human
cuucaagaucuggugaaaacacuaucucuugc

SEQ ID NO: 410936 - RNA, 32 nt, Human
cuucaagaugccucuucuaccucuuccaggaa

SEQ ID NO: 410937 - RNA, 32 nt, Human
cuucaagcaaagguccaaaaagacuggagaaa

SEQ ID NO: 410938 - RNA, 32 nt, Human
cuucaagcaagaaaauaagcaguguuguacuu

SEQ ID NO: 410939 - RNA, 32 nt, Human
cuucaagcacaauaaucaucacagacuugagu

SEQ ID NO: 410940 - RNA, 32 nt, Human
cuucaagcauuuucauucugugauuuauauca

SEQ ID NO: 410941 - RNA, 32 nt, Human
cuucaagccuccaaagaccagagggaaggguc

SEQ ID NO: 410942 - RNA, 32 nt, Human
cuucaagcucacugauauuuuccucugcuuga

SEQ ID NO: 410943 - RNA, 32 nt, Human
cuucaagcuggcgggagcaaugguucacauaa

SEQ ID NO: 410944 - RNA, 32 nt, Human
cuucaagcuguacauagggccucccagugcaa

SEQ ID NO: 410945 - RNA, 32 nt, Human
cuucaaggaagacucuacaagcuuuuguucac

SEQ ID NO: 410946 - RNA, 32 nt, Human
cuucaaggacaaacacuggcuggagaaagcca

SEQ ID NO: 410947 - RNA, 32 nt, Human
cuucaaggaggacugaguucucaggggagaac

SEQ ID NO: 410948 - RNA, 21 nt, Human
cuucaagggcagcaagaacga

SEQ ID NO: 410949 - RNA, 32 nt, Human
cuucaagggcaggaagaaggcaggauuaugca

SEQ ID NO: 410950 - RNA, 32 nt, Human
cuucaaggggccugggcugcugcucacgggua

SEQ ID NO: 410951 - RNA, 32 nt, Human
cuucaaggguuccuguggaucucaggaaggca

SEQ ID NO: 410952 - RNA, 32 nt, Human
cuucaagguugucuagagaaguuugccaugug

SEQ ID NO: 410953 - RNA, 32 nt, Human
cuucaaguaaucuagaagaauguggauacucu

SEQ ID NO: 410954 - RNA, 32 nt, Human
cuucaaguagagauucauucuuugagguugaa

SEQ ID NO: 410955 - RNA, 32 nt, Human
cuucaaguauuuuucuauaaucacuuuccccu

SEQ ID NO: 410956 - RNA, 19 nt, Human
cuucuugaagaucuucaga

SEQ ID NO: 410957 - RNA, 32 nt, Human
cuucuugacauccaccaagauaccagacauuu

SEQ ID NO: 410958 - RNA, 32 nt, Human
cuucuugagaaaaagacugcagaaaggagagg

SEQ ID NO: 410959 - RNA, 32 nt, Human
cuucuugagacaccugcugaccucuagccgga

SEQ ID NO: 410960 - RNA, 32 nt, Human
cuucuugagaccugcuuguccaccccaacaug

SEQ ID NO: 410961 - RNA, 32 nt, Human
cuucuugagcuugaggagcuccugggugcaaa

SEQ ID NO: 410962 - RNA, 32 nt, Human
cuucuugauuguaccacugaagguccaggaca

SEQ ID NO: 410963 - RNA, 32 nt, Human
cuucuugcacacccaccucucccugcaccugg

SEQ ID NO: 410964 - RNA, 32 nt, Human
cuucuugccacaucuucucagaagacuuucag

SEQ ID NO: 410965 - RNA, 32 nt, Human
cuucuugccaccugcaaccccaaucucaaucc

SEQ ID NO: 410966 - RNA, 32 nt, Human
cuucuugccaggacauaaaaugauacccuccu

SEQ ID NO: 410967 - RNA, 32 nt, Human
cuucuugccgaccuugaagcagaguugacguu

SEQ ID NO: 410968 - RNA, 32 nt, Human
cuucuugccguuggccuuucugacucuggaau

SEQ ID NO: 410969 - RNA, 32 nt, Human
cuucuugccucaccauuccccuaggcaggccc

SEQ ID NO: 410970 - RNA, 32 nt, Human
cuucuugccugggugcuggccugcccucuccg

SEQ ID NO: 410971 - RNA, 19 nt, Human
cuucuugccuucacuuucc

SEQ ID NO: 410972 - RNA, 32 nt, Human
cuucuugcgcuagucaagguccccgccuggag

SEQ ID NO: 410973 - RNA, 32 nt, Human
cuucuugcggcugaggagaggagcaguucagu

SEQ ID NO: 410974 - RNA, 32 nt, Human
cuucuugcguugauacuuugccccagaaaggc

SEQ ID NO: 410975 - RNA, 32 nt, Human
cuucuugcucaggcuccugaaggguugauucu

SEQ ID NO: 410976 - RNA, 32 nt, Human
cuucuugcuuauuuaaacugugcaagguaaaa

SEQ ID NO: 410977 - RNA, 32 nt, Human
cuucuugcuuugcagacugccugcagccauga

SEQ ID NO: 410978 - RNA, 32 nt, Human
cuucuuggaaggcagggcuggacacugaugga

SEQ ID NO: 410979 - RNA, 32 nt, Human
cuucuuggauguucuuggguuuggaaauaagu

SEQ ID NO: 410980 - RNA, 32 nt, Human
cuucuuggcaaaaauuaaaacaacaacaacaa

SEQ ID NO: 410981 - RNA, 32 nt, Human
cuucuuggcaugccauuguggagggcuuggcc

SEQ ID NO: 410982 - RNA, 22 nt, Human
cuucuuggcccuggcaggcagc

SEQ ID NO: 410983 - RNA, 32 nt, Human
cuucuuggcccuggcccugugcugcccgggca

SEQ ID NO: 410984 - RNA, 24 nt, Human
cuucuuggccucccaacucuuccc

SEQ ID NO: 410985 - RNA, 20 nt, Human
cuucuuggcucggcggcgcu

SEQ ID NO: 410986 - RNA, 16 nt, Human
cuucuugggacaggaa

SEQ ID NO: 410987 - RNA, 32 nt, Human
cuucuugggaggcugaggcaggauugcuugag

SEQ ID NO: 410988 - RNA, 32 nt, Human
cuucuugggaggcugaggugggaggauugcuu

SEQ ID NO: 410989 - RNA, 32 nt, Human
cuucuugggcuggggcguccaucuccuccugc

SEQ ID NO: 410990 - RNA, 32 nt, Human
cuucuuggggaccuugaacacuggagggucau

SEQ ID NO: 410991 - RNA, 20 nt, Human
cuucuuggggcgcagaggcu

SEQ ID NO: 410992 - RNA, 32 nt, Human
cuucuuggggcugcuccgccuccugaccagcc

SEQ ID NO: 410993 - RNA, 32 nt, Human
cuucuugggugaguugcaaguuaaaauuacca

SEQ ID NO: 410994 - RNA, 32 nt, Human
cuucuuggucaccaccucucccaccuuuugug

SEQ ID NO: 410995 - RNA, 32 nt, Human
cuucuuggucacugcacuucauagcccggcau

SEQ ID NO: 410996 - RNA, 32 nt, Human
cuucuuggucucacacuugggacucaaaaaug

SEQ ID NO: 410997 - RNA, 32 nt, Human
cuucuuggucuucuccuucugggccucauggc

SEQ ID NO: 410998 - RNA, 32 nt, Human
cuucuuggugugggaggcagaggugcugacgu

SEQ ID NO: 410999 - RNA, 32 nt, Human
cuucuugguucagagaugcuguaggaguugaa

SEQ ID NO: 411000 - RNA, 32 nt, Human
cuucuugucaacacccucuuaagcagcaccag

SEQ ID NO: 411001 - RNA, 32 nt, Human
cuucuugucaugugagugugguugugaaugau

SEQ ID NO: 411002 - RNA, 32 nt, Human
cuucuuguccuuccucuucucagugcaggagg

SEQ ID NO: 411003 - RNA, 32 nt, Human
cuucuuguguucccgugucugucugucuugca

SEQ ID NO: 411004 - RNA, 32 nt, Human
cuucuuguucgggggugggaaguggccaccgu

SEQ ID NO: 411005 - RNA, 32 nt, Human
cuucuuuaccccucacaauccuugccacagug

SEQ ID NO: 411006 - RNA, 32 nt, Human
cuucuuuacugcuuuuucaucaagugaauauu

SEQ ID NO: 411007 - RNA, 32 nt, Human
cuucuuuaguaaauguuaauuuguuucaaagu

SEQ ID NO: 411008 - RNA, 32 nt, Human
cuucuuuagugccaguccuugugguugaauaa

SEQ ID NO: 411009 - RNA, 32 nt, Human
cuucuuuauuccagcuccuauguucuguguau

SEQ ID NO: 411010 - RNA, 32 nt, Human
cuucuuucaccucccuuauuucuuugcuucuu

SEQ ID NO: 411011 - RNA, 32 nt, Human
cuucuuucacuaacuucuggacuuuccagcuc

SEQ ID NO: 411012 - RNA, 32 nt, Human
cuucuuucauuucugagcccaucuucuguacu

SEQ ID NO: 411013 - RNA, 32 nt, Human
cuucuuucauuucuucuacaacucauacacuc

SEQ ID NO: 411014 - RNA, 32 nt, Human
cuucuuuccacucagggcagauucuggggucu

SEQ ID NO: 411015 - RNA, 32 nt, Human
cuucuuuccagcccuucuccugugugccugcc

SEQ ID NO: 411016 - RNA, 32 nt, Human
cuucuuuccucccucccuuuccugguagccuc

SEQ ID NO: 411017 - RNA, 32 nt, Human
cuucuuuccugccucugauuccgggcugucau

SEQ ID NO: 411018 - RNA, 32 nt, Human
cuucuuucguuuccucgucaaacaucugauug

SEQ ID NO: 411019 - RNA, 20 nt, Human
cuucuuucucaauaccugcc

SEQ ID NO: 411020 - RNA, 32 nt, Human
cuucuuucucacuuccacaucucccccucuau

SEQ ID NO: 411021 - RNA, 24 nt, Human
cuucuuucuccaagcuccccuccu

SEQ ID NO: 411022 - RNA, 24 nt, Human
cuucuuucucccccacaccuaucu

SEQ ID NO: 411023 - RNA, 22 nt, Human
cuucuuucucccuuucccuccu

SEQ ID NO: 411024 - RNA, 32 nt, Human
cuucuuucucucucugcccccaccaagugcgg

SEQ ID NO: 411025 - RNA, 32 nt, Human
cuucuuucucucuuccuccaucauuuucccug

SEQ ID NO: 411026 - RNA, 21 nt, Human
cuucuuucucugucccuuccu

SEQ ID NO: 411027 - RNA, 21 nt, Human
cuucuuucucuucaacccccu

SEQ ID NO: 411028 - RNA, 32 nt, Human
cuucuuucugccccucuuccucccccuccucu

SEQ ID NO: 411029 - RNA, 32 nt, Human
cuucuuucugcugugcugcuucccucccaaac

SEQ ID NO: 411030 - RNA, 32 nt, Human
cuucuuucuuuuccuaaagaaucacggggaga

SEQ ID NO: 411031 - RNA, 32 nt, Human
cuucuuugacccuuaugacugaaagaucauca

SEQ ID NO: 411032 - RNA, 32 nt, Human
cuucuuugaucccagcaucucagucccccucc

SEQ ID NO: 411033 - RNA, 32 nt, Human
cuucuuugcccuuugcagugccacuuauuuag

SEQ ID NO: 411034 - RNA, 32 nt, Human
cuucuuugccuuucuucuuugucuuauuucug

SEQ ID NO: 411035 - RNA, 32 nt, Human
cuucuuugcuucuguuccuccugacccauuac

SEQ ID NO: 411036 - RNA, 32 nt, Human
cuucuuuggacuuggaaggugugcggggacug

SEQ ID NO: 411037 - RNA, 32 nt, Human
cuucuuuggagaggaggauggaagggaggggu

SEQ ID NO: 411038 - RNA, 32 nt, Human
cuucuuuggcuucugguucuuccagcccucau

SEQ ID NO: 411039 - RNA, 32 nt, Human
cuucuuugggcuguggcuugcagaacaaacua

SEQ ID NO: 411040 - RNA, 32 nt, Human
cuucuuuggggaacuggggaaggacugauaag

SEQ ID NO: 411041 - RNA, 32 nt, Human
cuucuuugggguggagagaauuuugagcgcua

SEQ ID NO: 411042 - RNA, 32 nt, Human
cuucuuugugccucuuuucucuccuuaauaag

SEQ ID NO: 411043 - RNA, 32 nt, Human
cuucuuugugguugcccaagguuguuuugcgu

SEQ ID NO: 411044 - RNA, 32 nt, Human
cuucuuuguuguguccucgaauggcagaaaaa

SEQ ID NO: 411045 - RNA, 32 nt, Human
cuucuuuguuuacucugcauacacugaguguu

SEQ ID NO: 411046 - RNA, 21 nt, Human
cuucuuuuaaaagacggucca

SEQ ID NO: 411047 - RNA, 32 nt, Human
cuucuuuuauuuccucugugaaccccuucucu

SEQ ID NO: 411048 - RNA, 32 nt, Human
cuucuuuucacuuuaccagaaaguguucuuua

SEQ ID NO: 411049 - RNA, 23 nt, Human
cuucuuuuccuucuuugcuucuu

SEQ ID NO: 411050 - RNA, 32 nt, Human
cuucuuuucuaggcaauauaaggaaagugauc

SEQ ID NO: 411051 - RNA, 32 nt, Human
cuucuuuucucccagucuccuguucauccauu

SEQ ID NO: 411052 - RNA, 32 nt, Human
cuucuuuucucccaucccgguugcaaucucac

SEQ ID NO: 411053 - RNA, 32 nt, Human
cuucuuuucucucccuuccuucuuccuucagg

SEQ ID NO: 411054 - RNA, 32 nt, Human
cuucuuuucucuucccccagugccuagguugc

SEQ ID NO: 411055 - RNA, 32 nt, Human
cuucuuuucugacuauuuuucagaaucucucu

SEQ ID NO: 411056 - RNA, 32 nt, Human
cuucuuuucugucccaggaggguggguaauuc

SEQ ID NO: 411057 - RNA, 32 nt, Human
cuucuuuucuugccucccugaccagcagacuc

SEQ ID NO: 411058 - RNA, 32 nt, Human
cuucuuuucuuguguuccccaggguuuuggga

SEQ ID NO: 411059 - RNA, 32 nt, Human
cuucuuuuguaggugggaauccagccucuguu

SEQ ID NO: 411060 - RNA, 32 nt, Human
cuucuuuuuauuucuuguccccaguguguacc

SEQ ID NO: 411061 - RNA, 32 nt, Human
cuucuuuuucccccaaccucccccuccugucc

SEQ ID NO: 411062 - RNA, 32 nt, Human
cuucuuuuucccuuugacuucuacagaaaucu

SEQ ID NO: 411063 - RNA, 18 nt, Human
cuucuuuuucucccuacc

SEQ ID NO: 411064 - RNA, 32 nt, Human
cuucuuuuucugcuuucauuuuaauuuuggga

SEQ ID NO: 411065 - RNA, 32 nt, Human
cuugaaaaacacaggauuauaaaauggugccg

SEQ ID NO: 411066 - RNA, 32 nt, Human
cuugaaaacaggagguggagguugcagugagc

SEQ ID NO: 411067 - RNA, 32 nt, Human
cuugaaaauugauauccuguggugcuaaagua

SEQ ID NO: 411068 - RNA, 32 nt, Human
cuugaaaccagccuggccaacguggugagacc

SEQ ID NO: 411069 - RNA, 21 nt, Human
cuugaaaccaggaguucgaga

SEQ ID NO: 411070 - RNA, 32 nt, Human
cuugaaaccaggaguuugagaccagccugagc

SEQ ID NO: 411071 - RNA, 32 nt, Human
cuugaaacccacaggcggagguugcggugggc

SEQ ID NO: 411072 - RNA, 32 nt, Human
cuugaaaccggaaggcagagguugcagugagc

SEQ ID NO: 411073 - RNA, 32 nt, Human
cuugaaaccgggaggcggagguugaggugagc

SEQ ID NO: 411074 - RNA, 32 nt, Human
cuugaaacucagcuugaagauuucagcaaaug

SEQ ID NO: 411075 - RNA, 32 nt, Human
cuugaaacuggaaggcagagguugcagugagc

SEQ ID NO: 411076 - RNA, 32 nt, Human
cuugaaacugggaggcagggguuggagugagc

SEQ ID NO: 411077 - RNA, 32 nt, Human
cuugaaacugggagguggagguugcagugagc

SEQ ID NO: 411078 - RNA, 32 nt, Human
cuugaaacugguuggggaaugaggugauaagc

SEQ ID NO: 411079 - RNA, 32 nt, Human
cuugaaacugucagggucagaggggaaccacc

SEQ ID NO: 411080 - RNA, 24 nt, Human
cuugaaagacauaggaaaauucau

SEQ ID NO: 411081 - RNA, 31 nt, Human
cuugaaagcacuuucugaccuacagaaguug

SEQ ID NO: 411082 - RNA, 32 nt, Human
cuugaaaggagaaagcacggggucgccccaaa

SEQ ID NO: 411083 - RNA, 32 nt, Human
cuugaaauagaugccucacaauucagacaguu

SEQ ID NO: 411084 - RNA, 32 nt, Human
cuugaaaucaucuagacacugcaaccucuugc

SEQ ID NO: 411085 - RNA, 32 nt, Human
cuugaaauccaauugguuucuguuauagcagu

SEQ ID NO: 411086 - RNA, 32 nt, Human
cuugaaaugggaauugagccuguuagaauuaa

SEQ ID NO: 411087 - RNA, 32 nt, Human
cuugaaauucuugcugccagcacagcagucug

SEQ ID NO: 411088 - RNA, 32 nt, Human
cuugaaauugaggagguuaaaaggaagagccu

SEQ ID NO: 411089 - RNA, 32 nt, Human
cuugaaauuuccacuuucaguuccauucauga

SEQ ID NO: 411090 - RNA, 32 nt, Human
cuugaaauuuuaagaaaccagaaacaaauaaa

SEQ ID NO: 411091 - RNA, 32 nt, Human
cuugaacaagguaggcagagguugcagugagc

SEQ ID NO: 411092 - RNA, 32 nt, Human
cuugaacaagucagcaucucugccuuucaaaa

SEQ ID NO: 411093 - RNA, 22 nt, Human
cuugaacacaaaugugcuuccu

SEQ ID NO: 411094 - RNA, 32 nt, Human
cuugaacacacgucuuguucccacccaucggu

SEQ ID NO: 411095 - RNA, 32 nt, Human
cuugaacacagaagguggagguugcagugagc

SEQ ID NO: 411096 - RNA, 32 nt, Human
cuugaacacaggaggcagagguugcagcgagc

SEQ ID NO: 411097 - RNA, 32 nt, Human
cuugaacacaggaggcagagguugcagugagc

SEQ ID NO: 411098 - RNA, 32 nt, Human
cuugaacaccacugugauucuccaaggacgaa

SEQ ID NO: 411099 - RNA, 32 nt, Human
cuugaacacgggaggcagagguugcagugagc

SEQ ID NO: 411100 - RNA, 20 nt, Human
cuugaacacugaagggcagg

SEQ ID NO: 411101 - RNA, 32 nt, Human
cuugaacagagcgggcuucuucauggcugcgu

SEQ ID NO: 411102 - RNA, 32 nt, Human
cuugaacaggggagauggagguugcagugagc

SEQ ID NO: 411103 - RNA, 31 nt, Human
cuugaacaguuucagguuauauuuuaauuuu

SEQ ID NO: 411104 - RNA, 32 nt, Human
cuugaacaucugagcaguuuugugcuuugagc

SEQ ID NO: 411105 - RNA, 32 nt, Human
cuugaacaugagauggggcugaucugaacuua

SEQ ID NO: 411106 - RNA, 26 nt, Human
cuugaacaugguagagguugcaguga

SEQ ID NO: 411107 - RNA, 32 nt, Human
cuugaacauguccaacuuuaagaacuuuaaga

SEQ ID NO: 411108 - RNA, 32 nt, Human
cuugaaccaaggaggcagagguuguaguaagc

SEQ ID NO: 411109 - RNA, 32 nt, Human
cuugaaccaaggagguggagguugcagugagc

SEQ ID NO: 411110 - RNA, 32 nt, Human
cuugaaccaagguggcagagguugcaguaagc

SEQ ID NO: 411111 - RNA, 32 nt, Human
cuugaaccagagagguggagguugcagugaac

SEQ ID NO: 411112 - RNA, 32 nt, Human
cuugaaccaggaaggcagagguugcacugagc

SEQ ID NO: 411113 - RNA, 32 nt, Human
cuugaaccagggaagcggagguugcagugagc

SEQ ID NO: 411114 - RNA, 32 nt, Human
cuugaaccagggaggcagaggcugcggugagc

SEQ ID NO: 411115 - RNA, 32 nt, Human
cuugaaccagggaggcagagguugcagugagc

SEQ ID NO: 411116 - RNA, 32 nt, Human
cuugaaccagggaggcagagguuguggugagc

SEQ ID NO: 411117 - RNA, 32 nt, Human
cuugaaccagggaggcagaguuugcagugaau

SEQ ID NO: 411118 - RNA, 32 nt, Human
cuugaaccagggaggcggagguugcagcaagc

SEQ ID NO: 411119 - RNA, 32 nt, Human
cuugaaccagggaggcggagguugcagugagc

SEQ ID NO: 411120 - RNA, 32 nt, Human
cuugaaccagggagguggagguugcagugagc

SEQ ID NO: 411121 - RNA, 21 nt, Human
cuugaacccaagaggcagagg

SEQ ID NO: 411122 - RNA, 32 nt, Human
cuugaacccaagaggcagaggaugcaaugagc

SEQ ID NO: 411123 - RNA, 22 nt, Human
cuugaacccaagaggcagaggu

SEQ ID NO: 411124 - RNA, 32 nt, Human
cuugaacccaagaggcagagguugcagugaac

SEQ ID NO: 411125 - RNA, 32 nt, Human
cuugaacccaagaggcagaguuugcagugagc

SEQ ID NO: 411126 - RNA, 22 nt, Human
cuugaacccaagaggcggaggu

SEQ ID NO: 411127 - RNA, 32 nt, Human
cuugaacccaagaggcggagguugcagugagc

SEQ ID NO: 411128 - RNA, 32 nt, Human
cuugaacccaagaggcggagguuguggugagc

SEQ ID NO: 411129 - RNA, 32 nt, Human
cuugaacccaagaggucgaggcugcagugagc

SEQ ID NO: 411130 - RNA, 32 nt, Human
cuugaacccaagagguggaggcugaagugagc

SEQ ID NO: 411131 - RNA, 32 nt, Human
cuugaacccaagagguggagguugcggugagc

SEQ ID NO: 411132 - RNA, 32 nt, Human
cuugaacccaccucccugucccuggacucuac

SEQ ID NO: 411133 - RNA, 32 nt, Human
cuugaacccagaaagcggagguugcagugacc

SEQ ID NO: 411134 - RNA, 32 nt, Human
cuugaacccagaagacagguugcagugagcca

SEQ ID NO: 411135 - RNA, 32 nt, Human
cuugaacccagaaggcagagguugcagugagc

SEQ ID NO: 411136 - RNA, 32 nt, Human
cuugaacccagaagguagagguugcagccaag

SEQ ID NO: 411137 - RNA, 32 nt, Human
cuugaacccagaaggugcagguugcagugagc

SEQ ID NO: 411138 - RNA, 32 nt, Human
cuugaacccagauagcagagguugcagugagc

SEQ ID NO: 411139 - RNA, 32 nt, Human
cuugaacccagcagauggagguugcagugagc

SEQ ID NO: 411140 - RNA, 32 nt, Human
cuugaacccagcaggcagagguugcagugagc

SEQ ID NO: 411141 - RNA, 32 nt, Human
cuugaacccagcaggcggagguugcggugagu

SEQ ID NO: 411142 - RNA, 32 nt, Human
cuugaacccagcaguucgagacuugccugggc

SEQ ID NO: 411143 - RNA, 32 nt, Human
cuugaacccaggaagcagagguugcaguaagc

SEQ ID NO: 411144 - RNA, 32 nt, Human
cuugaacccaggaagcagagguugcagugagc

SEQ ID NO: 411145 - RNA, 32 nt, Human
cuugaacccaggaagcagugguugagaucacg

SEQ ID NO: 411146 - RNA, 32 nt, Human
cuugaacccaggaagcggagguugcaaucagc

SEQ ID NO: 411147 - RNA, 32 nt, Human
cuugaacccaggaagcggagguugcagugagc

SEQ ID NO: 411148 - RNA, 32 nt, Human
cuugaacccaggaagcggagguuguggugagc

SEQ ID NO: 411149 - RNA, 32 nt, Human
cuugaacccaggaagcgggguugcagugagcc

SEQ ID NO: 411150 - RNA, 32 nt, Human
cuugaacccaggaaguagaagcuacagugagu

SEQ ID NO: 411151 - RNA, 32 nt, Human
cuugaacccaggaaguagagguugcagugagc

SEQ ID NO: 411152 - RNA, 32 nt, Human
cuugaacccaggaaguggagacugcagugagc

SEQ ID NO: 411153 - RNA, 32 nt, Human
cuugaacccaggaaguggagguugcagugagc

SEQ ID NO: 411154 - RNA, 32 nt, Human
cuugaacccaggaaguggcaguugcagugagc

SEQ ID NO: 411155 - RNA, 32 nt, Human
cuugaacccaggaauucaggcugcaguaagcu

SEQ ID NO: 411156 - RNA, 32 nt, Human
cuugaacccaggacgcagagguugcggugagc

SEQ ID NO: 411157 - RNA, 32 nt, Human
cuugaacccaggagacagagguugcagugagc

SEQ ID NO: 411158 - RNA, 32 nt, Human
cuugaacccaggagacagagguuguagugagc

SEQ ID NO: 411159 - RNA, 32 nt, Human
cuugaacccaggagacagagguuguggugggg

SEQ ID NO: 411160 - RNA, 32 nt, Human
cuugaacccaggagacagggguugcagugagc

SEQ ID NO: 411161 - RNA, 32 nt, Human
cuugaacccaggagacauggguugcagugagc

SEQ ID NO: 411162 - RNA, 32 nt, Human
cuugaacccaggagacgagguugcagugagcc

SEQ ID NO: 411163 - RNA, 32 nt, Human
cuugaacccaggagacggaaguugcagugagc

SEQ ID NO: 411164 - RNA, 32 nt, Human
cuugaacccaggagacggagguugcagugagc

SEQ ID NO: 411165 - RNA, 32 nt, Human
cuugaacccaggagacggagguugcggugagu

SEQ ID NO: 411166 - RNA, 32 nt, Human
cuugaacccaggagacggugguugcagugagc

SEQ ID NO: 411167 - RNA, 32 nt, Human
cuugaacccaggagaggaagguugcaguaagc

SEQ ID NO: 411168 - RNA, 32 nt, Human
cuugaacccaggagauagagguugcaaugagc

SEQ ID NO: 411169 - RNA, 32 nt, Human
cuugaacccaggagauggaaguugcagugagc

SEQ ID NO: 411170 - RNA, 32 nt, Human
cuugaacccaggagauggagauugcaguaggc

SEQ ID NO: 411171 - RNA, 32 nt, Human
cuugaacccaggagauggagguugcagugagc

SEQ ID NO: 411172 - RNA, 32 nt, Human
cuugaacccaggagauggagguugcggugagc

SEQ ID NO: 411173 - RNA, 32 nt, Human
cuugaacccaggagauugagguuguagugagc

SEQ ID NO: 411174 - RNA, 32 nt, Human
cuugaacccaggaggaagagguugcagugagc

SEQ ID NO: 411175 - RNA, 32 nt, Human
cuugaacccaggaggagguggagaucgcagug

SEQ ID NO: 411176 - RNA, 32 nt, Human
cuugaacccaggaggcacagauugcagugagc

SEQ ID NO: 411177 - RNA, 32 nt, Human
cuugaacccaggaggcagaaguugcagugagc

SEQ ID NO: 411178 - RNA, 32 nt, Human
cuugaacccaggaggcagagaucgcagugagu

SEQ ID NO: 411179 - RNA, 32 nt, Human
cuugaacccaggaggcagagauugcagugagc

SEQ ID NO: 411180 - RNA, 32 nt, Human
cuugaacccaggaggcagagauugcggugagc

SEQ ID NO: 411181 - RNA, 32 nt, Human
cuugaacccaggaggcagaggguugcagugag

SEQ ID NO: 411182 - RNA, 32 nt, Human
cuugaacccaggaggcagagguuacaguaaac

SEQ ID NO: 411183 - RNA, 32 nt, Human
cuugaacccaggaggcagagguuacagugagc

SEQ ID NO: 411184 - RNA, 32 nt, Human
cuugaacccaggaggcagagguugcaaugagc

SEQ ID NO: 411185 - RNA, 32 nt, Human
cuugaacccaggaggcagagguugcaguaagc

SEQ ID NO: 411186 - RNA, 32 nt, Human
cuugaacccaggaggcagagguugcagucagc

SEQ ID NO: 411187 - RNA, 32 nt, Human
cuugaacccaggaggcagagguugcagugagc

SEQ ID NO: 411188 - RNA, 32 nt, Human
cuugaacccaggaggcagagguugcagugagu

SEQ ID NO: 411189 - RNA, 32 nt, Human
cuugaacccaggaggcagagguugcagugcac

SEQ ID NO: 411190 - RNA, 32 nt, Human
cuugaacccaggaggcagagguugcagugcgc

SEQ ID NO: 411191 - RNA, 32 nt, Human
cuugaacccaggaggcagagguugcagugggc

SEQ ID NO: 411192 - RNA, 32 nt, Human
cuugaacccaggaggcagagguugcggugagc

SEQ ID NO: 411193 - RNA, 32 nt, Human
cuugaacccaggaggcagagguugcguugagc

SEQ ID NO: 411194 - RNA, 32 nt, Human
cuugaacccaggaggcagagguuggggugagc

SEQ ID NO: 411195 - RNA, 32 nt, Human
cuugaacccaggaggcagagguuguagugagc

SEQ ID NO: 411196 - RNA, 32 nt, Human
cuugaacccaggaggcagaguuugcagucagc

SEQ ID NO: 411197 - RNA, 32 nt, Human
cuugaacccaggaggcagaguuugcagugagc

SEQ ID NO: 411198 - RNA, 32 nt, Human
cuugaacccaggaggcagcuguugcagugagc

SEQ ID NO: 411199 - RNA, 32 nt, Human
cuugaacccaggaggcagugauugcagugagc

SEQ ID NO: 411200 - RNA, 32 nt, Human
cuugaacccaggaggcagugguugcaaugagc

SEQ ID NO: 411201 - RNA, 32 nt, Human
cuugaacccaggaggccgagguugcagugagc

SEQ ID NO: 411202 - RNA, 32 nt, Human
cuugaacccaggaggcgaagguugcaguaaac

SEQ ID NO: 411203 - RNA, 32 nt, Human
cuugaacccaggaggcggaaguugcagugagc

SEQ ID NO: 411204 - RNA, 32 nt, Human
cuugaacccaggaggcggagauugcagugagc

SEQ ID NO: 411205 - RNA, 32 nt, Human
cuugaacccaggaggcggagcuugcagugagc

SEQ ID NO: 411206 - RNA, 32 nt, Human
cuugaacccaggaggcggaggcagaggcugca

SEQ ID NO: 411207 - RNA, 32 nt, Human
cuugaacccaggaggcggaggcugcagugagc

SEQ ID NO: 411208 - RNA, 32 nt, Human
cuugaacccaggaggcggagguagcagugagc

SEQ ID NO: 411209 - RNA, 32 nt, Human
cuugaacccaggaggcggagguaguggugagc

SEQ ID NO: 411210 - RNA, 32 nt, Human
cuugaacccaggaggcggagguuacagugagc

SEQ ID NO: 411211 - RNA, 32 nt, Human
cuugaacccaggaggcggagguugcacugagc

SEQ ID NO: 411212 - RNA, 32 nt, Human
cuugaacccaggaggcggagguugcaguaagc

SEQ ID NO: 411213 - RNA, 32 nt, Human
cuugaacccaggaggcggagguugcagugaac

SEQ ID NO: 411214 - RNA, 32 nt, Human
cuugaacccaggaggcggagguugcagugaga

SEQ ID NO: 411215 - RNA, 32 nt, Human
cuugaacccaggaggcggagguugcagugagc

SEQ ID NO: 411216 - RNA, 32 nt, Human
cuugaacccaggaggcggagguugcagugauc

SEQ ID NO: 411217 - RNA, 32 nt, Human
cuugaacccaggaggcggagguugccgugagc

SEQ ID NO: 411218 - RNA, 32 nt, Human
cuugaacccaggaggcggagguugcggugagc

SEQ ID NO: 411219 - RNA, 32 nt, Human
cuugaacccaggaggcggagguugcggugagu

SEQ ID NO: 411220 - RNA, 32 nt, Human
cuugaacccaggaggcggagguuguagugagc

SEQ ID NO: 411221 - RNA, 32 nt, Human
cuugaacccaggaggcggagguuguggugagc

SEQ ID NO: 411222 - RNA, 32 nt, Human
cuugaacccaggaggcggaguuugcagugagc

SEQ ID NO: 411223 - RNA, 32 nt, Human
cuugaacccaggaggcggggguugcagugagu

SEQ ID NO: 411224 - RNA, 32 nt, Human
cuugaacccaggaggcugagguugcagugagc

SEQ ID NO: 411225 - RNA, 32 nt, Human
cuugaacccaggagguagaagcugcagugagc

SEQ ID NO: 411226 - RNA, 32 nt, Human
cuugaacccaggagguagaaguugcagugagc

SEQ ID NO: 411227 - RNA, 32 nt, Human
cuugaacccaggagguagaggcugcagugagc

SEQ ID NO: 411228 - RNA, 32 nt, Human
cuugaacccaggagguagagguugcagugagc

SEQ ID NO: 411229 - RNA, 32 nt, Human
cuugaacccaggaggugaagguugcagugacc

SEQ ID NO: 411230 - RNA, 32 nt, Human
cuugaacccaggaggugcagguugcagugagc

SEQ ID NO: 411231 - RNA, 32 nt, Human
cuugaacccaggagguggaaguugcuuugagc

SEQ ID NO: 411232 - RNA, 32 nt, Human
cuugaacccaggagguggagauugcagugagc

SEQ ID NO: 411233 - RNA, 32 nt, Human
cuugaacccaggagguggaggaugcagugaac

SEQ ID NO: 411234 - RNA, 32 nt, Human
cuugaacccaggagguggaggcugcggugagc

SEQ ID NO: 411235 - RNA, 32 nt, Human
cuugaacccaggagguggagguagcagugagc

SEQ ID NO: 411236 - RNA, 32 nt, Human
cuugaacccaggagguggagguuacagugagc

SEQ ID NO: 411237 - RNA, 32 nt, Human
cuugaacccaggagguggagguuccagugagc

SEQ ID NO: 411238 - RNA, 32 nt, Human
cuugaacccaggagguggagguugcaagugag

SEQ ID NO: 411239 - RNA, 32 nt, Human
cuugaacccaggagguggagguugcagcaagc

SEQ ID NO: 411240 - RNA, 32 nt, Human
cuugaacccaggagguggagguugcaguaagc

SEQ ID NO: 411241 - RNA, 32 nt, Human
cuugaacccaggagguggagguugcagugaac

SEQ ID NO: 411242 - RNA, 32 nt, Human
cuugaacccaggagguggagguugcagugagc

SEQ ID NO: 411243 - RNA, 32 nt, Human
cuugaacccaggagguggagguugcagugagg

SEQ ID NO: 411244 - RNA, 32 nt, Human
cuugaacccaggagguggagguugcagugagu

SEQ ID NO: 411245 - RNA, 32 nt, Human
cuugaacccaggagguggagguugcagugggc

SEQ ID NO: 411246 - RNA, 32 nt, Human
cuugaacccaggagguggagguugcaguuagc

SEQ ID NO: 411247 - RNA, 32 nt, Human
cuugaacccaggagguggagguugcggugagc

SEQ ID NO: 411248 - RNA, 32 nt, Human
cuugaacccaggagguggagguugcugugagc

SEQ ID NO: 411249 - RNA, 32 nt, Human
cuugaacccaggagguggagguuguagugaga

SEQ ID NO: 411250 - RNA, 32 nt, Human
cuugaacccaggagguggagguuguggugagc

SEQ ID NO: 411251 - RNA, 32 nt, Human
cuugaacccaggagguggaguuugcagugagc

SEQ ID NO: 411252 - RNA, 32 nt, Human
cuugaacccaggaggugggcauugcagugagc

SEQ ID NO: 411253 - RNA, 32 nt, Human
cuugaacccaggagguggggguugcaccgagc

SEQ ID NO: 411254 - RNA, 32 nt, Human
cuugaacccaggagguggugguugcagugagc

SEQ ID NO: 411255 - RNA, 32 nt, Human
cuugaacccaggagguguugcagugaaccaag

SEQ ID NO: 411256 - RNA, 21 nt, Human
cuugaacccaggagguugagg

SEQ ID NO: 411257 - RNA, 32 nt, Human
cuugaacccaggagguugaggcugcagugagu

SEQ ID NO: 411258 - RNA, 32 nt, Human
cuugaacccaggagucagagguuucagugagc

SEQ ID NO: 411259 - RNA, 32 nt, Human
cuugaacccaggagucggagguugcagugagu

SEQ ID NO: 411260 - RNA, 32 nt, Human
cuugaacccaggaguucaagaauagccugggc

SEQ ID NO: 411261 - RNA, 32 nt, Human
cuugaacccaggaguucaagaccagccuggac

SEQ ID NO: 411262 - RNA, 32 nt, Human
cuugaacccaggaguucaagaccagccugggc

SEQ ID NO: 411263 - RNA, 32 nt, Human
cuugaacccaggaguucaagaucagccugggc

SEQ ID NO: 411264 - RNA, 32 nt, Human
cuugaacccaggaguucaagucugcagugagc

SEQ ID NO: 411265 - RNA, 32 nt, Human
cuugaacccaggaguucgagaccagccugggc

SEQ ID NO: 411266 - RNA, 32 nt, Human
cuugaacccaggaguucgagaccauccugggc

SEQ ID NO: 411267 - RNA, 32 nt, Human
cuugaacccaggaguuucagaccaccuuggca

SEQ ID NO: 411268 - RNA, 32 nt, Human
cuugaacccaggaguuugacaucaaccugggc

SEQ ID NO: 411269 - RNA, 21 nt, Human
cuugaacccaggaguuugaga

SEQ ID NO: 411270 - RNA, 32 nt, Human
cuugaacccaggcaguggagguugcagugagc

SEQ ID NO: 411271 - RNA, 32 nt, Human
cuugaacccaggcggcagagguugcagugagu

SEQ ID NO: 411272 - RNA, 32 nt, Human
cuugaacccagggggcagagguugcagugagc

SEQ ID NO: 411273 - RNA, 32 nt, Human
cuugaacccaggggguggagguugcacugagc

SEQ ID NO: 411274 - RNA, 32 nt, Human
cuugaacccagguuguggagguuguagugagc

SEQ ID NO: 411275 - RNA, 32 nt, Human
cuugaacccaguagaggaagguugcaguaagc

SEQ ID NO: 411276 - RNA, 32 nt, Human
cuugaacccaguggcggaggcugcagugagcc

SEQ ID NO: 411277 - RNA, 32 nt, Human
cuugaacccauaaggcagagguugcagugagc

SEQ ID NO: 411278 - RNA, 32 nt, Human
cuugaacccaugaggcggagguugcagugagc

SEQ ID NO: 411279 - RNA, 32 nt, Human
cuugaacccaugagguggagguugcggugagc

SEQ ID NO: 411280 - RNA, 32 nt, Human
cuugaaccccagaggcagagguugcggugagc

SEQ ID NO: 411281 - RNA, 32 nt, Human
cuugaaccccagaggcggagguugcagugagc

SEQ ID NO: 411282 - RNA, 32 nt, Human
cuugaaccccggaggcggagguugcagugagc

SEQ ID NO: 411283 - RNA, 32 nt, Human
cuugaaccccggagguagagguugcagugagc

SEQ ID NO: 411284 - RNA, 22 nt, Human
cuugaacccgagagacggaggu

SEQ ID NO: 411285 - RNA, 32 nt, Human
cuugaacccgagagacggagguugcagugagc

SEQ ID NO: 411286 - RNA, 32 nt, Human
cuugaacccgagaggcggaaguugcagugagc

SEQ ID NO: 411287 - RNA, 32 nt, Human
cuugaacccgagaggcggagcuugcagugagc

SEQ ID NO: 411288 - RNA, 22 nt, Human
cuugaacccgagaggcggaggu

SEQ ID NO: 411289 - RNA, 23 nt, Human
cuugaacccgagaggcggaggug

SEQ ID NO: 411290 - RNA, 32 nt, Human
cuugaacccgagaggcggagguugcagugagc

SEQ ID NO: 411291 - RNA, 22 nt, Human
cuugaacccgagagguggaggu

SEQ ID NO: 411292 - RNA, 32 nt, Human
cuugaacccgagagguggagguugaagugagc

SEQ ID NO: 411293 - RNA, 32 nt, Human
cuugaacccgagagguggagguugcagugaac

SEQ ID NO: 411294 - RNA, 32 nt, Human
cuugaacccgagagguggagguugcagugagc

SEQ ID NO: 411295 - RNA, 32 nt, Human
cuugaacccggaaggcagagguugcagugagc

SEQ ID NO: 411296 - RNA, 32 nt, Human
cuugaacccggaaggcggagguugcagugagc

SEQ ID NO: 411297 - RNA, 32 nt, Human
cuugaacccggaagguggagguuguugcggug

SEQ ID NO: 411298 - RNA, 32 nt, Human
cuugaacccggcaggaagagguugcauugagc

SEQ ID NO: 411299 - RNA, 32 nt, Human
cuugaacccggcaggcagagguugcagugagc

SEQ ID NO: 411300 - RNA, 32 nt, Human
cuugaacccggcgggcagagguugcaguaagc

SEQ ID NO: 411301 - RNA, 32 nt, Human
cuugaacccgggaagcagagguugcagugaca

SEQ ID NO: 411302 - RNA, 32 nt, Human
cuugaacccgggaagcagagguugcagugagc

SEQ ID NO: 411303 - RNA, 32 nt, Human
cuugaacccgggaagcagagguugcggugagc

SEQ ID NO: 411304 - RNA, 32 nt, Human
cuugaacccgggaagcggagguugcagugagc

SEQ ID NO: 411305 - RNA, 32 nt, Human
cuugaacccgggaaguggaggcuggaguaaac

SEQ ID NO: 411306 - RNA, 32 nt, Human
cuugaacccgggaaguggagguugccgugagu

SEQ ID NO: 411307 - RNA, 32 nt, Human
cuugaacccgggagacggagguugcagugagc

SEQ ID NO: 411308 - RNA, 32 nt, Human
cuugaacccgggagacggcgcuugcagugagc

SEQ ID NO: 411309 - RNA, 32 nt, Human
cuugaacccgggagacgggagguuguggugag

SEQ ID NO: 411310 - RNA, 32 nt, Human
cuugaacccgggagaugaagguugcagugagc

SEQ ID NO: 411311 - RNA, 32 nt, Human
cuugaacccgggaggaggagguugcacugagc

SEQ ID NO: 411312 - RNA, 32 nt, Human
cuugaacccgggaggcaaagguugcagugagc

SEQ ID NO: 411313 - RNA, 32 nt, Human
cuugaacccgggaggcaaagguugcgguaagc

SEQ ID NO: 411314 - RNA, 32 nt, Human
cuugaacccgggaggcacagguuccagugggc

SEQ ID NO: 411315 - RNA, 32 nt, Human
cuugaacccgggaggcagaaguugcagugaac

SEQ ID NO: 411316 - RNA, 32 nt, Human
cuugaacccgggaggcagacuuugcagugagc

SEQ ID NO: 411317 - RNA, 32 nt, Human
cuugaacccgggaggcagagauagcagugaac

SEQ ID NO: 411318 - RNA, 32 nt, Human
cuugaacccgggaggcagagauugcaguaagc

SEQ ID NO: 411319 - RNA, 32 nt, Human
cuugaacccgggaggcagaggcugcacucuag

SEQ ID NO: 411320 - RNA, 32 nt, Human
cuugaacccgggaggcagaggcugcagugagc

SEQ ID NO: 411321 - RNA, 32 nt, Human
cuugaacccgggaggcagaggcuguagugagc

SEQ ID NO: 411322 - RNA, 32 nt, Human
cuugaacccgggaggcagagggugcaguaagc

SEQ ID NO: 411323 - RNA, 32 nt, Human
cuugaacccgggaggcagagguaguagugagc

SEQ ID NO: 411324 - RNA, 32 nt, Human
cuugaacccgggaggcagagguggcugugagc

SEQ ID NO: 411325 - RNA, 32 nt, Human
cuugaacccgggaggcagagguuacagugagc

SEQ ID NO: 411326 - RNA, 32 nt, Human
cuugaacccgggaggcagagguuaucgugagc

SEQ ID NO: 411327 - RNA, 32 nt, Human
cuugaacccgggaggcagagguugaagugagc

SEQ ID NO: 411328 - RNA, 32 nt, Human
cuugaacccgggaggcagagguugcagccggc

SEQ ID NO: 411329 - RNA, 32 nt, Human
cuugaacccgggaggcagagguugcaguaagc

SEQ ID NO: 411330 - RNA, 32 nt, Human
cuugaacccgggaggcagagguugcagugagc

SEQ ID NO: 411331 - RNA, 32 nt, Human
cuugaacccgggaggcagagguugcagugagg

SEQ ID NO: 411332 - RNA, 32 nt, Human
cuugaacccgggaggcagagguugcagugagu

SEQ ID NO: 411333 - RNA, 32 nt, Human
cuugaacccgggaggcagagguugcauugagc

SEQ ID NO: 411334 - RNA, 32 nt, Human
cuugaacccgggaggcagagguugcggugagc

SEQ ID NO: 411335 - RNA, 32 nt, Human
cuugaacccgggaggcagagguugcuguaagc

SEQ ID NO: 411336 - RNA, 32 nt, Human
cuugaacccgggaggcagagguuguagugagc

SEQ ID NO: 411337 - RNA, 32 nt, Human
cuugaacccgggaggcagcaguugcagugagc

SEQ ID NO: 411338 - RNA, 32 nt, Human
cuugaacccgggaggcggaaguuucagcgagc

SEQ ID NO: 411339 - RNA, 32 nt, Human
cuugaacccgggaggcggagauugcagugagc

SEQ ID NO: 411340 - RNA, 32 nt, Human
cuugaacccgggaggcggagauugcggugagc

SEQ ID NO: 411341 - RNA, 32 nt, Human
cuugaacccgggaggcggagcuugcagugaac

SEQ ID NO: 411342 - RNA, 32 nt, Human
cuugaacccgggaggcggagcuugcagugagc

SEQ ID NO: 411343 - RNA, 32 nt, Human
cuugaacccgggaggcggaggcugcagugagu

SEQ ID NO: 411344 - RNA, 32 nt, Human
cuugaacccgggaggcggagguuacagugagc

SEQ ID NO: 411345 - RNA, 32 nt, Human
cuugaacccgggaggcggagguuauggagagc

SEQ ID NO: 411346 - RNA, 32 nt, Human
cuugaacccgggaggcggagguucauggggaa

SEQ ID NO: 411347 - RNA, 32 nt, Human
cuugaacccgggaggcggagguuccagugagc

SEQ ID NO: 411348 - RNA, 32 nt, Human
cuugaacccgggaggcggagguugcaguaagc

SEQ ID NO: 411349 - RNA, 32 nt, Human
cuugaacccgggaggcggagguugcagugagc

SEQ ID NO: 411350 - RNA, 32 nt, Human
cuugaacccgggaggcggagguugcagugagg

SEQ ID NO: 411351 - RNA, 32 nt, Human
cuugaacccgggaggcggagguugcaguuagc

SEQ ID NO: 411352 - RNA, 32 nt, Human
cuugaacccgggaggcggagguugcaugagcu

SEQ ID NO: 411353 - RNA, 32 nt, Human
cuugaacccgggaggcggagguugcgacccaa

SEQ ID NO: 411354 - RNA, 32 nt, Human
cuugaacccgggaggcggagguugcggugagc

SEQ ID NO: 411355 - RNA, 32 nt, Human
cuugaacccgggaggcggagguuguagugagc

SEQ ID NO: 411356 - RNA, 32 nt, Human
cuugaacccgggaggcggagguuguggugagc

SEQ ID NO: 411357 - RNA, 32 nt, Human
cuugaacccgggaggcggagguuucagugagc

SEQ ID NO: 411358 - RNA, 32 nt, Human
cuugaacccgggaggcggaguugcggugagcc

SEQ ID NO: 411359 - RNA, 32 nt, Human
cuugaacccgggaggcggaguuugcagugagc

SEQ ID NO: 411360 - RNA, 32 nt, Human
cuugaacccgggaggcggaguuuugccagccu

SEQ ID NO: 411361 - RNA, 32 nt, Human
cuugaacccgggagggagagguugcagugagc

SEQ ID NO: 411362 - RNA, 32 nt, Human
cuugaacccgggagguagaggcugcaaugggc

SEQ ID NO: 411363 - RNA, 32 nt, Human
cuugaacccgggagguagagguugcagugagc

SEQ ID NO: 411364 - RNA, 32 nt, Human
cuugaacccgggagguggagauugcagugagc

SEQ ID NO: 411365 - RNA, 32 nt, Human
cuugaacccgggagguggagccuacagugagu

SEQ ID NO: 411366 - RNA, 32 nt, Human
cuugaacccgggagguggaggcugcaaugagc

SEQ ID NO: 411367 - RNA, 32 nt, Human
cuugaacccgggagguggaggcugcagcgagc

SEQ ID NO: 411368 - RNA, 32 nt, Human
cuugaacccgggagguggaggcugcagugagc

SEQ ID NO: 411369 - RNA, 32 nt, Human
cuugaacccgggagguggaggcugcagugagu

SEQ ID NO: 411370 - RNA, 32 nt, Human
cuugaacccgggagguggaggcugcggugagc

SEQ ID NO: 411371 - RNA, 32 nt, Human
cuugaacccgggagguggaggucgcggugagc

SEQ ID NO: 411372 - RNA, 32 nt, Human
cuugaacccgggagguggagguggagguugca

SEQ ID NO: 411373 - RNA, 32 nt, Human
cuugaacccgggagguggagguggcagugagc

SEQ ID NO: 411374 - RNA, 32 nt, Human
cuugaacccgggagguggagguuacagugagc

SEQ ID NO: 411375 - RNA, 32 nt, Human
cuugaacccgggagguggagguucuagugagc

SEQ ID NO: 411376 - RNA, 32 nt, Human
cuugaacccgggagguggagguugcaaugagc

SEQ ID NO: 411377 - RNA, 32 nt, Human
cuugaacccgggagguggagguugcagcaagc

SEQ ID NO: 411378 - RNA, 32 nt, Human
cuugaacccgggagguggagguugcaguaagc

SEQ ID NO: 411379 - RNA, 32 nt, Human
cuugaacccgggagguggagguugcagugaac

SEQ ID NO: 411380 - RNA, 32 nt, Human
cuugaacccgggagguggagguugcagugagc

SEQ ID NO: 411381 - RNA, 32 nt, Human
cuugaacccgggagguggagguugcagugagg

SEQ ID NO: 411382 - RNA, 32 nt, Human
cuugaacccgggagguggagguugccgugagc

SEQ ID NO: 411383 - RNA, 32 nt, Human
cuugaacccgggagguggagguugccgugagu

SEQ ID NO: 411384 - RNA, 32 nt, Human
cuugaacccgggagguggagguugcgaugagc

SEQ ID NO: 411385 - RNA, 32 nt, Human
cuugaacccgggagguggagguugcggugagc

SEQ ID NO: 411386 - RNA, 32 nt, Human
cuugaacccgggagguggagguuguagcgagc

SEQ ID NO: 411387 - RNA, 32 nt, Human
cuugaacccgggagguggagguuguagugagc

SEQ ID NO: 411388 - RNA, 32 nt, Human
cuugaacccgggagguggcaguugcagggagc

SEQ ID NO: 411389 - RNA, 32 nt, Human
cuugaacccgggaggugggaguuguagugagc

SEQ ID NO: 411390 - RNA, 32 nt, Human
cuugaacccgggagguguagguugcagugagc

SEQ ID NO: 411391 - RNA, 32 nt, Human
cuugaacccgggaguuaaagguugcagugagc

SEQ ID NO: 411392 - RNA, 32 nt, Human
cuugaacccgggaguuggagguugcagugagc

SEQ ID NO: 411393 - RNA, 32 nt, Human
cuugaacccgggaugcagagguugcagugagc

SEQ ID NO: 411394 - RNA, 32 nt, Human
cuugaacccgggcagcggagguugcagugagc

SEQ ID NO: 411395 - RNA, 32 nt, Human
cuugaacccgggggcagaggcugcagugagcc

SEQ ID NO: 411396 - RNA, 32 nt, Human
cuugaacccggguggcagagguugcagugagc

SEQ ID NO: 411397 - RNA, 32 nt, Human
cuugaacccgguaggcagagguugcagugagc

SEQ ID NO: 411398 - RNA, 32 nt, Human
cuugaacccgugaggcagagguugcagugaac

SEQ ID NO: 411399 - RNA, 32 nt, Human
cuugaacccgugaggcggagguuguagugagc

SEQ ID NO: 411400 - RNA, 32 nt, Human
cuugaacccuaaaggcagagguugcagugagc

SEQ ID NO: 411401 - RNA, 32 nt, Human
cuugaacccuggaaguggagguugcagugagc

SEQ ID NO: 411402 - RNA, 32 nt, Human
cuugaacccuggaggcagaggugguagugagc

SEQ ID NO: 411403 - RNA, 32 nt, Human
cuugaacccuggaggcagagguugcaaugagc

SEQ ID NO: 411404 - RNA, 32 nt, Human
cuugaacccuggaggcagagguuguggugagc

SEQ ID NO: 411405 - RNA, 32 nt, Human
cuugaacccuggaggcagagguuguggugagu

SEQ ID NO: 411406 - RNA, 32 nt, Human
cuugaacccuggaggcggagguugcagugagc

SEQ ID NO: 411407 - RNA, 32 nt, Human
cuugaacccuggaggcggagguugcagugagu

SEQ ID NO: 411408 - RNA, 32 nt, Human
cuugaacccuggagguggagguggagguugca

SEQ ID NO: 411409 - RNA, 32 nt, Human
cuugaacccuggagguggagguugcagugagc

SEQ ID NO: 411410 - RNA, 32 nt, Human
cuugaacccuggagguggcgguugcagugagc

SEQ ID NO: 411411 - RNA, 32 nt, Human
cuugaaccgaggaggcgaagguugcagugagc

SEQ ID NO: 411412 - RNA, 32 nt, Human
cuugaaccggggagacggagguugcagugagc

SEQ ID NO: 411413 - RNA, 32 nt, Human
cuugaaccggggaggcagagguugcagugagc

SEQ ID NO: 411414 - RNA, 32 nt, Human
cuugaaccggggaggcagagguugcaguuaag

SEQ ID NO: 411415 - RNA, 32 nt, Human
cuugaaccggggagguggaggcugcagugagc

SEQ ID NO: 411416 - RNA, 32 nt, Human
cuugaaccggggagguggagguugcagugagc

SEQ ID NO: 411417 - RNA, 32 nt, Human
cuugaaccggggaguuggagguugcagugagc

SEQ ID NO: 411418 - RNA, 32 nt, Human
cuugaaccuagaagguggagguugcagugagc

SEQ ID NO: 411419 - RNA, 32 nt, Human
cuugaaccuaggaagugcagguugaagugagc

SEQ ID NO: 411420 - RNA, 32 nt, Human
cuugaaccuaggaggcagaaguugcagugagc

SEQ ID NO: 411421 - RNA, 32 nt, Human
cuugaaccuaggaggcagagguugcagugagc

SEQ ID NO: 411422 - RNA, 32 nt, Human
cuugaaccuaggaggcggagguugcagugagc

SEQ ID NO: 411423 - RNA, 32 nt, Human
cuugaaccuaggaggcggagguugcagugagu

SEQ ID NO: 411424 - RNA, 32 nt, Human
cuugaaccuaggaggggaagguugcagugagc

SEQ ID NO: 411425 - RNA, 21 nt, Human
cuugaaccuaggaggucgagg

SEQ ID NO: 411426 - RNA, 32 nt, Human
cuugaaccuaggaggucgaggcugcagugagc

SEQ ID NO: 411427 - RNA, 32 nt, Human
cuugaaccuaggagguggagguugcagugagc

SEQ ID NO: 411428 - RNA, 32 nt, Human
cuugaaccuaggagguggagguugcauucaac

SEQ ID NO: 411429 - RNA, 21 nt, Human
cuugaaccuaggaguucgaga

SEQ ID NO: 411430 - RNA, 32 nt, Human
cuugaaccucaagcucucucuaaggagcuguu

SEQ ID NO: 411431 - RNA, 32 nt, Human
cuugaaccucagcggcggagguugcagugagu

SEQ ID NO: 411432 - RNA, 32 nt, Human
cuugaaccucggaggcggagguugcagugagc

SEQ ID NO: 411433 - RNA, 32 nt, Human
cuugaaccugagaaguggagguuguggugagc

SEQ ID NO: 411434 - RNA, 32 nt, Human
cuugaaccugagagacggagguugcagggagc

SEQ ID NO: 411435 - RNA, 32 nt, Human
cuugaaccugagaggcagagguuacagugagc

SEQ ID NO: 411436 - RNA, 32 nt, Human
cuugaaccugagaggcagagguugcagugagc

SEQ ID NO: 411437 - RNA, 32 nt, Human
cuugaaccugagaggcggagguugcagugagc

SEQ ID NO: 411438 - RNA, 32 nt, Human
cuugaaccugagaggugagguugcagugagcc

SEQ ID NO: 411439 - RNA, 32 nt, Human
cuugaaccugagagguggagguugcagugagc

SEQ ID NO: 411440 - RNA, 32 nt, Human
cuugaaccugagagguggagguuucagugagc

SEQ ID NO: 411441 - RNA, 32 nt, Human
cuugaaccugcgaggcagagauugcagugagc

SEQ ID NO: 411442 - RNA, 32 nt, Human
cuugaaccuggaaggcagagauugcagugagc

SEQ ID NO: 411443 - RNA, 32 nt, Human
cuugaaccuggaaggcagggguugcagugacc

SEQ ID NO: 411444 - RNA, 32 nt, Human
cuugaaccuggaaggcggagguugcagugagc

SEQ ID NO: 411445 - RNA, 32 nt, Human
cuugaaccuggcaaguguagguugcagugagc

SEQ ID NO: 411446 - RNA, 32 nt, Human
cuugaaccuggcaggcagagguugcagugagc

SEQ ID NO: 411447 - RNA, 32 nt, Human
cuugaaccuggcaggcagaguuugcagugaac

SEQ ID NO: 411448 - RNA, 32 nt, Human
cuugaaccuggcaggcggagguugcagugagc

SEQ ID NO: 411449 - RNA, 32 nt, Human
cuugaaccuggcagguggagguuacagugagc

SEQ ID NO: 411450 - RNA, 32 nt, Human
cuugaaccuggcagguggagguugcagugagu

SEQ ID NO: 411451 - RNA, 32 nt, Human
cuugaaccugggaagcagaggcuacagugagc

SEQ ID NO: 411452 - RNA, 32 nt, Human
cuugaaccugggaagcagagguugcagugagc

SEQ ID NO: 411453 - RNA, 32 nt, Human
cuugaaccugggaagcagaguuugcagugagc

SEQ ID NO: 411454 - RNA, 32 nt, Human
cuugaaccugggaagccgaaguagcagugagc

SEQ ID NO: 411455 - RNA, 32 nt, Human
cuugaaccugggaagucgaggcugcaagugag

SEQ ID NO: 411456 - RNA, 32 nt, Human
cuugaaccugggaagugcagguugcagugagc

SEQ ID NO: 411457 - RNA, 32 nt, Human
cuugaaccugggaaguggaggcugcagugagc

SEQ ID NO: 411458 - RNA, 32 nt, Human
cuugaaccugggagacagaaguuugcagugau

SEQ ID NO: 411459 - RNA, 32 nt, Human
cuugaaccugggagacagagguugcaaugaac

SEQ ID NO: 411460 - RNA, 32 nt, Human
cuugaaccugggagacagagguugcagugagc

SEQ ID NO: 411461 - RNA, 32 nt, Human
cuugaaccugggagacggagguugcagugagc

SEQ ID NO: 411462 - RNA, 32 nt, Human
cuugaaccugggagauggaaguugcagugaac

SEQ ID NO: 411463 - RNA, 32 nt, Human
cuugaaccugggagauggagauugcagugagc

SEQ ID NO: 411464 - RNA, 32 nt, Human
cuugaaccugggagauggaggcugcaguaagc

SEQ ID NO: 411465 - RNA, 32 nt, Human
cuugaaccugggagauggagguugcagagagc

SEQ ID NO: 411466 - RNA, 32 nt, Human
cuugaaccugggagauggggguuguagugagc

SEQ ID NO: 411467 - RNA, 32 nt, Human
cuugaaccugggagcaggagguugcagugagc

SEQ ID NO: 411468 - RNA, 32 nt, Human
cuugaaccugggagccugagguugcagugagc

SEQ ID NO: 411469 - RNA, 32 nt, Human
cuugaaccugggaggagaagguugcagugagc

SEQ ID NO: 411470 - RNA, 32 nt, Human
cuugaaccugggaggaggagguugcagugagc

SEQ ID NO: 411471 - RNA, 32 nt, Human
cuugaaccugggaggcaaagguugcagugagc

SEQ ID NO: 411472 - RNA, 32 nt, Human
cuugaaccugggaggcaaagguugcggugaac

SEQ ID NO: 411473 - RNA, 32 nt, Human
cuugaaccugggaggcagaaguugcagugaaa

SEQ ID NO: 411474 - RNA, 32 nt, Human
cuugaaccugggaggcagaaguugcagugagc

SEQ ID NO: 411475 - RNA, 32 nt, Human
cuugaaccugggaggcagaaguuguggugagc

SEQ ID NO: 411476 - RNA, 32 nt, Human
cuugaaccugggaggcagagauugcagugagc

SEQ ID NO: 411477 - RNA, 32 nt, Human
cuugaaccugggaggcagagggugcaguaagc

SEQ ID NO: 411478 - RNA, 32 nt, Human
cuugaaccugggaggcagagguuacaaugagc

SEQ ID NO: 411479 - RNA, 32 nt, Human
cuugaaccugggaggcagagguuacagugagc

SEQ ID NO: 411480 - RNA, 32 nt, Human
cuugaaccugggaggcagagguugcaaugagc

SEQ ID NO: 411481 - RNA, 32 nt, Human
cuugaaccugggaggcagagguugcagggaac

SEQ ID NO: 411482 - RNA, 32 nt, Human
cuugaaccugggaggcagagguugcaguaagc

SEQ ID NO: 411483 - RNA, 32 nt, Human
cuugaaccugggaggcagagguugcagugaac

SEQ ID NO: 411484 - RNA, 32 nt, Human
cuugaaccugggaggcagagguugcagugagc

SEQ ID NO: 411485 - RNA, 32 nt, Human
cuugaaccugggaggcagagguugcagugagg

SEQ ID NO: 411486 - RNA, 32 nt, Human
cuugaaccugggaggcagagguugcagugauc

SEQ ID NO: 411487 - RNA, 32 nt, Human
cuugaaccugggaggcagagguugccgugagc

SEQ ID NO: 411488 - RNA, 32 nt, Human
cuugaaccugggaggcagagguugcgguaagc

SEQ ID NO: 411489 - RNA, 32 nt, Human
cuugaaccugggaggcagagguuguagcgagc

SEQ ID NO: 411490 - RNA, 32 nt, Human
cuugaaccugggaggcagagguuguagugagc

SEQ ID NO: 411491 - RNA, 32 nt, Human
cuugaaccugggaggcagagguuguggugagc

SEQ ID NO: 411492 - RNA, 32 nt, Human
cuugaaccugggaggcagagguuucagugagc

SEQ ID NO: 411493 - RNA, 32 nt, Human
cuugaaccugggaggcagagucugcagugagc

SEQ ID NO: 411494 - RNA, 32 nt, Human
cuugaaccugggaggcagaguuuacagugagc

SEQ ID NO: 411495 - RNA, 32 nt, Human
cuugaaccugggaggcagaguuugcagugagc

SEQ ID NO: 411496 - RNA, 32 nt, Human
cuugaaccugggaggcagauguugcagugagc

SEQ ID NO: 411497 - RNA, 32 nt, Human
cuugaaccugggaggcagauguuguggugagc

SEQ ID NO: 411498 - RNA, 32 nt, Human
cuugaaccugggaggcagcgguugcaguaagc

SEQ ID NO: 411499 - RNA, 32 nt, Human
cuugaaccugggaggcagggguugcagugagc

SEQ ID NO: 411500 - RNA, 32 nt, Human
cuugaaccugggaggcaguuugcagugagcug

SEQ ID NO: 411501 - RNA, 32 nt, Human
cuugaaccugggaggccaagguugcagugagc

SEQ ID NO: 411502 - RNA, 32 nt, Human
cuugaaccugggaggcgaagguugcagugagc

SEQ ID NO: 411503 - RNA, 32 nt, Human
cuugaaccugggaggcgcagguugcagggagg

SEQ ID NO: 411504 - RNA, 32 nt, Human
cuugaaccugggaggcggaaguugcagugagc

SEQ ID NO: 411505 - RNA, 32 nt, Human
cuugaaccugggaggcggagauugcagugaac

SEQ ID NO: 411506 - RNA, 32 nt, Human
cuugaaccugggaggcggaggagguugcagug

SEQ ID NO: 411507 - RNA, 32 nt, Human
cuugaaccugggaggcggaggcugcagugagc

SEQ ID NO: 411508 - RNA, 32 nt, Human
cuugaaccugggaggcggagguuccagagagc

SEQ ID NO: 411509 - RNA, 32 nt, Human
cuugaaccugggaggcggagguugcaaugagc

SEQ ID NO: 411510 - RNA, 32 nt, Human
cuugaaccugggaggcggagguugcagggagc

SEQ ID NO: 411511 - RNA, 32 nt, Human
cuugaaccugggaggcggagguugcaguaagc

SEQ ID NO: 411512 - RNA, 32 nt, Human
cuugaaccugggaggcggagguugcagugagc

SEQ ID NO: 411513 - RNA, 32 nt, Human
cuugaaccugggaggcggagguugcagugagu

SEQ ID NO: 411514 - RNA, 32 nt, Human
cuugaaccugggaggcggagguugccgugagc

SEQ ID NO: 411515 - RNA, 32 nt, Human
cuugaaccugggaggcggagguugcggucagc

SEQ ID NO: 411516 - RNA, 32 nt, Human
cuugaaccugggaggcggagguugcggugagc

SEQ ID NO: 411517 - RNA, 32 nt, Human
cuugaaccugggaggcggagguugcugugagc

SEQ ID NO: 411518 - RNA, 32 nt, Human
cuugaaccugggaggcggagguuguagugagc

SEQ ID NO: 411519 - RNA, 32 nt, Human
cuugaaccugggaggcggagguuguggugagc

SEQ ID NO: 411520 - RNA, 32 nt, Human
cuugaaccugggaggcggauguugcuugcacu

SEQ ID NO: 411521 - RNA, 32 nt, Human
cuugaaccugggaggcugaaguugcagugagc

SEQ ID NO: 411522 - RNA, 32 nt, Human
cuugaaccugggaggcugagcuugcagugagc

SEQ ID NO: 411523 - RNA, 32 nt, Human
cuugaaccugggagggcggagguugcagugag

SEQ ID NO: 411524 - RNA, 32 nt, Human
cuugaaccugggagguacagguugcagugagc

SEQ ID NO: 411525 - RNA, 32 nt, Human
cuugaaccugggagguagaaguugcagugagc

SEQ ID NO: 411526 - RNA, 32 nt, Human
cuugaaccugggagguagagguugcacugagc

SEQ ID NO: 411527 - RNA, 32 nt, Human
cuugaaccugggagguagagguugcagugagc

SEQ ID NO: 411528 - RNA, 32 nt, Human
cuugaaccugggaggucaaagcggcagugagc

SEQ ID NO: 411529 - RNA, 32 nt, Human
cuugaaccugggaggucaaagcugcagucagc

SEQ ID NO: 411530 - RNA, 32 nt, Human
cuugaaccugggaggucaaggcuccagugaac

SEQ ID NO: 411531 - RNA, 32 nt, Human
cuugaaccugggaggugaagguugcugugggc

SEQ ID NO: 411532 - RNA, 32 nt, Human
cuugaaccugggagguggaagcugcagugagc

SEQ ID NO: 411533 - RNA, 32 nt, Human
cuugaaccugggagguggaaguugcagugagc

SEQ ID NO: 411534 - RNA, 32 nt, Human
cuugaaccugggagguggagacugcagugagc

SEQ ID NO: 411535 - RNA, 32 nt, Human
cuugaaccugggagguggagauugcagugagu

SEQ ID NO: 411536 - RNA, 32 nt, Human
cuugaaccugggagguggaggcagugagcuga

SEQ ID NO: 411537 - RNA, 32 nt, Human
cuugaaccugggagguggaggcuacagugagc

SEQ ID NO: 411538 - RNA, 32 nt, Human
cuugaaccugggagguggaggggaggcugcag

SEQ ID NO: 411539 - RNA, 32 nt, Human
cuugaaccugggagguggagguuacagugagc

SEQ ID NO: 411540 - RNA, 32 nt, Human
cuugaaccugggagguggagguuauagugagc

SEQ ID NO: 411541 - RNA, 32 nt, Human
cuugaaccugggagguggagguugcagcgagc

SEQ ID NO: 411542 - RNA, 32 nt, Human
cuugaaccugggagguggagguugcaguaagc

SEQ ID NO: 411543 - RNA, 32 nt, Human
cuugaaccugggagguggagguugcagugagc

SEQ ID NO: 411544 - RNA, 32 nt, Human
cuugaaccugggagguggagguugcagugagu

SEQ ID NO: 411545 - RNA, 32 nt, Human
cuugaaccugggagguggagguugcagugggc

SEQ ID NO: 411546 - RNA, 32 nt, Human
cuugaaccugggagguggagguugcauugagc

SEQ ID NO: 411547 - RNA, 32 nt, Human
cuugaaccugggagguggagguugcggugagc

SEQ ID NO: 411548 - RNA, 32 nt, Human
cuugaaccugggagguggagguugcugugagc

SEQ ID NO: 411549 - RNA, 32 nt, Human
cuugaaccugggagguggagguuguggugagc

SEQ ID NO: 411550 - RNA, 32 nt, Human
cuugaaccugggagguggagguuguggugagg

SEQ ID NO: 411551 - RNA, 32 nt, Human
cuugaaccugggagguggagguuucagugagc

SEQ ID NO: 411552 - RNA, 32 nt, Human
cuugaaccugggagguggaguugcagugagcc

SEQ ID NO: 411553 - RNA, 32 nt, Human
cuugaaccugggagguggauguugcagugagc

SEQ ID NO: 411554 - RNA, 32 nt, Human
cuugaaccugggaggugggaggcggaggagga

SEQ ID NO: 411555 - RNA, 32 nt, Human
cuugaaccugggagguggggguuucagugagc

SEQ ID NO: 411556 - RNA, 32 nt, Human
cuugaaccugggaggugggguccccaggcuua

SEQ ID NO: 411557 - RNA, 32 nt, Human
cuugaaccugggagguggugguugcagugagc

SEQ ID NO: 411558 - RNA, 32 nt, Human
cuugaaccugggaguuagagguugcagugagc

SEQ ID NO: 411559 - RNA, 32 nt, Human
cuugaaccugggaguuggagguugcagugaaa

SEQ ID NO: 411560 - RNA, 32 nt, Human
cuugaaccugggcggcagagguugcagugagu

SEQ ID NO: 411561 - RNA, 32 nt, Human
cuugaaccuggguggucgaggcugcagugagc

SEQ ID NO: 411562 - RNA, 32 nt, Human
cuugaaccugguaggcagagguugcagugagc

SEQ ID NO: 411563 - RNA, 32 nt, Human
cuugaaccugguaggcagagguuguagugagc

SEQ ID NO: 411564 - RNA, 32 nt, Human
cuugaaccugguagguggagguuucauugagc

SEQ ID NO: 411565 - RNA, 32 nt, Human
cuugaaccuguaaggcggagguugcagugagc

SEQ ID NO: 411566 - RNA, 32 nt, Human
cuugaaccugugagcugggaucgugccacugc

SEQ ID NO: 411567 - RNA, 32 nt, Human
cuugaaccugugaggaagagguugcagugagc

SEQ ID NO: 411568 - RNA, 32 nt, Human
cuugaaccugugaggcagagguugcagugagc

SEQ ID NO: 411569 - RNA, 32 nt, Human
cuugaaccugugggucagagguugcagugaac

SEQ ID NO: 411570 - RNA, 32 nt, Human
cuugaaccuugcuguccaucucucacacaacu

SEQ ID NO: 411571 - RNA, 32 nt, Human
cuugaaccuuggaggcagagguugcagugagc

SEQ ID NO: 411572 - RNA, 32 nt, Human
cuugaacgcgggaggcagagacugcagugagc

SEQ ID NO: 411573 - RNA, 32 nt, Human
cuugaacgugggaggcagaaguugcagugagc

SEQ ID NO: 411574 - RNA, 32 nt, Human
cuugaacgugggaggcagagguugcagugagc

SEQ ID NO: 411575 - RNA, 32 nt, Human
cuugaacgugggaggcagagguugcagugagu

SEQ ID NO: 411576 - RNA, 32 nt, Human
cuugaacgugggaggcggagguugcagcgagc

SEQ ID NO: 411577 - RNA, 32 nt, Human
cuugaacgugggaggcggagguuguagugagc

SEQ ID NO: 411578 - RNA, 32 nt, Human
cuugaacucagaaggcagagguugcaguggaa

SEQ ID NO: 411579 - RNA, 32 nt, Human
cuugaacucagaagguggagguugcagugagg

SEQ ID NO: 411580 - RNA, 32 nt, Human
cuugaacucaggagauggagguuucagugagc

SEQ ID NO: 411581 - RNA, 32 nt, Human
cuugaacucaggaggcagaaguugcgguuagc

SEQ ID NO: 411582 - RNA, 32 nt, Human
cuugaacucaggaggcagaaguuucuguaaac

SEQ ID NO: 411583 - RNA, 32 nt, Human
cuugaacucaggaggcggagguugcggugagc

SEQ ID NO: 411584 - RNA, 32 nt, Human
cuugaacucaggagguggagguugcagugagc

SEQ ID NO: 411585 - RNA, 32 nt, Human
cuugaacucaggagguggagguugcggugagc

SEQ ID NO: 411586 - RNA, 21 nt, Human
cuugaacucaggaguucaaga

SEQ ID NO: 411587 - RNA, 21 nt, Human
cuugaacucaggaguuggaga

SEQ ID NO: 411588 - RNA, 21 nt, Human
cuugaacucaggaguuugaga

SEQ ID NO: 411589 - RNA, 32 nt, Human
cuugaacucagguggcagagguugcagugagc

SEQ ID NO: 411590 - RNA, 32 nt, Human
cuugaacucccagggucccccuacaugugugc

SEQ ID NO: 411591 - RNA, 32 nt, Human
cuugaacuccuggccucaguugagccacugug

SEQ ID NO: 411592 - RNA, 32 nt, Human
cuugaacucgggaggaagagguugcagugagc

SEQ ID NO: 411593 - RNA, 32 nt, Human
cuugaacucgggaggcagagguugcagugagc

SEQ ID NO: 411594 - RNA, 32 nt, Human
cuugaacucgggaggcagagguuucagggagc

SEQ ID NO: 411595 - RNA, 32 nt, Human
cuugaacucgggaggcgaagguugcagugagc

SEQ ID NO: 411596 - RNA, 32 nt, Human
cuugaacucgggaggcggagguugcagugagc

SEQ ID NO: 411597 - RNA, 32 nt, Human
cuugaacucgggaggugaaaguugcagugagc

SEQ ID NO: 411598 - RNA, 32 nt, Human
cuugaacucgggagguggagauugcaguaagc

SEQ ID NO: 411599 - RNA, 32 nt, Human
cuugaacucgggagguggagguggcagugagc

SEQ ID NO: 411600 - RNA, 32 nt, Human
cuugaacucgggagguggagguugcagucagc

SEQ ID NO: 411601 - RNA, 32 nt, Human
cuugaacucgggagguggagguugcagugagc

SEQ ID NO: 411602 - RNA, 32 nt, Human
cuugaacucgggagguggagguugugaugugc

SEQ ID NO: 411603 - RNA, 21 nt, Human
cuugaacucgggaguucgaga

SEQ ID NO: 411604 - RNA, 32 nt, Human
cuugaacucgggugggggagguugcaaugagc

SEQ ID NO: 411605 - RNA, 32 nt, Human
cuugaacugaggagguggagguugcagugagc

SEQ ID NO: 411606 - RNA, 32 nt, Human
cuugaacugaggcagaggcuacagugagugga

SEQ ID NO: 411607 - RNA, 32 nt, Human
cuugaacuggggaggagaagguugcagugagc

SEQ ID NO: 411608 - RNA, 32 nt, Human
cuugaacuggggaggcagagguugcagugaga

SEQ ID NO: 411609 - RNA, 32 nt, Human
cuugaacuggggaggcagagguugcaguggcc

SEQ ID NO: 411610 - RNA, 32 nt, Human
cuugaacuggggaggcagagguugcggugagc

SEQ ID NO: 411611 - RNA, 32 nt, Human
cuugaacuguuuuaucuaaccucucuuuuucu

SEQ ID NO: 411612 - RNA, 32 nt, Human
cuugaacuucuugcaauaguaacugaaugucc

SEQ ID NO: 411613 - RNA, 32 nt, Human
cuugaacuugccucuuuuaccugcugcuucuc

SEQ ID NO: 411614 - RNA, 32 nt, Human
cuugaacuugggaggcagagguuguggugagc

SEQ ID NO: 411615 - RNA, 32 nt, Human
cuugaacuugggaggcagagguuucagugagc

SEQ ID NO: 411616 - RNA, 32 nt, Human
cuugaacuugggaggcggagguugcagugagc

SEQ ID NO: 411617 - RNA, 32 nt, Human
cuugaacuugggagggagagguugcagugagc

SEQ ID NO: 411618 - RNA, 32 nt, Human
cuugaacuugggagggguagguugcagugagc

SEQ ID NO: 411619 - RNA, 32 nt, Human
cuugaacuugggagguggagguugcagugagc

SEQ ID NO: 411620 - RNA, 32 nt, Human
cuugaacuugggagguggagguugcagugggc

SEQ ID NO: 411621 - RNA, 32 nt, Human
cuugaacuugugggguggagguugcagugagc

SEQ ID NO: 411622 - RNA, 32 nt, Human
cuugaagaaagaggagucagcuugcucucuau

SEQ ID NO: 411623 - RNA, 32 nt, Human
cuugaagaacuccugcaucucugcuugcaucu

SEQ ID NO: 411624 - RNA, 32 nt, Human
cuugaagaccugcuguaguuagauaugggcuu

SEQ ID NO: 411625 - RNA, 19 nt, Human
cuugaagagagcucugcuu

SEQ ID NO: 411626 - RNA, 32 nt, Human
cuugaagagauggauagucaagaugcugagau

SEQ ID NO: 411627 - RNA, 32 nt, Human
cuugaagagaugguuuugcugcucuccuugag

SEQ ID NO: 411628 - RNA, 32 nt, Human
cuugaagagcuuccucccucccaaaccugggu

SEQ ID NO: 411629 - RNA, 32 nt, Human
cuugaagauagaggggccauguggaaaucaag

SEQ ID NO: 411630 - RNA, 32 nt, Human
cuugaagaugcugaaacaggagagaaagggga

SEQ ID NO: 411631 - RNA, 32 nt, Human
cuugaagcaacaaagcagccacaguuucagac

SEQ ID NO: 411632 - RNA, 32 nt, Human
cuugaagcauggucagcagcagagagagcaac

SEQ ID NO: 411633 - RNA, 32 nt, Human
cuugaagccaggaggcagagguugcaguuagc

SEQ ID NO: 411634 - RNA, 32 nt, Human
cuugaagccaggaggcggagguugcagugagc

SEQ ID NO: 411635 - RNA, 21 nt, Human
cuugaagccaggaguucaaga

SEQ ID NO: 411636 - RNA, 32 nt, Human
cuugaagccaggaguucaagaccagccuggcc

SEQ ID NO: 411637 - RNA, 32 nt, Human
cuugaagccaggaguuccagaccagccugggc

SEQ ID NO: 411638 - RNA, 32 nt, Human
cuugaagccaggaguuggagaccagccuaggc

SEQ ID NO: 411639 - RNA, 32 nt, Human
cuugaagccaggaguuugagaccagcuuggau

SEQ ID NO: 411640 - RNA, 32 nt, Human
cuugaagccaggaguuugggaccagccugggc

SEQ ID NO: 411641 - RNA, 32 nt, Human
cuugaagccgcggcgaaccucuuccuacccua

SEQ ID NO: 411642 - RNA, 32 nt, Human
cuugaagccgggaggcggaaguuguggugagc

SEQ ID NO: 411643 - RNA, 32 nt, Human
cuugaagccgggagguggggguugcagugagc

SEQ ID NO: 411644 - RNA, 32 nt, Human
cuugaagccuaagguugaaaucaaagagugug

SEQ ID NO: 411645 - RNA, 32 nt, Human
cuugaagccuggaggcggaggcugcacugagc

SEQ ID NO: 411646 - RNA, 32 nt, Human
cuugaagcugggaggcggagguugcagugagc

SEQ ID NO: 411647 - RNA, 32 nt, Human
cuugaagcuucucaaaggcagacacagccgcg

SEQ ID NO: 411648 - RNA, 32 nt, Human
cuugaaggaaccuggucagucuccgguucagc

SEQ ID NO: 411649 - RNA, 32 nt, Human
cuugaaggaauacucacauacaugguuugaaa

SEQ ID NO: 411650 - RNA, 32 nt, Human
cuugaaggacaucuuccuucucaguauacccu

SEQ ID NO: 411651 - RNA, 32 nt, Human
cuugaaggagaaacagccccgguguggagagg

SEQ ID NO: 411652 - RNA, 32 nt, Human
cuugaaggagcagaagguguuugcuagacaaa

SEQ ID NO: 411653 - RNA, 32 nt, Human
cuugaaggcacacacauacacauauuuucagu

SEQ ID NO: 411654 - RNA, 32 nt, Human
cuugaaggccgaggcagguggaucaccugagg

SEQ ID NO: 411655 - RNA, 32 nt, Human
cuugaagggaaagacugggcggagagaaggag

SEQ ID NO: 411656 - RNA, 32 nt, Human
cuugaagggacagcauugccagcugcugcuga

SEQ ID NO: 411657 - RNA, 32 nt, Human
cuugaagggcugggcucuugccuuccuggagu

SEQ ID NO: 411658 - RNA, 32 nt, Human
cuugaaggguauaaagaauuuagaucaugccu

SEQ ID NO: 411659 - RNA, 32 nt, Human
cuugaaggucuaggugcuuuaaccucacauac

SEQ ID NO: 411660 - RNA, 32 nt, Human
cuugaaggucugucuuccaucuggcaccauaa

SEQ ID NO: 411661 - RNA, 32 nt, Human
cuugaagguucagaaccucugcagggaagggg

SEQ ID NO: 411662 - RNA, 32 nt, Human
cuugaaguacuaggaggaaaggugcuuugugu

SEQ ID NO: 411663 - RNA, 32 nt, Human
cuugaaguagacugagaagaauccacgaggug

SEQ ID NO: 411664 - RNA, 32 nt, Human
cuugaaguagggaggaggagguugcagugagc

SEQ ID NO: 411665 - RNA, 32 nt, Human
cuugaagucagcaggaccagaaacccacggga

SEQ ID NO: 411666 - RNA, 32 nt, Human
cuugaagucaucucaagaacaaaagacaacug

SEQ ID NO: 411667 - RNA, 32 nt, Human
cuugaaguccuaaaccacaccucagucacuaa

SEQ ID NO: 411668 - RNA, 32 nt, Human
cuugaauaaagugggugagucuuagaccuauc

SEQ ID NO: 411669 - RNA, 32 nt, Human
cuugaauaaggugaagaauuucacacaacaua

SEQ ID NO: 411670 - RNA, 19 nt, Human
cuugaauacagacaggagg

SEQ ID NO: 411671 - RNA, 32 nt, Human
cuugaauaccaucagaagaaacucagugaagu

SEQ ID NO: 411672 - RNA, 32 nt, Human
cuugaauauaaauaucaggaaucaugcaauua

SEQ ID NO: 411673 - RNA, 32 nt, Human
cuugaauauaggaggcagagguugcagugagc

SEQ ID NO: 411674 - RNA, 32 nt, Human
cuugaaucaacuucuuauuuugcucauaaaac

SEQ ID NO: 411675 - RNA, 32 nt, Human
cuugaaucacauagggagaaacguuauacucc

SEQ ID NO: 411676 - RNA, 32 nt, Human
cuugaaucagggaggcggagguuguggugagc

SEQ ID NO: 411677 - RNA, 32 nt, Human
cuugaaucaucuuggaucugggagaaggaaaa

SEQ ID NO: 411678 - RNA, 32 nt, Human
cuugaauccagaaggcggagguugcagugagc

SEQ ID NO: 411679 - RNA, 32 nt, Human
cuugaauccagcucagugcucuggguggcccc

SEQ ID NO: 411680 - RNA, 32 nt, Human
cuugaauccaggaagcaagcggagguugcagu

SEQ ID NO: 411681 - RNA, 32 nt, Human
cuugaauccaggaagcagagguugcggugagc

SEQ ID NO: 411682 - RNA, 32 nt, Human
cuugaauccaggaggaggagguugcagugagc

SEQ ID NO: 411683 - RNA, 32 nt, Human
cuugaauccaggaggcagaggcuguggugagc

SEQ ID NO: 411684 - RNA, 32 nt, Human
cuugaauccaggaggcagagguugcaaugagc

SEQ ID NO: 411685 - RNA, 32 nt, Human
cuugaauccaggaggcagagguugcagugagu

SEQ ID NO: 411686 - RNA, 32 nt, Human
cuugaauccaggaggcgaagguugcagugagc

SEQ ID NO: 411687 - RNA, 32 nt, Human
cuugaauccaggaggcggagguugcagugaac

SEQ ID NO: 411688 - RNA, 32 nt, Human
cuugaauccaggaggcggagguugcagugagc

SEQ ID NO: 411689 - RNA, 32 nt, Human
cuugaauccaggagguggagguugcagcgagc

SEQ ID NO: 411690 - RNA, 32 nt, Human
cuugaauccaggaguacgagaccacccugggc

SEQ ID NO: 411691 - RNA, 32 nt, Human
cuugaauccaggaguuagaccagccugggcaa

SEQ ID NO: 411692 - RNA, 32 nt, Human
cuugaauccaggaguucaagaccagcaugggg

SEQ ID NO: 411693 - RNA, 32 nt, Human
cuugaauccagguggcggagguugcagugagc

SEQ ID NO: 411694 - RNA, 32 nt, Human
cuugaaucccaggagacagagguugcagugag

SEQ ID NO: 411695 - RNA, 32 nt, Human
cuugaauccccgaggcggagguugcacugagc

SEQ ID NO: 411696 - RNA, 32 nt, Human
cuugaaucccugaggcagagguugcagugagc

SEQ ID NO: 411697 - RNA, 32 nt, Human
cuugaauccgggaggcagagauugcagugggc

SEQ ID NO: 411698 - RNA, 32 nt, Human
cuugaauccgggaggcagagguugcaggagcu

SEQ ID NO: 411699 - RNA, 32 nt, Human
cuugaauccgggaggcggagguugcagugaac

SEQ ID NO: 411700 - RNA, 32 nt, Human
cuugaauccgggaggcggagguugcggugagc

SEQ ID NO: 411701 - RNA, 32 nt, Human
cuugaauccgggagguggagguugcagugagc

SEQ ID NO: 411702 - RNA, 32 nt, Human
cuugaauccgugagguggagguuguagugagu

SEQ ID NO: 411703 - RNA, 32 nt, Human
cuugaauccucuauuaauuacugugugugagc

SEQ ID NO: 411704 - RNA, 32 nt, Human
cuugaauccuggaggcagagguugcagugagc

SEQ ID NO: 411705 - RNA, 32 nt, Human
cuugaauccuuuaacauccaccaggaaguuuu

SEQ ID NO: 411706 - RNA, 32 nt, Human
cuugaaucuaagaagcagagguugcagugagc

SEQ ID NO: 411707 - RNA, 32 nt, Human
cuugaaucuaggaggcagagguugcagugaac

SEQ ID NO: 411708 - RNA, 32 nt, Human
cuugaaucucuuccuguuucccuuaggacgac

SEQ ID NO: 411709 - RNA, 32 nt, Human
cuugaaucugagagauggaggcugcagugagc

SEQ ID NO: 411710 - RNA, 32 nt, Human
cuugaaucugggaggcagagguugcagugagc

SEQ ID NO: 411711 - RNA, 32 nt, Human
cuugaaucugggaggcagagguugcugugagc

SEQ ID NO: 411712 - RNA, 32 nt, Human
cuugaaucugggaggcggagauugcagugagc

SEQ ID NO: 411713 - RNA, 32 nt, Human
cuugaaucugggaggcggagguugcagugagc

SEQ ID NO: 411714 - RNA, 32 nt, Human
cuugaaucugggagguggagguugcagugagc

SEQ ID NO: 411715 - RNA, 32 nt, Human
cuugaaucuguuccuccucgaaugacccugua

SEQ ID NO: 411716 - RNA, 32 nt, Human
cuugaaucuuccgcuuccuccccaccgauuuc

SEQ ID NO: 411717 - RNA, 32 nt, Human
cuugaaugcaauauuuguuuauuccaaaagaa

SEQ ID NO: 411718 - RNA, 32 nt, Human
cuugaaugcuuugccauauucaggacagagac

SEQ ID NO: 411719 - RNA, 32 nt, Human
cuugaauggaaccuacuaaaaagagagaugaa

SEQ ID NO: 411720 - RNA, 32 nt, Human
cuugaaugguggagggaggcaguggggagaaa

SEQ ID NO: 411721 - RNA, 32 nt, Human
cuugaaugugggaggcggagguugcagugagu

SEQ ID NO: 411722 - RNA, 32 nt, Human
cuugaauuagaaacacaaacacugccuuuauu

SEQ ID NO: 411723 - RNA, 32 nt, Human
cuugaauucaggaggcggagguugcagugagc

SEQ ID NO: 411724 - RNA, 32 nt, Human
cuugaauucaggagguggagguugcagugagc

SEQ ID NO: 411725 - RNA, 32 nt, Human
cuugaauucgggagguggagguugcagugagc

SEQ ID NO: 411726 - RNA, 32 nt, Human
cuugaauucuaugcuaagcaggguuccaagua

SEQ ID NO: 411727 - RNA, 21 nt, Human
cuugaauugggaggggggcag

SEQ ID NO: 411728 - RNA, 32 nt, Human
cuugaauuggggaggcggagguugcagugagc

SEQ ID NO: 411729 - RNA, 32 nt, Human
cuugaauuuucauucugccauugacuuggcau

SEQ ID NO: 411730 - RNA, 32 nt, Human
cuugaauuuuucuuccucuccacuucuuagag

SEQ ID NO: 411731 - RNA, 32 nt, Human
cuugacaaagagacgggggugugaacugggca

SEQ ID NO: 411732 - RNA, 32 nt, Human
cuugacaacaacccagcugaggggagcaggca

SEQ ID NO: 411733 - RNA, 32 nt, Human
cuugacaacacaccuuaggaacaugugcuaag

SEQ ID NO: 411734 - RNA, 32 nt, Human
cuugacaacaggcgcauccucccaggccacca

SEQ ID NO: 411735 - RNA, 32 nt, Human
cuugacaacauggugaaaccccaucucuggua

SEQ ID NO: 411736 - RNA, 32 nt, Human
cuugacaacuauucacccuaccucagaucaua

SEQ ID NO: 411737 - RNA, 32 nt, Human
cuugacaacuggaugacuuuugagaacaaaga

SEQ ID NO: 411738 - RNA, 32 nt, Human
cuugacaauugugcuaaugacaaaguugucau

SEQ ID NO: 411739 - RNA, 19 nt, Human
cuugacacagguucugcug

SEQ ID NO: 411740 - RNA, 32 nt, Human
cuugacaccacugaugucgagugugcgggugu

SEQ ID NO: 411741 - RNA, 32 nt, Human
cuugacaccaggaguuagagagcagccugggc

SEQ ID NO: 411742 - RNA, 32 nt, Human
cuugacacugccuccugggagcaucguccugu

SEQ ID NO: 411743 - RNA, 32 nt, Human
cuugacagacucaagagaaacuacccagguau

SEQ ID NO: 411744 - RNA, 32 nt, Human
cuugacagaguuacucuuucagaagcuaaaua

SEQ ID NO: 411745 - RNA, 32 nt, Human
cuugacagaucuuuuucaacucaaauuaaugg

SEQ ID NO: 411746 - RNA, 32 nt, Human
cuugacaggcagcugggcaucagugcagcuga

SEQ ID NO: 411747 - RNA, 32 nt, Human
cuugacagggucuugcucugucauucaggcaa

SEQ ID NO: 411748 - RNA, 32 nt, Human
cuugacaggguuucaccauguuggcuaggaua

SEQ ID NO: 411749 - RNA, 18 nt, Human
cuugacagucagcugggc

SEQ ID NO: 411750 - RNA, 32 nt, Human
cuugacaugguggcucacgccuguaaucccuu

SEQ ID NO: 411751 - RNA, 22 nt, Human
cuugacauguagcuucuucuga

SEQ ID NO: 411752 - RNA, 32 nt, Human
cuugacauuguggguuacauugccagaaaugu

SEQ ID NO: 411753 - RNA, 32 nt, Human
cuugacauuuugauucuccagccugggcaacg

SEQ ID NO: 411754 - RNA, 32 nt, Human
cuugaccaagcaggaagcucagacugguugag

SEQ ID NO: 411755 - RNA, 32 nt, Human
cuugaccagaagcaguuuucgcaagugaugcu

SEQ ID NO: 411756 - RNA, 32 nt, Human
cuugaccagcacugcuucauccaagcugcuga

SEQ ID NO: 411757 - RNA, 32 nt, Human
cuugaccaguacaguucccaugaauucaaggu

SEQ ID NO: 411758 - RNA, 32 nt, Human
cuugaccauccucugacuuccugggccccuag

SEQ ID NO: 411759 - RNA, 32 nt, Human
cuugaccauguuugggcauggaggcuugcccc

SEQ ID NO: 411760 - RNA, 32 nt, Human
cuugaccauuguguggccacacuugcuagauu

SEQ ID NO: 411761 - RNA, 32 nt, Human
cuugacccagaaguccagaagggucaucugcc

SEQ ID NO: 411762 - RNA, 32 nt, Human
cuugacccaggaggcagagguugcagugagcc

SEQ ID NO: 411763 - RNA, 32 nt, Human
cuugacccaggaggcggagguugcggugaccc

SEQ ID NO: 411764 - RNA, 32 nt, Human
cuugacccaggagguggaggucgcagugagcc

SEQ ID NO: 411765 - RNA, 32 nt, Human
cuugacccaggaguucaagaccagccuggcca

SEQ ID NO: 411766 - RNA, 32 nt, Human
cuugaccccaggagguggacauugcagugagc

SEQ ID NO: 411767 - RNA, 32 nt, Human
cuugaccccaggaguucaagaccagccugggc

SEQ ID NO: 411768 - RNA, 32 nt, Human
cuugaccccaggccccugcuucucccucuagg

SEQ ID NO: 411769 - RNA, 32 nt, Human
cuugaccccaggugguggagguugcagugagc

SEQ ID NO: 411770 - RNA, 32 nt, Human
cuugaccccgggagguggaggcugcagugagu

SEQ ID NO: 411771 - RNA, 32 nt, Human
cuugacccugagagguagaggcugcauugagc

SEQ ID NO: 411772 - RNA, 32 nt, Human
cuugacccugauaccugcaccaugcuucaugg

SEQ ID NO: 411773 - RNA, 32 nt, Human
cuugacccugcaggaggagcuuggacuggccc

SEQ ID NO: 411774 - RNA, 32 nt, Human
cuugacccugggagguggagguggcagugagc

SEQ ID NO: 411775 - RNA, 32 nt, Human
cuugacccuuaccaaaccacagagaauccaaa

SEQ ID NO: 411776 - RNA, 32 nt, Human
cuugaccgggagacagagguugcagugagcug

SEQ ID NO: 411777 - RNA, 32 nt, Human
cuugaccgggaugaggcccacagacagguugu

SEQ ID NO: 411778 - RNA, 32 nt, Human
cuugaccguuuaaagcccauguuuucaaagca

SEQ ID NO: 411779 - RNA, 32 nt, Human
cuugaccuaaagucaaaggaccuguguagcau

SEQ ID NO: 411780 - RNA, 31 nt, Human
cuugaccuagauaaauacacuuugagaaauc

SEQ ID NO: 411781 - RNA, 32 nt, Human
cuugaccuaggugcccuuucugcuacaugcaa

SEQ ID NO: 411782 - RNA, 32 nt, Human
cuugaccucaggaggcggagguugcagugagc

SEQ ID NO: 411783 - RNA, 32 nt, Human
cuugaccucuuggcuuuuaccaaaggauguuu

SEQ ID NO: 411784 - RNA, 32 nt, Human
cuugaccugauguaauaaaaacugauaaaagc

SEQ ID NO: 411785 - RNA, 32 nt, Human
cuugaccugcauuccuagaauuucuuuguugc

SEQ ID NO: 411786 - RNA, 20 nt, Human
cuugaccugggaagacgccu

SEQ ID NO: 411787 - RNA, 32 nt, Human
cuugaccuuccagccugccaaguagcugggau

SEQ ID NO: 411788 - RNA, 32 nt, Human
cuugaccuugauaagaggccgccugcacacag

SEQ ID NO: 411789 - RNA, 32 nt, Human
cuugacgaccuuaaaaaggguuagauugacau

SEQ ID NO: 411790 - RNA, 23 nt, Human
cuugacgacuuccccucccacca

SEQ ID NO: 411791 - RNA, 32 nt, Human
cuugacgcuaucucccaucaccucugcuaucc

SEQ ID NO: 411792 - RNA, 32 nt, Human
cuugacgggaagcggagguugcagugagccga

SEQ ID NO: 411793 - RNA, 18 nt, Human
cuugacgguggggcguag

SEQ ID NO: 411794 - RNA, 32 nt, Human
cuugacgucacucaaagacaggccccaauccc

SEQ ID NO: 411795 - RNA, 21 nt, Human
cuugacgucaggaguucgaga

SEQ ID NO: 411796 - RNA, 32 nt, Human
cuugacguuaguaauuguuaaaggaauggcaa

SEQ ID NO: 411797 - RNA, 32 nt, Human
cuugacguuggcuugcuuuggggaugacuguc

SEQ ID NO: 411798 - RNA, 32 nt, Human
cuugacuaagaguagcuugaaggaggcaccau

SEQ ID NO: 411799 - RNA, 32 nt, Human
cuugacuaccuuucaaaaccagcacugugugg

SEQ ID NO: 411800 - RNA, 32 nt, Human
cuugacuauugaaaugcgaaaaauuagauuga

SEQ ID NO: 411801 - RNA, 32 nt, Human
cuugacucaauugauccucccaucucagccuc

SEQ ID NO: 411802 - RNA, 32 nt, Human
cuugacucacugcaacaucugccucccggguu

SEQ ID NO: 411803 - RNA, 32 nt, Human
cuugacucacugcaaccuccaccucccagguu

SEQ ID NO: 411804 - RNA, 32 nt, Human
cuugacucacugcaaccuccgccucacagcuu

SEQ ID NO: 411805 - RNA, 32 nt, Human
cuugacucacugcaaccuccgccucccagguu

SEQ ID NO: 411806 - RNA, 32 nt, Human
cuugacucacugcaaccucugccucccagguu

SEQ ID NO: 411807 - RNA, 32 nt, Human
cuugacucacugcaaccucugccucucggguu

SEQ ID NO: 411808 - RNA, 32 nt, Human
cuugacucacugcaacuucugccacccagguu

SEQ ID NO: 411809 - RNA, 32 nt, Human
cuugacucacugcaaucuccaccucccacagg

SEQ ID NO: 411810 - RNA, 32 nt, Human
cuugacucacugcaauucugccuccuggguuc

SEQ ID NO: 411811 - RNA, 32 nt, Human
cuugacucacugcagccucaaccucccaggcu

SEQ ID NO: 411812 - RNA, 32 nt, Human
cuugacucauccugcaaaccccugccaccccu

SEQ ID NO: 411813 - RNA, 32 nt, Human
cuugacuccaggaggcgcaggcugcagugagc

SEQ ID NO: 411814 - RNA, 32 nt, Human
cuugacuccaggggagaugaccugggggagga

SEQ ID NO: 411815 - RNA, 32 nt, Human
cuugacucccaaagugcugaaauuacaggcau

SEQ ID NO: 411816 - RNA, 32 nt, Human
cuugacuccuugugguuuaugucaucauacau

SEQ ID NO: 411817 - RNA, 32 nt, Human
cuugacucucccuccacccugccuccucgggc

SEQ ID NO: 411818 - RNA, 32 nt, Human
cuugacucugggaacagcugcuacccccaaga

SEQ ID NO: 411819 - RNA, 32 nt, Human
cuugacucugggaagaaaucuucugagcagac

SEQ ID NO: 411820 - RNA, 32 nt, Human
cuugacugccagugaagauggaccugcucuua

SEQ ID NO: 411821 - RNA, 31 nt, Human
cuugacugccucucucuuaccuguucaguuu

SEQ ID NO: 411822 - RNA, 32 nt, Human
cuugacuggcuucaguuccucucagcgcuccu

SEQ ID NO: 411823 - RNA, 32 nt, Human
cuugacugggcuggauggucaagauagccucu

SEQ ID NO: 411824 - RNA, 32 nt, Human
cuugacuguaggagccagaaggggacccaggu

SEQ ID NO: 411825 - RNA, 32 nt, Human
cuugacuguggcauugcacucugcacuguuuc

SEQ ID NO: 411826 - RNA, 32 nt, Human
cuugacugugguucuuuguggcaagauacuuu

SEQ ID NO: 411827 - RNA, 32 nt, Human
cuugacuguuucccuauuccucuccuuagaac

SEQ ID NO: 411828 - RNA, 32 nt, Human
cuugacuucccaaagugcugggauuaugggcg

SEQ ID NO: 411829 - RNA, 32 nt, Human
cuugacuucccaggcucaggcucaggugaucc

SEQ ID NO: 411830 - RNA, 32 nt, Human
cuugacuugcguuagaguguacucugaaacca

SEQ ID NO: 411831 - RNA, 32 nt, Human
cuugacuuguguguguuucugaaguguucgag

SEQ ID NO: 411832 - RNA, 32 nt, Human
cuugacuuuccacaguccugagguucccaaaa

SEQ ID NO: 411833 - RNA, 32 nt, Human
cuugacuuuccaggcccggagcagaaaggcau

SEQ ID NO: 411834 - RNA, 32 nt, Human
cuugacuuuuccccagcaucacaaacagccau

SEQ ID NO: 411835 - RNA, 32 nt, Human
cuugagaaaugagaauguguaaguggauugga

SEQ ID NO: 411836 - RNA, 19 nt, Human
cuugagaagccagcggggc

SEQ ID NO: 411837 - RNA, 32 nt, Human
cuugagaaggguucgcugccaggccuucgagu

SEQ ID NO: 411838 - RNA, 32 nt, Human
cuugagaauaggaggggagaucaaagaagaca

SEQ ID NO: 411839 - RNA, 32 nt, Human
cuugagaaugucccuuccauuucugagaacaa

SEQ ID NO: 411840 - RNA, 32 nt, Human
cuugagacaggccuggccaaccuggugacucu

SEQ ID NO: 411841 - RNA, 32 nt, Human
cuugagacaugggguuuggcugucuugcagga

SEQ ID NO: 411842 - RNA, 32 nt, Human
cuugagacauuuugaaagcagaaggaaaggag

SEQ ID NO: 411843 - RNA, 32 nt, Human
cuugagaccagccugagcaacacagcaagacc

SEQ ID NO: 411844 - RNA, 32 nt, Human
cuugagaccagccugagcaacauggcgaaacc

SEQ ID NO: 411845 - RNA, 32 nt, Human
cuugagaccagccuggccaaaauggugaaacu

SEQ ID NO: 411846 - RNA, 32 nt, Human
cuugagaccagccugggcaacaggcuauuuuu

SEQ ID NO: 411847 - RNA, 32 nt, Human
cuugagaccagccugggcaacauggcaaaaac

SEQ ID NO: 411848 - RNA, 32 nt, Human
cuugagaccagccugggcaacauggugaaacc

SEQ ID NO: 411849 - RNA, 32 nt, Human
cuugagaccagccuggggaacauagugagacc

SEQ ID NO: 411850 - RNA, 32 nt, Human
cuugagaccagccugggugacacagcaagacc

SEQ ID NO: 411851 - RNA, 32 nt, Human
cuugagaccagcuugggcaacauggcaaagcc

SEQ ID NO: 411852 - RNA, 32 nt, Human
cuugagaccaggaaguugaggcugcaaugagc

SEQ ID NO: 411853 - RNA, 21 nt, Human
cuugagaccaggaguucaaga

SEQ ID NO: 411854 - RNA, 32 nt, Human
cuugagaccaggaguucaagaccagccugaga

SEQ ID NO: 411855 - RNA, 32 nt, Human
cuugagaccaggaguucaagaccagccugggc

SEQ ID NO: 411856 - RNA, 21 nt, Human
cuugagaccaggaguucgaga

SEQ ID NO: 411857 - RNA, 32 nt, Human
cuugagaccaggaguucgagaccagccugaga

SEQ ID NO: 411858 - RNA, 32 nt, Human
cuugagaccaggaguucgagaccagccuggcc

SEQ ID NO: 411859 - RNA, 32 nt, Human
cuugagaccaggaguucgagaccagccugggc

SEQ ID NO: 411860 - RNA, 32 nt, Human
cuugagaccaggaguuugagaccagccuaggc

SEQ ID NO: 411861 - RNA, 32 nt, Human
cuugagaccaggaguuugggaccaaccugagc

SEQ ID NO: 411862 - RNA, 32 nt, Human
cuugagaccaggaguuugggaccaggcugggc

SEQ ID NO: 411863 - RNA, 32 nt, Human
cuugagaccauuucaaacuggagagaagcaag

SEQ ID NO: 411864 - RNA, 32 nt, Human
cuugagacucaccaauuucuggccuguucagg

SEQ ID NO: 411865 - RNA, 32 nt, Human
cuugagacugagaguuggaggcugcgaugagc

SEQ ID NO: 411866 - RNA, 32 nt, Human
cuugagacuggagccccgcggugcagggcagu

SEQ ID NO: 411867 - RNA, 32 nt, Human
cuugagacugggaggcagagguugcagugaac

SEQ ID NO: 411868 - RNA, 32 nt, Human
cuugagacuuuguguguaugggggacuuguau

SEQ ID NO: 411869 - RNA, 32 nt, Human
cuugagagaaggcagaggugguccgugggaaa

SEQ ID NO: 411870 - RNA, 32 nt, Human
cuugagagacaccugcaucuauaauccccgcc

SEQ ID NO: 411871 - RNA, 32 nt, Human
cuugagagacacugggacacugucagugcuag

SEQ ID NO: 411872 - RNA, 32 nt, Human
cuugagagagaagggcaggguggucuacucac

SEQ ID NO: 411873 - RNA, 32 nt, Human
cuugagagaguguggcucugucaccaaggcug

SEQ ID NO: 411874 - RNA, 21 nt, Human
cuugagagcccuccucuucua

SEQ ID NO: 411875 - RNA, 32 nt, Human
cuugagagcggcggccagggaggugcggagca

SEQ ID NO: 411876 - RNA, 32 nt, Human
cuugagagcugcggccagggaggugcggagca

SEQ ID NO: 411877 - RNA, 32 nt, Human
cuugagaggaagaggaguccaggcagccacag

SEQ ID NO: 411878 - RNA, 32 nt, Human
cuugagaggacauacuuuuccagccucauggg

SEQ ID NO: 411879 - RNA, 32 nt, Human
cuugagagguugaagcugcagugagcugugau

SEQ ID NO: 411880 - RNA, 32 nt, Human
cuugagagugggagcagagggccaggcaccca

SEQ ID NO: 411881 - RNA, 21 nt, Human
cuugagaucaggaguucaaga

SEQ ID NO: 411882 - RNA, 21 nt, Human
cuugagaucaggaguucgaga

SEQ ID NO: 411883 - RNA, 32 nt, Human
cuugagaucaucccggccaacauagugaaacc

SEQ ID NO: 411884 - RNA, 32 nt, Human
cuugagauccacccuccacagccucccaaacu

SEQ ID NO: 411885 - RNA, 32 nt, Human
cuugagaucggcugaagagagcgggcccaggc

SEQ ID NO: 411886 - RNA, 31 nt, Human
cuugagaugggaggagaacggaaggaaaaca

SEQ ID NO: 411887 - RNA, 32 nt, Human
cuugagauggguccuucagcuugcaguggucc

SEQ ID NO: 411888 - RNA, 32 nt, Human
cuugagcaaacaguugccgcucuccacccccu

SEQ ID NO: 411889 - RNA, 32 nt, Human
cuugagcaagggcaggggucccugagcuguuc

SEQ ID NO: 411890 - RNA, 32 nt, Human
cuugagcaauauagggagacccugucucuaca

SEQ ID NO: 411891 - RNA, 21 nt, Human
cuugagcacaggaguucaaga

SEQ ID NO: 411892 - RNA, 19 nt, Human
cuugagcaccagagagcag

SEQ ID NO: 411893 - RNA, 32 nt, Human
cuugagcagaauaaggagagaccaccgggugc

SEQ ID NO: 411894 - RNA, 32 nt, Human
cuugagcagagcaggggguaccugugggguuc

SEQ ID NO: 411895 - RNA, 32 nt, Human
cuugagcagagcucugcacccagccugcccgc

SEQ ID NO: 411896 - RNA, 32 nt, Human
cuugagcagcccauggcuuagcagaaccccag

SEQ ID NO: 411897 - RNA, 32 nt, Human
cuugagcauacuggcauuuacacagaaaugau

SEQ ID NO: 411898 - RNA, 32 nt, Human
cuugagcaugcuguuacaugcuugacacuuua

SEQ ID NO: 411899 - RNA, 32 nt, Human
cuugagcauggacucccagacugcaggggagc

SEQ ID NO: 411900 - RNA, 32 nt, Human
cuugagccaccgugccuggccucaagcgauuc

SEQ ID NO: 411901 - RNA, 32 nt, Human
cuugagccacuaugcccaaccaccauuaagau

SEQ ID NO: 411902 - RNA, 32 nt, Human
cuugagccacugcgcccggccuagaacccugc

SEQ ID NO: 411903 - RNA, 32 nt, Human
cuugagccacugcgccuggccuggucuagucu

SEQ ID NO: 411904 - RNA, 32 nt, Human
cuugagccagaaguucgagaccagccugagca

SEQ ID NO: 411905 - RNA, 32 nt, Human
cuugagccaggaagguugagguugcagugagc

SEQ ID NO: 411906 - RNA, 32 nt, Human
cuugagccaggaguuugagaccagcccacccg

SEQ ID NO: 411907 - RNA, 32 nt, Human
cuugagccagggaggucaaggcugcagugagc

SEQ ID NO: 411908 - RNA, 32 nt, Human
cuugagccagggagguggaggcuacagugagc

SEQ ID NO: 411909 - RNA, 22 nt, Human
cuugagcccaagaggcagaggu

SEQ ID NO: 411910 - RNA, 32 nt, Human
cuugagcccaagaggcagagguugcaggguca

SEQ ID NO: 411911 - RNA, 22 nt, Human
cuugagcccaagagguagaggu

SEQ ID NO: 411912 - RNA, 32 nt, Human
cuugagcccaagagguagagguugcagugagc

SEQ ID NO: 411913 - RNA, 22 nt, Human
cuugagcccaagagguggaggu

SEQ ID NO: 411914 - RNA, 32 nt, Human
cuugagcccaagagguggagguuacagugagc

SEQ ID NO: 411915 - RNA, 32 nt, Human
cuugagcccaagagguugaggcugcagugagc

SEQ ID NO: 411916 - RNA, 32 nt, Human
cuugagcccaauucaaagcugcagugagcugu

SEQ ID NO: 411917 - RNA, 21 nt, Human
cuugagcccagaaggucgagg

SEQ ID NO: 411918 - RNA, 32 nt, Human
cuugagcccagaagguugaagcugcagugagu

SEQ ID NO: 411919 - RNA, 32 nt, Human
cuugagcccagaaguucgagguugcagugagc

SEQ ID NO: 411920 - RNA, 32 nt, Human
cuugagcccagcaggcagagguugcagugagc

SEQ ID NO: 411921 - RNA, 32 nt, Human
cuugagcccagccuucugacugcauucagccc

SEQ ID NO: 411922 - RNA, 32 nt, Human
cuugagcccaggaagcagagguugcagugagc

SEQ ID NO: 411923 - RNA, 32 nt, Human
cuugagcccaggaagcggagguuacagugagc

SEQ ID NO: 411924 - RNA, 32 nt, Human
cuugagcccaggaagcggagguugcaaugagc

SEQ ID NO: 411925 - RNA, 32 nt, Human
cuugagcccaggaagucaaggcugcagugagc

SEQ ID NO: 411926 - RNA, 32 nt, Human
cuugagcccaggaaguccagaacguagugagc

SEQ ID NO: 411927 - RNA, 32 nt, Human
cuugagcccaggaaguggaggcugcagugacc

SEQ ID NO: 411928 - RNA, 32 nt, Human
cuugagcccaggaaguggagguugcagugagc

SEQ ID NO: 411929 - RNA, 21 nt, Human
cuugagcccaggaaguugagg

SEQ ID NO: 411930 - RNA, 32 nt, Human
cuugagcccaggaaguugaggcugcagugagc

SEQ ID NO: 411931 - RNA, 32 nt, Human
cuugagcccaggaauucaagaccagccugggc

SEQ ID NO: 411932 - RNA, 32 nt, Human
cuugagcccaggaauucaagaccaguccgagc

SEQ ID NO: 411933 - RNA, 32 nt, Human
cuugagcccaggaauucaagacuagccugcac

SEQ ID NO: 411934 - RNA, 32 nt, Human
cuugagcccaggaauucaaguguagccuaggg

SEQ ID NO: 411935 - RNA, 32 nt, Human
cuugagcccaggaauucgagaccagccuaggu

SEQ ID NO: 411936 - RNA, 32 nt, Human
cuugagcccaggaauucgagaccagccugggc

SEQ ID NO: 411937 - RNA, 32 nt, Human
cuugagcccaggaauuggaggcugcagugagc

SEQ ID NO: 411938 - RNA, 32 nt, Human
cuugagcccaggaauuugagaccagccuggac

SEQ ID NO: 411939 - RNA, 32 nt, Human
cuugagcccaggaauuugagaccagccugggc

SEQ ID NO: 411940 - RNA, 32 nt, Human
cuugagcccaggaauuugagguuguagugagc

SEQ ID NO: 411941 - RNA, 32 nt, Human
cuugagcccaggaauuugagucuagccuggac

SEQ ID NO: 411942 - RNA, 32 nt, Human
cuugagcccaggacuucaagaccagccuaggc

SEQ ID NO: 411943 - RNA, 32 nt, Human
cuugagcccaggagauuaagacuguaguauac

SEQ ID NO: 411944 - RNA, 21 nt, Human
cuugagcccaggagauugagg

SEQ ID NO: 411945 - RNA, 32 nt, Human
cuugagcccaggagauugaggcugaggcugca

SEQ ID NO: 411946 - RNA, 32 nt, Human
cuugagcccaggagauugaggcugcagugagc

SEQ ID NO: 411947 - RNA, 32 nt, Human
cuugagcccaggagcucaagaccagccuggac

SEQ ID NO: 411948 - RNA, 32 nt, Human
cuugagcccaggagcucgagaccagcuugguc

SEQ ID NO: 411949 - RNA, 32 nt, Human
cuugagcccaggagcuggagaucagccugggc

SEQ ID NO: 411950 - RNA, 32 nt, Human
cuugagcccaggagcuggaggcugcagugaac

SEQ ID NO: 411951 - RNA, 32 nt, Human
cuugagcccaggaggaggaggcugcagugagc

SEQ ID NO: 411952 - RNA, 32 nt, Human
cuugagcccaggaggcagaggcugcagugagc

SEQ ID NO: 411953 - RNA, 32 nt, Human
cuugagcccaggaggcagagguugcaguaagc

SEQ ID NO: 411954 - RNA, 32 nt, Human
cuugagcccaggaggcagagguugcagugagc

SEQ ID NO: 411955 - RNA, 32 nt, Human
cuugagcccaggaggccaagguugcagugggc

SEQ ID NO: 411956 - RNA, 21 nt, Human
cuugagcccaggaggcggagg

SEQ ID NO: 411957 - RNA, 32 nt, Human
cuugagcccaggaggcggaggcugcagugagc

SEQ ID NO: 411958 - RNA, 32 nt, Human
cuugagcccaggaggcggagguugcagugagc

SEQ ID NO: 411959 - RNA, 32 nt, Human
cuugagcccaggaggcugaggcugcagugcau

SEQ ID NO: 411960 - RNA, 21 nt, Human
cuugagcccaggaggucaagg

SEQ ID NO: 411961 - RNA, 32 nt, Human
cuugagcccaggaggucaaggcugaagugagc

SEQ ID NO: 411962 - RNA, 32 nt, Human
cuugagcccaggaggucaaggcugcagugagc

SEQ ID NO: 411963 - RNA, 21 nt, Human
cuugagcccaggaggucgagg

SEQ ID NO: 411964 - RNA, 32 nt, Human
cuugagcccaggaggucgaggcugcagugagc

SEQ ID NO: 411965 - RNA, 32 nt, Human
cuugagcccaggaggucgaggcugcagugugc

SEQ ID NO: 411966 - RNA, 32 nt, Human
cuugagcccaggaggucgagguugcagugagc

SEQ ID NO: 411967 - RNA, 21 nt, Human
cuugagcccaggaggucuagg

SEQ ID NO: 411968 - RNA, 32 nt, Human
cuugagcccaggaggucuaggcugcagugagc

SEQ ID NO: 411969 - RNA, 21 nt, Human
cuugagcccaggagguggagg

SEQ ID NO: 411970 - RNA, 32 nt, Human
cuugagcccaggagguggaggcugcaaugagc

SEQ ID NO: 411971 - RNA, 32 nt, Human
cuugagcccaggagguggagguugcaaugagc

SEQ ID NO: 411972 - RNA, 32 nt, Human
cuugagcccaggagguggagguugcagugagc

SEQ ID NO: 411973 - RNA, 32 nt, Human
cuugagcccaggagguggagguuucagcgagc

SEQ ID NO: 411974 - RNA, 32 nt, Human
cuugagcccaggagguugaggcugcagugaac

SEQ ID NO: 411975 - RNA, 32 nt, Human
cuugagcccaggagguugaggcugcagugagc

SEQ ID NO: 411976 - RNA, 32 nt, Human
cuugagcccaggagguugaggcugcagugagg

SEQ ID NO: 411977 - RNA, 32 nt, Human
cuugagcccaggaguccaaagccagccugggc

SEQ ID NO: 411978 - RNA, 32 nt, Human
cuugagcccaggagucuaggaccagccuggac

SEQ ID NO: 411979 - RNA, 32 nt, Human
cuugagcccaggagucugagaccagccucggc

SEQ ID NO: 411980 - RNA, 32 nt, Human
cuugagcccaggagucugagaccagccuggcc

SEQ ID NO: 411981 - RNA, 32 nt, Human
cuugagcccaggagucugagaccagccugggc

SEQ ID NO: 411982 - RNA, 32 nt, Human
cuugagcccaggagucugaggcuucagugagu

SEQ ID NO: 411983 - RNA, 32 nt, Human
cuugagcccaggagucugaggcuuuagugauc

SEQ ID NO: 411984 - RNA, 32 nt, Human
cuugagcccaggagucuugagaccagccuggg

SEQ ID NO: 411985 - RNA, 32 nt, Human
cuugagcccaggagugcaaaagcagccugagc

SEQ ID NO: 411986 - RNA, 32 nt, Human
cuugagcccaggagugcaaggcugcaaugagc

SEQ ID NO: 411987 - RNA, 32 nt, Human
cuugagcccaggaguuaagaggcugcagugac

SEQ ID NO: 411988 - RNA, 32 nt, Human
cuugagcccaggaguuagagaccagcccagcc

SEQ ID NO: 411989 - RNA, 32 nt, Human
cuugagcccaggaguuagagaccagccugggc

SEQ ID NO: 411990 - RNA, 32 nt, Human
cuugagcccaggaguucaaaaccagccugggc

SEQ ID NO: 411991 - RNA, 32 nt, Human
cuugagcccaggaguucaacaccagccugagc

SEQ ID NO: 411992 - RNA, 32 nt, Human
cuugagcccaggaguucaacaccagcuugggc

SEQ ID NO: 411993 - RNA, 21 nt, Human
cuugagcccaggaguucaaga

SEQ ID NO: 411994 - RNA, 32 nt, Human
cuugagcccaggaguucaagaacagccugggu

SEQ ID NO: 411995 - RNA, 32 nt, Human
cuugagcccaggaguucaagaccaaccuggug

SEQ ID NO: 411996 - RNA, 32 nt, Human
cuugagcccaggaguucaagaccacccugggc

SEQ ID NO: 411997 - RNA, 32 nt, Human
cuugagcccaggaguucaagaccagccugagc

SEQ ID NO: 411998 - RNA, 32 nt, Human
cuugagcccaggaguucaagaccagccuggac

SEQ ID NO: 411999 - RNA, 32 nt, Human
cuugagcccaggaguucaagaccagccuggga

SEQ ID NO: 412000 - RNA, 32 nt, Human
cuugagcccaggaguucaagaccagccugggc

SEQ ID NO: 412001 - RNA, 32 nt, Human
cuugagcccaggaguucaagaccagcuugggc

SEQ ID NO: 412002 - RNA, 32 nt, Human
cuugagcccaggaguucaagaccagucugggc

SEQ ID NO: 412003 - RNA, 32 nt, Human
cuugagcccaggaguucaagaccggccugagc

SEQ ID NO: 412004 - RNA, 32 nt, Human
cuugagcccaggaguucaagacuagccuaggc

SEQ ID NO: 412005 - RNA, 32 nt, Human
cuugagcccaggaguucaagagcagccugggc

SEQ ID NO: 412006 - RNA, 21 nt, Human
cuugagcccaggaguucaagg

SEQ ID NO: 412007 - RNA, 32 nt, Human
cuugagcccaggaguucaaggccagccugggc

SEQ ID NO: 412008 - RNA, 32 nt, Human
cuugagcccaggaguucaaggcuucagugagc

SEQ ID NO: 412009 - RNA, 32 nt, Human
cuugagcccaggaguucaauaccugucuggga

SEQ ID NO: 412010 - RNA, 32 nt, Human
cuugagcccaggaguucagaaucagccugggc

SEQ ID NO: 412011 - RNA, 21 nt, Human
cuugagcccaggaguucagga

SEQ ID NO: 412012 - RNA, 32 nt, Human
cuugagcccaggaguucaggaccugccugggc

SEQ ID NO: 412013 - RNA, 32 nt, Human
cuugagcccaggaguucaggacuagccugggc

SEQ ID NO: 412014 - RNA, 21 nt, Human
cuugagcccaggaguuccaga

SEQ ID NO: 412015 - RNA, 32 nt, Human
cuugagcccaggaguuccagaccagccugggc

SEQ ID NO: 412016 - RNA, 32 nt, Human
cuugagcccaggaguuccagaccagugugggc

SEQ ID NO: 412017 - RNA, 32 nt, Human
cuugagcccaggaguuccagacuagccugggc

SEQ ID NO: 412018 - RNA, 19 nt, Human
cuugagcccaggaguucga

SEQ ID NO: 412019 - RNA, 32 nt, Human
cuugagcccaggaguucgacaccaaccugagc

SEQ ID NO: 412020 - RNA, 32 nt, Human
cuugagcccaggaguucgacaccagccuggcc

SEQ ID NO: 412021 - RNA, 21 nt, Human
cuugagcccaggaguucgaga

SEQ ID NO: 412022 - RNA, 32 nt, Human
cuugagcccaggaguucgagacaagccugggu

SEQ ID NO: 412023 - RNA, 32 nt, Human
cuugagcccaggaguucgagaccacccugggc

SEQ ID NO: 412024 - RNA, 32 nt, Human
cuugagcccaggaguucgagaccagccggggc

SEQ ID NO: 412025 - RNA, 32 nt, Human
cuugagcccaggaguucgagaccagccugaac

SEQ ID NO: 412026 - RNA, 32 nt, Human
cuugagcccaggaguucgagaccagccuggac

SEQ ID NO: 412027 - RNA, 32 nt, Human
cuugagcccaggaguucgagaccagccugggc

SEQ ID NO: 412028 - RNA, 32 nt, Human
cuugagcccaggaguucgagaccagcuugggc

SEQ ID NO: 412029 - RNA, 32 nt, Human
cuugagcccaggaguucgagaccagucugggc

SEQ ID NO: 412030 - RNA, 32 nt, Human
cuugagcccaggaguucgagacuugccugggc

SEQ ID NO: 412031 - RNA, 32 nt, Human
cuugagcccaggaguucgagaucagccugagc

SEQ ID NO: 412032 - RNA, 32 nt, Human
cuugagcccaggaguucgagauuaaccugggc

SEQ ID NO: 412033 - RNA, 21 nt, Human
cuugagcccaggaguucgagg

SEQ ID NO: 412034 - RNA, 32 nt, Human
cuugagcccaggaguucgaggcugcagcgagc

SEQ ID NO: 412035 - RNA, 32 nt, Human
cuugagcccaggaguucgaggcugcagucagu

SEQ ID NO: 412036 - RNA, 32 nt, Human
cuugagcccaggaguucgaggcugcagugagc

SEQ ID NO: 412037 - RNA, 32 nt, Human
cuugagcccaggaguucgauaccagccugggc

SEQ ID NO: 412038 - RNA, 21 nt, Human
cuugagcccaggaguucggga

SEQ ID NO: 412039 - RNA, 32 nt, Human
cuugagcccaggaguucgggaccagccuggga

SEQ ID NO: 412040 - RNA, 21 nt, Human
cuugagcccaggaguucuaga

SEQ ID NO: 412041 - RNA, 32 nt, Human
cuugagcccaggaguucuagacaagccuggga

SEQ ID NO: 412042 - RNA, 32 nt, Human
cuugagcccaggaguugaaguccagccuaagc

SEQ ID NO: 412043 - RNA, 21 nt, Human
cuugagcccaggaguuggaga

SEQ ID NO: 412044 - RNA, 32 nt, Human
cuugagcccaggaguuggagaccagacugggg

SEQ ID NO: 412045 - RNA, 32 nt, Human
cuugagcccaggaguuggagaccagccuggau

SEQ ID NO: 412046 - RNA, 32 nt, Human
cuugagcccaggaguuggagaccagucuggga

SEQ ID NO: 412047 - RNA, 32 nt, Human
cuugagcccaggaguuggagaccugccugggc

SEQ ID NO: 412048 - RNA, 32 nt, Human
cuugagcccaggaguuggaggccagccugggc

SEQ ID NO: 412049 - RNA, 21 nt, Human
cuugagcccaggaguuuaaga

SEQ ID NO: 412050 - RNA, 32 nt, Human
cuugagcccaggaguuuaagaccagccugggc

SEQ ID NO: 412051 - RNA, 32 nt, Human
cuugagcccaggaguuuaagaccugccugggc

SEQ ID NO: 412052 - RNA, 32 nt, Human
cuugagcccaggaguuugaaaccagccugggc

SEQ ID NO: 412053 - RNA, 32 nt, Human
cuugagcccaggaguuugaaaccagccugggu

SEQ ID NO: 412054 - RNA, 32 nt, Human
cuugagcccaggaguuugaauccauccugggc

SEQ ID NO: 412055 - RNA, 32 nt, Human
cuugagcccaggaguuugacaccagccugggc

SEQ ID NO: 412056 - RNA, 21 nt, Human
cuugagcccaggaguuugaga

SEQ ID NO: 412057 - RNA, 32 nt, Human
cuugagcccaggaguuugagaccaaucuaggc

SEQ ID NO: 412058 - RNA, 32 nt, Human
cuugagcccaggaguuugagaccagcauggaa

SEQ ID NO: 412059 - RNA, 32 nt, Human
cuugagcccaggaguuugagaccagccagggc

SEQ ID NO: 412060 - RNA, 32 nt, Human
cuugagcccaggaguuugagaccagccuaggc

SEQ ID NO: 412061 - RNA, 32 nt, Human
cuugagcccaggaguuugagaccagccuggac

SEQ ID NO: 412062 - RNA, 32 nt, Human
cuugagcccaggaguuugagaccagccuggcc

SEQ ID NO: 412063 - RNA, 32 nt, Human
cuugagcccaggaguuugagaccagccugggc

SEQ ID NO: 412064 - RNA, 32 nt, Human
cuugagcccaggaguuugagaccagccugggu

SEQ ID NO: 412065 - RNA, 32 nt, Human
cuugagcccaggaguuugagaccaggcuaggc

SEQ ID NO: 412066 - RNA, 32 nt, Human
cuugagcccaggaguuugagaccauccugggc

SEQ ID NO: 412067 - RNA, 32 nt, Human
cuugagcccaggaguuugagacuagccuggcc

SEQ ID NO: 412068 - RNA, 32 nt, Human
cuugagcccaggaguuugagacuagccugggc

SEQ ID NO: 412069 - RNA, 32 nt, Human
cuugagcccaggaguuugagaucagccugguc

SEQ ID NO: 412070 - RNA, 32 nt, Human
cuugagcccaggaguuugaggccagacugcac

SEQ ID NO: 412071 - RNA, 32 nt, Human
cuugagcccaggaguuugaggccagccugggc

SEQ ID NO: 412072 - RNA, 32 nt, Human
cuugagcccaggaguuugaggcugcagugaac

SEQ ID NO: 412073 - RNA, 32 nt, Human
cuugagcccaggaguuugaggcugcagugagc

SEQ ID NO: 412074 - RNA, 32 nt, Human
cuugagcccaggaguuugaggcugcagugagu

SEQ ID NO: 412075 - RNA, 32 nt, Human
cuugagcccaggaguuugaggcugcggugagc

SEQ ID NO: 412076 - RNA, 32 nt, Human
cuugagcccaggaguuugagggcagccuggga

SEQ ID NO: 412077 - RNA, 32 nt, Human
cuugagcccaggaguuugaggguacagugugc

SEQ ID NO: 412078 - RNA, 32 nt, Human
cuugagcccaggaguuugagguugcagugagc

SEQ ID NO: 412079 - RNA, 32 nt, Human
cuugagcccaggaguuugagguugcagugcac

SEQ ID NO: 412080 - RNA, 32 nt, Human
cuugagcccaggaguuugaguccagccuggac

SEQ ID NO: 412081 - RNA, 32 nt, Human
cuugagcccaggaguuugcgaccagccugggc

SEQ ID NO: 412082 - RNA, 32 nt, Human
cuugagcccaggaguuuuagacuagccuggac

SEQ ID NO: 412083 - RNA, 32 nt, Human
cuugagcccaggaguuuugaguccagccugaa

SEQ ID NO: 412084 - RNA, 32 nt, Human
cuugagcccaggauuucaaguccagccugggc

SEQ ID NO: 412085 - RNA, 32 nt, Human
cuugagcccaggcgguugaggcugcagugagc

SEQ ID NO: 412086 - RNA, 21 nt, Human
cuugagcccaggcguucgaga

SEQ ID NO: 412087 - RNA, 32 nt, Human
cuugagcccagggguuugaggcugcagugagc

SEQ ID NO: 412088 - RNA, 32 nt, Human
cuugagcccaugaagucaggcugcagugagcu

SEQ ID NO: 412089 - RNA, 32 nt, Human
cuugagccccagggguggaggcugcaaugaac

SEQ ID NO: 412090 - RNA, 32 nt, Human
cuugagccccggaggucgaggcugcagugggc

SEQ ID NO: 412091 - RNA, 32 nt, Human
cuugagcccgagagacagagguugcagugagc

SEQ ID NO: 412092 - RNA, 32 nt, Human
cuugagcccgagagguggagacugcaguaagc

SEQ ID NO: 412093 - RNA, 32 nt, Human
cuugagcccgagagguggaggcuggagugaac

SEQ ID NO: 412094 - RNA, 32 nt, Human
cuugagcccggaaggcagagguugcagugagc

SEQ ID NO: 412095 - RNA, 32 nt, Human
cuugagcccggaaggcggagguugcagugagc

SEQ ID NO: 412096 - RNA, 21 nt, Human
cuugagcccggaaguucgaga

SEQ ID NO: 412097 - RNA, 32 nt, Human
cuugagcccgggaagcagagguugcagugaac

SEQ ID NO: 412098 - RNA, 32 nt, Human
cuugagcccgggaaguggagguugcacugagc

SEQ ID NO: 412099 - RNA, 32 nt, Human
cuugagcccgggaggcagaggcugcagugaac

SEQ ID NO: 412100 - RNA, 32 nt, Human
cuugagcccgggaggcagagguugcagugagc

SEQ ID NO: 412101 - RNA, 32 nt, Human
cuugagcccgggaggcggagguugcagugagc

SEQ ID NO: 412102 - RNA, 32 nt, Human
cuugagcccgggaggucaagguugcagugagu

SEQ ID NO: 412103 - RNA, 32 nt, Human
cuugagcccgggagguugaggcugcagugggg

SEQ ID NO: 412104 - RNA, 32 nt, Human
cuugagcccgggcugugacucccucuuugggg

SEQ ID NO: 412105 - RNA, 32 nt, Human
cuugagcccuagaggucgaggcugcagugagc

SEQ ID NO: 412106 - RNA, 32 nt, Human
cuugagcccuagagguugaggcugcagugagc

SEQ ID NO: 412107 - RNA, 32 nt, Human
cuugagcccuggagaucgaggcugcaguaagc

SEQ ID NO: 412108 - RNA, 32 nt, Human
cuugagcccuggaggucaaggcugcagugagc

SEQ ID NO: 412109 - RNA, 32 nt, Human
cuugagcccuggaguucaaggcugcagugagc

SEQ ID NO: 412110 - RNA, 32 nt, Human
cuugagcccuggaguuggagguugcagugagc

SEQ ID NO: 412111 - RNA, 32 nt, Human
cuugagcccuggcggcagagguugcagugagc

SEQ ID NO: 412112 - RNA, 32 nt, Human
cuugagccgaggggguggggguugcagugagc

SEQ ID NO: 412113 - RNA, 19 nt, Human
cuugagccgcucgcugccg

SEQ ID NO: 412114 - RNA, 32 nt, Human
cuugagccggggaggaggggguugcagugagc

SEQ ID NO: 412115 - RNA, 32 nt, Human
cuugagccggggaggcagagguugcagugagc

SEQ ID NO: 412116 - RNA, 32 nt, Human
cuugagccggggagguggaggcugcagugaac

SEQ ID NO: 412117 - RNA, 32 nt, Human
cuugagccuaagagaucaaggcugcagugagc

SEQ ID NO: 412118 - RNA, 32 nt, Human
cuugagccuaggaagucgaggcugcagugagc

SEQ ID NO: 412119 - RNA, 32 nt, Human
cuugagccuaggaggucgaggcugcaguggga

SEQ ID NO: 412120 - RNA, 32 nt, Human
cuugagccuaggagguugaggcugcagugagc

SEQ ID NO: 412121 - RNA, 32 nt, Human
cuugagccuccucaccccagacuccugacugu

SEQ ID NO: 412122 - RNA, 32 nt, Human
cuugagccucggaggcggagguugcagugagc

SEQ ID NO: 412123 - RNA, 32 nt, Human
cuugagccugagagaugaagguugcagugagc

SEQ ID NO: 412124 - RNA, 18 nt, Human
cuugagccugcagcagcu

SEQ ID NO: 412125 - RNA, 32 nt, Human
cuugagccuggaaaagguugcagugagcugga

SEQ ID NO: 412126 - RNA, 32 nt, Human
cuugagccuggaagacauagguugcaguguaa

SEQ ID NO: 412127 - RNA, 32 nt, Human
cuugagccugggaaguggaggcugcagugagc

SEQ ID NO: 412128 - RNA, 32 nt, Human
cuugagccugggacauugaggcugcagugaac

SEQ ID NO: 412129 - RNA, 32 nt, Human
cuugagccugggagauggagguugcagugagc

SEQ ID NO: 412130 - RNA, 32 nt, Human
cuugagccugggagauugaggcugcacugagc

SEQ ID NO: 412131 - RNA, 32 nt, Human
cuugagccugggagcaaggguugcagugagcu

SEQ ID NO: 412132 - RNA, 32 nt, Human
cuugagccugggagcgcagguugcaaugagcc

SEQ ID NO: 412133 - RNA, 32 nt, Human
cuugagccugggaggaagagguugcagugagc

SEQ ID NO: 412134 - RNA, 32 nt, Human
cuugagccugggaggcagagauugcacugagc

SEQ ID NO: 412135 - RNA, 32 nt, Human
cuugagccugggaggcagaggcugcagugagc

SEQ ID NO: 412136 - RNA, 32 nt, Human
cuugagccugggaggcagagguugcagugagc

SEQ ID NO: 412137 - RNA, 32 nt, Human
cuugagccugggaggcagagguugcugugagc

SEQ ID NO: 412138 - RNA, 32 nt, Human
cuugagccugggaggcggagguugcagugagc

SEQ ID NO: 412139 - RNA, 32 nt, Human
cuugagccugggaggcggggguuguggugagc

SEQ ID NO: 412140 - RNA, 32 nt, Human
cuugagccugggaggucaagccuacagugagc

SEQ ID NO: 412141 - RNA, 32 nt, Human
cuugagccugggaggucaaggcugcaguaagc

SEQ ID NO: 412142 - RNA, 32 nt, Human
cuugagccugggaggucaaggcugcagugaac

SEQ ID NO: 412143 - RNA, 32 nt, Human
cuugagccugggaggucaaggcugcagugagc

SEQ ID NO: 412144 - RNA, 32 nt, Human
cuugagccugggaggucauggcugcagagagc

SEQ ID NO: 412145 - RNA, 32 nt, Human
cuugagccugggaggucgaggcugcagugagc

SEQ ID NO: 412146 - RNA, 32 nt, Human
cuugagccugggaggucgaggcuguagugagc

SEQ ID NO: 412147 - RNA, 32 nt, Human
cuugagccugggagguggaggcuacugugagc

SEQ ID NO: 412148 - RNA, 32 nt, Human
cuugagccugggagguggagguugcacugagu

SEQ ID NO: 412149 - RNA, 32 nt, Human
cuugagccugggagguggagguugcagugagc

SEQ ID NO: 412150 - RNA, 32 nt, Human
cuugagccugggagguggagguugcagugagu

SEQ ID NO: 412151 - RNA, 32 nt, Human
cuugagccugggagguggagguugccagugag

SEQ ID NO: 412152 - RNA, 32 nt, Human
cuugagccugggagguggagguuucagugagc

SEQ ID NO: 412153 - RNA, 32 nt, Human
cuugagccugggagguugaggcugcagugagc

SEQ ID NO: 412154 - RNA, 32 nt, Human
cuugagccugggagguugugguugcagugagc

SEQ ID NO: 412155 - RNA, 32 nt, Human
cuugagccugggaguuugaggcugcagugagc

SEQ ID NO: 412156 - RNA, 32 nt, Human
cuugagccugggaugucaaggcugcagugagc

SEQ ID NO: 412157 - RNA, 21 nt, Human
cuugagccugggcaacagagu

SEQ ID NO: 412158 - RNA, 32 nt, Human
cuugagccugggggacugaggcugcagugagc

SEQ ID NO: 412159 - RNA, 32 nt, Human
cuugagccuguauuaaaggaaucaggccaggc

SEQ ID NO: 412160 - RNA, 32 nt, Human
cuugagccugugaggucgaggcugcagugagc

SEQ ID NO: 412161 - RNA, 32 nt, Human
cuugagccuuggaggcggagguugcagugagc

SEQ ID NO: 412162 - RNA, 32 nt, Human
cuugagccuuggauguuccuguggaccugaca

SEQ ID NO: 412163 - RNA, 32 nt, Human
cuugagcgauucuugugucucagucuuccggg

SEQ ID NO: 412164 - RNA, 32 nt, Human
cuugagcgcggagccgcucaagccacagcucc

SEQ ID NO: 412165 - RNA, 32 nt, Human
cuugagcuagggagguggugcagucagccucg

SEQ ID NO: 412166 - RNA, 21 nt, Human
cuugagcucaagaguucaaga

SEQ ID NO: 412167 - RNA, 21 nt, Human
cuugagcucaggaauuugaga

SEQ ID NO: 412168 - RNA, 21 nt, Human
cuugagcucaggagcuugaga

SEQ ID NO: 412169 - RNA, 32 nt, Human
cuugagcucaggaggcagagguugcagugagc

SEQ ID NO: 412170 - RNA, 32 nt, Human
cuugagcucaggagguugaggcugcagagagu

SEQ ID NO: 412171 - RNA, 32 nt, Human
cuugagcucaggaguccuaaaccagccugggc

SEQ ID NO: 412172 - RNA, 21 nt, Human
cuugagcucaggaguucaaga

SEQ ID NO: 412173 - RNA, 21 nt, Human
cuugagcucaggaguuccaga

SEQ ID NO: 412174 - RNA, 19 nt, Human
cuugagcucaggaguucga

SEQ ID NO: 412175 - RNA, 21 nt, Human
cuugagcucaggaguucuaga

SEQ ID NO: 412176 - RNA, 21 nt, Human
cuugagcucaggaguuugaga

SEQ ID NO: 412177 - RNA, 32 nt, Human
cuugagcucaggaguuuggaccagccugggca

SEQ ID NO: 412178 - RNA, 32 nt, Human
cuugagcucagggggccaaggcugcagugagu

SEQ ID NO: 412179 - RNA, 32 nt, Human
cuugagcucugcaaagaucagagcaggugagc

SEQ ID NO: 412180 - RNA, 32 nt, Human
cuugagcucuuugacucccagaagguacccca

SEQ ID NO: 412181 - RNA, 32 nt, Human
cuugagcugccucugagauuugggcugugcgg

SEQ ID NO: 412182 - RNA, 32 nt, Human
cuugagcugcugcugucacuccuccaccgagg

SEQ ID NO: 412183 - RNA, 32 nt, Human
cuugagcugggaacucaggcuccuggaaaaac

SEQ ID NO: 412184 - RNA, 32 nt, Human
cuugagcugggaguucaagaccagucugagca

SEQ ID NO: 412185 - RNA, 32 nt, Human
cuugagcuggggagauggaggcugcagugagc

SEQ ID NO: 412186 - RNA, 19 nt, Human
cuugagcuggggagugcag

SEQ ID NO: 412187 - RNA, 32 nt, Human
cuugagcuggguggggugaggggugagcagcc

SEQ ID NO: 412188 - RNA, 32 nt, Human
cuugagcuucagcccauuucucuccauuuccu

SEQ ID NO: 412189 - RNA, 32 nt, Human
cuugagcuuggaaguagcacuugcuguagacu

SEQ ID NO: 412190 - RNA, 32 nt, Human
cuugagcuugggaaaucaagguugcagugagc

SEQ ID NO: 412191 - RNA, 32 nt, Human
cuugagcuugggaagucgaggcugcagucagc

SEQ ID NO: 412192 - RNA, 20 nt, Human
cuugagcuuuaaagcauuga

SEQ ID NO: 412193 - RNA, 32 nt, Human
cuugaggaaacugaggcaaagaggagggcagg

SEQ ID NO: 412194 - RNA, 20 nt, Human
cuugaggaaggaccuugcca

SEQ ID NO: 412195 - RNA, 32 nt, Human
cuugaggacaacagggagcaucacuaguucau

SEQ ID NO: 412196 - RNA, 32 nt, Human
cuugaggacacauguccagugggaggugagac

SEQ ID NO: 412197 - RNA, 32 nt, Human
cuugaggacagaaacuugaaaacaaacacaaa

SEQ ID NO: 412198 - RNA, 32 nt, Human
cuugaggacugcuggcuguaaccagggcacau

SEQ ID NO: 412199 - RNA, 32 nt, Human
cuugaggagcuguuguguugaggacccaucaa

SEQ ID NO: 412200 - RNA, 32 nt, Human
cuugaggagcuuucuccugagcuccagucccu

SEQ ID NO: 412201 - RNA, 32 nt, Human
cuugaggaggaaccugucuuuaaagcuguccc

SEQ ID NO: 412202 - RNA, 21 nt, Human
cuugaggaggccgccacggca

SEQ ID NO: 412203 - RNA, 32 nt, Human
cuugaggauagacagauauacacaccacacac

SEQ ID NO: 412204 - RNA, 32 nt, Human
cuugaggcaaaaguugccagcacuuuagauuc

SEQ ID NO: 412205 - RNA, 32 nt, Human
cuugaggcaaagcauucauccuacaucauaaa

SEQ ID NO: 412206 - RNA, 32 nt, Human
cuugaggcacaaaucacuguggggaaacaauu

SEQ ID NO: 412207 - RNA, 32 nt, Human
cuugaggcagauccuggcacuaccucacagcu

SEQ ID NO: 412208 - RNA, 32 nt, Human
cuugaggcagggucucacucuguugaccaggc

SEQ ID NO: 412209 - RNA, 21 nt, Human
cuugaggccagaaguucgaga

SEQ ID NO: 412210 - RNA, 32 nt, Human
cuugaggccagccugggcaacauagugagacc

SEQ ID NO: 412211 - RNA, 32 nt, Human
cuugaggccagcugcuaugccagguggugucu

SEQ ID NO: 412212 - RNA, 32 nt, Human
cuugaggccaggagguugaggcugcagugagc

SEQ ID NO: 412213 - RNA, 32 nt, Human
cuugaggccaggaguauaagagcagccugggc

SEQ ID NO: 412214 - RNA, 32 nt, Human
cuugaggccaggagucccagagcagccugggc

SEQ ID NO: 412215 - RNA, 32 nt, Human
cuugaggccaggagucugagacaagccuaggc

SEQ ID NO: 412216 - RNA, 32 nt, Human
cuugaggccaggaguuaaagagcagccuggcu

SEQ ID NO: 412217 - RNA, 32 nt, Human
cuugaggccaggaguuagagaccagccuggcc

SEQ ID NO: 412218 - RNA, 21 nt, Human
cuugaggccaggaguucaaga

SEQ ID NO: 412219 - RNA, 32 nt, Human
cuugaggccaggaguucaagaccagccagggc

SEQ ID NO: 412220 - RNA, 32 nt, Human
cuugaggccaggaguucaagaccagcccaggc

SEQ ID NO: 412221 - RNA, 32 nt, Human
cuugaggccaggaguucaagaccagccuggcc

SEQ ID NO: 412222 - RNA, 32 nt, Human
cuugaggccaggaguucaagaccagccugggc

SEQ ID NO: 412223 - RNA, 32 nt, Human
cuugaggccaggaguucaagaccagcuuggcc

SEQ ID NO: 412224 - RNA, 32 nt, Human
cuugaggccaggaguucaagaccagucugggc

SEQ ID NO: 412225 - RNA, 32 nt, Human
cuugaggccaggaguucaagaccggccuggcc

SEQ ID NO: 412226 - RNA, 32 nt, Human
cuugaggccaggaguucaagacuagccuggcu

SEQ ID NO: 412227 - RNA, 32 nt, Human
cuugaggccaggaguucaagaucagccugggc

SEQ ID NO: 412228 - RNA, 32 nt, Human
cuugaggccaggaguucaaggccagccuggac

SEQ ID NO: 412229 - RNA, 32 nt, Human
cuugaggccaggaguucaauaucaguuugggc

SEQ ID NO: 412230 - RNA, 32 nt, Human
cuugaggccaggaguucaggaccagccugggc

SEQ ID NO: 412231 - RNA, 32 nt, Human
cuugaggccaggaguucaugacccgccuggcc

SEQ ID NO: 412232 - RNA, 32 nt, Human
cuugaggccaggaguuccagaccagccuggcc

SEQ ID NO: 412233 - RNA, 32 nt, Human
cuugaggccaggaguuccagaccagccugggc

SEQ ID NO: 412234 - RNA, 32 nt, Human
cuugaggccaggaguuccagaccagccugggu

SEQ ID NO: 412235 - RNA, 32 nt, Human
cuugaggccaggaguuccagagcagccugggc

SEQ ID NO: 412236 - RNA, 21 nt, Human
cuugaggccaggaguucgaga

SEQ ID NO: 412237 - RNA, 32 nt, Human
cuugaggccaggaguucgagaacagucuggcc

SEQ ID NO: 412238 - RNA, 32 nt, Human
cuugaggccaggaguucgagaccagccuaguu

SEQ ID NO: 412239 - RNA, 32 nt, Human
cuugaggccaggaguucgagaccagccucagc

SEQ ID NO: 412240 - RNA, 32 nt, Human
cuugaggccaggaguucgagaccagccugaac

SEQ ID NO: 412241 - RNA, 32 nt, Human
cuugaggccaggaguucgagaccagccugagc

SEQ ID NO: 412242 - RNA, 32 nt, Human
cuugaggccaggaguucgagaccagccuggac

SEQ ID NO: 412243 - RNA, 32 nt, Human
cuugaggccaggaguucgagaccagccuggcc

SEQ ID NO: 412244 - RNA, 32 nt, Human
cuugaggccaggaguucgagaccagccugggc

SEQ ID NO: 412245 - RNA, 32 nt, Human
cuugaggccaggaguucgagaccagccugguc

SEQ ID NO: 412246 - RNA, 32 nt, Human
cuugaggccaggaguucgagaccagccuguuc

SEQ ID NO: 412247 - RNA, 32 nt, Human
cuugaggccaggaguucgagaucagccuggcc

SEQ ID NO: 412248 - RNA, 32 nt, Human
cuugaggccaggaguucggguccggccugggc

SEQ ID NO: 412249 - RNA, 32 nt, Human
cuugaggccaggaguucugagaccagccuggc

SEQ ID NO: 412250 - RNA, 32 nt, Human
cuugaggccaggaguugcagaccagccugggu

SEQ ID NO: 412251 - RNA, 32 nt, Human
cuugaggccaggaguuggagaccagccuggcc

SEQ ID NO: 412252 - RNA, 32 nt, Human
cuugaggccaggaguuuaagaccagccugggc

SEQ ID NO: 412253 - RNA, 32 nt, Human
cuugaggccaggaguuuaaggccagccugggc

SEQ ID NO: 412254 - RNA, 32 nt, Human
cuugaggccaggaguuuaaggcuagccugggc

SEQ ID NO: 412255 - RNA, 32 nt, Human
cuugaggccaggaguuugaaaccagccuggcc

SEQ ID NO: 412256 - RNA, 32 nt, Human
cuugaggccaggaguuugaaacuagucugguc

SEQ ID NO: 412257 - RNA, 32 nt, Human
cuugaggccaggaguuugagacaagcuugggc

SEQ ID NO: 412258 - RNA, 32 nt, Human
cuugaggccaggaguuugagaccaaccugggc

SEQ ID NO: 412259 - RNA, 32 nt, Human
cuugaggccaggaguuugagaccaaccugguu

SEQ ID NO: 412260 - RNA, 32 nt, Human
cuugaggccaggaguuugagaccaccuugggc

SEQ ID NO: 412261 - RNA, 32 nt, Human
cuugaggccaggaguuugagaccagccugagu

SEQ ID NO: 412262 - RNA, 32 nt, Human
cuugaggccaggaguuugagaccagccuggca

SEQ ID NO: 412263 - RNA, 32 nt, Human
cuugaggccaggaguuugagaccagccuggcc

SEQ ID NO: 412264 - RNA, 32 nt, Human
cuugaggccaggaguuugagaccagccugggc

SEQ ID NO: 412265 - RNA, 32 nt, Human
cuugaggccaggaguuugagaccagcuugggc

SEQ ID NO: 412266 - RNA, 32 nt, Human
cuugaggccaggaguuugagaccuccugggca

SEQ ID NO: 412267 - RNA, 32 nt, Human
cuugaggccaggaguuugagacuagccuaggc

SEQ ID NO: 412268 - RNA, 32 nt, Human
cuugaggccaggaguuugagacuagccugggc

SEQ ID NO: 412269 - RNA, 32 nt, Human
cuugaggccaggaguuugagaucggccugggc

SEQ ID NO: 412270 - RNA, 32 nt, Human
cuugaggccaggaguuugaggcugcagugagu

SEQ ID NO: 412271 - RNA, 32 nt, Human
cuugaggccaggaguuuguuaccagccugggc

SEQ ID NO: 412272 - RNA, 32 nt, Human
cuugaggccguugcagacuuuggcgcggcucg

SEQ ID NO: 412273 - RNA, 32 nt, Human
cuugaggcugagaggucaagguugcagugagc

SEQ ID NO: 412274 - RNA, 32 nt, Human
cuugaggcugcugccauuuuuccacuuaacca

SEQ ID NO: 412275 - RNA, 32 nt, Human
cuugaggcugggaggcagagguugcagugagc

SEQ ID NO: 412276 - RNA, 32 nt, Human
cuugaggcugggaggcggagguugcagugagc

SEQ ID NO: 412277 - RNA, 32 nt, Human
cuugaggcuguggugugaaagguggccagccu

SEQ ID NO: 412278 - RNA, 32 nt, Human
cuugagggagcacuggcucuguggccaugcuu

SEQ ID NO: 412279 - RNA, 32 nt, Human
cuugagggaggaaguccugggacccagggagg

SEQ ID NO: 412280 - RNA, 32 nt, Human
cuugagggagggcuggaaucugucuucccuga

SEQ ID NO: 412281 - RNA, 32 nt, Human
cuugagggagggcuggggccuccuuguccugg

SEQ ID NO: 412282 - RNA, 18 nt, Human
cuugagggaggggugcag

SEQ ID NO: 412283 - RNA, 32 nt, Human
cuugaggggcaccacuacuccagcccagaagg

SEQ ID NO: 412284 - RNA, 32 nt, Human
cuugaggguagggaggcgggcccagugcagga

SEQ ID NO: 412285 - RNA, 32 nt, Human
cuugagggucuccacugcugccuugggggccu

SEQ ID NO: 412286 - RNA, 32 nt, Human
cuugaggguggaggaugggaagagggagagga

SEQ ID NO: 412287 - RNA, 21 nt, Human
cuugaggucaagaguuugaga

SEQ ID NO: 412288 - RNA, 21 nt, Human
cuugaggucagaaguucgaga

SEQ ID NO: 412289 - RNA, 32 nt, Human
cuugaggucaggaguccaagaccagccuggcc

SEQ ID NO: 412290 - RNA, 21 nt, Human
cuugaggucaggaguucaaga

SEQ ID NO: 412291 - RNA, 19 nt, Human
cuugaggucaggaguucga

SEQ ID NO: 412292 - RNA, 21 nt, Human
cuugaggucaggaguucgaga

SEQ ID NO: 412293 - RNA, 21 nt, Human
cuugaggucaggaguuugaga

SEQ ID NO: 412294 - RNA, 32 nt, Human
cuugaggucaggggaucacaccagccuaacca

SEQ ID NO: 412295 - RNA, 32 nt, Human
cuugaggugaugauaguuggccucuggucuac

SEQ ID NO: 412296 - RNA, 32 nt, Human
cuugagguuugggaccugaagcuccagugugg

SEQ ID NO: 412297 - RNA, 32 nt, Human
cuugaguaauuuggaacccaaaagugaagauc

SEQ ID NO: 412298 - RNA, 22 nt, Human
cuugaguagcugggauuacagg

SEQ ID NO: 412299 - RNA, 32 nt, Human
cuugaguagugacuucuuuggugaggcaagaa

SEQ ID NO: 412300 - RNA, 32 nt, Human
cuugaguauaagaaaugcauaugucacuagaa

SEQ ID NO: 412301 - RNA, 32 nt, Human
cuugagucacacaagcuugauaauauuaaaua

SEQ ID NO: 412302 - RNA, 32 nt, Human
cuugaguccaggaggcggaggcugcagugagc

SEQ ID NO: 412303 - RNA, 32 nt, Human
cuugaguccaggagguugaggcugcagucagc

SEQ ID NO: 412304 - RNA, 32 nt, Human
cuugaguccaggagguugaggcugcagugagc

SEQ ID NO: 412305 - RNA, 32 nt, Human
cuugaguccaggaguccgagaccagccugggc

SEQ ID NO: 412306 - RNA, 21 nt, Human
cuugaguccaggaguucaaga

SEQ ID NO: 412307 - RNA, 32 nt, Human
cuugaguccaggaguucaaggccagccugggc

SEQ ID NO: 412308 - RNA, 32 nt, Human
cuugaguccaggaguucaaggcugcagugagu

SEQ ID NO: 412309 - RNA, 32 nt, Human
cuugaguccaggaguuuaagaccagccuggac

SEQ ID NO: 412310 - RNA, 32 nt, Human
cuugaguccaggaguuugaaaccuaccuaggc

SEQ ID NO: 412311 - RNA, 32 nt, Human
cuugaguccaggaguuugagaccagccuggac

SEQ ID NO: 412312 - RNA, 32 nt, Human
cuugaguccaggaguuugagaccagccugggc

SEQ ID NO: 412313 - RNA, 32 nt, Human
cuugaguccaggaguuugagacuagccugauc

SEQ ID NO: 412314 - RNA, 32 nt, Human
cuugaguccaggaguuugagaugcgccugggc

SEQ ID NO: 412315 - RNA, 32 nt, Human
cuugaguccuggcuuuggcugacccuucuuug

SEQ ID NO: 412316 - RNA, 32 nt, Human
cuugagucuaccuuuggacugccuuccuuggg

SEQ ID NO: 412317 - RNA, 32 nt, Human
cuugagucuagacuguggccacagccucugcc

SEQ ID NO: 412318 - RNA, 32 nt, Human
cuugagucuccagcccacagccaagguggacg

SEQ ID NO: 412319 - RNA, 32 nt, Human
cuugagucuccucucuggauggaauccgcgag

SEQ ID NO: 412320 - RNA, 32 nt, Human
cuugagucugggaggcggagguugcagugagc

SEQ ID NO: 412321 - RNA, 32 nt, Human
cuugagucugggagguggaggcugcagugagc

SEQ ID NO: 412322 - RNA, 32 nt, Human
cuugagucuuccuguuuuuccuguaccggguc

SEQ ID NO: 412323 - RNA, 32 nt, Human
cuugagugaaguuugauacuauccagaaggua

SEQ ID NO: 412324 - RNA, 32 nt, Human
cuugagugagcacucacuggggcuguggcucc

SEQ ID NO: 412325 - RNA, 32 nt, Human
cuugagugcaaccucugcccacuguguucaag

SEQ ID NO: 412326 - RNA, 32 nt, Human
cuugaguggaauuggaugccucuaggagccca

SEQ ID NO: 412327 - RNA, 32 nt, Human
cuugaguggcagcgucuggacuccaggcagcc

SEQ ID NO: 412328 - RNA, 32 nt, Human
cuugagugguuaaauuacugucaugcaaagcg

SEQ ID NO: 412329 - RNA, 32 nt, Human
cuugaguuagauugaaguagaaucagugauag

SEQ ID NO: 412330 - RNA, 21 nt, Human
cuugaguucaggaguucgaga

SEQ ID NO: 412331 - RNA, 32 nt, Human
cuugaguucauagcuugaaaagagaccucaaa

SEQ ID NO: 412332 - RNA, 32 nt, Human
cuugaguugggcuggucacagccuugugaugu

SEQ ID NO: 412333 - RNA, 32 nt, Human
cuugaguuucuccauaugugcauguacaucua

SEQ ID NO: 412334 - RNA, 32 nt, Human
cuugaguuucuugaaggcuuccuggccuccag

SEQ ID NO: 412335 - RNA, 32 nt, Human
cuugauacaugguauccaguuugcauaguauc

SEQ ID NO: 412336 - RNA, 32 nt, Human
cuugauacuaaauuugggacucuuugcugcgg

SEQ ID NO: 412337 - RNA, 19 nt, Human
cuugauacuuucuuuaaaa

SEQ ID NO: 412338 - RNA, 32 nt, Human
cuugauagcuaaauaacuugccauuucuuuau

SEQ ID NO: 412339 - RNA, 32 nt, Human
cuugauagugagugacuucucgugagagaucu

SEQ ID NO: 412340 - RNA, 32 nt, Human
cuugauauaucaucucagaaacuuuccugaau

SEQ ID NO: 412341 - RNA, 32 nt, Human
cuugauauuaagcaugagaaagcucaugcuga

SEQ ID NO: 412342 - RNA, 32 nt, Human
cuugauauugcacagugcacuuauuuuguggc

SEQ ID NO: 412343 - RNA, 32 nt, Human
cuugaucacccaggcuagagugcaguggcgug

SEQ ID NO: 412344 - RNA, 32 nt, Human
cuugaucacgccacugcacuccagccugggug

SEQ ID NO: 412345 - RNA, 32 nt, Human
cuugaucagguuauauuacagucaaagaugau

SEQ ID NO: 412346 - RNA, 32 nt, Human
cuugaucaugcugcaguggguaguucuaagga

SEQ ID NO: 412347 - RNA, 32 nt, Human
cuugaucauggacuggugccuuugcauucaga

SEQ ID NO: 412348 - RNA, 32 nt, Human
cuugaucauggacuuucagccuccagaacuuc

SEQ ID NO: 412349 - RNA, 32 nt, Human
cuugauccaccccuucucccaccccagauccc

SEQ ID NO: 412350 - RNA, 32 nt, Human
cuugaucccaggaauuugagguugcaguaagc

SEQ ID NO: 412351 - RNA, 32 nt, Human
cuugaucccaggaggcggagguugcagugagu

SEQ ID NO: 412352 - RNA, 32 nt, Human
cuugaucccaggaggucgagaccagccugggg

SEQ ID NO: 412353 - RNA, 32 nt, Human
cuugaucccaggaguuugagaccagccugggc

SEQ ID NO: 412354 - RNA, 32 nt, Human
cuugauccgcaauaccgcuugccacauccucu

SEQ ID NO: 412355 - RNA, 32 nt, Human
cuugauccggggagguggaaguugcagugggc

SEQ ID NO: 412356 - RNA, 32 nt, Human
cuugauccugggaggcagagguuguagugagc

SEQ ID NO: 412357 - RNA, 27 nt, Human
cuugauccugggaggucaaggcugcag

SEQ ID NO: 412358 - RNA, 32 nt, Human
cuugaucgugccacugcacuccagccuggggg

SEQ ID NO: 412359 - RNA, 32 nt, Human
cuugaucguguguuucauuuucugccucuuug

SEQ ID NO: 412360 - RNA, 32 nt, Human
cuugaucucaggagguugaggcugcagugaau

SEQ ID NO: 412361 - RNA, 32 nt, Human
cuugaucuccacaauccuuuaucuuaaccuga

SEQ ID NO: 412362 - RNA, 32 nt, Human
cuugaucucucccaccccaucccucuccccag

SEQ ID NO: 412363 - RNA, 32 nt, Human
cuugaucucugacuuccagccuccagaaucac

SEQ ID NO: 412364 - RNA, 32 nt, Human
cuugaucugcagcuucucugaaguuuggaaaa

SEQ ID NO: 412365 - RNA, 32 nt, Human
cuugaucugucgcccaggcuggagugcaguag

SEQ ID NO: 412366 - RNA, 32 nt, Human
cuugaucugucuuucaaaacaauguccccuua

SEQ ID NO: 412367 - RNA, 32 nt, Human
cuugaucuguuacccaggcuggagugcagugg

SEQ ID NO: 412368 - RNA, 32 nt, Human
cuugaucuguucugucuuguggcagggcucua

SEQ ID NO: 412369 - RNA, 32 nt, Human
cuugaucuucaucaacaauuacacucaggaaa

SEQ ID NO: 412370 - RNA, 32 nt, Human
cuugaucuugaacuucucagccuccagaacga

SEQ ID NO: 412371 - RNA, 32 nt, Human
cuugaugaagagucuguuuuuaaucauaaaaa

SEQ ID NO: 412372 - RNA, 32 nt, Human
cuugaugaagccaccagugcccugacagagga

SEQ ID NO: 412373 - RNA, 22 nt, Human
cuugaugaccucuguuucuucc

SEQ ID NO: 412374 - RNA, 32 nt, Human
cuugaugagaagagaccccugcccauccucag

SEQ ID NO: 412375 - RNA, 32 nt, Human
cuugaugagcaugccagcuaugugguagggcc

SEQ ID NO: 412376 - RNA, 32 nt, Human
cuugaugcauaaaaacagcugggcucccuugg

SEQ ID NO: 412377 - RNA, 32 nt, Human
cuugaugccagccugcugcaacagacccuccc

SEQ ID NO: 412378 - RNA, 21 nt, Human
cuugaugccaggaguucaaga

SEQ ID NO: 412379 - RNA, 32 nt, Human
cuugaugccaggaguucaagaccagccugggc

SEQ ID NO: 412380 - RNA, 32 nt, Human
cuugaugccaggaguuccagaccaggcuggcc

SEQ ID NO: 412381 - RNA, 21 nt, Human
cuugaugccaggaguucgaga

SEQ ID NO: 412382 - RNA, 32 nt, Human
cuugaugccaggaguucgagaccagccuggcc

SEQ ID NO: 412383 - RNA, 32 nt, Human
cuugaugccucccggcuuugcagggagaccag

SEQ ID NO: 412384 - RNA, 32 nt, Human
cuugaugcuagcaacuuuccauuucucauggu

SEQ ID NO: 412385 - RNA, 32 nt, Human
cuugaugcuaggggccaggccuccucugugac

SEQ ID NO: 412386 - RNA, 32 nt, Human
cuugaugcucaccucuauauuaguuuauuguu

SEQ ID NO: 412387 - RNA, 32 nt, Human
cuugauggaagugggccaguccugguugucug

SEQ ID NO: 412388 - RNA, 32 nt, Human
cuugauggagaaggaaaaggcuggcaaggugg

SEQ ID NO: 412389 - RNA, 32 nt, Human
cuugauggaucacccccaggaggggaaaaugg

SEQ ID NO: 412390 - RNA, 32 nt, Human
cuugauggcaugcgccuguaaucccagcuacu

SEQ ID NO: 412391 - RNA, 32 nt, Human
cuugaugggagcuucagguucuugccaaagua

SEQ ID NO: 412392 - RNA, 32 nt, Human
cuugaugggcaggcuuggaagggacuucuccc

SEQ ID NO: 412393 - RNA, 32 nt, Human
cuugaugggucaaccuuuguguggcuccuggu

SEQ ID NO: 412394 - RNA, 32 nt, Human
cuugauggugugcaccuguaaucucagcuacu

SEQ ID NO: 412395 - RNA, 32 nt, Human
cuugaugguguugaaauguccaccuucuuaaa

SEQ ID NO: 412396 - RNA, 32 nt, Human
cuugaugugaagaucaaguucagugcuguggg

SEQ ID NO: 412397 - RNA, 32 nt, Human
cuugaugugagcucugggggagugugaaggau

SEQ ID NO: 412398 - RNA, 32 nt, Human
cuugaugugauggugaucaugggcugcucucu

SEQ ID NO: 412399 - RNA, 32 nt, Human
cuugaugugauguggcaggagggcaguggugg

SEQ ID NO: 412400 - RNA, 32 nt, Human
cuugauguguaagugacaugccauaguuuaca

SEQ ID NO: 412401 - RNA, 32 nt, Human
cuugauguuacaugacucuggaacaauaugaa

SEQ ID NO: 412402 - RNA, 32 nt, Human
cuugauguucuucuguguaacaggugaugucc

SEQ ID NO: 412403 - RNA, 32 nt, Human
cuugauuaaauguuagaccacagaaguggaau

SEQ ID NO: 412404 - RNA, 32 nt, Human
cuugauuauaccacugcacuccagccugggug

SEQ ID NO: 412405 - RNA, 32 nt, Human
cuugauucauucuacucugaaaauccaaaggu

SEQ ID NO: 412406 - RNA, 32 nt, Human
cuugauucauucucaugucauucugcacacag

SEQ ID NO: 412407 - RNA, 32 nt, Human
cuugauucauuucucgcccccgucacugauua

SEQ ID NO: 412408 - RNA, 32 nt, Human
cuugauuccucuauugcuggccuuacuugaug

SEQ ID NO: 412409 - RNA, 20 nt, Human
cuugauucuuguuacugccc

SEQ ID NO: 412410 - RNA, 32 nt, Human
cuugauugaggacuucaccccuugauuaaagc

SEQ ID NO: 412411 - RNA, 32 nt, Human
cuugauugcaccacugcacucuagccugggga

SEQ ID NO: 412412 - RNA, 32 nt, Human
cuugauugcugcugcuuaauuugauguaauau

SEQ ID NO: 412413 - RNA, 32 nt, Human
cuugauugggagggcggugggagccaguaaag

SEQ ID NO: 412414 - RNA, 32 nt, Human
cuugauugggggugggaacuccccuugcccug

SEQ ID NO: 412415 - RNA, 32 nt, Human
cuugauugucccuggauggagugcagucaccu

SEQ ID NO: 412416 - RNA, 32 nt, Human
cuugauugugucacugcacuccagccugggca

SEQ ID NO: 412417 - RNA, 32 nt, Human
cuugauugugucacugcacuccagcuugggug

SEQ ID NO: 412418 - RNA, 32 nt, Human
cuugauuuaggagagaauaaagggcuauauaa

SEQ ID NO: 412419 - RNA, 32 nt, Human
cuugauuucuucucuggaggcuuggaaacgcu

SEQ ID NO: 412420 - RNA, 32 nt, Human
cuugauuucuuuaagagugaacauuagacaua

SEQ ID NO: 412421 - RNA, 32 nt, Human
cuugauuugcuaugauaggagccaccuuggcu

SEQ ID NO: 412422 - RNA, 32 nt, Human
cuugauuuuaaguaguuacuguccuagugaau

SEQ ID NO: 412423 - RNA, 32 nt, Human
cuugauuuuccccucuucuccccaccuccacu

SEQ ID NO: 412424 - RNA, 32 nt, Human
cuugauuuucuuucuccucugauuucaguuca

SEQ ID NO: 412425 - RNA, 32 nt, Human
cuugcaaaaugcugggauuacaggcaugagcc

SEQ ID NO: 412426 - RNA, 32 nt, Human
cuugcaaacucuucccaccuccuucacgacac

SEQ ID NO: 412427 - RNA, 32 nt, Human
cuugcaaacuggccauggauggggaagugccc

SEQ ID NO: 412428 - RNA, 32 nt, Human
cuugcaaagugcugggauuccaggugggagcc

SEQ ID NO: 412429 - RNA, 21 nt, Human
cuugcaaauaaucacagauua

SEQ ID NO: 412430 - RNA, 32 nt, Human
cuugcaacaaauucugcaugguccagcgcucc

SEQ ID NO: 412431 - RNA, 31 nt, Human
cuugcaacacaagacccuaggagggaggacg

SEQ ID NO: 412432 - RNA, 32 nt, Human
cuugcaaccagcucuacuggauucuuaucaga

SEQ ID NO: 412433 - RNA, 32 nt, Human
cuugcaaccagcuuuggagaaagcccagcucc

SEQ ID NO: 412434 - RNA, 32 nt, Human
cuugcaaccuuaagaggucaaaauuuggauca

SEQ ID NO: 412435 - RNA, 32 nt, Human
cuugcaacuaccucugugacuaguggagacaa

SEQ ID NO: 412436 - RNA, 32 nt, Human
cuugcaacucaaauaggcuauauuucacaaua

SEQ ID NO: 412437 - RNA, 24 nt, Human
cuugcaacucaucagaaaauucau

SEQ ID NO: 412438 - RNA, 32 nt, Human
cuugcaacuuccuucuccacuaacccaggacu

SEQ ID NO: 412439 - RNA, 32 nt, Human
cuugcaagaccagccaaugaauaaugguaauc

SEQ ID NO: 412440 - RNA, 32 nt, Human
cuugcaagaucuaggaagaggaaggggaggga

SEQ ID NO: 412441 - RNA, 32 nt, Human
cuugcaagccaucacagaauucauauggagag

SEQ ID NO: 412442 - RNA, 32 nt, Human
cuugcaagcccuggaggagcuggaccucggug

SEQ ID NO: 412443 - RNA, 32 nt, Human
cuugcaaggaaaggagauguccagccaaugau

SEQ ID NO: 412444 - RNA, 32 nt, Human
cuugcaaggaggggccuuugagccucaguucu

SEQ ID NO: 412445 - RNA, 24 nt, Human
cuugcaagguggagguuacaguga

SEQ ID NO: 412446 - RNA, 32 nt, Human
cuugcaagguggagguuacagugagcugaaau

SEQ ID NO: 412447 - RNA, 32 nt, Human
cuugcaagguucaguaguggcagaucaugacu

SEQ ID NO: 412448 - RNA, 32 nt, Human
cuugcaaguaccacuccauccagccuugggca

SEQ ID NO: 412449 - RNA, 24 nt, Human
cuugcaaguuuauuuuugcuuccu

SEQ ID NO: 412450 - RNA, 32 nt, Human
cuugcaauccaggcuuuccuuggaaguggcug

SEQ ID NO: 412451 - RNA, 32 nt, Human
cuugcaaucccagcuacuugggacgcugaggu

SEQ ID NO: 412452 - RNA, 32 nt, Human
cuugcaaucccagcuauuugggaggcugaggc

SEQ ID NO: 412453 - RNA, 32 nt, Human
cuugcaaucccagugcuuugggagacugaggc

SEQ ID NO: 412454 - RNA, 32 nt, Human
cuugcacaaaccuagaugguguagcccacuac

SEQ ID NO: 412455 - RNA, 20 nt, Human
cuugcacaaauuguaaugug

SEQ ID NO: 412456 - RNA, 24 nt, Human
cuugcacaacaucagagaguucau

SEQ ID NO: 412457 - RNA, 32 nt, Human
cuugcacacaugcacacagaccacauagcaca

SEQ ID NO: 412458 - RNA, 32 nt, Human
cuugcacacucaccuccaccuucacaggccau

SEQ ID NO: 412459 - RNA, 32 nt, Human
cuugcacagaggcugacccugccuccccucuu

SEQ ID NO: 412460 - RNA, 22 nt, Human
cuugcacagcacugcuaaugua

SEQ ID NO: 412461 - RNA, 32 nt, Human
cuugcacagcaucagagaguucauacuggaga

SEQ ID NO: 412462 - RNA, 24 nt, Human
cuugcacagcaugagauaauucau

SEQ ID NO: 412463 - RNA, 17 nt, Human
cuugcacagccagagga

SEQ ID NO: 412464 - RNA, 32 nt, Human
cuugcacaggguggggcgcgcaguaggaaccu

SEQ ID NO: 412465 - RNA, 32 nt, Human
cuugcaccauugcacuccagccugggcgacaa

SEQ ID NO: 412466 - RNA, 32 nt, Human
cuugcacccaggagguggagguugcagugagc

SEQ ID NO: 412467 - RNA, 21 nt, Human
cuugcacccucuuugcuuccu

SEQ ID NO: 412468 - RNA, 19 nt, Human
cuugcaccgccagcugccg

SEQ ID NO: 412469 - RNA, 32 nt, Human
cuugcaccuauaaucccagcacuuugggaggc

SEQ ID NO: 412470 - RNA, 32 nt, Human
cuugcaccuggccaccuccccugcuucucccu

SEQ ID NO: 412471 - RNA, 32 nt, Human
cuugcaccuguaaucccagcacuuugggaggc

SEQ ID NO: 412472 - RNA, 32 nt, Human
cuugcaccuucccauauuuaugugccuuuugu

SEQ ID NO: 412473 - RNA, 32 nt, Human
cuugcaccuuuucauguacagcauuaaaauuu

SEQ ID NO: 412474 - RNA, 32 nt, Human
cuugcacgccccgcggagcucucuccauggua

SEQ ID NO: 412475 - RNA, 32 nt, Human
cuugcacuaauuaggguuagagaagaccccac

SEQ ID NO: 412476 - RNA, 32 nt, Human
cuugcacuaccagcaggcucucaccagcgcac

SEQ ID NO: 412477 - RNA, 32 nt, Human
cuugcacuacugcacuccagccugggugacag

SEQ ID NO: 412478 - RNA, 32 nt, Human
cuugcacuccagccugggugacagagugagac

SEQ ID NO: 412479 - RNA, 32 nt, Human
cuugcacuccuuugaacuuucuccccacuccu

SEQ ID NO: 412480 - RNA, 32 nt, Human
cuugcacucuugcccauaccaaugugaucguc

SEQ ID NO: 412481 - RNA, 32 nt, Human
cuugcacugaucuuucuccucuccuucuguga

SEQ ID NO: 412482 - RNA, 32 nt, Human
cuugcacugcacaaccuuccuucugcuucucc

SEQ ID NO: 412483 - RNA, 32 nt, Human
cuugcacugccaggcuggcuguagcgacucug

SEQ ID NO: 412484 - RNA, 32 nt, Human
cuugcacuggcuggagaaaggcaggcaguggg

SEQ ID NO: 412485 - RNA, 32 nt, Human
cuugcacugucacccaggcugcuggaguacag

SEQ ID NO: 412486 - RNA, 32 nt, Human
cuugcacugucacccaggcuggagugcagugg

SEQ ID NO: 412487 - RNA, 32 nt, Human
cuugcacugugaggugggggaggugggagagg

SEQ ID NO: 412488 - RNA, 32 nt, Human
cuugcacuguucacccuucacaucaacccugu

SEQ ID NO: 412489 - RNA, 32 nt, Human
cuugcacuucagaggcagacagugucauuaca

SEQ ID NO: 412490 - RNA, 32 nt, Human
cuugcacuugcagccugaagcggagagcacag

SEQ ID NO: 412491 - RNA, 32 nt, Human
cuugcacuuuuaguucaagaaacagugaaguc

SEQ ID NO: 412492 - RNA, 32 nt, Human
cuugcacuuuucucccucccugcccccucucg

SEQ ID NO: 412493 - RNA, 32 nt, Human
cuugcagaaaacgcuuaaccugaguuucauag

SEQ ID NO: 412494 - RNA, 24 nt, Human
cuugcagaacaucagaaaauucau

SEQ ID NO: 412495 - RNA, 32 nt, Human
cuugcagaaccagacagagaaccccacagacu

SEQ ID NO: 412496 - RNA, 24 nt, Human
cuugcagaauaucagaaaauucau

SEQ ID NO: 412497 - RNA, 32 nt, Human
cuugcagacaagugccuucucaauguguccuc

SEQ ID NO: 412498 - RNA, 32 nt, Human
cuugcagacccccagccggggcugaagcacag

SEQ ID NO: 412499 - RNA, 32 nt, Human
cuugcagacgggcuucucccacccccucacgc

SEQ ID NO: 412500 - RNA, 32 nt, Human
cuugcagacugagggcgguggggagaaccagg

SEQ ID NO: 412501 - RNA, 32 nt, Human
cuugcagacuuuuccccaccuuuggggcucgu

SEQ ID NO: 412502 - RNA, 32 nt, Human
cuugcagagcuaggugugugacugccucccuu

SEQ ID NO: 412503 - RNA, 32 nt, Human
cuugcagagguaaaggaggaggggcaggugga

SEQ ID NO: 412504 - RNA, 32 nt, Human
cuugcagagugggauugugggagggauuggca

SEQ ID NO: 412505 - RNA, 32 nt, Human
cuugcagauaaagauccaacaacaucuggauu

SEQ ID NO: 412506 - RNA, 23 nt, Human
cuugcagauuuaaccugucuucu

SEQ ID NO: 412507 - RNA, 32 nt, Human
cuugcagcaauggcuuggauuagauccacuug

SEQ ID NO: 412508 - RNA, 32 nt, Human
cuugcagcagcucugguggcagcuguccuuga

SEQ ID NO: 412509 - RNA, 32 nt, Human
cuugcagcaguggugcaagguccuucccaggg

SEQ ID NO: 412510 - RNA, 32 nt, Human
cuugcagccagccggcgguccagccuggugcc

SEQ ID NO: 412511 - RNA, 32 nt, Human
cuugcagccaugagccucuauuucucauuccu

SEQ ID NO: 412512 - RNA, 21 nt, Human
cuugcagccccacugcuccuu

SEQ ID NO: 412513 - RNA, 22 nt, Human
cuugcagccccccaaacuggga

SEQ ID NO: 412514 - RNA, 19 nt, Human
cuugcagccgccgccgccg

SEQ ID NO: 412515 - RNA, 32 nt, Human
cuugcagccuccagguccgguggggauucugc

SEQ ID NO: 412516 - RNA, 19 nt, Human
cuugcagcugccgccgccg

SEQ ID NO: 412517 - RNA, 32 nt, Human
cuugcagcuggugccauccaugucucacagcc

SEQ ID NO: 412518 - RNA, 32 nt, Human
cuugcagcuuacaucuguccugggcuucccca

SEQ ID NO: 412519 - RNA, 32 nt, Human
cuugcaggaauccugccucccugucaucccag

SEQ ID NO: 412520 - RNA, 24 nt, Human
cuugcaggacaucaggaaauucau

SEQ ID NO: 412521 - RNA, 32 nt, Human
cuugcaggacguuuuccccaaccucuuacacc

SEQ ID NO: 412522 - RNA, 23 nt, Human
cuugcaggagcgggggacugcug

SEQ ID NO: 412523 - RNA, 19 nt, Human
cuugcaggaggcggugcag

SEQ ID NO: 412524 - RNA, 27 nt, Human
cuugcaggagguggagguuguuggugg

SEQ ID NO: 412525 - RNA, 32 nt, Human
cuugcaggagguggagguuguugguggaggag

SEQ ID NO: 412526 - RNA, 22 nt, Human
cuugcaggaugccuuuccuuuu

SEQ ID NO: 412527 - RNA, 32 nt, Human
cuugcaggcccagaaacuagacuugggcauga

SEQ ID NO: 412528 - RNA, 32 nt, Human
cuugcaggcuguaacuucucucgagugccuga

SEQ ID NO: 412529 - RNA, 32 nt, Human
cuugcagggagcaccugucauccaggcagcuc

SEQ ID NO: 412530 - RNA, 21 nt, Human
cuugcagggcauccgggccug

SEQ ID NO: 412531 - RNA, 32 nt, Human
cuugcagggcuggcccugccugcuccugcggc

SEQ ID NO: 412532 - RNA, 23 nt, Human
cuugcagggcuucuggggcguug

SEQ ID NO: 412533 - RNA, 32 nt, Human
cuugcaggggaggccuggcugcagagaggcgg

SEQ ID NO: 412534 - RNA, 23 nt, Human
cuugcaggguggcugaagcccug

SEQ ID NO: 412535 - RNA, 32 nt, Human
cuugcaggucucuuuuuacuagaucauggcug

SEQ ID NO: 412536 - RNA, 23 nt, Human
cuugcaggugucgacugucuucc

SEQ ID NO: 412537 - RNA, 32 nt, Human
cuugcaguaagccgagagaggcaggcggauca

SEQ ID NO: 412538 - RNA, 32 nt, Human
cuugcaguagugccucugucuccucaccugca

SEQ ID NO: 412539 - RNA, 32 nt, Human
cuugcagucagcuucauaccauuuuuaaaguc

SEQ ID NO: 412540 - RNA, 32 nt, Human
cuugcagucccaggagcagaagauaugacggc

SEQ ID NO: 412541 - RNA, 24 nt, Human
cuugcaguccgcuaggugagagga

SEQ ID NO: 412542 - RNA, 32 nt, Human
cuugcaguccuacaacaagugagaggcuugcu

SEQ ID NO: 412543 - RNA, 32 nt, Human
cuugcagucuccagggcaccacagaccccagu

SEQ ID NO: 412544 - RNA, 32 nt, Human
cuugcagucuuuagagccccaggauuuaucuu

SEQ ID NO: 412545 - RNA, 32 nt, Human
cuugcagugagaugcucccagaugcauuuguc

SEQ ID NO: 412546 - RNA, 32 nt, Human
cuugcagugagccgagacugugcuccagccug

SEQ ID NO: 412547 - RNA, 32 nt, Human
cuugcagugagccgagauggcucacagaucaa

SEQ ID NO: 412548 - RNA, 32 nt, Human
cuugcagugagcugagaucgugacacugcacu

SEQ ID NO: 412549 - RNA, 32 nt, Human
cuugcagugagcugagauggcaccacugcacu

SEQ ID NO: 412550 - RNA, 32 nt, Human
cuugcagugagcugagauggcaccacuggacu

SEQ ID NO: 412551 - RNA, 32 nt, Human
cuugcagugagcugagauggcgccacugcacu

SEQ ID NO: 412552 - RNA, 32 nt, Human
cuugcagugagcugagauugcacuccagccug

SEQ ID NO: 412553 - RNA, 32 nt, Human
cuugcagugagcugagauugcgccacugcacu

SEQ ID NO: 412554 - RNA, 32 nt, Human
cuugcagugcuaaaaagcagaucguucucucu

SEQ ID NO: 412555 - RNA, 32 nt, Human
cuugcaguggauucuuggucaggugugcccac

SEQ ID NO: 412556 - RNA, 32 nt, Human
cuugcaguguaauccuggagcguaugcccugu

SEQ ID NO: 412557 - RNA, 24 nt, Human
cuugcaguucaucagagaauucau

SEQ ID NO: 412558 - RNA, 32 nt, Human
cuugcaguucaucagagaauucauacuggaga

SEQ ID NO: 412559 - RNA, 32 nt, Human
cuugcaguucugggaguaaagcucccagcaua

SEQ ID NO: 412560 - RNA, 32 nt, Human
cuugcaucaguuuguuuaacugugaguggcug

SEQ ID NO: 412561 - RNA, 32 nt, Human
cuugcaucgcguuccccgcauccucggguccu

SEQ ID NO: 412562 - RNA, 32 nt, Human
cuugcaucucagaauccuagagaugguugcug

SEQ ID NO: 412563 - RNA, 32 nt, Human
cuugcaucugaauguuuugguggagagaugac

SEQ ID NO: 412564 - RNA, 32 nt, Human
cuugcaugccugggcccaggcccagccucuug

SEQ ID NO: 412565 - RNA, 30 nt, Human
cuugcaugcugcugccacuccugcugcacc

SEQ ID NO: 412566 - RNA, 32 nt, Human
cuugcauggaggcggcgguggcacugaagaga

SEQ ID NO: 412567 - RNA, 32 nt, Human
cuugcauggucacuugagcccacacacacgcu

SEQ ID NO: 412568 - RNA, 32 nt, Human
cuugcauguaaacaucuuccagcaacaaucau

SEQ ID NO: 412569 - RNA, 32 nt, Human
cuugcauguggacugaagcugaccuucgauuc

SEQ ID NO: 412570 - RNA, 32 nt, Human
cuugcauguguauacauacauguaacuucauu

SEQ ID NO: 412571 - RNA, 31 nt, Human
cuugcauucauuuucugacaugcauugucgg

SEQ ID NO: 412572 - RNA, 31 nt, Human
cuugcauucauuuucugacaugcauuguugg

SEQ ID NO: 412573 - RNA, 32 nt, Human
cuugcauuccaggaguggccugugccucccac

SEQ ID NO: 412574 - RNA, 32 nt, Human
cuugcauuccaggggaguuuucuuuugaguag

SEQ ID NO: 412575 - RNA, 32 nt, Human
cuugcauugccugacucugaaaccagaagggc

SEQ ID NO: 412576 - RNA, 32 nt, Human
cuugcauugcuuuccucugagcuuuagugggu

SEQ ID NO: 412577 - RNA, 32 nt, Human
cuugcauuggcaccccuccagccuggaggcca

SEQ ID NO: 412578 - RNA, 32 nt, Human
cuugcauuuuagcagugcauguuucuaauuga

SEQ ID NO: 412579 - RNA, 32 nt, Human
cuugccaacaaacaccagaaauuagaagaggc

SEQ ID NO: 412580 - RNA, 32 nt, Human
cuugccaacacagugaaacccugucucuacua

SEQ ID NO: 412581 - RNA, 32 nt, Human
cuugccaacagcuguacacagguuuguucuaa

SEQ ID NO: 412582 - RNA, 32 nt, Human
cuugccaacauagugaaacccugucuuuacua

SEQ ID NO: 412583 - RNA, 32 nt, Human
cuugccaacauggugaaaccccaucucuacua

SEQ ID NO: 412584 - RNA, 32 nt, Human
cuugccaacauggugaaacccugucucuacua

SEQ ID NO: 412585 - RNA, 32 nt, Human
cuugccaacucuguuccagccuauggcuuuag

SEQ ID NO: 412586 - RNA, 32 nt, Human
cuugccacaacuggaaacacuugaaaggggac

SEQ ID NO: 412587 - RNA, 32 nt, Human
cuugccacagccaacagaaaaaucaaaaugau

SEQ ID NO: 412588 - RNA, 32 nt, Human
cuugccacagucacggggugcaugugcagagg

SEQ ID NO: 412589 - RNA, 32 nt, Human
cuugccacgcuguuguaaaaacccaagucccu

SEQ ID NO: 412590 - RNA, 17 nt, Human
cuugccacguccuguca

SEQ ID NO: 412591 - RNA, 32 nt, Human
cuugccacguucccacgggcuugggggaaaga

SEQ ID NO: 412592 - RNA, 32 nt, Human
cuugccacugcacaccagccugggcaacacag

SEQ ID NO: 412593 - RNA, 32 nt, Human
cuugccacugcacuccagccugggcaacagag

SEQ ID NO: 412594 - RNA, 32 nt, Human
cuugccacugcucuacagccuggaagacagag

SEQ ID NO: 412595 - RNA, 32 nt, Human
cuugccacugcucuccagccugagcgacagag

SEQ ID NO: 412596 - RNA, 32 nt, Human
cuugccacuggucucaaagcugggcagcccau

SEQ ID NO: 412597 - RNA, 32 nt, Human
cuugccacuguacuccagccugaagagcgaga

SEQ ID NO: 412598 - RNA, 32 nt, Human
cuugccacugucccuacccuccaggagugggu

SEQ ID NO: 412599 - RNA, 32 nt, Human
cuugccacugucuccuggcccucucucugauc

SEQ ID NO: 412600 - RNA, 32 nt, Human
cuugccagaggagaugaccaugauuuucagga

SEQ ID NO: 412601 - RNA, 32 nt, Human
cuugccagccucccuggggucuggggaccugc

SEQ ID NO: 412602 - RNA, 21 nt, Human
cuugccagccugacucagauc

SEQ ID NO: 412603 - RNA, 22 nt, Human
cuugccagcggggugggcgcgg

SEQ ID NO: 412604 - RNA, 24 nt, Human
cuugccagcuucccuuuucuccca

SEQ ID NO: 412605 - RNA, 32 nt, Human
cuugccaggaacccaguggccagggagcgugg

SEQ ID NO: 412606 - RNA, 32 nt, Human
cuugccaggaggggaguggcagugaggagggg

SEQ ID NO: 412607 - RNA, 32 nt, Human
cuugccaggccucuccccugcaggacuggcau

SEQ ID NO: 412608 - RNA, 32 nt, Human
cuugccagggagacccccgaaccuuugugcca

SEQ ID NO: 412609 - RNA, 32 nt, Human
cuugccaggucuccuacccacacuggggaaau

SEQ ID NO: 412610 - RNA, 32 nt, Human
cuugccaguaggggcggccgggcagaggcgcc

SEQ ID NO: 412611 - RNA, 32 nt, Human
cuugccagucugaacaguggcagcagagagca

SEQ ID NO: 412612 - RNA, 32 nt, Human
cuugccaucacugguccaggucuucaguuucc

SEQ ID NO: 412613 - RNA, 32 nt, Human
cuugccaucccucccuccaccucccugcaaua

SEQ ID NO: 412614 - RNA, 32 nt, Human
cuugccaugccuacccuucccugucugucugg

SEQ ID NO: 412615 - RNA, 32 nt, Human
cuugccauugcacuccagcugagagugugacc

SEQ ID NO: 412616 - RNA, 23 nt, Human
cuugcccaaacucaggcagcugg

SEQ ID NO: 412617 - RNA, 20 nt, Human
cuugcccaaacuggcagggg

SEQ ID NO: 412618 - RNA, 32 nt, Human
cuugcccaaagucacacagcugaacaguggug

SEQ ID NO: 412619 - RNA, 32 nt, Human
cuugcccaaagucacccagcugaacaguggua

SEQ ID NO: 412620 - RNA, 32 nt, Human
cuugcccaacuaaacccagaacucaaacuuaa

SEQ ID NO: 412621 - RNA, 32 nt, Human
cuugcccaagaguuugagaccagccuggacaa

SEQ ID NO: 412622 - RNA, 32 nt, Human
cuugcccacuggccgcugagcgcccccgagcc

SEQ ID NO: 412623 - RNA, 24 nt, Human
cuugcccagacuggaauacagugg

SEQ ID NO: 412624 - RNA, 27 nt, Human
cuugcccagagcugugcagugcagugg

SEQ ID NO: 412625 - RNA, 32 nt, Human
cuugcccagcacaaaguauuauagaacaaggu

SEQ ID NO: 412626 - RNA, 32 nt, Human
cuugcccagcuggguccaacacuuguucaguu

SEQ ID NO: 412627 - RNA, 32 nt, Human
cuugcccaggauguuguuaaaugcagaucuga

SEQ ID NO: 412628 - RNA, 32 nt, Human
cuugcccaggcagagagagcaggagcggaccg

SEQ ID NO: 412629 - RNA, 32 nt, Human
cuugcccaggcaggaggcuggggugcugugug

SEQ ID NO: 412630 - RNA, 22 nt, Human
cuugcccaggcaggaguacagu

SEQ ID NO: 412631 - RNA, 20 nt, Human
cuugcccaggcuggaguaca

SEQ ID NO: 412632 - RNA, 24 nt, Human
cuugcccaggcuggaguacaaugg

SEQ ID NO: 412633 - RNA, 24 nt, Human
cuugcccaggcuggagugcaaugg

SEQ ID NO: 412634 - RNA, 22 nt, Human
cuugcccaggcuggagugcagu

SEQ ID NO: 412635 - RNA, 24 nt, Human
cuugcccaggcuggagugcagugg

SEQ ID NO: 412636 - RNA, 24 nt, Human
cuugcccaggcuggagugucgugg

SEQ ID NO: 412637 - RNA, 24 nt, Human
cuugcccaggcuuggaguacagug

SEQ ID NO: 412638 - RNA, 22 nt, Human
cuugcccaggcuuuuugcuccu

SEQ ID NO: 412639 - RNA, 23 nt, Human
cuugcccagggccagugccaugg

SEQ ID NO: 412640 - RNA, 22 nt, Human
cuugcccagguagugaucagug

SEQ ID NO: 412641 - RNA, 32 nt, Human
cuugcccagguggcagagccagcuuuggacgc

SEQ ID NO: 412642 - RNA, 22 nt, Human
cuugcccaguaccauccagugg

SEQ ID NO: 412643 - RNA, 32 nt, Human
cuugcccaguaguucuggaggaaggcccggga

SEQ ID NO: 412644 - RNA, 32 nt, Human
cuugcccagucuuccuucaagacuaacucacu

SEQ ID NO: 412645 - RNA, 32 nt, Human
cuugcccauuaucagaaggaaaaagagcagaa

SEQ ID NO: 412646 - RNA, 32 nt, Human
cuugccccacaccaccuucacacccacacaca

SEQ ID NO: 412647 - RNA, 32 nt, Human
cuugccccacccuucaggaguuuccagagacc

SEQ ID NO: 412648 - RNA, 32 nt, Human
cuugccccacugcugugcaaugccuuaggacu

SEQ ID NO: 412649 - RNA, 32 nt, Human
cuugccccagaaguuugagaccagccugggca

SEQ ID NO: 412650 - RNA, 32 nt, Human
cuugccccaggccagguagcaagagagcagcg

SEQ ID NO: 412651 - RNA, 32 nt, Human
cuugccccagucccuucucuccagcuucaugu

SEQ ID NO: 412652 - RNA, 32 nt, Human
cuugcccccacugucaaggccuggucucaucu

SEQ ID NO: 412653 - RNA, 32 nt, Human
cuugcccccaucauuugucucugacaauacuu

SEQ ID NO: 412654 - RNA, 32 nt, Human
cuugccccgaggcugcacuaccacaggaaaua

SEQ ID NO: 412655 - RNA, 32 nt, Human
cuugccccuaaccucagcccgagggucuccag

SEQ ID NO: 412656 - RNA, 32 nt, Human
cuugccccuagagguaguuguuaaugauuuug

SEQ ID NO: 412657 - RNA, 32 nt, Human
cuugccccuaggaaggugaaucugcccuagcc

SEQ ID NO: 412658 - RNA, 32 nt, Human
cuugccccuccaccuggugcccaagccucccg

SEQ ID NO: 412659 - RNA, 32 nt, Human
cuugccccuccaggaagcugcagcgggccugc

SEQ ID NO: 412660 - RNA, 32 nt, Human
cuugccccucccccauuucccucucccccaug

SEQ ID NO: 412661 - RNA, 32 nt, Human
cuugccccugcucccuccaguaguggccccuu

SEQ ID NO: 412662 - RNA, 31 nt, Human
cuugccccuucuccagggccugugccagcuc

SEQ ID NO: 412663 - RNA, 21 nt, Human
cuugccccuuucuccucuccc

SEQ ID NO: 412664 - RNA, 32 nt, Human
cuugcccucacaccccgcugcccaggagccag

SEQ ID NO: 412665 - RNA, 32 nt, Human
cuugcccucagccucugagcuccaggggucag

SEQ ID NO: 412666 - RNA, 32 nt, Human
cuugcccucccaaaguguugggauuauaggca

SEQ ID NO: 412667 - RNA, 32 nt, Human
cuugcccucugccugccucagcugcugccuga

SEQ ID NO: 412668 - RNA, 32 nt, Human
cuugcccucuucucuuuucccuuccuguaccu

SEQ ID NO: 412669 - RNA, 32 nt, Human
cuugcccugauuuacacagcagucacauuccu

SEQ ID NO: 412670 - RNA, 32 nt, Human
cuugcccugccucaguuucuccaucucccugc

SEQ ID NO: 412671 - RNA, 32 nt, Human
cuugcccuggcuuagcugcaggagaagauggc

SEQ ID NO: 412672 - RNA, 32 nt, Human
cuugcccugggccagcccaggauuguacgugg

SEQ ID NO: 412673 - RNA, 32 nt, Human
cuugcccugucacccaggcuggagugcaaugg

SEQ ID NO: 412674 - RNA, 32 nt, Human
cuugcccugucacccaggcugggguacggugg

SEQ ID NO: 412675 - RNA, 32 nt, Human
cuugcccuguuccccaccuccuggcuccaguc

SEQ ID NO: 412676 - RNA, 32 nt, Human
cuugcccuguugcccaggcuggagagcagugg

SEQ ID NO: 412677 - RNA, 32 nt, Human
cuugcccuguugcccaggcuggagugcagugg

SEQ ID NO: 412678 - RNA, 32 nt, Human
cuugcccuuauuguccugcuuucccaaaaaca

SEQ ID NO: 412679 - RNA, 32 nt, Human
cuugcccuugccacacuugaucucaagggcau

SEQ ID NO: 412680 - RNA, 32 nt, Human
cuugcccuuugucccacuagacucuaacccag

SEQ ID NO: 412681 - RNA, 32 nt, Human
cuugccgaaaccagcaugaugcuucaaagagc

SEQ ID NO: 412682 - RNA, 32 nt, Human
cuugccgaaggauuuugcaguccucugucagu

SEQ ID NO: 412683 - RNA, 32 nt, Human
cuugccgacacccgccucuccccacccuuagg

SEQ ID NO: 412684 - RNA, 32 nt, Human
cuugccgaggaaacccaugcaggcuggguccc

SEQ ID NO: 412685 - RNA, 32 nt, Human
cuugccgccuccauaucaucaagcucuggugg

SEQ ID NO: 412686 - RNA, 23 nt, Human
cuugccgcugccucugggguucg

SEQ ID NO: 412687 - RNA, 32 nt, Human
cuugccggccacuccuccagcugccaggggca

SEQ ID NO: 412688 - RNA, 32 nt, Human
cuugccggccagacuucucuccccugcggcuc

SEQ ID NO: 412689 - RNA, 32 nt, Human
cuugccggggcuaaagcggaggaggggaccag

SEQ ID NO: 412690 - RNA, 32 nt, Human
cuugccguagcuuggguuugagugucaagcac

SEQ ID NO: 412691 - RNA, 32 nt, Human
cuugccguccacccucgguccucaugguccca

SEQ ID NO: 412692 - RNA, 32 nt, Human
cuugccguccagccuguccuugguguggggug

SEQ ID NO: 412693 - RNA, 32 nt, Human
cuugccguccuccugaggguaucuggagcuuc

SEQ ID NO: 412694 - RNA, 32 nt, Human
cuugccguggggaccuuggaaaccuggcuuug

SEQ ID NO: 412695 - RNA, 32 nt, Human
cuugccuagauuuaaggccacugugaggagag

SEQ ID NO: 412696 - RNA, 19 nt, Human
cuugccuagccucucccuc

SEQ ID NO: 412697 - RNA, 32 nt, Human
cuugccuagggggcagagggugcaguggcagu

SEQ ID NO: 412698 - RNA, 20 nt, Human
cuugccuagugggccuuccu

SEQ ID NO: 412699 - RNA, 32 nt, Human
cuugccuagugggccuuccuucccaggucgcc

SEQ ID NO: 412700 - RNA, 32 nt, Human
cuugccuaguguaucuuaucccugcacugugu

SEQ ID NO: 412701 - RNA, 32 nt, Human
cuugccuauuuucaucuugcuguuuucuuuuu

SEQ ID NO: 412702 - RNA, 32 nt, Human
cuugccucacuacaaccccugccuccuggguu

SEQ ID NO: 412703 - RNA, 32 nt, Human
cuugccucacugcaacgccugccucucaggcu

SEQ ID NO: 412704 - RNA, 32 nt, Human
cuugccucauuccucuggaauaaaguagcuuu

SEQ ID NO: 412705 - RNA, 32 nt, Human
cuugccuccaaauccuugucucaggccugcau

SEQ ID NO: 412706 - RNA, 32 nt, Human
cuugccuccacaccuuuguccuccaguuuagu

SEQ ID NO: 412707 - RNA, 32 nt, Human
cuugccuccacucaccacaagcugagcaggac

SEQ ID NO: 412708 - RNA, 24 nt, Human
cuugccuccaggaccuugcuuccu

SEQ ID NO: 412709 - RNA, 32 nt, Human
cuugccucccaaagugcuaagauuacagccuc

SEQ ID NO: 412710 - RNA, 32 nt, Human
cuugccucccaaagugcugggauuacaggugu

SEQ ID NO: 412711 - RNA, 32 nt, Human
cuugccucccaaagugcugggauugcaggcau

SEQ ID NO: 412712 - RNA, 32 nt, Human
cuugccuccccacugcagccugcgguccugcc

SEQ ID NO: 412713 - RNA, 32 nt, Human
cuugccuccuccuccuccucuaccuccaguca

SEQ ID NO: 412714 - RNA, 32 nt, Human
cuugccuccugacuagaccagucuucuugcau

SEQ ID NO: 412715 - RNA, 32 nt, Human
cuugccuccugccuccgcgcuuacacacgcac

SEQ ID NO: 412716 - RNA, 32 nt, Human
cuugccuccuguguaaucauuucuugggcccu

SEQ ID NO: 412717 - RNA, 32 nt, Human
cuugccuccuucuuuccucccucucucugggc

SEQ ID NO: 412718 - RNA, 32 nt, Human
cuugccucuccauccuccgaaaaaccccugag

SEQ ID NO: 412719 - RNA, 32 nt, Human
cuugccucugcacuuuucuauauuguucagcu

SEQ ID NO: 412720 - RNA, 32 nt, Human
cuugccucugcucucccuuuguggggacucag

SEQ ID NO: 412721 - RNA, 32 nt, Human
cuugccucuggagaccccagccccagagggcu

SEQ ID NO: 412722 - RNA, 26 nt, Human
cuugccucuucuugaguucuuugcuc

SEQ ID NO: 412723 - RNA, 22 nt, Human
cuugccucuuuuaccugcugcu

SEQ ID NO: 412724 - RNA, 23 nt, Human
cuugccugacacucagacccuca

SEQ ID NO: 412725 - RNA, 32 nt, Human
cuugccugcacccaccaugaggcauggagcag

SEQ ID NO: 412726 - RNA, 32 nt, Human
cuugccugcacuccauccugucugcaacgcug

SEQ ID NO: 412727 - RNA, 32 nt, Human
cuugccugcagcuuuuacuuaacccuguaguu

SEQ ID NO: 412728 - RNA, 32 nt, Human
cuugccugcaguguguguggcagcagcccaug

SEQ ID NO: 412729 - RNA, 32 nt, Human
cuugccugccagcugcucccgagguggccuug

SEQ ID NO: 412730 - RNA, 19 nt, Human
cuugccugcccuccugucu

SEQ ID NO: 412731 - RNA, 32 nt, Human
cuugccugccuaauggucaucuccccaguaga

SEQ ID NO: 412732 - RNA, 31 nt, Human
cuugccugccucugcuugcugcugucccugc

SEQ ID NO: 412733 - RNA, 32 nt, Human
cuugccugcugcagucggagcugguaaacuac

SEQ ID NO: 412734 - RNA, 21 nt, Human
cuugccuggaaugugucccca

SEQ ID NO: 412735 - RNA, 32 nt, Human
cuugccuggcacuuaaaccuugguagaucugg

SEQ ID NO: 412736 - RNA, 32 nt, Human
cuugccuggccugaugaugguggguggguggg

SEQ ID NO: 412737 - RNA, 32 nt, Human
cuugccuggccuggccugaggcucagcagugc

SEQ ID NO: 412738 - RNA, 18 nt, Human
cuugccuggcguucccuc

SEQ ID NO: 412739 - RNA, 32 nt, Human
cuugccuggcucccagggcuaggguuagggcu

SEQ ID NO: 412740 - RNA, 32 nt, Human
cuugccugggcaauguagcaagaccccauucu

SEQ ID NO: 412741 - RNA, 32 nt, Human
cuugccugggcucaagccuggcccuggcccgc

SEQ ID NO: 412742 - RNA, 32 nt, Human
cuugccuggucugcuuucuuccaaguuugccu

SEQ ID NO: 412743 - RNA, 32 nt, Human
cuugccuggugcuuccucccucauuguguugu

SEQ ID NO: 412744 - RNA, 32 nt, Human
cuugccugguuugaaaauuuguuaacaauaca

SEQ ID NO: 412745 - RNA, 32 nt, Human
cuugccuguagucccaacuacuugggaggcug

SEQ ID NO: 412746 - RNA, 32 nt, Human
cuugccugucgaggcaagaggcugcagaggcg

SEQ ID NO: 412747 - RNA, 32 nt, Human
cuugccugucuugugaggucugugccacaagg

SEQ ID NO: 412748 - RNA, 32 nt, Human
cuugccuguggaacauugucugguccuagcug

SEQ ID NO: 412749 - RNA, 32 nt, Human
cuugccuguggaggucgccucuccccagggga

SEQ ID NO: 412750 - RNA, 32 nt, Human
cuugccuguggcccccaggcucccucuguccu

SEQ ID NO: 412751 - RNA, 32 nt, Human
cuugccugugucacacaugagaagacugagac

SEQ ID NO: 412752 - RNA, 32 nt, Human
cuugccuguguggagcucagccugucucuuua

SEQ ID NO: 412753 - RNA, 32 nt, Human
cuugccuguguuucugugagggaggcugcuuu

SEQ ID NO: 412754 - RNA, 32 nt, Human
cuugccuguugccagacuggagugcaguggca

SEQ ID NO: 412755 - RNA, 22 nt, Human
cuugccuuagcuucuuugguca

SEQ ID NO: 412756 - RNA, 32 nt, Human
cuugccuuaggacggggccaggaggccacaca

SEQ ID NO: 412757 - RNA, 32 nt, Human
cuugccuuaggauggggccaggaggccaggca

SEQ ID NO: 412758 - RNA, 32 nt, Human
cuugccuucagcccuggagugggcagagagua

SEQ ID NO: 412759 - RNA, 32 nt, Human
cuugccuuccacccucuguucucccuccuugu

SEQ ID NO: 412760 - RNA, 32 nt, Human
cuugccuucccucuuuuccuccauccaucgug

SEQ ID NO: 412761 - RNA, 32 nt, Human
cuugccuucucccacuuggaccugcucagagc

SEQ ID NO: 412762 - RNA, 32 nt, Human
cuugccuucuucucccccuuccccugugcucc

SEQ ID NO: 412763 - RNA, 32 nt, Human
cuugccuuguauucccuucuucgggauacagc

SEQ ID NO: 412764 - RNA, 32 nt, Human
cuugccuuucccugaggaggugacuucagugu

SEQ ID NO: 412765 - RNA, 20 nt, Human
cuugccuuuccuggccccca

SEQ ID NO: 412766 - RNA, 32 nt, Human
cuugccuuucuuguaagacuuucuaagcgcau

SEQ ID NO: 412767 - RNA, 32 nt, Human
cuugccuuugcaauaccugcauccccagcacu

SEQ ID NO: 412768 - RNA, 19 nt, Human
cuugccuuugcugcugcug

SEQ ID NO: 412769 - RNA, 19 nt, Human
cuugccuuuuuuguuuccu

SEQ ID NO: 412770 - RNA, 21 nt, Human
cuugcgaccagccucauucua

SEQ ID NO: 412771 - RNA, 32 nt, Human
cuugcgccacugacuccuccuucagucggcuu

SEQ ID NO: 412772 - RNA, 32 nt, Human
cuugcgcccucccucugcuccugagaugcuga

SEQ ID NO: 412773 - RNA, 32 nt, Human
cuugcgccuguacucccagcacuuugggaggc

SEQ ID NO: 412774 - RNA, 32 nt, Human
cuugcgcgcacacacacauacaagcgggcacg

SEQ ID NO: 412775 - RNA, 32 nt, Human
cuugcgcuagauguugagaggcugaggggccc

SEQ ID NO: 412776 - RNA, 32 nt, Human
cuugcgcucaggaggcagagguuacagguuac

SEQ ID NO: 412777 - RNA, 32 nt, Human
cuugcgcucugccucgcuugcagccacgcuag

SEQ ID NO: 412778 - RNA, 32 nt, Human
cuugcgcuguugcccaggcucuagugcaaugg

SEQ ID NO: 412779 - RNA, 32 nt, Human
cuugcgcuugccggggaguccugcugccuucc

SEQ ID NO: 412780 - RNA, 32 nt, Human
cuugcggaccaacaggaggacucccagcuuuc

SEQ ID NO: 412781 - RNA, 24 nt, Human
cuugcggacgccggcuguucuucc

SEQ ID NO: 412782 - RNA, 23 nt, Human
cuugcggacucucccuuccuucc

SEQ ID NO: 412783 - RNA, 23 nt, Human
cuugcggacugcugguccccucu

SEQ ID NO: 412784 - RNA, 22 nt, Human
cuugcggaggacgcuuccuucc

SEQ ID NO: 412785 - RNA, 21 nt, Human
cuugcggcaccgcccacccac

SEQ ID NO: 412786 - RNA, 22 nt, Human
cuugcggcauccacgagaccac

SEQ ID NO: 412787 - RNA, 18 nt, Human
cuugcggcccagaaacca

SEQ ID NO: 412788 - RNA, 32 nt, Human
cuugcggcucagcucugguuuccucucccagg

SEQ ID NO: 412789 - RNA, 32 nt, Human
cuugcggcugggauccugggagccggggcacu

SEQ ID NO: 412790 - RNA, 32 nt, Human
cuugcgggccagcuagaguucugggugggcgu

SEQ ID NO: 412791 - RNA, 21 nt, Human
cuugcggucaggaguucgaga

SEQ ID NO: 412792 - RNA, 19 nt, Human
cuugcgguccuccugucuu

SEQ ID NO: 412793 - RNA, 32 nt, Human
cuugcggugagcugagauugcgccacugcacc

SEQ ID NO: 412794 - RNA, 32 nt, Human
cuugcguaggagagcagacacgaggacaugag

SEQ ID NO: 412795 - RNA, 21 nt, Human
cuugcgucaaaaucaggacug

SEQ ID NO: 412796 - RNA, 32 nt, Human
cuugcgugagguacucggguccgucccgacgg

SEQ ID NO: 412797 - RNA, 23 nt, Human
cuugcguuuguaacuguggucua

SEQ ID NO: 412798 - RNA, 32 nt, Human
cuugcuaaauauugagaaacuaaacuacuaag

SEQ ID NO: 412799 - RNA, 32 nt, Human
cuugcuaaccccaccaucacacugccacccug

SEQ ID NO: 412800 - RNA, 32 nt, Human
cuugcuaacuccaggaacagguuuaaguuuuu

SEQ ID NO: 412801 - RNA, 24 nt, Human
cuugcuaagcaucagagaauucau

SEQ ID NO: 412802 - RNA, 32 nt, Human
cuugcuacacagaaauaacaaacacguuauuu

SEQ ID NO: 412803 - RNA, 19 nt, Human
cuugcuacaucucuguuca

SEQ ID NO: 412804 - RNA, 25 nt, Human
cuugcuaccucuugcccuccuuccu

SEQ ID NO: 412805 - RNA, 32 nt, Human
cuugcuacgugacccaggcuggaguguaguag

SEQ ID NO: 412806 - RNA, 32 nt, Human
cuugcuacugaggccaggcugauaggagcuca

SEQ ID NO: 412807 - RNA, 32 nt, Human
cuugcuacugcuucggcuucccggcuaccccc

SEQ ID NO: 412808 - RNA, 32 nt, Human
cuugcuagagucuuccuuugucagccaggcug

SEQ ID NO: 412809 - RNA, 32 nt, Human
cuugcuagcguugcaaagaagggcccagcucc

SEQ ID NO: 412810 - RNA, 32 nt, Human
cuugcuagcugggcaagaaagcagcaguggac

SEQ ID NO: 412811 - RNA, 32 nt, Human
cuugcuaguauguagcauacuaccuggcaugu

SEQ ID NO: 412812 - RNA, 32 nt, Human
cuugcuagugaacgucuacuuaucucaaguuc

SEQ ID NO: 412813 - RNA, 32 nt, Human
cuugcuaucagcugcccuaaacuuuugcugag

SEQ ID NO: 412814 - RNA, 32 nt, Human
cuugcuaugucucccaggcuggagugcagugg

SEQ ID NO: 412815 - RNA, 32 nt, Human
cuugcuauguugcccaggcuagagugcagugg

SEQ ID NO: 412816 - RNA, 32 nt, Human
cuugcucaauggaucccaccccauggaaccca

SEQ ID NO: 412817 - RNA, 32 nt, Human
cuugcucacacugagauucuguguucuccucu

SEQ ID NO: 412818 - RNA, 32 nt, Human
cuugcucacagcaaagccagaaaugcucucuc

SEQ ID NO: 412819 - RNA, 31 nt, Human
cuugcucacagcugugcucugagugccuagc

SEQ ID NO: 412820 - RNA, 31 nt, Human
cuugcucaccucucugggccucagguucuac

SEQ ID NO: 412821 - RNA, 32 nt, Human
cuugcucacggcccgggcugggcugggcaggg

SEQ ID NO: 412822 - RNA, 32 nt, Human
cuugcucacugaucuucaugcacuccagguca

SEQ ID NO: 412823 - RNA, 32 nt, Human
cuugcucacuugcuacuagcaggcgacuuagg

SEQ ID NO: 412824 - RNA, 32 nt, Human
cuugcucagaugaaaggagccagcaaggacag

SEQ ID NO: 412825 - RNA, 32 nt, Human
cuugcucagccccuccaugccugcuuggugca

SEQ ID NO: 412826 - RNA, 32 nt, Human
cuugcucagggucacacagagacucagugggg

SEQ ID NO: 412827 - RNA, 32 nt, Human
cuugcucagguggcagaugccuuuguguuccu

SEQ ID NO: 412828 - RNA, 32 nt, Human
cuugcucaucuaaauaaggaaagacuuggugu

SEQ ID NO: 412829 - RNA, 32 nt, Human
cuugcuccacuaaggcccaagcucuuucucuc

SEQ ID NO: 412830 - RNA, 32 nt, Human
cuugcuccagcccaggcuggagugcaguggca

SEQ ID NO: 412831 - RNA, 32 nt, Human
cuugcuccaucugagaccagagccaagaucug

SEQ ID NO: 412832 - RNA, 32 nt, Human
cuugcucccaagggcccucaccagaggccagg

SEQ ID NO: 412833 - RNA, 32 nt, Human
cuugcucccagcuguaucauggaccugccuuc

SEQ ID NO: 412834 - RNA, 32 nt, Human
cuugcucccaugcugcugucccuucaggcuca

SEQ ID NO: 412835 - RNA, 32 nt, Human
cuugcucccugccuuauccuguguucagacag

SEQ ID NO: 412836 - RNA, 32 nt, Human
cuugcucccuuucucucucuguccuucccuuc

SEQ ID NO: 412837 - RNA, 32 nt, Human
cuugcuccugaugcaguuucugugccauugcu

SEQ ID NO: 412838 - RNA, 32 nt, Human
cuugcuccuggcuuugucugcaauggcagcug

SEQ ID NO: 412839 - RNA, 32 nt, Human
cuugcucgcccaggguggagugcaguggugug

SEQ ID NO: 412840 - RNA, 32 nt, Human
cuugcucggagcccagcacuccugggucucgg

SEQ ID NO: 412841 - RNA, 32 nt, Human
cuugcucuaccacccaggcuggagugcagugg

SEQ ID NO: 412842 - RNA, 32 nt, Human
cuugcucuaucacccaggcuggagugcagugg

SEQ ID NO: 412843 - RNA, 32 nt, Human
cuugcucuaucgcccaggcuggagugcagugg

SEQ ID NO: 412844 - RNA, 32 nt, Human
cuugcucuaucugaaguauucccaccagaguu

SEQ ID NO: 412845 - RNA, 32 nt, Human
cuugcucuauugcccaggcuggagugcagugg

SEQ ID NO: 412846 - RNA, 32 nt, Human
cuugcucucagagucuauaaauaaaagaauau

SEQ ID NO: 412847 - RNA, 32 nt, Human
cuugcucucaggagccuccagcucuuucugga

SEQ ID NO: 412848 - RNA, 32 nt, Human
cuugcucucccaggcuggagugcaguggugua

SEQ ID NO: 412849 - RNA, 32 nt, Human
cuugcucucccccucccucccuuacucuaaca

SEQ ID NO: 412850 - RNA, 32 nt, Human
cuugcucuccccugcccugcugccgccuccca

SEQ ID NO: 412851 - RNA, 32 nt, Human
cuugcucucgcccaggcuggagugcagugggu

SEQ ID NO: 412852 - RNA, 32 nt, Human
cuugcucucucacccaggccugaagugcagug

SEQ ID NO: 412853 - RNA, 32 nt, Human
cuugcucucucacccaggcuggaguguaagug

SEQ ID NO: 412854 - RNA, 32 nt, Human
cuugcucucugacuucucaggacacaggucau

SEQ ID NO: 412855 - RNA, 32 nt, Human
cuugcucugccacccaggcuggagugcagugg

SEQ ID NO: 412856 - RNA, 32 nt, Human
cuugcucugcuccuuucauccucgucuccccu

SEQ ID NO: 412857 - RNA, 23 nt, Human
cuugcucugcuggagugcggugg

SEQ ID NO: 412858 - RNA, 32 nt, Human
cuugcucugcuggagugcgguggugcaaucuc

SEQ ID NO: 412859 - RNA, 32 nt, Human
cuugcucugcuggagugcgguggugcagucuc

SEQ ID NO: 412860 - RNA, 32 nt, Human
cuugcucuggcgcccaggcuggaguacagugg

SEQ ID NO: 412861 - RNA, 32 nt, Human
cuugcucugucacccaggcuagagugcaaugg

SEQ ID NO: 412862 - RNA, 32 nt, Human
cuugcucugucacccaggcuagagugcaguag

SEQ ID NO: 412863 - RNA, 32 nt, Human
cuugcucugucacccaggcuggaaugcagugc

SEQ ID NO: 412864 - RNA, 32 nt, Human
cuugcucugucacccaggcuggaaugcagugg

SEQ ID NO: 412865 - RNA, 32 nt, Human
cuugcucugucacccaggcuggagcguaaugg

SEQ ID NO: 412866 - RNA, 32 nt, Human
cuugcucugucacccaggcuggaguacagugg

SEQ ID NO: 412867 - RNA, 32 nt, Human
cuugcucugucacccaggcuggagugcaaugg

SEQ ID NO: 412868 - RNA, 32 nt, Human
cuugcucugucacccaggcuggagugcaguag

SEQ ID NO: 412869 - RNA, 32 nt, Human
cuugcucugucacccaggcuggagugcaguga

SEQ ID NO: 412870 - RNA, 32 nt, Human
cuugcucugucacccaggcuggagugcagugc

SEQ ID NO: 412871 - RNA, 32 nt, Human
cuugcucugucacccaggcuggagugcagugg

SEQ ID NO: 412872 - RNA, 32 nt, Human
cuugcucugucacccaggcuggagugccaugg

SEQ ID NO: 412873 - RNA, 32 nt, Human
cuugcucugucacccaggcuggagugccgugg

SEQ ID NO: 412874 - RNA, 32 nt, Human
cuugcucugucacccaggcuggagugcgaugg

SEQ ID NO: 412875 - RNA, 32 nt, Human
cuugcucugucacccaggcuggagugcggugg

SEQ ID NO: 412876 - RNA, 32 nt, Human
cuugcucugucacccaggcuggagugcuaugg

SEQ ID NO: 412877 - RNA, 32 nt, Human
cuugcucugucacccaggcuggagugcugugg

SEQ ID NO: 412878 - RNA, 32 nt, Human
cuugcucugucacccaggcuggggcgcaaugg

SEQ ID NO: 412879 - RNA, 32 nt, Human
cuugcucugucacccaggcuugagugcagugg

SEQ ID NO: 412880 - RNA, 32 nt, Human
cuugcucugucccccaggcuggagugcagugg

SEQ ID NO: 412881 - RNA, 32 nt, Human
cuugcucugucgcccaggcuagagugcagugg

SEQ ID NO: 412882 - RNA, 32 nt, Human
cuugcucugucgcccaggcucgagugcagugg

SEQ ID NO: 412883 - RNA, 32 nt, Human
cuugcucugucgcccaggcugcagugcggugg

SEQ ID NO: 412884 - RNA, 32 nt, Human
cuugcucugucgcccaggcuggaaugcagugg

SEQ ID NO: 412885 - RNA, 32 nt, Human
cuugcucugucgcccaggcuggaguacagugg

SEQ ID NO: 412886 - RNA, 32 nt, Human
cuugcucugucgcccaggcuggagugaugagg

SEQ ID NO: 412887 - RNA, 32 nt, Human
cuugcucugucgcccaggcuggagugcagagg

SEQ ID NO: 412888 - RNA, 32 nt, Human
cuugcucugucgcccaggcuggagugcagucg

SEQ ID NO: 412889 - RNA, 32 nt, Human
cuugcucugucgcccaggcuggagugcaguga

SEQ ID NO: 412890 - RNA, 32 nt, Human
cuugcucugucgcccaggcuggagugcagugg

SEQ ID NO: 412891 - RNA, 32 nt, Human
cuugcucugucgcccaggcuggaguucagugg

SEQ ID NO: 412892 - RNA, 32 nt, Human
cuugcucugucgcccaggcuguagugcaaugg

SEQ ID NO: 412893 - RNA, 32 nt, Human
cuugcucugucucccaggcuagagugcaaugg

SEQ ID NO: 412894 - RNA, 32 nt, Human
cuugcucugucucccaggcuggagcguaguaa

SEQ ID NO: 412895 - RNA, 32 nt, Human
cuugcucugucucccaggcuggagugcaggcu

SEQ ID NO: 412896 - RNA, 32 nt, Human
cuugcucugucucccaggcuggagugcaguga

SEQ ID NO: 412897 - RNA, 32 nt, Human
cuugcucugucucccaggcuggagugcagugg

SEQ ID NO: 412898 - RNA, 32 nt, Human
cuugcucugucucccaggcuggagugcuaugg

SEQ ID NO: 412899 - RNA, 32 nt, Human
cuugcucugugacccagguugcagugagccaa

SEQ ID NO: 412900 - RNA, 32 nt, Human
cuugcucuguggcccaggcuggagugcagugg

SEQ ID NO: 412901 - RNA, 32 nt, Human
cuugcucuguggcccaggcuggaguguagugg

SEQ ID NO: 412902 - RNA, 32 nt, Human
cuugcucuguuacccaggcuggagugcagugg

SEQ ID NO: 412903 - RNA, 32 nt, Human
cuugcucuguuacccaggcuggaguguagugg

SEQ ID NO: 412904 - RNA, 32 nt, Human
cuugcucuguugcccaggcuagagugcagugg

SEQ ID NO: 412905 - RNA, 32 nt, Human
cuugcucuguugcccaggcuccagugcagugg

SEQ ID NO: 412906 - RNA, 32 nt, Human
cuugcucuguugcccaggcuggaaugcagugg

SEQ ID NO: 412907 - RNA, 32 nt, Human
cuugcucuguugcccaggcuggaguacauuug

SEQ ID NO: 412908 - RNA, 32 nt, Human
cuugcucuguugcccaggcuggaguccagugg

SEQ ID NO: 412909 - RNA, 32 nt, Human
cuugcucuguugcccaggcuggagugcaaugg

SEQ ID NO: 412910 - RNA, 32 nt, Human
cuugcucuguugcccaggcuggagugcacugg

SEQ ID NO: 412911 - RNA, 32 nt, Human
cuugcucuguugcccaggcuggagugcagcgg

SEQ ID NO: 412912 - RNA, 32 nt, Human
cuugcucuguugcccaggcuggagugcaggga

SEQ ID NO: 412913 - RNA, 32 nt, Human
cuugcucuguugcccaggcuggagugcaguag

SEQ ID NO: 412914 - RNA, 32 nt, Human
cuugcucuguugcccaggcuggagugcagucg

SEQ ID NO: 412915 - RNA, 32 nt, Human
cuugcucuguugcccaggcuggagugcaguga

SEQ ID NO: 412916 - RNA, 32 nt, Human
cuugcucuguugcccaggcuggagugcagugg

SEQ ID NO: 412917 - RNA, 32 nt, Human
cuugcucuguugcccaggcuggagugcggugg

SEQ ID NO: 412918 - RNA, 32 nt, Human
cuugcucuguugcccaggcuggaguguagaga

SEQ ID NO: 412919 - RNA, 32 nt, Human
cuugcucuguugcccaggcuggaguguagugg

SEQ ID NO: 412920 - RNA, 32 nt, Human
cuugcucuguugcccaggcugggugcagcggu

SEQ ID NO: 412921 - RNA, 32 nt, Human
cuugcucuguugcccaggcugguguguaguga

SEQ ID NO: 412922 - RNA, 32 nt, Human
cuugcucuguugccccagcuugagugcagugg

SEQ ID NO: 412923 - RNA, 32 nt, Human
cuugcucuuaggcugagacgccuugauguggc

SEQ ID NO: 412924 - RNA, 32 nt, Human
cuugcucuucucuccccuuugccucccucugc

SEQ ID NO: 412925 - RNA, 32 nt, Human
cuugcucuucugucugucaucuugcaggaugc

SEQ ID NO: 412926 - RNA, 21 nt, Human
cuugcucuuggaaguggugug

SEQ ID NO: 412927 - RNA, 32 nt, Human
cuugcucuuggggcagaagccacccacacuag

SEQ ID NO: 412928 - RNA, 32 nt, Human
cuugcucuuguccuagcuugggaggcuucccc

SEQ ID NO: 412929 - RNA, 32 nt, Human
cuugcucuuguggagcuuagagguuggugggg

SEQ ID NO: 412930 - RNA, 32 nt, Human
cuugcucuuugauagccaccuccuaggaaugg

SEQ ID NO: 412931 - RNA, 32 nt, Human
cuugcugaaaacaggcugggguguugagacac

SEQ ID NO: 412932 - RNA, 32 nt, Human
cuugcugaagagaagaaaaagcgaaagguuuu

SEQ ID NO: 412933 - RNA, 32 nt, Human
cuugcugaagcccagagggcugugggaccaug

SEQ ID NO: 412934 - RNA, 32 nt, Human
cuugcugaaucugucuuuguuucugcacuaau

SEQ ID NO: 412935 - RNA, 32 nt, Human
cuugcugacucuguggacuuugacuucaucau

SEQ ID NO: 412936 - RNA, 32 nt, Human
cuugcugagcccacccgcucucucugggucca

SEQ ID NO: 412937 - RNA, 32 nt, Human
cuugcugaggcccagcccagcccagcauagcc

SEQ ID NO: 412938 - RNA, 32 nt, Human
cuugcugagggcccuggccccaccugcugcca

SEQ ID NO: 412939 - RNA, 32 nt, Human
cuugcugaggggcagggagagcgccucuuccu

SEQ ID NO: 412940 - RNA, 32 nt, Human
cuugcugagucaucaucaucaucaucaucauu

SEQ ID NO: 412941 - RNA, 32 nt, Human
cuugcugauuuagaggcucguaugacacauuc

SEQ ID NO: 412942 - RNA, 32 nt, Human
cuugcugcaaggcucuuccugggaacuaaggg

SEQ ID NO: 412943 - RNA, 32 nt, Human
cuugcugcagccucaaccuccugggcucacgu

SEQ ID NO: 412944 - RNA, 32 nt, Human
cuugcugcagugagacuacauuucugucuaaa

SEQ ID NO: 412945 - RNA, 20 nt, Human
cuugcugcaguucuccuucc

SEQ ID NO: 412946 - RNA, 32 nt, Human
cuugcugcauugagaacaggccagucuugacc

SEQ ID NO: 412947 - RNA, 32 nt, Human
cuugcugcccaggcuggagugcaguggcucaa

SEQ ID NO: 412948 - RNA, 19 nt, Human
cuugcugcccauccuuccu

SEQ ID NO: 412949 - RNA, 32 nt, Human
cuugcugccccacugcagugggucugagugac

SEQ ID NO: 412950 - RNA, 19 nt, Human
cuugcugcccucccuuccc

SEQ ID NO: 412951 - RNA, 23 nt, Human
cuugcugccgugugcuccugccu

SEQ ID NO: 412952 - RNA, 32 nt, Human
cuugcugccuccaggccaggggagcaggagau

SEQ ID NO: 412953 - RNA, 32 nt, Human
cuugcugccuccuccuccuccaccugcucucc

SEQ ID NO: 412954 - RNA, 32 nt, Human
cuugcugccucuccuuucuuccucuugccucg

SEQ ID NO: 412955 - RNA, 32 nt, Human
cuugcugccuggggccugcucucucccaggaa

SEQ ID NO: 412956 - RNA, 32 nt, Human
cuugcugccugggugcccucuccuuugcaccc

SEQ ID NO: 412957 - RNA, 19 nt, Human
cuugcugccuucauccccu

SEQ ID NO: 412958 - RNA, 26 nt, Human
cuugcugccuuuuguugcucugcucu

SEQ ID NO: 412959 - RNA, 32 nt, Human
cuugcugcuagagugggaggagaaagaugucu

SEQ ID NO: 412960 - RNA, 32 nt, Human
cuugcugcucaauccauucccucuggcccagc

SEQ ID NO: 412961 - RNA, 32 nt, Human
cuugcugcucuagccgcugcucaggccacuua

SEQ ID NO: 412962 - RNA, 32 nt, Human
cuugcugcugcgcugcaaaaccauagcagauu

SEQ ID NO: 412963 - RNA, 32 nt, Human
cuugcugcugggaagugguacaaucauguuug

SEQ ID NO: 412964 - RNA, 19 nt, Human
cuugcugcuucuccugccu

SEQ ID NO: 412965 - RNA, 21 nt, Human
cuugcugcuucucuccucucc

SEQ ID NO: 412966 - RNA, 23 nt, Human
cuugcugcuucucuccucuccca

SEQ ID NO: 412967 - RNA, 23 nt, Human
cuugcugcuuuuccuugcuuucu

SEQ ID NO: 412968 - RNA, 32 nt, Human
cuugcugcuuuuucuucuguauuucuagguac

SEQ ID NO: 412969 - RNA, 32 nt, Human
cuugcuggacaguggcuguggugaggaguaug

SEQ ID NO: 412970 - RNA, 32 nt, Human
cuugcuggagcuagaaugagggggaggccgcc

SEQ ID NO: 412971 - RNA, 32 nt, Human
cuugcuggagcugcuggaggcccugggguugg

SEQ ID NO: 412972 - RNA, 18 nt, Human
cuugcuggaggcacaggg

SEQ ID NO: 412973 - RNA, 31 nt, Human
cuugcuggagugucucccagccaaucagggc

SEQ ID NO: 412974 - RNA, 32 nt, Human
cuugcuggcagugcuagccaggaaacagagug

SEQ ID NO: 412975 - RNA, 32 nt, Human
cuugcugggaaaucugucucagugcugguuuu

SEQ ID NO: 412976 - RNA, 32 nt, Human
cuugcugggagggucugcaggagaaccgcagg

SEQ ID NO: 412977 - RNA, 32 nt, Human
cuugcugggauuacaggugugagccaccaugc

SEQ ID NO: 412978 - RNA, 32 nt, Human
cuugcugggugagggcacaccacugccagggg

SEQ ID NO: 412979 - RNA, 32 nt, Human
cuugcuggucacugcaaccucugccuccuggg

SEQ ID NO: 412980 - RNA, 32 nt, Human
cuugcugguucagagccagcugucugaccaca

SEQ ID NO: 412981 - RNA, 32 nt, Human
cuugcuguauugcccaggcuggaguguggugg

SEQ ID NO: 412982 - RNA, 32 nt, Human
cuugcugucaaagaaacaccugagaugaauug

SEQ ID NO: 412983 - RNA, 19 nt, Human
cuugcugucagucacgggg

SEQ ID NO: 412984 - RNA, 32 nt, Human
cuugcugucaucugcauucgugcuucccaccu

SEQ ID NO: 412985 - RNA, 21 nt, Human
cuugcuguccacuccugcccu

SEQ ID NO: 412986 - RNA, 32 nt, Human
cuugcuguccgccugcacugcuuccugguaaa

SEQ ID NO: 412987 - RNA, 32 nt, Human
cuugcugucuacugaauaaauaaaugcaccuu

SEQ ID NO: 412988 - RNA, 32 nt, Human
cuugcugucucacccaggcuggagugcagugg

SEQ ID NO: 412989 - RNA, 32 nt, Human
cuugcugucuccccggcuggagcgcaguggca

SEQ ID NO: 412990 - RNA, 32 nt, Human
cuugcugucucggccuucuuugugcuucucug

SEQ ID NO: 412991 - RNA, 32 nt, Human
cuugcugucugucucauugucuuucucucccc

SEQ ID NO: 412992 - RNA, 32 nt, Human
cuugcugugagugaggaguuuggggaugugag

SEQ ID NO: 412993 - RNA, 32 nt, Human
cuugcugugggaugugccaguguccccaccaa

SEQ ID NO: 412994 - RNA, 32 nt, Human
cuugcugugucacccaggcugccaggcuggag

SEQ ID NO: 412995 - RNA, 32 nt, Human
cuugcugugugaagcgugugguucuccuagaa

SEQ ID NO: 412996 - RNA, 18 nt, Human
cuugcugugugaccugag

SEQ ID NO: 412997 - RNA, 32 nt, Human
cuugcuguguggcccaggcuggagugcagugg

SEQ ID NO: 412998 - RNA, 19 nt, Human
cuugcugugugugacacag

SEQ ID NO: 412999 - RNA, 32 nt, Human
cuugcuguguuccucaagcugcacuuuggggc

SEQ ID NO: 413000 - RNA, 32 nt, Human
cuugcuguguugcccaggcuagagugcagcag

SEQ ID NO: 413001 - RNA, 32 nt, Human
cuugcuguguugcccaggcuggagugcagugg

SEQ ID NO: 413002 - RNA, 32 nt, Human
cuugcuguguugcccaggcuggagugcggugg

SEQ ID NO: 413003 - RNA, 18 nt, Human
cuugcuguucaaagggug

SEQ ID NO: 413004 - RNA, 32 nt, Human
cuugcuguucaucuguugaucuggaggcagga

SEQ ID NO: 413005 - RNA, 32 nt, Human
cuugcuguucccaggcaccaccacagcaggug

SEQ ID NO: 413006 - RNA, 19 nt, Human
cuugcuguucuuucagggu

SEQ ID NO: 413007 - RNA, 18 nt, Human
cuugcuguugguggggua

SEQ ID NO: 413008 - RNA, 21 nt, Human
cuugcuguuguacacagggua

SEQ ID NO: 413009 - RNA, 19 nt, Human
cuugcuguuguaucaaggg

SEQ ID NO: 413010 - RNA, 18 nt, Human
cuugcuguuucaucaggg

SEQ ID NO: 413011 - RNA, 32 nt, Human
cuugcuuaaaagggcgaaacuccaucuuaaaa

SEQ ID NO: 413012 - RNA, 32 nt, Human
cuugcuuaaagaaaaggacagaaguuuaguac

SEQ ID NO: 413013 - RNA, 32 nt, Human
cuugcuuaaaggcacuggccagcaguguguga

SEQ ID NO: 413014 - RNA, 32 nt, Human
cuugcuuaacauccuguugcaugucuagcgug

SEQ ID NO: 413015 - RNA, 32 nt, Human
cuugcuuaccauuguagcccuacuaugccugg

SEQ ID NO: 413016 - RNA, 28 nt, Human
cuugcuuaugacuauugccuguucuuuu

SEQ ID NO: 413017 - RNA, 32 nt, Human
cuugcuucaagggauccucccaccucagccuc

SEQ ID NO: 413018 - RNA, 32 nt, Human
cuugcuucaauugcuuacccacugccugccca

SEQ ID NO: 413019 - RNA, 32 nt, Human
cuugcuucagugaggcagggggcauucacugc

SEQ ID NO: 413020 - RNA, 32 nt, Human
cuugcuucauucuuucaaaaacuacaucuuca

SEQ ID NO: 413021 - RNA, 32 nt, Human
cuugcuuccaccugcaggugcauuugguccuu

SEQ ID NO: 413022 - RNA, 32 nt, Human
cuugcuuccagaaaggguuuuaaagcccaugc

SEQ ID NO: 413023 - RNA, 21 nt, Human
cuugcuucccagcucuucuca

SEQ ID NO: 413024 - RNA, 32 nt, Human
cuugcuuccccuacccccaaccccugccuccu

SEQ ID NO: 413025 - RNA, 32 nt, Human
cuugcuuccugcugucccuccaccuccuguau

SEQ ID NO: 413026 - RNA, 32 nt, Human
cuugcuucucacuggcaguguugagcuuugga

SEQ ID NO: 413027 - RNA, 32 nt, Human
cuugcuucuccuucuccuuccugcuuccacgu

SEQ ID NO: 413028 - RNA, 22 nt, Human
cuugcuucucuuucucuucuca

SEQ ID NO: 413029 - RNA, 32 nt, Human
cuugcuucugcacagacccccuuucccuauaa

SEQ ID NO: 413030 - RNA, 24 nt, Human
cuugcuucuucaguucuuugcuca

SEQ ID NO: 413031 - RNA, 32 nt, Human
cuugcuucuuucuccaggccuggcuccuuauu

SEQ ID NO: 413032 - RNA, 24 nt, Human
cuugcuucuuucuugcuuugacca

SEQ ID NO: 413033 - RNA, 21 nt, Human
cuugcuucuuugcuuuugcuc

SEQ ID NO: 413034 - RNA, 32 nt, Human
cuugcuugaacccgggaggcagagguugcagu

SEQ ID NO: 413035 - RNA, 32 nt, Human
cuugcuuggaggcuggcaagagcuccauuuca

SEQ ID NO: 413036 - RNA, 32 nt, Human
cuugcuuggaugaggaaggaaggaggcaaagg

SEQ ID NO: 413037 - RNA, 32 nt, Human
cuugcuuguauuugguuuauugcaguggucug

SEQ ID NO: 413038 - RNA, 23 nt, Human
cuugcuugucuauuuuuacuuuc

SEQ ID NO: 413039 - RNA, 22 nt, Human
cuugcuuguugcaaugugguag

SEQ ID NO: 413040 - RNA, 32 nt, Human
cuugcuuuaaguguuuguuuguuaucucaguc

SEQ ID NO: 413041 - RNA, 32 nt, Human
cuugcuuuacucuggaaaguguggggauggag

SEQ ID NO: 413042 - RNA, 27 nt, Human
cuugcuuuaggauuugcuuguuuuucu

SEQ ID NO: 413043 - RNA, 32 nt, Human
cuugcuuuauucauccuccaucucaaaaugaa

SEQ ID NO: 413044 - RNA, 32 nt, Human
cuugcuuucaaauaugcuauggagccacaguu

SEQ ID NO: 413045 - RNA, 32 nt, Human
cuugcuuuccauccuggaugucagcuccaugg

SEQ ID NO: 413046 - RNA, 32 nt, Human
cuugcuuucucucucaugccuccugaggcugu

SEQ ID NO: 413047 - RNA, 32 nt, Human
cuugcuuucuucuccugugaugucccaguuuc

SEQ ID NO: 413048 - RNA, 32 nt, Human
cuugcuuucuucuuuccuuuacuccuggcuca

SEQ ID NO: 413049 - RNA, 22 nt, Human
cuugcuuucuuucuugcuuucu

SEQ ID NO: 413050 - RNA, 26 nt, Human
cuugcuuucuuucuuucuugcuuucu

SEQ ID NO: 413051 - RNA, 32 nt, Human
cuugcuuugcccaccuccacucuaauucccau

SEQ ID NO: 413052 - RNA, 25 nt, Human
cuugcuuugcuguuugguguaguaa

SEQ ID NO: 413053 - RNA, 32 nt, Human
cuugcuuugucacccaggcuggaguacagugg

SEQ ID NO: 413054 - RNA, 32 nt, Human
cuugcuuugucacccaggcuggagugcagugg

SEQ ID NO: 413055 - RNA, 32 nt, Human
cuugcuuugucacccaggcuggagugcagugu

SEQ ID NO: 413056 - RNA, 32 nt, Human
cuugcuuugucacccaggcuggagugcugugg

SEQ ID NO: 413057 - RNA, 32 nt, Human
cuugcuuugucgcccaggcuggagcgcagucc

SEQ ID NO: 413058 - RNA, 32 nt, Human
cuugcuuugucgcccaggcuggagugcagugg

SEQ ID NO: 413059 - RNA, 32 nt, Human
cuugcuuuguugcccaggcuggagugcaguag

SEQ ID NO: 413060 - RNA, 32 nt, Human
cuugcuuuguugcccaggcuggaguguggugg

SEQ ID NO: 413061 - RNA, 32 nt, Human
cuugcuuuguuuucccuggcuaacagucuagu

SEQ ID NO: 413062 - RNA, 32 nt, Human
cuugcuuuguuuucccugucaccucccuauua

SEQ ID NO: 413063 - RNA, 32 nt, Human
cuugcuuuucagaacauagggaugaaguaagg

SEQ ID NO: 413064 - RNA, 32 nt, Human
cuugcuuuuucucuggaccauccuggcuggaa

SEQ ID NO: 413065 - RNA, 32 nt, Human
cuugcuuuuuguuuuugccauuguguuuacgu

SEQ ID NO: 413066 - RNA, 24 nt, Human
cuuggaaaaauccagaaagaaaaa

SEQ ID NO: 413067 - RNA, 32 nt, Human
cuuggaaaagagacucauuugcugaugguuca

SEQ ID NO: 413068 - RNA, 32 nt, Human
cuuggaaacugguuuuggcucugaucagcggu

SEQ ID NO: 413069 - RNA, 32 nt, Human
cuuggaaaggaaauucuaacagagaagagcuu

SEQ ID NO: 413070 - RNA, 32 nt, Human
cuuggaaaggcugagacaggaggaucacuuga

SEQ ID NO: 413071 - RNA, 26 nt, Human
cuuggaaaggucacagaaggaaaaua

SEQ ID NO: 413072 - RNA, 32 nt, Human
cuuggaaauggaaucuggggaggcaggaauac

SEQ ID NO: 413073 - RNA, 32 nt, Human
cuuggaacacccugaagagcaacaugggagaa

SEQ ID NO: 413074 - RNA, 24 nt, Human
cuuggaaccaaagaguugcugcac

SEQ ID NO: 413075 - RNA, 32 nt, Human
cuuggaacccaccccaccucccucauuggggg

SEQ ID NO: 413076 - RNA, 32 nt, Human
cuuggaaccgcuucuagagcagucucugcuuu

SEQ ID NO: 413077 - RNA, 32 nt, Human
cuuggaacucccuuuugaccucagucuucucu

SEQ ID NO: 413078 - RNA, 32 nt, Human
cuuggaacuccucaagaaccugaagauuccag

SEQ ID NO: 413079 - RNA, 32 nt, Human
cuuggaacuccucaagaaccugaagauugaga

SEQ ID NO: 413080 - RNA, 32 nt, Human
cuuggaacugucagggucagaggggaaccacc

SEQ ID NO: 413081 - RNA, 32 nt, Human
cuuggaacuugccucuuguccugcuggaaaga

SEQ ID NO: 413082 - RNA, 31 nt, Human
cuuggaagaaagauuucagccaagagacaca

SEQ ID NO: 413083 - RNA, 32 nt, Human
cuuggaagaccaggguggguacauacuggaga

SEQ ID NO: 413084 - RNA, 32 nt, Human
cuuggaagacucuuauccaucugugaaacccu

SEQ ID NO: 413085 - RNA, 32 nt, Human
cuuggaagaggaggaggaggaggagaaggagg

SEQ ID NO: 413086 - RNA, 32 nt, Human
cuuggaagaggaugauaaagaaaaugauaagg

SEQ ID NO: 413087 - RNA, 21 nt, Human
cuuggaagccucuccuguccu

SEQ ID NO: 413088 - RNA, 32 nt, Human
cuuggaaggaagcauaagcuucccauuucaca

SEQ ID NO: 413089 - RNA, 22 nt, Human
cuuggaaggcucccacccaggu

SEQ ID NO: 413090 - RNA, 32 nt, Human
cuuggaaggcugagacaggagaauggcgugaa

SEQ ID NO: 413091 - RNA, 32 nt, Human
cuuggaaggcuggagcuucgggccaaggccca

SEQ ID NO: 413092 - RNA, 24 nt, Human
cuuggaaguccagaaaggaaaaua

SEQ ID NO: 413093 - RNA, 32 nt, Human
cuuggaagugacuguagugaaggucguggaag

SEQ ID NO: 413094 - RNA, 32 nt, Human
cuuggaaguggugugcaguaggaccugcuccc

SEQ ID NO: 413095 - RNA, 32 nt, Human
cuuggaaucuacugccugcuggccaggcuuua

SEQ ID NO: 413096 - RNA, 32 nt, Human
cuuggaauucuaagagccuuggacccgagugu

SEQ ID NO: 413097 - RNA, 32 nt, Human
cuuggaauucucccugccagcacagcagucug

SEQ ID NO: 413098 - RNA, 32 nt, Human
cuuggaauuugagacaaggaaagagcauucuu

SEQ ID NO: 413099 - RNA, 32 nt, Human
cuuggaauuugggauccucuucugucucuuga

SEQ ID NO: 413100 - RNA, 32 nt, Human
cuuggacaaucccuaccuaaucuccagggaua

SEQ ID NO: 413101 - RNA, 32 nt, Human
cuuggacacacuguguuccaccccucguggga

SEQ ID NO: 413102 - RNA, 32 nt, Human
cuuggacacccaacuuugccaccucgaggguc

SEQ ID NO: 413103 - RNA, 32 nt, Human
cuuggacagacuguucucccucuuguuaccug

SEQ ID NO: 413104 - RNA, 32 nt, Human
cuuggacagagaccaggauuuggggcugagcu

SEQ ID NO: 413105 - RNA, 32 nt, Human
cuuggacagggugggagaggggacacaugggu

SEQ ID NO: 413106 - RNA, 16 nt, Human
cuuggacaguagagga

SEQ ID NO: 413107 - RNA, 32 nt, Human
cuuggacaucugauacuuucugcauuccaaag

SEQ ID NO: 413108 - RNA, 32 nt, Human
cuuggacauguggaggugagggaugagaguau

SEQ ID NO: 413109 - RNA, 32 nt, Human
cuuggaccaagcucguuuuauucccuacucua

SEQ ID NO: 413110 - RNA, 32 nt, Human
cuuggaccacugacccucagauuuccagccuu

SEQ ID NO: 413111 - RNA, 18 nt, Human
cuuggaccaguuagauga

SEQ ID NO: 413112 - RNA, 32 nt, Human
cuuggaccaguuugcagagugaagaucaagaa

SEQ ID NO: 413113 - RNA, 21 nt, Human
cuuggaccauauaggcauuga

SEQ ID NO: 413114 - RNA, 32 nt, Human
cuuggacccacaguggagugcugguccgugcu

SEQ ID NO: 413115 - RNA, 32 nt, Human
cuuggacccaggccuugggagggaaugguggg

SEQ ID NO: 413116 - RNA, 32 nt, Human
cuuggacccgggaggcagagguugcagugagc

SEQ ID NO: 413117 - RNA, 32 nt, Human
cuuggacccgggaggcggagguugcagugagc

SEQ ID NO: 413118 - RNA, 32 nt, Human
cuuggacccuccucgucugcaugguaacuccg

SEQ ID NO: 413119 - RNA, 32 nt, Human
cuuggacccuggagguagaggcugcagugagc

SEQ ID NO: 413120 - RNA, 32 nt, Human
cuuggaccgcuucagccugggcugggagcagc

SEQ ID NO: 413121 - RNA, 32 nt, Human
cuuggaccggcggcugaugcaggaugacaacc

SEQ ID NO: 413122 - RNA, 32 nt, Human
cuuggaccuaggagguggagguugcagugagc

SEQ ID NO: 413123 - RNA, 32 nt, Human
cuuggaccuccaggggcuccuggguuggaggg

SEQ ID NO: 413124 - RNA, 32 nt, Human
cuuggaccugggaggcagagguuucagugagc

SEQ ID NO: 413125 - RNA, 32 nt, Human
cuuggaccugggagguggagguugcagugagc

SEQ ID NO: 413126 - RNA, 32 nt, Human
cuuggaccugggagguggagguugcggugagc

SEQ ID NO: 413127 - RNA, 32 nt, Human
cuuggaccuucucaucccagcaaacauccaau

SEQ ID NO: 413128 - RNA, 32 nt, Human
cuuggaccuucuccccuacggcugcuucucag

SEQ ID NO: 413129 - RNA, 32 nt, Human
cuuggaccuucucccuugcuuagaagugccag

SEQ ID NO: 413130 - RNA, 32 nt, Human
cuuggacguacaccuaaucccauggggccucg

SEQ ID NO: 413131 - RNA, 32 nt, Human
cuuggacuacauuucccuugaggcuuuacugg

SEQ ID NO: 413132 - RNA, 32 nt, Human
cuuggacuccaaagguggagguugcaguaagc

SEQ ID NO: 413133 - RNA, 32 nt, Human
cuuggacuccagagguggagguugcaguaagc

SEQ ID NO: 413134 - RNA, 20 nt, Human
cuuggacucccagccugcca

SEQ ID NO: 413135 - RNA, 32 nt, Human
cuuggacuccucucuuugcugaagagacccaa

SEQ ID NO: 413136 - RNA, 21 nt, Human
cuuggacuccugaccccaggu

SEQ ID NO: 413137 - RNA, 32 nt, Human
cuuggacucuccauuccucugccuguacuacc

SEQ ID NO: 413138 - RNA, 32 nt, Human
cuuggacugagccaaggaggcuugggaggccc

SEQ ID NO: 413139 - RNA, 22 nt, Human
cuuggacugaggacaagggcaa

SEQ ID NO: 413140 - RNA, 21 nt, Human
cuuggacuguaguccuucccc

SEQ ID NO: 413141 - RNA, 20 nt, Human
cuuggacuucccagccucca

SEQ ID NO: 413142 - RNA, 21 nt, Human
cuuggacuucuuggaaggcag

SEQ ID NO: 413143 - RNA, 32 nt, Human
cuuggacuugggaggcgguuguugcagugagc

SEQ ID NO: 413144 - RNA, 21 nt, Human
cuuggacuuuguuuucccuuc

SEQ ID NO: 413145 - RNA, 31 nt, Human
cuuggagaacaauauucauuugguuguggag

SEQ ID NO: 413146 - RNA, 22 nt, Human
cuuggagaagcagccccaugaa

SEQ ID NO: 413147 - RNA, 32 nt, Human
cuuggagaaguggaggugugcaugguguguag

SEQ ID NO: 413148 - RNA, 32 nt, Human
cuuggagacaacaugugguucuugacaacucu

SEQ ID NO: 413149 - RNA, 32 nt, Human
cuuggagacacccugccccacccuggcuccac

SEQ ID NO: 413150 - RNA, 22 nt, Human
cuuggagaccccuaaagaaaua

SEQ ID NO: 413151 - RNA, 32 nt, Human
cuuggagacccgugccuuccagauggcuggga

SEQ ID NO: 413152 - RNA, 32 nt, Human
cuuggagacugcuuuucuccagcucugucaac

SEQ ID NO: 413153 - RNA, 32 nt, Human
cuuggagagaagcagugcagggaauggauaug

SEQ ID NO: 413154 - RNA, 32 nt, Human
cuuggagagaggggcuggaggcuggacaggcu

SEQ ID NO: 413155 - RNA, 32 nt, Human
cuuggagagcccaggagcaggggagacaugga

SEQ ID NO: 413156 - RNA, 32 nt, Human
cuuggagagccccagauuggaggcagacagac

SEQ ID NO: 413157 - RNA, 32 nt, Human
cuuggagaggagaauaaaagaaugucuccugg

SEQ ID NO: 413158 - RNA, 32 nt, Human
cuuggagagggguugagagccuccuuuuuggu

SEQ ID NO: 413159 - RNA, 32 nt, Human
cuuggagaguggaucagagagacuaggacagu

SEQ ID NO: 413160 - RNA, 32 nt, Human
cuuggagaucaucuuggccagagugaagaccc

SEQ ID NO: 413161 - RNA, 32 nt, Human
cuuggagaugugggcagaggaagaggacacug

SEQ ID NO: 413162 - RNA, 32 nt, Human
cuuggagcacagacccucccuucagauccgca

SEQ ID NO: 413163 - RNA, 32 nt, Human
cuuggagcagaaucugcuaccugaggcuccag

SEQ ID NO: 413164 - RNA, 32 nt, Human
cuuggagcagccaguaaugacaguguccuaac

SEQ ID NO: 413165 - RNA, 32 nt, Human
cuuggagcagcuccucugcaggcacagccugg

SEQ ID NO: 413166 - RNA, 32 nt, Human
cuuggagcauuaucuuuaguuacuugaagagu

SEQ ID NO: 413167 - RNA, 32 nt, Human
cuuggagccaggaguuugagaccagccugggc

SEQ ID NO: 413168 - RNA, 32 nt, Human
cuuggagcccugccucugagccuggacgggaa

SEQ ID NO: 413169 - RNA, 32 nt, Human
cuuggagccuaugggcuucagaugucuuugcc

SEQ ID NO: 413170 - RNA, 32 nt, Human
cuuggagccuuggucugcagggucccuccuuc

SEQ ID NO: 413171 - RNA, 32 nt, Human
cuuggagcgaagucugccccaguggggauccu

SEQ ID NO: 413172 - RNA, 20 nt, Human
cuuggagcgagggggcgggg

SEQ ID NO: 413173 - RNA, 32 nt, Human
cuuggagcgggccugagagacaaggacaugug

SEQ ID NO: 413174 - RNA, 32 nt, Human
cuuggagcugugugccuguaaucccagcuaac

SEQ ID NO: 413175 - RNA, 32 nt, Human
cuuggaggagagcagcucccacuguggggaca

SEQ ID NO: 413176 - RNA, 32 nt, Human
cuuggaggagauggggacagggcuggagucaa

SEQ ID NO: 413177 - RNA, 32 nt, Human
cuuggaggaggcaccagcgaggaugacguuua

SEQ ID NO: 413178 - RNA, 32 nt, Human
cuuggaggagggcagaggcagugugggcugau

SEQ ID NO: 413179 - RNA, 20 nt, Human
cuuggaggauuaaaacaaca

SEQ ID NO: 413180 - RNA, 20 nt, Human
cuuggaggcagagguugcag

SEQ ID NO: 413181 - RNA, 23 nt, Human
cuuggaggcagagguugcaguga

SEQ ID NO: 413182 - RNA, 24 nt, Human
cuuggaggcagagguugcagugag

SEQ ID NO: 413183 - RNA, 21 nt, Human
cuuggaggccgggugcagugg

SEQ ID NO: 413184 - RNA, 32 nt, Human
cuuggaggcugcuuucuccuuuacuuggaagg

SEQ ID NO: 413185 - RNA, 32 nt, Human
cuuggaggcuggaagggguuaagccagaagug

SEQ ID NO: 413186 - RNA, 32 nt, Human
cuuggaggcugguguggccuugaggagggaag

SEQ ID NO: 413187 - RNA, 32 nt, Human
cuuggaggcugugagguugcagcaaaguuuua

SEQ ID NO: 413188 - RNA, 32 nt, Human
cuuggagggaggaagaaagggagccggcguuc

SEQ ID NO: 413189 - RNA, 32 nt, Human
cuuggagggcaaaggugacaucguggaagacc

SEQ ID NO: 413190 - RNA, 31 nt, Human
cuuggagggcacuucuuucgugguaguucuu

SEQ ID NO: 413191 - RNA, 32 nt, Human
cuuggagggccuccuuggcaaugcauuugaug

SEQ ID NO: 413192 - RNA, 32 nt, Human
cuuggaggggcagaccacuggacaagagcaag

SEQ ID NO: 413193 - RNA, 32 nt, Human
cuuggaggugugcagagaugucuaugcgggcc

SEQ ID NO: 413194 - RNA, 32 nt, Human
cuuggagguuagaagcaagauggaauugguua

SEQ ID NO: 413195 - RNA, 32 nt, Human
cuuggaguauuuaaaugcccauuugccaaaag

SEQ ID NO: 413196 - RNA, 32 nt, Human
cuuggaguccaagguguucugacaaggguggc

SEQ ID NO: 413197 - RNA, 32 nt, Human
cuuggaguccagccccuccagguccuccacag

SEQ ID NO: 413198 - RNA, 32 nt, Human
cuuggagucucuggugggcagagagggauggg

SEQ ID NO: 413199 - RNA, 32 nt, Human
cuuggagucugccaggucaccuuagggcaagg

SEQ ID NO: 413200 - RNA, 32 nt, Human
cuuggaguuacaacagaagcuggggaggugag

SEQ ID NO: 413201 - RNA, 32 nt, Human
cuuggauaacaacugcacuccagccuggauga

SEQ ID NO: 413202 - RNA, 32 nt, Human
cuuggauaacgacugcacuccagccuggauga

SEQ ID NO: 413203 - RNA, 32 nt, Human
cuuggauaagaaggguccuggggaagaagacu

SEQ ID NO: 413204 - RNA, 32 nt, Human
cuuggauaccagcacauuggagggagauagcc

SEQ ID NO: 413205 - RNA, 32 nt, Human
cuuggauaccugauauuuuauuucaagaaaga

SEQ ID NO: 413206 - RNA, 32 nt, Human
cuuggauacucuucucccaucucccuucacag

SEQ ID NO: 413207 - RNA, 25 nt, Human
cuuggauauaccuagauuccauaca

SEQ ID NO: 413208 - RNA, 32 nt, Human
cuuggauccaggcugggcacgguggcucacac

SEQ ID NO: 413209 - RNA, 32 nt, Human
cuuggauccuucagagccucagccacuagcug

SEQ ID NO: 413210 - RNA, 32 nt, Human
cuuggaucucagaauggccuggaaacggaugg

SEQ ID NO: 413211 - RNA, 32 nt, Human
cuuggaucuccugucuuauagauuuuauaucc

SEQ ID NO: 413212 - RNA, 32 nt, Human
cuuggaucucugaggggaaggaacagcaaaag

SEQ ID NO: 413213 - RNA, 32 nt, Human
cuuggaucugcagaugcaggaggcagauauca

SEQ ID NO: 413214 - RNA, 32 nt, Human
cuuggaucuggcuguugaguugacggguuccu

SEQ ID NO: 413215 - RNA, 32 nt, Human
cuuggaucuuuuugcagacuagcuaauuagcu

SEQ ID NO: 413216 - RNA, 32 nt, Human
cuuggaugaggaaggaaggaggcaaaggcacc

SEQ ID NO: 413217 - RNA, 17 nt, Human
cuuggauggagagauga

SEQ ID NO: 413218 - RNA, 32 nt, Human
cuuggauggaugaagucagagaggugggguga

SEQ ID NO: 413219 - RNA, 32 nt, Human
cuuggauggccucaaaagguucuugaacacca

SEQ ID NO: 413220 - RNA, 32 nt, Human
cuuggauggugucuuccucuccucagccgaga

SEQ ID NO: 413221 - RNA, 32 nt, Human
cuuggauguauguuccaaaggguccucauucu

SEQ ID NO: 413222 - RNA, 32 nt, Human
cuuggauuagcucuucauacccaaucagcagu

SEQ ID NO: 413223 - RNA, 32 nt, Human
cuuggauuauucacugccugucacaagccuca

SEQ ID NO: 413224 - RNA, 32 nt, Human
cuuggauucccuuucuuuccuuuuauuuuaaa

SEQ ID NO: 413225 - RNA, 32 nt, Human
cuuggauuccuguugauuaacuucuccauucu

SEQ ID NO: 413226 - RNA, 32 nt, Human
cuuggauucugcggcugaggcuuggggccuuu

SEQ ID NO: 413227 - RNA, 32 nt, Human
cuuggauuucuugguccugccuugccaacugc

SEQ ID NO: 413228 - RNA, 32 nt, Human
cuuggcaaaggcugaggggucagguugggaaa

SEQ ID NO: 413229 - RNA, 32 nt, Human
cuuggcaaaucugccaagcaugucuucaccaa

SEQ ID NO: 413230 - RNA, 24 nt, Human
cuuggcaacacagugagacccugu

SEQ ID NO: 413231 - RNA, 16 nt, Human
cuuggcaacagaguga

SEQ ID NO: 413232 - RNA, 20 nt, Human
cuuggcaacauggugaaacc

SEQ ID NO: 413233 - RNA, 32 nt, Human
cuuggcaacauggugaaaccccaucuccacca

SEQ ID NO: 413234 - RNA, 18 nt, Human
cuuggcaacgggacgcgg

SEQ ID NO: 413235 - RNA, 32 nt, Human
cuuggcaacuccagggcgcuccguucaagaau

SEQ ID NO: 413236 - RNA, 32 nt, Human
cuuggcaagccagcaggcugguacucggaccg

SEQ ID NO: 413237 - RNA, 32 nt, Human
cuuggcaagcccacccuuccuguggccucugu

SEQ ID NO: 413238 - RNA, 21 nt, Human
cuuggcaaugcacuucauaca

SEQ ID NO: 413239 - RNA, 32 nt, Human
cuuggcaaugccaaggucaucgauaccuuccc

SEQ ID NO: 413240 - RNA, 32 nt, Human
cuuggcacacacacauucgugugcucugcugc

SEQ ID NO: 413241 - RNA, 32 nt, Human
cuuggcacagaaguagcugcauaaaagagcac

SEQ ID NO: 413242 - RNA, 32 nt, Human
cuuggcacaggaguuccagaccagccugggca

SEQ ID NO: 413243 - RNA, 32 nt, Human
cuuggcacaggcugccccgagauuccugcgac

SEQ ID NO: 413244 - RNA, 32 nt, Human
cuuggcaccauccuggcuuuuggcagggauga

SEQ ID NO: 413245 - RNA, 32 nt, Human
cuuggcacccaccaacuuccugcacacacugg

SEQ ID NO: 413246 - RNA, 32 nt, Human
cuuggcacccagcuuccauuagaagggaauau

SEQ ID NO: 413247 - RNA, 32 nt, Human
cuuggcacccccuuccucagugcccuaguggc

SEQ ID NO: 413248 - RNA, 32 nt, Human
cuuggcacccggaggcagcggaggcaggcgca

SEQ ID NO: 413249 - RNA, 18 nt, Human
cuuggcaccgccgcuccg

SEQ ID NO: 413250 - RNA, 32 nt, Human
cuuggcaccuauaccuugaauaucugcuauca

SEQ ID NO: 413251 - RNA, 32 nt, Human
cuuggcacucaagcaguccuucugccucagcc

SEQ ID NO: 413252 - RNA, 21 nt, Human
cuuggcacugaugggcacugg

SEQ ID NO: 413253 - RNA, 32 nt, Human
cuuggcacuguacuccaaccuggguaacaggg

SEQ ID NO: 413254 - RNA, 32 nt, Human
cuuggcacuguuagugacagagcccagcaucc

SEQ ID NO: 413255 - RNA, 32 nt, Human
cuuggcacuucccucuguggcucugcucagaa

SEQ ID NO: 413256 - RNA, 18 nt, Human
cuuggcagaagggcccag

SEQ ID NO: 413257 - RNA, 19 nt, Human
cuuggcagaaggggugggg

SEQ ID NO: 413258 - RNA, 32 nt, Human
cuuggcagaauggcuguugaggggcaggcgcu

SEQ ID NO: 413259 - RNA, 32 nt, Human
cuuggcagaggaggaggagucaagggagcagg

SEQ ID NO: 413260 - RNA, 20 nt, Human
cuuggcagaggcaggugugg

SEQ ID NO: 413261 - RNA, 32 nt, Human
cuuggcagaguuuucacaugcuaacuggacua

SEQ ID NO: 413262 - RNA, 32 nt, Human
cuuggcagcagcaucgccucagccuggaguga

SEQ ID NO: 413263 - RNA, 19 nt, Human
cuuggcagcaggggcacag

SEQ ID NO: 413264 - RNA, 16 nt, Human
cuuggcagcaggguga

SEQ ID NO: 413265 - RNA, 32 nt, Human
cuuggcagcccccuguaguugacagguaagcu

SEQ ID NO: 413266 - RNA, 32 nt, Human
cuuggcagccuccuucccuguucaugagaauu

SEQ ID NO: 413267 - RNA, 21 nt, Human
cuuggcagccucuggcggcag

SEQ ID NO: 413268 - RNA, 32 nt, Human
cuuggcagccuggcagagguuugcagacaggc

SEQ ID NO: 413269 - RNA, 32 nt, Human
cuuggcagcucgccaacagguucagucagggg

SEQ ID NO: 413270 - RNA, 17 nt, Human
cuuggcagcugcagccc

SEQ ID NO: 413271 - RNA, 32 nt, Human
cuuggcagcugguacucccccagccagugcua

SEQ ID NO: 413272 - RNA, 19 nt, Human
cuuggcaggacuuggccag

SEQ ID NO: 413273 - RNA, 20 nt, Human
cuuggcaggagagauggugc

SEQ ID NO: 413274 - RNA, 20 nt, Human
cuuggcaggagagcccucag

SEQ ID NO: 413275 - RNA, 18 nt, Human
cuuggcaggauaaugcag

SEQ ID NO: 413276 - RNA, 21 nt, Human
cuuggcaggcaggaggugcgg

SEQ ID NO: 413277 - RNA, 32 nt, Human
cuuggcaggcagggccaacagcagcccccggg

SEQ ID NO: 413278 - RNA, 32 nt, Human
cuuggcaggccugagggccaguggggauccug

SEQ ID NO: 413279 - RNA, 22 nt, Human
cuuggcaggcggccgggcgcag

SEQ ID NO: 413280 - RNA, 20 nt, Human
cuuggcagggccaggcgggg

SEQ ID NO: 413281 - RNA, 19 nt, Human
cuuggcagggcuccugcag

SEQ ID NO: 413282 - RNA, 19 nt, Human
cuuggcagggggcaagcag

SEQ ID NO: 413283 - RNA, 20 nt, Human
cuuggcagggucuaagccag

SEQ ID NO: 413284 - RNA, 19 nt, Human
cuuggcagguccuggccag

SEQ ID NO: 413285 - RNA, 32 nt, Human
cuuggcaggucuggggcaagccuagcacuggg

SEQ ID NO: 413286 - RNA, 18 nt, Human
cuuggcaggugaggggcg

SEQ ID NO: 413287 - RNA, 32 nt, Human
cuuggcaggugaucccaagaccugcagcuuca

SEQ ID NO: 413288 - RNA, 20 nt, Human
cuuggcaggugggggcuuag

SEQ ID NO: 413289 - RNA, 32 nt, Human
cuuggcaguuauagcaggagaacacugucuua

SEQ ID NO: 413290 - RNA, 21 nt, Human
cuuggcaucacagggcagagc

SEQ ID NO: 413291 - RNA, 32 nt, Human
cuuggcaucccccgagggauguauuucggagc

SEQ ID NO: 413292 - RNA, 22 nt, Human
cuuggcaucggagugucagggc

SEQ ID NO: 413293 - RNA, 32 nt, Human
cuuggcaucugcacuccagcccaggacugugg

SEQ ID NO: 413294 - RNA, 32 nt, Human
cuuggcaucugucuugggguccagcccuaccc

SEQ ID NO: 413295 - RNA, 32 nt, Human
cuuggcaucuguggauggcuugaguguuaacu

SEQ ID NO: 413296 - RNA, 32 nt, Human
cuuggcaugauggcucacuccuguaaucccaa

SEQ ID NO: 413297 - RNA, 32 nt, Human
cuuggcauugcaaccuccauuucuagcuccug

SEQ ID NO: 413298 - RNA, 31 nt, Human
cuuggcauuuucaccagacaugcagauuuga

SEQ ID NO: 413299 - RNA, 32 nt, Human
cuuggccaaacagugaaacccuaucucuacua

SEQ ID NO: 413300 - RNA, 19 nt, Human
cuuggccaacauggugaaa

SEQ ID NO: 413301 - RNA, 32 nt, Human
cuuggccaauauagcaagacccugugucuaaa

SEQ ID NO: 413302 - RNA, 22 nt, Human
cuuggccacaagcagggucuga

SEQ ID NO: 413303 - RNA, 32 nt, Human
cuuggccacagcaacacccacugagcacgcug

SEQ ID NO: 413304 - RNA, 32 nt, Human
cuuggccacccacuucucccagccugugucuu

SEQ ID NO: 413305 - RNA, 22 nt, Human
cuuggccacgggaggcugcuga

SEQ ID NO: 413306 - RNA, 24 nt, Human
cuuggccacucacccaagcauugg

SEQ ID NO: 413307 - RNA, 19 nt, Human
cuuggccacuccaggcccu

SEQ ID NO: 413308 - RNA, 32 nt, Human
cuuggccacugcaagcuccaccucccagguuc

SEQ ID NO: 413309 - RNA, 32 nt, Human
cuuggccagagcccuguggccuaggggaaaau

SEQ ID NO: 413310 - RNA, 32 nt, Human
cuuggccagcagcugcccaggacacagugcag

SEQ ID NO: 413311 - RNA, 32 nt, Human
cuuggccagccuggccagccgccgagcagccc

SEQ ID NO: 413312 - RNA, 32 nt, Human
cuuggccagccugugucuccugucuaugacug

SEQ ID NO: 413313 - RNA, 32 nt, Human
cuuggccagcuggugcugcgaauccugccugc

SEQ ID NO: 413314 - RNA, 32 nt, Human
cuuggccagcugguucgagcggugagccgcgc

SEQ ID NO: 413315 - RNA, 32 nt, Human
cuuggccaggaucuuaagggacuuugaaaauu

SEQ ID NO: 413316 - RNA, 32 nt, Human
cuuggccaggugcaguaguucaugcccuguaa

SEQ ID NO: 413317 - RNA, 32 nt, Human
cuuggccaucguguggccgccaccuccgggaa

SEQ ID NO: 413318 - RNA, 22 nt, Human
cuuggccaucuaaacaucauca

SEQ ID NO: 413319 - RNA, 24 nt, Human
cuuggccaucuagcauuccauaca

SEQ ID NO: 413320 - RNA, 24 nt, Human
cuuggccaucuagcauuccaugca

SEQ ID NO: 413321 - RNA, 32 nt, Human
cuuggccaucuucuuccuucgucgucucuccu

SEQ ID NO: 413322 - RNA, 32 nt, Human
cuuggccauggggacgcccucagucuagggau

SEQ ID NO: 413323 - RNA, 24 nt, Human
cuuggccauucccaggaggcuugg

SEQ ID NO: 413324 - RNA, 32 nt, Human
cuuggcccaaguaguugggagguguuggcugc

SEQ ID NO: 413325 - RNA, 32 nt, Human
cuuggcccacugcaaccucugccucccggguu

SEQ ID NO: 413326 - RNA, 32 nt, Human
cuuggcccacugcaaccucugcuuccuagguu

SEQ ID NO: 413327 - RNA, 32 nt, Human
cuuggcccagcccuagcacccuacucacuggu

SEQ ID NO: 413328 - RNA, 32 nt, Human
cuuggcccaggaggcagagguugcagugagcu

SEQ ID NO: 413329 - RNA, 32 nt, Human
cuuggcccaggaguucauaaccagccuggauu

SEQ ID NO: 413330 - RNA, 32 nt, Human
cuuggcccagggccaggcagucgugguugcag

SEQ ID NO: 413331 - RNA, 32 nt, Human
cuuggccccacauuucugcaaacauaaauauu

SEQ ID NO: 413332 - RNA, 32 nt, Human
cuuggccccagcccugcugggcccagaacccu

SEQ ID NO: 413333 - RNA, 32 nt, Human
cuuggccccagcugcccagcaggugccucgau

SEQ ID NO: 413334 - RNA, 32 nt, Human
cuuggcccccagcuacaaugaaaaagaagaau

SEQ ID NO: 413335 - RNA, 21 nt, Human
cuuggcccccucggccacuga

SEQ ID NO: 413336 - RNA, 32 nt, Human
cuuggccccuccaucugggcuccuguggauag

SEQ ID NO: 413337 - RNA, 32 nt, Human
cuuggccccuggcccaggcugugucugcaaga

SEQ ID NO: 413338 - RNA, 32 nt, Human
cuuggccccuugaucaggaucaagcaggcacu

SEQ ID NO: 413339 - RNA, 32 nt, Human
cuuggcccgcugcaggccucaggcaggcgggg

SEQ ID NO: 413340 - RNA, 32 nt, Human
cuuggcccgguggcucaugccuguaaucccag

SEQ ID NO: 413341 - RNA, 32 nt, Human
cuuggcccuaagaauguuuugcacugacagug

SEQ ID NO: 413342 - RNA, 32 nt, Human
cuuggcccuauuuaaggcagauuuuacagagc

SEQ ID NO: 413343 - RNA, 32 nt, Human
cuuggcccuccccucuuucucccccaacccac

SEQ ID NO: 413344 - RNA, 32 nt, Human
cuuggcccucuuccucuccaaagcgccagaac

SEQ ID NO: 413345 - RNA, 32 nt, Human
cuuggcccugcacucucaacaugaguagcgaa

SEQ ID NO: 413346 - RNA, 32 nt, Human
cuuggcccugcucacaccuugauuuuggucuu

SEQ ID NO: 413347 - RNA, 32 nt, Human
cuuggcccuuccgcuccaccagccuggucuga

SEQ ID NO: 413348 - RNA, 32 nt, Human
cuuggcccuuuucacagagguggccuuggagu

SEQ ID NO: 413349 - RNA, 32 nt, Human
cuuggccgagacuaauguguggcccacagcuu

SEQ ID NO: 413350 - RNA, 20 nt, Human
cuuggccgagccgggggcgc

SEQ ID NO: 413351 - RNA, 24 nt, Human
cuuggccgcucuguaagcaucuga

SEQ ID NO: 413352 - RNA, 17 nt, Human
cuuggccgcugcugccg

SEQ ID NO: 413353 - RNA, 32 nt, Human
cuuggccggaagcugcggagaggcucagccac

SEQ ID NO: 413354 - RNA, 22 nt, Human
cuuggccgggcagggggcgggg

SEQ ID NO: 413355 - RNA, 19 nt, Human
cuuggccguggaggcguuu

SEQ ID NO: 413356 - RNA, 22 nt, Human
cuuggccuacacauucuauaca

SEQ ID NO: 413357 - RNA, 32 nt, Human
cuuggccuaggaguucaagaccagccugggcu

SEQ ID NO: 413358 - RNA, 32 nt, Human
cuuggccucaagugaaccagcacuucaugagu

SEQ ID NO: 413359 - RNA, 32 nt, Human
cuuggccucacugcuaaugacuccucacaccc

SEQ ID NO: 413360 - RNA, 32 nt, Human
cuuggccuccacaauccuuuaucuuaaccuga

SEQ ID NO: 413361 - RNA, 32 nt, Human
cuuggccuccaccaccucccacgcuucugaga

SEQ ID NO: 413362 - RNA, 32 nt, Human
cuuggccucccaaagugcgggauuacaagcgu

SEQ ID NO: 413363 - RNA, 32 nt, Human
cuuggccucccaaaugcugggauuacagacau

SEQ ID NO: 413364 - RNA, 32 nt, Human
cuuggccucccaagugcugggauuacaggcgc

SEQ ID NO: 413365 - RNA, 32 nt, Human
cuuggccucccuaagugcugggauuauaggcg

SEQ ID NO: 413366 - RNA, 32 nt, Human
cuuggccucccuaaguguugggauuauaggug

SEQ ID NO: 413367 - RNA, 32 nt, Human
cuuggccuccuaagugcugggauuacaggcgu

SEQ ID NO: 413368 - RNA, 22 nt, Human
cuuggccuccuggcugcuuucu

SEQ ID NO: 413369 - RNA, 32 nt, Human
cuuggccucucaccucagagcugcggaggagc

SEQ ID NO: 413370 - RNA, 32 nt, Human
cuuggccucucagacccagcucagccacggcc

SEQ ID NO: 413371 - RNA, 32 nt, Human
cuuggccucugacucccgucucugugcuugcc

SEQ ID NO: 413372 - RNA, 32 nt, Human
cuuggccugaguaucugugcagguaagucauu

SEQ ID NO: 413373 - RNA, 32 nt, Human
cuuggccugauguuuguccucacaggcaugcc

SEQ ID NO: 413374 - RNA, 32 nt, Human
cuuggccugcagaugcacccuccuggaugaau

SEQ ID NO: 413375 - RNA, 32 nt, Human
cuuggccugcagcaggaggagcagggaucuaa

SEQ ID NO: 413376 - RNA, 32 nt, Human
cuuggccugcaggugcuggagccaccccggca

SEQ ID NO: 413377 - RNA, 32 nt, Human
cuuggccugccugcccgccagccacgcguguc

SEQ ID NO: 413378 - RNA, 32 nt, Human
cuuggccugccuguucuguccuaucuucuuaa

SEQ ID NO: 413379 - RNA, 32 nt, Human
cuuggccugcugugcagugggccuucuguuca

SEQ ID NO: 413380 - RNA, 32 nt, Human
cuuggccuggacaaugaacaggauucaguuuu

SEQ ID NO: 413381 - RNA, 32 nt, Human
cuuggccuggcaguggcuucagagaggaccug

SEQ ID NO: 413382 - RNA, 32 nt, Human
cuuggccuggcgcgguggcucacaccuguaau

SEQ ID NO: 413383 - RNA, 32 nt, Human
cuuggccuguagagacagaccuaggaggcggg

SEQ ID NO: 413384 - RNA, 32 nt, Human
cuuggccuuccagccaugugguaccugcuagg

SEQ ID NO: 413385 - RNA, 32 nt, Human
cuuggccuuccauccucuccccacggcugaug

SEQ ID NO: 413386 - RNA, 32 nt, Human
cuuggccuucuccccucuucugagcuaguugg

SEQ ID NO: 413387 - RNA, 32 nt, Human
cuuggccuugguuccuguuugcacuggcuaca

SEQ ID NO: 413388 - RNA, 32 nt, Human
cuuggcgagccagaacugggaaccccgcggag

SEQ ID NO: 413389 - RNA, 32 nt, Human
cuuggcgcaguggcucacgccuguaaucccag

SEQ ID NO: 413390 - RNA, 32 nt, Human
cuuggcgcauucccacacuccagucuggaucc

SEQ ID NO: 413391 - RNA, 32 nt, Human
cuuggcgcccugagcuaagcaccaggacucac

SEQ ID NO: 413392 - RNA, 32 nt, Human
cuuggcgccgcauccuccucugggcucgcgau

SEQ ID NO: 413393 - RNA, 20 nt, Human
cuuggcggagaggggugugu

SEQ ID NO: 413394 - RNA, 20 nt, Human
cuuggcggcaguaggagcag

SEQ ID NO: 413395 - RNA, 18 nt, Human
cuuggcggcggggugggg

SEQ ID NO: 413396 - RNA, 20 nt, Human
cuuggcgggagaugcuccag

SEQ ID NO: 413397 - RNA, 20 nt, Human
cuuggcgggagggucugcag

SEQ ID NO: 413398 - RNA, 20 nt, Human
cuuggcgggaggguuggacg

SEQ ID NO: 413399 - RNA, 19 nt, Human
cuuggcgggugggcugcag

SEQ ID NO: 413400 - RNA, 18 nt, Human
cuuggcggugaaggucag

SEQ ID NO: 413401 - RNA, 32 nt, Human
cuuggcgucagccucucagguccuccauucac

SEQ ID NO: 413402 - RNA, 32 nt, Human
cuuggcgucaggacacuagggaugaacaugga

SEQ ID NO: 413403 - RNA, 32 nt, Human
cuuggcguccacccugcacagcaucacugaau

SEQ ID NO: 413404 - RNA, 22 nt, Human
cuuggcgugggcgugggcgcgg

SEQ ID NO: 413405 - RNA, 23 nt, Human
cuuggcgugggggcggggcgcgg

SEQ ID NO: 413406 - RNA, 32 nt, Human
cuuggcguggugguucacgccuguaaucccag

SEQ ID NO: 413407 - RNA, 32 nt, Human
cuuggcguuuggcucugugcucucuggccagg

SEQ ID NO: 413408 - RNA, 19 nt, Human
cuuggcuaacauggugaaa

SEQ ID NO: 413409 - RNA, 32 nt, Human
cuuggcuaagaugguccuucugugucuugcaa

SEQ ID NO: 413410 - RNA, 32 nt, Human
cuuggcuaagcaugaguuaagcagcaaaacgc

SEQ ID NO: 413411 - RNA, 32 nt, Human
cuuggcuacaccacucucccagccugugacca

SEQ ID NO: 413412 - RNA, 32 nt, Human
cuuggcuacccaggcaguggugaucuuugaca

SEQ ID NO: 413413 - RNA, 32 nt, Human
cuuggcuauuguccaugcucccagaaucaagc

SEQ ID NO: 413414 - RNA, 32 nt, Human
cuuggcucaagcuguccucuggccucagccuc

SEQ ID NO: 413415 - RNA, 32 nt, Human
cuuggcucaaggcauccucccaccucagcuuc

SEQ ID NO: 413416 - RNA, 32 nt, Human
cuuggcucaagugauucucccaccuuagccuc

SEQ ID NO: 413417 - RNA, 32 nt, Human
cuuggcucacaacugcaaccuccgucucccgg

SEQ ID NO: 413418 - RNA, 32 nt, Human
cuuggcucacagcagccucugccucccggguu

SEQ ID NO: 413419 - RNA, 24 nt, Human
cuuggcucaccacaaccuccaccu

SEQ ID NO: 413420 - RNA, 32 nt, Human
cuuggcucaccacaaccucugccucccggguu

SEQ ID NO: 413421 - RNA, 32 nt, Human
cuuggcucaccacaaccucugccuccuggguu

SEQ ID NO: 413422 - RNA, 20 nt, Human
cuuggcucaccgcaaccucc

SEQ ID NO: 413423 - RNA, 24 nt, Human
cuuggcucaccgcaaccuccaccu

SEQ ID NO: 413424 - RNA, 32 nt, Human
cuuggcucaccgcaaccucugccuaccggguu

SEQ ID NO: 413425 - RNA, 32 nt, Human
cuuggcucaccgcaaccucugccucccugguu

SEQ ID NO: 413426 - RNA, 32 nt, Human
cuuggcucaccgcaaccucugccuccuggguu

SEQ ID NO: 413427 - RNA, 32 nt, Human
cuuggcucaccucaaccucugccucccagguu

SEQ ID NO: 413428 - RNA, 32 nt, Human
cuuggcucacuacaaccucugccucccggguu

SEQ ID NO: 413429 - RNA, 32 nt, Human
cuuggcucacuacaugcuccacugccucccag

SEQ ID NO: 413430 - RNA, 32 nt, Human
cuuggcucacuccaaccuccuccuggguucca

SEQ ID NO: 413431 - RNA, 32 nt, Human
cuuggcucacugaaaccucugccucccgguuc

SEQ ID NO: 413432 - RNA, 32 nt, Human
cuuggcucacugcaaacuccgccuuccagguu

SEQ ID NO: 413433 - RNA, 32 nt, Human
cuuggcucacugcaaacucugccuaccagguu

SEQ ID NO: 413434 - RNA, 32 nt, Human
cuuggcucacugcaaacucugccuuuuggguu

SEQ ID NO: 413435 - RNA, 32 nt, Human
cuuggcucacugcaacauccgccucccggguu

SEQ ID NO: 413436 - RNA, 32 nt, Human
cuuggcucacugcaacaucugacuccuggguu

SEQ ID NO: 413437 - RNA, 32 nt, Human
cuuggcucacugcaaccacugcuuccuggguu

SEQ ID NO: 413438 - RNA, 32 nt, Human
cuuggcucacugcaaccacugucucccggguu

SEQ ID NO: 413439 - RNA, 32 nt, Human
cuuggcucacugcaacccccgccaccuagguu

SEQ ID NO: 413440 - RNA, 32 nt, Human
cuuggcucacugcaacccccgccuccaggguu

SEQ ID NO: 413441 - RNA, 32 nt, Human
cuuggcucacugcaacccucccucccggguuc

SEQ ID NO: 413442 - RNA, 32 nt, Human
cuuggcucacugcaaccucagccucccagguu

SEQ ID NO: 413443 - RNA, 20 nt, Human
cuuggcucacugcaaccucc

SEQ ID NO: 413444 - RNA, 21 nt, Human
cuuggcucacugcaaccucca

SEQ ID NO: 413445 - RNA, 32 nt, Human
cuuugggaggccgaggcgggcagaucacaagg

SEQ ID NO: 413446 - RNA, 32 nt, Human
cuuugggaggccgaggcgggcagaucaccuga

SEQ ID NO: 413447 - RNA, 32 nt, Human
cuuugggaggccgaggcgggcagaucacgagg

SEQ ID NO: 413448 - RNA, 32 nt, Human
cuuugggaggccgaggcgggcagaucacgagu

SEQ ID NO: 413449 - RNA, 32 nt, Human
cuuugggaggccgaggcgggcagaucacuuga

SEQ ID NO: 413450 - RNA, 32 nt, Human
cuuugggaggccgaggcgggcagaucaugagg

SEQ ID NO: 413451 - RNA, 32 nt, Human
cuuugggaggccgagguaggcagaucacgagg

SEQ ID NO: 413452 - RNA, 32 nt, Human
cuuugggaggccgaggugagcagaucaccuga

SEQ ID NO: 413453 - RNA, 32 nt, Human
cuuugggaggccgaggugggaggaucacuuga

SEQ ID NO: 413454 - RNA, 32 nt, Human
cuuugggaggccgaggugggcagaucacaagg

SEQ ID NO: 413455 - RNA, 32 nt, Human
cuuugggaggccgaggugggcagaucacaagu

SEQ ID NO: 413456 - RNA, 32 nt, Human
cuuugggaggccgaggugggcagaucaccgga

SEQ ID NO: 413457 - RNA, 32 nt, Human
cuuugggaggccgaggugggcagaucaccuaa

SEQ ID NO: 413458 - RNA, 32 nt, Human
cuuugggaggccgaggugggcagaucaccuga

SEQ ID NO: 413459 - RNA, 32 nt, Human
cuuugggaggccgaggugggcagaucacgaag

SEQ ID NO: 413460 - RNA, 32 nt, Human
cuuugggaggccgaggugggcagaucacgagg

SEQ ID NO: 413461 - RNA, 32 nt, Human
cuuugggaggccgaggugggcagaucacuuga

SEQ ID NO: 413462 - RNA, 32 nt, Human
cuuugggaggccgaggugggcagaucagcuga

SEQ ID NO: 413463 - RNA, 32 nt, Human
cuuugggaggccgaggugggcagaucaggagg

SEQ ID NO: 413464 - RNA, 32 nt, Human
cuuugggaggccgaggugggcagaucaugagg

SEQ ID NO: 413465 - RNA, 32 nt, Human
cuuugggaggccgaggugggcagaucaugggu

SEQ ID NO: 413466 - RNA, 32 nt, Human
cuuugggaggccgagguuggaggaucacuuga

SEQ ID NO: 413467 - RNA, 32 nt, Human
cuuugggaggccgaugugggcagaucacaagg

SEQ ID NO: 413468 - RNA, 32 nt, Human
cuuugggaggccgugaugggcagaucacuuga

SEQ ID NO: 413469 - RNA, 32 nt, Human
cuuugggaggccuaggcaggcagaucaccuga

SEQ ID NO: 413470 - RNA, 32 nt, Human
cuuugggaggccuaggcgggcagaucaccuga

SEQ ID NO: 413471 - RNA, 32 nt, Human
cuuugggaggccuaggugggcagaucaugagg

SEQ ID NO: 413472 - RNA, 32 nt, Human
cuuugggaggccugaguggauggaucacuuga

SEQ ID NO: 413473 - RNA, 32 nt, Human
cuuugggaggcggaggugagcagaucaccuga

SEQ ID NO: 413474 - RNA, 32 nt, Human
cuuugggaggcuaagacaggcagaucaccuga

SEQ ID NO: 413475 - RNA, 32 nt, Human
cuuugggaggcuaaggcaggcagaucaccuga

SEQ ID NO: 413476 - RNA, 32 nt, Human
cuuugggaggcuaaggcaggcagaucacuuga

SEQ ID NO: 413477 - RNA, 32 nt, Human
cuuugggaggcuaaggugggcagaucacuuga

SEQ ID NO: 413478 - RNA, 32 nt, Human
cuuugggaggcuacggugggcagaucaucuga

SEQ ID NO: 413479 - RNA, 32 nt, Human
cuuugggaggcugaagcaggaggaucacuuga

SEQ ID NO: 413480 - RNA, 32 nt, Human
cuuugggaggcugaagcaggaggauugcuuga

SEQ ID NO: 413481 - RNA, 32 nt, Human
cuuugggaggcugaagcaggcagaucaccuga

SEQ ID NO: 413482 - RNA, 32 nt, Human
cuuugggaggcugaagcggguggaucaccuga

SEQ ID NO: 413483 - RNA, 32 nt, Human
cuuugggaggcugaagcggguggaucaugagg

SEQ ID NO: 413484 - RNA, 32 nt, Human
cuuugggaggcugaagcugaaggaucacuuga

SEQ ID NO: 413485 - RNA, 32 nt, Human
cuuugggaggcugaaguaggaggaucgucuug

SEQ ID NO: 413486 - RNA, 32 nt, Human
cuuugggaggcugaagugggaggaucgcuuga

SEQ ID NO: 413487 - RNA, 32 nt, Human
cuuugggaggcugaagugggcagaucacgagg

SEQ ID NO: 413488 - RNA, 32 nt, Human
cuuugggaggcugaagugggcagauuacuuga

SEQ ID NO: 413489 - RNA, 32 nt, Human
cuuugggaggcugaagugggugaaucacuuga

SEQ ID NO: 413490 - RNA, 32 nt, Human
cuuugggaggcugaaguggguggaucacaagu

SEQ ID NO: 413491 - RNA, 32 nt, Human
cuuugggaggcugaaguggguggaucaccaga

SEQ ID NO: 413492 - RNA, 32 nt, Human
cuuugggaggcugacgugggcagaucaugagg

SEQ ID NO: 413493 - RNA, 32 nt, Human
cuuugggaggcugagaagggcggaucacgagg

SEQ ID NO: 413494 - RNA, 32 nt, Human
cuuugggaggcugagacaggcagaucacuuga

SEQ ID NO: 413495 - RNA, 32 nt, Human
cuuugggaggcugagacaggcggaucacgagg

SEQ ID NO: 413496 - RNA, 32 nt, Human
cuuugggaggcugagacaggcggaucaucuga

SEQ ID NO: 413497 - RNA, 32 nt, Human
cuuugggaggcugagacagguggaucaccuga

SEQ ID NO: 413498 - RNA, 32 nt, Human
cuuugggaggcugagacagguggaucacuuga

SEQ ID NO: 413499 - RNA, 32 nt, Human
cuuugggaggcugagacgggaggaucacauga

SEQ ID NO: 413500 - RNA, 32 nt, Human
cuuugggaggcugagacgggcagaucaccuga

SEQ ID NO: 413501 - RNA, 32 nt, Human
cuuugggaggcugagacgggcggaucacaagg

SEQ ID NO: 413502 - RNA, 32 nt, Human
cuuugggaggcugagacggguggauuaccuga

SEQ ID NO: 413503 - RNA, 32 nt, Human
cuuugggaggcugagaugggaggaucacuuga

SEQ ID NO: 413504 - RNA, 32 nt, Human
cuuugggaggcugagaugggaggaucucuuga

SEQ ID NO: 413505 - RNA, 32 nt, Human
cuuugggaggcugagaugggcagaucacuuga

SEQ ID NO: 413506 - RNA, 32 nt, Human
cuuugggaggcugagcaagguggguggaucac

SEQ ID NO: 413507 - RNA, 32 nt, Human
cuuugggaggcugagcugggcagaucaccuga

SEQ ID NO: 413508 - RNA, 32 nt, Human
cuuugggaggcugaggaaagcagaucacaagg

SEQ ID NO: 413509 - RNA, 32 nt, Human
cuuugggaggcugaggaaggcaaaucacaagg

SEQ ID NO: 413510 - RNA, 32 nt, Human
cuuugggaggcugaggaaggggcaucacuuga

SEQ ID NO: 413511 - RNA, 32 nt, Human
cuuugggaggcugaggacagaggaucacuuga

SEQ ID NO: 413512 - RNA, 32 nt, Human
cuuugggaggcugaggagagcagaucacuuga

SEQ ID NO: 413513 - RNA, 32 nt, Human
cuuugggaggcugaggagggcagaucacuuga

SEQ ID NO: 413514 - RNA, 32 nt, Human
cuuugggaggcugaggaggguggaucacuuga

SEQ ID NO: 413515 - RNA, 32 nt, Human
cuuugggaggcugaggauggaaaaucacuuga

SEQ ID NO: 413516 - RNA, 32 nt, Human
cuuugggaggcugaggcaagaggaucgcuuga

SEQ ID NO: 413517 - RNA, 32 nt, Human
cuuugggaggcugaggcaagaggauuacuuga

SEQ ID NO: 413518 - RNA, 32 nt, Human
cuuugggaggcugaggcaagcggaucauuuga

SEQ ID NO: 413519 - RNA, 32 nt, Human
cuuugggaggcugaggcaaguggaucacuuga

SEQ ID NO: 413520 - RNA, 32 nt, Human
cuuugggaggcugaggcagaaggaucacuuga

SEQ ID NO: 413521 - RNA, 32 nt, Human
cuuugggaggcugaggcagaaggauuaccuga

SEQ ID NO: 413522 - RNA, 32 nt, Human
cuuugggaggcugaggcaggagaaucacuuga

SEQ ID NO: 413523 - RNA, 32 nt, Human
cuuugggaggcugaggcaggaggaggauaacu

SEQ ID NO: 413524 - RNA, 32 nt, Human
cuuugggaggcugaggcaggaggauagcuuga

SEQ ID NO: 413525 - RNA, 32 nt, Human
cuuugggaggcugaggcaggaggaucacucga

SEQ ID NO: 413526 - RNA, 32 nt, Human
cuuugggaggcugaggcaggaggaucacuuga

SEQ ID NO: 413527 - RNA, 32 nt, Human
cuuugggaggcugaggcaggaggaucgcuuga

SEQ ID NO: 413528 - RNA, 32 nt, Human
cuuugggaggcugaggcaggaggauugcuuga

SEQ ID NO: 413529 - RNA, 32 nt, Human
cuuugggaggcugaggcaggaggauuguuuga

SEQ ID NO: 413530 - RNA, 32 nt, Human
cuuugggaggcugaggcaggcagaucacauga

SEQ ID NO: 413531 - RNA, 32 nt, Human
cuuugggaggcugaggcaggcagaucaccuga

SEQ ID NO: 413532 - RNA, 32 nt, Human
cuuugggaggcugaggcaggcagaucacgagg

SEQ ID NO: 413533 - RNA, 32 nt, Human
cuuugggaggcugaggcaggcagaucagcuga

SEQ ID NO: 413534 - RNA, 32 nt, Human
cuuugggaggcugaggcaggcagaucaucuga

SEQ ID NO: 413535 - RNA, 32 nt, Human
cuuugggaggcugaggcaggcagaucaugagg

SEQ ID NO: 413536 - RNA, 32 nt, Human
cuuugggaggcugaggcaggccaaucaccuga

SEQ ID NO: 413537 - RNA, 32 nt, Human
cuuugggaggcugaggcaggcggacacuugag

SEQ ID NO: 413538 - RNA, 32 nt, Human
cuuugggaggcugaggcaggcggaucacaagg

SEQ ID NO: 413539 - RNA, 32 nt, Human
cuuugggaggcugaggcaggcggaucacaggg

SEQ ID NO: 413540 - RNA, 32 nt, Human
cuuugggaggcugaggcaggcggaucaccuga

SEQ ID NO: 413541 - RNA, 32 nt, Human
cuuugggaggcugaggcaggcggaucacgagg

SEQ ID NO: 413542 - RNA, 32 nt, Human
cuuugggaggcugaggcaggcggaucacuuga

SEQ ID NO: 413543 - RNA, 32 nt, Human
cuuugggaggcugaggcaggcggaucaugagg

SEQ ID NO: 413544 - RNA, 32 nt, Human
cuuugggaggcugaggcaggcgggucaccuga

SEQ ID NO: 413545 - RNA, 32 nt, Human
cuuugggaggcugaggcaggcgggucaucuga

SEQ ID NO: 413546 - RNA, 32 nt, Human
cuuugggaggcugaggcaggcugaucacuuga

SEQ ID NO: 413547 - RNA, 32 nt, Human
cuuugggaggcugaggcaggucgaucacgagg

SEQ ID NO: 413548 - RNA, 32 nt, Human
cuuugggaggcugaggcaggugaaucacuugg

SEQ ID NO: 413549 - RNA, 32 nt, Human
cuuugggaggcugaggcagguggaucacaagg

SEQ ID NO: 413550 - RNA, 32 nt, Human
cuuugggaggcugaggcagguggaucacaaug

SEQ ID NO: 413551 - RNA, 32 nt, Human
cuuugggaggcugaggcagguggaucaccuca

SEQ ID NO: 413552 - RNA, 32 nt, Human
cuuugggaggcugaggcagguggaucaccuga

SEQ ID NO: 413553 - RNA, 32 nt, Human
cuuugggaggcugaggcagguggaucacgagg

SEQ ID NO: 413554 - RNA, 32 nt, Human
cuuugggaggcugaggcagguggaucacugga

SEQ ID NO: 413555 - RNA, 32 nt, Human
cuuugggaggcugaggcagguggaucacuuga

SEQ ID NO: 413556 - RNA, 32 nt, Human
cuuugggaggcugaggcagguggaucgccuga

SEQ ID NO: 413557 - RNA, 32 nt, Human
cuuugggaggcugaggcagguggcucacuuga

SEQ ID NO: 413558 - RNA, 32 nt, Human
cuuugggaggcugaggcaggugguucacugga

SEQ ID NO: 413559 - RNA, 32 nt, Human
cuuugggaggcugaggccggaggauugcuuga

SEQ ID NO: 413560 - RNA, 32 nt, Human
cuuugggaggcugaggccggcagaucacuuga

SEQ ID NO: 413561 - RNA, 32 nt, Human
cuuugggaggcugaggccgguggaucaccugg

SEQ ID NO: 413562 - RNA, 32 nt, Human
cuuugggaggcugaggcgagaggaucacuuga

SEQ ID NO: 413563 - RNA, 32 nt, Human
cuuugggaggcugaggcgaguggaucacaagg

SEQ ID NO: 413564 - RNA, 32 nt, Human
cuuugggaggcugaggcgcguggaucaccuga

SEQ ID NO: 413565 - RNA, 32 nt, Human
cuuugggaggcugaggcggauggaucaccuga

SEQ ID NO: 413566 - RNA, 32 nt, Human
cuuugggaggcugaggcggauggaucacgagg

SEQ ID NO: 413567 - RNA, 32 nt, Human
cuuugggaggcugaggcggccggaucacaagg

SEQ ID NO: 413568 - RNA, 32 nt, Human
cuuugggaggcugaggcgggaggaucaauuga

SEQ ID NO: 413569 - RNA, 32 nt, Human
cuuugggaggcugaggcgggaggaucacaagg

SEQ ID NO: 413570 - RNA, 32 nt, Human
cuuugggaggcugaggcgggaggaucgcuuga

SEQ ID NO: 413571 - RNA, 32 nt, Human
cuuugggaggcugaggcgggaggauugcuuga

SEQ ID NO: 413572 - RNA, 32 nt, Human
cuuugggaggcugaggcgggcagaucaacugg

SEQ ID NO: 413573 - RNA, 32 nt, Human
cuuugggaggcugaggcgggcagaucacaaga

SEQ ID NO: 413574 - RNA, 32 nt, Human
cuuugggaggcugaggcgggcagaucacaagg

SEQ ID NO: 413575 - RNA, 32 nt, Human
cuuugggaggcugaggcgggcagaucaccaga

SEQ ID NO: 413576 - RNA, 32 nt, Human
cuuugggaggcugaggcgggcagaucaccuga

SEQ ID NO: 413577 - RNA, 32 nt, Human
cuuugggaggcugaggcgggcagaucacgaag

SEQ ID NO: 413578 - RNA, 32 nt, Human
cuuugggaggcugaggcgggcagaucacgagg

SEQ ID NO: 413579 - RNA, 32 nt, Human
cuuugggaggcugaggcgggcagaucauucaa

SEQ ID NO: 413580 - RNA, 32 nt, Human
cuuugggaggcugaggcgggcgaaucauuuga

SEQ ID NO: 413581 - RNA, 32 nt, Human
cuuugggaggcugaggcgggcggaacaccuga

SEQ ID NO: 413582 - RNA, 32 nt, Human
cuuugggaggcugaggcgggcggaucacaagg

SEQ ID NO: 413583 - RNA, 32 nt, Human
cuuugggaggcugaggcgggcggaucaccuga

SEQ ID NO: 413584 - RNA, 32 nt, Human
cuuugggaggcugaggcgggcggaucacgagg

SEQ ID NO: 413585 - RNA, 32 nt, Human
cuuugggaggcugaggcgggcggaucacuagg

SEQ ID NO: 413586 - RNA, 32 nt, Human
cuuugggaggcugaggcgggcggaucaugagg

SEQ ID NO: 413587 - RNA, 32 nt, Human
cuuugggaggcugaggcggggagaucacaagg

SEQ ID NO: 413588 - RNA, 32 nt, Human
cuuugggaggcugaggcggguagaucacaagg

SEQ ID NO: 413589 - RNA, 32 nt, Human
cuuugggaggcugaggcgggugaaucacgagg

SEQ ID NO: 413590 - RNA, 32 nt, Human
cuuugggaggcugaggcgggugaaucaugagg

SEQ ID NO: 413591 - RNA, 32 nt, Human
cuuugggaggcugaggcggguggaacaccuga

SEQ ID NO: 413592 - RNA, 32 nt, Human
cuuugggaggcugaggcggguggaucaagagg

SEQ ID NO: 413593 - RNA, 32 nt, Human
cuuugggaggcugaggcggguggaucacaagc

SEQ ID NO: 413594 - RNA, 32 nt, Human
cuuugggaggcugaggcggguggaucacaagg

SEQ ID NO: 413595 - RNA, 32 nt, Human
cuuugggaggcugaggcggguggaucaccuaa

SEQ ID NO: 413596 - RNA, 32 nt, Human
cuuugggaggcugaggcggguggaucaccuga

SEQ ID NO: 413597 - RNA, 32 nt, Human
cuuugggaggcugaggcggguggaucacgagg

SEQ ID NO: 413598 - RNA, 32 nt, Human
cuuugggaggcugaggcggguggaucacuagg

SEQ ID NO: 413599 - RNA, 32 nt, Human
cuuugggaggcugaggcggguggaucacuuga

SEQ ID NO: 413600 - RNA, 32 nt, Human
cuuugggaggcugaggcggguggaucaucugg

SEQ ID NO: 413601 - RNA, 32 nt, Human
cuuugggaggcugaggcggguggaucaugagg

SEQ ID NO: 413602 - RNA, 32 nt, Human
cuuugggaggcugaggcggguggaucugcuga

SEQ ID NO: 413603 - RNA, 32 nt, Human
cuuugggaggcugaggcgggugggucaccuga

SEQ ID NO: 413604 - RNA, 32 nt, Human
cuuugggaggcugaggcggguugaucaccuga

SEQ ID NO: 413605 - RNA, 32 nt, Human
cuuugggaggcugaggcggucagaucaccaga

SEQ ID NO: 413606 - RNA, 32 nt, Human
cuuugggaggcugaggcuggagaaucgcuuga

SEQ ID NO: 413607 - RNA, 32 nt, Human
cuuugggaggcugaggcuggagaaucguuuga

SEQ ID NO: 413608 - RNA, 32 nt, Human
cuuugggaggcugaggcuggcagaucacuuga

SEQ ID NO: 413609 - RNA, 32 nt, Human
cuuugggaggcugaggcuggcgaaucaccaga

SEQ ID NO: 413610 - RNA, 32 nt, Human
cuuugggaggcugaggcuggcguaucaccuga

SEQ ID NO: 413611 - RNA, 32 nt, Human
cuuugggaggcugaggcugggggaucaccuga

SEQ ID NO: 413612 - RNA, 32 nt, Human
cuuugggaggcugagggaggcggaucacuuga

SEQ ID NO: 413613 - RNA, 32 nt, Human
cuuugggaggcugaggggguggaucaccugag

SEQ ID NO: 413614 - RNA, 32 nt, Human
cuuugggaggcugagguaggaggaucacguga

SEQ ID NO: 413615 - RNA, 32 nt, Human
cuuugggaggcugagguaggaggaucgcuuga

SEQ ID NO: 413616 - RNA, 32 nt, Human
cuuugggaggcugagguaggaggauugauuga

SEQ ID NO: 413617 - RNA, 32 nt, Human
cuuugggaggcugagguaggcagaucacuuga

SEQ ID NO: 413618 - RNA, 32 nt, Human
cuuugggaggcugagguagguggaucacccaa

SEQ ID NO: 413619 - RNA, 32 nt, Human
cuuugggaggcugagguagguggaucaugagg

SEQ ID NO: 413620 - RNA, 32 nt, Human
cuuugggaggcugaggucaggaguuugagauc

SEQ ID NO: 413621 - RNA, 32 nt, Human
cuuugggaggcugaggugagaggaucgcuuga

SEQ ID NO: 413622 - RNA, 32 nt, Human
cuuugggaggcugaggugagagggucacuuga

SEQ ID NO: 413623 - RNA, 32 nt, Human
cuuugggaggcugaggugaguggauuacaagg

SEQ ID NO: 413624 - RNA, 32 nt, Human
cuuugggaggcugagguggaaggaucgcuuga

SEQ ID NO: 413625 - RNA, 32 nt, Human
cuuugggaggcugagguggacagaucacgagg

SEQ ID NO: 413626 - RNA, 32 nt, Human
cuuugggaggcugagguggacggaucacgagg

SEQ ID NO: 413627 - RNA, 32 nt, Human
cuuugggaggcugaggugggaggaucccuuga

SEQ ID NO: 413628 - RNA, 32 nt, Human
cuuugggaggcugaggugggaggaucgcuuga

SEQ ID NO: 413629 - RNA, 32 nt, Human
cuuugggaggcugaggugggaggauugcuuga

SEQ ID NO: 413630 - RNA, 32 nt, Human
cuuugggaggcugaggugggagggucgcuuga

SEQ ID NO: 413631 - RNA, 32 nt, Human
cuuugggaggcugaggugggcaaaucaccuga

SEQ ID NO: 413632 - RNA, 32 nt, Human
cuuugggaggcugaggugggcagaucaacuga

SEQ ID NO: 413633 - RNA, 32 nt, Human
cuuugggaggcugaggugggcagaucacaagg

SEQ ID NO: 413634 - RNA, 32 nt, Human
cuuugggaggcugaggugggcagaucaccuag

SEQ ID NO: 413635 - RNA, 32 nt, Human
cuuugggaggcugaggugggcagaucaccuga

SEQ ID NO: 413636 - RNA, 32 nt, Human
cuuugggaggcugaggugggcagaucacgaga

SEQ ID NO: 413637 - RNA, 32 nt, Human
cuuugggaggcugaggugggcagaucacgagc

SEQ ID NO: 413638 - RNA, 32 nt, Human
cuuugggaggcugaggugggcagaucacgagg

SEQ ID NO: 413639 - RNA, 32 nt, Human
cuuugggaggcugaggugggcagaucacuuga

SEQ ID NO: 413640 - RNA, 32 nt, Human
cuuugggaggcugaggugggcagaucauuuga

SEQ ID NO: 413641 - RNA, 32 nt, Human
cuuugggaggcugaggugggcaggucauuuga

SEQ ID NO: 413642 - RNA, 32 nt, Human
cuuugggaggcugaggugggcauaucaccuga

SEQ ID NO: 413643 - RNA, 32 nt, Human
cuuugggaggcugaggugggcgaaucacaagg

SEQ ID NO: 413644 - RNA, 32 nt, Human
cuuugggaggcugaggugggcgcaucaccuga

SEQ ID NO: 413645 - RNA, 32 nt, Human
cuuugggaggcugaggugggcggaucaccuga

SEQ ID NO: 413646 - RNA, 32 nt, Human
cuuugggaggcugaggugggcggaucacgagg

SEQ ID NO: 413647 - RNA, 32 nt, Human
cuuugggaggcugaggugggcggaucacuuga

SEQ ID NO: 413648 - RNA, 32 nt, Human
cuuugggaggcugaggugggcggcucacgagg

SEQ ID NO: 413649 - RNA, 32 nt, Human
cuuugggaggcugagguggguagauuacuuga

SEQ ID NO: 413650 - RNA, 32 nt, Human
cuuugggaggcugagguggguggaccacuuga

SEQ ID NO: 413651 - RNA, 32 nt, Human
cuuugggaggcugagguggguggaucacaagg

SEQ ID NO: 413652 - RNA, 32 nt, Human
cuuugggaggcugagguggguggaucacaggu

SEQ ID NO: 413653 - RNA, 32 nt, Human
cuuugggaggcugagguggguggaucaccuaa

SEQ ID NO: 413654 - RNA, 32 nt, Human
cuuugggaggcugagguggguggaucaccuga

SEQ ID NO: 413655 - RNA, 32 nt, Human
cuuugggaggcugagguggguggaucacgagg

SEQ ID NO: 413656 - RNA, 32 nt, Human
cuuugggaggcugagguggguggaucacugga

SEQ ID NO: 413657 - RNA, 32 nt, Human
cuuugggaggcugagguggguggaucacuggg

SEQ ID NO: 413658 - RNA, 32 nt, Human
cuuugggaggcugagguggguggaucacuuga

SEQ ID NO: 413659 - RNA, 32 nt, Human
cuuugggaggcugagguggguggaucaucuga

SEQ ID NO: 413660 - RNA, 32 nt, Human
cuuugggaggcugagguggguggaucaugagg

SEQ ID NO: 413661 - RNA, 32 nt, Human
cuuugggaggcugagguggguggaucaugcgg

SEQ ID NO: 413662 - RNA, 32 nt, Human
cuuugggaggcugagguggguggaucauuuga

SEQ ID NO: 413663 - RNA, 32 nt, Human
cuuugggaggcugagguggguggcuuacaggg

SEQ ID NO: 413664 - RNA, 32 nt, Human
cuuugggaggcugagguggguguaucaccuga

SEQ ID NO: 413665 - RNA, 32 nt, Human
cuuugggaggcugagguggguguaucacuuga

SEQ ID NO: 413666 - RNA, 32 nt, Human
cuuugggaggcugagguggucagaucaccuaa

SEQ ID NO: 413667 - RNA, 32 nt, Human
cuuugggaggcugagucgggaggauagcguga

SEQ ID NO: 413668 - RNA, 32 nt, Human
cuuugggaggcugagucgggcggaucacauga

SEQ ID NO: 413669 - RNA, 32 nt, Human
cuuugggaggcugaguugggcggaucacuuga

SEQ ID NO: 413670 - RNA, 32 nt, Human
cuuugggaggcugaugcgggcggaucacaagg

SEQ ID NO: 413671 - RNA, 32 nt, Human
cuuugggaggcugcagcggguggaucacuuga

SEQ ID NO: 413672 - RNA, 32 nt, Human
cuuugggaggcugcggcaggcggaucacuuga

SEQ ID NO: 413673 - RNA, 32 nt, Human
cuuugggaggcugcggcgggcggaucaccuga

SEQ ID NO: 413674 - RNA, 32 nt, Human
cuuugggaggcuggggcgagaggauugcuuga

SEQ ID NO: 413675 - RNA, 32 nt, Human
cuuugggaggcuggggcgagcggaucaugagg

SEQ ID NO: 413676 - RNA, 32 nt, Human
cuuugggaggcuguggcagguggaucaccuga

SEQ ID NO: 413677 - RNA, 32 nt, Human
cuuugggagggcgaggcuagcagaucacuuga

SEQ ID NO: 413678 - RNA, 32 nt, Human
cuuugggagggggaggcaggcagaucacgacg

SEQ ID NO: 413679 - RNA, 32 nt, Human
cuuugggagggggaggcaggcagaucacgaug

SEQ ID NO: 413680 - RNA, 32 nt, Human
cuuugggagggugaggugggaggaucaccuga

SEQ ID NO: 413681 - RNA, 32 nt, Human
cuuugggagggugggggcagggcgggaucaac

SEQ ID NO: 413682 - RNA, 32 nt, Human
cuuugggagguagaggcaggcagaucacgagg

SEQ ID NO: 413683 - RNA, 32 nt, Human
cuuugggaggucgaggcaggcagaucaccuga

SEQ ID NO: 413684 - RNA, 32 nt, Human
cuuugggaggucgaggcgggcagaucacuuga

SEQ ID NO: 413685 - RNA, 32 nt, Human
cuuugggaggucgagguaggcagaucaccgag

SEQ ID NO: 413686 - RNA, 32 nt, Human
cuuugggaggucgaggugggcagaucaccuga

SEQ ID NO: 413687 - RNA, 32 nt, Human
cuuugggagguggguggaucaccugaggucgg

SEQ ID NO: 413688 - RNA, 32 nt, Human
cuuugggaugcugaagugagaggaucccauga

SEQ ID NO: 413689 - RNA, 32 nt, Human
cuuugggauggacuggaggagcgcagcgucca

SEQ ID NO: 413690 - RNA, 32 nt, Human
cuuugggauucugaggugggaggaucaugagg

SEQ ID NO: 413691 - RNA, 22 nt, Human
cuuugggcaaaggcccccucua

SEQ ID NO: 413692 - RNA, 32 nt, Human
cuuugggcaggggagcucggaggcucaggaug

SEQ ID NO: 413693 - RNA, 21 nt, Human
cuuugggcaucucuucugccu

SEQ ID NO: 413694 - RNA, 32 nt, Human
cuuugggccacuguucaggguacugaccauca

SEQ ID NO: 413695 - RNA, 19 nt, Human
cuuugggccuggucucugc

SEQ ID NO: 413696 - RNA, 32 nt, Human
cuuugggcucagugaagagucuggaguuuauc

SEQ ID NO: 413697 - RNA, 23 nt, Human
cuuugggcugaagcaccccacua

SEQ ID NO: 413698 - RNA, 32 nt, Human
cuuugggcuggcugcccuugcaaagcagcugg

SEQ ID NO: 413699 - RNA, 32 nt, Human
cuuugggcugggauggcaguggggcauaaugg

SEQ ID NO: 413700 - RNA, 18 nt, Human
cuuugggcuggggccaug

SEQ ID NO: 413701 - RNA, 32 nt, Human
cuuugggcugggggccucucuccugggucagg

SEQ ID NO: 413702 - RNA, 32 nt, Human
cuuuggggaaagaauuaggaagggucagaacc

SEQ ID NO: 413703 - RNA, 32 nt, Human
cuuuggggaagagagcucacuccccaugcggg

SEQ ID NO: 413704 - RNA, 21 nt, Human
cuuuggggacacccuccugcc

SEQ ID NO: 413705 - RNA, 32 nt, Human
cuuuggggagaaaaguauucaggaagugggug

SEQ ID NO: 413706 - RNA, 32 nt, Human
cuuuggggaggcagucacaggagugaggugca

SEQ ID NO: 413707 - RNA, 24 nt, Human
cuuuggggauugcauuuccugccu

SEQ ID NO: 413708 - RNA, 32 nt, Human
cuuuggggcccgaggaauuucagaccugaaca

SEQ ID NO: 413709 - RNA, 32 nt, Human
cuuugggggaaaggaaaaggcuuaccaggcug

SEQ ID NO: 413710 - RNA, 32 nt, Human
cuuugggggacaguaagucugggcccagcuuc

SEQ ID NO: 413711 - RNA, 32 nt, Human
cuuugggggaguaagaaugugugugcagaauu

SEQ ID NO: 413712 - RNA, 32 nt, Human
cuuugggggauggagucucaggguggcagagg

SEQ ID NO: 413713 - RNA, 20 nt, Human
cuuuggggggccuccugccu

SEQ ID NO: 413714 - RNA, 32 nt, Human
cuuugggggugcccugggaucccugggguagu

SEQ ID NO: 413715 - RNA, 32 nt, Human
cuuuggggguguucauggggccuggacuugca

SEQ ID NO: 413716 - RNA, 32 nt, Human
cuuuggggguuauuuaaugaaaaacaugcuau

SEQ ID NO: 413717 - RNA, 27 nt, Human
cuuuggggucuucuccaccaccugucu

SEQ ID NO: 413718 - RNA, 32 nt, Human
cuuuggggugggacuugcccugagcuuggagc

SEQ ID NO: 413719 - RNA, 32 nt, Human
cuuugggguuccauuuaggagcuuucuagaaa

SEQ ID NO: 413720 - RNA, 19 nt, Human
cuuugggguuuccugucug

SEQ ID NO: 413721 - RNA, 20 nt, Human
cuuugggguuuugccuguuu

SEQ ID NO: 413722 - RNA, 32 nt, Human
cuuuggguaaacuaaagaaagauaaaguauac

SEQ ID NO: 413723 - RNA, 32 nt, Human
cuuugggucucaauuuugccuucccuaaugaa

SEQ ID NO: 413724 - RNA, 32 nt, Human
cuuugggugagaaguugaagagucgggauaga

SEQ ID NO: 413725 - RNA, 32 nt, Human
cuuuggguggagccaccacuuccaguucugau

SEQ ID NO: 413726 - RNA, 32 nt, Human
cuuuggguggcugaggugagaggaucacuuga

SEQ ID NO: 413727 - RNA, 32 nt, Human
cuuugggugggacucuaagcaguauuugcaga

SEQ ID NO: 413728 - RNA, 32 nt, Human
cuuuggguguaggagggggugggcaggggaca

SEQ ID NO: 413729 - RNA, 32 nt, Human
cuuuggguguccaagagaaaugguuuuugcca

SEQ ID NO: 413730 - RNA, 19 nt, Human
cuuuggguucuuucugccu

SEQ ID NO: 413731 - RNA, 32 nt, Human
cuuugguagcagcucccugccuccagggcuuc

SEQ ID NO: 413732 - RNA, 32 nt, Human
cuuugguagcuggugggacugacgccuucuuc

SEQ ID NO: 413733 - RNA, 32 nt, Human
cuuugguaggcaaaggugggaggaucauuuga

SEQ ID NO: 413734 - RNA, 32 nt, Human
cuuugguaggccaagacaagcagaucacuuga

SEQ ID NO: 413735 - RNA, 32 nt, Human
cuuugguagguguuuugcuauuacagacagug

SEQ ID NO: 413736 - RNA, 32 nt, Human
cuuugguauuaaguggcaauuagaugaaacaa

SEQ ID NO: 413737 - RNA, 32 nt, Human
cuuuggucagcaccugcuuucucagacuugcc

SEQ ID NO: 413738 - RNA, 32 nt, Human
cuuuggucaggaguucaagaccacccuggcca

SEQ ID NO: 413739 - RNA, 32 nt, Human
cuuuggucaguaggaggcuggauuggaguggu

SEQ ID NO: 413740 - RNA, 32 nt, Human
cuuuggucauguugagguacaguuugcauagg

SEQ ID NO: 413741 - RNA, 32 nt, Human
cuuugguccccucacauuuggccagaggcaua

SEQ ID NO: 413742 - RNA, 32 nt, Human
cuuugguccuucuccuaaacccuucaguggcu

SEQ ID NO: 413743 - RNA, 32 nt, Human
cuuuggucuagcuuaagacucuggguggggca

SEQ ID NO: 413744 - RNA, 32 nt, Human
cuuuggucucaaagcaaauugcucugaucaga

SEQ ID NO: 413745 - RNA, 32 nt, Human
cuuuggucuccucuggucuaucagcucccauc

SEQ ID NO: 413746 - RNA, 26 nt, Human
cuuuggucuccuuuccccuccugucu

SEQ ID NO: 413747 - RNA, 32 nt, Human
cuuuggucuggguuguguggcuuuugggggau

SEQ ID NO: 413748 - RNA, 32 nt, Human
cuuuggugagcagcagcccuggggucacagac

SEQ ID NO: 413749 - RNA, 32 nt, Human
cuuuggugcagcucgccagggaugagaggcac

SEQ ID NO: 413750 - RNA, 32 nt, Human
cuuuggugcccaggccaaguagaaugagauga

SEQ ID NO: 413751 - RNA, 32 nt, Human
cuuuggugccugugcuauaagcagcagauuuu

SEQ ID NO: 413752 - RNA, 32 nt, Human
cuuuggugcuucugccuuuaguuuuaggacac

SEQ ID NO: 413753 - RNA, 32 nt, Human
cuuugguggcagcacgcccugccuuguggagc

SEQ ID NO: 413754 - RNA, 32 nt, Human
cuuugguggccccuccccaacuccuuccucuu

SEQ ID NO: 413755 - RNA, 32 nt, Human
cuuugguggucuuccuguggucuucccuuccc

SEQ ID NO: 413756 - RNA, 23 nt, Human
cuuuggugucccccucccaaggg

SEQ ID NO: 413757 - RNA, 32 nt, Human
cuuuggugucucagagaaggagucuaggucuu

SEQ ID NO: 413758 - RNA, 32 nt, Human
cuuuggugucucaguggccucuugcuuauucc

SEQ ID NO: 413759 - RNA, 32 nt, Human
cuuugguucucugcugugccugccuguguccu

SEQ ID NO: 413760 - RNA, 19 nt, Human
cuuugguugcaccuccugc

SEQ ID NO: 413761 - RNA, 32 nt, Human
cuuuguaaauagcaguucacauuuuuccacag

SEQ ID NO: 413762 - RNA, 32 nt, Human
cuuuguaacccagccaccaccaaaaagcaaac

SEQ ID NO: 413763 - RNA, 32 nt, Human
cuuuguaacccaggcuggaaugcaauggcaug

SEQ ID NO: 413764 - RNA, 32 nt, Human
cuuuguaaccucagugcuggggacugaggcga

SEQ ID NO: 413765 - RNA, 32 nt, Human
cuuuguaagaacaccaaccaaccaagguuuaa

SEQ ID NO: 413766 - RNA, 32 nt, Human
cuuuguaauaugccacugugaguacugacauu

SEQ ID NO: 413767 - RNA, 32 nt, Human
cuuuguacaggaaauauugcccaaugacuagu

SEQ ID NO: 413768 - RNA, 32 nt, Human
cuuuguacauucaggagcugcagagaggaaag

SEQ ID NO: 413769 - RNA, 32 nt, Human
cuuuguacccuguuccuuccucugcgcccucc

SEQ ID NO: 413770 - RNA, 32 nt, Human
cuuuguaccugcaagugccaucuuuaaggggg

SEQ ID NO: 413771 - RNA, 32 nt, Human
cuuuguacugccucucccgccuguggccaaag

SEQ ID NO: 413772 - RNA, 32 nt, Human
cuuuguacuuacugcccugccugugacaguug

SEQ ID NO: 413773 - RNA, 32 nt, Human
cuuuguacuucugcuuuuuauucuuccucaag

SEQ ID NO: 413774 - RNA, 32 nt, Human
cuuuguagaagcaggagcaagaguguuuggcu

SEQ ID NO: 413775 - RNA, 32 nt, Human
cuuuguagaugugaaugguacuauucaacgga

SEQ ID NO: 413776 - RNA, 32 nt, Human
cuuuguagccaucaacccgagugcaguuucga

SEQ ID NO: 413777 - RNA, 32 nt, Human
cuuuguaggaagagacacaguccugcagccuc

SEQ ID NO: 413778 - RNA, 21 nt, Human
cuuuguaggcaccuucugcuu

SEQ ID NO: 413779 - RNA, 32 nt, Human
cuuuguagggaaggcccugaugaccaguaacu

SEQ ID NO: 413780 - RNA, 32 nt, Human
cuuuguagggacguggauaaagguggaaacca

SEQ ID NO: 413781 - RNA, 32 nt, Human
cuuuguagguagacggagccacacuacaggca

SEQ ID NO: 413782 - RNA, 32 nt, Human
cuuuguaggucugcccaggguugacuccacca

SEQ ID NO: 413783 - RNA, 32 nt, Human
cuuuguagguucugggcuggguugugggggac

SEQ ID NO: 413784 - RNA, 32 nt, Human
cuuuguagugcuuggcuacucugugauggcag

SEQ ID NO: 413785 - RNA, 32 nt, Human
cuuuguauaaacacauucuuucugguacauuc

SEQ ID NO: 413786 - RNA, 32 nt, Human
cuuuguauguucucugagccuuaguugauuuu

SEQ ID NO: 413787 - RNA, 32 nt, Human
cuuuguauucuauuaagaaauagcuccuaagg

SEQ ID NO: 413788 - RNA, 32 nt, Human
cuuuguauugcaccucagauaaugugcuuuuu

SEQ ID NO: 413789 - RNA, 32 nt, Human
cuuuguauuuaacucuccaugugucauuccua

SEQ ID NO: 413790 - RNA, 32 nt, Human
cuuuguauuuaugacuaaaucuucccauucug

SEQ ID NO: 413791 - RNA, 32 nt, Human
cuuuguauuucucuguuaagcaaagaaauauu

SEQ ID NO: 413792 - RNA, 32 nt, Human
cuuuguauuugcuauuccucaucccagaauca

SEQ ID NO: 413793 - RNA, 32 nt, Human
cuuuguauuuuugcuccuaauuuuggacucag

SEQ ID NO: 413794 - RNA, 22 nt, Human
cuuugucaaaggcaagucucca

SEQ ID NO: 413795 - RNA, 32 nt, Human
cuuugucaaaggcaagucuccacccauaaccg

SEQ ID NO: 413796 - RNA, 32 nt, Human
cuuugucaacccacaagaagagagaugugcag

SEQ ID NO: 413797 - RNA, 31 nt, Human
cuuugucaagugucugcuccacgucaggcac

SEQ ID NO: 413798 - RNA, 32 nt, Human
cuuugucaccaggcuggagugcaguggugcaa

SEQ ID NO: 413799 - RNA, 32 nt, Human
cuuugucacccacgcuggaaugcaguggcggg

SEQ ID NO: 413800 - RNA, 32 nt, Human
cuuugucacccaggccggagugcaguggcaug

SEQ ID NO: 413801 - RNA, 32 nt, Human
cuuugucacccaggcuagagugcaguggcaug

SEQ ID NO: 413802 - RNA, 32 nt, Human
cuuugucacccaggcuagagugcaguggugca

SEQ ID NO: 413803 - RNA, 32 nt, Human
cuuugucacccaggcuggaaugcaguggcaca

SEQ ID NO: 413804 - RNA, 32 nt, Human
cuuugucacccaggcuggaguacaguggcgug

SEQ ID NO: 413805 - RNA, 32 nt, Human
cuuugucacccaggcuggaguauaguggcaca

SEQ ID NO: 413806 - RNA, 32 nt, Human
cuuugucacccaggcuggagugcaauggcaca

SEQ ID NO: 413807 - RNA, 32 nt, Human
cuuugucacccaggcuggagugcaauggcgug

SEQ ID NO: 413808 - RNA, 32 nt, Human
cuuugucacccaggcuggagugcaguggcacg

SEQ ID NO: 413809 - RNA, 32 nt, Human
cuuugucacccaggcuggagugcaguggugug

SEQ ID NO: 413810 - RNA, 32 nt, Human
cuuugucacccaggcuggagugcagugucgug

SEQ ID NO: 413811 - RNA, 32 nt, Human
cuuugucacccaggcuggagugcugugguguu

SEQ ID NO: 413812 - RNA, 32 nt, Human
cuuugucacccaggggcuugcuuugucacgca

SEQ ID NO: 413813 - RNA, 32 nt, Human
cuuugucacccaggguggugugcaguggagcu

SEQ ID NO: 413814 - RNA, 32 nt, Human
cuuugucacccaugcuggaguacaauggcaca

SEQ ID NO: 413815 - RNA, 32 nt, Human
cuuugucaccuaagcuggagugcagugcgcga

SEQ ID NO: 413816 - RNA, 32 nt, Human
cuuugucaccuaggcuggcauguaguggcaug

SEQ ID NO: 413817 - RNA, 32 nt, Human
cuuugucacgcaggcuagagugcaguggcgca

SEQ ID NO: 413818 - RNA, 32 nt, Human
cuuugucacuuugauucccacucugagaaguu

SEQ ID NO: 413819 - RNA, 32 nt, Human
cuuugucagacuccugccggcagcugcccugg

SEQ ID NO: 413820 - RNA, 32 nt, Human
cuuugucagccaggcuggagugcaaugugcaa

SEQ ID NO: 413821 - RNA, 32 nt, Human
cuuugucagccaggcuggagugcagugacacg

SEQ ID NO: 413822 - RNA, 32 nt, Human
cuuugucauuccaccuccucuggucaggcgag

SEQ ID NO: 413823 - RNA, 32 nt, Human
cuuuguccacuggguaaauuauauucauuaug

SEQ ID NO: 413824 - RNA, 32 nt, Human
cuuuguccaguggaauuggugauucugaauug

SEQ ID NO: 413825 - RNA, 32 nt, Human
cuuugucccaucaggacccuccugccuccucu

SEQ ID NO: 413826 - RNA, 32 nt, Human
cuuugucccaugcagaggugcagagauucauu

SEQ ID NO: 413827 - RNA, 32 nt, Human
cuuugucccccaggcuggagugcagugguaca

SEQ ID NO: 413828 - RNA, 32 nt, Human
cuuugucccccaggcuggagugcgauggcagg

SEQ ID NO: 413829 - RNA, 32 nt, Human
cuuugucccuacucucuguucuuacacccccu

SEQ ID NO: 413830 - RNA, 32 nt, Human
cuuugucccugcacucagcccuguggccccuu

SEQ ID NO: 413831 - RNA, 31 nt, Human
cuuuguccucaaagaaauuguugaaaaagaa

SEQ ID NO: 413832 - RNA, 32 nt, Human
cuuuguccucaguaucucuucgggguacaguu

SEQ ID NO: 413833 - RNA, 32 nt, Human
cuuuguccuccaggaggugggggaauguggua

SEQ ID NO: 413834 - RNA, 32 nt, Human
cuuuguccuccuccucuccaccccgccucccc

SEQ ID NO: 413835 - RNA, 32 nt, Human
cuuuguccugguuuccccuugagacuggggau

SEQ ID NO: 413836 - RNA, 32 nt, Human
cuuuguccuugcugcugguggggaagggaagc

SEQ ID NO: 413837 - RNA, 32 nt, Human
cuuugucgcccaggccggagugcaguggugcg

SEQ ID NO: 413838 - RNA, 32 nt, Human
cuuugucgcccaggcuggagcgcagucccgca

SEQ ID NO: 413839 - RNA, 32 nt, Human
cuuugucgcccaggcuggaguacaguggugcg

SEQ ID NO: 413840 - RNA, 32 nt, Human
cuuugucgcccaggcuggagugcaaugcacga

SEQ ID NO: 413841 - RNA, 32 nt, Human
cuuugucgcccaggcuggagugcaauggcgug

SEQ ID NO: 413842 - RNA, 32 nt, Human
cuuugucgcccaggcuggagugcaguggcaca

SEQ ID NO: 413843 - RNA, 32 nt, Human
cuuugucgcccaggcuggagugcaguggcacg

SEQ ID NO: 413844 - RNA, 32 nt, Human
cuuugucgcccaggcuggagugcaguggcagu

SEQ ID NO: 413845 - RNA, 32 nt, Human
cuuugucgcccaggcuggagugcaguggcgug

SEQ ID NO: 413846 - RNA, 32 nt, Human
cuuugucgcccaggcuggagugcaguggugug

SEQ ID NO: 413847 - RNA, 32 nt, Human
cuuugucgcccgggcaggagugcaguggcuca

SEQ ID NO: 413848 - RNA, 32 nt, Human
cuuugucgcccuggcuggagugcaguugcgca

SEQ ID NO: 413849 - RNA, 32 nt, Human
cuuugucgccgccuccccugugugccagcccu

SEQ ID NO: 413850 - RNA, 32 nt, Human
cuuugucuacaccauuaugugcgcugauaagc

SEQ ID NO: 413851 - RNA, 32 nt, Human
cuuugucuaggguucucagaugcuaucugccg

SEQ ID NO: 413852 - RNA, 32 nt, Human
cuuugucucaaaaagaaagaaagaaagaaaga

SEQ ID NO: 413853 - RNA, 32 nt, Human
cuuugucucacagaagacuaggagaaagaucu

SEQ ID NO: 413854 - RNA, 32 nt, Human
cuuugucucacaugauuccagugcaguagugc

SEQ ID NO: 413855 - RNA, 32 nt, Human
cuuugucucaggagcaaaccagccuuggcuuu

SEQ ID NO: 413856 - RNA, 32 nt, Human
cuuugucuccaccuccagcagacucgccuccc

SEQ ID NO: 413857 - RNA, 32 nt, Human
cuuugucucccaauaucacagaaaaauacaug

SEQ ID NO: 413858 - RNA, 32 nt, Human
cuuugucucccaggaaggugugaccucuccuu

SEQ ID NO: 413859 - RNA, 32 nt, Human
cuuugucuccucuuccccaucuaugucccuuu

SEQ ID NO: 413860 - RNA, 32 nt, Human
cuuugucucucccacuucaucucacuguaucc

SEQ ID NO: 413861 - RNA, 32 nt, Human
cuuugucucuucguccagagccuuauguaaga

SEQ ID NO: 413862 - RNA, 32 nt, Human
cuuugucugccacagacacagacagagggagu

SEQ ID NO: 413863 - RNA, 32 nt, Human
cuuugucugcucccaauucaccucguuacucu

SEQ ID NO: 413864 - RNA, 32 nt, Human
cuuugucugcuccucucugcaaugagcuuucu

SEQ ID NO: 413865 - RNA, 32 nt, Human
cuuugucugcuggccugcugggugcuggucua

SEQ ID NO: 413866 - RNA, 32 nt, Human
cuuugucuggcagacagccaacuggucaggua

SEQ ID NO: 413867 - RNA, 32 nt, Human
cuuugucuguccagaucuuuaggauuuuuaga

SEQ ID NO: 413868 - RNA, 32 nt, Human
cuuugucuguggaaggagacagaaggaaauug

SEQ ID NO: 413869 - RNA, 32 nt, Human
cuuugucuucaagaagcucacagucuauugga

SEQ ID NO: 413870 - RNA, 32 nt, Human
cuuugucuucagccucuccaggcaccaucucc

SEQ ID NO: 413871 - RNA, 32 nt, Human
cuuugucuucaucagaaaguucacaugggaga

SEQ ID NO: 413872 - RNA, 26 nt, Human
cuuugucuuucugcagaaaauucuac

SEQ ID NO: 413873 - RNA, 32 nt, Human
cuuugucuuugcucagaaccagcuccacccaa

SEQ ID NO: 413874 - RNA, 31 nt, Human
cuuugucuuugcuucuggccuguguaagcag

SEQ ID NO: 413875 - RNA, 22 nt, Human
cuuugugacaucucacauuuuu

SEQ ID NO: 413876 - RNA, 32 nt, Human
cuuugugacuaucagaaacaccugccaggccu

SEQ ID NO: 413877 - RNA, 32 nt, Human
cuuugugacugcucuacacugcaugucugaca

SEQ ID NO: 413878 - RNA, 32 nt, Human
cuuugugagaaaugccauuacccccagauugc

SEQ ID NO: 413879 - RNA, 32 nt, Human
cuuugugagagccagcccuguaugccaacacc

SEQ ID NO: 413880 - RNA, 19 nt, Human
cuuugugagccuccuucag

SEQ ID NO: 413881 - RNA, 32 nt, Human
cuuugugagcugugagugccuccuguggucuc

SEQ ID NO: 413882 - RNA, 32 nt, Human
cuuugugagcuucaguuuccuguucuauaaca

SEQ ID NO: 413883 - RNA, 32 nt, Human
cuuugugaggaacugaguguguccacguuggg

SEQ ID NO: 413884 - RNA, 32 nt, Human
cuuugugaggcugaggcgaguggaucacuuga

SEQ ID NO: 413885 - RNA, 32 nt, Human
cuuugugaggcugaggugggcagaucacgagg

SEQ ID NO: 413886 - RNA, 32 nt, Human
cuuugugaggggagaugaagcccacagagcug

SEQ ID NO: 413887 - RNA, 32 nt, Human
cuuugugaugcugaaggauacugccggcagca

SEQ ID NO: 413888 - RNA, 32 nt, Human
cuuugugauucucccugcucccuguggacaaa

SEQ ID NO: 413889 - RNA, 32 nt, Human
cuuugugauuuucuacacagaagauuauguca

SEQ ID NO: 413890 - RNA, 32 nt, Human
cuuugugcaauuucuggucaguggcccauauc

SEQ ID NO: 413891 - RNA, 32 nt, Human
cuuugugcacauuuauuuccucccucuacccc

SEQ ID NO: 413892 - RNA, 32 nt, Human
cuuugugcagaguguauaucucugccugggca

SEQ ID NO: 413893 - RNA, 32 nt, Human
cuuugugccagucucuaaguuggcaacuuugg

SEQ ID NO: 413894 - RNA, 32 nt, Human
cuuugugcccuagacuggagugcaauggcgcc

SEQ ID NO: 413895 - RNA, 32 nt, Human
cuuugugccgguagaauaaggaaggaagggag

SEQ ID NO: 413896 - RNA, 32 nt, Human
cuuugugccucuggacuggcaagauguccagg

SEQ ID NO: 413897 - RNA, 32 nt, Human
cuuugugccuggacccagagagugugggacuc

SEQ ID NO: 413898 - RNA, 32 nt, Human
cuuugugccuguagcucauuuuauuaugaccu

SEQ ID NO: 413899 - RNA, 32 nt, Human
cuuugugcuaaugacacuuacauauuucuugc

SEQ ID NO: 413900 - RNA, 32 nt, Human
cuuugugcuccauuacucaagacacugaagac

SEQ ID NO: 413901 - RNA, 32 nt, Human
cuuugugcuguggcagacuggggcuuuggaag

SEQ ID NO: 413902 - RNA, 32 nt, Human
cuuugugcugugugagcauacaagaaaacugc

SEQ ID NO: 413903 - RNA, 32 nt, Human
cuuugugcuuuauuauccuggugacaguuacc

SEQ ID NO: 413904 - RNA, 32 nt, Human
cuuugugcuuuggcguuccaccccuguuguua

SEQ ID NO: 413905 - RNA, 32 nt, Human
cuuuguggagaaaugugucaccucccccaacc

SEQ ID NO: 413906 - RNA, 32 nt, Human
cuuuguggcaugugccuguaaucccagcuauu

SEQ ID NO: 413907 - RNA, 32 nt, Human
cuuuguggcccagggccuggaccagaccauug

SEQ ID NO: 413908 - RNA, 32 nt, Human
cuuuguggcgacauucaggaacagaccauuca

SEQ ID NO: 413909 - RNA, 32 nt, Human
cuuugugggaaagacagaggcgggaggauuga

SEQ ID NO: 413910 - RNA, 32 nt, Human
cuuugugggaaucuguuccucaccauaucauc

SEQ ID NO: 413911 - RNA, 32 nt, Human
cuuugugggacccuccaggugcacagugacag

SEQ ID NO: 413912 - RNA, 32 nt, Human
cuuugugggagggagaggauuguucugagaac

SEQ ID NO: 413913 - RNA, 32 nt, Human
cuuugugggccuacagccuggaaagugccauc

SEQ ID NO: 413914 - RNA, 32 nt, Human
cuuuguggggcugagggagaaucacuugggcu

SEQ ID NO: 413915 - RNA, 32 nt, Human
cuuuguggggucaggacacagagugggaggga

SEQ ID NO: 413916 - RNA, 23 nt, Human
cuuugugggucgcacacauguuu

SEQ ID NO: 413917 - RNA, 32 nt, Human
cuuugugguuucuucugauuuuugccauuggg

SEQ ID NO: 413918 - RNA, 32 nt, Human
cuuugugguuuuaaagacaacugugaaauaaa

SEQ ID NO: 413919 - RNA, 24 nt, Human
cuuugugguuuuuccaaagauguu

SEQ ID NO: 413920 - RNA, 23 nt, Human
cuuugugguuuuuggaauaguuu

SEQ ID NO: 413921 - RNA, 32 nt, Human
cuuuguguaaagugccuacuggaaaugcacug

SEQ ID NO: 413922 - RNA, 32 nt, Human
cuuugugucaucgugagcaugugccccuuccc

SEQ ID NO: 413923 - RNA, 32 nt, Human
cuuugugucuccagcaucuaguacagugccug

SEQ ID NO: 413924 - RNA, 32 nt, Human
cuuugugucuguguccuuguuuaauaucuuaa

SEQ ID NO: 413925 - RNA, 32 nt, Human
cuuugugucuucucucaauuacauagcaauuu

SEQ ID NO: 413926 - RNA, 32 nt, Human
cuuugugugacgaugacccaggcuccaacaag

SEQ ID NO: 413927 - RNA, 32 nt, Human
cuuuguguguuuugagguaggagcaugaucaa

SEQ ID NO: 413928 - RNA, 32 nt, Human
cuuuguguuagcaagugugugguuucaucuau

SEQ ID NO: 413929 - RNA, 32 nt, Human
cuuuguguuuuugugcccuccuggggaccaga

SEQ ID NO: 413930 - RNA, 32 nt, Human
cuuuguuaagcagagucagcagugagguccuc

SEQ ID NO: 413931 - RNA, 32 nt, Human
cuuuguuacagcagcaauggaaaaugaauacu

SEQ ID NO: 413932 - RNA, 32 nt, Human
cuuuguuaccaguucuuccuccuuccucuuuu

SEQ ID NO: 413933 - RNA, 32 nt, Human
cuuuguuacccaggcuggaguacagugguguc

SEQ ID NO: 413934 - RNA, 32 nt, Human
cuuuguuacccaggcuggagugcaguggcaca

SEQ ID NO: 413935 - RNA, 32 nt, Human
cuuuguucagcaauggugugguuggagaguug

SEQ ID NO: 413936 - RNA, 32 nt, Human
cuuuguucaucauuggcccucauuccaagcac

SEQ ID NO: 413937 - RNA, 32 nt, Human
cuuuguuccagccugguuuccugggcugggcu

SEQ ID NO: 413938 - RNA, 32 nt, Human
cuuuguuccugcagggugcagcuccugucugc

SEQ ID NO: 413939 - RNA, 32 nt, Human
cuuuguucuauaucucuucuaagacaguuguu

SEQ ID NO: 413940 - RNA, 32 nt, Human
cuuuguucucaaggaauuugcauucuagaaag

SEQ ID NO: 413941 - RNA, 32 nt, Human
cuuuguucucaccucuaccugucauuccagca

SEQ ID NO: 413942 - RNA, 32 nt, Human
cuuuguucucaggccuuccagguaguccccuu

SEQ ID NO: 413943 - RNA, 32 nt, Human
cuuuguucucugcuuucuuuuucuuggaaaga

SEQ ID NO: 413944 - RNA, 32 nt, Human
cuuuguucuguaacggugccuuuucuuagggu

SEQ ID NO: 413945 - RNA, 32 nt, Human
cuuuguucugucugaggccaggaaguuugacc

SEQ ID NO: 413946 - RNA, 32 nt, Human
cuuuguucuucacuaggccugcauaauacagu

SEQ ID NO: 413947 - RNA, 32 nt, Human
cuuuguucuuccggcccugcugucugccuccc

SEQ ID NO: 413948 - RNA, 21 nt, Human
cuuuguugagaaccacuacua

SEQ ID NO: 413949 - RNA, 32 nt, Human
cuuuguugcagauagucuugccgcaucuuggc

SEQ ID NO: 413950 - RNA, 32 nt, Human
cuuuguugcagcacagucccuggcagagccag

SEQ ID NO: 413951 - RNA, 32 nt, Human
cuuuguugccaggcuggagugcaguggcgcga

SEQ ID NO: 413952 - RNA, 32 nt, Human
cuuuguugcccagacuggagggcaguggcgcg

SEQ ID NO: 413953 - RNA, 32 nt, Human
cuuuguugcccagacuggagugcaguggcaua

SEQ ID NO: 413954 - RNA, 32 nt, Human
cuuuguugcccagaggaugugcaguugucauc

SEQ ID NO: 413955 - RNA, 32 nt, Human
cuuuguugcccaggcuggagcgcaguggggug

SEQ ID NO: 413956 - RNA, 32 nt, Human
cuuuguugcccaggcuggagugcaauggcgca

SEQ ID NO: 413957 - RNA, 32 nt, Human
cuuuguugcccaggcuggagugcaguagcacg

SEQ ID NO: 413958 - RNA, 32 nt, Human
cuuuguugcccaggcuggagugcaguggcacg

SEQ ID NO: 413959 - RNA, 32 nt, Human
cuuuguugcccaggcuggagugcaguggucug

SEQ ID NO: 413960 - RNA, 32 nt, Human
cuuuguugcccaggcuggagugccuuggcgcg

SEQ ID NO: 413961 - RNA, 32 nt, Human
cuuuguugcccaggcuggagugcgguggcgug

SEQ ID NO: 413962 - RNA, 32 nt, Human
cuuuguugcccaggcuggagugcgguggugca

SEQ ID NO: 413963 - RNA, 32 nt, Human
cuuuguugcccaggcuggaguggaguggcgug

SEQ ID NO: 413964 - RNA, 32 nt, Human
cuuuguugcccaggcuggagugugguggggca

SEQ ID NO: 413965 - RNA, 32 nt, Human
cuuuguugcccaggcuggggugcaguggcacg

SEQ ID NO: 413966 - RNA, 23 nt, Human
cuuuguugcccaggcuggucuca

SEQ ID NO: 413967 - RNA, 32 nt, Human
cuuuguugcccaggcugguugaacucccguga

SEQ ID NO: 413968 - RNA, 32 nt, Human
cuuuguugccccuuuucugucaccaaccaacc

SEQ ID NO: 413969 - RNA, 32 nt, Human
cuuuguugcucaggcuggaguacaguggcaua

SEQ ID NO: 413970 - RNA, 32 nt, Human
cuuuguugcuugaagaaaaacaugucuuuuca

SEQ ID NO: 413971 - RNA, 32 nt, Human
cuuuguuggccucuuucugggucucugccugg

SEQ ID NO: 413972 - RNA, 32 nt, Human
cuuuguugggcgcgcacccccucccuuaggug

SEQ ID NO: 413973 - RNA, 32 nt, Human
cuuuguugucauucucaucgcagugcuuuggu

SEQ ID NO: 413974 - RNA, 32 nt, Human
cuuuguugucuaggcuggucuugaacugggcu

SEQ ID NO: 413975 - RNA, 32 nt, Human
cuuuguuuacccccacugcgcuccgacuguga

SEQ ID NO: 413976 - RNA, 32 nt, Human
cuuuguuuccauuuucuuuggcuuugugcaau

SEQ ID NO: 413977 - RNA, 32 nt, Human
cuuuguuucccaggcuggagugcaguggcacg

SEQ ID NO: 413978 - RNA, 20 nt, Human
cuuuguuuccgcggcuccug

SEQ ID NO: 413979 - RNA, 32 nt, Human
cuuuguuuccuccuugucacugaagauugggu

SEQ ID NO: 413980 - RNA, 32 nt, Human
cuuuguuucguuuccucugcugucuucuccag

SEQ ID NO: 413981 - RNA, 22 nt, Human
cuuuguuucuugguccuuggca

SEQ ID NO: 413982 - RNA, 32 nt, Human
cuuuguuugcaucuuaauuacaugucauaacg

SEQ ID NO: 413983 - RNA, 32 nt, Human
cuuuguuugccucuccgucuguuuucccucag

SEQ ID NO: 413984 - RNA, 32 nt, Human
cuuuguuugcuggaggauaagacacugaaaau

SEQ ID NO: 413985 - RNA, 32 nt, Human
cuuuguuugucugaacagguauuuuuauacau

SEQ ID NO: 413986 - RNA, 32 nt, Human
cuuuguuuucauguguaagaaaaggcccauua

SEQ ID NO: 413987 - RNA, 32 nt, Human
cuuuguuuucuaccacaauccuccuccuccuc

SEQ ID NO: 413988 - RNA, 22 nt, Human
cuuuguuuucuuacauauguuu

SEQ ID NO: 413989 - RNA, 32 nt, Human
cuuuguuuugaauauuuguaaguuuuuaagaa

SEQ ID NO: 413990 - RNA, 32 nt, Human
cuuuguuuugagacagagcgucucucucuguu

SEQ ID NO: 413991 - RNA, 32 nt, Human
cuuuguuuugagacggagucucgcucugucau

SEQ ID NO: 413992 - RNA, 32 nt, Human
cuuuguuuugagaugcaguuuaaacucccucu

SEQ ID NO: 413993 - RNA, 32 nt, Human
cuuuguuuugagauggagucuuguucugucac

SEQ ID NO: 413994 - RNA, 32 nt, Human
cuuuguuuugaggcagggucucgcucugucac

SEQ ID NO: 413995 - RNA, 32 nt, Human
cuuuguuuuucacauauaaauagaugauuuca

SEQ ID NO: 413996 - RNA, 22 nt, Human
cuuuguuuuuuaccuucugucu

SEQ ID NO: 413997 - RNA, 32 nt, Human
cuuuuaaaagucacuaaugacugccauucacc

SEQ ID NO: 413998 - RNA, 32 nt, Human
cuuuuaaacagccagcucuuacagcaccuaau

SEQ ID NO: 413999 - RNA, 32 nt, Human
cuuuuaaacccagcuacugaggaggcugaggc

SEQ ID NO: 414000 - RNA, 32 nt, Human
cuuuuaaacuugaucaaauaaaggacaguggg

SEQ ID NO: 414001 - RNA, 32 nt, Human
cuuuuaaagcagggaguggggaaaaguauuuu

SEQ ID NO: 414002 - RNA, 32 nt, Human
cuuuuaaaggaaauuuuggaggaaaauauagc

SEQ ID NO: 414003 - RNA, 32 nt, Human
cuuuuaaauagaagagagagggcccggcacgg

SEQ ID NO: 414004 - RNA, 32 nt, Human
cuuuuaaauauugucuuagccucggcaaacca

SEQ ID NO: 414005 - RNA, 32 nt, Human
cuuuuaaauauuuaaacuagguggugaauggu

SEQ ID NO: 414006 - RNA, 32 nt, Human
cuuuuaaaugggugaaaaaugguaauauaaca

SEQ ID NO: 414007 - RNA, 32 nt, Human
cuuuuaaaugugcugcucuucauuucaagaug

SEQ ID NO: 414008 - RNA, 32 nt, Human
cuuuuaaauguucucucugggagcuucauaua

SEQ ID NO: 414009 - RNA, 32 nt, Human
cuuuuaaauuaugucacuaaacuuuguaugag

SEQ ID NO: 414010 - RNA, 32 nt, Human
cuuuuaaccaaccaccaccaccaccaaaacca

SEQ ID NO: 414011 - RNA, 32 nt, Human
cuuuuaacuauguaauaauguacagaggaagc

SEQ ID NO: 414012 - RNA, 32 nt, Human
cuuuuaacugaaaaugagagacagaagccaca

SEQ ID NO: 414013 - RNA, 32 nt, Human
cuuuuaacuggaaauuuuuaugugaguuuucc

SEQ ID NO: 414014 - RNA, 32 nt, Human
cuuuuaacuguuggacaaaaccauaacuuugu

SEQ ID NO: 414015 - RNA, 18 nt, Human
cuuuuaagaauggcccca

SEQ ID NO: 414016 - RNA, 32 nt, Human
cuuuuaagcuaaaaucacaugcaagaauugac

SEQ ID NO: 414017 - RNA, 32 nt, Human
cuuuuaagcuacaguuccuucucuccauccuu

SEQ ID NO: 414018 - RNA, 32 nt, Human
cuuuuaagcugaugcagaaaauuccaaaauaa

SEQ ID NO: 414019 - RNA, 32 nt, Human
cuuuuaaggcagugugucuuucugagcacugu

SEQ ID NO: 414020 - RNA, 32 nt, Human
cuuuuaagguuccugagggucugccugagagg

SEQ ID NO: 414021 - RNA, 32 nt, Human
cuuuuaauaacaaaagcaugcaguucucugug

SEQ ID NO: 414022 - RNA, 32 nt, Human
cuuuuaaugauacugucuaagaauaaugacgu

SEQ ID NO: 414023 - RNA, 32 nt, Human
cuuuuaauucuuuggagauggcucuucugugu

SEQ ID NO: 414024 - RNA, 32 nt, Human
cuuuuaauugagguauuacuguguaaccauca

SEQ ID NO: 414025 - RNA, 32 nt, Human
cuuuuaauuuuuaauuuugaaaaugaggcccu

SEQ ID NO: 414026 - RNA, 32 nt, Human
cuuuuacagaggagagaauugaggcuucgaga

SEQ ID NO: 414027 - RNA, 32 nt, Human
cuuuuacagugggguugaugauacauuuggaa

SEQ ID NO: 414028 - RNA, 31 nt, Human
cuuuuacaguuucagaccucagcagcuguaa

SEQ ID NO: 414029 - RNA, 32 nt, Human
cuuuuacaguuucagaccucagcagcuguaag

SEQ ID NO: 414030 - RNA, 17 nt, Human
cuuuuaccaacagcauu

SEQ ID NO: 414031 - RNA, 32 nt, Human
cuuuuaccauugcugguugagcucaggcacug

SEQ ID NO: 414032 - RNA, 32 nt, Human
cuuuuaccccuggcagagccaguugcagugca

SEQ ID NO: 414033 - RNA, 32 nt, Human
cuuuuaccgcccaggcuggagugcagugccau

SEQ ID NO: 414034 - RNA, 23 nt, Human
cuuuuaccucguugcacugcuga

SEQ ID NO: 414035 - RNA, 32 nt, Human
cuuuuaccugcagcuuuuccugcuugauauag

SEQ ID NO: 414036 - RNA, 32 nt, Human
cuuuuaccugcucucccucagugaguccucaa

SEQ ID NO: 414037 - RNA, 32 nt, Human
cuuuuaccuguacuguauucuuggucaucuca

SEQ ID NO: 414038 - RNA, 32 nt, Human
cuuuuaccuguuccucuucuccuggccuuucc

SEQ ID NO: 414039 - RNA, 32 nt, Human
cuuuuaccuucugcucuucccuuuuuccugcc

SEQ ID NO: 414040 - RNA, 32 nt, Human
cuuuuaccuuucuccaccauccagagccacaa

SEQ ID NO: 414041 - RNA, 32 nt, Human
cuuuuacgagguaucagcacuuuucuuucauu

SEQ ID NO: 414042 - RNA, 32 nt, Human
cuuuuacucacugcccacuucucaucucuguc

SEQ ID NO: 414043 - RNA, 32 nt, Human
cuuuuacucuuugguuuuaucauuccauuuug

SEQ ID NO: 414044 - RNA, 31 nt, Human
cuuuuacugccuccugggccuucgucuuguu

SEQ ID NO: 414045 - RNA, 32 nt, Human
cuuuuacugccuccugggccuucgucuuguuc

SEQ ID NO: 414046 - RNA, 32 nt, Human
cuuuuacugugugguucccugcuuuuaacaga

SEQ ID NO: 414047 - RNA, 32 nt, Human
cuuuuacuuuuugcauuguccagacuucuuua

SEQ ID NO: 414048 - RNA, 32 nt, Human
cuuuuagaaauccugaagaauucagucuucgu

SEQ ID NO: 414049 - RNA, 32 nt, Human
cuuuuagacucugcuaaaacagugcucuggcu

SEQ ID NO: 414050 - RNA, 32 nt, Human
cuuuuagagacagggucucacuguguugccca

SEQ ID NO: 414051 - RNA, 32 nt, Human
cuuuuagagcaucuauaucugcaaccuguaaa

SEQ ID NO: 414052 - RNA, 32 nt, Human
cuuuuagagccagagggaauuauuuauuaagc

SEQ ID NO: 414053 - RNA, 32 nt, Human
cuuuuagagcccagaaauggcagucaccuuuc

SEQ ID NO: 414054 - RNA, 32 nt, Human
cuuuuagaggcagaggagcggaaggcaguggg

SEQ ID NO: 414055 - RNA, 32 nt, Human
cuuuuagaguccgaccucuggaaauguccaca

SEQ ID NO: 414056 - RNA, 32 nt, Human
cuuuuagcauuugauaugcauuucucagauuc

SEQ ID NO: 414057 - RNA, 32 nt, Human
cuuuuagccacaucugcaaagcagggaugguc

SEQ ID NO: 414058 - RNA, 32 nt, Human
cuuuuagccagccugcggacccagcccucugu

SEQ ID NO: 414059 - RNA, 17 nt, Human
cuuuuagccuucuuuaa

SEQ ID NO: 414060 - RNA, 32 nt, Human
cuuuuagcggucuccccuuagacuggaacccg

SEQ ID NO: 414061 - RNA, 32 nt, Human
cuuuuagcuagauguggcaugcaucugugagc

SEQ ID NO: 414062 - RNA, 32 nt, Human
cuuuuagcucuauacucucuggcuccccucau

SEQ ID NO: 414063 - RNA, 32 nt, Human
cuuuuagcugggguugggggacgggaagagcc

SEQ ID NO: 414064 - RNA, 32 nt, Human
cuuuuagcuuggaaacagucuuccacuaaccu

SEQ ID NO: 414065 - RNA, 32 nt, Human
cuuuuaggaaaaucacuuugucuaacucagaa

SEQ ID NO: 414066 - RNA, 32 nt, Human
cuuuuaggcaugagcuaaucucugauuaccuc

SEQ ID NO: 414067 - RNA, 32 nt, Human
cuuuuaggcucaggacggaaggucaguugcca

SEQ ID NO: 414068 - RNA, 21 nt, Human
cuuuuaggcugggugcagugg

SEQ ID NO: 414069 - RNA, 32 nt, Human
cuuuuagguaagaaauaggcaugaugauaagc

SEQ ID NO: 414070 - RNA, 32 nt, Human
cuuuuagguagaagaggcaauuuuacccuuau

SEQ ID NO: 414071 - RNA, 32 nt, Human
cuuuuaggucacagaaaccucugccugccagg

SEQ ID NO: 414072 - RNA, 32 nt, Human
cuuuuagguggaaggccagaugacagagggcg

SEQ ID NO: 414073 - RNA, 32 nt, Human
cuuuuagguuuucccaggacaggacagucccc

SEQ ID NO: 414074 - RNA, 32 nt, Human
cuuuuaguaacuauagucacuacuuuuuccau

SEQ ID NO: 414075 - RNA, 32 nt, Human
cuuuuaguacaauggaguggcugagccuuuga

SEQ ID NO: 414076 - RNA, 32 nt, Human
cuuuuagugaguggccaggaaaugcuaaaugu

SEQ ID NO: 414077 - RNA, 32 nt, Human
cuuuuaguggagaagagaggaagucagagggu

SEQ ID NO: 414078 - RNA, 32 nt, Human
cuuuuaguuaugaacuacuuccuuccagugca

SEQ ID NO: 414079 - RNA, 32 nt, Human
cuuuuaguuucucuucuuucuaaagaaggcuc

SEQ ID NO: 414080 - RNA, 32 nt, Human
cuuuuauaauaaguugaaaauuucauauaauu

SEQ ID NO: 414081 - RNA, 32 nt, Human
cuuuuauacauuuuagaaucaguguguuacua

SEQ ID NO: 414082 - RNA, 32 nt, Human
cuuuuauacugaagaugccgcacacaaacaau

SEQ ID NO: 414083 - RNA, 32 nt, Human
cuuuuauagacuugauuucaaauucuuaaguu

SEQ ID NO: 414084 - RNA, 32 nt, Human
cuuuuaucaacaugccugucuucaagauccca

SEQ ID NO: 414085 - RNA, 32 nt, Human
cuuuuaucaucuccuccacuguuuccuuuucu

SEQ ID NO: 414086 - RNA, 32 nt, Human
cuuuuaucauuuuaaaugguaggaauuuaagg

SEQ ID NO: 414087 - RNA, 32 nt, Human
cuuuuauccacaaguuccccuggcugaggauu

SEQ ID NO: 414088 - RNA, 32 nt, Human
cuuuuauccuugucccucuuuagucuguguuu

SEQ ID NO: 414089 - RNA, 32 nt, Human
cuuuuauccuuuggagccugggagacucccca

SEQ ID NO: 414090 - RNA, 32 nt, Human
cuuuuaucuccaaauacauaguugucucaaac

SEQ ID NO: 414091 - RNA, 32 nt, Human
cuuuuaucucuuccuuuucaaugaaggccuau

SEQ ID NO: 414092 - RNA, 32 nt, Human
cuuuuaucuuaaccugaacaugugcuuccuau

SEQ ID NO: 414093 - RNA, 32 nt, Human
cuuuuaugagcuguaacacucacccugaaggu

SEQ ID NO: 414094 - RNA, 32 nt, Human
cuuuuaugcugcuucgcuuuucucuaaacaga

SEQ ID NO: 414095 - RNA, 32 nt, Human
cuuuuauggcagugguggagugaggcagggau

SEQ ID NO: 414096 - RNA, 32 nt, Human
cuuuuauggccaucugccaaaucagugcuaac

SEQ ID NO: 414097 - RNA, 32 nt, Human
cuuuuauuaaaaccagucucagauaucauacu

SEQ ID NO: 414098 - RNA, 32 nt, Human
cuuuuauuaccacaguugcugccuccuccaga

SEQ ID NO: 414099 - RNA, 32 nt, Human
cuuuuauuagauucucaaagguucagaauggg

SEQ ID NO: 414100 - RNA, 32 nt, Human
cuuuuauuagccagugaaacacuugcuugcca

SEQ ID NO: 414101 - RNA, 32 nt, Human
cuuuuauuaugcaaauuagcuguggacuucug

SEQ ID NO: 414102 - RNA, 32 nt, Human
cuuuuauucccaagccuccuuggccccaguau

SEQ ID NO: 414103 - RNA, 32 nt, Human
cuuuuauugauugguuuauaugccauucuugu

SEQ ID NO: 414104 - RNA, 32 nt, Human
cuuuuauugcaggaacuguucaucuuaguucc

SEQ ID NO: 414105 - RNA, 22 nt, Human
cuuuuauugcauaugcuaaaca

SEQ ID NO: 414106 - RNA, 32 nt, Human
cuuuuauugcauuggaaagacuggcaaagucu

SEQ ID NO: 414107 - RNA, 32 nt, Human
cuuuuauugcccaggcuggaguguaguggcgc

SEQ ID NO: 414108 - RNA, 32 nt, Human
cuuuuauuucuuucaguuguguguucucauuu

SEQ ID NO: 414109 - RNA, 32 nt, Human
cuuuuauuucuuuccucuguuccucuucccuc

SEQ ID NO: 414110 - RNA, 32 nt, Human
cuuuuauuugugaauuaaagaugcaucgaugg

SEQ ID NO: 414111 - RNA, 32 nt, Human
cuuuuauuuucuuccucuugcuuuuguuaucu

SEQ ID NO: 414112 - RNA, 22 nt, Human
cuuuucaaaagguauccacacu

SEQ ID NO: 414113 - RNA, 32 nt, Human
cuuuucaaccugggugacagaaccagacccug

SEQ ID NO: 414114 - RNA, 19 nt, Human
cuuuucaacuguaggugcu

SEQ ID NO: 414115 - RNA, 32 nt, Human
cuuuucaagccuuccuuccauuguuuuucuuc

SEQ ID NO: 414116 - RNA, 21 nt, Human
cuuuucaaguacuuucugacu

SEQ ID NO: 414117 - RNA, 23 nt, Human
cuuuucaaugcacacaugcuuug

SEQ ID NO: 414118 - RNA, 21 nt, Human
cuuuucaauuccuguguuuug

SEQ ID NO: 414119 - RNA, 32 nt, Human
cuuuucacacaaucucuuuacagcagaaucca

SEQ ID NO: 414120 - RNA, 32 nt, Human
cuuuucacaccaucucagagguugaggagcau

SEQ ID NO: 414121 - RNA, 32 nt, Human
cuuuucacagcacuccuuugccccagagcaga

SEQ ID NO: 414122 - RNA, 32 nt, Human
cuuuucacagcagcgcugggaacgaacgcagg

SEQ ID NO: 414123 - RNA, 32 nt, Human
cuuuucacccaggaggagaggcguggcugagg

SEQ ID NO: 414124 - RNA, 32 nt, Human
cuuuucacgucagcuagguugcaaggauaaua

SEQ ID NO: 414125 - RNA, 32 nt, Human
cuuuucacugaggaggugguggaaggugucgc

SEQ ID NO: 414126 - RNA, 32 nt, Human
cuuuucacugaugacaaauacaaugacuucau

SEQ ID NO: 414127 - RNA, 32 nt, Human
cuuuucacuggaugauguaugagggaauuuua

SEQ ID NO: 414128 - RNA, 32 nt, Human
cuuuucacuuccucuccacaggagccucugca

SEQ ID NO: 414129 - RNA, 32 nt, Human
cuuuucacuuuguugcuaucauccuccuuucu

SEQ ID NO: 414130 - RNA, 32 nt, Human
cuuuucagacacagcagggccccgcgcagccg

SEQ ID NO: 414131 - RNA, 32 nt, Human
cuuuucagccccugacaggccacccccacucc

SEQ ID NO: 414132 - RNA, 32 nt, Human
cuuuucagccugggugccacagcgagacccua

SEQ ID NO: 414133 - RNA, 32 nt, Human
cuuuucagcgaaagccugucuccucacccacc

SEQ ID NO: 414134 - RNA, 32 nt, Human
cuuuucagcuguucuuagggcauuauaaaugg

SEQ ID NO: 414135 - RNA, 32 nt, Human
cuuuucagcuuaguuggucaucuaucacauga

SEQ ID NO: 414136 - RNA, 32 nt, Human
cuuuucaggauacuaaggaaaugguggucaga

SEQ ID NO: 414137 - RNA, 32 nt, Human
cuuuucagguuaggggagaggugacccugagg

SEQ ID NO: 414138 - RNA, 32 nt, Human
cuuuucaguuucucccccuccucuccugaccu

SEQ ID NO: 414139 - RNA, 32 nt, Human
cuuuucaguuugaacucuucuuugccaggugu

SEQ ID NO: 414140 - RNA, 32 nt, Human
cuuuucauccuggucacaugaagacagauggu

SEQ ID NO: 414141 - RNA, 32 nt, Human
cuuuucaucuguaccacacccuggugaaaccu

SEQ ID NO: 414142 - RNA, 32 nt, Human
cuuuucaugaagcacagcugcagcaaagccuu

SEQ ID NO: 414143 - RNA, 32 nt, Human
cuuuucaugcaggaguuacagacacugguuuc

SEQ ID NO: 414144 - RNA, 32 nt, Human
cuuuucauguaaagauaagaucuuuagcuauc

SEQ ID NO: 414145 - RNA, 32 nt, Human
cuuuucauguacaaagcacagaaacaguacau

SEQ ID NO: 414146 - RNA, 32 nt, Human
cuuuucauguguccuuccugagcaccucuagc

SEQ ID NO: 414147 - RNA, 32 nt, Human
cuuuucauucaaccccaugcuggauaaagaag

SEQ ID NO: 414148 - RNA, 32 nt, Human
cuuuuccaaaacugguacuuacgugaacuguu

SEQ ID NO: 414149 - RNA, 32 nt, Human
cuuuuccaaacaguccccugcuuucauguaca

SEQ ID NO: 414150 - RNA, 32 nt, Human
cuuuuccaaauuugucccaacagcccuguaag

SEQ ID NO: 414151 - RNA, 32 nt, Human
cuuuuccacagcugcuucuuuuugcucaaccu

SEQ ID NO: 414152 - RNA, 32 nt, Human
cuuuuccacaguuaacaacacagcuguuacac

SEQ ID NO: 414153 - RNA, 32 nt, Human
cuuuuccaccacugcuuucuaguccuuuaacu

SEQ ID NO: 414154 - RNA, 32 nt, Human
cuuuuccacccaugagacuguacugggagagg

SEQ ID NO: 414155 - RNA, 32 nt, Human
cuuuuccaccgucccugagacugggguugagg

SEQ ID NO: 414156 - RNA, 32 nt, Human
cuuuuccacugaagggugaagacauggcagcc

SEQ ID NO: 414157 - RNA, 32 nt, Human
cuuuuccagaaauacaaugcuagguguuuuga

SEQ ID NO: 414158 - RNA, 32 nt, Human
cuuuuccagaacuauggacaaauugaucagaa

SEQ ID NO: 414159 - RNA, 32 nt, Human
cuuuuccagacuguauggaugugaauggaauc

SEQ ID NO: 414160 - RNA, 32 nt, Human
cuuuuccagagaaagauccugauugucauuua

SEQ ID NO: 414161 - RNA, 32 nt, Human
cuuuuccagauggggaaacugaggcccagaau

SEQ ID NO: 414162 - RNA, 32 nt, Human
cuuuuccagcacaauuacuuccuagagugucu

SEQ ID NO: 414163 - RNA, 32 nt, Human
cuuuuccagcuggaugagaauuugagugcucu

SEQ ID NO: 414164 - RNA, 32 nt, Human
cuuuuccaggcucucuucucucccucucucuc

SEQ ID NO: 414165 - RNA, 32 nt, Human
cuuuuccagggacuuagggggauaggcuuugg

SEQ ID NO: 414166 - RNA, 32 nt, Human
cuuuuccagggugggggagggaaugaauacau

SEQ ID NO: 414167 - RNA, 32 nt, Human
cuuuuccagugcugcugacuucaccccacuug

SEQ ID NO: 414168 - RNA, 32 nt, Human
cuuuuccauagagagggaaagaaacuuugaga

SEQ ID NO: 414169 - RNA, 32 nt, Human
cuuuuccauuucucccuccaucaccaccugcc

SEQ ID NO: 414170 - RNA, 21 nt, Human
cuuuucccaaaguuucugacu

SEQ ID NO: 414171 - RNA, 32 nt, Human
cuuuucccaacaaaagcucacagucuaaucag

SEQ ID NO: 414172 - RNA, 32 nt, Human
cuuuucccaagaggagagaauggcugcugggu

SEQ ID NO: 414173 - RNA, 32 nt, Human
cuuuucccaagccagugagcaagagcauuauu

SEQ ID NO: 414174 - RNA, 32 nt, Human
cuuuucccacacacuggauugugaggcucuua

SEQ ID NO: 414175 - RNA, 32 nt, Human
cuuuucccacagcaguccaccucugcaggcug

SEQ ID NO: 414176 - RNA, 32 nt, Human
cuuuucccaccucuccccugacccccacccca

SEQ ID NO: 414177 - RNA, 32 nt, Human
cuuuucccaccucuuuggauguuuucaccaau

SEQ ID NO: 414178 - RNA, 32 nt, Human
cuuuucccagaaggccucuccuuuucagcaaa

SEQ ID NO: 414179 - RNA, 32 nt, Human
cuuuucccagccacagaaucaggugauggucc

SEQ ID NO: 414180 - RNA, 32 nt, Human
cuuuucccaggggcugugucuccucacuuggu

SEQ ID NO: 414181 - RNA, 32 nt, Human
cuuuucccaucguguagucaagagucugugcc

SEQ ID NO: 414182 - RNA, 32 nt, Human
cuuuucccaucuuuccaauacuuucuugaacu

SEQ ID NO: 414183 - RNA, 32 nt, Human
cuuuuccccaaguacaaccacacccacacuca

SEQ ID NO: 414184 - RNA, 32 nt, Human
cuuuucccccuucccauuucuucccacuuuca

SEQ ID NO: 414185 - RNA, 32 nt, Human
cuuuucccccuucucucucccucucccucucu

SEQ ID NO: 414186 - RNA, 32 nt, Human
cuuuuccccuggcaguggacauggcugcacuc

SEQ ID NO: 414187 - RNA, 32 nt, Human
cuuuuccccuucccugccuguuucugggacuu

SEQ ID NO: 414188 - RNA, 32 nt, Human
cuuuucccuagacugcagccagcggagcccgc

SEQ ID NO: 414189 - RNA, 32 nt, Human
cuuuucccuccaggcaucucugggaaaggacc

SEQ ID NO: 414190 - RNA, 32 nt, Human
cuuuucccucucuggcguccccggcugcuugu

SEQ ID NO: 414191 - RNA, 32 nt, Human
cuuuucccugccacccuucuugucuuuacuuc

SEQ ID NO: 414192 - RNA, 32 nt, Human
cuuuucccugugguucuucauucucagaguag

SEQ ID NO: 414193 - RNA, 32 nt, Human
cuuuucccuuaaaggaaacaacuaauacacau

SEQ ID NO: 414194 - RNA, 32 nt, Human
cuuuucccuucagagcucacacaguggucacc

SEQ ID NO: 414195 - RNA, 32 nt, Human
cuuuucccuuccagacuuugagugucuucccu

SEQ ID NO: 414196 - RNA, 32 nt, Human
cuuuucccuuucuccagucggcccaccuuggg

SEQ ID NO: 414197 - RNA, 32 nt, Human
cuuuuccgauagaaauuucuuaccucauuuuu

SEQ ID NO: 414198 - RNA, 32 nt, Human
cuuuuccuacuucugcccuucccugccacccc

SEQ ID NO: 414199 - RNA, 32 nt, Human
cuuuuccucaaagggagagagugcuauuguag

SEQ ID NO: 414200 - RNA, 32 nt, Human
cuuuuccuccaaaacaaaaauuagaggauuau

SEQ ID NO: 414201 - RNA, 18 nt, Human
cuuuuccucccccucguu

SEQ ID NO: 414202 - RNA, 32 nt, Human
cuuuuccucccucccuuccuucccuccuuccc

SEQ ID NO: 414203 - RNA, 32 nt, Human
cuuuuccucgugagacacgucccacugccuug

SEQ ID NO: 414204 - RNA, 32 nt, Human
cuuuuccucuggcaugguguagacugagacaa

SEQ ID NO: 414205 - RNA, 32 nt, Human
cuuuuccucugugaggagacaagacuuggaga

SEQ ID NO: 414206 - RNA, 32 nt, Human
cuuuuccucuuuuccuuccuccucuuuggaau

SEQ ID NO: 414207 - RNA, 32 nt, Human
cuuuuccugagccuccuuccuccuggauuccu

SEQ ID NO: 414208 - RNA, 32 nt, Human
cuuuuccugcagcucuucagagccacagaccu

SEQ ID NO: 414209 - RNA, 32 nt, Human
cuuuuccugcaugugccaccuccagugggaaa

SEQ ID NO: 414210 - RNA, 32 nt, Human
cuuuuccugcauuaugauaguaucugugugaa

SEQ ID NO: 414211 - RNA, 32 nt, Human
cuuuuccugccagagccaccccuuucccuccu

SEQ ID NO: 414212 - RNA, 18 nt, Human
cuuuuccugccuccuuca

SEQ ID NO: 414213 - RNA, 32 nt, Human
cuuuuccugccuccuucacauuuccuccccag

SEQ ID NO: 414214 - RNA, 32 nt, Human
cuuuuccugccugccugucugccugugaccug

SEQ ID NO: 414215 - RNA, 32 nt, Human
cuuuuccugccugucugcugcuggcucucuuc

SEQ ID NO: 414216 - RNA, 32 nt, Human
cuuuuccugccuguuguuugccuuuugucaac

SEQ ID NO: 414217 - RNA, 32 nt, Human
cuuuuccugguauaaauauucccacugugggc

SEQ ID NO: 414218 - RNA, 32 nt, Human
cuuuuccuguccacugaaaugccugagcagua

SEQ ID NO: 414219 - RNA, 32 nt, Human
cuuuuccuguggccugaccugccugugagugc

SEQ ID NO: 414220 - RNA, 32 nt, Human
cuuuuccuguuccuccucuagguauguagcug

SEQ ID NO: 414221 - RNA, 32 nt, Human
cuuuuccuuccagguucuguuacucacagaag

SEQ ID NO: 414222 - RNA, 32 nt, Human
cuuuuccuuccuuauuccuuccagucagggug

SEQ ID NO: 414223 - RNA, 19 nt, Human
cuuuuccuuuuuucacuuu

SEQ ID NO: 414224 - RNA, 32 nt, Human
cuuuucgaaagccagaggcucgaguuaccccu

SEQ ID NO: 414225 - RNA, 32 nt, Human
cuuuucgagaucuuuucccuugcuaaccggau

SEQ ID NO: 414226 - RNA, 32 nt, Human
cuuuucgcaacauaaucccagcacuuuggaac

SEQ ID NO: 414227 - RNA, 32 nt, Human
cuuuucgccaucuuuugucuuucuguggagcu

SEQ ID NO: 414228 - RNA, 32 nt, Human
cuuuucgccuuuccucucuauauuucgggucg

SEQ ID NO: 414229 - RNA, 32 nt, Human
cuuuucgcggggaacccagcuguuccugcgag

SEQ ID NO: 414230 - RNA, 32 nt, Human
cuuuucggcuacucaaccacuccgcaugcugc

SEQ ID NO: 414231 - RNA, 32 nt, Human
cuuuucguagugacaccagcuguguuggauug

SEQ ID NO: 414232 - RNA, 32 nt, Human
cuuuucgugguuuacaugcaggccaguaacag

SEQ ID NO: 414233 - RNA, 32 nt, Human
cuuuucguuugcugagggucacagaccccaac

SEQ ID NO: 414234 - RNA, 32 nt, Human
cuuuucuaaaaauacaaaaauuagccaaccgu

SEQ ID NO: 414235 - RNA, 32 nt, Human
cuuuucuaaaaauacaaaaauuagccagguau

SEQ ID NO: 414236 - RNA, 26 nt, Human
cuuuucuaaaaauuuuccuaguaaca

SEQ ID NO: 414237 - RNA, 32 nt, Human
cuuuucuaaccguuuucuggauggauuuugua

SEQ ID NO: 414238 - RNA, 32 nt, Human
cuuuucuaacuuucuuccacagaacacaguua

SEQ ID NO: 414239 - RNA, 32 nt, Human
cuuuucuacauacauuauuuucuuaauuguua

SEQ ID NO: 414240 - RNA, 32 nt, Human
cuuuucuaccugcucuauacuuggcacucaau

SEQ ID NO: 414241 - RNA, 32 nt, Human
cuuuucuagaaacaccauucuggaaguuuggc

SEQ ID NO: 414242 - RNA, 24 nt, Human
cuuuucuagucacagauguuuuca

SEQ ID NO: 414243 - RNA, 32 nt, Human
cuuuucuaguuuuaaaaccagaauuggaccuu

SEQ ID NO: 414244 - RNA, 32 nt, Human
cuuuucuauauacuucguuccccgccaaccgc

SEQ ID NO: 414245 - RNA, 32 nt, Human
cuuuucuauuaaaagugggaauuaggagagaa

SEQ ID NO: 414246 - RNA, 32 nt, Human
cuuuucucaaugcaccaagaguagaagcacaa

SEQ ID NO: 414247 - RNA, 32 nt, Human
cuuuucucaauuccucuucauuggcugauuac

SEQ ID NO: 414248 - RNA, 32 nt, Human
cuuuucucauaagggcacuaauccuaucugau

SEQ ID NO: 414249 - RNA, 32 nt, Human
cuuuucuccacugucauaaucucuuuccaucu

SEQ ID NO: 414250 - RNA, 18 nt, Human
cuuuucuccaguuugagc

SEQ ID NO: 414251 - RNA, 32 nt, Human
cuuuucuccaugacacgaggccaguccccagg

SEQ ID NO: 414252 - RNA, 32 nt, Human
cuuuucucccacccucuuuuccaagcuguuuc

SEQ ID NO: 414253 - RNA, 32 nt, Human
cuuuucuccccacuccuccagaaggcauaacc

SEQ ID NO: 414254 - RNA, 32 nt, Human
cuuuucucccucuucuuucuuacuuccauaag

SEQ ID NO: 414255 - RNA, 32 nt, Human
cuuuucuccucccuuccuuucccuucaaagua

SEQ ID NO: 414256 - RNA, 32 nt, Human
cuuuucuccuucaggaacugugaauggcuaga

SEQ ID NO: 414257 - RNA, 32 nt, Human
cuuuucuccuuuuucuucuuuuuaauagucua

SEQ ID NO: 414258 - RNA, 32 nt, Human
cuuuucucguauggggugguuuuugcauuaaa

SEQ ID NO: 414259 - RNA, 32 nt, Human
cuuuucucucaucagguugaucuuuaaauaaa

SEQ ID NO: 414260 - RNA, 32 nt, Human
cuuuucucuccacugacugccugucagcuagu

SEQ ID NO: 414261 - RNA, 32 nt, Human
cuuuucucuccucucuucugccucuuuucacu

SEQ ID NO: 414262 - RNA, 32 nt, Human
cuuuucucuccucugguucucaaccucaacga

SEQ ID NO: 414263 - RNA, 32 nt, Human
cuuuucucucuucagcccccaacccaguggag

SEQ ID NO: 414264 - RNA, 32 nt, Human
cuuuucucugcucuccugaaccuuuaggcuug

SEQ ID NO: 414265 - RNA, 32 nt, Human
cuuuucucuggcacuccaguccagcuugggcc

SEQ ID NO: 414266 - RNA, 32 nt, Human
cuuuucucuggcagacuaucaguguuugccuc

SEQ ID NO: 414267 - RNA, 32 nt, Human
cuuuucucugucuuccaugucuugagaucuca

SEQ ID NO: 414268 - RNA, 32 nt, Human
cuuuucucuguuuuucuuuuccuuccuuuuaa

SEQ ID NO: 414269 - RNA, 32 nt, Human
cuuuucucuucucucuccuccugggaaaagag

SEQ ID NO: 414270 - RNA, 32 nt, Human
cuuuucucuuuacuggaguuuccucuugucca

SEQ ID NO: 414271 - RNA, 32 nt, Human
cuuuucucuuucuccuuagucuucucauagca

SEQ ID NO: 414272 - RNA, 32 nt, Human
cuuuucugaacugggcauucugccuucaacca

SEQ ID NO: 414273 - RNA, 26 nt, Human
cuuuucugaagacuucaguuuuguua

SEQ ID NO: 414274 - RNA, 32 nt, Human
cuuuucugaagagauuguguuagcuccaaagc

SEQ ID NO: 414275 - RNA, 32 nt, Human
cuuuucugaauccugguuccaucaguauaccu

SEQ ID NO: 414276 - RNA, 32 nt, Human
cuuuucugaccuucaaaguccccuguagagac

SEQ ID NO: 414277 - RNA, 32 nt, Human
cuuuucugagaggaaaaggaaaagggaaggga

SEQ ID NO: 414278 - RNA, 32 nt, Human
cuuuucugagcagacguccagagcagagucag

SEQ ID NO: 414279 - RNA, 32 nt, Human
cuuuucugagguucggcucacacugagaucgg

SEQ ID NO: 414280 - RNA, 32 nt, Human
cuuuucugaguguugauggggguuaccagcuu

SEQ ID NO: 414281 - RNA, 32 nt, Human
cuuuucugcagguacuuccucagucuggugcu

SEQ ID NO: 414282 - RNA, 32 nt, Human
cuuuucugcauaguuuuucuucugcuuacuuu

SEQ ID NO: 414283 - RNA, 32 nt, Human
cuuuucugccaucagcuuuguuaccuaacagc

SEQ ID NO: 414284 - RNA, 32 nt, Human
cuuuucugcccaucccccaguaaagaaaaggc

SEQ ID NO: 414285 - RNA, 32 nt, Human
cuuuucugcuaucaccuuccucuugucagaau

SEQ ID NO: 414286 - RNA, 17 nt, Human
cuuuucugcucuuucaa

SEQ ID NO: 414287 - RNA, 32 nt, Human
cuuuucugcugggucugggaggagggaggcug

SEQ ID NO: 414288 - RNA, 32 nt, Human
cuuuucuggaggagggaggugcugugagccua

SEQ ID NO: 414289 - RNA, 32 nt, Human
cuuuucuggccagcuuuuccaggauuuauaaa

SEQ ID NO: 414290 - RNA, 32 nt, Human
cuuuucugguagguucugucugugccaagggc

SEQ ID NO: 414291 - RNA, 32 nt, Human
cuuuucuggucccucuucucuccucaguuucu

SEQ ID NO: 414292 - RNA, 32 nt, Human
cuuuucugguucugcugacccucagucuccug

SEQ ID NO: 414293 - RNA, 22 nt, Human
cuuuucuguaaguuucuauacu

SEQ ID NO: 414294 - RNA, 32 nt, Human
cuuuucuguccuuggccaucucagccuggccu

SEQ ID NO: 414295 - RNA, 32 nt, Human
cuuuucugugcuguugguucccaaaacuagaa

SEQ ID NO: 414296 - RNA, 32 nt, Human
cuuuucugugcuuucuucccugaggcauucuu

SEQ ID NO: 414297 - RNA, 28 nt, Human
cuuuucuguuuucuucucagucuuuuca

SEQ ID NO: 414298 - RNA, 32 nt, Human
cuuuucuuacccugaucuccccagaagccucu

SEQ ID NO: 414299 - RNA, 32 nt, Human
cuuuucuuaccugagacugggccugaagggag

SEQ ID NO: 414300 - RNA, 32 nt, Human
cuuuucuuauucaccuugcuugugcuuaaaca

SEQ ID NO: 414301 - RNA, 32 nt, Human
cuuuucuuauugugauuuauuuccuaauucuu

SEQ ID NO: 414302 - RNA, 32 nt, Human
cuuuucuuccuaguuaugggugguguuuuuag

SEQ ID NO: 414303 - RNA, 32 nt, Human
cuuuucuuccugucuguuccuccccuaauccu

SEQ ID NO: 414304 - RNA, 32 nt, Human
cuuuucuuccuucacaguuuuaucucacaaaa

SEQ ID NO: 414305 - RNA, 32 nt, Human
cuuuucuucuaaucugaauucuugcuucucuc

SEQ ID NO: 414306 - RNA, 32 nt, Human
cuuuucuucucccacuugcucagcagcuuggg

SEQ ID NO: 414307 - RNA, 32 nt, Human
cuuuucuucucccacuugcucagcaguuuggg

SEQ ID NO: 414308 - RNA, 32 nt, Human
cuuuucuucucccgugacuuuacucaucuuau

SEQ ID NO: 414309 - RNA, 32 nt, Human
cuuuucuucucugcuuucuucuuucugccccu

SEQ ID NO: 414310 - RNA, 32 nt, Human
cuuuucuucuuucaaauaaauggcaguuaacu

SEQ ID NO: 414311 - RNA, 32 nt, Human
cuuuucuugccauugaccccaagcucacccca

SEQ ID NO: 414312 - RNA, 32 nt, Human
cuuuucuugcuagggugaguuuauugucccug

SEQ ID NO: 414313 - RNA, 32 nt, Human
cuuuucuuggcguuccugccaggcucucccuc

SEQ ID NO: 414314 - RNA, 32 nt, Human
cuuuucuugguuguaguucucagaauaacuag

SEQ ID NO: 414315 - RNA, 32 nt, Human
cuuuucuuguugaacuucuuggaaaagccacc

SEQ ID NO: 414316 - RNA, 32 nt, Human
cuuuucuuuaggagaacagauuuugagcuauc

SEQ ID NO: 414317 - RNA, 32 nt, Human
cuuuucuuuauucagcauccacaaacauuuag

SEQ ID NO: 414318 - RNA, 32 nt, Human
cuuuucuuuauuuagcauccacaaacauuuag

SEQ ID NO: 414319 - RNA, 32 nt, Human
cuuuucuuucuuguucaauucaucuagauuau

SEQ ID NO: 414320 - RNA, 32 nt, Human
cuuuucuuucuuuccuucuuauuuuguuaugc

SEQ ID NO: 414321 - RNA, 32 nt, Human
cuuuucuuucuuucuucgacagagucucgcug

SEQ ID NO: 414322 - RNA, 24 nt, Human
cuuuucuuugcccucugugcuuug

SEQ ID NO: 414323 - RNA, 32 nt, Human
cuuuucuuuguguuaagagggacuugccucug

SEQ ID NO: 414324 - RNA, 32 nt, Human
cuuuucuuuuucucccauccuuuuuccuuccc

SEQ ID NO: 414325 - RNA, 32 nt, Human
cuuuucuuuuuggcccucccucccucccucuu

SEQ ID NO: 414326 - RNA, 32 nt, Human
cuuuugaaaagagaaaaagaaugaaguaacuu

SEQ ID NO: 414327 - RNA, 32 nt, Human
cuuuugaaaauguaaaauaaaaccaaaaauag

SEQ ID NO: 414328 - RNA, 32 nt, Human
cuuuugaaauccaacuucugugcaaaauuuua

SEQ ID NO: 414329 - RNA, 32 nt, Human
cuuuugaacagcuucgguccccacuaugacag

SEQ ID NO: 414330 - RNA, 19 nt, Human
cuuuugaaccuccaacagg

SEQ ID NO: 414331 - RNA, 32 nt, Human
cuuuugaagaagagaauagcugcccauagcag

SEQ ID NO: 414332 - RNA, 32 nt, Human
cuuuugaagaaucugagucauuucuuacauaa

SEQ ID NO: 414333 - RNA, 32 nt, Human
cuuuugaagagugcauuucaagcugccaaggu

SEQ ID NO: 414334 - RNA, 32 nt, Human
cuuuugaagcuccucauuguucuugagugugc

SEQ ID NO: 414335 - RNA, 32 nt, Human
cuuuugaagcuucaguauaccauguuugcaua

SEQ ID NO: 414336 - RNA, 32 nt, Human
cuuuugaaggaaauggauaaucccagggggug

SEQ ID NO: 414337 - RNA, 32 nt, Human
cuuuugaaggcuccucuuucugcccuucccca

SEQ ID NO: 414338 - RNA, 32 nt, Human
cuuuugaaguaugacaguauuaagucauaaga

SEQ ID NO: 414339 - RNA, 32 nt, Human
cuuuugaauuguuuuuauuguuuucuauuuau

SEQ ID NO: 414340 - RNA, 32 nt, Human
cuuuugaccaacucccugucauuccuaaccua

SEQ ID NO: 414341 - RNA, 32 nt, Human
cuuuugaccauggaauaccaucagccugagga

SEQ ID NO: 414342 - RNA, 32 nt, Human
cuuuugacccaggagggccgcgaggcuggagc

SEQ ID NO: 414343 - RNA, 20 nt, Human
cuuuugaccccguuccuuca

SEQ ID NO: 414344 - RNA, 32 nt, Human
cuuuugacuguaccuuuuucuccaguuacugu

SEQ ID NO: 414345 - RNA, 32 nt, Human
cuuuugagaugggggucuugcucuguugccca

SEQ ID NO: 414346 - RNA, 32 nt, Human
cuuuugagcccucaucaagcucucauugugau

SEQ ID NO: 414347 - RNA, 32 nt, Human
cuuuugaggaagggagggugggcaguggucug

SEQ ID NO: 414348 - RNA, 32 nt, Human
cuuuugaggagggugggacacaacaguacaga

SEQ ID NO: 414349 - RNA, 32 nt, Human
cuuuugaugauacccaucccuccuucauuuuu

SEQ ID NO: 414350 - RNA, 32 nt, Human
cuuuugaugaugucuacagaaaaugcuggcug

SEQ ID NO: 414351 - RNA, 32 nt, Human
cuuuugaugccauugagauucaccucccacaa

SEQ ID NO: 414352 - RNA, 32 nt, Human
cuuuugauggaaaauauguggguggauaguau

SEQ ID NO: 414353 - RNA, 32 nt, Human
cuuuugauugagccuccaccucugggauuuuu

SEQ ID NO: 414354 - RNA, 32 nt, Human
cuuuugauugugucugugcccccuuucuuguc

SEQ ID NO: 414355 - RNA, 32 nt, Human
cuuuugauuuccucuucucucccuucaagccc

SEQ ID NO: 414356 - RNA, 32 nt, Human
cuuuugcaaaacugugugaucuuugugaaagu

SEQ ID NO: 414357 - RNA, 32 nt, Human
cuuuugcacagcaaaaacugcgaggccagaac

SEQ ID NO: 414358 - RNA, 31 nt, Human
cuuuugcacaggcaccagcuaccucagggac

SEQ ID NO: 414359 - RNA, 32 nt, Human
cuuuugcacaguggaagaauuucuccagaaga

SEQ ID NO: 414360 - RNA, 32 nt, Human
cuuuugcacuacaauuuuuggaauccuuuugg

SEQ ID NO: 414361 - RNA, 32 nt, Human
cuuuugcacuugaauuugcaacugaauggauu

SEQ ID NO: 414362 - RNA, 32 nt, Human
cuuuugcagcacucacgccucugacagucuuu

SEQ ID NO: 414363 - RNA, 32 nt, Human
cuuuugcagcauggaucaaacauuggcuuacu

SEQ ID NO: 414364 - RNA, 32 nt, Human
cuuuugccaagaaggaugagacaaaaggccag

SEQ ID NO: 414365 - RNA, 20 nt, Human
cuuuugccacccccucccca

SEQ ID NO: 414366 - RNA, 32 nt, Human
cuuuugccagagagauauucggaggaggggug

SEQ ID NO: 414367 - RNA, 32 nt, Human
cuuuugccaguauuaugcauauauaaguuuac

SEQ ID NO: 414368 - RNA, 32 nt, Human
cuuuugcccacugucugcuaccaggggcucac

SEQ ID NO: 414369 - RNA, 32 nt, Human
cuuuugcccagacuggagugaaguagcaugau

SEQ ID NO: 414370 - RNA, 32 nt, Human
cuuuugcccaggagaaguuuuaccucaguugu

SEQ ID NO: 414371 - RNA, 24 nt, Human
cuuuugcccaggcuggagugcagu

SEQ ID NO: 414372 - RNA, 32 nt, Human
cuuuugcccaggcuggagugcaguggcacaau

SEQ ID NO: 414373 - RNA, 32 nt, Human
cuuuugcccaggcuggagugcaguggcgugau

SEQ ID NO: 414374 - RNA, 32 nt, Human
cuuuugcccaggcuggauggagugcaguggcg

SEQ ID NO: 414375 - RNA, 20 nt, Human
cuuuugccccacccccagca

SEQ ID NO: 414376 - RNA, 32 nt, Human
cuuuugcccccucccuccccucccucucgcuc

SEQ ID NO: 414377 - RNA, 32 nt, Human
cuuuugcccuuugucaucaccaacacaacaga

SEQ ID NO: 414378 - RNA, 32 nt, Human
cuuuugccuaggcuggcgucgagacuugaggc

SEQ ID NO: 414379 - RNA, 32 nt, Human
cuuuugccugcacucuugccugcugcccugag

SEQ ID NO: 414380 - RNA, 32 nt, Human
cuuuugccuguaaucccaacacuuugggagga

SEQ ID NO: 414381 - RNA, 32 nt, Human
cuuuugccuuucuacuuccuggaccccugacc

SEQ ID NO: 414382 - RNA, 32 nt, Human
cuuuugccuuugccagagacagcuccaacuga

SEQ ID NO: 414383 - RNA, 32 nt, Human
cuuuugcuagauagagacaaaauaucagugug

SEQ ID NO: 414384 - RNA, 32 nt, Human
cuuuugcuauggagcaaauccaggaaggcaag

SEQ ID NO: 414385 - RNA, 32 nt, Human
cuuuugcuccuuggauacuuugcagcuuccua

SEQ ID NO: 414386 - RNA, 32 nt, Human
cuuuugcucggcacuucucucuugccugccac

SEQ ID NO: 414387 - RNA, 32 nt, Human
cuuuugcucucaucuugguuuccauauacuau

SEQ ID NO: 414388 - RNA, 32 nt, Human
cuuuugcucucuuccucuuucuccggccaugu

SEQ ID NO: 414389 - RNA, 32 nt, Human
cuuuugcucuuacccaggcugagugcaguggc

SEQ ID NO: 414390 - RNA, 32 nt, Human
cuuuugcucuuuccuuccuuccuucuuccuuc

SEQ ID NO: 414391 - RNA, 32 nt, Human
cuuuugcugcuaccuugaccucaagcccuuca

SEQ ID NO: 414392 - RNA, 32 nt, Human
cuuuugcugcuuuaacauuuucuggauauuaa

SEQ ID NO: 414393 - RNA, 32 nt, Human
cuuuugcugggcucuccagagcugggcuuggc

SEQ ID NO: 414394 - RNA, 32 nt, Human
cuuuugcuuagcaaagggcugacuuuccauug

SEQ ID NO: 414395 - RNA, 32 nt, Human
cuuuugcuugauuuaugaaggcugccauaguu

SEQ ID NO: 414396 - RNA, 32 nt, Human
cuuuugcuuggauucccaucauggccccuuug

SEQ ID NO: 414397 - RNA, 32 nt, Human
cuuuuggaaagaacagaaaccgggaggagacu

SEQ ID NO: 414398 - RNA, 32 nt, Human
cuuuuggaacuucagccauuuccccagguugu

SEQ ID NO: 414399 - RNA, 18 nt, Human
cuuuuggaauuuccuuca

SEQ ID NO: 414400 - RNA, 32 nt, Human
cuuuuggagaagcaaagaguccagaagucuga

SEQ ID NO: 414401 - RNA, 32 nt, Human
cuuuuggagaagcaggagggcauuggcuuaac

SEQ ID NO: 414402 - RNA, 32 nt, Human
cuuuuggagcagggcaggcuggcugcuggcuc

SEQ ID NO: 414403 - RNA, 32 nt, Human
cuuuuggaggccaaggcaggaggaucacuuga

SEQ ID NO: 414404 - RNA, 32 nt, Human
cuuuuggaggcugaggcgggcagaucacuuga

SEQ ID NO: 414405 - RNA, 32 nt, Human
cuuuuggaggcugagguuggaggauugcuuga

SEQ ID NO: 414406 - RNA, 23 nt, Human
cuuuuggauaugcugaacgcaga

SEQ ID NO: 414407 - RNA, 32 nt, Human
cuuuuggauucaugcuuucuggaagguuuaaa

SEQ ID NO: 414408 - RNA, 32 nt, Human
cuuuuggcaacaguguuaaccauauuuuauua

SEQ ID NO: 414409 - RNA, 16 nt, Human
cuuuuggcaccuucag

SEQ ID NO: 414410 - RNA, 23 nt, Human
cuuuuggcaggaaaaccaauaga

SEQ ID NO: 414411 - RNA, 20 nt, Human
cuuuuggcagguacaacaga

SEQ ID NO: 414412 - RNA, 32 nt, Human
cuuuuggcaguauuucuuuacaaauguggcaa

SEQ ID NO: 414413 - RNA, 18 nt, Human
cuuuuggcaguuccucca

SEQ ID NO: 414414 - RNA, 17 nt, Human
cuuuuggcauccguuaa

SEQ ID NO: 414415 - RNA, 32 nt, Human
cuuuuggccaaacccuggaaugugccugcugg

SEQ ID NO: 414416 - RNA, 32 nt, Human
cuuuuggccacuuuaaaaagucuucccucacc

SEQ ID NO: 414417 - RNA, 32 nt, Human
cuuuuggccauggggagaauuugacauuuauu

SEQ ID NO: 414418 - RNA, 17 nt, Human
cuuuuggccuccugcaa

SEQ ID NO: 414419 - RNA, 17 nt, Human
cuuuuggccugauucga

SEQ ID NO: 414420 - RNA, 25 nt, Human
cuuuuggcgaguugccgggcacagg

SEQ ID NO: 414421 - RNA, 32 nt, Human
cuuuuggcgccuucccuuugccguacugggag

SEQ ID NO: 414422 - RNA, 18 nt, Human
cuuuuggcggccucuuca

SEQ ID NO: 414423 - RNA, 32 nt, Human
cuuuuggcguauacugauuccuccaacucucc

SEQ ID NO: 414424 - RNA, 19 nt, Human
cuuuuggcuacaucuucaa

SEQ ID NO: 414425 - RNA, 32 nt, Human
cuuuuggcuccucagagcuggagggggaugcu

SEQ ID NO: 414426 - RNA, 18 nt, Human
cuuuuggcugcuuuucaa

SEQ ID NO: 414427 - RNA, 17 nt, Human
cuuuuggcuuucauuaa

SEQ ID NO: 414428 - RNA, 18 nt, Human
cuuuuggcuuuguuucaa

SEQ ID NO: 414429 - RNA, 32 nt, Human
cuuuugggaacuauuucucuuuauuuauagug

SEQ ID NO: 414430 - RNA, 32 nt, Human
cuuuugggacuguggaagcaucagaugccagc

SEQ ID NO: 414431 - RNA, 32 nt, Human
cuuuugggaggcagagaugggaggauacuuga

SEQ ID NO: 414432 - RNA, 32 nt, Human
cuuuugggauuuuccuaagcagaaagaccuca

SEQ ID NO: 414433 - RNA, 31 nt, Human
cuuuugggcaaagggcuugugucuucagggg

SEQ ID NO: 414434 - RNA, 32 nt, Human
cuuuugggccacugcaaagauuccagccuggg

SEQ ID NO: 414435 - RNA, 32 nt, Human
cuuuuggggauuauacaccucagccgccugag

SEQ ID NO: 414436 - RNA, 32 nt, Human
cuuuuggggauuauuuauaaagaucagacuag

SEQ ID NO: 414437 - RNA, 32 nt, Human
cuuuuggggguuagaaggucagguguggagac

SEQ ID NO: 414438 - RNA, 18 nt, Human
cuuuuggguauuuuucaa

SEQ ID NO: 414439 - RNA, 32 nt, Human
cuuuuggguuuugucuaccucaugugguaccc

SEQ ID NO: 414440 - RNA, 32 nt, Human
cuuuugguaacucuggggagaucaauagauug

SEQ ID NO: 414441 - RNA, 32 nt, Human
cuuuugguaaugugauguugauguucuccccc

SEQ ID NO: 414442 - RNA, 20 nt, Human
cuuuugguauauuccuuuaa

SEQ ID NO: 414443 - RNA, 32 nt, Human
cuuuugguauucuuuuuguuucuuuuauuguu

SEQ ID NO: 414444 - RNA, 32 nt, Human
cuuuuggucaaugucuaggaaaucucuucaga

SEQ ID NO: 414445 - RNA, 17 nt, Human
cuuuuggucccucucaa

SEQ ID NO: 414446 - RNA, 32 nt, Human
cuuuuggucuucaugauaaaucuugcugcugc

SEQ ID NO: 414447 - RNA, 18 nt, Human
cuuuuggugacccuccag

SEQ ID NO: 414448 - RNA, 32 nt, Human
cuuuuggugagcucagcugagauguagaggga

SEQ ID NO: 414449 - RNA, 32 nt, Human
cuuuuggugccuggcugguuugcccagagcca

SEQ ID NO: 414450 - RNA, 32 nt, Human
cuuuuggugcucucaccuuaucuggaagaucu

SEQ ID NO: 414451 - RNA, 32 nt, Human
cuuuugguggccuggggcaugucuugaggccc

SEQ ID NO: 414452 - RNA, 32 nt, Human
cuuuugguuagaacugcaacuucggaguugag

SEQ ID NO: 414453 - RNA, 32 nt, Human
cuuuugguugggacagugguuuuauguagggg

SEQ ID NO: 414454 - RNA, 32 nt, Human
cuuuuguaaaauucacuuguuacuuucagacc

SEQ ID NO: 414455 - RNA, 32 nt, Human
cuuuuguaaauuccuucuuguuacauucuuua

SEQ ID NO: 414456 - RNA, 32 nt, Human
cuuuuguaacgggauuuuuauuuuugcucuuu

SEQ ID NO: 414457 - RNA, 32 nt, Human
cuuuuguaaggcccagggguugcacugagucu

SEQ ID NO: 414458 - RNA, 32 nt, Human
cuuuuguacuggucuccuucucuccuuuccac

SEQ ID NO: 414459 - RNA, 21 nt, Human
cuuuuguagagcuuuuuuccu

SEQ ID NO: 414460 - RNA, 32 nt, Human
cuuuuguagguacuucaccccucaccccauuu

SEQ ID NO: 414461 - RNA, 32 nt, Human
cuuuuguauaauucaauacaugaucaucaagu

SEQ ID NO: 414462 - RNA, 32 nt, Human
cuuuuguaucuauuugacauuuuccauuaaaa

SEQ ID NO: 414463 - RNA, 32 nt, Human
cuuuuguaugauacauaaagugcuugagucua

SEQ ID NO: 414464 - RNA, 32 nt, Human
cuuuuguauucaaaugaaaaugcuuuguacaa

SEQ ID NO: 414465 - RNA, 32 nt, Human
cuuuuguauuuucagaucuccuuggagcagua

SEQ ID NO: 414466 - RNA, 32 nt, Human
cuuuuguauuuuuaguagagacaggguuucac

SEQ ID NO: 414467 - RNA, 32 nt, Human
cuuuuguauuuuuaguagagaugggguuucac

SEQ ID NO: 414468 - RNA, 32 nt, Human
cuuuuguauuuuuaguagagaugggguuuugc

SEQ ID NO: 414469 - RNA, 32 nt, Human
cuuuugucaaaucuuaacauuuugccacuucc

SEQ ID NO: 414470 - RNA, 32 nt, Human
cuuuugucaaaucuuaacauuuugccacuucg

SEQ ID NO: 414471 - RNA, 32 nt, Human
cuuuugucacccaggcuggagugccauggcac

SEQ ID NO: 414472 - RNA, 23 nt, Human
cuuuugucccccaagcuggagua

SEQ ID NO: 414473 - RNA, 32 nt, Human
cuuuugucccccaagcuggaguacaaugacag

SEQ ID NO: 414474 - RNA, 32 nt, Human
cuuuugucgcauuuugcuucacugugaguagc

SEQ ID NO: 414475 - RNA, 32 nt, Human
cuuuugucucagaggacuuugaugcuucaaua

SEQ ID NO: 414476 - RNA, 32 nt, Human
cuuuugucuccacagcaaccagccacugcagg

SEQ ID NO: 414477 - RNA, 32 nt, Human
cuuuugucucucauagcacagagcaggagggg

SEQ ID NO: 414478 - RNA, 32 nt, Human
cuuuugucuguuccagccugcuugcaacccug

SEQ ID NO: 414479 - RNA, 32 nt, Human
cuuuugucuucauugucauaaacaucugcccc

SEQ ID NO: 414480 - RNA, 32 nt, Human
cuuuugugaaaccagaaugagaauucagguuc

SEQ ID NO: 414481 - RNA, 32 nt, Human
cuuuugugacaacagugaagaggggaaaauaa

SEQ ID NO: 414482 - RNA, 32 nt, Human
cuuuugugagccaggaucucagacugccguag

SEQ ID NO: 414483 - RNA, 17 nt, Human
cuuuugugauccuuuaa

SEQ ID NO: 414484 - RNA, 32 nt, Human
cuuuugugcuuuggguuucuuuguugacugaa

SEQ ID NO: 414485 - RNA, 32 nt, Human
cuuuuguggaaaaugaguguguuugcauggaa

SEQ ID NO: 414486 - RNA, 32 nt, Human
cuuuuguggugaggaggacacaggccugggaa

SEQ ID NO: 414487 - RNA, 32 nt, Human
cuuuuguguauaaaucccaaaauauuaaauuu

SEQ ID NO: 414488 - RNA, 32 nt, Human
cuuuuguguauuccauauuggccggccccaag

SEQ ID NO: 414489 - RNA, 32 nt, Human
cuuuuguguuucuguauaacaucgaugacgag

SEQ ID NO: 414490 - RNA, 32 nt, Human
cuuuuguuaaaaauaaaacaaugaguauguuu

SEQ ID NO: 414491 - RNA, 32 nt, Human
cuuuuguuaaguuagcccuuaccauuuagugc

SEQ ID NO: 414492 - RNA, 21 nt, Human
cuuuuguuaaugcuccuccga

SEQ ID NO: 414493 - RNA, 32 nt, Human
cuuuuguuaccugacaugccguagggugagcu

SEQ ID NO: 414494 - RNA, 32 nt, Human
cuuuuguuacugacaguugccuugguccuagc

SEQ ID NO: 414495 - RNA, 32 nt, Human
cuuuuguuaguuucaguaccucagcuaucaac

SEQ ID NO: 414496 - RNA, 32 nt, Human
cuuuuguucguuuugccuucuguccuuggaac

SEQ ID NO: 414497 - RNA, 32 nt, Human
cuuuuguucuauuccccagacuccucauuauu

SEQ ID NO: 414498 - RNA, 32 nt, Human
cuuuuguucucaaaugauaagagagcuaauac

SEQ ID NO: 414499 - RNA, 32 nt, Human
cuuuuguucuguucuucugugugcauuuuaug

SEQ ID NO: 414500 - RNA, 32 nt, Human
cuuuuguugcccaggcuggagugcaacggcgc

SEQ ID NO: 414501 - RNA, 32 nt, Human
cuuuuguugcccaggcuggagugcaaugaugc

SEQ ID NO: 414502 - RNA, 32 nt, Human
cuuuuguugcccaggcuggagugcaauggcgc

SEQ ID NO: 414503 - RNA, 32 nt, Human
cuuuuguugcccaggcuggagugcaauggugc

SEQ ID NO: 414504 - RNA, 32 nt, Human
cuuuuguugcccaggcuggaguguaguggcgc

SEQ ID NO: 414505 - RNA, 32 nt, Human
cuuuuguugcccaggcuggaguucaguggcgu

SEQ ID NO: 414506 - RNA, 32 nt, Human
cuuuuguugcgcaggcuggagugcaauggugc

SEQ ID NO: 414507 - RNA, 32 nt, Human
cuuuuguugcuucauucuuuccuugcuuuguu

SEQ ID NO: 414508 - RNA, 32 nt, Human
cuuuuguugucauucuugugauccuggguggg

SEQ ID NO: 414509 - RNA, 32 nt, Human
cuuuuguuuccuagaagagaucaaagaguggu

SEQ ID NO: 414510 - RNA, 32 nt, Human
cuuuuguuugcccuugaacagggcaguguugu

SEQ ID NO: 414511 - RNA, 32 nt, Human
cuuuuguuuucagcucuggagcacagacuuua

SEQ ID NO: 414512 - RNA, 32 nt, Human
cuuuuguuuucauuugaaguuuugccauuugu

SEQ ID NO: 414513 - RNA, 32 nt, Human
cuuuuuaaacauuugcauuugcuggacaauug

SEQ ID NO: 414514 - RNA, 32 nt, Human
cuuuuuaaaugacugaaugaaguccuucgugg

SEQ ID NO: 414515 - RNA, 32 nt, Human
cuuuuuaaauuucccagggaaggagaccguca

SEQ ID NO: 414516 - RNA, 32 nt, Human
cuuuuuaacugcacuuucuuuauauaaucguu

SEQ ID NO: 414517 - RNA, 32 nt, Human
cuuuuuaagagugccugcauccuccguuugcg

SEQ ID NO: 414518 - RNA, 32 nt, Human
cuuuuuaaguaauguggaagaaaaugguuuau

SEQ ID NO: 414519 - RNA, 19 nt, Human
cuuuuuaaugcucuuucaa

SEQ ID NO: 414520 - RNA, 32 nt, Human
cuuuuuacaaaacuauuuacuguaguguauug

SEQ ID NO: 414521 - RNA, 32 nt, Human
cuuuuuacagaagucagaccugcaccacaguc

SEQ ID NO: 414522 - RNA, 32 nt, Human
cuuuuuacauauauuuguuucauuucugcaga

SEQ ID NO: 414523 - RNA, 32 nt, Human
cuuuuuacuuuuucuuuugcuuuuucucggca

SEQ ID NO: 414524 - RNA, 32 nt, Human
cuuuuuagaggaaauucacucccucguaagca

SEQ ID NO: 414525 - RNA, 31 nt, Human
cuuuuuagcaagagagaaacaagaaugcaag

SEQ ID NO: 414526 - RNA, 32 nt, Human
cuuuuuagcaagagagaaacaagaaugcaagu

SEQ ID NO: 414527 - RNA, 32 nt, Human
cuuuuuagcauuagcugccaaaugacuucaaa

SEQ ID NO: 414528 - RNA, 32 nt, Human
cuuuuuagcauuccuuucugcuuauccuucuu

SEQ ID NO: 414529 - RNA, 32 nt, Human
cuuuuuagccccggcuguggaaagauagugag

SEQ ID NO: 414530 - RNA, 32 nt, Human
cuuuuuaggccaccuccaaggacucuaaaagg

SEQ ID NO: 414531 - RNA, 24 nt, Human
cuuuuuagggccaggcaggugccu

SEQ ID NO: 414532 - RNA, 32 nt, Human
cuuuuuaguaacccuucuuucugaacccaggg

SEQ ID NO: 414533 - RNA, 19 nt, Human
cuuuuuauacccucuggca

SEQ ID NO: 414534 - RNA, 32 nt, Human
cuuuuuaucagccucuggcugcagaagagcag

SEQ ID NO: 414535 - RNA, 32 nt, Human
cuuuuuaucugaauuaucauuuagucaaggua

SEQ ID NO: 414536 - RNA, 32 nt, Human
cuuuuuauucucauuacuucucuuucaguggc

SEQ ID NO: 414537 - RNA, 32 nt, Human
cuuuuucacacagcuaggucuuuucagaagug

SEQ ID NO: 414538 - RNA, 32 nt, Human
cuuuuucacuugaccacccuugcucauugguu

SEQ ID NO: 414539 - RNA, 32 nt, Human
cuuuuucagcaucacuucaccuguggacucuu

SEQ ID NO: 414540 - RNA, 32 nt, Human
cuuuuucaguucccuucuuccuucccucucaa

SEQ ID NO: 414541 - RNA, 28 nt, Human
cuuuuuccaagugcuuguuuuauuuauu

SEQ ID NO: 414542 - RNA, 32 nt, Human
cuuuuuccacacacaagagcucagggauccuc

SEQ ID NO: 414543 - RNA, 32 nt, Human
cuuuuuccacucuugacucacucugagccuuc

SEQ ID NO: 414544 - RNA, 32 nt, Human
cuuuuuccagccuucaguucuagugcacucug

SEQ ID NO: 414545 - RNA, 32 nt, Human
cuuuuuccaggccuccagguugcacauuuauu

SEQ ID NO: 414546 - RNA, 32 nt, Human
cuuuuucccauggcuucauuucuuccucacca

SEQ ID NO: 414547 - RNA, 32 nt, Human
cuuuuuccccuuccaccucucuuugccuguag

SEQ ID NO: 414548 - RNA, 32 nt, Human
cuuuuucccucacuugcaucaauaaagcuucu

SEQ ID NO: 414549 - RNA, 32 nt, Human
cuuuuucccucaguuaguggggagacuagcac

SEQ ID NO: 414550 - RNA, 32 nt, Human
cuuuuucccugagagacuacacugggaaccaa

SEQ ID NO: 414551 - RNA, 32 nt, Human
cuuuuucccuugccaguucccuggugacaguu

SEQ ID NO: 414552 - RNA, 32 nt, Human
cuuuuucccuuucccccuuuauuuuccuccuu

SEQ ID NO: 414553 - RNA, 32 nt, Human
cuuuuucccuuuccuuuccuuucauuuucuuu

SEQ ID NO: 414554 - RNA, 32 nt, Human
cuuuuucccuuuggcccugccccugcugagac

SEQ ID NO: 414555 - RNA, 32 nt, Human
cuuuuuccucaccuuuucaaaugcucgcaacu

SEQ ID NO: 414556 - RNA, 32 nt, Human
cuuuuuccucagcugucuuccaaguauuauuu

SEQ ID NO: 414557 - RNA, 32 nt, Human
cuuuuuccuccccucagaagcuccucucuggc

SEQ ID NO: 414558 - RNA, 32 nt, Human
cuuuuuccuccccuccuccuccucuccaauuc

SEQ ID NO: 414559 - RNA, 32 nt, Human
cuuuuuccuccccuucccucauucuuugccuc

SEQ ID NO: 414560 - RNA, 32 nt, Human
cuuuuuccuccuccuccucucccggccccggc

SEQ ID NO: 414561 - RNA, 32 nt, Human
cuuuuuccugcuagccugucccccucucugga

SEQ ID NO: 414562 - RNA, 32 nt, Human
cuuuuuccuucccaaaccucuauuuuaccucc

SEQ ID NO: 414563 - RNA, 32 nt, Human
cuuuuuccuugcaaauuauaauguuuuugaua

SEQ ID NO: 414564 - RNA, 32 nt, Human
cuuuuuccuuuccugauuccuuguguaugugu

SEQ ID NO: 414565 - RNA, 32 nt, Human
cuuuuuccuuucuucauuuuucugccuggaau

SEQ ID NO: 414566 - RNA, 31 nt, Human
cuuuuucgccucccagggccugugcgaucug

SEQ ID NO: 414567 - RNA, 32 nt, Human
cuuuuucgggacucuguauucccucuugggcu

SEQ ID NO: 414568 - RNA, 32 nt, Human
cuuuuucgguggggaugugaccagcuuugaac

SEQ ID NO: 414569 - RNA, 32 nt, Human
cuuuuucuaaugacuacaccugaaaaguauca

SEQ ID NO: 414570 - RNA, 32 nt, Human
cuuuuucuagucuucauaauuucuucacucaa

SEQ ID NO: 414571 - RNA, 32 nt, Human
cuuuuucucaggacaucucuggcaggugcauu

SEQ ID NO: 414572 - RNA, 32 nt, Human
cuuuuucuccaccucucucaauacauuccuca

SEQ ID NO: 414573 - RNA, 32 nt, Human
cuuuuucucccuccuccucaaguuccuuuuug

SEQ ID NO: 414574 - RNA, 32 nt, Human
cuuuuucucccuucccugaaagggccucuggu

SEQ ID NO: 414575 - RNA, 31 nt, Human
cuuuuucuccucucugagccuuugucuauug

SEQ ID NO: 414576 - RNA, 32 nt, Human
cuuuuucucuaaggcaggaaaggaaagacauu

SEQ ID NO: 414577 - RNA, 32 nt, Human
cuuuuucucuucgccgucuccugcuccucucc

SEQ ID NO: 414578 - RNA, 32 nt, Human
cuuuuucugcgcacucaggucgugacacccca

SEQ ID NO: 414579 - RNA, 32 nt, Human
cuuuuucuggaaaaucagggagacauggguaa

SEQ ID NO: 414580 - RNA, 32 nt, Human
cuuuuucuguagaggcaccacagggagguggg

SEQ ID NO: 414581 - RNA, 32 nt, Human
cuuuuucuguagccaggucuucccaaggauuu

SEQ ID NO: 414582 - RNA, 32 nt, Human
cuuuuucuguauucuccucugaccagagacaa

SEQ ID NO: 414583 - RNA, 18 nt, Human
cuuuuucuguucuuucaa

SEQ ID NO: 414584 - RNA, 32 nt, Human
cuuuuucuuaauggaagaagauauuuaauauc

SEQ ID NO: 414585 - RNA, 32 nt, Human
cuuuuucuuagcaaucuuuucuucaauauacu

SEQ ID NO: 414586 - RNA, 32 nt, Human
cuuuuucuucaaggagcacuagcugcugggga

SEQ ID NO: 414587 - RNA, 32 nt, Human
cuuuuucuucuccuccuccuccuuccuuccuc

SEQ ID NO: 414588 - RNA, 32 nt, Human
cuuuuucuuucucuugcuguuuccuucuucuu

SEQ ID NO: 414589 - RNA, 32 nt, Human
cuuuuucuuugguggcugcaggauuuuugcug

SEQ ID NO: 414590 - RNA, 32 nt, Human
cuuuuucuuuuccccucuaaaccuguuucuga

SEQ ID NO: 414591 - RNA, 32 nt, Human
cuuuuugaaaguugccuuuucucuccacccuu

SEQ ID NO: 414592 - RNA, 32 nt, Human
cuuuuugacagaaauccuaugcagcccaugua

SEQ ID NO: 414593 - RNA, 24 nt, Human
cuuuuugacaguaaacuucugccu

SEQ ID NO: 414594 - RNA, 21 nt, Human
cuuuuugaccuuucccaagga

SEQ ID NO: 414595 - RNA, 32 nt, Human
cuuuuugagacagggucuuacucuugucaccc

SEQ ID NO: 414596 - RNA, 32 nt, Human
cuuuuugagauggagucucgcucucuugacca

SEQ ID NO: 414597 - RNA, 32 nt, Human
cuuuuugagauggagucucgcucugucgccca

SEQ ID NO: 414598 - RNA, 32 nt, Human
cuuuuugagcuuugcaaguuguguacauaaua

SEQ ID NO: 414599 - RNA, 32 nt, Human
cuuuuugcacacacacgaauacaaagagccau

SEQ ID NO: 414600 - RNA, 32 nt, Human
cuuuuugcacacauuacaggugguguguucug

SEQ ID NO: 414601 - RNA, 32 nt, Human
cuuuuugcacaggcugagugcaaugccgugau

SEQ ID NO: 414602 - RNA, 32 nt, Human
cuuuuugcaccacuguucuagccuuuaaugcc

SEQ ID NO: 414603 - RNA, 32 nt, Human
cuuuuugcacucuugugacuaauuucuauaac

SEQ ID NO: 414604 - RNA, 32 nt, Human
cuuuuugcaggcccauggucagcucuggucua

SEQ ID NO: 414605 - RNA, 32 nt, Human
cuuuuugcaucuuaacugcaguuaauuuuccu

SEQ ID NO: 414606 - RNA, 32 nt, Human
cuuuuugcccaggcuggagugcaguggcgcca

SEQ ID NO: 414607 - RNA, 32 nt, Human
cuuuuugcccauauuuacuuccaucuuugggg

SEQ ID NO: 414608 - RNA, 32 nt, Human
cuuuuugccuaggcuggagugcagugguacaa

SEQ ID NO: 414609 - RNA, 32 nt, Human
cuuuuugccugaugccauuuuauugacagaca

SEQ ID NO: 414610 - RNA, 32 nt, Human
cuuuuugcuucaauaaaacaauagcuggcucu

SEQ ID NO: 414611 - RNA, 25 nt, Human
cuuuuugcuuccucaguuuuuauca

SEQ ID NO: 414612 - RNA, 32 nt, Human
cuuuuugcuuugcuuuggguucuugaacaggu

SEQ ID NO: 414613 - RNA, 32 nt, Human
cuuuuuggaacaaguguucagagcagacagaa

SEQ ID NO: 414614 - RNA, 32 nt, Human
cuuuuuggacacacaaauuaucuuaaaacucc

SEQ ID NO: 414615 - RNA, 31 nt, Human
cuuuuuggcaaaggcaucaagcauucaaaga

SEQ ID NO: 414616 - RNA, 31 nt, Human
cuuuuuggccucucugagcaguguuccuuuu

SEQ ID NO: 414617 - RNA, 32 nt, Human
cuuuuuggccugcucuccccagcucuuuucca

SEQ ID NO: 414618 - RNA, 32 nt, Human
cuuuuugggaccaucacugagagucaggaguu

SEQ ID NO: 414619 - RNA, 32 nt, Human
cuuuuugggggugaaauuggcagaugccugag

SEQ ID NO: 414620 - RNA, 32 nt, Human
cuuuuugguguaaaucuggacucuaauucugu

SEQ ID NO: 414621 - RNA, 32 nt, Human
cuuuuuggugucccgacauaccuacgcccccg

SEQ ID NO: 414622 - RNA, 32 nt, Human
cuuuuuggugugcacacacauuucaugugcag

SEQ ID NO: 414623 - RNA, 32 nt, Human
cuuuuugguucuuucagcuaccauaauaaccc

SEQ ID NO: 414624 - RNA, 32 nt, Human
cuuuuuguaacucagcuuaguaaugaagccac

SEQ ID NO: 414625 - RNA, 31 nt, Human
cuuuuuguaagagaugaaaaagaauugacac

SEQ ID NO: 414626 - RNA, 32 nt, Human
cuuuuuguaugaagcaugccucaguuuccuca

SEQ ID NO: 414627 - RNA, 32 nt, Human
cuuuuugucaggacaauuaggauuguaaugcu

SEQ ID NO: 414628 - RNA, 32 nt, Human
cuuuuuguccaccucuccuuuaucucuguuuc

SEQ ID NO: 414629 - RNA, 32 nt, Human
cuuuuugugaugacaagauggcugacagucac

SEQ ID NO: 414630 - RNA, 32 nt, Human
cuuuuugugugugccaauuuuguuaucacauc

SEQ ID NO: 414631 - RNA, 32 nt, Human
cuuuuuguguucagcccagcagucugccuuca

SEQ ID NO: 414632 - RNA, 32 nt, Human
cuuuuuguguuuuuauaacugucaccaguuag

SEQ ID NO: 414633 - RNA, 32 nt, Human
cuuuuuguucagauggggauuugcuaaagguu

SEQ ID NO: 414634 - RNA, 32 nt, Human
cuuuuuguucugccucucaaacuccugaccuc

SEQ ID NO: 414635 - RNA, 23 nt, Human
cuuuuuguucuuagucuuuuucu

SEQ ID NO: 414636 - RNA, 32 nt, Human
cuuuuuguucuuuuucaguuuuuaaccacuuu

SEQ ID NO: 414637 - RNA, 32 nt, Human
cuuuuuguuggggguggggugggggcagagga

SEQ ID NO: 414638 - RNA, 32 nt, Human
cuuuuuguuucugccuagucucugugcccugu

SEQ ID NO: 414639 - RNA, 32 nt, Human
cuuuuuguuuugcccucuggguguuuucuuug

SEQ ID NO: 414640 - RNA, 24 nt, Human
cuuuuuucccaugucuuugcaaua

SEQ ID NO: 414641 - RNA, 22 nt, Human
cuuuuuugauuuugcugacuuu

SEQ ID NO: 414642 - RNA, 23 nt, Human
cuuuuuugggcugggugcagugg

SEQ ID NO: 414643 - RNA, 21 nt, Human
gaaaaaauggcgugccuugug

SEQ ID NO: 414644 - RNA, 32 nt, Human
gaaaaacaaaacaaaaccacaugugaaguguu

SEQ ID NO: 414645 - RNA, 32 nt, Human
gaaaaacaaggcaggauacaaguuucagacaa

SEQ ID NO: 414646 - RNA, 32 nt, Human
gaaaaacacagcccaagaauuucaugaagcau

SEQ ID NO: 414647 - RNA, 32 nt, Human
gaaaaacacaugcuguucccaggccucaagau

SEQ ID NO: 414648 - RNA, 32 nt, Human
gaaaaacacuuuacuacugcagaaggaagaaa

SEQ ID NO: 414649 - RNA, 32 nt, Human
gaaaaacagaacacaaaagagcagagcaccua

SEQ ID NO: 414650 - RNA, 32 nt, Human
gaaaaacagccauaggcccuuucaguggccgg

SEQ ID NO: 414651 - RNA, 32 nt, Human
gaaaaacaggaaaguugggaagcggggguagg

SEQ ID NO: 414652 - RNA, 32 nt, Human
gaaaaacagugguuuucugucccuggaaauga

SEQ ID NO: 414653 - RNA, 32 nt, Human
gaaaaacauagaugggacagguaaaugaaaug

SEQ ID NO: 414654 - RNA, 32 nt, Human
gaaaaacaucauuacuggaaaccuauuaaaca

SEQ ID NO: 414655 - RNA, 32 nt, Human
gaaaaacaugaaaaggagagacuggccuagcc

SEQ ID NO: 414656 - RNA, 32 nt, Human
gaaaaaccaggccauacagagauaggagccga

SEQ ID NO: 414657 - RNA, 32 nt, Human
gaaaaaccauuuugaauaggauggaaucuaac

SEQ ID NO: 414658 - RNA, 32 nt, Human
gaaaaacccucccaggcaucccauaccagcac

SEQ ID NO: 414659 - RNA, 32 nt, Human
gaaaaaccucaccaguuuuacuaucaaagcca

SEQ ID NO: 414660 - RNA, 32 nt, Human
gaaaaaccuccccuucugaggcugcuuuccca

SEQ ID NO: 414661 - RNA, 32 nt, Human
gaaaaaccuggccauuugcugccucuaauucc

SEQ ID NO: 414662 - RNA, 32 nt, Human
gaaaaaccuucucuucagaaaagaagaaaaau

SEQ ID NO: 414663 - RNA, 32 nt, Human
gaaaaacggaggcucagagaggacguggaauu

SEQ ID NO: 414664 - RNA, 32 nt, Human
gaaaaacggguucaaaccccacuucugccacc

SEQ ID NO: 414665 - RNA, 32 nt, Human
gaaaaacuacagccagagguaaggcuggaaau

SEQ ID NO: 414666 - RNA, 32 nt, Human
gaaaaacucaauccucccaugaaaaucaguuc

SEQ ID NO: 414667 - RNA, 32 nt, Human
gaaaaacucaucaccacaugccuucacuccag

SEQ ID NO: 414668 - RNA, 32 nt, Human
gaaaaacucgcucuuggcuuucggcuuggagg

SEQ ID NO: 414669 - RNA, 32 nt, Human
gaaaaacugggagagucaaaagugagcagaag

SEQ ID NO: 414670 - RNA, 32 nt, Human
gaaaaacugguguucugaaauagccuaacauu

SEQ ID NO: 414671 - RNA, 32 nt, Human
gaaaaacuucaauuuugagaauggcaucugua

SEQ ID NO: 414672 - RNA, 32 nt, Human
gaaaaacuucaugcaugaaugagcauucccag

SEQ ID NO: 414673 - RNA, 18 nt, Human
gaaaaacuucucuggaga

SEQ ID NO: 414674 - RNA, 32 nt, Human
gaaaaagaaaacuacaucacauaccaggggag

SEQ ID NO: 414675 - RNA, 23 nt, Human
gaaaaagaaaagaaaccgaugga

SEQ ID NO: 414676 - RNA, 22 nt, Human
gaaaaagaaacaugaagucaug

SEQ ID NO: 414677 - RNA, 32 nt, Human
gaaaaagaaagccuaugggaaauggcugugcu

SEQ ID NO: 414678 - RNA, 32 nt, Human
gaaaaagaaagcuucucucugagcauccagau

SEQ ID NO: 414679 - RNA, 32 nt, Human
gaaaaagaaauguacuuguuaggaaguagcuu

SEQ ID NO: 414680 - RNA, 32 nt, Human
gaaaaagaagaaaauuaggacugauucagaag

SEQ ID NO: 414681 - RNA, 21 nt, Human
gaaaaagacagaagggcccgg

SEQ ID NO: 414682 - RNA, 32 nt, Human
gaaaaagacucugcaugggaauggccugccuu

SEQ ID NO: 414683 - RNA, 32 nt, Human
gaaaaagagagggagaugcagcagcugcugag

SEQ ID NO: 414684 - RNA, 32 nt, Human
gaaaaagagagggagguauggacugggggcca

SEQ ID NO: 414685 - RNA, 32 nt, Human
gaaaaagagagggggaaaaguagaucacuuau

SEQ ID NO: 414686 - RNA, 32 nt, Human
gaaaaagaguugagcaggauucucuuaggcua

SEQ ID NO: 414687 - RNA, 32 nt, Human
gaaaaagauauauucagaaagacagagugaua

SEQ ID NO: 414688 - RNA, 32 nt, Human
gaaaaagauaugguuugugaacuggggcauca

SEQ ID NO: 414689 - RNA, 32 nt, Human
gaaaaagcaaaaaggucuguccguuacuuuug

SEQ ID NO: 414690 - RNA, 31 nt, Human
gaaaaagcacuuuucauuuuuguaaguagau

SEQ ID NO: 414691 - RNA, 21 nt, Human
gaaaaagcaggaggugccagg

SEQ ID NO: 414692 - RNA, 32 nt, Human
gaaaaagcccagaagagaaggaagaggaaagc

SEQ ID NO: 414693 - RNA, 32 nt, Human
gaaaaagccucacagauuugaagaacuggacc

SEQ ID NO: 414694 - RNA, 32 nt, Human
gaaaaagccuuccacccuccugucuggcuuua

SEQ ID NO: 414695 - RNA, 32 nt, Human
gaaaaagcuccagagaccucacagcauuguag

SEQ ID NO: 414696 - RNA, 32 nt, Human
gaaaaagcugacuccauuuuugucccuggcgg

SEQ ID NO: 414697 - RNA, 32 nt, Human
gaaaaagcugggugcagugaaaugauucaugu

SEQ ID NO: 414698 - RNA, 32 nt, Human
gaaaaaggaaaguagaaggcagcugcuggccu

SEQ ID NO: 414699 - RNA, 32 nt, Human
gaaaaaggagaaaagggaaaagcagaaaggaa

SEQ ID NO: 414700 - RNA, 32 nt, Human
gaaaaaggagcugcaugcuucacuggaguuga

SEQ ID NO: 414701 - RNA, 32 nt, Human
gaaaaaggaggcagcaggcaagagaccuggag

SEQ ID NO: 414702 - RNA, 32 nt, Human
gaaaaaggauggacccagcacuccagggagaa

SEQ ID NO: 414703 - RNA, 23 nt, Human
gaaaaaggauuuacuuguugggg

SEQ ID NO: 414704 - RNA, 32 nt, Human
gaaaaaggcccagagcuguggccggacagagu

SEQ ID NO: 414705 - RNA, 32 nt, Human
gaaaaaggccugauuacagaaaaauaccauua

SEQ ID NO: 414706 - RNA, 32 nt, Human
gaaaaagggcugcccauguugugcuacacuau

SEQ ID NO: 414707 - RNA, 32 nt, Human
gaaaaagguuggagcaaggcuuuucacuacuu

SEQ ID NO: 414708 - RNA, 21 nt, Human
gaaaaaguaggcugggcgcgg

SEQ ID NO: 414709 - RNA, 32 nt, Human
gaaaaagucugucagaaccauguacaacaucc

SEQ ID NO: 414710 - RNA, 21 nt, Human
gaaaaagugaaaccagcccgg

SEQ ID NO: 414711 - RNA, 23 nt, Human
gaaaaagugggaauugacagccc

SEQ ID NO: 414712 - RNA, 24 nt, Human
gaaaaaguguaagagaaggccggg

SEQ ID NO: 414713 - RNA, 32 nt, Human
gaaaaaguuauucaggagaguauguugaucuu

SEQ ID NO: 414714 - RNA, 32 nt, Human
gaaaaaguucaacccaggucuuguauccugug

SEQ ID NO: 414715 - RNA, 18 nt, Human
gaaaaaguugcagucuca

SEQ ID NO: 414716 - RNA, 32 nt, Human
gaaaaaguugcccucaagccugaccuggaacc

SEQ ID NO: 414717 - RNA, 32 nt, Human
gaaaaaguuuaaaagaaauucugacagaugac

SEQ ID NO: 414718 - RNA, 32 nt, Human
gaaaaauaaaugccucauaaaugauaguacaa

SEQ ID NO: 414719 - RNA, 32 nt, Human
gaaaaauaagaaguauuacaacagaaaaaccu

SEQ ID NO: 414720 - RNA, 32 nt, Human
gaaaaauacauccaaauaaagacuuuauuauu

SEQ ID NO: 414721 - RNA, 32 nt, Human
gaaaaauaccguuugggaccaggcuggccuag

SEQ ID NO: 414722 - RNA, 32 nt, Human
gaaaaauacuuccuaggccgggcacagugguu

SEQ ID NO: 414723 - RNA, 32 nt, Human
gaaaaauagacccauucauuguguacauucac

SEQ ID NO: 414724 - RNA, 32 nt, Human
gaaaaauagcaacuauucauuuguucacaaca

SEQ ID NO: 414725 - RNA, 32 nt, Human
gaaaaauaggcacagaguaaagacuuguaagu

SEQ ID NO: 414726 - RNA, 32 nt, Human
gaaaaauaucuccacucuccccauuccuguuc

SEQ ID NO: 414727 - RNA, 32 nt, Human
gaaaaauaugaccacacuccagcugggaucac

SEQ ID NO: 414728 - RNA, 32 nt, Human
gaaaaaucacacaggcugggugcaguggcuca

SEQ ID NO: 414729 - RNA, 32 nt, Human
gaaaaaucaguguagaagaauaccucaugugc

SEQ ID NO: 414730 - RNA, 32 nt, Human
gaaaaaucaugcuggagggaagcccuacacau

SEQ ID NO: 414731 - RNA, 32 nt, Human
gaaaaaucauuuucuuugucugagucucuggu

SEQ ID NO: 414732 - RNA, 32 nt, Human
gaaaaauccacccacaaaugaauuaucaggag

SEQ ID NO: 414733 - RNA, 32 nt, Human
gaaaaaucccuaagaccugaccugccuacucc

SEQ ID NO: 414734 - RNA, 32 nt, Human
gaaaaauccuaccaguguaagcaaugucggaa

SEQ ID NO: 414735 - RNA, 32 nt, Human
gaaaaaucuuugucauucugucaguuuuuaaa

SEQ ID NO: 414736 - RNA, 30 nt, Human
gaaaaaugaaaccugaugaaacuccuaugu

SEQ ID NO: 414737 - RNA, 32 nt, Human
gaaaaaugaauagagccucagagagcuguggc

SEQ ID NO: 414738 - RNA, 32 nt, Human
gaaaaaugagaucagaaguggagauguugggg

SEQ ID NO: 414739 - RNA, 32 nt, Human
gaaaaaugaggaugaauaacaaguuuggcaaa

SEQ ID NO: 414740 - RNA, 32 nt, Human
gaaaaaugaggauugccuuccuuguaugcgcu

SEQ ID NO: 414741 - RNA, 32 nt, Human
gaaaaaugagggagagagaaaggguggccacu

SEQ ID NO: 414742 - RNA, 30 nt, Human
gaaaaaugcaggaagaggagggggaaaguu

SEQ ID NO: 414743 - RNA, 31 nt, Human
gaaaaaugcucaaucucagcuaacauuccau

SEQ ID NO: 414744 - RNA, 32 nt, Human
gaaaaauggaaagagaaaaagauggaauaucu

SEQ ID NO: 414745 - RNA, 32 nt, Human
gaaaaauggaagacuugugacgcagacgacag

SEQ ID NO: 414746 - RNA, 32 nt, Human
gaaaaauggagcugccccagugcuccuggacc

SEQ ID NO: 414747 - RNA, 32 nt, Human
gaaaaauggccaaaaaucauccuuuccacuug

SEQ ID NO: 414748 - RNA, 32 nt, Human
gaaaaauggucugucauaaauuauuuccccgg

SEQ ID NO: 414749 - RNA, 32 nt, Human
gaaaaaugucuauuuugaucccuugccuauuu

SEQ ID NO: 414750 - RNA, 32 nt, Human
gaaaaaugucuuugcuccuuggcagcuaccag

SEQ ID NO: 414751 - RNA, 19 nt, Human
gaaaaaugugcaaagccuu

SEQ ID NO: 414752 - RNA, 32 nt, Human
gaaaaaugugcaaaggaaacuauugucucgcu

SEQ ID NO: 414753 - RNA, 32 nt, Human
gaaaaauguuaacauuuuguuccuacagguua

SEQ ID NO: 414754 - RNA, 32 nt, Human
gaaaaauguuccccauugaauuccuguuuuag

SEQ ID NO: 414755 - RNA, 32 nt, Human
gaaaaauguuccccguugaauuccuguuuuag

SEQ ID NO: 414756 - RNA, 32 nt, Human
gaaaaauguuuuguacccaucuggaaaaccaa

SEQ ID NO: 414757 - RNA, 32 nt, Human
gaaaaauuaauguuauuaaauaguuugcaaau

SEQ ID NO: 414758 - RNA, 32 nt, Human
gaaaaauuacucuucuuuaaugcuaaguauug

SEQ ID NO: 414759 - RNA, 32 nt, Human
gaaaaauucaacaaaauccuguuucucagugg

SEQ ID NO: 414760 - RNA, 32 nt, Human
gaaaaauuccagaaauaaaacaauucauaagu

SEQ ID NO: 414761 - RNA, 32 nt, Human
gaaaaauuccaucuucauuacugccuuaugac

SEQ ID NO: 414762 - RNA, 32 nt, Human
gaaaaauuccuaagaaucagaguagaaauaaa

SEQ ID NO: 414763 - RNA, 32 nt, Human
gaaaaauucuaccuucuuuuauggucaaacug

SEQ ID NO: 414764 - RNA, 32 nt, Human
gaaaaauucucaaagccugaaagaaaaucugu

SEQ ID NO: 414765 - RNA, 18 nt, Human
gaaaaauucucucuggga

SEQ ID NO: 414766 - RNA, 32 nt, Human
gaaaaauuggcuagaugugguggugcacgccu

SEQ ID NO: 414767 - RNA, 32 nt, Human
gaaaaauuuccagaugaaaaggcagcuuauuu

SEQ ID NO: 414768 - RNA, 32 nt, Human
gaaaaauuuguaggugagaucaccuccuuugc

SEQ ID NO: 414769 - RNA, 32 nt, Human
gaaaaauuuuggugaguucugcacauuucccc

SEQ ID NO: 414770 - RNA, 22 nt, Human
gaaaacaaaacaaaacaaaaca

SEQ ID NO: 414771 - RNA, 32 nt, Human
gaaaacaaaacaacccagagggcuguguucca

SEQ ID NO: 414772 - RNA, 32 nt, Human
gaaaacaaaacaccacaaaacagacuucacua

SEQ ID NO: 414773 - RNA, 32 nt, Human
gaaaacaaaacucagacucacucuucagucau

SEQ ID NO: 414774 - RNA, 32 nt, Human
gaaaacaaaaugagcggggacacagaaaccaa

SEQ ID NO: 414775 - RNA, 32 nt, Human
gaaaacaaaaugccaguugcauugguuucccc

SEQ ID NO: 414776 - RNA, 32 nt, Human
gaaaacaaacacaucaauaucucuuccaaaug

SEQ ID NO: 414777 - RNA, 32 nt, Human
gaaaacaaagaaguguucaaagagcacagacu

SEQ ID NO: 414778 - RNA, 32 nt, Human
gaaaacaaagaauguuuugagaauguguuaau

SEQ ID NO: 414779 - RNA, 31 nt, Human
gaaaacaaaggcucuuuucagagccauucua

SEQ ID NO: 414780 - RNA, 19 nt, Human
gaaaacaacaaaacaaaca

SEQ ID NO: 414781 - RNA, 32 nt, Human
gaaaacaacuccaguucucugccugcaccaug

SEQ ID NO: 414782 - RNA, 32 nt, Human
gaaaacaagccugagggaggaggcaggaguug

SEQ ID NO: 414783 - RNA, 32 nt, Human
gaaaacaagcugcauggccucucuccagcucu

SEQ ID NO: 414784 - RNA, 32 nt, Human
gaaaacaaggagaccuggggugggugugguug

SEQ ID NO: 414785 - RNA, 32 nt, Human
gaaaacaaggcagcagcgcaccugccaccccu

SEQ ID NO: 414786 - RNA, 32 nt, Human
gaaaacaauuuugccgccccugccuggaaacu

SEQ ID NO: 414787 - RNA, 32 nt, Human
gaaaacacaaaugccuuauuuauacagaagca

SEQ ID NO: 414788 - RNA, 32 nt, Human
gaaaacacacauaugaggaguugcauuauuuu

SEQ ID NO: 414789 - RNA, 32 nt, Human
gaaaacacaggcuuuugcacauccaaugucuc

SEQ ID NO: 414790 - RNA, 32 nt, Human
gaaaacaccaugucauggaguguaggaaagag

SEQ ID NO: 414791 - RNA, 32 nt, Human
gaaaacaccuucauccaggcugggcgaggugg

SEQ ID NO: 414792 - RNA, 32 nt, Human
gaaaacacggaagaagucucuaugagaagagc

SEQ ID NO: 414793 - RNA, 32 nt, Human
gaaaacacuaagaauaaugucacugcaucagu

SEQ ID NO: 414794 - RNA, 32 nt, Human
gaaaacagaaaucugcaucucagccugagacg

SEQ ID NO: 414795 - RNA, 32 nt, Human
gaaaacagaacaucauuagaacaaaggacaga

SEQ ID NO: 414796 - RNA, 32 nt, Human
gaaaacagaacccaaaaggguaagugguuagu

SEQ ID NO: 414797 - RNA, 32 nt, Human
gaaaacagaagcaaaggagagcuugggggugg

SEQ ID NO: 414798 - RNA, 32 nt, Human
gaaaacagacuuguaaaaagcuuagaucauca

SEQ ID NO: 414799 - RNA, 32 nt, Human
gaaaacagaggcugaggcugggcacgguggcu

SEQ ID NO: 414800 - RNA, 17 nt, Human
gaaaacagccccagcca

SEQ ID NO: 414801 - RNA, 31 nt, Human
gaaaacaggaaacuggucaaaggcuccuaca

SEQ ID NO: 414802 - RNA, 32 nt, Human
gaaaacaggagguggagguugcagugagccga

SEQ ID NO: 414803 - RNA, 32 nt, Human
gaaaacaggcugggacaguggugcaugccagu

SEQ ID NO: 414804 - RNA, 32 nt, Human
gaaaacaggcugggcccgguggcucacuccug

SEQ ID NO: 414805 - RNA, 32 nt, Human
gaaaacagugggaugauguauuccaagugcug

SEQ ID NO: 414806 - RNA, 32 nt, Human
gaaaacaguuccucaaauuugaccccaaauuu

SEQ ID NO: 414807 - RNA, 32 nt, Human
gaaaacauaccugcccgcaguuggaguuggac

SEQ ID NO: 414808 - RNA, 32 nt, Human
gaaaacauauccucagcaauuucccaagaaac

SEQ ID NO: 414809 - RNA, 32 nt, Human
gaaaacaucaauauaucaccuaccaucauuuc

SEQ ID NO: 414810 - RNA, 32 nt, Human
gaaaacaucagccauuacauuacuuggcucug

SEQ ID NO: 414811 - RNA, 22 nt, Human
gaaaacaugguagaauuggaga

SEQ ID NO: 414812 - RNA, 32 nt, Human
gaaaacauucaaaaguucacaucccuguuugg

SEQ ID NO: 414813 - RNA, 32 nt, Human
gaaaacauuugauuaucaggacagaguagaag

SEQ ID NO: 414814 - RNA, 20 nt, Human
gaaaacauuugccucagcca

SEQ ID NO: 414815 - RNA, 32 nt, Human
gaaaacauuuuaaaauguguuuucacauuaaa

SEQ ID NO: 414816 - RNA, 32 nt, Human
gaaaaccaaaaccaaacgaaaugucuaaggaa

SEQ ID NO: 414817 - RNA, 32 nt, Human
gaaaaccaaaguguggguagaaaccccaaaug

SEQ ID NO: 414818 - RNA, 32 nt, Human
gaaaaccaaauuuaaaggcaugucuccagugc

SEQ ID NO: 414819 - RNA, 32 nt, Human
gaaaaccaacuaaggacucucaaaccauaccu

SEQ ID NO: 414820 - RNA, 23 nt, Human
gaaaaccaagacagaauugggaa

SEQ ID NO: 414821 - RNA, 32 nt, Human
gaaaaccaagugucagagccccuuccccuugu

SEQ ID NO: 414822 - RNA, 31 nt, Human
gaaaaccaaguguccggauggcaggggccag

SEQ ID NO: 414823 - RNA, 32 nt, Human
gaaaaccaccauauaucauaauucaacagagg

SEQ ID NO: 414824 - RNA, 32 nt, Human
gaaaaccaccucuguuuuccuugcucuauaca

SEQ ID NO: 414825 - RNA, 32 nt, Human
gaaaaccacugcaagccccaaggagccagcug

SEQ ID NO: 414826 - RNA, 32 nt, Human
gaaaaccagccaagcuuuauucacgacacacu

SEQ ID NO: 414827 - RNA, 32 nt, Human
gaaaaccagccaagcuuuauucaggacacacu

SEQ ID NO: 414828 - RNA, 32 nt, Human
gaaaaccagccacugcaaaacuuuauaaucaa

SEQ ID NO: 414829 - RNA, 25 nt, Human
gaaaaccagcggagagagggccggg

SEQ ID NO: 414830 - RNA, 32 nt, Human
gaaaaccagggggaugaguggcuuccauggag

SEQ ID NO: 414831 - RNA, 32 nt, Human
gaaaaccagucuccccuacucuggguggggaa

SEQ ID NO: 414832 - RNA, 32 nt, Human
gaaaaccaucuggggucccuuuuccagucccc

SEQ ID NO: 414833 - RNA, 32 nt, Human
gaaaaccauggacugaauggaccauuuuaugu

SEQ ID NO: 414834 - RNA, 32 nt, Human
gaaaaccauuucagaagccuggauuaaggcaa

SEQ ID NO: 414835 - RNA, 23 nt, Human
gaaaacccaaacaaaacaaaaca

SEQ ID NO: 414836 - RNA, 32 nt, Human
gaaaacccagcccuggcuguuuacucaggcuc

SEQ ID NO: 414837 - RNA, 21 nt, Human
gaaaaccccaagcauuuggaa

SEQ ID NO: 414838 - RNA, 32 nt, Human
gaaaaccccagcccuucucccauggcaggcua

SEQ ID NO: 414839 - RNA, 32 nt, Human
gaaaacccugaauaacuuuaugugccacugag

SEQ ID NO: 414840 - RNA, 32 nt, Human
gaaaacccugccuuaccucucccuucccccua

SEQ ID NO: 414841 - RNA, 32 nt, Human
gaaaacccuggaguggagggaggcucagagau

SEQ ID NO: 414842 - RNA, 32 nt, Human
gaaaaccgcaggccugucgccuaggcggccac

SEQ ID NO: 414843 - RNA, 32 nt, Human
gaaaaccguccaggaagggaggcugcagcccc

SEQ ID NO: 414844 - RNA, 32 nt, Human
gaaaaccuaaacaagccucuugcucaguaaag

SEQ ID NO: 414845 - RNA, 32 nt, Human
gaaaaccuaagccucccucucucuccggcacc

SEQ ID NO: 414846 - RNA, 32 nt, Human
gaaaaccucuauacaggauagccaacaauaaa

SEQ ID NO: 414847 - RNA, 32 nt, Human
gaaaaccugcauccucugggcuuguuaacuug

SEQ ID NO: 414848 - RNA, 32 nt, Human
gaaaaccugccucucauuuuguuuguaaagaa

SEQ ID NO: 414849 - RNA, 32 nt, Human
gaaaaccugccugagcguggauggugcaugca

SEQ ID NO: 414850 - RNA, 32 nt, Human
gaaaaccugcucugcugaugucgaauuccuug

SEQ ID NO: 414851 - RNA, 32 nt, Human
gaaaaccugcuuuguagaugcagagagaagcu

SEQ ID NO: 414852 - RNA, 24 nt, Human
gaaaaccuggugacugauauaguu

SEQ ID NO: 414853 - RNA, 32 nt, Human
gaaaaccuucucccaggagucaaaacccuuug

SEQ ID NO: 414854 - RNA, 32 nt, Human
gaaaaccuuuagagaagaagcugcuggcugag

SEQ ID NO: 414855 - RNA, 32 nt, Human
gaaaacgaaaaccuguucucuccuucauugug

SEQ ID NO: 414856 - RNA, 32 nt, Human
gaaaacgaccgagaccgaagauuggcuacugu

SEQ ID NO: 414857 - RNA, 32 nt, Human
gaaaacgcgccaaguuccccucgguggcggag

SEQ ID NO: 414858 - RNA, 32 nt, Human
gaaaacggaagcaggguucuugccugguagcu

SEQ ID NO: 414859 - RNA, 21 nt, Human
gaaaacggggagagaggagcc

SEQ ID NO: 414860 - RNA, 32 nt, Human
gaaaacggggucuguggcgguacucugaacaa

SEQ ID NO: 414861 - RNA, 32 nt, Human
gaaaacgguaacucaagaggacagaggcuggu

SEQ ID NO: 414862 - RNA, 32 nt, Human
gaaaacuaaacacacacauaaacaguuauaag

SEQ ID NO: 414863 - RNA, 32 nt, Human
gaaaacuaauaugccggcguuuaagccugugc

SEQ ID NO: 414864 - RNA, 32 nt, Human
gaaaacuauuccaggacuaauucuuaaucggc

SEQ ID NO: 414865 - RNA, 32 nt, Human
gaaaacucaagcugcaccauaaagcuaaagga

SEQ ID NO: 414866 - RNA, 32 nt, Human
gaaaacucaaguccgguggaaguggcuggaag

SEQ ID NO: 414867 - RNA, 32 nt, Human
gaaaacucaauaccaucaucucuuaucucuau

SEQ ID NO: 414868 - RNA, 32 nt, Human
gaaaacucacugccuuuaccuacuagaauuuc

SEQ ID NO: 414869 - RNA, 32 nt, Human
gaaaacucagagagggucuucguugcucaguc

SEQ ID NO: 414870 - RNA, 32 nt, Human
gaaaacucaggaguucaagaccagccuaggca

SEQ ID NO: 414871 - RNA, 32 nt, Human
gaaaacuccagccauccuggaguugauauuca

SEQ ID NO: 414872 - RNA, 20 nt, Human
gaaaacucccagcucugcca

SEQ ID NO: 414873 - RNA, 32 nt, Human
gaaaacuccuuugacagagauuugguuuucac

SEQ ID NO: 414874 - RNA, 32 nt, Human
gaaaacucguuuucugcucccuucccucgucc

SEQ ID NO: 414875 - RNA, 32 nt, Human
gaaaacucuagauuuuucucauaucaggugau

SEQ ID NO: 414876 - RNA, 32 nt, Human
gaaaacucuggaauggagaggcuggcgacugg

SEQ ID NO: 414877 - RNA, 32 nt, Human
gaaaacucuucucaagaaaaucuaugugcaga

SEQ ID NO: 414878 - RNA, 32 nt, Human
gaaaacugaagcaccuucccuaaagaaaacuu

SEQ ID NO: 414879 - RNA, 32 nt, Human
gaaaacugaagugcaaucagggccaagaaaaa

SEQ ID NO: 414880 - RNA, 32 nt, Human
gaaaacugaguuaaaagaaaguaggcauuuag

SEQ ID NO: 414881 - RNA, 32 nt, Human
gaaaacugcaguccgggauggcucagucggcc

SEQ ID NO: 414882 - RNA, 32 nt, Human
gaaaacugcugauuuuacauuuuauggcugaa

SEQ ID NO: 414883 - RNA, 32 nt, Human
gaaaacuggaccagagguggaaagauguauuu

SEQ ID NO: 414884 - RNA, 32 nt, Human
gaaaacugggucccgcacagagccaggucccc

SEQ ID NO: 414885 - RNA, 24 nt, Human
gaaaacugguugaaaaugaaguua

SEQ ID NO: 414886 - RNA, 24 nt, Human
gaaaacugguuuuucauguguuuu

SEQ ID NO: 414887 - RNA, 32 nt, Human
gaaaacuguuaucuuuuccugcugugaguuua

SEQ ID NO: 414888 - RNA, 24 nt, Human
gaaaacuguugggaugaugugguu

SEQ ID NO: 414889 - RNA, 32 nt, Human
gaaaacuuaaagaaaggaaggcugggcauugu

SEQ ID NO: 414890 - RNA, 32 nt, Human
gaaaacuuagaagaaaaggcagagacaggcaa

SEQ ID NO: 414891 - RNA, 19 nt, Human
gaaaacuuagccauggaga

SEQ ID NO: 414892 - RNA, 23 nt, Human
gaaaacuugaucugugguguuuu

SEQ ID NO: 414893 - RNA, 24 nt, Human
gaaaacuuguauuaccauggguuu

SEQ ID NO: 414894 - RNA, 24 nt, Human
gaaaacuuguauuauguguguuuu

SEQ ID NO: 414895 - RNA, 32 nt, Human
gaaaagaaaacagacaguuuaguucagaaugg

SEQ ID NO: 414896 - RNA, 32 nt, Human
gaaaagaaaagaaaagaaagaaaggaauuagg

SEQ ID NO: 414897 - RNA, 32 nt, Human
gaaaagaaaagaaagagaaaagaaaagaaaau

SEQ ID NO: 414898 - RNA, 32 nt, Human
gaaaagaaacgaaggaaggaacaagaggagaa

SEQ ID NO: 414899 - RNA, 32 nt, Human
gaaaagaaagauuaaaccuacuuucauaugua

SEQ ID NO: 414900 - RNA, 32 nt, Human
gaaaagaaaggaaugagagggaaaguuuggac

SEQ ID NO: 414901 - RNA, 32 nt, Human
gaaaagaaaggaccagucuucacuuucugcau

SEQ ID NO: 414902 - RNA, 32 nt, Human
gaaaagaaagugccuuauuuuccuucaugguc

SEQ ID NO: 414903 - RNA, 32 nt, Human
gaaaagaaagugguuggucugagguuggagga

SEQ ID NO: 414904 - RNA, 32 nt, Human
gaaaagaacuacgagaggaagcauggcacuug

SEQ ID NO: 414905 - RNA, 25 nt, Human
gaaaagaacuguuuacugcuugaua

SEQ ID NO: 414906 - RNA, 32 nt, Human
gaaaagaagagaaaagaagaagaaaggaaaaa

SEQ ID NO: 414907 - RNA, 32 nt, Human
gaaaagaagaggaggaggagagcgacgggacg

SEQ ID NO: 414908 - RNA, 32 nt, Human
gaaaagaaggaaggaaggaagaaugugcaaga

SEQ ID NO: 414909 - RNA, 32 nt, Human
gaaaagaaggagcaccuugagcuggauggggg

SEQ ID NO: 414910 - RNA, 32 nt, Human
gaaaagaaggaguggaggaagacucuggaacc

SEQ ID NO: 414911 - RNA, 19 nt, Human
gaaaagaaugagaauucua

SEQ ID NO: 414912 - RNA, 32 nt, Human
gaaaagacaacaaaaguaucuucauacuuccu

SEQ ID NO: 414913 - RNA, 32 nt, Human
gaaaagacaacuggcuacaaagaaggauguca

SEQ ID NO: 414914 - RNA, 32 nt, Human
gaaaagacagaaaaggaagaggaaggaaggaa

SEQ ID NO: 414915 - RNA, 32 nt, Human
gaaaagacaucagaguagagaaaaugguuucu

SEQ ID NO: 414916 - RNA, 32 nt, Human
gaaaagaccaaaguggaagaggaagugaaaac

SEQ ID NO: 414917 - RNA, 32 nt, Human
gaaaagacccagccagggcuggcugcuccagc

SEQ ID NO: 414918 - RNA, 32 nt, Human
gaaaagacgcagaacaugaagggacucagaag

SEQ ID NO: 414919 - RNA, 21 nt, Human
gaaaagacugccccaacugua

SEQ ID NO: 414920 - RNA, 32 nt, Human
gaaaagacuugccgcacuucugaguccaaaca

SEQ ID NO: 414921 - RNA, 32 nt, Human
gaaaagagaagaaagcugacucagggauaguu

SEQ ID NO: 414922 - RNA, 32 nt, Human
gaaaagagaaggaccaacaucccccuuucccu

SEQ ID NO: 414923 - RNA, 32 nt, Human
gaaaagagaaucugccaccagaucgaauuucg

SEQ ID NO: 414924 - RNA, 32 nt, Human
gaaaagagagaaagggauaaucaccuggaaga

SEQ ID NO: 414925 - RNA, 32 nt, Human
gaaaagagaggcauaguuauaggaaacuggaa

SEQ ID NO: 414926 - RNA, 32 nt, Human
gaaaagagagguggccuuguaaugaagccuca

SEQ ID NO: 414927 - RNA, 32 nt, Human
gaaaagagauggugcccugggccagguggcug

SEQ ID NO: 414928 - RNA, 32 nt, Human
gaaaagagauuauuuuugccaccuacaucuau

SEQ ID NO: 414929 - RNA, 32 nt, Human
gaaaagagauuuagaguauaacagaaacaagu

SEQ ID NO: 414930 - RNA, 32 nt, Human
gaaaagaggaagaggcugcaauggagcagcac

SEQ ID NO: 414931 - RNA, 32 nt, Human
gaaaagaggaggaggaggaggaagaaagaaaa

SEQ ID NO: 414932 - RNA, 32 nt, Human
gaaaagagggcugagggccuggaggugggcuc

SEQ ID NO: 414933 - RNA, 32 nt, Human
gaaaagagggguaccuguuuucauuugaaaac

SEQ ID NO: 414934 - RNA, 32 nt, Human
gaaaagaucacccaacaccuuugaggcuuaaa

SEQ ID NO: 414935 - RNA, 19 nt, Human
gaaaagaugcugcuuuuga

SEQ ID NO: 414936 - RNA, 31 nt, Human
gaaaagauggaagaaguugccagcaggauca

SEQ ID NO: 414937 - RNA, 32 nt, Human
gaaaagauguuauuucuguggaugcugcugug

SEQ ID NO: 414938 - RNA, 32 nt, Human
gaaaagauuuguaucaaacagaaucagaggca

SEQ ID NO: 414939 - RNA, 32 nt, Human
gaaaagcaaacauaugcacgcacuuuucuugu

SEQ ID NO: 414940 - RNA, 32 nt, Human
gaaaagcaaagacauggaauuuuaaagaguga

SEQ ID NO: 414941 - RNA, 32 nt, Human
gaaaagcaacaggagaagaaucagggcaggaa

SEQ ID NO: 414942 - RNA, 32 nt, Human
gaaaagcaaccaaaaagggaaaaaggacuccu

SEQ ID NO: 414943 - RNA, 32 nt, Human
gaaaagcaaccaugcauuuacuggucaaugcc

SEQ ID NO: 414944 - RNA, 21 nt, Human
gaaaagcaaggagagacucua

SEQ ID NO: 414945 - RNA, 32 nt, Human
gaaaagcaaucagucacaacucaccuagcgac

SEQ ID NO: 414946 - RNA, 32 nt, Human
gaaaagcaauuaggauuaaaaguuuccauuua

SEQ ID NO: 414947 - RNA, 22 nt, Human
gaaaagcacaaccagaccuucu

SEQ ID NO: 414948 - RNA, 19 nt, Human
gaaaagcacacaggcuuua

SEQ ID NO: 414949 - RNA, 32 nt, Human
gaaaagcaccaacaaaugaagcucacuaaaug

SEQ ID NO: 414950 - RNA, 32 nt, Human
gaaaagcacuccggaagaaugaagcuaagaag

SEQ ID NO: 414951 - RNA, 20 nt, Human
gaaaagcacuccuggagcuu

SEQ ID NO: 414952 - RNA, 20 nt, Human
gaaaagcacucucuucucua

SEQ ID NO: 414953 - RNA, 19 nt, Human
gaaaagcacuucugcucua

SEQ ID NO: 414954 - RNA, 21 nt, Human
gaaaagcacuugccaucucug

SEQ ID NO: 414955 - RNA, 21 nt, Human
gaaaagcacuuguucucucug

SEQ ID NO: 414956 - RNA, 32 nt, Human
gaaaagcagaaagagagaguggccggaugggg

SEQ ID NO: 414957 - RNA, 32 nt, Human
gaaaagcagaacaccugaaagccagcaauuuc

SEQ ID NO: 414958 - RNA, 32 nt, Human
gaaaagcagagggagggagggagggggucuuc

SEQ ID NO: 414959 - RNA, 21 nt, Human
gaaaagcagauagacugaaga

SEQ ID NO: 414960 - RNA, 32 nt, Human
gaaaagcagcugguauggguuugggugucaau

SEQ ID NO: 414961 - RNA, 32 nt, Human
gaaaagcagcuguuccuugugccugaggagau

SEQ ID NO: 414962 - RNA, 20 nt, Human
gaaaagcaggaauaacuuua

SEQ ID NO: 414963 - RNA, 19 nt, Human
gaaaagcagucggacucua

SEQ ID NO: 414964 - RNA, 32 nt, Human
gaaaagcauacacuuauuuuauuugaaugcag

SEQ ID NO: 414965 - RNA, 18 nt, Human
gaaaagcaucagaacucu

SEQ ID NO: 414966 - RNA, 32 nt, Human
gaaaagcaugaaaacugagaugcugaagguga

SEQ ID NO: 414967 - RNA, 21 nt, Human
gaaaagcauucauuaauuuua

SEQ ID NO: 414968 - RNA, 20 nt, Human
gaaaagcauuccauauuuua

SEQ ID NO: 414969 - RNA, 19 nt, Human
gaaaagcauucugagcuuu

SEQ ID NO: 414970 - RNA, 20 nt, Human
gaaaagcauuggagcgucug

SEQ ID NO: 414971 - RNA, 32 nt, Human
gaaaagccaaagucuuucugaagaaucugugc

SEQ ID NO: 414972 - RNA, 32 nt, Human
gaaaagccaauccugaauucagaugaaauugc

SEQ ID NO: 414973 - RNA, 32 nt, Human
gaaaagccaccaauucuagaucuugauuugaa

SEQ ID NO: 414974 - RNA, 32 nt, Human
gaaaagccaguauucuuuuauaaaauuaucuu

SEQ ID NO: 414975 - RNA, 32 nt, Human
gaaaagccauauguaucauaaauaucagaugu

SEQ ID NO: 414976 - RNA, 32 nt, Human
gaaaagccaucuuuaauauaguucuucaccac

SEQ ID NO: 414977 - RNA, 32 nt, Human
gaaaagcccacauugcugguuacauguguaaa

SEQ ID NO: 414978 - RNA, 32 nt, Human
gaaaagccgagaacccagggccagcaguggaa

SEQ ID NO: 414979 - RNA, 32 nt, Human
gaaaagccuccgccugcuguguggacuucauc

SEQ ID NO: 414980 - RNA, 32 nt, Human
gaaaagcggagccugugacgugcacuugagaa

SEQ ID NO: 414981 - RNA, 32 nt, Human
gaaaagcggaggaggacgcccaggaggaggcg

SEQ ID NO: 414982 - RNA, 32 nt, Human
gaaaagcuaagcugggacugaggcaugcaagc

SEQ ID NO: 414983 - RNA, 19 nt, Human
gaaaagcuacaggacucua

SEQ ID NO: 414984 - RNA, 32 nt, Human
gaaaagcucacugcugccccagccgggcuucu

SEQ ID NO: 414985 - RNA, 32 nt, Human
gaaaagcucacuggaccagcuaggugacaucc

SEQ ID NO: 414986 - RNA, 32 nt, Human
gaaaagcucgaagguccauguguuuugcaaau

SEQ ID NO: 414987 - RNA, 32 nt, Human
gaaaagcucucacaaagcuuuugagcucauag

SEQ ID NO: 414988 - RNA, 32 nt, Human
gaaaagcugagucuggcuagaccagggcuaug

SEQ ID NO: 414989 - RNA, 32 nt, Human
gaaaagcugauucugguuaucucuuuaaggac

SEQ ID NO: 414990 - RNA, 32 nt, Human
gaaaagcugcaaggucaggcuccuggggcccu

SEQ ID NO: 414991 - RNA, 32 nt, Human
gaaaagcugccaugauucugugguguucuaag

SEQ ID NO: 414992 - RNA, 22 nt, Human
gaaaagcugugugcgacacaga

SEQ ID NO: 414993 - RNA, 32 nt, Human
gaaaagcuguuuuucucacaugugaacagcuu

SEQ ID NO: 414994 - RNA, 32 nt, Human
gaaaagcuuaccuauuuuaaaaagccaaauuu

SEQ ID NO: 414995 - RNA, 16 nt, Human
gaaaagcuucauucca

SEQ ID NO: 414996 - RNA, 26 nt, Human
gaaaagcuugcagaaccagacagaga

SEQ ID NO: 414997 - RNA, 32 nt, Human
gaaaagcuuuguuuguucuuguuuuuaaguuu

SEQ ID NO: 414998 - RNA, 32 nt, Human
gaaaaggaaagaugggggacacuuccagugug

SEQ ID NO: 414999 - RNA, 32 nt, Human
gaaaaggaaaucuagcaugugaggggacuaag

SEQ ID NO: 415000 - RNA, 32 nt, Human
gaaaaggaaaugacacuugagauccuuggaau

SEQ ID NO: 415001 - RNA, 32 nt, Human
gaaaaggaaauggcuuuuauaaacaucuuuua

SEQ ID NO: 415002 - RNA, 32 nt, Human
gaaaaggaaggggauaacucagaggaacagac

SEQ ID NO: 415003 - RNA, 32 nt, Human
gaaaaggaauuuaaaggaaggauagaaaguug

SEQ ID NO: 415004 - RNA, 32 nt, Human
gaaaaggacauuuguguuuuuccuucaauggu

SEQ ID NO: 415005 - RNA, 32 nt, Human
gaaaaggagaaaagguucguuuggaaguauag

SEQ ID NO: 415006 - RNA, 32 nt, Human
gaaaaggagaggaggaagcugaggcaacuuug

SEQ ID NO: 415007 - RNA, 32 nt, Human
gaaaaggaggaaaacuuagaagaaaaggcaga

SEQ ID NO: 415008 - RNA, 32 nt, Human
gaaaaggaggaaggaaggaaaaggugauucgc

SEQ ID NO: 415009 - RNA, 32 nt, Human
gaaaaggaguuaggagaaagaagagcagcuga

SEQ ID NO: 415010 - RNA, 19 nt, Human
gaaaaggaucuaagggaag

SEQ ID NO: 415011 - RNA, 32 nt, Human
gaaaaggaucuguccacuccuggucauuggug

SEQ ID NO: 415012 - RNA, 32 nt, Human
gaaaaggauuucagaugcaugccagguuucca

SEQ ID NO: 415013 - RNA, 32 nt, Human
gaaaaggcaaagcugcaugagacacagccuuc

SEQ ID NO: 415014 - RNA, 32 nt, Human
gaaaaggcacucucguguucuccucacucugu

SEQ ID NO: 415015 - RNA, 32 nt, Human
gaaaaggcaggcaguggacucugccaguauua

SEQ ID NO: 415016 - RNA, 32 nt, Human
gaaaaggcaggcaguguggucacagaccgagg

SEQ ID NO: 415017 - RNA, 32 nt, Human
gaaaaggcauuucucaaccaucucucagcagu

SEQ ID NO: 415018 - RNA, 32 nt, Human
gaaaaggcggcggggcugggcccagcgaggug

SEQ ID NO: 415019 - RNA, 32 nt, Human
gaaaaggcucaggggugagguggagagggaga

SEQ ID NO: 415020 - RNA, 32 nt, Human
gaaaaggcugcagacagucacagggaagugcu

SEQ ID NO: 415021 - RNA, 32 nt, Human
gaaaaggcugcugacaaggcugagggaggacc

SEQ ID NO: 415022 - RNA, 32 nt, Human
gaaaaggcuuaugggccagggggugggaggga

SEQ ID NO: 415023 - RNA, 16 nt, Human
gaaaagggaacaguuu

SEQ ID NO: 415024 - RNA, 31 nt, Human
gaaaagggaacgugguacucacuggaugcac

SEQ ID NO: 415025 - RNA, 32 nt, Human
gaaaagggaagagaugggugugggguggcaau

SEQ ID NO: 415026 - RNA, 32 nt, Human
gaaaagggaaggcaaaaggaaaagagaaaagg

SEQ ID NO: 415027 - RNA, 32 nt, Human
gaaaagggaagggagagaaaaaggagagccuc

SEQ ID NO: 415028 - RNA, 32 nt, Human
gaaaagggaauagaauuuugacucuauauaaa

SEQ ID NO: 415029 - RNA, 32 nt, Human
gaaaagggagagaccuagaaggggcuuggacc

SEQ ID NO: 415030 - RNA, 32 nt, Human
gaaaagggagagacgaaaaggguacaggcuca

SEQ ID NO: 415031 - RNA, 32 nt, Human
gaaaagggagaugagggaucucagggaagccc

SEQ ID NO: 415032 - RNA, 32 nt, Human
gaaaagggaggaaacggcagagccagagagaa

SEQ ID NO: 415033 - RNA, 32 nt, Human
gaaaagggaggcagaggaggcagaggcagagg

SEQ ID NO: 415034 - RNA, 32 nt, Human
gaaaagggauggauguguagcccaucucagga

SEQ ID NO: 415035 - RNA, 32 nt, Human
gaaaagggcagaagagaggcagcagcgugguc

SEQ ID NO: 415036 - RNA, 32 nt, Human
gaaaagggcagacuggaccugcagugauggug

SEQ ID NO: 415037 - RNA, 31 nt, Human
gaaaagggccuggaaagaggggagccaacaa

SEQ ID NO: 415038 - RNA, 32 nt, Human
gaaaagggcucugcagagcuugcacauaaaga

SEQ ID NO: 415039 - RNA, 32 nt, Human
gaaaaggggagggugcagggagaggggaggcg

SEQ ID NO: 415040 - RNA, 32 nt, Human
gaaaaggggagugcuaacugggggagcgagaa

SEQ ID NO: 415041 - RNA, 32 nt, Human
gaaaaggggugcuggaaggaggccccagugga

SEQ ID NO: 415042 - RNA, 32 nt, Human
gaaaaggguuccaccucuccccaaccggaguu

SEQ ID NO: 415043 - RNA, 32 nt, Human
gaaaagguaccugaggaugcagaaguaccuac

SEQ ID NO: 415044 - RNA, 21 nt, Human
gaaaagguccuugacuugaug

SEQ ID NO: 415045 - RNA, 32 nt, Human
gaaaaggucugggaaguaugggggauggugug

SEQ ID NO: 415046 - RNA, 32 nt, Human
gaaaagguggcaugcuaaacagcaaccuugau

SEQ ID NO: 415047 - RNA, 32 nt, Human
gaaaagguggcgaagaggcugccugaagagca

SEQ ID NO: 415048 - RNA, 32 nt, Human
gaaaagguugagaagaucuggggaagagaagg

SEQ ID NO: 415049 - RNA, 32 nt, Human
gaaaagguuuuagaaaaagugaagagcuggaa

SEQ ID NO: 415050 - RNA, 32 nt, Human
gaaaaguaagcaaggggagggaagagagaggu

SEQ ID NO: 415051 - RNA, 32 nt, Human
gaaaaguacugagugaagggcagaaaaagaga

SEQ ID NO: 415052 - RNA, 32 nt, Human
gaaaaguacuuagcugggagugguggcaagcg

SEQ ID NO: 415053 - RNA, 32 nt, Human
gaaaaguacuucaggcugggcacaguggcuca

SEQ ID NO: 415054 - RNA, 32 nt, Human
gaaaaguagccugccuguggcauuuagaggcc

SEQ ID NO: 415055 - RNA, 21 nt, Human
gaaaaguaggaggaggaucug

SEQ ID NO: 415056 - RNA, 32 nt, Human
gaaaaguaguucaaguguacagaaaguggauu

SEQ ID NO: 415057 - RNA, 22 nt, Human
gaaaaguauacaaaacaaaaca

SEQ ID NO: 415058 - RNA, 32 nt, Human
gaaaaguauggagucuggagaaucgcuagacu

SEQ ID NO: 415059 - RNA, 20 nt, Human
gaaaagucacaggagaacuu

SEQ ID NO: 415060 - RNA, 32 nt, Human
gaaaagucaccguagcccacuguggcaucaga

SEQ ID NO: 415061 - RNA, 20 nt, Human
gaaaagucacuuggaacucu

SEQ ID NO: 415062 - RNA, 32 nt, Human
gaaaagucagcaagacccgagauguguaugga

SEQ ID NO: 415063 - RNA, 32 nt, Human
gaaaagucagcccuugacugagggccagauca

SEQ ID NO: 415064 - RNA, 32 nt, Human
gaaaaguccaccuugucuucucucagaaaacc

SEQ ID NO: 415065 - RNA, 32 nt, Human
gaaaaguccgagagaaucaggauggaggccgu

SEQ ID NO: 415066 - RNA, 32 nt, Human
gaaaaguccuguaaggaugaugaauuuagaaa

SEQ ID NO: 415067 - RNA, 32 nt, Human
gaaaagucggcagcagagggaacagggaagaa

SEQ ID NO: 415068 - RNA, 32 nt, Human
gaaaagucuaacuccauuaaaugccuuaaugg

SEQ ID NO: 415069 - RNA, 32 nt, Human
gaaaagucucucucaacaccucguucaugcaa

SEQ ID NO: 415070 - RNA, 23 nt, Human
gaaaagucucuuggggaccucug

SEQ ID NO: 415071 - RNA, 32 nt, Human
gaaaagucuuccaugcacuuccagucucuuuc

SEQ ID NO: 415072 - RNA, 32 nt, Human
gaaaagugacggccaggugcaguggcucacgc

SEQ ID NO: 415073 - RNA, 32 nt, Human
gaaaagugacugcgauucugaagaaccgcugc

SEQ ID NO: 415074 - RNA, 32 nt, Human
gaaaagugacuggaguccagggacaugaugga

SEQ ID NO: 415075 - RNA, 31 nt, Human
gaaaagugacuucaucccuucgguccuaagu

SEQ ID NO: 415076 - RNA, 31 nt, Human
gaaaagugcaguauuuaccuguugaauucag

SEQ ID NO: 415077 - RNA, 32 nt, Human
gaaaagugcuuugcuggaguccuguucucuga

SEQ ID NO: 415078 - RNA, 32 nt, Human
gaaaaguggccaagggccacccccgcugauga

SEQ ID NO: 415079 - RNA, 19 nt, Human
gaaaagugggagacuucug

SEQ ID NO: 415080 - RNA, 23 nt, Human
gaaaagugggcccauaugaagua

SEQ ID NO: 415081 - RNA, 20 nt, Human
gaaaagugguagagccucua

SEQ ID NO: 415082 - RNA, 32 nt, Human
gaaaaguguagggacugagaagggcugcagcc

SEQ ID NO: 415083 - RNA, 32 nt, Human
gaaaaguguccucuggcugaguggccacuagg

SEQ ID NO: 415084 - RNA, 32 nt, Human
gaaaagugucucaaaugcauucuacugcggga

SEQ ID NO: 415085 - RNA, 32 nt, Human
gaaaaguuacaagagaaagaaaggauacaacu

SEQ ID NO: 415086 - RNA, 32 nt, Human
gaaaaguugaagagagaguuugaaugaaggac

SEQ ID NO: 415087 - RNA, 20 nt, Human
gaaaaguugagaggacuuua

SEQ ID NO: 415088 - RNA, 32 nt, Human
gaaaaguugcagaauagaaauagccacacucc

SEQ ID NO: 415089 - RNA, 32 nt, Human
gaaaaguugcucccgagguccaugccccugga

SEQ ID NO: 415090 - RNA, 22 nt, Human
gaaaaguuggcggaggacugua

SEQ ID NO: 415091 - RNA, 32 nt, Human
gaaaaguugggacacugaggugucacagcuuc

SEQ ID NO: 415092 - RNA, 32 nt, Human
gaaaaguugugccugagugcaugagacagaau

SEQ ID NO: 415093 - RNA, 32 nt, Human
gaaaaguugugccugagugcaugagauagaau

SEQ ID NO: 415094 - RNA, 32 nt, Human
gaaaaguuuacaaccugcuuggauuuuugccc

SEQ ID NO: 415095 - RNA, 32 nt, Human
gaaaaguuuucagaaaacugcuauguagauuu

SEQ ID NO: 415096 - RNA, 32 nt, Human
gaaaauaaacauuuuacuguuuuuauggaucc

SEQ ID NO: 415097 - RNA, 32 nt, Human
gaaaauaaaccagccugggcuagaggagaauu

SEQ ID NO: 415098 - RNA, 22 nt, Human
gaaaauaaagauuuagaaacca

SEQ ID NO: 415099 - RNA, 32 nt, Human
gaaaauaaaguguguucugugccugaaaaugg

SEQ ID NO: 415100 - RNA, 32 nt, Human
gaaaauaaaguugagggaaucucuccagauaa

SEQ ID NO: 415101 - RNA, 32 nt, Human
gaaaauaaauguagcuggugggagacuuugua

SEQ ID NO: 415102 - RNA, 32 nt, Human
gaaaauaacacauuuaaguauauaaaaccuau

SEQ ID NO: 415103 - RNA, 20 nt, Human
gaaaauaacuaauaaaccau

SEQ ID NO: 415104 - RNA, 32 nt, Human
gaaaauaacuccuaaauguccaaaaagaacau

SEQ ID NO: 415105 - RNA, 32 nt, Human
gaaaauaacuugacugaauuacacaaggauuc

SEQ ID NO: 415106 - RNA, 32 nt, Human
gaaaauaagccauuagcucagaagaacuuuaa

SEQ ID NO: 415107 - RNA, 32 nt, Human
gaaaauaaggaggaguugucagacaaggacau

SEQ ID NO: 415108 - RNA, 32 nt, Human
gaaaauaaggugggcuucacuggagaaaugga

SEQ ID NO: 415109 - RNA, 26 nt, Human
gaaaauaaugaaguuguagaaaccau

SEQ ID NO: 415110 - RNA, 32 nt, Human
gaaaauacagaauuagccaggcaugguggcac

SEQ ID NO: 415111 - RNA, 32 nt, Human
gaaaauacagagagugaguguguggaagagag

SEQ ID NO: 415112 - RNA, 32 nt, Human
gaaaauacagcuacuucugccuuauggcuagg

SEQ ID NO: 415113 - RNA, 32 nt, Human
gaaaauacuacugcugagcauuuuugaagacu

SEQ ID NO: 415114 - RNA, 32 nt, Human
gaaaauacugaacucugucugagugggauggu

SEQ ID NO: 415115 - RNA, 21 nt, Human
gaaaauacugauguguguuuu

SEQ ID NO: 415116 - RNA, 32 nt, Human
gaaaauagaccagcuuaaugucuucaggaugu

SEQ ID NO: 415117 - RNA, 32 nt, Human
gaaaauagcaaaggaaaucacugugaagaaug

SEQ ID NO: 415118 - RNA, 32 nt, Human
gaaaauagccugcucccagaggaaaagugaau

SEQ ID NO: 415119 - RNA, 32 nt, Human
gaaaauagcuaaaugucauucuccaucucuuu

SEQ ID NO: 415120 - RNA, 32 nt, Human
gaaaauagcuucaucuuaucugccuucuuaug

SEQ ID NO: 415121 - RNA, 32 nt, Human
gaaaauaggacugucagaagcugccaguuauu

SEQ ID NO: 415122 - RNA, 32 nt, Human
gaaaauagguuagaaucuauggcuugauuaaa

SEQ ID NO: 415123 - RNA, 24 nt, Human
gaaaauauaaaaauuagccaggca

SEQ ID NO: 415124 - RNA, 32 nt, Human
gaaaauauagucacaggaaacuacucacguaa

SEQ ID NO: 415125 - RNA, 32 nt, Human
gaaaauaucaaagcauacauuaccucagcugg

SEQ ID NO: 415126 - RNA, 32 nt, Human
gaaaauauccuuuaacucauguaacugaguaa

SEQ ID NO: 415127 - RNA, 32 nt, Human
gaaaauaucguuagcuguaaaaguaauauuau

SEQ ID NO: 415128 - RNA, 32 nt, Human
gaaaauaucuaauagcuaccagaaggagaugc

SEQ ID NO: 415129 - RNA, 32 nt, Human
gaaaauaucugagacaaaauguauacaaauau

SEQ ID NO: 415130 - RNA, 32 nt, Human
gaaaauaugaagucgcaugcacuggauaucua

SEQ ID NO: 415131 - RNA, 32 nt, Human
gaaaauauggugcugaggaguguuaaaguaga

SEQ ID NO: 415132 - RNA, 32 nt, Human
gaaaauauguuuggaauauuccacuauuugca

SEQ ID NO: 415133 - RNA, 32 nt, Human
gaaaauauuuaugaacuauauuucucauugca

SEQ ID NO: 415134 - RNA, 32 nt, Human
gaaaauauuuugcucuugaggacucugacagc

SEQ ID NO: 415135 - RNA, 32 nt, Human
gaaaaucaagggaggaaggaacaagaucaagg

SEQ ID NO: 415136 - RNA, 32 nt, Human
gaaaaucacaggacccgaggaaaaagaaugag

SEQ ID NO: 415137 - RNA, 32 nt, Human
gaaaaucacuacaacaaaugcuaacuucuaau

SEQ ID NO: 415138 - RNA, 32 nt, Human
gaaaaucacucccagucaucccaaaccccuga

SEQ ID NO: 415139 - RNA, 32 nt, Human
gaaaaucacugucacacaauuccaauggauuu

SEQ ID NO: 415140 - RNA, 32 nt, Human
gaaaaucacuuaggaaauggcuuugugauuca

SEQ ID NO: 415141 - RNA, 32 nt, Human
gaaaaucacuugaacccaggaggcagagguug

SEQ ID NO: 415142 - RNA, 32 nt, Human
gaaaaucagccaaggacuaagcuuccauagaa

SEQ ID NO: 415143 - RNA, 32 nt, Human
gaaaaucaggcagucggccuggagucugugcc

SEQ ID NO: 415144 - RNA, 32 nt, Human
gaaaaucaguguucacagagacugccuccacc

SEQ ID NO: 415145 - RNA, 32 nt, Human
gaaaaucauauccugaaucauacugagacuga

SEQ ID NO: 415146 - RNA, 32 nt, Human
gaaaaucauccagaagcacugugauauugugu

SEQ ID NO: 415147 - RNA, 32 nt, Human
gaaaauccaagaggaagaaggaucuacggaua

SEQ ID NO: 415148 - RNA, 32 nt, Human
gaaaauccaaucuacaaacaaaggccauccua

SEQ ID NO: 415149 - RNA, 32 nt, Human
gaaaauccaggaguauccaucugcaguuaugu

SEQ ID NO: 415150 - RNA, 32 nt, Human
gaaaaucccagcugcccuugccugaacugauu

SEQ ID NO: 415151 - RNA, 32 nt, Human
gaaaaucccagggcccuuaagauaugcuguau

SEQ ID NO: 415152 - RNA, 32 nt, Human
gaaaaucccaucacuccagcagcugggaccug

SEQ ID NO: 415153 - RNA, 32 nt, Human
gaaaaucccauguuugcuuuauuuuauuuuaa

SEQ ID NO: 415154 - RNA, 32 nt, Human
gaaaaucccuuuuaaggccaaggaaagcugaa

SEQ ID NO: 415155 - RNA, 32 nt, Human
gaaaauccuaaaccucguacccaaaccugucu

SEQ ID NO: 415156 - RNA, 32 nt, Human
gaaaauccuauugauuucaucucacccauuuc

SEQ ID NO: 415157 - RNA, 32 nt, Human
gaaaauccucacugcacuccagcagaggcuag

SEQ ID NO: 415158 - RNA, 32 nt, Human
gaaaaucgcuugaacccaggaggcagagauug

SEQ ID NO: 415159 - RNA, 32 nt, Human
gaaaaucgcuugaacccgggaggcagagguua

SEQ ID NO: 415160 - RNA, 32 nt, Human
gaaaaucggagucacuuaggaggcagcaugag

SEQ ID NO: 415161 - RNA, 32 nt, Human
gaaaaucggugaggauguugugcucagaaaug

SEQ ID NO: 415162 - RNA, 32 nt, Human
gaaaaucuacccauacucaaguugcacgguca

SEQ ID NO: 415163 - RNA, 32 nt, Human
gaaaaucuagccccgggcacuugccuuggagu

SEQ ID NO: 415164 - RNA, 32 nt, Human
gaaaaucuauucguuagagaaggaugaacagc

SEQ ID NO: 415165 - RNA, 32 nt, Human
gaaaaucuggacaauagauguggacuccaagg

SEQ ID NO: 415166 - RNA, 32 nt, Human
gaaaaucuuagaguaaauuuuagucuuaaagc

SEQ ID NO: 415167 - RNA, 32 nt, Human
gaaaaugaaaguacauuucacagggugggagu

SEQ ID NO: 415168 - RNA, 32 nt, Human
gaaaaugaacugaaggaugccacccagggaga

SEQ ID NO: 415169 - RNA, 21 nt, Human
gaaaaugaacuucugguuuca

SEQ ID NO: 415170 - RNA, 32 nt, Human
gaaaaugaagaguauuuuuaaggagaugguau

SEQ ID NO: 415171 - RNA, 28 nt, Human
gaaaaugaagcugcugccucaaucgacc

SEQ ID NO: 415172 - RNA, 32 nt, Human
gaaaaugaagcuggggacugggugcgucccau

SEQ ID NO: 415173 - RNA, 20 nt, Human
gaaaaugaaggugacuuuca

SEQ ID NO: 415174 - RNA, 22 nt, Human
gaaaaugaauccaaguguuuca

SEQ ID NO: 415175 - RNA, 32 nt, Human
gaaaaugaauccacagcucuacuccagguucu

SEQ ID NO: 415176 - RNA, 22 nt, Human
gaaaaugagcuggagaauuuua

SEQ ID NO: 415177 - RNA, 29 nt, Human
gaaaaugagugagacucaaaauucaacaa

SEQ ID NO: 415178 - RNA, 32 nt, Human
gaaaaugauaaauuuucuguugugcauucaau

SEQ ID NO: 415179 - RNA, 32 nt, Human
gaaaaugauuguuuagcaucuuuacagaugga

SEQ ID NO: 415180 - RNA, 32 nt, Human
gaaaaugcaaugacuggcugggugcaguggcu

SEQ ID NO: 415181 - RNA, 32 nt, Human
gaaaaugcaccacugcacuccagcaugggcaa

SEQ ID NO: 415182 - RNA, 32 nt, Human
gaaaaugcagugaggggagguccucacccagg

SEQ ID NO: 415183 - RNA, 32 nt, Human
gaaaaugcccagaggaaauggaaccauuucac

SEQ ID NO: 415184 - RNA, 32 nt, Human
gaaaaugcccagcguuacuucgaugcccugcu

SEQ ID NO: 415185 - RNA, 32 nt, Human
gaaaaugcccgugaagagaagacugaaugugu

SEQ ID NO: 415186 - RNA, 23 nt, Human
gaaaaugccuccuauuucuggca

SEQ ID NO: 415187 - RNA, 32 nt, Human
gaaaaugcucaucugucaucuucauggaugaa

SEQ ID NO: 415188 - RNA, 32 nt, Human
gaaaaugcugggaccaaagauugggccggguu

SEQ ID NO: 415189 - RNA, 32 nt, Human
gaaaauggagagaaugaagagcgcugugccag

SEQ ID NO: 415190 - RNA, 32 nt, Human
gaaaauggagagcuccagcagcgaugaugagg

SEQ ID NO: 415191 - RNA, 21 nt, Human
gaaaauggagagcuggcuuca

SEQ ID NO: 415192 - RNA, 32 nt, Human
gaaaauggagugaacaggaggcaaagccacgc

SEQ ID NO: 415193 - RNA, 32 nt, Human
gaaaauggcagcaacaugaagcugcccauucc

SEQ ID NO: 415194 - RNA, 31 nt, Human
gaaaauggcccaacggagcacuguauuuccu

SEQ ID NO: 415195 - RNA, 32 nt, Human
gaaaauggcgugaacccgggagguggagcuug

SEQ ID NO: 415196 - RNA, 32 nt, Human
gaaaauggcugcaauuacaacaagaagugaag

SEQ ID NO: 415197 - RNA, 32 nt, Human
gaaaauggcuugaacccgggaggcagagguug

SEQ ID NO: 415198 - RNA, 32 nt, Human
gaaaauggcuuucucagccaggcgugguuacu

SEQ ID NO: 415199 - RNA, 32 nt, Human
gaaaauggugcuggagaccaguauuuaguaaa

SEQ ID NO: 415200 - RNA, 32 nt, Human
gaaaaugguguuuuccucaagaagacuacugg

SEQ ID NO: 415201 - RNA, 32 nt, Human
gaaaauguagcucuuaguuuacacuucaaaga

SEQ ID NO: 415202 - RNA, 22 nt, Human
gaaaauguauggaugaauucug

SEQ ID NO: 415203 - RNA, 32 nt, Human
gaaaaugucccucccuuacccccauccuuaac

SEQ ID NO: 415204 - RNA, 32 nt, Human
gaaaaugugguuucugcuguccuuucucuugg

SEQ ID NO: 415205 - RNA, 32 nt, Human
gaaaauguguagccagacacacacagacauug

SEQ ID NO: 415206 - RNA, 32 nt, Human
gaaaauguuacuuagaaaaucauaaggaagag

SEQ ID NO: 415207 - RNA, 32 nt, Human
gaaaauguucugacagcauuucagcugugagc

SEQ ID NO: 415208 - RNA, 32 nt, Human
gaaaauguugccaguugauggggaagaaagga

SEQ ID NO: 415209 - RNA, 32 nt, Human
gaaaauguuuccuugugccugcuccuguacuu

SEQ ID NO: 415210 - RNA, 32 nt, Human
gaaaauuaaaaggcaaaacaauagacaucugc

SEQ ID NO: 415211 - RNA, 32 nt, Human
gaaaauuacauauuaagguuuugcuggggugc

SEQ ID NO: 415212 - RNA, 32 nt, Human
gaaaauuagaugcagagaauucagagauuucu

SEQ ID NO: 415213 - RNA, 32 nt, Human
gaaaauuaggucugaauucaagagaaaguaug

SEQ ID NO: 415214 - RNA, 32 nt, Human
gaaaauuaguauuuuggauagauuugucaaaa

SEQ ID NO: 415215 - RNA, 32 nt, Human
gaaaauuauagcaacaguacuuaggagaauag

SEQ ID NO: 415216 - RNA, 32 nt, Human
gaaaauuauggacugggacucuucagaaauuc

SEQ ID NO: 415217 - RNA, 32 nt, Human
gaaaauuauuuggaacuuaguaaccaguuguu

SEQ ID NO: 415218 - RNA, 32 nt, Human
gaaaauucaagaaaauaaauguagcugguggg

SEQ ID NO: 415219 - RNA, 32 nt, Human
gaaaauucacauuugaaaaugaaaaugauuac

SEQ ID NO: 415220 - RNA, 32 nt, Human
gaaaauucaguauuuucacaagcuacaaaaac

SEQ ID NO: 415221 - RNA, 32 nt, Human
gaaaauucuaccucuauguccuucaugaggau

SEQ ID NO: 415222 - RNA, 22 nt, Human
gaaaauugaaaauguauaguca

SEQ ID NO: 415223 - RNA, 32 nt, Human
gaaaauugaaagucaucccugauuccuccuuc

SEQ ID NO: 415224 - RNA, 32 nt, Human
gaaaauugaaggagauguuugaugaggaauau

SEQ ID NO: 415225 - RNA, 32 nt, Human
gaaaauugaaggagauguuugauguggaauau

SEQ ID NO: 415226 - RNA, 32 nt, Human
gaaaauugcaccacugugcuugguuuguacuu

SEQ ID NO: 415227 - RNA, 32 nt, Human
gaaaauugcccgguugcugggguccgcgccug

SEQ ID NO: 415228 - RNA, 32 nt, Human
gaaaauugcucuuaaacuuuccuagcuauaag

SEQ ID NO: 415229 - RNA, 32 nt, Human
gaaaauugcuugaacucaggaggcagaaguuu

SEQ ID NO: 415230 - RNA, 32 nt, Human
gaaaauuggaagcaaggaacagcaacagcacc

SEQ ID NO: 415231 - RNA, 32 nt, Human
gaaaauuggacuuaagaugccaugucuuggcu

SEQ ID NO: 415232 - RNA, 32 nt, Human
gaaaauugguuucauuuaacaaaagaucagau

SEQ ID NO: 415233 - RNA, 32 nt, Human
gaaaauuuagcucuggguagcucuuaaaucuu

SEQ ID NO: 415234 - RNA, 32 nt, Human
gaaaauuucccaucuucucauuggccaucagu

SEQ ID NO: 415235 - RNA, 32 nt, Human
gaaaauuugaagcccccaggggugggguggac

SEQ ID NO: 415236 - RNA, 32 nt, Human
gaaaauuugcagcugccagugcuuuccuugug

SEQ ID NO: 415237 - RNA, 32 nt, Human
gaaaauuuggccagacaccguggcucacuccu

SEQ ID NO: 415238 - RNA, 32 nt, Human
gaaacaaaaacacacacgcagaauuaacaauu

SEQ ID NO: 415239 - RNA, 32 nt, Human
gaaacaaaaauauaagaauuauuagcuacuuu

SEQ ID NO: 415240 - RNA, 21 nt, Human
gaaacaaaacaaaacaaaaca

SEQ ID NO: 415241 - RNA, 32 nt, Human
gaaacaaaaggacauuaaugaggaauaagaca

SEQ ID NO: 415242 - RNA, 31 nt, Human
gaaacaaaaguguccagugacagggaauuaa

SEQ ID NO: 415243 - RNA, 32 nt, Human
gaaacaaaccaccauugccugcuggcucuuau

SEQ ID NO: 415244 - RNA, 32 nt, Human
gaaacaaacccaggugucucucaacaagcuac

SEQ ID NO: 415245 - RNA, 32 nt, Human
gaaacaaacuggagaagaagguaggagaaagg

SEQ ID NO: 415246 - RNA, 20 nt, Human
gaaacaaacuuuaucucccu

SEQ ID NO: 415247 - RNA, 32 nt, Human
gaaacaaagcagguugucccacauguauaaaa

SEQ ID NO: 415248 - RNA, 32 nt, Human
gaaacaaaugcuguaauucaaaagcauuugac

SEQ ID NO: 415249 - RNA, 32 nt, Human
gaaacaacaaaccugcgccugcaccgccucug

SEQ ID NO: 415250 - RNA, 32 nt, Human
gaaacaacagaagucuauucaccugugcacua

SEQ ID NO: 415251 - RNA, 32 nt, Human
gaaacaacagcauccgaacugcacugggaacu

SEQ ID NO: 415252 - RNA, 32 nt, Human
gaaacaacagguucaguacauuggcucaguuc

SEQ ID NO: 415253 - RNA, 32 nt, Human
gaaacaaccaccaucgguuaaauuugaugcaa

SEQ ID NO: 415254 - RNA, 32 nt, Human
gaaacaaccauccuagcuuccuagggaagaca

SEQ ID NO: 415255 - RNA, 32 nt, Human
gaaacaagaaggaguuuugaaagggaauagga

SEQ ID NO: 415256 - RNA, 32 nt, Human
gaaacaagagccuuuguaauacugaaccucau

SEQ ID NO: 415257 - RNA, 32 nt, Human
gaaacaagaggaaggguuuggggugggaaagu

SEQ ID NO: 415258 - RNA, 32 nt, Human
gaaacaagagguggaacaugugaaugaaucgu

SEQ ID NO: 415259 - RNA, 32 nt, Human
gaaacaagccaagauggagaugccagcuccag

SEQ ID NO: 415260 - RNA, 32 nt, Human
gaaacaaggaggcacuuccuguaggagcacug

SEQ ID NO: 415261 - RNA, 32 nt, Human
gaaacaaggcaaguugcugaaggauuucuaaa

SEQ ID NO: 415262 - RNA, 32 nt, Human
gaaacaaggcuucucucagccuccccaccagu

SEQ ID NO: 415263 - RNA, 32 nt, Human
gaaacaagggccaggccagcuguggcugcaaa

SEQ ID NO: 415264 - RNA, 32 nt, Human
gaaacaauaagggaaccgucuguuuuuaaaug

SEQ ID NO: 415265 - RNA, 32 nt, Human
gaaacaaucauugcuaaaauacauauucuuaa

SEQ ID NO: 415266 - RNA, 32 nt, Human
gaaacaaugaaguggaaaagaaaacagcuaaa

SEQ ID NO: 415267 - RNA, 32 nt, Human
gaaacaauguggagucucccucugauugguuu

SEQ ID NO: 415268 - RNA, 32 nt, Human
gaaacaauuagcugcccgugacucagcugcca

SEQ ID NO: 415269 - RNA, 21 nt, Human
gaaacacaaaaaugaugugua

SEQ ID NO: 415270 - RNA, 32 nt, Human
gaaacacaagacggcuaaaacucuccaggggc

SEQ ID NO: 415271 - RNA, 32 nt, Human
gaaacacacagcauacagacuuaccccauaga

SEQ ID NO: 415272 - RNA, 32 nt, Human
gaaacacacccgcgcacacagcugcucucuac

SEQ ID NO: 415273 - RNA, 32 nt, Human
gaaacacagcucccauauuugagugugcaugu

SEQ ID NO: 415274 - RNA, 32 nt, Human
gaaacacaggagaggaagaauuuggaaugaaa

SEQ ID NO: 415275 - RNA, 32 nt, Human
gaaacacagugugacggugcccagggaaagaa

SEQ ID NO: 415276 - RNA, 32 nt, Human
gaaacacauaaccaaaaugguuugauucacug

SEQ ID NO: 415277 - RNA, 32 nt, Human
gaaacacaucuucagccuccuccugggccagc

SEQ ID NO: 415278 - RNA, 32 nt, Human
gaaacaccaggcacacaccugcccccagucuc

SEQ ID NO: 415279 - RNA, 32 nt, Human
gaaacaccaugggaguuaacagugcaucuccc

SEQ ID NO: 415280 - RNA, 32 nt, Human
gaaacacccacuguguuuugcucacucccacu

SEQ ID NO: 415281 - RNA, 32 nt, Human
gaaacaccuaaccuugacagaaucaucaccag

SEQ ID NO: 415282 - RNA, 32 nt, Human
gaaacaccugaaugaacuuugaugaaguacag

SEQ ID NO: 415283 - RNA, 21 nt, Human
gaaacacgcccuuguacagga

SEQ ID NO: 415284 - RNA, 24 nt, Human
gaaacacuagaggucaaccuuaca

SEQ ID NO: 415285 - RNA, 32 nt, Human
gaaacacuaggcugacuuagucucccagccua

SEQ ID NO: 415286 - RNA, 21 nt, Human
gaaacacuaggugccugccca

SEQ ID NO: 415287 - RNA, 32 nt, Human
gaaacacucccagggacucuggggagaggcug

SEQ ID NO: 415288 - RNA, 32 nt, Human
gaaacacucuucuagcagcauuauggggacuu

SEQ ID NO: 415289 - RNA, 32 nt, Human
gaaacacugaaaagaaggaaagaugguuaaac

SEQ ID NO: 415290 - RNA, 32 nt, Human
gaaacacugaacaaccuccugcuuuaaacaac

SEQ ID NO: 415291 - RNA, 32 nt, Human
gaaacacugccucccuucagcagguagcucau

SEQ ID NO: 415292 - RNA, 32 nt, Human
gaaacacugccucuguuccuccuugagccugu

SEQ ID NO: 415293 - RNA, 32 nt, Human
gaaacacugcugauuugcugugguguugggug

SEQ ID NO: 415294 - RNA, 32 nt, Human
gaaacacugcuuccugaaacuuccugcuauug

SEQ ID NO: 415295 - RNA, 32 nt, Human
gaaacacuuuacaaccugcucucucucugaag

SEQ ID NO: 415296 - RNA, 19 nt, Human
gaaacagaaagauuggaga

SEQ ID NO: 415297 - RNA, 32 nt, Human
gaaacagaacauagccacccuguuucaucagu

SEQ ID NO: 415298 - RNA, 32 nt, Human
gaaacagaacauagccacccuuuuucaucagu

SEQ ID NO: 415299 - RNA, 32 nt, Human
gaaacagaacucaucaaggaucuagucucucg

SEQ ID NO: 415300 - RNA, 21 nt, Human
gaaacagaagcaaauuucccu

SEQ ID NO: 415301 - RNA, 32 nt, Human
gaaacagacacaacuccaguguggacucccgc

SEQ ID NO: 415302 - RNA, 32 nt, Human
gaaacagagagaaagguguggccucuccacuu

SEQ ID NO: 415303 - RNA, 32 nt, Human
gaaacagagagaccagugaggaggcuucugug

SEQ ID NO: 415304 - RNA, 32 nt, Human
gaaacagaggcagacauagacaugcaccaauu

SEQ ID NO: 415305 - RNA, 32 nt, Human
gaaacagauauagaacaauggaagugacaaca

SEQ ID NO: 415306 - RNA, 32 nt, Human
gaaacagauccagcagugcaaagaacuucuuc

SEQ ID NO: 415307 - RNA, 27 nt, Human
gaaacagaucuuuguaucuugucacca

SEQ ID NO: 415308 - RNA, 32 nt, Human
gaaacagcaagagucucugcaccccacuugga

SEQ ID NO: 415309 - RNA, 32 nt, Human
gaaacagcacagaacacgaggugguccccaug

SEQ ID NO: 415310 - RNA, 32 nt, Human
gaaacagcagcacuauuuuccucuuuucuuaa

SEQ ID NO: 415311 - RNA, 32 nt, Human
gaaacagcaggagaagcggaaaacagagcuug

SEQ ID NO: 415312 - RNA, 32 nt, Human
gaaacagccagcauauuuuauauugccaaagu

SEQ ID NO: 415313 - RNA, 19 nt, Human
gaaacagcccagaucuccu

SEQ ID NO: 415314 - RNA, 32 nt, Human
gaaacagcuacggggaugggacccugggagcu

SEQ ID NO: 415315 - RNA, 32 nt, Human
gaaacagcuaggcagucgccuuuugccaaaau

SEQ ID NO: 415316 - RNA, 32 nt, Human
gaaacaggaaagaagagagggagagagaggaa

SEQ ID NO: 415317 - RNA, 22 nt, Human
gaaacaggagaauagcuugaac

SEQ ID NO: 415318 - RNA, 22 nt, Human
gaaacaggagaaucacuugaac

SEQ ID NO: 415319 - RNA, 22 nt, Human
gaaacaggagaauugcuugaac

SEQ ID NO: 415320 - RNA, 32 nt, Human
gaaacaggaggaaacucagugaccucugccuc

SEQ ID NO: 415321 - RNA, 32 nt, Human
gaaacaggccucgugauucaggagacugaagg

SEQ ID NO: 415322 - RNA, 32 nt, Human
gaaacaggcugaagaaucugggccaguccaga

SEQ ID NO: 415323 - RNA, 31 nt, Human
gaaacagggagaccugggguccuguggauaa

SEQ ID NO: 415324 - RNA, 32 nt, Human
gaaacagggaggguccucgaggaggacacacc

SEQ ID NO: 415325 - RNA, 32 nt, Human
gaaacagggcagcaguggggugaaauuuucuu

SEQ ID NO: 415326 - RNA, 32 nt, Human
gaaacaggugccagggcaggagggggcugggg

SEQ ID NO: 415327 - RNA, 32 nt, Human
gaaacaggugugugugaacugggcacagauug

SEQ ID NO: 415328 - RNA, 32 nt, Human
gaaacaguagcccagagguucaggaagauguu

SEQ ID NO: 415329 - RNA, 32 nt, Human
gaaacagucucgcucugucucccagguuggag

SEQ ID NO: 415330 - RNA, 32 nt, Human
gaaacagugauuaaguuugaucaagccauggu

SEQ ID NO: 415331 - RNA, 32 nt, Human
gaaacagugcagcccaggucccaugggggcag

SEQ ID NO: 415332 - RNA, 32 nt, Human
gaaacagugcaggcucuggagccagacuggcg

SEQ ID NO: 415333 - RNA, 32 nt, Human
gaaacaguggaggcugcugggagccaggccag

SEQ ID NO: 415334 - RNA, 32 nt, Human
gaaacaguucuggcacacaggcagaacacugg

SEQ ID NO: 415335 - RNA, 32 nt, Human
gaaacaguugauaucccucccuuagcaaacag

SEQ ID NO: 415336 - RNA, 16 nt, Human
gaaacaguugcucugu

SEQ ID NO: 415337 - RNA, 32 nt, Human
gaaacaguuucauggaguuuaaguugagugaa

SEQ ID NO: 415338 - RNA, 32 nt, Human
gaaacauaaugcaaucuugcaugugggugggg

SEQ ID NO: 415339 - RNA, 32 nt, Human
gaaacauagagggagagagggagagagccuau

SEQ ID NO: 415340 - RNA, 32 nt, Human
gaaacauagcucagaagaccgaagcacuccuu

SEQ ID NO: 415341 - RNA, 32 nt, Human
gaaacauauaccuuuuucacaucuaggaagaa

SEQ ID NO: 415342 - RNA, 32 nt, Human
gaaacaucacuguggaugacuacuuucacgag

SEQ ID NO: 415343 - RNA, 32 nt, Human
gaaacaucucucucuucuccaagcauaaagga

SEQ ID NO: 415344 - RNA, 32 nt, Human
gaaacaugacccagcuggucagaaagggaaug

SEQ ID NO: 415345 - RNA, 30 nt, Human
gaaacaugacccuugcugccuacaaagaga

SEQ ID NO: 415346 - RNA, 32 nt, Human
gaaacaugacucuuuauugucuguaaaucuaa

SEQ ID NO: 415347 - RNA, 32 nt, Human
gaaacaugaguaaaaguauauguaauguauau

SEQ ID NO: 415348 - RNA, 32 nt, Human
gaaacaugcaagccuuucccucccucuccuuu

SEQ ID NO: 415349 - RNA, 32 nt, Human
gaaacaugccauuuuucagugaagauucuaau

SEQ ID NO: 415350 - RNA, 32 nt, Human
gaaacauguaauccuaaauuuacccucuugaa

SEQ ID NO: 415351 - RNA, 30 nt, Human
gaaacauguggaaugauauugagcugcuaa

SEQ ID NO: 415352 - RNA, 23 nt, Human
gaaacauuaucuccucuuguaca

SEQ ID NO: 415353 - RNA, 32 nt, Human
gaaacauuccuucucccggacagcuggaccca

SEQ ID NO: 415354 - RNA, 32 nt, Human
gaaacauucuggaccuucuuccuugcacuugg

SEQ ID NO: 415355 - RNA, 32 nt, Human
gaaacauugaaagacuuguuacagagggccau

SEQ ID NO: 415356 - RNA, 32 nt, Human
gaaacauuucugagaggaggcuccagccucag

SEQ ID NO: 415357 - RNA, 32 nt, Human
gaaacauuuggcuucagggaaccagacucugu

SEQ ID NO: 415358 - RNA, 32 nt, Human
gaaaccaaaaugauaaauagcuuuaagaaugu

SEQ ID NO: 415359 - RNA, 32 nt, Human
gaaaccaaaccugaagauaccuugaucuugga

SEQ ID NO: 415360 - RNA, 32 nt, Human
gaaaccaaaccugaccugaacuuacacugaua

SEQ ID NO: 415361 - RNA, 32 nt, Human
gaaaccaaaccugcugucaccuugaucuugga

SEQ ID NO: 415362 - RNA, 32 nt, Human
gaaaccaaaguuggaaaagaagaauuguagug

SEQ ID NO: 415363 - RNA, 32 nt, Human
gaaaccaacagggaaacagaacuaucuuuaua

SEQ ID NO: 415364 - RNA, 32 nt, Human
gaaaccaacgcgggaugucagacuucaccaaa

SEQ ID NO: 415365 - RNA, 32 nt, Human
gaaaccaagaagcggauggggaagggagagcu

SEQ ID NO: 415366 - RNA, 32 nt, Human
gaaaccaagcuggauuuugcagugcauauguu

SEQ ID NO: 415367 - RNA, 32 nt, Human
gaaaccaaggcagagcugaggggacagggagg

SEQ ID NO: 415368 - RNA, 21 nt, Human
gaaaccaagguggcuauggcg

SEQ ID NO: 415369 - RNA, 32 nt, Human
gaaaccaauuggaggaaacauaaucuucauuc

SEQ ID NO: 415370 - RNA, 32 nt, Human
gaaaccacacaguucucauuacuguuauuuau

SEQ ID NO: 415371 - RNA, 32 nt, Human
gaaaccacacccuggcccagacugccagcccu

SEQ ID NO: 415372 - RNA, 32 nt, Human
gaaaccacacuucuugaaacagccugggugac

SEQ ID NO: 415373 - RNA, 32 nt, Human
gaaaccacagugauaaccacagugacagccaa

SEQ ID NO: 415374 - RNA, 32 nt, Human
gaaaccacaguggcacagagugcagugccugc

SEQ ID NO: 415375 - RNA, 32 nt, Human
gaaaccaccacccagguucaagcaauuauccu

SEQ ID NO: 415376 - RNA, 32 nt, Human
gaaaccaccgucugccccagacccugacccag

SEQ ID NO: 415377 - RNA, 32 nt, Human
gaaaccaccugacauccacccgcugagcgcac

SEQ ID NO: 415378 - RNA, 19 nt, Human
gaaaccaccuuccuucaug

SEQ ID NO: 415379 - RNA, 32 nt, Human
gaaaccacgucagauacugaguagcuugcuga

SEQ ID NO: 415380 - RNA, 32 nt, Human
gaaaccacugcaacacccaccagcaggugaac

SEQ ID NO: 415381 - RNA, 32 nt, Human
gaaaccagaagguggagguggcagugagccga

SEQ ID NO: 415382 - RNA, 32 nt, Human
gaaaccagaugaucauucugauaaaggaaauu

SEQ ID NO: 415383 - RNA, 32 nt, Human
gaaaccagcagaugcccagcuguagcugugca

SEQ ID NO: 415384 - RNA, 32 nt, Human
gaaaccagccccaguaaucaguaagucaggcu

SEQ ID NO: 415385 - RNA, 32 nt, Human
gaaaccagccugaccaacguggagaaacccca

SEQ ID NO: 415386 - RNA, 32 nt, Human
gaaaccagccuggccaacaaggugagaccccc

SEQ ID NO: 415387 - RNA, 32 nt, Human
gaaaccagccuggccaacguggugagacccug

SEQ ID NO: 415388 - RNA, 32 nt, Human
gaaaccagccugggcaacauagggagacccca

SEQ ID NO: 415389 - RNA, 32 nt, Human
gaaaccagccugggcaacauagugagacccug

SEQ ID NO: 415390 - RNA, 32 nt, Human
gaaaccagccuuuucagcaucucacccauuag

SEQ ID NO: 415391 - RNA, 32 nt, Human
gaaaccagcuaaaucaugacaccuucaauuug

SEQ ID NO: 415392 - RNA, 32 nt, Human
gaaaccaggagggagacugcgagugagugccc

SEQ ID NO: 415393 - RNA, 32 nt, Human
gaaaccaggaggugaggagaccaaggauuagg

SEQ ID NO: 415394 - RNA, 32 nt, Human
gaaaccaggcaucuccuaggaaaaagagcagc

SEQ ID NO: 415395 - RNA, 32 nt, Human
gaaaccagugaauuccguggcuggcacaccac

SEQ ID NO: 415396 - RNA, 32 nt, Human
gaaaccagugggaggaaaugaaguuuucagga

SEQ ID NO: 415397 - RNA, 32 nt, Human
gaaaccaguuauauccauugccacagcaauac

SEQ ID NO: 415398 - RNA, 32 nt, Human
gaaaccauccgcaaccugaggaagucuuuugc

SEQ ID NO: 415399 - RNA, 32 nt, Human
gaaaccaucucaugcucuguggcuccaggguu

SEQ ID NO: 415400 - RNA, 32 nt, Human
gaaaccaucugcccaacuagccucaacugaca

SEQ ID NO: 415401 - RNA, 32 nt, Human
gaaaccaugagacugacagaucugccugaaau

SEQ ID NO: 415402 - RNA, 32 nt, Human
gaaaccaugcagccccuucccuucccuucccu

SEQ ID NO: 415403 - RNA, 31 nt, Human
gaaaccauggcagaaggagagacagagucac

SEQ ID NO: 415404 - RNA, 32 nt, Human
gaaaccaugggggaauccaaagacuugaaguc

SEQ ID NO: 415405 - RNA, 32 nt, Human
gaaaccaugugcuucucauucaguucuggacu

SEQ ID NO: 415406 - RNA, 32 nt, Human
gaaaccauguucaggagcucuguuuguggucc

SEQ ID NO: 415407 - RNA, 32 nt, Human
gaaaccauuuauuuuaaaaaugauuagauugc

SEQ ID NO: 415408 - RNA, 32 nt, Human
gaaacccaaaaaucucaucuuggguguuuuca

SEQ ID NO: 415409 - RNA, 32 nt, Human
gaaacccaacccucuccuguguguucuguuau

SEQ ID NO: 415410 - RNA, 32 nt, Human
gaaacccaagaggcagagguugaguaagcuga

SEQ ID NO: 415411 - RNA, 31 nt, Human
gaaacccaaguguccaucuccaucggaacag

SEQ ID NO: 415412 - RNA, 32 nt, Human
gaaacccacaggcggagguugcggugggcugg

SEQ ID NO: 415413 - RNA, 32 nt, Human
gaaacccacuagucccagcuccugggguggca

SEQ ID NO: 415414 - RNA, 32 nt, Human
gaaacccagaaggcagggguugcagugagcca

SEQ ID NO: 415415 - RNA, 19 nt, Human
gaaacccagcaauuugcug

SEQ ID NO: 415416 - RNA, 32 nt, Human
gaaacccagccuccggcgcacagggaacaugu

SEQ ID NO: 415417 - RNA, 32 nt, Human
gaaacccagggaaccucucugaagugacaccu

SEQ ID NO: 415418 - RNA, 32 nt, Human
gaaacccagggaggggucagcucugcaaaaac

SEQ ID NO: 415419 - RNA, 32 nt, Human
gaaacccagugacaccugucuaggugaagacu

SEQ ID NO: 415420 - RNA, 32 nt, Human
gaaacccaugaucaccccuuugagguagauug

SEQ ID NO: 415421 - RNA, 32 nt, Human
gaaaccccagccccuagggaguuugcucagga

SEQ ID NO: 415422 - RNA, 32 nt, Human
gaaaccccagccugguuuugauggcagcagua

SEQ ID NO: 415423 - RNA, 18 nt, Human
gaaaccccaucucuacua

SEQ ID NO: 415424 - RNA, 32 nt, Human
gaaaccccaucucuacuaaaaauagagaaaaa

SEQ ID NO: 415425 - RNA, 32 nt, Human
gaaaccccaucucuacuagaaguacagagauu

SEQ ID NO: 415426 - RNA, 18 nt, Human
gaaaccccaucucuacug

SEQ ID NO: 415427 - RNA, 18 nt, Human
gaaaccccaucucuauua

SEQ ID NO: 415428 - RNA, 32 nt, Human
gaaaccccaucucuauuauauaagaaauuagc

SEQ ID NO: 415429 - RNA, 32 nt, Human
gaaaccccaucucuuaaagaaaaaguuagcca

SEQ ID NO: 415430 - RNA, 18 nt, Human
gaaaccccaucuuuacua

SEQ ID NO: 415431 - RNA, 18 nt, Human
gaaaccccauuucuacua

SEQ ID NO: 415432 - RNA, 32 nt, Human
gaaaccccauuuuucccaggguaaucaugaaa

SEQ ID NO: 415433 - RNA, 32 nt, Human
gaaacccccauguuggccaggcuggucucaaa

SEQ ID NO: 415434 - RNA, 32 nt, Human
gaaacccccuaaaaauacaaaaauuagccggg

SEQ ID NO: 415435 - RNA, 32 nt, Human
gaaacccccugccccugccucccccagcccgg

SEQ ID NO: 415436 - RNA, 28 nt, Human
gaaacccccugccuucuggccccaucua

SEQ ID NO: 415437 - RNA, 18 nt, Human
gaaaccccgucucuacua

SEQ ID NO: 415438 - RNA, 32 nt, Human
gaaaccccuaaaucgagaccuggcugccuuuu

SEQ ID NO: 415439 - RNA, 32 nt, Human
gaaaccccucccaccuuuacacaugcccaggc

SEQ ID NO: 415440 - RNA, 32 nt, Human
gaaaccccuuucuccuccugcuccuugucccc

SEQ ID NO: 415441 - RNA, 32 nt, Human
gaaacccgggaaguggagguugcagugagcca

SEQ ID NO: 415442 - RNA, 32 nt, Human
gaaacccuacacccucccccuccagggaaugc

SEQ ID NO: 415443 - RNA, 32 nt, Human
gaaacccuaggcagacaccaggccaggcuuga

SEQ ID NO: 415444 - RNA, 18 nt, Human
gaaacccuaucucuacua

SEQ ID NO: 415445 - RNA, 32 nt, Human
gaaacccuauuuucuuuucuccaagaccaugg

SEQ ID NO: 415446 - RNA, 32 nt, Human
gaaacccucuacugccccauaagccaggaaaa

SEQ ID NO: 415447 - RNA, 32 nt, Human
gaaacccucuucuucccuggucuggcucugcu

SEQ ID NO: 415448 - RNA, 32 nt, Human
gaaacccugaaauacaaaaauuagucaggcau

SEQ ID NO: 415449 - RNA, 32 nt, Human
gaaacccugaacccgaguccucagccaugacg

SEQ ID NO: 415450 - RNA, 32 nt, Human
gaaacccugacugucuacagauuccaacuuua

SEQ ID NO: 415451 - RNA, 32 nt, Human
gaaacccugaucccaguggaggcuguaaccca

SEQ ID NO: 415452 - RNA, 32 nt, Human
gaaacccugauguaaagaucagucccaguuau

SEQ ID NO: 415453 - RNA, 32 nt, Human
gaaacccugcauaguguggcugagccucagga

SEQ ID NO: 415454 - RNA, 32 nt, Human
gaaacccugcauucaauguagcugucaauuca

SEQ ID NO: 415455 - RNA, 32 nt, Human
gaaacccuggaccaguggucucacauggugcu

SEQ ID NO: 415456 - RNA, 20 nt, Human
gaaacccugucucuacaaaa

SEQ ID NO: 415457 - RNA, 32 nt, Human
gaaacccuugauagaaacuggaagccugccau

SEQ ID NO: 415458 - RNA, 32 nt, Human
gaaacccuuguuccuuccucuggucauugacg

SEQ ID NO: 415459 - RNA, 32 nt, Human
gaaaccgaaaaacaggcuuguguccuuccauu

SEQ ID NO: 415460 - RNA, 32 nt, Human
gaaaccgaggcugaagcugggaggugagccag

SEQ ID NO: 415461 - RNA, 32 nt, Human
gaaaccggaaggcagagguugcagugagccaa

SEQ ID NO: 415462 - RNA, 32 nt, Human
gaaaccgggaggcggagguugaggugagccga

SEQ ID NO: 415463 - RNA, 17 nt, Human
gaaaccggguaacggcu

SEQ ID NO: 415464 - RNA, 32 nt, Human
gaaaccuacagaaccgacaaaaauuagggugc

SEQ ID NO: 415465 - RNA, 32 nt, Human
gaaaccuagaaucaaacugagauacagauuuc

SEQ ID NO: 415466 - RNA, 32 nt, Human
gaaaccuaggggcacauuggguaauaagagua

SEQ ID NO: 415467 - RNA, 32 nt, Human
gaaaccuauagacgauguuuuaauguaccuuc

SEQ ID NO: 415468 - RNA, 32 nt, Human
gaaaccuauccuccucaccagaagagccugug

SEQ ID NO: 415469 - RNA, 32 nt, Human
gaaaccuaucucugaguuuugggaccaggucg

SEQ ID NO: 415470 - RNA, 32 nt, Human
gaaaccuauuacagccugcagcugugagcuga

SEQ ID NO: 415471 - RNA, 32 nt, Human
gaaaccucagcgugaagggacauaucacugac

SEQ ID NO: 415472 - RNA, 32 nt, Human
gaaaccuccagaggaaucuguuugcuuccuga

SEQ ID NO: 415473 - RNA, 32 nt, Human
gaaaccucugcagcucauucugccacugcaaa

SEQ ID NO: 415474 - RNA, 32 nt, Human
gaaaccucuuuauuucccuccugaggggucuc

SEQ ID NO: 415475 - RNA, 32 nt, Human
gaaaccugaacauggaaaccaccagaacaaga

SEQ ID NO: 415476 - RNA, 32 nt, Human
gaaaccugagaggcagcaccacacaguggaaa

SEQ ID NO: 415477 - RNA, 32 nt, Human
gaaaccugagaugcagugggccaagggguaug

SEQ ID NO: 415478 - RNA, 32 nt, Human
gaaaccugcagccugggcucccggcuacaaca

SEQ ID NO: 415479 - RNA, 32 nt, Human
gaaaccugcuuuguaggggauuauguagacua

SEQ ID NO: 415480 - RNA, 32 nt, Human
gaaaccugggacaucugaacugcuccaugaag

SEQ ID NO: 415481 - RNA, 32 nt, Human
gaaaccugggcagcccucucaguggcuuccua

SEQ ID NO: 415482 - RNA, 32 nt, Human
gaaaccugggcuggagugagguggaaggaugu

SEQ ID NO: 415483 - RNA, 32 nt, Human
gaaaccuggggcuaggggaaaugaaaggaagc

SEQ ID NO: 415484 - RNA, 32 nt, Human
gaaaccuggguccuagucccagcucuuccaug

SEQ ID NO: 415485 - RNA, 32 nt, Human
gaaaccugucucuacaaaaauacaaaaauuag

SEQ ID NO: 415486 - RNA, 32 nt, Human
gaaaccuuauaaaagaaauuauauggcaaggu

SEQ ID NO: 415487 - RNA, 21 nt, Human
gaaaccuuaugaaugcaguga

SEQ ID NO: 415488 - RNA, 32 nt, Human
gaaaccuuccaaugcuucuguugaucucagua

SEQ ID NO: 415489 - RNA, 32 nt, Human
gaaaccuucccaaagcucuccacaucacucuc

SEQ ID NO: 415490 - RNA, 32 nt, Human
gaaaccuugcuguccucaccuccaaggcaggg

SEQ ID NO: 415491 - RNA, 32 nt, Human
gaaaccuugggaacaugaugaaugugaggaaa

SEQ ID NO: 415492 - RNA, 22 nt, Human
gaaaccuugguuucuccauccu

SEQ ID NO: 415493 - RNA, 20 nt, Human
gaaaccuuuacccaugacca

SEQ ID NO: 415494 - RNA, 32 nt, Human
gaaaccuuugcugcugaaaugaggcaaaauga

SEQ ID NO: 415495 - RNA, 32 nt, Human
gaaaccuuugugagacagagaacagggaauua

SEQ ID NO: 415496 - RNA, 24 nt, Human
gaaaccuuuuaccuauuaccuucc

SEQ ID NO: 415497 - RNA, 32 nt, Human
gaaacgaaagaaagcaaagcaaagucagugaa

SEQ ID NO: 415498 - RNA, 32 nt, Human
gaaacgaagaagcagauggagaggucccauua

SEQ ID NO: 415499 - RNA, 32 nt, Human
gaaacgaaguugagaaaaugauuuucccuuug

SEQ ID NO: 415500 - RNA, 32 nt, Human
gaaacgacacaucccagugggauuuccaacac

SEQ ID NO: 415501 - RNA, 32 nt, Human
gaaacgaccccacaggucagguggaggguggg

SEQ ID NO: 415502 - RNA, 32 nt, Human
gaaacgaggcugcaguggugguaguaggaaga

SEQ ID NO: 415503 - RNA, 32 nt, Human
gaaacgaggguuuauuccguugcccacuccgc

SEQ ID NO: 415504 - RNA, 32 nt, Human
gaaacgaugaaccuguaaucacucuggccaaa

SEQ ID NO: 415505 - RNA, 32 nt, Human
gaaacgcaccaugccugcuuccaucuuuugcu

SEQ ID NO: 415506 - RNA, 32 nt, Human
gaaacgcacccauggggcaccugcucucggcc

SEQ ID NO: 415507 - RNA, 32 nt, Human
gaaacgcaggaguccuuccugguagccagcuc

SEQ ID NO: 415508 - RNA, 32 nt, Human
gaaacgcagggucuuguugcaagucuggcuua

SEQ ID NO: 415509 - RNA, 31 nt, Human
gaaacgcaguuuccauggcccaacucacagu

SEQ ID NO: 415510 - RNA, 32 nt, Human
gaaacgccuguauuuaaagggauaguaacucg

SEQ ID NO: 415511 - RNA, 32 nt, Human
gaaacgcuacaucuucucugguugaggggcuu

SEQ ID NO: 415512 - RNA, 32 nt, Human
gaaacgcucaugcacaccuggcugcacaggug

SEQ ID NO: 415513 - RNA, 32 nt, Human
gaaacgcucaugggugcaucccugacgagccc

SEQ ID NO: 415514 - RNA, 32 nt, Human
gaaacgcucccacucccacgggccaucgaggg

SEQ ID NO: 415515 - RNA, 32 nt, Human
gaaacgcugaggcuccagcccuagccagcccu

SEQ ID NO: 415516 - RNA, 32 nt, Human
gaaacgcuuuggugcuuuucuccaguuuucug

SEQ ID NO: 415517 - RNA, 32 nt, Human
gaaacggagcccaucuaaccaaugcccagcac

SEQ ID NO: 415518 - RNA, 25 nt, Human
gaaacggaucaccaaauugaugugu

SEQ ID NO: 415519 - RNA, 32 nt, Human
gaaacggcagaagaaagugccagugcaggaga

SEQ ID NO: 415520 - RNA, 32 nt, Human
gaaacgggaggccauaguuucuaagaaggagg

SEQ ID NO: 415521 - RNA, 32 nt, Human
gaaacgggaggcggagguugcagugagccgaa

SEQ ID NO: 415522 - RNA, 32 nt, Human
gaaacgggguuucaccauguugcucaggcugg

SEQ ID NO: 415523 - RNA, 32 nt, Human
gaaacggucauuuaucaggagccaucuuuauu

SEQ ID NO: 415524 - RNA, 18 nt, Human
gaaacgguggaacaguuu

SEQ ID NO: 415525 - RNA, 32 nt, Human
gaaacguauacuuuaacaacaaaggaauuaca

SEQ ID NO: 415526 - RNA, 32 nt, Human
gaaacgucccuugccacuccccacucucauca

SEQ ID NO: 415527 - RNA, 31 nt, Human
gaaacuaaaagcuuucacucuuagaaacauu

SEQ ID NO: 415528 - RNA, 32 nt, Human
gaaacuaaaaguacauauguauuauacacuug

SEQ ID NO: 415529 - RNA, 32 nt, Human
gaaacuaacuacuaacuagucuuuggaauucg

SEQ ID NO: 415530 - RNA, 32 nt, Human
gaaacuaagagagaauugguacuuuaauuacu

SEQ ID NO: 415531 - RNA, 32 nt, Human
gaaacuaagaucaagacacauguuuggggaua

SEQ ID NO: 415532 - RNA, 32 nt, Human
gaaacuacauaagcaaaccaagcccuaugaac

SEQ ID NO: 415533 - RNA, 32 nt, Human
gaaacuacauagcaugcuuuugcucaaaauag

SEQ ID NO: 415534 - RNA, 21 nt, Human
gaaacuacaugaaugcaguga

SEQ ID NO: 415535 - RNA, 32 nt, Human
gaaacuaccuaaaaggauauguuaucacugga

SEQ ID NO: 415536 - RNA, 32 nt, Human
gaaacuagaaugagagggaagagauagcaugg

SEQ ID NO: 415537 - RNA, 32 nt, Human
gaaacuagaucuucccacagaacacuggggac

SEQ ID NO: 415538 - RNA, 32 nt, Human
gaaacuagcuaccacacccugacuuuacccuu

SEQ ID NO: 415539 - RNA, 32 nt, Human
gaaacuagggaaacuaguucuuugguuaauga

SEQ ID NO: 415540 - RNA, 32 nt, Human
gaaacuaugguucaagaagagaggacggggcu

SEQ ID NO: 415541 - RNA, 32 nt, Human
gaaacuauucuaagaguaacaaaggaaaacaa

SEQ ID NO: 415542 - RNA, 23 nt, Human
gaaacucaaaacugacacuagga

SEQ ID NO: 415543 - RNA, 24 nt, Human
gaaacucaaaauugaacacaguga

SEQ ID NO: 415544 - RNA, 21 nt, Human
gaaacucaagcauuuucacua

SEQ ID NO: 415545 - RNA, 31 nt, Human
gaaacucacagcuacaagggcaggugaggaa

SEQ ID NO: 415546 - RNA, 32 nt, Human
gaaacucacgcugcuccagccugaggcuucca

SEQ ID NO: 415547 - RNA, 32 nt, Human
gaaacucacugcaaaaucaccacgacucuuuc

SEQ ID NO: 415548 - RNA, 32 nt, Human
gaaacucacuucuggcaccugucgagaugcca

SEQ ID NO: 415549 - RNA, 32 nt, Human
gaaacucagauguccaaacuaauuuuaacaaa

SEQ ID NO: 415550 - RNA, 32 nt, Human
gaaacucagccauccuuagagaacuguggugc

SEQ ID NO: 415551 - RNA, 20 nt, Human
gaaacucagucguucaggga

SEQ ID NO: 415552 - RNA, 32 nt, Human
gaaacucaugcaaugccuacaggaagcuuugu

SEQ ID NO: 415553 - RNA, 23 nt, Human
gaaacucaugggauuuguaacca

SEQ ID NO: 415554 - RNA, 21 nt, Human
gaaacucauugaaaacaauga

SEQ ID NO: 415555 - RNA, 32 nt, Human
gaaacuccaauuucucuugcauggagacuccu

SEQ ID NO: 415556 - RNA, 32 nt, Human
gaaacuccaggcaguccucaagaggcugaaga

SEQ ID NO: 415557 - RNA, 32 nt, Human
gaaacuccaguuccuuuccucucuugccucuu

SEQ ID NO: 415558 - RNA, 18 nt, Human
gaaacuccaucucuacua

SEQ ID NO: 415559 - RNA, 32 nt, Human
gaaacuccaucuucaaaacaaaacaaaacaaa

SEQ ID NO: 415560 - RNA, 32 nt, Human
gaaacucccaggagacagcagccuaguuuucg

SEQ ID NO: 415561 - RNA, 32 nt, Human
gaaacuccgucucaaaaacaaagaaggauaua

SEQ ID NO: 415562 - RNA, 32 nt, Human
gaaacuccugaaaaucuugaaauggauuucua

SEQ ID NO: 415563 - RNA, 32 nt, Human
gaaacuccuggagcaacaaagaagagagaaaa

SEQ ID NO: 415564 - RNA, 32 nt, Human
gaaacucuaccuaacagggaacuaucuucaaa

SEQ ID NO: 415565 - RNA, 32 nt, Human
gaaacucucccagagacgaagaaagaguccug

SEQ ID NO: 415566 - RNA, 32 nt, Human
gaaacucucccauccaacaucacccaguggau

SEQ ID NO: 415567 - RNA, 32 nt, Human
gaaacucugaaagucccucccaaaaagaugga

SEQ ID NO: 415568 - RNA, 32 nt, Human
gaaacucugaagauggaucauggccaugacug

SEQ ID NO: 415569 - RNA, 32 nt, Human
gaaacucugcaggccuuccgccugauuauuau

SEQ ID NO: 415570 - RNA, 31 nt, Human
gaaacucuuaucaauaaaaccccaacaucac

SEQ ID NO: 415571 - RNA, 32 nt, Human
gaaacucuucucuccaaaucccaggccuggcu

SEQ ID NO: 415572 - RNA, 32 nt, Human
gaaacugaaggcagaugccucuccuuguuaaa

SEQ ID NO: 415573 - RNA, 32 nt, Human
gaaacugaagggaguuuugcaagugaaaauuu

SEQ ID NO: 415574 - RNA, 32 nt, Human
gaaacugaaguugaggaauagugaagaguuug

SEQ ID NO: 415575 - RNA, 32 nt, Human
gaaacugacagcugucuuccacagccucugau

SEQ ID NO: 415576 - RNA, 32 nt, Human
gaaacugaccaccacccacaacuccgccagug

SEQ ID NO: 415577 - RNA, 32 nt, Human
gaaacugacugcuucagggcucagcuggaaga

SEQ ID NO: 415578 - RNA, 31 nt, Human
gaaacugagaccauccuagccaacaugguga

SEQ ID NO: 415579 - RNA, 19 nt, Human
gaaacugagagcuccuggg

SEQ ID NO: 415580 - RNA, 32 nt, Human
gaaacugagcccagagaccacaagcaaacugg

SEQ ID NO: 415581 - RNA, 32 nt, Human
gaaacugagccuuugcaagcauugaagcccac

SEQ ID NO: 415582 - RNA, 32 nt, Human
gaaacugaggcacaauaggguuaugacuugcu

SEQ ID NO: 415583 - RNA, 32 nt, Human
gaaacugaggcagagagugccguggagugguu

SEQ ID NO: 415584 - RNA, 32 nt, Human
gaaacugcacuccugucuucuggcuucagucu

SEQ ID NO: 415585 - RNA, 32 nt, Human
gaaacugccccugagcucacacauauuuccaa

SEQ ID NO: 415586 - RNA, 32 nt, Human
gaaacugccgcaucugccauauaaaggagaug

SEQ ID NO: 415587 - RNA, 24 nt, Human
gaaacugccuauaucuugccauca

SEQ ID NO: 415588 - RNA, 32 nt, Human
gaaacugcggcaggccgggugcagugucucaa

SEQ ID NO: 415589 - RNA, 32 nt, Human
gaaacugcuagcaaucaugcaauucuucagcu

SEQ ID NO: 415590 - RNA, 22 nt, Human
gaaacugcuauggacauggagg

SEQ ID NO: 415591 - RNA, 32 nt, Human
gaaacugcugagccaugcagggcagccuggug

SEQ ID NO: 415592 - RNA, 32 nt, Human
gaaacuggaaggcagagguugcagugagccaa

SEQ ID NO: 415593 - RNA, 32 nt, Human
gaaacuggaaggcagagguugcagugagccga

SEQ ID NO: 415594 - RNA, 32 nt, Human
gaaacuggacuaacaaugaggccaaagacuuu

SEQ ID NO: 415595 - RNA, 32 nt, Human
gaaacuggagugaaagggaagcaaugcagaaa

SEQ ID NO: 415596 - RNA, 32 nt, Human
gaaacuggccccggaucagagcaggaccuccc

SEQ ID NO: 415597 - RNA, 32 nt, Human
gaaacuggcgcugcugcugccucggcagcacc

SEQ ID NO: 415598 - RNA, 32 nt, Human
gaaacugggaggcagggguuggagugagccag

SEQ ID NO: 415599 - RNA, 32 nt, Human
gaaacugggaggcggagcuugcagugagccga

SEQ ID NO: 415600 - RNA, 32 nt, Human
gaaacugggagguggagguugcagugagccaa

SEQ ID NO: 415601 - RNA, 32 nt, Human
gaaacugggaugaccuggacccugccguaugg

SEQ ID NO: 415602 - RNA, 32 nt, Human
gaaacuggggaagggaaaacaaaccuucaaag

SEQ ID NO: 415603 - RNA, 32 nt, Human
gaaacuggggaaugugucucugccuguaaacu

SEQ ID NO: 415604 - RNA, 21 nt, Human
gaaacuggggucuuccucucc

SEQ ID NO: 415605 - RNA, 32 nt, Human
gaaacuggguuucucauuaaaguuguuuccca

SEQ ID NO: 415606 - RNA, 32 nt, Human
gaaacuggugcagcagaucaugcaaaguaaaa

SEQ ID NO: 415607 - RNA, 32 nt, Human
gaaacuggugccccagcagaucaaagguggga

SEQ ID NO: 415608 - RNA, 32 nt, Human
gaaacugguugugaucacaaagcacaacgaug

SEQ ID NO: 415609 - RNA, 32 nt, Human
gaaacuguauuuuggaagauauuugaaauuau

SEQ ID NO: 415610 - RNA, 32 nt, Human
gaaacuguauuuuuccuuuuguuuucauuuga

SEQ ID NO: 415611 - RNA, 32 nt, Human
gaaacugucugcuuuuugcuauuucugcaguu

SEQ ID NO: 415612 - RNA, 32 nt, Human
gaaacugugaaauaauaaaaguguguugucuu

SEQ ID NO: 415613 - RNA, 32 nt, Human
gaaacugugaugacuuugauuuuugugaaacg

SEQ ID NO: 415614 - RNA, 32 nt, Human
gaaacugugcacguuuuugucccuucaguugc

SEQ ID NO: 415615 - RNA, 32 nt, Human
gaaacuguggcaagagcgucugugcugaacca

SEQ ID NO: 415616 - RNA, 32 nt, Human
gaaacuguggcaccuccacugacagaggcggc

SEQ ID NO: 415617 - RNA, 32 nt, Human
gaaacugugugagcuguccugaccuggacgau

SEQ ID NO: 415618 - RNA, 32 nt, Human
gaaacuguuagaguugggggcucugcuuuuuc

SEQ ID NO: 415619 - RNA, 32 nt, Human
gaaacuguucccaccugcuggagugaaggggc

SEQ ID NO: 415620 - RNA, 32 nt, Human
gaaacuguugaugucacauccuuugacccugg

SEQ ID NO: 415621 - RNA, 22 nt, Human
gaaacuguugauguuugcauca

SEQ ID NO: 415622 - RNA, 32 nt, Human
gaaacuuaacaaucauggcagaaggaccucuu

SEQ ID NO: 415623 - RNA, 22 nt, Human
gaaacuuaagggacaagggcca

SEQ ID NO: 415624 - RNA, 32 nt, Human
gaaacuuacccauucagugcaccaagagcagc

SEQ ID NO: 415625 - RNA, 32 nt, Human
gaaacuuacccugagcaugacugggacacagc

SEQ ID NO: 415626 - RNA, 32 nt, Human
gaaacuuagugugccuuggaaaaggccgcaag

SEQ ID NO: 415627 - RNA, 32 nt, Human
gaaacuuauuucacuuucacacugccuucagg

SEQ ID NO: 415628 - RNA, 32 nt, Human
gaaacuucaaacuaaaccacuaacucaaugaa

SEQ ID NO: 415629 - RNA, 32 nt, Human
gaaacuucaagaaacuucaauaagggaugcau

SEQ ID NO: 415630 - RNA, 32 nt, Human
gaaacuucaagcaaaucuacuucaacacuuca

SEQ ID NO: 415631 - RNA, 32 nt, Human
gaaacuucacauaucacauucuuuuuaucaga

SEQ ID NO: 415632 - RNA, 32 nt, Human
gaaacuucaccucugcugagcccucauucccc

SEQ ID NO: 415633 - RNA, 32 nt, Human
gaaacuucacguggcuacauuguauuuccccc

SEQ ID NO: 415634 - RNA, 32 nt, Human
gaaacuucaguuauuguauugguaacuauaaa

SEQ ID NO: 415635 - RNA, 32 nt, Human
gaaacuuccccauucggugcaccaagagcaac

SEQ ID NO: 415636 - RNA, 32 nt, Human
gaaacuuccuuugagaauugugcgacuucaca

SEQ ID NO: 415637 - RNA, 32 nt, Human
gaaacuucguugccagagaugacugggguuuu

SEQ ID NO: 415638 - RNA, 32 nt, Human
gaaacuucucagaaauuaaucugaaauggcag

SEQ ID NO: 415639 - RNA, 32 nt, Human
gaaacuucuuagggcaaacccaccucccacuc

SEQ ID NO: 415640 - RNA, 32 nt, Human
gaaacuugaacaaagagcggcaauuccacuuc

SEQ ID NO: 415641 - RNA, 32 nt, Human
gaaacuugagagaagagaaguuagugauuccc

SEQ ID NO: 415642 - RNA, 32 nt, Human
gaaacuugaucaggaaagugacacuggucuuu

SEQ ID NO: 415643 - RNA, 32 nt, Human
gaaacuugccccuucccauuucuagagcugga

SEQ ID NO: 415644 - RNA, 32 nt, Human
gaaacuuggacugagcuacugcuggcuuccuu

SEQ ID NO: 415645 - RNA, 32 nt, Human
gaaacuuggcuguagacaucugaagagggugc

SEQ ID NO: 415646 - RNA, 32 nt, Human
gaaacuuguuagaaauacaaauuuuagggccu

SEQ ID NO: 415647 - RNA, 32 nt, Human
gaaacuuuaucaucuuucacuuuugguuuucc

SEQ ID NO: 415648 - RNA, 32 nt, Human
gaaacuuugcuuguuugaaguccuguggauuc

SEQ ID NO: 415649 - RNA, 32 nt, Human
gaaacuuuggugguggucauggaggcaguuuu

SEQ ID NO: 415650 - RNA, 32 nt, Human
gaaacuuuucaaggacaguguauuauaacaau

SEQ ID NO: 415651 - RNA, 32 nt, Human
gaaacuuuucauuuccuguuccuugcuaauua

SEQ ID NO: 415652 - RNA, 32 nt, Human
gaaacuuuuggauguggggcaucauccgcauc

SEQ ID NO: 415653 - RNA, 32 nt, Human
gaaacuuuuguagcaaucuggucuauagacuu

SEQ ID NO: 415654 - RNA, 32 nt, Human
gaaagaaaaacagcauuuuucucuagcagaga

SEQ ID NO: 415655 - RNA, 32 nt, Human
gaaagaaaaaccugcauauuuuguacagaaaa

SEQ ID NO: 415656 - RNA, 32 nt, Human
gaaagaaaaagaaagaaagaaaagaaaagaaa

SEQ ID NO: 415657 - RNA, 32 nt, Human
gaaagaaaaauguaggcaucauagccauucag

SEQ ID NO: 415658 - RNA, 32 nt, Human
gaaagaaaaauuaucuugaauguaguauucaa

SEQ ID NO: 415659 - RNA, 32 nt, Human
gaaagaaaacaaaaccaacaguuaguggaguc

SEQ ID NO: 415660 - RNA, 32 nt, Human
gaaagaaaacacaaagagaaaauaugaacaau

SEQ ID NO: 415661 - RNA, 32 nt, Human
gaaagaaaaucaccagcuucaugcccugaaau

SEQ ID NO: 415662 - RNA, 32 nt, Human
gaaagaaaauggaggaagaggaaguaggaaga

SEQ ID NO: 415663 - RNA, 32 nt, Human
gaaagaaaauuuaggggccaguucucaaggaa

SEQ ID NO: 415664 - RNA, 20 nt, Human
gaaagaaacaggaccccucc

SEQ ID NO: 415665 - RNA, 32 nt, Human
gaaagaaacaugugaguaagugagagagagug

SEQ ID NO: 415666 - RNA, 32 nt, Human
gaaagaaacauucgguaaagaggggaagaugu

SEQ ID NO: 415667 - RNA, 32 nt, Human
gaaagaaacuaaucacagcacagaaguaccuu

SEQ ID NO: 415668 - RNA, 32 nt, Human
gaaagaaacuaccuuuuuauaaugcacaacug

SEQ ID NO: 415669 - RNA, 32 nt, Human
gaaagaaagaaaaagaaagaaagaaaagaaaa

SEQ ID NO: 415670 - RNA, 32 nt, Human
gaaagaaagaaagagaaaagaaaagaaaagca

SEQ ID NO: 415671 - RNA, 32 nt, Human
gaaagaaagaaagaguggguuucagaaguguc

SEQ ID NO: 415672 - RNA, 17 nt, Human
gaaagaaagacuguggu

SEQ ID NO: 415673 - RNA, 32 nt, Human
gaaagaaagaugaccccuuccugaggcccguu

SEQ ID NO: 415674 - RNA, 32 nt, Human
gaaagaaagcaaagcaaagucagugaaagaca

SEQ ID NO: 415675 - RNA, 31 nt, Human
gaaagaaaggaaagaaagaaagacuguaaua

SEQ ID NO: 415676 - RNA, 32 nt, Human
gaaagaaagggaaaagggagaaaaagaaacac

SEQ ID NO: 415677 - RNA, 32 nt, Human
gaaagaaaggggcaaggaaaguaagaagacau

SEQ ID NO: 415678 - RNA, 32 nt, Human
gaaagaaaugauacauuuuccccaaguaaggu

SEQ ID NO: 415679 - RNA, 32 nt, Human
gaaagaaauguaccuucuuucacucugucauc

SEQ ID NO: 415680 - RNA, 32 nt, Human
gaaagaaauuaagguuagcggaucauguacaa

SEQ ID NO: 415681 - RNA, 32 nt, Human
gaaagaacacacuagggagaaacccuaucaau

SEQ ID NO: 415682 - RNA, 32 nt, Human
gaaagaacaguuacuggcagaggaagaggaug

SEQ ID NO: 415683 - RNA, 32 nt, Human
gaaagaacauuauuccgggcgcgguggcucac

SEQ ID NO: 415684 - RNA, 32 nt, Human
gaaagaacguucccaccugccuagccauggga

SEQ ID NO: 415685 - RNA, 32 nt, Human
gaaagaacucaccuuucuggggcucucugaca

SEQ ID NO: 415686 - RNA, 32 nt, Human
gaaagaacucuccaccacggggaaugugaaag

SEQ ID NO: 415687 - RNA, 24 nt, Human
gaaagaacucucccaacccugggg

SEQ ID NO: 415688 - RNA, 32 nt, Human
gaaagaacuuuuagcaagguugugcuuucaaa

SEQ ID NO: 415689 - RNA, 23 nt, Human
gaaagaagaaaagauaauaccca

SEQ ID NO: 415690 - RNA, 32 nt, Human
gaaagaagaacuccaaguuacuggacaccagg

SEQ ID NO: 415691 - RNA, 32 nt, Human
gaaagaagacccuucuauuuagaguagaaaca

SEQ ID NO: 415692 - RNA, 32 nt, Human
gaaagaagagaauccaagggagagggguuggu

SEQ ID NO: 415693 - RNA, 32 nt, Human
gaaagaagagcaaauacaaaagccugaaggaa

SEQ ID NO: 415694 - RNA, 32 nt, Human
gaaagaagagcucagauugaaaggagggagcu

SEQ ID NO: 415695 - RNA, 32 nt, Human
gaaagaagcacaugaacuacagccuggaggug

SEQ ID NO: 415696 - RNA, 32 nt, Human
gaaagaagcaccucacagcuccuuucuagguc

SEQ ID NO: 415697 - RNA, 32 nt, Human
gaaagaagccagugccccaggucaccuaagac

SEQ ID NO: 415698 - RNA, 32 nt, Human
gaaagaagccauugaaaacaaagacauucuuc

SEQ ID NO: 415699 - RNA, 32 nt, Human
gaaagaagcgggccugaacaccaugaucccuu

SEQ ID NO: 415700 - RNA, 32 nt, Human
gaaagaagcuucuagaugcauauuguggggag

SEQ ID NO: 415701 - RNA, 22 nt, Human
gaaagaaggaaauaaaacauca

SEQ ID NO: 415702 - RNA, 32 nt, Human
gaaagaaggaaaugaaugugcauuuuauuaau

SEQ ID NO: 415703 - RNA, 18 nt, Human
gaaagaaggaccucggga

SEQ ID NO: 415704 - RNA, 32 nt, Human
gaaagaaggagaaggaagaagagagaaggaga

SEQ ID NO: 415705 - RNA, 32 nt, Human
gaaagaaggagagaaugagugagugcuugaaa

SEQ ID NO: 415706 - RNA, 32 nt, Human
gaaagaaggcaaggagguaggaagagagggag

SEQ ID NO: 415707 - RNA, 23 nt, Human
gaaagaagggugccacccccucc

SEQ ID NO: 415708 - RNA, 32 nt, Human
gaaagaaguacugaugacuuuucaaaacaaau

SEQ ID NO: 415709 - RNA, 32 nt, Human
gaaagaaguccccagaagaugagcucuguuac

SEQ ID NO: 415710 - RNA, 32 nt, Human
gaaagaaguggggacagagcagaacuuucacc

SEQ ID NO: 415711 - RNA, 32 nt, Human
gaaagaauaaccacugcacuccaaccugggca

SEQ ID NO: 415712 - RNA, 32 nt, Human
gaaagaauaaguuuugguucaaagucaauaau

SEQ ID NO: 415713 - RNA, 32 nt, Human
gaaagaauaccucaggaaaaacaaauacacuu

SEQ ID NO: 415714 - RNA, 32 nt, Human
gaaagaaugacccuggugagugcucuaaguuu

SEQ ID NO: 415715 - RNA, 32 nt, Human
gaaagacaaaacuguuugccauuuuuacuggc

SEQ ID NO: 415716 - RNA, 32 nt, Human
gaaagacaaacgggagagaaaaagaggaaggc

SEQ ID NO: 415717 - RNA, 32 nt, Human
gaaagacaaagaaggaaaagaguaucaaaggc

SEQ ID NO: 415718 - RNA, 32 nt, Human
gaaagacaaauggauucccuuagaaguaagau

SEQ ID NO: 415719 - RNA, 31 nt, Human
gaaagacaagaugcaacuaggaagagacaca

SEQ ID NO: 415720 - RNA, 21 nt, Human
gaaagacaaggaaaccccuga

SEQ ID NO: 415721 - RNA, 32 nt, Human
gaaagacaggcagggaaaagcuuaggcugacc

SEQ ID NO: 415722 - RNA, 32 nt, Human
gaaagacaucacauaccuucagcacuucucac

SEQ ID NO: 415723 - RNA, 32 nt, Human
gaaagacauuuguucucccaaaacugauuacu

SEQ ID NO: 415724 - RNA, 32 nt, Human
gaaagaccagaagaguggacaacuagcaacuu

SEQ ID NO: 415725 - RNA, 32 nt, Human
gaaagaccagagcucuugcaucagggaaacau

SEQ ID NO: 415726 - RNA, 32 nt, Human
gaaagaccauuuuuccuccacugaacuagggu

SEQ ID NO: 415727 - RNA, 32 nt, Human
gaaagacccaggcugcgggacgcggugcaggc

SEQ ID NO: 415728 - RNA, 32 nt, Human
gaaagacccuggcacccgcccgacaccugcgu

SEQ ID NO: 415729 - RNA, 32 nt, Human
gaaagaccucaguacaugcuuugcacucuccu

SEQ ID NO: 415730 - RNA, 32 nt, Human
gaaagacucacugucuacaccaucccucuucc

SEQ ID NO: 415731 - RNA, 32 nt, Human
gaaagacugaagaggcuggagugcaguggcgc

SEQ ID NO: 415732 - RNA, 32 nt, Human
gaaagacugcuccuggugcagggccuuuacca

SEQ ID NO: 415733 - RNA, 32 nt, Human
gaaagacuggcguggcaagcgucgcccugaaa

SEQ ID NO: 415734 - RNA, 32 nt, Human
gaaagacuggcugucuuccuccucacugcauc

SEQ ID NO: 415735 - RNA, 32 nt, Human
gaaagacuguacaaaguauaagucuuagaugu

SEQ ID NO: 415736 - RNA, 32 nt, Human
gaaagacuuacaugguccucaggcauggacag

SEQ ID NO: 415737 - RNA, 32 nt, Human
gaaagagaaaccagguauucugcuacaguuug

SEQ ID NO: 415738 - RNA, 32 nt, Human
gaaagagaaagaauuugcaaccaugaggaaug

SEQ ID NO: 415739 - RNA, 32 nt, Human
gaaagagaaagaauuuguuucacaguuuggau

SEQ ID NO: 415740 - RNA, 32 nt, Human
gaaagagaaagagaaggaaggaaggagaaaga

SEQ ID NO: 415741 - RNA, 32 nt, Human
gaaagagaaaugcaggagccgcggggcucccg

SEQ ID NO: 415742 - RNA, 32 nt, Human
gaaagagaacuccgagugggggucuggccuag

SEQ ID NO: 415743 - RNA, 32 nt, Human
gaaagagaaggaaggaaggagaaagagaagga

SEQ ID NO: 415744 - RNA, 32 nt, Human
gaaagagaagugucuaaaagcuucaaaauguu

SEQ ID NO: 415745 - RNA, 32 nt, Human
gaaagagaaugagagaaagagaaugagagaga

SEQ ID NO: 415746 - RNA, 32 nt, Human
gaaagagacaagaaauccuaguggccucccag

SEQ ID NO: 415747 - RNA, 23 nt, Human
gaaagagacagagugcugagggg

SEQ ID NO: 415748 - RNA, 32 nt, Human
gaaagagacuuagggaaguggaagagaaaggg

SEQ ID NO: 415749 - RNA, 32 nt, Human
gaaagagagaauaugaaagaaagggaaaauuu

SEQ ID NO: 415750 - RNA, 32 nt, Human
gaaagagagacagggucucaccauguugccca

SEQ ID NO: 415751 - RNA, 32 nt, Human
gaaagagagaggaggagggggaaagagcaaac

SEQ ID NO: 415752 - RNA, 32 nt, Human
gaaagagagaucagacugucacugugucuaug

SEQ ID NO: 415753 - RNA, 32 nt, Human
gaaagagaggaagagagaagcaaacauguagg

SEQ ID NO: 415754 - RNA, 32 nt, Human
gaaagagaggagagaaagaaaaagagaguggg

SEQ ID NO: 415755 - RNA, 32 nt, Human
gaaagagaggcggaggggagagagggauuuuc

SEQ ID NO: 415756 - RNA, 32 nt, Human
gaaagagauccaggaagcaugagugcuggaua

SEQ ID NO: 415757 - RNA, 32 nt, Human
gaaagagauccaggucuggagcuggagagaac

SEQ ID NO: 415758 - RNA, 32 nt, Human
gaaagagcaaacacuuuggaaucaaacagagu

SEQ ID NO: 415759 - RNA, 32 nt, Human
gaaagagcaguggcugcaggagaggccuuccc

SEQ ID NO: 415760 - RNA, 32 nt, Human
gaaagagcccagaagcagcccuggcccuguaa

SEQ ID NO: 415761 - RNA, 19 nt, Human
gaaagagcccagccugcca

SEQ ID NO: 415762 - RNA, 32 nt, Human
gaaagagccccuggguggagguugaggccauu

SEQ ID NO: 415763 - RNA, 32 nt, Human
gaaagagccgaguaucuuccagccgcugccuc

SEQ ID NO: 415764 - RNA, 32 nt, Human
gaaagagccuggcaaggcccuguugacuagca

SEQ ID NO: 415765 - RNA, 32 nt, Human
gaaagagccuugaagaccuucagucugacccc

SEQ ID NO: 415766 - RNA, 32 nt, Human
gaaagagcguccauaggagaagugagaauacu

SEQ ID NO: 415767 - RNA, 32 nt, Human
gaaagagcugagccacucuccccauccaggga

SEQ ID NO: 415768 - RNA, 22 nt, Human
gaaagagcuggauuggcugggg

SEQ ID NO: 415769 - RNA, 32 nt, Human
gaaagagcuggcugggggccuugcccaaacca

SEQ ID NO: 415770 - RNA, 32 nt, Human
gaaagagcuuuuagcaagguugugcuuuucau

SEQ ID NO: 415771 - RNA, 23 nt, Human
gaaagaggaagccaaaccugagg

SEQ ID NO: 415772 - RNA, 22 nt, Human
gaaagaggagagccucacggga

SEQ ID NO: 415773 - RNA, 32 nt, Human
gaaagaggaucucuagagucugggagagaaca

SEQ ID NO: 415774 - RNA, 32 nt, Human
gaaagaggauggcuauuucauccacuaaaggu

SEQ ID NO: 415775 - RNA, 23 nt, Human
gaaagaggauuuacagggugggg

SEQ ID NO: 415776 - RNA, 32 nt, Human
gaaagaggcaagaaagaagugcuauguggcga

SEQ ID NO: 415777 - RNA, 32 nt, Human
gaaagaggcacccuuccaucugauuccagcac

SEQ ID NO: 415778 - RNA, 32 nt, Human
gaaagaggccaucucacuagaauaggauauua

SEQ ID NO: 415779 - RNA, 32 nt, Human
gaaagaggcgcaggacgaggaggcagaacccg

SEQ ID NO: 415780 - RNA, 32 nt, Human
gaaagaggcuccagaggagcagugagcucgag

SEQ ID NO: 415781 - RNA, 32 nt, Human
gaaagaggcucuggacagcagaagccuccaag

SEQ ID NO: 415782 - RNA, 32 nt, Human
gaaagaggcuuccucuucucaggaagaagcca

SEQ ID NO: 415783 - RNA, 32 nt, Human
gaaagagggaggaagagagggagggagggagg

SEQ ID NO: 415784 - RNA, 32 nt, Human
gaaagaggggacaggugucagagcagggagaa

SEQ ID NO: 415785 - RNA, 32 nt, Human
gaaagaggggaggagggaggaagaauagagga

SEQ ID NO: 415786 - RNA, 32 nt, Human
gaaagaggggcagaggagggaaggcgacugca

SEQ ID NO: 415787 - RNA, 32 nt, Human
gaaagaggggcugaggccugaacugggccuaa

SEQ ID NO: 415788 - RNA, 32 nt, Human
gaaagaggggcuuggagagggagacagggcca

SEQ ID NO: 415789 - RNA, 32 nt, Human
gaaagagggggaaaggaggaccgaagaggagg

SEQ ID NO: 415790 - RNA, 32 nt, Human
gaaagaggguucccgcuggaggagaagguguu

SEQ ID NO: 415791 - RNA, 32 nt, Human
gaaagagguagugccaaucuccuugcccagau

SEQ ID NO: 415792 - RNA, 32 nt, Human
gaaagaggucgccccaaguggcccagagucgu

SEQ ID NO: 415793 - RNA, 32 nt, Human
gaaagaguacccagaggagccugagcacacuc

SEQ ID NO: 415794 - RNA, 32 nt, Human
gaaagaguacugugugcugagagaccauggca

SEQ ID NO: 415795 - RNA, 32 nt, Human
gaaagaguauggagagaaaaagaggcacaccu

SEQ ID NO: 415796 - RNA, 32 nt, Human
gaaagagucaucugauguaauucucucacuua

SEQ ID NO: 415797 - RNA, 32 nt, Human
gaaagaguccccaugcacuuggaguccaugag

SEQ ID NO: 415798 - RNA, 32 nt, Human
gaaagaguccucccagagcugcaguucgggcc

SEQ ID NO: 415799 - RNA, 32 nt, Human
gaaagagugaauaggcugggcaugguggcuca

SEQ ID NO: 415800 - RNA, 32 nt, Human
gaaagagugauagggagagggagcgaggcugg

SEQ ID NO: 415801 - RNA, 32 nt, Human
gaaagaguuaaagaugaggaagagauauuuuu

SEQ ID NO: 415802 - RNA, 32 nt, Human
gaaagaguuccagagggaggcugaaccugagg

SEQ ID NO: 415803 - RNA, 32 nt, Human
gaaagaguucccaagcuucuaccuuccuuuug

SEQ ID NO: 415804 - RNA, 32 nt, Human
gaaagaguuguuccaaucauguaaccuucugu

SEQ ID NO: 415805 - RNA, 18 nt, Human
gaaagauaaagcuucuga

SEQ ID NO: 415806 - RNA, 32 nt, Human
gaaagauaaagugaaaguuuauuucaggacug

SEQ ID NO: 415807 - RNA, 32 nt, Human
gaaagauaaguuaaauuucaagggggucauau

SEQ ID NO: 415808 - RNA, 32 nt, Human
gaaagauacagcacuccucaugccuuccugga

SEQ ID NO: 415809 - RNA, 32 nt, Human
gaaagauauguugccagcauugugcucagccg

SEQ ID NO: 415810 - RNA, 32 nt, Human
gaaagauauuugaacccgaccugggcaauucc

SEQ ID NO: 415811 - RNA, 32 nt, Human
gaaagaucagguaggcgaaaagaugacaggau

SEQ ID NO: 415812 - RNA, 32 nt, Human
gaaagaucucaaauucaagagacucauggaca

SEQ ID NO: 415813 - RNA, 32 nt, Human
gaaagaucucucucgagcgcaccauaaaccug

SEQ ID NO: 415814 - RNA, 32 nt, Human
gaaagaugaaaccggaggccgggcucacggug

SEQ ID NO: 415815 - RNA, 32 nt, Human
gaaagaugaagagagaugaggcaggacuagca

SEQ ID NO: 415816 - RNA, 32 nt, Human
gaaagaugaauaaagacaaacaugacaaacua

SEQ ID NO: 415817 - RNA, 32 nt, Human
gaaagaugagcuuuuuauucuacuacuuggaa

SEQ ID NO: 415818 - RNA, 24 nt, Human
gaaagaugaggacuuugacuggaa

SEQ ID NO: 415819 - RNA, 32 nt, Human
gaaagaugcaaucuuuuucccaggccccagcc

SEQ ID NO: 415820 - RNA, 32 nt, Human
gaaagaugccuaggaaggaugaggaugacagg

SEQ ID NO: 415821 - RNA, 32 nt, Human
gaaagauggaaagugaaccaaaaaggcuagaa

SEQ ID NO: 415822 - RNA, 32 nt, Human
gaaagauggaggagaaaaagaaaaggaagaaa

SEQ ID NO: 415823 - RNA, 32 nt, Human
gaaagauggcacccucccacccgcaggagugc

SEQ ID NO: 415824 - RNA, 23 nt, Human
gaaagaugguuuuggaacuggaa

SEQ ID NO: 415825 - RNA, 30 nt, Human
gaaagauguccaggucgggcgcggcggcug

SEQ ID NO: 415826 - RNA, 32 nt, Human
gaaagaugugugugugagaguauguaugugug

SEQ ID NO: 415827 - RNA, 32 nt, Human
gaaagauuaaggaucaggauugcaugaaagaa

SEQ ID NO: 415828 - RNA, 32 nt, Human
gaaagauuaggacagacagcugagauggcaga

SEQ ID NO: 415829 - RNA, 32 nt, Human
gaaagauuauuguuugucggccuguguauauu

SEQ ID NO: 415830 - RNA, 32 nt, Human
gaaagauucacgcaagcaucucaccaggauuc

SEQ ID NO: 415831 - RNA, 32 nt, Human
gaaagauucacuguacuaacuacuuucuucag

SEQ ID NO: 415832 - RNA, 32 nt, Human
gaaagauuccagcacugagccgugagccgguc

SEQ ID NO: 415833 - RNA, 32 nt, Human
gaaagauuccaggacagagaugacagaggcuu

SEQ ID NO: 415834 - RNA, 32 nt, Human
gaaagauucucgcuaauggauuuccugcugcu

SEQ ID NO: 415835 - RNA, 32 nt, Human
gaaagauugaaggaugcaauggcaaauauaaa

SEQ ID NO: 415836 - RNA, 32 nt, Human
gaaagauugacuucaaucucaugagaacccug

SEQ ID NO: 415837 - RNA, 32 nt, Human
gaaagauuuacauagccuuacacuucucucua

SEQ ID NO: 415838 - RNA, 32 nt, Human
gaaagcaaagggauuucuggaagcuugaacuu

SEQ ID NO: 415839 - RNA, 32 nt, Human
gaaagcaaauacgagggagacugagagccuca

SEQ ID NO: 415840 - RNA, 32 nt, Human
gaaagcaacucuugccccuccuccucugggca

SEQ ID NO: 415841 - RNA, 32 nt, Human
gaaagcaacuucagguuucaucuugcucuauu

SEQ ID NO: 415842 - RNA, 19 nt, Human
gaaagcaacuuuacugaga

SEQ ID NO: 415843 - RNA, 32 nt, Human
gaaagcaagaacagaaaacgaagccacaggaa

SEQ ID NO: 415844 - RNA, 32 nt, Human
gaaagcaagaggaggaagauaaaugcccggag

SEQ ID NO: 415845 - RNA, 32 nt, Human
gaaagcaagaucaugaaggugugcaaaugauu

SEQ ID NO: 415846 - RNA, 19 nt, Human
gaaagcaagucaccuacca

SEQ ID NO: 415847 - RNA, 32 nt, Human
gaaagcaaugggaagccaugcucugcauacuc

SEQ ID NO: 415848 - RNA, 32 nt, Human
gaaagcacaaauuuaacggcuucacuggacag

SEQ ID NO: 415849 - RNA, 32 nt, Human
gaaagcacaagcuuuuccuguauauuauauuu

SEQ ID NO: 415850 - RNA, 32 nt, Human
gaaagcacagccgugccuggccagacuccauc

SEQ ID NO: 415851 - RNA, 32 nt, Human
gaaagcacaggcugugcugucgaggcgccugc

SEQ ID NO: 415852 - RNA, 24 nt, Human
gaaagcacauauuugggaacucug

SEQ ID NO: 415853 - RNA, 32 nt, Human
gaaagcacccuccaauaaacccaggcuccagg

SEQ ID NO: 415854 - RNA, 32 nt, Human
gaaagcaccuuccuggaggaugugggagggcc

SEQ ID NO: 415855 - RNA, 32 nt, Human
gaaagcacggggccuuucccacccacccucag

SEQ ID NO: 415856 - RNA, 32 nt, Human
gaaagcacuauacauccuauuguuucuuucuu

SEQ ID NO: 415857 - RNA, 32 nt, Human
gaaagcacucagacaugucuguccucacagca

SEQ ID NO: 415858 - RNA, 21 nt, Human
gaaagcacucggagaauugug

SEQ ID NO: 415859 - RNA, 32 nt, Human
gaaagcagaccaacccagcugccuuaccuuau

SEQ ID NO: 415860 - RNA, 32 nt, Human
gaaagcagacuggccagggacuuugcgaucca

SEQ ID NO: 415861 - RNA, 32 nt, Human
gaaagcagagaggcagcucgcuacgugaccau

SEQ ID NO: 415862 - RNA, 32 nt, Human
gaaagcagagcccagacucuuggagcaggugu

SEQ ID NO: 415863 - RNA, 32 nt, Human
gaaagcagaggcauccuugagcuuuaaagcau

SEQ ID NO: 415864 - RNA, 32 nt, Human
gaaagcagcaagccccgggcugugcucaagcc

SEQ ID NO: 415865 - RNA, 32 nt, Human
gaaagcagccuggccaacauagugggacccug

SEQ ID NO: 415866 - RNA, 32 nt, Human
gaaagcagcgaguuggcagagcagggcugcau

SEQ ID NO: 415867 - RNA, 32 nt, Human
gaaagcagcuggugugggaggaaaggcuccau

SEQ ID NO: 415868 - RNA, 32 nt, Human
gaaagcaggagaaaggaaggauuaauugccug

SEQ ID NO: 415869 - RNA, 32 nt, Human
gaaagcaggagagagacugaguggcacauccu

SEQ ID NO: 415870 - RNA, 32 nt, Human
gaaagcaggagguguucucagacuugacccug

SEQ ID NO: 415871 - RNA, 32 nt, Human
gaaagcaggauguggcaguugcagugagaaag

SEQ ID NO: 415872 - RNA, 32 nt, Human
gaaagcaggauuucuuucaugugugaaauguc

SEQ ID NO: 415873 - RNA, 20 nt, Human
gaaagcaguggagguggggg

SEQ ID NO: 415874 - RNA, 21 nt, Human
gaaagcauaacauggguacag

SEQ ID NO: 415875 - RNA, 32 nt, Human
gaaagcauccaaaccacccaaaugaccaaggc

SEQ ID NO: 415876 - RNA, 32 nt, Human
gaaagcaucugaagacaucuaacuuagagucu

SEQ ID NO: 415877 - RNA, 32 nt, Human
gaaagcaucuguguuuauuauacucggguguc

SEQ ID NO: 415878 - RNA, 32 nt, Human
gaaagcaugaacuugcagaacucccucggaga

SEQ ID NO: 415879 - RNA, 32 nt, Human
gaaagcauggcugagagcaacugagggaaagg

SEQ ID NO: 415880 - RNA, 32 nt, Human
gaaagcaugucaggacagagcuguuggauugg

SEQ ID NO: 415881 - RNA, 32 nt, Human
gaaagcaugugugggccaaagcugaauuucca

SEQ ID NO: 415882 - RNA, 32 nt, Human
gaaagcauugaauguucugaucagaugugacu

SEQ ID NO: 415883 - RNA, 32 nt, Human
gaaagcauuguuuuaguccaggcacaguggcu

SEQ ID NO: 415884 - RNA, 32 nt, Human
gaaagcauuuugcaucagccuggagugaacca

SEQ ID NO: 415885 - RNA, 20 nt, Human
gaaagccaaaguacuggacu

SEQ ID NO: 415886 - RNA, 22 nt, Human
gaaagccaagaaacauguuuuc

SEQ ID NO: 415887 - RNA, 32 nt, Human
gaaagccaagagugcaggaugagagcugucug

SEQ ID NO: 415888 - RNA, 32 nt, Human
gaaagccaaggucuggagaagcucccaggaac

SEQ ID NO: 415889 - RNA, 32 nt, Human
gaaagccaagugugagggcugaaagaaugccc

SEQ ID NO: 415890 - RNA, 32 nt, Human
gaaagccaauaugaggccaggugguggcucau

SEQ ID NO: 415891 - RNA, 32 nt, Human
gaaagccaauuauugaccuuccuuccuuccuu

SEQ ID NO: 415892 - RNA, 32 nt, Human
gaaagccacacggagaggccacugugggugaa

SEQ ID NO: 415893 - RNA, 32 nt, Human
gaaagccagaaggagagcccucaccagaaacc

SEQ ID NO: 415894 - RNA, 32 nt, Human
gaaagccagagggacagagggagugagaaaga

SEQ ID NO: 415895 - RNA, 32 nt, Human
gaaagccagccugccuuuuagcacuuggauac

SEQ ID NO: 415896 - RNA, 32 nt, Human
gaaagccagcuauuuugcauuugaaggaauug

SEQ ID NO: 415897 - RNA, 21 nt, Human
gaaagccagcucucuucugaa

SEQ ID NO: 415898 - RNA, 18 nt, Human
gaaagccagcuucccucu

SEQ ID NO: 415899 - RNA, 32 nt, Human
gaaagccaggaagaagaggaagagcaccccca

SEQ ID NO: 415900 - RNA, 32 nt, Human
gaaagccaggagcugugauugacaguagcugu

SEQ ID NO: 415901 - RNA, 32 nt, Human
gaaagccagggcagcuccuuccccagccagga

SEQ ID NO: 415902 - RNA, 32 nt, Human
gaaagccagugcugcuacuuucaugccuugga

SEQ ID NO: 415903 - RNA, 32 nt, Human
gaaagccaucucuuccucugaucuggggucug

SEQ ID NO: 415904 - RNA, 32 nt, Human
gaaagccauggcagauuuccagccuggugaug

SEQ ID NO: 415905 - RNA, 32 nt, Human
gaaagcccagaaccagucccuuuaaugcacuu

SEQ ID NO: 415906 - RNA, 32 nt, Human
gaaagcccaggccgcaggagugggaugcccgu

SEQ ID NO: 415907 - RNA, 32 nt, Human
gaaagccccucagaacugggaaggccagguaa

SEQ ID NO: 415908 - RNA, 32 nt, Human
gaaagccccugggcuuucuuccuuccugaccu

SEQ ID NO: 415909 - RNA, 32 nt, Human
gaaagcccgccuuguugccugcuuugugcuuu

SEQ ID NO: 415910 - RNA, 32 nt, Human
gaaagcccggaggagcgaacagaaggauccuc

SEQ ID NO: 415911 - RNA, 32 nt, Human
gaaagcccgugucugcagaaccccugucagaa

SEQ ID NO: 415912 - RNA, 32 nt, Human
gaaagcccuaucucucugcaggcucgccucug

SEQ ID NO: 415913 - RNA, 32 nt, Human
gaaagcccucauccucaccgccucccgcuucc

SEQ ID NO: 415914 - RNA, 22 nt, Human
gaaagcccucccucccugaacu

SEQ ID NO: 415915 - RNA, 32 nt, Human
gaaagcccugcaggaaguuuaaccugcguguc

SEQ ID NO: 415916 - RNA, 32 nt, Human
gaaagcccuggaacugcuuggcucagaucagc

SEQ ID NO: 415917 - RNA, 32 nt, Human
gaaagcccuguaccaggcagccucugcuccau

SEQ ID NO: 415918 - RNA, 32 nt, Human
gaaagcccuuuuguucugcggcugccagccug

SEQ ID NO: 415919 - RNA, 32 nt, Human
gaaagccgggcggcaguggaggggacagugga

SEQ ID NO: 415920 - RNA, 32 nt, Human
gaaagccuagagaccgccacugugauucaccu

SEQ ID NO: 415921 - RNA, 32 nt, Human
gaaccugggaggcagagguugcgguaagccga

SEQ ID NO: 415922 - RNA, 24 nt, Human
gaaccugggaggcagagguuguag

SEQ ID NO: 415923 - RNA, 32 nt, Human
gaaccugggaggcagagguuguagcgagccaa

SEQ ID NO: 415924 - RNA, 32 nt, Human
gaaccugggaggcagagguuguagugagcuga

SEQ ID NO: 415925 - RNA, 32 nt, Human
gaaccugggaggcagagguuguggugagccaa

SEQ ID NO: 415926 - RNA, 32 nt, Human
gaaccugggaggcagagguuguggugagcuaa

SEQ ID NO: 415927 - RNA, 32 nt, Human
gaaccugggaggcagagguuguggugagcuga

SEQ ID NO: 415928 - RNA, 24 nt, Human
gaaccugggaggcagagguuucag

SEQ ID NO: 415929 - RNA, 32 nt, Human
gaaccugggaggcagagguuucagugagccaa

SEQ ID NO: 415930 - RNA, 24 nt, Human
gaaccugggaggcagagucugcag

SEQ ID NO: 415931 - RNA, 32 nt, Human
gaaccugggaggcagagucugcagugagccga

SEQ ID NO: 415932 - RNA, 32 nt, Human
gaaccugggaggcagaguuuacagugagccga

SEQ ID NO: 415933 - RNA, 24 nt, Human
gaaccugggaggcagaguuugcag

SEQ ID NO: 415934 - RNA, 32 nt, Human
gaaccugggaggcagaguuugcagugagccga

SEQ ID NO: 415935 - RNA, 32 nt, Human
gaaccugggaggcagaguuugcagugagcgga

SEQ ID NO: 415936 - RNA, 24 nt, Human
gaaccugggaggcagauguugcag

SEQ ID NO: 415937 - RNA, 32 nt, Human
gaaccugggaggcagauguugcagugagccga

SEQ ID NO: 415938 - RNA, 32 nt, Human
gaaccugggaggcagauguuguggugagccga

SEQ ID NO: 415939 - RNA, 24 nt, Human
gaaccugggaggcagcgguugcag

SEQ ID NO: 415940 - RNA, 32 nt, Human
gaaccugggaggcagcgguugcaguaagccaa

SEQ ID NO: 415941 - RNA, 24 nt, Human
gaaccugggaggcagggguugcag

SEQ ID NO: 415942 - RNA, 32 nt, Human
gaaccugggaggcagggguugcagugagcuga

SEQ ID NO: 415943 - RNA, 32 nt, Human
gaaccugggaggcaguuugcagugagcugaga

SEQ ID NO: 415944 - RNA, 32 nt, Human
gaaccugggaggccaagguugcagugagccga

SEQ ID NO: 415945 - RNA, 24 nt, Human
gaaccugggaggcgaagguugcag

SEQ ID NO: 415946 - RNA, 32 nt, Human
gaaccugggaggcgaagguugcagugagccaa

SEQ ID NO: 415947 - RNA, 32 nt, Human
gaaccugggaggcgaagguugcagugagcuga

SEQ ID NO: 415948 - RNA, 24 nt, Human
gaaccugggaggcgcagguugcag

SEQ ID NO: 415949 - RNA, 32 nt, Human
gaaccugggaggcgcagguugcagggaggcgg

SEQ ID NO: 415950 - RNA, 24 nt, Human
gaaccugggaggcggaaguugcag

SEQ ID NO: 415951 - RNA, 32 nt, Human
gaaccugggaggcggaaguugcagugagccaa

SEQ ID NO: 415952 - RNA, 32 nt, Human
gaaccugggaggcggaaguugcagugagccga

SEQ ID NO: 415953 - RNA, 32 nt, Human
gaaccugggaggcggaaguugcagugagcuga

SEQ ID NO: 415954 - RNA, 24 nt, Human
gaaccugggaggcggagauugcag

SEQ ID NO: 415955 - RNA, 32 nt, Human
gaaccugggaggcggagauugcagugaaccaa

SEQ ID NO: 415956 - RNA, 32 nt, Human
gaaccugggaggcggagcuuacagugaaccga

SEQ ID NO: 415957 - RNA, 32 nt, Human
gaaccugggaggcggagcuugcaaugaacuga

SEQ ID NO: 415958 - RNA, 32 nt, Human
gaaccugggaggcggagcuugcaguaagccga

SEQ ID NO: 415959 - RNA, 32 nt, Human
gaaccugggaggcggagcuugcagugagccaa

SEQ ID NO: 415960 - RNA, 32 nt, Human
gaaccugggaggcggagcuugcagugagccca

SEQ ID NO: 415961 - RNA, 32 nt, Human
gaaccugggaggcggagcuugcagugagccga

SEQ ID NO: 415962 - RNA, 32 nt, Human
gaaccugggaggcggagcuugcagugagcuga

SEQ ID NO: 415963 - RNA, 32 nt, Human
gaaccugggaggcggaggagguugcagugaac

SEQ ID NO: 415964 - RNA, 24 nt, Human
gaaccugggaggcggaggcugcag

SEQ ID NO: 415965 - RNA, 32 nt, Human
gaaccugggaggcggaggcugcagugagccga

SEQ ID NO: 415966 - RNA, 32 nt, Human
gaaccugggaggcggaggcugcagugagcugg

SEQ ID NO: 415967 - RNA, 24 nt, Human
gaaccugggaggcggagguggcag

SEQ ID NO: 415968 - RNA, 32 nt, Human
gaaccugggaggcggagguuccagagagccaa

SEQ ID NO: 415969 - RNA, 23 nt, Human
gaaccugggaggcggagguugca

SEQ ID NO: 415970 - RNA, 32 nt, Human
gaaccugggaggcggagguugcaaugagccga

SEQ ID NO: 415971 - RNA, 24 nt, Human
gaaccugggaggcggagguugcag

SEQ ID NO: 415972 - RNA, 32 nt, Human
gaaccugggaggcggagguugcagggagcuga

SEQ ID NO: 415973 - RNA, 32 nt, Human
gaaccugggaggcggagguugcaguaagccca

SEQ ID NO: 415974 - RNA, 32 nt, Human
gaaccugggaggcggagguugcagucagccaa

SEQ ID NO: 415975 - RNA, 32 nt, Human
gaaccugggaggcggagguugcagugaaccaa

SEQ ID NO: 415976 - RNA, 32 nt, Human
gaaccugggaggcggagguugcagugagccaa

SEQ ID NO: 415977 - RNA, 32 nt, Human
gaaccugggaggcggagguugcagugagccac

SEQ ID NO: 415978 - RNA, 32 nt, Human
gaaccugggaggcggagguugcagugagccga

SEQ ID NO: 415979 - RNA, 32 nt, Human
gaaccugggaggcggagguugcagugagccgc

SEQ ID NO: 415980 - RNA, 32 nt, Human
gaaccugggaggcggagguugcagugagcgag

SEQ ID NO: 415981 - RNA, 32 nt, Human
gaaccugggaggcggagguugcagugagcgga

SEQ ID NO: 415982 - RNA, 32 nt, Human
gaaccugggaggcggagguugcagugagcuaa

SEQ ID NO: 415983 - RNA, 32 nt, Human
gaaccugggaggcggagguugcagugagcuga

SEQ ID NO: 415984 - RNA, 32 nt, Human
gaaccugggaggcggagguugcagugagucga

SEQ ID NO: 415985 - RNA, 32 nt, Human
gaaccugggaggcggagguugcagugaguuga

SEQ ID NO: 415986 - RNA, 32 nt, Human
gaaccugggaggcggagguugccgugagccga

SEQ ID NO: 415987 - RNA, 24 nt, Human
gaaccugggaggcggagguugcgg

SEQ ID NO: 415988 - RNA, 32 nt, Human
gaaccugggaggcggagguugcggucagcuga

SEQ ID NO: 415989 - RNA, 32 nt, Human
gaaccugggaggcggagguugcggugagcuga

SEQ ID NO: 415990 - RNA, 32 nt, Human
gaaccugggaggcggagguugcugugagcuga

SEQ ID NO: 415991 - RNA, 24 nt, Human
gaaccugggaggcggagguuguag

SEQ ID NO: 415992 - RNA, 32 nt, Human
gaaccugggaggcggagguuguagugagccaa

SEQ ID NO: 415993 - RNA, 32 nt, Human
gaaccugggaggcggagguuguagugagccga

SEQ ID NO: 415994 - RNA, 32 nt, Human
gaaccugggaggcggagguugugaugagccaa

SEQ ID NO: 415995 - RNA, 32 nt, Human
gaaccugggaggcggagguuguggugagccaa

SEQ ID NO: 415996 - RNA, 32 nt, Human
gaaccugggaggcggagguuguggugagccga

SEQ ID NO: 415997 - RNA, 32 nt, Human
gaaccugggaggcggauguugaagugagcuga

SEQ ID NO: 415998 - RNA, 32 nt, Human
gaaccugggaggcggggguuguggugagccgu

SEQ ID NO: 415999 - RNA, 24 nt, Human
gaaccugggaggcugaaguugcag

SEQ ID NO: 416000 - RNA, 32 nt, Human
gaaccugggaggcugaaguugcagugagccga

SEQ ID NO: 416001 - RNA, 32 nt, Human
gaaccugggaggcugagcuugcagugagcuga

SEQ ID NO: 416002 - RNA, 25 nt, Human
gaaccugggagggcggagguugcag

SEQ ID NO: 416003 - RNA, 32 nt, Human
gaaccugggagggcggagguugcagugagcca

SEQ ID NO: 416004 - RNA, 24 nt, Human
gaaccugggagggggagguugcag

SEQ ID NO: 416005 - RNA, 32 nt, Human
gaaccugggagggggagguugccgugagcuga

SEQ ID NO: 416006 - RNA, 24 nt, Human
gaaccugggagguacagguugcag

SEQ ID NO: 416007 - RNA, 32 nt, Human
gaaccugggagguacagguugcagugagccca

SEQ ID NO: 416008 - RNA, 24 nt, Human
gaaccugggagguagaaguugcag

SEQ ID NO: 416009 - RNA, 32 nt, Human
gaaccugggagguagaaguugcagugagccaa

SEQ ID NO: 416010 - RNA, 32 nt, Human
gaaccugggagguagagguugcacugagccga

SEQ ID NO: 416011 - RNA, 24 nt, Human
gaaccugggagguagagguugcag

SEQ ID NO: 416012 - RNA, 32 nt, Human
gaaccugggagguagagguugcagugagccaa

SEQ ID NO: 416013 - RNA, 32 nt, Human
gaaccugggagguagagguugcagugagccga

SEQ ID NO: 416014 - RNA, 32 nt, Human
gaaccugggaggucaaagcggcagugagcuaa

SEQ ID NO: 416015 - RNA, 32 nt, Human
gaaccugggaggucaagauugcagugagcuau

SEQ ID NO: 416016 - RNA, 32 nt, Human
gaaccugggaggugaagguugcugugggccaa

SEQ ID NO: 416017 - RNA, 32 nt, Human
gaaccugggagguggaagcugcagugagccaa

SEQ ID NO: 416018 - RNA, 24 nt, Human
gaaccugggagguggaaguugcag

SEQ ID NO: 416019 - RNA, 32 nt, Human
gaaccugggagguggaaguugcagugagccaa

SEQ ID NO: 416020 - RNA, 32 nt, Human
gaaccugggagguggaaguugcagugagccga

SEQ ID NO: 416021 - RNA, 32 nt, Human
gaaccugggagguggaaguugcagugagcuga

SEQ ID NO: 416022 - RNA, 32 nt, Human
gaaccugggagguggagacugcagugagccga

SEQ ID NO: 416023 - RNA, 24 nt, Human
gaaccugggagguggagauugcag

SEQ ID NO: 416024 - RNA, 32 nt, Human
gaaccugggagguggagauugcagugagccca

SEQ ID NO: 416025 - RNA, 32 nt, Human
gaaccugggagguggagauugcagugagucaa

SEQ ID NO: 416026 - RNA, 24 nt, Human
gaaccugggagguggagcuugcag

SEQ ID NO: 416027 - RNA, 32 nt, Human
gaaccugggagguggagcuugcagugaaccga

SEQ ID NO: 416028 - RNA, 32 nt, Human
gaaccugggagguggagcuugcagugagccga

SEQ ID NO: 416029 - RNA, 32 nt, Human
gaaccugggagguggagcuugcagugagcgga

SEQ ID NO: 416030 - RNA, 32 nt, Human
gaaccugggagguggagcuugcagugagcuga

SEQ ID NO: 416031 - RNA, 32 nt, Human
  misc_feature (24)..(24): n is a, c, g or u
gaaccugggagguggagcuugcanugagccaa

SEQ ID NO: 416032 - RNA, 32 nt, Human
gaaccugggagguggaggcagugagcugagau

SEQ ID NO: 416033 - RNA, 24 nt, Human
gaaccugggagguggaggcuacag

SEQ ID NO: 416034 - RNA, 32 nt, Human
gaaccugggagguggaggcuacagugagcuga

SEQ ID NO: 416035 - RNA, 32 nt, Human
gaaccugggagguggaggcugcagugaaccga

SEQ ID NO: 416036 - RNA, 32 nt, Human
gaaccugggagguggaggggaggcugcaguga

SEQ ID NO: 416037 - RNA, 32 nt, Human
gaaccugggagguggagguuacagugagccga

SEQ ID NO: 416038 - RNA, 32 nt, Human
gaaccugggagguggagguuauagugagccua

SEQ ID NO: 416039 - RNA, 32 nt, Human
gaaccugggagguggagguugaggugagcuca

SEQ ID NO: 416040 - RNA, 22 nt, Human
gaaccugggagguggagguugc

SEQ ID NO: 416041 - RNA, 23 nt, Human
gaaccugggagguggagguugca

SEQ ID NO: 416042 - RNA, 24 nt, Human
gaaccugggagguggagguugcag

SEQ ID NO: 416043 - RNA, 32 nt, Human
gaaccugggagguggagguugcagcgagccaa

SEQ ID NO: 416044 - RNA, 32 nt, Human
gaaccugggagguggagguugcaguaagccaa

SEQ ID NO: 416045 - RNA, 32 nt, Human
gaaccugggagguggagguugcaguaagcuga

SEQ ID NO: 416046 - RNA, 32 nt, Human
gaaccugggagguggagguugcagugagcaga

SEQ ID NO: 416047 - RNA, 32 nt, Human
gaaccugggagguggagguugcagugagccaa

SEQ ID NO: 416048 - RNA, 32 nt, Human
gaaccugggagguggagguugcagugagccga

SEQ ID NO: 416049 - RNA, 32 nt, Human
gaaccugggagguggagguugcagugagcuga

SEQ ID NO: 416050 - RNA, 32 nt, Human
gaaccugggagguggagguugcagugagcugu

SEQ ID NO: 416051 - RNA, 32 nt, Human
gaaccugggagguggagguugcagugagucga

SEQ ID NO: 416052 - RNA, 32 nt, Human
gaaccugggagguggagguugcagugaguuga

SEQ ID NO: 416053 - RNA, 32 nt, Human
gaaccugggagguggagguugcagugggccaa

SEQ ID NO: 416054 - RNA, 32 nt, Human
gaaccugggagguggagguugcagugggcuaa

SEQ ID NO: 416055 - RNA, 32 nt, Human
gaaccugggagguggagguugcagugggcuga

SEQ ID NO: 416056 - RNA, 32 nt, Human
gaaccugggagguggagguugcauugagccaa

SEQ ID NO: 416057 - RNA, 32 nt, Human
gaaccugggagguggagguugcauugagcuga

SEQ ID NO: 416058 - RNA, 32 nt, Human
gaaccugggagguggagguugcgagaucacac

SEQ ID NO: 416059 - RNA, 24 nt, Human
gaaccugggagguggagguugcgg

SEQ ID NO: 416060 - RNA, 32 nt, Human
gaaccugggagguggagguugcggugagccaa

SEQ ID NO: 416061 - RNA, 32 nt, Human
gaaccugggagguggagguugcggugagccga

SEQ ID NO: 416062 - RNA, 32 nt, Human
gaaccugggagguggagguugcggugagcuga

SEQ ID NO: 416063 - RNA, 32 nt, Human
gaaccugggagguggagguugcugugagcuga

SEQ ID NO: 416064 - RNA, 32 nt, Human
gaaccugggagguggagguuguggugagccaa

SEQ ID NO: 416065 - RNA, 32 nt, Human
gaaccugggagguggagguuguggugaggcga

SEQ ID NO: 416066 - RNA, 24 nt, Human
gaaccugggagguggagguuucag

SEQ ID NO: 416067 - RNA, 32 nt, Human
gaaccugggagguggagguuucagugagccaa

SEQ ID NO: 416068 - RNA, 23 nt, Human
gaaccugggagguggaguugcag

SEQ ID NO: 416069 - RNA, 32 nt, Human
gaaccugggagguggaguugcagugagccgag

SEQ ID NO: 416070 - RNA, 24 nt, Human
gaaccugggagguggauguugcag

SEQ ID NO: 416071 - RNA, 32 nt, Human
gaaccugggagguggauguugcagugagcuga

SEQ ID NO: 416072 - RNA, 24 nt, Human
gaaccugggagguggggguugcag

SEQ ID NO: 416073 - RNA, 32 nt, Human
gaaccugggagguggggguuucagugagcuga

SEQ ID NO: 416074 - RNA, 24 nt, Human
gaaccugggagguggugguugcag

SEQ ID NO: 416075 - RNA, 32 nt, Human
gaaccugggagguggugguugcagugagcuga

SEQ ID NO: 416076 - RNA, 24 nt, Human
gaaccugggagucaaagguugcag

SEQ ID NO: 416077 - RNA, 24 nt, Human
gaaccugggaguuagagguugcag

SEQ ID NO: 416078 - RNA, 32 nt, Human
gaaccugggaguuagagguugcagugagcuga

SEQ ID NO: 416079 - RNA, 24 nt, Human
gaaccugggaguuggagguugcag

SEQ ID NO: 416080 - RNA, 32 nt, Human
gaaccugggaguuggagguugcagugaaacga

SEQ ID NO: 416081 - RNA, 24 nt, Human
gaaccugggauguggagguugcag

SEQ ID NO: 416082 - RNA, 32 nt, Human
gaaccugggauguggagguugcagugagccaa

SEQ ID NO: 416083 - RNA, 24 nt, Human
gaaccugggcggcaaagguugcag

SEQ ID NO: 416084 - RNA, 24 nt, Human
gaaccugggcggcagagguugcag

SEQ ID NO: 416085 - RNA, 32 nt, Human
gaaccugggcggcagagguugcagugagucaa

SEQ ID NO: 416086 - RNA, 32 nt, Human
gaaccugggcggcucuggaggcccagggcagg

SEQ ID NO: 416087 - RNA, 32 nt, Human
gaaccugggcucuucacucaggaaaagagaag

SEQ ID NO: 416088 - RNA, 24 nt, Human
gaaccuggggggcggagguugcag

SEQ ID NO: 416089 - RNA, 24 nt, Human
gaaccuggggggcugagguugcag

SEQ ID NO: 416090 - RNA, 32 nt, Human
gaaccugggugggaaguagggaagaagccgug

SEQ ID NO: 416091 - RNA, 32 nt, Human
gaaccuggguggucgaggcugcagugagccga

SEQ ID NO: 416092 - RNA, 24 nt, Human
gaaccugguaggcagagguugcag

SEQ ID NO: 416093 - RNA, 32 nt, Human
gaaccugguaggcagagguugcagugagccga

SEQ ID NO: 416094 - RNA, 32 nt, Human
gaaccugguaggcagagguuguagugagccga

SEQ ID NO: 416095 - RNA, 32 nt, Human
gaaccugguagguggagguuucauugagccac

SEQ ID NO: 416096 - RNA, 32 nt, Human
gaaccuggucccagcuugaguuccugccuuuc

SEQ ID NO: 416097 - RNA, 32 nt, Human
gaaccugguguccaaucagauccugacauucc

SEQ ID NO: 416098 - RNA, 32 nt, Human
gaaccugguucacccuucauaccagcuccaag

SEQ ID NO: 416099 - RNA, 32 nt, Human
gaaccugguugggcaguaggggagggagggag

SEQ ID NO: 416100 - RNA, 32 nt, Human
gaaccuguaaggcggagguugcagugagccga

SEQ ID NO: 416101 - RNA, 32 nt, Human
gaaccugugaagagcggaagggccaagggacg

SEQ ID NO: 416102 - RNA, 24 nt, Human
gaaccugugaggaagagguugcag

SEQ ID NO: 416103 - RNA, 32 nt, Human
gaaccugugaggaagagguugcagugagcuga

SEQ ID NO: 416104 - RNA, 32 nt, Human
gaaccugugaggcagagguugcagugagccaa

SEQ ID NO: 416105 - RNA, 32 nt, Human
gaaccugugaggcagauccaugacuggcaaca

SEQ ID NO: 416106 - RNA, 32 nt, Human
gaaccugugaggcggagcuugcagggagucga

SEQ ID NO: 416107 - RNA, 24 nt, Human
gaaccugugaggcggagguugcag

SEQ ID NO: 416108 - RNA, 24 nt, Human
gaaccugugagguggagcuugcag

SEQ ID NO: 416109 - RNA, 32 nt, Human
gaaccugugagguggagcuugcagugagccaa

SEQ ID NO: 416110 - RNA, 21 nt, Human
gaaccuguggcaccugucccu

SEQ ID NO: 416111 - RNA, 32 nt, Human
gaaccugugggucagagguugcagugaaccaa

SEQ ID NO: 416112 - RNA, 32 nt, Human
gaaccuguguacgcacacacacauauacauac

SEQ ID NO: 416113 - RNA, 32 nt, Human
gaaccuuacugaaccacuugcagauuccaaaa

SEQ ID NO: 416114 - RNA, 32 nt, Human
gaaccuuauggaagaggacaucaaagaaagaa

SEQ ID NO: 416115 - RNA, 32 nt, Human
gaaccuucaugccuuauuuauuucuaaugggu

SEQ ID NO: 416116 - RNA, 32 nt, Human
gaaccuuccacagcucuccaucacccagugaa

SEQ ID NO: 416117 - RNA, 32 nt, Human
gaaccuuccagccuuuggccuugugguuccuc

SEQ ID NO: 416118 - RNA, 32 nt, Human
gaaccuucccagagcagcagaggcccuucuac

SEQ ID NO: 416119 - RNA, 32 nt, Human
gaaccuucccucuccuuccucucgcagauuac

SEQ ID NO: 416120 - RNA, 32 nt, Human
gaaccuucuagaggaauauaugauuuauucac

SEQ ID NO: 416121 - RNA, 32 nt, Human
gaaccuucucccucguacagcacaggaaccug

SEQ ID NO: 416122 - RNA, 32 nt, Human
gaaccuucuggccaguacuggaaaggggaaug

SEQ ID NO: 416123 - RNA, 32 nt, Human
gaaccuugaaggucaauguauuggacagguca

SEQ ID NO: 416124 - RNA, 32 nt, Human
gaaccuuggaggcagagguugcagugagcuga

SEQ ID NO: 416125 - RNA, 32 nt, Human
gaaccuuggagguggagguuguggugagccau

SEQ ID NO: 416126 - RNA, 32 nt, Human
gaaccuugggucuggagagccaugaagaggga

SEQ ID NO: 416127 - RNA, 32 nt, Human
gaaccuuguaaauaugucuguaauauuaaugc

SEQ ID NO: 416128 - RNA, 32 nt, Human
gaaccuuguagugccaaaaacuuuuuaaaagg

SEQ ID NO: 416129 - RNA, 32 nt, Human
gaaccuuguuuuuguggugaaggauccuaaag

SEQ ID NO: 416130 - RNA, 32 nt, Human
gaaccuuucuacugcugagcuguggccaaggu

SEQ ID NO: 416131 - RNA, 32 nt, Human
gaaccuuuuguggggcucauucacagaagggg

SEQ ID NO: 416132 - RNA, 32 nt, Human
gaacgaaacuccgucucaaaaacaaagaagga

SEQ ID NO: 416133 - RNA, 32 nt, Human
gaacgaaaugucccuuacaagauucuucuauu

SEQ ID NO: 416134 - RNA, 32 nt, Human
gaacgaagccagggguucagaugacacugcug

SEQ ID NO: 416135 - RNA, 32 nt, Human
gaacgaaugccacgugcccucacccagcccgg

SEQ ID NO: 416136 - RNA, 20 nt, Human
gaacgacagcaccacagccc

SEQ ID NO: 416137 - RNA, 32 nt, Human
gaacgagaaggagcaggagcugcgggagacug

SEQ ID NO: 416138 - RNA, 32 nt, Human
gaacgagagcaucuuguucauugccuuuuuca

SEQ ID NO: 416139 - RNA, 32 nt, Human
gaacgagcacagagguuggcuguggguccugg

SEQ ID NO: 416140 - RNA, 32 nt, Human
gaacgagcccuugagcccccuguaccccgccg

SEQ ID NO: 416141 - RNA, 32 nt, Human
gaacgaggaccuggacucagagccagacaggg

SEQ ID NO: 416142 - RNA, 32 nt, Human
gaacgaggcaucaucugcccccggcuacaacu

SEQ ID NO: 416143 - RNA, 32 nt, Human
gaacgagggaacacaagugucuucucauaaga

SEQ ID NO: 416144 - RNA, 32 nt, Human
gaacgagugugggcgcgaggcaggaugacgac

SEQ ID NO: 416145 - RNA, 32 nt, Human
gaacgauaaugcaaagugcuauguucuuggcu

SEQ ID NO: 416146 - RNA, 32 nt, Human
gaacgauauaaauacauuaauaugcucuuucu

SEQ ID NO: 416147 - RNA, 32 nt, Human
gaacgaucacugccuuaccccugcugcugcag

SEQ ID NO: 416148 - RNA, 32 nt, Human
gaacgaugacaucagagauuccgaccuuccug

SEQ ID NO: 416149 - RNA, 32 nt, Human
gaacgauguacacugauguucaucucauaaau

SEQ ID NO: 416150 - RNA, 32 nt, Human
gaacgauugccacccauccaguccauggucca

SEQ ID NO: 416151 - RNA, 32 nt, Human
gaacgcaaagcugagaacauggacguuaauau

SEQ ID NO: 416152 - RNA, 32 nt, Human
gaacgcaagaagggaauagguggucugaacgu

SEQ ID NO: 416153 - RNA, 32 nt, Human
gaacgcacacuggcugucacuaggaagcgcca

SEQ ID NO: 416154 - RNA, 32 nt, Human
gaacgcaccuggccucugcuccaccucaacag

SEQ ID NO: 416155 - RNA, 32 nt, Human
gaacgcacgcccugccccagcccgucucuccg

SEQ ID NO: 416156 - RNA, 32 nt, Human
gaacgcacucagcugcucgagccgccccgggc

SEQ ID NO: 416157 - RNA, 32 nt, Human
gaacgcacugaagacagcucuugguccaaagc

SEQ ID NO: 416158 - RNA, 32 nt, Human
gaacgcacugcacaccuaaggcaaaucccugg

SEQ ID NO: 416159 - RNA, 32 nt, Human
gaacgcagaagcaggaaauggagaguuugucc

SEQ ID NO: 416160 - RNA, 32 nt, Human
gaacgcaggaggcugaggcugcagugaguugu

SEQ ID NO: 416161 - RNA, 32 nt, Human
gaacgcaggcagaucacuugaggucaggaauu

SEQ ID NO: 416162 - RNA, 32 nt, Human
gaacgcagugcugugcggaggccuuaacuuga

SEQ ID NO: 416163 - RNA, 32 nt, Human
gaacgccagagggagggagggaggcaagaagg

SEQ ID NO: 416164 - RNA, 32 nt, Human
gaacgccaugacuguucagaagcacaauacua

SEQ ID NO: 416165 - RNA, 32 nt, Human
gaacgccauucaaccgaacauucuucccaagc

SEQ ID NO: 416166 - RNA, 32 nt, Human
gaacgcccaguuggccggaccugcucagugac

SEQ ID NO: 416167 - RNA, 32 nt, Human
gaacgcccugcggcaccaggugguguugcggc

SEQ ID NO: 416168 - RNA, 32 nt, Human
gaacgccgggaggcgggaggagagggggcugc

SEQ ID NO: 416169 - RNA, 23 nt, Human
gaacgccugaccucaagugaucc

SEQ ID NO: 416170 - RNA, 24 nt, Human
gaacgccugaccucagaugaucca

SEQ ID NO: 416171 - RNA, 32 nt, Human
gaacgccuuccaggaaccuguggacuaggggu

SEQ ID NO: 416172 - RNA, 32 nt, Human
gaacgcgccacuggacacaugaggaagaggcu

SEQ ID NO: 416173 - RNA, 32 nt, Human
gaacgcgggaggcagagacugcagugagccga

SEQ ID NO: 416174 - RNA, 32 nt, Human
gaacgcgggagguggaggauacaaugaacccg

SEQ ID NO: 416175 - RNA, 32 nt, Human
gaacgcuauuuccuaaauauuugcuacacaca

SEQ ID NO: 416176 - RNA, 32 nt, Human
gaacgcuccagcccaggacuucgaggcugcaa

SEQ ID NO: 416177 - RNA, 32 nt, Human
gaacgcucccggcuuggccucggcugaugggc

SEQ ID NO: 416178 - RNA, 32 nt, Human
gaacgcugagcgguggcaugacuugcccgugg

SEQ ID NO: 416179 - RNA, 32 nt, Human
gaacgcugcagcugcacccacccugcuugauc

SEQ ID NO: 416180 - RNA, 32 nt, Human
gaacgcuggcuggggacgaucacaaagccucu

SEQ ID NO: 416181 - RNA, 32 nt, Human
gaacgcugggagaaugcugggagccugcuguu

SEQ ID NO: 416182 - RNA, 32 nt, Human
gaacgcugggcaacauggugaaaccccgucuc

SEQ ID NO: 416183 - RNA, 32 nt, Human
gaacgcuuguagucccagcuacucaggaggcu

SEQ ID NO: 416184 - RNA, 32 nt, Human
gaacggaaggcagaggacagaggcuggacgug

SEQ ID NO: 416185 - RNA, 32 nt, Human
gaacggaagggcccugcucucaagcagugcga

SEQ ID NO: 416186 - RNA, 32 nt, Human
gaacggaagucauccugaaaauaaaaguacag

SEQ ID NO: 416187 - RNA, 32 nt, Human
gaacggaggaagagaaaaauacuucagauaaa

SEQ ID NO: 416188 - RNA, 32 nt, Human
gaacggaugguggugagagggacagaccaggc

SEQ ID NO: 416189 - RNA, 32 nt, Human
gaacggcauaaaaacagaaauuacccaguaaa

SEQ ID NO: 416190 - RNA, 32 nt, Human
gaacggcauaaacugaguguucagcugguguu

SEQ ID NO: 416191 - RNA, 32 nt, Human
gaacggccugaagcaugggggccaggcuguca

SEQ ID NO: 416192 - RNA, 19 nt, Human
gaacggcgccuuugggaag

SEQ ID NO: 416193 - RNA, 32 nt, Human
gaacggcugcuguuucagcuguuggccuuuuc

SEQ ID NO: 416194 - RNA, 32 nt, Human
gaacggcuggacugccugccggcuuagggagg

SEQ ID NO: 416195 - RNA, 32 nt, Human
gaacgggaaggagccccaggagggagagggac

SEQ ID NO: 416196 - RNA, 32 nt, Human
gaacgggaccccuagcuaccacugccuccagg

SEQ ID NO: 416197 - RNA, 32 nt, Human
gaacgggagccguacucaggaggcagaauuca

SEQ ID NO: 416198 - RNA, 32 nt, Human
gaacgggaggcugcaggauggucaagcugacg

SEQ ID NO: 416199 - RNA, 32 nt, Human
gaacgggggaagggcggggugagggaagaaag

SEQ ID NO: 416200 - RNA, 32 nt, Human
gaacggggucaggauggacgaggacgugcuaa

SEQ ID NO: 416201 - RNA, 32 nt, Human
gaacggugcuuugcgcaucgagaccaucgacc

SEQ ID NO: 416202 - RNA, 24 nt, Human
gaacgguggaggcagaggugacag

SEQ ID NO: 416203 - RNA, 32 nt, Human
gaacgguguagacauuucccccaguaugagca

SEQ ID NO: 416204 - RNA, 30 nt, Human
gaacguagccucuuuguguccacuguggaa

SEQ ID NO: 416205 - RNA, 31 nt, Human
gaacguaggaaaccugucgaugcuuacaucu

SEQ ID NO: 416206 - RNA, 31 nt, Human
gaacguaugaacacaucagguugcucagcaa

SEQ ID NO: 416207 - RNA, 32 nt, Human
gaacgucaaggucgugggaaauaaaaggcagu

SEQ ID NO: 416208 - RNA, 32 nt, Human
gaacgucacagcaacaggcgcagggccugccc

SEQ ID NO: 416209 - RNA, 32 nt, Human
gaacgucccacuguccuggccuggagcuaggc

SEQ ID NO: 416210 - RNA, 32 nt, Human
gaacguccucuaugaagaccuucagguuuccu

SEQ ID NO: 416211 - RNA, 32 nt, Human
gaacgucuccaccagcuucccuuccagccgac

SEQ ID NO: 416212 - RNA, 32 nt, Human
gaacgucugaaaugagagugccauguauuucu

SEQ ID NO: 416213 - RNA, 32 nt, Human
gaacgucugggcagccagggaccugcccauuc

SEQ ID NO: 416214 - RNA, 32 nt, Human
gaacgucuguccccugugaugcuggcuguuau

SEQ ID NO: 416215 - RNA, 32 nt, Human
gaacgucuucacuggguggugucagcugggac

SEQ ID NO: 416216 - RNA, 32 nt, Human
gaacgugaauuggacucaacucgaguagcagc

SEQ ID NO: 416217 - RNA, 32 nt, Human
gaacguggaagacaaggcagaagaggcuggcc

SEQ ID NO: 416218 - RNA, 23 nt, Human
gaacguggaggcagagguugcag

SEQ ID NO: 416219 - RNA, 32 nt, Human
gaacguggaggcagagguugcagugagccgag

SEQ ID NO: 416220 - RNA, 32 nt, Human
gaacguggaggcccuguccuagugcugaggac

SEQ ID NO: 416221 - RNA, 24 nt, Human
gaacgugggaggcagaaguugcag

SEQ ID NO: 416222 - RNA, 32 nt, Human
gaacgugggaggcagaaguugcagugagccaa

SEQ ID NO: 416223 - RNA, 24 nt, Human
gaacgugggaggcagagguugcag

SEQ ID NO: 416224 - RNA, 32 nt, Human
gaacgugggaggcagagguugcagugagccga

SEQ ID NO: 416225 - RNA, 32 nt, Human
gaacgugggaggcagagguugcagugagugga

SEQ ID NO: 416226 - RNA, 24 nt, Human
gaacgugggaggcggagguugcag

SEQ ID NO: 416227 - RNA, 32 nt, Human
gaacgugggaggcggagguugcagcgagcuga

SEQ ID NO: 416228 - RNA, 32 nt, Human
gaacgugggaggcggagguugcagugagcuga

SEQ ID NO: 416229 - RNA, 24 nt, Human
gaacgugggaggcggagguuguag

SEQ ID NO: 416230 - RNA, 32 nt, Human
gaacgugggaggcggagguuguagugagccag

SEQ ID NO: 416231 - RNA, 32 nt, Human
gaacgugggaguucagcugcuucucuugccua

SEQ ID NO: 416232 - RNA, 32 nt, Human
gaacgugguuuucauuuauuuuucccucaaaa

SEQ ID NO: 416233 - RNA, 32 nt, Human
gaacguguucacaggcuguuguguggcaauga

SEQ ID NO: 416234 - RNA, 32 nt, Human
gaacguuggagcuguacuaguuguuaaaacgu

SEQ ID NO: 416235 - RNA, 32 nt, Human
gaacguuggugagggagggcagcucugcgccc

SEQ ID NO: 416236 - RNA, 32 nt, Human
gaacuaaacacuccuucuuagcacuuccugug

SEQ ID NO: 416237 - RNA, 32 nt, Human
gaacuaaaccccuggcuuuugugcacacugca

SEQ ID NO: 416238 - RNA, 32 nt, Human
gaacuaaacucccaccuccugauucaggcagc

SEQ ID NO: 416239 - RNA, 32 nt, Human
gaacuaaauaaauaaauauuaaacaccuaaaa

SEQ ID NO: 416240 - RNA, 32 nt, Human
gaacuaacauguaguauuugugcugcugcauu

SEQ ID NO: 416241 - RNA, 32 nt, Human
gaacuaagaagaugccauugcacuccagccug

SEQ ID NO: 416242 - RNA, 23 nt, Human
gaacuaagcaggacaccuggagg

SEQ ID NO: 416243 - RNA, 32 nt, Human
gaacuaaggccuucuaucagacugccuggcca

SEQ ID NO: 416244 - RNA, 32 nt, Human
gaacuaauaaauucaggguggugaugcuuacc

SEQ ID NO: 416245 - RNA, 31 nt, Human
gaacuaaugagaccugugcaggaucacugga

SEQ ID NO: 416246 - RNA, 32 nt, Human
gaacuaauuugguggcaggucuccucugaagg

SEQ ID NO: 416247 - RNA, 32 nt, Human
gaacuacaaccagcucagagcgccagccagag

SEQ ID NO: 416248 - RNA, 32 nt, Human
gaacuacagaaaccuggucucccuaggugucu

SEQ ID NO: 416249 - RNA, 32 nt, Human
gaacuacagaaaccuggucuuuuuggguauug

SEQ ID NO: 416250 - RNA, 32 nt, Human
gaacuacagaaaccugguuuucuugggugaag

SEQ ID NO: 416251 - RNA, 32 nt, Human
gaacuacagaauuguucucucccgcucaagaa

SEQ ID NO: 416252 - RNA, 32 nt, Human
gaacuacagacaccuggucuuccuugguauug

SEQ ID NO: 416253 - RNA, 32 nt, Human
gaacuacagacuccaucuuuucacccaaauca

SEQ ID NO: 416254 - RNA, 32 nt, Human
gaacuacagccaucuaguuucccuggcuuaug

SEQ ID NO: 416255 - RNA, 32 nt, Human
gaacuacagccaucuaguuuccuuggcuuaug

SEQ ID NO: 416256 - RNA, 32 nt, Human
gaacuacaggcacgcaccaccacgcccggcua

SEQ ID NO: 416257 - RNA, 32 nt, Human
gaacuacaggcaugcaccaccaugccuggcua

SEQ ID NO: 416258 - RNA, 32 nt, Human
gaacuacaggcgcccgccaugaugcccggcuc

SEQ ID NO: 416259 - RNA, 32 nt, Human
gaacuacaggugugcaccaccaugccugguuc

SEQ ID NO: 416260 - RNA, 32 nt, Human
gaacuaccauuuccuccccuuagcugcccuug

SEQ ID NO: 416261 - RNA, 23 nt, Human
gaacuaccugauuucugccucca

SEQ ID NO: 416262 - RNA, 32 nt, Human
gaacuaccuucucuucugucaugacccuaucu

SEQ ID NO: 416263 - RNA, 32 nt, Human
gaacuacgggaacaauauucuucaagagaagg

SEQ ID NO: 416264 - RNA, 32 nt, Human
gaacuacuacucacaguuaccacuugggguca

SEQ ID NO: 416265 - RNA, 32 nt, Human
gaacuacucagggaaugaaggugucagaauaa

SEQ ID NO: 416266 - RNA, 24 nt, Human
gaacuacugaccucagcugaucca

SEQ ID NO: 416267 - RNA, 32 nt, Human
gaacuagaccaaugagacuagccuggggcggg

SEQ ID NO: 416268 - RNA, 32 nt, Human
gaacuagccacagaaucauuuguuuuuauguc

SEQ ID NO: 416269 - RNA, 32 nt, Human
gaacuagcccaccuuaucuggcugcuuuagcu

SEQ ID NO: 416270 - RNA, 32 nt, Human
gaacuaggaggcagagguugcagugagccgag

SEQ ID NO: 416271 - RNA, 32 nt, Human
gaacuaggaggguuugccuucucugagaccag

SEQ ID NO: 416272 - RNA, 32 nt, Human
gaacuaggaguccugggagagcugugguggga

SEQ ID NO: 416273 - RNA, 24 nt, Human
gaacuagggaagcggagguugcag

SEQ ID NO: 416274 - RNA, 32 nt, Human
gaacuagggccaggugucccaguggcugcggc

SEQ ID NO: 416275 - RNA, 32 nt, Human
gaacuagggccucuccccuggugaagacccag

SEQ ID NO: 416276 - RNA, 32 nt, Human
gaacuagggcugggguugugggugccucuucu

SEQ ID NO: 416277 - RNA, 32 nt, Human
gaacuagguggacaugccaucccuggucuccu

SEQ ID NO: 416278 - RNA, 32 nt, Human
gaacuagugcagcuuuucauuguguugugugg

SEQ ID NO: 416279 - RNA, 32 nt, Human
gaacuaguucaucaaguagcccaaguaggaga

SEQ ID NO: 416280 - RNA, 32 nt, Human
gaacuaguuuugggaaauguagcccuggguuu

SEQ ID NO: 416281 - RNA, 32 nt, Human
gaacuauaauauauacaguauauggaaggaua

SEQ ID NO: 416282 - RNA, 32 nt, Human
gaacuauagaaaagacagacugugcauuuguu

SEQ ID NO: 416283 - RNA, 32 nt, Human
gaacuauaggcaugugccaccaugcccagcua

SEQ ID NO: 416284 - RNA, 32 nt, Human
gaacuauauccagguguugucaugaaaguaug

SEQ ID NO: 416285 - RNA, 32 nt, Human
gaacuaucaccuguuucaaggacuuugcuagc

SEQ ID NO: 416286 - RNA, 32 nt, Human
gaacuaucagcuccuggcaucuguaaggaugc

SEQ ID NO: 416287 - RNA, 32 nt, Human
gaacuauccacaagucuaauguuuccaugcuu

SEQ ID NO: 416288 - RNA, 24 nt, Human
gaacuaugauagcaccacugcacu

SEQ ID NO: 416289 - RNA, 32 nt, Human
gaacuaugauaguaccacugcacuccagccug

SEQ ID NO: 416290 - RNA, 24 nt, Human
gaacuaugauugcaucacugcacu

SEQ ID NO: 416291 - RNA, 24 nt, Human
gaacuaugauugugccacugcacu

SEQ ID NO: 416292 - RNA, 32 nt, Human
gaacuauggaaagcggaagagcaggucuugau

SEQ ID NO: 416293 - RNA, 32 nt, Human
gaacuauggacagaaggaagccuacuauugug

SEQ ID NO: 416294 - RNA, 21 nt, Human
gaacuauggggcuucugggaa

SEQ ID NO: 416295 - RNA, 32 nt, Human
gaacuaugugccugugagcucuucagagcugg

SEQ ID NO: 416296 - RNA, 32 nt, Human
gaacuaugugcuuuuaaccuuuggaaauacau

SEQ ID NO: 416297 - RNA, 32 nt, Human
gaacuauguugugguugcacagacacggagaa

SEQ ID NO: 416298 - RNA, 32 nt, Human
gaacuauuagguuagugcaaaaguaauugugg

SEQ ID NO: 416299 - RNA, 32 nt, Human
gaacuauuuaucugaguucccucugccggaac

SEQ ID NO: 416300 - RNA, 32 nt, Human
gaacuauuucucuuuauuuauagugucgggcu

SEQ ID NO: 416301 - RNA, 23 nt, Human
gaacucaaagagcacccagaggc

SEQ ID NO: 416302 - RNA, 21 nt, Human
gaacucaaccucaggugaucc

SEQ ID NO: 416303 - RNA, 32 nt, Human
gaacucaacugcuguuuacagugucagauuaa

SEQ ID NO: 416304 - RNA, 32 nt, Human
gaacucaacuggcaaggcugcuuuucugugcu

SEQ ID NO: 416305 - RNA, 24 nt, Human
gaacucaagcccauccaugagaca

SEQ ID NO: 416306 - RNA, 32 nt, Human
gaacucaaggccucugacaaugccaaggccuu

SEQ ID NO: 416307 - RNA, 32 nt, Human
gaacucaaguaacuucaugaauacuacaaacu

SEQ ID NO: 416308 - RNA, 32 nt, Human
gaacucacacaaauggcauuccagagucugcc

SEQ ID NO: 416309 - RNA, 32 nt, Human
gaacucaccaugguguuagcagcuuuuacuag

SEQ ID NO: 416310 - RNA, 32 nt, Human
gaacucaccauugcacuccagccuggaugaca

SEQ ID NO: 416311 - RNA, 32 nt, Human
gaacucaccgccuccccugccugggcacuccc

SEQ ID NO: 416312 - RNA, 32 nt, Human
gaacucacgaagaacauuguggcuguaacaga

SEQ ID NO: 416313 - RNA, 32 nt, Human
gaacucacugaggaauggugacauuugggggc

SEQ ID NO: 416314 - RNA, 32 nt, Human
gaacucacuuccucuuuauaaugagucacuau

SEQ ID NO: 416315 - RNA, 22 nt, Human
gaacucacuucuggaggugcag

SEQ ID NO: 416316 - RNA, 24 nt, Human
gaacucagaaggcagagguugcag

SEQ ID NO: 416317 - RNA, 32 nt, Human
gaacucagaaggcagagguugcaguggaaaaa

SEQ ID NO: 416318 - RNA, 24 nt, Human
gaacucagaaggcggaggcugcag

SEQ ID NO: 416319 - RNA, 32 nt, Human
gaacucagaaggcggaggcugcagugagccga

SEQ ID NO: 416320 - RNA, 32 nt, Human
gaacucagaaggcggagguuccagugagccau

SEQ ID NO: 416321 - RNA, 24 nt, Human
gaacucagaagguggagguugcag

SEQ ID NO: 416322 - RNA, 32 nt, Human
gaacucagaagguggagguugcagugaggcga

SEQ ID NO: 416323 - RNA, 32 nt, Human
gaacucagagagguggcuauugcauugcgcag

SEQ ID NO: 416324 - RNA, 32 nt, Human
gaacucagagucccaguguugagucugggagc

SEQ ID NO: 416325 - RNA, 24 nt, Human
gaacucagcaaggcagacuggcug

SEQ ID NO: 416326 - RNA, 22 nt, Human
gaacucagcaaguggagguugc

SEQ ID NO: 416327 - RNA, 32 nt, Human
gaacucagcagcugccaccgcagcugccuccu

SEQ ID NO: 416328 - RNA, 22 nt, Human
gaacucagccguggccuuggcu

SEQ ID NO: 416329 - RNA, 22 nt, Human
gaacucagccugcacagaggca

SEQ ID NO: 416330 - RNA, 22 nt, Human
gaacucagccugggacuggcug

SEQ ID NO: 416331 - RNA, 32 nt, Human
gaacucagccugggacuggcugggcgagacuc

SEQ ID NO: 416332 - RNA, 21 nt, Human
gaacucagccuugauucacug

SEQ ID NO: 416333 - RNA, 32 nt, Human
gaacucagcuccuccagccccaccucccagca

SEQ ID NO: 416334 - RNA, 32 nt, Human
gaacucagcugaggccuugccuugaggggcag

SEQ ID NO: 416335 - RNA, 24 nt, Human
gaacucaggagacggagguuacag

SEQ ID NO: 416336 - RNA, 32 nt, Human
gaacucaggagacggagguuacagugagucga

SEQ ID NO: 416337 - RNA, 24 nt, Human
gaacucaggagauggagguuucag

SEQ ID NO: 416338 - RNA, 32 nt, Human
gaacucaggagauggagguuucagugagccaa

SEQ ID NO: 416339 - RNA, 24 nt, Human
gaacucaggaggcagaaguugcgg

SEQ ID NO: 416340 - RNA, 23 nt, Human
gaacucaggaggcagagguugca

SEQ ID NO: 416341 - RNA, 32 nt, Human
gaacucaggaggcagagguugcaaugagccaa

SEQ ID NO: 416342 - RNA, 24 nt, Human
gaacucaggaggcagagguugcag

SEQ ID NO: 416343 - RNA, 32 nt, Human
gaacucaggaggcagagguugcagugagccaa

SEQ ID NO: 416344 - RNA, 32 nt, Human
gaacucaggaggcggaaguugcggugagccaa

SEQ ID NO: 416345 - RNA, 32 nt, Human
gaacucaggaggcggagcuugcagugagccga

SEQ ID NO: 416346 - RNA, 24 nt, Human
gaacucaggaggcggaggcugcag

SEQ ID NO: 416347 - RNA, 32 nt, Human
gaacucaggaggcggaggcugcagucaaccaa

SEQ ID NO: 416348 - RNA, 32 nt, Human
gaacucaggaggcggagguugcggugagccga

SEQ ID NO: 416349 - RNA, 32 nt, Human
gaacucaggaggcggagguugcggugagcuga

SEQ ID NO: 416350 - RNA, 24 nt, Human
gaacucaggagguggagguugcag

SEQ ID NO: 416351 - RNA, 32 nt, Human
gaacucaggagguggagguugcagugagcuga

SEQ ID NO: 416352 - RNA, 32 nt, Human
gaacucaggagguggagguugcggugagccaa

SEQ ID NO: 416353 - RNA, 32 nt, Human
gaacucaggaguucaagaccagccugggaaaa

SEQ ID NO: 416354 - RNA, 32 nt, Human
gaacucaggaguucaagaccagccugggcaaa

SEQ ID NO: 416355 - RNA, 32 nt, Human
gaacucaggaguucaagaccagccugggcaac

SEQ ID NO: 416356 - RNA, 32 nt, Human
gaacucaggaguuggagaccagccugggcaac

SEQ ID NO: 416357 - RNA, 32 nt, Human
gaacucaggaguuuaagaccagccugggcaac

SEQ ID NO: 416358 - RNA, 32 nt, Human
gaacucaggaguuuaagaccagccugggcaag

SEQ ID NO: 416359 - RNA, 32 nt, Human
gaacucaggcagccuaguagaggcaguggugg

SEQ ID NO: 416360 - RNA, 32 nt, Human
gaacucagggcacuccacauggggcaaacugc

SEQ ID NO: 416361 - RNA, 24 nt, Human
gaacucaggggguggagguugcag

SEQ ID NO: 416362 - RNA, 32 nt, Human
gaacucaggggguggagguugcagugaguuga

SEQ ID NO: 416363 - RNA, 32 nt, Human
gaacucagguggcagagguugcagugagccga

SEQ ID NO: 416364 - RNA, 32 nt, Human
gaacucaguuuucccauauguaagaugggaaa

SEQ ID NO: 416365 - RNA, 32 nt, Human
gaacucauaagaaaaaucaaugauaaagagau

SEQ ID NO: 416366 - RNA, 32 nt, Human
gaacucaucauaaguacuugcugauggaagaa

SEQ ID NO: 416367 - RNA, 32 nt, Human
gaacucaucauggagaaaaccaaacaaaugcu

SEQ ID NO: 416368 - RNA, 32 nt, Human
gaacucaucauuccagccugggcaacaagagu

SEQ ID NO: 416369 - RNA, 23 nt, Human
gaacucaugaccucaagugaucc

SEQ ID NO: 416370 - RNA, 24 nt, Human
gaacucauggccucaaaugaucca

SEQ ID NO: 416371 - RNA, 32 nt, Human
gaacuccaaccugcacuccagccugggcaaca

SEQ ID NO: 416372 - RNA, 24 nt, Human
gaacuccaaguuaguggauugcag

SEQ ID NO: 416373 - RNA, 32 nt, Human
gaacuccacuacccuuuucccucccagaccac

SEQ ID NO: 416374 - RNA, 32 nt, Human
gaacuccacugaggcaggcugacugcuuaacc

SEQ ID NO: 416375 - RNA, 23 nt, Human
gaacuccagaccucaggugaucc

SEQ ID NO: 416376 - RNA, 24 nt, Human
gaacuccagaccucaggugaucua

SEQ ID NO: 416377 - RNA, 32 nt, Human
gaacuccagcacccaccucccuacucucccuc

SEQ ID NO: 416378 - RNA, 32 nt, Human
gaacuccagcagcucugcacuggguagagcug

SEQ ID NO: 416379 - RNA, 32 nt, Human
gaacuccaggcaggaagcagugcccuggaaaa

SEQ ID NO: 416380 - RNA, 32 nt, Human
gaacuccaguucauucacucaguggcucaucc

SEQ ID NO: 416381 - RNA, 32 nt, Human
gaacuccaucucauucucuccccuccagaaga

SEQ ID NO: 416382 - RNA, 32 nt, Human
gaacuccauuuuggauuuugaaucaagcaaua

SEQ ID NO: 416383 - RNA, 32 nt, Human
gaacucccaaagugcugggauuacaggcguga

SEQ ID NO: 416384 - RNA, 24 nt, Human
gaacucccaaccucaagugaucca

SEQ ID NO: 416385 - RNA, 23 nt, Human
gaacucccaaccucaagugaucu

SEQ ID NO: 416386 - RNA, 23 nt, Human
gaacucccaaccucaggugaucc

SEQ ID NO: 416387 - RNA, 24 nt, Human
gaacucccaaccucaggugaucca

SEQ ID NO: 416388 - RNA, 32 nt, Human
gaacucccagggagcaacagcacacagugugg

SEQ ID NO: 416389 - RNA, 32 nt, Human
gaacucccccagccuacaaccuaggaggugca

SEQ ID NO: 416390 - RNA, 32 nt, Human
gaacucccccuccaggccaucucauuggcugc

SEQ ID NO: 416391 - RNA, 23 nt, Human
gaacucccgaccucaagugaucc

SEQ ID NO: 416392 - RNA, 23 nt, Human
gaacucccgaccucaagugaucu

SEQ ID NO: 416393 - RNA, 23 nt, Human
gaacucccgaccucagguaaucc

SEQ ID NO: 416394 - RNA, 23 nt, Human
gaacucccgaccucaggugaucc

SEQ ID NO: 416395 - RNA, 24 nt, Human
gaacucccgaccucaggugaucca

SEQ ID NO: 416396 - RNA, 23 nt, Human
gaacucccgaccucaggugaucu

SEQ ID NO: 416397 - RNA, 24 nt, Human
gaacucccgaccucaggugaucua

SEQ ID NO: 416398 - RNA, 22 nt, Human
gaacucccgaccuugugaucca

SEQ ID NO: 416399 - RNA, 23 nt, Human
gaacucccgaccuugugauccac

SEQ ID NO: 416400 - RNA, 23 nt, Human
gaacucccgaucucaggugaucc

SEQ ID NO: 416401 - RNA, 24 nt, Human
gaacucccggacucgggugaucca

SEQ ID NO: 416402 - RNA, 27 nt, Human
gaacucccucggagacgcagguugcag

SEQ ID NO: 416403 - RNA, 32 nt, Human
gaacucccucggagacgcagguugcaguggac

SEQ ID NO: 416404 - RNA, 32 nt, Human
gaacucccucuuaagcuuggcuucugggacag

SEQ ID NO: 416405 - RNA, 32 nt, Human
gaacucccugcucuggucugacccucugcacg

SEQ ID NO: 416406 - RNA, 23 nt, Human
gaacuccuaaccucaagugaucc

SEQ ID NO: 416407 - RNA, 24 nt, Human
gaacuccuaaccucaagugaucca

SEQ ID NO: 416408 - RNA, 24 nt, Human
gaacuccuaaccucaggugaucca

SEQ ID NO: 416409 - RNA, 24 nt, Human
gaacuccuaaccucagguuaucca

SEQ ID NO: 416410 - RNA, 24 nt, Human
gaacuccuaaccuccagugaucca

SEQ ID NO: 416411 - RNA, 24 nt, Human
gaacuccuaaccucgggugaucca

SEQ ID NO: 416412 - RNA, 23 nt, Human
gaacuccuagacucaagugaucc

SEQ ID NO: 416413 - RNA, 24 nt, Human
gaacuccuagccucaagcaaucca

SEQ ID NO: 416414 - RNA, 23 nt, Human
gaacuccuagccucaagcgaucc

SEQ ID NO: 416415 - RNA, 23 nt, Human
gaacuccuaggcucaagugaucc

SEQ ID NO: 416416 - RNA, 32 nt, Human
gaacuccuaugcagccugagagaaguucucua

SEQ ID NO: 416417 - RNA, 32 nt, Human
gaacuccucaagggcagagaacugucuuucau

SEQ ID NO: 416418 - RNA, 24 nt, Human
gaacuccucaccucaggugaucca

SEQ ID NO: 416419 - RNA, 32 nt, Human
gaacuccuccuuccucugggcucucuguaaca

SEQ ID NO: 416420 - RNA, 23 nt, Human
gaacuccugaacgcaagugaucc

SEQ ID NO: 416421 - RNA, 24 nt, Human
gaacuccugaacucaaguaaucca

SEQ ID NO: 416422 - RNA, 23 nt, Human
gaacuccugaacucaagugaucc

SEQ ID NO: 416423 - RNA, 24 nt, Human
gaacuccugaacucaagugauuca

SEQ ID NO: 416424 - RNA, 24 nt, Human
gaacuccugacauaagguaaucca

SEQ ID NO: 416425 - RNA, 24 nt, Human
gaacuccugacaucaggugaucca

SEQ ID NO: 416426 - RNA, 22 nt, Human
gaacuccugaccaagugaucca

SEQ ID NO: 416427 - RNA, 22 nt, Human
gaacuccugaccacagguaauc

SEQ ID NO: 416428 - RNA, 24 nt, Human
gaacuccugaccacauguggucca

SEQ ID NO: 416429 - RNA, 23 nt, Human
gaacuccugaccccaaguguucc

SEQ ID NO: 416430 - RNA, 24 nt, Human
gaacuccugaccccaaguuaucca

SEQ ID NO: 416431 - RNA, 21 nt, Human
gaacuccugaccccagauuca

SEQ ID NO: 416432 - RNA, 23 nt, Human
gaacuccugaccccaggugaucc

SEQ ID NO: 416433 - RNA, 22 nt, Human
gaacuccugacccugugaucca

SEQ ID NO: 416434 - RNA, 23 nt, Human
gaacuccugacccugugauccac

SEQ ID NO: 416435 - RNA, 24 nt, Human
gaacuccugaccgcaagugaucca

SEQ ID NO: 416436 - RNA, 24 nt, Human
gaacuccugaccgcagguaaucca

SEQ ID NO: 416437 - RNA, 23 nt, Human
gaacuccugaccucaaacgaucu

SEQ ID NO: 416438 - RNA, 23 nt, Human
gaacuccugaccucaaaugagcc

SEQ ID NO: 416439 - RNA, 23 nt, Human
gaacuccugaccucaacugaucc

SEQ ID NO: 416440 - RNA, 24 nt, Human
gaacuccugaccucaacuggucca

SEQ ID NO: 416441 - RNA, 24 nt, Human
gaacuccugaccucaagcgaucca

SEQ ID NO: 416442 - RNA, 23 nt, Human
gaacuccugaccucaagcgaucu

SEQ ID NO: 416443 - RNA, 23 nt, Human
gaacuccugaccucaaguaaucu

SEQ ID NO: 416444 - RNA, 23 nt, Human
gaacuccugaccucaagugaccc

SEQ ID NO: 416445 - RNA, 21 nt, Human
gaacuccugaccucaagugau

SEQ ID NO: 416446 - RNA, 22 nt, Human
gaacuccugaccucaagugauc

SEQ ID NO: 416447 - RNA, 23 nt, Human
gaacuccugaccucaagugaucc

SEQ ID NO: 416448 - RNA, 24 nt, Human
gaacuccugaccucaagugaucca

SEQ ID NO: 416449 - RNA, 23 nt, Human
gaacuccugaccucaagugaucu

SEQ ID NO: 416450 - RNA, 23 nt, Human
gaacuccugaccucaagugauuu

SEQ ID NO: 416451 - RNA, 23 nt, Human
gaacuccugaccucacacaaucc

SEQ ID NO: 416452 - RNA, 24 nt, Human
gaacuccugaccucagauaaucca

SEQ ID NO: 416453 - RNA, 23 nt, Human
gaacuccugaccucagauaaucu

SEQ ID NO: 416454 - RNA, 24 nt, Human
gaacuccugaccucagaugaccca

SEQ ID NO: 416455 - RNA, 23 nt, Human
gaacuccugaccucagaugaucu

SEQ ID NO: 416456 - RNA, 24 nt, Human
gaacuccugaccucagaugauuca

SEQ ID NO: 416457 - RNA, 24 nt, Human
gaacuccugaccucaggcgaucua

SEQ ID NO: 416458 - RNA, 22 nt, Human
gaacuccugaccucagguaauc

SEQ ID NO: 416459 - RNA, 23 nt, Human
gaacuccugaccucagguaaucc

SEQ ID NO: 416460 - RNA, 24 nt, Human
gaacuccugaccucagguaaucca

SEQ ID NO: 416461 - RNA, 20 nt, Human
gaacuccugaccucagguga

SEQ ID NO: 416462 - RNA, 23 nt, Human
gaacuccugaccucaggugagcc

SEQ ID NO: 416463 - RNA, 24 nt, Human
gaacuccugaccucaggugagcca

SEQ ID NO: 416464 - RNA, 22 nt, Human
gaacuccugaccucaggugauc

SEQ ID NO: 416465 - RNA, 23 nt, Human
gaacuccugaccucaggugaucc

SEQ ID NO: 416466 - RNA, 24 nt, Human
gaacuccugaccucaggugaucca

SEQ ID NO: 416467 - RNA, 23 nt, Human
gaacuccugaccucaggugaucu

SEQ ID NO: 416468 - RNA, 24 nt, Human
gaacuccugaccucaggugaugca

SEQ ID NO: 416469 - RNA, 23 nt, Human
gaacuccugaccucaggugauuc

SEQ ID NO: 416470 - RNA, 24 nt, Human
gaacuccugaccucaggugauuca

SEQ ID NO: 416471 - RNA, 23 nt, Human
gaacuccugaccucaguugaucc

SEQ ID NO: 416472 - RNA, 24 nt, Human
gaacuccugaccucaguugaucca

SEQ ID NO: 416473 - RNA, 21 nt, Human
gaacuccugaccucaugaucc

SEQ ID NO: 416474 - RNA, 22 nt, Human
gaacuccugaccucaugaucca

SEQ ID NO: 416475 - RNA, 23 nt, Human
gaacuccugaccucaugauccac

SEQ ID NO: 416476 - RNA, 32 nt, Human
gaacuccugaccucaugauuugccugccuuug

SEQ ID NO: 416477 - RNA, 22 nt, Human
gaacuccugaccuccugaucca

SEQ ID NO: 416478 - RNA, 22 nt, Human
gaacuccugaccucgggaucca

SEQ ID NO: 416479 - RNA, 22 nt, Human
gaacuccugaccucgugaccca

SEQ ID NO: 416480 - RNA, 23 nt, Human
gaacuccugaccucgugacccac

SEQ ID NO: 416481 - RNA, 22 nt, Human
gaacuccugaccucgugagcca

SEQ ID NO: 416482 - RNA, 20 nt, Human
gaacuccugaccucgugauc

SEQ ID NO: 416483 - RNA, 22 nt, Human
gaacuccugaccucgugaucca

SEQ ID NO: 416484 - RNA, 23 nt, Human
gaacuccugaccucgugauccac

SEQ ID NO: 416485 - RNA, 32 nt, Human
gaacuccugaccucgugauuugccugccuggg

SEQ ID NO: 416486 - RNA, 23 nt, Human
gaacuccugaccugaagcgaucc

SEQ ID NO: 416487 - RNA, 24 nt, Human
gaacuccugaccugaagugaucca

SEQ ID NO: 416488 - RNA, 24 nt, Human
gaacuccugaccugaagugaugca

SEQ ID NO: 416489 - RNA, 24 nt, Human
gaacuccugaccuuaagugaucca

SEQ ID NO: 416490 - RNA, 24 nt, Human
gaacuccugaccuuacgugaucca

SEQ ID NO: 416491 - RNA, 23 nt, Human
gaacuccugaccuuaggugaucc

SEQ ID NO: 416492 - RNA, 24 nt, Human
gaacuccugaccuuaggugaucca

SEQ ID NO: 416493 - RNA, 25 nt, Human
gaacuccugaccuucaggugaucca

SEQ ID NO: 416494 - RNA, 24 nt, Human
gaacuccugaccuuggguaaucca

SEQ ID NO: 416495 - RNA, 23 nt, Human
gaacuccugaccuuggugaucca

SEQ ID NO: 416496 - RNA, 22 nt, Human
gaacuccugaccuugugauaca

SEQ ID NO: 416497 - RNA, 22 nt, Human
gaacuccugaccuugugaucca

SEQ ID NO: 416498 - RNA, 23 nt, Human
gaacuccugaccuugugauccac

SEQ ID NO: 416499 - RNA, 23 nt, Human
gaacuccugacgucaggugaucc

SEQ ID NO: 416500 - RNA, 22 nt, Human
gaacuccugacguggugaucca

SEQ ID NO: 416501 - RNA, 23 nt, Human
gaacuccugacugcaggugaucc

SEQ ID NO: 416502 - RNA, 24 nt, Human
gaacuccugacuucaagugaucca

SEQ ID NO: 416503 - RNA, 24 nt, Human
gaacuccugacuucaggugaccca

SEQ ID NO: 416504 - RNA, 23 nt, Human
gaacuccugacuucaugugaucc

SEQ ID NO: 416505 - RNA, 24 nt, Human
gaacuccugacuugaaaugaucca

SEQ ID NO: 416506 - RNA, 24 nt, Human
gaacuccugacuuuaggugaucca

SEQ ID NO: 416507 - RNA, 23 nt, Human
gaacuccugagcucaagcaaucc

SEQ ID NO: 416508 - RNA, 24 nt, Human
gaacuccugagcucaagcagucca

SEQ ID NO: 416509 - RNA, 21 nt, Human
gaacuccugagcucaagugau

SEQ ID NO: 416510 - RNA, 23 nt, Human
gaacuccugagcucaagugaucc

SEQ ID NO: 416511 - RNA, 24 nt, Human
gaacuccugagcucaagugaucca

SEQ ID NO: 416512 - RNA, 23 nt, Human
gaacuccugagcucaggcaaucc

SEQ ID NO: 416513 - RNA, 24 nt, Human
gaacuccugagcucaggcagucca

SEQ ID NO: 416514 - RNA, 24 nt, Human
gaacuccugagcucaggugaucca

SEQ ID NO: 416515 - RNA, 22 nt, Human
gaacuccugagucaagugaucc

SEQ ID NO: 416516 - RNA, 24 nt, Human
gaacuccugaucucaggcaaucca

SEQ ID NO: 416517 - RNA, 23 nt, Human
gaacuccugauguuaggugaccc

SEQ ID NO: 416518 - RNA, 32 nt, Human
gaacuccugcagccugcacuuccgagagaucc

SEQ ID NO: 416519 - RNA, 32 nt, Human
gaacuccugcauuccaaccagccugggugaca

SEQ ID NO: 416520 - RNA, 24 nt, Human
gaacuccugcccucaggugaucca

SEQ ID NO: 416521 - RNA, 25 nt, Human
gaacuccuggaccucaagugaucua

SEQ ID NO: 416522 - RNA, 23 nt, Human
gaacuccuggacuuagacgaucc

SEQ ID NO: 416523 - RNA, 23 nt, Human
gaacuccuggcaucaagcgaucc

SEQ ID NO: 416524 - RNA, 32 nt, Human
gaacuccuggccauaggugaucugccugccuc

SEQ ID NO: 416525 - RNA, 23 nt, Human
gaacuccuggccuaggugaucca

SEQ ID NO: 416526 - RNA, 23 nt, Human
gaacuccuggccucaagcaaucc

SEQ ID NO: 416527 - RNA, 23 nt, Human
gaacuccuggccucaagcgaucc

SEQ ID NO: 416528 - RNA, 24 nt, Human
gaacuccuggccucaagcgaucca

SEQ ID NO: 416529 - RNA, 23 nt, Human
gaacuccuggccucaagugaccc

SEQ ID NO: 416530 - RNA, 24 nt, Human
gaacuccuggccucaagugaucca

SEQ ID NO: 416531 - RNA, 24 nt, Human
gaacuccuggccucaagugauuca

SEQ ID NO: 416532 - RNA, 24 nt, Human
gaacuccuggccucaggugaucca

SEQ ID NO: 416533 - RNA, 23 nt, Human
gaacuccuggcuacaagugaucc

SEQ ID NO: 416534 - RNA, 32 nt, Human
gaacuccuggcugaucucuuuuacuuaauucu

SEQ ID NO: 416535 - RNA, 23 nt, Human
gaacuccuggcuucaagcgaucc

SEQ ID NO: 416536 - RNA, 23 nt, Human
gaacuccugggaucaagugaucc

SEQ ID NO: 416537 - RNA, 23 nt, Human
gaacuccugggcacaagugaucc

SEQ ID NO: 416538 - RNA, 21 nt, Human
gaacuccugggcccaagugau

SEQ ID NO: 416539 - RNA, 23 nt, Human
gaacuccugggcccaagugaucc

SEQ ID NO: 416540 - RNA, 24 nt, Human
gaacuccugggcucaacugaucca

SEQ ID NO: 416541 - RNA, 23 nt, Human
gaacuccugggcucaagcgaucc

SEQ ID NO: 416542 - RNA, 24 nt, Human
gaacuccugggcucaagcgaucca

SEQ ID NO: 416543 - RNA, 24 nt, Human
gaacuccugggcucaagcggucca

SEQ ID NO: 416544 - RNA, 23 nt, Human
gaacuccugggcucaagugaucc

SEQ ID NO: 416545 - RNA, 32 nt, Human
gaacuccugggcucaagugauccacuugccuu

SEQ ID NO: 416546 - RNA, 24 nt, Human
gaacuccugggcucaaguggucca

SEQ ID NO: 416547 - RNA, 20 nt, Human
gaacuccugggcucaaugau

SEQ ID NO: 416548 - RNA, 23 nt, Human
gaacuccugggcucagaugaucc

SEQ ID NO: 416549 - RNA, 23 nt, Human
gaacuccugggcuuaagugaccc

SEQ ID NO: 416550 - RNA, 23 nt, Human
gaacuccuggucucaagugaucc

SEQ ID NO: 416551 - RNA, 32 nt, Human
gaacuccuggucucuugcgguccuccugucuu

SEQ ID NO: 416552 - RNA, 23 nt, Human
gaacuccugguuucaagcgaucc

SEQ ID NO: 416553 - RNA, 23 nt, Human
gaacuccuguccucagguaaucc

SEQ ID NO: 416554 - RNA, 23 nt, Human
gaacuccugugcucaagugaucc

SEQ ID NO: 416555 - RNA, 24 nt, Human
gaacuccuuaccucaggugaucca

SEQ ID NO: 416556 - RNA, 32 nt, Human
gaacuccuuggcuucuuuacuuaguucaagcc

SEQ ID NO: 416557 - RNA, 32 nt, Human
gaacucgcauggaaggggacaccccacaccgc

SEQ ID NO: 416558 - RNA, 32 nt, Human
gaacucgccagagacugagagcagagaccacu

SEQ ID NO: 416559 - RNA, 32 nt, Human
gaacucgcuucccaggcuucugagagucccgg

SEQ ID NO: 416560 - RNA, 32 nt, Human
gaacucggaaggcugggcaguggagcaaaaug

SEQ ID NO: 416561 - RNA, 32 nt, Human
gaacucggaggcgugcuuccuccacccgccgg

SEQ ID NO: 416562 - RNA, 32 nt, Human
gaacucggcugcggcuccauggucugaguugu

SEQ ID NO: 416563 - RNA, 24 nt, Human
gaacucgggaggaagagguugcag

SEQ ID NO: 416564 - RNA, 32 nt, Human
gaacucgggaggaagagguugcagugagcuga

SEQ ID NO: 416565 - RNA, 24 nt, Human
gaacucgggaggcagagguugcag

SEQ ID NO: 416566 - RNA, 32 nt, Human
gaacucgggaggcagagguugcagugagcuga

SEQ ID NO: 416567 - RNA, 32 nt, Human
gaacucgggaggcagagguugucaugagcuga

SEQ ID NO: 416568 - RNA, 32 nt, Human
gaacucgggaggcagagguuucagggagccaa

SEQ ID NO: 416569 - RNA, 24 nt, Human
gaacucgggaggcgaagguugcag

SEQ ID NO: 416570 - RNA, 32 nt, Human
gaacucgggaggcgaagguugcagugagccga

SEQ ID NO: 416571 - RNA, 32 nt, Human
gaacucgggaggcggagguugcagugagccga

SEQ ID NO: 416572 - RNA, 32 nt, Human
gaacucgggaggcggauguugcagugagccaa

SEQ ID NO: 416573 - RNA, 32 nt, Human
gaacucgggaggugaaaguugcagugagccga

SEQ ID NO: 416574 - RNA, 32 nt, Human
gaacucgggagguggagauugcaguaagccga

SEQ ID NO: 416575 - RNA, 32 nt, Human
gaacucgggagguggagguggcagugagccga

SEQ ID NO: 416576 - RNA, 24 nt, Human
gaacucgggagguggagguugcag

SEQ ID NO: 416577 - RNA, 32 nt, Human
gaacucgggagguggagguugcagucagccaa

SEQ ID NO: 416578 - RNA, 32 nt, Human
gaacucgggagguggagguugcagugagcuga

SEQ ID NO: 416579 - RNA, 32 nt, Human
gaacucgggagguggagguugugaugugcuga

SEQ ID NO: 416580 - RNA, 32 nt, Human
gaacucgggcccugagcuccucacugccgccc

SEQ ID NO: 416581 - RNA, 24 nt, Human
gaacucggggggcagagguugcag

SEQ ID NO: 416582 - RNA, 23 nt, Human
gaacucgggugggggagguugca

SEQ ID NO: 416583 - RNA, 32 nt, Human
gaacucgggugggggagguugcaaugagccga

SEQ ID NO: 416584 - RNA, 32 nt, Human
gaacucgucaggaaggcaggagacaggagacg

SEQ ID NO: 416585 - RNA, 32 nt, Human
gaacucuaaaccugcguguguggcugugcacc

SEQ ID NO: 416586 - RNA, 32 nt, Human
gaacucuacaucuagcaauuucucuuuaaaac

SEQ ID NO: 416587 - RNA, 32 nt, Human
gaacucuaggaaauauggucuuaugcuaggua

SEQ ID NO: 416588 - RNA, 32 nt, Human
gaacucucaagaggagugggagugcgggaguc

SEQ ID NO: 416589 - RNA, 32 nt, Human
gaacucucaggccaagaggagcccugggguga

SEQ ID NO: 416590 - RNA, 32 nt, Human
gaacucucaguucugccuagguguuuuugggg

SEQ ID NO: 416591 - RNA, 32 nt, Human
gaacucuccacccucaucucucugcguauuuc

SEQ ID NO: 416592 - RNA, 32 nt, Human
gaacucuccagugcccuauagcugcaagaguu

SEQ ID NO: 416593 - RNA, 32 nt, Human
gaacucucccaaggccacacagccggugcuag

SEQ ID NO: 416594 - RNA, 21 nt, Human
gaacucucccaccugucuccu

SEQ ID NO: 416595 - RNA, 21 nt, Human
gaacucucuucuccuauccua

SEQ ID NO: 416596 - RNA, 32 nt, Human
gaacucugaauagagacuugaagagugaggaa

SEQ ID NO: 416597 - RNA, 32 nt, Human
gaacucugagcagugcuugaaugaaguuguag

SEQ ID NO: 416598 - RNA, 32 nt, Human
gaacucugcaccuuccuccaccaggagccugg

SEQ ID NO: 416599 - RNA, 32 nt, Human
gaacucugcccaggugugcaggguuuggcuug

SEQ ID NO: 416600 - RNA, 31 nt, Human
gaacucugccucucugcuucuucaucuucuu

SEQ ID NO: 416601 - RNA, 32 nt, Human
gaacucugcuaagcuccgcugcagagacaggc

SEQ ID NO: 416602 - RNA, 32 nt, Human
gaacucugcucacugcaaccuccgccucccag

SEQ ID NO: 416603 - RNA, 32 nt, Human
gaacucuggaagcacugcucucugucagugau

SEQ ID NO: 416604 - RNA, 32 nt, Human
gaacucuggagucugcucaccuuccugccuca

SEQ ID NO: 416605 - RNA, 32 nt, Human
gaacucugggcuggaggcagggagacacugcc

SEQ ID NO: 416606 - RNA, 32 nt, Human
gaacucuguaacccucagcaaguuucauuuuu

SEQ ID NO: 416607 - RNA, 32 nt, Human
gaacucuguaccagcacaauccugccucacug

SEQ ID NO: 416608 - RNA, 32 nt, Human
gaacucugugaaggauggaacuuucagauauc

SEQ ID NO: 416609 - RNA, 32 nt, Human
gaacucuuacaucaagaggucuccaguaccuc

SEQ ID NO: 416610 - RNA, 32 nt, Human
gaacucuuccaaguaauuucacagguggagau

SEQ ID NO: 416611 - RNA, 32 nt, Human
gaacucuucugcacucugagcuggccagcccc

SEQ ID NO: 416612 - RNA, 32 nt, Human
gaacucuucugccauuuuccuccuucacucgu

SEQ ID NO: 416613 - RNA, 24 nt, Human
gaacucuugaccucaggugaucca

SEQ ID NO: 416614 - RNA, 32 nt, Human
gaacucuugaccucaggugauccugagccuca

SEQ ID NO: 416615 - RNA, 24 nt, Human
gaacucuugaccucgggugaucca

SEQ ID NO: 416616 - RNA, 24 nt, Human
gaacucuugacuucagaugaucca

SEQ ID NO: 416617 - RNA, 32 nt, Human
gaacucuugcagaggaaggauuuggaauauuu

SEQ ID NO: 416618 - RNA, 23 nt, Human
gaacucuuggccucaagcgaucc

SEQ ID NO: 416619 - RNA, 23 nt, Human
gaacucuuggccucaaguaaucc

SEQ ID NO: 416620 - RNA, 23 nt, Human
gaacucuuggccucaggugaucc

SEQ ID NO: 416621 - RNA, 23 nt, Human
gaacucuugggcucaagcgaucc

SEQ ID NO: 416622 - RNA, 23 nt, Human
gaacucuugggcucaagugaucc

SEQ ID NO: 416623 - RNA, 32 nt, Human
gaacucuuggugcugguguuuugggcagaaag

SEQ ID NO: 416624 - RNA, 32 nt, Human
gaacucuuguuucuuggggaaggagaggaggg

SEQ ID NO: 416625 - RNA, 32 nt, Human
gaacucuuucaacucugcgcugcccagccuuc

SEQ ID NO: 416626 - RNA, 32 nt, Human
gaacucuuucugagagacugcagcacaccuag

SEQ ID NO: 416627 - RNA, 32 nt, Human
gaacugaaaggcugugaccagccugguggcgc

SEQ ID NO: 416628 - RNA, 32 nt, Human
gaacugaacauguaaaaaguaugggaaacaga

SEQ ID NO: 416629 - RNA, 32 nt, Human
gaacugaagcgcccugaaccccagccuguccg

SEQ ID NO: 416630 - RNA, 32 nt, Human
gaacugaagcuucucagaucagaaaagauaaa

SEQ ID NO: 416631 - RNA, 24 nt, Human
gaacugaaggaugccacccaggga

SEQ ID NO: 416632 - RNA, 32 nt, Human
gaacugaagggccuggccaaccaugugguugu

SEQ ID NO: 416633 - RNA, 32 nt, Human
gaacugacccccucagccccagcccaucaccc

SEQ ID NO: 416634 - RNA, 32 nt, Human
gaacugaccuacugaccugccugcuggcauga

SEQ ID NO: 416635 - RNA, 24 nt, Human
gaacugaccugaguccccuuccaa

SEQ ID NO: 416636 - RNA, 32 nt, Human
gaacugacugaacuagagcuugcagugaagug

SEQ ID NO: 416637 - RNA, 24 nt, Human
gaacugagauugcgccaccgcacu

SEQ ID NO: 416638 - RNA, 32 nt, Human
gaacugagauugugccacuacacuccagccug

SEQ ID NO: 416639 - RNA, 24 nt, Human
gaacugaggagguggagguugcag

SEQ ID NO: 416640 - RNA, 27 nt, Human
gaacugaggagguggagguugcaguga

SEQ ID NO: 416641 - RNA, 32 nt, Human
gaacugaggagguggagguugcagugagccga

SEQ ID NO: 416642 - RNA, 32 nt, Human
gaacugaggccccaggaugacagaacaggaga

SEQ ID NO: 416643 - RNA, 32 nt, Human
gaacugaggccugggugauuuauuuauuggga

SEQ ID NO: 416644 - RNA, 32 nt, Human
gaacugaggggaguagagggagagggcaggug

SEQ ID NO: 416645 - RNA, 32 nt, Human
gaacugaguucccagcaucaucuuauucugaa

SEQ ID NO: 416646 - RNA, 32 nt, Human
gaacugaucuguccuucgugaaacgcaacaaa

SEQ ID NO: 416647 - RNA, 32 nt, Human
gaacugaucuucaugcugagcgacagcccugg

SEQ ID NO: 416648 - RNA, 32 nt, Human
gaacugaugaagcugcagaaccaaugaggugg

SEQ ID NO: 416649 - RNA, 18 nt, Human
gaacugaugaccacccca

SEQ ID NO: 416650 - RNA, 32 nt, Human
gaacugaugcuuaaacacacagguguguugca

SEQ ID NO: 416651 - RNA, 32 nt, Human
gaacugauuugugaucaggaacgauuccaggu

SEQ ID NO: 416652 - RNA, 22 nt, Human
gaacugcaagcuccccucagcc

SEQ ID NO: 416653 - RNA, 32 nt, Human
gaacugcaccuuuaggccaucucagcuugcug

SEQ ID NO: 416654 - RNA, 32 nt, Human
gaacugcagacuccuuuguacucucaaacucc

SEQ ID NO: 416655 - RNA, 32 nt, Human
gaacugcagaugugcgccaccaugcccggcua

SEQ ID NO: 416656 - RNA, 32 nt, Human
gaacugcagcggagcgugugaggugccuggca

SEQ ID NO: 416657 - RNA, 32 nt, Human
gaacugcagcuugaggaauucucuccacaccu

SEQ ID NO: 416658 - RNA, 32 nt, Human
gaacugcaggccaguuccaaagaguguuugcu

SEQ ID NO: 416659 - RNA, 32 nt, Human
gaacugcauaucggaggugguggaggaggagg

SEQ ID NO: 416660 - RNA, 19 nt, Human
gaacugcaugcugcaggug

SEQ ID NO: 416661 - RNA, 32 nt, Human
gaacugcauuaguuaagauuacccagacuugg

SEQ ID NO: 416662 - RNA, 32 nt, Human
gaacugccauccagcuuuggugcaauggcuga

SEQ ID NO: 416663 - RNA, 32 nt, Human
gaacugccggggcuuccagccacccaccccuc

SEQ ID NO: 416664 - RNA, 32 nt, Human
gaacugccugggguacauaugugaacacucca

SEQ ID NO: 416665 - RNA, 32 nt, Human
gaacugcgauaacugagaaacuucuuaccagu

SEQ ID NO: 416666 - RNA, 31 nt, Human
gaacugcucaauaaauguauguggcaugaau

SEQ ID NO: 416667 - RNA, 32 nt, Human
gaacugcucaccacugucuuccuggguuugca

SEQ ID NO: 416668 - RNA, 32 nt, Human
gaacugcucagagcuugagaugaaaugacaua

SEQ ID NO: 416669 - RNA, 31 nt, Human
gaacugcucuacauuuggccugugccagugg

SEQ ID NO: 416670 - RNA, 32 nt, Human
gaacugcucuacauuuggccugugccaguggc

SEQ ID NO: 416671 - RNA, 23 nt, Human
gaacugcugaccucaaguaaucc

SEQ ID NO: 416672 - RNA, 24 nt, Human
gaacugcugaccucaggugaucca

SEQ ID NO: 416673 - RNA, 18 nt, Human
gaacugcugagcuuuaca

SEQ ID NO: 416674 - RNA, 32 nt, Human
gaacugcugauagcccuuacugagggcaaaag

SEQ ID NO: 416675 - RNA, 32 nt, Human
gaacugcugcagcugcugccgccgccggagga

SEQ ID NO: 416676 - RNA, 21 nt, Human
gaacugcugcaugggccggca

SEQ ID NO: 416677 - RNA, 32 nt, Human
gaacugcugcccucccuuccuucuacuuaacu

SEQ ID NO: 416678 - RNA, 32 nt, Human
gaacugcugccugauuccuguguggggagaag

SEQ ID NO: 416679 - RNA, 32 nt, Human
gaacugcugcggcacguggccccuggguugca

SEQ ID NO: 416680 - RNA, 20 nt, Human
gaacugcugcuuguccggca

SEQ ID NO: 416681 - RNA, 24 nt, Human
gaacugcuggccucaagcgaucca

SEQ ID NO: 416682 - RNA, 32 nt, Human
gaacugcuguauucuaacaaauuuacuacacg

SEQ ID NO: 416683 - RNA, 32 nt, Human
gaacugcuuagguaggagugcacugcaguuuc

SEQ ID NO: 416684 - RNA, 32 nt, Human
gaacugcuuccucauuuaacaagguaggaagu

SEQ ID NO: 416685 - RNA, 32 nt, Human
gaacuggaaagucacuucccauagaagcaaaa

SEQ ID NO: 416686 - RNA, 32 nt, Human
gaacuggacagaacugaaacacagcaacacca

SEQ ID NO: 416687 - RNA, 32 nt, Human
gaacuggacccgagggacccagcucaacuuga

SEQ ID NO: 416688 - RNA, 32 nt, Human
gaacuggagagggaggggucugcggucagucg

SEQ ID NO: 416689 - RNA, 32 nt, Human
gaacuggagcccacuccuccucccucucguug

SEQ ID NO: 416690 - RNA, 21 nt, Human
gaacuggagcugccacagggg

SEQ ID NO: 416691 - RNA, 32 nt, Human
gaacuggaggaagcgaagcaucaaggccagag

SEQ ID NO: 416692 - RNA, 32 nt, Human
gaacuggaggccaggaaucuccucacugaaaa

SEQ ID NO: 416693 - RNA, 32 nt, Human
gaacuggagggugagaggaagggugggucugu

SEQ ID NO: 416694 - RNA, 32 nt, Human
gaacuggaugccacagaaagaggaguggucuu

SEQ ID NO: 416695 - RNA, 32 nt, Human
gaacuggcaaggaugcagucagcuguuugcag

SEQ ID NO: 416696 - RNA, 32 nt, Human
gaacuggcagcagccucuacugggcuuuuacu

SEQ ID NO: 416697 - RNA, 22 nt, Human
gaacuggcagugccucuuccaa

SEQ ID NO: 416698 - RNA, 32 nt, Human
gaacuggccagccuucggggccaacucccugg

SEQ ID NO: 416699 - RNA, 32 nt, Human
gaacuggccucugccuuugguuuacucagggu

SEQ ID NO: 416700 - RNA, 32 nt, Human
gaacuggccuggagagaguccuguaccacuca

SEQ ID NO: 416701 - RNA, 32 nt, Human
gaacuggcgaguucaggugggguggggacagc

SEQ ID NO: 416702 - RNA, 32 nt, Human
gaacuggcguagaggcaacagagccaucuaga

SEQ ID NO: 416703 - RNA, 32 nt, Human
gaacuggcucaagcaaucugcccaccucgguc

SEQ ID NO: 416704 - RNA, 22 nt, Human
gaacuggcugggccccugggga

SEQ ID NO: 416705 - RNA, 32 nt, Human
gaacuggcuuuucugagagaugaaucaauaau

SEQ ID NO: 416706 - RNA, 32 nt, Human
gaacugggaaacaggcagagguuggaacaguu

SEQ ID NO: 416707 - RNA, 32 nt, Human
gaacugggagaggaagagagcaggacaaggca

SEQ ID NO: 416708 - RNA, 32 nt, Human
gaacugggaggcagguuuggaggcugcagugg

SEQ ID NO: 416709 - RNA, 32 nt, Human
gaacugggagggaagggugagacggagccgga

SEQ ID NO: 416710 - RNA, 32 nt, Human
gaacugggaguccagggagggagcugaggagc

SEQ ID NO: 416711 - RNA, 32 nt, Human
gaacugggcagacaccccuggagcucagccga

SEQ ID NO: 416712 - RNA, 32 nt, Human
gaacugggccagcuccggucccuuccuuuugg

SEQ ID NO: 416713 - RNA, 32 nt, Human
gaacugggccuggggcuggaggccugggaucc

SEQ ID NO: 416714 - RNA, 32 nt, Human
gaacugggcuagucuagucugccuucuuuccu

SEQ ID NO: 416715 - RNA, 32 nt, Human
gaacugggcucacugcagccuagaccugcugg

SEQ ID NO: 416716 - RNA, 32 nt, Human
gaacuggggaagcagagguuguagugagccga

SEQ ID NO: 416717 - RNA, 32 nt, Human
gaacuggggaagggaaagaaggccugugggcg

SEQ ID NO: 416718 - RNA, 24 nt, Human
gaacuggggaggagaagguugcag

SEQ ID NO: 416719 - RNA, 32 nt, Human
gaacuggggaggagaagguugcagugagccga

SEQ ID NO: 416720 - RNA, 32 nt, Human
gaacuggggaggcagagguugcagugagacaa

SEQ ID NO: 416721 - RNA, 32 nt, Human
gaacuggggaggcagagguugcaguggcccga

SEQ ID NO: 416722 - RNA, 24 nt, Human
gaacuggggaggcagagguugcgg

SEQ ID NO: 416723 - RNA, 32 nt, Human
gaacuggggaggcagagguugcggugagccca

SEQ ID NO: 416724 - RNA, 24 nt, Human
gaacuggggagguagagguuacag

SEQ ID NO: 416725 - RNA, 32 nt, Human
gaacugggguccagagaggccaggucacagag

SEQ ID NO: 416726 - RNA, 32 nt, Human
gaacuggguaacaggcagaggcuggaacaguu

SEQ ID NO: 416727 - RNA, 32 nt, Human
gaacuggguaacaggcagagguuggaacaguu

SEQ ID NO: 416728 - RNA, 32 nt, Human
gaacugggugcacacaugaguggggcagccgg

SEQ ID NO: 416729 - RNA, 32 nt, Human
gaacuggguggccuuugaauugccugcuuucc

SEQ ID NO: 416730 - RNA, 32 nt, Human
gaacuggguguugguguccauggaacuuccuc

SEQ ID NO: 416731 - RNA, 22 nt, Human
gaacuggguucccaugcuuugu

SEQ ID NO: 416732 - RNA, 24 nt, Human
gaacugguauagggcaccuagagg

SEQ ID NO: 416733 - RNA, 32 nt, Human
gaacuggucauagaggaagagcuagaaaucca

SEQ ID NO: 416734 - RNA, 32 nt, Human
gaacuggugacacguggcuguacauucagcac

SEQ ID NO: 416735 - RNA, 24 nt, Human
gaacugguuacuuucugucucugu

SEQ ID NO: 416736 - RNA, 32 nt, Human
gaacugguucaauuccccgcuccugggcuucc

SEQ ID NO: 416737 - RNA, 32 nt, Human
gaacugguuuucauuuuuauaacugguagacu

SEQ ID NO: 416738 - RNA, 32 nt, Human
gaacuguaucugaguaacagaggacagcuguu

SEQ ID NO: 416739 - RNA, 20 nt, Human
gaacuguauuaugugguuuu

SEQ ID NO: 416740 - RNA, 32 nt, Human
gaacugucaccgcuguucccagacacacuuau

SEQ ID NO: 416741 - RNA, 19 nt, Human
gaacugucagugcggagua

SEQ ID NO: 416742 - RNA, 22 nt, Human
gaacugucguucacagcugcgu

SEQ ID NO: 416743 - RNA, 32 nt, Human
gaacugucuaguccugguuugggauuuaucuu

SEQ ID NO: 416744 - RNA, 32 nt, Human
gaacugugagacaauaaacucucauuguuuua

SEQ ID NO: 416745 - RNA, 32 nt, Human
gaacugugagcuucguugauguuagucaaagc

SEQ ID NO: 416746 - RNA, 32 nt, Human
gaacugugcccacugccuuuuccuuugcucug

SEQ ID NO: 416747 - RNA, 32 nt, Human
gaacugugcuuccaaacagaaaucaggaguga

SEQ ID NO: 416748 - RNA, 32 nt, Human
gaacuguggacugauucaguguaaauaaaaac

SEQ ID NO: 416749 - RNA, 32 nt, Human
gaacuguggauggaaaccaaugacagauauca

SEQ ID NO: 416750 - RNA, 32 nt, Human
gaacuguggcaggugggaauaauccugcccuu

SEQ ID NO: 416751 - RNA, 32 nt, Human
gaacuguggggaccuggaggccuccaacgacu

SEQ ID NO: 416752 - RNA, 31 nt, Human
gaacuguggguggauggguggauugccuggg

SEQ ID NO: 416753 - RNA, 32 nt, Human
gaacuguggucucguccaucugcacagccagg

SEQ ID NO: 416754 - RNA, 32 nt, Human
gaacuguggugacuacagguaacugaaaccau

SEQ ID NO: 416755 - RNA, 32 nt, Human
gaacuguguaaaccagcaugcugucugccaua

SEQ ID NO: 416756 - RNA, 32 nt, Human
gaacuguguagugcucuucuuugccauuugca

SEQ ID NO: 416757 - RNA, 32 nt, Human
gaacuguucuuuggaccuaggauucugccgug

SEQ ID NO: 416758 - RNA, 32 nt, Human
gaacuguuucaugcugcuguguuuucaaaagc

SEQ ID NO: 416759 - RNA, 32 nt, Human
gaacuguuuuuauccagcagugaagcucuuga

SEQ ID NO: 416760 - RNA, 20 nt, Human
gaacuuaaaaacugcugcua

SEQ ID NO: 416761 - RNA, 32 nt, Human
gaacuuaaccuuggagugagagcccagggaca

SEQ ID NO: 416762 - RNA, 32 nt, Human
gaacuuaagacauuagauguguggcuauguca

SEQ ID NO: 416763 - RNA, 32 nt, Human
gaacuuaagagggagagcacugugggcaugca

SEQ ID NO: 416764 - RNA, 32 nt, Human
gaacuuaagcucuugcucuuaggcugagacgc

SEQ ID NO: 416765 - RNA, 32 nt, Human
gaacuuaaggauggagccagcucugcauuauc

SEQ ID NO: 416766 - RNA, 32 nt, Human
gaacuuaccaucugaugauauguauguacagc

SEQ ID NO: 416767 - RNA, 19 nt, Human
gaacuuaccucuacuguua

SEQ ID NO: 416768 - RNA, 32 nt, Human
gaacuuagagguggagcaguuggauucugugc

SEQ ID NO: 416769 - RNA, 32 nt, Human
gaacuuagccaagagucugggucuccgggcca

SEQ ID NO: 416770 - RNA, 32 nt, Human
gaacuuagccuccugaacagucuucuucgaaa

SEQ ID NO: 416771 - RNA, 32 nt, Human
gaacuuaggagagaagcacggaggagcccccg

SEQ ID NO: 416772 - RNA, 32 nt, Human
gaacuuaggcuguuacacaacugcuggggucu

SEQ ID NO: 416773 - RNA, 32 nt, Human
gaacuuauacagucucagccacucugcuuuga

SEQ ID NO: 416774 - RNA, 32 nt, Human
gaacuuauagagcuucugcuucccuuucccuu

SEQ ID NO: 416775 - RNA, 23 nt, Human
gaacuuaugaccucaggugaucc

SEQ ID NO: 416776 - RNA, 32 nt, Human
gaacuucaacuuucugauuccaugucuguuag

SEQ ID NO: 416777 - RNA, 32 nt, Human
gaacuucacaggcuagaauggugaaaugaccu

SEQ ID NO: 416778 - RNA, 32 nt, Human
gaacuucagaguauauuaaauuaccuucuuac

SEQ ID NO: 416779 - RNA, 32 nt, Human
gaacuucagaugcuugcagacacuucaugaau

SEQ ID NO: 416780 - RNA, 32 nt, Human
gaacuucagucauccucuuggcaauuugaggg

SEQ ID NO: 416781 - RNA, 32 nt, Human
gaacuucaguuuauaauuggaagagaaauuuu

SEQ ID NO: 416782 - RNA, 32 nt, Human
gaacuuccaggcuuucuaccucgacucucacc

SEQ ID NO: 416783 - RNA, 32 nt, Human
gaacuucccaggagagccagcugggaagcagu

SEQ ID NO: 416784 - RNA, 32 nt, Human
gaacuuccccuuaccuccucucucuggcucgg

SEQ ID NO: 416785 - RNA, 32 nt, Human
gaacuuccguccuguaccugacuccaccucca

SEQ ID NO: 416786 - RNA, 32 nt, Human
gaacuuccuauguuaugguucuuucucuguga

SEQ ID NO: 416787 - RNA, 32 nt, Human
gaacuuccuugugaauccuuccagaaauacuc

SEQ ID NO: 416788 - RNA, 32 nt, Human
gaacuucgaggaaaucaauuucugaugcucca

SEQ ID NO: 416789 - RNA, 32 nt, Human
gaacuucuaaacagcacauccucgagccagcc

SEQ ID NO: 416790 - RNA, 32 nt, Human
gaacuucuaaccccgucccaaaagaggcggug

SEQ ID NO: 416791 - RNA, 32 nt, Human
gaacuucuacagaagcagguugcagugagccg

SEQ ID NO: 416792 - RNA, 32 nt, Human
gaacuucuagccugcuuuauaaucaaucaguu

SEQ ID NO: 416793 - RNA, 32 nt, Human
gaacuucucauggggaagaaguggagggaugc

SEQ ID NO: 416794 - RNA, 32 nt, Human
gaacuucuccaccgaccccgucaccuggauug

SEQ ID NO: 416795 - RNA, 32 nt, Human
gaacuucuccauccuuggcuuugauauuucag

SEQ ID NO: 416796 - RNA, 32 nt, Human
gaacuucucugggaugcugggauucuugccug

SEQ ID NO: 416797 - RNA, 24 nt, Human
gaacuucugaccucaaguggucca

SEQ ID NO: 416798 - RNA, 24 nt, Human
gaacuucugaccucaggugaucca

SEQ ID NO: 416799 - RNA, 24 nt, Human
gaacuucugacgucaagugaucca

SEQ ID NO: 416800 - RNA, 24 nt, Human
gaacuucugaucucaagugaucca

SEQ ID NO: 416801 - RNA, 32 nt, Human
gaacuucugggcaaaucuggaugcuaauugcu

SEQ ID NO: 416802 - RNA, 22 nt, Human
gaacuucugggcucaagcaauu

SEQ ID NO: 416803 - RNA, 23 nt, Human
gaacuucuguagcagagguugca

SEQ ID NO: 416804 - RNA, 32 nt, Human
gaacuucugugugguggcaguacuguggccca

SEQ ID NO: 416805 - RNA, 32 nt, Human
gaacuucuuguccuagaucagccccaaucugu

SEQ ID NO: 416806 - RNA, 32 nt, Human
gaacuugaacugcaggggcagagccagugaau

SEQ ID NO: 416807 - RNA, 32 nt, Human
gaacuugaagaguaagaauaaaaacuaccaaa

SEQ ID NO: 416808 - RNA, 32 nt, Human
gaacuugaagguuaaaccacuagcccauuuca

SEQ ID NO: 416809 - RNA, 32 nt, Human
gaacuugacaagauuagcucaagcagauagag

SEQ ID NO: 416810 - RNA, 32 nt, Human
gaacuugacagguuguguugaugcucuuaguu

SEQ ID NO: 416811 - RNA, 32 nt, Human
gaacuugaccacugccacaccagcccuggggu

SEQ ID NO: 416812 - RNA, 32 nt, Human
gaacuugaggggaaaagaaacaucccagggau

SEQ ID NO: 416813 - RNA, 32 nt, Human
gaacuugaguuggaagaggcaagucuggucuc

SEQ ID NO: 416814 - RNA, 32 nt, Human
gaacuugaucacuugaagcucagaccuauugg

SEQ ID NO: 416815 - RNA, 32 nt, Human
gaacuugcagugagccaagaucgcgccacugc

SEQ ID NO: 416816 - RNA, 32 nt, Human
gaacuugcggugagccgagaucgcaccacugc

SEQ ID NO: 416817 - RNA, 32 nt, Human
gaacuugcucacaacugugacuccucaggucg

SEQ ID NO: 416818 - RNA, 32 nt, Human
gaacuugcugccaaagagaaggcuaaugagga

SEQ ID NO: 416819 - RNA, 31 nt, Human
gaacuugcuguuucuaaacaugcaggcuggu

SEQ ID NO: 416820 - RNA, 32 nt, Human
gaacuugcuuaaggucacacagcuggugagug

SEQ ID NO: 416821 - RNA, 19 nt, Human
gaacuuggacuccugggaa

SEQ ID NO: 416822 - RNA, 32 nt, Human
gaacuuggacuccugggaacauggacaagccc

SEQ ID NO: 416823 - RNA, 32 nt, Human
gaacuuggauggccaggauggggucccgcggc

SEQ ID NO: 416824 - RNA, 32 nt, Human
gaacuuggauguaccugcccccaauccaugaa

SEQ ID NO: 416825 - RNA, 32 nt, Human
gaacuuggauugcaggaaagucaaaguaauau

SEQ ID NO: 416826 - RNA, 32 nt, Human
gaacuuggcacggccagcuugggacccaggac

SEQ ID NO: 416827 - RNA, 32 nt, Human
gaacuuggcagaaacacuacaacauuuucauu

SEQ ID NO: 416828 - RNA, 31 nt, Human
gaacuuggcauuuucugauauagaaaaaggc

SEQ ID NO: 416829 - RNA, 32 nt, Human
gaacuugggaggaucccaccucagccuucgug

SEQ ID NO: 416830 - RNA, 24 nt, Human
gaacuugggaggcagagguugcag

SEQ ID NO: 416831 - RNA, 32 nt, Human
gaacuugggaggcagagguuguggugagccga

SEQ ID NO: 416832 - RNA, 24 nt, Human
gaacuugggaggcagagguuucag

SEQ ID NO: 416833 - RNA, 32 nt, Human
gaacuugggaggcagagguuucagugagccga

SEQ ID NO: 416834 - RNA, 32 nt, Human
gaacuugggaggcggagcuugcggugagccaa

SEQ ID NO: 416835 - RNA, 24 nt, Human
gaacuugggaggcggagguugcag

SEQ ID NO: 416836 - RNA, 32 nt, Human
gaacuugggaggcggagguugcagugagcuaa

SEQ ID NO: 416837 - RNA, 32 nt, Human
gaacuugggagggagagguugcagugagccca

SEQ ID NO: 416838 - RNA, 32 nt, Human
gaacuugggagggguagguugcagugagcuga

SEQ ID NO: 416839 - RNA, 24 nt, Human
gaacuugggagguagagguuacag

SEQ ID NO: 416840 - RNA, 24 nt, Human
gaacuugggagguggagcuuacag

SEQ ID NO: 416841 - RNA, 32 nt, Human
gaacuugggagguggagcuuacagugagccga

SEQ ID NO: 416842 - RNA, 24 nt, Human
gaacuugggagguggagguugcag

SEQ ID NO: 416843 - RNA, 32 nt, Human
gaacuugggagguggagguugcagugagccag

SEQ ID NO: 416844 - RNA, 32 nt, Human
gaacuugggagguggagguugcagugggccga

SEQ ID NO: 416845 - RNA, 32 nt, Human
gaacuugggcgccgggcacacgcccagucccg

SEQ ID NO: 416846 - RNA, 32 nt, Human
gaacuugggggaggacacaaauccagagugca

SEQ ID NO: 416847 - RNA, 32 nt, Human
gaacuuggguucaaggaagauggagaugcguc

SEQ ID NO: 416848 - RNA, 32 nt, Human
gaacuuggguugauuucaauguuaauaaacua

SEQ ID NO: 416849 - RNA, 32 nt, Human
gaacuugguauccuguuuccaucccagccuuc

SEQ ID NO: 416850 - RNA, 32 nt, Human
gaacuuguagugagccaagaucacgccacugc

SEQ ID NO: 416851 - RNA, 32 nt, Human
gaacuuguaucuucucagcaaccuucacuuug

SEQ ID NO: 416852 - RNA, 32 nt, Human
gaacuuguauuuuuguggaugaugaccuuggu

SEQ ID NO: 416853 - RNA, 32 nt, Human
gaacuugucaaauuaaugucuacagugauaug

SEQ ID NO: 416854 - RNA, 32 nt, Human
gaacuugucaaauuacagccaaugagaaaaua

SEQ ID NO: 416855 - RNA, 32 nt, Human
gaacuuguccauaugaauaaaaguuaucgaag

SEQ ID NO: 416856 - RNA, 32 nt, Human
gaacuugucuguguguccagaggaggagucca

SEQ ID NO: 416857 - RNA, 32 nt, Human
gaacuugugaauuuuauuuuuaaggauucacc

SEQ ID NO: 416858 - RNA, 32 nt, Human
gaacuugugaccuucucugagguugcagcggc

SEQ ID NO: 416859 - RNA, 32 nt, Human
gaacuuguggagagacuacaaaguuuugguug

SEQ ID NO: 416860 - RNA, 32 nt, Human
gaacuugugggauggugggguuggcuucccug

SEQ ID NO: 416861 - RNA, 32 nt, Human
gaacuugugggguggagguugcagugagcuga

SEQ ID NO: 416862 - RNA, 32 nt, Human
gaacuuguuucaggaagugugagcacgggccu

SEQ ID NO: 416863 - RNA, 32 nt, Human
gaacuuguuucccuuauccauuuccuuuuuca

SEQ ID NO: 416864 - RNA, 32 nt, Human
gaacuuuaacaucagucauugcacaggagcua

SEQ ID NO: 416865 - RNA, 32 nt, Human
gaacuuuagaaaccacaccuccucgcuguagu

SEQ ID NO: 416866 - RNA, 32 nt, Human
gaacuuuauucccaucaaacacugaccuaauc

SEQ ID NO: 416867 - RNA, 32 nt, Human
gaacuuucaguacuguacuaccacagauugau

SEQ ID NO: 416868 - RNA, 32 nt, Human
gaacuuuccauggcugguggcagagguagaaa

SEQ ID NO: 416869 - RNA, 32 nt, Human
gaacuuuccucacccgccccugcccagacagg

SEQ ID NO: 416870 - RNA, 32 nt, Human
gaacuuuccuccucgggguggggguggggguu

SEQ ID NO: 416871 - RNA, 32 nt, Human
gaacuuuccuuccugucacugugaauacuugg

SEQ ID NO: 416872 - RNA, 32 nt, Human
gaacuuucuaaccuuaagaagaauaggaaagu

SEQ ID NO: 416873 - RNA, 32 nt, Human
gaacuuucuaggcugagucuagugccccuauu

SEQ ID NO: 416874 - RNA, 32 nt, Human
gaacuuucucuacaacccuugggagcgugggg

SEQ ID NO: 416875 - RNA, 32 nt, Human
gaacuuucucugucugucucucucugugucuc

SEQ ID NO: 416876 - RNA, 32 nt, Human
gaacuuucucuuuuuaggaauaccaaaguuuu

SEQ ID NO: 416877 - RNA, 18 nt, Human
gaacuuucuggacuccca

SEQ ID NO: 416878 - RNA, 17 nt, Human
gaacuuucuggauucca

SEQ ID NO: 416879 - RNA, 32 nt, Human
gaacuuucugggauguucucugugccuuggaa

SEQ ID NO: 416880 - RNA, 32 nt, Human
gaacuuucuugagggauagguggacccugaca

SEQ ID NO: 416881 - RNA, 32 nt, Human
gaacuuugaacccauguuaauuuuggacccua

SEQ ID NO: 416882 - RNA, 32 nt, Human
gaacuuugaggccagaggugauccagugauuu

SEQ ID NO: 416883 - RNA, 32 nt, Human
gaacuuugggaggccgaggugaguggauugcu

SEQ ID NO: 416884 - RNA, 32 nt, Human
gaacuuugggaggccuagauggguggaucacu

SEQ ID NO: 416885 - RNA, 32 nt, Human
gaacuuugucucuaauggcuuuugccacaacc

SEQ ID NO: 416886 - RNA, 32 nt, Human
gaacuuugugacugcagaacugacaguugacu

SEQ ID NO: 416887 - RNA, 32 nt, Human
gaacuuuugagugaugacucugagaaguugaa

SEQ ID NO: 416888 - RNA, 22 nt, Human
gaacuuuugcuccaggguccca

SEQ ID NO: 416889 - RNA, 32 nt, Human
gaacuuuuggaaaaucucagagggucuggggc

SEQ ID NO: 416890 - RNA, 32 nt, Human
gaacuuuuucuguugaacaaaauauucacaac

SEQ ID NO: 416891 - RNA, 32 nt, Human
gaacuuuuugcacuagacugauguuguuuuuc

SEQ ID NO: 416892 - RNA, 32 nt, Human
gaagaaaaacaguccgcgacagcuaggcgcgu

SEQ ID NO: 416893 - RNA, 32 nt, Human
gaagaaaaagaaaaagaagaagaaaggcagaa

SEQ ID NO: 416894 - RNA, 32 nt, Human
gaagaaaaagaaguaccacucuggccuggccu

SEQ ID NO: 416895 - RNA, 32 nt, Human
gaagaaaaaggccaaggaguuugaagauuuuu

SEQ ID NO: 416896 - RNA, 32 nt, Human
gaagaaaaaguuaaaaggaaggugaagugcgg

SEQ ID NO: 416897 - RNA, 32 nt, Human
gaagaaaaauuggccgggcaugguggcucaug

SEQ ID NO: 416898 - RNA, 32 nt, Human
gaagaaaacaccucuuagcugugugacugauu

SEQ ID NO: 416899 - RNA, 21 nt, Human
gaagaaaacuuaaacccugug

SEQ ID NO: 416900 - RNA, 32 nt, Human
gaagaaaacuuccaguacccguggaaccccag

SEQ ID NO: 416901 - RNA, 32 nt, Human
gaagaaaagccacccccugcacccuccauagc

SEQ ID NO: 416902 - RNA, 32 nt, Human
gaagaaaagcuucuuugauaaauguggaguuc

SEQ ID NO: 416903 - RNA, 32 nt, Human
gaagaaaaggcagagacaggcaagacagcauc

SEQ ID NO: 416904 - RNA, 32 nt, Human
gaagaaaaguaguucugguauguuucauugau

SEQ ID NO: 416905 - RNA, 32 nt, Human
gaagaaaagugagagcuucagcagaacguguc

SEQ ID NO: 416906 - RNA, 32 nt, Human
gaagaaaauaaauacuguauacuuuuaaauuu

SEQ ID NO: 416907 - RNA, 32 nt, Human
gaagaaaaugucccucccuuacccccauccuu

SEQ ID NO: 416908 - RNA, 32 nt, Human
gaagaaaauguucuuccaguuacuuuccaauu

SEQ ID NO: 416909 - RNA, 32 nt, Human
gaagaaacaaagucaccuuucucuccagugcc

SEQ ID NO: 416910 - RNA, 32 nt, Human
gaagaaacaagccaucuccauccagagcccau

SEQ ID NO: 416911 - RNA, 22 nt, Human
gaagaaacaccucuuacaguca

SEQ ID NO: 416912 - RNA, 32 nt, Human
gaagaaacagaagaacucaugcugccagauag

SEQ ID NO: 416913 - RNA, 32 nt, Human
gaagaaacagaagcggcucaguucaccuugau

SEQ ID NO: 416914 - RNA, 32 nt, Human
gaagaaacagaaggggcucaguucaccuugau

SEQ ID NO: 416915 - RNA, 32 nt, Human
gaagaaacauaugugacaugguauuuuaguaa

SEQ ID NO: 416916 - RNA, 32 nt, Human
gaagaaaccacagaaagaaaacuacagaccuc

SEQ ID NO: 416917 - RNA, 32 nt, Human
gaagaaacgcggcccuguuccagccugucucg

SEQ ID NO: 416918 - RNA, 32 nt, Human
gaagaaacugauuaaagagcuauaccacauaa

SEQ ID NO: 416919 - RNA, 32 nt, Human
gaagaaacugauuuagaaaaugcuagagcuga

SEQ ID NO: 416920 - RNA, 32 nt, Human
gaagaaacuggauagucgagagcccagaguug

SEQ ID NO: 416921 - RNA, 32 nt, Human
gaagaaacuuccaaaaauaucuagguuugucc

SEQ ID NO: 416922 - RNA, 32 nt, Human
gaagaaagaaaggggaagcagugaagaaaggg

SEQ ID NO: 416923 - RNA, 32 nt, Human
gaagaaagaagagaaagguauagcuaacucau

SEQ ID NO: 416924 - RNA, 32 nt, Human
gaagaaagacuccuuuccugcaucuuucauag

SEQ ID NO: 416925 - RNA, 32 nt, Human
gaagaaagaguuccagagggaggcugaaccug

SEQ ID NO: 416926 - RNA, 32 nt, Human
gaagaaagaugggguguccuucugugcugaac

SEQ ID NO: 416927 - RNA, 32 nt, Human
gaagaaagauucacacugcaccaggagacauc

SEQ ID NO: 416928 - RNA, 32 nt, Human
gaagaaagauuguagguggcuuggggaaugug

SEQ ID NO: 416929 - RNA, 28 nt, Human
gaagaaagcagcccccaugucccagcca

SEQ ID NO: 416930 - RNA, 30 nt, Human
gaagaaagcuugcagcuagaaagaguggaa

SEQ ID NO: 416931 - RNA, 32 nt, Human
gaagaaaggaagagaaaugcaaagugugggca

SEQ ID NO: 416932 - RNA, 32 nt, Human
gaagaaaggaagcacaauuggcagguuaucac

SEQ ID NO: 416933 - RNA, 32 nt, Human
gaagaaaggagggggcaagggagaagcugcug

SEQ ID NO: 416934 - RNA, 31 nt, Human
gaagaaagggacuucccuugcccaggggccu

SEQ ID NO: 416935 - RNA, 32 nt, Human
gaagaaagggugacauuuauuuugacaaguuu

SEQ ID NO: 416936 - RNA, 32 nt, Human
gaagaaaggugaacuccuuuucucaagcacuu

SEQ ID NO: 416937 - RNA, 32 nt, Human
gaagaaaguccacccuugguuccuaacuggaa

SEQ ID NO: 416938 - RNA, 31 nt, Human
gaagaaagugagaagauagaguacuggauca

SEQ ID NO: 416939 - RNA, 24 nt, Human
gaagaaauaacucacaaucuuccu

SEQ ID NO: 416940 - RNA, 32 nt, Human
gaagaaauaagaaagaucugcagggaugaaaa

SEQ ID NO: 416941 - RNA, 24 nt, Human
gaagaaauagacaacgaucugccu

SEQ ID NO: 416942 - RNA, 24 nt, Human
gaagaaauauaguagaacccuuug

SEQ ID NO: 416943 - RNA, 32 nt, Human
gaagaaauccauaacacccccaccccaacacc

SEQ ID NO: 416944 - RNA, 32 nt, Human
gaagaaauccaucauaccauuaccucauccug

SEQ ID NO: 416945 - RNA, 32 nt, Human
gaagaaaucuggguggacaagacgcugcaguu

SEQ ID NO: 416946 - RNA, 32 nt, Human
gaagaaaugaaaggaagaggagcuugagaguc

SEQ ID NO: 416947 - RNA, 32 nt, Human
gaagaaaugaacacugguauuagacuuaaaga

SEQ ID NO: 416948 - RNA, 32 nt, Human
gaagaaaugaacagcaaggcugaagacagaga

SEQ ID NO: 416949 - RNA, 22 nt, Human
gaagaaaugaccccaucagcca

SEQ ID NO: 416950 - RNA, 22 nt, Human
gaagaaaugaccccaucggcca

SEQ ID NO: 416951 - RNA, 22 nt, Human
gaagaaaugaccccauuggcca

SEQ ID NO: 416952 - RNA, 32 nt, Human
gaagaaaugcagagccagccugugcugcccac

SEQ ID NO: 416953 - RNA, 32 nt, Human
gaagaaaugcuacugguuuuuaaaaagcaaag

SEQ ID NO: 416954 - RNA, 32 nt, Human
gaagaaauggaauucuggcuccugggucccua

SEQ ID NO: 416955 - RNA, 18 nt, Human
gaagaaauggcggccuug

SEQ ID NO: 416956 - RNA, 32 nt, Human
gaagaaaugggagggagcaggauggagagcag

SEQ ID NO: 416957 - RNA, 32 nt, Human
gaagaaauuagccaagugugguggugcaugcc

SEQ ID NO: 416958 - RNA, 32 nt, Human
gaagaacaaagaauggggauguaaccauacgg

SEQ ID NO: 416959 - RNA, 32 nt, Human
gaagaacaaagucacuuugauuugaagugaga

SEQ ID NO: 416960 - RNA, 32 nt, Human
gaagaacaccaggaaagacagacaggaccagu

SEQ ID NO: 416961 - RNA, 31 nt, Human
gaagaacagagaccugucuggaaaaucgauc

SEQ ID NO: 416962 - RNA, 32 nt, Human
gaagaacagagcaguggcacuggaccuccugu

SEQ ID NO: 416963 - RNA, 32 nt, Human
gaagaacagagccagggaaagaauggugggga

SEQ ID NO: 416964 - RNA, 32 nt, Human
gaagaacagucggcucccaguguggucaugag

SEQ ID NO: 416965 - RNA, 32 nt, Human
gaagaacaucuggaguuggagccgcacaucug

SEQ ID NO: 416966 - RNA, 32 nt, Human
gaagaacauucuuuucaauggagcucaucuuc

SEQ ID NO: 416967 - RNA, 32 nt, Human
gaagaaccagagagaaauggaucccugagcuc

SEQ ID NO: 416968 - RNA, 32 nt, Human
gaagaaccagagaggcucugagaaaccucggg

SEQ ID NO: 416969 - RNA, 32 nt, Human
gaagaaccaggcccaagacuuuaccauucuga

SEQ ID NO: 416970 - RNA, 32 nt, Human
gaagaaccaguccugccaacaucuugaucuug

SEQ ID NO: 416971 - RNA, 32 nt, Human
gaagaaccauacucuuuccacugacaugaucc

SEQ ID NO: 416972 - RNA, 32 nt, Human
gaagaacccaggcgccugagccccagcuccgg

SEQ ID NO: 416973 - RNA, 32 nt, Human
gaagaacccccuucauguucauuaauauucuc

SEQ ID NO: 416974 - RNA, 32 nt, Human
gaagaaccuagaggccugguuugcuuuggugg

SEQ ID NO: 416975 - RNA, 32 nt, Human
gaagaacggaagggagggaaagacaaauuucu

SEQ ID NO: 416976 - RNA, 32 nt, Human
gaagaacguggcgaaaccccguaucuauuauu

SEQ ID NO: 416977 - RNA, 32 nt, Human
gaagaacucgaauuugaugaccaguuugagaa

SEQ ID NO: 416978 - RNA, 23 nt, Human
gaagaacucugaaccagaaguca

SEQ ID NO: 416979 - RNA, 32 nt, Human
gaagaacuggaaccccagcuucccuccagccu

SEQ ID NO: 416980 - RNA, 32 nt, Human
gaagaacuggagaaauaccagcaaagggcugu

SEQ ID NO: 416981 - RNA, 32 nt, Human
gaagaacuggugagccaagggaucaugccgcc

SEQ ID NO: 416982 - RNA, 32 nt, Human
gaagaacuguuuggcaagagagagaaguucga

SEQ ID NO: 416983 - RNA, 32 nt, Human
gaagaacuucauaucugaguaccauuugccau

SEQ ID NO: 416984 - RNA, 32 nt, Human
gaagaacuuucagccaauaaagcuugugcuuc

SEQ ID NO: 416985 - RNA, 32 nt, Human
gaagaagaaagccaggacuggagcagacgacg

SEQ ID NO: 416986 - RNA, 32 nt, Human
gaagaagaaagccaugcuuagaauggugcuuc

SEQ ID NO: 416987 - RNA, 32 nt, Human
gaagaagaagaaaagaaagaaagaaagaaaga

SEQ ID NO: 416988 - RNA, 23 nt, Human
gaagaagaagaaacccagcuuuc

SEQ ID NO: 416989 - RNA, 32 nt, Human
gaagaagaagaagaggaggaggaggaggagga

SEQ ID NO: 416990 - RNA, 32 nt, Human
gaagaagaagaaggaagagcagcagcgucugg

SEQ ID NO: 416991 - RNA, 32 nt, Human
gaagaagaagacgaaggaggaggacacacuuu

SEQ ID NO: 416992 - RNA, 32 nt, Human
gaagaagaagaggaagaaagaacaguagaaaa

SEQ ID NO: 416993 - RNA, 32 nt, Human
gaagaagaagaggaggaggaggaggaggaaga

SEQ ID NO: 416994 - RNA, 32 nt, Human
gaagaagaaggaggaggaggaggaggaggagg

SEQ ID NO: 416995 - RNA, 32 nt, Human
gaagaagaaggaugaagaagaccucuggaucu

SEQ ID NO: 416996 - RNA, 32 nt, Human
gaagaagaagucaggucagcagaaaauuccuc

SEQ ID NO: 416997 - RNA, 32 nt, Human
gaagaagaagugaaauauaaauauguauacau

SEQ ID NO: 416998 - RNA, 32 nt, Human
gaagaagaaugaaguccaggaggagaagggcu

SEQ ID NO: 416999 - RNA, 32 nt, Human
gaagaagacucagcuggugaaggcucaguacu

SEQ ID NO: 417000 - RNA, 32 nt, Human
gaagaagacugaugagacuaggugcuuugcuu

SEQ ID NO: 417001 - RNA, 32 nt, Human
gaagaagagagaggagaagaggaggaggcaga

SEQ ID NO: 417002 - RNA, 32 nt, Human
gaagaagagcuuggugaagaagaaagggguca

SEQ ID NO: 417003 - RNA, 32 nt, Human
gaagaagaggaagaggaaagaaaaggagucag

SEQ ID NO: 417004 - RNA, 32 nt, Human
gaagaagaggaagaggaaagaaagacaaguca

SEQ ID NO: 417005 - RNA, 32 nt, Human
gaagaagaggagaccuaggaaugaccuuguaa

SEQ ID NO: 417006 - RNA, 32 nt, Human
gaagaagaggaggaggaggagaugguggccga

SEQ ID NO: 417007 - RNA, 32 nt, Human
gaagaagaggaggaggaggaggaggaagaaga

SEQ ID NO: 417008 - RNA, 32 nt, Human
gaagaagaggaggaggaggaggaggaggagga

SEQ ID NO: 417009 - RNA, 32 nt, Human
gaagaagaggaugaggaugagauggaagagga

SEQ ID NO: 417010 - RNA, 32 nt, Human
gaagaagaggguggagcaggaggcucucacug

SEQ ID NO: 417011 - RNA, 32 nt, Human
gaagaagaguuugccaggaaacuacaggaaca

SEQ ID NO: 417012 - RNA, 32 nt, Human
gaagaagaucccuaauaugggucaagauccag

SEQ ID NO: 417013 - RNA, 32 nt, Human
gaagaagaucccuauaugggucaagauccaga

SEQ ID NO: 417014 - RNA, 32 nt, Human
gaagaagauggcccagcuccccaagaaagccu

SEQ ID NO: 417015 - RNA, 32 nt, Human
gaagaagauuccaggaagaggaaacaauacgu

SEQ ID NO: 417016 - RNA, 18 nt, Human
gaagaagcaaaccugaua

SEQ ID NO: 417017 - RNA, 32 nt, Human
gaagaagcaagaccaugguggggaagaugugg

SEQ ID NO: 417018 - RNA, 32 nt, Human
gaagaagcaauacccaaccccaccaaagaaaa

SEQ ID NO: 417019 - RNA, 24 nt, Human
gaagaagcagaaggagcaggagca

SEQ ID NO: 417020 - RNA, 32 nt, Human
gaagaagcagaggaacuucucaucuugcugaa

SEQ ID NO: 417021 - RNA, 32 nt, Human
gaagaagcagccgccgcagccccgguggaaac

SEQ ID NO: 417022 - RNA, 32 nt, Human
gaagaagccaagaggucauuuguggucauugu

SEQ ID NO: 417023 - RNA, 32 nt, Human
gaagaagccccgccaccagcagcuucugccau

SEQ ID NO: 417024 - RNA, 32 nt, Human
gaagaagccuucuuuucuuucuucuaugugaa

SEQ ID NO: 417025 - RNA, 32 nt, Human
gaagaagcuaugcugcuucccagccuggcuuc

SEQ ID NO: 417026 - RNA, 32 nt, Human
gaagaagcucccaggcagcaugugggauggac

SEQ ID NO: 417027 - RNA, 32 nt, Human
gaagaagcugagcuauuggaacaggaaauaga

SEQ ID NO: 417028 - RNA, 32 nt, Human
gaagaagcuguucacggugugauaauacucuu

SEQ ID NO: 417029 - RNA, 32 nt, Human
gaagaaggaaaaagacaaaaaggaagucugga

SEQ ID NO: 417030 - RNA, 31 nt, Human
gaagaaggaacgagagaaagagugagaggaa

SEQ ID NO: 417031 - RNA, 32 nt, Human
gaagaaggaagaaggagaaggaagaggaggaa

SEQ ID NO: 417032 - RNA, 32 nt, Human
gaagaaggaagaggaaagggaggaggaggauu

SEQ ID NO: 417033 - RNA, 32 nt, Human
gaagaaggaaguaaggaggaaaaaggaagaau

SEQ ID NO: 417034 - RNA, 32 nt, Human
gaagaaggaaguaggaaggagggaggaggaag

SEQ ID NO: 417035 - RNA, 21 nt, Human
gaagaaggaagugaacccuca

SEQ ID NO: 417036 - RNA, 32 nt, Human
gaagaaggagaucagacagggggagggcugac

SEQ ID NO: 417037 - RNA, 32 nt, Human
gaagaaggaggaagaaagaaggagaaggaaga

SEQ ID NO: 417038 - RNA, 32 nt, Human
gaagaaggaggaggaggaggaggaggaggagg

SEQ ID NO: 417039 - RNA, 32 nt, Human
gaagaaggagggaaggaaguagggaggcaggg

SEQ ID NO: 417040 - RNA, 32 nt, Human
gaagaaggcagugcuggaggugcagguggcau

SEQ ID NO: 417041 - RNA, 32 nt, Human
gaagaaggcuccucucuccaucgcaccccauc

SEQ ID NO: 417042 - RNA, 32 nt, Human
gaagaagggaaagcuuuggcagaaucuuggaa

SEQ ID NO: 417043 - RNA, 32 nt, Human
gaagaagggagaagaaaggugaguuugagcug

SEQ ID NO: 417044 - RNA, 32 nt, Human
gaagaaggggagaggagguugugugggacaag

SEQ ID NO: 417045 - RNA, 32 nt, Human
gaagaaggggcgggguaugggagaagccuccc

SEQ ID NO: 417046 - RNA, 32 nt, Human
gaagaagggugaggacagcaccagacuuagcc

SEQ ID NO: 417047 - RNA, 18 nt, Human
gaagaaggguggagagga

SEQ ID NO: 417048 - RNA, 32 nt, Human
gaagaagguaauucuaacccacacauugucau

SEQ ID NO: 417049 - RNA, 32 nt, Human
gaagaaggucagcaggguucauuuaaauggau

SEQ ID NO: 417050 - RNA, 32 nt, Human
gaagaaggugugggacaagaagaaaggguauu

SEQ ID NO: 417051 - RNA, 32 nt, Human
gaagaaguaggggagaggagaggacucagcgg

SEQ ID NO: 417052 - RNA, 32 nt, Human
gaagaagucacagaucuaaagaggcaagcagu

SEQ ID NO: 417053 - RNA, 32 nt, Human
gaagaagucugaggcagacggugaggguggcc

SEQ ID NO: 417054 - RNA, 32 nt, Human
gaagaagugaugccaccaucucuagccauaau

SEQ ID NO: 417055 - RNA, 32 nt, Human
gaagaaguggggugggacaacagugaaaucua

SEQ ID NO: 417056 - RNA, 32 nt, Human
gaagaaguggggugggacgacagugaaaucua

SEQ ID NO: 417057 - RNA, 32 nt, Human
gaagaaguuaggaggaagaagggggaaaaagg

SEQ ID NO: 417058 - RNA, 32 nt, Human
gaagaaguuccacuuuuugcccaaggucauuc

SEQ ID NO: 417059 - RNA, 32 nt, Human
gaagaaguugaggacggucugccuucccucgu

SEQ ID NO: 417060 - RNA, 32 nt, Human
gaagaaguugccagagguuccacccucugagg

SEQ ID NO: 417061 - RNA, 32 nt, Human
gaagaauaacauccauugucauacagcuccaa

SEQ ID NO: 417062 - RNA, 32 nt, Human
gaagaauacugauguuuaccuguauuugcuuu

SEQ ID NO: 417063 - RNA, 32 nt, Human
gaagaauaucacaauucuaauguaauaauaua

SEQ ID NO: 417064 - RNA, 32 nt, Human
gaagaauaucuuucuagcccucagccacuaca

SEQ ID NO: 417065 - RNA, 32 nt, Human
gaagaaucagccuggcagcagcauugugauua

SEQ ID NO: 417066 - RNA, 32 nt, Human
gaagaaucauucuucuuuuucaugcauuuguc

SEQ ID NO: 417067 - RNA, 32 nt, Human
gaagaauccagagaaaucagagcaggucaaau

SEQ ID NO: 417068 - RNA, 32 nt, Human
gaagaaucccaccucagugaaaugcuacaacu

SEQ ID NO: 417069 - RNA, 32 nt, Human
gaagaaucuacaaccuggagcauuucagguuu

SEQ ID NO: 417070 - RNA, 32 nt, Human
gaagaaucugaccaguaucuugcaguguugac

SEQ ID NO: 417071 - RNA, 32 nt, Human
gaagaaucuuuccuuuguccuguucuaaccua

SEQ ID NO: 417072 - RNA, 32 nt, Human
gaagaaugaaggaggaagaaggcaguagaaag

SEQ ID NO: 417073 - RNA, 32 nt, Human
gaagaaugaccucaccauccagcugcaggcug

SEQ ID NO: 417074 - RNA, 32 nt, Human
gaagaaugagacauugaaaacaugcacagugg

SEQ ID NO: 417075 - RNA, 32 nt, Human
gaagaaugagggugagcagacaucugggcaag

SEQ ID NO: 417076 - RNA, 32 nt, Human
gaagaaugcaaaccaggugaugguuucaaugc

SEQ ID NO: 417077 - RNA, 32 nt, Human
gaagaauggaauuggagauuguagacgugguu

SEQ ID NO: 417078 - RNA, 32 nt, Human
gaagaauggcagacuauugaacagguguauuu

SEQ ID NO: 417079 - RNA, 32 nt, Human
gaagaauggcgaggggagagcagaggagaagg

SEQ ID NO: 417080 - RNA, 32 nt, Human
gaagaaugggaaagagaaagagacagagacug

SEQ ID NO: 417081 - RNA, 32 nt, Human
gaagaauggggugagaggagacaugaggaaag

SEQ ID NO: 417082 - RNA, 32 nt, Human
gaagaauggguagaauaaagauuugauguggu

SEQ ID NO: 417083 - RNA, 32 nt, Human
gaagaauggugccaccacucaagcaacaagcc

SEQ ID NO: 417084 - RNA, 32 nt, Human
gaagaauggugucccauccuugcaagguaaug

SEQ ID NO: 417085 - RNA, 32 nt, Human
gaagaaugugcuccaggaugcuucaguagaaa

SEQ ID NO: 417086 - RNA, 32 nt, Human
gaagaauguugucagaaguagggaguaggcac

SEQ ID NO: 417087 - RNA, 32 nt, Human
gaagaauucacucagaccuucauggcugcaau

SEQ ID NO: 417088 - RNA, 32 nt, Human
gaagaauucuccaaacauuguggacugucucu

SEQ ID NO: 417089 - RNA, 32 nt, Human
gaagaauugaaggcgggaaugcauauggacag

SEQ ID NO: 417090 - RNA, 32 nt, Human
gaagaauuggcaccuuccuagggaaggagacg

SEQ ID NO: 417091 - RNA, 32 nt, Human
gaagaauuggcuuccuuucuugaaagugguga

SEQ ID NO: 417092 - RNA, 20 nt, Human
gaagaauuuucuucuugcca

SEQ ID NO: 417093 - RNA, 32 nt, Human
gaagacaaaaggaagaaagaagaggagaggug

SEQ ID NO: 417094 - RNA, 32 nt, Human
gaagacaaagagauccgauuucccugggacug

SEQ ID NO: 417095 - RNA, 32 nt, Human
gaagacaaaugaagagaaugcauuuugagcau

SEQ ID NO: 417096 - RNA, 32 nt, Human
gaagacaagaccgaaggagcugauggguagag

SEQ ID NO: 417097 - RNA, 32 nt, Human
gaagacaagagaucucugcucaguccuggcug

SEQ ID NO: 417098 - RNA, 32 nt, Human
gaagacaagauccuaauuccugucauuaguga

SEQ ID NO: 417099 - RNA, 32 nt, Human
gaagacaagaugggcaccuacucuacaauucu

SEQ ID NO: 417100 - RNA, 32 nt, Human
gaagacaagucaggccucagaaacccagccaa

SEQ ID NO: 417101 - RNA, 32 nt, Human
gaagacaaguggcugcuaccuucuguuaucgu

SEQ ID NO: 417102 - RNA, 22 nt, Human
gaagacacaaagcauuguugca

SEQ ID NO: 417103 - RNA, 32 nt, Human
gaagacacagagagaagagggccgaggagaga

SEQ ID NO: 417104 - RNA, 32 nt, Human
gaagacacaggccuuccucagcacccguguca

SEQ ID NO: 417105 - RNA, 31 nt, Human
gaagacacaguguccauccucccagauugga

SEQ ID NO: 417106 - RNA, 21 nt, Human
gaagacaccaggacaaugaca

SEQ ID NO: 417107 - RNA, 23 nt, Human
gaagacacgcgcuagaaaucgca

SEQ ID NO: 417108 - RNA, 23 nt, Human
gaagacacugaugagacugagga

SEQ ID NO: 417109 - RNA, 32 nt, Human
gaagacacuuuauucguuuauauugugagaaa

SEQ ID NO: 417110 - RNA, 32 nt, Human
gaagacagaaccuggucuucugauucccugug

SEQ ID NO: 417111 - RNA, 32 nt, Human
gaagacagaacugcucucucugaccuucuuca

SEQ ID NO: 417112 - RNA, 32 nt, Human
gaagacagaagaaugaaagaaguguuuugaaa

SEQ ID NO: 417113 - RNA, 32 nt, Human
gaagacagacccacagcccugcccuugucucu

SEQ ID NO: 417114 - RNA, 32 nt, Human
gaagacagacuggcagggcagcaccuccauag

SEQ ID NO: 417115 - RNA, 32 nt, Human
gaagacagagguggaggcaggagccaguggcu

SEQ ID NO: 417116 - RNA, 32 nt, Human
gaagacagagguggcaggacaaggaagaggac

SEQ ID NO: 417117 - RNA, 32 nt, Human
gaagacagcauuccacagccuggucaggaggg

SEQ ID NO: 417118 - RNA, 32 nt, Human
gaagacagcgggccuggcugggcaucccugug

SEQ ID NO: 417119 - RNA, 19 nt, Human
gaagacagcuguagagcaa

SEQ ID NO: 417120 - RNA, 32 nt, Human
gaagacaggaagaaaggaagagagggaaguaa

SEQ ID NO: 417121 - RNA, 22 nt, Human
gaagacaggagcugcagaacag

SEQ ID NO: 417122 - RNA, 32 nt, Human
gaagacaggcagcauggaaggcaugguggaga

SEQ ID NO: 417123 - RNA, 32 nt, Human
gaagacaggcagccaggggcuguggggagaca

SEQ ID NO: 417124 - RNA, 32 nt, Human
gaagacaggcaguggggcucucacuugggaaa

SEQ ID NO: 417125 - RNA, 32 nt, Human
gaagacaggcuucccuuccuucccccuccuua

SEQ ID NO: 417126 - RNA, 32 nt, Human
gaagacaggucacucuccccuaggcaguuccu

SEQ ID NO: 417127 - RNA, 32 nt, Human
gaagacaguaaauauuaggcugugggcugcug

SEQ ID NO: 417128 - RNA, 32 nt, Human
gaagacaguagaaauuccacugguaaauggcc

SEQ ID NO: 417129 - RNA, 32 nt, Human
gaagacagucaugggaccucagggagccagga

SEQ ID NO: 417130 - RNA, 32 nt, Human
gaagacagugcagccacccagccuuuaccagc

SEQ ID NO: 417131 - RNA, 32 nt, Human
gaagacaguuccaaaccacacacaaagcacaa

SEQ ID NO: 417132 - RNA, 32 nt, Human
gaagacauaaaggaauaaugauacauuaaaau

SEQ ID NO: 417133 - RNA, 32 nt, Human
gaagacauaagaaaaucuuaguaacuaccaga

SEQ ID NO: 417134 - RNA, 19 nt, Human
gaagacaucaaccuccgcc

SEQ ID NO: 417135 - RNA, 32 nt, Human
gaagacaucccacacccccacccagcacacac

SEQ ID NO: 417136 - RNA, 32 nt, Human
gaagacaucuuccuucucugccucggcuuccu

SEQ ID NO: 417137 - RNA, 32 nt, Human
gaagacaugaagcgcugagcugagggacgagg

SEQ ID NO: 417138 - RNA, 32 nt, Human
gaagacauucccaagugccuguccuuauugga

SEQ ID NO: 417139 - RNA, 22 nt, Human
gaagaccaagcccccuccuccu

SEQ ID NO: 417140 - RNA, 31 nt, Human
gaagaccacagcuagacggacaaacagcauu

SEQ ID NO: 417141 - RNA, 31 nt, Human
gaagaccacagcuagauggacaaacagcauu

SEQ ID NO: 417142 - RNA, 32 nt, Human
gaagaccacuaaagagagacaccaagaaugga

SEQ ID NO: 417143 - RNA, 32 nt, Human
gaagaccacugcacaccuucuaguaacacugc

SEQ ID NO: 417144 - RNA, 32 nt, Human
gaagaccagcaguaaguucuguuuuucugugg

SEQ ID NO: 417145 - RNA, 32 nt, Human
gaagaccagcugaggcagaggcugcaaggggu

SEQ ID NO: 417146 - RNA, 32 nt, Human
gaagaccaggguaugggcacuuuugccuucuc

SEQ ID NO: 417147 - RNA, 32 nt, Human
gaagaccagguggcaggucgcaguuggguacc

SEQ ID NO: 417148 - RNA, 32 nt, Human
gaagaccauauuucauagcagacuucaauuuu

SEQ ID NO: 417149 - RNA, 22 nt, Human
gaagaccauuagguggccucca

SEQ ID NO: 417150 - RNA, 25 nt, Human
gaagacccaagcuuucccuccgcca

SEQ ID NO: 417151 - RNA, 32 nt, Human
gaagacccaagugaguuugaaacaccugcucu

SEQ ID NO: 417152 - RNA, 31 nt, Human
gaagacccacguguagccacagcagagucua

SEQ ID NO: 417153 - RNA, 32 nt, Human
gaagacccagcaggaagccaggcugagugagc

SEQ ID NO: 417154 - RNA, 32 nt, Human
gaagacccaucuuaaagcuaaguuuacccaag

SEQ ID NO: 417155 - RNA, 32 nt, Human
gaagacccugcuuaaagggccccacaccacag

SEQ ID NO: 417156 - RNA, 32 nt, Human
gaagaccgaagcacuccuuccccuggcaggca

SEQ ID NO: 417157 - RNA, 32 nt, Human
gaagaccgcguccugaauuucuucacuagagc

SEQ ID NO: 417158 - RNA, 32 nt, Human
gaagaccgggaaaaagggaguacuggagccag

SEQ ID NO: 417159 - RNA, 32 nt, Human
gaagaccggggugacaagcagauacugcugug

SEQ ID NO: 417160 - RNA, 32 nt, Human
gaagaccuagaacauauccucagcaagaaaca

SEQ ID NO: 417161 - RNA, 32 nt, Human
gaagaccuagaagaggaugaggauuucauucc

SEQ ID NO: 417162 - RNA, 32 nt, Human
gaagaccucagggucucagaaaguaggcaggg

SEQ ID NO: 417163 - RNA, 32 nt, Human
gaagaccucccaggucucaguggaacuugcuc

SEQ ID NO: 417164 - RNA, 32 nt, Human
gaagaccuccggcucuugucaggcucuugucu

SEQ ID NO: 417165 - RNA, 32 nt, Human
gaagaccugccaggaagauuaaauggugaagg

SEQ ID NO: 417166 - RNA, 32 nt, Human
gaagaccuggaguucaagauuucugaugagga

SEQ ID NO: 417167 - RNA, 32 nt, Human
gaagaccuggggagcaguggcaggaggagaca

SEQ ID NO: 417168 - RNA, 32 nt, Human
gaagaccuggguggaaagcgguuuggaugaaa

SEQ ID NO: 417169 - RNA, 25 nt, Human
gaagaccuucagguuuccuccuccu

SEQ ID NO: 417170 - RNA, 32 nt, Human
gaagaccuucuagaagagaugauggugggaga

SEQ ID NO: 417171 - RNA, 32 nt, Human
gaagaccuucuggugugggcugggcagcaauu

SEQ ID NO: 417172 - RNA, 32 nt, Human
gaagaccuuuccugccagcuuccagggcucuu

SEQ ID NO: 417173 - RNA, 32 nt, Human
gaagaccuuugucuucuucaucuggcgccggu

SEQ ID NO: 417174 - RNA, 32 nt, Human
gaagacgacagccuggccaaccaagggaaagg

SEQ ID NO: 417175 - RNA, 32 nt, Human
gaagacgagguucugcggagagagaggcucca

SEQ ID NO: 417176 - RNA, 18 nt, Human
gaagacgagugaucugaa

SEQ ID NO: 417177 - RNA, 32 nt, Human
gaagacgaugggcagaggagugacagccgcag

SEQ ID NO: 417178 - RNA, 32 nt, Human
gaagacgcugaggaggaggaggaggcggagga

SEQ ID NO: 417179 - RNA, 32 nt, Human
gaagacgcuuccuggguuugaggaguucagug

SEQ ID NO: 417180 - RNA, 32 nt, Human
gaagacggagcugccccagcuguggcuggggg

SEQ ID NO: 417181 - RNA, 31 nt, Human
gaagacggcaaagguauuggggaucacaugg

SEQ ID NO: 417182 - RNA, 32 nt, Human
gaagacggcacuaggacccagggaaguccccg

SEQ ID NO: 417183 - RNA, 32 nt, Human
gaagacgggagagagguauuuagaugauaagu

SEQ ID NO: 417184 - RNA, 32 nt, Human
gaagacggggaagggaaaagaaacccauagca

SEQ ID NO: 417185 - RNA, 32 nt, Human
gaagacgguaauguucuucuacucacuucaca

SEQ ID NO: 417186 - RNA, 32 nt, Human
gaagacgguguuuugccauguugggcaggcug

SEQ ID NO: 417187 - RNA, 31 nt, Human
gaagacguacuucaucgucaugcagagcguc

SEQ ID NO: 417188 - RNA, 32 nt, Human
gaagacguagucaugcagcacgucagcagcuc

SEQ ID NO: 417189 - RNA, 32 nt, Human
gaagacgucuccccuucucugccucaccuggu

SEQ ID NO: 417190 - RNA, 32 nt, Human
gaagacuaagagucccaugaagugggcaccau

SEQ ID NO: 417191 - RNA, 32 nt, Human
gaagacuacaaaccaccaucuaccaucugcca

SEQ ID NO: 417192 - RNA, 32 nt, Human
gaagacuagccuacuucaucucaggacccgcc

SEQ ID NO: 417193 - RNA, 32 nt, Human
gaagacuaugggguaccugaugaggacaagag

SEQ ID NO: 417194 - RNA, 32 nt, Human
gaagacuauguacagagacugaccucacagac

SEQ ID NO: 417195 - RNA, 18 nt, Human
gaagacucaagccugcca

SEQ ID NO: 417196 - RNA, 32 nt, Human
gaagacucacuggccgaauggcagcaguagau

SEQ ID NO: 417197 - RNA, 32 nt, Human
gaagacucagcaacuccagccucuguagcauu

SEQ ID NO: 417198 - RNA, 32 nt, Human
gaagacucagcaggaacaagguaggcuucaaa

SEQ ID NO: 417199 - RNA, 32 nt, Human
gaagacucagcccagcgaagcucauucccuua

SEQ ID NO: 417200 - RNA, 16 nt, Human
gaagacucagcccgcc

SEQ ID NO: 417201 - RNA, 20 nt, Human
gaagacucaggagucugcca

SEQ ID NO: 417202 - RNA, 32 nt, Human
gaagacucagugccaaggaaaggggcuucuug

SEQ ID NO: 417203 - RNA, 32 nt, Human
gaagacucaucugaaguaucacagacuccuau

SEQ ID NO: 417204 - RNA, 21 nt, Human
gaagacuccccugccucccca

SEQ ID NO: 417205 - RNA, 16 nt, Human
gaagacucgccccacc

SEQ ID NO: 417206 - RNA, 18 nt, Human
gaagacucgcccucgcca

SEQ ID NO: 417207 - RNA, 18 nt, Human
gaagacucuccacugacc

SEQ ID NO: 417208 - RNA, 21 nt, Human
gaagacucuccgccccacgcc

SEQ ID NO: 417209 - RNA, 20 nt, Human
gaagacucuccuugaggcca

SEQ ID NO: 417210 - RNA, 19 nt, Human
gaagacucucugagcgacc

SEQ ID NO: 417211 - RNA, 32 nt, Human
gaagacucucuuuuugcccucgggaaaaagca

SEQ ID NO: 417212 - RNA, 32 nt, Human
gaagacucuggacacugaacugacuuuggaac

SEQ ID NO: 417213 - RNA, 19 nt, Human
gaagacucuuccccugcca

SEQ ID NO: 417214 - RNA, 32 nt, Human
gaagacucuugccuuuuuccugggcaacucua

SEQ ID NO: 417215 - RNA, 20 nt, Human
gaagacucuugcuuccacca

SEQ ID NO: 417216 - RNA, 32 nt, Human
gaagacucuuggccaggcagauggcuucucgg

SEQ ID NO: 417217 - RNA, 32 nt, Human
gaagacugaaagcaagguggcccagugugggg

SEQ ID NO: 417218 - RNA, 32 nt, Human
gaagacugaaguuugaugaagucugguuuaag

SEQ ID NO: 417219 - RNA, 32 nt, Human
gaagacugaauggagcucuguauacauucuag

SEQ ID NO: 417220 - RNA, 32 nt, Human
gaagacugaggcaggagaauggcgugaaccca

SEQ ID NO: 417221 - RNA, 32 nt, Human
gaagacugaggcaggaggaucguuugagcuca

SEQ ID NO: 417222 - RNA, 32 nt, Human
gaagacugaggcuggaggaucgcuugagccca

SEQ ID NO: 417223 - RNA, 32 nt, Human
gaagacugaugccaccaccugaaggcucauga

SEQ ID NO: 417224 - RNA, 32 nt, Human
gaagacugcuagacuuuaggcaaggggaucac

SEQ ID NO: 417225 - RNA, 31 nt, Human
gaagacugcuccugguggccugugcauaggg

SEQ ID NO: 417226 - RNA, 25 nt, Human
gaagacuggaaagagacauaucucu

SEQ ID NO: 417227 - RNA, 32 nt, Human
gaagacuggcuuucggcucacaguuuaaaaug

SEQ ID NO: 417228 - RNA, 32 nt, Human
gaagacugggcaacauauuuaagauuuccagc

SEQ ID NO: 417229 - RNA, 32 nt, Human
gaagacuggggcagcaguuggggaagugucug

SEQ ID NO: 417230 - RNA, 22 nt, Human
gaagacuggggcugaguaguua

SEQ ID NO: 417231 - RNA, 23 nt, Human
gaagacugguuaauuauaaguua

SEQ ID NO: 417232 - RNA, 32 nt, Human
gaagacuguacucugcagccugccuuccuaga

SEQ ID NO: 417233 - RNA, 32 nt, Human
gaagacuguaggcugguuacaucccccuaguu

SEQ ID NO: 417234 - RNA, 32 nt, Human
gaagacugucagaaucauccuccaucacuaga

SEQ ID NO: 417235 - RNA, 32 nt, Human
gaagacuucagcacacaugucagcauugacug

SEQ ID NO: 417236 - RNA, 32 nt, Human
gaagacuuccgguuggucgaggaacugagggu

SEQ ID NO: 417237 - RNA, 32 nt, Human
gaagacuuccucacgguaauggagauuguagu

SEQ ID NO: 417238 - RNA, 32 nt, Human
gaagacuuccuugaauuuccuugacauuuuuc

SEQ ID NO: 417239 - RNA, 32 nt, Human
gaagacuucuuggguaguuuagaucccauguc

SEQ ID NO: 417240 - RNA, 32 nt, Human
gaagacuugacggagccucacuuuaaaaacaa

SEQ ID NO: 417241 - RNA, 32 nt, Human
gaagacuuggccuuuucucugccugcaugucc

SEQ ID NO: 417242 - RNA, 32 nt, Human
gaagacuuggguccuugggucgcaggugggag

SEQ ID NO: 417243 - RNA, 22 nt, Human
gaagacuugucagaccaucaau

SEQ ID NO: 417244 - RNA, 32 nt, Human
gaagacuuuacagauguccucuguaaauagca

SEQ ID NO: 417245 - RNA, 21 nt, Human
gaagacuuuugccuccgucca

SEQ ID NO: 417246 - RNA, 32 nt, Human
gaagacuuuuguuaugaggagcugcagauuag

SEQ ID NO: 417247 - RNA, 32 nt, Human
gaagagaaaagcauaggaaaggaaacaguggu

SEQ ID NO: 417248 - RNA, 32 nt, Human
gaagagaaaagggagucaugcauuuugcuuug

SEQ ID NO: 417249 - RNA, 32 nt, Human
gaagagaaagagaucaggcaacagugauucua

SEQ ID NO: 417250 - RNA, 32 nt, Human
gaagagaaagaggaggagaauuaagaagagga

SEQ ID NO: 417251 - RNA, 32 nt, Human
gaagagaaaggaagagccagcaguucuuucuc

SEQ ID NO: 417252 - RNA, 31 nt, Human
gaagagaaaguguccaguagggcggaggcgg

SEQ ID NO: 417253 - RNA, 32 nt, Human
gaagagaaauggagaauaagcagcacaguguu

SEQ ID NO: 417254 - RNA, 32 nt, Human
gaagagaacaaaaggcaaaggaaggaggaauu

SEQ ID NO: 417255 - RNA, 32 nt, Human
gaagagaacgcgagaagggaagaugggggccg

SEQ ID NO: 417256 - RNA, 32 nt, Human
gaagagaacugugagaauacaggaagccccca

SEQ ID NO: 417257 - RNA, 32 nt, Human
gaagagaagaaaauggaggagaggaggggacu

SEQ ID NO: 417258 - RNA, 23 nt, Human
gaagagaagaccaagcccuggga

SEQ ID NO: 417259 - RNA, 32 nt, Human
gaagagaagagaggagucaacccaggggagca

SEQ ID NO: 417260 - RNA, 32 nt, Human
gaagagaagauugaccaaaccauccaaaugcc

SEQ ID NO: 417261 - RNA, 22 nt, Human
gaagagaagcccagcucuggga

SEQ ID NO: 417262 - RNA, 32 nt, Human
gaagagaaggacaaacuuaaaaggugaaaaga

SEQ ID NO: 417263 - RNA, 16 nt, Human
gaagagaaguugcaga

SEQ ID NO: 417264 - RNA, 32 nt, Human
gaagagaaugugccaauacauugguagauccu

SEQ ID NO: 417265 - RNA, 32 nt, Human
gaagagacaaaggagacuccugagggauuuag

SEQ ID NO: 417266 - RNA, 32 nt, Human
gaagagacaauagcauuagaaauaagugauua

SEQ ID NO: 417267 - RNA, 17 nt, Human
gaagagacaccagagac

SEQ ID NO: 417268 - RNA, 32 nt, Human
gaagagacaggaguggaccaggagagguccag

SEQ ID NO: 417269 - RNA, 32 nt, Human
gaagagacagugugggcugagagcagagggag

SEQ ID NO: 417270 - RNA, 31 nt, Human
gaagagacaucacccaguaggagggaguacg

SEQ ID NO: 417271 - RNA, 32 nt, Human
gaagagacaugcaagcuggcuggagugcagag

SEQ ID NO: 417272 - RNA, 31 nt, Human
gaagagaccauauuuguucgcagaggaagcc

SEQ ID NO: 417273 - RNA, 20 nt, Human
gaagagaccccggcggcggc

SEQ ID NO: 417274 - RNA, 32 nt, Human
gaagagaccccucuccccagugccccacaucu

SEQ ID NO: 417275 - RNA, 19 nt, Human
gaagagaccuugaaaggac

SEQ ID NO: 417276 - RNA, 32 nt, Human
gaagagacggaugaugaacaagcuuuacaucg

SEQ ID NO: 417277 - RNA, 32 nt, Human
gaagagacugacacaagagauguaaaaaggca

SEQ ID NO: 417278 - RNA, 32 nt, Human
gaagagacugcugguaguccucggcaggaagu

SEQ ID NO: 417279 - RNA, 32 nt, Human
gaagagacuucuucccuucaggcuuauuguuu

SEQ ID NO: 417280 - RNA, 32 nt, Human
gaagagagaagaggaagaggaagaggaagaga

SEQ ID NO: 417281 - RNA, 32 nt, Human
gaagagagaaggaggaaaagaagcaguuccug

SEQ ID NO: 417282 - RNA, 32 nt, Human
gaagagagaagggagagggaggaggccggggc

SEQ ID NO: 417283 - RNA, 32 nt, Human
gaagagagaggaagggagaagggagaggaaug

SEQ ID NO: 417284 - RNA, 32 nt, Human
gaagagagaggaagggugagggugaggcgugu

SEQ ID NO: 417285 - RNA, 21 nt, Human
gaagagagaggagaagaggag

SEQ ID NO: 417286 - RNA, 32 nt, Human
gaagagagagggaugagagggagggagaggag

SEQ ID NO: 417287 - RNA, 32 nt, Human
gaagagagagugagaagggggaagcaccagac

SEQ ID NO: 417288 - RNA, 32 nt, Human
gaagagagcaagggauuuccugggacaucugg

SEQ ID NO: 417289 - RNA, 32 nt, Human
gaagagagcacuguggugagguggugagaccg

SEQ ID NO: 417290 - RNA, 21 nt, Human
gaagagagcgcagcccggcca

SEQ ID NO: 417291 - RNA, 32 nt, Human
gaagagagcgugccucagguuacuugaacuug

SEQ ID NO: 417292 - RNA, 32 nt, Human
gaagagagcuccacuuacaaagaacugcuucu

SEQ ID NO: 417293 - RNA, 32 nt, Human
gaagagagcucuauuaaaagaggaauauugca

SEQ ID NO: 417294 - RNA, 32 nt, Human
gaagagaggaagcagccccagggaccaauuuu

SEQ ID NO: 417295 - RNA, 32 nt, Human
gaagagaggacacaucucccaccauuaccaga

SEQ ID NO: 417296 - RNA, 32 nt, Human
gaagagaggagagaccugggagugggagcuca

SEQ ID NO: 417297 - RNA, 32 nt, Human
gaagagaggagaggagagaggcagagagcggu

SEQ ID NO: 417298 - RNA, 32 nt, Human
gaagagaggagcagcaauccugaggggcuggg

SEQ ID NO: 417299 - RNA, 21 nt, Human
gaagagaggcacagacacaga

SEQ ID NO: 417300 - RNA, 32 nt, Human
gaagagaggcagagagggaaagaggcagagaa

SEQ ID NO: 417301 - RNA, 32 nt, Human
gaagagagggaagagaaagcacagagcagaga

SEQ ID NO: 417302 - RNA, 32 nt, Human
gaagagagggagagagaggaaagggaaggaag

SEQ ID NO: 417303 - RNA, 32 nt, Human
gaagagagggaggaggaaaggaaggagagaga

SEQ ID NO: 417304 - RNA, 32 nt, Human
gaagagagggguucuacccacagaucaacugu

SEQ ID NO: 417305 - RNA, 32 nt, Human
gaagagagggugaaagagucgcugcacccagg

SEQ ID NO: 417306 - RNA, 32 nt, Human
gaagagagguuagguaaagagaguuuggagga

SEQ ID NO: 417307 - RNA, 32 nt, Human
gaagagaguagagcucaaaacuggauuaucac

SEQ ID NO: 417308 - RNA, 32 nt, Human
gaagagagugagaggagcaacagugaaaggcc

SEQ ID NO: 417309 - RNA, 32 nt, Human
gaagagagugugaaacaggagccucagauaac

SEQ ID NO: 417310 - RNA, 32 nt, Human
gaagagaguuugaaaguuguauacuguuaaug

SEQ ID NO: 417311 - RNA, 32 nt, Human
gaagagauacacugcauuucccuuuaccaacu

SEQ ID NO: 417312 - RNA, 32 nt, Human
gaagagauagaaggcacagaagaucacagcua

SEQ ID NO: 417313 - RNA, 32 nt, Human
gaagagauagaggaggaggagggggaggaaga

SEQ ID NO: 417314 - RNA, 32 nt, Human
gaagagauauccaggccaggugcaguggcuca

SEQ ID NO: 417315 - RNA, 32 nt, Human
gaagagaucacuucagguggcuuuuguggagg

SEQ ID NO: 417316 - RNA, 32 nt, Human
gaagagaucaggaagagaaggagcagagcaga

SEQ ID NO: 417317 - RNA, 32 nt, Human
gaagagaucauagaaaccagagccuucucccc

SEQ ID NO: 417318 - RNA, 32 nt, Human
gaagagaucuuucugcaacaggauauucuucu

SEQ ID NO: 417319 - RNA, 32 nt, Human
gaagagaugcuacugccuggagacuggggucu

SEQ ID NO: 417320 - RNA, 32 nt, Human
gaagagaugcugucuuggucuuguuggacgag

SEQ ID NO: 417321 - RNA, 32 nt, Human
gaagagaugcugucuuggucuuguuggaggag

SEQ ID NO: 417322 - RNA, 31 nt, Human
gaagagauggagcuggacagagcuguggggg

SEQ ID NO: 417323 - RNA, 32 nt, Human
gaagagaugggaaaaggucaucaaagggcauu

SEQ ID NO: 417324 - RNA, 30 nt, Human
gaagagaugggagccagggcacgauagagc

SEQ ID NO: 417325 - RNA, 32 nt, Human
gaagagaugguuuugcugcucuccuugaggau

SEQ ID NO: 417326 - RNA, 22 nt, Human
gaagagauuucucccucuagca

SEQ ID NO: 417327 - RNA, 32 nt, Human
gaagagcaaaacugaggacaugguugagaaaa

SEQ ID NO: 417328 - RNA, 32 nt, Human
gaagagcaaaggacagguagucuagagagggu

SEQ ID NO: 417329 - RNA, 32 nt, Human
gaagagcaacaacaaacugcuuacgacagguu

SEQ ID NO: 417330 - RNA, 32 nt, Human
gaagagcaacaacagacaggugaccuucuugg

SEQ ID NO: 417331 - RNA, 32 nt, Human
gaagagcaagcagagucaugaccagggacaca

SEQ ID NO: 417332 - RNA, 32 nt, Human
gaagagcaagcuggagaggcugggcaggggcu

SEQ ID NO: 417333 - RNA, 20 nt, Human
gaagagcaauagaaccuuua

SEQ ID NO: 417334 - RNA, 32 nt, Human
gaagagcacagaacaauuucucauuucauauu

SEQ ID NO: 417335 - RNA, 32 nt, Human
gaagagcacagcugcagaucccaggccucugg

SEQ ID NO: 417336 - RNA, 21 nt, Human
gaagagcacuuggagauccua

SEQ ID NO: 417337 - RNA, 21 nt, Human
gaagagcacuuugaaauuuug

SEQ ID NO: 417338 - RNA, 32 nt, Human
gaagagcagaggguacaaguccccgcucacac

SEQ ID NO: 417339 - RNA, 32 nt, Human
gaagagcagaucauuccucucuggccucagcc

SEQ ID NO: 417340 - RNA, 32 nt, Human
gaagagcagcagcauggauggauuuuaugacc

SEQ ID NO: 417341 - RNA, 22 nt, Human
gaagagcagcuccagagcccug

SEQ ID NO: 417342 - RNA, 32 nt, Human
gaagagcagcuggcaugaugacugcuguuuga

SEQ ID NO: 417343 - RNA, 26 nt, Human
gaagagcaggaagggauacacucucc

SEQ ID NO: 417344 - RNA, 32 nt, Human
gaagagcaggaagggauacacucuccagugca

SEQ ID NO: 417345 - RNA, 20 nt, Human
gaagagcaggagggaacucu

SEQ ID NO: 417346 - RNA, 32 nt, Human
gaagagcaggcugcgccaggguuccuggcggg

SEQ ID NO: 417347 - RNA, 32 nt, Human
gaagagcagugaccccagcagagaggggccug

SEQ ID NO: 417348 - RNA, 32 nt, Human
gaagagcagugcuguccaugauguaauggaag

SEQ ID NO: 417349 - RNA, 32 nt, Human
gaagagcaucacagggcauaguuucacaaaag

SEQ ID NO: 417350 - RNA, 20 nt, Human
gaagagcauggggugcucug

SEQ ID NO: 417351 - RNA, 20 nt, Human
gaagagcauucugaccucug

SEQ ID NO: 417352 - RNA, 21 nt, Human
gaagagcauuugggaaagcug

SEQ ID NO: 417353 - RNA, 32 nt, Human
gaagagccacaagaccacacacacagcccuua

SEQ ID NO: 417354 - RNA, 32 nt, Human
gaagagccacagugagggagaucccauccccu

SEQ ID NO: 417355 - RNA, 32 nt, Human
gaagagccaggauaugagaagaugggagaggg

SEQ ID NO: 417356 - RNA, 32 nt, Human
gaagagcccagaaaaucaaggcaaacauuugu

SEQ ID NO: 417357 - RNA, 20 nt, Human
gaagagccccaagcagacua

SEQ ID NO: 417358 - RNA, 32 nt, Human
gaagagcccgcacgaugcagaccucaugccca

SEQ ID NO: 417359 - RNA, 19 nt, Human
gaagagcccuagagcuuug

SEQ ID NO: 417360 - RNA, 32 nt, Human
gaagagcccugcuucccugccuccuccuaccu

SEQ ID NO: 417361 - RNA, 31 nt, Human
gaagagcccuuucagcacuuucucaucugug

SEQ ID NO: 417362 - RNA, 32 nt, Human
gaagagccuaucugucaucgccugaggugccc

SEQ ID NO: 417363 - RNA, 32 nt, Human
gaagagccugcucgggacgucagggcccgggg

SEQ ID NO: 417364 - RNA, 32 nt, Human
gaagagccuucccucauuauugucauucuugg

SEQ ID NO: 417365 - RNA, 21 nt, Human
gaagagcgcucuagacaggac

SEQ ID NO: 417366 - RNA, 32 nt, Human
gaagagcggagagagaaggaagaggcgaugug

SEQ ID NO: 417367 - RNA, 32 nt, Human
gaagagcgggcugaggaaacccagagggacca

SEQ ID NO: 417368 - RNA, 22 nt, Human
gaagagcguacugcagagccua

SEQ ID NO: 417369 - RNA, 32 nt, Human
gaagagcuaaagauccgagaaaaagaagaugc

SEQ ID NO: 417370 - RNA, 32 nt, Human
gaagagcuaccagaugguguucuugaaucuga

SEQ ID NO: 417371 - RNA, 18 nt, Human
gaagagcuccagauggac

SEQ ID NO: 417372 - RNA, 32 nt, Human
gaagagcucccagagauuguagaaagagucca

SEQ ID NO: 417373 - RNA, 20 nt, Human
gaagagcucucggccaccaa

SEQ ID NO: 417374 - RNA, 32 nt, Human
gaagagcugacuccagccuguccaugcacggc

SEQ ID NO: 417375 - RNA, 32 nt, Human
gaagagcugagacauccguuccccuacaagaa

SEQ ID NO: 417376 - RNA, 32 nt, Human
gaagagcugcagcuuugacagugcuuauuuaa

SEQ ID NO: 417377 - RNA, 32 nt, Human
gaagagcugcccggcucacugcagccugguua

SEQ ID NO: 417378 - RNA, 32 nt, Human
gaagagcugccgaagagguggagccaggcagg

SEQ ID NO: 417379 - RNA, 32 nt, Human
gaagagcuggaaaauucucgaagcugcaccgu

SEQ ID NO: 417380 - RNA, 23 nt, Human
gaagagcuggauuauauauuucc

SEQ ID NO: 417381 - RNA, 22 nt, Human
gaagagcuugcccacagacaca

SEQ ID NO: 417382 - RNA, 32 nt, Human
gaagagcuuggaagagcuggggagaggguagg

SEQ ID NO: 417383 - RNA, 32 nt, Human
gaagaggaaagccacguagagugguuggcaug

SEQ ID NO: 417384 - RNA, 32 nt, Human
gaagaggaaagggaggaggaggauuuaucauu

SEQ ID NO: 417385 - RNA, 32 nt, Human
gaagaggaagaggaggaggaggagaccggcag

SEQ ID NO: 417386 - RNA, 32 nt, Human
gaagaggaagcacuccucugaugauuacuacu

SEQ ID NO: 417387 - RNA, 32 nt, Human
gaagaggaagggaggaagggaacagagaggaa

SEQ ID NO: 417388 - RNA, 32 nt, Human
gaagaggaaugagccauauauuggggaaaauc

SEQ ID NO: 417389 - RNA, 24 nt, Human
gaagaggacaaggcccucggcagc

SEQ ID NO: 417390 - RNA, 18 nt, Human
gaagaggacgagguggcg

SEQ ID NO: 417391 - RNA, 32 nt, Human
gaagaggagaauaaggaggagcaggaggaaga

SEQ ID NO: 417392 - RNA, 32 nt, Human
gaagaggagacacagacacagagcaggaggac

SEQ ID NO: 417393 - RNA, 32 nt, Human
gaagaggagaggcagagagggcgcggggaccg

SEQ ID NO: 417394 - RNA, 32 nt, Human
gaagaggagaggguauggggcggcagacccua

SEQ ID NO: 417395 - RNA, 32 nt, Human
gaagaggagaugggaggaaaugcaguuucaug

SEQ ID NO: 417396 - RNA, 32 nt, Human
gaagaggagcaucugcuccagauggaaaaugg

SEQ ID NO: 417397 - RNA, 32 nt, Human
gaagaggagccagccaggucuucauucaaacc

SEQ ID NO: 417398 - RNA, 23 nt, Human
gaagaggagccagcgcccgaggg

SEQ ID NO: 417399 - RNA, 22 nt, Human
gaagaggagccaggaaccgggg

SEQ ID NO: 417400 - RNA, 20 nt, Human
gaagaggagccgcggcgagg

SEQ ID NO: 417401 - RNA, 32 nt, Human
gaagaggagcgugaggagggaggcgaggcaug

SEQ ID NO: 417402 - RNA, 32 nt, Human
gaagaggaggaagaggaugaccugagugagcu

SEQ ID NO: 417403 - RNA, 32 nt, Human
gaagaggaggagaagggaggggguggccuggu

SEQ ID NO: 417404 - RNA, 32 nt, Human
gaagaggaggaggaggaggagaaggaggagag

SEQ ID NO: 417405 - RNA, 32 nt, Human
gaagaggaggaggaggaggaggaagaagaaag

SEQ ID NO: 417406 - RNA, 32 nt, Human
gaagaggaggaggaggaggaggaagcugaaga

SEQ ID NO: 417407 - RNA, 32 nt, Human
gaagaggaggaggaggaggaggaaggggcuug

SEQ ID NO: 417408 - RNA, 32 nt, Human
gaagaggaggaggaggaggaggaggaggagga

SEQ ID NO: 417409 - RNA, 32 nt, Human
gaagaggaggaggaggaggaggcuggguuggg

SEQ ID NO: 417410 - RNA, 32 nt, Human
gaagaggaggaggugggggcuggaggugcugg

SEQ ID NO: 417411 - RNA, 21 nt, Human
gaagaggaggcaccgcggcgg

SEQ ID NO: 417412 - RNA, 32 nt, Human
gaagaggaggcugagagggucaaaagaaaacu

SEQ ID NO: 417413 - RNA, 32 nt, Human
gaagaggaggggauaugacagcucauguuccu

SEQ ID NO: 417414 - RNA, 32 nt, Human
gaagaggaggguggggcccuggaugacuuucc

SEQ ID NO: 417415 - RNA, 19 nt, Human
gaagaggagguucuucggg

SEQ ID NO: 417416 - RNA, 32 nt, Human
gaagaggaguagaagagagccagugaagucag

SEQ ID NO: 417417 - RNA, 32 nt, Human
gaagaggauggcagaggcugcugggccuugga

SEQ ID NO: 417418 - RNA, 22 nt, Human
gaagaggauguggagaacuuug

SEQ ID NO: 417419 - RNA, 32 nt, Human
gaagaggauuauucgggagauugcuggugugg

SEQ ID NO: 417420 - RNA, 32 nt, Human
gaagaggcaagccugcacacacacuuccuguc

SEQ ID NO: 417421 - RNA, 32 nt, Human
gaagaggcagaaaguguggcagaggcacacgu

SEQ ID NO: 417422 - RNA, 32 nt, Human
gaagaggcagaugggggucaaaccacugccuu

SEQ ID NO: 417423 - RNA, 32 nt, Human
gaagaggcagcccccacccacucuguucucgu

SEQ ID NO: 417424 - RNA, 32 nt, Human
gaagaggcaggcacuggcuggcucagcuccac

SEQ ID NO: 417425 - RNA, 32 nt, Human
gaagaggcagggccccugacggaggcuuugcu

SEQ ID NO: 417426 - RNA, 31 nt, Human
gaagaggcagucaaggaggaaggagagacau

SEQ ID NO: 417427 - RNA, 32 nt, Human
gaagaggcaguuguggagggagagggagcaag

SEQ ID NO: 417428 - RNA, 19 nt, Human
gaagaggccaagcuucugg

SEQ ID NO: 417429 - RNA, 32 nt, Human
gaagaggccacuggccaggccucccaggcagg

SEQ ID NO: 417430 - RNA, 32 nt, Human
gaagaggccagugggagaggagaggaggggga

SEQ ID NO: 417431 - RNA, 32 nt, Human
gaagaggccauacugcuccagccggggcuccg

SEQ ID NO: 417432 - RNA, 32 nt, Human
gaagaggcccucagcccucccccggucucaga

SEQ ID NO: 417433 - RNA, 32 nt, Human
gaagaggcccuugagucacagacccacagacg

SEQ ID NO: 417434 - RNA, 32 nt, Human
gaagaggccgaggagugaggcagcagccucua

SEQ ID NO: 417435 - RNA, 20 nt, Human
gaagaggccgcggcuucugg

SEQ ID NO: 417436 - RNA, 32 nt, Human
gaagaggccuucaagcccugcagccuccgacu

SEQ ID NO: 417437 - RNA, 20 nt, Human
gaagaggcgacccaaggcgg

SEQ ID NO: 417438 - RNA, 24 nt, Human
gaagaggcgcccugugaacccugu

SEQ ID NO: 417439 - RNA, 32 nt, Human
gaagaggcucagcauccugcacaugcccuuuc

SEQ ID NO: 417440 - RNA, 32 nt, Human
gaagaggcucuccacuguccacccuaacacau

SEQ ID NO: 417441 - RNA, 19 nt, Human
gaagagggaaggaaagaga

SEQ ID NO: 417442 - RNA, 32 nt, Human
gaagagggacuugcccuaauucaggugaucac

SEQ ID NO: 417443 - RNA, 32 nt, Human
gaagagggagagaagaaagaagaaaaggagaa

SEQ ID NO: 417444 - RNA, 32 nt, Human
gaagagggaggcaggccucuauucaaaggcag

SEQ ID NO: 417445 - RNA, 32 nt, Human
gaagagggagggagggaggagugcugaagauu

SEQ ID NO: 417446 - RNA, 32 nt, Human
gaagagggauagggccagcaaggcagggaucg

SEQ ID NO: 417447 - RNA, 32 nt, Human
gaagagggaucugcaagugcaggguguugguu

SEQ ID NO: 417448 - RNA, 32 nt, Human
gaagagggcagaauccucagcucccaucauug

SEQ ID NO: 417449 - RNA, 31 nt, Human
gaagagggcaggagagaaaaaugaacugcaa

SEQ ID NO: 417450 - RNA, 22 nt, Human
gaagagggccugggccccgugg

SEQ ID NO: 417451 - RNA, 20 nt, Human
gaagagggccuucucggggc

SEQ ID NO: 417452 - RNA, 32 nt, Human
gaagagggcgcgaggguagcagccagagggag

SEQ ID NO: 417453 - RNA, 32 nt, Human
gaagagggcgucugcuggagguuccaggcccc

SEQ ID NO: 417454 - RNA, 20 nt, Human
gaagagggcuggcugcggcg

SEQ ID NO: 417455 - RNA, 32 nt, Human
gaagaggggaaagagaggcagagagggggaag

SEQ ID NO: 417456 - RNA, 22 nt, Human
gaagaggggcagugacccugug

SEQ ID NO: 417457 - RNA, 32 nt, Human
gaagaggggcggccccaccagccccggcugag

SEQ ID NO: 417458 - RNA, 32 nt, Human
gaagaggggcgucaguuuucucuggcucgcuc

SEQ ID NO: 417459 - RNA, 32 nt, Human
gaagaggggcuggagugcggcuggucugcgcu

SEQ ID NO: 417460 - RNA, 32 nt, Human
gaagagggggugaaggccagaggcucggggcu

SEQ ID NO: 417461 - RNA, 32 nt, Human
gaagagggugcugguccugcccuuuugaggcc

SEQ ID NO: 417462 - RNA, 32 nt, Human
gaagaggguggagugggcucugccccacaguc

SEQ ID NO: 417463 - RNA, 32 nt, Human
gaagagguacuuuccuggaauaauugucuacc

SEQ ID NO: 417464 - RNA, 32 nt, Human
gaagagguagccccugaacgcagagccuaaga

SEQ ID NO: 417465 - RNA, 32 nt, Human
gaagaggucaugccugggaggaagggaucguc

SEQ ID NO: 417466 - RNA, 26 nt, Human
gaagaggugacaaccucagucucccu

SEQ ID NO: 417467 - RNA, 32 nt, Human
gaagaggugaugaucucuuuguauaggucaua

SEQ ID NO: 417468 - RNA, 32 nt, Human
gaagaggugcaguggggagaccaggugggaug

SEQ ID NO: 417469 - RNA, 32 nt, Human
gaagaggugccaagccgacccugcugcgagcc

SEQ ID NO: 417470 - RNA, 32 nt, Human
gaagagguggaggaggaggaggaagaggugga

SEQ ID NO: 417471 - RNA, 32 nt, Human
gaagagguggaggaggaggaggaggagguggu

SEQ ID NO: 417472 - RNA, 32 nt, Human
gaagaggugugagcaggauucuucugaaugac

SEQ ID NO: 417473 - RNA, 32 nt, Human
gaagagguguuggggcaggaagugagucucuc

SEQ ID NO: 417474 - RNA, 32 nt, Human
gaagagguucaagugauucuugugccucaggc

SEQ ID NO: 417475 - RNA, 32 nt, Human
gaagagguugagaagacuccugggcuucagcc

SEQ ID NO: 417476 - RNA, 32 nt, Human
gaagagguuuagugcccuccugagugacugcg

SEQ ID NO: 417477 - RNA, 32 nt, Human
gaagagguuugccgucugggcagcccugucgg

SEQ ID NO: 417478 - RNA, 32 nt, Human
gaagaguaaguugaguacaacauguuaugcca

SEQ ID NO: 417479 - RNA, 24 nt, Human
gaagaguaccuggugaacccugug

SEQ ID NO: 417480 - RNA, 21 nt, Human
gaagaguacuuggaaugucug

SEQ ID NO: 417481 - RNA, 32 nt, Human
gaagaguagcuaggcagaugcagagauggaga

SEQ ID NO: 417482 - RNA, 32 nt, Human
gaagaguagcugagccccagagccucucugga

SEQ ID NO: 417483 - RNA, 32 nt, Human
gaagaguaggaaaagagaagggcugcucaggg

SEQ ID NO: 417484 - RNA, 32 nt, Human
gaagaguagggccuccuuccuccccugccugc

SEQ ID NO: 417485 - RNA, 32 nt, Human
gaagaguaggugagcgcuuugcagucacagaa

SEQ ID NO: 417486 - RNA, 32 nt, Human
gaagaguauacucuuugccuuaggauagcgua

SEQ ID NO: 417487 - RNA, 32 nt, Human
gaagaguauuaagaaagaugcucaagucccau

SEQ ID NO: 417488 - RNA, 32 nt, Human
gaagaguccccgauguuuguagaccuuaugug

SEQ ID NO: 417489 - RNA, 32 nt, Human
gaagagucccgcagaauaugcugguaugaugg

SEQ ID NO: 417490 - RNA, 32 nt, Human
gaagaguccucuggggaggaccccaagggccg

SEQ ID NO: 417491 - RNA, 32 nt, Human
gaagaguccugaggggcaacacacaagaacca

SEQ ID NO: 417492 - RNA, 32 nt, Human
gaagagucuccucgccccagagucaucuucgg

SEQ ID NO: 417493 - RNA, 32 nt, Human
gaagagucugcagcauuuguucuccuggcucc

SEQ ID NO: 417494 - RNA, 21 nt, Human
gaagagugaccugccucccca

SEQ ID NO: 417495 - RNA, 32 nt, Human
gaagagugagggugaaggcaagaaguagagca

SEQ ID NO: 417496 - RNA, 32 nt, Human
gaagagugcaucuccagccuaugaaacagcug

SEQ ID NO: 417497 - RNA, 32 nt, Human
gaagagugcggggcccuuccuccuggggacag

SEQ ID NO: 417498 - RNA, 32 nt, Human
gaagaguggaagaugacggagaugcauuuuga

SEQ ID NO: 417499 - RNA, 20 nt, Human
gaagaguggcaugcuucugg

SEQ ID NO: 417500 - RNA, 32 nt, Human
gaagagugggaaggagaggagugagugaagua

SEQ ID NO: 417501 - RNA, 32 nt, Human
gaagaguggucuugaggggguaauaaaccucc

SEQ ID NO: 417502 - RNA, 32 nt, Human
gaagaguucuacuuguggauguuuuuaauuuu

SEQ ID NO: 417503 - RNA, 32 nt, Human
gaagaguugaaagagcuggagacugucuguga

SEQ ID NO: 417504 - RNA, 32 nt, Human
gaagaguugagugaucacgcuggagaugaagg

SEQ ID NO: 417505 - RNA, 32 nt, Human
gaagaguuuaaaagcaugaaacauuucagaag

SEQ ID NO: 417506 - RNA, 32 nt, Human
gaagaguuucuccaccaggcagcaggugaagg

SEQ ID NO: 417507 - RNA, 23 nt, Human
gaagauaaagaguguacaucuuu

SEQ ID NO: 417508 - RNA, 32 nt, Human
gaagauaaaugagcgcagcagagauggagaaa

SEQ ID NO: 417509 - RNA, 32 nt, Human
gaagauaaaugauguaguugaucaguaauccu

SEQ ID NO: 417510 - RNA, 32 nt, Human
gaagauaaguaagcagguacuuaaagcaccug

SEQ ID NO: 417511 - RNA, 32 nt, Human
gaagauaccaacagccuccugaaacucacgag

SEQ ID NO: 417512 - RNA, 32 nt, Human
gaagauaccccuuuucugaggaaugaguuugc

SEQ ID NO: 417513 - RNA, 32 nt, Human
gaagauacucccacaggggcucagcaggagca

SEQ ID NO: 417514 - RNA, 32 nt, Human
gaagauacugucucacagcacuuuguaugaac

SEQ ID NO: 417515 - RNA, 32 nt, Human
gaagauagaguuguuucuuagaacuuuguaau

SEQ ID NO: 417516 - RNA, 32 nt, Human
gaagauauuccaacucaaaaccagccucaugc

SEQ ID NO: 417517 - RNA, 32 nt, Human
gaagaucaagggagucaggccacccaggagca

SEQ ID NO: 417518 - RNA, 32 nt, Human
gaagaucaaguuuguacauacacuaguggcau

SEQ ID NO: 417519 - RNA, 32 nt, Human
gaagaucacgccacugcacuccagccugagug

SEQ ID NO: 417520 - RNA, 32 nt, Human
gaagaucacuugaacccgggaggcagagguug

SEQ ID NO: 417521 - RNA, 32 nt, Human
gaagaucagaaugccagcauggucgagcucua

SEQ ID NO: 417522 - RNA, 32 nt, Human
gaagaucagacugacagagacacacacuagcc

SEQ ID NO: 417523 - RNA, 32 nt, Human
gaagaucagcuauuagaagagaaagaucaguu

SEQ ID NO: 417524 - RNA, 32 nt, Human
gaagaucagucuaagcugccacggugaugaga

SEQ ID NO: 417525 - RNA, 32 nt, Human
gaagauccaagaaggcugagguaagcagucuu

SEQ ID NO: 417526 - RNA, 32 nt, Human
gaagauccaagccaggaagaugggcuugaagc

SEQ ID NO: 417527 - RNA, 32 nt, Human
gaagauccaaguuuaaaauugccugcggaaug

SEQ ID NO: 417528 - RNA, 32 nt, Human
gaagauccaaguuuaaaauugcugcggaaugu

SEQ ID NO: 417529 - RNA, 32 nt, Human
gaagauccagaaccauggcaagaaacuugaca

SEQ ID NO: 417530 - RNA, 32 nt, Human
gaagauccaggaguugaagaccagccugggca

SEQ ID NO: 417531 - RNA, 32 nt, Human
gaagaucccaggcucaagugcaaaaacugcgg

SEQ ID NO: 417532 - RNA, 32 nt, Human
gaagauccccagacuucauagaauacucaggg

SEQ ID NO: 417533 - RNA, 32 nt, Human
gaagauccuaaaacaaaagcucauccauuugc

SEQ ID NO: 417534 - RNA, 32 nt, Human
gaagauccugggcaccuuccagaagcucaaga

SEQ ID NO: 417535 - RNA, 32 nt, Human
gaagauccuucgugaucaccaugcuguucuca

SEQ ID NO: 417536 - RNA, 32 nt, Human
gaagaucgagccacugcacuccagccugggca

SEQ ID NO: 417537 - RNA, 32 nt, Human
gaagaucgcaagucagaguggccggcaggcac

SEQ ID NO: 417538 - RNA, 32 nt, Human
gaagaucgcaccacugcacgcacuccagccug

SEQ ID NO: 417539 - RNA, 32 nt, Human
gaagaucuacacccaucccccuuccucuagcc

SEQ ID NO: 417540 - RNA, 32 nt, Human
gaagaucuacugcucccucucuccacacggag

SEQ ID NO: 417541 - RNA, 32 nt, Human
gaagaucucacuuuccccuugugggguaggaa

SEQ ID NO: 417542 - RNA, 32 nt, Human
gaagaucucgguugcugagugcagggaaggag

SEQ ID NO: 417543 - RNA, 32 nt, Human
gaagaucugauuaagggcuuuucacaauggua

SEQ ID NO: 417544 - RNA, 32 nt, Human
gaagaucugcagagugagaagccagaccauuc

SEQ ID NO: 417545 - RNA, 32 nt, Human
gaagaucugcagcagucuccccaaaucaguga

SEQ ID NO: 417546 - RNA, 32 nt, Human
gaagaucugcagcuauucuuuuacuuaacaug

SEQ ID NO: 417547 - RNA, 32 nt, Human
gaagaucugccuccccaccgccuuuucucacu

SEQ ID NO: 417548 - RNA, 32 nt, Human
gaagaucugcucacuccggaaaaagaaaauga

SEQ ID NO: 417549 - RNA, 32 nt, Human
gaagaucugggagauuguggacgggcugugcu

SEQ ID NO: 417550 - RNA, 32 nt, Human
gaagaucuguaucuagagaggagcaugccaug

SEQ ID NO: 417551 - RNA, 31 nt, Human
gaagaucuuaauaacagauguugaaagaagg

SEQ ID NO: 417552 - RNA, 32 nt, Human
gaagaugaaauggaugauccuggagauucaga

SEQ ID NO: 417553 - RNA, 32 nt, Human
gaagaugacuaucuugcaugcaugagaaugaa

SEQ ID NO: 417554 - RNA, 19 nt, Human
gaagaugacuuccugggaa

SEQ ID NO: 417555 - RNA, 32 nt, Human
gaagaugacuugacccugggagcggaggccac

SEQ ID NO: 417556 - RNA, 32 nt, Human
gaagaugagaaggugaauauaaucaaugccaa

SEQ ID NO: 417557 - RNA, 32 nt, Human
gaagaugagcaggccagugggaggaggggcag

SEQ ID NO: 417558 - RNA, 32 nt, Human
gaagaugagcaucuccccuaacaccaccuacc

SEQ ID NO: 417559 - RNA, 32 nt, Human
gaagaugagcccaggcuaacuuagcacagauc

SEQ ID NO: 417560 - RNA, 29 nt, Human
gaagaugaggcugaagauuggguucaucu

SEQ ID NO: 417561 - RNA, 32 nt, Human
gaagaugaggggaggaaggaggugaggcggua

SEQ ID NO: 417562 - RNA, 32 nt, Human
gaagaugaggugaggaaggaagggguugcugu

SEQ ID NO: 417563 - RNA, 32 nt, Human
gaagaugaucuuuuugccauugccaaggacag

SEQ ID NO: 417564 - RNA, 29 nt, Human
gaagaugaugagacagaggcagagccauu

SEQ ID NO: 417565 - RNA, 32 nt, Human
gaagaugaugaguacuccccuuggggauauga

SEQ ID NO: 417566 - RNA, 29 nt, Human
gaagaugcaaugucagcuauuuaggacag

SEQ ID NO: 417567 - RNA, 32 nt, Human
gaagaugcacagguggcuccugggcuugggcu

SEQ ID NO: 417568 - RNA, 32 nt, Human
gaagaugcagccacccuccuuuacaugucaca

SEQ ID NO: 417569 - RNA, 32 nt, Human
gaagaugcagccccuuccuccagccugagaga

SEQ ID NO: 417570 - RNA, 32 nt, Human
gaagaugccaaaacagaucaggcacagaaagc

SEQ ID NO: 417571 - RNA, 32 nt, Human
gaagaugccauugcacuccagccugggcaaca

SEQ ID NO: 417572 - RNA, 32 nt, Human
gaagaugccucagaaggaagaaauaaaugagu

SEQ ID NO: 417573 - RNA, 32 nt, Human
gaagaugccuguccucuccguggaagacccug

SEQ ID NO: 417574 - RNA, 29 nt, Human
gaagaugcggccggagcccggaggcugcu

SEQ ID NO: 417575 - RNA, 32 nt, Human
gaagaugcuccagcaacacagccugggcccca

SEQ ID NO: 417576 - RNA, 31 nt, Human
gaagaugcuuaguaaaagcuguugaaaggau

SEQ ID NO: 417577 - RNA, 32 nt, Human
gaagaugcuuuggcugccugagguccugcuug

SEQ ID NO: 417578 - RNA, 29 nt, Human
gaagauggaaacacuggagucagaacuga

SEQ ID NO: 417579 - RNA, 32 nt, Human
gaagauggagaaagaggccaucuggguacaac

SEQ ID NO: 417580 - RNA, 29 nt, Human
gaagauggagcacggcacacuccucgccc

SEQ ID NO: 417581 - RNA, 32 nt, Human
gaagauggagucucgcucugucacccaggcug

SEQ ID NO: 417582 - RNA, 29 nt, Human
gaagauggagucuugcucugucaccaggc

SEQ ID NO: 417583 - RNA, 29 nt, Human
gaagauggccacugcccaguugcagagga

SEQ ID NO: 417584 - RNA, 32 nt, Human
gaagauggccuugccuugggguccugcuuguu

SEQ ID NO: 417585 - RNA, 29 nt, Human
gaagauggcggcagugguggagguggagg

SEQ ID NO: 417586 - RNA, 20 nt, Human
gaagauggcggcccgggcgg

SEQ ID NO: 417587 - RNA, 29 nt, Human
gaagauggcggcggccguuccacagcggg

SEQ ID NO: 417588 - RNA, 29 nt, Human
gaagauggcggcggcgcaggaggcggacg

SEQ ID NO: 417589 - RNA, 32 nt, Human
gaagauggcgggaaaagggaucaaagacucag

SEQ ID NO: 417590 - RNA, 29 nt, Human
gaagauggcugcagacaagccugcagauc

SEQ ID NO: 417591 - RNA, 29 nt, Human
gaagauggcugggccucacacgccuugga

SEQ ID NO: 417592 - RNA, 32 nt, Human
gaagauggcuugagcccaggagguggagguug

SEQ ID NO: 417593 - RNA, 32 nt, Human
gaagauggcuugagcccaggagguugaggcug

SEQ ID NO: 417594 - RNA, 32 nt, Human
gaagaugggaacacugguggaggauggaaagg

SEQ ID NO: 417595 - RNA, 32 nt, Human
gaagaugggaagcacagauugcagugaaccga

SEQ ID NO: 417596 - RNA, 32 nt, Human
gaagauggggcccuggcuuuccagggagugca

SEQ ID NO: 417597 - RNA, 32 nt, Human
gaagaugggggcggagacugaagugaccuggc

SEQ ID NO: 417598 - RNA, 32 nt, Human
gaagauggucccaaauuccuugucacucccug

SEQ ID NO: 417599 - RNA, 29 nt, Human
gaagauggucgccaagcaaaggauccgua

SEQ ID NO: 417600 - RNA, 32 nt, Human
gaagaugguggaggacggcgcggaggagcugg

SEQ ID NO: 417601 - RNA, 32 nt, Human
gaagaugguuugagcccaggaggcagaauuug

SEQ ID NO: 417602 - RNA, 32 nt, Human
gaagaugucccauggcuacugaaggggcugcc

SEQ ID NO: 417603 - RNA, 32 nt, Human
gaagaugucccuguagagcagccccagggaag

SEQ ID NO: 417604 - RNA, 32 nt, Human
gaagauguggcaggagaaagaaagaaaacggg

SEQ ID NO: 417605 - RNA, 32 nt, Human
gaagauguguugacagucgugaguguguaucc

SEQ ID NO: 417606 - RNA, 32 nt, Human
gaagauguugaaugagauucacuaugucaaua

SEQ ID NO: 417607 - RNA, 29 nt, Human
gaagauguuucuggugggccugacagggg

SEQ ID NO: 417608 - RNA, 32 nt, Human
gaagauguuuuuaugaagucucuuucugauca

SEQ ID NO: 417609 - RNA, 32 nt, Human
gaagauuaccgaggaaaggaaaagugguaagg

SEQ ID NO: 417610 - RNA, 32 nt, Human
gaagauuaccgcuggccuacugugaagguaga

SEQ ID NO: 417611 - RNA, 32 nt, Human
gaagauuagaagcagugggggucgguggcugu

SEQ ID NO: 417612 - RNA, 32 nt, Human
gaagauuaggcagagugggcaggaagaccagc

SEQ ID NO: 417613 - RNA, 24 nt, Human
gaagauuauuucaugccuccgcca

SEQ ID NO: 417614 - RNA, 32 nt, Human
gaagauucugaccugucugaucaaauaaaggc

SEQ ID NO: 417615 - RNA, 32 nt, Human
gaagauucugucucccuguucccccuccccag

SEQ ID NO: 417616 - RNA, 32 nt, Human
gaagauucuuacucugauucucagcugagcug

SEQ ID NO: 417617 - RNA, 32 nt, Human
gaagauucuuccagauucuagcaauguuuguu

SEQ ID NO: 417618 - RNA, 32 nt, Human
gaagauugcccagggaugauguuauggagaua

SEQ ID NO: 417619 - RNA, 32 nt, Human
gaagauugcuauagagucccugggcuuuaaac

SEQ ID NO: 417620 - RNA, 25 nt, Human
gaagauugcuucucuucucuccucc

SEQ ID NO: 417621 - RNA, 32 nt, Human
gaagauuggcuuuaagaugaaggccugcauuu

SEQ ID NO: 417622 - RNA, 32 nt, Human
gaagauugggagaaaguagcugugggacuugg

SEQ ID NO: 417623 - RNA, 32 nt, Human
gaagauugggccaggugggauuacaggcgcga

SEQ ID NO: 417624 - RNA, 32 nt, Human
gaagauuggguaauuguccuuccuucaguguu

SEQ ID NO: 417625 - RNA, 32 nt, Human
gaagauuuagaggaggaggaggaagugucaga

SEQ ID NO: 417626 - RNA, 32 nt, Human
gaagauuucaaaagcauagggcuguggucucu

SEQ ID NO: 417627 - RNA, 32 nt, Human
gaagauuucauggcugcauccuugccagccga

SEQ ID NO: 417628 - RNA, 32 nt, Human
gaagauuuccuugaaaucuucucaagcucuua

SEQ ID NO: 417629 - RNA, 32 nt, Human
gaagauuuuauuuuacccuugaucuuaacaaa

SEQ ID NO: 417630 - RNA, 32 nt, Human
gaagauuuuugcugcagaaucaguuacaaaca

SEQ ID NO: 417631 - RNA, 32 nt, Human
gaagcaaaaagaggaggaggaagaggagcuca

SEQ ID NO: 417632 - RNA, 32 nt, Human
gaagcaaaaagcaguguuuccuuuguguuuga

SEQ ID NO: 417633 - RNA, 32 nt, Human
gaagcaaaaggaguaagauuuuuaaagacaga

SEQ ID NO: 417634 - RNA, 32 nt, Human
gaagcaaaauguuugcugccaaagacaaauca

SEQ ID NO: 417635 - RNA, 32 nt, Human
gaagcaaacgaaagccccuguucuccaagcaa

SEQ ID NO: 417636 - RNA, 32 nt, Human
gaagcaaagaggaagggaaggcagaaccaggg

SEQ ID NO: 417637 - RNA, 32 nt, Human
gaagcaaagagugagaaagaauaggggcugaa

SEQ ID NO: 417638 - RNA, 32 nt, Human
gaagcaaagccuuggugccugugagcucaucu

SEQ ID NO: 417639 - RNA, 32 nt, Human
gaagcaaaggaauucagggcugggaaaauuua

SEQ ID NO: 417640 - RNA, 32 nt, Human
gaagcaaaggagagcuuggggguggggagaaa

SEQ ID NO: 417641 - RNA, 32 nt, Human
gaagcaaaggcagaggcccuggggugggagca

SEQ ID NO: 417642 - RNA, 21 nt, Human
gaagcaaauuaaacauccuga

SEQ ID NO: 417643 - RNA, 32 nt, Human
gaagcaacaagugugggguuaagcagggagaa

SEQ ID NO: 417644 - RNA, 32 nt, Human
gaagcaacacucugugggucucuggcauuucu

SEQ ID NO: 417645 - RNA, 32 nt, Human
gaagcaacagaagaacgaaagcagggauuuau

SEQ ID NO: 417646 - RNA, 32 nt, Human
gaagcaacgaaaacaaaaugcacagccugaau

SEQ ID NO: 417647 - RNA, 32 nt, Human
gaagcaacuaauucuggugcucaggcugggcu

SEQ ID NO: 417648 - RNA, 32 nt, Human
gaagcaacugcgcugauugaugcgccacagac

SEQ ID NO: 417649 - RNA, 32 nt, Human
gaagcaacuuggaagaggaaagaaaagaaguc

SEQ ID NO: 417650 - RNA, 32 nt, Human
gaagcaagaaagacacugccuccucugaggga

SEQ ID NO: 417651 - RNA, 32 nt, Human
gaagcaagaauggagaguccaaguuugugaua

SEQ ID NO: 417652 - RNA, 21 nt, Human
gaagcaagagaaucgcuugaa

SEQ ID NO: 417653 - RNA, 22 nt, Human
gaagcaagagaaucgcuugaac

SEQ ID NO: 417654 - RNA, 32 nt, Human
gaagcaagagcucagaggggagaggggcuggc

SEQ ID NO: 417655 - RNA, 32 nt, Human
gaagcaagggaguaucagacuaugaugaugcu

SEQ ID NO: 417656 - RNA, 32 nt, Human
gaagcaaggguucuacaaagaggucaaagcua

SEQ ID NO: 417657 - RNA, 32 nt, Human
gaagcaaggugaggagucucuaccuccaugug

SEQ ID NO: 417658 - RNA, 32 nt, Human
gaagcaauauuacucccuccccuacaccaggg

SEQ ID NO: 417659 - RNA, 32 nt, Human
gaagcaaucuagacuguugugaugaguguaug

SEQ ID NO: 417660 - RNA, 32 nt, Human
gaagcaaugccacggcuccaggguuucagaug

SEQ ID NO: 417661 - RNA, 32 nt, Human
gaagcacaaauugcccagaccuaacaaaagcg

SEQ ID NO: 417662 - RNA, 32 nt, Human
gaagcacacaggcuccaugagcugggcggaga

SEQ ID NO: 417663 - RNA, 32 nt, Human
gaagcacagauuaucauaucugucuugcaaau

SEQ ID NO: 417664 - RNA, 32 nt, Human
gaagcacagcaauaggaagucucuccacaaac

SEQ ID NO: 417665 - RNA, 32 nt, Human
gaagcacagcacaggggcucagccugggaucc

SEQ ID NO: 417666 - RNA, 32 nt, Human
gaagcacagcagcaucuucaaacauguacaaa

SEQ ID NO: 417667 - RNA, 18 nt, Human
gaagcacagcuguugggg

SEQ ID NO: 417668 - RNA, 32 nt, Human
gaagcacaggcagcaggaugaggggauacuug

SEQ ID NO: 417669 - RNA, 32 nt, Human
gaagcacaucuggacagcugugcggccuccuu

SEQ ID NO: 417670 - RNA, 32 nt, Human
gaagcacaucuguagcaagauggcugagaaau

SEQ ID NO: 417671 - RNA, 32 nt, Human
gaagcacaucuuaaaggaaugaaguguaaugc

SEQ ID NO: 417672 - RNA, 32 nt, Human
gaagcacaugaacuacagccuggagguggagg

SEQ ID NO: 417673 - RNA, 32 nt, Human
gaagcaccccaccccucugccugcugccugau

SEQ ID NO: 417674 - RNA, 32 nt, Human
gaagcaccccauagggugggcugaguaaccuu

SEQ ID NO: 417675 - RNA, 32 nt, Human
gaagcaccguggcugcuauuaucugcucuccg

SEQ ID NO: 417676 - RNA, 32 nt, Human
gaagcaccucaagccugagcagccuguagaug

SEQ ID NO: 417677 - RNA, 32 nt, Human
gaagcaccuugaucuuugguguccuggacuuc

SEQ ID NO: 417678 - RNA, 32 nt, Human
gaagcacggugcuucugaagguccccagcgca

SEQ ID NO: 417679 - RNA, 32 nt, Human
gaagcacucccaggcucauccugggagcuuuc

SEQ ID NO: 417680 - RNA, 32 nt, Human
gaagcacugcuuucuuuccucaggaccugaug

SEQ ID NO: 417681 - RNA, 32 nt, Human
gaagcacugggucaggugaggucugaggacag

SEQ ID NO: 417682 - RNA, 32 nt, Human
gaagcacuguagcagagacucuggccuuguga

SEQ ID NO: 417683 - RNA, 32 nt, Human
gaagcacugucaucuuccacgucaucuucaca

SEQ ID NO: 417684 - RNA, 32 nt, Human
gaagcagaaagccugcuggggauggugccagc

SEQ ID NO: 417685 - RNA, 21 nt, Human
gaagcagaaauacauauuucc

SEQ ID NO: 417686 - RNA, 21 nt, Human
gaagcagaagaaucgcuugaa

SEQ ID NO: 417687 - RNA, 22 nt, Human
gaagcagaagaaucgcuugaac

SEQ ID NO: 417688 - RNA, 32 nt, Human
gaagcagaaguuagaucccacagucaucaagu

SEQ ID NO: 417689 - RNA, 19 nt, Human
gaagcagaaugaaaccaca

SEQ ID NO: 417690 - RNA, 32 nt, Human
gaagcagacauugucucuacaagcucagagag

SEQ ID NO: 417691 - RNA, 32 nt, Human
gaagcagaccagcccacuacagagccaggcau

SEQ ID NO: 417692 - RNA, 32 nt, Human
gaagcagacccggggguguccucccugcccuc

SEQ ID NO: 417693 - RNA, 19 nt, Human
gaagcagacggcggcgcug

SEQ ID NO: 417694 - RNA, 32 nt, Human
gaagcagagaugggggcucccuauguugccca

SEQ ID NO: 417695 - RNA, 32 nt, Human
gaagcagagcagcgugaggaagauggugcuca

SEQ ID NO: 417696 - RNA, 32 nt, Human
gaagcagagccuggucgugaggaacagccgcc

SEQ ID NO: 417697 - RNA, 32 nt, Human
gaagcagagggagggacugggcagggacugcc

SEQ ID NO: 417698 - RNA, 32 nt, Human
gaagcagauaaauugauaucuuguaccugaaa

SEQ ID NO: 417699 - RNA, 32 nt, Human
gaagcagauauccaaagggugcagccccuuuu

SEQ ID NO: 417700 - RNA, 32 nt, Human
gaagcagaucugaggacaucucugugccaggc

SEQ ID NO: 417701 - RNA, 32 nt, Human
gaagcagaugcugauugggacccauauaccac

SEQ ID NO: 417702 - RNA, 32 nt, Human
gaagcagauuuuaaccccaucuggcagccauu

SEQ ID NO: 417703 - RNA, 28 nt, Human
gaagcagcaagugcugacaucaucacgg

SEQ ID NO: 417704 - RNA, 32 nt, Human
gaagcagcaauucugccacuaccagcagcaac

SEQ ID NO: 417705 - RNA, 32 nt, Human
gaagcagcaccagaacaccaccuacuuccugg

SEQ ID NO: 417706 - RNA, 32 nt, Human
gaagcagcagaggggacuccccaucccgggca

SEQ ID NO: 417707 - RNA, 32 nt, Human
gaagcagcaggaaaugugcauguggguagaga

SEQ ID NO: 417708 - RNA, 32 nt, Human
gaagcagcaucaggacagcagagcagagcccc

SEQ ID NO: 417709 - RNA, 32 nt, Human
gaagcagccaggaguggcuggggaagaaucug

SEQ ID NO: 417710 - RNA, 21 nt, Human
gaagcagccauuucaucacua

SEQ ID NO: 417711 - RNA, 32 nt, Human
gaagcagccuggguguguaaagagauagucau

SEQ ID NO: 417712 - RNA, 32 nt, Human
gaagcagcuauccacaaagcuuccugccccag

SEQ ID NO: 417713 - RNA, 32 nt, Human
gaagcagcuccaggagcgccggcgccggcugg

SEQ ID NO: 417714 - RNA, 32 nt, Human
gaagcagcucuuggaggagaugagcauuuugu

SEQ ID NO: 417715 - RNA, 22 nt, Human
gaagcagcugacaugcuggugg

SEQ ID NO: 417716 - RNA, 20 nt, Human
gaagcagcugagacuguugg

SEQ ID NO: 417717 - RNA, 21 nt, Human
gaagcagcugauccuggaggg

SEQ ID NO: 417718 - RNA, 32 nt, Human
gaagcagcugccgaaagcugcagccuuuccgc

SEQ ID NO: 417719 - RNA, 32 nt, Human
gaagcagcuggcagccuggggcgugcuucagg

SEQ ID NO: 417720 - RNA, 32 nt, Human
gaagcagcuuuuccuacgaucugcauuaugua

SEQ ID NO: 417721 - RNA, 31 nt, Human
gaagcaggaaagggagacaaagacuggcuuc

SEQ ID NO: 417722 - RNA, 32 nt, Human
gaagcaggaaagggagacaaagacuggcuucu

SEQ ID NO: 417723 - RNA, 32 nt, Human
gaagcaggaauacaggacacagcagacccucg

SEQ ID NO: 417724 - RNA, 32 nt, Human
gaagcaggacucagaggaagagcacccugacc

SEQ ID NO: 417725 - RNA, 32 nt, Human
gaagcaggagaaagaugaggacuuugacugga

SEQ ID NO: 417726 - RNA, 22 nt, Human
gaagcaggagaaucacuuaaac

SEQ ID NO: 417727 - RNA, 22 nt, Human
gaagcaggagaaucacuugaac

SEQ ID NO: 417728 - RNA, 32 nt, Human
gaagcaggagaaucacuugaacucaggaggca

SEQ ID NO: 417729 - RNA, 21 nt, Human
gaagcaggagaaucgcuggaa

SEQ ID NO: 417730 - RNA, 22 nt, Human
gaagcaggagaaucgcuggaac

SEQ ID NO: 417731 - RNA, 22 nt, Human
gaagcaggagaaucgcuuaaau

SEQ ID NO: 417732 - RNA, 21 nt, Human
gaagcaggagaaucgcuugaa

SEQ ID NO: 417733 - RNA, 22 nt, Human
gaagcaggagaaucgcuugaac

SEQ ID NO: 417734 - RNA, 21 nt, Human
gaagcaggagaaucgcuugag

SEQ ID NO: 417735 - RNA, 21 nt, Human
gaagcaggagaauugccugaa

SEQ ID NO: 417736 - RNA, 22 nt, Human
gaagcaggagaauugccugaac

SEQ ID NO: 417737 - RNA, 22 nt, Human
gaagcaggagaauugcucaaac

SEQ ID NO: 417738 - RNA, 21 nt, Human
gaagcaggagaauugcucgaa

SEQ ID NO: 417739 - RNA, 22 nt, Human
gaagcaggagaauugcucgaac

SEQ ID NO: 417740 - RNA, 21 nt, Human
gaagcaggagaauugcuugaa

SEQ ID NO: 417741 - RNA, 22 nt, Human
gaagcaggagaauugcuugaac

SEQ ID NO: 417742 - RNA, 32 nt, Human
gaagcaggagagaaggcugggcagaagggcug

SEQ ID NO: 417743 - RNA, 32 nt, Human
gaagcaggagagggggaggaaaaggagaggga

SEQ ID NO: 417744 - RNA, 19 nt, Human
gaagcaggagcaucuucuu

SEQ ID NO: 417745 - RNA, 32 nt, Human
gaagcaggagcccagaccgugggagagccaga

SEQ ID NO: 417746 - RNA, 32 nt, Human
gaagcaggagcugcugaaguugcuggucaacc

SEQ ID NO: 417747 - RNA, 32 nt, Human
gaagcaggaggaaggaaggacuggaaggaaaa

SEQ ID NO: 417748 - RNA, 32 nt, Human
gaagcaggaggaggggaggagagaguggggcu

SEQ ID NO: 417749 - RNA, 32 nt, Human
gaagcaggagguggagaagacccagugaagug

SEQ ID NO: 417750 - RNA, 22 nt, Human
gaagcaggauaaucgcuugaac

SEQ ID NO: 417751 - RNA, 20 nt, Human
gaagcaggcagaucaccuga

SEQ ID NO: 417752 - RNA, 32 nt, Human
gaagcaggccgcagaguagacagcugcuccuu

SEQ ID NO: 417753 - RNA, 32 nt, Human
gaagcaggccuugaugagggugcaugagugua

SEQ ID NO: 417754 - RNA, 31 nt, Human
gaagcaggcgagagagaaacagcuacugcgu

SEQ ID NO: 417755 - RNA, 22 nt, Human
gaagcaggcggaucacgagguc

SEQ ID NO: 417756 - RNA, 32 nt, Human
gaagcagggauaggugggcugcagugacauca

SEQ ID NO: 417757 - RNA, 32 nt, Human
gaagcagggccaaacccucuuccuugucuccc

SEQ ID NO: 417758 - RNA, 32 nt, Human
gaagcagggcccagaggagacccaucaacuca

SEQ ID NO: 417759 - RNA, 32 nt, Human
gaagcagggcuucagcagcuucgacugucuua

SEQ ID NO: 417760 - RNA, 32 nt, Human
gaagcaggggcugaggaacacuuagagggugg

SEQ ID NO: 417761 - RNA, 32 nt, Human
gaagcagggucugcucuuccccuggggaagca

SEQ ID NO: 417762 - RNA, 32 nt, Human
gaagcagggugaagaauggguuggagcaugga

SEQ ID NO: 417763 - RNA, 17 nt, Human
gaagcagggugguggca

SEQ ID NO: 417764 - RNA, 32 nt, Human
gaagcagguauucuuguccaaggaacaggugc

SEQ ID NO: 417765 - RNA, 32 nt, Human
gaagcaggucugggugaaagagcugugaaugg

SEQ ID NO: 417766 - RNA, 32 nt, Human
gaagcaggugaagagcaaccacaaguuuaaau

SEQ ID NO: 417767 - RNA, 32 nt, Human
gaagcaguagagugcuuccagggaggagaaag

SEQ ID NO: 417768 - RNA, 32 nt, Human
gaagcaguagcugagcaccugcccucacauac

SEQ ID NO: 417769 - RNA, 32 nt, Human
gaagcagucaccaaaauccagugagaaacacc

SEQ ID NO: 417770 - RNA, 19 nt, Human
gaagcagucauaccugcuc

SEQ ID NO: 417771 - RNA, 32 nt, Human
gaagcagucugcagacuggagaucccaugacg

SEQ ID NO: 417772 - RNA, 32 nt, Human
gaagcagugggcucuccaggugcagugguuca

SEQ ID NO: 417773 - RNA, 32 nt, Human
gaagcaguucaaggaucuaaagagcaucaagg

SEQ ID NO: 417774 - RNA, 32 nt, Human
gaagcaguuucacaucagucucuccagauagc

SEQ ID NO: 417775 - RNA, 32 nt, Human
gaagcauaaaacacagggagcugguggguugg

SEQ ID NO: 417776 - RNA, 32 nt, Human
gaagcauagcuccagcuggaggguaccuuuua

SEQ ID NO: 417777 - RNA, 32 nt, Human
gaagcauauauggccacaaagcacagaggcuu

SEQ ID NO: 417778 - RNA, 32 nt, Human
gaagcauauugcugaguggugccugaaaauug

SEQ ID NO: 417779 - RNA, 27 nt, Human
gaagcaucaauaaauauuugagaaaug

SEQ ID NO: 417780 - RNA, 32 nt, Human
gaagcaucacccaggcuggcagaucaugguag

SEQ ID NO: 417781 - RNA, 19 nt, Human
gaagcaucgugcauaguuc

SEQ ID NO: 417782 - RNA, 32 nt, Human
gaagcaucuuggugauguagcucuuuucuuca

SEQ ID NO: 417783 - RNA, 32 nt, Human
gaagcaugaacaaauccacaaaaugcccaaga

SEQ ID NO: 417784 - RNA, 32 nt, Human
gaagcaugacagccaccuuggcaccaggagga

SEQ ID NO: 417785 - RNA, 32 nt, Human
gaagcaugagggagggagggaggagggagaaa

SEQ ID NO: 417786 - RNA, 32 nt, Human
gaagcaugcccucccuguccauuugucuuaua

SEQ ID NO: 417787 - RNA, 32 nt, Human
gaagcaugcuagagugaaagaaaaagaaagag

SEQ ID NO: 417788 - RNA, 32 nt, Human
gaagcaugcuagagugaaagaaagagagcacg

SEQ ID NO: 417789 - RNA, 32 nt, Human
gaagcauggauggggaugaaggcacaggcguc

SEQ ID NO: 417790 - RNA, 21 nt, Human
gaagcauggcagcaucugcuu

SEQ ID NO: 417791 - RNA, 32 nt, Human
gaagcauggccugggagcuuggaagggagggg

SEQ ID NO: 417792 - RNA, 32 nt, Human
gaagcauggcgcaccagccucugcaacuagug

SEQ ID NO: 417793 - RNA, 32 nt, Human
gaagcaugggggcaggagcagagcagacacag

SEQ ID NO: 417794 - RNA, 32 nt, Human
gaagcauggucugccuggacugcacuucucua

SEQ ID NO: 417795 - RNA, 30 nt, Human
gaagcaugucggccaccagcguggacaccc

SEQ ID NO: 417796 - RNA, 32 nt, Human
gaagcauuaugaaggccagacuuacucauuuu

SEQ ID NO: 417797 - RNA, 32 nt, Human
gaagcauuccagcaugauuccucagaugcaau

SEQ ID NO: 417798 - RNA, 32 nt, Human
gaagcauuccccuggaaaaccagcacaagaca

SEQ ID NO: 417799 - RNA, 32 nt, Human
gaagcauucugacuucugguuuuuccacccug

SEQ ID NO: 417800 - RNA, 32 nt, Human
gaagcauucuggaagccaugggaacaggagcu

SEQ ID NO: 417801 - RNA, 32 nt, Human
gaagcauuggaaggaauguagcuuuaaaauga

SEQ ID NO: 417802 - RNA, 32 nt, Human
gaagcauugucuguaggccagcacucauccuc

SEQ ID NO: 417803 - RNA, 32 nt, Human
gaagcauuucaccucugaucucagcuucccca

SEQ ID NO: 417804 - RNA, 32 nt, Human
gaagccaaaaggagauucacauaauggcccaa

SEQ ID NO: 417805 - RNA, 32 nt, Human
gaagccaaaaguuaugaaaugcaucagcagug

SEQ ID NO: 417806 - RNA, 32 nt, Human
gaagccaaacaaggagcuuucugcagaaugaa

SEQ ID NO: 417807 - RNA, 32 nt, Human
gaagccaaacagcaagaagcuguuaccacacc

SEQ ID NO: 417808 - RNA, 32 nt, Human
gaagccaagcuggccgagguugcaguccauga

SEQ ID NO: 417809 - RNA, 27 nt, Human
gaagccaaggcaaaaggaucgcuugag

SEQ ID NO: 417810 - RNA, 27 nt, Human
gaagccaaggcaggaagacugcuugaa

SEQ ID NO: 417811 - RNA, 27 nt, Human
gaagccaaggcagguggaucgcuugag

SEQ ID NO: 417812 - RNA, 32 nt, Human
gaagccaagguacagagagcagccuggcccuc

SEQ ID NO: 417813 - RNA, 32 nt, Human
gaagccaaggugggcggaucaccugaggucag

SEQ ID NO: 417814 - RNA, 32 nt, Human
gaagccaauggagggagagggagcgucagaag

SEQ ID NO: 417815 - RNA, 32 nt, Human
gaagccacagaaggaugcagagagagaccaac

SEQ ID NO: 417816 - RNA, 32 nt, Human
gaagccacagaagucaccgaugaaccacugga

SEQ ID NO: 417817 - RNA, 32 nt, Human
gaagccacaugcuggauggcuacaaggggcuc

SEQ ID NO: 417818 - RNA, 32 nt, Human
gaagccaccaacaaugaguacucagagaucaa

SEQ ID NO: 417819 - RNA, 32 nt, Human
gaagccaccacuggcuuucaggcuugggggug

SEQ ID NO: 417820 - RNA, 32 nt, Human
gaagccaccaucaaaacaaaggaugggauacg

SEQ ID NO: 417821 - RNA, 32 nt, Human
gaagccacccaaccucuccaucaccaucccgc

SEQ ID NO: 417822 - RNA, 32 nt, Human
gaagccaccgggaaagcagccagcacaaaggg

SEQ ID NO: 417823 - RNA, 32 nt, Human
gaagccaccucggggugacugagcggaaggcc

SEQ ID NO: 417824 - RNA, 32 nt, Human
gaagccacugccuccccuggcugugccacagc

SEQ ID NO: 417825 - RNA, 19 nt, Human
gaagccacuucuuuuggcu

SEQ ID NO: 417826 - RNA, 32 nt, Human
gaagccacuuugccucuucucccuucaagcac

SEQ ID NO: 417827 - RNA, 32 nt, Human
gaagccagaagccaggggguggggaagagaga

SEQ ID NO: 417828 - RNA, 32 nt, Human
gaagccagaaggaaugaaggccugcagugagg

SEQ ID NO: 417829 - RNA, 32 nt, Human
gaagccagacacaacccugcguacgcugcuca

SEQ ID NO: 417830 - RNA, 32 nt, Human
gaagccagaccaggaaagugaaaggaaaugga

SEQ ID NO: 417831 - RNA, 20 nt, Human
gaagccagaccuggguuggg

SEQ ID NO: 417832 - RNA, 32 nt, Human
gaagccagacgcacaccagcaggaugacaaac

SEQ ID NO: 417833 - RNA, 32 nt, Human
gaagccagaggaccuggagcugcugaugcggc

SEQ ID NO: 417834 - RNA, 22 nt, Human
gaagccagaggcagagguugca

SEQ ID NO: 417835 - RNA, 32 nt, Human
gaagccagaggcagagguugcaaugagccggg

SEQ ID NO: 417836 - RNA, 32 nt, Human
gaagccagagucuuauaacaccucccaagaaa

SEQ ID NO: 417837 - RNA, 32 nt, Human
gaagccagaugcuucaggauuaagaccccaug

SEQ ID NO: 417838 - RNA, 32 nt, Human
gaagccagccccaccagggcugugcugugacu

SEQ ID NO: 417839 - RNA, 32 nt, Human
gaagccagccuaucaccuggcugggugagaag

SEQ ID NO: 417840 - RNA, 32 nt, Human
gaagccagccuggaccauacacugccuggagg

SEQ ID NO: 417841 - RNA, 32 nt, Human
gaagccagccugggcaacaaagugagaccgag

SEQ ID NO: 417842 - RNA, 32 nt, Human
gaagccagccuuucagcaccccuuacccucca

SEQ ID NO: 417843 - RNA, 32 nt, Human
gaagccagcugguaauguauauucaggacuuc

SEQ ID NO: 417844 - RNA, 30 nt, Human
gaagccagcuugcagagagagcaagaacag

SEQ ID NO: 417845 - RNA, 32 nt, Human
gaagccaggacagaggccaggagccagcccug

SEQ ID NO: 417846 - RNA, 32 nt, Human
gaagccaggacgucaggcugaccaacaccuca

SEQ ID NO: 417847 - RNA, 32 nt, Human
gaagccaggagaagaagagggagaaacugucc

SEQ ID NO: 417848 - RNA, 32 nt, Human
gaagccaggagcucaagaacagccugggcaaa

SEQ ID NO: 417849 - RNA, 32 nt, Human
gaagccaggagcucaagagcagccugggcaau

SEQ ID NO: 417850 - RNA, 24 nt, Human
gaagccaggaggcagagguugcag

SEQ ID NO: 417851 - RNA, 32 nt, Human
gaagccaggaggcagagguugcagugagccaa

SEQ ID NO: 417852 - RNA, 32 nt, Human
gaagccaggaggcagagguugcaguuagccca

SEQ ID NO: 417853 - RNA, 32 nt, Human
gaagccaggaggcggagguugcagugagccga

SEQ ID NO: 417854 - RNA, 32 nt, Human
gaagccaggaguucaagaccagccuggccaac

SEQ ID NO: 417855 - RNA, 32 nt, Human
gaagccaggaguuccagaccagccugggcagc

SEQ ID NO: 417856 - RNA, 32 nt, Human
gaagccaggaguucgagaccagccuggguaac

SEQ ID NO: 417857 - RNA, 24 nt, Human
gaagccaggaguuugagaccagcu

SEQ ID NO: 417858 - RNA, 32 nt, Human
gaagccaggaguuugggaccagccugggcaac

SEQ ID NO: 417859 - RNA, 32 nt, Human
gaagccaggccuggccuugccucaguuguauc

SEQ ID NO: 417860 - RNA, 32 nt, Human
gaagccaggcggggugcagacggcugcugauu

SEQ ID NO: 417861 - RNA, 21 nt, Human
gaagccaggcuaacuggguga

SEQ ID NO: 417862 - RNA, 32 nt, Human
gaagccaggcucugugcuucugccuuuaaggc

SEQ ID NO: 417863 - RNA, 32 nt, Human
gaagccagggagaagcauugauugaugugggc

SEQ ID NO: 417864 - RNA, 32 nt, Human
gaagccagggagggagacaggagggcaggagg

SEQ ID NO: 417865 - RNA, 32 nt, Human
gaagccagggccugggacccucuggcugggca

SEQ ID NO: 417866 - RNA, 32 nt, Human
gaagccaggggacuccagccugggcgggguga

SEQ ID NO: 417867 - RNA, 32 nt, Human
gaagccaggggcccugcacucaugccaccugc

SEQ ID NO: 417868 - RNA, 32 nt, Human
gaagccaguaguucaagaccagccugggcaac

SEQ ID NO: 417869 - RNA, 32 nt, Human
gaagccagugagaccacgagccccagaagaac

SEQ ID NO: 417870 - RNA, 32 nt, Human
gaagccagugcacgccagccugggcgacagac

SEQ ID NO: 417871 - RNA, 18 nt, Human
gaagccagugccugugua

SEQ ID NO: 417872 - RNA, 32 nt, Human
gaagccagugccuguguacucacugaaauuga

SEQ ID NO: 417873 - RNA, 30 nt, Human
gaagccaguguggaaucagaacagauaaca

SEQ ID NO: 417874 - RNA, 32 nt, Human
gaagccauacccucccccaucugggggcccug

SEQ ID NO: 417875 - RNA, 32 nt, Human
gaagccauaggagccuccagaugggggcuggc

SEQ ID NO: 417876 - RNA, 32 nt, Human
gaagccauagugucacuuccacacaauuauuu

SEQ ID NO: 417877 - RNA, 32 nt, Human
gaagccaucaccuggcccaugucccuacaaac

SEQ ID NO: 417878 - RNA, 32 nt, Human
gaagccaucccuccucccccaggauccacaug

SEQ ID NO: 417879 - RNA, 32 nt, Human
gaagccaugcagauacccagcauggagaaccc

SEQ ID NO: 417880 - RNA, 24 nt, Human
gaagccaugcagugacacccgcua

SEQ ID NO: 417881 - RNA, 32 nt, Human
gaagccauggccugccugccuuuuggcuuugu

SEQ ID NO: 417882 - RNA, 32 nt, Human
gaagccaugucagcaccacacacugcagcucu

SEQ ID NO: 417883 - RNA, 32 nt, Human
gaagccaugugcauuauccuuuacggacgcag

SEQ ID NO: 417884 - RNA, 32 nt, Human
gaagccauucaguguuuccaucuuggcugagu

SEQ ID NO: 417885 - RNA, 32 nt, Human
gaagcccaagugggugaaucaccugaggucag

SEQ ID NO: 417886 - RNA, 32 nt, Human
gaagcccaaucacuacaaccacuaaccacaac

SEQ ID NO: 417887 - RNA, 32 nt, Human
gaagcccacagaagacagagaaggaacaacua

SEQ ID NO: 417888 - RNA, 32 nt, Human
gaagcccacaguuaaaucagaggucacaaaua

SEQ ID NO: 417889 - RNA, 32 nt, Human
gaagcccaccugcaauuucccaccuccugccc

SEQ ID NO: 417890 - RNA, 32 nt, Human
gaagcccagcagaugggagcaccuggacuugg

SEQ ID NO: 417891 - RNA, 32 nt, Human
gaagcccagccccucaggugcccccacacaca

SEQ ID NO: 417892 - RNA, 21 nt, Human
gaagcccagcuaaagccaaga

SEQ ID NO: 417893 - RNA, 18 nt, Human
gaagcccagcucugggaa

SEQ ID NO: 417894 - RNA, 32 nt, Human
gaagcccaggaggugguguuggcugcagggua

SEQ ID NO: 417895 - RNA, 32 nt, Human
gaagcccagggaggggaagagggugcuccccc

SEQ ID NO: 417896 - RNA, 32 nt, Human
gaagcccagggcuguggagcagccucucuccu

SEQ ID NO: 417897 - RNA, 23 nt, Human
gaagcccaggggcucaggacagg

SEQ ID NO: 417898 - RNA, 32 nt, Human
gaagcccagggugaagacagucacucauccgu

SEQ ID NO: 417899 - RNA, 32 nt, Human
gaagcccagggugggauguuagagggcauagu

SEQ ID NO: 417900 - RNA, 21 nt, Human
gaagcccagucucugagcuga

SEQ ID NO: 417901 - RNA, 32 nt, Human
gaagcccaguguccucagcuucauguccagug

SEQ ID NO: 417902 - RNA, 32 nt, Human
gaagcccaguuggcuggaaccgagaguugguc

SEQ ID NO: 417903 - RNA, 32 nt, Human
gaagcccaguuugcucucugguguuuguuaau

SEQ ID NO: 417904 - RNA, 32 nt, Human
gaagcccauagcccuuucccagccuuuuuggu

SEQ ID NO: 417905 - RNA, 32 nt, Human
gaagcccaugaggaccauuguguggauccaug

SEQ ID NO: 417906 - RNA, 32 nt, Human
gaagcccaugcaggaagcucuugaguuacugu

SEQ ID NO: 417907 - RNA, 21 nt, Human
gaagccccaagcaacuuuccu

SEQ ID NO: 417908 - RNA, 17 nt, Human
gaagccccacuugcccu

SEQ ID NO: 417909 - RNA, 32 nt, Human
gaagccccaggccgcagggggcaaggggccag

SEQ ID NO: 417910 - RNA, 32 nt, Human
gaagccccagguagcaggcuucagagagaaua

SEQ ID NO: 417911 - RNA, 32 nt, Human
gaagccccaucuuucugucuccacgcauggag

SEQ ID NO: 417912 - RNA, 32 nt, Human
gaagcccccagccagggcggggcggcgcagcc

SEQ ID NO: 417913 - RNA, 32 nt, Human
gaagcccccaggcugcgucuggaguggcagag

SEQ ID NO: 417914 - RNA, 24 nt, Human
gaagccccccaccccagcuuuccu

SEQ ID NO: 417915 - RNA, 21 nt, Human
gaagcccccuuugccaucccu

SEQ ID NO: 417916 - RNA, 32 nt, Human
gaagccccuccaucugcccugggguggaggca

SEQ ID NO: 417917 - RNA, 32 nt, Human
gaagccccuccccucucacacugaccuccccc

SEQ ID NO: 417918 - RNA, 32 nt, Human
gaagccccugaccuucuugaauaaccuggaua

SEQ ID NO: 417919 - RNA, 32 nt, Human
gaagccccuggaaggcagaaaaguugggagca

SEQ ID NO: 417920 - RNA, 24 nt, Human
gaagccccuggcauuugcugggga

SEQ ID NO: 417921 - RNA, 32 nt, Human
gaagccccuuccucccuccacuugcucccucu

SEQ ID NO: 417922 - RNA, 32 nt, Human
gaagcccgaccaagcuguccccuuccccugug

SEQ ID NO: 417923 - RNA, 32 nt, Human
gaagcccgaggaacucuuugcuccccugcuuu

SEQ ID NO: 417924 - RNA, 32 nt, Human
gaagcccgcggcagcggcagccuggauccagg

SEQ ID NO: 417925 - RNA, 21 nt, Human
gaagcccguccuccuaugcug

SEQ ID NO: 417926 - RNA, 32 nt, Human
gaagcccgugaagccgucaucuaaguccugcu

SEQ ID NO: 417927 - RNA, 32 nt, Human
gaagcccuaccugacuucccuaggcagguauu

SEQ ID NO: 417928 - RNA, 32 nt, Human
gaagcccuaugacauccucaggcuccccagac

SEQ ID NO: 417929 - RNA, 32 nt, Human
gaagcccucccgccuccugcccacaauggccu

SEQ ID NO: 417930 - RNA, 21 nt, Human
gaagcccucgagguucuggcu

SEQ ID NO: 417931 - RNA, 32 nt, Human
gaagcccucuccucagcuuuacuugcuccccc

SEQ ID NO: 417932 - RNA, 32 nt, Human
gaagcccucugcagucaugagcucugacgcag

SEQ ID NO: 417933 - RNA, 32 nt, Human
gaagcccugcagcuacagcugcuucauucccu

SEQ ID NO: 417934 - RNA, 32 nt, Human
gaagcccugccugcccucugccaccgggcugg

SEQ ID NO: 417935 - RNA, 32 nt, Human
gaagcccugcucaugagaagccuccccuuugc

SEQ ID NO: 417936 - RNA, 32 nt, Human
gaagcccugcuccucuucuccccaccaaggca

SEQ ID NO: 417937 - RNA, 32 nt, Human
gaagcccuggagacagccguugggugagggug

SEQ ID NO: 417938 - RNA, 32 nt, Human
gaagcccugggagcuguggcagcauccucucc

SEQ ID NO: 417939 - RNA, 32 nt, Human
gaagcccuuagacugccaggcacagagucggg

SEQ ID NO: 417940 - RNA, 19 nt, Human
gaagcccuucuaccuuccu

SEQ ID NO: 417941 - RNA, 32 nt, Human
gaagcccuugugugugcaggggugcacauguu

SEQ ID NO: 417942 - RNA, 32 nt, Human
gaagcccuuuuugcucuuucuguucagaugag

SEQ ID NO: 417943 - RNA, 32 nt, Human
gaagccgaagaagaaaauccaguagcacgguu

SEQ ID NO: 417944 - RNA, 32 nt, Human
gaagccgacccaggccugaggggccaggaacu

SEQ ID NO: 417945 - RNA, 32 nt, Human
gaagccgacgugggaggguagcuugaggccag

SEQ ID NO: 417946 - RNA, 25 nt, Human
gaagccgagaccuaaaguugggggg

SEQ ID NO: 417947 - RNA, 32 nt, Human
gaagccgagccgcggcuccuagcggcggcgcc

SEQ ID NO: 417948 - RNA, 32 nt, Human
gaagccgaggcgggcagaucaccugaggucag

SEQ ID NO: 417949 - RNA, 32 nt, Human
gaagccgaggugggcagaucaccugaggccag

SEQ ID NO: 417950 - RNA, 32 nt, Human
gaagccgaggugggcggaucaccugaggucgg

SEQ ID NO: 417951 - RNA, 32 nt, Human
gaagccgagucaggugggucaccugaggucag

SEQ ID NO: 417952 - RNA, 32 nt, Human
gaagccgagucggguggaucaccugaggucag

SEQ ID NO: 417953 - RNA, 32 nt, Human
gaagccgcagcccaaggaggucgucacuugcc

SEQ ID NO: 417954 - RNA, 32 nt, Human
gaagccgcauuuucacgcuggcuggcagugug

SEQ ID NO: 417955 - RNA, 32 nt, Human
gaagccgcucaggcucaagagcaacauggagg

SEQ ID NO: 417956 - RNA, 32 nt, Human
gaagccgcucaggcucaagagcaacauggggg

SEQ ID NO: 417957 - RNA, 32 nt, Human
gaagccgcugccccuugcaccuccucgggccu

SEQ ID NO: 417958 - RNA, 32 nt, Human
gaagccggcccccgcucugcagaagcugcauu

SEQ ID NO: 417959 - RNA, 32 nt, Human
gaagccggcgagggggagccagcagcggcggu

SEQ ID NO: 417960 - RNA, 32 nt, Human
gaagccggcuuuggcccugcggcugcuaccgu

SEQ ID NO: 417961 - RNA, 32 nt, Human
gaagccgggagcggcaggcgggcgagauaagu

SEQ ID NO: 417962 - RNA, 32 nt, Human
gaagccgggaggcggaaguuguggugagccga

SEQ ID NO: 417963 - RNA, 32 nt, Human
gaagccgggaggcucagccugaaaguggcucc

SEQ ID NO: 417964 - RNA, 32 nt, Human
gaagccgggagguggggguugcagugagccga

SEQ ID NO: 417965 - RNA, 32 nt, Human
gaagccgggcagcagaggaguacuugaagugg

SEQ ID NO: 417966 - RNA, 32 nt, Human
gaagccgggcggggccagggggucaaacacgg

SEQ ID NO: 417967 - RNA, 32 nt, Human
gaagccgucgcccguggcagacugccugcuga

SEQ ID NO: 417968 - RNA, 32 nt, Human
gaagccguugccagccugucucugcgcucgcc

SEQ ID NO: 417969 - RNA, 32 nt, Human
gaagccuacagcaacauucugagacugcucca

SEQ ID NO: 417970 - RNA, 32 nt, Human
gaagccuacaucuucuuauucuauuuaggaau

SEQ ID NO: 417971 - RNA, 32 nt, Human
gaagccuacuggcuggaaucagugcuccagca

SEQ ID NO: 417972 - RNA, 32 nt, Human
gaagccuagcagcugcuccauaaaccuagccc

SEQ ID NO: 417973 - RNA, 32 nt, Human
gaagccuagggggugggccgccagucuucagg

SEQ ID NO: 417974 - RNA, 32 nt, Human
gaagccucaaauacaauacuuauuuuauuuau

SEQ ID NO: 417975 - RNA, 32 nt, Human
gaagccucacaagaguggagacauauggacug

SEQ ID NO: 417976 - RNA, 32 nt, Human
gaagccucacugggcugcuaugucucuguauu

SEQ ID NO: 417977 - RNA, 32 nt, Human
gaagccucagacauugccaucggcugugaaag

SEQ ID NO: 417978 - RNA, 32 nt, Human
gaagccucagcucuggacagcugugccuucac

SEQ ID NO: 417979 - RNA, 32 nt, Human
gaagccucagggagcuacaacaucaaguuacg

SEQ ID NO: 417980 - RNA, 32 nt, Human
gaagccuccucagcguggguucuuggaagagg

SEQ ID NO: 417981 - RNA, 32 nt, Human
gaagccucuaucuccucuucacccauaagaaa

SEQ ID NO: 417982 - RNA, 32 nt, Human
gaagccucucugucaucuccccuucccagccc

SEQ ID NO: 417983 - RNA, 32 nt, Human
gaagccucugugcugcucaccugcccaaagcc

SEQ ID NO: 417984 - RNA, 32 nt, Human
gaagccugaaagagagaaaacuccaucggaag

SEQ ID NO: 417985 - RNA, 32 nt, Human
gaagccugaggagccuuccagcucuaagauag

SEQ ID NO: 417986 - RNA, 32 nt, Human
gaagccugaggggaaggaaggaaguacgggcg

SEQ ID NO: 417987 - RNA, 32 nt, Human
gaagccugagucuauuuuggaucuguaaauaa

SEQ ID NO: 417988 - RNA, 32 nt, Human
gaagccugcagcguucacgaagugacauugau

SEQ ID NO: 417989 - RNA, 32 nt, Human
gaagccugcagggaaagccacuggagaguuuu

SEQ ID NO: 417990 - RNA, 32 nt, Human
gaagccugcaucccgcuccccugggccccgac

SEQ ID NO: 417991 - RNA, 32 nt, Human
gaagccugcccuggcccagccuggcugggucu

SEQ ID NO: 417992 - RNA, 32 nt, Human
gaagccugcuucagaagugacugaaacggcau

SEQ ID NO: 417993 - RNA, 32 nt, Human
gaagccuggaaauguugacccucaaagggcau

SEQ ID NO: 417994 - RNA, 32 nt, Human
gaagccuggacucugccccacgcuguggcccu

SEQ ID NO: 417995 - RNA, 32 nt, Human
gaagccuggaggcggaggcugcacugagcuga

SEQ ID NO: 417996 - RNA, 32 nt, Human
gaagccuggaguagggagagcgaguuugggag

SEQ ID NO: 417997 - RNA, 32 nt, Human
gaagccugggaggacgguggcuugccggucug

SEQ ID NO: 417998 - RNA, 32 nt, Human
gaagccugggcugcugggacuggguucauucu

SEQ ID NO: 417999 - RNA, 32 nt, Human
gaagccuggggacugcagcccagggacgaggc

SEQ ID NO: 418000 - RNA, 32 nt, Human
gaagccuggguaaaauuguauuacaugaucuu

SEQ ID NO: 418001 - RNA, 32 nt, Human
gaagccuguaaucccagcuacuugggaggcug

SEQ ID NO: 418002 - RNA, 32 nt, Human
gaagccuguaggagaccuugagccagaggacc

SEQ ID NO: 418003 - RNA, 32 nt, Human
gaagccuguagucccagcuacuccggaggcug

SEQ ID NO: 418004 - RNA, 32 nt, Human
gaagccuguagucccagcuacucgggaggcug

SEQ ID NO: 418005 - RNA, 32 nt, Human
gaagccuguccacccaugcuuggagaggcuug

SEQ ID NO: 418006 - RNA, 32 nt, Human
gaagccugugaugaggcugagauaaagcacag

SEQ ID NO: 418007 - RNA, 32 nt, Human
gaagccugugccacuacauccuggaguuuggc

SEQ ID NO: 418008 - RNA, 32 nt, Human
gaagccuuagagggugacauagcuagaaagug

SEQ ID NO: 418009 - RNA, 32 nt, Human
gaagccuucagguugcugugcaauggaauagu

SEQ ID NO: 418010 - RNA, 32 nt, Human
gaagccuucauuuaaucucugcaguucaucuc

SEQ ID NO: 418011 - RNA, 32 nt, Human
gaagccuugaggucugucaccacccacagcca

SEQ ID NO: 418012 - RNA, 32 nt, Human
gaagccuugugcaaaggucggugcccagcccc

SEQ ID NO: 418013 - RNA, 32 nt, Human
gaagccuugugcaaaugcccuaggggugugcu

SEQ ID NO: 418014 - RNA, 32 nt, Human
gaagccuugugggugugagcagcacccaucca

SEQ ID NO: 418015 - RNA, 31 nt, Human
gaagccuuguuucacugaguuggagagacug

SEQ ID NO: 418016 - RNA, 32 nt, Human
gaagccuuuccaggacccauguguaggcacaa

SEQ ID NO: 418017 - RNA, 32 nt, Human
gaagccuuucuaggaagaggauugcccucaua

SEQ ID NO: 418018 - RNA, 32 nt, Human
gaagccuuucuuuuccauuguuucuggauauu

SEQ ID NO: 418019 - RNA, 32 nt, Human
gaagccuuugaagauuucaguuuguaaguagu

SEQ ID NO: 418020 - RNA, 32 nt, Human
gaagccuuugcacccugggaggaaggaccacc

SEQ ID NO: 418021 - RNA, 32 nt, Human
gaagcgaagccgaaaaaggcagcagcgaagga

SEQ ID NO: 418022 - RNA, 32 nt, Human
gaagcgaccccgggggcagcccgggccguguc

SEQ ID NO: 418023 - RNA, 32 nt, Human
gaagcgagagagcugcugccacugcugcuacc

SEQ ID NO: 418024 - RNA, 32 nt, Human
gaagcgagagaggcaccuuguucuccaagaac

SEQ ID NO: 418025 - RNA, 32 nt, Human
gaagcgagaggaugagaggaggccggcccagc

SEQ ID NO: 418026 - RNA, 32 nt, Human
gaagcgagcacaggcugggguggaugacuuau

SEQ ID NO: 418027 - RNA, 32 nt, Human
gaagcgagggccugguucugaggggucggcuu

SEQ ID NO: 418028 - RNA, 23 nt, Human
gaagcgaguggaucaccugaggu

SEQ ID NO: 418029 - RNA, 32 nt, Human
gaagcgcagccccugugaauaacagguggcuu

SEQ ID NO: 418030 - RNA, 32 nt, Human
gaagcgcagcgcaguggcgagaggagccccuu

SEQ ID NO: 418031 - RNA, 32 nt, Human
gaagcgccgacucccugagucuggaccuccau

SEQ ID NO: 418032 - RNA, 32 nt, Human
gaagcgccuccaaacucacagccucguagagc

SEQ ID NO: 418033 - RNA, 18 nt, Human
gaagcgccugccucccca

SEQ ID NO: 418034 - RNA, 32 nt, Human
gaagcgcgcaccugccaagcaggaugaauaau

SEQ ID NO: 418035 - RNA, 32 nt, Human
gaagcgcggccgcggcggcggcgggcggcgcu

SEQ ID NO: 418036 - RNA, 32 nt, Human
gaagcgcgggacaggcagaugcagugagugag

SEQ ID NO: 418037 - RNA, 32 nt, Human
gaagcgcuacaaagcagccacugugcuuacug

SEQ ID NO: 418038 - RNA, 32 nt, Human
gaagcgcucgccugccccacagccugggccuu

SEQ ID NO: 418039 - RNA, 32 nt, Human
gaagcgcugcuuuugagucucuaccucgauga

SEQ ID NO: 418040 - RNA, 32 nt, Human
gaagcgcugggcggaaguggcuguggcuuugc

SEQ ID NO: 418041 - RNA, 32 nt, Human
gaagcgcuucacuccagguugguagcuucuuu

SEQ ID NO: 418042 - RNA, 32 nt, Human
gaagcggaagcugcagcuggggugggggcagc

SEQ ID NO: 418043 - RNA, 32 nt, Human
gaagcggaauugggagaaaaugaguuauaaug

SEQ ID NO: 418044 - RNA, 32 nt, Human
gaagcggagggcgaggaggagcagaggagcac

SEQ ID NO: 418045 - RNA, 19 nt, Human
gaagcggagggcuccgggc

SEQ ID NO: 418046 - RNA, 19 nt, Human
gaagcggagguugcaguga

SEQ ID NO: 418047 - RNA, 32 nt, Human
gaagcggauuggguccugggccucugugauga

SEQ ID NO: 418048 - RNA, 32 nt, Human
gaagcggcacuggagacccaggaaaaaucucg

SEQ ID NO: 418049 - RNA, 32 nt, Human
gaagcggcaggcggaggcgcgguccgggcgcu

SEQ ID NO: 418050 - RNA, 32 nt, Human
gaagcggccaagugccuggacccagaggcuuu

SEQ ID NO: 418051 - RNA, 23 nt, Human
gaagcggcggucgguggcagggg

SEQ ID NO: 418052 - RNA, 19 nt, Human
gaagcggcugccuccgcca

SEQ ID NO: 418053 - RNA, 32 nt, Human
gaagcgggcgcucuuccagccuggagaaggcu

SEQ ID NO: 418054 - RNA, 23 nt, Human
gaagcgggcggaucaccugaggu

SEQ ID NO: 418055 - RNA, 22 nt, Human
gaagcgggcggaucacgagguc

SEQ ID NO: 418056 - RNA, 32 nt, Human
gaagcggggagagagagcgagcgaaaagcggg

SEQ ID NO: 418057 - RNA, 23 nt, Human
gaagcggguggaucaccugaggu

SEQ ID NO: 418058 - RNA, 27 nt, Human
gaagcgggugucacuuccucucuagua

SEQ ID NO: 418059 - RNA, 32 nt, Human
gaagcgguccugcugggguggguggguguuag

SEQ ID NO: 418060 - RNA, 32 nt, Human
gaagcgucaggacugcagcuccagccucuuca

SEQ ID NO: 418061 - RNA, 32 nt, Human
gaagcgucgccgcaucccccagaagagcgcaa

SEQ ID NO: 418062 - RNA, 32 nt, Human
gaagcgugagccacucagaacucaccaaaaug

SEQ ID NO: 418063 - RNA, 32 nt, Human
gaagcgugauucugcugagugucagugugacc

SEQ ID NO: 418064 - RNA, 32 nt, Human
gaagcguuugcacauccuggccccagaagauu

SEQ ID NO: 418065 - RNA, 32 nt, Human
gaagcguuugucagcccuggagcccagagcgg

SEQ ID NO: 418066 - RNA, 23 nt, Human
gaagcuaaaaccugagcuagaag

SEQ ID NO: 418067 - RNA, 32 nt, Human
gaagcuaaagagauguguagcucacaggggcu

SEQ ID NO: 418068 - RNA, 32 nt, Human
gaagcuaaaguauuguuggaccuaguaaacua

SEQ ID NO: 418069 - RNA, 32 nt, Human
gaagcuaagauggguggaucacuugaggucag

SEQ ID NO: 418070 - RNA, 32 nt, Human
gaagcuaagguacaaagaggccaagagacuua

SEQ ID NO: 418071 - RNA, 32 nt, Human
gaagcuaaggugggaggaucaccugagcucaa

SEQ ID NO: 418072 - RNA, 32 nt, Human
gaagcuacaguagcaauuuugcagugagcaca

SEQ ID NO: 418073 - RNA, 32 nt, Human
gaagcuacagugagccuugauugugucacugc

SEQ ID NO: 418074 - RNA, 20 nt, Human
gaagcuaccggcugcugggg

SEQ ID NO: 418075 - RNA, 32 nt, Human
gaagcuacucgugccauccaggucuccgagcc

SEQ ID NO: 418076 - RNA, 32 nt, Human
gaagcuagaagucccccuugaaugacccccag

SEQ ID NO: 418077 - RNA, 32 nt, Human
gaagcuagagagcuccagcaggggcacagagg

SEQ ID NO: 418078 - RNA, 32 nt, Human
gaagcuagaguccucagcugcagccuucucug

SEQ ID NO: 418079 - RNA, 30 nt, Human
gaagcuagcuugcaaucccaaagucagaag

SEQ ID NO: 418080 - RNA, 32 nt, Human
gaagcuaggaguuugagaccagccugggcaac

SEQ ID NO: 418081 - RNA, 32 nt, Human
gaagcuaugagcauuuaaaaacuguuuacagc

SEQ ID NO: 418082 - RNA, 20 nt, Human
gaagcucaaccccccuauga

SEQ ID NO: 418083 - RNA, 32 nt, Human
gaagcucaaguuggccacccaagucugagaaa

SEQ ID NO: 418084 - RNA, 32 nt, Human
gaagcucacagaaugggcuucuugccugacag

SEQ ID NO: 418085 - RNA, 32 nt, Human
gaagcucacuggccacaauacccaccucugug

SEQ ID NO: 418086 - RNA, 32 nt, Human
gaagcucagagcuggaggugagcuucugaggc

SEQ ID NO: 418087 - RNA, 32 nt, Human
gaagcucagugcagcugcagggugugggguca

SEQ ID NO: 418088 - RNA, 32 nt, Human
gaagcucaguuugccagcauagugccaaagac

SEQ ID NO: 418089 - RNA, 32 nt, Human
gaagcucaucacagcgaaccaggucucucaaa

SEQ ID NO: 418090 - RNA, 32 nt, Human
gaagcucaucugaccuccugacucucagcccu

SEQ ID NO: 418091 - RNA, 32 nt, Human
gaagcucauggacaagguucucagggaaguuu

SEQ ID NO: 418092 - RNA, 32 nt, Human
gaagcuccacugucacccuccaccucuucacc

SEQ ID NO: 418093 - RNA, 32 nt, Human
gaagcuccagacccucuccaccuggucaacau

SEQ ID NO: 418094 - RNA, 32 nt, Human
gaagcuccagaggggcccaggcugcagccugc

SEQ ID NO: 418095 - RNA, 32 nt, Human
gaagcuccagccugaaccauguuuuucacuug

SEQ ID NO: 418096 - RNA, 32 nt, Human
gaagcuccccauccaccuaucugaguaccuga

SEQ ID NO: 418097 - RNA, 32 nt, Human
gaagcucccccucccugcuucccuuggccgag

SEQ ID NO: 418098 - RNA, 24 nt, Human
gaagcuccguaggacuuccccgga

SEQ ID NO: 418099 - RNA, 32 nt, Human
gaagcuccucucugcccugcccuccaguuguc

SEQ ID NO: 418100 - RNA, 21 nt, Human
gaagcucgagccgccuccgcc

SEQ ID NO: 418101 - RNA, 32 nt, Human
gaagcucggacucagucugaucuagcugagcu

SEQ ID NO: 418102 - RNA, 17 nt, Human
gaagcucuaucugggaa

SEQ ID NO: 418103 - RNA, 32 nt, Human
gaagcucucaagugcggagaauucuuugcaca

SEQ ID NO: 418104 - RNA, 32 nt, Human
gaagcucucccugaacauccccaucaucacug

SEQ ID NO: 418105 - RNA, 32 nt, Human
gaagcucuccucuugcccucuucagcuuccgg

SEQ ID NO: 418106 - RNA, 32 nt, Human
gaagcucugaagauccuuucugccauuacgca

SEQ ID NO: 418107 - RNA, 32 nt, Human
gaagcucugaggaugguugcagugaggaagca

SEQ ID NO: 418108 - RNA, 32 nt, Human
gaagcucugcucgcugcuuccaccucaccaug

SEQ ID NO: 418109 - RNA, 32 nt, Human
gaagcucugcugagaugcagacaggaaaauaa

SEQ ID NO: 418110 - RNA, 32 nt, Human
gaagcucugcugucuggggcaagcuuucuuuc

SEQ ID NO: 418111 - RNA, 32 nt, Human
gaagcucuggaaacuuguggguggggcccagg

SEQ ID NO: 418112 - RNA, 24 nt, Human
gaagcucugggccaccucccugga

SEQ ID NO: 418113 - RNA, 19 nt, Human
gaagcucugguggaugcua

SEQ ID NO: 418114 - RNA, 32 nt, Human
gaagcucuguaagaaagaaaaggucagccucc

SEQ ID NO: 418115 - RNA, 32 nt, Human
gaagcucuuccaggaagcagcggcggccccac

SEQ ID NO: 418116 - RNA, 17 nt, Human
gaagcugaaacugggga

SEQ ID NO: 418117 - RNA, 32 nt, Human
gaagcugaaagagacucuggggcacuaaauuc

SEQ ID NO: 418118 - RNA, 25 nt, Human
gaagcugaaaggaugauccugggga

SEQ ID NO: 418119 - RNA, 32 nt, Human
gaagcugaacccagggccuggcuguggucuuc

SEQ ID NO: 418120 - RNA, 32 nt, Human
gaagcugaagaaaaagcgccagugaagaaauc

SEQ ID NO: 418121 - RNA, 17 nt, Human
gaagcugaaggcuggag

SEQ ID NO: 418122 - RNA, 32 nt, Human
gaagcugaagugggaggaucaccugagcucug

SEQ ID NO: 418123 - RNA, 32 nt, Human
gaagcugaccaacacuacagagaucccacacu

SEQ ID NO: 418124 - RNA, 32 nt, Human
gaagcugacuucugaagaugacugccucaccu

SEQ ID NO: 418125 - RNA, 32 nt, Human
gaagcugagacaacauacucuguccauacaua

SEQ ID NO: 418126 - RNA, 17 nt, Human
gaagcugagagcuggag

SEQ ID NO: 418127 - RNA, 32 nt, Human
gaagcugagauggguggaucaccugagcucag

SEQ ID NO: 418128 - RNA, 21 nt, Human
gaagcugaggagggcugggag

SEQ ID NO: 418129 - RNA, 32 nt, Human
gaagcugaggcaggagaaucccuugaaccuga

SEQ ID NO: 418130 - RNA, 32 nt, Human
gaagcugaggcaggaggaucaccugaggucag

SEQ ID NO: 418131 - RNA, 32 nt, Human
gaagcugaggcgggcggaucaccugaggucag

SEQ ID NO: 418132 - RNA, 32 nt, Human
gaagcugaggcugccucuuccuagccacagga

SEQ ID NO: 418133 - RNA, 20 nt, Human
gaagcugagggagcucaggg

SEQ ID NO: 418134 - RNA, 19 nt, Human
gaagcugagggcauugaga

SEQ ID NO: 418135 - RNA, 32 nt, Human
gaagcugagggcgugucagcaggccuuucgau

SEQ ID NO: 418136 - RNA, 24 nt, Human
gaagcugagggcugagaccaaggg

SEQ ID NO: 418137 - RNA, 26 nt, Human
gaagcugaggggcuguguuugagggg

SEQ ID NO: 418138 - RNA, 32 nt, Human
gaagcugaggugagaggaucucuagagcccag

SEQ ID NO: 418139 - RNA, 16 nt, Human
gaagcugaggugggaa

SEQ ID NO: 418140 - RNA, 16 nt, Human
gaagcugaggugggag

SEQ ID NO: 418141 - RNA, 24 nt, Human
gaagcugaggugggaggagugcuu

SEQ ID NO: 418142 - RNA, 24 nt, Human
gaagcugagucccagugcuggggg

SEQ ID NO: 418143 - RNA, 23 nt, Human
gaagcugagugcuguccaggagg

SEQ ID NO: 418144 - RNA, 32 nt, Human
gaagcugauacuucuccuuuugcucacagcug

SEQ ID NO: 418145 - RNA, 32 nt, Human
gaagcugauaggaaaucaccccagggaacccg

SEQ ID NO: 418146 - RNA, 26 nt, Human
gaagcugaugcagcguugccgagggg

SEQ ID NO: 418147 - RNA, 32 nt, Human
gaagcugaugcaggggaaagaaauuaacaacc

SEQ ID NO: 418148 - RNA, 23 nt, Human
gaagcugaugcuguacuuggggg

SEQ ID NO: 418149 - RNA, 32 nt, Human
gaagcugauggggacggagagaggagccaguc

SEQ ID NO: 418150 - RNA, 22 nt, Human
gaagcugauucacuaugggggg

SEQ ID NO: 418151 - RNA, 32 nt, Human
gaagcugcaagcuggggagaucguggaaauga

SEQ ID NO: 418152 - RNA, 24 nt, Human
gaagcugcaggaauauuuaucucc

SEQ ID NO: 418153 - RNA, 25 nt, Human
gaagcugcaggaauauuuaucucca

SEQ ID NO: 418154 - RNA, 22 nt, Human
gaagcugcaggcugcccaggag

SEQ ID NO: 418155 - RNA, 32 nt, Human
gaagcugcaggcuuugccauugugaaccaugg

SEQ ID NO: 418156 - RNA, 32 nt, Human
gaagcugcagugagcagggaucguaccacugc

SEQ ID NO: 418157 - RNA, 32 nt, Human
gaagcugcagugagccaagaucacaccacugc

SEQ ID NO: 418158 - RNA, 32 nt, Human
gaagcugcagugagccaugauugcaccacugc

SEQ ID NO: 418159 - RNA, 32 nt, Human
gaagcugcagugagccgagaucaggccauugc

SEQ ID NO: 418160 - RNA, 32 nt, Human
gaagcugcagugagcuaggaucgugccacugc

SEQ ID NO: 418161 - RNA, 32 nt, Human
gaagcugcagugagcuaugaucacaccacugc

SEQ ID NO: 418162 - RNA, 32 nt, Human
gaagcugcagugagcuaugauugugccacaca

SEQ ID NO: 418163 - RNA, 32 nt, Human
gaagcugcagugagcugugaucgcaccacugc

SEQ ID NO: 418164 - RNA, 32 nt, Human
gaagcugcagugagcugugaucgcaccacugu

SEQ ID NO: 418165 - RNA, 32 nt, Human
gaagcugcagugagguaugguugugccacugc

SEQ ID NO: 418166 - RNA, 32 nt, Human
gaagcugcagugaguugugaucaugccacugu

SEQ ID NO: 418167 - RNA, 32 nt, Human
gaagcugcaguuggaagacccuggaggaugcc

SEQ ID NO: 418168 - RNA, 32 nt, Human
gaagcugcaucgugcuccuccagccugcacug

SEQ ID NO: 418169 - RNA, 32 nt, Human
gaagcugccaccgccuccuccaucucccggag

SEQ ID NO: 418170 - RNA, 32 nt, Human
gaagcugccagggcaggagaggcugcuggaag

SEQ ID NO: 418171 - RNA, 32 nt, Human
gaagcugccaucagggaucuuccccugccccg

SEQ ID NO: 418172 - RNA, 32 nt, Human
gaagcugccaucuccccgccacccgcucgucc

SEQ ID NO: 418173 - RNA, 32 nt, Human
gaagcugcccaggugaccaguccugggagugc

SEQ ID NO: 418174 - RNA, 20 nt, Human
gaagcugcccugcccuggca

SEQ ID NO: 418175 - RNA, 32 nt, Human
gaagcugcccugcugugguuuagcacugcaaa

SEQ ID NO: 418176 - RNA, 32 nt, Human
gaagcugccgccgccucugcccgcccggcgcc

SEQ ID NO: 418177 - RNA, 32 nt, Human
gaagcugccgcuggcugagagaccaugaagaa

SEQ ID NO: 418178 - RNA, 32 nt, Human
gaagcugccuaugcguccccagccugggcuga

SEQ ID NO: 418179 - RNA, 32 nt, Human
gaagcugcggccgccucgcacccggaacaaca

SEQ ID NO: 418180 - RNA, 32 nt, Human
gaagcugcucacugcucacacgcugccuccuc

SEQ ID NO: 418181 - RNA, 32 nt, Human
gaagcugcuccgugcuuguuugcucaccuggg

SEQ ID NO: 418182 - RNA, 32 nt, Human
gaagcugcucugaaaucuccuuuagccaucac

SEQ ID NO: 418183 - RNA, 32 nt, Human
gaagcugcugagccaugggcuacgcgcgggcu

SEQ ID NO: 418184 - RNA, 21 nt, Human
gaagcugcugcagcccugcca

SEQ ID NO: 418185 - RNA, 32 nt, Human
gaagcugcuggcugacugccauguccacgcag

SEQ ID NO: 418186 - RNA, 21 nt, Human
gaagcugcugugacuccagca

SEQ ID NO: 418187 - RNA, 32 nt, Human
gaagcugcuguggcugaugcggauucagaaag

SEQ ID NO: 418188 - RNA, 32 nt, Human
gaagcugcuucaaaucacucuugacuacaugg

SEQ ID NO: 418189 - RNA, 22 nt, Human
gaagcuggaaaacuccuaggaa

SEQ ID NO: 418190 - RNA, 22 nt, Human
gaagcuggaaaaggcaaaggag

SEQ ID NO: 418191 - RNA, 32 nt, Human
gaagcuggaaacacugagcugaguguugaggc

SEQ ID NO: 418192 - RNA, 32 nt, Human
gaagcuggaaggaggaagggaggguaaguggc

SEQ ID NO: 418193 - RNA, 32 nt, Human
gaagcuggacgagucagccacugggaggucua

SEQ ID NO: 418194 - RNA, 32 nt, Human
gaagcuggagagagaggaaccaguugccaagg

SEQ ID NO: 418195 - RNA, 32 nt, Human
gaagcuggagaucacaggcgugucuugucggg

SEQ ID NO: 418196 - RNA, 32 nt, Human
gaagcuggagccaccugcggcucugagaggga

SEQ ID NO: 418197 - RNA, 32 nt, Human
gaagcuggaggcagagauuggagugauacauu

SEQ ID NO: 418198 - RNA, 32 nt, Human
gaagcuggagguguuagacaccagcccccugc

SEQ ID NO: 418199 - RNA, 32 nt, Human
gaagcuggcaucuccccagccauccuaugcag

SEQ ID NO: 418200 - RNA, 32 nt, Human
gaagcuggccacugaaaacuguaagaugguca

SEQ ID NO: 418201 - RNA, 16 nt, Human
gaagcuggccagggaa

SEQ ID NO: 418202 - RNA, 32 nt, Human
gaagcuggcccagggugguggucagcuggguc

SEQ ID NO: 418203 - RNA, 32 nt, Human
gaagcuggccuggguccagggagagaccucgu

SEQ ID NO: 418204 - RNA, 32 nt, Human
gaagcuggcuaaccuccacuuccacauuccag

SEQ ID NO: 418205 - RNA, 17 nt, Human
gaagcuggcucuucuga

SEQ ID NO: 418206 - RNA, 32 nt, Human
gaagcuggcugcccccauuccugcugcugcug

SEQ ID NO: 418207 - RNA, 32 nt, Human
gaagcugggacccugggcuggacuguccuuuc

SEQ ID NO: 418208 - RNA, 32 nt, Human
gaagcugggagagagguaugggacagauucuu

SEQ ID NO: 418209 - RNA, 23 nt, Human
gaagcugggagccaugugggggg

SEQ ID NO: 418210 - RNA, 32 nt, Human
gaagcugggaggagaaggcggcggaaggugga

SEQ ID NO: 418211 - RNA, 32 nt, Human
gaagcugggaggcagaguuuucagugagccaa

SEQ ID NO: 418212 - RNA, 24 nt, Human
gaagcugggaggcggagguugcag

SEQ ID NO: 418213 - RNA, 32 nt, Human
gaagcugggaggcggagguugcagugagccaa

SEQ ID NO: 418214 - RNA, 32 nt, Human
gaagcugggaggucaggugggguggaugauau

SEQ ID NO: 418215 - RNA, 32 nt, Human
gaagcugggauuacaggcaugcgccaccacgc

SEQ ID NO: 418216 - RNA, 32 nt, Human
gaagcugggcaggacaaguaggacaucccugg

SEQ ID NO: 418217 - RNA, 20 nt, Human
gaagcugggccacgagcuga

SEQ ID NO: 418218 - RNA, 32 nt, Human
gaagcugggccaggacaaacagaaguuagaag

SEQ ID NO: 418219 - RNA, 32 nt, Human
gaagcuggggcaugggcucuaggggaaccugg

SEQ ID NO: 418220 - RNA, 20 nt, Human
gaagcugggggcagcugggg

SEQ ID NO: 418221 - RNA, 32 nt, Human
gaagcugguauuucuauuucuuuuggauuuuu

SEQ ID NO: 418222 - RNA, 32 nt, Human
gaagcuggugaaugcaggcucugagcggcucc

SEQ ID NO: 418223 - RNA, 32 nt, Human
gaagcuggugcagccacacagggagugcagcc

SEQ ID NO: 418224 - RNA, 21 nt, Human
gaagcuggugcugcuuggagg

SEQ ID NO: 418225 - RNA, 32 nt, Human
gaagcugguuacuguacgcaaguugagugcca

SEQ ID NO: 418226 - RNA, 32 nt, Human
gaagcuguaacaaccucugcuauuuaaggaga

SEQ ID NO: 418227 - RNA, 17 nt, Human
gaagcuguacuugggaa

SEQ ID NO: 418228 - RNA, 32 nt, Human
gaagcuguauucuggagaucagcuccagguuc

SEQ ID NO: 418229 - RNA, 19 nt, Human
gaagcugucaccacaguuc

SEQ ID NO: 418230 - RNA, 32 nt, Human
gaagcugucauccuaagggaaaaaccuccauc

SEQ ID NO: 418231 - RNA, 32 nt, Human
gaagcuguccccaucucagugucagaccagcc

SEQ ID NO: 418232 - RNA, 32 nt, Human
gaagcugugaaucacaagcucugccucuuucu

SEQ ID NO: 418233 - RNA, 32 nt, Human
gaagcugugagggacccacagauuuuggaaac

SEQ ID NO: 418234 - RNA, 19 nt, Human
gaagcugugggcugugggg

SEQ ID NO: 418235 - RNA, 32 nt, Human
gaagcuguggugagcuguugauugcaccacug

SEQ ID NO: 418236 - RNA, 32 nt, Human
gaagcuguugagguccuaggcaauugaugcag

SEQ ID NO: 418237 - RNA, 31 nt, Human
gaagcuguuugaguaaaccuguugaagagug

SEQ ID NO: 418238 - RNA, 20 nt, Human
gaagcuguuugcagcagcuc

SEQ ID NO: 418239 - RNA, 32 nt, Human
gaagcuuaaaaagguguuuugucuggaacuua

SEQ ID NO: 418240 - RNA, 32 nt, Human
gaagcuuaagaagaaggauaaagggaagcugg

SEQ ID NO: 418241 - RNA, 32 nt, Human
gaagcuuaaucuguauuuacagcugcucccca

SEQ ID NO: 418242 - RNA, 32 nt, Human
gaagcuuacacaucucccucagccucugguuu

SEQ ID NO: 418243 - RNA, 32 nt, Human
gaagcuuacuauaucauuauuauaaguagcau

SEQ ID NO: 418244 - RNA, 32 nt, Human
gaagcuucaacaaaaggcuuaccugguaagaa

SEQ ID NO: 418245 - RNA, 32 nt, Human
gaagcuucagcaucugcugggauaacuggagg

SEQ ID NO: 418246 - RNA, 32 nt, Human
gaagcuucagugagccaugauugcacugucgc

SEQ ID NO: 418247 - RNA, 32 nt, Human
gaagcuucaguuauaaauaguaauuggaguga

SEQ ID NO: 418248 - RNA, 32 nt, Human
gaagcuucaucugaagauguccugggcguuca

SEQ ID NO: 418249 - RNA, 25 nt, Human
gaagcuucaucuguauuuauagcca

SEQ ID NO: 418250 - RNA, 32 nt, Human
gaagcuuccacaaaauuagaaaggacaacagu

SEQ ID NO: 418251 - RNA, 32 nt, Human
gaagcuuccacucacgguggcaggggaagggg

SEQ ID NO: 418252 - RNA, 32 nt, Human
gaagcuucccagccccacuugccugcaggcuu

SEQ ID NO: 418253 - RNA, 32 nt, Human
gaagcuucccugguccccuccuuucuggccau

SEQ ID NO: 418254 - RNA, 32 nt, Human
gaagcuuccgggguggccuccaccuccuggcu

SEQ ID NO: 418255 - RNA, 22 nt, Human
gaagcuuccuccccucucagca

SEQ ID NO: 418256 - RNA, 32 nt, Human
gaagcuuccugaugccucccaagaagcaaaug

SEQ ID NO: 418257 - RNA, 32 nt, Human
gaagcuucuacacacuggaaauucuauuaaga

SEQ ID NO: 418258 - RNA, 32 nt, Human
gaagcuucucucuuaaacuucaucagaacauu

SEQ ID NO: 418259 - RNA, 20 nt, Human
gaagcuucuugaccuccaua

SEQ ID NO: 418260 - RNA, 21 nt, Human
gaagcuugaaguaucaucucu

SEQ ID NO: 418261 - RNA, 32 nt, Human
gaagcuugcauccuugaggcucagggaugaga

SEQ ID NO: 418262 - RNA, 22 nt, Human
gaagcuugccuuugaacuggaa

SEQ ID NO: 418263 - RNA, 32 nt, Human
gaagcuuguuacugagaaggacaguggaggcg

SEQ ID NO: 418264 - RNA, 32 nt, Human
gaagcuuguugaaaacccagacugucuccacg

SEQ ID NO: 418265 - RNA, 32 nt, Human
gaagcuuucucuaagcccuucccaguugcuuc

SEQ ID NO: 418266 - RNA, 32 nt, Human
gaagcuuucugcaaaugcagcaccacugguau

SEQ ID NO: 418267 - RNA, 32 nt, Human
gaagcuuugccauuggcugguggagaaggagg

SEQ ID NO: 418268 - RNA, 32 nt, Human
gaagcuuugugugauauucuuccaaauguagu

SEQ ID NO: 418269 - RNA, 32 nt, Human
gaagcuuuguuucuaaaaguaccuugaaauga

SEQ ID NO: 418270 - RNA, 32 nt, Human
gaagcuuuuccagagcccccaggcuaggaacc

SEQ ID NO: 418271 - RNA, 32 nt, Human
gaagcuuuucuuuggcgauucagugucacaaa

SEQ ID NO: 418272 - RNA, 32 nt, Human
gaagcuuuugcagccggacaggucgcgaagca

SEQ ID NO: 418273 - RNA, 26 nt, Human
gaagcuuuugccagcuauuugggggg

SEQ ID NO: 418274 - RNA, 32 nt, Human
gaagcuuuuugaagagcacauucuccucagug

SEQ ID NO: 418275 - RNA, 32 nt, Human
gaaggaaaaaccacuaagguauuaucugaauu

SEQ ID NO: 418276 - RNA, 32 nt, Human
gaaggaaaaagagcaacagauccagggagcau

SEQ ID NO: 418277 - RNA, 32 nt, Human
gaaggaaaaagcaggaaacugaaggaagcagg

SEQ ID NO: 418278 - RNA, 32 nt, Human
gaaggaaaacauuccaacauuaaccggucacc

SEQ ID NO: 418279 - RNA, 32 nt, Human
gaaggaaaacuaauaaacaaaaagcaguagca

SEQ ID NO: 418280 - RNA, 32 nt, Human
gaaggaaaagaaaugcuaggagaagagccaug

SEQ ID NO: 418281 - RNA, 32 nt, Human
gaaggaaaagacacugcccugcaagguugugc

SEQ ID NO: 418282 - RNA, 32 nt, Human
gaaggaaaagccucugggagcacauucugcug

SEQ ID NO: 418283 - RNA, 32 nt, Human
gaaggaaaaggacggacacaugcugaaaacgg

SEQ ID NO: 418284 - RNA, 22 nt, Human
gaaggaaaaggugcacauuuuc

SEQ ID NO: 418285 - RNA, 32 nt, Human
gaaggaaaagugggcagugcgcacugugggag

SEQ ID NO: 418286 - RNA, 32 nt, Human
gaaggaaaagugggguuggggcuggguggucu

SEQ ID NO: 418287 - RNA, 32 nt, Human
gaaggaaaaugugaaugaaaguagugcuggau

SEQ ID NO: 418288 - RNA, 32 nt, Human
gaaggaaacacacucggcugggcacagugacg

SEQ ID NO: 418289 - RNA, 23 nt, Human
gaaggaaacccugacuccugggg

SEQ ID NO: 418290 - RNA, 32 nt, Human
gaaggaaaccuccagcugaacuuucuaacaau

SEQ ID NO: 418291 - RNA, 32 nt, Human
gaaggaaacgggacccaggggaagaaagcgcu

SEQ ID NO: 418292 - RNA, 32 nt, Human
gaaggaaagaaaagguccagaucagaguucag

SEQ ID NO: 418293 - RNA, 22 nt, Human
gaaggaaagaaaaugcaucuuc

SEQ ID NO: 418294 - RNA, 32 nt, Human
gaaggaaagcggagacccgagcagggguuuua

SEQ ID NO: 418295 - RNA, 32 nt, Human
gaaggaaaggagagaaggcaggaagaaggcaa

SEQ ID NO: 418296 - RNA, 32 nt, Human
gaaggaaagggaggggcccuggaggagaggcu

SEQ ID NO: 418297 - RNA, 32 nt, Human
gaaggaaaguaagccuuuuugucaccucaaua

SEQ ID NO: 418298 - RNA, 32 nt, Human
gaaggaaaugaaacucaccuaucuuucuauca

SEQ ID NO: 418299 - RNA, 32 nt, Human
gaaggaaaugaccacagacagccauguucugg

SEQ ID NO: 418300 - RNA, 32 nt, Human
gaaggaaaugauuuccuaugauucugcuuacu

SEQ ID NO: 418301 - RNA, 32 nt, Human
gaaggaaauguucucaaggucucaggcuauuu

SEQ ID NO: 418302 - RNA, 32 nt, Human
gaaggaacaagaggagaaagcagagauaaaac

SEQ ID NO: 418303 - RNA, 19 nt, Human
gaaggaacauugcagagcu

SEQ ID NO: 418304 - RNA, 32 nt, Human
gaaggaaccagcuaagggucagauuguuuuuc

SEQ ID NO: 418305 - RNA, 32 nt, Human
gaaggaaccaggacccucagagcccagcaucc

SEQ ID NO: 418306 - RNA, 32 nt, Human
gaaggaacgggggaagggcggggugagggaag

SEQ ID NO: 418307 - RNA, 32 nt, Human
gaaggaacuagagugaagaggacaggagccau

SEQ ID NO: 418308 - RNA, 32 nt, Human
gaaggaacugacacauucucucagagcucaag

SEQ ID NO: 418309 - RNA, 32 nt, Human
gaaggaacuggucugcucacacuugcuggcuu

SEQ ID NO: 418310 - RNA, 21 nt, Human
gaaggaagaacagccacagga

SEQ ID NO: 418311 - RNA, 26 nt, Human
gaaggaagaagagaaaacauauuucc

SEQ ID NO: 418312 - RNA, 32 nt, Human
gaaggaagaagagggaagaauccgaccacuuu

SEQ ID NO: 418313 - RNA, 32 nt, Human
gaaggaagagcaagaacauggccacacccacc

SEQ ID NO: 418314 - RNA, 32 nt, Human
gaaggaagaggaaagaaaaauugugcagagag

SEQ ID NO: 418315 - RNA, 32 nt, Human
gaaggaagaggaaagggaggaggaggauuuau

SEQ ID NO: 418316 - RNA, 22 nt, Human
gaaggaagauucagucuccacu

SEQ ID NO: 418317 - RNA, 32 nt, Human
gaaggaagcaagcaucuccgcaucgcauccuc

SEQ ID NO: 418318 - RNA, 22 nt, Human
gaaggaagcacccaucuucacu

SEQ ID NO: 418319 - RNA, 32 nt, Human
gaaggaagcaugaaggaugcacaggucaggcc

SEQ ID NO: 418320 - RNA, 32 nt, Human
gaaggaagcauuccaccuucccccuuucuccc

SEQ ID NO: 418321 - RNA, 32 nt, Human
gaaggaagccaagggagcagugcaauggauuu

SEQ ID NO: 418322 - RNA, 21 nt, Human
gaaggaagcccaugagaggac

SEQ ID NO: 418323 - RNA, 32 nt, Human
gaaggaaggaaaacacaggcagcucuaagugu

SEQ ID NO: 418324 - RNA, 32 nt, Human
gaaggaaggaagagagggaggcgggcaagcag

SEQ ID NO: 418325 - RNA, 32 nt, Human
gaaggaaggaaggaaggaaggaaggaaggaga

SEQ ID NO: 418326 - RNA, 32 nt, Human
gaaggaaggaaggaaggaaggaaggagaaagg

SEQ ID NO: 418327 - RNA, 32 nt, Human
gaaggaaggaagggaggcgcgcugugcgcccc

SEQ ID NO: 418328 - RNA, 32 nt, Human
gaaggaaggaccaggcuuccagcuccucugca

SEQ ID NO: 418329 - RNA, 32 nt, Human
gaaggaaggagaacaggaggaggcaugagcga

SEQ ID NO: 418330 - RNA, 32 nt, Human
gaaggaaggagagggagggggaggauagagcc

SEQ ID NO: 418331 - RNA, 32 nt, Human
gaaggaaggagagguuugccugcuccuacggg

SEQ ID NO: 418332 - RNA, 32 nt, Human
gaaggaaggagggaggaaaggaaggaaaaagg

SEQ ID NO: 418333 - RNA, 32 nt, Human
gaaggaaggaggugguugugcaggauggcgac

SEQ ID NO: 418334 - RNA, 32 nt, Human
gaaggaaggagucccagcaggagcacagcccu

SEQ ID NO: 418335 - RNA, 32 nt, Human
gaaggaagggacagagaaagaagggacagagg

SEQ ID NO: 418336 - RNA, 32 nt, Human
gaaggaagggccaccuucccugaaggacacug

SEQ ID NO: 418337 - RNA, 32 nt, Human
gaaggaaggggaagaggaagggaaaagcgagc

SEQ ID NO: 418338 - RNA, 32 nt, Human
gaaggaaggggagagacaaagggggacugagu

SEQ ID NO: 418339 - RNA, 32 nt, Human
gaaggaaggguaagggaaaggauggggaccac

SEQ ID NO: 418340 - RNA, 32 nt, Human
gaaggaaguaggggaauggaaguggaaggaug

SEQ ID NO: 418341 - RNA, 23 nt, Human
gaaggaagucccgaccuuccugg

SEQ ID NO: 418342 - RNA, 23 nt, Human
gaaggaagugcagggagcccugg

SEQ ID NO: 418343 - RNA, 22 nt, Human
gaaggaaguguaucuucauaca

SEQ ID NO: 418344 - RNA, 26 nt, Human
gaaggaauaaaaauuugaguuucaaa

SEQ ID NO: 418345 - RNA, 32 nt, Human
gaaggaaucauuguccuuucuccaguuuuugu

SEQ ID NO: 418346 - RNA, 32 nt, Human
gaaggaaucucccagggauucacaguucaccc

SEQ ID NO: 418347 - RNA, 32 nt, Human
gaaggaaucugaauguuaagcuuuagcaaaug

SEQ ID NO: 418348 - RNA, 32 nt, Human
gaaggaaugagagagagugaaaaggagagggu

SEQ ID NO: 418349 - RNA, 32 nt, Human
gaaggacaaagggagagggaggugcaggucgc

SEQ ID NO: 418350 - RNA, 32 nt, Human
gaaggacaacaaaggccaauuugccaucacca

SEQ ID NO: 418351 - RNA, 32 nt, Human
gaaggacaacagcaucuucccaaaaccauuga

SEQ ID NO: 418352 - RNA, 32 nt, Human
gaaggacaacuaggaagccacuuggaggggag

SEQ ID NO: 418353 - RNA, 32 nt, Human
gaaggacaagagaaguucuccagggaauugca

SEQ ID NO: 418354 - RNA, 32 nt, Human
gaaggacacggugauggauguacuaugucuga

SEQ ID NO: 418355 - RNA, 32 nt, Human
gaaggacacugacuccucaaccccugugcuca

SEQ ID NO: 418356 - RNA, 32 nt, Human
gaaggacagacggacccaggagggagggcagc

SEQ ID NO: 418357 - RNA, 32 nt, Human
gaaggacagauggacccaggagggagggcagc

SEQ ID NO: 418358 - RNA, 32 nt, Human
gaaggacaggacccucaggaauucagugccuu

SEQ ID NO: 418359 - RNA, 32 nt, Human
gaaggacagugauguggggaggccguggggca

SEQ ID NO: 418360 - RNA, 32 nt, Human
gaaggacaucgggcaggacugacacugugucu

SEQ ID NO: 418361 - RNA, 32 nt, Human
gaaggacaucuucaccgucuccaugaaugaga

SEQ ID NO: 418362 - RNA, 32 nt, Human
gaaggacauggagccugagccagagaaccagc

SEQ ID NO: 418363 - RNA, 32 nt, Human
gaaggacauguaguacccacaucucuaggccu

SEQ ID NO: 418364 - RNA, 32 nt, Human
gaaggaccaaccaguuugggugaacaguggcc

SEQ ID NO: 418365 - RNA, 32 nt, Human
gaaggaccaagccucagcaccccagggcugcg

SEQ ID NO: 418366 - RNA, 32 nt, Human
gaaggacccacuguucuucuguuguacgagcu

SEQ ID NO: 418367 - RNA, 32 nt, Human
gaaggacccagaggggcccagcugaccugucu

SEQ ID NO: 418368 - RNA, 32 nt, Human
gaaggacccucaaaacugccuccuggagucca

SEQ ID NO: 418369 - RNA, 32 nt, Human
gaaggacccuggaaggagggagagcaggcagc

SEQ ID NO: 418370 - RNA, 32 nt, Human
gaaggaccgagaggcgggaggagcagcggcuc

SEQ ID NO: 418371 - RNA, 32 nt, Human
gaaggaccugacucuguguggacgcaaagaua

SEQ ID NO: 418372 - RNA, 32 nt, Human
gaaggaccuggugugccauggcugcaaacagc

SEQ ID NO: 418373 - RNA, 32 nt, Human
gaaggaccuugagauugaugcauuuugagcag

SEQ ID NO: 418374 - RNA, 32 nt, Human
gaaggacgcgaacccuucucugaccccagcuc

SEQ ID NO: 418375 - RNA, 32 nt, Human
gaaggacgugacaggugccgacgccaccgccg

SEQ ID NO: 418376 - RNA, 32 nt, Human
gaaggacuaucggcagugcagcaauaaugaca

SEQ ID NO: 418377 - RNA, 32 nt, Human
gaaggacuccaccgcugcccuccuggaacugc

SEQ ID NO: 418378 - RNA, 32 nt, Human
gaaggacucgguguuguguccaucaucaacgg

SEQ ID NO: 418379 - RNA, 32 nt, Human
gaaggacuggggccacguggagcugcuggagg

SEQ ID NO: 418380 - RNA, 32 nt, Human
gaaggacuucuuugcagggccagugguuucug

SEQ ID NO: 418381 - RNA, 32 nt, Human
gaaggagaaagaggaggagagagaaaaagggc

SEQ ID NO: 418382 - RNA, 32 nt, Human
gaaggagaaaugcagauuauuaccaggaggcu

SEQ ID NO: 418383 - RNA, 32 nt, Human
gaaggagaaccuggggagggugugugggaaga

SEQ ID NO: 418384 - RNA, 32 nt, Human
gaaggagaagcugguggccacagcagaguccu

SEQ ID NO: 418385 - RNA, 32 nt, Human
gaaggagaagcuucuugagauaccaaauaaag

SEQ ID NO: 418386 - RNA, 32 nt, Human
gaaggagaaggaaaaagaaaguaaugccacac

SEQ ID NO: 418387 - RNA, 32 nt, Human
gaaggagacagacagcuggcaguuccucgccu

SEQ ID NO: 418388 - RNA, 32 nt, Human
gaaggagacagugucucccuuugggaaaacua

SEQ ID NO: 418389 - RNA, 32 nt, Human
gaaggagagaaaauggcauccauggauuacag

SEQ ID NO: 418390 - RNA, 32 nt, Human
gaaggagagaaagguggaaggaagggaaggag

SEQ ID NO: 418391 - RNA, 32 nt, Human
gaaggagagacugaggcaaggcaaagugauag

SEQ ID NO: 418392 - RNA, 32 nt, Human
gaaggagagaggcagagagggagagaggcaga

SEQ ID NO: 418393 - RNA, 32 nt, Human
gaaggagagagggaagggucaggguagagaca

SEQ ID NO: 418394 - RNA, 22 nt, Human
gaaggagagcccauaaggggac

SEQ ID NO: 418395 - RNA, 32 nt, Human
gaaggagagcccccuccucaaugauuaccggg

SEQ ID NO: 418396 - RNA, 32 nt, Human
gaaggagagcccuggggauguggagaagccac

SEQ ID NO: 418397 - RNA, 32 nt, Human
gaaggagagcugcacauugagaacaaaggagg

SEQ ID NO: 418398 - RNA, 32 nt, Human
gaaggagagggaggggaccgucaggaagccgc

SEQ ID NO: 418399 - RNA, 32 nt, Human
gaaggagagggagggggaggauagagcccauc

SEQ ID NO: 418400 - RNA, 32 nt, Human
gaaggagaggguggggagggaggcaucuaggg

SEQ ID NO: 418401 - RNA, 32 nt, Human
gaaggagauaucccacauuuaaaguucuuauu

SEQ ID NO: 418402 - RNA, 32 nt, Human
gaaggagaucaagugaaccuucuacaacuccu

SEQ ID NO: 418403 - RNA, 32 nt, Human
gaaggagaucagcaggacgcugcgcacaacau

SEQ ID NO: 418404 - RNA, 32 nt, Human
gaaggagaugauucuuucaagggacacaggca

SEQ ID NO: 418405 - RNA, 32 nt, Human
gaaggagcacaguauccuccuguccaucucgu

SEQ ID NO: 418406 - RNA, 32 nt, Human
gaaggagcaccggguuccugcccagcacugug

SEQ ID NO: 418407 - RNA, 32 nt, Human
gaaggagcacgccugggcugggccccagggag

SEQ ID NO: 418408 - RNA, 32 nt, Human
gaaggagcagggcucuggagggauucgcauuc

SEQ ID NO: 418409 - RNA, 32 nt, Human
gaaggagcauccgugcugcuguggaaaauauc

SEQ ID NO: 418410 - RNA, 32 nt, Human
gaaggagccaauauaucuacuuucauuaagaa

SEQ ID NO: 418411 - RNA, 32 nt, Human
gaaggagccacaccaccugugacuccagcucu

SEQ ID NO: 418412 - RNA, 32 nt, Human
gaaggagccaccagcuggaggaaaggggcucc

SEQ ID NO: 418413 - RNA, 23 nt, Human
gaaggagccagaguacacgcucc

SEQ ID NO: 418414 - RNA, 32 nt, Human
gaaggagcccaggagcagaggaaguagagaga

SEQ ID NO: 418415 - RNA, 32 nt, Human
gaaggagcccagguggcacacgcccagcugcg

SEQ ID NO: 418416 - RNA, 26 nt, Human
gaaggagccguccuccagccccagga

SEQ ID NO: 418417 - RNA, 32 nt, Human
gaaggagccuaagacagaaaugacagaucucu

SEQ ID NO: 418418 - RNA, 32 nt, Human
gaaggagcgccagguccuccuugcuggcaggu

SEQ ID NO: 418419 - RNA, 32 nt, Human
gaaggagcguucgaggaauggaugaggucggg

SEQ ID NO: 418420 - RNA, 32 nt, Human
gaaggagcucucuucuugcuuggcagcuggac

SEQ ID NO: 418421 - RNA, 32 nt, Human
gaaggaggaaaaggugucuugcuggcuugccu

SEQ ID NO: 418422 - RNA, 32 nt, Human
gaaggaggaaccagcaagaccugugggguggg

SEQ ID NO: 418423 - RNA, 32 nt, Human
gaaggaggaagaggaggaggaggaagagggga

SEQ ID NO: 418424 - RNA, 32 nt, Human
gaaggaggacaguggcccaggccacacagcuc

SEQ ID NO: 418425 - RNA, 32 nt, Human
gaaggaggagaaagcaggcgaagcggggccau

SEQ ID NO: 418426 - RNA, 32 nt, Human
gaaggaggagacccacgagggagccggaagga

SEQ ID NO: 418427 - RNA, 32 nt, Human
gaaggaggagacugagugauuaagucacccac

SEQ ID NO: 418428 - RNA, 32 nt, Human
gaaggaggagagacaccgggcccagggcaccc

SEQ ID NO: 418429 - RNA, 32 nt, Human
gaaggaggagccaagacccacacccaggagga

SEQ ID NO: 418430 - RNA, 32 nt, Human
gaaggaggaggaagaggggcagguguagggag

SEQ ID NO: 418431 - RNA, 32 nt, Human
gaaggaggaggaggaggaggaggaggaggggg

SEQ ID NO: 418432 - RNA, 32 nt, Human
gaaggaggaggcggggcugcacugugagcccg

SEQ ID NO: 418433 - RNA, 32 nt, Human
gaaggaggauacauuuguuuguguugcucccc

SEQ ID NO: 418434 - RNA, 32 nt, Human
gaaggaggauugcuugagcucaggaguuugag

SEQ ID NO: 418435 - RNA, 32 nt, Human
gaaggaggcagaagggagagugaugcacgaug

SEQ ID NO: 418436 - RNA, 21 nt, Human
gaaggaggcaggaagggagag

SEQ ID NO: 418437 - RNA, 20 nt, Human
gaaggaggcaggacagaggc

SEQ ID NO: 418438 - RNA, 22 nt, Human
gaaggaggcaggcaugggggac

SEQ ID NO: 418439 - RNA, 21 nt, Human
gaaggaggcagggguugggac

SEQ ID NO: 418440 - RNA, 32 nt, Human
gaaggaggccaucaaggacaaggaggaaccuc

SEQ ID NO: 418441 - RNA, 32 nt, Human
gaaggaggccaucagcaaacugggaagaggac

SEQ ID NO: 418442 - RNA, 31 nt, Human
gaaggaggccuccuugggccuggucccccuu

SEQ ID NO: 418443 - RNA, 32 nt, Human
gaaggaggcuagcuucuagccuggguggccau

SEQ ID NO: 418444 - RNA, 32 nt, Human
gaaggaggcuuaggacuuuccacuccuggcug

SEQ ID NO: 418445 - RNA, 32 nt, Human
gaaggagggaaacugaaaacaccguggccccu

SEQ ID NO: 418446 - RNA, 32 nt, Human
gaaggagggaaaggauguaggcgaaggaggug

SEQ ID NO: 418447 - RNA, 32 nt, Human
gaaggagggaaggagugcuggggagaaggggc

SEQ ID NO: 418448 - RNA, 32 nt, Human
gaaggagggagaccccaaaaagagcagcacag

SEQ ID NO: 418449 - RNA, 32 nt, Human
gacaaggaggcagaggccugagcgaggcggaa

SEQ ID NO: 418450 - RNA, 32 nt, Human
gacaaggaggugggagaggguagcagcauggg

SEQ ID NO: 418451 - RNA, 32 nt, Human
gacaaggaggugggggcagcugaguuagaguc

SEQ ID NO: 418452 - RNA, 32 nt, Human
gacaaggauagagaggaggagggaagaacaaa

SEQ ID NO: 418453 - RNA, 24 nt, Human
gacaaggaugaaggccugaauggg

SEQ ID NO: 418454 - RNA, 32 nt, Human
gacaaggaugacuaaggucagagcaggugacc

SEQ ID NO: 418455 - RNA, 32 nt, Human
gacaaggcaaagcccgcauaauuuuaagacgg

SEQ ID NO: 418456 - RNA, 32 nt, Human
gacaaggcccccugccuuugccucacauaaac

SEQ ID NO: 418457 - RNA, 32 nt, Human
gacaaggcggcggcggcugcugugcugggugc

SEQ ID NO: 418458 - RNA, 32 nt, Human
gacaaggcuauguuucuccuagaaacagguuu

SEQ ID NO: 418459 - RNA, 32 nt, Human
gacaaggcucccccucugacccuuccuguugg

SEQ ID NO: 418460 - RNA, 32 nt, Human
gacaaggcugaccucacugucauuucaggggg

SEQ ID NO: 418461 - RNA, 32 nt, Human
gacaaggcuggacuagcaacugcuagaaaaug

SEQ ID NO: 418462 - RNA, 32 nt, Human
gacaagggaggcaguggcuaguggggugaaca

SEQ ID NO: 418463 - RNA, 32 nt, Human
gacaagggcaagauuauuaagcagcaagagac

SEQ ID NO: 418464 - RNA, 31 nt, Human
gacaagggcuguguugucacagcaggaauag

SEQ ID NO: 418465 - RNA, 32 nt, Human
gacaaggggaaugcaguggugccuggaaacuu

SEQ ID NO: 418466 - RNA, 32 nt, Human
gacaaggguagccagcuuggagucuagcaacu

SEQ ID NO: 418467 - RNA, 32 nt, Human
  misc_feature (31)..(31): n is a, c, g or u
gacaagggucaagccaggaugggcccaggcnu

SEQ ID NO: 418468 - RNA, 20 nt, Human
gacaagggucuccacugugg

SEQ ID NO: 418469 - RNA, 32 nt, Human
gacaaggucuggauuuguggguguuuucauug

SEQ ID NO: 418470 - RNA, 32 nt, Human
gacaaggucuguggcuuccuggaaaugucacu

SEQ ID NO: 418471 - RNA, 23 nt, Human
gacaaggucuuacccagcccagg

SEQ ID NO: 418472 - RNA, 32 nt, Human
gacaaggugcaggacuccagagaaggccaaau

SEQ ID NO: 418473 - RNA, 32 nt, Human
gacaagguggagggcuggacggccaucaccac

SEQ ID NO: 418474 - RNA, 32 nt, Human
gacaagguggcugcuccagagguggcugagcc

SEQ ID NO: 418475 - RNA, 20 nt, Human
gacaagguuucacuauguug

SEQ ID NO: 418476 - RNA, 32 nt, Human
gacaaguaaagcaauggauggcuucaauaucc

SEQ ID NO: 418477 - RNA, 32 nt, Human
gacaaguacacguguacucacagagggagaga

SEQ ID NO: 418478 - RNA, 32 nt, Human
gacaaguagagaagaacauaagaagaaaaacc

SEQ ID NO: 418479 - RNA, 32 nt, Human
gacaaguaucuagccagucuuugcuacaaguu

SEQ ID NO: 418480 - RNA, 32 nt, Human
gacaagucauuacguuuucauuucucacaacu

SEQ ID NO: 418481 - RNA, 21 nt, Human
gacaaguccguugaggcugcc

SEQ ID NO: 418482 - RNA, 18 nt, Human
gacaagucuccaggcuga

SEQ ID NO: 418483 - RNA, 32 nt, Human
gacaagucuccuacucccaaaacuauuuaagg

SEQ ID NO: 418484 - RNA, 32 nt, Human
gacaagucuucagcccacacccugccagcccc

SEQ ID NO: 418485 - RNA, 32 nt, Human
gacaagugaaugagaugucaccaggauaagac

SEQ ID NO: 418486 - RNA, 32 nt, Human
gacaagugacagcaaagaagguggugaagguu

SEQ ID NO: 418487 - RNA, 22 nt, Human
gacaagugagcagucugugcca

SEQ ID NO: 418488 - RNA, 19 nt, Human
gacaaguguaaagcaugca

SEQ ID NO: 418489 - RNA, 32 nt, Human
gacaaguguaccucugcacucaaugcuggaau

SEQ ID NO: 418490 - RNA, 32 nt, Human
gacaaguucaugucuaauuuugcauuuccagu

SEQ ID NO: 418491 - RNA, 32 nt, Human
gacaaguugggaaugauguggugauuuagaau

SEQ ID NO: 418492 - RNA, 32 nt, Human
gacaaguuguaccuugcccucucuccagcucu

SEQ ID NO: 418493 - RNA, 32 nt, Human
gacaaguuugauggagagagaggcagagacag

SEQ ID NO: 418494 - RNA, 24 nt, Human
gacaauaaaaguuucggaguugaa

SEQ ID NO: 418495 - RNA, 32 nt, Human
gacaauaaaccugcagcguuucaugccacguc

SEQ ID NO: 418496 - RNA, 29 nt, Human
gacaauaaagcaugcacuguaagaacuga

SEQ ID NO: 418497 - RNA, 32 nt, Human
gacaauaacaucacaagcuaaaagccagagaa

SEQ ID NO: 418498 - RNA, 32 nt, Human
gacaauaaggauuuuuauagauauaauuuaau

SEQ ID NO: 418499 - RNA, 32 nt, Human
gacaauagcuguggggaaagaaaaugaguucc

SEQ ID NO: 418500 - RNA, 32 nt, Human
gacaauauuuagaacccaaauuuuggagugcu

SEQ ID NO: 418501 - RNA, 32 nt, Human
gacaaucacaaaucugugagggcugcugguua

SEQ ID NO: 418502 - RNA, 32 nt, Human
gacaaucaccaucugaauuccagaagcccugu

SEQ ID NO: 418503 - RNA, 32 nt, Human
gacaaucagaagagcuaccugcccucugaagc

SEQ ID NO: 418504 - RNA, 32 nt, Human
gacaaucauuguggaagcagaagguugucaug

SEQ ID NO: 418505 - RNA, 32 nt, Human
gacaaucccuuucgucuccuuccuccgcugcu

SEQ ID NO: 418506 - RNA, 32 nt, Human
gacaauccuggguuauccuugugggcucaguu

SEQ ID NO: 418507 - RNA, 32 nt, Human
gacaaucuauuuuguuacuugcacuuguuauu

SEQ ID NO: 418508 - RNA, 16 nt, Human
gacaaucucaggcuga

SEQ ID NO: 418509 - RNA, 32 nt, Human
gacaaucuccaggagaaccuacagauuggaag

SEQ ID NO: 418510 - RNA, 17 nt, Human
gacaaucuggggacuga

SEQ ID NO: 418511 - RNA, 32 nt, Human
gacaaugacaacugauaagggaugcaaaacca

SEQ ID NO: 418512 - RNA, 31 nt, Human
gacaaugaggagacagaaaaagcugcaugau

SEQ ID NO: 418513 - RNA, 32 nt, Human
gacaaugaggagacagaaaaagcugcaugaua

SEQ ID NO: 418514 - RNA, 32 nt, Human
gacaaugagggccacagagaaggugguguuuc

SEQ ID NO: 418515 - RNA, 32 nt, Human
gacaaugauucugucaucaccaucuccaugga

SEQ ID NO: 418516 - RNA, 31 nt, Human
gacaaugauuucacaacuagagggaagcagu

SEQ ID NO: 418517 - RNA, 32 nt, Human
gacaaugcauuuucagggaccagccccaucac

SEQ ID NO: 418518 - RNA, 32 nt, Human
gacaaugccaggaggcuucauugacguuguag

SEQ ID NO: 418519 - RNA, 32 nt, Human
gacaaugccaggauggcaguggaugacuucaa

SEQ ID NO: 418520 - RNA, 32 nt, Human
gacaaugccuggaacauaauagacacuaguua

SEQ ID NO: 418521 - RNA, 32 nt, Human
gacaaugcuggaguuaauucccagggaaggug

SEQ ID NO: 418522 - RNA, 22 nt, Human
gacaauggaaggaugcaggcca

SEQ ID NO: 418523 - RNA, 22 nt, Human
gacaauggaggcagagauugga

SEQ ID NO: 418524 - RNA, 30 nt, Human
gacaauggccucuccaggcuuuucuccugc

SEQ ID NO: 418525 - RNA, 32 nt, Human
gacaauggcgugaaccugggaggcagagcuug

SEQ ID NO: 418526 - RNA, 32 nt, Human
gacaauggcucacaucuguaaucccagcacuu

SEQ ID NO: 418527 - RNA, 32 nt, Human
gacaauggcugcaggaaaucauucaggcggga

SEQ ID NO: 418528 - RNA, 32 nt, Human
gacaauggcuugaaccugggaggcagagguug

SEQ ID NO: 418529 - RNA, 23 nt, Human
gacaaugggaauggccugugcca

SEQ ID NO: 418530 - RNA, 32 nt, Human
gacaaugggcacugauuugauaccauggcacu

SEQ ID NO: 418531 - RNA, 32 nt, Human
gacaaugggcuggcugccacgccccgaccccg

SEQ ID NO: 418532 - RNA, 32 nt, Human
gacaaugggcugggucgcucccauuuggccug

SEQ ID NO: 418533 - RNA, 32 nt, Human
gacaauggguaaaaugucuccagggcauauga

SEQ ID NO: 418534 - RNA, 32 nt, Human
gacaauggugugaacccaggaggcggugcuug

SEQ ID NO: 418535 - RNA, 20 nt, Human
gacaaugugagacucugucu

SEQ ID NO: 418536 - RNA, 29 nt, Human
gacaauguggaccaauuucuucaaacuac

SEQ ID NO: 418537 - RNA, 32 nt, Human
gacaauguugaaugaaugucuggcucagugau

SEQ ID NO: 418538 - RNA, 32 nt, Human
gacaauguugaaugaaugucugggucagugau

SEQ ID NO: 418539 - RNA, 32 nt, Human
gacaauuagcagucucugccucccuuggaaac

SEQ ID NO: 418540 - RNA, 32 nt, Human
gacaauucacacuggggagaaaccuuacaagu

SEQ ID NO: 418541 - RNA, 32 nt, Human
gacaauucagaggcgaggagauucuguaaacu

SEQ ID NO: 418542 - RNA, 32 nt, Human
gacaauucaugcaagaagauauacaaauauua

SEQ ID NO: 418543 - RNA, 17 nt, Human
gacaauucugggugcga

SEQ ID NO: 418544 - RNA, 19 nt, Human
gacaauucuuccaguggaa

SEQ ID NO: 418545 - RNA, 32 nt, Human
gacaauucuucuucuucugauguggcccaggg

SEQ ID NO: 418546 - RNA, 32 nt, Human
gacaauugacccaaucacucuguccaucaaac

SEQ ID NO: 418547 - RNA, 32 nt, Human
gacaauuggagcacaggaauguuaacauguau

SEQ ID NO: 418548 - RNA, 32 nt, Human
gacaauugguguuuacacccucuugucagcaa

SEQ ID NO: 418549 - RNA, 22 nt, Human
gacaauuguauacagaguuaaa

SEQ ID NO: 418550 - RNA, 32 nt, Human
gacaauuguccagguggacugcauguuuauuu

SEQ ID NO: 418551 - RNA, 16 nt, Human
gacaauuuagggcuga

SEQ ID NO: 418552 - RNA, 18 nt, Human
gacaauuuauguaucuga

SEQ ID NO: 418553 - RNA, 32 nt, Human
gacaauuuauuaauuugagaaagucaccuuga

SEQ ID NO: 418554 - RNA, 32 nt, Human
gacacaaaaggccacauacuguaugaacucau

SEQ ID NO: 418555 - RNA, 32 nt, Human
gacacaaagcaaaaaugcucuaaugccaauug

SEQ ID NO: 418556 - RNA, 32 nt, Human
gacacaaagcaggaggccacauaaagacagag

SEQ ID NO: 418557 - RNA, 32 nt, Human
gacacaaaggacacgcauguccagugggcugg

SEQ ID NO: 418558 - RNA, 32 nt, Human
gacacaaauuuucaaguuuacacuucauauag

SEQ ID NO: 418559 - RNA, 32 nt, Human
gacacaacgcggagcggggcugaggggccgcc

SEQ ID NO: 418560 - RNA, 32 nt, Human
gacacaacugcacuccagcuugggcaacaggg

SEQ ID NO: 418561 - RNA, 32 nt, Human
gacacaacugccugcugccuuuccacagcuau

SEQ ID NO: 418562 - RNA, 32 nt, Human
gacacaacugggauugcugagcucaaggguug

SEQ ID NO: 418563 - RNA, 32 nt, Human
gacacaagaauuauacaguuucccucuauaag

SEQ ID NO: 418564 - RNA, 32 nt, Human
gacacaagacucccugcagcugugcuggggua

SEQ ID NO: 418565 - RNA, 32 nt, Human
gacacaagagccucacaugagaaauuaccagu

SEQ ID NO: 418566 - RNA, 32 nt, Human
gacacaagaugcccccuucauucaucaguuac

SEQ ID NO: 418567 - RNA, 22 nt, Human
gacacaagcugcagccuugucc

SEQ ID NO: 418568 - RNA, 32 nt, Human
gacacaaggacugagcuaugggcuccagcuag

SEQ ID NO: 418569 - RNA, 32 nt, Human
gacacaaggagcugcggggcuggagaaggcca

SEQ ID NO: 418570 - RNA, 32 nt, Human
gacacaaguuuaccuauguaacaaaccugcac

SEQ ID NO: 418571 - RNA, 32 nt, Human
gacacaaguuuaccuguauaacaaaccugcac

SEQ ID NO: 418572 - RNA, 32 nt, Human
gacacaauaauuauuugcaaaaugaguaaaca

SEQ ID NO: 418573 - RNA, 32 nt, Human
gacacaauagaugguuuauagacucagcagcc

SEQ ID NO: 418574 - RNA, 32 nt, Human
gacacaaucagacuuaaauaauacggaagaua

SEQ ID NO: 418575 - RNA, 32 nt, Human
gacacaaugcaguuuacuugccucuucauacc

SEQ ID NO: 418576 - RNA, 32 nt, Human
gacacaauggagagguaagacagaccacaaac

SEQ ID NO: 418577 - RNA, 23 nt, Human
gacacaauuuccacaaccuuuca

SEQ ID NO: 418578 - RNA, 32 nt, Human
gacacacaaaacaccugggaaacuggagaaca

SEQ ID NO: 418579 - RNA, 32 nt, Human
gacacacaaaggcaaacagaucugccaucgau

SEQ ID NO: 418580 - RNA, 31 nt, Human
gacacacaagucgcguggguuggagaagcca

SEQ ID NO: 418581 - RNA, 32 nt, Human
gacacacacagucuucacugugcugcagccag

SEQ ID NO: 418582 - RNA, 32 nt, Human
gacacacacaugcacgcaugcuguaugcacuu

SEQ ID NO: 418583 - RNA, 32 nt, Human
gacacacaccuguaaucucagcuacucaggag

SEQ ID NO: 418584 - RNA, 20 nt, Human
gacacacaccuguaguccca

SEQ ID NO: 418585 - RNA, 32 nt, Human
gacacacacgugguucucagugcuagggccgg

SEQ ID NO: 418586 - RNA, 23 nt, Human
gacacacacuggaggcaaacccu

SEQ ID NO: 418587 - RNA, 32 nt, Human
gacacacagacaaucccaacaucacacacugu

SEQ ID NO: 418588 - RNA, 25 nt, Human
gacacacagccuccugacuccagga

SEQ ID NO: 418589 - RNA, 23 nt, Human
gacacacauccaugacacagccu

SEQ ID NO: 418590 - RNA, 23 nt, Human
gacacacauccgugacacagccu

SEQ ID NO: 418591 - RNA, 32 nt, Human
gacacacauucugccuuggauuccuagauuac

SEQ ID NO: 418592 - RNA, 32 nt, Human
gacacaccaaagaagacucugcaucagugaag

SEQ ID NO: 418593 - RNA, 22 nt, Human
gacacaccacaccuacacuccc

SEQ ID NO: 418594 - RNA, 32 nt, Human
gacacaccacaccuaccuugggggaaugccgu

SEQ ID NO: 418595 - RNA, 32 nt, Human
gacacaccagccucucucucuagcaugguggc

SEQ ID NO: 418596 - RNA, 32 nt, Human
gacacacccaggaaggcuuuugaagucaagcc

SEQ ID NO: 418597 - RNA, 32 nt, Human
gacacaccucaguaaagagcaaaggcaacgcc

SEQ ID NO: 418598 - RNA, 32 nt, Human
gacacaccugcccuccccagccagcuccuguc

SEQ ID NO: 418599 - RNA, 32 nt, Human
gacacaccugugcacacaugccuacaggccag

SEQ ID NO: 418600 - RNA, 32 nt, Human
gacacaccuguguuaagaccagcccucugcuu

SEQ ID NO: 418601 - RNA, 32 nt, Human
gacacaccuuuauguauguaacaaaccagcac

SEQ ID NO: 418602 - RNA, 32 nt, Human
gacacacgcccguaaucccagcuacucaggag

SEQ ID NO: 418603 - RNA, 32 nt, Human
gacacacgccuguaaucccagcugcucgggag

SEQ ID NO: 418604 - RNA, 32 nt, Human
gacacacgcggagaggaggagaggcugaggga

SEQ ID NO: 418605 - RNA, 32 nt, Human
gacacacucacacucucaucucuuuccuuggc

SEQ ID NO: 418606 - RNA, 32 nt, Human
gacacacuccuauaauccuagcacuuugggag

SEQ ID NO: 418607 - RNA, 32 nt, Human
gacacacugcugugacugccucuuguuaaugu

SEQ ID NO: 418608 - RNA, 32 nt, Human
gacacagaagaguucaugugcagugauguggg

SEQ ID NO: 418609 - RNA, 22 nt, Human
gacacagaaggcugccgggugg

SEQ ID NO: 418610 - RNA, 32 nt, Human
gacacagaagugaagucugugucugugcacuu

SEQ ID NO: 418611 - RNA, 32 nt, Human
gacacagaauaguuuacacacuguguggggga

SEQ ID NO: 418612 - RNA, 32 nt, Human
gacacagacacaaagcaggaggccacauaaag

SEQ ID NO: 418613 - RNA, 32 nt, Human
gacacagacagcccuggcugaaaggagcacag

SEQ ID NO: 418614 - RNA, 32 nt, Human
gacacagacauggacauggacacagaaaccac

SEQ ID NO: 418615 - RNA, 32 nt, Human
gacacagacuucugagguggcagcgggaggga

SEQ ID NO: 418616 - RNA, 32 nt, Human
gacacagagacacccacccagcacaccagaca

SEQ ID NO: 418617 - RNA, 32 nt, Human
gacacagagacaccucuggcuaccuagaguuc

SEQ ID NO: 418618 - RNA, 32 nt, Human
gacacagagauccccuagguccuggcccaggc

SEQ ID NO: 418619 - RNA, 32 nt, Human
gacacagagcacagcugugcuggaaguguggg

SEQ ID NO: 418620 - RNA, 32 nt, Human
gacacagagcccagagggacagcgcccagagc

SEQ ID NO: 418621 - RNA, 32 nt, Human
gacacagaggcucagagagaauaaccuccauc

SEQ ID NO: 418622 - RNA, 32 nt, Human
gacacagaggggcaguagaggcugcaggcguc

SEQ ID NO: 418623 - RNA, 32 nt, Human
gacacagaugaugagacagaguuuagggugca

SEQ ID NO: 418624 - RNA, 32 nt, Human
gacacagcagcaauaaacuuacaaguaaaauu

SEQ ID NO: 418625 - RNA, 32 nt, Human
gacacagcauaauguuuggcuaaugccaccag

SEQ ID NO: 418626 - RNA, 32 nt, Human
gacacagcaucacaucacacacacagaaauua

SEQ ID NO: 418627 - RNA, 32 nt, Human
gacacagccacuucuggugguuaccacucacc

SEQ ID NO: 418628 - RNA, 32 nt, Human
gacacagccauggcccagccccaaggccaggc

SEQ ID NO: 418629 - RNA, 32 nt, Human
gacacagccucaccagcccaugcucggccaga

SEQ ID NO: 418630 - RNA, 32 nt, Human
gacacagcgccuucccuucaggaguugcgucu

SEQ ID NO: 418631 - RNA, 23 nt, Human
gacacagcuaccucuguuggcau

SEQ ID NO: 418632 - RNA, 32 nt, Human
gacacagcucagcuugcucacgcccagagaga

SEQ ID NO: 418633 - RNA, 17 nt, Human
gacacagcugggucugg

SEQ ID NO: 418634 - RNA, 18 nt, Human
gacacagcuggguucuga

SEQ ID NO: 418635 - RNA, 32 nt, Human
gacacagcuguggaggucacagcugcuccuuu

SEQ ID NO: 418636 - RNA, 32 nt, Human
gacacaggaccagggagggagccccagaggca

SEQ ID NO: 418637 - RNA, 32 nt, Human
gacacaggagaaagccgccuccgcuggaggcc

SEQ ID NO: 418638 - RNA, 32 nt, Human
gacacaggaggaaccccuucucugguugagcu

SEQ ID NO: 418639 - RNA, 32 nt, Human
gacacaggagggcugggcuccacuucauccag

SEQ ID NO: 418640 - RNA, 32 nt, Human
gacacaggaguguugccauguuguccaaacug

SEQ ID NO: 418641 - RNA, 32 nt, Human
gacacaggauccuggccugagaauugagggga

SEQ ID NO: 418642 - RNA, 24 nt, Human
gacacaggcaaaccuuauuacuau

SEQ ID NO: 418643 - RNA, 32 nt, Human
gacacaggccagcuccacaguguugccagagc

SEQ ID NO: 418644 - RNA, 32 nt, Human
gacacaggccuguggucccaggaaaaggucug

SEQ ID NO: 418645 - RNA, 32 nt, Human
gacacaggcuggguuggucugccccucaguca

SEQ ID NO: 418646 - RNA, 32 nt, Human
gacacagggaagcacugcccagccccugccug

SEQ ID NO: 418647 - RNA, 32 nt, Human
gacacagggaucuucugaaguugcuuugaauc

SEQ ID NO: 418648 - RNA, 32 nt, Human
gacacagggcccuaugguccuacugugggugg

SEQ ID NO: 418649 - RNA, 22 nt, Human
gacacagggucucaccauguug

SEQ ID NO: 418650 - RNA, 18 nt, Human
gacacaggguuucaccau

SEQ ID NO: 418651 - RNA, 18 nt, Human
gacacagguccacaggga

SEQ ID NO: 418652 - RNA, 32 nt, Human
gacacaggugagggagguaaugggggagcccu

SEQ ID NO: 418653 - RNA, 18 nt, Human
gacacagucucgcuuugu

SEQ ID NO: 418654 - RNA, 32 nt, Human
gacacauacauccuaaaagcaccacagcagag

SEQ ID NO: 418655 - RNA, 32 nt, Human
gacacauaggacacaggaauuccuggguccuu

SEQ ID NO: 418656 - RNA, 32 nt, Human
gacacauaguaaggagaauggaauaauacaug

SEQ ID NO: 418657 - RNA, 32 nt, Human
gacacauaguaaucucuaaggugcaaaacaca

SEQ ID NO: 418658 - RNA, 32 nt, Human
gacacauauggacacacauauggacacgugug

SEQ ID NO: 418659 - RNA, 32 nt, Human
gacacauauguacguaauuucuccaauguuua

SEQ ID NO: 418660 - RNA, 32 nt, Human
gacacauccuccuaccguccccaaaucccccu

SEQ ID NO: 418661 - RNA, 32 nt, Human
gacacaucuccugagggaucccagaaagaacc

SEQ ID NO: 418662 - RNA, 32 nt, Human
gacacaucucuaguacuuuuugucauaaacaa

SEQ ID NO: 418663 - RNA, 32 nt, Human
gacacaucuggggacagucuccuuccuggagg

SEQ ID NO: 418664 - RNA, 32 nt, Human
gacacaugagcagccccgacaggccuggcucc

SEQ ID NO: 418665 - RNA, 32 nt, Human
gacacaugagcccagccccagcucaccugcca

SEQ ID NO: 418666 - RNA, 32 nt, Human
gacacaugcacacacaucacacccucaaacac

SEQ ID NO: 418667 - RNA, 32 nt, Human
gacacaugccuguaaucccagcaacucaggag

SEQ ID NO: 418668 - RNA, 32 nt, Human
gacacaugccuguagucccagcuacucaggag

SEQ ID NO: 418669 - RNA, 32 nt, Human
gacacaugccuguaguccuagcuacuugggag

SEQ ID NO: 418670 - RNA, 19 nt, Human
gacacauggcaaauguuga

SEQ ID NO: 418671 - RNA, 24 nt, Human
gacacauggccccucccccugcca

SEQ ID NO: 418672 - RNA, 32 nt, Human
gacacauggcugcuuggccugccacguguggg

SEQ ID NO: 418673 - RNA, 32 nt, Human
gacacauguauucucaucugugguccaggccg

SEQ ID NO: 418674 - RNA, 32 nt, Human
gacacauuaauuagcuugauuaauuuagauua

SEQ ID NO: 418675 - RNA, 24 nt, Human
gacacauuuugccuacacuugcua

SEQ ID NO: 418676 - RNA, 26 nt, Human
gacacauuuuuacccuucauucccau

SEQ ID NO: 418677 - RNA, 32 nt, Human
gacaccaaagcaugagcaacaaaaggaagaau

SEQ ID NO: 418678 - RNA, 32 nt, Human
gacaccaaaugagggacauggaaaggggugag

SEQ ID NO: 418679 - RNA, 21 nt, Human
gacaccaaauuaugguguaga

SEQ ID NO: 418680 - RNA, 32 nt, Human
gacaccaaggcaggaggcuaggaggucuacaa

SEQ ID NO: 418681 - RNA, 32 nt, Human
gacaccaaggcuguggucugugcagugaaucg

SEQ ID NO: 418682 - RNA, 32 nt, Human
gacaccaagggcccauuuccuccccucucuac

SEQ ID NO: 418683 - RNA, 32 nt, Human
gacaccaagguggguggaucaccugaggucag

SEQ ID NO: 418684 - RNA, 32 nt, Human
gacaccaaugaaccccagccagccuggacccc

SEQ ID NO: 418685 - RNA, 32 nt, Human
gacaccaaugaaccccagucagccuggacccc

SEQ ID NO: 418686 - RNA, 32 nt, Human
gacaccaauggcccacgaaaucugcuacuccg

SEQ ID NO: 418687 - RNA, 32 nt, Human
gacaccacaauugugccuucugugggccaggc

SEQ ID NO: 418688 - RNA, 32 nt, Human
gacaccacaggggcaccugcaggcugggagac

SEQ ID NO: 418689 - RNA, 32 nt, Human
gacaccacaggugcccuggagcccuuguguga

SEQ ID NO: 418690 - RNA, 32 nt, Human
gacaccaccaacaacagaaagaucagaguuaa

SEQ ID NO: 418691 - RNA, 32 nt, Human
gacaccaccaggcaccucccuaggcaacgcca

SEQ ID NO: 418692 - RNA, 32 nt, Human
gacaccaccaugaccggcuccugcugcggcuc

SEQ ID NO: 418693 - RNA, 32 nt, Human
gacaccaccccuggcugggcuacugggcucag

SEQ ID NO: 418694 - RNA, 32 nt, Human
gacaccaccgacuuccuuucugcgucaccagu

SEQ ID NO: 418695 - RNA, 32 nt, Human
gacaccaccugcccaugcuuccuugaauuagg

SEQ ID NO: 418696 - RNA, 32 nt, Human
gacaccaccugcuugcauucauccccuccucc

SEQ ID NO: 418697 - RNA, 23 nt, Human
gacaccaccugucaaagcugccu

SEQ ID NO: 418698 - RNA, 32 nt, Human
gacaccacgccacugcacuccagccuggguga

SEQ ID NO: 418699 - RNA, 32 nt, Human
gacaccacgugcuccuccuaagccaaaaacau

SEQ ID NO: 418700 - RNA, 32 nt, Human
gacaccacugcacuccaaccuagguaacagag

SEQ ID NO: 418701 - RNA, 32 nt, Human
gacaccacugcacuccagccugggugacagag

SEQ ID NO: 418702 - RNA, 32 nt, Human
gacaccagaaaauucauacucacuaaaacccc

SEQ ID NO: 418703 - RNA, 32 nt, Human
gacaccagaaagucugguggcuuuggucccaa

SEQ ID NO: 418704 - RNA, 32 nt, Human
gacaccagaauggagcgcaggagcagcacgug

SEQ ID NO: 418705 - RNA, 32 nt, Human
gacaccagaggacacacacagugcuguggcuu

SEQ ID NO: 418706 - RNA, 32 nt, Human
gacaccagaucuaugguccaggagauggagag

SEQ ID NO: 418707 - RNA, 32 nt, Human
gacaccagcagauccccaggggcugcugggca

SEQ ID NO: 418708 - RNA, 32 nt, Human
gacaccagccaucaugugccuggaaauuaaac

SEQ ID NO: 418709 - RNA, 32 nt, Human
gacaccagcccuguccuagcccuucaguaaga

SEQ ID NO: 418710 - RNA, 32 nt, Human
gacaccagccugggcaacauagugagaccuug

SEQ ID NO: 418711 - RNA, 32 nt, Human
gacaccagccugggcaacaugguaagaccccu

SEQ ID NO: 418712 - RNA, 32 nt, Human
gacaccagcgucuccggcagccucuuggucau

SEQ ID NO: 418713 - RNA, 32 nt, Human
gacaccagcugaagacuggaaggguggaagga

SEQ ID NO: 418714 - RNA, 32 nt, Human
gacaccaggaagaggacaaacugcauggacuc

SEQ ID NO: 418715 - RNA, 32 nt, Human
gacaccaggaggucagggcacagaggacgugc

SEQ ID NO: 418716 - RNA, 32 nt, Human
gacaccaggaguuagagagcagccugggcaac

SEQ ID NO: 418717 - RNA, 32 nt, Human
gacaccaggccccauguggcccccaggccuuu

SEQ ID NO: 418718 - RNA, 32 nt, Human
gacaccagggagagacagagacagagaugaca

SEQ ID NO: 418719 - RNA, 32 nt, Human
gacaccaggguggguggaucaccugaggucag

SEQ ID NO: 418720 - RNA, 32 nt, Human
gacaccagguuggagaggcaccugccaacuac

SEQ ID NO: 418721 - RNA, 32 nt, Human
gacaccagugaaccccagucagccuggacccc

SEQ ID NO: 418722 - RNA, 24 nt, Human
gacaccagugggcccaggaccugg

SEQ ID NO: 418723 - RNA, 21 nt, Human
gacaccaguucccuacaagca

SEQ ID NO: 418724 - RNA, 22 nt, Human
gacaccauaagccacagccuca

SEQ ID NO: 418725 - RNA, 32 nt, Human
gacaccauagccacugcccccuccccuggaug

SEQ ID NO: 418726 - RNA, 32 nt, Human
gacaccaucacgggcaugcacagcguggaggu

SEQ ID NO: 418727 - RNA, 19 nt, Human
gacaccaucuuuuauucuu

SEQ ID NO: 418728 - RNA, 32 nt, Human
gacaccaugaaaggcugcucuuaacuuugucu

SEQ ID NO: 418729 - RNA, 32 nt, Human
gacaccaugacagcaaaaggacugggacugau

SEQ ID NO: 418730 - RNA, 32 nt, Human
gacaccaugagccaccaccgcugacugacuuu

SEQ ID NO: 418731 - RNA, 32 nt, Human
gacaccaugucccaggacaguguuacuucuuc

SEQ ID NO: 418732 - RNA, 32 nt, Human
gacaccaugucuuccucuuccucucucuucca

SEQ ID NO: 418733 - RNA, 24 nt, Human
gacaccauucauuccugcuccaua

SEQ ID NO: 418734 - RNA, 32 nt, Human
gacaccauuggaccccacccagccuggaucua

SEQ ID NO: 418735 - RNA, 32 nt, Human
gacaccauugucucccuuuaaucuucucuuuu

SEQ ID NO: 418736 - RNA, 32 nt, Human
gacaccauuucaccugagaccaauaggugcac

SEQ ID NO: 418737 - RNA, 23 nt, Human
gacacccaagcuugucacccgcu

SEQ ID NO: 418738 - RNA, 32 nt, Human
gacacccaaugccauccccaagggcuucaugg

SEQ ID NO: 418739 - RNA, 32 nt, Human
gacacccaaugucuacaaucaaaaagauaaua

SEQ ID NO: 418740 - RNA, 32 nt, Human
gacacccacaccccuguauucuccuccgaacc

SEQ ID NO: 418741 - RNA, 32 nt, Human
gacacccacuccuagcccugaggcucgugccc

SEQ ID NO: 418742 - RNA, 32 nt, Human
gacacccacugccucugugaccuugggugggu

SEQ ID NO: 418743 - RNA, 32 nt, Human
gacacccaggagacgcagugucagagcgugug

SEQ ID NO: 418744 - RNA, 21 nt, Human
gacacccaggccacccugccu

SEQ ID NO: 418745 - RNA, 32 nt, Human
gacacccaucaccaccaccaccacggugaccc

SEQ ID NO: 418746 - RNA, 32 nt, Human
gacacccaucuccaccaccacuacggugaccc

SEQ ID NO: 418747 - RNA, 32 nt, Human
gacacccauucaacccuucagacucccuccug

SEQ ID NO: 418748 - RNA, 32 nt, Human
gacaccccacacccccugccugaauggauggg

SEQ ID NO: 418749 - RNA, 32 nt, Human
gacaccccagaucuucucaacuggaaccacga

SEQ ID NO: 418750 - RNA, 32 nt, Human
gacaccccagcugcucuggcaaggaugggcag

SEQ ID NO: 418751 - RNA, 32 nt, Human
gacacccccagaaucccuccccagagacugca

SEQ ID NO: 418752 - RNA, 32 nt, Human
gacacccccagcccggucagagucacacgggg

SEQ ID NO: 418753 - RNA, 32 nt, Human
gacacccccuccuccaccuucaaugcuggggc

SEQ ID NO: 418754 - RNA, 32 nt, Human
gacacccccugggauggcucaaaggagucagg

SEQ ID NO: 418755 - RNA, 32 nt, Human
gacacccccuuacuagcccccaacacacagaa

SEQ ID NO: 418756 - RNA, 32 nt, Human
gacaccccgaguugugcuucaugagaguugga

SEQ ID NO: 418757 - RNA, 32 nt, Human
gacaccccucuccaccccuccugcuuccccag

SEQ ID NO: 418758 - RNA, 32 nt, Human
gacaccccugcacugccuucugggugugccag

SEQ ID NO: 418759 - RNA, 32 nt, Human
gacaccccuuucuccaccugcuccuccuccuc

SEQ ID NO: 418760 - RNA, 32 nt, Human
gacacccgaccacaccagagcgugggagacgg

SEQ ID NO: 418761 - RNA, 23 nt, Human
gacacccgccguuucacccagcc

SEQ ID NO: 418762 - RNA, 17 nt, Human
gacacccgcgcuggcug

SEQ ID NO: 418763 - RNA, 32 nt, Human
gacacccggcaccauucucccuucucucuuuu

SEQ ID NO: 418764 - RNA, 32 nt, Human
gacacccguuccccugcaucaucugucuugcg

SEQ ID NO: 418765 - RNA, 32 nt, Human
gacacccucagccaagggacagugccauccuu

SEQ ID NO: 418766 - RNA, 21 nt, Human
gacacccucuuaacuccggga

SEQ ID NO: 418767 - RNA, 32 nt, Human
gacacccugcuaggcucuguagauggauguau

SEQ ID NO: 418768 - RNA, 32 nt, Human
gacacccuggcuggcccugacugacuguauuc

SEQ ID NO: 418769 - RNA, 32 nt, Human
gacacccugggccuuccuggaagccugcaguu

SEQ ID NO: 418770 - RNA, 32 nt, Human
gacacccuugaagauuuggccugggccaguga

SEQ ID NO: 418771 - RNA, 32 nt, Human
gacacccuuuguaacucucuucuccucccuag

SEQ ID NO: 418772 - RNA, 32 nt, Human
gacaccgaagcagaggauacaggaggauuaaa

SEQ ID NO: 418773 - RNA, 32 nt, Human
gacaccgaauagagagugaauuucaaaggauu

SEQ ID NO: 418774 - RNA, 32 nt, Human
gacaccgaguccuagcuaggcgcucacagaau

SEQ ID NO: 418775 - RNA, 32 nt, Human
gacaccgaugugggauacguucugaguaguug

SEQ ID NO: 418776 - RNA, 32 nt, Human
gacaccgcagcgcuugcccugcgccagggacu

SEQ ID NO: 418777 - RNA, 32 nt, Human
gacaccgcaggcagagguugcucggggccuug

SEQ ID NO: 418778 - RNA, 32 nt, Human
gacaccgcaguucuguucagccaucagaagag

SEQ ID NO: 418779 - RNA, 32 nt, Human
gacaccgcuccuccaggucuccauaauugucu

SEQ ID NO: 418780 - RNA, 17 nt, Human
gacaccgcuggcugcug

SEQ ID NO: 418781 - RNA, 32 nt, Human
gacaccggauuuguuucuuauuccuucacuuu

SEQ ID NO: 418782 - RNA, 32 nt, Human
gacaccggguucacgagcugcccacgcccucu

SEQ ID NO: 418783 - RNA, 32 nt, Human
gacaccggucucugcugaggcucccagccuca

SEQ ID NO: 418784 - RNA, 32 nt, Human
gacaccgugaugagacuggcccccaaggcagc

SEQ ID NO: 418785 - RNA, 32 nt, Human
gacaccguggccuggaggguggcaugguccca

SEQ ID NO: 418786 - RNA, 32 nt, Human
gacaccuaaggggacuuccuuacaacaccuug

SEQ ID NO: 418787 - RNA, 32 nt, Human
gacaccuaagugccuccccaaccagggucugu

SEQ ID NO: 418788 - RNA, 32 nt, Human
gacaccucaaccagaaggaaucuuaacagcaa

SEQ ID NO: 418789 - RNA, 32 nt, Human
gacaccucacagaguggggaggacggaggcug

SEQ ID NO: 418790 - RNA, 20 nt, Human
gacaccuccaccaaaccucc

SEQ ID NO: 418791 - RNA, 22 nt, Human
gacaccucccaaccccacccca

SEQ ID NO: 418792 - RNA, 17 nt, Human
gacaccucccagcgugg

SEQ ID NO: 418793 - RNA, 24 nt, Human
gacaccucccagcgugggacccca

SEQ ID NO: 418794 - RNA, 22 nt, Human
gacaccucccaggggacuguuc

SEQ ID NO: 418795 - RNA, 24 nt, Human
gacaccucccaguguucaccuaca

SEQ ID NO: 418796 - RNA, 32 nt, Human
gacaccuccgagagaguggagggaaaaugugu

SEQ ID NO: 418797 - RNA, 24 nt, Human
gacaccuccucucuggauccucca

SEQ ID NO: 418798 - RNA, 32 nt, Human
gacaccuccuugggacacugggauuauucaua

SEQ ID NO: 418799 - RNA, 32 nt, Human
gacaccucuccucugcugccauacucucccuu

SEQ ID NO: 418800 - RNA, 32 nt, Human
gacaccucugcacucccuugggcagagauggg

SEQ ID NO: 418801 - RNA, 32 nt, Human
gacaccucugcaggauuggcccccaggaucgc

SEQ ID NO: 418802 - RNA, 32 nt, Human
gacaccucuuucucauucauucuccuuuuccc

SEQ ID NO: 418803 - RNA, 32 nt, Human
gacaccugaccuuuugaagcuucauaauucac

SEQ ID NO: 418804 - RNA, 32 nt, Human
gacaccugcaaaauaaguucugccugggcauu

SEQ ID NO: 418805 - RNA, 32 nt, Human
gacaccugcagccuuuggucuccuggaugggc

SEQ ID NO: 418806 - RNA, 32 nt, Human
gacaccugcucuguaacugucuuucccacuga

SEQ ID NO: 418807 - RNA, 32 nt, Human
gacaccugcucuguaacugucuuucccgcuga

SEQ ID NO: 418808 - RNA, 32 nt, Human
gacaccugcuucugauuccacaaggggcuuuu

SEQ ID NO: 418809 - RNA, 32 nt, Human
gacaccuggaaugggagcuuguaacuuuuaca

SEQ ID NO: 418810 - RNA, 32 nt, Human
gacaccuggauaccaaaugcaggaugaggagu

SEQ ID NO: 418811 - RNA, 32 nt, Human
gacaccuggaugacauuucaguacccgcuggc

SEQ ID NO: 418812 - RNA, 32 nt, Human
gacaccuggaugcugcucagcgggcccuguac

SEQ ID NO: 418813 - RNA, 32 nt, Human
gacaccugggccucaggcagagcccagcccug

SEQ ID NO: 418814 - RNA, 19 nt, Human
gacaccugggcugggcugg

SEQ ID NO: 418815 - RNA, 32 nt, Human
gacaccuggucugcccaggccugccucccuuc

SEQ ID NO: 418816 - RNA, 16 nt, Human
gacaccuguaauccca

SEQ ID NO: 418817 - RNA, 32 nt, Human
gacaccuguaaucccagcuacuagggaggcug

SEQ ID NO: 418818 - RNA, 16 nt, Human
gacaccuguaguccca

SEQ ID NO: 418819 - RNA, 32 nt, Human
gacaccuguagucccagcuacuuggagggcag

SEQ ID NO: 418820 - RNA, 32 nt, Human
gacaccuguagucccagcugcuugggaggcug

SEQ ID NO: 418821 - RNA, 32 nt, Human
gacaccuguggacucccuaagagccgcggguu

SEQ ID NO: 418822 - RNA, 32 nt, Human
gacaccuguggucccagcuauucgggaggcug

SEQ ID NO: 418823 - RNA, 32 nt, Human
gacaccuuccagcccuaccaucagcugaaugc

SEQ ID NO: 418824 - RNA, 32 nt, Human
gacaccuucccacaccuguaaucucagcacuu

SEQ ID NO: 418825 - RNA, 32 nt, Human
gacaccuucuucuacuccuacuuccggucccu

SEQ ID NO: 418826 - RNA, 32 nt, Human
gacaccuucuuucugggcucaaguauccugcc

SEQ ID NO: 418827 - RNA, 32 nt, Human
gacaccuugcagcugccgccgccgccaccgag

SEQ ID NO: 418828 - RNA, 32 nt, Human
gacaccuugggccuucuuuuccagucaggugg

SEQ ID NO: 418829 - RNA, 32 nt, Human
gacaccuuguguuuaggaucaucucugcaggu

SEQ ID NO: 418830 - RNA, 32 nt, Human
gacaccuuugaccaaaugccuucuaugguuca

SEQ ID NO: 418831 - RNA, 32 nt, Human
gacacgaacucagguccuuucaucucauccau

SEQ ID NO: 418832 - RNA, 32 nt, Human
gacacgaaugcaccuucucuuugcuaccaaca

SEQ ID NO: 418833 - RNA, 32 nt, Human
gacacgacacucacccggagaaacccagcaag

SEQ ID NO: 418834 - RNA, 32 nt, Human
gacacgagaaaagacaggcuguggauucagug

SEQ ID NO: 418835 - RNA, 32 nt, Human
gacacgagaccuguaagcagguggugagaagu

SEQ ID NO: 418836 - RNA, 32 nt, Human
gacacgaggcacagaaaacaaauaucaaagau

SEQ ID NO: 418837 - RNA, 32 nt, Human
gacacgaguuaaccuauguaacaaaccugcau

SEQ ID NO: 418838 - RNA, 32 nt, Human
gacacgauggcagccaaacugcagcuucaaac

SEQ ID NO: 418839 - RNA, 32 nt, Human
gacacgcagcgcuugcggcaguacaaugcccc

SEQ ID NO: 418840 - RNA, 32 nt, Human
gacacgcaggagguggggaugcgcgugcggcu

SEQ ID NO: 418841 - RNA, 32 nt, Human
gacacgccaagucccguuucgcacucggcuuc

SEQ ID NO: 418842 - RNA, 32 nt, Human
gacacgccccuucggacaugcgcaguguagcc

SEQ ID NO: 418843 - RNA, 32 nt, Human
gacacgcccuacccccuucucuuccaaguuuc

SEQ ID NO: 418844 - RNA, 32 nt, Human
gacacgccuccaccauaugcucauccuuccug

SEQ ID NO: 418845 - RNA, 32 nt, Human
gacacgccuuugaccagaacugcaacauuuca

SEQ ID NO: 418846 - RNA, 32 nt, Human
gacacggcacuucaggcuccacgcacagaauc

SEQ ID NO: 418847 - RNA, 32 nt, Human
gacacggccgcaccugccccaaagcgggccgc

SEQ ID NO: 418848 - RNA, 32 nt, Human
gacacggccguggagcuggagcucccaggaua

SEQ ID NO: 418849 - RNA, 32 nt, Human
gacacgggacaagaacuugggaacugccauac

SEQ ID NO: 418850 - RNA, 32 nt, Human
gacacggggguuucuccacguuggccaggcug

SEQ ID NO: 418851 - RNA, 32 nt, Human
gacacggugaaauccaggucucggguccgauu

SEQ ID NO: 418852 - RNA, 32 nt, Human
gacacggugcugcugcugcacggccuaucgca

SEQ ID NO: 418853 - RNA, 21 nt, Human
gacacgguuugcaaaguugga

SEQ ID NO: 418854 - RNA, 32 nt, Human
gacacgucuucccugugaaaggcacaggaaga

SEQ ID NO: 418855 - RNA, 32 nt, Human
gacacgugaaccaccauugcugggguuccagc

SEQ ID NO: 418856 - RNA, 32 nt, Human
gacacgugagcugaguuugaagaaaaaguuaa

SEQ ID NO: 418857 - RNA, 32 nt, Human
gacacgugccuguagucccagcuacucgggag

SEQ ID NO: 418858 - RNA, 32 nt, Human
gacacgugccuguagucccagcuacucuggag

SEQ ID NO: 418859 - RNA, 32 nt, Human
gacacguggcagccacacucacccagccucuu

SEQ ID NO: 418860 - RNA, 21 nt, Human
gacacgugggcacuggugugg

SEQ ID NO: 418861 - RNA, 32 nt, Human
gacacguggucuguccuucaaggccuccuccg

SEQ ID NO: 418862 - RNA, 32 nt, Human
gacacguguccaugcaccacagacacacccac

SEQ ID NO: 418863 - RNA, 32 nt, Human
gacacguguuuaccuauguagaaaccuucaua

SEQ ID NO: 418864 - RNA, 32 nt, Human
gacacuaacacuaggaaugacagaagucaauc

SEQ ID NO: 418865 - RNA, 32 nt, Human
gacacuaacgaaauaucaaagucauuaaagac

SEQ ID NO: 418866 - RNA, 32 nt, Human
gacacuaaguguccuggcaaggguuucagggu

SEQ ID NO: 418867 - RNA, 32 nt, Human
gacacuacaaaugccagcucucaccagauggc

SEQ ID NO: 418868 - RNA, 32 nt, Human
gacacuacaaguggcccacagggagccuuucg

SEQ ID NO: 418869 - RNA, 32 nt, Human
gacacuacccuuaguuuuaauuuucccugaca

SEQ ID NO: 418870 - RNA, 24 nt, Human
gacacuagaagcaccguggccugg

SEQ ID NO: 418871 - RNA, 20 nt, Human
gacacuagaauccugaccug

SEQ ID NO: 418872 - RNA, 32 nt, Human
gacacuaggaacagcuucaugaguucaguaga

SEQ ID NO: 418873 - RNA, 32 nt, Human
gacacuaggggccuuacauggccaggucucau

SEQ ID NO: 418874 - RNA, 32 nt, Human
gacacucaagcucucuggaaagguucagaaau

SEQ ID NO: 418875 - RNA, 32 nt, Human
gacacucaggcaggcuggcuuagucuuugugc

SEQ ID NO: 418876 - RNA, 32 nt, Human
gacacucaguuguguggggugcugcagucaua

SEQ ID NO: 418877 - RNA, 32 nt, Human
gacacucaucgaggagcuucacugugcgggac

SEQ ID NO: 418878 - RNA, 24 nt, Human
gacacuccaacucuacacagcuca

SEQ ID NO: 418879 - RNA, 32 nt, Human
gacacuccaagaagcugcgggaaggacagcag

SEQ ID NO: 418880 - RNA, 32 nt, Human
gacacuccugccgguaguuuagggccgagacg

SEQ ID NO: 418881 - RNA, 32 nt, Human
gacacucgucgagggccucugcgggacugucu

SEQ ID NO: 418882 - RNA, 32 nt, Human
gacacucucaaaggucuucucggauggaaguc

SEQ ID NO: 418883 - RNA, 32 nt, Human
gacacucucguucugucacccaggcuggagug

SEQ ID NO: 418884 - RNA, 32 nt, Human
gacacucucucugaguagugcuuuaccauuuu

SEQ ID NO: 418885 - RNA, 32 nt, Human
gacacucugcaggagaccaagagaagggggaa

SEQ ID NO: 418886 - RNA, 32 nt, Human
gacacucugucacccaggcuggagugcaaugg

SEQ ID NO: 418887 - RNA, 32 nt, Human
gacacugaaauggauucuuggaaagauucuga

SEQ ID NO: 418888 - RNA, 32 nt, Human
gacacugaagacccucagcuguuuccaucugc

SEQ ID NO: 418889 - RNA, 32 nt, Human
gacacugaauguguguuuuggaaaaauggacu

SEQ ID NO: 418890 - RNA, 32 nt, Human
gacacugacuccucaaccccugugcucagccg

SEQ ID NO: 418891 - RNA, 32 nt, Human
gacacugagcuucaucaggcccucccugggua

SEQ ID NO: 418892 - RNA, 32 nt, Human
gacacugaggauuguggagcugagugacacca

SEQ ID NO: 418893 - RNA, 32 nt, Human
gacacugagggcuccuagccgcagcagacuuc

SEQ ID NO: 418894 - RNA, 32 nt, Human
gacacugagugugacuucuguccuccauuugu

SEQ ID NO: 418895 - RNA, 32 nt, Human
gacacugaucacuaaaugaauggaugaucuac

SEQ ID NO: 418896 - RNA, 32 nt, Human
gacacugaucacugcguccccugcagcagaug

SEQ ID NO: 418897 - RNA, 32 nt, Human
gacacugcagccagggggccagaaggacugac

SEQ ID NO: 418898 - RNA, 32 nt, Human
gacacugcauguugauguugaaucaacugaug

SEQ ID NO: 418899 - RNA, 32 nt, Human
gacacugccacucuccccauuggcaccgcuuc

SEQ ID NO: 418900 - RNA, 32 nt, Human
gacacugccacugauucuccagugcauguugg

SEQ ID NO: 418901 - RNA, 32 nt, Human
gacacugccaucaucaucccaaggcaggcugc

SEQ ID NO: 418902 - RNA, 32 nt, Human
gacacugccccucccccgaccugggcccacac

SEQ ID NO: 418903 - RNA, 32 nt, Human
gacacugcccuccagccugggugacagaguga

SEQ ID NO: 418904 - RNA, 32 nt, Human
gacacugcucaggaagcaguagacccugucag

SEQ ID NO: 418905 - RNA, 32 nt, Human
gacacugcucuuccuacuuccuccucuccugg

SEQ ID NO: 418906 - RNA, 32 nt, Human
gacacugcuggugggagcaggaaggagcagug

SEQ ID NO: 418907 - RNA, 32 nt, Human
gacacuggaaauguucaacuguaguuuuauua

SEQ ID NO: 418908 - RNA, 32 nt, Human
gacacuggaccugccuuggcuucuuugauccc

SEQ ID NO: 418909 - RNA, 32 nt, Human
gacacuggcagcuguggaaaugaaugaggcac

SEQ ID NO: 418910 - RNA, 32 nt, Human
gacacuggccucgggauagccaugggcaagcu

SEQ ID NO: 418911 - RNA, 32 nt, Human
gacacugggaacugggcugucuagccggguau

SEQ ID NO: 418912 - RNA, 32 nt, Human
gacacugggaccccgaucccagccuccacucc

SEQ ID NO: 418913 - RNA, 32 nt, Human
gacacugggaggucagcauguuccacaggugu

SEQ ID NO: 418914 - RNA, 32 nt, Human
gacacugggcaggucaugggucgggggccucc

SEQ ID NO: 418915 - RNA, 32 nt, Human
gacacugggggugggaggcccugcagggaaac

SEQ ID NO: 418916 - RNA, 32 nt, Human
gacacugggguccuuccaucucuggggcccac

SEQ ID NO: 418917 - RNA, 32 nt, Human
gacacugggucugaggcuuuugaggacaguca

SEQ ID NO: 418918 - RNA, 21 nt, Human
gacacuguagaacauaacuca

SEQ ID NO: 418919 - RNA, 32 nt, Human
gacacugucacagcggaugacagacuuucuac

SEQ ID NO: 418920 - RNA, 32 nt, Human
gacacugucaucugcauuuaaucaagacuucu

SEQ ID NO: 418921 - RNA, 32 nt, Human
gacacugucggggcagcuggggccacaagcag

SEQ ID NO: 418922 - RNA, 32 nt, Human
gacacugugggauguuuagcggcagccuuggc

SEQ ID NO: 418923 - RNA, 16 nt, Human
gacacugugggucuga

SEQ ID NO: 418924 - RNA, 32 nt, Human
gacacugugugggcauauggaacagagcaacc

SEQ ID NO: 418925 - RNA, 32 nt, Human
gacacuguuccggacucguaccagccuguuua

SEQ ID NO: 418926 - RNA, 32 nt, Human
gacacuguuccugccagcuccggucuuggaaa

SEQ ID NO: 418927 - RNA, 32 nt, Human
gacacuguugcaugccccagaaagcuuguggu

SEQ ID NO: 418928 - RNA, 32 nt, Human
gacacuuacagauugagcuguaugaauucagc

SEQ ID NO: 418929 - RNA, 32 nt, Human
gacacuuacugauuaauuuuuaacaagguaga

SEQ ID NO: 418930 - RNA, 32 nt, Human
gacacuuagaaaacagauaacagccccuccau

SEQ ID NO: 418931 - RNA, 32 nt, Human
gacacuuagaucuaggaaguuuuuguagaacu

SEQ ID NO: 418932 - RNA, 32 nt, Human
gacacuuaguaagccuagccuuuaaccaucuu

SEQ ID NO: 418933 - RNA, 18 nt, Human
gacacuucaauaaagcua

SEQ ID NO: 418934 - RNA, 32 nt, Human
gacacuuccagagagcugcaccagagaccaac

SEQ ID NO: 418935 - RNA, 32 nt, Human
gacacuucccagcgauuccagccugggcuccg

SEQ ID NO: 418936 - RNA, 21 nt, Human
gacacuucuaucagcaguguu

SEQ ID NO: 418937 - RNA, 32 nt, Human
gacacuucucuccucagacuucaagggcuacc

SEQ ID NO: 418938 - RNA, 32 nt, Human
gacacuuggcgcccuuuuccagccucaauggc

SEQ ID NO: 418939 - RNA, 32 nt, Human
gacacuugggaacuuucagguacucuguacac

SEQ ID NO: 418940 - RNA, 32 nt, Human
gacacuugggguccacaaucccagguccauac

SEQ ID NO: 418941 - RNA, 16 nt, Human
gacacuuggggucugg

SEQ ID NO: 418942 - RNA, 16 nt, Human
gacacuugggguuuga

SEQ ID NO: 418943 - RNA, 32 nt, Human
gacacuugucauuguuaccagcagucuccaaa

SEQ ID NO: 418944 - RNA, 32 nt, Human
gacacuuucuccggacccagcauguaggugcc

SEQ ID NO: 418945 - RNA, 32 nt, Human
gacacuuugccaaggcucuccccucucgcccc

SEQ ID NO: 418946 - RNA, 32 nt, Human
gacacuuuuucuaggcucuaccaauaaaagcc

SEQ ID NO: 418947 - RNA, 32 nt, Human
gacagaaaaauguaagaauuuguuuuuaccau

SEQ ID NO: 418948 - RNA, 32 nt, Human
gacagaaaaaugucaucauauugaaaaauguu

SEQ ID NO: 418949 - RNA, 32 nt, Human
gacagaaaacugcagugaacacaugccaaaac

SEQ ID NO: 418950 - RNA, 32 nt, Human
gacagaaaaggcagaagcuggggcuuucugga

SEQ ID NO: 418951 - RNA, 18 nt, Human
gacagaaaagggaagaga

SEQ ID NO: 418952 - RNA, 32 nt, Human
gacagaaacccuaccuaucugauaagauuagc

SEQ ID NO: 418953 - RNA, 32 nt, Human
gacagaaacccuaccuaucugauaagauuggc

SEQ ID NO: 418954 - RNA, 32 nt, Human
gacagaaagagcgagcgaggagagggagcccg

SEQ ID NO: 418955 - RNA, 32 nt, Human
gacagaaagcaagagaccagagucccgggaaa

SEQ ID NO: 418956 - RNA, 21 nt, Human
gacagaaagcugugccgccac

SEQ ID NO: 418957 - RNA, 32 nt, Human
gacagaaagguuuucagagaaaaagaaauggu

SEQ ID NO: 418958 - RNA, 32 nt, Human
gacagaaauacugaaugacuuuacacuuagga

SEQ ID NO: 418959 - RNA, 32 nt, Human
gacagaacagagaccuccucaccagggcuucc

SEQ ID NO: 418960 - RNA, 32 nt, Human
gacagaaccaggcugagccaggccuccacccc

SEQ ID NO: 418961 - RNA, 32 nt, Human
gacagaacgguugggccuugccggcugucggu

SEQ ID NO: 418962 - RNA, 32 nt, Human
gacagaacugcacuuguagccggagacaacug

SEQ ID NO: 418963 - RNA, 32 nt, Human
gacagaagaaacaagguuuucaguccccacag

SEQ ID NO: 418964 - RNA, 32 nt, Human
gacagaagaagaaaguaaagaggaauggacuu

SEQ ID NO: 418965 - RNA, 32 nt, Human
gacagaagaagggagacaaagcucccuccugu

SEQ ID NO: 418966 - RNA, 32 nt, Human
gacagaagagugagaagcagauggaggagaag

SEQ ID NO: 418967 - RNA, 32 nt, Human
gacagaagauacaagaagggagaggugucugc

SEQ ID NO: 418968 - RNA, 32 nt, Human
gacagaagcaggcuggagguaaggccuuugag

SEQ ID NO: 418969 - RNA, 21 nt, Human
gacagaagccccaggccucca

SEQ ID NO: 418970 - RNA, 32 nt, Human
gacagaagcccuggggcaaccuccucggccac

SEQ ID NO: 418971 - RNA, 32 nt, Human
gacagaaggaaagagaggaagagagaagcaaa

SEQ ID NO: 418972 - RNA, 32 nt, Human
gacagaaggaccgggcagggcuugccuugggg

SEQ ID NO: 418973 - RNA, 32 nt, Human
gacagaaggagagaaggcuggaggcugacagg

SEQ ID NO: 418974 - RNA, 31 nt, Human
gacagaaggggcgguucagccaagacagaug

SEQ ID NO: 418975 - RNA, 32 nt, Human
gacagaagggucuccuuggucauguggcauuu

SEQ ID NO: 418976 - RNA, 32 nt, Human
gacagaagucaugaggaugcaugaauggguaa

SEQ ID NO: 418977 - RNA, 32 nt, Human
gacagaagugaaugggaauggagaggccggcg

SEQ ID NO: 418978 - RNA, 32 nt, Human
gacagaauacuuucuuuccuuccuucaaguac

SEQ ID NO: 418979 - RNA, 32 nt, Human
gacagaauccauacuuaacacucuuuccaaga

SEQ ID NO: 418980 - RNA, 32 nt, Human
gacagaaucucacuccagccugggcaacagaa

SEQ ID NO: 418981 - RNA, 32 nt, Human
gacagaaucucucacugaaacucauggucaug

SEQ ID NO: 418982 - RNA, 32 nt, Human
gacagaaugaugguuguuuuguaucauuugau

SEQ ID NO: 418983 - RNA, 23 nt, Human
gacagaauucuccaaaacaugca

SEQ ID NO: 418984 - RNA, 32 nt, Human
gacagacaacuuuugagagggcagcagacucc

SEQ ID NO: 418985 - RNA, 32 nt, Human
gacagacacacgaccacgcggcgccaccgccc

SEQ ID NO: 418986 - RNA, 32 nt, Human
gacagacacaugauaagccaaacuguuccugc

SEQ ID NO: 418987 - RNA, 32 nt, Human
gacagacagacagacacgcacacacacccauc

SEQ ID NO: 418988 - RNA, 32 nt, Human
gacagacagaccggggauccugccuggcggcg

SEQ ID NO: 418989 - RNA, 32 nt, Human
gacagacagagggagaggagaagagacgcaaa

SEQ ID NO: 418990 - RNA, 32 nt, Human
gacagacagcggggacagggaggccgacacgg

SEQ ID NO: 418991 - RNA, 32 nt, Human
gacagacaggauggacuuccuccggcuauacc

SEQ ID NO: 418992 - RNA, 32 nt, Human
gacagacaggcagacagacgcacggacaagca

SEQ ID NO: 418993 - RNA, 32 nt, Human
gacagacaggcgcuccccgcagcuccgcacgg

SEQ ID NO: 418994 - RNA, 32 nt, Human
gacagacauuucaacaaugauacaguccuguc

SEQ ID NO: 418995 - RNA, 32 nt, Human
gacagaccacccagugcugcaggagacaggcc

SEQ ID NO: 418996 - RNA, 32 nt, Human
gacagacccagccuuugugcucucacccucca

SEQ ID NO: 418997 - RNA, 32 nt, Human
gacagacccaggcuggagucuuggcugugccc

SEQ ID NO: 418998 - RNA, 32 nt, Human
gacagacgccuguaaucccagcuacuugggag

SEQ ID NO: 418999 - RNA, 32 nt, Human
gacagacucuuccccuccucucccucugccuc

SEQ ID NO: 419000 - RNA, 32 nt, Human
gacagacugcagcugcguuacugugcugagag

SEQ ID NO: 419001 - RNA, 32 nt, Human
gacagagacacaucaggggaagauggugaggu

SEQ ID NO: 419002 - RNA, 32 nt, Human
gacagagacagagaaauaagcauuagagaccu

SEQ ID NO: 419003 - RNA, 32 nt, Human
gacagagacagagagagacaaugaggcacaga

SEQ ID NO: 419004 - RNA, 32 nt, Human
gacagagacaucuuggccugucccugccuggg

SEQ ID NO: 419005 - RNA, 32 nt, Human
gacagagacgaggagaggaacaggaagagaga

SEQ ID NO: 419006 - RNA, 32 nt, Human
gacagagacgcuggcuaggccgcccuccccac

SEQ ID NO: 419007 - RNA, 32 nt, Human
gacagagacguacgugagcagauggaaccccc

SEQ ID NO: 419008 - RNA, 32 nt, Human
gacagagacugcagggguccacugugagaggu

SEQ ID NO: 419009 - RNA, 32 nt, Human
gacagagagacagagagaggggaagagagaca

SEQ ID NO: 419010 - RNA, 32 nt, Human
gacagagagagauagagcaggaggucggggca

SEQ ID NO: 419011 - RNA, 32 nt, Human
gacagagagccuccagagagugaacagucuuc

SEQ ID NO: 419012 - RNA, 32 nt, Human
gacagagaggaaggaaggauuggaaaaguccc

SEQ ID NO: 419013 - RNA, 32 nt, Human
gacagagaggaguugccagggaagaagguuug

SEQ ID NO: 419014 - RNA, 32 nt, Human
gacagagaggcagagaagagaccccuuuagaa

SEQ ID NO: 419015 - RNA, 32 nt, Human
gacagagaggcagagagagauagagacagagu

SEQ ID NO: 419016 - RNA, 32 nt, Human
gacagagauccuaugggugagguggagggggu

SEQ ID NO: 419017 - RNA, 32 nt, Human
gacagagcaagacccuguuucaaaaagaaaaa

SEQ ID NO: 419018 - RNA, 32 nt, Human
gacagagcaagaccugucacccugccacccau

SEQ ID NO: 419019 - RNA, 20 nt, Human
gacagagcaagacucugucu

SEQ ID NO: 419020 - RNA, 16 nt, Human
gacagagcaccugggg

SEQ ID NO: 419021 - RNA, 32 nt, Human
gacagagcacgcuucagggauaggagaucaua

SEQ ID NO: 419022 - RNA, 32 nt, Human
gacagagcagagccagggccaggcgcaccagg

SEQ ID NO: 419023 - RNA, 32 nt, Human
gacagagcagagccauggagaauaagcauuga

SEQ ID NO: 419024 - RNA, 32 nt, Human
gacagagcagaggaucuuuccaaccacaucug

SEQ ID NO: 419025 - RNA, 32 nt, Human
gacagagcagcccugcacuguuuucccuccac

SEQ ID NO: 419026 - RNA, 32 nt, Human
gacagagcagggaaacgugcagaggaaauggu

SEQ ID NO: 419027 - RNA, 18 nt, Human
gacagagcagggcaggca

SEQ ID NO: 419028 - RNA, 32 nt, Human
gacagagccacuaggcgaaaaggagagacggg

SEQ ID NO: 419029 - RNA, 32 nt, Human
gacagagccacugcagaggaccagacugggaa

SEQ ID NO: 419030 - RNA, 32 nt, Human
gacagagccccaaacuccucggccucacuggg

SEQ ID NO: 419031 - RNA, 20 nt, Human
gacagagcgagacucugucu

SEQ ID NO: 419032 - RNA, 32 nt, Human
gacagagcuacagcugggacagcuccaagcua

SEQ ID NO: 419033 - RNA, 31 nt, Human
gacagagcugagggucuuuguaggaguugcu

SEQ ID NO: 419034 - RNA, 32 nt, Human
gacagaggaaacugaggcuucagggaggggug

SEQ ID NO: 419035 - RNA, 32 nt, Human
gacagaggcaaaaaucugcuaacucagggggc

SEQ ID NO: 419036 - RNA, 32 nt, Human
gacagaggcggagccuggcaaguguaccaucc

SEQ ID NO: 419037 - RNA, 32 nt, Human
gacagaggcuacaucugcccuagggagguccu

SEQ ID NO: 419038 - RNA, 32 nt, Human
gacagaggcucugaggccuguggcuggacccu

SEQ ID NO: 419039 - RNA, 32 nt, Human
gacagaggcugaugcuggaguggccaguagag

SEQ ID NO: 419040 - RNA, 32 nt, Human
gacagaggcugcagcacccagggaggaacgcc

SEQ ID NO: 419041 - RNA, 32 nt, Human
gacagaggcugcagggcuggggcugggugagg

SEQ ID NO: 419042 - RNA, 32 nt, Human
gacagaggcuuaggccaugagccuccucaaca

SEQ ID NO: 419043 - RNA, 32 nt, Human
gacagagggagaggagaagagacgcaaaagac

SEQ ID NO: 419044 - RNA, 20 nt, Human
gacagagggagcagcugagg

SEQ ID NO: 419045 - RNA, 32 nt, Human
gacagagggagguggacggcagggaucaggga

SEQ ID NO: 419046 - RNA, 32 nt, Human
gacagagggcuggaaacaagacgcuccagaau

SEQ ID NO: 419047 - RNA, 32 nt, Human
gacagagggggaggggaaggagccggaggggc

SEQ ID NO: 419048 - RNA, 32 nt, Human
gacagagggugacaucauaggagcagcucgcu

SEQ ID NO: 419049 - RNA, 20 nt, Human
gacagaguaagacucugucu

SEQ ID NO: 419050 - RNA, 32 nt, Human
gacagagucacccaggcuggagugcaguggug

SEQ ID NO: 419051 - RNA, 18 nt, Human
gacagagucucaaucugu

SEQ ID NO: 419052 - RNA, 32 nt, Human
gacagagucucacucugucacucaggcuggag

SEQ ID NO: 419053 - RNA, 32 nt, Human
gacagagucucacuuugcuucccaggcuggag

SEQ ID NO: 419054 - RNA, 18 nt, Human
gacagagucucagucugu

SEQ ID NO: 419055 - RNA, 18 nt, Human
gacagagucucgcacugu

SEQ ID NO: 419056 - RNA, 32 nt, Human
gacagagucuggguuccagggcugcuuucucc

SEQ ID NO: 419057 - RNA, 32 nt, Human
gacagagucugguucuguuucccaggcuggag

SEQ ID NO: 419058 - RNA, 32 nt, Human
gacagagucuuccucugucuccuaagcuggag

SEQ ID NO: 419059 - RNA, 18 nt, Human
gacagagucuugcucugu

SEQ ID NO: 419060 - RNA, 20 nt, Human
gacagagugagacacugucu

SEQ ID NO: 419061 - RNA, 20 nt, Human
gacagagugagacccugucu

SEQ ID NO: 419062 - RNA, 20 nt, Human
gacagagugagacuccgucu

SEQ ID NO: 419063 - RNA, 20 nt, Human
gacagagugagacucugucu

SEQ ID NO: 419064 - RNA, 32 nt, Human
gacagagugauacccaucaauuuucuauccuu

SEQ ID NO: 419065 - RNA, 32 nt, Human
gacagagugcugaggggcacucuccccugaau

SEQ ID NO: 419066 - RNA, 19 nt, Human
gacagaguggacucugccu

SEQ ID NO: 419067 - RNA, 32 nt, Human
gacagaguggcgaccucgguggucgauugagc

SEQ ID NO: 419068 - RNA, 32 nt, Human
gacagauacugugcacuuacugccucacuuaa

SEQ ID NO: 419069 - RNA, 32 nt, Human
gacagaucacugcagccuccaacuccugggcu

SEQ ID NO: 419070 - RNA, 32 nt, Human
gacagaucagggagaccggggaagaaggagga

SEQ ID NO: 419071 - RNA, 32 nt, Human
gacagaucagggcccaccucccugccagggag

SEQ ID NO: 419072 - RNA, 32 nt, Human
gacagaucccuuccucccuccgacucaaagaa

SEQ ID NO: 419073 - RNA, 32 nt, Human
gacagaucugcaggacagauuuaucuguugaa

SEQ ID NO: 419074 - RNA, 21 nt, Human
gacagaugaagaugaagccca

SEQ ID NO: 419075 - RNA, 32 nt, Human
gacagaugacaucagaagacaccuauuuagaa

SEQ ID NO: 419076 - RNA, 32 nt, Human
gacagaugcccucagaauuggggcaugggagg

SEQ ID NO: 419077 - RNA, 32 nt, Human
gacagaugccuccuggguuuggaagggggaug

SEQ ID NO: 419078 - RNA, 23 nt, Human
gacagauggaccaccaaccugga

SEQ ID NO: 419079 - RNA, 32 nt, Human
gacagauggauguccaguuuacugucugcuuc

SEQ ID NO: 419080 - RNA, 32 nt, Human
gacagaugggccggaugcaauggcucacgucu

SEQ ID NO: 419081 - RNA, 32 nt, Human
gacagauggucauuuagccucuggggugaaau

SEQ ID NO: 419082 - RNA, 32 nt, Human
gacagaugugugucuguccucaggaggugaaa

SEQ ID NO: 419083 - RNA, 32 nt, Human
gacagauucauggaacuuagaguccaauagga

SEQ ID NO: 419084 - RNA, 32 nt, Human
gacagauuggacaacuauaacgacaccucccu

SEQ ID NO: 419085 - RNA, 32 nt, Human
gacagauuuugcccucaaucacaauauuugua

SEQ ID NO: 419086 - RNA, 32 nt, Human
gacagcaaagagacugagagacuguugaucaa

SEQ ID NO: 419087 - RNA, 32 nt, Human
gacagcaacuuccggcugguguccucagagca

SEQ ID NO: 419088 - RNA, 32 nt, Human
gacagcaagcuccuggaacacaagucacaugc

SEQ ID NO: 419089 - RNA, 32 nt, Human
gacagcaaugaggaguuggaaggugcaaaguc

SEQ ID NO: 419090 - RNA, 32 nt, Human
gacagcacaagucugaguugcuguuuggucug

SEQ ID NO: 419091 - RNA, 32 nt, Human
gacagcaccacugcacagagcuuugggaggcu

SEQ ID NO: 419092 - RNA, 32 nt, Human
gacagcaccacugcacuccagccaggaaugag

SEQ ID NO: 419093 - RNA, 32 nt, Human
gacagcaccacugcacuccagccugggugaca

SEQ ID NO: 419094 - RNA, 32 nt, Human
gacagcaccacugcugaggagucugaggacug

SEQ ID NO: 419095 - RNA, 32 nt, Human
gacagcaccauugcaccccagccugagcaaca

SEQ ID NO: 419096 - RNA, 32 nt, Human
gacagcacccugcuggcccuccagggggcccu

SEQ ID NO: 419097 - RNA, 32 nt, Human
gacagcacugcuuccaugcuucauacaucagg

SEQ ID NO: 419098 - RNA, 32 nt, Human
gacagcacugugccuuggucuccagggacccc

SEQ ID NO: 419099 - RNA, 32 nt, Human
gacagcagacaaaaugaaagaaaaugagagca

SEQ ID NO: 419100 - RNA, 32 nt, Human
gacagcagagggcuaggaggcucgggcucagc

SEQ ID NO: 419101 - RNA, 32 nt, Human
gacagcagcaccacuccagccucagagacugc

SEQ ID NO: 419102 - RNA, 32 nt, Human
gacagcagcagugaguccagugaccuccagcu

SEQ ID NO: 419103 - RNA, 32 nt, Human
gacagcagcaugucaccacugcccucacaguc

SEQ ID NO: 419104 - RNA, 32 nt, Human
gacagcagccaagauggggagagaaacgggga

SEQ ID NO: 419105 - RNA, 32 nt, Human
gacagcagccaguacuuuuccuggugaccacc

SEQ ID NO: 419106 - RNA, 23 nt, Human
gacagcagcccuggggcccgcag

SEQ ID NO: 419107 - RNA, 32 nt, Human
gacagcagcccuggugccccagccugcuaggg

SEQ ID NO: 419108 - RNA, 32 nt, Human
gacagcagcuagugaugcugaugcugcugguc

SEQ ID NO: 419109 - RNA, 32 nt, Human
gacagcagcucagcauccuguggcugcacacg

SEQ ID NO: 419110 - RNA, 32 nt, Human
gacagcagcuguccccugugcugguguggcag

SEQ ID NO: 419111 - RNA, 32 nt, Human
gacagcaggaaccuaaaauaucugccaucauc

SEQ ID NO: 419112 - RNA, 32 nt, Human
gacagcaggaacuugagggaaagaugaauaaa

SEQ ID NO: 419113 - RNA, 32 nt, Human
gacagcaggaucaagacaacccguuggagccc

SEQ ID NO: 419114 - RNA, 32 nt, Human
gacagcaggcggaaagauuugaaggaaaacug

SEQ ID NO: 419115 - RNA, 32 nt, Human
gacagcagugcuggcacuuggguguccauggg

SEQ ID NO: 419116 - RNA, 32 nt, Human
gacagcaucccagcuacacagccacucccaga

SEQ ID NO: 419117 - RNA, 32 nt, Human
gacagcaucggaacaauuuccacagcagcagu

SEQ ID NO: 419118 - RNA, 32 nt, Human
gacagcaucuugcucugucucccaggcuggag

SEQ ID NO: 419119 - RNA, 31 nt, Human
gacagcaugcuggccaagggucuucccccac

SEQ ID NO: 419120 - RNA, 30 nt, Human
gacagcauguugcaaucacagauaaaugua

SEQ ID NO: 419121 - RNA, 32 nt, Human
gacagcauugacugguuuacaggcccugcucc

SEQ ID NO: 419122 - RNA, 17 nt, Human
gacagcauugggucugg

SEQ ID NO: 419123 - RNA, 31 nt, Human
gacagccaaguguccagccugacccagagau

SEQ ID NO: 419124 - RNA, 32 nt, Human
gacagccacagcaacagcaacagccccacugc

SEQ ID NO: 419125 - RNA, 32 nt, Human
gacagccacccaggccugguuagugacuccca

SEQ ID NO: 419126 - RNA, 32 nt, Human
gacagccacugccccggcuccagcuccagccc

SEQ ID NO: 419127 - RNA, 32 nt, Human
gacagccaggcaggggguuccagaguggggug

SEQ ID NO: 419128 - RNA, 32 nt, Human
gacagccaggugacuaccaguccuggggacac

SEQ ID NO: 419129 - RNA, 32 nt, Human
gacagccaucagaauucucccacaccaagugc

SEQ ID NO: 419130 - RNA, 32 nt, Human
gacagccaugaagaaggaagcuguagaggugu

SEQ ID NO: 419131 - RNA, 32 nt, Human
gacagccaugaagcuggccagcagcgacacca

SEQ ID NO: 419132 - RNA, 32 nt, Human
gacagccaugcugcuggcacuacagaggccag

SEQ ID NO: 419133 - RNA, 32 nt, Human
gacagcccacccuuguguccacugugaccccu

SEQ ID NO: 419134 - RNA, 32 nt, Human
gacagcccagacacuucccucugugaccauga

SEQ ID NO: 419135 - RNA, 32 nt, Human
gacagccccacaugcaugcacacgcaugcaca

SEQ ID NO: 419136 - RNA, 32 nt, Human
gacagccccgcucccagauguaaagaacgcga

SEQ ID NO: 419137 - RNA, 21 nt, Human
gacagccccuccggcugggug

SEQ ID NO: 419138 - RNA, 32 nt, Human
gacagccccugacaguggccucaaggagcugc

SEQ ID NO: 419139 - RNA, 32 nt, Human
gacagccccuggcagugccaccaccgcagccg

SEQ ID NO: 419140 - RNA, 32 nt, Human
gacagccccuucagccccuucuccccuccccg

SEQ ID NO: 419141 - RNA, 32 nt, Human
gacagcccgcacagcugcccagccugcggaga

SEQ ID NO: 419142 - RNA, 32 nt, Human
gacagcccgggcaguaggaugcagccccagag

SEQ ID NO: 419143 - RNA, 32 nt, Human
gacagcccuccccucaccacucccuaccuugg

SEQ ID NO: 419144 - RNA, 32 nt, Human
gacagcccuggguggcucugucacacagccac

SEQ ID NO: 419145 - RNA, 32 nt, Human
gacagcccuuccaacugugucaucucuucucu

SEQ ID NO: 419146 - RNA, 32 nt, Human
gacagccgccgccucugcauguaccacagccc

SEQ ID NO: 419147 - RNA, 32 nt, Human
gacagccggauaucggggacacugccuuggga

SEQ ID NO: 419148 - RNA, 19 nt, Human
gacagccguuccugccagg

SEQ ID NO: 419149 - RNA, 32 nt, Human
gacagccucacccaccccaccugggcccagcc

SEQ ID NO: 419150 - RNA, 32 nt, Human
gacagccucagggcaucucugagacacagggg

SEQ ID NO: 419151 - RNA, 32 nt, Human
gacagccuccaagacaaauggaagagagaaag

SEQ ID NO: 419152 - RNA, 32 nt, Human
gacagccuccugcaccugugcaagggaacugu

SEQ ID NO: 419153 - RNA, 32 nt, Human
gacagccucugccucugucuccugccacaauc

SEQ ID NO: 419154 - RNA, 32 nt, Human
gacagccugaggccuguccucacucacugucu

SEQ ID NO: 419155 - RNA, 32 nt, Human
gacagccugagguccguccucacucacugucu

SEQ ID NO: 419156 - RNA, 32 nt, Human
gacagccugcagcccuuucugcauggggugcu

SEQ ID NO: 419157 - RNA, 22 nt, Human
gacagccugcccuucauccuca

SEQ ID NO: 419158 - RNA, 22 nt, Human
gacagccugcucugaggcugca

SEQ ID NO: 419159 - RNA, 22 nt, Human
gacagccugcuggcaguccuca

SEQ ID NO: 419160 - RNA, 32 nt, Human
gacagccugcuguguccugucuuuucuccugu

SEQ ID NO: 419161 - RNA, 32 nt, Human
gacagccuggagcuugggcuguggaagauuuc

SEQ ID NO: 419162 - RNA, 16 nt, Human
gacagccuggcucuga

SEQ ID NO: 419163 - RNA, 16 nt, Human
gacagccugggacuga

SEQ ID NO: 419164 - RNA, 32 nt, Human
gacagccuucaucagugcaauguuugcagggu

SEQ ID NO: 419165 - RNA, 32 nt, Human
gacagccuugcaggcugggcucagggacaaag

SEQ ID NO: 419166 - RNA, 32 nt, Human
gacagccuuuaaucccccuccuccccagaagg

SEQ ID NO: 419167 - RNA, 22 nt, Human
gacagcgaugaaccuacccgcc

SEQ ID NO: 419168 - RNA, 24 nt, Human
gacagcgaugacuaucaccuccua

SEQ ID NO: 419169 - RNA, 32 nt, Human
gacagcgauucugagggugacugaggcuacag

SEQ ID NO: 419170 - RNA, 32 nt, Human
gacagcgcagggggaacccagggagcgcgaug

SEQ ID NO: 419171 - RNA, 16 nt, Human
gacagcgcccggccca

SEQ ID NO: 419172 - RNA, 32 nt, Human
gacagcgcccugaccaaccuaaagcuagcucc

SEQ ID NO: 419173 - RNA, 32 nt, Human
gacagcgcugccucucccuugcacucagcucu

SEQ ID NO: 419174 - RNA, 32 nt, Human
gacagcgcuguggaugccggucuggugccggc

SEQ ID NO: 419175 - RNA, 32 nt, Human
gacagcggagagaaccaggcagcccagaaacc

SEQ ID NO: 419176 - RNA, 32 nt, Human
gacagcggcuuccuugauccuugccacccgcg

SEQ ID NO: 419177 - RNA, 32 nt, Human
gacagcggggaaccugggagaccccuccgccc

SEQ ID NO: 419178 - RNA, 17 nt, Human
gacagcggugggucugg

SEQ ID NO: 419179 - RNA, 24 nt, Human
gacagcguggcaugugguguggua

SEQ ID NO: 419180 - RNA, 32 nt, Human
gacagcguuucuggguuaugcauaacuucuca

SEQ ID NO: 419181 - RNA, 32 nt, Human
gacagcuaccugcauuguagaaccuuuucuua

SEQ ID NO: 419182 - RNA, 32 nt, Human
gacagcucaaaccaucuuuggcuacugugccc

SEQ ID NO: 419183 - RNA, 32 nt, Human
gacagcucaccuagcggcaauggcugcagacu

SEQ ID NO: 419184 - RNA, 32 nt, Human
gacagcucaccuagcggcaauggcugcagagg

SEQ ID NO: 419185 - RNA, 32 nt, Human
gacagcucaccuagcggcaauggcugcaggaa

SEQ ID NO: 419186 - RNA, 32 nt, Human
gacagcucaccuagcggcaauggcugcaggcu

SEQ ID NO: 419187 - RNA, 32 nt, Human
gacagcucaccuagcugcaauggcuacagagg

SEQ ID NO: 419188 - RNA, 32 nt, Human
gacagcucaccuagcugcaauggcuacaggcu

SEQ ID NO: 419189 - RNA, 22 nt, Human
gacagcuccauaacaacaugca

SEQ ID NO: 419190 - RNA, 32 nt, Human
gacagcuccggaagugucgugccugaaccccu

SEQ ID NO: 419191 - RNA, 32 nt, Human
gacagcuccguguggagagcuuagccccugga

SEQ ID NO: 419192 - RNA, 32 nt, Human
gacagcucuguagccugacaagaaauaaaacc

SEQ ID NO: 419193 - RNA, 32 nt, Human
gacagcugaacucacaccacacccagcuuaua

SEQ ID NO: 419194 - RNA, 19 nt, Human
gacagcugaggcucagaga

SEQ ID NO: 419195 - RNA, 32 nt, Human
gacagcugaucugucggaaccaggacacaaaa

SEQ ID NO: 419196 - RNA, 32 nt, Human
gacagcugcaccgacuuggagcucuuugagaa

SEQ ID NO: 419197 - RNA, 32 nt, Human
gacagcugcaccucucagcgucuccagcucca

SEQ ID NO: 419198 - RNA, 32 nt, Human
gacagcugcaccugcguuacagacacacccga

SEQ ID NO: 419199 - RNA, 32 nt, Human
gacagcuggaaagagcgcggagccagcgccug

SEQ ID NO: 419200 - RNA, 32 nt, Human
gacagcuggagacagagaucaaacacucaagg

SEQ ID NO: 419201 - RNA, 32 nt, Human
gacagcuggcaguggagccugcuuuauuuagc

SEQ ID NO: 419202 - RNA, 32 nt, Human
gacagcuggcccuacuuuccucccucugcugc

SEQ ID NO: 419203 - RNA, 32 nt, Human
gacagcugggcugugggcaggacaggggacuc

SEQ ID NO: 419204 - RNA, 32 nt, Human
gacagcuggggagagacauggcagggucggag

SEQ ID NO: 419205 - RNA, 32 nt, Human
gacagcuuagauuuagccccaguuccugcacg

SEQ ID NO: 419206 - RNA, 32 nt, Human
gacagcuuccucacaccccugucccacccaca

SEQ ID NO: 419207 - RNA, 32 nt, Human
gacagcuuccugggggcagcacugggcggucg

SEQ ID NO: 419208 - RNA, 32 nt, Human
gacagcuucgcucuuucucuuccugccuuucc

SEQ ID NO: 419209 - RNA, 32 nt, Human
gacagcuucugcucugagaugcauuguuccua

SEQ ID NO: 419210 - RNA, 32 nt, Human
gacagcuugaaaugacauuccaggcaaugccu

SEQ ID NO: 419211 - RNA, 32 nt, Human
gacagcuugagccucaggauucuuguucuucc

SEQ ID NO: 419212 - RNA, 32 nt, Human
gacagcuugcagauggcgcguucucacggugg

SEQ ID NO: 419213 - RNA, 32 nt, Human
gacagcuuuccagagcuuugugcucaggcuac

SEQ ID NO: 419214 - RNA, 32 nt, Human
gacagcuuuccucaaaaagcagaaggagagug

SEQ ID NO: 419215 - RNA, 32 nt, Human
gacaggaaagggaauuccaaggggcaggagga

SEQ ID NO: 419216 - RNA, 23 nt, Human
gacaggaaaucccaagacugcuu

SEQ ID NO: 419217 - RNA, 32 nt, Human
gacaggaacccacaaucaggaggcaacccugg

SEQ ID NO: 419218 - RNA, 32 nt, Human
gacaggaaccucagcccagggugcuggccuuu

SEQ ID NO: 419219 - RNA, 32 nt, Human
gacaggaagaaaacauguccaggccccugguc

SEQ ID NO: 419220 - RNA, 32 nt, Human
gacaggaagaaaggagggaagagcugaugugg

SEQ ID NO: 419221 - RNA, 32 nt, Human
gacaggaagaggagggagagggugacgaacac

SEQ ID NO: 419222 - RNA, 32 nt, Human
gacaggaaggagaagaggcaggugagcagggc

SEQ ID NO: 419223 - RNA, 22 nt, Human
gacaggacaccucccaacccca

SEQ ID NO: 419224 - RNA, 32 nt, Human
gacaggacacuucacaggacacuugagcacag

SEQ ID NO: 419225 - RNA, 32 nt, Human
gacaggacaggaugggacagcaggauagacag

SEQ ID NO: 419226 - RNA, 32 nt, Human
gacaggaccaacacccccacaccccagaggcg

SEQ ID NO: 419227 - RNA, 21 nt, Human
gacaggaccagaucccaggag

SEQ ID NO: 419228 - RNA, 23 nt, Human
gacaggaccccuauguccaggaa

SEQ ID NO: 419229 - RNA, 32 nt, Human
gacaggaccccuauguccaggaaaggggaaaa

SEQ ID NO: 419230 - RNA, 32 nt, Human
gacaggacucgcugccuuucuuucccgucaga

SEQ ID NO: 419231 - RNA, 32 nt, Human
gacaggacuuggaccgcuucagccugggcugg

SEQ ID NO: 419232 - RNA, 18 nt, Human
gacaggacuuuccaggaa

SEQ ID NO: 419233 - RNA, 20 nt, Human
gacaggagaaagagaggcaa

SEQ ID NO: 419234 - RNA, 32 nt, Human
gacaggagaaucaguuuaaagacuuuaaaaau

SEQ ID NO: 419235 - RNA, 32 nt, Human
gacaggagacauggguugaaugcugaaaacau

SEQ ID NO: 419236 - RNA, 32 nt, Human
gacaggagaccagcugccuuugagcagggagu

SEQ ID NO: 419237 - RNA, 32 nt, Human
gacaggagaggaaggagggcaggggcggaguu

SEQ ID NO: 419238 - RNA, 32 nt, Human
gacaggagcugggagcucugcaccacgagcuu

SEQ ID NO: 419239 - RNA, 32 nt, Human
gacaggaggcagcagaaguugcagagaagagu

SEQ ID NO: 419240 - RNA, 32 nt, Human
gacaggagggcugugguguacccuggaggugu

SEQ ID NO: 419241 - RNA, 32 nt, Human
gacaggagugagccaccacaccuggccacucg

SEQ ID NO: 419242 - RNA, 32 nt, Human
gacaggaucagugacccacagcuuuggggaaa

SEQ ID NO: 419243 - RNA, 32 nt, Human
gacaggaucucaggcuggagugcaguggcaca

SEQ ID NO: 419244 - RNA, 32 nt, Human
gacaggaucuugcucugucucccaggcuggag

SEQ ID NO: 419245 - RNA, 32 nt, Human
gacaggaucuuugcaguacaacaccucuaugc

SEQ ID NO: 419246 - RNA, 31 nt, Human
gacaggaugagagugucaggugugcuucgcc

SEQ ID NO: 419247 - RNA, 32 nt, Human
gacaggauuggggugacagcccagggaugcau

SEQ ID NO: 419248 - RNA, 32 nt, Human
gacaggauuucacuauguuggccagguugguc

SEQ ID NO: 419249 - RNA, 21 nt, Human
gacaggcaagcuuccacugca

SEQ ID NO: 419250 - RNA, 18 nt, Human
gacaggcacacacaugca

SEQ ID NO: 419251 - RNA, 19 nt, Human
gacaggcacaugccaccac

SEQ ID NO: 419252 - RNA, 32 nt, Human
gacaggcaccucuucugccuuuacuuggucuc

SEQ ID NO: 419253 - RNA, 32 nt, Human
gacaggcaccuguaaucccagcuacucaggag

SEQ ID NO: 419254 - RNA, 32 nt, Human
gacaggcaccuguaaucccagcuacucgggag

SEQ ID NO: 419255 - RNA, 18 nt, Human
gacaggcacuuagaugca

SEQ ID NO: 419256 - RNA, 17 nt, Human
gacaggcagacacaugc

SEQ ID NO: 419257 - RNA, 32 nt, Human
gacaggcagccugcugccguaugcuucagugg

SEQ ID NO: 419258 - RNA, 32 nt, Human
gacaggcagccuggugccaggccugaaaccag

SEQ ID NO: 419259 - RNA, 18 nt, Human
gacaggcagggagaugca

SEQ ID NO: 419260 - RNA, 20 nt, Human
gacaggcauaaacaagaaca

SEQ ID NO: 419261 - RNA, 32 nt, Human
gacaggcaucuguggagccugggaaaugaccu

SEQ ID NO: 419262 - RNA, 32 nt, Human
gacaggcaugagccaccacgccuggucuauga

SEQ ID NO: 419263 - RNA, 32 nt, Human
gacaggcaugagccaccgcgccuggccccuuc

SEQ ID NO: 419264 - RNA, 32 nt, Human
gacaggcaugagccaccgugcccggccggucc

SEQ ID NO: 419265 - RNA, 32 nt, Human
gacaggcaugagccacgacgcccagccacaag

SEQ ID NO: 419266 - RNA, 20 nt, Human
gacaggcaugugaacaccca

SEQ ID NO: 419267 - RNA, 20 nt, Human
gacaggcauuugugacagca

SEQ ID NO: 419268 - RNA, 32 nt, Human
gacaggccaagaaacuccacaucauaacagcc

SEQ ID NO: 419269 - RNA, 32 nt, Human
gacaggccaguucuccauucugcaggacuauc

SEQ ID NO: 419270 - RNA, 32 nt, Human
gacaggccauucuaauaacagaaacaaacaag

SEQ ID NO: 419271 - RNA, 32 nt, Human
gacaggcccugccugccacccuaggcagggaa

SEQ ID NO: 419272 - RNA, 32 nt, Human
gacaggccgcgcugggacaggugccgguacua

SEQ ID NO: 419273 - RNA, 32 nt, Human
gacaggccucuggccaagagcuuagucaggcu

SEQ ID NO: 419274 - RNA, 32 nt, Human
gacaggccugcaggaaugugcuucauuagcug

SEQ ID NO: 419275 - RNA, 32 nt, Human
gacaggccuggaguuacgcacacugagugccc

SEQ ID NO: 419276 - RNA, 32 nt, Human
gacaggccugggacgggcucucccucacagcc

SEQ ID NO: 419277 - RNA, 32 nt, Human
gacaggccuguccaacacaucucccuuuucca

SEQ ID NO: 419278 - RNA, 32 nt, Human
gacaggccuuucuccaucuucaagagugacac

SEQ ID NO: 419279 - RNA, 32 nt, Human
gacaggccuuucuccuuagaggccagaggugc

SEQ ID NO: 419280 - RNA, 32 nt, Human
gacaggccuuucucucagccucuggaagccac

SEQ ID NO: 419281 - RNA, 32 nt, Human
gacaggcgacagaccugcggcaggaccagagg

SEQ ID NO: 419282 - RNA, 32 nt, Human
gacaggcgaugagacaagaugucagaagcuag

SEQ ID NO: 419283 - RNA, 32 nt, Human
gacaggcgugagccacagcucccagccuaggc

SEQ ID NO: 419284 - RNA, 32 nt, Human
gacaggcgugagccaccgcgcccagccugauu

SEQ ID NO: 419285 - RNA, 32 nt, Human
gacaggcgugagccaccgcgcccggccuauac

SEQ ID NO: 419286 - RNA, 32 nt, Human
gacaggcgugagccaccgcgccgggcccaaua

SEQ ID NO: 419287 - RNA, 32 nt, Human
gacaggcgugagccccugcgcccggccuuugu

SEQ ID NO: 419288 - RNA, 32 nt, Human
gacaggcgugauccaccgugcccagccgggaa

SEQ ID NO: 419289 - RNA, 32 nt, Human
gacaggcguguggggaguucacugugaccuag

SEQ ID NO: 419290 - RNA, 32 nt, Human
gacaggcuaggagagaagggacugggguuacu

SEQ ID NO: 419291 - RNA, 32 nt, Human
gacaggcucagaccugauccuuccucaggagc

SEQ ID NO: 419292 - RNA, 32 nt, Human
gacaggcucaugggagcuggugagagagagca

SEQ ID NO: 419293 - RNA, 32 nt, Human
gacaggcuccuccucucccuccagaagccagg

SEQ ID NO: 419294 - RNA, 21 nt, Human
gacaggcuccugagaaaugca

SEQ ID NO: 419295 - RNA, 21 nt, Human
gacaggcucucuuguauucuu

SEQ ID NO: 419296 - RNA, 32 nt, Human
gacaggcugaggcucaaggaaggugguccuca

SEQ ID NO: 419297 - RNA, 32 nt, Human
gacaggcugguccugaggauacagcugucccg

SEQ ID NO: 419298 - RNA, 32 nt, Human
gacaggcuucuauccacucugccugcgguucg

SEQ ID NO: 419299 - RNA, 31 nt, Human
gacagggaaaggggaacugguuuucagggaa

SEQ ID NO: 419300 - RNA, 32 nt, Human
gacagggaacagcuucaggauacuuccaggag

SEQ ID NO: 419301 - RNA, 32 nt, Human
gacagggaacaugaugggcacugaccuccugu

SEQ ID NO: 419302 - RNA, 32 nt, Human
gacagggaagguggaggaguggauagaacuug

SEQ ID NO: 419303 - RNA, 32 nt, Human
gacagggacaagcauaucuaagaggcugaaca

SEQ ID NO: 419304 - RNA, 32 nt, Human
gacagggagacagggucucacuguguugccua

SEQ ID NO: 419305 - RNA, 32 nt, Human
gacagggagaugggacauucugagggacccgg

SEQ ID NO: 419306 - RNA, 32 nt, Human
gacagggagcugcagaagcucgaggagugggg

SEQ ID NO: 419307 - RNA, 32 nt, Human
gacagggagcugguuggggaggaccagaaauc

SEQ ID NO: 419308 - RNA, 32 nt, Human
gacagggaggauuuaguuauucugcuacuuac

SEQ ID NO: 419309 - RNA, 32 nt, Human
gacagggaggcugagggucagcaagguuaagg

SEQ ID NO: 419310 - RNA, 32 nt, Human
gacagggaggguggaggaguggauagaacuug

SEQ ID NO: 419311 - RNA, 32 nt, Human
gacagggaggguguuuuggguggcauagaggu

SEQ ID NO: 419312 - RNA, 32 nt, Human
gacagggagguugugaugagccaaggucaugc

SEQ ID NO: 419313 - RNA, 32 nt, Human
gacagggcaagugagaccuggugaggguggcu

SEQ ID NO: 419314 - RNA, 32 nt, Human
gacagggcagaggcguccgcugacaaaucacu

SEQ ID NO: 419315 - RNA, 32 nt, Human
gacagggcccaggucagccucagucugcugug

SEQ ID NO: 419316 - RNA, 32 nt, Human
gacagggccggagaaagauggagcagcccggg

SEQ ID NO: 419317 - RNA, 17 nt, Human
gacagggcgaacaagca

SEQ ID NO: 419318 - RNA, 32 nt, Human
gacagggcuagcagaugaagagaggaggacau

SEQ ID NO: 419319 - RNA, 32 nt, Human
gacagggcucagagggcuaggcacggagggaa

SEQ ID NO: 419320 - RNA, 32 nt, Human
gacagggcuggcaggagcagacugccucagcc

SEQ ID NO: 419321 - RNA, 18 nt, Human
gacagggcugggaacagc

SEQ ID NO: 419322 - RNA, 32 nt, Human
gacagggcugucucccccuccaucuggagcuc

SEQ ID NO: 419323 - RNA, 17 nt, Human
gacaggggaagacagca

SEQ ID NO: 419324 - RNA, 32 nt, Human
gacaggggaaguggguccccaggucagcccuu

SEQ ID NO: 419325 - RNA, 23 nt, Human
gacaggggaccaaggucagggcc

SEQ ID NO: 419326 - RNA, 32 nt, Human
gacaggggagagaaugggagaggagcaccucc

SEQ ID NO: 419327 - RNA, 32 nt, Human
gacaggggagugagaagggugcguugcagaau

SEQ ID NO: 419328 - RNA, 19 nt, Human
gacaggggcaagcaggcca

SEQ ID NO: 419329 - RNA, 22 nt, Human
gacaggggcuugccaggucuca

SEQ ID NO: 419330 - RNA, 32 nt, Human
gacagggggagucucuggagguaaagcugguc

SEQ ID NO: 419331 - RNA, 32 nt, Human
gacagggggcaggccagagagagagggcagau

SEQ ID NO: 419332 - RNA, 32 nt, Human
gacaggggucucgcugaacuccuggccuccag

SEQ ID NO: 419333 - RNA, 32 nt, Human
gacaggggugacagacacagagugcccaggua

SEQ ID NO: 419334 - RNA, 32 nt, Human
gacaggguaggaauaugugggagggcugggcu

SEQ ID NO: 419335 - RNA, 32 nt, Human
gacagggucucaacucuguuacccaggcugga

SEQ ID NO: 419336 - RNA, 18 nt, Human
gacagggucucacuaugu

SEQ ID NO: 419337 - RNA, 18 nt, Human
gacagggucucacucugu

SEQ ID NO: 419338 - RNA, 32 nt, Human
gacagggucugcuauagucaccagggagaagc

SEQ ID NO: 419339 - RNA, 32 nt, Human
gacagggucuucuauguugcccaggcugucuu

SEQ ID NO: 419340 - RNA, 32 nt, Human
gacagggucuugacuggagugcaguggugcga

SEQ ID NO: 419341 - RNA, 18 nt, Human
gacagggucuugcucugu

SEQ ID NO: 419342 - RNA, 32 nt, Human
gacagggugaggcucccagacgcuccucgagg

SEQ ID NO: 419343 - RNA, 30 nt, Human
gacagggugagucgcagggcacaguguggg

SEQ ID NO: 419344 - RNA, 32 nt, Human
gacagggugggcuuccugcccuucccucuggg

SEQ ID NO: 419345 - RNA, 31 nt, Human
gacagggugggucucccuuaccaaagagaag

SEQ ID NO: 419346 - RNA, 32 nt, Human
gacaggguguguggcauuguguucuaugccag

SEQ ID NO: 419347 - RNA, 32 nt, Human
gacaggguugcccaggguggagugcaguggca

SEQ ID NO: 419348 - RNA, 20 nt, Human
gacaggguuucaccauguua

SEQ ID NO: 419349 - RNA, 20 nt, Human
gacaggguuucaccauguug

SEQ ID NO: 419350 - RNA, 21 nt, Human
gacaggguuucaccauguugg

SEQ ID NO: 419351 - RNA, 32 nt, Human
gacaggguuucauauuggccagacuggucucg

SEQ ID NO: 419352 - RNA, 32 nt, Human
gacaggguuucaucauguuggccaggaugguc

SEQ ID NO: 419353 - RNA, 32 nt, Human
gacaggguuucaucauguuggccaggaugguu

SEQ ID NO: 419354 - RNA, 32 nt, Human
gacaggguuucaucauguuggccaggcuaguc

SEQ ID NO: 419355 - RNA, 32 nt, Human
gacaggguuucaucauguuggccaggcugguc

SEQ ID NO: 419356 - RNA, 32 nt, Human
gacaggguuucaucauuguuggccaggcuggu

SEQ ID NO: 419357 - RNA, 32 nt, Human
gacaggguuucggguuucaccauguuggccag

SEQ ID NO: 419358 - RNA, 32 nt, Human
gacaggguuuuuaagaaauaauuauucuaauu

SEQ ID NO: 419359 - RNA, 32 nt, Human
gacagguaaguggcagaggugaggggauaagu

SEQ ID NO: 419360 - RNA, 32 nt, Human
gacagguacaaggagaagagauggggacuaug

SEQ ID NO: 419361 - RNA, 32 nt, Human
gacagguacagagagaccagguggccuguucc

SEQ ID NO: 419362 - RNA, 32 nt, Human
gacagguaggaaggaaggaaaggaggaaaggg

SEQ ID NO: 419363 - RNA, 22 nt, Human
gacagguauggaagaauauaca

SEQ ID NO: 419364 - RNA, 18 nt, Human
gacaggucacaaacauca

SEQ ID NO: 419365 - RNA, 17 nt, Human
gacaggucaccuugcag

SEQ ID NO: 419366 - RNA, 32 nt, Human
gacaggucacuuacaggggaugccauucaauc

SEQ ID NO: 419367 - RNA, 32 nt, Human
gacaggucagcccucuguagcucagugucacc

SEQ ID NO: 419368 - RNA, 32 nt, Human
gacaggucauggaauucucauccaccaucgaa

SEQ ID NO: 419369 - RNA, 32 nt, Human
gacagguccacccucaccauccgggucuuuag

SEQ ID NO: 419370 - RNA, 32 nt, Human
gacaggucuagagugauccaucccaccucuaa

SEQ ID NO: 419371 - RNA, 32 nt, Human
gacaggucucuuuccuggaaugcagcccaggc

SEQ ID NO: 419372 - RNA, 32 nt, Human
gacaggucugcgcugagcauugaggaggguau

SEQ ID NO: 419373 - RNA, 32 nt, Human
gacaggucuuuuugccauuccuccaggacauc

SEQ ID NO: 419374 - RNA, 32 nt, Human
gacaggugaacucugguccucugcaccuguuu

SEQ ID NO: 419375 - RNA, 32 nt, Human
gacaggugaaugucacagguccauaagaagga

SEQ ID NO: 419376 - RNA, 31 nt, Human
gacaggugacaccuggauaccaaaugcagga

SEQ ID NO: 419377 - RNA, 32 nt, Human
gacaggugaccuucuuggguugugcuucacaa

SEQ ID NO: 419378 - RNA, 32 nt, Human
gacaggugagggacacucaggagcucauuuuc

SEQ ID NO: 419379 - RNA, 32 nt, Human
gacaggugcagagagagaauaaacugugucua

SEQ ID NO: 419380 - RNA, 32 nt, Human
gacaggugcccgaacacagggucuccaggacg

SEQ ID NO: 419381 - RNA, 32 nt, Human
gacaggugccuguaaucccagcuacucgguag

SEQ ID NO: 419382 - RNA, 32 nt, Human
gacaggugccuguaaucccagcuacuugggag

SEQ ID NO: 419383 - RNA, 32 nt, Human
gacaggugccuguagucccagcuacucgggag

SEQ ID NO: 419384 - RNA, 32 nt, Human
gacagguggcccagcaguugcagcauggugug

SEQ ID NO: 419385 - RNA, 32 nt, Human
gacagguggcgacggcagaggaauaccuucac

SEQ ID NO: 419386 - RNA, 32 nt, Human
gacaggugggagaauggguguaggaggcaggc

SEQ ID NO: 419387 - RNA, 32 nt, Human
gacaggugggcccagugaacuuuuccaguaaa

SEQ ID NO: 419388 - RNA, 32 nt, Human
gacaggugguuccugggguccugagauccagc

SEQ ID NO: 419389 - RNA, 32 nt, Human
gacagguguaaucccuggugcugcaguggacc

SEQ ID NO: 419390 - RNA, 32 nt, Human
gacaggugugagccaccgcccccggccccucg

SEQ ID NO: 419391 - RNA, 32 nt, Human
gacaggugugagccacugcgcccagccugaau

SEQ ID NO: 419392 - RNA, 32 nt, Human
gacaggugugccugugcuccugcccaggagca

SEQ ID NO: 419393 - RNA, 32 nt, Human
gacagguguggacccugagggugcggugguga

SEQ ID NO: 419394 - RNA, 32 nt, Human
gacagguuccagggggugcuuuuggccugcuc

SEQ ID NO: 419395 - RNA, 32 nt, Human
gacagguucuaucaugggugacaccaggagag

SEQ ID NO: 419396 - RNA, 32 nt, Human
gacagguuugcaggaaacccucagaaaggggg

SEQ ID NO: 419397 - RNA, 32 nt, Human
gacaguaaaugucuugcuacauuuuucuauuu

SEQ ID NO: 419398 - RNA, 32 nt, Human
gacaguaauaagaauggaaaagagauauggga

SEQ ID NO: 419399 - RNA, 19 nt, Human
gacaguagcccccuccuua

SEQ ID NO: 419400 - RNA, 32 nt, Human
gacaguagggcucccagguggcugguucucag

SEQ ID NO: 419401 - RNA, 32 nt, Human
gacaguaggggaaagagcugagcuccauucug

SEQ ID NO: 419402 - RNA, 32 nt, Human
gacaguaucacagaucaagaauggaguacgag

SEQ ID NO: 419403 - RNA, 32 nt, Human
gacaguaucccagcuacaacaggacgacaccg

SEQ ID NO: 419404 - RNA, 32 nt, Human
gacagucaaaggacacgagagaaaggaagggg

SEQ ID NO: 419405 - RNA, 32 nt, Human
gacagucacaacaaggacaacaaggacacaac

SEQ ID NO: 419406 - RNA, 25 nt, Human
gacagucacagaggaacaagaucaa

SEQ ID NO: 419407 - RNA, 25 nt, Human
gacagucacggaggaacaagaucaa

SEQ ID NO: 419408 - RNA, 25 nt, Human
gacagucacggaggaagaagaucaa

SEQ ID NO: 419409 - RNA, 32 nt, Human
gacagucacugcaaucucuuuaccaccucccc

SEQ ID NO: 419410 - RNA, 32 nt, Human
gacagucagcagucugcuauuaaguggccuac

SEQ ID NO: 419411 - RNA, 32 nt, Human
gacagucagggugaaacuucuuuugccagaag

SEQ ID NO: 419412 - RNA, 32 nt, Human
gacagucaguguggaggccacaggguacucgc

SEQ ID NO: 419413 - RNA, 31 nt, Human
gacagucaugagagaggaaaacugcaaugac

SEQ ID NO: 419414 - RNA, 32 nt, Human
gacaguccccaaaacagagauugucaggcccc

SEQ ID NO: 419415 - RNA, 32 nt, Human
gacaguccccauuaccggucuaucuuuauaag

SEQ ID NO: 419416 - RNA, 32 nt, Human
gacagucccccaggcugagucaaaagugguuc

SEQ ID NO: 419417 - RNA, 32 nt, Human
gacagucccuucucccuucuuccuucuuccuu

SEQ ID NO: 419418 - RNA, 21 nt, Human
gacaguccggagcuguagcag

SEQ ID NO: 419419 - RNA, 32 nt, Human
gacaguccggguaacauaaugagaccuguccu

SEQ ID NO: 419420 - RNA, 17 nt, Human
gacaguccuggguuuga

SEQ ID NO: 419421 - RNA, 32 nt, Human
gacagucgcagugccauggaggagcccagcag

SEQ ID NO: 419422 - RNA, 32 nt, Human
gacagucgugaggauggcagagcugcugcauu

SEQ ID NO: 419423 - RNA, 32 nt, Human
gacagucuaauguuaaaugagaaaaaucaacu

SEQ ID NO: 419424 - RNA, 32 nt, Human
gacagucuaggaggaggaggagguagggugug

SEQ ID NO: 419425 - RNA, 32 nt, Human
gacagucuauaugauuucauguggcagaccug

SEQ ID NO: 419426 - RNA, 32 nt, Human
gacagucucacagaggaagggcagguguccua

SEQ ID NO: 419427 - RNA, 32 nt, Human
gacagucuccuggacaaggaguuuccagcugc

SEQ ID NO: 419428 - RNA, 32 nt, Human
gacagucucgcaaccagcagccuagacagccc

SEQ ID NO: 419429 - RNA, 32 nt, Human
gacagucucuacgcugugaauauugccuggug

SEQ ID NO: 419430 - RNA, 32 nt, Human
gacagucucucuucauugaguaauguaaauug

SEQ ID NO: 419431 - RNA, 32 nt, Human
gacagucuguuucccaggcuggaguguaguga

SEQ ID NO: 419432 - RNA, 32 nt, Human
gacagugaagcugggugcgguggugcacuccu

SEQ ID NO: 419433 - RNA, 32 nt, Human
gacagugacaacccuuucucuccaguucucca

SEQ ID NO: 419434 - RNA, 32 nt, Human
gacagugacauaaaaggcaauggaauuuucua

SEQ ID NO: 419435 - RNA, 32 nt, Human
gacagugaccaagacacuaacaaaggcuccug

SEQ ID NO: 419436 - RNA, 32 nt, Human
gacagugaccuccacccccgcagcccucuuaa

SEQ ID NO: 419437 - RNA, 32 nt, Human
gacagugaccugcagaugaggacucugaacac

SEQ ID NO: 419438 - RNA, 21 nt, Human
gacagugaccuuccugucuca

SEQ ID NO: 419439 - RNA, 32 nt, Human
gacagugaccuuccugucucagggguugggga

SEQ ID NO: 419440 - RNA, 32 nt, Human
gacagugagaccaccccgcuguggaaacaugg

SEQ ID NO: 419441 - RNA, 32 nt, Human
gacagugagaggauauugagggcuucagcugc

SEQ ID NO: 419442 - RNA, 32 nt, Human
gacagugagccccagaucuccuagcucuggcu

SEQ ID NO: 419443 - RNA, 32 nt, Human
gacagugagcuucuaucccaggcccugcagcc

SEQ ID NO: 419444 - RNA, 32 nt, Human
gacagugaucauucaggguucaucucacugga

SEQ ID NO: 419445 - RNA, 32 nt, Human
gacagugauuaguguugugucaccaauucagg

SEQ ID NO: 419446 - RNA, 32 nt, Human
gacagugcaacaacuggucuccaccaguauuu

SEQ ID NO: 419447 - RNA, 32 nt, Human
gacagugcagagccaggaccagcccggcccau

SEQ ID NO: 419448 - RNA, 32 nt, Human
gacagugcauccagaggaaggcaccuugcuga

SEQ ID NO: 419449 - RNA, 32 nt, Human
gacagugcaugcacuccagccugggcaacaga

SEQ ID NO: 419450 - RNA, 32 nt, Human
gacagugccaccguacucuagccugggcgaca

SEQ ID NO: 419451 - RNA, 32 nt, Human
gacagugccaggagaugcaggaauggcauuau

SEQ ID NO: 419452 - RNA, 32 nt, Human
gacagugccaggaggaagaaggaaggaguccc

SEQ ID NO: 419453 - RNA, 20 nt, Human
gacagugcccagagcaugca

SEQ ID NO: 419454 - RNA, 32 nt, Human
gacagugccugauuugagauggggucccaggu

SEQ ID NO: 419455 - RNA, 32 nt, Human
gacagugccugggaauguacuuauucugcagc

SEQ ID NO: 419456 - RNA, 32 nt, Human
gacagugcggaugcaagagcaccuggccaagc

SEQ ID NO: 419457 - RNA, 32 nt, Human
gacagugcuuugugacagcaguggagcccugu

SEQ ID NO: 419458 - RNA, 32 nt, Human
gacaguggaaaagccuuuauugacuaauugau

SEQ ID NO: 419459 - RNA, 32 nt, Human
gacaguggaaacauucaaagcagaacuucuca

SEQ ID NO: 419460 - RNA, 32 nt, Human
gacaguggaggccucccuuccuucucacagca

SEQ ID NO: 419461 - RNA, 32 nt, Human
gacaguggaguguugcuucucacugaaacagc

SEQ ID NO: 419462 - RNA, 32 nt, Human
gacaguggcccaggccacacagcucacugggc

SEQ ID NO: 419463 - RNA, 32 nt, Human
gacaguggccuccccuuccccucccugcccca

SEQ ID NO: 419464 - RNA, 32 nt, Human
gacaguggcgugcucagggcuugggaaaccca

SEQ ID NO: 419465 - RNA, 32 nt, Human
gacaguggcucacaccuguaaucucagccucc

SEQ ID NO: 419466 - RNA, 32 nt, Human
gacaguggcugcagcaguccaggugcacacua

SEQ ID NO: 419467 - RNA, 32 nt, Human
gacaguggcuucaccuguccuuuagggaagcu

SEQ ID NO: 419468 - RNA, 32 nt, Human
gacaguggggcugaggguuaacaaggaggucu

SEQ ID NO: 419469 - RNA, 32 nt, Human
gacagugggugaggacaggcuucaggcugucu

SEQ ID NO: 419470 - RNA, 32 nt, Human
gacaguggguggucaacagaaaccccaucccu

SEQ ID NO: 419471 - RNA, 22 nt, Human
gacaguggucguggaaguugga

SEQ ID NO: 419472 - RNA, 32 nt, Human
gacagugguucuuaugauguuuucccuuaacu

SEQ ID NO: 419473 - RNA, 32 nt, Human
gacagugucagccuaagccucuggagaugcuu

SEQ ID NO: 419474 - RNA, 32 nt, Human
gacagugucuugcucugucucccaggcuggag

SEQ ID NO: 419475 - RNA, 32 nt, Human
gacagugugagccugcucaccuucauccugcu

SEQ ID NO: 419476 - RNA, 32 nt, Human
gacagugugcaucaccucugggccaaggacaa

SEQ ID NO: 419477 - RNA, 32 nt, Human
gacaguguggccuggggguuugggggugccag

SEQ ID NO: 419478 - RNA, 32 nt, Human
gacaguguguggaggggcaggagcgugaugca

SEQ ID NO: 419479 - RNA, 32 nt, Human
gacaguguugggggaugugaaugaggacaagc

SEQ ID NO: 419480 - RNA, 32 nt, Human
gacaguguuguucaaagacagccuaguaagua

SEQ ID NO: 419481 - RNA, 32 nt, Human
gacaguuacaaaccaggucaccauccucagag

SEQ ID NO: 419482 - RNA, 32 nt, Human
gacaguuacgcuucguccuccaccucucccuc

SEQ ID NO: 419483 - RNA, 32 nt, Human
gacaguuauugacacugaugugcaaugaagug

SEQ ID NO: 419484 - RNA, 32 nt, Human
gacaguucagagcugcccucuccugggcaugg

SEQ ID NO: 419485 - RNA, 32 nt, Human
gacaguucaggccugugucugccuccuuggga

SEQ ID NO: 419486 - RNA, 32 nt, Human
gacaguucuguuacucagcugcagaggccgca

SEQ ID NO: 419487 - RNA, 32 nt, Human
gacaguucuuuguuuggaggcucucuugugca

SEQ ID NO: 419488 - RNA, 32 nt, Human
gacaguugaaccugguggcaguugcagaugag

SEQ ID NO: 419489 - RNA, 32 nt, Human
gacaguugaauaaucaaaaauauuuuauuagg

SEQ ID NO: 419490 - RNA, 32 nt, Human
gacaguuggauggggaggaggcaccauuugcu

SEQ ID NO: 419491 - RNA, 32 nt, Human
gacaguuggccucugugaauauugguauaauu

SEQ ID NO: 419492 - RNA, 32 nt, Human
gacaguuggggaaaggagaaggcccuuuaaag

SEQ ID NO: 419493 - RNA, 32 nt, Human
gacaguugugagccacugcgcccagccccuaa

SEQ ID NO: 419494 - RNA, 32 nt, Human
gacaguuuacuucaagacaggagacauggguu

SEQ ID NO: 419495 - RNA, 32 nt, Human
gacaguuucgucucccugucaauggccucgug

SEQ ID NO: 419496 - RNA, 32 nt, Human
gacaguuucuccuaacuuucugcuuuagcgua

SEQ ID NO: 419497 - RNA, 32 nt, Human
gacaguuucuuagagggcuugucuccuuucua

SEQ ID NO: 419498 - RNA, 32 nt, Human
gacaguuugcauucuugcaacauuaaaccaaa

SEQ ID NO: 419499 - RNA, 32 nt, Human
gacaguuuguauacugacagguccuuccaguc

SEQ ID NO: 419500 - RNA, 32 nt, Human
gacaguuuucuggcaugaacuacugaacuuau

SEQ ID NO: 419501 - RNA, 32 nt, Human
gacaguuuuuguagcuuucuauugagagucag

SEQ ID NO: 419502 - RNA, 32 nt, Human
gacauaaaaaggaaaucugucuucucuucccu

SEQ ID NO: 419503 - RNA, 32 nt, Human
gacauaacagaaaaaggugaaaacacucuccc

SEQ ID NO: 419504 - RNA, 32 nt, Human
gacauaacugcucuggaccucagcuuugcuau

SEQ ID NO: 419505 - RNA, 32 nt, Human
gacauaacugguuugacucuguccaacucugu

SEQ ID NO: 419506 - RNA, 25 nt, Human
gacauaagauaauucuggcugggug

SEQ ID NO: 419507 - RNA, 32 nt, Human
gacauaaguaggugcuucaucuguaagcgcug

SEQ ID NO: 419508 - RNA, 32 nt, Human
gacauaaguuuauccuggacaauuuccauauu

SEQ ID NO: 419509 - RNA, 32 nt, Human
gacauaauauccauuucacauaccauuuuugu

SEQ ID NO: 419510 - RNA, 32 nt, Human
gacauacacaauauaaaucauaugucuucaca

SEQ ID NO: 419511 - RNA, 32 nt, Human
gacauacacacguuaccagacgcuggagcugg

SEQ ID NO: 419512 - RNA, 32 nt, Human
gacauacacaugcacucacauucguacuugca

SEQ ID NO: 419513 - RNA, 32 nt, Human
gacauacaccuggauuuuugcauuucaggggu

SEQ ID NO: 419514 - RNA, 32 nt, Human
gacauacacuucagaagcuccuaaaacagaga

SEQ ID NO: 419515 - RNA, 32 nt, Human
gacauacaguugcaaauacucacugcaagaag

SEQ ID NO: 419516 - RNA, 32 nt, Human
gacauacaguugcaaauacucacugcaugaag

SEQ ID NO: 419517 - RNA, 32 nt, Human
gacauacauagagacagcagaccuggauggug

SEQ ID NO: 419518 - RNA, 32 nt, Human
gacauacaugcugucucagggugaucgugggu

SEQ ID NO: 419519 - RNA, 32 nt, Human
gacauacuagucugcaggaugaauuucauaac

SEQ ID NO: 419520 - RNA, 32 nt, Human
gacauacugaagcuccagccagggggaugggu

SEQ ID NO: 419521 - RNA, 32 nt, Human
gacauacuguauagguugcagaugucuaaggc

SEQ ID NO: 419522 - RNA, 32 nt, Human
gacauacuugaccuugaaaaaucuggggucau

SEQ ID NO: 419523 - RNA, 22 nt, Human
gacauacuuuaacuauugucau

SEQ ID NO: 419524 - RNA, 32 nt, Human
gacauagagagaggggaaggguuggaaaggag

SEQ ID NO: 419525 - RNA, 32 nt, Human
gacauagagagggagaagaagucagagagggu

SEQ ID NO: 419526 - RNA, 32 nt, Human
gacauagauuauacuacuacuaauuuuuggau

SEQ ID NO: 419527 - RNA, 32 nt, Human
gacauagcucucuccugcuaccagucugugcc

SEQ ID NO: 419528 - RNA, 32 nt, Human
gacauagggcagggggccucacugccuuguug

SEQ ID NO: 419529 - RNA, 32 nt, Human
gacauagggguaagguaugggagagguaggug

SEQ ID NO: 419530 - RNA, 32 nt, Human
gacauaguaguucagguggcccaugccuggga

SEQ ID NO: 419531 - RNA, 32 nt, Human
gacauagucuuucucacccuuacuucacucuu

SEQ ID NO: 419532 - RNA, 32 nt, Human
gacauagugugcagagguguaccagggaucau

SEQ ID NO: 419533 - RNA, 32 nt, Human
gacauauacacacacauauauguauguauauu

SEQ ID NO: 419534 - RNA, 32 nt, Human
gacauauacagaauugaagaugauguggggau

SEQ ID NO: 419535 - RNA, 32 nt, Human
gacauauauuaggucagcucuuacuuuugaaa

SEQ ID NO: 419536 - RNA, 32 nt, Human
gacauauauuuuuauaaggugagguaacucag

SEQ ID NO: 419537 - RNA, 32 nt, Human
gacauaugagcagagaccugcaggaaaucggg

SEQ ID NO: 419538 - RNA, 32 nt, Human
gacauaugaugggacugcuuccccuacauuau

SEQ ID NO: 419539 - RNA, 24 nt, Human
gacauauuaaagccuuuauuccau

SEQ ID NO: 419540 - RNA, 32 nt, Human
gacauauuacauaggaauuuagugucaauuuc

SEQ ID NO: 419541 - RNA, 32 nt, Human
gacauauugugagacuuuucaaccuccauaau

SEQ ID NO: 419542 - RNA, 32 nt, Human
gacauauuuucaggauggugcgucaggauauc

SEQ ID NO: 419543 - RNA, 32 nt, Human
gacaucaaacaugcuguacuugcaaugaaguc

SEQ ID NO: 419544 - RNA, 32 nt, Human
gacaucaaagcaucagcucucuggaccuggga

SEQ ID NO: 419545 - RNA, 32 nt, Human
gacaucaaagguugaagagaagacuuaguugc

SEQ ID NO: 419546 - RNA, 32 nt, Human
gacaucaaccucuagacagggaacagcuucag

SEQ ID NO: 419547 - RNA, 32 nt, Human
gacaucaagaagcaggcaggaaaauggaaaaa

SEQ ID NO: 419548 - RNA, 32 nt, Human
gacaucaagggugcgucacagccacagugagg

SEQ ID NO: 419549 - RNA, 32 nt, Human
gacaucacaagaaaacuauaagccaauauucc

SEQ ID NO: 419550 - RNA, 32 nt, Human
gacaucacaggcugugccaacauguggggcga

SEQ ID NO: 419551 - RNA, 32 nt, Human
gacaucaccugagcccccaccuagccauccau

SEQ ID NO: 419552 - RNA, 32 nt, Human
gacaucacgagcuguccaggaggcgggccugg

SEQ ID NO: 419553 - RNA, 32 nt, Human
gacaucacuggcauugcaccugggugugcccc

SEQ ID NO: 419554 - RNA, 32 nt, Human
gacaucacuguugccugcaaggacaccacgug

SEQ ID NO: 419555 - RNA, 21 nt, Human
gacaucacuugaaaggccaga

SEQ ID NO: 419556 - RNA, 32 nt, Human
gacaucagccaaggccacuucgucugaggaag

SEQ ID NO: 419557 - RNA, 32 nt, Human
gacaucagccacuuuuuauauucauguacauu

SEQ ID NO: 419558 - RNA, 32 nt, Human
gacaucagccuccugccagcaguucuugaagc

SEQ ID NO: 419559 - RNA, 32 nt, Human
gacaucagccugagccucuucgcagccucguu

SEQ ID NO: 419560 - RNA, 19 nt, Human
gacaucagcgcaggacguu

SEQ ID NO: 419561 - RNA, 21 nt, Human
gacaucagcguccacccgcua

SEQ ID NO: 419562 - RNA, 32 nt, Human
gacaucagcucuguucaugagugcucagaguc

SEQ ID NO: 419563 - RNA, 32 nt, Human
gacaucagggcaggcuuccuggagcaggaggu

SEQ ID NO: 419564 - RNA, 32 nt, Human
gacaucaucacagcagccuccucacuugggua

SEQ ID NO: 419565 - RNA, 32 nt, Human
gacaucauccccacuaugaucaacaucggcuc

SEQ ID NO: 419566 - RNA, 32 nt, Human
gacaucaucccccagcucugggaguuuccagu

SEQ ID NO: 419567 - RNA, 32 nt, Human
gacaucaugccacugcacuccagccuggggcu

SEQ ID NO: 419568 - RNA, 32 nt, Human
gacauccacaggguagagguugggugugugua

SEQ ID NO: 419569 - RNA, 32 nt, Human
gacauccaccaagauaccagacauuugaguga

SEQ ID NO: 419570 - RNA, 32 nt, Human
gacauccagccaaacucucagucuugccuuaa

SEQ ID NO: 419571 - RNA, 32 nt, Human
gacauccagccccuaguaauacuuaaggcacu

SEQ ID NO: 419572 - RNA, 32 nt, Human
gacauccaggaugaucaggagccuucauuaaa

SEQ ID NO: 419573 - RNA, 32 nt, Human
gacauccagguucccacccaggccuuccuucc

SEQ ID NO: 419574 - RNA, 32 nt, Human
gacauccauacuuauguugucuggaagagcca

SEQ ID NO: 419575 - RNA, 32 nt, Human
gacauccaucuggucugggauuucgggaguua

SEQ ID NO: 419576 - RNA, 32 nt, Human
gacaucccaguuacucaccacacccauagugc

SEQ ID NO: 419577 - RNA, 18 nt, Human
gacauccccugggucgcu

SEQ ID NO: 419578 - RNA, 21 nt, Human
gacaucccggcggccgcgcug

SEQ ID NO: 419579 - RNA, 32 nt, Human
gacaucccuaccccugccucacugccuauuug

SEQ ID NO: 419580 - RNA, 32 nt, Human
gacaucccuguuccuuucuuuccagccugacu

SEQ ID NO: 419581 - RNA, 32 nt, Human
gacauccgcccuggcccucagagcugccccuu

SEQ ID NO: 419582 - RNA, 32 nt, Human
gacauccgcucccucucacacgcugaggggga

SEQ ID NO: 419583 - RNA, 32 nt, Human
gacauccuacacuucaggauuacuugacuauc

SEQ ID NO: 419584 - RNA, 32 nt, Human
gacauccucccccuacacucccucucugagcc

SEQ ID NO: 419585 - RNA, 32 nt, Human
gacauccugauggggaggcagagccaggaagc

SEQ ID NO: 419586 - RNA, 19 nt, Human
gacauccugcacacccuca

SEQ ID NO: 419587 - RNA, 32 nt, Human
gacauccugcagggcucuguagauggauguau

SEQ ID NO: 419588 - RNA, 32 nt, Human
gacauccuggacaccacaggggcaccugcagg

SEQ ID NO: 419589 - RNA, 32 nt, Human
gacauccuggcguacuugaagcaauucaaaac

SEQ ID NO: 419590 - RNA, 32 nt, Human
gacauccugggaacucugggacucacuagauu

SEQ ID NO: 419591 - RNA, 32 nt, Human
gacaucgcgccacugcacuccagccugggcga

SEQ ID NO: 419592 - RNA, 32 nt, Human
gacaucgcgccacugcacuucagccuggacaa

SEQ ID NO: 419593 - RNA, 32 nt, Human
gacaucgcgccauugcacuccagccuggguga

SEQ ID NO: 419594 - RNA, 32 nt, Human
gacaucgcuggcugccccuuugggcggagagg

SEQ ID NO: 419595 - RNA, 30 nt, Human
gacaucggcaacuucgagcuccuguggagg

SEQ ID NO: 419596 - RNA, 32 nt, Human
gacaucgggggcaaguuugcaguggggccgga

SEQ ID NO: 419597 - RNA, 32 nt, Human
gacaucuaaaccccggcgugugcagugcccau

SEQ ID NO: 419598 - RNA, 32 nt, Human
gacaucuaugugaagagcugggugaagggguu

SEQ ID NO: 419599 - RNA, 32 nt, Human
gacaucucccucuccuugcuggcuccaucuuu

SEQ ID NO: 419600 - RNA, 32 nt, Human
gacaucucucuagcccauccauugcuuacagu

SEQ ID NO: 419601 - RNA, 32 nt, Human
gacaucucuggguucugcagcagcacgcaggc

SEQ ID NO: 419602 - RNA, 32 nt, Human
gacaucucuugccuuguccuccgguauguucu

SEQ ID NO: 419603 - RNA, 32 nt, Human
gacaucugaguccuagaccgagauaccagcug

SEQ ID NO: 419604 - RNA, 32 nt, Human
gacaucugcaagccaaggagagaggcugcagg

SEQ ID NO: 419605 - RNA, 32 nt, Human
gacaucugcaccaaggagagucuggacaaagc

SEQ ID NO: 419606 - RNA, 32 nt, Human
gacaucugccuaacgguuuuguuucuuugucu

SEQ ID NO: 419607 - RNA, 32 nt, Human
gacaucugggauccaagcacagcaauuucuuu

SEQ ID NO: 419608 - RNA, 32 nt, Human
gacaucuggguuguuuccaguuuaggauuguu

SEQ ID NO: 419609 - RNA, 16 nt, Human
gacaucuguaauccca

SEQ ID NO: 419610 - RNA, 31 nt, Human
gacaucugucucucuggagugucugucuguc

SEQ ID NO: 419611 - RNA, 32 nt, Human
gacaucugugccucauuccugaucucaagggg

SEQ ID NO: 419612 - RNA, 32 nt, Human
gacaucuguguucuuccugucagcuccacgcc

SEQ ID NO: 419613 - RNA, 32 nt, Human
gacaucuuaguucugaccuuguggaggccgcg

SEQ ID NO: 419614 - RNA, 32 nt, Human
gacaucuucucccucccuugccucagauuuau

SEQ ID NO: 419615 - RNA, 32 nt, Human
gacaucuucucccucccuugccucagggaagu

SEQ ID NO: 419616 - RNA, 32 nt, Human
gacaucuuuccaggaacagcgugaggaggaca

SEQ ID NO: 419617 - RNA, 32 nt, Human
gacaucuuuucuucaagccugccaucaaggac

SEQ ID NO: 419618 - RNA, 32 nt, Human
gacaugaagaucuggcacuggcuuuuugucac

SEQ ID NO: 419619 - RNA, 32 nt, Human
gacaugaagcugcacacauacacccgucuggu

SEQ ID NO: 419620 - RNA, 32 nt, Human
gacaugaaggggagggaggguguggggaugcc

SEQ ID NO: 419621 - RNA, 28 nt, Human
gacaugaaguacccaucucccuucuuug

SEQ ID NO: 419622 - RNA, 32 nt, Human
gacaugaaugggcuggguccugaacagagaau

SEQ ID NO: 419623 - RNA, 20 nt, Human
gacaugagacuccauuuuga

SEQ ID NO: 419624 - RNA, 32 nt, Human
gacaugagaggugcuuuuguuuuggagauucg

SEQ ID NO: 419625 - RNA, 32 nt, Human
gacaugagccacugcaccugcccagcucccca

SEQ ID NO: 419626 - RNA, 32 nt, Human
gacaugagccugcuggccaauacugugcccag

SEQ ID NO: 419627 - RNA, 32 nt, Human
gacaugaggcagcauuuccuccacacuagggu

SEQ ID NO: 419628 - RNA, 32 nt, Human
gacaugaggcaguuccuuccaggugauucugu

SEQ ID NO: 419629 - RNA, 28 nt, Human
gacaugagggcggcccgugcucugcugc

SEQ ID NO: 419630 - RNA, 32 nt, Human
gacaugaggggaggggaaaggacagagguaga

SEQ ID NO: 419631 - RNA, 32 nt, Human
gacaugaggucaagcaaaagaggucagagucc

SEQ ID NO: 419632 - RNA, 32 nt, Human
gacaugaguugcuugcuuuaggucacagugau

SEQ ID NO: 419633 - RNA, 32 nt, Human
gacaugauacagucauguuacagggaauucaa

SEQ ID NO: 419634 - RNA, 32 nt, Human
gacaugaucauagcucacuccagccugaagca

SEQ ID NO: 419635 - RNA, 32 nt, Human
gacaugauccaaacuugauaaaggacaugaaa

SEQ ID NO: 419636 - RNA, 32 nt, Human
gacaugauggcacauggaaugacaaucagcua

SEQ ID NO: 419637 - RNA, 32 nt, Human
gacaugaugugacaaucucgaucgaucaugga

SEQ ID NO: 419638 - RNA, 32 nt, Human
gacaugauuuaacuccaguuugaugaaccucc

SEQ ID NO: 419639 - RNA, 32 nt, Human
gacaugcaacuguuguugaaugaugacagcaa

SEQ ID NO: 419640 - RNA, 32 nt, Human
gacaugcagcauccuucgccccacuccacuca

SEQ ID NO: 419641 - RNA, 32 nt, Human
gacaugcagcguugggaggagcagagccaggg

SEQ ID NO: 419642 - RNA, 32 nt, Human
gacaugcagcuguguguggcaguauuuuagua

SEQ ID NO: 419643 - RNA, 32 nt, Human
gacaugcccauccugacauuguaugcuacgag

SEQ ID NO: 419644 - RNA, 32 nt, Human
gacaugcccauucacuacagccuggaugacaa

SEQ ID NO: 419645 - RNA, 32 nt, Human
gacaugccccaaugcuucuauaugcuaaguga

SEQ ID NO: 419646 - RNA, 32 nt, Human
gacaugccuucucucugcuccucauaauaucc

SEQ ID NO: 419647 - RNA, 32 nt, Human
gacaugccuuucuccacguccgccuccucgac

SEQ ID NO: 419648 - RNA, 32 nt, Human
gacaugcgggagagagaaugagccagagggac

SEQ ID NO: 419649 - RNA, 32 nt, Human
gacaugcgggagccaggagagcacccuucucc

SEQ ID NO: 419650 - RNA, 32 nt, Human
gacaugcgugagugcgugugguggguggagcc

SEQ ID NO: 419651 - RNA, 32 nt, Human
gacaugcucacacacugucacacucacacacu

SEQ ID NO: 419652 - RNA, 32 nt, Human
gacaugcugaugcuucaaggagaaauauuuuc

SEQ ID NO: 419653 - RNA, 32 nt, Human
gacaugcugccuccugccgcggaaccuuccgc

SEQ ID NO: 419654 - RNA, 32 nt, Human
gacaugcugccugaacauacacacgcacaccc

SEQ ID NO: 419655 - RNA, 19 nt, Human
gacaugcuggccucagaga

SEQ ID NO: 419656 - RNA, 32 nt, Human
gacaugcugguguugucauaccacacgacacg

SEQ ID NO: 419657 - RNA, 32 nt, Human
gacaugcuguauuggcuacuccagaaaguagg

SEQ ID NO: 419658 - RNA, 22 nt, Human
gacaugcuucucucuucuucua

SEQ ID NO: 419659 - RNA, 32 nt, Human
gacauggaccugggaggaaggaaggaccuggg

SEQ ID NO: 419660 - RNA, 32 nt, Human
gacauggagacaggcccagagcacagagagag

SEQ ID NO: 419661 - RNA, 32 nt, Human
gacauggagacuccugcccuguuguguauaga

SEQ ID NO: 419662 - RNA, 28 nt, Human
gacauggagagagugacccuggcccuuc

SEQ ID NO: 419663 - RNA, 32 nt, Human
gacauggagcaguucuguggcauaaauaaagg

SEQ ID NO: 419664 - RNA, 28 nt, Human
gacauggaggagaaggacuacagugagg

SEQ ID NO: 419665 - RNA, 32 nt, Human
gacauggaggcagugcuugcauugcuuuguuc

SEQ ID NO: 419666 - RNA, 32 nt, Human
gacauggaugaaacuggaaaccaucauucuca

SEQ ID NO: 419667 - RNA, 28 nt, Human
gacauggaugagaaggaggaggaugagg

SEQ ID NO: 419668 - RNA, 32 nt, Human
gacauggccaacaacauggggcucaggucugu

SEQ ID NO: 419669 - RNA, 28 nt, Human
gacauggcggaggcgauggauuugggca

SEQ ID NO: 419670 - RNA, 32 nt, Human
gacauggcgguugggccugguagcucaggccu

SEQ ID NO: 419671 - RNA, 28 nt, Human
gacauggcucaggagaagauggagcuag

SEQ ID NO: 419672 - RNA, 32 nt, Human
gacauggcuccccucuuacugccuguggggag

SEQ ID NO: 419673 - RNA, 28 nt, Human
gacauggcugcccagugugucacaaagg

SEQ ID NO: 419674 - RNA, 32 nt, Human
gacauggcuugagccccuugaaugucauugcg

SEQ ID NO: 419675 - RNA, 21 nt, Human
gacaugggacaggccugcagg

SEQ ID NO: 419676 - RNA, 32 nt, Human
gacaugggagaaagggaugggagccacagugc

SEQ ID NO: 419677 - RNA, 32 nt, Human
gacaugggcaccucgggaggcccgggcccugc

SEQ ID NO: 419678 - RNA, 32 nt, Human
gacaugggccccaguuuccagacccugacacc

SEQ ID NO: 419679 - RNA, 32 nt, Human
gacauggggacagacuguugcagaucaguauc

SEQ ID NO: 419680 - RNA, 32 nt, Human
gacauggggcuguggcagugggagacaccgca

SEQ ID NO: 419681 - RNA, 32 nt, Human
gacauggggcuguggcagugggagacaccgcg

SEQ ID NO: 419682 - RNA, 32 nt, Human
gacauggugccauccucacaggccuagcucau

SEQ ID NO: 419683 - RNA, 32 nt, Human
gacauggugggccaccugcaucugcagggcau

SEQ ID NO: 419684 - RNA, 32 nt, Human
gacaugguguguggauggggacuugccccaag

SEQ ID NO: 419685 - RNA, 32 nt, Human
gacaugguuagcaaucucaauuucauuuuuga

SEQ ID NO: 419686 - RNA, 32 nt, Human
gacaugguuguucacauuugcugccacggaac

SEQ ID NO: 419687 - RNA, 32 nt, Human
gacauguaagugcuuaaagaaaagaauuuuaa

SEQ ID NO: 419688 - RNA, 32 nt, Human
gacauguagauuuggagauacugugguuugau

SEQ ID NO: 419689 - RNA, 30 nt, Human
gacauguagcucuccaugguccucccucug

SEQ ID NO: 419690 - RNA, 32 nt, Human
gacauguauacaaauucuuccuuaagugaaag

SEQ ID NO: 419691 - RNA, 32 nt, Human
gacaugucagggacguugugcaggauccagga

SEQ ID NO: 419692 - RNA, 32 nt, Human
gacaugucauuuccuaucucccauuugccuuc

SEQ ID NO: 419693 - RNA, 32 nt, Human
gacauguccgaggucacacaacaaagcagcau

SEQ ID NO: 419694 - RNA, 32 nt, Human
gacauguccuucugagcccgguaagagcaaaa

SEQ ID NO: 419695 - RNA, 28 nt, Human
gacaugucgcccucuggucgccuguguc

SEQ ID NO: 419696 - RNA, 32 nt, Human
gacaugucuagggugagaccagugcucagcac

SEQ ID NO: 419697 - RNA, 32 nt, Human
gacaugugacaucuaccucccgaccuaccacc

SEQ ID NO: 419698 - RNA, 32 nt, Human
gacaugugagccacucagaacucaccaaaaug

SEQ ID NO: 419699 - RNA, 32 nt, Human
gacaugugaugggucuccccacgggggcugca

SEQ ID NO: 419700 - RNA, 23 nt, Human
gacaugugauuucuaaaauucca

SEQ ID NO: 419701 - RNA, 28 nt, Human
gacaugugcaggauguccuucaagaagg

SEQ ID NO: 419702 - RNA, 32 nt, Human
gacaugugccuguaaucccagcuacucaggag

SEQ ID NO: 419703 - RNA, 32 nt, Human
gacaugugcugggucuguggggccguggcccg

SEQ ID NO: 419704 - RNA, 32 nt, Human
gacauguggcgcucgggcgagugccuugcaga

SEQ ID NO: 419705 - RNA, 32 nt, Human
gacaugugggcuccccgaagcccagccagaga

SEQ ID NO: 419706 - RNA, 31 nt, Human
gacauguggguggagaagggaggguggccag

SEQ ID NO: 419707 - RNA, 32 nt, Human
gacauguguagcaucaaaacacaaaggcccac

SEQ ID NO: 419708 - RNA, 32 nt, Human
gacaugugugagucaauagccaucgggguccu

SEQ ID NO: 419709 - RNA, 32 nt, Human
gacaugugugcgugugcacacacgcaaguaug

SEQ ID NO: 419710 - RNA, 32 nt, Human
gacauguguggugaaggcuuugcugaagcauc

SEQ ID NO: 419711 - RNA, 32 nt, Human
gacauguuggccaggcugguggugagcuccug

SEQ ID NO: 419712 - RNA, 32 nt, Human
gacauguugguguaaaguuucuccucugcucc

SEQ ID NO: 419713 - RNA, 32 nt, Human
gacauguuuaccagcacacggcucuucuuccc

SEQ ID NO: 419714 - RNA, 32 nt, Human
gacauguuuccccuccucccacccucauuuuc

SEQ ID NO: 419715 - RNA, 32 nt, Human
gacauguuucuggaaguggguggguggguuug

SEQ ID NO: 419716 - RNA, 32 nt, Human
gacauuacacaaaaucagagugcugaguacag

SEQ ID NO: 419717 - RNA, 32 nt, Human
gacauuacagugagcccagauugugccacugc

SEQ ID NO: 419718 - RNA, 32 nt, Human
gacauuagaaucuggaacaaagcaauguuaac

SEQ ID NO: 419719 - RNA, 20 nt, Human
gacauuagcaaagacaugca

SEQ ID NO: 419720 - RNA, 32 nt, Human
gacauuaguagccacuccagcucucuuugggu

SEQ ID NO: 419721 - RNA, 32 nt, Human
gacauuaguguacagcccauguccaagcccag

SEQ ID NO: 419722 - RNA, 32 nt, Human
gacauuagugugaacacaggacagcuucgcuc

SEQ ID NO: 419723 - RNA, 32 nt, Human
gacauucaaugaauuauauucaaugcauuuaa

SEQ ID NO: 419724 - RNA, 32 nt, Human
gacauucaggcagaaagugcuggugcguuuuc

SEQ ID NO: 419725 - RNA, 32 nt, Human
gacauucauguuuagaugauuagcccucuugu

SEQ ID NO: 419726 - RNA, 32 nt, Human
gacauuccaaccaccaccagccagacauuaca

SEQ ID NO: 419727 - RNA, 32 nt, Human
gacauuccaaggaucuaauccaggaaguacuc

SEQ ID NO: 419728 - RNA, 18 nt, Human
gacauuccaccauuguga

SEQ ID NO: 419729 - RNA, 32 nt, Human
gacauuccaguucugcggcccagacggcagaa

SEQ ID NO: 419730 - RNA, 32 nt, Human
gacauuccauuucauguuccacugugauuaac

SEQ ID NO: 419731 - RNA, 32 nt, Human
gacauuccgucuuccuccauguagucccucuu

SEQ ID NO: 419732 - RNA, 32 nt, Human
gacauucgggaggugucuugaggcucagggag

SEQ ID NO: 419733 - RNA, 32 nt, Human
gacauucucaugaguaaccuucugccuucacu

SEQ ID NO: 419734 - RNA, 32 nt, Human
gacauucuccacugaauuuuaacuuuccuuga

SEQ ID NO: 419735 - RNA, 32 nt, Human
gacauucucucuccaucuccccuuucagcggc

SEQ ID NO: 419736 - RNA, 32 nt, Human
gacauucuguucuacacccuccaggaaaugac

SEQ ID NO: 419737 - RNA, 32 nt, Human
gacauucuuaacagggcggcagucuaguguug

SEQ ID NO: 419738 - RNA, 32 nt, Human
gacauucuucauccaccaauguuguacaugua

SEQ ID NO: 419739 - RNA, 32 nt, Human
gacauugacuuccuggaucuuugcggccccag

SEQ ID NO: 419740 - RNA, 32 nt, Human
gacauugagauuguccuuuuccccugaucaaa

SEQ ID NO: 419741 - RNA, 32 nt, Human
gacauugaggcugcagugaacugugauggcac

SEQ ID NO: 419742 - RNA, 32 nt, Human
gacauugauugcugcauuuuaccuucaaaaua

SEQ ID NO: 419743 - RNA, 32 nt, Human
gacauugauuguuccaacacuuguuucuauua

SEQ ID NO: 419744 - RNA, 32 nt, Human
gacauugcaacuggcccugccuguggguccua

SEQ ID NO: 419745 - RNA, 24 nt, Human
gacauugcaaguucacaccuuuca

SEQ ID NO: 419746 - RNA, 32 nt, Human
gacauugcagccgccuaccugcuccagggaag

SEQ ID NO: 419747 - RNA, 32 nt, Human
gacauugcagugagccaagaucgcacccuuac

SEQ ID NO: 419748 - RNA, 32 nt, Human
gacauugccuggguaacagccacugagauccu

SEQ ID NO: 419749 - RNA, 32 nt, Human
gacauugcgagcuuuguggagcuccaggaagc

SEQ ID NO: 419750 - RNA, 32 nt, Human
gacauugcgccacugcacuccagcgcggaaga

SEQ ID NO: 419751 - RNA, 32 nt, Human
gacauugcuaagaugcucuaucuugcucugua

SEQ ID NO: 419752 - RNA, 32 nt, Human
gacauugcucuguaggugagagaggaccauga

SEQ ID NO: 419753 - RNA, 32 nt, Human
gacauugcugagccacacuguuaagucugcuc

SEQ ID NO: 419754 - RNA, 32 nt, Human
gacauugcuggcugaggaucccuagcauaaca

SEQ ID NO: 419755 - RNA, 32 nt, Human
gacauuggacuuucuauuaaauaauuuuuaag

SEQ ID NO: 419756 - RNA, 24 nt, Human
gacauuggagcaccuuccucucca

SEQ ID NO: 419757 - RNA, 32 nt, Human
gacauuggagcaccuuccucuccagccagagg

SEQ ID NO: 419758 - RNA, 32 nt, Human
gacauuggauccuauacugugagagcugguua

SEQ ID NO: 419759 - RNA, 32 nt, Human
gacauuggccuuaguaggcuguauucacugcu

SEQ ID NO: 419760 - RNA, 32 nt, Human
gacauuggcuaucauuugacaagacuaacuuu

SEQ ID NO: 419761 - RNA, 32 nt, Human
gacauugggcgcagaggugggaaagggccuca

SEQ ID NO: 419762 - RNA, 20 nt, Human
gacauuggucucuuguguug

SEQ ID NO: 419763 - RNA, 32 nt, Human
gacauuguaagaggugguggggaccagcuaau

SEQ ID NO: 419764 - RNA, 21 nt, Human
gacauugucagcgagcacaga

SEQ ID NO: 419765 - RNA, 32 nt, Human
gacauugucaggcacggauggcugguccgaag

SEQ ID NO: 419766 - RNA, 32 nt, Human
gacauugucauuauucuuccuccaucuaucug

SEQ ID NO: 419767 - RNA, 32 nt, Human
gacauugugccacccucaauccgacaaucgaa

SEQ ID NO: 419768 - RNA, 32 nt, Human
gacauugugggaccccagaggcuguccugucc

SEQ ID NO: 419769 - RNA, 32 nt, Human
gacauugugucugagccaugcccagccgcugg

SEQ ID NO: 419770 - RNA, 32 nt, Human
gacauuguugcaaauggacacagucuuaaugg

SEQ ID NO: 419771 - RNA, 22 nt, Human
gacauuguuuccucaaggcaga

SEQ ID NO: 419772 - RNA, 32 nt, Human
gacauuuacugaaggagggacauggacaaaac

SEQ ID NO: 419773 - RNA, 32 nt, Human
gacauuuagcuugccagacaucaguuuucaug

SEQ ID NO: 419774 - RNA, 32 nt, Human
gacauuuauccgccuccuuggagaacacagcc

SEQ ID NO: 419775 - RNA, 32 nt, Human
gacauuuauguuucuuuuacauucaugacagc

SEQ ID NO: 419776 - RNA, 32 nt, Human
gacauuuauucacuuccucucauuagauccaa

SEQ ID NO: 419777 - RNA, 32 nt, Human
gacauuucaagaaacacauguguugaccaccu

SEQ ID NO: 419778 - RNA, 31 nt, Human
gacauuucaauaaaauuguuuggaaaauaaa

SEQ ID NO: 419779 - RNA, 32 nt, Human
gacauuucauggguuuuauuuaaucacacccc

SEQ ID NO: 419780 - RNA, 32 nt, Human
gacauuucauuagccaugcaacauggauaugu

SEQ ID NO: 419781 - RNA, 32 nt, Human
gacauuucauuugugccaaaaauauuaaaaau

SEQ ID NO: 419782 - RNA, 32 nt, Human
gacauuuccacauauccucugaaaucuaggug

SEQ ID NO: 419783 - RNA, 32 nt, Human
gacauuucccauagccuugacagugccaggag

SEQ ID NO: 419784 - RNA, 32 nt, Human
gacauuucuacucauccccacacugccuucca

SEQ ID NO: 419785 - RNA, 32 nt, Human
gacauuucucaccucugauuccggcucuccuu

SEQ ID NO: 419786 - RNA, 17 nt, Human
gacauuucuggcucuga

SEQ ID NO: 419787 - RNA, 32 nt, Human
gacauuugaauguaagaaaaccuucucccagg

SEQ ID NO: 419788 - RNA, 32 nt, Human
gacauuugagccacaguuuuuagaucagcacc

SEQ ID NO: 419789 - RNA, 32 nt, Human
gacauuugaucaaccuuuaguuggaauaauaa

SEQ ID NO: 419790 - RNA, 32 nt, Human
gacauuugccaaggaggaaccuaaggaagaua

SEQ ID NO: 419791 - RNA, 29 nt, Human
gacauuugccuuuuugugccuggaucuug

SEQ ID NO: 419792 - RNA, 32 nt, Human
gacauuuggcaggaguuuugacugggguagga

SEQ ID NO: 419793 - RNA, 32 nt, Human
gacauuugggcuggccaacagcagaaaguccc

SEQ ID NO: 419794 - RNA, 32 nt, Human
gacauuuggguuguuucccaucuuuuuguuac

SEQ ID NO: 419795 - RNA, 32 nt, Human
gacauuuguggcagugcugaagggggcauugc

SEQ ID NO: 419796 - RNA, 32 nt, Human
gacauuugugggcaagcagaugacagagguuu

SEQ ID NO: 419797 - RNA, 32 nt, Human
gacauuuguguauccacauucuuaccuuuggu

SEQ ID NO: 419798 - RNA, 32 nt, Human
gacauuuguuuauucuuguaacaaauuaaaac

SEQ ID NO: 419799 - RNA, 32 nt, Human
gacauuuuacagcuucaccaggagaaugugca

SEQ ID NO: 419800 - RNA, 32 nt, Human
gacauuuuagagaguuuccuucuucauucacc

SEQ ID NO: 419801 - RNA, 22 nt, Human
gacauuuucauaugcaauggaa

SEQ ID NO: 419802 - RNA, 32 nt, Human
gacauuuucuaggaagaugguggcagaaaaag

SEQ ID NO: 419803 - RNA, 32 nt, Human
gacauuuucuggaucuccugcaugucaggagc

SEQ ID NO: 419804 - RNA, 32 nt, Human
gacauuuucuuucaugggcaccaaccugcauu

SEQ ID NO: 419805 - RNA, 32 nt, Human
gacauuuugauucuccagccugggcaacggag

SEQ ID NO: 419806 - RNA, 32 nt, Human
gacauuuuguacagugcucuccggugcuguga

SEQ ID NO: 419807 - RNA, 16 nt, Human
gacauuuugugucuga

SEQ ID NO: 419808 - RNA, 32 nt, Human
gaccaaaaaggauggauuucccuggccucucu

SEQ ID NO: 419809 - RNA, 31 nt, Human
gaccaaaagagaccuuguuuucuuugagaag

SEQ ID NO: 419810 - RNA, 32 nt, Human
gaccaaaaucaagugaguaggugaccaguucc

SEQ ID NO: 419811 - RNA, 32 nt, Human
gaccaaaaugaaaccuuuuucucugaagaauc

SEQ ID NO: 419812 - RNA, 32 nt, Human
gaccaaaauggagaaaccccaucucuacuaaa

SEQ ID NO: 419813 - RNA, 32 nt, Human
gaccaaaauggugaaaccccgucucuacuaaa

SEQ ID NO: 419814 - RNA, 32 nt, Human
gaccaaaauggugaaacccugucucuacuaaa

SEQ ID NO: 419815 - RNA, 32 nt, Human
gaccaaaauggugaaaccuccucucuacuaaa

SEQ ID NO: 419816 - RNA, 32 nt, Human
gaccaaacauaggacuguuacagggaagaaaa

SEQ ID NO: 419817 - RNA, 32 nt, Human
gaccaaaccagaaaccuccaauucucaugugg

SEQ ID NO: 419818 - RNA, 32 nt, Human
gaccaaacccucucccuguuggugaccccugu

SEQ ID NO: 419819 - RNA, 32 nt, Human
gaccaaacccuugugacuuuuagguaagaaau

SEQ ID NO: 419820 - RNA, 32 nt, Human
gaccaaacuuggcuccagccauugcggugguu

SEQ ID NO: 419821 - RNA, 22 nt, Human
gaccaaagacuugaccacucaa

SEQ ID NO: 419822 - RNA, 32 nt, Human
gaccaaagauuaguaaccaguuauacccagua

SEQ ID NO: 419823 - RNA, 32 nt, Human
gaccaaaggccgcccccgccugcugggguucc

SEQ ID NO: 419824 - RNA, 32 nt, Human
gaccaaagggguggggauaauggggagcccca

SEQ ID NO: 419825 - RNA, 32 nt, Human
gaccaaauagcaucugguucagugggggccgg

SEQ ID NO: 419826 - RNA, 24 nt, Human
gaccaaaugagaagaaccccgggg

SEQ ID NO: 419827 - RNA, 32 nt, Human
gaccaaaugagcuggagcauguauggaggugc

SEQ ID NO: 419828 - RNA, 32 nt, Human
gaccaaauucugagcugcugagcugcuuacuu

SEQ ID NO: 419829 - RNA, 32 nt, Human
gaccaacaacaacgauguggccauccugcucu

SEQ ID NO: 419830 - RNA, 32 nt, Human
gaccaacaaucaggcucucacaguuguuucuc

SEQ ID NO: 419831 - RNA, 32 nt, Human
gaccaacacagaggagagaaaacaaaaauagc

SEQ ID NO: 419832 - RNA, 32 nt, Human
gaccaacaccucagaccuucugaagcagccca

SEQ ID NO: 419833 - RNA, 32 nt, Human
gaccaacacgcacuugcagggaauggcccagc

SEQ ID NO: 419834 - RNA, 32 nt, Human
gaccaacacggagaaaccccaucucuacuaaa

SEQ ID NO: 419835 - RNA, 32 nt, Human
gaccaacacggagaaaccccgucucuacuaaa

SEQ ID NO: 419836 - RNA, 32 nt, Human
gaccaacacggugaaaccccaucucuacuaaa

SEQ ID NO: 419837 - RNA, 32 nt, Human
gaccaacacggugaaaccccgucucuacuaaa

SEQ ID NO: 419838 - RNA, 32 nt, Human
gaccaacacugcacucaaugagccagccucuc

SEQ ID NO: 419839 - RNA, 32 nt, Human
gaccaacagaacuucacagugacacuggacca

SEQ ID NO: 419840 - RNA, 32 nt, Human
gaccaacagcuggccgaggcucagggauagag

SEQ ID NO: 419841 - RNA, 32 nt, Human
gaccaacaggugcuauuggagugcaaaguguu

SEQ ID NO: 419842 - RNA, 32 nt, Human
gaccaacauagugaaaccccaucucuacuaaa

SEQ ID NO: 419843 - RNA, 32 nt, Human
gaccaacauagugaaaccccaucucuacugaa

SEQ ID NO: 419844 - RNA, 32 nt, Human
gaccaacauagugaaacccccgucucuacuaa

SEQ ID NO: 419845 - RNA, 29 nt, Human
gaccaacauaguuucaccccaucucuacu

SEQ ID NO: 419846 - RNA, 32 nt, Human
gaccaacaugaagaaaccccaucucuacuaaa

SEQ ID NO: 419847 - RNA, 32 nt, Human
gaccaacaugacgaaaccccgucucuacuaaa

SEQ ID NO: 419848 - RNA, 32 nt, Human
gaccaacaugaugaaacccccgucucuacuaa

SEQ ID NO: 419849 - RNA, 22 nt, Human
gaccaacaugaugaaaccccgu

SEQ ID NO: 419850 - RNA, 32 nt, Human
gaccaacaugaugaaaccccgucuguacuaaa

SEQ ID NO: 419851 - RNA, 32 nt, Human
gaccaacaugaugaaaccccguugcuacuaaa

SEQ ID NO: 419852 - RNA, 32 nt, Human
gaccaacaugcugaaacccagucucuacuaaa

SEQ ID NO: 419853 - RNA, 32 nt, Human
gaccaacaugcugaaaccccaucucuauuaga

SEQ ID NO: 419854 - RNA, 32 nt, Human
gaccaacauggagaaaccccaauuguacuaaa

SEQ ID NO: 419855 - RNA, 32 nt, Human
gaccaacauggagaaaccccaucuccacuaaa

SEQ ID NO: 419856 - RNA, 32 nt, Human
gaccaacauggagaaaccccaucucuacuaaa

SEQ ID NO: 419857 - RNA, 32 nt, Human
gaccaacauggagaaaccccaucucucccgaa

SEQ ID NO: 419858 - RNA, 32 nt, Human
gaccaacauggagaaaccccaucuguacuaaa

SEQ ID NO: 419859 - RNA, 32 nt, Human
gaccaacauggagaaaccccauuucuacuaaa

SEQ ID NO: 419860 - RNA, 32 nt, Human
gaccaacauggagaaacccccaucucuacuga

SEQ ID NO: 419861 - RNA, 32 nt, Human
gaccaacauggagaaaccccgucccuacuaaa

SEQ ID NO: 419862 - RNA, 32 nt, Human
gaccaacauggagaaaccccgucucuacuaaa

SEQ ID NO: 419863 - RNA, 32 nt, Human
gaccaacauggagaaaccccgucucuauuggg

SEQ ID NO: 419864 - RNA, 32 nt, Human
gaccaacauggagaaaccccgucucugcuaaa

SEQ ID NO: 419865 - RNA, 32 nt, Human
gaccaacauggagaaaccccgugucuacuaaa

SEQ ID NO: 419866 - RNA, 32 nt, Human
gaccaacauggagaaaccccugucucuguuaa

SEQ ID NO: 419867 - RNA, 32 nt, Human
gaccaacauggagaaacgccaucucuacuaaa

SEQ ID NO: 419868 - RNA, 32 nt, Human
gaccaacauggagaaacuccaucucuacuaaa

SEQ ID NO: 419869 - RNA, 32 nt, Human
gaccaacauggagaaaugccaucucuacuaaa

SEQ ID NO: 419870 - RNA, 32 nt, Human
gaccaacauggauaaaucccaucucuacuaaa

SEQ ID NO: 419871 - RNA, 32 nt, Human
gaccaacauggcgaaaccccaucucuacuaaa

SEQ ID NO: 419872 - RNA, 32 nt, Human
gaccaacauggcgaaaccccauuucuacuaaa

SEQ ID NO: 419873 - RNA, 32 nt, Human
gaccaacauggcgaaaccccgucucuacuaaa

SEQ ID NO: 419874 - RNA, 32 nt, Human
gaccaacauggcgaaaccccgucucuagcaaa

SEQ ID NO: 419875 - RNA, 32 nt, Human
gaccaacaugguaaaaccacaucucuacuaaa

SEQ ID NO: 419876 - RNA, 32 nt, Human
gaccaacauggugaaaaccccaucucuacuaa

SEQ ID NO: 419877 - RNA, 32 nt, Human
gaccaacauggugaaacaccaucucuacuaaa

SEQ ID NO: 419878 - RNA, 32 nt, Human
gaccaacauggugaaacacugucucuacuaaa

SEQ ID NO: 419879 - RNA, 19 nt, Human
gaccaacauggugaaaccc

SEQ ID NO: 419880 - RNA, 20 nt, Human
gaccaacauggugaaacccc

SEQ ID NO: 419881 - RNA, 32 nt, Human
gaccaacauggugaaaccccaucucuacaaaa

SEQ ID NO: 419882 - RNA, 32 nt, Human
gaccaacauggugaaaccccaucucuacgaaa

SEQ ID NO: 419883 - RNA, 32 nt, Human
gaccaacauggugaaaccccaucucuacuaaa

SEQ ID NO: 419884 - RNA, 32 nt, Human
gaccaacauggugaaaccccaucucuacuuaa

SEQ ID NO: 419885 - RNA, 32 nt, Human
gaccaacauggugaaaccccaucuguacuaaa

SEQ ID NO: 419886 - RNA, 32 nt, Human
gaccaacauggugaaaccccaucuuuacugaa

SEQ ID NO: 419887 - RNA, 32 nt, Human
gaccaacauggugaaaccccauuucuacuaaa

SEQ ID NO: 419888 - RNA, 22 nt, Human
gaccaacauggugaaaccccgu

SEQ ID NO: 419889 - RNA, 32 nt, Human
gaccaacauggugaaaccccgucucuacaaaa

SEQ ID NO: 419890 - RNA, 32 nt, Human
gaccaacauggugaaaccccgucucuacuaaa

SEQ ID NO: 419891 - RNA, 32 nt, Human
gaccaacauggugaaaccccgucucuacuaac

SEQ ID NO: 419892 - RNA, 32 nt, Human
gaccaacauggugaaaccccgucuuuauuaaa

SEQ ID NO: 419893 - RNA, 32 nt, Human
gaccaacauggugaaaccccgugucuacuaaa

SEQ ID NO: 419894 - RNA, 32 nt, Human
gaccaacauggugaaaccccguuucuacuaaa

SEQ ID NO: 419895 - RNA, 32 nt, Human
gaccaacauggugaaaccccuucucuacguau

SEQ ID NO: 419896 - RNA, 32 nt, Human
gaccaacauggugaaacccugucucuaccaaa

SEQ ID NO: 419897 - RNA, 32 nt, Human
gaccaacauggugaaacccugucucuacgaaa

SEQ ID NO: 419898 - RNA, 32 nt, Human
gaccaacauggugaaacccugucucuacuaaa

SEQ ID NO: 419899 - RNA, 32 nt, Human
gaccaacauggugaaacccuguuucuacuaaa

SEQ ID NO: 419900 - RNA, 32 nt, Human
gaccaacauggugaaaccucaacucuacuaaa

SEQ ID NO: 419901 - RNA, 32 nt, Human
gaccaacauggugaaaccucaucucuacuaaa

SEQ ID NO: 419902 - RNA, 32 nt, Human
gaccaacauggugaaaccucgucucugcuaaa

SEQ ID NO: 419903 - RNA, 32 nt, Human
gaccaacauggugaaacgccaucucuacuaaa

SEQ ID NO: 419904 - RNA, 32 nt, Human
gaccaacauggugaaacuaugucucuacuaaa

SEQ ID NO: 419905 - RNA, 32 nt, Human
gaccaacauggugaaacuccaucucuacuaaa

SEQ ID NO: 419906 - RNA, 32 nt, Human
gaccaacauggugaaacucuguucuacuaaaa

SEQ ID NO: 419907 - RNA, 32 nt, Human
gaccaacauggugaaagcccguuucuacuaaa

SEQ ID NO: 419908 - RNA, 32 nt, Human
gaccaacauggugaaauccagucucuacuuaa

SEQ ID NO: 419909 - RNA, 32 nt, Human
gaccaacauggugaaaucccgucucuauuaaa

SEQ ID NO: 419910 - RNA, 32 nt, Human
gaccaacauggugaaauccugucucuacuaaa

SEQ ID NO: 419911 - RNA, 32 nt, Human
gaccaacauggugaaaugaaaccccaucucaa

SEQ ID NO: 419912 - RNA, 32 nt, Human
gaccaacauggugagacccugucucuacuaaa

SEQ ID NO: 419913 - RNA, 32 nt, Human
gaccaaccaaccaaguaugccccaaaccaaag

SEQ ID NO: 419914 - RNA, 32 nt, Human
gaccaaccacuuucguaucauaauuucuuuuu

SEQ ID NO: 419915 - RNA, 28 nt, Human
gaccaacccaugguugccucaucagcag

SEQ ID NO: 419916 - RNA, 24 nt, Human
gaccaaccucuuuucaacccauca

SEQ ID NO: 419917 - RNA, 32 nt, Human
gaccaaccugcauucaugcccuuguauccgca

SEQ ID NO: 419918 - RNA, 32 nt, Human
gaccaaccugcucuguccccaaaggacgccug

SEQ ID NO: 419919 - RNA, 32 nt, Human
gaccaaccuggagaaaccccgucucuacuaaa

SEQ ID NO: 419920 - RNA, 32 nt, Human
gaccaaccuggugaaaccccgucucuacaaaa

SEQ ID NO: 419921 - RNA, 32 nt, Human
gaccaacguggagaaaccccaucucuacuaaa

SEQ ID NO: 419922 - RNA, 32 nt, Human
gaccaacguggagaaacccccgucucuacuaa

SEQ ID NO: 419923 - RNA, 32 nt, Human
gaccaacguggagaaaccccgucucuauuaaa

SEQ ID NO: 419924 - RNA, 32 nt, Human
gaccaacguggagaaaccccgucuuuacuaaa

SEQ ID NO: 419925 - RNA, 32 nt, Human
gaccaacguggagaaaugccaucucuacuaaa

SEQ ID NO: 419926 - RNA, 32 nt, Human
gaccaacguggugaaaccccaucucuacuaaa

SEQ ID NO: 419927 - RNA, 32 nt, Human
gaccaacguggugaaaccccgucucuacuaaa

SEQ ID NO: 419928 - RNA, 32 nt, Human
gaccaacguggugaaacccugucucuacugga

SEQ ID NO: 419929 - RNA, 32 nt, Human
gaccaacguggugaaacuccgucucuacuaaa

SEQ ID NO: 419930 - RNA, 32 nt, Human
gaccaacugcaacacugugccugcgagucucc

SEQ ID NO: 419931 - RNA, 32 nt, Human
gaccaacugcggcugcucauggccacuggacc

SEQ ID NO: 419932 - RNA, 32 nt, Human
gaccaacuguaaugauuucacuuuuaucagua

SEQ ID NO: 419933 - RNA, 32 nt, Human
gaccaacuuuuacuucucagaggccauuuaaa

SEQ ID NO: 419934 - RNA, 32 nt, Human
gaccaagaaaauacauuuauuauuugcuaauu

SEQ ID NO: 419935 - RNA, 32 nt, Human
gaccaagaaagagccaucaggccagguaucca

SEQ ID NO: 419936 - RNA, 32 nt, Human
gaccaagaaagcuucuuaucaaaagaagcaca

SEQ ID NO: 419937 - RNA, 32 nt, Human
gaccaagaagagcugguuuaggugagacugga

SEQ ID NO: 419938 - RNA, 32 nt, Human
gaccaagaagucugggcuggguccaguccccg

SEQ ID NO: 419939 - RNA, 32 nt, Human
gaccaagaauuuaccagcugucagaggacugu

SEQ ID NO: 419940 - RNA, 32 nt, Human
gaccaagacuggaguaagaccuuuuaacccug

SEQ ID NO: 419941 - RNA, 32 nt, Human
gaccaagaggcagaagagcagagcagucgggg

SEQ ID NO: 419942 - RNA, 32 nt, Human
gaccaagagguguggaaggaaaagugggguug

SEQ ID NO: 419943 - RNA, 32 nt, Human
gaccaagaguguggaguaaauggugcacccca

SEQ ID NO: 419944 - RNA, 32 nt, Human
gaccaagauggcagguggaggccaggcuuacc

SEQ ID NO: 419945 - RNA, 32 nt, Human
gaccaagcaguggauauugagccugugaaguc

SEQ ID NO: 419946 - RNA, 32 nt, Human
gaccaagccauccugagggcauggacauuguc

SEQ ID NO: 419947 - RNA, 32 nt, Human
gaccaagcccccaguacaagcgcuggggccca

SEQ ID NO: 419948 - RNA, 32 nt, Human
gaccaagccugaccaauauggagaaacccugu

SEQ ID NO: 419949 - RNA, 32 nt, Human
gaccaagccuuguggcaccagcaaucuccaaa

SEQ ID NO: 419950 - RNA, 32 nt, Human
gaccaagcuggaugugaaccagucccagaaca

SEQ ID NO: 419951 - RNA, 32 nt, Human
gaccaagcuggucucuaacuccugggcuuaag

SEQ ID NO: 419952 - RNA, 32 nt, Human
gaccaaggaccccagagcccaccugugugacg

SEQ ID NO: 419953 - RNA, 32 nt, Human
gaccaaggaccuccaaggagguaucuuuccca

SEQ ID NO: 419954 - RNA, 32 nt, Human
gaccaaggcagcaggaaggagaaaggagggaa

SEQ ID NO: 419955 - RNA, 32 nt, Human
gaccaaggcaucugccccaacauggccuugag

SEQ ID NO: 419956 - RNA, 32 nt, Human
gaccaaggggucugagacuuaggcccuggcuc

SEQ ID NO: 419957 - RNA, 32 nt, Human
gaccaaggguguccaaucuuuggcuucccugg

SEQ ID NO: 419958 - RNA, 32 nt, Human
gaccaaggguuuccauguucaaacagucaaca

SEQ ID NO: 419959 - RNA, 32 nt, Human
gaccaagguggugaaaccccaucucuaguuaa

SEQ ID NO: 419960 - RNA, 32 nt, Human
gaccaagguggugaaaccccgucucuacuaaa

SEQ ID NO: 419961 - RNA, 32 nt, Human
gaccaaguacuggagcccagccccagacagcu

SEQ ID NO: 419962 - RNA, 32 nt, Human
gaccaagucccauuagaagagcuguucuuuga

SEQ ID NO: 419963 - RNA, 32 nt, Human
gaccaagugagaagaaucauaagaauauggga

SEQ ID NO: 419964 - RNA, 32 nt, Human
gaccaaguucugcuguuugggugacagugcuu

SEQ ID NO: 419965 - RNA, 32 nt, Human
gaccaauagcaucugugccagagauguacugu

SEQ ID NO: 419966 - RNA, 32 nt, Human
gaccaauaugaugaaaccccgucucuacuaaa

SEQ ID NO: 419967 - RNA, 32 nt, Human
gaccaauauggugaaaccccaucucuacuaaa

SEQ ID NO: 419968 - RNA, 32 nt, Human
gaccaauauggugaaaccccgucucuacuaaa

SEQ ID NO: 419969 - RNA, 32 nt, Human
gaccaauauggugaaaccccuucucuacuaaa

SEQ ID NO: 419970 - RNA, 32 nt, Human
gaccaaucaccaaaugugggaaagcacuacag

SEQ ID NO: 419971 - RNA, 32 nt, Human
gaccaaucagaggcacuuucauuuuucaucug

SEQ ID NO: 419972 - RNA, 32 nt, Human
gaccaaugagacgacuucagcaucuuuuuaaa

SEQ ID NO: 419973 - RNA, 32 nt, Human
gaccaaugauggucaccaaaucagcugcuacu

SEQ ID NO: 419974 - RNA, 32 nt, Human
gaccaaugcccacuuccccuccugggucaccu

SEQ ID NO: 419975 - RNA, 29 nt, Human
gaccaauggcugcuucauccccgacguug

SEQ ID NO: 419976 - RNA, 32 nt, Human
gaccaauguccuuguggucuuugcugcugcuc

SEQ ID NO: 419977 - RNA, 32 nt, Human
gaccaauuacagucuugugccucuccaaauuc

SEQ ID NO: 419978 - RNA, 18 nt, Human
gaccaauucugugacccc

SEQ ID NO: 419979 - RNA, 32 nt, Human
gaccaauugugcuucaggccuccugcagagau

SEQ ID NO: 419980 - RNA, 32 nt, Human
gaccaauuuuaagggaauccaggacagcuuuc

SEQ ID NO: 419981 - RNA, 32 nt, Human
gaccacaacagcccuguccacugugagcucug

SEQ ID NO: 419982 - RNA, 32 nt, Human
gaccacaagacaaccaacagcuggccacguac

SEQ ID NO: 419983 - RNA, 32 nt, Human
gaccacaaucacacaccaccaugcccugcucc

SEQ ID NO: 419984 - RNA, 19 nt, Human
gaccacacaaacccagccu

SEQ ID NO: 419985 - RNA, 32 nt, Human
gaccacacauugcccuuuucucagggaaggaa

SEQ ID NO: 419986 - RNA, 22 nt, Human
gaccacacauuucaaaguugcc

SEQ ID NO: 419987 - RNA, 32 nt, Human
gaccacaccacugcacuccauccugggcaaca

SEQ ID NO: 419988 - RNA, 32 nt, Human
gaccacaccacugcacuccugccugggcaaua

SEQ ID NO: 419989 - RNA, 32 nt, Human
gaccacaccaguguccaugcccagagguucug

SEQ ID NO: 419990 - RNA, 32 nt, Human
gaccacaccauugcacuccagccugggcaaca

SEQ ID NO: 419991 - RNA, 32 nt, Human
gaccacacccaccgcaaccucauccccucagc

SEQ ID NO: 419992 - RNA, 22 nt, Human
gaccacacccagccaaccugcc

SEQ ID NO: 419993 - RNA, 32 nt, Human
gaccacacccagcuaauuuuuguauuuuuagu

SEQ ID NO: 419994 - RNA, 18 nt, Human
gaccacaccccaaugccu

SEQ ID NO: 419995 - RNA, 20 nt, Human
gaccacaccuaaaacugccu

SEQ ID NO: 419996 - RNA, 32 nt, Human
gaccacacgcacuucaggguggaagcuggaag

SEQ ID NO: 419997 - RNA, 32 nt, Human
gaccacacgugucuccuccuccucaucuuagc

SEQ ID NO: 419998 - RNA, 32 nt, Human
gaccacacuccccucccucccuccagcagcuc

SEQ ID NO: 419999 - RNA, 22 nt, Human
gaccacagaccccacaccaggu

SEQ ID NO: 420000 - RNA, 19 nt, Human
gaccacagaugcuccacca

SEQ ID NO: 420001 - RNA, 32 nt, Human
gaccacagcagaaguuauagagcgagaacuua

SEQ ID NO: 420002 - RNA, 32 nt, Human
gaccacagcagcaccuccuccaugcaggccuu

SEQ ID NO: 420003 - RNA, 32 nt, Human
gaccacagcagcccugcgugggcaucaccucc

SEQ ID NO: 420004 - RNA, 31 nt, Human
gaccacagcauguccaucagcucagcagagc

SEQ ID NO: 420005 - RNA, 25 nt, Human
gaccacagccaucccucuccaugcc

SEQ ID NO: 420006 - RNA, 32 nt, Human
gaccacagccaucccucuccaugcccugugug

SEQ ID NO: 420007 - RNA, 32 nt, Human
gaccacagcugcagaucaguucuuagcaauga

SEQ ID NO: 420008 - RNA, 32 nt, Human
gaccacagcugccuccuccuccagagaaugcc

SEQ ID NO: 420009 - RNA, 32 nt, Human
gaccacagcugugaccggcugcuccagaagaa

SEQ ID NO: 420010 - RNA, 32 nt, Human
gaccacaggccuggcuaaauuuugacuuuuug

SEQ ID NO: 420011 - RNA, 21 nt, Human
gaccacaggcgcccaccacca

SEQ ID NO: 420012 - RNA, 32 nt, Human
gaccacaggcgcccaccaccaugcccagauga

SEQ ID NO: 420013 - RNA, 21 nt, Human
gaccacaggcgugcaccacca

SEQ ID NO: 420014 - RNA, 32 nt, Human
gaccacaggcuuguuaccaccaugcucggcuu

SEQ ID NO: 420015 - RNA, 23 nt, Human
gaccacagguguugcuggugacu

SEQ ID NO: 420016 - RNA, 32 nt, Human
gaccacagucucuauccuggggguaaaggggu

SEQ ID NO: 420017 - RNA, 32 nt, Human
gaccacagucuuggcugagaucaaagggauga

SEQ ID NO: 420018 - RNA, 32 nt, Human
gaccacaucacugcagacccagggaccaccga

SEQ ID NO: 420019 - RNA, 32 nt, Human
gaccacauccccaaauuccaucauguccaaaa

SEQ ID NO: 420020 - RNA, 32 nt, Human
gaccacaugacccagaggugcagggagaagcc

SEQ ID NO: 420021 - RNA, 32 nt, Human
gaccacauggagggaaaaagaaaacaauucuu

SEQ ID NO: 420022 - RNA, 32 nt, Human
gaccacauucaucugggcaugccugcaguacu

SEQ ID NO: 420023 - RNA, 32 nt, Human
gaccacauuguacccauuucacagagaaggag

SEQ ID NO: 420024 - RNA, 32 nt, Human
gaccaccaagaugccagcaggauauaccguaa

SEQ ID NO: 420025 - RNA, 32 nt, Human
gaccaccaaucaggaaccuuugcuggaagcuu

SEQ ID NO: 420026 - RNA, 32 nt, Human
gaccaccacacugcaaggacacuugagguacu

SEQ ID NO: 420027 - RNA, 32 nt, Human
gaccaccaccaccaccaccacucaccaccauc

SEQ ID NO: 420028 - RNA, 32 nt, Human
gaccaccagccugggcgcaguggugcuggggg

SEQ ID NO: 420029 - RNA, 32 nt, Human
gaccaccaucaccaagcagaucacgcccuacg

SEQ ID NO: 420030 - RNA, 23 nt, Human
gaccaccauccucagaagccaag

SEQ ID NO: 420031 - RNA, 32 nt, Human
gaccaccaugccaccuccucgccuccucuucu

SEQ ID NO: 420032 - RNA, 32 nt, Human
gaccaccauggagaaaccccgucucuacugaa

SEQ ID NO: 420033 - RNA, 32 nt, Human
gaccacccacaaugcuuugagcuucuuuuaua

SEQ ID NO: 420034 - RNA, 22 nt, Human
gaccacccaggauguuuuccaa

SEQ ID NO: 420035 - RNA, 32 nt, Human
gaccacccaggugggaguguaagauaaccuuc

SEQ ID NO: 420036 - RNA, 32 nt, Human
gaccacccagugccauggccacuuagggcugg

SEQ ID NO: 420037 - RNA, 32 nt, Human
gaccaccccaggagacucaaaggccugcaucu

SEQ ID NO: 420038 - RNA, 32 nt, Human
gaccaccccauucuucucaagcaaggauugcc

SEQ ID NO: 420039 - RNA, 20 nt, Human
gaccaccccggcagccugag

SEQ ID NO: 420040 - RNA, 32 nt, Human
gaccaccccugcaggcauccaaaggagcacac

SEQ ID NO: 420041 - RNA, 32 nt, Human
gaccaccccugcccaccguccaacaccuccca

SEQ ID NO: 420042 - RNA, 32 nt, Human
gaccacccggccacagaaauggcggugggagg

SEQ ID NO: 420043 - RNA, 32 nt, Human
gaccacccugaccaacaugaaaccccgucucu

SEQ ID NO: 420044 - RNA, 32 nt, Human
gaccacccuggcugaaaugacacaccuacucc

SEQ ID NO: 420045 - RNA, 32 nt, Human
gaccacccuuucucccugcccagccagggacu

SEQ ID NO: 420046 - RNA, 22 nt, Human
gaccacccuuugcugggaggaa

SEQ ID NO: 420047 - RNA, 32 nt, Human
gaccaccgccccaccaccuccugggaccacac

SEQ ID NO: 420048 - RNA, 32 nt, Human
gaccaccgcgcuuuccccuccucagccugggc

SEQ ID NO: 420049 - RNA, 17 nt, Human
gaccaccgugggucuga

SEQ ID NO: 420050 - RNA, 32 nt, Human
gaccaccuccuccugcugaaauauuacugcuu

SEQ ID NO: 420051 - RNA, 20 nt, Human
gaccaccucgggggugcuuu

SEQ ID NO: 420052 - RNA, 32 nt, Human
gaccaccugccucuccccaagggagcagacuc

SEQ ID NO: 420053 - RNA, 21 nt, Human
gaccaccuggacugccaucca

SEQ ID NO: 420054 - RNA, 32 nt, Human
gaccaccugucuggacaccacaaagaugccac

SEQ ID NO: 420055 - RNA, 21 nt, Human
gaccaccuguggccucuccaa

SEQ ID NO: 420056 - RNA, 32 nt, Human
gaccaccuuggcaacacagugagacccugucu

SEQ ID NO: 420057 - RNA, 32 nt, Human
gaccaccuuuugaagagcucaaaggagaauau

SEQ ID NO: 420058 - RNA, 17 nt, Human
gaccacgaaagggaguc

SEQ ID NO: 420059 - RNA, 20 nt, Human
gaccacgaccacaccacagg

SEQ ID NO: 420060 - RNA, 32 nt, Human
gaccacgagcuggccuucucucgucugaucgu

SEQ ID NO: 420061 - RNA, 32 nt, Human
gaccacgauuccugaugcauuacugugagaag

SEQ ID NO: 420062 - RNA, 32 nt, Human
gaccacgccacugcacuccagcccgggugaca

SEQ ID NO: 420063 - RNA, 32 nt, Human
gaccacgccauugcacuccagccugggugaca

SEQ ID NO: 420064 - RNA, 32 nt, Human
gaccacgccauugcacuccagcuugggcaaua

SEQ ID NO: 420065 - RNA, 20 nt, Human
gaccacgccccugccugaga

SEQ ID NO: 420066 - RNA, 32 nt, Human
gaccacgcccuuuaaccuagaccugccuguga

SEQ ID NO: 420067 - RNA, 22 nt, Human
gaccacgccgauugcugagagg

SEQ ID NO: 420068 - RNA, 32 nt, Human
gaccacgcucgacuaauuuuuguauuuuuggu

SEQ ID NO: 420069 - RNA, 32 nt, Human
gaccacggagagaaagccgggacuugaggugg

SEQ ID NO: 420070 - RNA, 32 nt, Human
gaccacggcucacauccuccugggugaagaau

SEQ ID NO: 420071 - RNA, 32 nt, Human
gaccacgggaggcccaggugcggagaggaggc

SEQ ID NO: 420072 - RNA, 19 nt, Human
gaccacgggcacccagaga

SEQ ID NO: 420073 - RNA, 19 nt, Human
gaccacggugaaaccccgu

SEQ ID NO: 420074 - RNA, 32 nt, Human
gaccacguggccuccgagcagcucagggcgcc

SEQ ID NO: 420075 - RNA, 32 nt, Human
gaccacgugggaacagccugcagugagcggug

SEQ ID NO: 420076 - RNA, 32 nt, Human
gaccacguugcugcccaggucuggaccucagc

SEQ ID NO: 420077 - RNA, 32 nt, Human
gaccacuacagcuggacgggcaauggcggguc

SEQ ID NO: 420078 - RNA, 32 nt, Human
gaccacuaggagagcggacggaggcggcgccu

SEQ ID NO: 420079 - RNA, 32 nt, Human
gaccacuauacuccagccuggcaacagagcaa

SEQ ID NO: 420080 - RNA, 32 nt, Human
gaccacuaucuacacauuuauuccccaaauac

SEQ ID NO: 420081 - RNA, 32 nt, Human
gaccacucauuucccaucaugacacugcuguu

SEQ ID NO: 420082 - RNA, 32 nt, Human
gaccacuccccuggcacuguuacuugccucug

SEQ ID NO: 420083 - RNA, 32 nt, Human
gaccacucgggccaagaauuccugccuaaaug

SEQ ID NO: 420084 - RNA, 32 nt, Human
gaccacucugccccagcggucgucacagaaag

SEQ ID NO: 420085 - RNA, 31 nt, Human
gaccacugacuucuccugaccugagggcccu

SEQ ID NO: 420086 - RNA, 32 nt, Human
gaccacugcagccuccaccuccuaggcucaag

SEQ ID NO: 420087 - RNA, 32 nt, Human
gaccacugccaaggagccuauccgaauuugua

SEQ ID NO: 420088 - RNA, 32 nt, Human
gaccacugccaaggagccuaucugaauuugua

SEQ ID NO: 420089 - RNA, 32 nt, Human
gaccacugcccgcccauucaccuuauaugccu

SEQ ID NO: 420090 - RNA, 32 nt, Human
gaccacugcccuccagccugggcaauagagca

SEQ ID NO: 420091 - RNA, 32 nt, Human
gaccacugcucaccgacuucagacuccaguuu

SEQ ID NO: 420092 - RNA, 32 nt, Human
gaccacugcucuccagccugggcaacagagua

SEQ ID NO: 420093 - RNA, 29 nt, Human
gaccacuggcugcugaaauacuuuucuug

SEQ ID NO: 420094 - RNA, 32 nt, Human
gaccacugggaggggagugguggacacccagc

SEQ ID NO: 420095 - RNA, 32 nt, Human
gaccacuggggucucccacaagguggggucag

SEQ ID NO: 420096 - RNA, 23 nt, Human
gaccacuguauguuuacuucuca

SEQ ID NO: 420097 - RNA, 32 nt, Human
gaccacuguggacucuaaacugcacuugucuc

SEQ ID NO: 420098 - RNA, 18 nt, Human
gaccacuguucuccagca

SEQ ID NO: 420099 - RNA, 32 nt, Human
gaccacuuaauugcuuuccugccuccuugaaa

SEQ ID NO: 420100 - RNA, 32 nt, Human
gaccacuuauacugucugucugaggcagaaga

SEQ ID NO: 420101 - RNA, 32 nt, Human
gaccacuugcccacccuccugcccaccauaug

SEQ ID NO: 420102 - RNA, 32 nt, Human
gaccacuuggaaauaaaccauuggacagauuu

SEQ ID NO: 420103 - RNA, 32 nt, Human
gaccacuugggcucuguuuucucagcuccaau

SEQ ID NO: 420104 - RNA, 32 nt, Human
gaccacuuggguccccagagcuggggagaugg

SEQ ID NO: 420105 - RNA, 32 nt, Human
gaccacuuugccuuguagcuuuuucuaucuuu

SEQ ID NO: 420106 - RNA, 32 nt, Human
gaccacuuuucccacuaccugcagccuuuuau

SEQ ID NO: 420107 - RNA, 32 nt, Human
gaccagaaacaccucccuucuccaacaaaagg

SEQ ID NO: 420108 - RNA, 32 nt, Human
gaccagaaacucaagagauaggguagccaugu

SEQ ID NO: 420109 - RNA, 32 nt, Human
gaccagaaauuacccacccaaccaggcucagg

SEQ ID NO: 420110 - RNA, 19 nt, Human
gaccagaaccugcuugcug

SEQ ID NO: 420111 - RNA, 32 nt, Human
gaccagaagcagcugcgcuacacggaggaacu

SEQ ID NO: 420112 - RNA, 23 nt, Human
gaccagaagcccagcagaugcca

SEQ ID NO: 420113 - RNA, 32 nt, Human
gaccagaagcugaggcccucucagggaggaga

SEQ ID NO: 420114 - RNA, 32 nt, Human
gaccagaaguagcugggauuuguuugcaaauu

SEQ ID NO: 420115 - RNA, 32 nt, Human
gaccagaagugcugaugaccucagggaaaaag

SEQ ID NO: 420116 - RNA, 32 nt, Human
gaccagaaucccagggacagaggacuggguag

SEQ ID NO: 420117 - RNA, 32 nt, Human
gaccagaaucugccauggcaacaggcuuuaaa

SEQ ID NO: 420118 - RNA, 20 nt, Human
gaccagacaagaaaaggauu

SEQ ID NO: 420119 - RNA, 19 nt, Human
gaccagacaccuguuugau

SEQ ID NO: 420120 - RNA, 20 nt, Human
gaccagacagucaaggugau

SEQ ID NO: 420121 - RNA, 32 nt, Human
gaccagacauuaugggccuggaaguacuauag

SEQ ID NO: 420122 - RNA, 32 nt, Human
gaccagaccagagggaucggaggcucaggccc

SEQ ID NO: 420123 - RNA, 32 nt, Human
gaccagaccugacacacagauaccucacucau

SEQ ID NO: 420124 - RNA, 22 nt, Human
gaccagacgugaugcuggaagg

SEQ ID NO: 420125 - RNA, 32 nt, Human
gaccagacugacugcacaggagcagguggagg

SEQ ID NO: 420126 - RNA, 32 nt, Human
gaccagacugccagccugugccagucugaccu

SEQ ID NO: 420127 - RNA, 32 nt, Human
gaccagacuggcaacauagugagacccugucu

SEQ ID NO: 420128 - RNA, 32 nt, Human
gaccagagacccaguggggaguuaccgucuga

SEQ ID NO: 420129 - RNA, 32 nt, Human
gaccagagagcaccuugcccuuccauggaaac

SEQ ID NO: 420130 - RNA, 32 nt, Human
gaccagagaggaccguucugcuggacgccuac

SEQ ID NO: 420131 - RNA, 32 nt, Human
gaccagagccagccagcagcaaaaagagcaug

SEQ ID NO: 420132 - RNA, 32 nt, Human
gaccagagcgguaucucuggcaccacacuagg

SEQ ID NO: 420133 - RNA, 32 nt, Human
gaccagaggagagcaugagggguggggcuuug

SEQ ID NO: 420134 - RNA, 32 nt, Human
gaccagaggcagcugccaccgugcccucagcc

SEQ ID NO: 420135 - RNA, 32 nt, Human
gaccagaggcuggaguggggguguguuauagc

SEQ ID NO: 420136 - RNA, 32 nt, Human
gaccagagggaggaggccgggagcagcgaccu

SEQ ID NO: 420137 - RNA, 32 nt, Human
gaccagagggcuaguguggggucauggcccau

SEQ ID NO: 420138 - RNA, 32 nt, Human
gaccagaggguaagauggguuauggagauggu

SEQ ID NO: 420139 - RNA, 32 nt, Human
gaccagaggucccuguggcuacaguagcgcag

SEQ ID NO: 420140 - RNA, 32 nt, Human
gaccagagugccaggagcuaauggagccaggc

SEQ ID NO: 420141 - RNA, 32 nt, Human
gaccagaguggaccagcacaccccaggagaga

SEQ ID NO: 420142 - RNA, 32 nt, Human
gaccagagugggcaauggagguggucagaaau

SEQ ID NO: 420143 - RNA, 32 nt, Human
gaccagaugcaacuaauauaucugccaaauug

SEQ ID NO: 420144 - RNA, 32 nt, Human
gaccagaugcuuuugguuguuguauuucacaa

SEQ ID NO: 420145 - RNA, 28 nt, Human
gaccagauguguccugccucaucccuag

SEQ ID NO: 420146 - RNA, 32 nt, Human
gaccagauugccuggguggaaggccaugaacc

SEQ ID NO: 420147 - RNA, 32 nt, Human
gaccagcaaccaggcccugcugcagcuugagg

SEQ ID NO: 420148 - RNA, 32 nt, Human
gaccagcaauuaaaagcaacacuggcucuugc

SEQ ID NO: 420149 - RNA, 32 nt, Human
gaccagcacaguggaggccccaggcaacagag

SEQ ID NO: 420150 - RNA, 32 nt, Human
gaccagcagaacuguaccuguugggcacuuuu

SEQ ID NO: 420151 - RNA, 32 nt, Human
gaccagcagacuaauggggaugagguacuguu

SEQ ID NO: 420152 - RNA, 32 nt, Human
gaccagcagagggagggaucaggcagcagugu

SEQ ID NO: 420153 - RNA, 22 nt, Human
gaccagcagcaagggccgagcg

SEQ ID NO: 420154 - RNA, 32 nt, Human
gaccagcagccugacuugacuuuugaguccua

SEQ ID NO: 420155 - RNA, 32 nt, Human
gaccagcagcgaaaaagcuggccacacacugu

SEQ ID NO: 420156 - RNA, 23 nt, Human
gaccagcagcgacugcggagcga

SEQ ID NO: 420157 - RNA, 21 nt, Human
gaccagcagcggucuagagga

SEQ ID NO: 420158 - RNA, 32 nt, Human
gaccagcaucuccagaccccagccuuucuccu

SEQ ID NO: 420159 - RNA, 32 nt, Human
gaccagcaugguggaacccccaucucuacuaa

SEQ ID NO: 420160 - RNA, 32 nt, Human
gaccagcauguucuccccaaagaccaagauau

SEQ ID NO: 420161 - RNA, 32 nt, Human
gaccagcauguucuccccaaagaccagaauau

SEQ ID NO: 420162 - RNA, 32 nt, Human
gaccagcauuuaaccaaccuaagggcccaaag

SEQ ID NO: 420163 - RNA, 32 nt, Human
gaccagccacagaacuuccucccacuuauccc

SEQ ID NO: 420164 - RNA, 32 nt, Human
gaccagccacugcuccuugggccugcagggac

SEQ ID NO: 420165 - RNA, 18 nt, Human
gaccagccacuguugcug

SEQ ID NO: 420166 - RNA, 32 nt, Human
gaccagccagggaggcagcagaggcuggaacc

SEQ ID NO: 420167 - RNA, 32 nt, Human
gaccagccaucuccauuuuauaaauaagaaaa

SEQ ID NO: 420168 - RNA, 32 nt, Human
gaccagccaucuugcaaccucaccucacagca

SEQ ID NO: 420169 - RNA, 32 nt, Human
gaccagcccagccugcauacuugccacuuggc

SEQ ID NO: 420170 - RNA, 32 nt, Human
gaccagcccagccuggucaacauggcaaaacc

SEQ ID NO: 420171 - RNA, 32 nt, Human
gaccagccccaggccaagcaaaaagaaagccc

SEQ ID NO: 420172 - RNA, 32 nt, Human
gaccagccccugagccucccgggugcuggcag

SEQ ID NO: 420173 - RNA, 32 nt, Human
gaccagccccuggggcuggcagggaggagcuc

SEQ ID NO: 420174 - RNA, 24 nt, Human
gaccagccccuuccaacccaguca

SEQ ID NO: 420175 - RNA, 32 nt, Human
gaccagcccugccucuuucauuuccagaccuu

SEQ ID NO: 420176 - RNA, 32 nt, Human
gaccagccucaacauggagaaaccccaucucu

SEQ ID NO: 420177 - RNA, 32 nt, Human
gaccagccucaacauggagaaaccccgucucu

SEQ ID NO: 420178 - RNA, 32 nt, Human
gaccagccuccacccccacuccagccucagcg

SEQ ID NO: 420179 - RNA, 32 nt, Human
gaccagccuccugggacugugacugcuuuuga

SEQ ID NO: 420180 - RNA, 32 nt, Human
gaccagccucuaccuccagauccagggaggcc

SEQ ID NO: 420181 - RNA, 19 nt, Human
gaccagccuggccaacaua

SEQ ID NO: 420182 - RNA, 32 nt, Human
gaccagccuggccaaccaacauggugaaaccc

SEQ ID NO: 420183 - RNA, 32 nt, Human
gaccagccuggccaaccaacauggugaaaccu

SEQ ID NO: 420184 - RNA, 32 nt, Human
gaccagccuggccaauacaaaaauuagccggg

SEQ ID NO: 420185 - RNA, 19 nt, Human
gaccagccugggaaacaua

SEQ ID NO: 420186 - RNA, 32 nt, Human
gaccagccugggagacagagcauggaaaccua

SEQ ID NO: 420187 - RNA, 19 nt, Human
gaccagccugggcaacaca

SEQ ID NO: 420188 - RNA, 19 nt, Human
gaccagccuggguaacaua

SEQ ID NO: 420189 - RNA, 19 nt, Human
gaccagccugguaccagga

SEQ ID NO: 420190 - RNA, 32 nt, Human
gaccagccuggugccuuggcaucucccaaugg

SEQ ID NO: 420191 - RNA, 32 nt, Human
gaccagccuugcagccuccagguccggugggg

SEQ ID NO: 420192 - RNA, 32 nt, Human
gaccagcggcugaggccaggaugccguccagg

SEQ ID NO: 420193 - RNA, 32 nt, Human
gaccagcuacccacagcaaccaaagagacuuc

SEQ ID NO: 420194 - RNA, 32 nt, Human
gaccagcuaggcucucccaggugcaauguggg

SEQ ID NO: 420195 - RNA, 32 nt, Human
gaccagcuaguuugggagguggcggcagaaua

SEQ ID NO: 420196 - RNA, 21 nt, Human
gaccagcucaaacgggagcca

SEQ ID NO: 420197 - RNA, 19 nt, Human
gaccagcucagagauguua

SEQ ID NO: 420198 - RNA, 23 nt, Human
gaccagcucagccugccucccca

SEQ ID NO: 420199 - RNA, 21 nt, Human
gaccagcucagcgaggagcca

SEQ ID NO: 420200 - RNA, 22 nt, Human
gaccagcucaggacagaugcca

SEQ ID NO: 420201 - RNA, 32 nt, Human
gaccagcucccaguaaaaaccccaggcacuca

SEQ ID NO: 420202 - RNA, 18 nt, Human
gaccagcuccuccaguca

SEQ ID NO: 420203 - RNA, 32 nt, Human
gaccagcugcugcagaagcucagggccagucg

SEQ ID NO: 420204 - RNA, 32 nt, Human
gaccagcugcuggccacauuuccugcuuuauu

SEQ ID NO: 420205 - RNA, 32 nt, Human
gaccagcuggccgcccgcgacucccucaucgc

SEQ ID NO: 420206 - RNA, 32 nt, Human
gaccagcugggcaccauagugagacccuaucu

SEQ ID NO: 420207 - RNA, 32 nt, Human
gaccagcuguagcucauuccagccuguaccuu

SEQ ID NO: 420208 - RNA, 32 nt, Human
gaccagcuucaaggagcggaaggcuggcuuga

SEQ ID NO: 420209 - RNA, 32 nt, Human
gaccagcuucuuuuucuugcaguuacagaugu

SEQ ID NO: 420210 - RNA, 32 nt, Human
gaccagcuuggugaaacccugucucuacuaaa

SEQ ID NO: 420211 - RNA, 32 nt, Human
gaccagcuuguacuugaagaucuagguuuugg

SEQ ID NO: 420212 - RNA, 24 nt, Human
gaccagcuuugcagccagaagcca

SEQ ID NO: 420213 - RNA, 32 nt, Human
gaccaggaaagccgaaggcggagcagcuggag

SEQ ID NO: 420214 - RNA, 32 nt, Human
gaccaggacagaaccacaggcacacacugagg

SEQ ID NO: 420215 - RNA, 32 nt, Human
gaccaggacuacauuucccaagaggcucugcu

SEQ ID NO: 420216 - RNA, 32 nt, Human
gaccaggagcaaugugcagccuccucuccccc

SEQ ID NO: 420217 - RNA, 32 nt, Human
gaccaggagcaucuggaccaucgaccuggccu

SEQ ID NO: 420218 - RNA, 32 nt, Human
gaccaggagccuccauauccugacugaaaacc

SEQ ID NO: 420219 - RNA, 32 nt, Human
gaccaggaggaaccugacucagaugcugaggu

SEQ ID NO: 420220 - RNA, 32 nt, Human
gaccaggaggacagaguuugcuuucauauuuu

SEQ ID NO: 420221 - RNA, 32 nt, Human
gaccaggaggaggaggaggaggaggaggagag

SEQ ID NO: 420222 - RNA, 32 nt, Human
gaccaggagggcccuggaggcccagccacaga

SEQ ID NO: 420223 - RNA, 32 nt, Human
gaccaggagguugaggcugcagugagccguga

SEQ ID NO: 420224 - RNA, 32 nt, Human
gaccaggaguucgagaagagccugggcaacau

SEQ ID NO: 420225 - RNA, 32 nt, Human
gaccaggaguucgaggcugcagugagccgaga

SEQ ID NO: 420226 - RNA, 32 nt, Human
gaccaggaguuugaggcuucagugagcucuaa

SEQ ID NO: 420227 - RNA, 32 nt, Human
gaccaggaucuaguuucuuucucucuacucug

SEQ ID NO: 420228 - RNA, 32 nt, Human
gaccaggaugccaggagcagagacaggguggc

SEQ ID NO: 420229 - RNA, 32 nt, Human
gaccaggcaaaaaguccauuuugugcucagaa

SEQ ID NO: 420230 - RNA, 32 nt, Human
gaccaggcacuuugaggaagggcaguucgugg

SEQ ID NO: 420231 - RNA, 19 nt, Human
gaccaggcaggcaaaggcc

SEQ ID NO: 420232 - RNA, 32 nt, Human
gaccaggcagggcagagacaauggcugcagga

SEQ ID NO: 420233 - RNA, 32 nt, Human
gaccaggcagucucuaaugaauaggcaaggcc

SEQ ID NO: 420234 - RNA, 32 nt, Human
gaccaggccagccccagugacuccaggcucca

SEQ ID NO: 420235 - RNA, 32 nt, Human
gaccaggcccugcuuaccucuguuuugguuuu

SEQ ID NO: 420236 - RNA, 32 nt, Human
gaccaggccuuucauucugggcucgagaccaa

SEQ ID NO: 420237 - RNA, 23 nt, Human
gaccaggcuacuucuccccuccu

SEQ ID NO: 420238 - RNA, 16 nt, Human
gaccaggcucccagag

SEQ ID NO: 420239 - RNA, 32 nt, Human
gaccaggcucuggaccaugcaggaggaaagaa

SEQ ID NO: 420240 - RNA, 27 nt, Human
gaccaggcugccaggcaccaucugcca

SEQ ID NO: 420241 - RNA, 32 nt, Human
gaccaggcugcuccaucuccgcuaagcccagg

SEQ ID NO: 420242 - RNA, 32 nt, Human
gaccaggcugggaggacagagccagcagcugc

SEQ ID NO: 420243 - RNA, 32 nt, Human
gaccaggcuggguuggggguuggguggggcug

SEQ ID NO: 420244 - RNA, 32 nt, Human
gaccaggcuguccuugaccugcagagaugugu

SEQ ID NO: 420245 - RNA, 32 nt, Human
gaccaggcuuccaaugacuaggucaccagguc

SEQ ID NO: 420246 - RNA, 32 nt, Human
gaccaggcuuccagcuccucugcaccagaccu

SEQ ID NO: 420247 - RNA, 32 nt, Human
gaccagggaccaggccagggugcgggcaggca

SEQ ID NO: 420248 - RNA, 17 nt, Human
gaccagggaccaggcug

SEQ ID NO: 420249 - RNA, 22 nt, Human
gaccagggcagcugcacacuua

SEQ ID NO: 420250 - RNA, 20 nt, Human
gaccagggccaugggucuga

SEQ ID NO: 420251 - RNA, 32 nt, Human
gaccagggcccggcgugguggaucaugccugu

SEQ ID NO: 420252 - RNA, 32 nt, Human
gaccagggccgugcccgcaucuuccuaaggca

SEQ ID NO: 420253 - RNA, 32 nt, Human
gaccagggcuggccagccccuuccgcagccuc

SEQ ID NO: 420254 - RNA, 32 nt, Human
gaccagggcuugucuccuccuggacuugggcc

SEQ ID NO: 420255 - RNA, 32 nt, Human
gaccaggggccagccagugucugaccaagguc

SEQ ID NO: 420256 - RNA, 32 nt, Human
gaccaggggcuuguugagagcugagccaugca

SEQ ID NO: 420257 - RNA, 32 nt, Human
gaccagggggagacuccuggccucagccagug

SEQ ID NO: 420258 - RNA, 32 nt, Human
gaccagggguucagaggagacuauuuacccuu

SEQ ID NO: 420259 - RNA, 32 nt, Human
gaccaggguggagcugagaagaggaggaggug

SEQ ID NO: 420260 - RNA, 32 nt, Human
gaccaggguugcugccccaacugcugccacuc

SEQ ID NO: 420261 - RNA, 32 nt, Human
gaccagguagccgaggacagugaggcaugucu

SEQ ID NO: 420262 - RNA, 32 nt, Human
gaccagguaggaggaggagagggaguagaaag

SEQ ID NO: 420263 - RNA, 32 nt, Human
gaccaggucaccgacgaugagggcgcaccugc

SEQ ID NO: 420264 - RNA, 32 nt, Human
gaccaggucccuagguucacaugcccccuaca

SEQ ID NO: 420265 - RNA, 32 nt, Human
gaccaggucucccaucuccuacuuuaugacgc

SEQ ID NO: 420266 - RNA, 32 nt, Human
gaccaggucuuguuucucucucugugcuacca

SEQ ID NO: 420267 - RNA, 32 nt, Human
gaccagguggaggaagucaccuacgacguggc

SEQ ID NO: 420268 - RNA, 32 nt, Human
gaccaggugguggccagagaggcuccaggggc

SEQ ID NO: 420269 - RNA, 32 nt, Human
gaccagguuguggcagaggauucuguguuccu

SEQ ID NO: 420270 - RNA, 32 nt, Human
gaccagucacauagaugaaccaccaacacaaa

SEQ ID NO: 420271 - RNA, 32 nt, Human
gaccagucccugcccauggccaucuggauggu

SEQ ID NO: 420272 - RNA, 32 nt, Human
gaccaguccuuucugggaccucaaugggucac

SEQ ID NO: 420273 - RNA, 32 nt, Human
gaccagucuucaguauaaucucagccagaaaa

SEQ ID NO: 420274 - RNA, 32 nt, Human
gaccagugauuucagcucucacucccuucuca

SEQ ID NO: 420275 - RNA, 32 nt, Human
gaccagugcauccucaagcucugcuccuucag

SEQ ID NO: 420276 - RNA, 32 nt, Human
gaccagugccugccaaccagauguuacugguc

SEQ ID NO: 420277 - RNA, 32 nt, Human
gaccagugcucuucaggaauguggcugcaagc

SEQ ID NO: 420278 - RNA, 32 nt, Human
gaccaguggcaaagaaacuccuuucauuuugu

SEQ ID NO: 420279 - RNA, 32 nt, Human
gaccaguggcugggagccccacacagaugcug

SEQ ID NO: 420280 - RNA, 32 nt, Human
gaccaguguaauagucacagacuugcauccug

SEQ ID NO: 420281 - RNA, 32 nt, Human
gaccaguguugcccgaggaggggccggccugc

SEQ ID NO: 420282 - RNA, 32 nt, Human
gaccaguucugagugagaaucagacuugcccc

SEQ ID NO: 420283 - RNA, 32 nt, Human
gaccaguuggcaaacccaaguaacaaaucagc

SEQ ID NO: 420284 - RNA, 32 nt, Human
gaccaguuugauugaggagcugcacugaucac

SEQ ID NO: 420285 - RNA, 32 nt, Human
gaccaguuugccuccuucccugccuuaaaagc

SEQ ID NO: 420286 - RNA, 32 nt, Human
gaccauaagacauauuuuauguccuuuugcca

SEQ ID NO: 420287 - RNA, 32 nt, Human
gaccauaagacauauuuuauguccuuuugccg

SEQ ID NO: 420288 - RNA, 32 nt, Human
gaccauaccacugcauuccagccugggugaca

SEQ ID NO: 420289 - RNA, 32 nt, Human
gaccauaccagugcauuccagccuggguacac

SEQ ID NO: 420290 - RNA, 32 nt, Human
gaccauacugaccacaaaugauauugucauua

SEQ ID NO: 420291 - RNA, 24 nt, Human
gaccauacuuugagaacccauggg

SEQ ID NO: 420292 - RNA, 32 nt, Human
gaccauagaguccucucucugccucuauccca

SEQ ID NO: 420293 - RNA, 32 nt, Human
gaccauaggagagaugugggaggcucaguucc

SEQ ID NO: 420294 - RNA, 32 nt, Human
gaccauauauggacguggguuggcaauaagag

SEQ ID NO: 420295 - RNA, 32 nt, Human
gaccauauuuacucuuucuaacuuucuuuacu

SEQ ID NO: 420296 - RNA, 32 nt, Human
gaccaucaagugggaagaugugauuugucuug

SEQ ID NO: 420297 - RNA, 32 nt, Human
gaccaucacaugccuccccucaaucacagguu

SEQ ID NO: 420298 - RNA, 32 nt, Human
gaccaucaccucccaguagcaauuugcuuuca

SEQ ID NO: 420299 - RNA, 32 nt, Human
gaccaucaccugcccaccuaagcccacggugc

SEQ ID NO: 420300 - RNA, 32 nt, Human
gaccaucacuacuaauuccagaccauuuccau

SEQ ID NO: 420301 - RNA, 32 nt, Human
gaccaucagccagcaagaguuuggccgcacug

SEQ ID NO: 420302 - RNA, 32 nt, Human
gaccaucauggugaaaccucaucuccgcuaaa

SEQ ID NO: 420303 - RNA, 32 nt, Human
gaccaucauuaaauguguacugugaagagauu

SEQ ID NO: 420304 - RNA, 32 nt, Human
gaccauccaacauuaaaaacugcugauagaag

SEQ ID NO: 420305 - RNA, 32 nt, Human
gaccaucccaggaaguugugggguuggggagg

SEQ ID NO: 420306 - RNA, 32 nt, Human
gaccaucccccaaacucuacucuuauacccag

SEQ ID NO: 420307 - RNA, 32 nt, Human
gaccaucccccuccagccccacugccugccca

SEQ ID NO: 420308 - RNA, 32 nt, Human
gaccauccucacccuguguuugcuuuguucca

SEQ ID NO: 420309 - RNA, 32 nt, Human
gaccauccugcccggaccacagaaggagaguu

SEQ ID NO: 420310 - RNA, 32 nt, Human
gaccauccugguucacccagaauugcaccaaa

SEQ ID NO: 420311 - RNA, 32 nt, Human
gaccaucgacuuggccagugagacugagaaug

SEQ ID NO: 420312 - RNA, 32 nt, Human
gaccaucuaggagaggggagggcagagggggu

SEQ ID NO: 420313 - RNA, 32 nt, Human
gaccaucuagggucaguaccugcugggcuuag

SEQ ID NO: 420314 - RNA, 32 nt, Human
gaccaucucacugccuaccguuuccuuuuucc

SEQ ID NO: 420315 - RNA, 32 nt, Human
gaccaucucguccuuuuuguaucgcggaaacc

SEQ ID NO: 420316 - RNA, 32 nt, Human
gaccaucucugccucugccuuccccugcuccu

SEQ ID NO: 420317 - RNA, 32 nt, Human
gaccaucucuguccccuccacccucacuccau

SEQ ID NO: 420318 - RNA, 32 nt, Human
gaccaucugccagcuucucucguuccgucgau

SEQ ID NO: 420319 - RNA, 32 nt, Human
gaccaugaagaaaaauggggagaaaagaacaa

SEQ ID NO: 420320 - RNA, 32 nt, Human
gaccaugacuaccuucaccuggaacaucaacc

SEQ ID NO: 420321 - RNA, 22 nt, Human
gaccaugagagauaaggacuga

SEQ ID NO: 420322 - RNA, 32 nt, Human
gaccaugagcuucuccuccucauccucccagc

SEQ ID NO: 420323 - RNA, 29 nt, Human
gaccaugaguuggauuccuuuuaagauug

SEQ ID NO: 420324 - RNA, 32 nt, Human
gaccaugcacaguacacauacgugcauacaca

SEQ ID NO: 420325 - RNA, 32 nt, Human
gaccaugcacagugccuggggcggaaggagga

SEQ ID NO: 420326 - RNA, 32 nt, Human
gaccaugcagaucacugucaguggagggaagc

SEQ ID NO: 420327 - RNA, 32 nt, Human
gaccaugcaguggauucugacuggccuucaaa

SEQ ID NO: 420328 - RNA, 32 nt, Human
gaccaugccacugcacuccagccugggcaaca

SEQ ID NO: 420329 - RNA, 32 nt, Human
gaccaugccacugcacuccggccugggugaca

SEQ ID NO: 420330 - RNA, 32 nt, Human
gaccaugccauugcacuccagccugggcgaca

SEQ ID NO: 420331 - RNA, 32 nt, Human
gaccaugccauuggacuccagccugggcaaaa

SEQ ID NO: 420332 - RNA, 32 nt, Human
gaccaugcccacuuaauuuuuguauuuuuagg

SEQ ID NO: 420333 - RNA, 32 nt, Human
gaccaugccuggcuaauuuuguauuuuuagua

SEQ ID NO: 420334 - RNA, 32 nt, Human
gaccaugccugggaauggagccaccacaucca

SEQ ID NO: 420335 - RNA, 29 nt, Human
gaccaugcugcuguucugccccggcugcg

SEQ ID NO: 420336 - RNA, 32 nt, Human
gaccaugcuggaauuggaugauucugcaauuc

SEQ ID NO: 420337 - RNA, 32 nt, Human
gaccaugcugggaauccagaaacagggacccc

SEQ ID NO: 420338 - RNA, 32 nt, Human
gaccauggaaucaccagcuagagguuauggac

SEQ ID NO: 420339 - RNA, 29 nt, Human
gaccauggaauccagagcugaagggggcu

SEQ ID NO: 420340 - RNA, 32 nt, Human
gaccauggcccuggcccuggcccggcgucgcu

SEQ ID NO: 420341 - RNA, 32 nt, Human
gaccauggccugggugguuaagggagugggac

SEQ ID NO: 420342 - RNA, 32 nt, Human
gaccaugggggaguguggugcagaugggcagg

SEQ ID NO: 420343 - RNA, 32 nt, Human
gaccauggggucuuguguuuccaacuucgaag

SEQ ID NO: 420344 - RNA, 32 nt, Human
gaccaugggugaguuacuuaagccaggcucug

SEQ ID NO: 420345 - RNA, 19 nt, Human
gaccauggugaaaccccgu

SEQ ID NO: 420346 - RNA, 32 nt, Human
gaccaugugcugccgcccaaccugcucuagug

SEQ ID NO: 420347 - RNA, 32 nt, Human
gaccaugugcuguccgcaggccuggaugcccu

SEQ ID NO: 420348 - RNA, 32 nt, Human
gaccaugugucaggaaaauugugaacguagau

SEQ ID NO: 420349 - RNA, 32 nt, Human
gaccaugugucugguuucuggccugccacaac

SEQ ID NO: 420350 - RNA, 32 nt, Human
gaccauguucuccacagugucuccaguggaaa

SEQ ID NO: 420351 - RNA, 32 nt, Human
gaccauguuggccaggcuggucucgaacuccc

SEQ ID NO: 420352 - RNA, 32 nt, Human
gaccauguuggccaggcuggucucgaacuccu

SEQ ID NO: 420353 - RNA, 32 nt, Human
gaccauuagcaggcacccaggccugucuuugg

SEQ ID NO: 420354 - RNA, 32 nt, Human
gaccauuauuacuggugcaaaaugaguugaua

SEQ ID NO: 420355 - RNA, 19 nt, Human
gaccauucaggacacaggg

SEQ ID NO: 420356 - RNA, 32 nt, Human
gaccauuccauucaggagcaaagagcaccaug

SEQ ID NO: 420357 - RNA, 32 nt, Human
gaccauuccucaggaaacuuuguugacagcgg

SEQ ID NO: 420358 - RNA, 19 nt, Human
gaccauuccuuucuucaua

SEQ ID NO: 420359 - RNA, 32 nt, Human
gaccauucuauuguguggaugaccacauaaaa

SEQ ID NO: 420360 - RNA, 19 nt, Human
gaccauugaagaaaaggac

SEQ ID NO: 420361 - RNA, 32 nt, Human
gaccauuggcugcgcuaacccccagcccacag

SEQ ID NO: 420362 - RNA, 32 nt, Human
gaccauuggcuucccucaucugaggcguggga

SEQ ID NO: 420363 - RNA, 32 nt, Human
gaccauugugaaaaugaaacgggaugaccuca

SEQ ID NO: 420364 - RNA, 32 nt, Human
gaccauuuagaggugagaugggcagaugagga

SEQ ID NO: 420365 - RNA, 32 nt, Human
gaccauuuauuauaaagcugcaaagaagcugu

SEQ ID NO: 420366 - RNA, 32 nt, Human
gaccauuuccaggagggucuguccccagaugc

SEQ ID NO: 420367 - RNA, 32 nt, Human
gaccauuucccugaugcucugagcuuaugauc

SEQ ID NO: 420368 - RNA, 32 nt, Human
gaccauuuccuaucugccaggcauuuuucuaa

SEQ ID NO: 420369 - RNA, 22 nt, Human
gaccauuuggcaucggcuccug

SEQ ID NO: 420370 - RNA, 24 nt, Human
gaccauuuugagaucauggaggaa

SEQ ID NO: 420371 - RNA, 32 nt, Human
gacccaaaccagacuguccuggcuauccucuc

SEQ ID NO: 420372 - RNA, 32 nt, Human
gacccaaagcguugggauuacaggcaugagcc

SEQ ID NO: 420373 - RNA, 32 nt, Human
gacccaaagcuuaugaaagaagaacagauauc

SEQ ID NO: 420374 - RNA, 32 nt, Human
gacccaaaggaaauagcaguggggaagcauca

SEQ ID NO: 420375 - RNA, 32 nt, Human
gacccaaaggauaagaaagaaaagagagcuca

SEQ ID NO: 420376 - RNA, 32 nt, Human
gacccaaagugcugggauuacaggugugagcc

SEQ ID NO: 420377 - RNA, 25 nt, Human
gacccaaccagcauucccccuggca

SEQ ID NO: 420378 - RNA, 32 nt, Human
gacccaacucaggccuuggugucccuggacug

SEQ ID NO: 420379 - RNA, 32 nt, Human
gacccaacucucuggggugcucaggggcuugg

SEQ ID NO: 420380 - RNA, 25 nt, Human
gacccaacucuuagagggcacauca

SEQ ID NO: 420381 - RNA, 20 nt, Human
gacccaacugaggacaggga

SEQ ID NO: 420382 - RNA, 23 nt, Human
gacccaacuuuccagaccuucca

SEQ ID NO: 420383 - RNA, 32 nt, Human
gacccaagauugugccacugcacuccacccug

SEQ ID NO: 420384 - RNA, 32 nt, Human
gacccaagcaaucccaaccuggugcuagguca

SEQ ID NO: 420385 - RNA, 24 nt, Human
gacccaagcaccacaucaccgcga

SEQ ID NO: 420386 - RNA, 32 nt, Human
gacccaagcccaggaccuucguggagcugcuu

SEQ ID NO: 420387 - RNA, 22 nt, Human
gacccaagcccugaaggccuga

SEQ ID NO: 420388 - RNA, 32 nt, Human
gacccaaggcaucuugaaucccaucuauaaga

SEQ ID NO: 420389 - RNA, 32 nt, Human
gacccaagugaaauucaucuuugaguugauuc

SEQ ID NO: 420390 - RNA, 32 nt, Human
gacccaaucuccaggaaaacaacacucacaua

SEQ ID NO: 420391 - RNA, 32 nt, Human
gacccaaugcacacaaaacaacccuagagugu

SEQ ID NO: 420392 - RNA, 31 nt, Human
gacccaaugccauuacagaaauuccauuaca

SEQ ID NO: 420393 - RNA, 32 nt, Human
gacccaauggugcuggaaaaaguucaucuauu

SEQ ID NO: 420394 - RNA, 32 nt, Human
gacccaauucaucaacuggaaagcaauucuau

SEQ ID NO: 420395 - RNA, 32 nt, Human
gacccacacagaacaggggcugagggcacuga

SEQ ID NO: 420396 - RNA, 32 nt, Human
gacccacaccuguaaucccagcacuuugggag

SEQ ID NO: 420397 - RNA, 32 nt, Human
gacccacaccuugccgugccccggacuacagc

SEQ ID NO: 420398 - RNA, 32 nt, Human
gacccacacucuggacagucugggacauccag

SEQ ID NO: 420399 - RNA, 32 nt, Human
gacccacagaaaaggagcccauggaacacaag

SEQ ID NO: 420400 - RNA, 32 nt, Human
gacccacagaaaggaggcagcacacagagaaa

SEQ ID NO: 420401 - RNA, 32 nt, Human
gacccacagacuccuggucugagcccaauaaa

SEQ ID NO: 420402 - RNA, 32 nt, Human
gacccacagauggcgucaaugugaacaccucu

SEQ ID NO: 420403 - RNA, 32 nt, Human
gacccacagccagcuuuguuucuugaaugugg

SEQ ID NO: 420404 - RNA, 32 nt, Human
gacccacaggcagaguugacacggaaccccaa

SEQ ID NO: 420405 - RNA, 32 nt, Human
gacccacagguggggaaacugaggcaggaaca

SEQ ID NO: 420406 - RNA, 32 nt, Human
gacccacaguggcugccugccuccgggaggga

SEQ ID NO: 420407 - RNA, 32 nt, Human
gacccacaucugcagugggaaugaagcugaag

SEQ ID NO: 420408 - RNA, 32 nt, Human
gacccacaugccauuuguacugaccccaucac

SEQ ID NO: 420409 - RNA, 32 nt, Human
gacccacauggacuaaaggcaaugccaggagc

SEQ ID NO: 420410 - RNA, 32 nt, Human
gacccacauggagaaacgccaucucuacuaaa

SEQ ID NO: 420411 - RNA, 32 nt, Human
gacccaccaagugcuuuucccaagggucuggg

SEQ ID NO: 420412 - RNA, 32 nt, Human
gacccaccacagugugggcaggcaccauccag

SEQ ID NO: 420413 - RNA, 32 nt, Human
gacccaccaccucuugcacucucgcuuuugga

SEQ ID NO: 420414 - RNA, 32 nt, Human
gacccaccauacccuguguauguaugcauguu

SEQ ID NO: 420415 - RNA, 32 nt, Human
gacccacccaacaaucagagacaugucuggug

SEQ ID NO: 420416 - RNA, 16 nt, Human
gacccaccccaccccc

SEQ ID NO: 420417 - RNA, 32 nt, Human
gacccaccccagcugcugcugccacacucgcg

SEQ ID NO: 420418 - RNA, 32 nt, Human
gacccaccccucuacuccucacccucagcaca

SEQ ID NO: 420419 - RNA, 32 nt, Human
gacccaccccucuccagguuaucccagaaaug

SEQ ID NO: 420420 - RNA, 32 nt, Human
gacccaccuccaggaccucaaggaagugacac

SEQ ID NO: 420421 - RNA, 32 nt, Human
gacccaccuggccccuccucugacacagggcu

SEQ ID NO: 420422 - RNA, 32 nt, Human
gacccaccuuacuggccagucugcauccuugc

SEQ ID NO: 420423 - RNA, 32 nt, Human
gacccaccuuucuccccgccagcugcaucaga

SEQ ID NO: 420424 - RNA, 32 nt, Human
gacccacgaccggcuggucacuugcugccacc

SEQ ID NO: 420425 - RNA, 32 nt, Human
gacccacgcagccacccagccucagcacucau

SEQ ID NO: 420426 - RNA, 32 nt, Human
gacccacgccguggagaggaccagccucaggu

SEQ ID NO: 420427 - RNA, 32 nt, Human
gacccacggacuccuggucuggcccaauaaag

SEQ ID NO: 420428 - RNA, 32 nt, Human
gacccacguagacugcagacccugccacggac

SEQ ID NO: 420429 - RNA, 32 nt, Human
gacccacgugcuccagucccagcuccaaaagc

SEQ ID NO: 420430 - RNA, 32 nt, Human
gacccacuauaccuugcauuugcugaguacac

SEQ ID NO: 420431 - RNA, 32 nt, Human
gacccacuccccucacauuccacaggcccaug

SEQ ID NO: 420432 - RNA, 32 nt, Human
gacccacugcauuccagccuggcgacagagca

SEQ ID NO: 420433 - RNA, 32 nt, Human
gacccacuggagccagccccacccuaggcagg

SEQ ID NO: 420434 - RNA, 22 nt, Human
gacccacuggcuucugcucuca

SEQ ID NO: 420435 - RNA, 32 nt, Human
gacccacuguaacuuagccacugaugaaccuu

SEQ ID NO: 420436 - RNA, 32 nt, Human
gacccagaaacuuuaacaaaaauguggcucau

SEQ ID NO: 420437 - RNA, 32 nt, Human
gacccagaaagagggaacaaugaggaccccuc

SEQ ID NO: 420438 - RNA, 32 nt, Human
gacccagaaggugggguuggcagggggagggu

SEQ ID NO: 420439 - RNA, 19 nt, Human
gacccagaccagccaaaga

SEQ ID NO: 420440 - RNA, 22 nt, Human
gacccagaccagucccaacgcc

SEQ ID NO: 420441 - RNA, 19 nt, Human
gacccagacgaggggaugc

SEQ ID NO: 420442 - RNA, 20 nt, Human
gacccagacggucugugugg

SEQ ID NO: 420443 - RNA, 32 nt, Human
gacccagacucaguuccugaauuucugugacc

SEQ ID NO: 420444 - RNA, 22 nt, Human
gacccagacucuaggaagcugg

SEQ ID NO: 420445 - RNA, 32 nt, Human
gacccagagagaaaggaugcaguucccuccug

SEQ ID NO: 420446 - RNA, 21 nt, Human
gacccagagagcuagggcugg

SEQ ID NO: 420447 - RNA, 32 nt, Human
gacccagagagugugggacuccccgcuucauc

SEQ ID NO: 420448 - RNA, 32 nt, Human
gacccagagccccauccugaugaccucacaga

SEQ ID NO: 420449 - RNA, 32 nt, Human
gacccagaggggcagcgcagggcgcagagcac

SEQ ID NO: 420450 - RNA, 21 nt, Human
gacccagaggugccccuuccu

SEQ ID NO: 420451 - RNA, 22 nt, Human
gacccagagguggaggccacgg

SEQ ID NO: 420452 - RNA, 32 nt, Human
gacccagagugccuacccucgccugccugggc

SEQ ID NO: 420453 - RNA, 32 nt, Human
gacccagaugguauuggacacagugccccgcu

SEQ ID NO: 420454 - RNA, 23 nt, Human
gacccagcaacaugcuuuaaccc

SEQ ID NO: 420455 - RNA, 32 nt, Human
gacccagcaacugcuucucucccuucucucuc

SEQ ID NO: 420456 - RNA, 32 nt, Human
gacccagcaccaacauuagcacuugaagaacu

SEQ ID NO: 420457 - RNA, 19 nt, Human
gacccagcagcaucaagcc

SEQ ID NO: 420458 - RNA, 24 nt, Human
gacccagcaggaggacccaacgcu

SEQ ID NO: 420459 - RNA, 32 nt, Human
gacccagcaguuuccucugcucacucuuuucc

SEQ ID NO: 420460 - RNA, 32 nt, Human
gacccagcaucugaguuagguuccagcaugua

SEQ ID NO: 420461 - RNA, 32 nt, Human
gacccagccagccggguccugcuggucccuac

SEQ ID NO: 420462 - RNA, 20 nt, Human
gacccagccagggcuggcug

SEQ ID NO: 420463 - RNA, 32 nt, Human
gacccagccagucucauccagcagguuggguu

SEQ ID NO: 420464 - RNA, 23 nt, Human
gacccagcccagccugagcccca

SEQ ID NO: 420465 - RNA, 32 nt, Human
gacccagcccccauggcuucagaagagcuaca

SEQ ID NO: 420466 - RNA, 32 nt, Human
gacccagcccccauggcuucagaagaggaugg

SEQ ID NO: 420467 - RNA, 32 nt, Human
gacccagcccgagauggaguacgacugugaga

SEQ ID NO: 420468 - RNA, 32 nt, Human
gacccagccgcuggcucccagccuggcugaag

SEQ ID NO: 420469 - RNA, 32 nt, Human
gacccagccuccuguuuaauaggcugagccca

SEQ ID NO: 420470 - RNA, 17 nt, Human
gacccagccuugcacuc

SEQ ID NO: 420471 - RNA, 32 nt, Human
gacccagcucacuggucagccuacacaugucu

SEQ ID NO: 420472 - RNA, 32 nt, Human
gacccagcugccucuuacgguuugguauggga

SEQ ID NO: 420473 - RNA, 32 nt, Human
gacccagcuguagugagguugcagugauugag

SEQ ID NO: 420474 - RNA, 32 nt, Human
gacccaggaagcggagguugcagugagccaag

SEQ ID NO: 420475 - RNA, 32 nt, Human
gacccaggaccagcaacccgcgaccaaucaug

SEQ ID NO: 420476 - RNA, 32 nt, Human
gacccaggacugauguggaccaggaaggacag

SEQ ID NO: 420477 - RNA, 32 nt, Human
gacccaggagccaagagaaggcugaagccagc

SEQ ID NO: 420478 - RNA, 32 nt, Human
gacccaggaggcagagcuugcagugagccgag

SEQ ID NO: 420479 - RNA, 23 nt, Human
gacccaggaggcagagguugcag

SEQ ID NO: 420480 - RNA, 26 nt, Human
gacccaggaggcagagguugcaguga

SEQ ID NO: 420481 - RNA, 32 nt, Human
gacccaggaggcagagguugcagugagccaag

SEQ ID NO: 420482 - RNA, 32 nt, Human
gacccaggaggcggagguugcggugacccucc

SEQ ID NO: 420483 - RNA, 32 nt, Human
gacccaggagguggaggucgcagugagccgag

SEQ ID NO: 420484 - RNA, 32 nt, Human
gacccaggauuuagggucacaugcugcaggca

SEQ ID NO: 420485 - RNA, 32 nt, Human
gacccaggcagcccggguccccgccucccgga

SEQ ID NO: 420486 - RNA, 32 nt, Human
gacccaggcagcccuggugaggccgcaggagu

SEQ ID NO: 420487 - RNA, 32 nt, Human
gacccaggcagugucagcagugaagguucucg

SEQ ID NO: 420488 - RNA, 32 nt, Human
gacccaggcaucuggggagccacagaagucgu

SEQ ID NO: 420489 - RNA, 20 nt, Human
gacccaggcccaagagaccc

SEQ ID NO: 420490 - RNA, 32 nt, Human
gacccaggccuucugggcucugucccccgcac

SEQ ID NO: 420491 - RNA, 32 nt, Human
gacccaggcucugaagauucccagaagccaca

SEQ ID NO: 420492 - RNA, 32 nt, Human
gacccaggcugcgggacgcggugcaggcugcg

SEQ ID NO: 420493 - RNA, 32 nt, Human
gacccagggaaagggaagcaggguaggagucc

SEQ ID NO: 420494 - RNA, 32 nt, Human
gacccagggaacuggagagagcuccagaaagg

SEQ ID NO: 420495 - RNA, 32 nt, Human
gacccagggaaugggcccagggcaggacccua

SEQ ID NO: 420496 - RNA, 32 nt, Human
gacccagggaggucgaugcugcagugagcuau

SEQ ID NO: 420497 - RNA, 32 nt, Human
gacccagggaggugaagugcacagacucggca

SEQ ID NO: 420498 - RNA, 32 nt, Human
gacccaggucugugggguccagccuggcaaaa

SEQ ID NO: 420499 - RNA, 32 nt, Human
gacccaggugaacacgcugacugugaaccugc

SEQ ID NO: 420500 - RNA, 32 nt, Human
gacccaggugacccagcucugugucauuugga

SEQ ID NO: 420501 - RNA, 32 nt, Human
gacccagguggagguaaggaagagucuggugg

SEQ ID NO: 420502 - RNA, 32 nt, Human
gacccagguggcugggguggcagcugaucaug

SEQ ID NO: 420503 - RNA, 32 nt, Human
gacccaggugggggcuccugcagccacugccc

SEQ ID NO: 420504 - RNA, 32 nt, Human
gacccagucacuucucccaguuuagugauaac

SEQ ID NO: 420505 - RNA, 23 nt, Human
gacccagugaacccaaggccuga

SEQ ID NO: 420506 - RNA, 32 nt, Human
gacccaguuucuuguuaauaagugccaacucc

SEQ ID NO: 420507 - RNA, 32 nt, Human
gacccauaacuucaaacaucugccucagagua

SEQ ID NO: 420508 - RNA, 32 nt, Human
gacccauaccuucuccccacagccucugcuga

SEQ ID NO: 420509 - RNA, 32 nt, Human
gacccauaucuggguggagaaugggugaaaag

SEQ ID NO: 420510 - RNA, 19 nt, Human
gacccaucaccccucuggu

SEQ ID NO: 420511 - RNA, 18 nt, Human
gacccaucaccgguccua

SEQ ID NO: 420512 - RNA, 32 nt, Human
gacccaucacuggaagugggauuugaaaugca

SEQ ID NO: 420513 - RNA, 32 nt, Human
gacccaucaucuucucacccacccucauugca

SEQ ID NO: 420514 - RNA, 32 nt, Human
gacccauccccuuuccaguacacacaccugau

SEQ ID NO: 420515 - RNA, 32 nt, Human
gacccauccucccagccagguuucccuccagc

SEQ ID NO: 420516 - RNA, 32 nt, Human
gacccaucucaacuggcccagcaucccaacuu

SEQ ID NO: 420517 - RNA, 32 nt, Human
gacccaucucacccucucucauuccucaaagc

SEQ ID NO: 420518 - RNA, 32 nt, Human
gacccaucucucuugugcuccagacuucauca

SEQ ID NO: 420519 - RNA, 32 nt, Human
gacccaucuuccuccucugccaccccgaucuu

SEQ ID NO: 420520 - RNA, 16 nt, Human
gacccaucuucugcug

SEQ ID NO: 420521 - RNA, 32 nt, Human
gacccaugaggcagaaaaagccaugggcuagc

SEQ ID NO: 420522 - RNA, 32 nt, Human
gacccaugccacacacaaccagucccgaaaau

SEQ ID NO: 420523 - RNA, 32 nt, Human
gacccaugcgccacguccugggugguggaauc

SEQ ID NO: 420524 - RNA, 32 nt, Human
gacccauggaucugaauaaacauguccuugcu

SEQ ID NO: 420525 - RNA, 32 nt, Human
gacccauggcccugugcagggugcagggugag

SEQ ID NO: 420526 - RNA, 18 nt, Human
gacccaugugcuuccuug

SEQ ID NO: 420527 - RNA, 32 nt, Human
gacccauucagaccccagcgcuccggaaagua

SEQ ID NO: 420528 - RNA, 32 nt, Human
gacccauuccuguuccucuccccaccacuacu

SEQ ID NO: 420529 - RNA, 32 nt, Human
gacccauucuaugccugucucucagggauuaa

SEQ ID NO: 420530 - RNA, 23 nt, Human
gacccauucucaguaaugggaga

SEQ ID NO: 420531 - RNA, 32 nt, Human
gacccauugccucuguuggaagacagaggucc

SEQ ID NO: 420532 - RNA, 32 nt, Human
gacccauugggaccagcccacccggaccuaac

SEQ ID NO: 420533 - RNA, 21 nt, Human
gacccauuuacaaccaucacc

SEQ ID NO: 420534 - RNA, 32 nt, Human
gacccauuuccccagccgugucgucuccagga

SEQ ID NO: 420535 - RNA, 32 nt, Human
gacccauuugggcagacacaggccacggaaac

SEQ ID NO: 420536 - RNA, 32 nt, Human
gaccccaaagagaccgccaucauggacgaccu

SEQ ID NO: 420537 - RNA, 32 nt, Human
gaccccaacaccugcaugcuggguccagagcc

SEQ ID NO: 420538 - RNA, 32 nt, Human
gaccccaaccacgguacucaucaccaccacca

SEQ ID NO: 420539 - RNA, 32 nt, Human
gaccccaaccucuaccgcgugggacagagcaa

SEQ ID NO: 420540 - RNA, 32 nt, Human
gaccccaacuccugccugcccacacugugacu

SEQ ID NO: 420541 - RNA, 32 nt, Human
gaccccaacuucucuuugaucucugaaucccc

SEQ ID NO: 420542 - RNA, 18 nt, Human
gaccccaagcucacccca

SEQ ID NO: 420543 - RNA, 20 nt, Human
gaccccaagucccccacccc

SEQ ID NO: 420544 - RNA, 24 nt, Human
gaccccaaguuucugugcauucag

SEQ ID NO: 420545 - RNA, 32 nt, Human
gaccccaauccugaagaucuggacccgguuuc

SEQ ID NO: 420546 - RNA, 32 nt, Human
gaccccaaucugcuugaaaccugacucugcuu

SEQ ID NO: 420547 - RNA, 19 nt, Human
gaccccacaccccuccuug

SEQ ID NO: 420548 - RNA, 32 nt, Human
gaccccacagcaccugggccagaccaacagcu

SEQ ID NO: 420549 - RNA, 20 nt, Human
gaccccacaggacccaggag

SEQ ID NO: 420550 - RNA, 32 nt, Human
gaccccacauccacccucguucaucaucaucu

SEQ ID NO: 420551 - RNA, 32 nt, Human
gaccccaccacugcacuccagccuggaugaca

SEQ ID NO: 420552 - RNA, 32 nt, Human
gaccccaccacuguugccauggugaccaaacu

SEQ ID NO: 420553 - RNA, 32 nt, Human
gaccccaccauugcacuccaguccgggaaaca

SEQ ID NO: 420554 - RNA, 32 nt, Human
gaccccacccaggcacauuagcgaccaggcuu

SEQ ID NO: 420555 - RNA, 32 nt, Human
gaccccaccucccucccugccugccagcccua

SEQ ID NO: 420556 - RNA, 32 nt, Human
gaccccaccugggaaccuuuuucccucaguua

SEQ ID NO: 420557 - RNA, 32 nt, Human
gaccccacgcgcugccccuuccuggccugacc

SEQ ID NO: 420558 - RNA, 20 nt, Human
gaccccacucccugcucuaa

SEQ ID NO: 420559 - RNA, 32 nt, Human
gaccccacucugucccugucaggaggcucugc

SEQ ID NO: 420560 - RNA, 32 nt, Human
gaccccacugccgccacacagagccacacagu

SEQ ID NO: 420561 - RNA, 19 nt, Human
gaccccacuggccaccccu

SEQ ID NO: 420562 - RNA, 32 nt, Human
gaccccagaaaccaggucacauggaccacagu

SEQ ID NO: 420563 - RNA, 20 nt, Human
gaccccagacaacccacccc

SEQ ID NO: 420564 - RNA, 32 nt, Human
gaccccagagaugcuuagagacaggacaccug

SEQ ID NO: 420565 - RNA, 32 nt, Human
gaccccagagcagcauaaaagccagcacugca

SEQ ID NO: 420566 - RNA, 32 nt, Human
gaccccagagggccagaagaacucaccccagu

SEQ ID NO: 420567 - RNA, 32 nt, Human
gaccccagauucacaucauacuugaaguucau

SEQ ID NO: 420568 - RNA, 32 nt, Human
gaccccagcaaaagaaaaauauugcuguaccu

SEQ ID NO: 420569 - RNA, 32 nt, Human
gaccccagccucccugcccauccuuccacugc

SEQ ID NO: 420570 - RNA, 32 nt, Human
gaccccagccuggguggucacuagaggugcug

SEQ ID NO: 420571 - RNA, 20 nt, Human
gaccccagcgacacagcccc

SEQ ID NO: 420572 - RNA, 21 nt, Human
gaccccagcucaacacgcccc

SEQ ID NO: 420573 - RNA, 32 nt, Human
gaccccagcucugguggcgggcagcagcgccg

SEQ ID NO: 420574 - RNA, 32 nt, Human
gaccccaggaggcagagguugaagugagccag

SEQ ID NO: 420575 - RNA, 32 nt, Human
gaccccaggaggcgaagauugcagugagcuga

SEQ ID NO: 420576 - RNA, 32 nt, Human
gaccccaggagguggacauugcagugagccga

SEQ ID NO: 420577 - RNA, 32 nt, Human
gaccccaggaguucaagaccagccugggcaac

SEQ ID NO: 420578 - RNA, 32 nt, Human
gaccccaggcagcagcgagugacaggacgucu

SEQ ID NO: 420579 - RNA, 32 nt, Human
gaccccaggcagcucgagcaugcccugagcuc

SEQ ID NO: 420580 - RNA, 24 nt, Human
gaccccaggccccuucccccagca

SEQ ID NO: 420581 - RNA, 32 nt, Human
gaccccaggcccugugcauguccccaguggag

SEQ ID NO: 420582 - RNA, 32 nt, Human
gaccccaggccuggcuguccgcagggccagga

SEQ ID NO: 420583 - RNA, 32 nt, Human
gaccccagggcuguggggacuugggggacagu

SEQ ID NO: 420584 - RNA, 32 nt, Human
gaccccaggucauuugugaccacacaccuggu

SEQ ID NO: 420585 - RNA, 32 nt, Human
gaccccaggugguggagguugcagugagccaa

SEQ ID NO: 420586 - RNA, 32 nt, Human
gaccccagucaccacauccuucugccugggug

SEQ ID NO: 420587 - RNA, 32 nt, Human
gaccccaguucgccgacuaagcagaagaaaga

SEQ ID NO: 420588 - RNA, 32 nt, Human
gaccccauauccacugguagccaccuccccau

SEQ ID NO: 420589 - RNA, 32 nt, Human
gaccccaucccccagccgaccaguuuccucuc

SEQ ID NO: 420590 - RNA, 17 nt, Human
gaccccauccgcuccua

SEQ ID NO: 420591 - RNA, 32 nt, Human
gaccccaucucagcaaaacaauaaaaauuaac

SEQ ID NO: 420592 - RNA, 24 nt, Human
gaccccaugcuguccccaacagcu

SEQ ID NO: 420593 - RNA, 32 nt, Human
gaccccauggaagacccugaaacacucagcca

SEQ ID NO: 420594 - RNA, 32 nt, Human
gaccccauggggcccagacagagcacaggagc

SEQ ID NO: 420595 - RNA, 20 nt, Human
gaccccaugguccauccccu

SEQ ID NO: 420596 - RNA, 32 nt, Human
gaccccauuagguauggagagcugggaggagg

SEQ ID NO: 420597 - RNA, 32 nt, Human
gaccccauuucucccuccuuuccaacuuccuu

SEQ ID NO: 420598 - RNA, 32 nt, Human
gacccccaaauacauccugcggaaggaauuca

SEQ ID NO: 420599 - RNA, 32 nt, Human
gacccccaacuugcagcugcccaccucacccu

SEQ ID NO: 420600 - RNA, 23 nt, Human
gacccccaagcauccccagcacc

SEQ ID NO: 420601 - RNA, 32 nt, Human
gacccccaagccccacugaggccccuacugag

SEQ ID NO: 420602 - RNA, 32 nt, Human
gacccccaagguagugauggcagcuggugcau

SEQ ID NO: 420603 - RNA, 32 nt, Human
gacccccacagcucccuuccgaggcugcaggg

SEQ ID NO: 420604 - RNA, 32 nt, Human
gacccccaccaccccuccccagccuccugacc

SEQ ID NO: 420605 - RNA, 21 nt, Human
gacccccaccucccacccuga

SEQ ID NO: 420606 - RNA, 32 nt, Human
gacccccagcaugguuagcgcugaccuucauu

SEQ ID NO: 420607 - RNA, 32 nt, Human
gacccccagccccgcuuccuggacccgcaggc

SEQ ID NO: 420608 - RNA, 20 nt, Human
gacccccagcugggaguccc

SEQ ID NO: 420609 - RNA, 17 nt, Human
gacccccaggaacguuc

SEQ ID NO: 420610 - RNA, 21 nt, Human
gacccccaggccgaggguccc

SEQ ID NO: 420611 - RNA, 32 nt, Human
gacccccagguuuuugcgaaccccagaagaga

SEQ ID NO: 420612 - RNA, 21 nt, Human
gacccccaugcuguggugacu

SEQ ID NO: 420613 - RNA, 32 nt, Human
gacccccauggcacacaccugccaacagcacu

SEQ ID NO: 420614 - RNA, 32 nt, Human
gacccccauguaacagauggaggaauugaauc

SEQ ID NO: 420615 - RNA, 22 nt, Human
gaccccccaccccugcuuucgu

SEQ ID NO: 420616 - RNA, 24 nt, Human
gaccccccggagugcugagcuuca

SEQ ID NO: 420617 - RNA, 21 nt, Human
gaccccccggccuccgccugc

SEQ ID NO: 420618 - RNA, 17 nt, Human
gaccccccucacccuga

SEQ ID NO: 420619 - RNA, 21 nt, Human
gacccccgaaccuuugugcca

SEQ ID NO: 420620 - RNA, 18 nt, Human
gacccccgaccuggcccc

SEQ ID NO: 420621 - RNA, 32 nt, Human
gacccccgaggaccuccucuccucgcccugug

SEQ ID NO: 420622 - RNA, 18 nt, Human
gacccccgagggugccca

SEQ ID NO: 420623 - RNA, 32 nt, Human
gacccccgcaccugcccucuggcaccagaugc

SEQ ID NO: 420624 - RNA, 20 nt, Human
gacccccgccaccuguccca

SEQ ID NO: 420625 - RNA, 32 nt, Human
gacccccgccaggggagaccaggcuggcugga

SEQ ID NO: 420626 - RNA, 18 nt, Human
gacccccgccccggcccg

SEQ ID NO: 420627 - RNA, 18 nt, Human
gacccccgcccugcccca

SEQ ID NO: 420628 - RNA, 21 nt, Human
gacccccgccgcagaguccca

SEQ ID NO: 420629 - RNA, 18 nt, Human
gacccccgccgcggcccg

SEQ ID NO: 420630 - RNA, 19 nt, Human
gacccccgcgggcggaccc

SEQ ID NO: 420631 - RNA, 19 nt, Human
gacccccggaacaagccua

SEQ ID NO: 420632 - RNA, 17 nt, Human
gacccccggaagccucc

SEQ ID NO: 420633 - RNA, 19 nt, Human
gacccccggagaugguccc

SEQ ID NO: 420634 - RNA, 21 nt, Human
gacccccggagccgggaccca

SEQ ID NO: 420635 - RNA, 18 nt, Human
gacccccggaggauccca

SEQ ID NO: 420636 - RNA, 19 nt, Human
gacccccggcccgcagccc

SEQ ID NO: 420637 - RNA, 21 nt, Human
gacccccggcccgcagcccca

SEQ ID NO: 420638 - RNA, 18 nt, Human
gacccccggccugccccc

SEQ ID NO: 420639 - RNA, 19 nt, Human
gacccccggcgcgggccca

SEQ ID NO: 420640 - RNA, 17 nt, Human
gacccccgggaagccca

SEQ ID NO: 420641 - RNA, 32 nt, Human
gacccccgggacaagggucugagacccaaagg

SEQ ID NO: 420642 - RNA, 32 nt, Human
gacccccgggacucccgcacacccaggaccgg

SEQ ID NO: 420643 - RNA, 32 nt, Human
gacccccgggagcuugccauccagcugaggaa

SEQ ID NO: 420644 - RNA, 18 nt, Human
gacccccgggauugccca

SEQ ID NO: 420645 - RNA, 20 nt, Human
gacccccgggcgcgggaucc

SEQ ID NO: 420646 - RNA, 21 nt, Human
gacccccggggcggcuuccca

SEQ ID NO: 420647 - RNA, 19 nt, Human
gacccccgggguggccuca

SEQ ID NO: 420648 - RNA, 32 nt, Human
gacccccgguggacagggagagccugagacgc

SEQ ID NO: 420649 - RNA, 32 nt, Human
gacccccgucagcugcuucugcugccuagguu

SEQ ID NO: 420650 - RNA, 19 nt, Human
gacccccuacccacccugg

SEQ ID NO: 420651 - RNA, 32 nt, Human
gacccccuccauccuugacccccaacaccuca

SEQ ID NO: 420652 - RNA, 17 nt, Human
gacccccuccucugcug

SEQ ID NO: 420653 - RNA, 32 nt, Human
gacccccugcagcucaagcaugucugcaggac

SEQ ID NO: 420654 - RNA, 32 nt, Human
gacccccugcagcuucccugaccacgccacug

SEQ ID NO: 420655 - RNA, 19 nt, Human
gacccccugggccggcccg

SEQ ID NO: 420656 - RNA, 32 nt, Human
gacccccuuccccaggcauccccaccuccuac

SEQ ID NO: 420657 - RNA, 32 nt, Human
gacccccuucccgggcugcacuuuggguccag

SEQ ID NO: 420658 - RNA, 32 nt, Human
gacccccuuccuaggaugccccggcuucaguc

SEQ ID NO: 420659 - RNA, 32 nt, Human
gacccccuugaccccucuauuucuguuggcua

SEQ ID NO: 420660 - RNA, 32 nt, Human
gacccccuuuccucagccuccaccugcaggac

SEQ ID NO: 420661 - RNA, 32 nt, Human
gaccccgacaccaggcccugcccaggcuuaug

SEQ ID NO: 420662 - RNA, 32 nt, Human
gaccccgagaagaggccauccuuugugaagcu

SEQ ID NO: 420663 - RNA, 32 nt, Human
gaccccgagagggaggcgaggcgcugcuuguc

SEQ ID NO: 420664 - RNA, 32 nt, Human
gaccccgagaucagugccuaccucuggucuag

SEQ ID NO: 420665 - RNA, 32 nt, Human
gaccccgccggacccggaggcucacagggaac

SEQ ID NO: 420666 - RNA, 32 nt, Human
gaccccgccugggaacaacagucauucuuccu

SEQ ID NO: 420667 - RNA, 32 nt, Human
gaccccgcgcgucauccacacgcagacgcaga

SEQ ID NO: 420668 - RNA, 32 nt, Human
gaccccgcucugaaagccgggggugagugugg

SEQ ID NO: 420669 - RNA, 32 nt, Human
gaccccggcaggcagcagcaugaaauucagcc

SEQ ID NO: 420670 - RNA, 21 nt, Human
gaccccggcuccgcccuggca

SEQ ID NO: 420671 - RNA, 32 nt, Human
gaccccggcuugagguaacagcgcgagcugag

SEQ ID NO: 420672 - RNA, 32 nt, Human
gaccccgggaagggaaggcagccugguuucuc

SEQ ID NO: 420673 - RNA, 32 nt, Human
gaccccgggagguggaggcugcagugaguugu

SEQ ID NO: 420674 - RNA, 32 nt, Human
gaccccgggggugcaggaaggaaguggggccc

SEQ ID NO: 420675 - RNA, 32 nt, Human
gaccccgguugcuagggugugucuccuuggcc

SEQ ID NO: 420676 - RNA, 32 nt, Human
gaccccguagccaccaccacacugcuuccagg

SEQ ID NO: 420677 - RNA, 17 nt, Human
gaccccguccaccuccu

SEQ ID NO: 420678 - RNA, 32 nt, Human
gaccccguggguguccuggacccgcugcucca

SEQ ID NO: 420679 - RNA, 32 nt, Human
gaccccguuccaagugcacugcccggccaagc

SEQ ID NO: 420680 - RNA, 32 nt, Human
gaccccuaaauucuccuccucccccauuuuga

SEQ ID NO: 420681 - RNA, 32 nt, Human
gaccccuaaggcagaacugagaauaaacaugu

SEQ ID NO: 420682 - RNA, 32 nt, Human
gaccccuaguuccacugcacauggcccuccuc

SEQ ID NO: 420683 - RNA, 32 nt, Human
gaccccucaaagcagagccaguagugaucagu

SEQ ID NO: 420684 - RNA, 32 nt, Human
gaccccucacacucaccuagccaccauggaca

SEQ ID NO: 420685 - RNA, 32 nt, Human
gaccccucaccuaggugaugugagucucuugc

SEQ ID NO: 420686 - RNA, 32 nt, Human
gaccccucacuuaggcuuuccucugccacccc

SEQ ID NO: 420687 - RNA, 32 nt, Human
gaccccuccaggugaccggccaccccagggca

SEQ ID NO: 420688 - RNA, 32 nt, Human
gaccccucccauccuucccauuuccuuugaug

SEQ ID NO: 420689 - RNA, 22 nt, Human
gaccccuccccucgugucagcu

SEQ ID NO: 420690 - RNA, 32 nt, Human
gaccccucccugccucccugcccugacacuca

SEQ ID NO: 420691 - RNA, 32 nt, Human
gaccccuccgccaguuuugucuugugaugcca

SEQ ID NO: 420692 - RNA, 32 nt, Human
gaccccuccuuauucuccaauucauguacagu

SEQ ID NO: 420693 - RNA, 32 nt, Human
gaccccuccuucucccucuccugggucgaucc

SEQ ID NO: 420694 - RNA, 24 nt, Human
gaccccucgacuggccacagccca

SEQ ID NO: 420695 - RNA, 19 nt, Human
gaccccucgcucacccugg

SEQ ID NO: 420696 - RNA, 32 nt, Human
gaccccucuaauucucuuacccagaauauuua

SEQ ID NO: 420697 - RNA, 32 nt, Human
gaccccucucccaucccagcagugacugguga

SEQ ID NO: 420698 - RNA, 32 nt, Human
gaccccucuccuccuccuuccucuuggucuca

SEQ ID NO: 420699 - RNA, 32 nt, Human
gaccccucuccucucugcaagagccugccucu

SEQ ID NO: 420700 - RNA, 32 nt, Human
gaccccucuccucugcugccauacucccccuu

SEQ ID NO: 420701 - RNA, 32 nt, Human
gaccccucugccugccccaaccccuuuggagg

SEQ ID NO: 420702 - RNA, 32 nt, Human
gaccccugaccuuuccagcuuuguccuucaga

SEQ ID NO: 420703 - RNA, 32 nt, Human
gaccccugacucuuccagccagaaagauggug

SEQ ID NO: 420704 - RNA, 32 nt, Human
gaccccugacucuugcagccagaaagauggug

SEQ ID NO: 420705 - RNA, 32 nt, Human
gaccccugagcagcucugugaugggaucccag

SEQ ID NO: 420706 - RNA, 32 nt, Human
gaccccugcagccagagguuugcaguggguag

SEQ ID NO: 420707 - RNA, 32 nt, Human
gaccccugcauccuucugccuugggccuccaa

SEQ ID NO: 420708 - RNA, 32 nt, Human
gaccccugcccaggaagaguucacuggucgcu

SEQ ID NO: 420709 - RNA, 32 nt, Human
gaccccugcccaggcucaggcccaugagguau

SEQ ID NO: 420710 - RNA, 32 nt, Human
gaccccugccccucucuggguggagaagcucc

SEQ ID NO: 420711 - RNA, 32 nt, Human
gaccccugcccugcaaagauggggcugaagga

SEQ ID NO: 420712 - RNA, 32 nt, Human
gaccccugcugcagggcagaguucagguccac

SEQ ID NO: 420713 - RNA, 32 nt, Human
gaccccugcugccaccucuccugggccugugu

SEQ ID NO: 420714 - RNA, 32 nt, Human
gaccccuggaacuggcggguauucuggucauu

SEQ ID NO: 420715 - RNA, 32 nt, Human
gaccccuggcaaacugggcacuuggccuaugu

SEQ ID NO: 420716 - RNA, 22 nt, Human
gaccccuggccacccagacccc

SEQ ID NO: 420717 - RNA, 32 nt, Human
gaccccuggcugcuacagcugcgucacagagg

SEQ ID NO: 420718 - RNA, 32 nt, Human
gaccccugggagagggacuuugguagggucau

SEQ ID NO: 420719 - RNA, 32 nt, Human
gaccccugggagaggggcagugagaguuuguu

SEQ ID NO: 420720 - RNA, 32 nt, Human
gaccccugugacuccuggccugggcagguggg

SEQ ID NO: 420721 - RNA, 32 nt, Human
gaccccuguggccccuggccugggcagguggg

SEQ ID NO: 420722 - RNA, 32 nt, Human
gaccccuguucccagcuaggcucuuucccaac

SEQ ID NO: 420723 - RNA, 32 nt, Human
gaccccuguuuccucuuugucuugccccugga

SEQ ID NO: 420724 - RNA, 32 nt, Human
gaccccuuaagggagggaagaggcugggguga

SEQ ID NO: 420725 - RNA, 32 nt, Human
gaccccuucccugagguggcugucuccaugag

SEQ ID NO: 420726 - RNA, 18 nt, Human
gaccccuuccucacccug

SEQ ID NO: 420727 - RNA, 32 nt, Human
gaccccuucuccacccucucccugagcacagg

SEQ ID NO: 420728 - RNA, 32 nt, Human
gaccccuuuccuguaaccugcacuuugggaug

SEQ ID NO: 420729 - RNA, 21 nt, Human
gaccccuuuucccucuugcgu

SEQ ID NO: 420730 - RNA, 32 nt, Human
gacccgaaaugagggagcccagcuggggucuu

SEQ ID NO: 420731 - RNA, 32 nt, Human
gacccgaccccacuacaccacaccuagagccc

SEQ ID NO: 420732 - RNA, 32 nt, Human
gacccgagauaguaccacugcacuccagccug

SEQ ID NO: 420733 - RNA, 32 nt, Human
gacccgagccgauuucucuuggauuuggcuac

SEQ ID NO: 420734 - RNA, 32 nt, Human
gacccgagggccugcugcuuccugguuaagua

SEQ ID NO: 420735 - RNA, 32 nt, Human
gacccgaugcagacuccugaaacagacuacuc

SEQ ID NO: 420736 - RNA, 32 nt, Human
gacccgauuuuccaggugcgucagucaccccu

SEQ ID NO: 420737 - RNA, 32 nt, Human
gacccgcacacacacccacacugcugcccugg

SEQ ID NO: 420738 - RNA, 32 nt, Human
gacccgcacucuuccauguccguagggagacg

SEQ ID NO: 420739 - RNA, 32 nt, Human
gacccgcagccgcggcggcggcggcggcggcg

SEQ ID NO: 420740 - RNA, 32 nt, Human
gacccgcccccuccuuugcuccggaaucucuc

SEQ ID NO: 420741 - RNA, 32 nt, Human
gacccgcccccucgcccccaccccuguguguu

SEQ ID NO: 420742 - RNA, 32 nt, Human
gacccgccgcuuccccuucagccugggaccag

SEQ ID NO: 420743 - RNA, 32 nt, Human
gacccgccguccugcuauccuucgcuuccccc

SEQ ID NO: 420744 - RNA, 32 nt, Human
gacccgccucugccaugaaagccaugcccugg

SEQ ID NO: 420745 - RNA, 22 nt, Human
gacccgccucugugcuccaggg

SEQ ID NO: 420746 - RNA, 32 nt, Human
gacccgccucuuccaccaagacagagacguua

SEQ ID NO: 420747 - RNA, 32 nt, Human
gacccgccugggaacaagggaugaggaggagu

SEQ ID NO: 420748 - RNA, 21 nt, Human
gacccgcgcccgggccugcgg

SEQ ID NO: 420749 - RNA, 32 nt, Human
gacccgcggagucacugcagggaggagagggg

SEQ ID NO: 420750 - RNA, 32 nt, Human
gacccgcguggccaugguuaugguuguggauu

SEQ ID NO: 420751 - RNA, 32 nt, Human
gacccgcuagagagacaccgcagggaaguccu

SEQ ID NO: 420752 - RNA, 25 nt, Human
gacccgcuuggaggccacagccccg

SEQ ID NO: 420753 - RNA, 32 nt, Human
gacccggaacccagaggacgcgacaccaugac

SEQ ID NO: 420754 - RNA, 32 nt, Human
gacccggacucccuuucugccaccccaggcug

SEQ ID NO: 420755 - RNA, 32 nt, Human
gacccggagcagcagcagaggcaggaggacua

SEQ ID NO: 420756 - RNA, 32 nt, Human
gacccggagccgcgguacaggugugguugcuu

SEQ ID NO: 420757 - RNA, 31 nt, Human
gacccggaguuuccucuuucacuggauggag

SEQ ID NO: 420758 - RNA, 32 nt, Human
gacccggauagaaaauggcccugcguuuagcc

SEQ ID NO: 420759 - RNA, 32 nt, Human
gacccggaugcagagucuacagccugacccag

SEQ ID NO: 420760 - RNA, 32 nt, Human
gacccggcccucaaguccuccuauuagggcag

SEQ ID NO: 420761 - RNA, 32 nt, Human
gacccggccgcagaccguucugggcagcucug

SEQ ID NO: 420762 - RNA, 32 nt, Human
gacccggcucuccuggcccuguguugagggua

SEQ ID NO: 420763 - RNA, 32 nt, Human
gacccgggaaauacacacagagccaggagcag

SEQ ID NO: 420764 - RNA, 32 nt, Human
gacccgggaaggcgaggaaggcgaggcgggcg

SEQ ID NO: 420765 - RNA, 32 nt, Human
gacccgggacuccuccuguccugggccgaaug

SEQ ID NO: 420766 - RNA, 21 nt, Human
gacccgggacugacuucggga

SEQ ID NO: 420767 - RNA, 23 nt, Human
gacccgggaggcagagguugcag

SEQ ID NO: 420768 - RNA, 32 nt, Human
gacccgggaggcagagguugcagugagccgag

SEQ ID NO: 420769 - RNA, 26 nt, Human
gacccgggaggcggagguugcaguga

SEQ ID NO: 420770 - RNA, 32 nt, Human
gacccgggaggcggagguugcagugagccaag

SEQ ID NO: 420771 - RNA, 32 nt, Human
gacccgggaggcggagguugcagugagccgag

SEQ ID NO: 420772 - RNA, 26 nt, Human
gacccgggagguggagguugcaguga

SEQ ID NO: 420773 - RNA, 32 nt, Human
gacccgggcugcagcgggggaggaggagacgg

SEQ ID NO: 420774 - RNA, 32 nt, Human
gacccggggcagccucugggugaacagcagcg

SEQ ID NO: 420775 - RNA, 32 nt, Human
gacccggggcccgccucacaccccaguggauu

SEQ ID NO: 420776 - RNA, 32 nt, Human
gacccgggggcaggugcugcagugaggggucu

SEQ ID NO: 420777 - RNA, 32 nt, Human
gacccggguugcuuuuugccucccucuacugc

SEQ ID NO: 420778 - RNA, 32 nt, Human
gacccgguguuccucuugguggcagauaccug

SEQ ID NO: 420779 - RNA, 32 nt, Human
gacccguaaacuucacuggcaggauggcaggg

SEQ ID NO: 420780 - RNA, 23 nt, Human
gacccguccucucacccccagca

SEQ ID NO: 420781 - RNA, 32 nt, Human
gacccguccucugcaaccuccuuucugugccc

SEQ ID NO: 420782 - RNA, 32 nt, Human
gacccgugagccuggccaaggugcugaagacc

SEQ ID NO: 420783 - RNA, 32 nt, Human
gacccgugcccaaucuccucucccucuguugu

SEQ ID NO: 420784 - RNA, 32 nt, Human
gacccgugccuguauauuccacgcuuugcgca

SEQ ID NO: 420785 - RNA, 32 nt, Human
gacccguggacagguuggggauggggugugug

SEQ ID NO: 420786 - RNA, 32 nt, Human
gacccguggggcagccaguccucccagggacu

SEQ ID NO: 420787 - RNA, 32 nt, Human
gacccgugucugcugguugggaaguggagaaa

SEQ ID NO: 420788 - RNA, 32 nt, Human
gacccuaaaugagagauaugucccaggaugga

SEQ ID NO: 420789 - RNA, 32 nt, Human
gacccuaagagcacacugcacagggaaaauug

SEQ ID NO: 420790 - RNA, 32 nt, Human
gacccuacagcccaggcuuuccaggaggagcu

SEQ ID NO: 420791 - RNA, 32 nt, Human
gacccuaccagccugcgggaaggugguauggc

SEQ ID NO: 420792 - RNA, 32 nt, Human
gacccuacccuugugagagucaaggcacagag

SEQ ID NO: 420793 - RNA, 32 nt, Human
gacccuaccuccagaucacccaccucaucagg

SEQ ID NO: 420794 - RNA, 32 nt, Human
gacccuagaccucugcagcccauaccaggucu

SEQ ID NO: 420795 - RNA, 31 nt, Human
gacccuaggagaccugacuggaacuggcucc

SEQ ID NO: 420796 - RNA, 32 nt, Human
gacccuagggagacccgggugugcgccgccug

SEQ ID NO: 420797 - RNA, 32 nt, Human
gacccuagguauccacagcugugacauggggg

SEQ ID NO: 420798 - RNA, 32 nt, Human
gacccuaucucugagcgcugcagccuacuguu

SEQ ID NO: 420799 - RNA, 32 nt, Human
gacccucaaaccuacaccaaccaccuuagaug

SEQ ID NO: 420800 - RNA, 32 nt, Human
gacccucaaacuccucccugaaccucucagga

SEQ ID NO: 420801 - RNA, 32 nt, Human
gacccucaacagagacaggaaaaccugcccgu

SEQ ID NO: 420802 - RNA, 32 nt, Human
gacccucacaccagcaccccuccucaccacca

SEQ ID NO: 420803 - RNA, 32 nt, Human
gacccucacagcucugaauuugcuucuguuau

SEQ ID NO: 420804 - RNA, 32 nt, Human
gacccucaccaggaaccacaucugccagcacc

SEQ ID NO: 420805 - RNA, 32 nt, Human
gacccucaccccagcauagacacacacccccu

SEQ ID NO: 420806 - RNA, 20 nt, Human
gacccucacccccacccugg

SEQ ID NO: 420807 - RNA, 32 nt, Human
gacccucagaagcaguggcagaagcaguagaa

SEQ ID NO: 420808 - RNA, 32 nt, Human
gacccucagaucuucuuuucuaauagccauuu

SEQ ID NO: 420809 - RNA, 32 nt, Human
gacccucaggcaggagggcacugaccacaccc

SEQ ID NO: 420810 - RNA, 32 nt, Human
gacccucagggcccugaaccgucgcucucugg

SEQ ID NO: 420811 - RNA, 31 nt, Human
gacccucagugaagacucuguugaagacuuu

SEQ ID NO: 420812 - RNA, 17 nt, Human
gacccucaguucuggaa

SEQ ID NO: 420813 - RNA, 32 nt, Human
gacccucaucucugggcuacacggugauucag

SEQ ID NO: 420814 - RNA, 32 nt, Human
gacccucauuccagagagggugcugccccaua

SEQ ID NO: 420815 - RNA, 32 nt, Human
gacccuccagagccaggaggccaaggcuguga

SEQ ID NO: 420816 - RNA, 32 nt, Human
gacccuccaguucugccacaggucugccgaug

SEQ ID NO: 420817 - RNA, 32 nt, Human
gacccuccauagcaaccaagagauguuaaaac

SEQ ID NO: 420818 - RNA, 32 nt, Human
gacccuccauuucucccccucacccaugcuga

SEQ ID NO: 420819 - RNA, 32 nt, Human
gacccucccccugccuuccucuugccuuggga

SEQ ID NO: 420820 - RNA, 18 nt, Human
gacccuccccgcaccccc

SEQ ID NO: 420821 - RNA, 32 nt, Human
gacccuccccgcuccccugucauuucaucgcg

SEQ ID NO: 420822 - RNA, 32 nt, Human
gacccucccucugccuccuccaugaaggucuc

SEQ ID NO: 420823 - RNA, 32 nt, Human
gacccucccuucagauccgcagucucuaggua

SEQ ID NO: 420824 - RNA, 32 nt, Human
gacccuccgaaggaagguuuugccgcuggcgc

SEQ ID NO: 420825 - RNA, 32 nt, Human
gacccuccgcccacuuccuucucccuccacca

SEQ ID NO: 420826 - RNA, 32 nt, Human
gacccuccuagccuugaacacacacauguaca

SEQ ID NO: 420827 - RNA, 32 nt, Human
gacccuccuauucuauaaaacucugcauguag

SEQ ID NO: 420828 - RNA, 32 nt, Human
gacccuccuccccucuucccaucccuuccccc

SEQ ID NO: 420829 - RNA, 32 nt, Human
gacccuccuccgaacugccuuacccugcuuau

SEQ ID NO: 420830 - RNA, 32 nt, Human
gacccuccugaacugcacuacaagacacuuug

SEQ ID NO: 420831 - RNA, 32 nt, Human
gacccuccuggaccagccccaggcuccugugc

SEQ ID NO: 420832 - RNA, 32 nt, Human
gacccuccuguugcagccucacucucuacagg

SEQ ID NO: 420833 - RNA, 32 nt, Human
gacccuccuucgcgacggcaaggccugcaccu

SEQ ID NO: 420834 - RNA, 32 nt, Human
gacccucgagggcuuguguccauuuggccuuu

SEQ ID NO: 420835 - RNA, 32 nt, Human
gacccucgguccugugcaccgcuuuggggcac

SEQ ID NO: 420836 - RNA, 32 nt, Human
gacccucuagcaccugaguguugaugaucauu

SEQ ID NO: 420837 - RNA, 32 nt, Human
gacccucuccaucccccacccggcucagaacu

SEQ ID NO: 420838 - RNA, 32 nt, Human
gacccucuccuagucuaacuccugggcgugcu

SEQ ID NO: 420839 - RNA, 32 nt, Human
gacccucuccugggcauugguuccugcuggua

SEQ ID NO: 420840 - RNA, 32 nt, Human
gacccucugccacccucucugccacgcaggac

SEQ ID NO: 420841 - RNA, 32 nt, Human
gacccucugccgcugcuuccaggcugggcagc

SEQ ID NO: 420842 - RNA, 32 nt, Human
gacccucugccuggcaacugccccgucugaga

SEQ ID NO: 420843 - RNA, 21 nt, Human
gacccucugggcccagccuca

SEQ ID NO: 420844 - RNA, 32 nt, Human
gacccucugucccuucccuccuggcccgcugg

SEQ ID NO: 420845 - RNA, 20 nt, Human
gacccucuugcccacccuga

SEQ ID NO: 420846 - RNA, 32 nt, Human
gacccugaagucagagcaggccagccaagcag

SEQ ID NO: 420847 - RNA, 32 nt, Human
gacccugacccgcuucccagacucuaugcugg

SEQ ID NO: 420848 - RNA, 21 nt, Human
gacccugaccgcccacacccc

SEQ ID NO: 420849 - RNA, 22 nt, Human
gacccugaccucaagugaucca

SEQ ID NO: 420850 - RNA, 32 nt, Human
gacccugacucugccugaggccagccugcccg

SEQ ID NO: 420851 - RNA, 32 nt, Human
gacccugagagaggagggaggagggaaccugg

SEQ ID NO: 420852 - RNA, 32 nt, Human
gacccugagcacagccugguaugcgugcgggc

SEQ ID NO: 420853 - RNA, 32 nt, Human
gacccugagccaaguucccugugccuuaggcu

SEQ ID NO: 420854 - RNA, 32 nt, Human
gacccugagccccugagcugcauuuuacggua

SEQ ID NO: 420855 - RNA, 32 nt, Human
gacccugaggcccugaggguggaaguggacac

SEQ ID NO: 420856 - RNA, 32 nt, Human
gacccugaggggauggaguuuucaaguccuuc

SEQ ID NO: 420857 - RNA, 32 nt, Human
gacccugaggggcaguaggacuccaaccgcuu

SEQ ID NO: 420858 - RNA, 32 nt, Human
gacccugaggucaacacagaaaaucaugugcu

SEQ ID NO: 420859 - RNA, 32 nt, Human
gacccugaugggcuggacuugccccuccggua

SEQ ID NO: 420860 - RNA, 32 nt, Human
gacccugcaggaggagcuuggacuggccccag

SEQ ID NO: 420861 - RNA, 32 nt, Human
gacccugcaggcagucagcaccagccucagca

SEQ ID NO: 420862 - RNA, 32 nt, Human
gacccugcagugagugggugugauuuuuguuu

SEQ ID NO: 420863 - RNA, 32 nt, Human
gacccugcauuguggucaggagcacugaaugc

SEQ ID NO: 420864 - RNA, 32 nt, Human
gacccugcccaccugucugccugccccgccug

SEQ ID NO: 420865 - RNA, 32 nt, Human
gacccugccccuggcacggcagugccagcugu

SEQ ID NO: 420866 - RNA, 20 nt, Human
gacccugccgcggcuggcug

SEQ ID NO: 420867 - RNA, 32 nt, Human
gacccugcggccuuccggccuuccgcaguguu

SEQ ID NO: 420868 - RNA, 32 nt, Human
gacccugcuauuuucuccuugugugacuuugg

SEQ ID NO: 420869 - RNA, 32 nt, Human
gacccugcucaaggaggcucaucuggccuccu

SEQ ID NO: 420870 - RNA, 32 nt, Human
gacccugcucaggccaccugccuggcuccugc

SEQ ID NO: 420871 - RNA, 21 nt, Human
gacccugcugaaagcagugua

SEQ ID NO: 420872 - RNA, 32 nt, Human
gacccugcugcugccaagcuguggacccucuc

SEQ ID NO: 420873 - RNA, 32 nt, Human
gacccugcugggacaccaggacaaggaagaca

SEQ ID NO: 420874 - RNA, 32 nt, Human
gacccuggaagagaccguggcuauggaaacgg

SEQ ID NO: 420875 - RNA, 32 nt, Human
gacccuggaaggcaggggacugcgagcugggc

SEQ ID NO: 420876 - RNA, 32 nt, Human
gacccuggaaugggguugguuuggacaccccc

SEQ ID NO: 420877 - RNA, 32 nt, Human
gacccuggagcuuccauucaccugccauccag

SEQ ID NO: 420878 - RNA, 32 nt, Human
gacccuggaggcccccucacacgaaggcugcu

SEQ ID NO: 420879 - RNA, 32 nt, Human
gacccuggaggggcucugaggauagcaaucag

SEQ ID NO: 420880 - RNA, 32 nt, Human
gacccuggagguagaggcugcagugagccaag

SEQ ID NO: 420881 - RNA, 32 nt, Human
gacccuggauggggcuuccagcucagaaccca

SEQ ID NO: 420882 - RNA, 32 nt, Human
gacccuggcacccuccugagccggcgugugcc

SEQ ID NO: 420883 - RNA, 32 nt, Human
gacccuggccaacauggugaaaucccaucuau

SEQ ID NO: 420884 - RNA, 32 nt, Human
gacccuggccuccccuguggccucuuugagug

SEQ ID NO: 420885 - RNA, 32 nt, Human
gacccuggcuccaagccccggccucuauagua

SEQ ID NO: 420886 - RNA, 32 nt, Human
gacccugggaaaugucuacaaaugucuauuuc

SEQ ID NO: 420887 - RNA, 22 nt, Human
gacccugggagagaaggacuga

SEQ ID NO: 420888 - RNA, 32 nt, Human
gacccugggagguggagguggcagugagccga

SEQ ID NO: 420889 - RNA, 32 nt, Human
gacccugggccucaaaggcaagcccugaccuc

SEQ ID NO: 420890 - RNA, 32 nt, Human
gacccugggcugccagaugcaggaagcaucaa

SEQ ID NO: 420891 - RNA, 32 nt, Human
gacccuggggcggacccaggagccaaacucuu

SEQ ID NO: 420892 - RNA, 32 nt, Human
gacccuggugcugccaccugccccuacucaag

SEQ ID NO: 420893 - RNA, 32 nt, Human
gacccugguggugaaaucaaugacagacaaag

SEQ ID NO: 420894 - RNA, 21 nt, Human
gacccuggugguggccagagc

SEQ ID NO: 420895 - RNA, 32 nt, Human
gacccugguucgagcccagggugcgcuucggg

SEQ ID NO: 420896 - RNA, 32 nt, Human
gacccuguaggccgaagggagaaacaagagug

SEQ ID NO: 420897 - RNA, 32 nt, Human
gacccuguccccagggaggacauggcucugag

SEQ ID NO: 420898 - RNA, 32 nt, Human
gacccugugcaggagcagcuccgggugacacg

SEQ ID NO: 420899 - RNA, 32 nt, Human
gacccugugcaucugugcauuuggcaaaaugu

SEQ ID NO: 420900 - RNA, 32 nt, Human
gacccugugcuggccauccuaucucugauucu

SEQ ID NO: 420901 - RNA, 32 nt, Human
gacccuguuccacaguccuguauuccauccua

SEQ ID NO: 420902 - RNA, 20 nt, Human
gacccuguucccucacccug

SEQ ID NO: 420903 - RNA, 32 nt, Human
gacccuguucuaagcucugccuugccaagccc

SEQ ID NO: 420904 - RNA, 32 nt, Human
gacccuguuucccaauuugcccccaaggccua

SEQ ID NO: 420905 - RNA, 32 nt, Human
gacccuuauaguucuaucccagaauggcauca

SEQ ID NO: 420906 - RNA, 32 nt, Human
gacccuucaagcucuguccuuauccauuaccu

SEQ ID NO: 420907 - RNA, 32 nt, Human
gacccuucacagacuuacacauuuacucacca

SEQ ID NO: 420908 - RNA, 22 nt, Human
gacccuucaccuccagaugcca

SEQ ID NO: 420909 - RNA, 32 nt, Human
gacccuucagcuggcucugcccugccagugcc

SEQ ID NO: 420910 - RNA, 32 nt, Human
gacccuucccaaaucugcuccagcaggacuaa

SEQ ID NO: 420911 - RNA, 32 nt, Human
gacccuucccacccucugcaagcuccugagau

SEQ ID NO: 420912 - RNA, 32 nt, Human
gacccuuccccaaauacuaggcucagagcaac

SEQ ID NO: 420913 - RNA, 18 nt, Human
gacccuuccccauccuga

SEQ ID NO: 420914 - RNA, 32 nt, Human
gacccuucccucaagucucaccaguucugcuc

SEQ ID NO: 420915 - RNA, 32 nt, Human
gacccuucccuguugcugucccugcaucucgu

SEQ ID NO: 420916 - RNA, 32 nt, Human
gacccuuccguacuccuggacccccuugaccc

SEQ ID NO: 420917 - RNA, 32 nt, Human
gacccuuccugccugcaccccgguccucagcc

SEQ ID NO: 420918 - RNA, 25 nt, Human
gacccuucuagacaucacugucagc

SEQ ID NO: 420919 - RNA, 32 nt, Human
gacccuucucagaccgaggcgccaccacccca

SEQ ID NO: 420920 - RNA, 32 nt, Human
gacccuucuccaagcaccucagcgcacuugcc

SEQ ID NO: 420921 - RNA, 32 nt, Human
gacccuucuccuuagaaguggaaguaguggag

SEQ ID NO: 420922 - RNA, 32 nt, Human
gacccuucuggugcccuuugggaauaaagcug

SEQ ID NO: 420923 - RNA, 32 nt, Human
gacccuugaacccaggcaguggugggauggga

SEQ ID NO: 420924 - RNA, 32 nt, Human
gacccuugacagccccagccuaggcagauggg

SEQ ID NO: 420925 - RNA, 32 nt, Human
gacccuugaguucuguuggcccacugacuuua

SEQ ID NO: 420926 - RNA, 32 nt, Human
gacccuugcauucacugauaacuuucuggcag

SEQ ID NO: 420927 - RNA, 27 nt, Human
gacccuugccucaccccucccccuggc

SEQ ID NO: 420928 - RNA, 32 nt, Human
gacccuugccucaccccucccccuggccucac

SEQ ID NO: 420929 - RNA, 32 nt, Human
gacccuugccuuccacacuugcaggugucacg

SEQ ID NO: 420930 - RNA, 32 nt, Human
gacccuuggccuguucagcuauuuaucccauc

SEQ ID NO: 420931 - RNA, 32 nt, Human
gacccuuggcugcagggguugcuuccgccacu

SEQ ID NO: 420932 - RNA, 32 nt, Human
gacccuugggcugacagagcagguucucauuu

SEQ ID NO: 420933 - RNA, 32 nt, Human
gacccuuguguaucagcagcauuucugacuga

SEQ ID NO: 420934 - RNA, 32 nt, Human
gacccuuguuucugccaaaaccaugcuaugaa

SEQ ID NO: 420935 - RNA, 32 nt, Human
gacccuuuaacauaggcugccuuaguaacaaa

SEQ ID NO: 420936 - RNA, 32 nt, Human
gacccuuuaauucucacaaccaaccagucaug

SEQ ID NO: 420937 - RNA, 21 nt, Human
gacccuuuagaaaucagccca

SEQ ID NO: 420938 - RNA, 32 nt, Human
gacccuuuccgcccucccuuggaucuccaugu

SEQ ID NO: 420939 - RNA, 32 nt, Human
gacccuuucuccggacccagcauguaggugcc

SEQ ID NO: 420940 - RNA, 32 nt, Human
gacccuuuuccccucacccucugcccuucuaa

SEQ ID NO: 420941 - RNA, 32 nt, Human
gacccuuuucuguccaucagaggacagcugua

SEQ ID NO: 420942 - RNA, 32 nt, Human
gacccuuuugucacaguacagcucuugucuuu

SEQ ID NO: 420943 - RNA, 32 nt, Human
gacccuuuuuggacuagccagaauucuacccu

SEQ ID NO: 420944 - RNA, 32 nt, Human
gaccgaaagucuccugcuuucacugcgguccc

SEQ ID NO: 420945 - RNA, 32 nt, Human
gaccgaacucaagacuggcaagaaauguaaaa

SEQ ID NO: 420946 - RNA, 19 nt, Human
gaccgaagccacccggagg

SEQ ID NO: 420947 - RNA, 32 nt, Human
gaccgaaggaugacacaccagccaucugacca

SEQ ID NO: 420948 - RNA, 32 nt, Human
gaccgaaggggaaaacccgcucucucaggcgc

SEQ ID NO: 420949 - RNA, 32 nt, Human
gaccgaaggggaggaaaggaaaaggauggaca

SEQ ID NO: 420950 - RNA, 32 nt, Human
gaccgacauggagaaaccccaucucuacuaaa

SEQ ID NO: 420951 - RNA, 32 nt, Human
gaccgacaugggcaacaugacaagaccccauc

SEQ ID NO: 420952 - RNA, 32 nt, Human
gaccgaccagccagggcaacacagugagaccc

SEQ ID NO: 420953 - RNA, 32 nt, Human
gaccgacggccgcuggagugcacuggcaugau

SEQ ID NO: 420954 - RNA, 32 nt, Human
gaccgacuucuuucucuuuacccucauuggcg

SEQ ID NO: 420955 - RNA, 32 nt, Human
gacuuucugccuggaguguaugacugcacaug

SEQ ID NO: 420956 - RNA, 32 nt, Human
gacuuucuggccaagcugcacugugugcggca

SEQ ID NO: 420957 - RNA, 32 nt, Human
gacuuucugggaacacagagaccaagagggag

SEQ ID NO: 420958 - RNA, 32 nt, Human
gacuuucugguucauuuuuguuuguuuuguuu

SEQ ID NO: 420959 - RNA, 32 nt, Human
gacuuucuuuggauaugaggguuuugaaaccu

SEQ ID NO: 420960 - RNA, 32 nt, Human
gacuuugaaagccagagauuccuggcgcaggc

SEQ ID NO: 420961 - RNA, 32 nt, Human
gacuuugaacugcucuugcugaagaggcucca

SEQ ID NO: 420962 - RNA, 32 nt, Human
gacuuugacacacauggccaccuuggcacaaa

SEQ ID NO: 420963 - RNA, 27 nt, Human
gacuuugacacauuuuaguuauuuuaa

SEQ ID NO: 420964 - RNA, 32 nt, Human
gacuuugaugucagcaguugcugguaaaauga

SEQ ID NO: 420965 - RNA, 32 nt, Human
gacuuugcaccugucuucaggcugccagggga

SEQ ID NO: 420966 - RNA, 31 nt, Human
gacuuugcacuuugguuacacagaacauugg

SEQ ID NO: 420967 - RNA, 32 nt, Human
gacuuugcagaaccgguccaaggugagaguag

SEQ ID NO: 420968 - RNA, 32 nt, Human
gacuuugcagugagcaaugggucuccacaagu

SEQ ID NO: 420969 - RNA, 32 nt, Human
gacuuugcagugagcugagaucgugccacugc

SEQ ID NO: 420970 - RNA, 32 nt, Human
gacuuugcauaugcuaacuacaaguauaaccu

SEQ ID NO: 420971 - RNA, 32 nt, Human
gacuuugccagauuccuuacauuuguaggugu

SEQ ID NO: 420972 - RNA, 32 nt, Human
gacuuugcuaucucugagaugucugcuacuuc

SEQ ID NO: 420973 - RNA, 32 nt, Human
gacuuugcuaucucugagaugucugcuacuug

SEQ ID NO: 420974 - RNA, 32 nt, Human
gacuuugcucccauuccauacuguuuuuguca

SEQ ID NO: 420975 - RNA, 32 nt, Human
gacuuugcucuccaccaggcagaagaugacag

SEQ ID NO: 420976 - RNA, 32 nt, Human
gacuuugcucuucauuuaaaccaaaaucauau

SEQ ID NO: 420977 - RNA, 32 nt, Human
gacuuugcugacugguaccuggagcagcugaa

SEQ ID NO: 420978 - RNA, 32 nt, Human
gacuuugcuguaauuuuggucuugaggggcgg

SEQ ID NO: 420979 - RNA, 32 nt, Human
gacuuugcuuguuuacuuucugccucagauug

SEQ ID NO: 420980 - RNA, 32 nt, Human
gacuuuggacugcuucagucucugccaucuuc

SEQ ID NO: 420981 - RNA, 32 nt, Human
gacuuuggagccaagaaacacucugugugacu

SEQ ID NO: 420982 - RNA, 32 nt, Human
gacuuuggagccacccacacugggaagacuag

SEQ ID NO: 420983 - RNA, 32 nt, Human
gacuuuggaggacuguugggaaggcauuauug

SEQ ID NO: 420984 - RNA, 32 nt, Human
gacuuugggaggccaaggcgggcagaucaccg

SEQ ID NO: 420985 - RNA, 32 nt, Human
gacuuugggaggccaaggcgggcagaucaccu

SEQ ID NO: 420986 - RNA, 32 nt, Human
gacuuugggaggccgaggcagguggaucacuu

SEQ ID NO: 420987 - RNA, 32 nt, Human
gacuuugggaggcugaggcagguggaucaccu

SEQ ID NO: 420988 - RNA, 32 nt, Human
gacuuugggcagggaaggcgggcgggcggggg

SEQ ID NO: 420989 - RNA, 32 nt, Human
gacuuuggguuguuucugacuuuuggcuauug

SEQ ID NO: 420990 - RNA, 32 nt, Human
gacuuuggugaaaguguaccacucuuuuagaa

SEQ ID NO: 420991 - RNA, 32 nt, Human
gacuuugguggagguaguucuuuggcagcggg

SEQ ID NO: 420992 - RNA, 32 nt, Human
gacuuuguacacugaagaaaagaaaacugcau

SEQ ID NO: 420993 - RNA, 32 nt, Human
gacuuugucuucaagaagcucacagucuauug

SEQ ID NO: 420994 - RNA, 32 nt, Human
gacuuugucuugacuucuagugagaauuauaa

SEQ ID NO: 420995 - RNA, 32 nt, Human
gacuuugugaucauuacagaaaugcuggugua

SEQ ID NO: 420996 - RNA, 32 nt, Human
gacuuugugguuuacccccuucaccuuccagg

SEQ ID NO: 420997 - RNA, 23 nt, Human
gacuuuguuagaugagggaggaa

SEQ ID NO: 420998 - RNA, 32 nt, Human
gacuuuguucucuuccucaccugaaauuaugc

SEQ ID NO: 420999 - RNA, 32 nt, Human
gacuuuuaggcugggugcaguggcucacaccu

SEQ ID NO: 421000 - RNA, 32 nt, Human
gacuuuuauauguacacugaccaugugaugua

SEQ ID NO: 421001 - RNA, 32 nt, Human
gacuuuucaaagaaaauuguacuugaauuauu

SEQ ID NO: 421002 - RNA, 32 nt, Human
gacuuuucaagggggaccacccuaccugucau

SEQ ID NO: 421003 - RNA, 32 nt, Human
gacuuuucagccacaauuacaugucaucauuu

SEQ ID NO: 421004 - RNA, 32 nt, Human
gacuuuucaugccaaaugagacucucugagaa

SEQ ID NO: 421005 - RNA, 32 nt, Human
gacuuuucccacacacuggauugugaggcucu

SEQ ID NO: 421006 - RNA, 32 nt, Human
gacuuuucccgcuguuucucagccucugggau

SEQ ID NO: 421007 - RNA, 32 nt, Human
gacuuuucuacugaucaucauaacucuguauc

SEQ ID NO: 421008 - RNA, 32 nt, Human
gacuuuucuccucugcaauguggguugcuguc

SEQ ID NO: 421009 - RNA, 32 nt, Human
gacuuuucucucuuauaccaacaauaucagaa

SEQ ID NO: 421010 - RNA, 32 nt, Human
gacuuuucugagaaaccaggcuuacaugacuu

SEQ ID NO: 421011 - RNA, 32 nt, Human
gacuuuugaugcccuccuugaaugacuccaau

SEQ ID NO: 421012 - RNA, 32 nt, Human
gacuuuugcaaauuauggagagaggccaucaa

SEQ ID NO: 421013 - RNA, 32 nt, Human
gacuuuugcaucuguauaaaaauaucagugag

SEQ ID NO: 421014 - RNA, 32 nt, Human
gacuuuugcuuccucuacggaggcaaguaaca

SEQ ID NO: 421015 - RNA, 32 nt, Human
gacuuuuggcugcuucggugacccauuguaga

SEQ ID NO: 421016 - RNA, 32 nt, Human
gacuuuuguccuucuuucuuccaaucuguucu

SEQ ID NO: 421017 - RNA, 32 nt, Human
gacuuuuuacaaaggacuucccucauuaaacu

SEQ ID NO: 421018 - RNA, 32 nt, Human
gacuuuuucaacucagcuuuuugagaccugaa

SEQ ID NO: 421019 - RNA, 18 nt, Human
gacuuuuuccuuggcuuu

SEQ ID NO: 421020 - RNA, 17 nt, Human
gacuuuuugacauagca

SEQ ID NO: 421021 - RNA, 32 nt, Human
gacuuuuugagaaaucucgguggaguagugga

SEQ ID NO: 421022 - RNA, 32 nt, Human
gacuuuuugcagcucggcugugccucaucuuc

SEQ ID NO: 421023 - RNA, 20 nt, Human
gacuuuuuuauacaauggaa

SEQ ID NO: 421024 - RNA, 25 nt, Human
gacuuuuuuccccaugagcccucug

SEQ ID NO: 421025 - RNA, 24 nt, Human
gagaaaaaagaaauugguuaugaa

SEQ ID NO: 421026 - RNA, 21 nt, Human
gagaaaaaagugacucaugaa

SEQ ID NO: 421027 - RNA, 32 nt, Human
gagaaaaacaaacagaccaaaugcccaggagc

SEQ ID NO: 421028 - RNA, 32 nt, Human
gagaaaaaccuuauuuucuuuuguaagagcug

SEQ ID NO: 421029 - RNA, 21 nt, Human
gagaaaaagaaauccaggagc

SEQ ID NO: 421030 - RNA, 32 nt, Human
gagaaaaagacaugauaauacaggcaagaugg

SEQ ID NO: 421031 - RNA, 32 nt, Human
gagaaaaagagaugggaacgaggcagaggaaa

SEQ ID NO: 421032 - RNA, 32 nt, Human
gagaaaaagaggaggccaaaaggggcaaggua

SEQ ID NO: 421033 - RNA, 32 nt, Human
gagaaaaagagggagacaggacagcuaagcaa

SEQ ID NO: 421034 - RNA, 32 nt, Human
gagaaaaagauggaagaagaaggugugagugu

SEQ ID NO: 421035 - RNA, 32 nt, Human
gagaaaaagcaacuguauaaaugaauguagag

SEQ ID NO: 421036 - RNA, 32 nt, Human
gagaaaaagcaagggcagcggcauucacacag

SEQ ID NO: 421037 - RNA, 32 nt, Human
gagaaaaagggaaagaaggaaagucgagaggc

SEQ ID NO: 421038 - RNA, 26 nt, Human
gagaaaaagggagggaaggagaaaga

SEQ ID NO: 421039 - RNA, 21 nt, Human
gagaaaaaguggagucaugaa

SEQ ID NO: 421040 - RNA, 32 nt, Human
gagaaaaauuaaagcuaaaauuagcugcaaag

SEQ ID NO: 421041 - RNA, 23 nt, Human
gagaaaacaaaacaaaaggaaca

SEQ ID NO: 421042 - RNA, 21 nt, Human
gagaaaacaaaacaaaccaaa

SEQ ID NO: 421043 - RNA, 32 nt, Human
gagaaaacacaccugagaggggcugcuggcug

SEQ ID NO: 421044 - RNA, 22 nt, Human
gagaaaacagcaccccaaggac

SEQ ID NO: 421045 - RNA, 23 nt, Human
gagaaaacagccagcaggaggag

SEQ ID NO: 421046 - RNA, 32 nt, Human
gagaaaacaugcuucagcuguggagggcacau

SEQ ID NO: 421047 - RNA, 32 nt, Human
gagaaaacauuugcgauggaaaagugacuuug

SEQ ID NO: 421048 - RNA, 32 nt, Human
gagaaaacauuuucucuuuccuccucuugaac

SEQ ID NO: 421049 - RNA, 23 nt, Human
gagaaaacccuaugaguauucca

SEQ ID NO: 421050 - RNA, 21 nt, Human
gagaaaacgaggcuccuucca

SEQ ID NO: 421051 - RNA, 19 nt, Human
gagaaaacuagccagagua

SEQ ID NO: 421052 - RNA, 32 nt, Human
gagaaaacucaggaauucugagucuucccugc

SEQ ID NO: 421053 - RNA, 32 nt, Human
gagaaaacucuucugugccccagugaacaaau

SEQ ID NO: 421054 - RNA, 32 nt, Human
gagaaaacugaggcucaggagggggaguugac

SEQ ID NO: 421055 - RNA, 24 nt, Human
gagaaaacugcaaccaaggaagaa

SEQ ID NO: 421056 - RNA, 32 nt, Human
gagaaaagagccagaaguugaugugggaagaa

SEQ ID NO: 421057 - RNA, 32 nt, Human
gagaaaagagccucagcaagagaguuuugcca

SEQ ID NO: 421058 - RNA, 32 nt, Human
gagaaaagagguggauggagggaagggugagg

SEQ ID NO: 421059 - RNA, 32 nt, Human
gagaaaagagugagaacuaggugugcaagaac

SEQ ID NO: 421060 - RNA, 32 nt, Human
gagaaaagauacuuauguuuugcucaucuaac

SEQ ID NO: 421061 - RNA, 32 nt, Human
gagaaaagcagaacacaucacacagaugccag

SEQ ID NO: 421062 - RNA, 24 nt, Human
gagaaaagcaucugcaaaaugcua

SEQ ID NO: 421063 - RNA, 32 nt, Human
gagaaaagccaagaccuggagcgagcuggagu

SEQ ID NO: 421064 - RNA, 32 nt, Human
gagaaaagcugaaggcuugaaaagaggcaugu

SEQ ID NO: 421065 - RNA, 32 nt, Human
gagaaaagcugcaaauugcucaacuggcauug

SEQ ID NO: 421066 - RNA, 31 nt, Human
gagaaaaggaaacugccuuggauaauggcaa

SEQ ID NO: 421067 - RNA, 32 nt, Human
gagaaaaggacccugagaaggagguugcggcu

SEQ ID NO: 421068 - RNA, 32 nt, Human
gagaaaaggagaaagggagcuuguucuuccca

SEQ ID NO: 421069 - RNA, 32 nt, Human
gagaaaaggagaaguagagauaagggaagggg

SEQ ID NO: 421070 - RNA, 32 nt, Human
gagaaaaggagagagguugagcgagcgagaga

SEQ ID NO: 421071 - RNA, 32 nt, Human
gagaaaaggaggagaacaggagacgagaagga

SEQ ID NO: 421072 - RNA, 32 nt, Human
gagaaaaggcaaccugccuccagccugaaaua

SEQ ID NO: 421073 - RNA, 32 nt, Human
gagaaaagggagcuagggaaggagcaguggac

SEQ ID NO: 421074 - RNA, 23 nt, Human
gagaaaagggaggaaacggcaga

SEQ ID NO: 421075 - RNA, 32 nt, Human
gagaaaaguaaucauuuuaggucuuaaagacu

SEQ ID NO: 421076 - RNA, 32 nt, Human
gagaaaagucuuccaucauaaauuuaacuuca

SEQ ID NO: 421077 - RNA, 32 nt, Human
gagaaaagugugaacccaggaggcggagcuug

SEQ ID NO: 421078 - RNA, 21 nt, Human
gagaaaaguugggacaggagc

SEQ ID NO: 421079 - RNA, 32 nt, Human
gagaaaauaagggcuguguuuucaguuuagac

SEQ ID NO: 421080 - RNA, 32 nt, Human
gagaaaauaauccagucuucacuggguuccca

SEQ ID NO: 421081 - RNA, 32 nt, Human
gagaaaauagugggaaauagaaaagugugugc

SEQ ID NO: 421082 - RNA, 32 nt, Human
gagaaaaugcgggaauccugaaugacaguggg

SEQ ID NO: 421083 - RNA, 32 nt, Human
gagaaaauugggccugauagggugagaaucac

SEQ ID NO: 421084 - RNA, 23 nt, Human
gagaaacaaaaccacaggaggaa

SEQ ID NO: 421085 - RNA, 23 nt, Human
gagaaacaaacaaaacaaacaca

SEQ ID NO: 421086 - RNA, 32 nt, Human
gagaaacaacuagcuggacaauacucaauuca

SEQ ID NO: 421087 - RNA, 32 nt, Human
gagaaacaaguaugcucucagcugguauugaa

SEQ ID NO: 421088 - RNA, 32 nt, Human
gagaaacacauucuuauuaauucuucaccugu

SEQ ID NO: 421089 - RNA, 32 nt, Human
gagaaacagauggucaaguagaugucuguuag

SEQ ID NO: 421090 - RNA, 19 nt, Human
gagaaacagauguugcaga

SEQ ID NO: 421091 - RNA, 32 nt, Human
gagaaacaggaucagaggguggauauagggcu

SEQ ID NO: 421092 - RNA, 32 nt, Human
gagaaacaggcagcagaggaacccaaaggcag

SEQ ID NO: 421093 - RNA, 32 nt, Human
gagaaacauggagcagcgcacgcccaggcgau

SEQ ID NO: 421094 - RNA, 32 nt, Human
gagaaacauuauucaacacugguuacccagug

SEQ ID NO: 421095 - RNA, 32 nt, Human
gagaaaccaaccacaggcacccaagcacuacc

SEQ ID NO: 421096 - RNA, 32 nt, Human
gagaaaccacgugaaaccuacauugcuauguu

SEQ ID NO: 421097 - RNA, 32 nt, Human
gagaaaccagaagaauuccucugaccacuuac

SEQ ID NO: 421098 - RNA, 32 nt, Human
gagaaaccagaaggaugcuacacccaccaucu

SEQ ID NO: 421099 - RNA, 32 nt, Human
gagaaaccagcccugggacacccuaucacagg

SEQ ID NO: 421100 - RNA, 32 nt, Human
gagaaacccacugaucagcuccucaaaaccca

SEQ ID NO: 421101 - RNA, 32 nt, Human
gagaaacccagccagggugucaggggcucagg

SEQ ID NO: 421102 - RNA, 32 nt, Human
gagaaaccccagaccuggauucugaguuuuuc

SEQ ID NO: 421103 - RNA, 17 nt, Human
gagaaaccccucuggga

SEQ ID NO: 421104 - RNA, 32 nt, Human
gagaaacccuaaaucacuccucucuccacuug

SEQ ID NO: 421105 - RNA, 32 nt, Human
gagaaaccuccacccuccccaggucccacauu

SEQ ID NO: 421106 - RNA, 32 nt, Human
gagaaaccuggaagaauauuugcucaacugug

SEQ ID NO: 421107 - RNA, 32 nt, Human
gagaaaccuguggucuagaaccacagcaagaa

SEQ ID NO: 421108 - RNA, 32 nt, Human
gagaaaccuuacaaaugguguggugaggucau

SEQ ID NO: 421109 - RNA, 32 nt, Human
gagaaaccuugagccagaagacccaagcuaag

SEQ ID NO: 421110 - RNA, 17 nt, Human
gagaaacggcgcuggga

SEQ ID NO: 421111 - RNA, 16 nt, Human
gagaaacgggcugggg

SEQ ID NO: 421112 - RNA, 32 nt, Human
gagaaacguccccucaccccaucccucagcca

SEQ ID NO: 421113 - RNA, 23 nt, Human
gagaaacuccuuuaauaccccac

SEQ ID NO: 421114 - RNA, 32 nt, Human
gagaaacucggggccaccuccacuccaugugc

SEQ ID NO: 421115 - RNA, 19 nt, Human
gagaaacugacaccacuca

SEQ ID NO: 421116 - RNA, 32 nt, Human
gagaaacugaggaaccacaguccugguggggg

SEQ ID NO: 421117 - RNA, 18 nt, Human
gagaaacugaguuccuga

SEQ ID NO: 421118 - RNA, 32 nt, Human
gagaaacugcaacaaaaauguccuguggauga

SEQ ID NO: 421119 - RNA, 32 nt, Human
gagaaacugggguggcagggagggagggaggg

SEQ ID NO: 421120 - RNA, 32 nt, Human
gagaaacuuaagcuaaagucuguuauacagaa

SEQ ID NO: 421121 - RNA, 32 nt, Human
gagaaagaaaaaugcuggaacaugcuugaugu

SEQ ID NO: 421122 - RNA, 20 nt, Human
gagaaagaaaagcugaagga

SEQ ID NO: 421123 - RNA, 21 nt, Human
gagaaagaaaaucugaagggc

SEQ ID NO: 421124 - RNA, 32 nt, Human
gagaaagaaagaaagaaagaaagggaaagaug

SEQ ID NO: 421125 - RNA, 32 nt, Human
gagaaagaaagaaagaaagagagagaaagaaa

SEQ ID NO: 421126 - RNA, 18 nt, Human
gagaaagaaagaaagggc

SEQ ID NO: 421127 - RNA, 21 nt, Human
gagaaagaaagccacaaggau

SEQ ID NO: 421128 - RNA, 32 nt, Human
gagaaagaaagugaauaaaucaggaauauaag

SEQ ID NO: 421129 - RNA, 18 nt, Human
gagaaagaacccaagaga

SEQ ID NO: 421130 - RNA, 18 nt, Human
gagaaagaaccucuuucc

SEQ ID NO: 421131 - RNA, 32 nt, Human
gagaaagaacuccucauaggaauacugaagaa

SEQ ID NO: 421132 - RNA, 32 nt, Human
gagaaagaacuuaaagagcuaggaggacagag

SEQ ID NO: 421133 - RNA, 21 nt, Human
gagaaagaacuuucucuucca

SEQ ID NO: 421134 - RNA, 18 nt, Human
gagaaagaagaaaaagga

SEQ ID NO: 421135 - RNA, 23 nt, Human
gagaaagaagaggaggagucaga

SEQ ID NO: 421136 - RNA, 18 nt, Human
gagaaagaagccaaugac

SEQ ID NO: 421137 - RNA, 22 nt, Human
gagaaagaaggccugggagggg

SEQ ID NO: 421138 - RNA, 32 nt, Human
gagaaagaagggagagaaaagguugcaucugc

SEQ ID NO: 421139 - RNA, 20 nt, Human
gagaaagaauccugcuucca

SEQ ID NO: 421140 - RNA, 32 nt, Human
gagaaagaaugagaaagaaaaggaaugcaaga

SEQ ID NO: 421141 - RNA, 32 nt, Human
gagaaagaaugucuuuucgaggcggaggucgu

SEQ ID NO: 421142 - RNA, 18 nt, Human
gagaaagaauuuuuucca

SEQ ID NO: 421143 - RNA, 22 nt, Human
gagaaagaauuuuuuccaagga

SEQ ID NO: 421144 - RNA, 32 nt, Human
gagaaagacacagugggaauugauuauguauu

SEQ ID NO: 421145 - RNA, 32 nt, Human
gagaaagacagagagaaauugaguuccugaca

SEQ ID NO: 421146 - RNA, 32 nt, Human
gagaaagacaggaggaaagagggccaugggag

SEQ ID NO: 421147 - RNA, 32 nt, Human
gagaaagaccaugguuguugcugagaggguaa

SEQ ID NO: 421148 - RNA, 17 nt, Human
gagaaagagaaagaagg

SEQ ID NO: 421149 - RNA, 18 nt, Human
gagaaagagaaagaugga

SEQ ID NO: 421150 - RNA, 22 nt, Human
gagaaagagaaaggaaguggac

SEQ ID NO: 421151 - RNA, 18 nt, Human
gagaaagagaaaucagga

SEQ ID NO: 421152 - RNA, 21 nt, Human
gagaaagagaaaugcaggagc

SEQ ID NO: 421153 - RNA, 21 nt, Human
gagaaagagaacuacuaagga

SEQ ID NO: 421154 - RNA, 20 nt, Human
gagaaagagaagacaagagc

SEQ ID NO: 421155 - RNA, 32 nt, Human
gagaaagagaagcuugucucagaagcuccacc

SEQ ID NO: 421156 - RNA, 32 nt, Human
gagaaagagaaggaaggaaggagaaagagaag

SEQ ID NO: 421157 - RNA, 24 nt, Human
gagaaagagaaggauccccaagga

SEQ ID NO: 421158 - RNA, 16 nt, Human
gagaaagagaauggga

SEQ ID NO: 421159 - RNA, 20 nt, Human
gagaaagagacaaagaggac

SEQ ID NO: 421160 - RNA, 32 nt, Human
gagaaagagagaagaagaaaggaagaggaaag

SEQ ID NO: 421161 - RNA, 18 nt, Human
gagaaagagagagaagga

SEQ ID NO: 421162 - RNA, 17 nt, Human
gagaaagagagagagga

SEQ ID NO: 421163 - RNA, 32 nt, Human
gagaaagagagcaugagagggagcgagacagg

SEQ ID NO: 421164 - RNA, 20 nt, Human
gagaaagagcagcucaggac

SEQ ID NO: 421165 - RNA, 18 nt, Human
gagaaagagccacauccc

SEQ ID NO: 421166 - RNA, 18 nt, Human
gagaaagagccccauccc

SEQ ID NO: 421167 - RNA, 21 nt, Human
gagaaagagccccccaaggau

SEQ ID NO: 421168 - RNA, 21 nt, Human
gagaaagagcucccuccucca

SEQ ID NO: 421169 - RNA, 32 nt, Human
gagaaagaggagaagaagaaugaugagcacaa

SEQ ID NO: 421170 - RNA, 18 nt, Human
gagaaagaggcgcaggac

SEQ ID NO: 421171 - RNA, 21 nt, Human
gagaaagagggcaaucaggac

SEQ ID NO: 421172 - RNA, 32 nt, Human
gagaaagaggugaggauggaaggauggagaaa

SEQ ID NO: 421173 - RNA, 21 nt, Human
gagaaagagucaaccaagggc

SEQ ID NO: 421174 - RNA, 19 nt, Human
gagaaagaguccgcgacca

SEQ ID NO: 421175 - RNA, 19 nt, Human
gagaaagagucuugcucca

SEQ ID NO: 421176 - RNA, 18 nt, Human
gagaaagaguggauuuca

SEQ ID NO: 421177 - RNA, 32 nt, Human
gagaaagauaguugcaaccucaccucccucac

SEQ ID NO: 421178 - RNA, 19 nt, Human
gagaaagaugcucaucaca

SEQ ID NO: 421179 - RNA, 18 nt, Human
gagaaagauuccaaaggc

SEQ ID NO: 421180 - RNA, 18 nt, Human
gagaaagauuccuuccca

SEQ ID NO: 421181 - RNA, 16 nt, Human
gagaaagauucugggg

SEQ ID NO: 421182 - RNA, 32 nt, Human
gagaaagauugguguaaucugcuuuccugucu

SEQ ID NO: 421183 - RNA, 32 nt, Human
gagaaagcaaaaagguuccaagagguacuuuu

SEQ ID NO: 421184 - RNA, 25 nt, Human
gagaaagcaaaacaaaacaauaaca

SEQ ID NO: 421185 - RNA, 32 nt, Human
gagaaagcaaaggugcacuccagacucugggg

SEQ ID NO: 421186 - RNA, 32 nt, Human
gagaaagcacuggaauccaggcuuccagcucc

SEQ ID NO: 421187 - RNA, 19 nt, Human
gagaaagcagaguccucca

SEQ ID NO: 421188 - RNA, 21 nt, Human
gagaaagcaguuuccaaggau

SEQ ID NO: 421189 - RNA, 26 nt, Human
gagaaagcaucugcuccaaggaggga

SEQ ID NO: 421190 - RNA, 32 nt, Human
gagaaagcaugaggauauucccaaugacuaug

SEQ ID NO: 421191 - RNA, 32 nt, Human
gagaaagccacuucuggugguugccagccacc

SEQ ID NO: 421192 - RNA, 32 nt, Human
gagaaagcccacccucucccgcgccccaggaa

SEQ ID NO: 421193 - RNA, 32 nt, Human
gagaaagcccgggcaggagagcacagagccgg

SEQ ID NO: 421194 - RNA, 32 nt, Human
gagaaagcccguaaggagcugaaggaggagcu

SEQ ID NO: 421195 - RNA, 20 nt, Human
gagaaagcccucaguguucu

SEQ ID NO: 421196 - RNA, 32 nt, Human
gagaaagccugcuugcuucuuccuucauuugg

SEQ ID NO: 421197 - RNA, 32 nt, Human
gagaaagccuggcagaggguugggggcuaaga

SEQ ID NO: 421198 - RNA, 32 nt, Human
gagaaagcgcagaugcuagcacaugcccuaau

SEQ ID NO: 421199 - RNA, 32 nt, Human
gagaaagcgccauugcacuccagucuggguga

SEQ ID NO: 421200 - RNA, 32 nt, Human
gagaaagcggcagcagauugugcugccgcagg

SEQ ID NO: 421201 - RNA, 32 nt, Human
gagaaagcuacuuggaaaucuggagcaaacau

SEQ ID NO: 421202 - RNA, 32 nt, Human
gagaaagcucuauccagccugucaccacugcc

SEQ ID NO: 421203 - RNA, 32 nt, Human
gagaaagcugaggaggcuuuggaagagaaggu

SEQ ID NO: 421204 - RNA, 32 nt, Human
gagaaagcugcacucuguugagcuccagggcg

SEQ ID NO: 421205 - RNA, 32 nt, Human
gagaaagcugggcccuacagaaaccuaacgcu

SEQ ID NO: 421206 - RNA, 32 nt, Human
gagaaagcuuugaggaagacuugucugucccc

SEQ ID NO: 421207 - RNA, 32 nt, Human
gagaaaggaaagaggaagggggagcggcgaga

SEQ ID NO: 421208 - RNA, 26 nt, Human
gagaaaggaauaagcucucugugaug

SEQ ID NO: 421209 - RNA, 32 nt, Human
gagaaaggaauguugccuuugagaacugucuu

SEQ ID NO: 421210 - RNA, 18 nt, Human
gagaaaggacccuuccca

SEQ ID NO: 421211 - RNA, 32 nt, Human
gagaaaggaccuaggguggggaagggaggguc

SEQ ID NO: 421212 - RNA, 21 nt, Human
gagaaaggagacaagaugugg

SEQ ID NO: 421213 - RNA, 21 nt, Human
gagaaaggagccccacaucca

SEQ ID NO: 421214 - RNA, 18 nt, Human
gagaaaggagggaguggg

SEQ ID NO: 421215 - RNA, 32 nt, Human
gagaaaggaguaagaauggggauggcaaaggg

SEQ ID NO: 421216 - RNA, 32 nt, Human
gagaaaggagugaaggaggcaggugggaaaug

SEQ ID NO: 421217 - RNA, 32 nt, Human
gagaaaggauuuccuuucuuuuuaaucuucca

SEQ ID NO: 421218 - RNA, 32 nt, Human
gagaaaggauuucugaggagugugugaugugu

SEQ ID NO: 421219 - RNA, 32 nt, Human
gagaaaggcaugaauccaggaggcagagcuug

SEQ ID NO: 421220 - RNA, 18 nt, Human
gagaaaggcugaagggga

SEQ ID NO: 421221 - RNA, 32 nt, Human
gagaaaggcugcaguggccucagugauguaca

SEQ ID NO: 421222 - RNA, 19 nt, Human
gagaaaggcuuccccacca

SEQ ID NO: 421223 - RNA, 19 nt, Human
gagaaagggaauccaagga

SEQ ID NO: 421224 - RNA, 21 nt, Human
gagaaagggaauuucauccca

SEQ ID NO: 421225 - RNA, 23 nt, Human
gagaaagggacaagugaggcagg

SEQ ID NO: 421226 - RNA, 22 nt, Human
gagaaagggagaagacagcaga

SEQ ID NO: 421227 - RNA, 24 nt, Human
gagaaagggagagagggagggaga

SEQ ID NO: 421228 - RNA, 32 nt, Human
gagaaagggagagagggagggagagagaguga

SEQ ID NO: 421229 - RNA, 32 nt, Human
gagaaagggagagagggagggagaggaucgug

SEQ ID NO: 421230 - RNA, 32 nt, Human
gagaaagggcccuggccaggcuggauggaugc

SEQ ID NO: 421231 - RNA, 32 nt, Human
gagaaaggggcuuugggcucugccccucuggc

SEQ ID NO: 421232 - RNA, 19 nt, Human
gagaaagggggccauggac

SEQ ID NO: 421233 - RNA, 21 nt, Human
gagaaaggugagaggaggaga

SEQ ID NO: 421234 - RNA, 32 nt, Human
gagaaagguguuagauguuacggugccuucua

SEQ ID NO: 421235 - RNA, 18 nt, Human
gagaaaguaauuauucca

SEQ ID NO: 421236 - RNA, 32 nt, Human
gagaaaguauuugucucuccaacuugaaaaug

SEQ ID NO: 421237 - RNA, 32 nt, Human
gagaaagucuucauggggugcuagagcaucuu

SEQ ID NO: 421238 - RNA, 32 nt, Human
gagaaagugaaaaugccacucucuccacccca

SEQ ID NO: 421239 - RNA, 32 nt, Human
gagaaagugaacagcauuuguuggaaggugau

SEQ ID NO: 421240 - RNA, 32 nt, Human
gagaaagugagcuaaguugggguggggugagu

SEQ ID NO: 421241 - RNA, 23 nt, Human
gagaaaguggaaggcauggaagc

SEQ ID NO: 421242 - RNA, 20 nt, Human
gagaaaguggagaagguaga

SEQ ID NO: 421243 - RNA, 18 nt, Human
gagaaaguggcucauucc

SEQ ID NO: 421244 - RNA, 32 nt, Human
gagaaaguucacagggaauuggaaauccuugu

SEQ ID NO: 421245 - RNA, 32 nt, Human
gagaaauaagcucagauggaagagauaaacga

SEQ ID NO: 421246 - RNA, 32 nt, Human
gagaaauaagggccuuaauuuguacugucugc

SEQ ID NO: 421247 - RNA, 32 nt, Human
gagaaauaccacaugccagucuucccaggaag

SEQ ID NO: 421248 - RNA, 32 nt, Human
gagaaauaccuuuagaggugacuuuaaggaaa

SEQ ID NO: 421249 - RNA, 19 nt, Human
gagaaauagaaauccaagg

SEQ ID NO: 421250 - RNA, 20 nt, Human
gagaaaucaacaguuccuga

SEQ ID NO: 421251 - RNA, 32 nt, Human
gagaaaucaagugaaggaaggaggcggaguuu

SEQ ID NO: 421252 - RNA, 32 nt, Human
gagaaaucacacucaagcauuaucaagugaag

SEQ ID NO: 421253 - RNA, 22 nt, Human
gagaaaucaugaaugucaugaa

SEQ ID NO: 421254 - RNA, 32 nt, Human
gagaaaucccagggcauuguaccaaggaccua

SEQ ID NO: 421255 - RNA, 32 nt, Human
gagaaaucuccucaaacccagaagguuuaauc

SEQ ID NO: 421256 - RNA, 32 nt, Human
gagaaaugaaguauucccauucccaggcaccu

SEQ ID NO: 421257 - RNA, 32 nt, Human
gagaaaugagugaaugugggugaucugcuuuu

SEQ ID NO: 421258 - RNA, 30 nt, Human
gagaaaugcacuuuucagcuccuguuucag

SEQ ID NO: 421259 - RNA, 32 nt, Human
gagaaaugccaggaucguggcucacagggacc

SEQ ID NO: 421260 - RNA, 32 nt, Human
gagaaaugccuguucagcuacuuugcccaugu

SEQ ID NO: 421261 - RNA, 32 nt, Human
gagaaaugcuacuggcauuuaguggaugaugg

SEQ ID NO: 421262 - RNA, 32 nt, Human
gagaaauggacauggcuggagacuuugagucc

SEQ ID NO: 421263 - RNA, 18 nt, Human
gagaaauggacucaggga

SEQ ID NO: 421264 - RNA, 32 nt, Human
gagaaauggacuucgccugaggcuguuugcca

SEQ ID NO: 421265 - RNA, 32 nt, Human
gagaaauggagcucuguggcuucccacccaaa

SEQ ID NO: 421266 - RNA, 32 nt, Human
gagaaauggcucuguauaaucuauggcuaucc

SEQ ID NO: 421267 - RNA, 32 nt, Human
gagaaaugggaaagaagagggagggagagaga

SEQ ID NO: 421268 - RNA, 32 nt, Human
gagaaaugggguggaauagggaacuguaaugg

SEQ ID NO: 421269 - RNA, 32 nt, Human
gagaaauggucagaaggaacgacaccacagaa

SEQ ID NO: 421270 - RNA, 32 nt, Human
gagaaauguacccuauuauuuccuucauaaag

SEQ ID NO: 421271 - RNA, 32 nt, Human
gagaaauguaguguuucauuuuguaugcauua

SEQ ID NO: 421272 - RNA, 32 nt, Human
gagaaauguggacagagggcuugaagacaugg

SEQ ID NO: 421273 - RNA, 32 nt, Human
gagaaaugugguggaaacaggagugaauaaag

SEQ ID NO: 421274 - RNA, 32 nt, Human
gagaaauuagacuguaccuguguacacuucua

SEQ ID NO: 421275 - RNA, 32 nt, Human
gagaaauuaggggcgggugggaagggauggga

SEQ ID NO: 421276 - RNA, 32 nt, Human
gagaaauucaggcugggugcaguggcucacac

SEQ ID NO: 421277 - RNA, 32 nt, Human
gagaaauuccucuuuaaaugaacaaguaacca

SEQ ID NO: 421278 - RNA, 32 nt, Human
gagaaauuggggacccugaagaaagggggcca

SEQ ID NO: 421279 - RNA, 32 nt, Human
gagaaauuucaaugaaaagaaaagccaaugga

SEQ ID NO: 421280 - RNA, 32 nt, Human
gagaaauuuggugaagaaacaugggaaaaauu

SEQ ID NO: 421281 - RNA, 32 nt, Human
gagaaauuuuguuaccucuauccuggcuugcc

SEQ ID NO: 421282 - RNA, 21 nt, Human
gagaacaaaacaaaacaaaca

SEQ ID NO: 421283 - RNA, 32 nt, Human
gagaacaaaaggcaaaggaaggaggaauucgc

SEQ ID NO: 421284 - RNA, 23 nt, Human
gagaacaaagacacaacauacca

SEQ ID NO: 421285 - RNA, 32 nt, Human
gagaacaacagaaugaaagaaauguaucucug

SEQ ID NO: 421286 - RNA, 32 nt, Human
gagaacaaccugcuggaaagaccugggcagaa

SEQ ID NO: 421287 - RNA, 32 nt, Human
gagaacaagaugaccugggccccgagaaacaa

SEQ ID NO: 421288 - RNA, 32 nt, Human
gagaacaaggaccaccuggguucuccagucuu

SEQ ID NO: 421289 - RNA, 32 nt, Human
gagaacaaggcggcgcuggaggcgugggucag

SEQ ID NO: 421290 - RNA, 32 nt, Human
gagaacaaggucacugaccucugccuacaauc

SEQ ID NO: 421291 - RNA, 19 nt, Human
gagaacacacgagcacgua

SEQ ID NO: 421292 - RNA, 32 nt, Human
gagaacacagaaugagccagcagacuggccag

SEQ ID NO: 421293 - RNA, 32 nt, Human
gagaacacagccgauucaccugagcaggaccu

SEQ ID NO: 421294 - RNA, 32 nt, Human
gagaacacagguuaccuuguucuugaaacacg

SEQ ID NO: 421295 - RNA, 24 nt, Human
gagaacacaguagauguguaguca

SEQ ID NO: 421296 - RNA, 32 nt, Human
gagaacaccaaaacaaaaaguaaaaagcagaa

SEQ ID NO: 421297 - RNA, 32 nt, Human
gagaacaccagagaccucaaauuacuuuguga

SEQ ID NO: 421298 - RNA, 19 nt, Human
gagaacacccaguucuuga

SEQ ID NO: 421299 - RNA, 32 nt, Human
gagaacacccaugaacguuccccaaguucucc

SEQ ID NO: 421300 - RNA, 20 nt, Human
gagaacacgaggaaggcaga

SEQ ID NO: 421301 - RNA, 32 nt, Human
gagaacacguggacacagggaggagaacaaca

SEQ ID NO: 421302 - RNA, 32 nt, Human
gagaacacugaauugccaacgagcaggagagu

SEQ ID NO: 421303 - RNA, 20 nt, Human
gagaacacugugagcauuuu

SEQ ID NO: 421304 - RNA, 32 nt, Human
gagaacacuguggcugaaauauaauuuuucuc

SEQ ID NO: 421305 - RNA, 32 nt, Human
gagaacagaaauauuccuacugucuuuggaaa

SEQ ID NO: 421306 - RNA, 32 nt, Human
gagaacagaagggugacgcugcccagacucac

SEQ ID NO: 421307 - RNA, 32 nt, Human
gagaacagagaagaaaagacacucugaaaaag

SEQ ID NO: 421308 - RNA, 32 nt, Human
gagaacagagcaauggcagcugcugugugagg

SEQ ID NO: 421309 - RNA, 19 nt, Human
gagaacagcaaguuccuga

SEQ ID NO: 421310 - RNA, 32 nt, Human
gagaacagccugagggagguggaggccuguua

SEQ ID NO: 421311 - RNA, 32 nt, Human
gagaacagccuggccaacagacgggagccacu

SEQ ID NO: 421312 - RNA, 23 nt, Human
gagaacagccuucaucuccuccu

SEQ ID NO: 421313 - RNA, 32 nt, Human
gagaacaggaacagaacugagcaggggcaggu

SEQ ID NO: 421314 - RNA, 21 nt, Human
gagaacaggaagaggcggaug

SEQ ID NO: 421315 - RNA, 32 nt, Human
gagaacaggagggaggaggagaugaaagagga

SEQ ID NO: 421316 - RNA, 32 nt, Human
gagaacaggcccugugcaggaccagaaguaau

SEQ ID NO: 421317 - RNA, 32 nt, Human
gagaacaggcugaggggagcugagaggagcug

SEQ ID NO: 421318 - RNA, 31 nt, Human
gagaacaggguggaagaucugggggagcuaa

SEQ ID NO: 421319 - RNA, 24 nt, Human
gagaacaguguagccuggccugua

SEQ ID NO: 421320 - RNA, 32 nt, Human
gagaacagugucaucucuuccuuuguugauaa

SEQ ID NO: 421321 - RNA, 32 nt, Human
gagaacauaagccugcucguaaagcucaaucc

SEQ ID NO: 421322 - RNA, 32 nt, Human
gagaacauagggccaggcacuguggcucaugc

SEQ ID NO: 421323 - RNA, 32 nt, Human
gagaacauauuuccaagacagaggauucuaug

SEQ ID NO: 421324 - RNA, 22 nt, Human
gagaacaucccgcuucugaagc

SEQ ID NO: 421325 - RNA, 23 nt, Human
gagaacauccgcgaaggcuguug

SEQ ID NO: 421326 - RNA, 32 nt, Human
gagaacauccuucucccucagcuggagggagc

SEQ ID NO: 421327 - RNA, 32 nt, Human
gagaacaucugcccuccagccccugaccccaa

SEQ ID NO: 421328 - RNA, 22 nt, Human
gagaacauggucacccaaaagc

SEQ ID NO: 421329 - RNA, 32 nt, Human
gagaacauguguuuucugauaacucacaaccc

SEQ ID NO: 421330 - RNA, 32 nt, Human
gagaacauuaaacuaccagucugguaagcugg

SEQ ID NO: 421331 - RNA, 32 nt, Human
gagaaccaagugaccgacucauuuacaacuga

SEQ ID NO: 421332 - RNA, 32 nt, Human
gagaaccaauucuggagaacagccucacuucu

SEQ ID NO: 421333 - RNA, 32 nt, Human
gagaaccacagaaaaucugccugccagguguu

SEQ ID NO: 421334 - RNA, 32 nt, Human
gagaaccacccuugcuugaggaauucugaagc

SEQ ID NO: 421335 - RNA, 32 nt, Human
gagaaccaccuaccccugacuucuguuuaguc

SEQ ID NO: 421336 - RNA, 32 nt, Human
gagaaccacuggucaggucagcucccagcucc

SEQ ID NO: 421337 - RNA, 32 nt, Human
gagaaccaggagagaugauggugugauuacag

SEQ ID NO: 421338 - RNA, 32 nt, Human
gagaaccaggaggcagagcgggaggguggcau

SEQ ID NO: 421339 - RNA, 32 nt, Human
gagaaccaggggucugugccucuccucauucc

SEQ ID NO: 421340 - RNA, 32 nt, Human
gagaaccaucgagccuguggaaguucuuucuc

SEQ ID NO: 421341 - RNA, 32 nt, Human
gagaacccacaggacaccaaagagagcccacc

SEQ ID NO: 421342 - RNA, 32 nt, Human
gagaacccaccucucccccaagggccucagcc

SEQ ID NO: 421343 - RNA, 32 nt, Human
gagaacccagagcaaugacaccagucuggacu

SEQ ID NO: 421344 - RNA, 32 nt, Human
gagaacccagcucugggaccaagucacuugcu

SEQ ID NO: 421345 - RNA, 32 nt, Human
gagaacccauccagaucccccuucccuucuuc

SEQ ID NO: 421346 - RNA, 32 nt, Human
gagaaccccucagggcagauagcuggcucaga

SEQ ID NO: 421347 - RNA, 32 nt, Human
gagaaccccugccaugcucuggucuguucuga

SEQ ID NO: 421348 - RNA, 32 nt, Human
gagaaccccugccuccgucgcggcuccuggag

SEQ ID NO: 421349 - RNA, 32 nt, Human
gagaacccgcccggaggaagaaggaaggcgcg

SEQ ID NO: 421350 - RNA, 32 nt, Human
gagaacccgggccuuccccucccagugccucc

SEQ ID NO: 421351 - RNA, 32 nt, Human
gagaacccucaccucugaucuggccucuacga

SEQ ID NO: 421352 - RNA, 32 nt, Human
gagaacccugcaaauuuucuuccucauaauug

SEQ ID NO: 421353 - RNA, 32 nt, Human
gagaacccugcaucuugcacuuugggaauaag

SEQ ID NO: 421354 - RNA, 32 nt, Human
gagaacccugugggggcggcugugggggaggu

SEQ ID NO: 421355 - RNA, 32 nt, Human
gagaacccuuccccauuuucauauccuuucuu

SEQ ID NO: 421356 - RNA, 32 nt, Human
gagaaccgaauuugaacacugaccuugucauu

SEQ ID NO: 421357 - RNA, 32 nt, Human
gagaaccgauauagcagugcccagggguagag

SEQ ID NO: 421358 - RNA, 32 nt, Human
gagaaccgcaucacuucauuugcucagaccca

SEQ ID NO: 421359 - RNA, 32 nt, Human
gagaaccgccaggaggcuggagcccagccagg

SEQ ID NO: 421360 - RNA, 32 nt, Human
gagaaccuagaggugguggugcaggugggaau

SEQ ID NO: 421361 - RNA, 19 nt, Human
gagaaccucaagcuccugg

SEQ ID NO: 421362 - RNA, 19 nt, Human
gagaaccucacacgccuga

SEQ ID NO: 421363 - RNA, 21 nt, Human
gagaaccucauccaugccugg

SEQ ID NO: 421364 - RNA, 19 nt, Human
gagaaccuccacccucuga

SEQ ID NO: 421365 - RNA, 32 nt, Human
gagaaccuccacccucugacaccauggucaac

SEQ ID NO: 421366 - RNA, 18 nt, Human
gagaaccugaguucccgg

SEQ ID NO: 421367 - RNA, 32 nt, Human
gagaaccugcaaccguuuccgccuccugcuag

SEQ ID NO: 421368 - RNA, 19 nt, Human
gagaaccugccuuccuaga

SEQ ID NO: 421369 - RNA, 32 nt, Human
gagaaccugcggaaggagaagcuucccaggac

SEQ ID NO: 421370 - RNA, 20 nt, Human
gagaaccugcugcuuccuga

SEQ ID NO: 421371 - RNA, 19 nt, Human
gagaaccuggaguuccuga

SEQ ID NO: 421372 - RNA, 32 nt, Human
gagaaccuguauuuccuucuucaacaaagaag

SEQ ID NO: 421373 - RNA, 19 nt, Human
gagaaccugucccuccuga

SEQ ID NO: 421374 - RNA, 21 nt, Human
gagaaccuuauauuguccuga

SEQ ID NO: 421375 - RNA, 19 nt, Human
gagaaccuucugcuucuga

SEQ ID NO: 421376 - RNA, 20 nt, Human
gagaaccuugggucuggaga

SEQ ID NO: 421377 - RNA, 19 nt, Human
gagaaccuuuccguuccug

SEQ ID NO: 421378 - RNA, 32 nt, Human
gagaacgaccuuucuuucuuuauuucucagcc

SEQ ID NO: 421379 - RNA, 32 nt, Human
gagaacgacucccagaaaauuagccgggcgug

SEQ ID NO: 421380 - RNA, 32 nt, Human
gagaacggagaagaaguuguagcagagggaaa

SEQ ID NO: 421381 - RNA, 32 nt, Human
gagaacggcgugaacccgggaggcggagcuug

SEQ ID NO: 421382 - RNA, 32 nt, Human
gagaacgggaaagagggaggugggaaauagaa

SEQ ID NO: 421383 - RNA, 32 nt, Human
gagaacgggcagacugccuccucaaguggguc

SEQ ID NO: 421384 - RNA, 32 nt, Human
gagaacgggcccagggugcuguggagaucaac

SEQ ID NO: 421385 - RNA, 32 nt, Human
gagaacguggcccagcccuggagggcaggcgg

SEQ ID NO: 421386 - RNA, 32 nt, Human
gagaacuaacccaauauggcaggaagccacug

SEQ ID NO: 421387 - RNA, 16 nt, Human
gagaacuagugaagua

SEQ ID NO: 421388 - RNA, 32 nt, Human
gagaacuauuaacugccuuccuucugugggcu

SEQ ID NO: 421389 - RNA, 20 nt, Human
gagaacucacagcucuggga

SEQ ID NO: 421390 - RNA, 32 nt, Human
gagaacucaccauugcacuccagccuggauga

SEQ ID NO: 421391 - RNA, 32 nt, Human
gagaacucauacuggagagaagcccuauguuu

SEQ ID NO: 421392 - RNA, 32 nt, Human
gagaacucauuuccaacuguacaaccuuuaug

SEQ ID NO: 421393 - RNA, 32 nt, Human
gagaacuccaaacugucccagcagguuugcuu

SEQ ID NO: 421394 - RNA, 32 nt, Human
gagaacucccacuaaaaggugaaaaugcucaa

SEQ ID NO: 421395 - RNA, 32 nt, Human
gagaacucccacuaaaagugaaaaugcucaaa

SEQ ID NO: 421396 - RNA, 32 nt, Human
gagaacuccgaggagagcagggggaguggagg

SEQ ID NO: 421397 - RNA, 32 nt, Human
gagaacucuccccuucuucccucucucauccc

SEQ ID NO: 421398 - RNA, 32 nt, Human
gagaacucucucuucccacuaagugauauaac

SEQ ID NO: 421399 - RNA, 19 nt, Human
gagaacugaauccaaggau

SEQ ID NO: 421400 - RNA, 31 nt, Human
gagaacugacuucucucuuaaaaaguacaga

SEQ ID NO: 421401 - RNA, 32 nt, Human
gagaacugagauggaauucaagagagaagugu

SEQ ID NO: 421402 - RNA, 32 nt, Human
gagaacugaggcugaggguagagggaguaugc

SEQ ID NO: 421403 - RNA, 32 nt, Human
gagaacugagugacccagaagggguggcgaag

SEQ ID NO: 421404 - RNA, 32 nt, Human
gagaacugcacagaggccugguguggacauug

SEQ ID NO: 421405 - RNA, 32 nt, Human
gagaacugccugaacccaggaggcagagguug

SEQ ID NO: 421406 - RNA, 32 nt, Human
gagaacugcugaguuacugaaagaccuuuugg

SEQ ID NO: 421407 - RNA, 32 nt, Human
gagaacugcuucugucucuggagagacagaag

SEQ ID NO: 421408 - RNA, 32 nt, Human
gagaacugcuugaacccaggaggcagagguug

SEQ ID NO: 421409 - RNA, 23 nt, Human
gagaacuggcaaggaugcaguca

SEQ ID NO: 421410 - RNA, 24 nt, Human
gagaacuggcccagagcccuugga

SEQ ID NO: 421411 - RNA, 32 nt, Human
gagaacuggcuggccuuguuuccugagucuga

SEQ ID NO: 421412 - RNA, 32 nt, Human
gagaacuggcuuggugacuuugcuucacuaca

SEQ ID NO: 421413 - RNA, 32 nt, Human
gagaacugggaggaagcuggagaaaagaugcc

SEQ ID NO: 421414 - RNA, 32 nt, Human
gagaacugguuggaguuauggaaaagaugccc

SEQ ID NO: 421415 - RNA, 19 nt, Human
gagaacuguccugcagcug

SEQ ID NO: 421416 - RNA, 32 nt, Human
gagaacugucgggaccaggaagacucauucca

SEQ ID NO: 421417 - RNA, 24 nt, Human
gagaacuuacuaaaggcacuuccu

SEQ ID NO: 421418 - RNA, 17 nt, Human
gagaacuuagcagggug

SEQ ID NO: 421419 - RNA, 32 nt, Human
gagaacuuagcccagagcuagugaacgagccu

SEQ ID NO: 421420 - RNA, 32 nt, Human
gagaacuucuggccuguccucccuggcugcug

SEQ ID NO: 421421 - RNA, 18 nt, Human
gagaacuugaugcaaagu

SEQ ID NO: 421422 - RNA, 22 nt, Human
gagaacuuggcucagggcuccu

SEQ ID NO: 421423 - RNA, 22 nt, Human
gagaacuugguaacgugaagua

SEQ ID NO: 421424 - RNA, 32 nt, Human
gagaacuugguauccaugacuguggaggggcc

SEQ ID NO: 421425 - RNA, 32 nt, Human
gagaacuuggugagcuaugaauuacucucagu

SEQ ID NO: 421426 - RNA, 23 nt, Human
gagaacuuguugcgacauuuccu

SEQ ID NO: 421427 - RNA, 18 nt, Human
gagaacuuucugugagua

SEQ ID NO: 421428 - RNA, 23 nt, Human
gagaacuuugccacaggucuucu

SEQ ID NO: 421429 - RNA, 32 nt, Human
gagaacuuugggccaguagagacgggguuuca

SEQ ID NO: 421430 - RNA, 32 nt, Human
gagaagaaaagccagaaaauuagcuuaaaagc

SEQ ID NO: 421431 - RNA, 32 nt, Human
gagaagaaaauugacaaauacacagagguccu

SEQ ID NO: 421432 - RNA, 17 nt, Human
gagaagaaagauacaga

SEQ ID NO: 421433 - RNA, 32 nt, Human
gagaagaaaucaguggauacuggauuugcucc

SEQ ID NO: 421434 - RNA, 24 nt, Human
gagaagaacaaucgggcccagcca

SEQ ID NO: 421435 - RNA, 25 nt, Human
gagaagaacccuugggccccuggga

SEQ ID NO: 421436 - RNA, 32 nt, Human
gagaagaagaagcagaaggagcaggagcaagg

SEQ ID NO: 421437 - RNA, 32 nt, Human
gagaagaagagaaagaaaagaaaaagaaaaag

SEQ ID NO: 421438 - RNA, 32 nt, Human
gagaagaagaggagauggaggggccaggagcc

SEQ ID NO: 421439 - RNA, 32 nt, Human
gagaagaagauaagcuggaagaggccagggaa

SEQ ID NO: 421440 - RNA, 32 nt, Human
gagaagaaggaaaggcacagguggagaacagu

SEQ ID NO: 421441 - RNA, 32 nt, Human
gagaagaaggaacgagagaaagagugagagga

SEQ ID NO: 421442 - RNA, 32 nt, Human
gagaagaauguucaugcuaauucuucuuacau

SEQ ID NO: 421443 - RNA, 32 nt, Human
gagaagaauucucaucauaguugggagccauu

SEQ ID NO: 421444 - RNA, 32 nt, Human
gagaagacacacuugggacacagugaagacag

SEQ ID NO: 421445 - RNA, 32 nt, Human
gagaagacacuaagggccccacaggcuuguuu

SEQ ID NO: 421446 - RNA, 32 nt, Human
gagaagacauacugcagggcucagugagggag

SEQ ID NO: 421447 - RNA, 32 nt, Human
gagaagacccagcuggaguucaugucgcaaca

SEQ ID NO: 421448 - RNA, 31 nt, Human
gagaagacccgauaagugucacuggauguga

SEQ ID NO: 421449 - RNA, 32 nt, Human
gagaagaccuucuagugagccugggccaggag

SEQ ID NO: 421450 - RNA, 32 nt, Human
gagaagaccuugggccaagaugcuaaauggga

SEQ ID NO: 421451 - RNA, 32 nt, Human
gagaagacuacuccuccaccucuuguggaggg

SEQ ID NO: 421452 - RNA, 32 nt, Human
gagaagacugggcuagggagaaugcagagagg

SEQ ID NO: 421453 - RNA, 24 nt, Human
gagaagacuucaucaugacaggac

SEQ ID NO: 421454 - RNA, 32 nt, Human
gagaagagagagggagauaaaagggggagaca

SEQ ID NO: 421455 - RNA, 32 nt, Human
gagaagagaggagaggagagaggcagagagcg

SEQ ID NO: 421456 - RNA, 32 nt, Human
gagaagagaguuuccacguugucaucauagga

SEQ ID NO: 421457 - RNA, 32 nt, Human
gagaagagcaaagaaguuaaaagagaaguguc

SEQ ID NO: 421458 - RNA, 18 nt, Human
gagaagagcagcacguua

SEQ ID NO: 421459 - RNA, 32 nt, Human
gagaagagccagcccuucccuccuggggucua

SEQ ID NO: 421460 - RNA, 32 nt, Human
gagaagagccugacgcagaggaagcaucugag

SEQ ID NO: 421461 - RNA, 32 nt, Human
gagaagagccugggcaacauagugagacccca

SEQ ID NO: 421462 - RNA, 32 nt, Human
gagaagaggaaccauuugugcagaucaucuag

SEQ ID NO: 421463 - RNA, 32 nt, Human
gagaagaggaagggagcagagagcacugagag

SEQ ID NO: 421464 - RNA, 32 nt, Human
gagaagaggaagggaggaagggaacagagagg

SEQ ID NO: 421465 - RNA, 32 nt, Human
gagaagaggacagaggaugugugggaaagcug

SEQ ID NO: 421466 - RNA, 32 nt, Human
gagaagaggagaaaaauaaaacaaggagggag

SEQ ID NO: 421467 - RNA, 32 nt, Human
gagaagaggagaaaucuguagugagcaaagga

SEQ ID NO: 421468 - RNA, 32 nt, Human
gagaagaggagaaguuuuagaccagagaaacc

SEQ ID NO: 421469 - RNA, 32 nt, Human
gagaagaggagagagaagccagggccgagcgu

SEQ ID NO: 421470 - RNA, 32 nt, Human
gagaagaggagaggcagagagggcgcggggac

SEQ ID NO: 421471 - RNA, 32 nt, Human
gagaagaggaggguagaaaugaaggaaaaauu

SEQ ID NO: 421472 - RNA, 32 nt, Human
gagaagaggcuggccaagccacaguucugacg

SEQ ID NO: 421473 - RNA, 32 nt, Human
gagaagagggaagugaaaagaucuucuuguga

SEQ ID NO: 421474 - RNA, 21 nt, Human
gagaagagggagaggcaggag

SEQ ID NO: 421475 - RNA, 19 nt, Human
gagaagagggccuggugga

SEQ ID NO: 421476 - RNA, 32 nt, Human
gagaagagggcugggcgcuccaugauuuagcc

SEQ ID NO: 421477 - RNA, 32 nt, Human
gagaagaggggcccuuggcugcagagaucagc

SEQ ID NO: 421478 - RNA, 32 nt, Human
gagaagaggggcuggagugcggcuggucugcg

SEQ ID NO: 421479 - RNA, 32 nt, Human
gagaagagggucaucacuauccuccagaaccc

SEQ ID NO: 421480 - RNA, 32 nt, Human
gagaagaguaagaauguagaccagcuuauuga

SEQ ID NO: 421481 - RNA, 32 nt, Human
gagaagaucugccuccacggagccgcuguccc

SEQ ID NO: 421482 - RNA, 32 nt, Human
gagaagaucuggcaccacaccuucuacgauua

SEQ ID NO: 421483 - RNA, 21 nt, Human
gagaagaucuuggaggaccug

SEQ ID NO: 421484 - RNA, 31 nt, Human
gagaagaugaacacggccgaccaggccaggg

SEQ ID NO: 421485 - RNA, 32 nt, Human
gagaagaugaaccagucuucuuccccucacua

SEQ ID NO: 421486 - RNA, 32 nt, Human
gagaagaugccaauguuucauccaccggcugc

SEQ ID NO: 421487 - RNA, 32 nt, Human
gagaagaugccauaaaauaaacaccucccuaa

SEQ ID NO: 421488 - RNA, 31 nt, Human
gagaagaugcggaaggagaauggggaggcga

SEQ ID NO: 421489 - RNA, 22 nt, Human
gagaagauggaccaaggagaga

SEQ ID NO: 421490 - RNA, 32 nt, Human
gagaagaugggagagggaagggggagguguga

SEQ ID NO: 421491 - RNA, 31 nt, Human
gagaagauggguggagaggaugaugaacuca

SEQ ID NO: 421492 - RNA, 31 nt, Human
gagaagauggugcugcggcggcugcuggccg

SEQ ID NO: 421493 - RNA, 32 nt, Human
gagaagauuuaucuugacuuaagacuuggaau

SEQ ID NO: 421494 - RNA, 32 nt, Human
gagaagauuuccaugaaagaauugcagcccug

SEQ ID NO: 421495 - RNA, 32 nt, Human
gagaagcaaaaaugagauccaggcuggagcgg

SEQ ID NO: 421496 - RNA, 32 nt, Human
gagaagcaaucagcugccauccugcccuccag

SEQ ID NO: 421497 - RNA, 32 nt, Human
gagaagcaaugugaaaagcaucaggaaagcug

SEQ ID NO: 421498 - RNA, 32 nt, Human
gagaagcacagcaauaggaagucucuccacaa

SEQ ID NO: 421499 - RNA, 32 nt, Human
gagaagcacagcaauauacauucauaauauac

SEQ ID NO: 421500 - RNA, 32 nt, Human
gagaagcacagcaugcgugccugcacuugccc

SEQ ID NO: 421501 - RNA, 32 nt, Human
gagaagcaccugccagcaacagcuuccuucuu

SEQ ID NO: 421502 - RNA, 19 nt, Human
gagaagcacgauggcucua

SEQ ID NO: 421503 - RNA, 18 nt, Human
gagaagcacucuacucua

SEQ ID NO: 421504 - RNA, 18 nt, Human
gagaagcacucugaauuc

SEQ ID NO: 421505 - RNA, 21 nt, Human
gagaagcacuguugaaauuua

SEQ ID NO: 421506 - RNA, 20 nt, Human
gagaagcacuuugggauucu

SEQ ID NO: 421507 - RNA, 32 nt, Human
gagaagcagagaagaagaaaggagcugaggag

SEQ ID NO: 421508 - RNA, 32 nt, Human
gagaagcagagagcgagagggggaagaggagc

SEQ ID NO: 421509 - RNA, 20 nt, Human
gagaagcagaggcaauucua

SEQ ID NO: 421510 - RNA, 32 nt, Human
gagaagcagcagagagaggcgcuggagcgggc

SEQ ID NO: 421511 - RNA, 19 nt, Human
gagaagcagcaggacuuua

SEQ ID NO: 421512 - RNA, 32 nt, Human
gagaagcagccccugagggagucugcugaggc

SEQ ID NO: 421513 - RNA, 20 nt, Human
gagaagcaggaagagcacug

SEQ ID NO: 421514 - RNA, 20 nt, Human
gagaagcaggagcaacucua

SEQ ID NO: 421515 - RNA, 21 nt, Human
gagaagcaggccaggccuggg

SEQ ID NO: 421516 - RNA, 23 nt, Human
gagaagcaggcuugcaagaaugg

SEQ ID NO: 421517 - RNA, 32 nt, Human
gagaagcagggugggcugcuggcagugcagga

SEQ ID NO: 421518 - RNA, 32 nt, Human
gagaagcagucagugauggaggcugcaagagu

SEQ ID NO: 421519 - RNA, 32 nt, Human
gagaagcagucugaugacagagagaggcucua

SEQ ID NO: 421520 - RNA, 15 nt, Human
gagaagcaucugggg

SEQ ID NO: 421521 - RNA, 21 nt, Human
gagaagcaugcaacaauuaga

SEQ ID NO: 421522 - RNA, 32 nt, Human
gagaagcauggcgcccugcccacccacugcgc

SEQ ID NO: 421523 - RNA, 22 nt, Human
gagaagcauuaaugaaacuuua

SEQ ID NO: 421524 - RNA, 22 nt, Human
gagaagcauucagagggcacug

SEQ ID NO: 421525 - RNA, 18 nt, Human
gagaagcauuccacucug

SEQ ID NO: 421526 - RNA, 22 nt, Human
gagaagcauuugguaagcuuua

SEQ ID NO: 421527 - RNA, 32 nt, Human
gagaagccaaagauguugaccaggaagaucaa

SEQ ID NO: 421528 - RNA, 24 nt, Human
gagaagccaccuucaggccuggga

SEQ ID NO: 421529 - RNA, 32 nt, Human
gagaagccacugugggcaccaccgugggggaa

SEQ ID NO: 421530 - RNA, 32 nt, Human
gagaagccagaggcacuggcugcacuggaccc

SEQ ID NO: 421531 - RNA, 32 nt, Human
gagaagccagcgccucuacaccccagaucccu

SEQ ID NO: 421532 - RNA, 32 nt, Human
gagaagccagggugauagcccagacucugccc

SEQ ID NO: 421533 - RNA, 32 nt, Human
gagaagccaguacuugaaucgcuauauuucua

SEQ ID NO: 421534 - RNA, 32 nt, Human
gagaagccagugcggcagguucacaggcgagg

SEQ ID NO: 421535 - RNA, 32 nt, Human
gagaagccaugcguuccagccuuccacggucc

SEQ ID NO: 421536 - RNA, 32 nt, Human
gagaagccauggaagguugugguuguaaauga

SEQ ID NO: 421537 - RNA, 32 nt, Human
gagaagccauuuuuagcucagagcaacccuua

SEQ ID NO: 421538 - RNA, 32 nt, Human
gagaagcccaggaaauuucuccaccuguguuu

SEQ ID NO: 421539 - RNA, 23 nt, Human
gagaagcccuaggcaaagacugg

SEQ ID NO: 421540 - RNA, 32 nt, Human
gagaagcccucuuuauuuugguaaaugucacu

SEQ ID NO: 421541 - RNA, 32 nt, Human
gagaagccgcuggccuuugccgcuugaaagcu

SEQ ID NO: 421542 - RNA, 17 nt, Human
gagaagccgggaggcuc

SEQ ID NO: 421543 - RNA, 19 nt, Human
gagaagccuacaucuucuu

SEQ ID NO: 421544 - RNA, 32 nt, Human
gagaagccuacaucuucuuauucuauuuagga

SEQ ID NO: 421545 - RNA, 19 nt, Human
gagaagccucccucauucc

SEQ ID NO: 421546 - RNA, 32 nt, Human
gagaagccugauauguaacccaggcggguggg

SEQ ID NO: 421547 - RNA, 32 nt, Human
gagaagccuugcaucaaccucuugggccucag

SEQ ID NO: 421548 - RNA, 32 nt, Human
gagaagccuuucuguugcccugcaaggagcag

SEQ ID NO: 421549 - RNA, 32 nt, Human
gagaagcgcggccuggccuggccuggguggcg

SEQ ID NO: 421550 - RNA, 32 nt, Human
gagaagcgcugguaggagaggcuuuaaggugg

SEQ ID NO: 421551 - RNA, 32 nt, Human
gagaagcggccgcggccagggaacggggcauc

SEQ ID NO: 421552 - RNA, 32 nt, Human
gagaagcuaagcugcagcucguagcugcuacc

SEQ ID NO: 421553 - RNA, 23 nt, Human
gagaagcuaaggcagguggauca

SEQ ID NO: 421554 - RNA, 32 nt, Human
gagaagcuagucuguuuaaaacaggaaguuau

SEQ ID NO: 421555 - RNA, 32 nt, Human
gagaagcuauguuuagcaucuucugucaugag

SEQ ID NO: 421556 - RNA, 32 nt, Human
gagaagcucacucuguguuaggcacaguggug

SEQ ID NO: 421557 - RNA, 32 nt, Human
gagaagcucacuguucacugugcaaagcccca

SEQ ID NO: 421558 - RNA, 32 nt, Human
gagaagcucacuuucaaaauuugauauggaca

SEQ ID NO: 421559 - RNA, 32 nt, Human
gagaagcucagcgcccagccuggggaauuuaa

SEQ ID NO: 421560 - RNA, 32 nt, Human
gagaagcucagcugccuuccuggggcuggucc

SEQ ID NO: 421561 - RNA, 32 nt, Human
gagaagcucugggacuggggcagcagcaaggc

SEQ ID NO: 421562 - RNA, 32 nt, Human
gagaagcucuguuuuugucauucauguacauu

SEQ ID NO: 421563 - RNA, 32 nt, Human
gagaagcugagagaagaggaaaagaggagugg

SEQ ID NO: 421564 - RNA, 32 nt, Human
gagaagcugauccugaaauucauauagaaaug

SEQ ID NO: 421565 - RNA, 32 nt, Human
gagaagcugcagcgacuuuauggaaggagaag

SEQ ID NO: 421566 - RNA, 32 nt, Human
gagaagcugcagcugcaggagugcuugugggc

SEQ ID NO: 421567 - RNA, 32 nt, Human
gagaagcugccugucuacaucagccugggcug

SEQ ID NO: 421568 - RNA, 32 nt, Human
gagaagcugcuggaggagaugcccaaggauca

SEQ ID NO: 421569 - RNA, 32 nt, Human
gagaagcuggacugcagcugguuucaggaacu

SEQ ID NO: 421570 - RNA, 32 nt, Human
gagaagcugggaaguaaggaggugaggugaau

SEQ ID NO: 421571 - RNA, 32 nt, Human
gagaagcuguguuacugaacagccuggugaua

SEQ ID NO: 421572 - RNA, 32 nt, Human
gagaagcuuguugacauuuucuccccuuccuc

SEQ ID NO: 421573 - RNA, 32 nt, Human
gagaagcuuuccugccaaaucaaaggcugaga

SEQ ID NO: 421574 - RNA, 21 nt, Human
gagaaggaaaagccucuggga

SEQ ID NO: 421575 - RNA, 22 nt, Human
gagaaggaaaagugacgaagag

SEQ ID NO: 421576 - RNA, 23 nt, Human
gagaaggaaacgggaguggagag

SEQ ID NO: 421577 - RNA, 32 nt, Human
gagaaggaaagcuucuuucugggcagccagag

SEQ ID NO: 421578 - RNA, 21 nt, Human
gagaaggaaaguacacgggag

SEQ ID NO: 421579 - RNA, 32 nt, Human
gagaaggaagaaacccggacuggaggagguga

SEQ ID NO: 421580 - RNA, 32 nt, Human
gagaaggaagaaagaaaagaaauaagaagaga

SEQ ID NO: 421581 - RNA, 32 nt, Human
gagaaggaagaaaggugaccggcaaagggugg

SEQ ID NO: 421582 - RNA, 32 nt, Human
gagaaggaagagaccaggugggcucugagaca

SEQ ID NO: 421583 - RNA, 32 nt, Human
gagaaggaagaggaaagaaaaauugugcagag

SEQ ID NO: 421584 - RNA, 32 nt, Human
gagaaggaagcauggccugggagcuuggaagg

SEQ ID NO: 421585 - RNA, 32 nt, Human
gagaaggaaggcagcccaggagucagguaugc

SEQ ID NO: 421586 - RNA, 22 nt, Human
gagaaggaaguacccuggggag

SEQ ID NO: 421587 - RNA, 23 nt, Human
gagaaggaauaagacggcaggag

SEQ ID NO: 421588 - RNA, 32 nt, Human
gagaaggaaucugagcagggaucgaucuggcc

SEQ ID NO: 421589 - RNA, 32 nt, Human
gagaaggaaugaccaacagggaaaguaauccu

SEQ ID NO: 421590 - RNA, 32 nt, Human
gagaaggacaagaccuguuuccuugagacuuu

SEQ ID NO: 421591 - RNA, 32 nt, Human
gagaaggacagagagacggacaccucggcccu

SEQ ID NO: 421592 - RNA, 32 nt, Human
gagaaggacaggagguauggggugggggaggg

SEQ ID NO: 421593 - RNA, 23 nt, Human
gagaaggacagggaugcggcgag

SEQ ID NO: 421594 - RNA, 18 nt, Human
gagaaggaccccuuccca

SEQ ID NO: 421595 - RNA, 22 nt, Human
gagaaggacccugggagcucug

SEQ ID NO: 421596 - RNA, 25 nt, Human
gagaaggacccugggagcucuggga

SEQ ID NO: 421597 - RNA, 32 nt, Human
gagaaggacugcacuuagaacugcauuuuggc

SEQ ID NO: 421598 - RNA, 32 nt, Human
gagaaggacugcacuuagaacugcauuuuggu

SEQ ID NO: 421599 - RNA, 32 nt, Human
gagaaggagaaggaagaaggagaggagaagaa

SEQ ID NO: 421600 - RNA, 32 nt, Human
gagaaggagacaccuccuggaggccccagucc

SEQ ID NO: 421601 - RNA, 24 nt, Human
gagaaggagagaaagagacgggag

SEQ ID NO: 421602 - RNA, 18 nt, Human
gagaaggagagaggcaga

SEQ ID NO: 421603 - RNA, 32 nt, Human
gagaaggagcagaaagauguguuuuugcaaag

SEQ ID NO: 421604 - RNA, 18 nt, Human
gagaaggagccaucucca

SEQ ID NO: 421605 - RNA, 24 nt, Human
gagaaggagcugcagaugagggag

SEQ ID NO: 421606 - RNA, 32 nt, Human
gagaaggaggaaccuuuuccuucugcagcccc

SEQ ID NO: 421607 - RNA, 32 nt, Human
gagaaggaggaagacaaaggcaagaaggaaaa

SEQ ID NO: 421608 - RNA, 32 nt, Human
gagaaggaggcacagcaggugccugaagggaa

SEQ ID NO: 421609 - RNA, 21 nt, Human
gagaaggaggcagcgcaggag

SEQ ID NO: 421610 - RNA, 32 nt, Human
gagaaggaggcaggauaccuggagauuugugg

SEQ ID NO: 421611 - RNA, 24 nt, Human
gagaaggaggcccugcugcaggag

SEQ ID NO: 421612 - RNA, 32 nt, Human
gagaaggaggcugggggaucaccagccccaag

SEQ ID NO: 421613 - RNA, 32 nt, Human
gagaaggagggagagagccaaaugucugagua

SEQ ID NO: 421614 - RNA, 32 nt, Human
gagaaggagggagggaaaaggggucaggcaca

SEQ ID NO: 421615 - RNA, 24 nt, Human
gagaaggaggucagugcucaggga

SEQ ID NO: 421616 - RNA, 32 nt, Human
gagaaggagguggaggcaggauggguccuaag

SEQ ID NO: 421617 - RNA, 32 nt, Human
gagaaggagguggggauccgagugcagugaga

SEQ ID NO: 421618 - RNA, 32 nt, Human
gagaaggaguuggaggaggaggaggaggaggc

SEQ ID NO: 421619 - RNA, 32 nt, Human
gagaaggaugaugauaagaacauggcagaaaa

SEQ ID NO: 421620 - RNA, 31 nt, Human
gagaaggauuaugaggagguugguguggauu

SEQ ID NO: 421621 - RNA, 32 nt, Human
gagaaggcaaacugaggcagcaugcacggagg

SEQ ID NO: 421622 - RNA, 19 nt, Human
gagaaggcagaccgaagag

SEQ ID NO: 421623 - RNA, 32 nt, Human
gagaaggcagagagaagaaagcagacaggaaa

SEQ ID NO: 421624 - RNA, 32 nt, Human
gagaaggcagagagcuagcuccucccuuucuu

SEQ ID NO: 421625 - RNA, 21 nt, Human
gagaaggcagaggaggaggga

SEQ ID NO: 421626 - RNA, 32 nt, Human
gagaaggcagcauacugaccaguggcuuuuug

SEQ ID NO: 421627 - RNA, 32 nt, Human
gagaaggcagccuucgaaguccugggcauugg

SEQ ID NO: 421628 - RNA, 21 nt, Human
gagaaggcagucaaguaggaa

SEQ ID NO: 421629 - RNA, 22 nt, Human
gagaaggcaucaaaggagacug

SEQ ID NO: 421630 - RNA, 32 nt, Human
gagaaggccacugguucugugccgcagcacgc

SEQ ID NO: 421631 - RNA, 22 nt, Human
gagaaggcccggaggggcucug

SEQ ID NO: 421632 - RNA, 32 nt, Human
gagaaggcgccaacagcacacagggucagggu

SEQ ID NO: 421633 - RNA, 19 nt, Human
gagaaggcgccagauagga

SEQ ID NO: 421634 - RNA, 18 nt, Human
gagaaggcggagggcucu

SEQ ID NO: 421635 - RNA, 32 nt, Human
gagaaggcggugccgagccccugcugcugcau

SEQ ID NO: 421636 - RNA, 32 nt, Human
gagaaggcguuucgcucuuguugcccaggcug

SEQ ID NO: 421637 - RNA, 32 nt, Human
gagaaggcuaaccugcagcaccagagaaaccu

SEQ ID NO: 421638 - RNA, 32 nt, Human
gagaaggcuacaggcuguguucaaugacacua

SEQ ID NO: 421639 - RNA, 32 nt, Human
gagaaggcugacuggcuggacucauugagcug

SEQ ID NO: 421640 - RNA, 32 nt, Human
gagaaggcuuuugucuuuccuccugcuacgau

SEQ ID NO: 421641 - RNA, 16 nt, Human
gagaagggaaggcaga

SEQ ID NO: 421642 - RNA, 32 nt, Human
gagaagggacuuugcugucagguccaagcccu

SEQ ID NO: 421643 - RNA, 32 nt, Human
gagaagggagacuuccgaggaagauuaggcag

SEQ ID NO: 421644 - RNA, 32 nt, Human
gagaagggagagagagcuagagggacaaagag

SEQ ID NO: 421645 - RNA, 32 nt, Human
gagaagggagagagugggaguuucccagcccg

SEQ ID NO: 421646 - RNA, 32 nt, Human
gagaagggagcacuggcuuugcuuucaucagg

SEQ ID NO: 421647 - RNA, 32 nt, Human
gagaagggagccccaggcuggagcagcaugag

SEQ ID NO: 421648 - RNA, 32 nt, Human
gagaagggaggaggugggggaggagggcucuu

SEQ ID NO: 421649 - RNA, 32 nt, Human
gagaagggaggcaagggaggggcagcagaacc

SEQ ID NO: 421650 - RNA, 32 nt, Human
gagaagggagggaagagagcagaagggaagaa

SEQ ID NO: 421651 - RNA, 32 nt, Human
gagaagggagggaggaagacaggaaggaagga

SEQ ID NO: 421652 - RNA, 22 nt, Human
gagaagggauuucaccauguug

SEQ ID NO: 421653 - RNA, 32 nt, Human
gagaagggcaggggcaggagagggcugcggag

SEQ ID NO: 421654 - RNA, 32 nt, Human
gagaagggcagguguccggagcugucggggug

SEQ ID NO: 421655 - RNA, 22 nt, Human
gagaagggccagaucgcgggag

SEQ ID NO: 421656 - RNA, 32 nt, Human
gagaagggcccggagggugucuccccaagcca

SEQ ID NO: 421657 - RNA, 32 nt, Human
gagaagggccucucccccaacccucagccguu

SEQ ID NO: 421658 - RNA, 32 nt, Human
gagaagggcggcagaggcaguggggcuggcuc

SEQ ID NO: 421659 - RNA, 32 nt, Human
gagaagggcgugaacccgggaagcggagcuug

SEQ ID NO: 421660 - RNA, 32 nt, Human
gagaagggcgugaacccgggaggcggagcuug

SEQ ID NO: 421661 - RNA, 32 nt, Human
gagaagggcugccccgggcccucugguucucg

SEQ ID NO: 421662 - RNA, 19 nt, Human
gagaagggcugggcccugg

SEQ ID NO: 421663 - RNA, 24 nt, Human
gagaagggcuucaggacgcgggag

SEQ ID NO: 421664 - RNA, 32 nt, Human
gagaagggcuucucucccucugccuuuccgcg

SEQ ID NO: 421665 - RNA, 21 nt, Human
gagaaggggagaccgcggcgg

SEQ ID NO: 421666 - RNA, 19 nt, Human
gagaaggggagagcaucua

SEQ ID NO: 421667 - RNA, 32 nt, Human
gagaaggggaggaggacuccagcugggcucgg

SEQ ID NO: 421668 - RNA, 32 nt, Human
gagaaggggaguggaggaagcacgggacugga

SEQ ID NO: 421669 - RNA, 18 nt, Human
gagaaggggccuccccca

SEQ ID NO: 421670 - RNA, 18 nt, Human
gagaaggggccuccucca

SEQ ID NO: 421671 - RNA, 32 nt, Human
gagaagggggaagcaccagacacuuuacagau

SEQ ID NO: 421672 - RNA, 32 nt, Human
gagaagggggagguucacauguuugcagugaa

SEQ ID NO: 421673 - RNA, 23 nt, Human
gagaagggguuucaccacauugg

SEQ ID NO: 421674 - RNA, 32 nt, Human
gagaaggguaauagguuggugcagugaauggg

SEQ ID NO: 421675 - RNA, 22 nt, Human
gagaagggucuagaagcaggag

SEQ ID NO: 421676 - RNA, 22 nt, Human
gagaaggguggaaggugcagga

SEQ ID NO: 421677 - RNA, 32 nt, Human
gagaagggugggaacccgggaggcagagcuug

SEQ ID NO: 421678 - RNA, 17 nt, Human
gagaaggguuuuuggga

SEQ ID NO: 421679 - RNA, 32 nt, Human
gagaagguacagaggccagggagugaaaaugg

SEQ ID NO: 421680 - RNA, 20 nt, Human
gagaagguacccaaagggaa

SEQ ID NO: 421681 - RNA, 32 nt, Human
gagaagguaguugaaggguagggccuuuuauu

SEQ ID NO: 421682 - RNA, 32 nt, Human
gagaaggucccauuccaggucuugcccaaguc

SEQ ID NO: 421683 - RNA, 32 nt, Human
gagaaggucugcagcuucacuccugagccagc

SEQ ID NO: 421684 - RNA, 32 nt, Human
gagaaggugaagaucagucuaagcugccacgg

SEQ ID NO: 421685 - RNA, 32 nt, Human
gagaaggugaggccaguaaccaucucauggga

SEQ ID NO: 421686 - RNA, 32 nt, Human
gagaaggugaucgcucugcucucccaaccccc

SEQ ID NO: 421687 - RNA, 32 nt, Human
gagaagguggagaagagagaagaggaagagga

SEQ ID NO: 421688 - RNA, 32 nt, Human
gagaagguggagaggaggaugggccucaggag

SEQ ID NO: 421689 - RNA, 32 nt, Human
gagaaggugggugggcucagggagaacggcca

SEQ ID NO: 421690 - RNA, 32 nt, Human
gagaagguguauuucacuggugcaauggcuug

SEQ ID NO: 421691 - RNA, 32 nt, Human
gagaagguucagaaagccaguacagagggagu

SEQ ID NO: 421692 - RNA, 32 nt, Human
gagaagguucuugugggcucugggcccauccc

SEQ ID NO: 421693 - RNA, 22 nt, Human
gagaagguuugggagaacuuug

SEQ ID NO: 421694 - RNA, 32 nt, Human
gagaagguuuucuuccuucuguugcucuggaa

SEQ ID NO: 421695 - RNA, 32 nt, Human
gagaaguaaagucagaaagaacgaacagcugu

SEQ ID NO: 421696 - RNA, 32 nt, Human
gagaaguacagaaaggcugggagcagcccaga

SEQ ID NO: 421697 - RNA, 22 nt, Human
gagaaguacuuaccaggacucu

SEQ ID NO: 421698 - RNA, 19 nt, Human
gagaaguaggaagagccug

SEQ ID NO: 421699 - RNA, 32 nt, Human
gagaagucaaaggaacuuuuguuucuccucaa

SEQ ID NO: 421700 - RNA, 32 nt, Human
gagaagucaaguuugaauacagcagcuuaguu

SEQ ID NO: 421701 - RNA, 32 nt, Human
gagaagucacaaaacagcagauuucccaagag

SEQ ID NO: 421702 - RNA, 32 nt, Human
gagaagucaguuggagaaaaugaagaaaaagg

SEQ ID NO: 421703 - RNA, 32 nt, Human
gagaaguccaaggguugcugggagagguugca

SEQ ID NO: 421704 - RNA, 32 nt, Human
gagaaguccaaggguugcugggagagguuggu

SEQ ID NO: 421705 - RNA, 25 nt, Human
gagaaguccugaguacagagacugg

SEQ ID NO: 421706 - RNA, 32 nt, Human
gagaagucgaggaagagagagacggggucaga

SEQ ID NO: 421707 - RNA, 32 nt, Human
gagaagucgggaggggacaggaagggagggcg

SEQ ID NO: 421708 - RNA, 15 nt, Human
gagaagucucuggga

SEQ ID NO: 421709 - RNA, 32 nt, Human
gagaagucucuuuccuggaaugcagcccagac

SEQ ID NO: 421710 - RNA, 16 nt, Human
gagaagucugaggcuc

SEQ ID NO: 421711 - RNA, 32 nt, Human
gagaagugaaacccaagugaaagaguauugcu

SEQ ID NO: 421712 - RNA, 32 nt, Human
gagaagugaagugccuggggucgaaggagcug

SEQ ID NO: 421713 - RNA, 22 nt, Human
gagaagugacaagaugaaggag

SEQ ID NO: 421714 - RNA, 32 nt, Human
gagaagugacaagaugaaggaggacucugagu

SEQ ID NO: 421715 - RNA, 32 nt, Human
gagaagugagggaggaagaaggcagugucccu

SEQ ID NO: 421716 - RNA, 32 nt, Human
gagaagugagucagggcagggcagcugguauc

SEQ ID NO: 421717 - RNA, 32 nt, Human
gagaagugcaaccugcauuucacuuugugguc

SEQ ID NO: 421718 - RNA, 32 nt, Human
gagaagugccagaaagcccggaagcaaggaag

SEQ ID NO: 421719 - RNA, 20 nt, Human
gagaagugccucaucccuga

SEQ ID NO: 421720 - RNA, 32 nt, Human
gagaaguggaaucacuggccugaggucacaug

SEQ ID NO: 421721 - RNA, 32 nt, Human
gagaaguggcaaagacggcagguuggacaucu

SEQ ID NO: 421722 - RNA, 22 nt, Human
gagaagugggaaagaagcaaug

SEQ ID NO: 421723 - RNA, 23 nt, Human
gagaagugggaaguagcuuggga

SEQ ID NO: 421724 - RNA, 32 nt, Human
gagaaguggguggggacagaccagcccuuccc

SEQ ID NO: 421725 - RNA, 32 nt, Human
gagaagugucagcucuggaaccagguggcccu

SEQ ID NO: 421726 - RNA, 32 nt, Human
gagaagugucccagacccauuucgccuugcug

SEQ ID NO: 421727 - RNA, 32 nt, Human
gagaaguguccccaggagguugggggaggagc

SEQ ID NO: 421728 - RNA, 32 nt, Human
gagaaguuacaucugaccuccaugucccuggu

SEQ ID NO: 421729 - RNA, 23 nt, Human
gagaaguucaacaccaaaacugg

SEQ ID NO: 421730 - RNA, 32 nt, Human
gagaaguucaagcucauccauucuuuagacac

SEQ ID NO: 421731 - RNA, 32 nt, Human
gagaaguucccagcagcucaggagaguggcug

SEQ ID NO: 421732 - RNA, 32 nt, Human
gagaaguugaaggguccuugugccaguccucc

SEQ ID NO: 421733 - RNA, 21 nt, Human
gagaaguugaccaaggaagga

SEQ ID NO: 421734 - RNA, 32 nt, Human
gagaaguugcaggguugaguuggucccggcaa

SEQ ID NO: 421735 - RNA, 32 nt, Human
gagaaguugcugauauucaucaguguguuugg

SEQ ID NO: 421736 - RNA, 32 nt, Human
gagaauaaaacaauucggcggccaguguuucc

SEQ ID NO: 421737 - RNA, 18 nt, Human
gagaauaaauccaaagac

SEQ ID NO: 421738 - RNA, 18 nt, Human
gagaauaagaauugcaga

SEQ ID NO: 421739 - RNA, 32 nt, Human
gagaauacucagaacaugaaccucuuuaaagc

SEQ ID NO: 421740 - RNA, 32 nt, Human
gagaauagaggcauguuucagcuaaacacaug

SEQ ID NO: 421741 - RNA, 32 nt, Human
gagaauagaguaugguugauucccagcauuca

SEQ ID NO: 421742 - RNA, 32 nt, Human
gagaauagcgugaacccgggaggcggagcuug

SEQ ID NO: 421743 - RNA, 32 nt, Human
gagaauagcuggaacccgggaggcagagguug

SEQ ID NO: 421744 - RNA, 32 nt, Human
gagaauaggagugacugccagugagcaagagg

SEQ ID NO: 421745 - RNA, 19 nt, Human
gagaauagugcguuccuga

SEQ ID NO: 421746 - RNA, 32 nt, Human
gagaauagugugaacccaggaggcggagcuug

SEQ ID NO: 421747 - RNA, 32 nt, Human
gagaauauaaacacaccuguuuuguuuuucuu

SEQ ID NO: 421748 - RNA, 32 nt, Human
gagaauauacacacccugucaccaucacaucu

SEQ ID NO: 421749 - RNA, 32 nt, Human
gagaauaucuguagugacagcuccugagcacc

SEQ ID NO: 421750 - RNA, 32 nt, Human
gagaauaucuugcuccccuccugagucagccu

SEQ ID NO: 421751 - RNA, 32 nt, Human
gagaauauuggcugcugauuguugccaucacg

SEQ ID NO: 421752 - RNA, 31 nt, Human
gagaaucacagcuaaugaguaacagugcuua

SEQ ID NO: 421753 - RNA, 31 nt, Human
gagaaucacagcucuaauaccuagagugacc

SEQ ID NO: 421754 - RNA, 32 nt, Human
gagaaucacauucagggcaggcuagggacacg

SEQ ID NO: 421755 - RNA, 31 nt, Human
gagaaucacauuucuuuacagguuaaagaca

SEQ ID NO: 421756 - RNA, 32 nt, Human
gagaaucaccugaacccaggaggcagagguug

SEQ ID NO: 421757 - RNA, 32 nt, Human
gagaaucacugcacuagaucacuuuguguuuu

SEQ ID NO: 421758 - RNA, 32 nt, Human
gagaaucacuuagacccgggaggcagagguug

SEQ ID NO: 421759 - RNA, 32 nt, Human
gagaaucacuugaaccagggaggcagaggcug

SEQ ID NO: 421760 - RNA, 32 nt, Human
gagaaucacuugaaccagggaggcagagguug

SEQ ID NO: 421761 - RNA, 32 nt, Human
gagaaucacuugaaccagggaggcagaguuug

SEQ ID NO: 421762 - RNA, 32 nt, Human
gagaaucacuugaaccagggaggcggagguug

SEQ ID NO: 421763 - RNA, 32 nt, Human
gagaaucacuugaacccaggaggcagagauug

SEQ ID NO: 421764 - RNA, 32 nt, Human
gagaaucacuugaacccaggaggcagagguug

SEQ ID NO: 421765 - RNA, 32 nt, Human
gagaaucacuugaacccaggaggcagaguuug

SEQ ID NO: 421766 - RNA, 32 nt, Human
gagaaucacuugaacccaggaggcggaaguug

SEQ ID NO: 421767 - RNA, 32 nt, Human
gagaaucacuugaacccaggaggcggagguug

SEQ ID NO: 421768 - RNA, 32 nt, Human
gagaaucacuugaacccaggagguagagguug

SEQ ID NO: 421769 - RNA, 32 nt, Human
gagaaucacuugaacccgggaggcagagggug

SEQ ID NO: 421770 - RNA, 32 nt, Human
gagaaucacuugaacccgggaggcagagguug

SEQ ID NO: 421771 - RNA, 32 nt, Human
gagaaucacuugaaccggggaggcagagguug

SEQ ID NO: 421772 - RNA, 32 nt, Human
gagaaucacuugaaccugggaggcagagguua

SEQ ID NO: 421773 - RNA, 32 nt, Human
gagaaucacuugaaccugggaggcagagguug

SEQ ID NO: 421774 - RNA, 32 nt, Human
gagaaucacuugaaccugggaggcagagguuu

SEQ ID NO: 421775 - RNA, 32 nt, Human
gagaaucacuugaaccugggaggcagaguuua

SEQ ID NO: 421776 - RNA, 32 nt, Human
gagaaucacuugaacucaggaggcagaaguug

SEQ ID NO: 421777 - RNA, 32 nt, Human
gagaaucacuugaacuggggaggcagagguug

SEQ ID NO: 421778 - RNA, 32 nt, Human
gagaaucacuugaaucagggaggcggagguug

SEQ ID NO: 421779 - RNA, 32 nt, Human
gagaaucacuuggaccugggaggcagagguuu

SEQ ID NO: 421780 - RNA, 32 nt, Human
gagaaucaggaaaauuccuucaacugcauugc

SEQ ID NO: 421781 - RNA, 32 nt, Human
gagaaucagguauuaauggaaagacucaauca

SEQ ID NO: 421782 - RNA, 32 nt, Human
gagaaucaugccacccucaaagccucauccac

SEQ ID NO: 421783 - RNA, 32 nt, Human
gagaaucauuugaacccgggaggcagagguug

SEQ ID NO: 421784 - RNA, 32 nt, Human
gagaaucauuugaaccugggaggcagagguug

SEQ ID NO: 421785 - RNA, 32 nt, Human
gagaauccaucuuuuacuaggagaccagauuc

SEQ ID NO: 421786 - RNA, 32 nt, Human
gagaaucccagaggaggccgugaacuguucug

SEQ ID NO: 421787 - RNA, 25 nt, Human
gagaaucccagcggggccucagaga

SEQ ID NO: 421788 - RNA, 32 nt, Human
gagaaucccugaccccugcccugggccuuaac

SEQ ID NO: 421789 - RNA, 32 nt, Human
gagaaucccuugaacccaggaggcagaaguug

SEQ ID NO: 421790 - RNA, 32 nt, Human
gagaaucccuugaacccaggaggcagagguug

SEQ ID NO: 421791 - RNA, 32 nt, Human
gagaauccgugaccccugcccugggccuuaac

SEQ ID NO: 421792 - RNA, 32 nt, Human
gagaauccucccggaaccucuggauucugacg

SEQ ID NO: 421793 - RNA, 32 nt, Human
gagaauccuucaaaaugcuacacccacauucu

SEQ ID NO: 421794 - RNA, 32 nt, Human
gagaauccuuucucccugccuucuugcccugc

SEQ ID NO: 421795 - RNA, 32 nt, Human
gagaaucgacaaauaggacuguuucuccguuu

SEQ ID NO: 421796 - RNA, 32 nt, Human
gagaaucgccugaacccaggaggcggagcuug

SEQ ID NO: 421797 - RNA, 32 nt, Human
gagaaucgcggccgcagccaucagcccuggag

SEQ ID NO: 421798 - RNA, 32 nt, Human
gagaaucgcgugaacccaggaggcggaggcug

SEQ ID NO: 421799 - RNA, 32 nt, Human
gagaaucgcuugaaacugggaggcagggguug

SEQ ID NO: 421800 - RNA, 32 nt, Human
gagaaucgcuugaaccagggaggcggagguug

SEQ ID NO: 421801 - RNA, 32 nt, Human
gagaaucgcuugaacccaggaggcagaaguug

SEQ ID NO: 421802 - RNA, 32 nt, Human
gagaaucgcuugaacccaggaggcagagauug

SEQ ID NO: 421803 - RNA, 32 nt, Human
gagaaucgcuugaacccaggaggcagagguug

SEQ ID NO: 421804 - RNA, 32 nt, Human
gagaaucgcuugaacccaggaggcggagauug

SEQ ID NO: 421805 - RNA, 32 nt, Human
gagaaucgcuugaacccaggaggcggagcuug

SEQ ID NO: 421806 - RNA, 32 nt, Human
gagaaucgcuugaacccaggaggcggaggcug

SEQ ID NO: 421807 - RNA, 32 nt, Human
gagaaucgcuugaacccaggaggcggagguua

SEQ ID NO: 421808 - RNA, 32 nt, Human
gagaaucgcuugaacccaggaggcggagguug

SEQ ID NO: 421809 - RNA, 32 nt, Human
gagaaucgcuugaacccaggagguagagguug

SEQ ID NO: 421810 - RNA, 32 nt, Human
gagaaucgcuugaacccgggaggcagaaguug

SEQ ID NO: 421811 - RNA, 32 nt, Human
gagaaucgcuugaacccgggaggcagagauug

SEQ ID NO: 421812 - RNA, 32 nt, Human
gagaaucgcuugaacccgggaggcagaggcug

SEQ ID NO: 421813 - RNA, 32 nt, Human
gagaaucgcuugaacccgggaggcagagguag

SEQ ID NO: 421814 - RNA, 32 nt, Human
gagaaucgcuugaacccgggaggcagaggugg

SEQ ID NO: 421815 - RNA, 32 nt, Human
gagaaucgcuugaacccgggaggcagagguug

SEQ ID NO: 421816 - RNA, 32 nt, Human
gagaaucgcuugaaccggggaggcagagguug

SEQ ID NO: 421817 - RNA, 32 nt, Human
gagaaucgcuugaaccuaggaggcagaaguug

SEQ ID NO: 421818 - RNA, 32 nt, Human
gagaaucgcuugaaccugggaggcagaaguug

SEQ ID NO: 421819 - RNA, 32 nt, Human
gagaaucgcuugaaccugggaggcagagguug

SEQ ID NO: 421820 - RNA, 32 nt, Human
gagaaucgcuugaaccugggaggcagauguug

SEQ ID NO: 421821 - RNA, 32 nt, Human
gagaaucgcuugaacucgggaggcagagguug

SEQ ID NO: 421822 - RNA, 32 nt, Human
gagaaucgcuugagacugggaggcagagguug

SEQ ID NO: 421823 - RNA, 32 nt, Human
gagaaucgcuugagccggggaggcagagguug

SEQ ID NO: 421824 - RNA, 32 nt, Human
gagaaucgcuugagccugggaggcagagguug

SEQ ID NO: 421825 - RNA, 32 nt, Human
gagaaucgcuugagcuggagugcaguggugca

SEQ ID NO: 421826 - RNA, 22 nt, Human
gagaaucgggagaaggaggaga

SEQ ID NO: 421827 - RNA, 32 nt, Human
gagaaucguuugaacccaggaggcggagguug

SEQ ID NO: 421828 - RNA, 32 nt, Human
gagaaucguuugaaccugggaggcagagguug

SEQ ID NO: 421829 - RNA, 32 nt, Human
gagaaucguuugaacucaggaggcagagguug

SEQ ID NO: 421830 - RNA, 32 nt, Human
gagaaucuagccuucagccuguccaguguuaa

SEQ ID NO: 421831 - RNA, 32 nt, Human
gagaaucuaggccaccccaaccucuguucccc

SEQ ID NO: 421832 - RNA, 19 nt, Human
gagaaucucauauucccga

SEQ ID NO: 421833 - RNA, 32 nt, Human
gagaaucuccuugaagacacugaggccuacgu

SEQ ID NO: 421834 - RNA, 32 nt, Human
gagaaucucgggaggcagagguugcagugagc

SEQ ID NO: 421835 - RNA, 32 nt, Human
gagaaucucuugaacccaggaggcggagguug

SEQ ID NO: 421836 - RNA, 32 nt, Human
gagaaucucuugaacccgggaggcagagguug

SEQ ID NO: 421837 - RNA, 32 nt, Human
gagaaucucuugaauccaggaggcagaggcug

SEQ ID NO: 421838 - RNA, 32 nt, Human
gagaaucugcuccaaaaagcuggccacaucuc

SEQ ID NO: 421839 - RNA, 32 nt, Human
gagaaucugcugucgccugcagcugcucgccu

SEQ ID NO: 421840 - RNA, 32 nt, Human
gagaaucuggaauucgagaacuuuaaaaauag

SEQ ID NO: 421841 - RNA, 32 nt, Human
gagaaucuggacaaaguaauacucuuguagaa

SEQ ID NO: 421842 - RNA, 17 nt, Human
gagaaucuggaguugaa

SEQ ID NO: 421843 - RNA, 32 nt, Human
gagaaucugguggaugcuggaccuugcugcug

SEQ ID NO: 421844 - RNA, 32 nt, Human
gagaaucugucagccuuggagggaagggaucc

SEQ ID NO: 421845 - RNA, 32 nt, Human
gagaaucuuacaugauuauucgugcaggggca

SEQ ID NO: 421846 - RNA, 32 nt, Human
gagaaugaaacacacacauccacagaaacaga

SEQ ID NO: 421847 - RNA, 32 nt, Human
gagaaugaaaucgggugcaugugacacuaaua

SEQ ID NO: 421848 - RNA, 32 nt, Human
gagaaugaagugaaccgaggaggcagagcuug

SEQ ID NO: 421849 - RNA, 32 nt, Human
gagaaugacacuaaguuucagacuucagggca

SEQ ID NO: 421850 - RNA, 32 nt, Human
gagaaugacagaagcaaaggacuuauuauuaa

SEQ ID NO: 421851 - RNA, 32 nt, Human
gagaaugacagcuguagucauaucugagcaua

SEQ ID NO: 421852 - RNA, 32 nt, Human
gagaaugacauacauccuuuccauuuagcuca

SEQ ID NO: 421853 - RNA, 32 nt, Human
gagaaugacaugaacccaggaggcggagcuug

SEQ ID NO: 421854 - RNA, 32 nt, Human
gagaaugagaaagagagggacagagagauaaa

SEQ ID NO: 421855 - RNA, 32 nt, Human
gagaaugagccaacccauguaccugcugcaac

SEQ ID NO: 421856 - RNA, 32 nt, Human
gagaaugagcuggagcuugagcuggagcagga

SEQ ID NO: 421857 - RNA, 32 nt, Human
gagaaugaggccucgcuguguugcccaggcug

SEQ ID NO: 421858 - RNA, 32 nt, Human
gagaaugauacaguuuagaaauucuagagaag

SEQ ID NO: 421859 - RNA, 29 nt, Human
gagaaugauguggagccaggagaggggau

SEQ ID NO: 421860 - RNA, 32 nt, Human
gagaaugauuggggguuccaaaccacuuucuu

SEQ ID NO: 421861 - RNA, 32 nt, Human
gagaaugauuugaaccuaggaggcagagguug

SEQ ID NO: 421862 - RNA, 32 nt, Human
gagaaugcagagcucuaaucggcuagacugau

SEQ ID NO: 421863 - RNA, 32 nt, Human
gagaaugcagaggcuuuuauucguggacucac

SEQ ID NO: 421864 - RNA, 32 nt, Human
gagaaugcaguggcaugaucacagcucacugc

SEQ ID NO: 421865 - RNA, 32 nt, Human
gagaaugcaguuuccaaguacggcucucaguu

SEQ ID NO: 421866 - RNA, 23 nt, Human
gagaaugcauuuugagcauuuca

SEQ ID NO: 421867 - RNA, 32 nt, Human
gagaaugccacugcacuacagccugggcgaca

SEQ ID NO: 421868 - RNA, 32 nt, Human
gagaaugccaguguuacuccagcaggcaacca

SEQ ID NO: 421869 - RNA, 32 nt, Human
gagaaugccugggggucccucaccuggcuagg

SEQ ID NO: 421870 - RNA, 32 nt, Human
gagaaugcuaacagcacaggauacaguacuuc

SEQ ID NO: 421871 - RNA, 32 nt, Human
gagaaugcucuggggaguacaccaggcucagc

SEQ ID NO: 421872 - RNA, 32 nt, Human
gagaaugcuugccuugcauuugcacauccaga

SEQ ID NO: 421873 - RNA, 29 nt, Human
gagaauggaagagacaaaagaggcuaugu

SEQ ID NO: 421874 - RNA, 32 nt, Human
gagaauggacagguaggaaggaaggaaaggag

SEQ ID NO: 421875 - RNA, 32 nt, Human
gagaauggacagugugucuaaggaugugauuu

SEQ ID NO: 421876 - RNA, 32 nt, Human
gagaauggacauccuggauaugcugggagagg

SEQ ID NO: 421877 - RNA, 32 nt, Human
gagaauggaccgcuuuccagagcccagaagcc

SEQ ID NO: 421878 - RNA, 32 nt, Human
gagaauggagcuguagccucauggacaauaaa

SEQ ID NO: 421879 - RNA, 29 nt, Human
gagaauggaggagcacacagaggcaggcu

SEQ ID NO: 421880 - RNA, 32 nt, Human
gagaauggaggcaggaauugagcugacugagg

SEQ ID NO: 421881 - RNA, 32 nt, Human
gagaauggagucucccucugucaccaaggcug

SEQ ID NO: 421882 - RNA, 32 nt, Human
gagaauggagugaacccgggaggcagagcuug

SEQ ID NO: 421883 - RNA, 32 nt, Human
gagaauggagugaacccgggaggcagagguug

SEQ ID NO: 421884 - RNA, 32 nt, Human
gagaauggcauaaacccaggaggccgagcuga

SEQ ID NO: 421885 - RNA, 32 nt, Human
gagaauggcaugaacccaggaggcagagcuug

SEQ ID NO: 421886 - RNA, 32 nt, Human
gagaauggcaugaacccaggaguuggagcuug

SEQ ID NO: 421887 - RNA, 32 nt, Human
gagaauggcaugaacccgggaggcagagcuug

SEQ ID NO: 421888 - RNA, 32 nt, Human
gagaauggcaugaacccgggaggcagagguug

SEQ ID NO: 421889 - RNA, 32 nt, Human
gagaauggcaugaaccugggaggcagagcuug

SEQ ID NO: 421890 - RNA, 32 nt, Human
gagaauggcaugaacucaggaggcggagcuug

SEQ ID NO: 421891 - RNA, 32 nt, Human
gagaauggccagaacccaggaggcagagcuug

SEQ ID NO: 421892 - RNA, 32 nt, Human
gagaauggccagagagugucucucuagacugg

SEQ ID NO: 421893 - RNA, 32 nt, Human
gagaauggcccaaaccugacauggacaagcau

SEQ ID NO: 421894 - RNA, 32 nt, Human
gagaauggccugaacccgggaggcagagcuug

SEQ ID NO: 421895 - RNA, 32 nt, Human
gagaauggcgggaacccaggaggcagagguug

SEQ ID NO: 421896 - RNA, 32 nt, Human
gagaauggcgugaaccagggaggaggagcuug

SEQ ID NO: 421897 - RNA, 32 nt, Human
gagaauggcgugaacccagcgggaagagguug

SEQ ID NO: 421898 - RNA, 32 nt, Human
gagaauggcgugaacccaggagacggagcuug

SEQ ID NO: 421899 - RNA, 32 nt, Human
gagaauggcgugaacccaggaggaggagcuug

SEQ ID NO: 421900 - RNA, 32 nt, Human
gagaauggcgugaacccaggaggcagagcuug

SEQ ID NO: 421901 - RNA, 32 nt, Human
gagaauggcgugaacccaggaggcagagguug

SEQ ID NO: 421902 - RNA, 32 nt, Human
gagaauggcgugaacccaggaggcggagcugg

SEQ ID NO: 421903 - RNA, 32 nt, Human
gagaauggcgugaacccaggaggcggagcuug

SEQ ID NO: 421904 - RNA, 32 nt, Human
gagaauggcgugaacccaggagguggagcuug

SEQ ID NO: 421905 - RNA, 32 nt, Human
gagaauggcgugaaccccggaggcggagcuug

SEQ ID NO: 421906 - RNA, 32 nt, Human
gagaauggcgugaacccgagaggcggagcuug

SEQ ID NO: 421907 - RNA, 32 nt, Human
gagaauggcgugaacccggcgggaagagguug

SEQ ID NO: 421908 - RNA, 32 nt, Human
gagaauggcgugaacccgggaagcggagcuug

SEQ ID NO: 421909 - RNA, 32 nt, Human
gagaauggcgugaacccgggagacggagcuug

SEQ ID NO: 421910 - RNA, 32 nt, Human
gagaauggcgugaacccgggaggcagaccuug

SEQ ID NO: 421911 - RNA, 32 nt, Human
gagaauggcgugaacccgggaggcagagcuug

SEQ ID NO: 421912 - RNA, 32 nt, Human
gagaauggcgugaacccgggaggcggaacuug

SEQ ID NO: 421913 - RNA, 32 nt, Human
gagaauggcgugaacccgggaggcggagcuug

SEQ ID NO: 421914 - RNA, 32 nt, Human
gagaauggcgugaacccgggaggcggagguug

SEQ ID NO: 421915 - RNA, 32 nt, Human
gagaauggcgugaacccgggaggcggaucuug

SEQ ID NO: 421916 - RNA, 32 nt, Human
gagaauggcgugaacccgggagguggagcuug

SEQ ID NO: 421917 - RNA, 32 nt, Human
gagaauggcgugaacccgggagucgagaucgc

SEQ ID NO: 421918 - RNA, 32 nt, Human
gagaauggcgugaacccgggaguggagcuugc

SEQ ID NO: 421919 - RNA, 32 nt, Human
gagaauggcgugaaccugggaggcagagcuug

SEQ ID NO: 421920 - RNA, 32 nt, Human
gagaauggcgugaauccaggagguggagccug

SEQ ID NO: 421921 - RNA, 32 nt, Human
gagaauggcgugaaucggggaggcagagcuug

SEQ ID NO: 421922 - RNA, 32 nt, Human
gagaauggcgugagcccaggaggcggagcuug

SEQ ID NO: 421923 - RNA, 32 nt, Human
gagaauggcgugaggccaggaggcggagcuug

SEQ ID NO: 421924 - RNA, 22 nt, Human
gagaauggcugggugcugggga

SEQ ID NO: 421925 - RNA, 32 nt, Human
gagaauggcuugaacccaggagacagagguug

SEQ ID NO: 421926 - RNA, 32 nt, Human
gagaauggcuugaacccaggagguggagguug

SEQ ID NO: 421927 - RNA, 32 nt, Human
gagaauggcuugaacccgggaggcagagguug

SEQ ID NO: 421928 - RNA, 32 nt, Human
gagaauggcuugaaccugggaggcagagguug

SEQ ID NO: 421929 - RNA, 32 nt, Human
gagaauggcuugagcccaggaggcagaggcug

SEQ ID NO: 421930 - RNA, 32 nt, Human
gagaauggcuugagcccaggaguucaagaccg

SEQ ID NO: 421931 - RNA, 32 nt, Human
gagaaugggaacaggucaugguucuacuucag

SEQ ID NO: 421932 - RNA, 32 nt, Human
gagaaugggagcccucccugccccaccguccu

SEQ ID NO: 421933 - RNA, 32 nt, Human
gagaauggggaggcaagaucucagggacacca

SEQ ID NO: 421934 - RNA, 32 nt, Human
gagaauggggcugggaagaaagaggcaacacc

SEQ ID NO: 421935 - RNA, 32 nt, Human
gagaauggggcugugaaggucugggagauaac

SEQ ID NO: 421936 - RNA, 32 nt, Human
gagaaugggguccccugcacugaagguccccg

SEQ ID NO: 421937 - RNA, 32 nt, Human
gagaauggggucuugcucugucacccaggcug

SEQ ID NO: 421938 - RNA, 32 nt, Human
gagaauggggugaacccgggaggaagagcuug

SEQ ID NO: 421939 - RNA, 32 nt, Human
gagaaugguaugaauccaggagguggagcuug

SEQ ID NO: 421940 - RNA, 32 nt, Human
gagaauggugcggagcuugcagugagccgaga

SEQ ID NO: 421941 - RNA, 32 nt, Human
gagaauggugugaacccaggaggcacagcuug

SEQ ID NO: 421942 - RNA, 32 nt, Human
gagaauggugugaacccaggaggcagagcuug

SEQ ID NO: 421943 - RNA, 32 nt, Human
gagaauggugugaacccaggaggcggagcuug

SEQ ID NO: 421944 - RNA, 32 nt, Human
gagaauggugugaacccagugagccgagaucg

SEQ ID NO: 421945 - RNA, 32 nt, Human
gagaauggugugaacccccaaggcggagcuug

SEQ ID NO: 421946 - RNA, 32 nt, Human
gagaauggugugaacccgggaagcggagcuug

SEQ ID NO: 421947 - RNA, 32 nt, Human
gagaauggugugaacccgggagcggagguugc

SEQ ID NO: 421948 - RNA, 32 nt, Human
gagaauggugugaacccgggaggcagagcuug

SEQ ID NO: 421949 - RNA, 32 nt, Human
gagaauggugugaacccgggaggcggagcuug

SEQ ID NO: 421950 - RNA, 32 nt, Human
gagaauggugugaacccgggagguggagcuuc

SEQ ID NO: 421951 - RNA, 32 nt, Human
gagaauggugugaacccgggagguggagcuug

SEQ ID NO: 421952 - RNA, 32 nt, Human
gagaauggugugaacccgggcgguggagcuug

SEQ ID NO: 421953 - RNA, 32 nt, Human
gagaaugguguggacccaggaggcagagcuug

SEQ ID NO: 421954 - RNA, 32 nt, Human
gagaaugucccaguagauuagacuucaaccuu

SEQ ID NO: 421955 - RNA, 32 nt, Human
gagaaugucgugaacccgggaggcggagcuug

SEQ ID NO: 421956 - RNA, 32 nt, Human
gagaaugugcaggugcauuucacagagagguc

SEQ ID NO: 421957 - RNA, 32 nt, Human
gagaaugugggauaugguagaggucuuuguuu

SEQ ID NO: 421958 - RNA, 32 nt, Human
gagaauguugacuuagaagcaauagggggcag

SEQ ID NO: 421959 - RNA, 32 nt, Human
gagaauuaagagccucccucccucccucuauc

SEQ ID NO: 421960 - RNA, 32 nt, Human
gagaauuacuuauuucuuuucucuauucucau

SEQ ID NO: 421961 - RNA, 32 nt, Human
gagaauuacuugaacccaggaggcagagaucg

SEQ ID NO: 421962 - RNA, 32 nt, Human
gagaauuagaaaacauguaccuuccucugggc

SEQ ID NO: 421963 - RNA, 32 nt, Human
gagaauuaugguagauuuacauuccaaaggcu

SEQ ID NO: 421964 - RNA, 22 nt, Human
gagaauuauuuauuugccauca

SEQ ID NO: 421965 - RNA, 32 nt, Human
gagaauuauuuuuaauauguaaauucucucaa

SEQ ID NO: 421966 - RNA, 32 nt, Human
gagaauucacaguggaaagaaaagccaugaau

SEQ ID NO: 421967 - RNA, 32 nt, Human
gagaauucacauaggaaagaaaccagaugaag

SEQ ID NO: 421968 - RNA, 32 nt, Human
gagaauucacaugggaauaaaauuccauugcu

SEQ ID NO: 421969 - RNA, 32 nt, Human
gagaauuccaggcucacaaagggagaggagag

SEQ ID NO: 421970 - RNA, 32 nt, Human
gagaauuccucccagugauggucaguauucuu

SEQ ID NO: 421971 - RNA, 32 nt, Human
gagaauucucucuuuuuggggcaaaggucagu

SEQ ID NO: 421972 - RNA, 20 nt, Human
gagaauucuggacagugguc

SEQ ID NO: 421973 - RNA, 32 nt, Human
gagaauucuguggugcuugagaaacagacagu

SEQ ID NO: 421974 - RNA, 32 nt, Human
gagaauugacucacacaaucacaaagcaaagu

SEQ ID NO: 421975 - RNA, 32 nt, Human
gagaauugauugaacccgggaggcagagguug

SEQ ID NO: 421976 - RNA, 32 nt, Human
gagaauugccugaacccaggaggcggagguug

SEQ ID NO: 421977 - RNA, 32 nt, Human
gagaauugcuugaacacgggaggcagagguug

SEQ ID NO: 421978 - RNA, 32 nt, Human
gagaauugcuugaacccaggaggcagagauug

SEQ ID NO: 421979 - RNA, 32 nt, Human
gagaauugcuugaacccaggaggcagagguua

SEQ ID NO: 421980 - RNA, 32 nt, Human
gagaauugcuugaacccaggaggcagagguug

SEQ ID NO: 421981 - RNA, 32 nt, Human
gagaauugcuugaacccaggaggcggaggcag

SEQ ID NO: 421982 - RNA, 32 nt, Human
gagaauugcuugaacccaggaggcggagguag

SEQ ID NO: 421983 - RNA, 32 nt, Human
gagaauugcuugaacccaggaggcggagguug

SEQ ID NO: 421984 - RNA, 32 nt, Human
gagaauugcuugaacccaggaggcggaguuug

SEQ ID NO: 421985 - RNA, 32 nt, Human
gagaauugcuugaacccaggagguagaaguug

SEQ ID NO: 421986 - RNA, 32 nt, Human
gagaauugcuugaacccgggaggcagagguug

SEQ ID NO: 421987 - RNA, 32 nt, Human
gagaauugcuugaacgcgggaggcagagacug

SEQ ID NO: 421988 - RNA, 32 nt, Human
gagaauugcuugaacuggggaggcagagguug

SEQ ID NO: 421989 - RNA, 32 nt, Human
gagaauugcuugaagccagaggcagagguugc

SEQ ID NO: 421990 - RNA, 32 nt, Human
gagaauugcuugaauccaggaggcagagguug

SEQ ID NO: 421991 - RNA, 32 nt, Human
gagaauugcuugagcccaggaggcagagguug

SEQ ID NO: 421992 - RNA, 32 nt, Human
gagaauugcuugagcccgggaggcagaggcug

SEQ ID NO: 421993 - RNA, 32 nt, Human
gagaauugcuugaguccaggaggcagagguuc

SEQ ID NO: 421994 - RNA, 32 nt, Human
gagaauugcuuggacccgggaggcagagguug

SEQ ID NO: 421995 - RNA, 32 nt, Human
gagaauuggagagcaguaaaagacugaagaua

SEQ ID NO: 421996 - RNA, 32 nt, Human
gagaauugguugaacccaggaggcggagguug

SEQ ID NO: 421997 - RNA, 32 nt, Human
gagaauuguuugaacccgggaggcagagguug

SEQ ID NO: 421998 - RNA, 32 nt, Human
gagaauuguuugaagcugggaggcagaguuuu

SEQ ID NO: 421999 - RNA, 32 nt, Human
gagaauuucagaaauugagaacaauuucauaa

SEQ ID NO: 422000 - RNA, 32 nt, Human
gagaauuucuugaacccgggaggcagacuuug

SEQ ID NO: 422001 - RNA, 32 nt, Human
gagaauuuggaauuugaagaagaagaagaggg

SEQ ID NO: 422002 - RNA, 32 nt, Human
gagaauuuuugaaagguagucaaacuucuuuu

SEQ ID NO: 422003 - RNA, 32 nt, Human
gagacaaaaagcugcuccuccuuugaguacug

SEQ ID NO: 422004 - RNA, 32 nt, Human
gagacaaaacccucugcuuccuugggucccuc

SEQ ID NO: 422005 - RNA, 32 nt, Human
gagacaaacccuugaugcuccuugcucggcgu

SEQ ID NO: 422006 - RNA, 32 nt, Human
gagacaaagccgcgucagggggcccggccggg

SEQ ID NO: 422007 - RNA, 32 nt, Human
gagacaaaugaagccacagggaaagugaaaua

SEQ ID NO: 422008 - RNA, 19 nt, Human
gagacaaaugcaguaggca

SEQ ID NO: 422009 - RNA, 32 nt, Human
gagacaaauuuuaacuucuugucuauaguugu

SEQ ID NO: 422010 - RNA, 21 nt, Human
gagacaacacagagacagagg

SEQ ID NO: 422011 - RNA, 32 nt, Human
gagacaaccaaagaagcauuaaggcagguuga

SEQ ID NO: 422012 - RNA, 32 nt, Human
gagacaaccccuccucuucccuggcuggcgca

SEQ ID NO: 422013 - RNA, 32 nt, Human
gagacaaccuuucugucuucagccucugcuau

SEQ ID NO: 422014 - RNA, 32 nt, Human
gagacaacugcacuccagugugggcgugccuu

SEQ ID NO: 422015 - RNA, 32 nt, Human
gagacaacugccacccagccugggccuuccca

SEQ ID NO: 422016 - RNA, 32 nt, Human
gagacaagaagagggaaaguagaaauauucua

SEQ ID NO: 422017 - RNA, 32 nt, Human
gagacaagaaggguuuuccacccuggaaucaa

SEQ ID NO: 422018 - RNA, 32 nt, Human
gagacaagagaaggagagaagagcugcagccc

SEQ ID NO: 422019 - RNA, 23 nt, Human
gagacaagaguuucaccauguug

SEQ ID NO: 422020 - RNA, 32 nt, Human
gagacaagaguuucaccauguuggccaggcug

SEQ ID NO: 422021 - RNA, 32 nt, Human
gagacaagaucucacucuauugcucaggcugg

SEQ ID NO: 422022 - RNA, 32 nt, Human
gagacaagaucuugcucuguugcucagucuag

SEQ ID NO: 422023 - RNA, 32 nt, Human
gagacaagauguggaggugaagacagugauau

SEQ ID NO: 422024 - RNA, 22 nt, Human
gagacaagauuucaccauguug

SEQ ID NO: 422025 - RNA, 22 nt, Human
gagacaagauuucaccguuuug

SEQ ID NO: 422026 - RNA, 22 nt, Human
gagacaagauuucgccauguug

SEQ ID NO: 422027 - RNA, 32 nt, Human
gagacaagccugggcaacauagugagaccuuc

SEQ ID NO: 422028 - RNA, 32 nt, Human
gagacaaggaaaggaaaggaaaggccuggcau

SEQ ID NO: 422029 - RNA, 22 nt, Human
gagacaaggcuuugccauguug

SEQ ID NO: 422030 - RNA, 32 nt, Human
gagacaagggaccugcugucauccccaucugu

SEQ ID NO: 422031 - RNA, 22 nt, Human
gagacaagggaggaaggacaga

SEQ ID NO: 422032 - RNA, 32 nt, Human
gagacaagggucuuaccauguugcccaggcug

SEQ ID NO: 422033 - RNA, 20 nt, Human
gagacaaggucucacuaugu

SEQ ID NO: 422034 - RNA, 22 nt, Human
gagacaaggucucgccauguug

SEQ ID NO: 422035 - RNA, 22 nt, Human
gagacaaggucucuccauguug

SEQ ID NO: 422036 - RNA, 32 nt, Human
gagacaaggucugcccgacccaugucuaugcu

SEQ ID NO: 422037 - RNA, 22 nt, Human
gagacaaggucuugcuauguug

SEQ ID NO: 422038 - RNA, 18 nt, Human
gagacaagguuucaccau

SEQ ID NO: 422039 - RNA, 23 nt, Human
gagacaagguuucaccauauugg

SEQ ID NO: 422040 - RNA, 21 nt, Human
gagacaagguuucaccauguu

SEQ ID NO: 422041 - RNA, 22 nt, Human
gagacaagguuucaccauguua

SEQ ID NO: 422042 - RNA, 22 nt, Human
gagacaagguuucaccauguug

SEQ ID NO: 422043 - RNA, 22 nt, Human
gagacaagguuucacccuguug

SEQ ID NO: 422044 - RNA, 23 nt, Human
gagacaagguuucacccuguugg

SEQ ID NO: 422045 - RNA, 22 nt, Human
gagacaagguuucacuauguug

SEQ ID NO: 422046 - RNA, 22 nt, Human
gagacaagguuucgccauguug

SEQ ID NO: 422047 - RNA, 23 nt, Human
gagacaagguuucgccauguugg

SEQ ID NO: 422048 - RNA, 22 nt, Human
gagacaagguuucgcuauguug

SEQ ID NO: 422049 - RNA, 23 nt, Human
gagacaagguuucgcuauguugg

SEQ ID NO: 422050 - RNA, 22 nt, Human
gagacaagguuuugccauguug

SEQ ID NO: 422051 - RNA, 22 nt, Human
gagacaagguuuugcucuguug

SEQ ID NO: 422052 - RNA, 22 nt, Human
gagacaagguuuugcuguguug

SEQ ID NO: 422053 - RNA, 32 nt, Human
gagacaagucaacauggugaaaccucaucucu

SEQ ID NO: 422054 - RNA, 32 nt, Human
gagacaagugcagcuccuccagcuggagaggc

SEQ ID NO: 422055 - RNA, 30 nt, Human
gagacaaguguucaaacagaaagacgcuug

SEQ ID NO: 422056 - RNA, 31 nt, Human
gagacaauguagcagaauaccaggcagacag

SEQ ID NO: 422057 - RNA, 31 nt, Human
gagacaauguguaccaggacagcagaaagac

SEQ ID NO: 422058 - RNA, 32 nt, Human
gagacacaacacggaaauauugcugcacugcu

SEQ ID NO: 422059 - RNA, 32 nt, Human
gagacacaagaugccagcaccugcucagagga

SEQ ID NO: 422060 - RNA, 32 nt, Human
gagacacaaggaagaaaacacuaguaaccaac

SEQ ID NO: 422061 - RNA, 32 nt, Human
gagacacaaggcaagagacugaaucaucaaag

SEQ ID NO: 422062 - RNA, 32 nt, Human
gagacacaaggcagagagaggagcagaagcag

SEQ ID NO: 422063 - RNA, 16 nt, Human
gagacacagaccccuu

SEQ ID NO: 422064 - RNA, 20 nt, Human
gagacacagagagagacaga

SEQ ID NO: 422065 - RNA, 32 nt, Human
gagacacagaggagucagggccuggacuccug

SEQ ID NO: 422066 - RNA, 32 nt, Human
gagacacagaguucuugcuucuuucugucuac

SEQ ID NO: 422067 - RNA, 32 nt, Human
gagacacagauggaaguggaagcuuuggcaga

SEQ ID NO: 422068 - RNA, 32 nt, Human
gagacacagccugacauacacauaucaucuca

SEQ ID NO: 422069 - RNA, 32 nt, Human
gagacacagccuucuggcugggacugacuugg

SEQ ID NO: 422070 - RNA, 32 nt, Human
gagacacagccuugccccaguuacugcccacc

SEQ ID NO: 422071 - RNA, 32 nt, Human
gagacacaggaaccagacuccccaaaugucuc

SEQ ID NO: 422072 - RNA, 32 nt, Human
gagacacagguaacccagaguggacagugauu

SEQ ID NO: 422073 - RNA, 32 nt, Human
gagacaccaagaagaagcugcgggaaggacag

SEQ ID NO: 422074 - RNA, 18 nt, Human
gagacaccagacagacag

SEQ ID NO: 422075 - RNA, 32 nt, Human
gagacaccagcagguggcugcagugacguuag

SEQ ID NO: 422076 - RNA, 32 nt, Human
gagacaccaguguuuucccaugguuucugggu

SEQ ID NO: 422077 - RNA, 32 nt, Human
gagacaccaguucugccuacaggagugaguuu

SEQ ID NO: 422078 - RNA, 32 nt, Human
gagacaccauguuagucguggcuggucuccaa

SEQ ID NO: 422079 - RNA, 32 nt, Human
gagacaccauuuucuuucuaaacuuuuccaga

SEQ ID NO: 422080 - RNA, 32 nt, Human
gagacacccacuguacaguucucagggcucua

SEQ ID NO: 422081 - RNA, 32 nt, Human
gagacacccagagugggaucccuuccugcagg

SEQ ID NO: 422082 - RNA, 32 nt, Human
gagacaccccuaaaggcucccauuaggucaca

SEQ ID NO: 422083 - RNA, 25 nt, Human
gagacacccucuuuggcccucacua

SEQ ID NO: 422084 - RNA, 32 nt, Human
gagacaccgaagcagaggauacaggaggauua

SEQ ID NO: 422085 - RNA, 32 nt, Human
gagacaccuaguguauggcucaugcccagccu

SEQ ID NO: 422086 - RNA, 22 nt, Human
gagacaccucagagccccgcaa

SEQ ID NO: 422087 - RNA, 32 nt, Human
gagacaccuccaggccguagccugggggcugg

SEQ ID NO: 422088 - RNA, 32 nt, Human
gagacaccuggacccuguaaggcugugagcug

SEQ ID NO: 422089 - RNA, 32 nt, Human
gagacacgcagaccagcugaggaggacaaaga

SEQ ID NO: 422090 - RNA, 32 nt, Human
gagacacgcgagcggggagaccuccaaggcag

SEQ ID NO: 422091 - RNA, 32 nt, Human
gagacacgcgcugucuguuguggugggccucc

SEQ ID NO: 422092 - RNA, 22 nt, Human
gagacacggucccaccauguua

SEQ ID NO: 422093 - RNA, 32 nt, Human
gagacacguggagacuggaugagggcagauga

SEQ ID NO: 422094 - RNA, 32 nt, Human
gagacacucccgcccccaccagacucaagccc

SEQ ID NO: 422095 - RNA, 32 nt, Human
gagacacucugccucugguggcugcagagcaa

SEQ ID NO: 422096 - RNA, 32 nt, Human
gagacacucuggggcuccucauucagugggac

SEQ ID NO: 422097 - RNA, 23 nt, Human
gagacacugaacuuccugagcca

SEQ ID NO: 422098 - RNA, 32 nt, Human
gagacacugauuccaaguccaugugggggcau

SEQ ID NO: 422099 - RNA, 32 nt, Human
gagacacugggcagaaaacagaagaucaucau

SEQ ID NO: 422100 - RNA, 32 nt, Human
gagacacuuagcuucccucucccucauucccg

SEQ ID NO: 422101 - RNA, 32 nt, Human
gagacagaagagaaggaggagggggcagcugg

SEQ ID NO: 422102 - RNA, 32 nt, Human
gagacagaagaggagacacagacacagagcag

SEQ ID NO: 422103 - RNA, 32 nt, Human
gagacagaagccucugcaccuacugugcagaa

SEQ ID NO: 422104 - RNA, 32 nt, Human
gagacagaauguguuucuggucacucauucua

SEQ ID NO: 422105 - RNA, 32 nt, Human
gagacagacacaacaguaucugaaaagaauac

SEQ ID NO: 422106 - RNA, 32 nt, Human
gagacagacagagaaggcagcaggcggccuuu

SEQ ID NO: 422107 - RNA, 32 nt, Human
gagacagacagcaagacacagaggcagagaga

SEQ ID NO: 422108 - RNA, 32 nt, Human
gagacagacgcugaggcggguaggaggagccc

SEQ ID NO: 422109 - RNA, 32 nt, Human
gagacagacuugugguucuucaacagcugugc

SEQ ID NO: 422110 - RNA, 32 nt, Human
gagacagagaaagagagagaauucuuucaagu

SEQ ID NO: 422111 - RNA, 32 nt, Human
gagacagagacacagccauccgccaccaccgc

SEQ ID NO: 422112 - RNA, 32 nt, Human
gagacagagacuggcauuuuccucucccgaag

SEQ ID NO: 422113 - RNA, 23 nt, Human
gagacagagaggcuuugagcugu

SEQ ID NO: 422114 - RNA, 32 nt, Human
gagacagagagggagagagggacagagagaga

SEQ ID NO: 422115 - RNA, 32 nt, Human
gagacagagauccaggcuuucaaggaggagcu

SEQ ID NO: 422116 - RNA, 32 nt, Human
gagacagagcccuccaccccucucacacacac

SEQ ID NO: 422117 - RNA, 32 nt, Human
gagacagagccggggucacuguccuuaagacg

SEQ ID NO: 422118 - RNA, 18 nt, Human
gagacagagccucagcca

SEQ ID NO: 422119 - RNA, 19 nt, Human
gagacagagccucagccug

SEQ ID NO: 422120 - RNA, 32 nt, Human
gagacagagcugguugggaagacauggggagg

SEQ ID NO: 422121 - RNA, 22 nt, Human
gagacagagcuucuccauguug

SEQ ID NO: 422122 - RNA, 32 nt, Human
gagacagaggagaggaaagggaaguaguuugg

SEQ ID NO: 422123 - RNA, 32 nt, Human
gagacagaggcugauggccaggaggaccuaga

SEQ ID NO: 422124 - RNA, 21 nt, Human
gagacagaggcugcauugagc

SEQ ID NO: 422125 - RNA, 23 nt, Human
gagacagagggaagccugagcca

SEQ ID NO: 422126 - RNA, 32 nt, Human
gagacagagggcaaugaugugugcaaguacga

SEQ ID NO: 422127 - RNA, 32 nt, Human
gagacagagggugugauggugggugcugggag

SEQ ID NO: 422128 - RNA, 32 nt, Human
gagacagaggucucgcucugucgcccagguug

SEQ ID NO: 422129 - RNA, 32 nt, Human
gagacagagucacccaggcuggagugcagugg

SEQ ID NO: 422130 - RNA, 20 nt, Human
gagacagagucucacccugu

SEQ ID NO: 422131 - RNA, 20 nt, Human
gagacagagucucacucugu

SEQ ID NO: 422132 - RNA, 18 nt, Human
gagacagaguuucaccau

SEQ ID NO: 422133 - RNA, 22 nt, Human
gagacagaguuucaccauguug

SEQ ID NO: 422134 - RNA, 22 nt, Human
gagacagaguuucacucucguu

SEQ ID NO: 422135 - RNA, 20 nt, Human
gagacagaguuucacucugu

SEQ ID NO: 422136 - RNA, 22 nt, Human
gagacagaguuucacucuuguu

SEQ ID NO: 422137 - RNA, 22 nt, Human
gagacagaguuucauucuuguu

SEQ ID NO: 422138 - RNA, 22 nt, Human
gagacagaguuucgcucuuguu

SEQ ID NO: 422139 - RNA, 23 nt, Human
gagacagaguuucgcuuuuguug

SEQ ID NO: 422140 - RNA, 22 nt, Human
gagacagaguuucgucauguug

SEQ ID NO: 422141 - RNA, 22 nt, Human
gagacagaguuuuaccauguug

SEQ ID NO: 422142 - RNA, 22 nt, Human
gagacagaguuuugccauguug

SEQ ID NO: 422143 - RNA, 22 nt, Human
gagacagaguuuugcuauguug

SEQ ID NO: 422144 - RNA, 22 nt, Human
gagacagaguuuugcuguguug

SEQ ID NO: 422145 - RNA, 32 nt, Human
gagacagaugcuccugccauguuugccacccu

SEQ ID NO: 422146 - RNA, 20 nt, Human
gagacagauggcacccugag

SEQ ID NO: 422147 - RNA, 32 nt, Human
gagacagcaaagcauauuuuuacaucaauuug

SEQ ID NO: 422148 - RNA, 32 nt, Human
gagacagcaccacugcugaggagucugaggac

SEQ ID NO: 422149 - RNA, 32 nt, Human
gagacagcaccgacuucacacauuccugggcu

SEQ ID NO: 422150 - RNA, 32 nt, Human
gagacagcagaggucugaccgccccgcugagg

SEQ ID NO: 422151 - RNA, 32 nt, Human
gagacagccagggagagaggggcaaggagcuc

SEQ ID NO: 422152 - RNA, 32 nt, Human
gagacagcccacccccagccugcaagagaggc

SEQ ID NO: 422153 - RNA, 23 nt, Human
gagacagccuagacacuggcugg

SEQ ID NO: 422154 - RNA, 32 nt, Human
gagacagccugagauauggccucaugggaagg

SEQ ID NO: 422155 - RNA, 32 nt, Human
gagacagcgaugacauuugcucucacagcaga

SEQ ID NO: 422156 - RNA, 22 nt, Human
gagacagcguuucaccauguua

SEQ ID NO: 422157 - RNA, 32 nt, Human
gagacagcuuauuaggcagccugcucuccucu

SEQ ID NO: 422158 - RNA, 32 nt, Human
gagacagcuucagaggauacggggcgcugccu

SEQ ID NO: 422159 - RNA, 32 nt, Human
gagacagcuucucugcaguaaaacacauuugg

SEQ ID NO: 422160 - RNA, 21 nt, Human
gagacaggaaaauagcuugaa

SEQ ID NO: 422161 - RNA, 32 nt, Human
gagacaggaagagacuggugauucaagagaga

SEQ ID NO: 422162 - RNA, 32 nt, Human
gagacaggaaggcagggcgcagugguugaaac

SEQ ID NO: 422163 - RNA, 32 nt, Human
gagacaggacgugucucucuccacgucuucca

SEQ ID NO: 422164 - RNA, 22 nt, Human
gagacaggagaaucacuugaac

SEQ ID NO: 422165 - RNA, 22 nt, Human
gagacaggagaaucacuugaau

SEQ ID NO: 422166 - RNA, 21 nt, Human
gagacaggagaaucgcucgaa

SEQ ID NO: 422167 - RNA, 22 nt, Human
gagacaggagaaucgcucgaac

SEQ ID NO: 422168 - RNA, 22 nt, Human
gagacaggagaaucgcuuaaac

SEQ ID NO: 422169 - RNA, 21 nt, Human
gagacaggagaaucgcuugaa

SEQ ID NO: 422170 - RNA, 22 nt, Human
gagacaggagaaucgcuugaac

SEQ ID NO: 422171 - RNA, 22 nt, Human
gagacaggagaaucgcuugaau

SEQ ID NO: 422172 - RNA, 21 nt, Human
gagacaggagaauugcuugaa

SEQ ID NO: 422173 - RNA, 22 nt, Human
gagacaggagaauugcuugaac

SEQ ID NO: 422174 - RNA, 21 nt, Human
gagacaggagagucgcuugaa

SEQ ID NO: 422175 - RNA, 22 nt, Human
gagacaggagagucgcuugaac

SEQ ID NO: 422176 - RNA, 32 nt, Human
gagacaggaggaguaggaggaggcagggccuc

SEQ ID NO: 422177 - RNA, 21 nt, Human
gagacaggaggaucgcuugaa

SEQ ID NO: 422178 - RNA, 32 nt, Human
gagacaggagucuugccauguugcccaggcug

SEQ ID NO: 422179 - RNA, 32 nt, Human
gagacaggaguuuugcucuguugcccaggcug

SEQ ID NO: 422180 - RNA, 21 nt, Human
gagacaggaucucacuauguu

SEQ ID NO: 422181 - RNA, 22 nt, Human
gagacaggaucucacuauguug

SEQ ID NO: 422182 - RNA, 20 nt, Human
gagacaggaucucacucugu

SEQ ID NO: 422183 - RNA, 22 nt, Human
gagacaggaucucacucuguug

SEQ ID NO: 422184 - RNA, 19 nt, Human
gagacaggauguccauguu

SEQ ID NO: 422185 - RNA, 22 nt, Human
gagacaggauuucaccauguug

SEQ ID NO: 422186 - RNA, 22 nt, Human
gagacaggauuucacuauguug

SEQ ID NO: 422187 - RNA, 22 nt, Human
gagacaggauuucacuguguua

SEQ ID NO: 422188 - RNA, 22 nt, Human
gagacaggauuucaucauguug

SEQ ID NO: 422189 - RNA, 22 nt, Human
gagacaggauuucaucguguug

SEQ ID NO: 422190 - RNA, 22 nt, Human
gagacaggauuucuccauguug

SEQ ID NO: 422191 - RNA, 22 nt, Human
gagacaggauuuuaccauguug

SEQ ID NO: 422192 - RNA, 22 nt, Human
gagacaggauuuuacuguguug

SEQ ID NO: 422193 - RNA, 32 nt, Human
gagacaggcaggagucggaaugcugaaccagc

SEQ ID NO: 422194 - RNA, 32 nt, Human
gagacaggcccaagagaugaagagugagaggg

SEQ ID NO: 422195 - RNA, 32 nt, Human
gagacaggccugaugccaaaggcuuugggcuc

SEQ ID NO: 422196 - RNA, 22 nt, Human
gagacaggcucucaccauguug

SEQ ID NO: 422197 - RNA, 32 nt, Human
gagacaggcucugacucuggcacuuugcucag

SEQ ID NO: 422198 - RNA, 32 nt, Human
gagacagggaauggggcacggagaagguaggu

SEQ ID NO: 422199 - RNA, 32 nt, Human
gagacagggagacagacagagaggcagagaga

SEQ ID NO: 422200 - RNA, 21 nt, Human
gagacagggccucacucuguu

SEQ ID NO: 422201 - RNA, 22 nt, Human
gagacagggccucacucuguug

SEQ ID NO: 422202 - RNA, 32 nt, Human
gagacagggcuggcuccucucgccccuggagc

SEQ ID NO: 422203 - RNA, 22 nt, Human
gagacagggcuucaccauguug

SEQ ID NO: 422204 - RNA, 22 nt, Human
gagacagggcuucacuguguua

SEQ ID NO: 422205 - RNA, 32 nt, Human
gagacaggggagagagaaagacaaagagggga

SEQ ID NO: 422206 - RNA, 26 nt, Human
gagacaggggcacagagagacagagg

SEQ ID NO: 422207 - RNA, 32 nt, Human
gagacaggggcaggggagagacucucucccca

SEQ ID NO: 422208 - RNA, 32 nt, Human
gagacagggggcaggccagagagagagggcag

SEQ ID NO: 422209 - RNA, 32 nt, Human
gagacaggggucucacuauguugcccaaacug

SEQ ID NO: 422210 - RNA, 32 nt, Human
gagacaggggucucccucugucacccaggcug

SEQ ID NO: 422211 - RNA, 32 nt, Human
gagacaggggucuugccaugucgcccaggcug

SEQ ID NO: 422212 - RNA, 23 nt, Human
gagacagggguuucaccacguug

SEQ ID NO: 422213 - RNA, 24 nt, Human
gagacagggguuucaccacguugg

SEQ ID NO: 422214 - RNA, 32 nt, Human
gagacagggguuucaccacguuggccaggcug

SEQ ID NO: 422215 - RNA, 19 nt, Human
gagacagggguuucaccau

SEQ ID NO: 422216 - RNA, 24 nt, Human
gagacagggguuucaccauauugg

SEQ ID NO: 422217 - RNA, 32 nt, Human
gagacagggguuucaccauauuggccaggcug

SEQ ID NO: 422218 - RNA, 32 nt, Human
gagacagggguuucuuccauguugcccaggcu

SEQ ID NO: 422219 - RNA, 22 nt, Human
gagacaggguaucuccauguug

SEQ ID NO: 422220 - RNA, 20 nt, Human
gagacagggucucacacugu

SEQ ID NO: 422221 - RNA, 20 nt, Human
gagacagggucucaccaugu

SEQ ID NO: 422222 - RNA, 22 nt, Human
gagacagggucucaccauguua

SEQ ID NO: 422223 - RNA, 22 nt, Human
gagacagggucucaccauguug

SEQ ID NO: 422224 - RNA, 18 nt, Human
gagacagggucucacuau

SEQ ID NO: 422225 - RNA, 32 nt, Human
gagacagggucucacuauauugcucaggcugg

SEQ ID NO: 422226 - RNA, 22 nt, Human
gagacagggucucacuauguug

SEQ ID NO: 422227 - RNA, 20 nt, Human
gagacagggucucacucugu

SEQ ID NO: 422228 - RNA, 32 nt, Human
gagacagggucucacucugucauccaggcugg

SEQ ID NO: 422229 - RNA, 22 nt, Human
gagacagggucucacucuguua

SEQ ID NO: 422230 - RNA, 22 nt, Human
gagacagggucucacucuguug

SEQ ID NO: 422231 - RNA, 20 nt, Human
gagacagggucucacugugu

SEQ ID NO: 422232 - RNA, 22 nt, Human
gagacagggucucacuguguug

SEQ ID NO: 422233 - RNA, 22 nt, Human
gagacagggucucacuuuguug

SEQ ID NO: 422234 - RNA, 22 nt, Human
gagacagggucucccuguguug

SEQ ID NO: 422235 - RNA, 20 nt, Human
gagacagggucucccuuugu

SEQ ID NO: 422236 - RNA, 22 nt, Human
gagacagggucucgcaguguug

SEQ ID NO: 422237 - RNA, 22 nt, Human
gagacagggucucgccauguug

SEQ ID NO: 422238 - RNA, 20 nt, Human
gagacagggucucgcucugu

SEQ ID NO: 422239 - RNA, 22 nt, Human
gagacagggucucgcucuguug

SEQ ID NO: 422240 - RNA, 22 nt, Human
gagacagggucuggcucuguug

SEQ ID NO: 422241 - RNA, 32 nt, Human
gagacagggucugggucuuucacccaggcugg

SEQ ID NO: 422242 - RNA, 22 nt, Human
gagacagggucugucuuuguua

SEQ ID NO: 422243 - RNA, 32 nt, Human
gagacagggucuguugccuaggcgggagugca

SEQ ID NO: 422244 - RNA, 32 nt, Human
gagacagggucuuaccacauugcucagguugu

SEQ ID NO: 422245 - RNA, 18 nt, Human
gagacagggucuuaccau

SEQ ID NO: 422246 - RNA, 20 nt, Human
gagacagggucuuacucugu

SEQ ID NO: 422247 - RNA, 21 nt, Human
gagacagggucuucuauguug

SEQ ID NO: 422248 - RNA, 22 nt, Human
gagacagggucuugcuauguug

SEQ ID NO: 422249 - RNA, 22 nt, Human
gagacagggucuugcucuguug

SEQ ID NO: 422250 - RNA, 22 nt, Human
gagacagggucuugcuguguua

SEQ ID NO: 422251 - RNA, 22 nt, Human
gagacagggucuugcuguguug

SEQ ID NO: 422252 - RNA, 22 nt, Human
gagacagggucuugcuuuguug

SEQ ID NO: 422253 - RNA, 22 nt, Human
gagacagggucuuucucuguug

SEQ ID NO: 422254 - RNA, 20 nt, Human
gagacagggugucacucugu

SEQ ID NO: 422255 - RNA, 18 nt, Human
gagacaggguuccaccgu

SEQ ID NO: 422256 - RNA, 18 nt, Human
gagacaggguucuguguu

SEQ ID NO: 422257 - RNA, 23 nt, Human
gagacaggguucuuaccauguug

SEQ ID NO: 422258 - RNA, 32 nt, Human
gagacaggguucuuaccauguuggccaggcug

SEQ ID NO: 422259 - RNA, 22 nt, Human
gagacaggguuucacaauguug

SEQ ID NO: 422260 - RNA, 23 nt, Human
gagacaggguuucaccacauugg

SEQ ID NO: 422261 - RNA, 22 nt, Human
gagacaggguuucaccacguug

SEQ ID NO: 422262 - RNA, 23 nt, Human
gagacaggguuucaccacguugg

SEQ ID NO: 422263 - RNA, 22 nt, Human
gagacaggguuucaccagguug

SEQ ID NO: 422264 - RNA, 23 nt, Human
gagacaggguuucaccagguugg

SEQ ID NO: 422265 - RNA, 18 nt, Human
gagacaggguuucaccau

SEQ ID NO: 422266 - RNA, 23 nt, Human
gagacaggguuucaccauauugg

SEQ ID NO: 422267 - RNA, 22 nt, Human
gagacaggguuucaccaucuug

SEQ ID NO: 422268 - RNA, 23 nt, Human
gagacaggguuucaccaucuugg

SEQ ID NO: 422269 - RNA, 20 nt, Human
gagacaggguuucaccaugu

SEQ ID NO: 422270 - RNA, 21 nt, Human
gagacaggguuucaccauguu

SEQ ID NO: 422271 - RNA, 22 nt, Human
gagacaggguuucaccauguua

SEQ ID NO: 422272 - RNA, 22 nt, Human
gagacaggguuucaccauguug

SEQ ID NO: 422273 - RNA, 23 nt, Human
gagacaggguuucaccauguugg

SEQ ID NO: 422274 - RNA, 22 nt, Human
gagacaggguuucaccauuuug

SEQ ID NO: 422275 - RNA, 23 nt, Human
gagacaggguuucaccauuuugg

SEQ ID NO: 422276 - RNA, 21 nt, Human
gagacaggguuucacccuguu

SEQ ID NO: 422277 - RNA, 21 nt, Human
gagacaggguuucaccguguu

SEQ ID NO: 422278 - RNA, 22 nt, Human
gagacaggguuucaccguguua

SEQ ID NO: 422279 - RNA, 22 nt, Human
gagacaggguuucaccguguug

SEQ ID NO: 422280 - RNA, 23 nt, Human
gagacaggguuucaccguguugg

SEQ ID NO: 422281 - RNA, 22 nt, Human
gagacaggguuucacuacguug

SEQ ID NO: 422282 - RNA, 23 nt, Human
gagacaggguuucacuacguugg

SEQ ID NO: 422283 - RNA, 19 nt, Human
gagacaggguuucacuaug

SEQ ID NO: 422284 - RNA, 23 nt, Human
gagacaggguuucacuaugcugg

SEQ ID NO: 422285 - RNA, 20 nt, Human
gagacaggguuucacuaugu

SEQ ID NO: 422286 - RNA, 22 nt, Human
gagacaggguuucacuaugugg

SEQ ID NO: 422287 - RNA, 22 nt, Human
gagacaggguuucacuauguug

SEQ ID NO: 422288 - RNA, 23 nt, Human
gagacaggguuucacuauguugg

SEQ ID NO: 422289 - RNA, 23 nt, Human
gagacaggguuucacucuuuugg

SEQ ID NO: 422290 - RNA, 21 nt, Human
gagacaggguuucacuguguu

SEQ ID NO: 422291 - RNA, 22 nt, Human
gagacaggguuucacuguguua

SEQ ID NO: 422292 - RNA, 22 nt, Human
gagacaggguuucacuguguug

SEQ ID NO: 422293 - RNA, 23 nt, Human
gagacaggguuucacuguguugg

SEQ ID NO: 422294 - RNA, 22 nt, Human
gagacaggguuucaucauguug

SEQ ID NO: 422295 - RNA, 23 nt, Human
gagacaggguuucaucauguugg

SEQ ID NO: 422296 - RNA, 22 nt, Human
gagacaggguuucccuauguug

SEQ ID NO: 422297 - RNA, 22 nt, Human
gagacaggguuucgcaauguug

SEQ ID NO: 422298 - RNA, 23 nt, Human
gagacaggguuucgcaauguugg

SEQ ID NO: 422299 - RNA, 32 nt, Human
gagacaggguuucgccacauugcccaggccca

SEQ ID NO: 422300 - RNA, 18 nt, Human
gagacaggguuucgccau

SEQ ID NO: 422301 - RNA, 23 nt, Human
gagacaggguuucgccauauugg

SEQ ID NO: 422302 - RNA, 22 nt, Human
gagacaggguuucgccauguug

SEQ ID NO: 422303 - RNA, 23 nt, Human
gagacaggguuucgccauguugg

SEQ ID NO: 422304 - RNA, 19 nt, Human
gagacaggguuucuccaug

SEQ ID NO: 422305 - RNA, 20 nt, Human
gagacaggguuucuccaugu

SEQ ID NO: 422306 - RNA, 22 nt, Human
gagacaggguuucuccauguug

SEQ ID NO: 422307 - RNA, 22 nt, Human
gagacaggguuucuccguguug

SEQ ID NO: 422308 - RNA, 20 nt, Human
gagacaggguuuggcugugu

SEQ ID NO: 422309 - RNA, 16 nt, Human
gagacaggguuugugu

SEQ ID NO: 422310 - RNA, 22 nt, Human
gagacaggguuuuaccauguug

SEQ ID NO: 422311 - RNA, 23 nt, Human
gagacaggguuuuaccauguugg

SEQ ID NO: 422312 - RNA, 22 nt, Human
gagacaggguuuugccacguug

SEQ ID NO: 422313 - RNA, 21 nt, Human
gagacaggguuuugccauguu

SEQ ID NO: 422314 - RNA, 22 nt, Human
gagacaggguuuugccauguug

SEQ ID NO: 422315 - RNA, 23 nt, Human
gagacaggguuuugccauguugg

SEQ ID NO: 422316 - RNA, 23 nt, Human
gagacaggguuuugccguguugg

SEQ ID NO: 422317 - RNA, 32 nt, Human
gagacaggguuuugcucuuguugcccagccug

SEQ ID NO: 422318 - RNA, 22 nt, Human
gagacaggguuuuuuguuguug

SEQ ID NO: 422319 - RNA, 32 nt, Human
gagacaggugagaagagggauggccagcacac

SEQ ID NO: 422320 - RNA, 17 nt, Human
gagacaggugcgaagug

SEQ ID NO: 422321 - RNA, 22 nt, Human
gagacagguggaucacgagguc

SEQ ID NO: 422322 - RNA, 32 nt, Human
gagacaggugggccacaugagcccagguauuc

SEQ ID NO: 422323 - RNA, 32 nt, Human
gagacaggugucucucuacguugcccaggcug

SEQ ID NO: 422324 - RNA, 22 nt, Human
gagacagguuucaccacauugg

SEQ ID NO: 422325 - RNA, 17 nt, Human
gagacagguuucaccau

SEQ ID NO: 422326 - RNA, 22 nt, Human
gagacagguuucaccauauugg

SEQ ID NO: 422327 - RNA, 21 nt, Human
gagacagguuucaccauguug

SEQ ID NO: 422328 - RNA, 22 nt, Human
gagacagguuucaccauguugg

SEQ ID NO: 422329 - RNA, 22 nt, Human
gagacagguuuucaccauguua

SEQ ID NO: 422330 - RNA, 22 nt, Human
gagacagguuuucaccauguug

SEQ ID NO: 422331 - RNA, 32 nt, Human
gagacaguaucccaggcugacaagggcuugcc

SEQ ID NO: 422332 - RNA, 32 nt, Human
gagacaguaugagacagagacugagaaaccac

SEQ ID NO: 422333 - RNA, 32 nt, Human
gagacaguauguggucugcagcacuugaaaua

SEQ ID NO: 422334 - RNA, 32 nt, Human
gagacagugaagucaccccguguccuuuuugc

SEQ ID NO: 422335 - RNA, 32 nt, Human
gagacagugauagagacagaggaacaaaaaga

SEQ ID NO: 422336 - RNA, 32 nt, Human
gagacagugccaaccagaccacggucagaauu

SEQ ID NO: 422337 - RNA, 32 nt, Human
gagacagugccaggaggaagaaggaaggaguc

SEQ ID NO: 422338 - RNA, 32 nt, Human
gagacagugucacuuauucuugcugagaaugc

SEQ ID NO: 422339 - RNA, 32 nt, Human
gagacaguguuuagccauguugcccaggcugu

SEQ ID NO: 422340 - RNA, 22 nt, Human
gagacaguguuucaccauguug

SEQ ID NO: 422341 - RNA, 32 nt, Human
gagacaguuagauuuacuuccucuuuucuaau

SEQ ID NO: 422342 - RNA, 32 nt, Human
gagacauaaagugacuguggaaagccuuuuaa

SEQ ID NO: 422343 - RNA, 32 nt, Human
gagacauaaggagagacaaaaacagguuugug

SEQ ID NO: 422344 - RNA, 22 nt, Human
gagacauagagauagagacaga

SEQ ID NO: 422345 - RNA, 32 nt, Human
gagacauagcccugucccccagccuggcaccu

SEQ ID NO: 422346 - RNA, 32 nt, Human
gagacauagcuacaugugaugugcacaugugu

SEQ ID NO: 422347 - RNA, 32 nt, Human
gagacaucaagagagacagacagagacaugaa

SEQ ID NO: 422348 - RNA, 22 nt, Human
gagacaucacaaccuccaacaa

SEQ ID NO: 422349 - RNA, 32 nt, Human
gagacaucacccaguaggagggaguacggucu

SEQ ID NO: 422350 - RNA, 32 nt, Human
gagacaucacgucacccaccagccugggcccg

SEQ ID NO: 422351 - RNA, 32 nt, Human
gagacaucacugccuuuuucucaguugguugu

SEQ ID NO: 422352 - RNA, 32 nt, Human
gagacaucauagagaaaugagaugcuuaccug

SEQ ID NO: 422353 - RNA, 23 nt, Human
gagacaucccuggugccuggaga

SEQ ID NO: 422354 - RNA, 32 nt, Human
gagacauccuuucugaauacuucuugaugggu

SEQ ID NO: 422355 - RNA, 22 nt, Human
gagacaucgcaaccuccaacaa

SEQ ID NO: 422356 - RNA, 32 nt, Human
gagacaucugccucucuggcccucugagauau

SEQ ID NO: 422357 - RNA, 32 nt, Human
gagacaugagccuguagguucaguagguagag

SEQ ID NO: 422358 - RNA, 32 nt, Human
gagacaugaugguggagaauaaggagaguugu

SEQ ID NO: 422359 - RNA, 32 nt, Human
gagacaugcauucuauaaucauguagacacuc

SEQ ID NO: 422360 - RNA, 32 nt, Human
gagacauggaauugaagagcacuagaaacaac

SEQ ID NO: 422361 - RNA, 32 nt, Human
gagacaugggcagcugacacagcagaccuuga

SEQ ID NO: 422362 - RNA, 32 nt, Human
gagacauggggaguuggagcugaaggaggaau

SEQ ID NO: 422363 - RNA, 30 nt, Human
gagacauggugcugucggagcuagcggcgc

SEQ ID NO: 422364 - RNA, 30 nt, Human
gagacaugucugacacaagcgagaguggug

SEQ ID NO: 422365 - RNA, 32 nt, Human
gagacauguuaccucuucauacacuccuauaa

SEQ ID NO: 422366 - RNA, 18 nt, Human
gagacauucucagaugaa

SEQ ID NO: 422367 - RNA, 32 nt, Human
gagacauucugaaucuuagacuuucugagggg

SEQ ID NO: 422368 - RNA, 32 nt, Human
gagacauugcauucuacuacugcucugauggu

SEQ ID NO: 422369 - RNA, 32 nt, Human
gagacauuggucucacuguguugcccagacug

SEQ ID NO: 422370 - RNA, 20 nt, Human
gagacauuuccugugcuaga

SEQ ID NO: 422371 - RNA, 23 nt, Human
gagacauuucuggauccaggcca

SEQ ID NO: 422372 - RNA, 32 nt, Human
gagaccaaaaugucaaaauauaccucaucaga

SEQ ID NO: 422373 - RNA, 19 nt, Human
gagaccaacagauagacag

SEQ ID NO: 422374 - RNA, 24 nt, Human
gagaccaagagagcaaaccagaga

SEQ ID NO: 422375 - RNA, 32 nt, Human
gagaccaagaguucaagaccagccuggccaac

SEQ ID NO: 422376 - RNA, 32 nt, Human
gagaccaagcagagaauaagacagugcggagc

SEQ ID NO: 422377 - RNA, 18 nt, Human
gagaccaaggcaggcaga

SEQ ID NO: 422378 - RNA, 22 nt, Human
gagaccaaggcaggcagaucac

SEQ ID NO: 422379 - RNA, 32 nt, Human
gagaccaaggcggauggaucaccugaggucag

SEQ ID NO: 422380 - RNA, 18 nt, Human
gagaccaaggcgggcaga

SEQ ID NO: 422381 - RNA, 32 nt, Human
gagaccaaggcggguggaucaccugaggucag

SEQ ID NO: 422382 - RNA, 32 nt, Human
gagaccaaggugggcagaucaccugaggucag

SEQ ID NO: 422383 - RNA, 32 nt, Human
gagaccaaggugggcggaucaccugaggucag

SEQ ID NO: 422384 - RNA, 32 nt, Human
gagaccacaccacugcacuccauccugggcaa

SEQ ID NO: 422385 - RNA, 32 nt, Human
gagaccacaccacugcacuccugccugggcaa

SEQ ID NO: 422386 - RNA, 32 nt, Human
gagaccacaccauugcacuccagccugggcaa

SEQ ID NO: 422387 - RNA, 32 nt, Human
gagaccacacuggccuccccuaggagcacguc

SEQ ID NO: 422388 - RNA, 21 nt, Human
gagaccacagaaucagguuuu

SEQ ID NO: 422389 - RNA, 32 nt, Human
gagaccacagcccccggggagaggcggagggg

SEQ ID NO: 422390 - RNA, 23 nt, Human
gagaccacagguguugcugguga

SEQ ID NO: 422391 - RNA, 19 nt, Human
gagaccacgcagccuuccu

SEQ ID NO: 422392 - RNA, 32 nt, Human
gagaccacgccauugcacuccagccuggguga

SEQ ID NO: 422393 - RNA, 32 nt, Human
gagaccacgccauugcacuccagcuugggcaa

SEQ ID NO: 422394 - RNA, 32 nt, Human
gagaccacucaacccccaccuggaaggggcaa

SEQ ID NO: 422395 - RNA, 32 nt, Human
gagaccacugcacuccagccugggcaacagag

SEQ ID NO: 422396 - RNA, 21 nt, Human
gagaccagaaccugcuugcug

SEQ ID NO: 422397 - RNA, 32 nt, Human
gagaccagacuggccaacacagcgagaccccc

SEQ ID NO: 422398 - RNA, 32 nt, Human
gagaccagagcuggccugaaaauuacuggugu

SEQ ID NO: 422399 - RNA, 32 nt, Human
gagaccagagugggaggaaggcggggagucca

SEQ ID NO: 422400 - RNA, 32 nt, Human
gagaccagaucccugucuucugaccuccaaca

SEQ ID NO: 422401 - RNA, 32 nt, Human
gagaccagcagagaucaaauguaacaaagcac

SEQ ID NO: 422402 - RNA, 32 nt, Human
gagaccagcagccuggccaauauggugaaacu

SEQ ID NO: 422403 - RNA, 24 nt, Human
gagaccagcccagccaacauggca

SEQ ID NO: 422404 - RNA, 24 nt, Human
gagaccagccuagccaacauggca

SEQ ID NO: 422405 - RNA, 32 nt, Human
gagaccagccuccuggccaacauggugaaacu

SEQ ID NO: 422406 - RNA, 32 nt, Human
gagaccagccugaccaacaugaugaaaugcug

SEQ ID NO: 422407 - RNA, 32 nt, Human
gagaccagccugaccaacauggagaaaugcca

SEQ ID NO: 422408 - RNA, 32 nt, Human
gagaccagccugaccaacauggagaagccccg

SEQ ID NO: 422409 - RNA, 32 nt, Human
gagaccagccugaccaacauggugaaacgcca

SEQ ID NO: 422410 - RNA, 32 nt, Human
gagaccagccugaccaacauggugaaagcccg

SEQ ID NO: 422411 - RNA, 32 nt, Human
gagaccagccugaccaacguggagaaacacua

SEQ ID NO: 422412 - RNA, 32 nt, Human
gagaccagccugaccaacguggagaaaccccg

SEQ ID NO: 422413 - RNA, 32 nt, Human
gagaccagccugaccaagaugaugaaacgcua

SEQ ID NO: 422414 - RNA, 32 nt, Human
gagaccagccuggacaacacagugagaccuca

SEQ ID NO: 422415 - RNA, 32 nt, Human
gagaccagccuggacaacauagugagaccccc

SEQ ID NO: 422416 - RNA, 32 nt, Human
gagaccagccuggacaacauagugagaccccg

SEQ ID NO: 422417 - RNA, 32 nt, Human
gagaccagccuggacaacauagugagaccucg

SEQ ID NO: 422418 - RNA, 32 nt, Human
gagaccagccuggauaacaaagggagacccag

SEQ ID NO: 422419 - RNA, 32 nt, Human
gagaccagccuggaugacauaaugagauucug

SEQ ID NO: 422420 - RNA, 32 nt, Human
gagaccagccuggcaacacagcaagacccuau

SEQ ID NO: 422421 - RNA, 32 nt, Human
gagaccagccuggcaacauggcaagacccugc

SEQ ID NO: 422422 - RNA, 32 nt, Human
gagaccagccuggccaacacggugagacccug

SEQ ID NO: 422423 - RNA, 32 nt, Human
gagaccagccuggccaacacuaucuguacuaa

SEQ ID NO: 422424 - RNA, 32 nt, Human
gagaccagccuggccaacagacgggagccacu

SEQ ID NO: 422425 - RNA, 32 nt, Human
gagaccagccuggccaacauagcgagagcagc

SEQ ID NO: 422426 - RNA, 32 nt, Human
gagaccagccuggccaacaugccuccagggca

SEQ ID NO: 422427 - RNA, 32 nt, Human
gagaccagccuggccaacauggcaagacccca

SEQ ID NO: 422428 - RNA, 32 nt, Human
gagaccagccuggccaacauggcgagacccca

SEQ ID NO: 422429 - RNA, 32 nt, Human
gagaccagccuggccaacauggcggaacccca

SEQ ID NO: 422430 - RNA, 32 nt, Human
gagaccagccuggccaacauggcggaacccug

SEQ ID NO: 422431 - RNA, 32 nt, Human
gagaccagccuggccaacauggugagacccca

SEQ ID NO: 422432 - RNA, 32 nt, Human
gagaccagccuggccaacauggugagacccug

SEQ ID NO: 422433 - RNA, 32 nt, Human
gagaccagccuggccaacaugguggaacccaa

SEQ ID NO: 422434 - RNA, 32 nt, Human
gagaccagccuggccaacauggugugagaccc

SEQ ID NO: 422435 - RNA, 32 nt, Human
gagaccagccuggccaccauggugagaccccg

SEQ ID NO: 422436 - RNA, 32 nt, Human
gagaccagccuggccagcauggugagaccccg

SEQ ID NO: 422437 - RNA, 32 nt, Human
gagaccagccugggcaaaacagugggaccccc

SEQ ID NO: 422438 - RNA, 32 nt, Human
gagaccagccugggcaacaaagugagaccccc

SEQ ID NO: 422439 - RNA, 32 nt, Human
gagaccagccugggcaacaaagugagacucca

SEQ ID NO: 422440 - RNA, 32 nt, Human
gagaccagccugggcaacacagcgagaacuug

SEQ ID NO: 422441 - RNA, 32 nt, Human
gagaccagccugggcaacacagcgagaucucu

SEQ ID NO: 422442 - RNA, 32 nt, Human
gagaccagccugggcaacacaggaagaccccg

SEQ ID NO: 422443 - RNA, 32 nt, Human
gagaccagccugggcaacacagggagaccccg

SEQ ID NO: 422444 - RNA, 32 nt, Human
gagaccagccugggcaacacagggagacgcuc

SEQ ID NO: 422445 - RNA, 32 nt, Human
gagaccagccugggcaacacagggagacucug

SEQ ID NO: 422446 - RNA, 32 nt, Human
gagaccagccugggcaacacagugagaacccu

SEQ ID NO: 422447 - RNA, 32 nt, Human
gagaccagccugggcaacagagugagacucug

SEQ ID NO: 422448 - RNA, 32 nt, Human
gagaccagccugggcaacaggguaagguccug

SEQ ID NO: 422449 - RNA, 32 nt, Human
gagaccagccugggcaacauagagagacccug

SEQ ID NO: 422450 - RNA, 32 nt, Human
gagaccagccugggcaacauagagagaccucu

SEQ ID NO: 422451 - RNA, 32 nt, Human
gagaccagccugggcaacauagcaagaccccc

SEQ ID NO: 422452 - RNA, 32 nt, Human
gagaccagccugggcaacauagcaagaccccg

SEQ ID NO: 422453 - RNA, 32 nt, Human
gagaccagccugggcaacauagcaagacccug

SEQ ID NO: 422454 - RNA, 32 nt, Human
gagaccagccugggcaacauagcaagacucug

SEQ ID NO: 422455 - RNA, 32 nt, Human
gagaccagccugggcaacauagcaagaucccu

SEQ ID NO: 422456 - RNA, 32 nt, Human
gagaccagccugggcaacauagcgagacccca

SEQ ID NO: 422457 - RNA, 32 nt, Human
gagaccagccugggcaacauagcgagaccuua

SEQ ID NO: 422458 - RNA, 32 nt, Human
gagaccagccugggcaacauagggaggccccg

SEQ ID NO: 422459 - RNA, 32 nt, Human
gagaccagccugggcaacauaguaagaccuca

SEQ ID NO: 422460 - RNA, 32 nt, Human
gagaccagccugggcaacauaguaagacgcug

SEQ ID NO: 422461 - RNA, 32 nt, Human
gagaccagccugggcaacauagugagacccca

SEQ ID NO: 422462 - RNA, 32 nt, Human
gagaccagccugggcaacauagugagaccccc

SEQ ID NO: 422463 - RNA, 32 nt, Human
gagaccagccugggcaacauagugagaccuca

SEQ ID NO: 422464 - RNA, 32 nt, Human
gagaccagccugggcaacauagugagacucug

SEQ ID NO: 422465 - RNA, 32 nt, Human
gagaccagccugggcaacauagugagacuguc

SEQ ID NO: 422466 - RNA, 32 nt, Human
gagaccagccugggcaacauagugagauccca

SEQ ID NO: 422467 - RNA, 32 nt, Human
gagaccagccugggcaacauagugaggccccu

SEQ ID NO: 422468 - RNA, 32 nt, Human
gagaccagccugggcaacauagugagugagac

SEQ ID NO: 422469 - RNA, 32 nt, Human
gagaccagccugggcaacauaugagaaacccg

SEQ ID NO: 422470 - RNA, 32 nt, Human
gagaccagccugggcaacauaugggacacccc

SEQ ID NO: 422471 - RNA, 32 nt, Human
gagaccagccugggcaacaucaggagauccuu

SEQ ID NO: 422472 - RNA, 32 nt, Human
gagaccagccugggcaacaucaugagacguca

SEQ ID NO: 422473 - RNA, 32 nt, Human
gagaccagccugggcaacaucgggagacccca

SEQ ID NO: 422474 - RNA, 32 nt, Human
gagaccagccugggcaacauggagaaaccccg

SEQ ID NO: 422475 - RNA, 32 nt, Human
gagaccagccugggcaacauggagagaccccu

SEQ ID NO: 422476 - RNA, 32 nt, Human
gagaccagccugggcaacauggcaagacccca

SEQ ID NO: 422477 - RNA, 32 nt, Human
gagaccagccugggcaacauggcgagacccug

SEQ ID NO: 422478 - RNA, 32 nt, Human
gagaccagccugggcaacauggcgagauccug

SEQ ID NO: 422479 - RNA, 32 nt, Human
gagaccagccugggcaacauggcgaggccucu

SEQ ID NO: 422480 - RNA, 32 nt, Human
gagaccagccugggcaacauggggagacccag

SEQ ID NO: 422481 - RNA, 32 nt, Human
gagaccagccugggcaacauggugagaccaau

SEQ ID NO: 422482 - RNA, 32 nt, Human
gagaccagccugggcaacauggugagaccccg

SEQ ID NO: 422483 - RNA, 32 nt, Human
gagaccagccugggcaaccuaaugagaguucc

SEQ ID NO: 422484 - RNA, 32 nt, Human
gagaccagccugggcaacgcagugagagaccc

SEQ ID NO: 422485 - RNA, 32 nt, Human
gagaccagccugggcaacguagucagacccca

SEQ ID NO: 422486 - RNA, 32 nt, Human
gagaccagccugggcaacguauugagaccaug

SEQ ID NO: 422487 - RNA, 32 nt, Human
gagaccagccugggcaagauggcaagaccuug

SEQ ID NO: 422488 - RNA, 32 nt, Human
gagaccagccugggcaauauagcaagaccccu

SEQ ID NO: 422489 - RNA, 32 nt, Human
gagaccagccugggcaauauagcgagacuuca

SEQ ID NO: 422490 - RNA, 32 nt, Human
gagaccagccugggcaauauagugagaccucu

SEQ ID NO: 422491 - RNA, 32 nt, Human
gagaccagccugggcaauaucgugagacccca

SEQ ID NO: 422492 - RNA, 32 nt, Human
gagaccagccugggcaauauggugagacucca

SEQ ID NO: 422493 - RNA, 32 nt, Human
gagaccagccugggcagcauagcaagacacau

SEQ ID NO: 422494 - RNA, 32 nt, Human
gagaccagccugggcagcauagcaagacccca

SEQ ID NO: 422495 - RNA, 32 nt, Human
gagaccagccugggcagcauagcaagaucccc

SEQ ID NO: 422496 - RNA, 32 nt, Human
gagaccagccugggcaucguagugagacucca

SEQ ID NO: 422497 - RNA, 32 nt, Human
gagaccagccugggcgauauagugaggcccca

SEQ ID NO: 422498 - RNA, 32 nt, Human
gagaccagccugggcuacauagugagaccaca

SEQ ID NO: 422499 - RNA, 32 nt, Human
gagaccagccuggggaacauagugagacccuu

SEQ ID NO: 422500 - RNA, 32 nt, Human
gagaccagccuggggaccauagcgagaccgcu

SEQ ID NO: 422501 - RNA, 32 nt, Human
gagaccagccuggguaacauagcaagacucug

SEQ ID NO: 422502 - RNA, 32 nt, Human
gagaccagccuggguaacauagcuagaccaca

SEQ ID NO: 422503 - RNA, 32 nt, Human
gagaccagccuggguaacauagugagacccua

SEQ ID NO: 422504 - RNA, 32 nt, Human
gagaccagccuggguaacauggggagauccua

SEQ ID NO: 422505 - RNA, 32 nt, Human
gagaccagccugggugacacagcaagacccca

SEQ ID NO: 422506 - RNA, 32 nt, Human
gagaccagccugguaaaauagugagaccucau

SEQ ID NO: 422507 - RNA, 20 nt, Human
gagaccagccugguaccagg

SEQ ID NO: 422508 - RNA, 23 nt, Human
gagaccagccuggugccuuggca

SEQ ID NO: 422509 - RNA, 32 nt, Human
gagaccagcuacccacagcaaccaaagagacu

SEQ ID NO: 422510 - RNA, 23 nt, Human
gagaccagcucuccagccuggca

SEQ ID NO: 422511 - RNA, 32 nt, Human
gagaccagcuuggugaaacccugucucuacua

SEQ ID NO: 422512 - RNA, 32 nt, Human
gagaccaggaaaggaagaaaggcagcuucacu

SEQ ID NO: 422513 - RNA, 32 nt, Human
gagaccaggaaguugaggcugcaaugagccgu

SEQ ID NO: 422514 - RNA, 32 nt, Human
gagaccaggagguugaggcugcagugagccgu

SEQ ID NO: 422515 - RNA, 32 nt, Human
gagaccaggagucagacuguaggacgaccucg

SEQ ID NO: 422516 - RNA, 32 nt, Human
gagaccaggaguucaagaccagccugggcaac

SEQ ID NO: 422517 - RNA, 32 nt, Human
gagaccaggaguucaagaccagccugggcaau

SEQ ID NO: 422518 - RNA, 23 nt, Human
gagaccaggaguuccaaaccagc

SEQ ID NO: 422519 - RNA, 32 nt, Human
gagaccaggaguucgagaccagccuggccaac

SEQ ID NO: 422520 - RNA, 32 nt, Human
gagaccaggaguucgagaccagccugggcagc

SEQ ID NO: 422521 - RNA, 32 nt, Human
gagaccaggauucaugcuggucuggaacaaug

SEQ ID NO: 422522 - RNA, 32 nt, Human
gagaccaggcagccauggccacugccuuccuc

SEQ ID NO: 422523 - RNA, 32 nt, Human
gagaccaggccaugggcccucacggagaggaa

SEQ ID NO: 422524 - RNA, 25 nt, Human
gagaccaggcuggcuggauccagca

SEQ ID NO: 422525 - RNA, 24 nt, Human
gagaccaggcuuggcugcgggaga

SEQ ID NO: 422526 - RNA, 32 nt, Human
gagaccaggucagacacuaccugcuggcugcc

SEQ ID NO: 422527 - RNA, 32 nt, Human
gagaccagugugaagacucacccuggaagaga

SEQ ID NO: 422528 - RNA, 32 nt, Human
gagaccagugugaggacucacccuggaagaga

SEQ ID NO: 422529 - RNA, 32 nt, Human
gagaccauaccacugcauuccagccuggguga

SEQ ID NO: 422530 - RNA, 29 nt, Human
gagaccaugaagagcugcggccgcccagg

SEQ ID NO: 422531 - RNA, 32 nt, Human
gagaccaugagaaggagaguucagggguccca

SEQ ID NO: 422532 - RNA, 32 nt, Human
gagaccaugccacugcacuccagccugggcaa

SEQ ID NO: 422533 - RNA, 32 nt, Human
gagaccaugccacugcacuccggccuggguga

SEQ ID NO: 422534 - RNA, 32 nt, Human
gagaccaugccauugcacuccagccugggcga

SEQ ID NO: 422535 - RNA, 32 nt, Human
gagaccaugccauuggacuccagccugggcaa

SEQ ID NO: 422536 - RNA, 32 nt, Human
gagaccauggucuguagaccccuucccgauuc

SEQ ID NO: 422537 - RNA, 19 nt, Human
gagaccauguugugccagg

SEQ ID NO: 422538 - RNA, 32 nt, Human
gagacccaaacagugggggcacauguacugca

SEQ ID NO: 422539 - RNA, 32 nt, Human
gagacccaaacccucuuagcagucuucagagu

SEQ ID NO: 422540 - RNA, 32 nt, Human
gagacccaagucaucaugaaaaaggcccaagu

SEQ ID NO: 422541 - RNA, 21 nt, Human
gagacccagaagucuucaaga

SEQ ID NO: 422542 - RNA, 32 nt, Human
gagacccagcacucugguucucucucugccug

SEQ ID NO: 422543 - RNA, 32 nt, Human
gagacccagcagagggaggcagaagggccuuc

SEQ ID NO: 422544 - RNA, 32 nt, Human
gagacccagccaagugccuuuuccucagcacu

SEQ ID NO: 422545 - RNA, 32 nt, Human
gagacccagccgcuggcucccagccuggcuga

SEQ ID NO: 422546 - RNA, 32 nt, Human
gagacccagcuuuugagagacagggugugggc

SEQ ID NO: 422547 - RNA, 32 nt, Human
gagacccaggaugaagggaugcagugagguca

SEQ ID NO: 422548 - RNA, 32 nt, Human
gagacccauccagccaagcugguggacaaccu

SEQ ID NO: 422549 - RNA, 32 nt, Human
gagaccccaaagacucuggaggucaucuggcg

SEQ ID NO: 422550 - RNA, 19 nt, Human
gagaccccagaagguggau

SEQ ID NO: 422551 - RNA, 32 nt, Human
gagaccccagcacccccuugcucacucucuug

SEQ ID NO: 422552 - RNA, 32 nt, Human
gagaccccagcaccuugagcacacaggagcca

SEQ ID NO: 422553 - RNA, 32 nt, Human
gagaccccagcagaggaggacaguggcucuga

SEQ ID NO: 422554 - RNA, 32 nt, Human
gagaccccaucucaaaaacaaaacaccaaaca

SEQ ID NO: 422555 - RNA, 32 nt, Human
gagaccccaucucuaagaaaaagaaaaagaaa

SEQ ID NO: 422556 - RNA, 20 nt, Human
gagaccccaucucuacaaaa

SEQ ID NO: 422557 - RNA, 18 nt, Human
gagaccccaucucuacua

SEQ ID NO: 422558 - RNA, 32 nt, Human
gagaccccaugccaccccaccauggugagugc

SEQ ID NO: 422559 - RNA, 32 nt, Human
gagacccccacaguucucaauccagggaaagg

SEQ ID NO: 422560 - RNA, 32 nt, Human
gagacccccacccucccuuucccggucugcua

SEQ ID NO: 422561 - RNA, 22 nt, Human
gagacccccagggcagugggug

SEQ ID NO: 422562 - RNA, 24 nt, Human
gagacccccgugggcacgugucca

SEQ ID NO: 422563 - RNA, 32 nt, Human
gagacccccucagaccagcacagagaccuguc

SEQ ID NO: 422564 - RNA, 32 nt, Human
gagaccccggagccucugcuucuccuacacug

SEQ ID NO: 422565 - RNA, 26 nt, Human
gagaccccuuggacaaacagauuuuu

SEQ ID NO: 422566 - RNA, 32 nt, Human
gagacccgcuuugcgcccagacugagccagag

SEQ ID NO: 422567 - RNA, 32 nt, Human
gagacccggaagcagauuacguggagugacgg

SEQ ID NO: 422568 - RNA, 26 nt, Human
gagacccggaccugguccgcugggga

SEQ ID NO: 422569 - RNA, 32 nt, Human
gagacccgggagccacccgccgggccccuuca

SEQ ID NO: 422570 - RNA, 32 nt, Human
gagacccuccccaacacagugagaccccagcc

SEQ ID NO: 422571 - RNA, 32 nt, Human
gagacccuccuccucagacugcuggagcaaca

SEQ ID NO: 422572 - RNA, 20 nt, Human
gagacccucgggccugggga

SEQ ID NO: 422573 - RNA, 32 nt, Human
gagacccugaagaugcuuuuggacaguggucu

SEQ ID NO: 422574 - RNA, 21 nt, Human
gagacccugagagcccuggga

SEQ ID NO: 422575 - RNA, 32 nt, Human
gagacccugaggccucccaccuccccaaggcc

SEQ ID NO: 422576 - RNA, 32 nt, Human
gagacccugcaauggccaccucuuuaaaaggg

SEQ ID NO: 422577 - RNA, 32 nt, Human
gagacccugcagcugagggagcaucauggcag

SEQ ID NO: 422578 - RNA, 32 nt, Human
gagacccugccacccauuccaucuccauccaa

SEQ ID NO: 422579 - RNA, 32 nt, Human
gagacccugcccagagguaaaggaggcagggu

SEQ ID NO: 422580 - RNA, 32 nt, Human
gagacccuggaaguggagguggcugugugcug

SEQ ID NO: 422581 - RNA, 32 nt, Human
gagacccuggcuuggaaagugaacuugcagcc

SEQ ID NO: 422582 - RNA, 32 nt, Human
gagacccugggagcuguggcugucuucugugg

SEQ ID NO: 422583 - RNA, 32 nt, Human
gagacccugugcucccccugcccuggguggag

SEQ ID NO: 422584 - RNA, 32 nt, Human
gagacccuguguauuucagagcuggauacugc

SEQ ID NO: 422585 - RNA, 32 nt, Human
gagaccgaaguccgcagaaccugccugugucc

SEQ ID NO: 422586 - RNA, 32 nt, Human
gagaccgacggccgcuggagugcacuggcaug

SEQ ID NO: 422587 - RNA, 32 nt, Human
gagaccgacucaggcuguccucaggccgcgug

SEQ ID NO: 422588 - RNA, 32 nt, Human
gagaccgacuucuuucucuuuacccucauugg

SEQ ID NO: 422589 - RNA, 32 nt, Human
gagaccgagccacuguacuccagccuagguga

SEQ ID NO: 422590 - RNA, 32 nt, Human
gagaccgaggagggagagucucccagggagca

SEQ ID NO: 422591 - RNA, 32 nt, Human
gagaccgaggcagguggaucaccugaggucag

SEQ ID NO: 422592 - RNA, 32 nt, Human
gagaccgaggcagguggaucaccugggucggg

SEQ ID NO: 422593 - RNA, 23 nt, Human
gagaccgaggcaugagagucacu

SEQ ID NO: 422594 - RNA, 32 nt, Human
gagaccgaggcggguggcucaccugaggucgg

SEQ ID NO: 422595 - RNA, 32 nt, Human
gagaccgcaccacugcacuccagccugggcga

SEQ ID NO: 422596 - RNA, 32 nt, Human
gagaccgcagggcuuuggccugggcagcuucc

SEQ ID NO: 422597 - RNA, 32 nt, Human
gagaccgcgccacugcacuccagccugggcaa

SEQ ID NO: 422598 - RNA, 32 nt, Human
gagaccgcggcgucuccagccucgguaccaug

SEQ ID NO: 422599 - RNA, 32 nt, Human
gagaccggagucuugcucuugucgccuccuga

SEQ ID NO: 422600 - RNA, 32 nt, Human
gagaccggccuugucugcugggcacgggucuu

SEQ ID NO: 422601 - RNA, 16 nt, Human
gagaccggcucuggga

SEQ ID NO: 422602 - RNA, 32 nt, Human
gagaccgggaggaucacagagccagcauguua

SEQ ID NO: 422603 - RNA, 22 nt, Human
gagaccgggcuucaccauguug

SEQ ID NO: 422604 - RNA, 32 nt, Human
gagaccggugcuggugcagguccuugguaugc

SEQ ID NO: 422605 - RNA, 22 nt, Human
gagaccgguuuucaccacguug

SEQ ID NO: 422606 - RNA, 32 nt, Human
gagaccguaagaaccucuuagcuuugugcguu

SEQ ID NO: 422607 - RNA, 32 nt, Human
gagaccgugccacugcacuccagccuggcaac

SEQ ID NO: 422608 - RNA, 32 nt, Human
gagaccgugccacugcacuccagccugggcaa

SEQ ID NO: 422609 - RNA, 32 nt, Human
gagaccgugggaugugggugggaucugggauu

SEQ ID NO: 422610 - RNA, 32 nt, Human
gagaccguguccauggggcgugcaguggaggc

SEQ ID NO: 422611 - RNA, 32 nt, Human
gagaccguguucaugcaacacagcauuauuuc

SEQ ID NO: 422612 - RNA, 32 nt, Human
gagaccguguucccaggagcacugacugcagu

SEQ ID NO: 422613 - RNA, 32 nt, Human
gagaccuacaaggacaaguuugucaucaucug

SEQ ID NO: 422614 - RNA, 32 nt, Human
gagaccuaccggcaagcaaaggagcgggagga

SEQ ID NO: 422615 - RNA, 32 nt, Human
gagaccuaccugcuggagaagucgcgggccau

SEQ ID NO: 422616 - RNA, 32 nt, Human
gagaccuacuaaaaaugggaaucaagucuugg

SEQ ID NO: 422617 - RNA, 32 nt, Human
gagaccuagcacaggaggaagagaugggcagg

SEQ ID NO: 422618 - RNA, 32 nt, Human
gagaccuaggagguggucuuguggugguacau

SEQ ID NO: 422619 - RNA, 32 nt, Human
gagaccuagucucacucuguugcccaggcugg

SEQ ID NO: 422620 - RNA, 32 nt, Human
gagaccucaguucugugugucucuagaggucc

SEQ ID NO: 422621 - RNA, 32 nt, Human
gagaccuccagcaaggaugaugucaccauaac

SEQ ID NO: 422622 - RNA, 32 nt, Human
gagaccuccgccucugcacuccagccugggug

SEQ ID NO: 422623 - RNA, 32 nt, Human
gagaccuccugccgggcaggucacugugcuga

SEQ ID NO: 422624 - RNA, 32 nt, Human
gagaccucuaauuuuucuuccucuccagccag

SEQ ID NO: 422625 - RNA, 32 nt, Human
gagaccucuugucucuguggccaaccucugcu

SEQ ID NO: 422626 - RNA, 32 nt, Human
gagaccugacagagucucagucaugcugcaac

SEQ ID NO: 422627 - RNA, 32 nt, Human
gagaccugagaggcaccaggcccagccguggc

SEQ ID NO: 422628 - RNA, 20 nt, Human
gagaccugaggaggaggcag

SEQ ID NO: 422629 - RNA, 32 nt, Human
gagaccugaggccagacggaacuacaacaugu

SEQ ID NO: 422630 - RNA, 32 nt, Human
gagaccugcagagucaaccaagcacagguuag

SEQ ID NO: 422631 - RNA, 32 nt, Human
gagaccugcaggaaaucggggagugagaccug

SEQ ID NO: 422632 - RNA, 32 nt, Human
gagaccugcaggaggcaagggcugcaacagac

SEQ ID NO: 422633 - RNA, 32 nt, Human
gagaccugcccucucugcgcugaggcccagcc

SEQ ID NO: 422634 - RNA, 24 nt, Human
gagaccugcgacaaagacagguua

SEQ ID NO: 422635 - RNA, 32 nt, Human
gagaccuggccuagugacagagccaggauuca

SEQ ID NO: 422636 - RNA, 29 nt, Human
gagaccuggcugcugugucccgcggcuug

SEQ ID NO: 422637 - RNA, 32 nt, Human
gagaccugggagcccucgggaaaccucccccg

SEQ ID NO: 422638 - RNA, 32 nt, Human
gagaccugggaggaagcuggagaaaagaugcc

SEQ ID NO: 422639 - RNA, 32 nt, Human
gagaccugggcaggaauggcugcucuaggguc

SEQ ID NO: 422640 - RNA, 32 nt, Human
gagaccuggggcugccucacccucucuccaga

SEQ ID NO: 422641 - RNA, 32 nt, Human
gagaccuggugggggcacacagcugcuauaua

SEQ ID NO: 422642 - RNA, 32 nt, Human
gagaccugucaucugcaucuggucccuccccc

SEQ ID NO: 422643 - RNA, 32 nt, Human
gagaccugugugaacuauugagaagaucggaa

SEQ ID NO: 422644 - RNA, 32 nt, Human
gagaccuugacagaugccuggaggucagaaau

SEQ ID NO: 422645 - RNA, 31 nt, Human
gagaccuugcuuucuguuucacugggaaaca

SEQ ID NO: 422646 - RNA, 32 nt, Human
gagaccuuuucccagcuggagcccugucauuc

SEQ ID NO: 422647 - RNA, 24 nt, Human
gagacgaaaagcaccaacaaauga

SEQ ID NO: 422648 - RNA, 32 nt, Human
gagacgaagcaguucuggagugccugaacggc

SEQ ID NO: 422649 - RNA, 31 nt, Human
gagacgaaggagagagagcugaggguggagg

SEQ ID NO: 422650 - RNA, 32 nt, Human
gagacgacaccacugcacuccagccuggguga

SEQ ID NO: 422651 - RNA, 18 nt, Human
gagacgagcccggggcgg

SEQ ID NO: 422652 - RNA, 32 nt, Human
gagacgaggcaggcacagcugccagagaccau

SEQ ID NO: 422653 - RNA, 22 nt, Human
gagacgaggcuucaccauguug

SEQ ID NO: 422654 - RNA, 22 nt, Human
gagacgaggucccaccauguug

SEQ ID NO: 422655 - RNA, 23 nt, Human
gagacgagguuucaccaucuugg

SEQ ID NO: 422656 - RNA, 22 nt, Human
gagacgagguuucaccauguug

SEQ ID NO: 422657 - RNA, 23 nt, Human
gagacgagguuucaccauguugg

SEQ ID NO: 422658 - RNA, 21 nt, Human
gagacgagguuucaccguguu

SEQ ID NO: 422659 - RNA, 23 nt, Human
gagacgagguuucacuguguugg

SEQ ID NO: 422660 - RNA, 22 nt, Human
gagacgagguuucgccauguug

SEQ ID NO: 422661 - RNA, 22 nt, Human
gagacgagguuuugccauguug

SEQ ID NO: 422662 - RNA, 32 nt, Human
gagacgcacacagcugagcacuuagcaggcac

SEQ ID NO: 422663 - RNA, 32 nt, Human
gagacgcagcacucccaugucugccgguuccc

SEQ ID NO: 422664 - RNA, 32 nt, Human
gagacgcagcagccuguguccuccagggccuc

SEQ ID NO: 422665 - RNA, 32 nt, Human
gagacgcaggagguggagccggccgggugcuc

SEQ ID NO: 422666 - RNA, 32 nt, Human
gagacgcaggguggcuggaggaagugagaggu

SEQ ID NO: 422667 - RNA, 22 nt, Human
gagacgcaguuucaccguguua

SEQ ID NO: 422668 - RNA, 32 nt, Human
gagacgccaaaagagaagauacagaggguggg

SEQ ID NO: 422669 - RNA, 32 nt, Human
gagacgccaggcugggauuuccgcucgaucug

SEQ ID NO: 422670 - RNA, 32 nt, Human
gagacgcccuggaacgucuguguagccucagu

SEQ ID NO: 422671 - RNA, 32 nt, Human
gagacgccgggcaggcagaagcagcagguacc

SEQ ID NO: 422672 - RNA, 32 nt, Human
gagacgcugcauuuccccgccugcugcagcuc

SEQ ID NO: 422673 - RNA, 32 nt, Human
gagacgcugcuccggcaggugcagccccggaa

SEQ ID NO: 422674 - RNA, 32 nt, Human
gagacgcuguuugugggagcacugggcucaug

SEQ ID NO: 422675 - RNA, 32 nt, Human
gagacggaagaggagacacagacacaaagcag

SEQ ID NO: 422676 - RNA, 32 nt, Human
gagacggacagagaggaggaugacuuccuuuu

SEQ ID NO: 422677 - RNA, 32 nt, Human
gagacggacagcacccuccucaucuggcaggu

SEQ ID NO: 422678 - RNA, 32 nt, Human
gagacggacuccuguucaccuaggugaggugu

SEQ ID NO: 422679 - RNA, 32 nt, Human
gagacggagacucacucuguugcccagacugg

SEQ ID NO: 422680 - RNA, 32 nt, Human
gagacggagauucacuuuuguugcccaggcug

SEQ ID NO: 422681 - RNA, 32 nt, Human
gagacggagcccuccaccccucucacacacuc

SEQ ID NO: 422682 - RNA, 20 nt, Human
gagacggagcuugcagugag

SEQ ID NO: 422683 - RNA, 32 nt, Human
gagacggaggaaagguggcagccagauuacuu

SEQ ID NO: 422684 - RNA, 32 nt, Human
gagacggaggaaggucugaggagcagcuucag

SEQ ID NO: 422685 - RNA, 32 nt, Human
gagacggagucucacucuugucacucaggcug

SEQ ID NO: 422686 - RNA, 20 nt, Human
gagacggagucucgcgcugu

SEQ ID NO: 422687 - RNA, 20 nt, Human
gagacggagucucgcucugu

SEQ ID NO: 422688 - RNA, 32 nt, Human
gagacggagucuggcucuguccgccaggcugg

SEQ ID NO: 422689 - RNA, 20 nt, Human
gagacggagucuuacucugu

SEQ ID NO: 422690 - RNA, 19 nt, Human
gagacggagucuugcucug

SEQ ID NO: 422691 - RNA, 20 nt, Human
gagacggagucuugcucugu

SEQ ID NO: 422692 - RNA, 32 nt, Human
gagacggaguugcccaggcuggagugcagcgc

SEQ ID NO: 422693 - RNA, 22 nt, Human
gagacggaguuucaccauguua

SEQ ID NO: 422694 - RNA, 22 nt, Human
gagacggaguuucaccauguug

SEQ ID NO: 422695 - RNA, 32 nt, Human
gagacggaguuucacucuuguugcccaggcug

SEQ ID NO: 422696 - RNA, 32 nt, Human
gagacggaguuucacuguuguugcccaggcug

SEQ ID NO: 422697 - RNA, 32 nt, Human
gagacggaguuucacuuuuguugcccaggcug

SEQ ID NO: 422698 - RNA, 32 nt, Human
gagacggaguuucccucuuguugcccaggcug

SEQ ID NO: 422699 - RNA, 32 nt, Human
gagacggaguuucccucuuguugcccgggcug

SEQ ID NO: 422700 - RNA, 32 nt, Human
gagacggaguuucgcucuuauugcccaggcug

SEQ ID NO: 422701 - RNA, 32 nt, Human
gagacggaguuucgcucuuguugcccaagcug

SEQ ID NO: 422702 - RNA, 32 nt, Human
gagacggaguuucgcucuuguugcccaggcug

SEQ ID NO: 422703 - RNA, 32 nt, Human
gagacggaguuucgcuguuguugcccaggcug

SEQ ID NO: 422704 - RNA, 32 nt, Human
gagacggaguuucucucuuguuacccaggcug

SEQ ID NO: 422705 - RNA, 32 nt, Human
gagacggaguuuugcucuuguugcccaggcug

SEQ ID NO: 422706 - RNA, 32 nt, Human
gagacggaguuuugcuuuuauugcccaggcug

SEQ ID NO: 422707 - RNA, 32 nt, Human
gagacggaguuuuguucuuguugcccaggcug

SEQ ID NO: 422708 - RNA, 22 nt, Human
gagacggcauuucaccauguug

SEQ ID NO: 422709 - RNA, 32 nt, Human
gagacggccacgaagagaggaggcagugagca

SEQ ID NO: 422710 - RNA, 22 nt, Human
gagacggcccuucucucuccuc

SEQ ID NO: 422711 - RNA, 32 nt, Human
gagacggccuccugcccugcgcagccaguccc

SEQ ID NO: 422712 - RNA, 22 nt, Human
gagacggcguuucaccauguug

SEQ ID NO: 422713 - RNA, 32 nt, Human
gagacggcuccucagaugcucagcuaagccua

SEQ ID NO: 422714 - RNA, 32 nt, Human
gagacgggacucaggucaucaaaaugaaagcc

SEQ ID NO: 422715 - RNA, 32 nt, Human
gagacgggagagagaagaagaguggguuugaa

SEQ ID NO: 422716 - RNA, 32 nt, Human
gagacgggagagaggagagagaaagagagaga

SEQ ID NO: 422717 - RNA, 32 nt, Human
gagacgggagucuuacuuuguugcccaggcug

SEQ ID NO: 422718 - RNA, 22 nt, Human
gagacgggauucuaccauguug

SEQ ID NO: 422719 - RNA, 22 nt, Human
gagacgggauuucaccauguug

SEQ ID NO: 422720 - RNA, 23 nt, Human
gagacgggauuucaccauguugg

SEQ ID NO: 422721 - RNA, 21 nt, Human
gagacgggauuucaccguguu

SEQ ID NO: 422722 - RNA, 22 nt, Human
gagacgggauuucaccguguua

SEQ ID NO: 422723 - RNA, 21 nt, Human
gagacgggauuucacuguguu

SEQ ID NO: 422724 - RNA, 23 nt, Human
gagacgggauuucacuguguugg

SEQ ID NO: 422725 - RNA, 23 nt, Human
gagacgggauuuuaucauguugg

SEQ ID NO: 422726 - RNA, 32 nt, Human
gagacgggcagaucaccugagaucaggaguuu

SEQ ID NO: 422727 - RNA, 22 nt, Human
gagacgggcagaucacgagguc

SEQ ID NO: 422728 - RNA, 32 nt, Human
gagacgggcaggacgcccugccccgcaccagc

SEQ ID NO: 422729 - RNA, 22 nt, Human
gagacgggcggaucacgagguc

SEQ ID NO: 422730 - RNA, 22 nt, Human
gagacggggccucacuauguug

SEQ ID NO: 422731 - RNA, 22 nt, Human
gagacggggcuucaccacguug

SEQ ID NO: 422732 - RNA, 23 nt, Human
gagacggggcuucaccacguugg

SEQ ID NO: 422733 - RNA, 23 nt, Human
gagacggggcuucaccaucuugg

SEQ ID NO: 422734 - RNA, 32 nt, Human
gagacggggcuucaccaucuuggccaggcugg

SEQ ID NO: 422735 - RNA, 23 nt, Human
gagacggggcuucacuauguugg

SEQ ID NO: 422736 - RNA, 23 nt, Human
gagacggggcuucuccauguugg

SEQ ID NO: 422737 - RNA, 22 nt, Human
gagacggggguuucaccauguu

SEQ ID NO: 422738 - RNA, 23 nt, Human
gagacggggguuucaccauguua

SEQ ID NO: 422739 - RNA, 32 nt, Human
gagacggggguuucaccauguuagccaggcug

SEQ ID NO: 422740 - RNA, 23 nt, Human
gagacggggguuucaccauguug

SEQ ID NO: 422741 - RNA, 24 nt, Human
gagacggggguuucaccauguugg

SEQ ID NO: 422742 - RNA, 32 nt, Human
gagacggggguuucaccauguuggccagguug

SEQ ID NO: 422743 - RNA, 32 nt, Human
gagacggggguuucaccauguuggcugggcug

SEQ ID NO: 422744 - RNA, 24 nt, Human
gagacggggguuucacuauguugg

SEQ ID NO: 422745 - RNA, 32 nt, Human
gagacggggguuucacuauguuggcuaggcug

SEQ ID NO: 422746 - RNA, 32 nt, Human
gagacggggguuucgccguguuggccaggaug

SEQ ID NO: 422747 - RNA, 23 nt, Human
gagacgggguaucacuauauugg

SEQ ID NO: 422748 - RNA, 21 nt, Human
gagacggggucucacucuguu

SEQ ID NO: 422749 - RNA, 23 nt, Human
gagacggggucuccccauauugg

SEQ ID NO: 422750 - RNA, 22 nt, Human
gagacggggucucgcaacauug

SEQ ID NO: 422751 - RNA, 23 nt, Human
gagacggggucucgccauguugg

SEQ ID NO: 422752 - RNA, 22 nt, Human
gagacggggucuggcuguguug

SEQ ID NO: 422753 - RNA, 22 nt, Human
gagacggggucuugcuauguug

SEQ ID NO: 422754 - RNA, 22 nt, Human
gagacggggucuugcucuguug

SEQ ID NO: 422755 - RNA, 22 nt, Human
gagacgggguucaccauguugg

SEQ ID NO: 422756 - RNA, 23 nt, Human
gagacgggguuuaaccauguugg

SEQ ID NO: 422757 - RNA, 23 nt, Human
gagacgggguuucaacguguugg

SEQ ID NO: 422758 - RNA, 21 nt, Human
gagacgggguuucacaguguu

SEQ ID NO: 422759 - RNA, 32 nt, Human
gagacgggguuucaccacauugcucaggcugg

SEQ ID NO: 422760 - RNA, 23 nt, Human
gagacgggguuucaccacauugg

SEQ ID NO: 422761 - RNA, 22 nt, Human
gagacgggguuucaccacguug

SEQ ID NO: 422762 - RNA, 23 nt, Human
gagacgggguuucaccacguugg

SEQ ID NO: 422763 - RNA, 21 nt, Human
gagacgggguuucaccagguu

SEQ ID NO: 422764 - RNA, 22 nt, Human
gagacgggguuucaccagguua

SEQ ID NO: 422765 - RNA, 24 nt, Human
gagacgggguuucaccaguguugg

SEQ ID NO: 422766 - RNA, 18 nt, Human
gagacgggguuucaccau

SEQ ID NO: 422767 - RNA, 23 nt, Human
gagacgggguuucaccauacugg

SEQ ID NO: 422768 - RNA, 23 nt, Human
gagacgggguuucaccauauugg

SEQ ID NO: 422769 - RNA, 23 nt, Human
gagacgggguuucaccaucuugg

SEQ ID NO: 422770 - RNA, 19 nt, Human
gagacgggguuucaccaug

SEQ ID NO: 422771 - RNA, 23 nt, Human
gagacgggguuucaccaugcugg

SEQ ID NO: 422772 - RNA, 21 nt, Human
gagacgggguuucaccauguu

SEQ ID NO: 422773 - RNA, 22 nt, Human
gagacgggguuucaccauguua

SEQ ID NO: 422774 - RNA, 22 nt, Human
gagacgggguuucaccauguug

SEQ ID NO: 422775 - RNA, 32 nt, Human
gagacgggguuucaccauguugcucaggcugg

SEQ ID NO: 422776 - RNA, 23 nt, Human
gagacgggguuucaccauguugg

SEQ ID NO: 422777 - RNA, 22 nt, Human
gagacgggguuucaccauuuug

SEQ ID NO: 422778 - RNA, 23 nt, Human
gagacgggguuucaccauuuugg

SEQ ID NO: 422779 - RNA, 21 nt, Human
gagacgggguuucaccguguu

SEQ ID NO: 422780 - RNA, 22 nt, Human
gagacgggguuucaccguguua

SEQ ID NO: 422781 - RNA, 22 nt, Human
gagacgggguuucaccguguug

SEQ ID NO: 422782 - RNA, 23 nt, Human
gagacgggguuucaccguguugg

SEQ ID NO: 422783 - RNA, 23 nt, Human
gagacgggguuucaccuuguugg

SEQ ID NO: 422784 - RNA, 23 nt, Human
gagacgggguuucacuauauugg

SEQ ID NO: 422785 - RNA, 23 nt, Human
gagacgggguuucacuauguugg

SEQ ID NO: 422786 - RNA, 20 nt, Human
gagacgggguuucacucugu

SEQ ID NO: 422787 - RNA, 19 nt, Human
gagacgggguuucacugug

SEQ ID NO: 422788 - RNA, 21 nt, Human
gagacgggguuucacuguguu

SEQ ID NO: 422789 - RNA, 23 nt, Human
gagacgggguuucacuguguugg

SEQ ID NO: 422790 - RNA, 21 nt, Human
gagacgggguuucacuuuguu

SEQ ID NO: 422791 - RNA, 22 nt, Human
gagacgggguuucagcauauug

SEQ ID NO: 422792 - RNA, 23 nt, Human
gagacgggguuucagcauguugg

SEQ ID NO: 422793 - RNA, 23 nt, Human
gagacgggguuucaucauguugg

SEQ ID NO: 422794 - RNA, 21 nt, Human
gagacgggguuucaucguguu

SEQ ID NO: 422795 - RNA, 23 nt, Human
gagacgggguuucauuauguugg

SEQ ID NO: 422796 - RNA, 23 nt, Human
gagacgggguuuccccauguugg

SEQ ID NO: 422797 - RNA, 21 nt, Human
gagacgggguuuccccguguu

SEQ ID NO: 422798 - RNA, 22 nt, Human
gagacgggguuucgccaaguug

SEQ ID NO: 422799 - RNA, 23 nt, Human
gagacgggguuucgccacauugg

SEQ ID NO: 422800 - RNA, 22 nt, Human
gagacgggguuucgccauauug

SEQ ID NO: 422801 - RNA, 22 nt, Human
gagacgggguuucgccauguug

SEQ ID NO: 422802 - RNA, 23 nt, Human
gagacgggguuucgccauguugg

SEQ ID NO: 422803 - RNA, 22 nt, Human
gagacgggguuucgccauuugg

SEQ ID NO: 422804 - RNA, 22 nt, Human
gagacgggguuucgccguguug

SEQ ID NO: 422805 - RNA, 23 nt, Human
gagacgggguuucgcuauuuugg

SEQ ID NO: 422806 - RNA, 23 nt, Human
gagacgggguuucgcucuuguug

SEQ ID NO: 422807 - RNA, 23 nt, Human
gagacgggguuucgcuguguugg

SEQ ID NO: 422808 - RNA, 23 nt, Human
gagacgggguuucggcauguugg

SEQ ID NO: 422809 - RNA, 23 nt, Human
gagacgggguuucuccaugucgg

SEQ ID NO: 422810 - RNA, 21 nt, Human
gagacgggguuucuccauguu

SEQ ID NO: 422811 - RNA, 22 nt, Human
gagacgggguuucuccauguua

SEQ ID NO: 422812 - RNA, 23 nt, Human
gagacgggguuucuccauguugg

SEQ ID NO: 422813 - RNA, 23 nt, Human
gagacgggguuucuccguguugg

SEQ ID NO: 422814 - RNA, 23 nt, Human
gagacgggguuucuccuuguugg

SEQ ID NO: 422815 - RNA, 21 nt, Human
gagacgggguuugaccguguu

SEQ ID NO: 422816 - RNA, 22 nt, Human
gagacgggguuugccaugcugg

SEQ ID NO: 422817 - RNA, 20 nt, Human
gagacgggguuugcuguguu

SEQ ID NO: 422818 - RNA, 21 nt, Human
gagacgggguuuuaccauguu

SEQ ID NO: 422819 - RNA, 22 nt, Human
gagacgggguuuuaccauguua

SEQ ID NO: 422820 - RNA, 23 nt, Human
gagacgggguuuuaccauguugg

SEQ ID NO: 422821 - RNA, 21 nt, Human
gagacgggguuuuaccguguu

SEQ ID NO: 422822 - RNA, 21 nt, Human
gagacgggguuuugccauguu

SEQ ID NO: 422823 - RNA, 22 nt, Human
gagacgggguuuugccauguug

SEQ ID NO: 422824 - RNA, 23 nt, Human
gagacgggguuuugccauguugg

SEQ ID NO: 422825 - RNA, 19 nt, Human
gagacgggucucacuaugu

SEQ ID NO: 422826 - RNA, 22 nt, Human
gagacggguggaucacgagguc

SEQ ID NO: 422827 - RNA, 32 nt, Human
gagacgggugggcggcuggagaccaugcagag

SEQ ID NO: 422828 - RNA, 21 nt, Human
gagacggguuucaccacguug

SEQ ID NO: 422829 - RNA, 22 nt, Human
gagacggguuucaccacguugg

SEQ ID NO: 422830 - RNA, 21 nt, Human
gagacggguuucaccauauug

SEQ ID NO: 422831 - RNA, 21 nt, Human
gagacggguuucaccauguug

SEQ ID NO: 422832 - RNA, 22 nt, Human
gagacggguuucaccauguugg

SEQ ID NO: 422833 - RNA, 21 nt, Human
gagacggguuucaucauguua

SEQ ID NO: 422834 - RNA, 22 nt, Human
gagacggguuuucaccauguug

SEQ ID NO: 422835 - RNA, 32 nt, Human
gagacgguaaagcuggaggugccugagaccag

SEQ ID NO: 422836 - RNA, 32 nt, Human
gagacggucccggaagaaugggacucuguucc

SEQ ID NO: 422837 - RNA, 32 nt, Human
gagacggugauggauaaauugacaacucugua

SEQ ID NO: 422838 - RNA, 32 nt, Human
gagacggugcaaaucugguggaagaugccugc

SEQ ID NO: 422839 - RNA, 32 nt, Human
gagacggugccauugcucuccagccugggcga

SEQ ID NO: 422840 - RNA, 23 nt, Human
gagacggugguuucaccauguug

SEQ ID NO: 422841 - RNA, 24 nt, Human
gagacggugguuucaccauguugg

SEQ ID NO: 422842 - RNA, 32 nt, Human
gagacggugucacugcacuccagccuggguga

SEQ ID NO: 422843 - RNA, 22 nt, Human
gagacgguguuucaccauguug

SEQ ID NO: 422844 - RNA, 32 nt, Human
gagacgguuuggcggugaguccugggccaggc

SEQ ID NO: 422845 - RNA, 32 nt, Human
gagacguccagcucuguccucucuuccucacu

SEQ ID NO: 422846 - RNA, 32 nt, Human
gagacguccaucuggcagccugcguggccguc

SEQ ID NO: 422847 - RNA, 32 nt, Human
gagacgucuucugcagccaccugcuuuccaga

SEQ ID NO: 422848 - RNA, 32 nt, Human
gagacgugaagaggaggaagagugggagaaug

SEQ ID NO: 422849 - RNA, 32 nt, Human
gagacguguccccacugaggugccccacagca

SEQ ID NO: 422850 - RNA, 32 nt, Human
gagacguguuccauuauucugcuggaacaugg

SEQ ID NO: 422851 - RNA, 32 nt, Human
gagacuaaagaaaauuuucaagaggaacauau

SEQ ID NO: 422852 - RNA, 32 nt, Human
gagacuaaaugacuugcccaggguaaaacagu

SEQ ID NO: 422853 - RNA, 27 nt, Human
gagacuaaggcaggagaaucgccugaa

SEQ ID NO: 422854 - RNA, 23 nt, Human
gagacuacaagugugugccacca

SEQ ID NO: 422855 - RNA, 32 nt, Human
gagacuacccuuuagguugaaguuugaccugg

SEQ ID NO: 422856 - RNA, 32 nt, Human
gagacuagaagaggggagcagaaagggaccuu

SEQ ID NO: 422857 - RNA, 32 nt, Human
gagacuagacauuuucugucuccucacuuguc

SEQ ID NO: 422858 - RNA, 32 nt, Human
gagacuagagcauccagggggccaggccccaa

SEQ ID NO: 422859 - RNA, 32 nt, Human
gagacuagagggagugggguugcaguggcugc

SEQ ID NO: 422860 - RNA, 23 nt, Human
gagacuagagguguuuaccacca

SEQ ID NO: 422861 - RNA, 32 nt, Human
gagacuagccugggcaacauaaugagacccca

SEQ ID NO: 422862 - RNA, 32 nt, Human
gagacuagccugggcaacauaccgagacccca

SEQ ID NO: 422863 - RNA, 32 nt, Human
gagacuagccugggcaacauagcgagaccucg

SEQ ID NO: 422864 - RNA, 32 nt, Human
gagacuagccugggcaacauggugagacccca

SEQ ID NO: 422865 - RNA, 32 nt, Human
gagacuagccugggcaacccagugagaccccg

SEQ ID NO: 422866 - RNA, 32 nt, Human
gagacuagccugggcaacgugaugagacuccg

SEQ ID NO: 422867 - RNA, 32 nt, Human
gagacuagccugggcaauaugaugagacccug

SEQ ID NO: 422868 - RNA, 32 nt, Human
gagacuagccuggggcggggcgcggggccaga

SEQ ID NO: 422869 - RNA, 32 nt, Human
gagacuagccugggucccauaguaagacccug

SEQ ID NO: 422870 - RNA, 21 nt, Human
gagacuagcuggaaccaggga

SEQ ID NO: 422871 - RNA, 32 nt, Human
gagacuagcuggaaccagggagguagagguug

SEQ ID NO: 422872 - RNA, 32 nt, Human
gagacuaggaguuugaggcugcagugaacuaa

SEQ ID NO: 422873 - RNA, 32 nt, Human
gagacuagggaguggugaugacugucaacgag

SEQ ID NO: 422874 - RNA, 32 nt, Human
gagacuaugccacugcacuccagccuagguga

SEQ ID NO: 422875 - RNA, 32 nt, Human
gagacuauguuauuuuaaacagucuucuguuu

SEQ ID NO: 422876 - RNA, 32 nt, Human
gagacucaacuccugggaggagagggucucaa

SEQ ID NO: 422877 - RNA, 32 nt, Human
gagacucagaagcagagagugggagguggaug

SEQ ID NO: 422878 - RNA, 32 nt, Human
gagacucagaggcagacccagaaaggggcuca

SEQ ID NO: 422879 - RNA, 32 nt, Human
gagacucagauugucugaauugagcuaucgca

SEQ ID NO: 422880 - RNA, 32 nt, Human
gagacucagcaacgacccauaccucagacccg

SEQ ID NO: 422881 - RNA, 32 nt, Human
gagacucagccucugcuggagaaagccacgcc

SEQ ID NO: 422882 - RNA, 32 nt, Human
gagacucagugcagugggcagggaagacauaa

SEQ ID NO: 422883 - RNA, 32 nt, Human
gagacucauagaggagaagaagaggcaaaagg

SEQ ID NO: 422884 - RNA, 32 nt, Human
gagacucauggacuuggggcucugccuguagg

SEQ ID NO: 422885 - RNA, 32 nt, Human
gagacuccaagaagaagcugcgggaaggacag

SEQ ID NO: 422886 - RNA, 32 nt, Human
gagacuccaagaagcugcgggaaggacagcag

SEQ ID NO: 422887 - RNA, 32 nt, Human
gagacuccaagcugggcugagccagagcagaa

SEQ ID NO: 422888 - RNA, 32 nt, Human
gagacuccagcagagcccugaaguguggacaa

SEQ ID NO: 422889 - RNA, 32 nt, Human
gagacuccaucccaaaaacaaaacaaaacaaa

SEQ ID NO: 422890 - RNA, 32 nt, Human
gagacuccaucucaaaaacaaaacaaauaaac

SEQ ID NO: 422891 - RNA, 32 nt, Human
gagacucccacuguuguuccaguuccaagcau

SEQ ID NO: 422892 - RNA, 32 nt, Human
gagacucccauccucucuucccccucaccaag

SEQ ID NO: 422893 - RNA, 32 nt, Human
gagacuccccaaggaccccauucugccuccuu

SEQ ID NO: 422894 - RNA, 32 nt, Human
gagacuccgucucaaaaacaaacaaacaaaaa

SEQ ID NO: 422895 - RNA, 32 nt, Human
gagacuccuacaggagccaaauuuguaauuua

SEQ ID NO: 422896 - RNA, 17 nt, Human
gagacuccuccugcagu

SEQ ID NO: 422897 - RNA, 32 nt, Human
gagacuccucucccggggaaggcuuucaucag

SEQ ID NO: 422898 - RNA, 32 nt, Human
gagacuccuguugccagaaucagacugcccua

SEQ ID NO: 422899 - RNA, 32 nt, Human
gagacuccuuucucucccgauucuacagucug

SEQ ID NO: 422900 - RNA, 32 nt, Human
gagacucgccuccagccucccaccuccgcccg

SEQ ID NO: 422901 - RNA, 32 nt, Human
gagacucggacaucuuuccaggaacagcguga

SEQ ID NO: 422902 - RNA, 32 nt, Human
gagacucggauggggacauggagaacaaccca

SEQ ID NO: 422903 - RNA, 32 nt, Human
gagacucggucucaaaaacaaaacaaaacaaa

SEQ ID NO: 422904 - RNA, 22 nt, Human
gagacucgguuucaccauguug

SEQ ID NO: 422905 - RNA, 23 nt, Human
gagacucgguuucaccauguugg

SEQ ID NO: 422906 - RNA, 32 nt, Human
gagacucuagggagcuauguaccuucuugcag

SEQ ID NO: 422907 - RNA, 32 nt, Human
gagacucucaugucacaggcgugccuugcugc

SEQ ID NO: 422908 - RNA, 32 nt, Human
gagacucucuaaaaauaaaaauguuagaguga

SEQ ID NO: 422909 - RNA, 32 nt, Human
gagacucucuugaacccaggaggcagagguug

SEQ ID NO: 422910 - RNA, 32 nt, Human
gagacucugaguuuaugaucugugccauaaaa

SEQ ID NO: 422911 - RNA, 32 nt, Human
gagacucugccuggccacugagaacagccaaa

SEQ ID NO: 422912 - RNA, 32 nt, Human
gagacucugggaacuuuuaggggucacucaau

SEQ ID NO: 422913 - RNA, 32 nt, Human
gagacucugggacccaggcagcugccaccuug

SEQ ID NO: 422914 - RNA, 32 nt, Human
gagacucugucucaaaaacaaaacaaaacaga

SEQ ID NO: 422915 - RNA, 32 nt, Human
gagacucugugagggggcuggagcagccuggu

SEQ ID NO: 422916 - RNA, 32 nt, Human
gagacucuugcucugcugaguccccauucccc

SEQ ID NO: 422917 - RNA, 32 nt, Human
gagacugaaaccagaaguuguuauguuuaaaa

SEQ ID NO: 422918 - RNA, 32 nt, Human
gagacugaagauuguuagggcaccuuagaaug

SEQ ID NO: 422919 - RNA, 16 nt, Human
gagacugaagcagaac

SEQ ID NO: 422920 - RNA, 32 nt, Human
gagacugaagucuuuguggaaaccacuguuac

SEQ ID NO: 422921 - RNA, 24 nt, Human
gagacugacucucagagccagaga

SEQ ID NO: 422922 - RNA, 32 nt, Human
gagacugagauacccgugcuccgcucgccucc

SEQ ID NO: 422923 - RNA, 32 nt, Human
gagacugagaugggagaggccugagacggaga

SEQ ID NO: 422924 - RNA, 32 nt, Human
gagacugagaugggaggaucgcuugagaccag

SEQ ID NO: 422925 - RNA, 32 nt, Human
gagacugagcaucuguuccuagcucccuccgg

SEQ ID NO: 422926 - RNA, 32 nt, Human
gagacugagccacugcacuccagccugggcaa

SEQ ID NO: 422927 - RNA, 32 nt, Human
gagacugaggagaaacuguagagaauaauacu

SEQ ID NO: 422928 - RNA, 32 nt, Human
gagacugaggcgaguggaucaccugaggucag

SEQ ID NO: 422929 - RNA, 32 nt, Human
gagacugaggcggaucaccugaggucaggagu

SEQ ID NO: 422930 - RNA, 32 nt, Human
gagacugaggcggguggaucaccugaggucag

SEQ ID NO: 422931 - RNA, 32 nt, Human
gagacugaggcugaggcuggggaacaucgggc

SEQ ID NO: 422932 - RNA, 32 nt, Human
gagacugagguggguggaucaccugaggucag

SEQ ID NO: 422933 - RNA, 32 nt, Human
gagacugagucccuuuuuauacuucaacagac

SEQ ID NO: 422934 - RNA, 32 nt, Human
gagacugcaacaaucugugucccuggaaugcu

SEQ ID NO: 422935 - RNA, 32 nt, Human
gagacugcaccacugcacuucagccuggguga

SEQ ID NO: 422936 - RNA, 32 nt, Human
gagacugcaccauugcauuccagccugggcaa

SEQ ID NO: 422937 - RNA, 32 nt, Human
gagacugcagagugccuucccugaugcugcag

SEQ ID NO: 422938 - RNA, 32 nt, Human
gagacugcagcucagagauuacuccagcaaag

SEQ ID NO: 422939 - RNA, 32 nt, Human
gagacugcaguaagccaagaucaugccacugc

SEQ ID NO: 422940 - RNA, 32 nt, Human
gagacugcagugagccaagauugugccacuac

SEQ ID NO: 422941 - RNA, 32 nt, Human
gagacugcagugagccaugauauugccagccu

SEQ ID NO: 422942 - RNA, 32 nt, Human
gagacugcagugagccgagaucacaccacugc

SEQ ID NO: 422943 - RNA, 32 nt, Human
gagacugcagugagccgagaucgcaccacugc

SEQ ID NO: 422944 - RNA, 32 nt, Human
gagacugcagugagccgagauugugccacugc

SEQ ID NO: 422945 - RNA, 32 nt, Human
gagacugcagugagcuaugaucaugccauugu

SEQ ID NO: 422946 - RNA, 32 nt, Human
gagacugcagugagcugagaucacacuacugc

SEQ ID NO: 422947 - RNA, 32 nt, Human
gagacugcagugagcugagaucgcaccauugc

SEQ ID NO: 422948 - RNA, 32 nt, Human
gagacugcaugcuggagagaaacuugaagaac

SEQ ID NO: 422949 - RNA, 32 nt, Human
gagacugccaugaaguugaucugccucccaga

SEQ ID NO: 422950 - RNA, 32 nt, Human
gagacugcccugcuugguguuuugcaggauga

SEQ ID NO: 422951 - RNA, 32 nt, Human
gagacugccguguccuccgagcacuuuguuuu

SEQ ID NO: 422952 - RNA, 32 nt, Human
gagacugccuuccucuggcacuggcagugacc

SEQ ID NO: 422953 - RNA, 32 nt, Human
gagacugccuugagacagugcuugccuugaga

SEQ ID NO: 422954 - RNA, 32 nt, Human
gagacugcgccaccgcgcuccagccuggguga

SEQ ID NO: 422955 - RNA, 32 nt, Human
gagacugcgccacggcacuccagccugggcga

SEQ ID NO: 422956 - RNA, 32 nt, Human
gagacugcgggaggcaggggaugcaugggugu

SEQ ID NO: 422957 - RNA, 32 nt, Human
gagacugcuauacauuucugugggugggggua

SEQ ID NO: 422958 - RNA, 25 nt, Human
gagacugcucuaccaauagaucuuu

SEQ ID NO: 422959 - RNA, 32 nt, Human
gagacugcuucauggugucuucagaggcagac

SEQ ID NO: 422960 - RNA, 32 nt, Human
gagacuggaacaguuuccauggugcuggagga

SEQ ID NO: 422961 - RNA, 32 nt, Human
gagacuggaagagacagagaucagagggagac

SEQ ID NO: 422962 - RNA, 32 nt, Human
gagacuggaaguuuaaaaauguacaaguccuu

SEQ ID NO: 422963 - RNA, 32 nt, Human
gagacuggacagcucuggaggaacaggccugc

SEQ ID NO: 422964 - RNA, 32 nt, Human
gagacuggagucaggagagagcaggaggcccu

SEQ ID NO: 422965 - RNA, 32 nt, Human
gagacuggagugggacacagugggugaaacug

SEQ ID NO: 422966 - RNA, 32 nt, Human
gagacuggcagcauuuugcuccugccuuagag

SEQ ID NO: 422967 - RNA, 32 nt, Human
gagacuggcgugaacccaggaggcggaccuug

SEQ ID NO: 422968 - RNA, 32 nt, Human
gagacuggcucaauaucgacuucugagaaaug

SEQ ID NO: 422969 - RNA, 32 nt, Human
gagacugggagcagucucuuaaacaaaagcaa

SEQ ID NO: 422970 - RNA, 32 nt, Human
gagacugggaggcagagguugcagugaaccga

SEQ ID NO: 422971 - RNA, 32 nt, Human
gagacugggcaccccugccuccugccucccgc

SEQ ID NO: 422972 - RNA, 32 nt, Human
gagacugggccacugcacuccagccuggauga

SEQ ID NO: 422973 - RNA, 32 nt, Human
gagacugggcuggggcugguaucacacccuca

SEQ ID NO: 422974 - RNA, 24 nt, Human
gagacuggggcugcaaugagcuau

SEQ ID NO: 422975 - RNA, 32 nt, Human
gagacuggggucugggcuguuccagacuucaa

SEQ ID NO: 422976 - RNA, 32 nt, Human
gagacuggggucugggcuguuccggacuucaa

SEQ ID NO: 422977 - RNA, 22 nt, Human
gagacuggguuucaccacguug

SEQ ID NO: 422978 - RNA, 23 nt, Human
gagacuggguuucaccacguugg

SEQ ID NO: 422979 - RNA, 20 nt, Human
gagacuggguuucaccaugu

SEQ ID NO: 422980 - RNA, 22 nt, Human
gagacuggguuucaccauguug

SEQ ID NO: 422981 - RNA, 23 nt, Human
gagacuggguuucaccauguugg

SEQ ID NO: 422982 - RNA, 22 nt, Human
gagacuggguuucaccguguua

SEQ ID NO: 422983 - RNA, 32 nt, Human
gagacuggugcccugcgagcuccaccccaccc

SEQ ID NO: 422984 - RNA, 32 nt, Human
gagacugguggagggugggcugggcaugggau

SEQ ID NO: 422985 - RNA, 32 nt, Human
gagacugguguuugauggauguuuuauacuaa

SEQ ID NO: 422986 - RNA, 32 nt, Human
gagacugguuuugccaagucgcccaggcuggu

SEQ ID NO: 422987 - RNA, 32 nt, Human
gagacuguagugcacuaugaucacgccuguga

SEQ ID NO: 422988 - RNA, 32 nt, Human
gagacugucuauacugagaaccacuguugcua

SEQ ID NO: 422989 - RNA, 32 nt, Human
gagacugucucucggcugcagcccuggugcga

SEQ ID NO: 422990 - RNA, 32 nt, Human
gagacugugcagggaccagugacaacuagggg

SEQ ID NO: 422991 - RNA, 32 nt, Human
gagacugugccacugcacuccagccuggguga

SEQ ID NO: 422992 - RNA, 32 nt, Human
gagacugugccacugcaguccagccuggguga

SEQ ID NO: 422993 - RNA, 32 nt, Human
gagacugugcuacugcacuccagccugggcaa

SEQ ID NO: 422994 - RNA, 32 nt, Human
gagacugugcuucugaacugggauugucuuac

SEQ ID NO: 422995 - RNA, 32 nt, Human
gagacuguggguggagcugccugcugcacuca

SEQ ID NO: 422996 - RNA, 32 nt, Human
gagacugugucauugcacuccagccugggcga

SEQ ID NO: 422997 - RNA, 32 nt, Human
gagacugugucugcuuucugccuccucuucca

SEQ ID NO: 422998 - RNA, 21 nt, Human
gagacuguuggaaccaugaga

SEQ ID NO: 422999 - RNA, 32 nt, Human
gagacuguuuggaaucccgccccacauucucc

SEQ ID NO: 423000 - RNA, 32 nt, Human
gagacuuaaaggacaggaggaggagauggcca

SEQ ID NO: 423001 - RNA, 32 nt, Human
gagacuuaauacugagcaauguuuugaaacaa

SEQ ID NO: 423002 - RNA, 32 nt, Human
gagacuuagcuccauggccaaagacgauggua

SEQ ID NO: 423003 - RNA, 32 nt, Human
gagacuuagggaggguagggggagagugugga

SEQ ID NO: 423004 - RNA, 19 nt, Human
gagacuuaucagaugggac

SEQ ID NO: 423005 - RNA, 32 nt, Human
gagacuuauucacuaucaggaguacagcgugg

SEQ ID NO: 423006 - RNA, 32 nt, Human
gagacuucacugcaccuugacuuguagauuug

SEQ ID NO: 423007 - RNA, 32 nt, Human
gagacuuccuugggguugcaaccuggggaagc

SEQ ID NO: 423008 - RNA, 32 nt, Human
gagacuuccuuuccuugcacuucucuccuauu

SEQ ID NO: 423009 - RNA, 32 nt, Human
gagacuucuacauccaaagcaccaagaggcgu

SEQ ID NO: 423010 - RNA, 32 nt, Human
gagacuucuccaagcugcuucacaagcaaacu

SEQ ID NO: 423011 - RNA, 32 nt, Human
gagacuucugccuccccuccuacccucuggcc

SEQ ID NO: 423012 - RNA, 32 nt, Human
gagacuucuucccauucccaccauuguuccuc

SEQ ID NO: 423013 - RNA, 32 nt, Human
gagacuucuugggccuuccugccugccacccc

SEQ ID NO: 423014 - RNA, 32 nt, Human
gagacuugagccaccaccagucagaggugcaa

SEQ ID NO: 423015 - RNA, 32 nt, Human
gagacuugccugaacccaggaggcagagguug

SEQ ID NO: 423016 - RNA, 32 nt, Human
gagacuuggagcagugggagaccccucucccg

SEQ ID NO: 423017 - RNA, 32 nt, Human
gagacuuggugcucgguauuuuuaauuaugga

SEQ ID NO: 423018 - RNA, 32 nt, Human
gagacuugugccuggaaggaaaaagagguagc

SEQ ID NO: 423019 - RNA, 32 nt, Human
gagacuuuagaggaagaacggaagagaaugca

SEQ ID NO: 423020 - RNA, 32 nt, Human
gagacuuuaggcaagcagcccaaagggguaaa

SEQ ID NO: 423021 - RNA, 32 nt, Human
gagacuuugaguccuugggaggagaaggcccu

SEQ ID NO: 423022 - RNA, 32 nt, Human
gagacuuugagugaaguagccuagaggauucu

SEQ ID NO: 423023 - RNA, 32 nt, Human
gagacuuuggagaccuggaggagcaggagaca

SEQ ID NO: 423024 - RNA, 32 nt, Human
gagacuuuguacaguggccucucuaaaaguac

SEQ ID NO: 423025 - RNA, 32 nt, Human
gagacuuuucgggagaugcagcagcagaugau

SEQ ID NO: 423026 - RNA, 19 nt, Human
gagacuuuuggaagaggau

SEQ ID NO: 423027 - RNA, 32 nt, Human
gagacuuuuggcaaccuguugcugcucuacug

SEQ ID NO: 423028 - RNA, 32 nt, Human
gagagaaaacucagacagggagggcgcagggc

SEQ ID NO: 423029 - RNA, 32 nt, Human
gagagaaaaggggcagcuggaggcagaugagc

SEQ ID NO: 423030 - RNA, 32 nt, Human
gagagaaaauuccuguuccaagagaaaauaag

SEQ ID NO: 423031 - RNA, 32 nt, Human
gagagaaacacacaccuucccuaggacccagc

SEQ ID NO: 423032 - RNA, 32 nt, Human
gagagaaacaccgaaauucagauagcucaggg

SEQ ID NO: 423033 - RNA, 32 nt, Human
gagagaaacagaggagacagagagggagagag

SEQ ID NO: 423034 - RNA, 32 nt, Human
gagagaaaccaugcucucuagcaacauugagc

SEQ ID NO: 423035 - RNA, 21 nt, Human
gagagaaacccaacacaugua

SEQ ID NO: 423036 - RNA, 21 nt, Human
gagagaaacccuacacaugua

SEQ ID NO: 423037 - RNA, 23 nt, Human
gagagaaacuaaacacauacgua

SEQ ID NO: 423038 - RNA, 32 nt, Human
gagagaaacugaggcccagcagagggaggcag

SEQ ID NO: 423039 - RNA, 20 nt, Human
gagagaaacuggacuggaac

SEQ ID NO: 423040 - RNA, 32 nt, Human
gagagaaagagaaagagaaggaaggaaggaga

SEQ ID NO: 423041 - RNA, 32 nt, Human
gagagaaagaggaaaagggaagggggaaaccc

SEQ ID NO: 423042 - RNA, 32 nt, Human
gagagaaagaguuggaccuccuccaguucucu

SEQ ID NO: 423043 - RNA, 32 nt, Human
gagagaaagcaguggcuuucagacacaccaaa

SEQ ID NO: 423044 - RNA, 19 nt, Human
gagagaaagccaggcaggu

SEQ ID NO: 423045 - RNA, 32 nt, Human
gagagaaaguagcacauggaguagcugagguu

SEQ ID NO: 423046 - RNA, 32 nt, Human
gagagaaauaaacauuuagaggauuuaauuag

SEQ ID NO: 423047 - RNA, 18 nt, Human
gagagaaaucuuaguaaa

SEQ ID NO: 423048 - RNA, 18 nt, Human
gagagaaaugacaggagc

SEQ ID NO: 423049 - RNA, 32 nt, Human
gagagaacaaauuuggggcaguaguugaaaac

SEQ ID NO: 423050 - RNA, 32 nt, Human
gagagaacaggaggugaaagaaaagggugagu

SEQ ID NO: 423051 - RNA, 32 nt, Human
gagagaacaguuaucuuaguaccuauggauuu

SEQ ID NO: 423052 - RNA, 32 nt, Human
gagagaacauggcccaggcccuuuccuucccc

SEQ ID NO: 423053 - RNA, 32 nt, Human
gagagaacccuccaggggacaagaugaagggg

SEQ ID NO: 423054 - RNA, 32 nt, Human
gagagaaccugcuuccuuccaucagccauacc

SEQ ID NO: 423055 - RNA, 22 nt, Human
gagagaacgaggaggaaggaga

SEQ ID NO: 423056 - RNA, 32 nt, Human
gagagaacuaugaccugcagcaacucuggaaa

SEQ ID NO: 423057 - RNA, 32 nt, Human
gagagaacugggugaugacaggggaaucugaa

SEQ ID NO: 423058 - RNA, 32 nt, Human
gagagaagaaaagggaaagaagcugaaaaugu

SEQ ID NO: 423059 - RNA, 32 nt, Human
gagagaagaagaggaagaagaggaggcggcgg

SEQ ID NO: 423060 - RNA, 32 nt, Human
gagagaagaccucuuccugaaucacuggacuc

SEQ ID NO: 423061 - RNA, 32 nt, Human
gagagaagacucagcauuugcuuuggaguaag

SEQ ID NO: 423062 - RNA, 19 nt, Human
gagagaagagaagagggag

SEQ ID NO: 423063 - RNA, 32 nt, Human
gagagaagaggaaaagaggaguggccagacuc

SEQ ID NO: 423064 - RNA, 32 nt, Human
gagagaagaggaagucuggguugggaggggcc

SEQ ID NO: 423065 - RNA, 32 nt, Human
gagagaagaggaggagaagggaggggguggcc

SEQ ID NO: 423066 - RNA, 32 nt, Human
gagagaagagggagaggcaggagccggcccaa

SEQ ID NO: 423067 - RNA, 32 nt, Human
gagagaagagggcagagccgugcauggggcug

SEQ ID NO: 423068 - RNA, 32 nt, Human
gagagaagaggggcuggagugcggcuggucug

SEQ ID NO: 423069 - RNA, 32 nt, Human
gagagaagauaacauuuacaaguaaacaguaa

SEQ ID NO: 423070 - RNA, 32 nt, Human
gagagaagauggaagggaagggccagugcaac

SEQ ID NO: 423071 - RNA, 31 nt, Human
gagagaagcacagaaccuggcauucacugga

SEQ ID NO: 423072 - RNA, 32 nt, Human
gagagaagcauggcgcccugcccacccacugc

SEQ ID NO: 423073 - RNA, 32 nt, Human
gagagaagcugcucuccccuccuugaagaagc

SEQ ID NO: 423074 - RNA, 32 nt, Human
gagagaaggaaagaaagccgggagguggaaga

SEQ ID NO: 423075 - RNA, 32 nt, Human
gagagaaggaaaggagagaaggcaggaagaag

SEQ ID NO: 423076 - RNA, 32 nt, Human
gagagaaggaagagucuaggcugagcaacaug

SEQ ID NO: 423077 - RNA, 32 nt, Human
gagagaaggaaggggauaggcagcuuugacag

SEQ ID NO: 423078 - RNA, 32 nt, Human
gagagaaggagaaggaagaaggagaggagaag

SEQ ID NO: 423079 - RNA, 32 nt, Human
gagagaaggagguggggauccgagugcaguga

SEQ ID NO: 423080 - RNA, 32 nt, Human
gagagaaggcgaggacgcugaagaaccagaca

SEQ ID NO: 423081 - RNA, 32 nt, Human
gagagaagggagagaauaaaaugcaauaacga

SEQ ID NO: 423082 - RNA, 20 nt, Human
gagagaagguaaagcuaccu

SEQ ID NO: 423083 - RNA, 32 nt, Human
gagagaaguaugugcagcccccaaugaucagc

SEQ ID NO: 423084 - RNA, 32 nt, Human
gagagaagucgaggaagagagagacgggguca

SEQ ID NO: 423085 - RNA, 32 nt, Human
gagagaaucaccaggauggaacacaggucuug

SEQ ID NO: 423086 - RNA, 32 nt, Human
gagagaauccuacaaaugugaaaaauguggca

SEQ ID NO: 423087 - RNA, 32 nt, Human
gagagaaugaacaccagaauuaggguaaugga

SEQ ID NO: 423088 - RNA, 31 nt, Human
gagagaauggaagagacaaaagaggcuaugu

SEQ ID NO: 423089 - RNA, 32 nt, Human
gagagaauucccauguacacuucaccaaacuu

SEQ ID NO: 423090 - RNA, 32 nt, Human
gagagacacaauauccgcagccuuacaccuua

SEQ ID NO: 423091 - RNA, 32 nt, Human
gagagacacagagagaaggagaaagagggagg

SEQ ID NO: 423092 - RNA, 19 nt, Human
gagagacagaggaggcaga

SEQ ID NO: 423093 - RNA, 32 nt, Human
gagagacagagggagagugugcauacagcagc

SEQ ID NO: 423094 - RNA, 32 nt, Human
gagagacagaggggaagagaggcagagaggga

SEQ ID NO: 423095 - RNA, 32 nt, Human
gagagacagcacaggcagccccacggacgacg

SEQ ID NO: 423096 - RNA, 32 nt, Human
gagagacagcgagaagaagccgcggcuggcua

SEQ ID NO: 423097 - RNA, 32 nt, Human
gagagacaggagagagagggagggagcgagag

SEQ ID NO: 423098 - RNA, 32 nt, Human
gagagacaggagaggaaggagggcaggggcgg

SEQ ID NO: 423099 - RNA, 32 nt, Human
gagagacagggagagucagccuccacauucag

SEQ ID NO: 423100 - RNA, 32 nt, Human
gagagacagggguacgccagaggaagcugggc

SEQ ID NO: 423101 - RNA, 32 nt, Human
gagagacagugagcugcaagacugccucccca

SEQ ID NO: 423102 - RNA, 32 nt, Human
gagagacagugggcugcacccacccaggagug

SEQ ID NO: 423103 - RNA, 32 nt, Human
gagagacauacucugcuacuauguccucaggu

SEQ ID NO: 423104 - RNA, 32 nt, Human
gagagacauugccuccaccucuccuuggaaau

SEQ ID NO: 423105 - RNA, 32 nt, Human
gagagacauuggagagaaaaugacugucuccu

SEQ ID NO: 423106 - RNA, 32 nt, Human
gagagaccagaccauuuuagaaaaagauaaaa

SEQ ID NO: 423107 - RNA, 32 nt, Human
gagagaccagccuggccagcauagugaaaccc

SEQ ID NO: 423108 - RNA, 32 nt, Human
gagagaccagccuucuggugcugcagucagga

SEQ ID NO: 423109 - RNA, 22 nt, Human
gagagaccagcuggcaucugca

SEQ ID NO: 423110 - RNA, 32 nt, Human
gagagacccaggaugaagggaugcagugaggu

SEQ ID NO: 423111 - RNA, 20 nt, Human
gagagaccccagcccuggag

SEQ ID NO: 423112 - RNA, 32 nt, Human
gagagacccuuguggguccaugcuaacaaaga

SEQ ID NO: 423113 - RNA, 32 nt, Human
gagagaccuagagggcccagcauguggcuggg

SEQ ID NO: 423114 - RNA, 32 nt, Human
gagagaccugacccuucucucacuucuaaauu

SEQ ID NO: 423115 - RNA, 32 nt, Human
gagagacgcaaucuccccucccucccaucccc

SEQ ID NO: 423116 - RNA, 32 nt, Human
gagagacgcagcccugggggccagcuggugcu

SEQ ID NO: 423117 - RNA, 32 nt, Human
gagagacgcauggcccgaagucaaagugcugg

SEQ ID NO: 423118 - RNA, 25 nt, Human
gagagacgcggaggaggagacauga

SEQ ID NO: 423119 - RNA, 32 nt, Human
gagagacgcugugauuggcaggaggcaggaua

SEQ ID NO: 423120 - RNA, 32 nt, Human
gagagacggcuccucagaugcucagcuaagcc

SEQ ID NO: 423121 - RNA, 31 nt, Human
gagagacgggagagagaagaagaguggguuu

SEQ ID NO: 423122 - RNA, 32 nt, Human
gagagacuaagcugaaacugcugcucagcucc

SEQ ID NO: 423123 - RNA, 32 nt, Human
gagagacuaguuuccacauccuucccuccuuu

SEQ ID NO: 423124 - RNA, 32 nt, Human
gagagacuaucuuguguugugccuguaugaau

SEQ ID NO: 423125 - RNA, 32 nt, Human
gagagacuccuugggggucgagcacuguggcu

SEQ ID NO: 423126 - RNA, 32 nt, Human
gagagacucggccccugcucuccucacugucc

SEQ ID NO: 423127 - RNA, 32 nt, Human
gagagacucuaaacagaugagcacagagccag

SEQ ID NO: 423128 - RNA, 32 nt, Human
gagagacugaagaagcagagccuguaucaugg

SEQ ID NO: 423129 - RNA, 32 nt, Human
gagagacugagacaggagucuuccggagucag

SEQ ID NO: 423130 - RNA, 32 nt, Human
gagagacuuaggaaagaaaaagacacagagac

SEQ ID NO: 423131 - RNA, 32 nt, Human
gagagacuucaaggaucaacucuaaagugcua

SEQ ID NO: 423132 - RNA, 32 nt, Human
gagagacuuccucuuggcucccaggaggaggg

SEQ ID NO: 423133 - RNA, 32 nt, Human
gagagacuuccucuugggucccaggaagaggg

SEQ ID NO: 423134 - RNA, 32 nt, Human
gagagacuugcaccuuggacaagccacacaau

SEQ ID NO: 423135 - RNA, 32 nt, Human
gagagacuugcagcuuggauacacagcagugu

SEQ ID NO: 423136 - RNA, 32 nt, Human
gagagacuuguagguacaaucuaggccuugaa

SEQ ID NO: 423137 - RNA, 22 nt, Human
gagagacuuguggccugggaga

SEQ ID NO: 423138 - RNA, 32 nt, Human
gagagagaaacaaauaugcagcuuucgaaacc

SEQ ID NO: 423139 - RNA, 32 nt, Human
gagagagaaagaaagaaagaaagaaagggaaa

SEQ ID NO: 423140 - RNA, 32 nt, Human
gagagagaacacagccuugccaagcagcaaug

SEQ ID NO: 423141 - RNA, 32 nt, Human
gagagagaagaaaagaaaaaugaagaaaagua

SEQ ID NO: 423142 - RNA, 32 nt, Human
gagagagaagaaaaugguggccggagauggga

SEQ ID NO: 423143 - RNA, 32 nt, Human
gagagagaaugagacagagacuuaaggaagag

SEQ ID NO: 423144 - RNA, 32 nt, Human
gagagagaaugucuuuucgaggcggaggucgu

SEQ ID NO: 423145 - RNA, 32 nt, Human
gagagagacagaagccccagccccagaaccug

SEQ ID NO: 423146 - RNA, 32 nt, Human
gagagagacagagagagaaaauaaacuacccc

SEQ ID NO: 423147 - RNA, 32 nt, Human
gagagagacauagagauagagacagagaggca

SEQ ID NO: 423148 - RNA, 32 nt, Human
gagagagacucaaagcccuggggcccggcccu

SEQ ID NO: 423149 - RNA, 32 nt, Human
gagagagagcacgcuagcucucaggaugggga

SEQ ID NO: 423150 - RNA, 32 nt, Human
gagagagagcugggccagggagcugcugcagg

SEQ ID NO: 423151 - RNA, 18 nt, Human
gagagagaggacgagaga

SEQ ID NO: 423152 - RNA, 32 nt, Human
gagagagaggacgagagagggggucagagaag

SEQ ID NO: 423153 - RNA, 32 nt, Human
gagagagaggagaagggagugaggggccgcug

SEQ ID NO: 423154 - RNA, 21 nt, Human
gagagagaggagagagagugu

SEQ ID NO: 423155 - RNA, 32 nt, Human
gagagagaggcaacccugggggccaguucagg

SEQ ID NO: 423156 - RNA, 32 nt, Human
gagagagaggcagagagcagggcagcggcuuc

SEQ ID NO: 423157 - RNA, 32 nt, Human
gagagagagggagagacaaaauaccuaccagg

SEQ ID NO: 423158 - RNA, 32 nt, Human
gagagagagggagagagagggagagaaaggga

SEQ ID NO: 423159 - RNA, 32 nt, Human
gagagagagggagaggaagaaaagagagagag

SEQ ID NO: 423160 - RNA, 32 nt, Human
gagagagagggagggagagggagugaagagcc

SEQ ID NO: 423161 - RNA, 32 nt, Human
gagagagagggcugggaggaaaaguaguucau

SEQ ID NO: 423162 - RNA, 32 nt, Human
gagagagaucaaaggcugggagauucuaagag

SEQ ID NO: 423163 - RNA, 32 nt, Human
gagagagauccucagaguggaaggagggggaa

SEQ ID NO: 423164 - RNA, 32 nt, Human
gagagagauuccacugaagccaagagagagcc

SEQ ID NO: 423165 - RNA, 32 nt, Human
gagagagcagaggggucaguucacaaccaucu

SEQ ID NO: 423166 - RNA, 32 nt, Human
gagagagcaggaacagggagagaguagggaca

SEQ ID NO: 423167 - RNA, 32 nt, Human
gagagagcaguuuuccaacuaugucaacaaag

SEQ ID NO: 423168 - RNA, 32 nt, Human
gagagagcauauccaucuccuccucacugccu

SEQ ID NO: 423169 - RNA, 32 nt, Human
gagagagcauggagcuggagaggaucgucagu

SEQ ID NO: 423170 - RNA, 32 nt, Human
gagagagccaccaaggaggagcaggggagcga

SEQ ID NO: 423171 - RNA, 32 nt, Human
gagagagccacuuaaccucucuggaccuuguu

SEQ ID NO: 423172 - RNA, 32 nt, Human
gagagagccagacagccccaagcuucugaguc

SEQ ID NO: 423173 - RNA, 32 nt, Human
gagagagcccguccaaguugggcuccaucgcu

SEQ ID NO: 423174 - RNA, 32 nt, Human
gagagagcccucuccaugcagggcagauggag

SEQ ID NO: 423175 - RNA, 32 nt, Human
gagagagccgggaggcagagggaguagugacc

SEQ ID NO: 423176 - RNA, 32 nt, Human
gagagagcuacaccuccccaggcccaggucuc

SEQ ID NO: 423177 - RNA, 32 nt, Human
gagagagcuagggcagacaugcagugaaaugg

SEQ ID NO: 423178 - RNA, 32 nt, Human
gagagagcucugggccuucuuccugccagucu

SEQ ID NO: 423179 - RNA, 32 nt, Human
gagagagcugcgauccauccaggccaagacca

SEQ ID NO: 423180 - RNA, 32 nt, Human
gagagagcugggaggggcacaggcagcaaggu

SEQ ID NO: 423181 - RNA, 32 nt, Human
gagagagcuuccuguuucuaaguggccugcag

SEQ ID NO: 423182 - RNA, 32 nt, Human
gagagaggaagagacccaagaggcccagggaa

SEQ ID NO: 423183 - RNA, 32 nt, Human
gagagaggaagaggagcagaagggggcagcag

SEQ ID NO: 423184 - RNA, 32 nt, Human
gagagaggaaggaggugacguucaggugcugu

SEQ ID NO: 423185 - RNA, 32 nt, Human
gagagaggaagggacagcaggagugaggugaa

SEQ ID NO: 423186 - RNA, 21 nt, Human
gagagaggacagcacaggcuc

SEQ ID NO: 423187 - RNA, 32 nt, Human
gagagaggaccagcggccagagccucagugac

SEQ ID NO: 423188 - RNA, 32 nt, Human
gagagaggagaagaggaggaggcagaggaaga

SEQ ID NO: 423189 - RNA, 32 nt, Human
gagagaggagccagccagggaggggcagcugc

SEQ ID NO: 423190 - RNA, 32 nt, Human
gagagaggaggaagagggagucuggcaugagu

SEQ ID NO: 423191 - RNA, 32 nt, Human
gagagaggaggcagaggcugggaaugggagca

SEQ ID NO: 423192 - RNA, 32 nt, Human
gagagaggaguccucacuugucuuccuuaauu

SEQ ID NO: 423193 - RNA, 32 nt, Human
gagagaggcacagaccugucuccugggugcau

SEQ ID NO: 423194 - RNA, 32 nt, Human
gagagaggcagagagacagagagggagagagg

SEQ ID NO: 423195 - RNA, 18 nt, Human
gagagaggcagcagcgug

SEQ ID NO: 423196 - RNA, 19 nt, Human
gagagaggcagcugggaga

SEQ ID NO: 423197 - RNA, 31 nt, Human
gagagaggcaggucucccagcucagaccccg

SEQ ID NO: 423198 - RNA, 32 nt, Human
gagagaggcgcgucugccccacccucaaaccc

SEQ ID NO: 423199 - RNA, 32 nt, Human
gagagaggcgggaggaagaaguaacaagagga

SEQ ID NO: 423200 - RNA, 32 nt, Human
gagagaggcugagucugauuguuuacacaaga

SEQ ID NO: 423201 - RNA, 32 nt, Human
gagagaggcugugaagccagaggggucgagga

SEQ ID NO: 423202 - RNA, 32 nt, Human
gagagaggcuuggaggcugggggugagucuca

SEQ ID NO: 423203 - RNA, 32 nt, Human
gagagagggaagaaaagaucuuuugcccugga

SEQ ID NO: 423204 - RNA, 20 nt, Human
gagagagggaaggagggaga

SEQ ID NO: 423205 - RNA, 32 nt, Human
gagagagggagaaagaaagaaaggagaaagag

SEQ ID NO: 423206 - RNA, 32 nt, Human
gagagagggagagagagugagagagacugacu

SEQ ID NO: 423207 - RNA, 23 nt, Human
gagagagggagaggaagaaaaga

SEQ ID NO: 423208 - RNA, 32 nt, Human
gagagagggagcgagagccaggcaggaccgca

SEQ ID NO: 423209 - RNA, 32 nt, Human
gagagagggaggcagaagaggaagucagagcg

SEQ ID NO: 423210 - RNA, 32 nt, Human
gagagagggagggagaagagagauagugggua

SEQ ID NO: 423211 - RNA, 32 nt, Human
gagagagggagggagagagagugaaagaagaa

SEQ ID NO: 423212 - RNA, 32 nt, Human
gagagagggagggagagggagugaagagccug

SEQ ID NO: 423213 - RNA, 32 nt, Human
gagagagggaggugaaagcuggugugagccca

SEQ ID NO: 423214 - RNA, 32 nt, Human
gagagagggcaggcccaggucaggaggaggua

SEQ ID NO: 423215 - RNA, 32 nt, Human
gagagaggggcagagcucaagaugggauuaug

SEQ ID NO: 423216 - RNA, 32 nt, Human
gagagaggggcucaggaacugggagccucgug

SEQ ID NO: 423217 - RNA, 32 nt, Human
gagagagggggugagagagggcaggcggggac

SEQ ID NO: 423218 - RNA, 32 nt, Human
gagagagggucucauucugucacccaggcuag

SEQ ID NO: 423219 - RNA, 32 nt, Human
gagagagguacccaaggucacauagcuaguua

SEQ ID NO: 423220 - RNA, 32 nt, Human
gagagaggugcagaauuccugguucugagcag

SEQ ID NO: 423221 - RNA, 32 nt, Human
gagagaggugugagccccuugucucacaccgg

SEQ ID NO: 423222 - RNA, 21 nt, Human
gagagagguuucaccauguua

SEQ ID NO: 423223 - RNA, 32 nt, Human
gagagaguagggagagagucucucucuaccac

SEQ ID NO: 423224 - RNA, 32 nt, Human
gagagagugaggacaggcugcgggaggagcug

SEQ ID NO: 423225 - RNA, 32 nt, Human
gagagagugcaggagaguagaaacaaaaggaa

SEQ ID NO: 423226 - RNA, 32 nt, Human
gagagagugcugggcagauggauggugagcac

SEQ ID NO: 423227 - RNA, 32 nt, Human
gagagaguuagaaaaauuuuugguagagagaa

SEQ ID NO: 423228 - RNA, 32 nt, Human
gagagaguuagauuugaauaagaagaauggug

SEQ ID NO: 423229 - RNA, 32 nt, Human
gagagauacagcaacagacccagaaacuaaag

SEQ ID NO: 423230 - RNA, 19 nt, Human
gagagauaggaagcugccu

SEQ ID NO: 423231 - RNA, 32 nt, Human
gagagauagggugggaggcagggcaaugcagg

SEQ ID NO: 423232 - RNA, 18 nt, Human
gagagauauccuggcuga

SEQ ID NO: 423233 - RNA, 32 nt, Human
gagagaucacggucaugaagaucagcccccaa

SEQ ID NO: 423234 - RNA, 32 nt, Human
gagagaucugaagaugcugcacugcuggcuuu

SEQ ID NO: 423235 - RNA, 22 nt, Human
gagagaugaaaggauggucucc

SEQ ID NO: 423236 - RNA, 30 nt, Human
gagagaugaaggggcagcagaaaacagcug

SEQ ID NO: 423237 - RNA, 30 nt, Human
gagagaugagagaggccuucacuguucacc

SEQ ID NO: 423238 - RNA, 32 nt, Human
gagagaugaguugcacaagauuauacacuguu

SEQ ID NO: 423239 - RNA, 20 nt, Human
gagagaugaugugaucccca

SEQ ID NO: 423240 - RNA, 32 nt, Human
gagagaugcccagguugcacaggagugggaug

SEQ ID NO: 423241 - RNA, 32 nt, Human
gagagaugcucaccaagcuucuauuuaucuaa

SEQ ID NO: 423242 - RNA, 32 nt, Human
gagagauggagcaaagugagggccgagugaga

SEQ ID NO: 423243 - RNA, 32 nt, Human
gagagauggagucagggucccuggagaaggag

SEQ ID NO: 423244 - RNA, 32 nt, Human
gagagauggcuggaccaauucucuccaugaca

SEQ ID NO: 423245 - RNA, 22 nt, Human
gagagaugggaccuggggcaaa

SEQ ID NO: 423246 - RNA, 32 nt, Human
gagagaugggcacgaaagagcuguaauacagu

SEQ ID NO: 423247 - RNA, 32 nt, Human
gagagaugugacguuggaacugcucuggcacu

SEQ ID NO: 423248 - RNA, 32 nt, Human
gagagaugugaugaugaaaacaggcucaggga

SEQ ID NO: 423249 - RNA, 32 nt, Human
gagagauguuauuugggagacuugagaugcuu

SEQ ID NO: 423250 - RNA, 32 nt, Human
gagagauugccuggcccugcuugaaugucaug

SEQ ID NO: 423251 - RNA, 32 nt, Human
gagagauuuucagaccccuggguacauggugg

SEQ ID NO: 423252 - RNA, 32 nt, Human
gagagcaaaggagucaggaauggcuuuuacuc

SEQ ID NO: 423253 - RNA, 32 nt, Human
gagagcaacauuuuacccacacacagauaaag

SEQ ID NO: 423254 - RNA, 32 nt, Human
gagagcaagagggagagugugugagagagagu

SEQ ID NO: 423255 - RNA, 32 nt, Human
gagagcaagauggagcccaagauggaacccaa

SEQ ID NO: 423256 - RNA, 32 nt, Human
gagagcaagccccagccuuggugcucauaaau

SEQ ID NO: 423257 - RNA, 32 nt, Human
gagagcaagucacucccggcugccuuuuucac

SEQ ID NO: 423258 - RNA, 32 nt, Human
gagagcaaugggcagggaaggaaggggucugc

SEQ ID NO: 423259 - RNA, 32 nt, Human
gagagcacaccacugcacuccagccugggcaa

SEQ ID NO: 423260 - RNA, 32 nt, Human
gagagcacagcagacccuuagcagaacagaaa

SEQ ID NO: 423261 - RNA, 32 nt, Human
gagagcacagcccuugccuggagcccaggaac

SEQ ID NO: 423262 - RNA, 32 nt, Human
gagagcacccacugaauugacaugacccucug

SEQ ID NO: 423263 - RNA, 22 nt, Human
gagagcacccugcauucugccu

SEQ ID NO: 423264 - RNA, 32 nt, Human
gagagcaccgcugcacucgcggccggcgaugc

SEQ ID NO: 423265 - RNA, 16 nt, Human
gagagcaccucagaga

SEQ ID NO: 423266 - RNA, 32 nt, Human
gagagcaccuccccaaacacacaagcucucag

SEQ ID NO: 423267 - RNA, 32 nt, Human
gagagcacgccacugcacuccagccuggguga

SEQ ID NO: 423268 - RNA, 32 nt, Human
gagagcacggaagcccagagugaacagaaaga

SEQ ID NO: 423269 - RNA, 22 nt, Human
gagagcacgggguagccggaga

SEQ ID NO: 423270 - RNA, 32 nt, Human
gagagcacugccucccugugugacugggugag

SEQ ID NO: 423271 - RNA, 32 nt, Human
gagagcacugugacuccagcccuggcucggag

SEQ ID NO: 423272 - RNA, 17 nt, Human
gagagcagaacuccaag

SEQ ID NO: 423273 - RNA, 18 nt, Human
gagagcagaaggauggga

SEQ ID NO: 423274 - RNA, 32 nt, Human
gagagcagacacagccccauggcccucccucu

SEQ ID NO: 423275 - RNA, 20 nt, Human
gagagcagagacucuuggga

SEQ ID NO: 423276 - RNA, 20 nt, Human
gagagcagagauacagugag

SEQ ID NO: 423277 - RNA, 32 nt, Human
gagagcagaggacgagccgggacgcggcgccg

SEQ ID NO: 423278 - RNA, 32 nt, Human
gagagcagagggggucaugcagugagugggug

SEQ ID NO: 423279 - RNA, 32 nt, Human
gagagcagagugagauuaaagagcgagaaagc

SEQ ID NO: 423280 - RNA, 32 nt, Human
gagagcagcagacaagcuggacuggggaagau

SEQ ID NO: 423281 - RNA, 32 nt, Human
gagagcagcaggacccuucacagcagguccuu

SEQ ID NO: 423282 - RNA, 32 nt, Human
gagagcagcaguucuuccagcacagcgcuuga

SEQ ID NO: 423283 - RNA, 32 nt, Human
gagagcagccagggcaacacagcgagacccug

SEQ ID NO: 423284 - RNA, 32 nt, Human
gagagcagccuggccaacaccgugaaccucgu

SEQ ID NO: 423285 - RNA, 32 nt, Human
gagagcagccuggccaacagaggugagcaccu

SEQ ID NO: 423286 - RNA, 32 nt, Human
gagagcagccugggcaacauagcaagaacuca

SEQ ID NO: 423287 - RNA, 32 nt, Human
gagagcagccugggcaacguagagauccccau

SEQ ID NO: 423288 - RNA, 23 nt, Human
gagagcagcugcagugguuggga

SEQ ID NO: 423289 - RNA, 32 nt, Human
gagagcagcugcagugguugggaggagcuuga

SEQ ID NO: 423290 - RNA, 32 nt, Human
gagagcaggcggggccgcccagugggucaggc

SEQ ID NO: 423291 - RNA, 23 nt, Human
gagagcagggaguggcucaggga

SEQ ID NO: 423292 - RNA, 21 nt, Human
gagagcagggaguggcuggga

SEQ ID NO: 423293 - RNA, 20 nt, Human
gagagcaggggagcuuggga

SEQ ID NO: 423294 - RNA, 32 nt, Human
gagagcagucauaucuuaccccuagauguuca

SEQ ID NO: 423295 - RNA, 31 nt, Human
gagagcaguccacuggauguuggagagccag

SEQ ID NO: 423296 - RNA, 32 nt, Human
gagagcauagcaucaugauguauuagcuguuc

SEQ ID NO: 423297 - RNA, 32 nt, Human
gagagcaucauggaugcagggccggucuuggu

SEQ ID NO: 423298 - RNA, 32 nt, Human
gagagcaucccagacuccccaaagaggaugga

SEQ ID NO: 423299 - RNA, 19 nt, Human
gagagcaucucccuggagg

SEQ ID NO: 423300 - RNA, 32 nt, Human
gagagcaucugcaaaaugcaaagagaacuacc

SEQ ID NO: 423301 - RNA, 32 nt, Human
gagagcaugccgcugcacuccagccugggaga

SEQ ID NO: 423302 - RNA, 32 nt, Human
gagagcauuggguucaaguuugcaucaaacau

SEQ ID NO: 423303 - RNA, 32 nt, Human
gagagcauuuguccuugacuguaaguacagag

SEQ ID NO: 423304 - RNA, 32 nt, Human
gagagccaaacagagcccaggagacuccacua

SEQ ID NO: 423305 - RNA, 32 nt, Human
gagagccaaacagagcccagggagacuccacu

SEQ ID NO: 423306 - RNA, 32 nt, Human
gagagccaagcccuguguccccaaggaguccc

SEQ ID NO: 423307 - RNA, 32 nt, Human
gagagccacucagcgggccucucccagccgcc

SEQ ID NO: 423308 - RNA, 32 nt, Human
gagagccacugccuccccugccuccccugccu

SEQ ID NO: 423309 - RNA, 31 nt, Human
gagagccagagagcgagcagagggggcgggc

SEQ ID NO: 423310 - RNA, 32 nt, Human
gagagccagagagguucacuauaccaugacuc

SEQ ID NO: 423311 - RNA, 32 nt, Human
gagagccagcagagaggggugaauggaagaag

SEQ ID NO: 423312 - RNA, 32 nt, Human
gagagccagcccggagagaugcaguucuugcc

SEQ ID NO: 423313 - RNA, 32 nt, Human
gagagccaggccugcccugcccugcuggcuuc

SEQ ID NO: 423314 - RNA, 32 nt, Human
gagagccaguggccacagcugcagagcacugc

SEQ ID NO: 423315 - RNA, 32 nt, Human
gagagccaucuucuuacccccuggccacaugg

SEQ ID NO: 423316 - RNA, 32 nt, Human
gagagccaugcagggcgucugcagcccaggcc

SEQ ID NO: 423317 - RNA, 32 nt, Human
gagagccaugcaguccaagcgggauugugagc

SEQ ID NO: 423318 - RNA, 32 nt, Human
gagagccaugcaguccacgcgggauugugagc

SEQ ID NO: 423319 - RNA, 21 nt, Human
gagagcccaagccccaaugcc

SEQ ID NO: 423320 - RNA, 32 nt, Human
gagagcccagaacaugcauauaaaggaaacau

SEQ ID NO: 423321 - RNA, 32 nt, Human
gagagcccagaaccccaguagcagcagaaggg

SEQ ID NO: 423322 - RNA, 32 nt, Human
gagagcccagaggaggaguuuggccaggugga

SEQ ID NO: 423323 - RNA, 32 nt, Human
gagagcccagcacuuggcagguguccaguacc

SEQ ID NO: 423324 - RNA, 32 nt, Human
gagagcccagucucccuccaggaaaggccuga

SEQ ID NO: 423325 - RNA, 32 nt, Human
gagagcccgaacaggaagaggguacagcuuug

SEQ ID NO: 423326 - RNA, 32 nt, Human
gagagcccgaggaggcagcggccgcaggcagc

SEQ ID NO: 423327 - RNA, 32 nt, Human
gagagcccgcagcugccgcagccggccccagu

SEQ ID NO: 423328 - RNA, 32 nt, Human
gagagcccgccaggcccugccccugcucggcu

SEQ ID NO: 423329 - RNA, 32 nt, Human
gagagcccucugcugcuuuccaacacacaauu

SEQ ID NO: 423330 - RNA, 32 nt, Human
gagagcccugcaccuggccagagugucacagg

SEQ ID NO: 423331 - RNA, 32 nt, Human
gagagcccugcagaagcugcagcugaccagga

SEQ ID NO: 423332 - RNA, 32 nt, Human
gagagcccugccuggggagcugugccagcuca

SEQ ID NO: 423333 - RNA, 32 nt, Human
gagagcccugggucagcauugcucuggcacug

SEQ ID NO: 423334 - RNA, 32 nt, Human
gagagcccuuucucccauccauuggagguccc

SEQ ID NO: 423335 - RNA, 32 nt, Human
gagagccgaggugggaggcaugggaaacagug

SEQ ID NO: 423336 - RNA, 32 nt, Human
gagagccgcaggagcagcaggcuguggcccag

SEQ ID NO: 423337 - RNA, 32 nt, Human
gagagccggcaggaggggacccugccgauugu

SEQ ID NO: 423338 - RNA, 32 nt, Human
gagagccggcgcccugccuggcccggcggccu

SEQ ID NO: 423339 - RNA, 32 nt, Human
gagagccggcggcccugaaggugagugaggcc

SEQ ID NO: 423340 - RNA, 32 nt, Human
gagagccggcuggagucugggaugcagaacag

SEQ ID NO: 423341 - RNA, 32 nt, Human
gagagccggcuggagucugggaugcagaacau

SEQ ID NO: 423342 - RNA, 32 nt, Human
gagagccgggaggcagagggaguagugaccgc

SEQ ID NO: 423343 - RNA, 32 nt, Human
gagagccggggugaugucuccagcggcagcgu

SEQ ID NO: 423344 - RNA, 32 nt, Human
gagagccuacuguaacccucauggccaccccc

SEQ ID NO: 423345 - RNA, 32 nt, Human
gagagccuccauccugucuucauccucaagug

SEQ ID NO: 423346 - RNA, 32 nt, Human
gagagccucccucugcugcaggagcucgucca

SEQ ID NO: 423347 - RNA, 32 nt, Human
gagagccugccuggcuuguccaagcucaaagg

SEQ ID NO: 423348 - RNA, 26 nt, Human
gagagccugcgaggucaagcugcaga

SEQ ID NO: 423349 - RNA, 32 nt, Human
gagagccugcuuccugcugccugccgaaauuu

SEQ ID NO: 423350 - RNA, 21 nt, Human
gagagccuggaggccugaaga

SEQ ID NO: 423351 - RNA, 22 nt, Human
gagagccuggauacgaagcagg

SEQ ID NO: 423352 - RNA, 22 nt, Human
gagagccuggauggaucacagg

SEQ ID NO: 423353 - RNA, 32 nt, Human
gagagccuggugcugcugcugcuguggcguga

SEQ ID NO: 423354 - RNA, 32 nt, Human
gagagccugguggaucucugucuuccagcccu

SEQ ID NO: 423355 - RNA, 19 nt, Human
gagagccugucacuccaga

SEQ ID NO: 423356 - RNA, 32 nt, Human
gagagccugugaguuugaggcugcaaugagcu

SEQ ID NO: 423357 - RNA, 32 nt, Human
gagagccuucccaugacccccaugaagagauc

SEQ ID NO: 423358 - RNA, 32 nt, Human
gagagccuuguucugucaccuaggcuggaaug

SEQ ID NO: 423359 - RNA, 19 nt, Human
gagagcgaaagugcuuuag

SEQ ID NO: 423360 - RNA, 32 nt, Human
gagagcgacucugugucccaggcacagcugug

SEQ ID NO: 423361 - RNA, 32 nt, Human
gagagcgagagcgagaacgagaucaggagcga

SEQ ID NO: 423362 - RNA, 21 nt, Human
gagagcgagcccccaaugccc

SEQ ID NO: 423363 - RNA, 32 nt, Human
gagagcgaugcugcgccucugccccucuccug

SEQ ID NO: 423364 - RNA, 32 nt, Human
gagagcgauuucugggauggaagccaucugcc

SEQ ID NO: 423365 - RNA, 32 nt, Human
gagagcgcagccgccuucacagcagucuggau

SEQ ID NO: 423366 - RNA, 32 nt, Human
gagagcgcagggcggggagaggcguggggagc

SEQ ID NO: 423367 - RNA, 21 nt, Human
gagagcgccgauggcugggga

SEQ ID NO: 423368 - RNA, 32 nt, Human
gagagcgcuacggcuacggccugggcacuggu

SEQ ID NO: 423369 - RNA, 32 nt, Human
gagagcgcuccgaagacugagaugagcuuggg

SEQ ID NO: 423370 - RNA, 32 nt, Human
gagagcggaauccugcuccgccgucgcagcag

SEQ ID NO: 423371 - RNA, 32 nt, Human
gagagcggacagaucucugggugcugggcggu

SEQ ID NO: 423372 - RNA, 24 nt, Human
gagagcggaggagagagaggcaga

SEQ ID NO: 423373 - RNA, 32 nt, Human
gagagcggccggucccagccauggcccgccuu

SEQ ID NO: 423374 - RNA, 32 nt, Human
gagagcggcuggagaaagaugcaguccucagg

SEQ ID NO: 423375 - RNA, 32 nt, Human
gagagcgggagugagagcaggaacgacgcaga

SEQ ID NO: 423376 - RNA, 32 nt, Human
gagagcgggcccugcgcgccugaugggucgag

SEQ ID NO: 423377 - RNA, 32 nt, Human
gagagcggucccaagcccuggggcccuaggcu

SEQ ID NO: 423378 - RNA, 32 nt, Human
gagagcgugugcacagcgaggccaucucaccg

SEQ ID NO: 423379 - RNA, 32 nt, Human
gagagcuaaaaaggaagcaaugagaacaacag

SEQ ID NO: 423380 - RNA, 32 nt, Human
gagagcuaaugaagguauguugccaaaauuua

SEQ ID NO: 423381 - RNA, 32 nt, Human
gagagcuacauugaagacgagcucuucauuca

SEQ ID NO: 423382 - RNA, 32 nt, Human
gagagcuagguagcuaucaaaacgcuuagaca

SEQ ID NO: 423383 - RNA, 32 nt, Human
gagagcuaucuauuucccuaaccuacuuaauu

SEQ ID NO: 423384 - RNA, 32 nt, Human
gagagcucaaguuucagagucagaauuaggca

SEQ ID NO: 423385 - RNA, 32 nt, Human
gagagcucacccaggcggggguguugugggua

SEQ ID NO: 423386 - RNA, 22 nt, Human
gagagcuccuccagccuggaga

SEQ ID NO: 423387 - RNA, 32 nt, Human
gagagcuccuucagcaucuucagcuucugcug

SEQ ID NO: 423388 - RNA, 32 nt, Human
gagagcucgucuccuaucaaucagagaacccc

SEQ ID NO: 423389 - RNA, 32 nt, Human
gagagcucgugcuggggagaaguccaccaaga

SEQ ID NO: 423390 - RNA, 22 nt, Human
gagagcucugagccucucagca

SEQ ID NO: 423391 - RNA, 19 nt, Human
gagagcucugagcucuggc

SEQ ID NO: 423392 - RNA, 20 nt, Human
gagagcucuggcugcagagc

SEQ ID NO: 423393 - RNA, 23 nt, Human
gagagcucuggcuggcaucuggu

SEQ ID NO: 423394 - RNA, 24 nt, Human
gagagcucuggcuggcauugacca

SEQ ID NO: 423395 - RNA, 20 nt, Human
gagagcucuggcuuaucagg

SEQ ID NO: 423396 - RNA, 32 nt, Human
gagagcucuuucuccugcuguucuggguuccu

SEQ ID NO: 423397 - RNA, 32 nt, Human
gagagcugaagugccccagccagcagcuagcc

SEQ ID NO: 423398 - RNA, 32 nt, Human
gagagcugaggaugccaaggccagucugcagc

SEQ ID NO: 423399 - RNA, 32 nt, Human
gagagcugaggauuuccaggacuuuguaaguu

SEQ ID NO: 423400 - RNA, 32 nt, Human
gagagcugcacucuggcuggggaaggcaugag

SEQ ID NO: 423401 - RNA, 32 nt, Human
gagagcugccacccucuucuuucuccccagcc

SEQ ID NO: 423402 - RNA, 32 nt, Human
gagagcugccacugagcagcccugccaggggu

SEQ ID NO: 423403 - RNA, 32 nt, Human
gagagcugcccucccacucucucuccaaauuu

SEQ ID NO: 423404 - RNA, 32 nt, Human
gagagcugccuuggacucuccaaugcagcugc

SEQ ID NO: 423405 - RNA, 32 nt, Human
gagagcugcgaggccgggguucccaggguuca

SEQ ID NO: 423406 - RNA, 32 nt, Human
gagagcugcucuggaaaaugugacccagaucc

SEQ ID NO: 423407 - RNA, 20 nt, Human
gagagcugcugauauaguca

SEQ ID NO: 423408 - RNA, 32 nt, Human
gagagcuggacucugguuuuuauccuuucugu

SEQ ID NO: 423409 - RNA, 32 nt, Human
gagagcuggagccguggcugagcucagcugga

SEQ ID NO: 423410 - RNA, 21 nt, Human
gagagcuggaggacaauaucc

SEQ ID NO: 423411 - RNA, 21 nt, Human
gagagcuggaguuggcuccau

SEQ ID NO: 423412 - RNA, 32 nt, Human
gagagcuggauaguccugggacacagaguuag

SEQ ID NO: 423413 - RNA, 21 nt, Human
gagagcuggaugugcaugccc

SEQ ID NO: 423414 - RNA, 32 nt, Human
gagagcuggcugcuucagcugcgagccugaca

SEQ ID NO: 423415 - RNA, 23 nt, Human
gagagcuggcuugagaguaguua

SEQ ID NO: 423416 - RNA, 32 nt, Human
gagagcugggaggcggcgaucgcagcugggcc

SEQ ID NO: 423417 - RNA, 32 nt, Human
gagagcugggagggaccaagguuguaagggug

SEQ ID NO: 423418 - RNA, 32 nt, Human
gagagcugguaaucccagcuacucaugaggcu

SEQ ID NO: 423419 - RNA, 22 nt, Human
gagagcuggucgcccaccaccc

SEQ ID NO: 423420 - RNA, 32 nt, Human
gagagcuguacccagagaguccugugcugaau

SEQ ID NO: 423421 - RNA, 32 nt, Human
gagagcugugagaaggagaugcggcugcugcu

SEQ ID NO: 423422 - RNA, 32 nt, Human
gagagcugugcaucagcuagaaugacagguuu

SEQ ID NO: 423423 - RNA, 21 nt, Human
gagagcuguuccccaccgccc

SEQ ID NO: 423424 - RNA, 32 nt, Human
gagagcuuacugugugcuaggcauuuucuuaa

SEQ ID NO: 423425 - RNA, 32 nt, Human
gagagcuuaucaaagugcuggaagaggccaau

SEQ ID NO: 423426 - RNA, 32 nt, Human
gagagcuucaccugucccuccuggcuugugcg

SEQ ID NO: 423427 - RNA, 31 nt, Human
gagagcuuccugaaggaccuguugaacucag

SEQ ID NO: 423428 - RNA, 32 nt, Human
gagagcuucucauguucuuccuuuguauaaag

SEQ ID NO: 423429 - RNA, 32 nt, Human
gagagcuucucuuccuccucuggacgcugucc

SEQ ID NO: 423430 - RNA, 16 nt, Human
gagagcuucugagaga

SEQ ID NO: 423431 - RNA, 32 nt, Human
gagagcuucugaucccagcuauuagggacaga

SEQ ID NO: 423432 - RNA, 32 nt, Human
gagagcuugcagcugccaucuuagaugugcuc

SEQ ID NO: 423433 - RNA, 32 nt, Human
gagagcuugccauccagcucacgaagacagag

SEQ ID NO: 423434 - RNA, 32 nt, Human
gagagcuugguacagcagcacacacugcuugc

SEQ ID NO: 423435 - RNA, 32 nt, Human
gagagcuuguucccucccucccugugcaugca

SEQ ID NO: 423436 - RNA, 32 nt, Human
gagagcuuuagcugagaccugcuuuuacagac

SEQ ID NO: 423437 - RNA, 32 nt, Human
gagagcuuuccuguucaugcugccucacaacc

SEQ ID NO: 423438 - RNA, 32 nt, Human
gagaggaaaagaugagauccacuuggauacca

SEQ ID NO: 423439 - RNA, 32 nt, Human
gagaggaaacaucuuaccaucuggucauucau

SEQ ID NO: 423440 - RNA, 32 nt, Human
gagaggaaaggaggaggcaauuuauaaaugca

SEQ ID NO: 423441 - RNA, 18 nt, Human
gagaggaaauccaaugac

SEQ ID NO: 423442 - RNA, 32 nt, Human
gagaggaaaugagaacgaggcuuuggagcaca

SEQ ID NO: 423443 - RNA, 32 nt, Human
gagaggaaauggcugcuucaucaucauccucc

SEQ ID NO: 423444 - RNA, 32 nt, Human
gagaggaacaagggccuccgaaaccccaaccc

SEQ ID NO: 423445 - RNA, 32 nt, Human
gagaggaacaugguggccacagcuggagugac

SEQ ID NO: 423446 - RNA, 32 nt, Human
gagaggaaccaccacacccagcagcuccugac

SEQ ID NO: 423447 - RNA, 32 nt, Human
gagaggaaccuaguuuaggaccucuuuuauua

SEQ ID NO: 423448 - RNA, 22 nt, Human
gagaggaacguggaacaggagc

SEQ ID NO: 423449 - RNA, 32 nt, Human
gagaggaagaggaaaggaaggaaagccagggg

SEQ ID NO: 423450 - RNA, 32 nt, Human
gagaggaagaggagucggaagggaggcggggu

SEQ ID NO: 423451 - RNA, 32 nt, Human
gagaggaagggaaggaaggagagggaggggga

SEQ ID NO: 423452 - RNA, 32 nt, Human
gagaggaagggauuccuagcagaggaacagcu

SEQ ID NO: 423453 - RNA, 32 nt, Human
gagaggaagggccgcugugcacugcccggccu

SEQ ID NO: 423454 - RNA, 32 nt, Human
gagaggaaggugugggguggaacaggugucca

SEQ ID NO: 423455 - RNA, 32 nt, Human
gagaggaagguuggcuccaggccagguguccu

SEQ ID NO: 423456 - RNA, 32 nt, Human
gagaggacaccccacccuccagcguggccuuu

SEQ ID NO: 423457 - RNA, 32 nt, Human
gagaggacagcugguugugggagaguuccccc

SEQ ID NO: 423458 - RNA, 32 nt, Human
gagaggacaggguggagaggaggagaacccug

SEQ ID NO: 423459 - RNA, 32 nt, Human
gagaggaccuaaaaggaaacacuucugugguu

SEQ ID NO: 423460 - RNA, 32 nt, Human
gagaggaccuccagaacaccagguaccguggc

SEQ ID NO: 423461 - RNA, 32 nt, Human
gagaggacucgaaguccaucuccgggauggcc

SEQ ID NO: 423462 - RNA, 32 nt, Human
gagaggacuggggucccaggaguaggaggagc

SEQ ID NO: 423463 - RNA, 32 nt, Human
gagaggacugggucagagagcagggaguggcu

SEQ ID NO: 423464 - RNA, 32 nt, Human
gagaggagaacaguaggauugcuguggccuag

SEQ ID NO: 423465 - RNA, 32 nt, Human
gagaggagaagaggaggaggcagaggaagaaa

SEQ ID NO: 423466 - RNA, 32 nt, Human
gagaggagaaggaggaagaagaggaggaggag

SEQ ID NO: 423467 - RNA, 32 nt, Human
gagaggagaagggaaauggaggugaggggugg

SEQ ID NO: 423468 - RNA, 32 nt, Human
gagaggagaagggagagagcuguucuuuuucu

SEQ ID NO: 423469 - RNA, 32 nt, Human
gagaggagaagugcgccaauguugucuuuucu

SEQ ID NO: 423470 - RNA, 32 nt, Human
gagaggagaauaggagugacugccagugagca

SEQ ID NO: 423471 - RNA, 32 nt, Human
gagaggagaauagggaauuaggguaaacaacg

SEQ ID NO: 423472 - RNA, 32 nt, Human
gagaggagacacacugcucauggucagggcuu

SEQ ID NO: 423473 - RNA, 32 nt, Human
gagaggagacauucugcgcugcagaggcacuc

SEQ ID NO: 423474 - RNA, 32 nt, Human
gagaggagaccaggaugaaggagccagucgaa

SEQ ID NO: 423475 - RNA, 32 nt, Human
gagaggagagaccugggagugggagcucaggu

SEQ ID NO: 423476 - RNA, 19 nt, Human
gagaggagagaguuuggga

SEQ ID NO: 423477 - RNA, 32 nt, Human
gagaggagaggaagaggguggagugggcucug

SEQ ID NO: 423478 - RNA, 32 nt, Human
gagaggagaggcugcugucacugguaccggau

SEQ ID NO: 423479 - RNA, 32 nt, Human
gagaggagagugaacagggagcggggcuuuug

SEQ ID NO: 423480 - RNA, 32 nt, Human
gagaggagaucugagaccuguggggaaaacaa

SEQ ID NO: 423481 - RNA, 32 nt, Human
gagaggagauggcaggacacagcaaacaggac

SEQ ID NO: 423482 - RNA, 32 nt, Human
gagaggagcaaagaagccaugacaacuucaua

SEQ ID NO: 423483 - RNA, 32 nt, Human
gagaggagcaggccauggaggcaggugccagg

SEQ ID NO: 423484 - RNA, 32 nt, Human
gagaggagcccccgaccgagagcccagugaca

SEQ ID NO: 423485 - RNA, 32 nt, Human
gagaggagcuaaaucagacuggaucucugcca

SEQ ID NO: 423486 - RNA, 32 nt, Human
gagaggagcuuaaagacacaaacggguagaau

SEQ ID NO: 423487 - RNA, 32 nt, Human
gagaggaggaagagggagucugagcaugagcu

SEQ ID NO: 423488 - RNA, 32 nt, Human
gagaggaggaagagggagucuggcaugaguug

SEQ ID NO: 423489 - RNA, 32 nt, Human
gagaggaggaagagggggccccuaguagcaag

SEQ ID NO: 423490 - RNA, 32 nt, Human
gagaggaggaagauugagcuggggcaacagcc

SEQ ID NO: 423491 - RNA, 21 nt, Human
gagaggaggaauuaguuggga

SEQ ID NO: 423492 - RNA, 32 nt, Human
gagaggaggagaacccugaaggagagacggaa

SEQ ID NO: 423493 - RNA, 32 nt, Human
gagaggaggagaaggagggugagaggagcaaa

SEQ ID NO: 423494 - RNA, 32 nt, Human
gagaggaggaggaggaggcugagagagggagg

SEQ ID NO: 423495 - RNA, 32 nt, Human
gagaggaggaggaggaugaagaagguuauaac

SEQ ID NO: 423496 - RNA, 19 nt, Human
gagaggaggaggagggaga

SEQ ID NO: 423497 - RNA, 32 nt, Human
gagaggaggaggaggugggcagaggaaggagg

SEQ ID NO: 423498 - RNA, 32 nt, Human
gagaggaggagguggucuuaggcagugaugga

SEQ ID NO: 423499 - RNA, 32 nt, Human
gagaggaggcggggugggggaggcggggagag

SEQ ID NO: 423500 - RNA, 32 nt, Human
gagaggaggcucgaggaaugaaccuuggucug

SEQ ID NO: 423501 - RNA, 32 nt, Human
gagaggagggagugagacuguuggcuuaggaa

SEQ ID NO: 423502 - RNA, 32 nt, Human
gagaggagggcggcgggagcugagccggaauc

SEQ ID NO: 423503 - RNA, 32 nt, Human
gagaggaggggcagaggagcugccaggggaag

SEQ ID NO: 423504 - RNA, 32 nt, Human
gagaggaggggcagaggcugugaacagggaga

SEQ ID NO: 423505 - RNA, 32 nt, Human
gagaggagggggagaaggaggggaagagagag

SEQ ID NO: 423506 - RNA, 32 nt, Human
gagaggagugugaagcaaggagcuuagauaag

SEQ ID NO: 423507 - RNA, 32 nt, Human
gagaggagugugugugcacguauucaucugug

SEQ ID NO: 423508 - RNA, 32 nt, Human
gagaggaguucuuuggcucuauuggauuuguc

SEQ ID NO: 423509 - RNA, 32 nt, Human
gagaggauccaguuagagacucaguaucagcg

SEQ ID NO: 423510 - RNA, 32 nt, Human
gagaggaugagguaggcggaucacugggguca

SEQ ID NO: 423511 - RNA, 32 nt, Human
gagaggaugagguuugaggagcagagggaaga

SEQ ID NO: 423512 - RNA, 32 nt, Human
gagaggaugcagagggaagggaagagaaggga

SEQ ID NO: 423513 - RNA, 32 nt, Human
gagaggaugcgaguagggagggcaggagggug

SEQ ID NO: 423514 - RNA, 32 nt, Human
gagaggauuuguggugcuuggaagagccggcc

SEQ ID NO: 423515 - RNA, 32 nt, Human
gagaggauuuucaggauuauuggaggauuagg

SEQ ID NO: 423516 - RNA, 23 nt, Human
gagaggcaacaggaggcauucug

SEQ ID NO: 423517 - RNA, 32 nt, Human
gagaggcaacuuucccugucgggcuugaguug

SEQ ID NO: 423518 - RNA, 32 nt, Human
gagaggcaagaaaauuaugcuguccauagaag

SEQ ID NO: 423519 - RNA, 21 nt, Human
gagaggcaagagaaagcucug

SEQ ID NO: 423520 - RNA, 32 nt, Human
gagaggcaagggaaagccgaagacugaaaauu

SEQ ID NO: 423521 - RNA, 32 nt, Human
gagaggcaagggguggacggagccaaaggccg

SEQ ID NO: 423522 - RNA, 32 nt, Human
gagaggcaaucaggggguuguauacugcacug

SEQ ID NO: 423523 - RNA, 24 nt, Human
gagaggcaaugaagacaggugcuc

SEQ ID NO: 423524 - RNA, 21 nt, Human
gagaggcaaugaugagugauc

SEQ ID NO: 423525 - RNA, 20 nt, Human
gagaggcaccuggcacucug

SEQ ID NO: 423526 - RNA, 19 nt, Human
gagccaccgugccuggccu

SEQ ID NO: 423527 - RNA, 20 nt, Human
gagccaccgugccuggccua

SEQ ID NO: 423528 - RNA, 21 nt, Human
gagccaccgugccuggccuaa

SEQ ID NO: 423529 - RNA, 21 nt, Human
gagccaccgugccuggccuag

SEQ ID NO: 423530 - RNA, 21 nt, Human
gagccaccgugcucagccuaa

SEQ ID NO: 423531 - RNA, 18 nt, Human
gagccaccgugcucggcc

SEQ ID NO: 423532 - RNA, 18 nt, Human
gagccaccgugcugggcc

SEQ ID NO: 423533 - RNA, 20 nt, Human
gagccaccgugggacaucaa

SEQ ID NO: 423534 - RNA, 18 nt, Human
gagccaccucacuuggcc

SEQ ID NO: 423535 - RNA, 32 nt, Human
gagccaccucagccacgugagccaugccagcc

SEQ ID NO: 423536 - RNA, 32 nt, Human
gagccaccucaucaaaugaaagucacugcuga

SEQ ID NO: 423537 - RNA, 28 nt, Human
gagccaccuccaccccuuuccggaauuc

SEQ ID NO: 423538 - RNA, 20 nt, Human
gagccaccucgcccagccua

SEQ ID NO: 423539 - RNA, 18 nt, Human
gagccaccugcaaccuag

SEQ ID NO: 423540 - RNA, 32 nt, Human
gagccaccugccagccucgcugggcagggcug

SEQ ID NO: 423541 - RNA, 32 nt, Human
gagccaccuucaggcuguaaggucaucguaua

SEQ ID NO: 423542 - RNA, 32 nt, Human
gagccaccuucuuuaccucugagcuuucugcc

SEQ ID NO: 423543 - RNA, 20 nt, Human
gagccaccuugggaaccuag

SEQ ID NO: 423544 - RNA, 24 nt, Human
gagccacgaucacaccauugcacu

SEQ ID NO: 423545 - RNA, 32 nt, Human
gagccacgcucccuccugucucucacaccuuu

SEQ ID NO: 423546 - RNA, 21 nt, Human
gagccacggcaccuggccuga

SEQ ID NO: 423547 - RNA, 32 nt, Human
gagccacggcacuccacccugggcaacagagc

SEQ ID NO: 423548 - RNA, 32 nt, Human
gagccacgucuucuccaccucggagccccacg

SEQ ID NO: 423549 - RNA, 19 nt, Human
gagccacuaccauucugcu

SEQ ID NO: 423550 - RNA, 32 nt, Human
gagccacucuccacuuucucucacaggcugcu

SEQ ID NO: 423551 - RNA, 21 nt, Human
gagccacucugcuuggccuga

SEQ ID NO: 423552 - RNA, 19 nt, Human
gagccacugacucuucuga

SEQ ID NO: 423553 - RNA, 32 nt, Human
gagccacugagggucacccugccuuccuccuu

SEQ ID NO: 423554 - RNA, 25 nt, Human
gagccacugaucauaccacugcacu

SEQ ID NO: 423555 - RNA, 21 nt, Human
gagccacugcacccagccuag

SEQ ID NO: 423556 - RNA, 32 nt, Human
gagccacugcacccagccugggagagggguuu

SEQ ID NO: 423557 - RNA, 32 nt, Human
gagccacugcacccagccugugauguuucugu

SEQ ID NO: 423558 - RNA, 21 nt, Human
gagccacugcacccggccuaa

SEQ ID NO: 423559 - RNA, 21 nt, Human
gagccacugcacccggccuga

SEQ ID NO: 423560 - RNA, 19 nt, Human
gagccacugcaccuggccu

SEQ ID NO: 423561 - RNA, 20 nt, Human
gagccacugcaccuggccua

SEQ ID NO: 423562 - RNA, 21 nt, Human
gagccacugcaccuggccuga

SEQ ID NO: 423563 - RNA, 32 nt, Human
gagccacugcaccuggccuggagcucaguucu

SEQ ID NO: 423564 - RNA, 32 nt, Human
gagccacugcacuccaaucugggugacagaau

SEQ ID NO: 423565 - RNA, 32 nt, Human
gagccacugcacuccagcccaggugacagagu

SEQ ID NO: 423566 - RNA, 32 nt, Human
gagccacugcacuccagccucggccacagugc

SEQ ID NO: 423567 - RNA, 32 nt, Human
gagccacugcacuccagccugaugacagagca

SEQ ID NO: 423568 - RNA, 32 nt, Human
gagccacugcacuccagccugggcaacagaug

SEQ ID NO: 423569 - RNA, 32 nt, Human
gagccacugcacuccagccugggcaauagagc

SEQ ID NO: 423570 - RNA, 32 nt, Human
gagccacugcacuccagccugggcagcugaac

SEQ ID NO: 423571 - RNA, 32 nt, Human
gagccacugcacuccagccugggcgacagagc

SEQ ID NO: 423572 - RNA, 32 nt, Human
gagccacugcacuccagccugggggaaagagc

SEQ ID NO: 423573 - RNA, 32 nt, Human
gagccacugcacuccagccugggugacagagc

SEQ ID NO: 423574 - RNA, 32 nt, Human
gagccacugcacuccagccugggugacagagu

SEQ ID NO: 423575 - RNA, 32 nt, Human
gagccacugcacuccagccugggugacagcgc

SEQ ID NO: 423576 - RNA, 32 nt, Human
gagccacugcacuccagccugggugacugagc

SEQ ID NO: 423577 - RNA, 32 nt, Human
gagccacugcacuccagccugggugaugaaga

SEQ ID NO: 423578 - RNA, 32 nt, Human
gagccacugcacuccugggcaacagagcaaga

SEQ ID NO: 423579 - RNA, 32 nt, Human
gagccacugcauuccagccugggcgaaagaga

SEQ ID NO: 423580 - RNA, 32 nt, Human
gagccacugccuccccugccuccccugccugc

SEQ ID NO: 423581 - RNA, 32 nt, Human
gagccacugccuggccuggccguagguuugua

SEQ ID NO: 423582 - RNA, 21 nt, Human
gagccacugcgcccagccuga

SEQ ID NO: 423583 - RNA, 20 nt, Human
gagccacugcgcccggccua

SEQ ID NO: 423584 - RNA, 21 nt, Human
gagccacugcgcccggccuaa

SEQ ID NO: 423585 - RNA, 21 nt, Human
gagccacugcgcccggccuag

SEQ ID NO: 423586 - RNA, 19 nt, Human
gagccacugcgccuggccu

SEQ ID NO: 423587 - RNA, 21 nt, Human
gagccacugcgccuggccuaa

SEQ ID NO: 423588 - RNA, 21 nt, Human
gagccacugcgccuggccuag

SEQ ID NO: 423589 - RNA, 21 nt, Human
gagccacugcguccugccuaa

SEQ ID NO: 423590 - RNA, 32 nt, Human
gagccacugcucagugcacuucucccuuccaa

SEQ ID NO: 423591 - RNA, 18 nt, Human
gagccacugcuccuggcc

SEQ ID NO: 423592 - RNA, 32 nt, Human
gagccacuggaggaagcuguuuugagccaggg

SEQ ID NO: 423593 - RNA, 21 nt, Human
gagccacugggcccagccuaa

SEQ ID NO: 423594 - RNA, 23 nt, Human
gagccacuggggccaaagugaga

SEQ ID NO: 423595 - RNA, 21 nt, Human
gagccacuguaccccgccuaa

SEQ ID NO: 423596 - RNA, 32 nt, Human
gagccacuguacuccagccuaggugacaaagc

SEQ ID NO: 423597 - RNA, 32 nt, Human
gagccacuguccccggccuccuggcuuccuuc

SEQ ID NO: 423598 - RNA, 32 nt, Human
gagccacugugccaggcacaauggucuuuugu

SEQ ID NO: 423599 - RNA, 18 nt, Human
gagccacugugccaggcc

SEQ ID NO: 423600 - RNA, 21 nt, Human
gagccacugugcccagccuaa

SEQ ID NO: 423601 - RNA, 32 nt, Human
gagccacugugcccagccuaguuucuuuucug

SEQ ID NO: 423602 - RNA, 18 nt, Human
gagccacugugcccggcc

SEQ ID NO: 423603 - RNA, 20 nt, Human
gagccacugugcccggccua

SEQ ID NO: 423604 - RNA, 21 nt, Human
gagccacugugcccggccuag

SEQ ID NO: 423605 - RNA, 32 nt, Human
gagccacugugcccggccuuuugaguuaauuu

SEQ ID NO: 423606 - RNA, 20 nt, Human
gagccacugugccuagccua

SEQ ID NO: 423607 - RNA, 18 nt, Human
gagccacugugccuggcc

SEQ ID NO: 423608 - RNA, 19 nt, Human
gagccacugugccuggccu

SEQ ID NO: 423609 - RNA, 21 nt, Human
gagccacugugccuggccuga

SEQ ID NO: 423610 - RNA, 22 nt, Human
gagccacugugccuggccugua

SEQ ID NO: 423611 - RNA, 32 nt, Human
gagccacugugccuggccuucuaguucuuuaa

SEQ ID NO: 423612 - RNA, 32 nt, Human
gagccacugugccuggcugaguuuucuuaaag

SEQ ID NO: 423613 - RNA, 32 nt, Human
gagccacugugccuggcuggcagagcuuuucc

SEQ ID NO: 423614 - RNA, 32 nt, Human
gagccacugugccuggcugguuauuuuguuug

SEQ ID NO: 423615 - RNA, 32 nt, Human
gagccacugugccuggcuucaggcugggauuu

SEQ ID NO: 423616 - RNA, 20 nt, Human
gagccacugugcucggccua

SEQ ID NO: 423617 - RNA, 22 nt, Human
gagccacuguggaagcagagca

SEQ ID NO: 423618 - RNA, 18 nt, Human
gagccacugugucuggcc

SEQ ID NO: 423619 - RNA, 32 nt, Human
gagccacuuacccggccucugccucuuguuaa

SEQ ID NO: 423620 - RNA, 21 nt, Human
gagccagaaaccacccagaga

SEQ ID NO: 423621 - RNA, 22 nt, Human
gagccagaagagcacggagcag

SEQ ID NO: 423622 - RNA, 32 nt, Human
gagccagaaguggccccucugccccuccaggc

SEQ ID NO: 423623 - RNA, 32 nt, Human
gagccagacagacccugaaaagaaggacgggu

SEQ ID NO: 423624 - RNA, 22 nt, Human
gagccagaccauuucuucccca

SEQ ID NO: 423625 - RNA, 32 nt, Human
gagccagacccauggggccaaggaagaggaag

SEQ ID NO: 423626 - RNA, 32 nt, Human
gagccagaccuggagaaauagccccagggccc

SEQ ID NO: 423627 - RNA, 32 nt, Human
gagccagagagguagaggcugcagugagcuau

SEQ ID NO: 423628 - RNA, 19 nt, Human
gagccagagcccacagagc

SEQ ID NO: 423629 - RNA, 32 nt, Human
gagccagagcuuccgcauuuucuuuacuauuc

SEQ ID NO: 423630 - RNA, 32 nt, Human
gagccagaggaagagauagccauggaggacag

SEQ ID NO: 423631 - RNA, 32 nt, Human
gagccagaggaauguuccaaagagccagaagc

SEQ ID NO: 423632 - RNA, 32 nt, Human
gagccagaggagcacaggcgggcaggucacug

SEQ ID NO: 423633 - RNA, 32 nt, Human
gagccagaggcagaggagcugcgcggacgccg

SEQ ID NO: 423634 - RNA, 32 nt, Human
gagccagagggaggaaguugaaaggauacuaa

SEQ ID NO: 423635 - RNA, 32 nt, Human
gagccagaguggcugggaugugggagcagcau

SEQ ID NO: 423636 - RNA, 32 nt, Human
gagccagaucaaaguauguauguuguuaauau

SEQ ID NO: 423637 - RNA, 32 nt, Human
gagccagaucagugcgagugugacugaaaaug

SEQ ID NO: 423638 - RNA, 32 nt, Human
gagccagaucccuggucaugccuggaagcuuu

SEQ ID NO: 423639 - RNA, 32 nt, Human
gagccagaugccagcaccugagguugcccacc

SEQ ID NO: 423640 - RNA, 32 nt, Human
gagccagaugcugaggaagagauuccgggagg

SEQ ID NO: 423641 - RNA, 23 nt, Human
gagccagauucauuccuucuuca

SEQ ID NO: 423642 - RNA, 24 nt, Human
gagccagauuuucucugugcucuu

SEQ ID NO: 423643 - RNA, 32 nt, Human
gagccagcacuugccuuuacgaccauguucaa

SEQ ID NO: 423644 - RNA, 32 nt, Human
gagccagcagaggccuccacccagugcuggga

SEQ ID NO: 423645 - RNA, 32 nt, Human
gagccagcaggccucccugaaacacugcuucu

SEQ ID NO: 423646 - RNA, 32 nt, Human
gagccagcagggcaucuuggaaaaggaacucu

SEQ ID NO: 423647 - RNA, 32 nt, Human
gagccagccagggaggggcagcugcagugacc

SEQ ID NO: 423648 - RNA, 32 nt, Human
gagccagcccaggguccccaguucucaacacu

SEQ ID NO: 423649 - RNA, 32 nt, Human
gagccagcccggcgcccuagcagaugcacgug

SEQ ID NO: 423650 - RNA, 32 nt, Human
gagccagccugaugccgacaggucuuguaacc

SEQ ID NO: 423651 - RNA, 32 nt, Human
gagccagccuucuaacagcuacccuuccauca

SEQ ID NO: 423652 - RNA, 32 nt, Human
gagccagcgacaacagcaccagagccaggcag

SEQ ID NO: 423653 - RNA, 32 nt, Human
gagccagcgagaccacgaacucaccagaagga

SEQ ID NO: 423654 - RNA, 23 nt, Human
gagccagcgaggcggcccagggg

SEQ ID NO: 423655 - RNA, 32 nt, Human
gagccagcgauccugaacuguguuccugccca

SEQ ID NO: 423656 - RNA, 24 nt, Human
gagccagcgcccucuccccucucc

SEQ ID NO: 423657 - RNA, 25 nt, Human
gagccagcgcugcugccagugugag

SEQ ID NO: 423658 - RNA, 25 nt, Human
gagccagcggagcaccgcgggcugg

SEQ ID NO: 423659 - RNA, 32 nt, Human
gagccagcggcugucuugcugccuguacuuac

SEQ ID NO: 423660 - RNA, 32 nt, Human
gagccagcuaaaccucuccucauaaaucaccg

SEQ ID NO: 423661 - RNA, 32 nt, Human
gagccagcucuaucagggucuucccauggugg

SEQ ID NO: 423662 - RNA, 32 nt, Human
gagccagcucuuccuauccuguagcguguaga

SEQ ID NO: 423663 - RNA, 32 nt, Human
gagccagcuggccugcugcucuccagucaagu

SEQ ID NO: 423664 - RNA, 26 nt, Human
gagccagcugugugaccauccagggg

SEQ ID NO: 423665 - RNA, 32 nt, Human
gagccagcuguuuccaguuguuacugaaguua

SEQ ID NO: 423666 - RNA, 32 nt, Human
gagccagcuucgccaggcgaagacagagcugg

SEQ ID NO: 423667 - RNA, 32 nt, Human
gagccagcuuuguuucagaaucugcuacuugg

SEQ ID NO: 423668 - RNA, 30 nt, Human
gagccaggaagccucaggcuucacgacuga

SEQ ID NO: 423669 - RNA, 32 nt, Human
gagccaggaagguugagguugcagugagcuau

SEQ ID NO: 423670 - RNA, 32 nt, Human
gagccaggaauccugcggucugggcccaacac

SEQ ID NO: 423671 - RNA, 32 nt, Human
gagccaggacucaaagccagucuaggagccau

SEQ ID NO: 423672 - RNA, 32 nt, Human
gagccaggacugugacacugcacuccagccug

SEQ ID NO: 423673 - RNA, 32 nt, Human
gagccaggagaaagcugauggagccaggacag

SEQ ID NO: 423674 - RNA, 32 nt, Human
gagccaggagagaaaggcagcucccuucaccu

SEQ ID NO: 423675 - RNA, 32 nt, Human
gagccaggagcagaagcaaagagcagacacac

SEQ ID NO: 423676 - RNA, 32 nt, Human
gagccaggagccaaggaaugcagcccuagaag

SEQ ID NO: 423677 - RNA, 22 nt, Human
gagccaggagcuacagagcggg

SEQ ID NO: 423678 - RNA, 32 nt, Human
gagccaggaggagcccaacagagcagcagggg

SEQ ID NO: 423679 - RNA, 32 nt, Human
gagccaggaggaggagguugcagugagccgag

SEQ ID NO: 423680 - RNA, 32 nt, Human
gagccaggaggcaguggggcugugggcucaga

SEQ ID NO: 423681 - RNA, 32 nt, Human
gagccaggagguugagguugcagugagcugag

SEQ ID NO: 423682 - RNA, 24 nt, Human
gagccaggaucaugccacugcacu

SEQ ID NO: 423683 - RNA, 24 nt, Human
gagccaggaucgcgccauugcacu

SEQ ID NO: 423684 - RNA, 24 nt, Human
gagccaggauggcaccacugcacu

SEQ ID NO: 423685 - RNA, 24 nt, Human
gagccaggauuccugauccagaga

SEQ ID NO: 423686 - RNA, 24 nt, Human
gagccaggauugcaccacugcacu

SEQ ID NO: 423687 - RNA, 24 nt, Human
gagccaggauugcgccaccacacu

SEQ ID NO: 423688 - RNA, 24 nt, Human
gagccaggauugugccacugcacu

SEQ ID NO: 423689 - RNA, 32 nt, Human
gagccaggauuuucacacccccuccucaagcu

SEQ ID NO: 423690 - RNA, 23 nt, Human
gagccaggcacccuccucuguca

SEQ ID NO: 423691 - RNA, 24 nt, Human
gagccaggcagcaaggaccagagg

SEQ ID NO: 423692 - RNA, 21 nt, Human
gagccaggcauggcauagagg

SEQ ID NO: 423693 - RNA, 32 nt, Human
gagccaggcaugguugaccugcuuuccauguc

SEQ ID NO: 423694 - RNA, 22 nt, Human
gagccaggccagggcccggaga

SEQ ID NO: 423695 - RNA, 23 nt, Human
gagccaggcccaagacacagcag

SEQ ID NO: 423696 - RNA, 32 nt, Human
gagccaggcccaggaacuucagaucaaguuca

SEQ ID NO: 423697 - RNA, 23 nt, Human
gagccaggccccagcagaugcgg

SEQ ID NO: 423698 - RNA, 23 nt, Human
gagccaggccccccaggaggcag

SEQ ID NO: 423699 - RNA, 21 nt, Human
gagccaggcccugaggaacag

SEQ ID NO: 423700 - RNA, 22 nt, Human
gagccaggccggaacucaggga

SEQ ID NO: 423701 - RNA, 32 nt, Human
gagccaggccuccucaaguuggccucucagac

SEQ ID NO: 423702 - RNA, 21 nt, Human
gagccaggcgucccucugccu

SEQ ID NO: 423703 - RNA, 22 nt, Human
gagccaggcguggagcgcgaga

SEQ ID NO: 423704 - RNA, 20 nt, Human
gagccaggcucucgcucugu

SEQ ID NO: 423705 - RNA, 22 nt, Human
gagccaggcugugcccgaggga

SEQ ID NO: 423706 - RNA, 32 nt, Human
gagccaggcuuuguagcgaggccaggucuucg

SEQ ID NO: 423707 - RNA, 32 nt, Human
gagccagggagagcucacaggcacaagaauaa

SEQ ID NO: 423708 - RNA, 32 nt, Human
gagccagggaggucaaggcugcagugagccgu

SEQ ID NO: 423709 - RNA, 32 nt, Human
gagccagggagguggaggcuacagugagccau

SEQ ID NO: 423710 - RNA, 20 nt, Human
gagccagggaucuuggccua

SEQ ID NO: 423711 - RNA, 22 nt, Human
gagccagggccuggcgagcugg

SEQ ID NO: 423712 - RNA, 24 nt, Human
gagccagggcgugucucccggagg

SEQ ID NO: 423713 - RNA, 32 nt, Human
gagccaggggagaaggguguggggaucagaca

SEQ ID NO: 423714 - RNA, 32 nt, Human
gagccagggguagguucuggaggcucaagcaa

SEQ ID NO: 423715 - RNA, 21 nt, Human
gagccaggguucccccaggga

SEQ ID NO: 423716 - RNA, 20 nt, Human
gagccaggguuucaccaugu

SEQ ID NO: 423717 - RNA, 23 nt, Human
gagccaggguuucaccaugucgg

SEQ ID NO: 423718 - RNA, 20 nt, Human
gagccaggguuuccucuuca

SEQ ID NO: 423719 - RNA, 21 nt, Human
gagccagguccauaccccuuc

SEQ ID NO: 423720 - RNA, 20 nt, Human
gagccaggucccucagccca

SEQ ID NO: 423721 - RNA, 22 nt, Human
gagccagguccuccuccuccuc

SEQ ID NO: 423722 - RNA, 32 nt, Human
gagccaggucuaaaguuugaagaaaaagaaaa

SEQ ID NO: 423723 - RNA, 22 nt, Human
gagccaggucuccaccucugca

SEQ ID NO: 423724 - RNA, 32 nt, Human
gagccaggugcaggccauuggagagaaggucu

SEQ ID NO: 423725 - RNA, 22 nt, Human
gagccaggugcugcucagcaga

SEQ ID NO: 423726 - RNA, 23 nt, Human
gagccagguggacaugccagaga

SEQ ID NO: 423727 - RNA, 32 nt, Human
gagccagguggagccacuugaggucagguguu

SEQ ID NO: 423728 - RNA, 32 nt, Human
gagccagguggguggagggagggagaucauga

SEQ ID NO: 423729 - RNA, 21 nt, Human
gagccagguugguaguuacaa

SEQ ID NO: 423730 - RNA, 21 nt, Human
gagccaguaccgccugcacuu

SEQ ID NO: 423731 - RNA, 21 nt, Human
gagccaguagugaucaguauc

SEQ ID NO: 423732 - RNA, 32 nt, Human
gagccagucaucuccauccauccacagccaug

SEQ ID NO: 423733 - RNA, 20 nt, Human
gagccaguccucccuuccca

SEQ ID NO: 423734 - RNA, 32 nt, Human
gagccagugagaggccagcuuagagaaugcuu

SEQ ID NO: 423735 - RNA, 22 nt, Human
gagccagugcuuccccucuccc

SEQ ID NO: 423736 - RNA, 32 nt, Human
gagccaguggagguggccuggagcagcagccc

SEQ ID NO: 423737 - RNA, 32 nt, Human
gagccaguggggacacagcaauaaugugggug

SEQ ID NO: 423738 - RNA, 32 nt, Human
gagccagugugggcauggucacgacgcggggc

SEQ ID NO: 423739 - RNA, 32 nt, Human
gagccauagagcacccuuccuccugggccaga

SEQ ID NO: 423740 - RNA, 22 nt, Human
gagccauaugagcccucagggg

SEQ ID NO: 423741 - RNA, 20 nt, Human
gagccauauuuugagacccc

SEQ ID NO: 423742 - RNA, 32 nt, Human
gagccaucaccuaggacugacucggcagugug

SEQ ID NO: 423743 - RNA, 32 nt, Human
gagccaucacuacggauacgggcugcuggacg

SEQ ID NO: 423744 - RNA, 24 nt, Human
gagccaucaucaugccacugcacu

SEQ ID NO: 423745 - RNA, 32 nt, Human
gagccaucauucaucccuuaacaggcacauua

SEQ ID NO: 423746 - RNA, 32 nt, Human
gagccaucccacucccuuuccccucuucccug

SEQ ID NO: 423747 - RNA, 32 nt, Human
gagccaucccaucaucugucauggguugaccc

SEQ ID NO: 423748 - RNA, 32 nt, Human
gagccauccuccugccugggccucccaaagug

SEQ ID NO: 423749 - RNA, 32 nt, Human
gagccauccugucuucugcuugagugucuuca

SEQ ID NO: 423750 - RNA, 18 nt, Human
gagccaucgugucuggcc

SEQ ID NO: 423751 - RNA, 32 nt, Human
gagccaucugcuggucaggaaguccuccagag

SEQ ID NO: 423752 - RNA, 19 nt, Human
gagccaucuguccuucuca

SEQ ID NO: 423753 - RNA, 32 nt, Human
gagccaucuuuuacagauuauuuuggaguuuu

SEQ ID NO: 423754 - RNA, 32 nt, Human
gagccaugaagagggaaggaaaagagggcaag

SEQ ID NO: 423755 - RNA, 32 nt, Human
gagccaugaaggugaaaggcagucuuucguua

SEQ ID NO: 423756 - RNA, 24 nt, Human
gagccaugaaugccccacugcacu

SEQ ID NO: 423757 - RNA, 32 nt, Human
gagccaugacggugccacugcacuccagcuug

SEQ ID NO: 423758 - RNA, 23 nt, Human
gagccaugacugugccacugcac

SEQ ID NO: 423759 - RNA, 32 nt, Human
gagccaugaggagccucaguuuugaaagaggu

SEQ ID NO: 423760 - RNA, 23 nt, Human
gagccaugaggcaccacugcacu

SEQ ID NO: 423761 - RNA, 32 nt, Human
gagccaugauauugccagccugggugacagag

SEQ ID NO: 423762 - RNA, 24 nt, Human
gagccaugaucacaccacugcacu

SEQ ID NO: 423763 - RNA, 24 nt, Human
gagccaugaucauaccacugcacu

SEQ ID NO: 423764 - RNA, 24 nt, Human
gagccaugaucaugccacugcacu

SEQ ID NO: 423765 - RNA, 24 nt, Human
gagccaugaucgagccacugcacu

SEQ ID NO: 423766 - RNA, 24 nt, Human
gagccaugaucgcaccacugcacu

SEQ ID NO: 423767 - RNA, 24 nt, Human
gagccaugaucgcaccauugcacu

SEQ ID NO: 423768 - RNA, 24 nt, Human
gagccaugaucgcgccacugcacu

SEQ ID NO: 423769 - RNA, 24 nt, Human
gagccaugaucgugccacuacacu

SEQ ID NO: 423770 - RNA, 32 nt, Human
gagccaugauggacacagaggggcaguagagg

SEQ ID NO: 423771 - RNA, 32 nt, Human
gagccaugaugguaccccugcacuccagccca

SEQ ID NO: 423772 - RNA, 24 nt, Human
gagccaugauggugccacugcacu

SEQ ID NO: 423773 - RNA, 32 nt, Human
gagccaugauggugccacugcacuccagccug

SEQ ID NO: 423774 - RNA, 24 nt, Human
gagccaugauuacuccacugcacu

SEQ ID NO: 423775 - RNA, 25 nt, Human
gagccaugauucacagcacugcacu

SEQ ID NO: 423776 - RNA, 24 nt, Human
gagccaugauugcaccacugcacu

SEQ ID NO: 423777 - RNA, 24 nt, Human
gagccaugauugcaccacuguacu

SEQ ID NO: 423778 - RNA, 24 nt, Human
gagccaugauugugccacugcacu

SEQ ID NO: 423779 - RNA, 32 nt, Human
gagccaugcagggcagccugguggcggcuagg

SEQ ID NO: 423780 - RNA, 32 nt, Human
gagccaugccaaugcacuccagucugggcaac

SEQ ID NO: 423781 - RNA, 24 nt, Human
gagccaugcucacaccacugcacu

SEQ ID NO: 423782 - RNA, 32 nt, Human
gagccaugcucacaccacugcacuccagccug

SEQ ID NO: 423783 - RNA, 30 nt, Human
gagccaugggcaacaucuccucuaacaucu

SEQ ID NO: 423784 - RNA, 32 nt, Human
gagccauggggccggagccgcagugagcacca

SEQ ID NO: 423785 - RNA, 32 nt, Human
gagccaugguauaaauuaacagguuaauguca

SEQ ID NO: 423786 - RNA, 30 nt, Human
gagccauggugaacgaagccagaggaaaca

SEQ ID NO: 423787 - RNA, 32 nt, Human
gagccaugguguuggccccugaggcagccugu

SEQ ID NO: 423788 - RNA, 32 nt, Human
gagccauguagggaggcuauucccaggcauac

SEQ ID NO: 423789 - RNA, 32 nt, Human
gagccauguauacaucugaacuccuccugggc

SEQ ID NO: 423790 - RNA, 24 nt, Human
gagccauguucacaccgcugcacu

SEQ ID NO: 423791 - RNA, 19 nt, Human
gagccauuacaacagcuua

SEQ ID NO: 423792 - RNA, 32 nt, Human
gagccauucccuguguguucacucuccuccca

SEQ ID NO: 423793 - RNA, 26 nt, Human
gagccauuccucacccccgugaccuc

SEQ ID NO: 423794 - RNA, 32 nt, Human
gagccauucucaauaaacauuugcugaagaaa

SEQ ID NO: 423795 - RNA, 32 nt, Human
gagccauucugugacaaacucaccucccaaag

SEQ ID NO: 423796 - RNA, 32 nt, Human
gagccauucugugugugacucuggguggaagu

SEQ ID NO: 423797 - RNA, 32 nt, Human
gagccauugcacuccagccuggacagcaggag

SEQ ID NO: 423798 - RNA, 32 nt, Human
gagccauugcacuccagccugggcaacaagag

SEQ ID NO: 423799 - RNA, 32 nt, Human
gagccauugcaggccucugccugcugcccccu

SEQ ID NO: 423800 - RNA, 32 nt, Human
gagccauugccaaaugguaaagaaaugaaaag

SEQ ID NO: 423801 - RNA, 32 nt, Human
gagccauugcucuccagccugggugacacagc

SEQ ID NO: 423802 - RNA, 22 nt, Human
gagccauuucaaucuugacuuc

SEQ ID NO: 423803 - RNA, 32 nt, Human
gagccauuucugggcacguggcagcagucgcu

SEQ ID NO: 423804 - RNA, 32 nt, Human
gagccauuugugagagagaauccggaagcguu

SEQ ID NO: 423805 - RNA, 32 nt, Human
gagcccaaauaaugccugcuggauugucuccu

SEQ ID NO: 423806 - RNA, 18 nt, Human
gagcccaacagagcagca

SEQ ID NO: 423807 - RNA, 20 nt, Human
gagcccaaccuggcacucaa

SEQ ID NO: 423808 - RNA, 21 nt, Human
gagcccaacugauggcccugg

SEQ ID NO: 423809 - RNA, 24 nt, Human
gagcccaagaggcagagguugcag

SEQ ID NO: 423810 - RNA, 32 nt, Human
gagcccaagaggcagagguugcagggucaaga

SEQ ID NO: 423811 - RNA, 24 nt, Human
gagcccaagagguagagguugcag

SEQ ID NO: 423812 - RNA, 32 nt, Human
gagcccaagagguagagguugcagugagccaa

SEQ ID NO: 423813 - RNA, 32 nt, Human
gagcccaagagguggagguuacagugagcaga

SEQ ID NO: 423814 - RNA, 32 nt, Human
gagcccaagagguugaggcugcagugagccau

SEQ ID NO: 423815 - RNA, 32 nt, Human
gagcccaagagucggagaccagccugggcaac

SEQ ID NO: 423816 - RNA, 32 nt, Human
gagcccaagaguucaagaccagccugggaaac

SEQ ID NO: 423817 - RNA, 32 nt, Human
gagcccaagaguucaagaucagccugggcagu

SEQ ID NO: 423818 - RNA, 32 nt, Human
gagcccaagaguuccagaccagccuggccacc

SEQ ID NO: 423819 - RNA, 32 nt, Human
gagcccaagaguucgacgcugcagugagcuau

SEQ ID NO: 423820 - RNA, 32 nt, Human
gagcccaagaguucgagaccagccugggcaac

SEQ ID NO: 423821 - RNA, 32 nt, Human
gagcccaagaguuggagaccagccugggcaac

SEQ ID NO: 423822 - RNA, 32 nt, Human
gagcccaagaguuuuagaccagccugggcaac

SEQ ID NO: 423823 - RNA, 32 nt, Human
gagcccaagauauccuuccugaggcagagauu

SEQ ID NO: 423824 - RNA, 20 nt, Human
gagcccaagcaaagccauca

SEQ ID NO: 423825 - RNA, 19 nt, Human
gagcccaagcagcacucag

SEQ ID NO: 423826 - RNA, 32 nt, Human
gagcccaagcagcacucaggagaggggagaaa

SEQ ID NO: 423827 - RNA, 21 nt, Human
gagcccaagccaagcaucgca

SEQ ID NO: 423828 - RNA, 22 nt, Human
gagcccaagccaagccaucgca

SEQ ID NO: 423829 - RNA, 22 nt, Human
gagcccaagccccuccccucca

SEQ ID NO: 423830 - RNA, 18 nt, Human
gagcccaagccgcagcaa

SEQ ID NO: 423831 - RNA, 32 nt, Human
gagcccaagccgcggucccgggccggcaccca

SEQ ID NO: 423832 - RNA, 19 nt, Human
gagcccaagcgucccucag

SEQ ID NO: 423833 - RNA, 32 nt, Human
gagcccaagguggguggaucaccugagguaag

SEQ ID NO: 423834 - RNA, 32 nt, Human
gagcccaagucccguuuccccaaaaauccccc

SEQ ID NO: 423835 - RNA, 16 nt, Human
gagcccaagugccauc

SEQ ID NO: 423836 - RNA, 32 nt, Human
gagcccaaugacacuucugccuaggcucgcgc

SEQ ID NO: 423837 - RNA, 32 nt, Human
gagcccacaccaucuggcccaggcuggccccc

SEQ ID NO: 423838 - RNA, 32 nt, Human
gagcccacagcugacuucauggugcuacaaua

SEQ ID NO: 423839 - RNA, 32 nt, Human
gagcccacagcugugggaggggcugcuacugc

SEQ ID NO: 423840 - RNA, 32 nt, Human
gagcccacagcuuccaagcaggaaaagggacc

SEQ ID NO: 423841 - RNA, 30 nt, Human
gagcccacagcuugccaagaaagaccccaa

SEQ ID NO: 423842 - RNA, 32 nt, Human
gagcccaccagccuggcauccauguugacauc

SEQ ID NO: 423843 - RNA, 32 nt, Human
gagcccaccagcugccagacauccuaugugga

SEQ ID NO: 423844 - RNA, 32 nt, Human
gagcccacgagauggaaguugcagugaacuga

SEQ ID NO: 423845 - RNA, 32 nt, Human
gagcccacgaggauggucacaugccaugugca

SEQ ID NO: 423846 - RNA, 32 nt, Human
gagcccacgaguucaaggcugcagugagucgu

SEQ ID NO: 423847 - RNA, 18 nt, Human
gagcccacggcuguccuc

SEQ ID NO: 423848 - RNA, 22 nt, Human
gagcccacgucgccugucaccc

SEQ ID NO: 423849 - RNA, 32 nt, Human
gagcccacucaaaggggagacagaggcagugc

SEQ ID NO: 423850 - RNA, 32 nt, Human
gagcccacugaggggccagggaggaaggaggc

SEQ ID NO: 423851 - RNA, 32 nt, Human
gagcccacuucuauguggagaggggagcaccc

SEQ ID NO: 423852 - RNA, 18 nt, Human
gagcccagaacauucccc

SEQ ID NO: 423853 - RNA, 32 nt, Human
gagcccagaagcucaaggcugcagugagccaa

SEQ ID NO: 423854 - RNA, 32 nt, Human
gagcccagaagcuggaaguugcaaugaacuau

SEQ ID NO: 423855 - RNA, 32 nt, Human
gagcccagaagcuugaagcugcagugagcuag

SEQ ID NO: 423856 - RNA, 32 nt, Human
gagcccagaagguugaagcugcagugaguugu

SEQ ID NO: 423857 - RNA, 32 nt, Human
gagcccagaaguucaagggugcagugagcuau

SEQ ID NO: 423858 - RNA, 32 nt, Human
gagcccagaaguucgaggccagccuggccaac

SEQ ID NO: 423859 - RNA, 32 nt, Human
gagcccagaaguucgagguugcagugagccau

SEQ ID NO: 423860 - RNA, 32 nt, Human
gagcccagaaguuugagaccagccuaggcaac

SEQ ID NO: 423861 - RNA, 32 nt, Human
gagcccagaaguuugagaccagccugugcaac

SEQ ID NO: 423862 - RNA, 32 nt, Human
gagcccagaaguuugagacugcagugagccau

SEQ ID NO: 423863 - RNA, 32 nt, Human
gagcccagaaguuugaggccagccugggaaau

SEQ ID NO: 423864 - RNA, 32 nt, Human
gagcccagaaguuugaggcugcaaugagccgu

SEQ ID NO: 423865 - RNA, 32 nt, Human
gagcccagacacaccuggguccccauucuggg

SEQ ID NO: 423866 - RNA, 19 nt, Human
gagcccagacacgucuccu

SEQ ID NO: 423867 - RNA, 21 nt, Human
gagcccagacccugcucuccu

SEQ ID NO: 423868 - RNA, 23 nt, Human
gagcccagaccuccccucuuccu

SEQ ID NO: 423869 - RNA, 19 nt, Human
gagcccagacgaccccucu

SEQ ID NO: 423870 - RNA, 32 nt, Human
gagcccagagccgagagcaggagucggcucug

SEQ ID NO: 423871 - RNA, 32 nt, Human
gagcccagagccuccugccacacacaugcaca

SEQ ID NO: 423872 - RNA, 32 nt, Human
gagcccagaggcggagguugcagugagccgag

SEQ ID NO: 423873 - RNA, 32 nt, Human
gagcccagagguagaggcugcagugagccaug

SEQ ID NO: 423874 - RNA, 32 nt, Human
gagcccagauagccccacugcacuccagccug

SEQ ID NO: 423875 - RNA, 20 nt, Human
gagcccagaucacccauucc

SEQ ID NO: 423876 - RNA, 24 nt, Human
gagcccagaucgcaccacugcacu

SEQ ID NO: 423877 - RNA, 32 nt, Human
gagcccagaucgcaccacugcacuccagucug

SEQ ID NO: 423878 - RNA, 24 nt, Human
gagcccagaucgcgacacugcacu

SEQ ID NO: 423879 - RNA, 24 nt, Human
gagcccagaucgcgccauugcacu

SEQ ID NO: 423880 - RNA, 18 nt, Human
gagcccagaucuauuccc

SEQ ID NO: 423881 - RNA, 18 nt, Human
gagcccagaucugccccc

SEQ ID NO: 423882 - RNA, 24 nt, Human
gagcccagauggcgccacugcacu

SEQ ID NO: 423883 - RNA, 32 nt, Human
gagcccagauggcgccacugcacuccagccug

SEQ ID NO: 423884 - RNA, 32 nt, Human
gagcccagauugcaccacuacacuccagccug

SEQ ID NO: 423885 - RNA, 24 nt, Human
gagcccagauugcaccacugcacu

SEQ ID NO: 423886 - RNA, 19 nt, Human
gagcccagauuucuucccc

SEQ ID NO: 423887 - RNA, 18 nt, Human
gagcccagcacugacccc

SEQ ID NO: 423888 - RNA, 20 nt, Human
gagcccagcacuuacucccc

SEQ ID NO: 423889 - RNA, 32 nt, Human
gagcccagcaggcagagguugcagugagcuga

SEQ ID NO: 423890 - RNA, 32 nt, Human
gagcccagcaguucaagaccagccugggcaac

SEQ ID NO: 423891 - RNA, 32 nt, Human
gagcccagcaguucgagaccagccuggacaac

SEQ ID NO: 423892 - RNA, 32 nt, Human
gagcccagcaguuggaggcugcagugagcuau

SEQ ID NO: 423893 - RNA, 19 nt, Human
gagcccagccacccucccc

SEQ ID NO: 423894 - RNA, 20 nt, Human
gagcccagcccccacccccc

SEQ ID NO: 423895 - RNA, 19 nt, Human
gagcccagccgcccgcccc

SEQ ID NO: 423896 - RNA, 21 nt, Human
gagcccagccgcccguccccu

SEQ ID NO: 423897 - RNA, 32 nt, Human
gagcccagccucucccugccaaagcccaacuc

SEQ ID NO: 423898 - RNA, 20 nt, Human
gagcccagccugggggccag

SEQ ID NO: 423899 - RNA, 16 nt, Human
gagcccagccugugcc

SEQ ID NO: 423900 - RNA, 25 nt, Human
gagcccagcgcccuccucuucuccu

SEQ ID NO: 423901 - RNA, 32 nt, Human
gagcccagcgcuggcccugccuccgccugccc

SEQ ID NO: 423902 - RNA, 32 nt, Human
gagcccagcggucccgaggaaaacuugggcaa

SEQ ID NO: 423903 - RNA, 32 nt, Human
gagcccagcugucgguccccagcccugcccgg

SEQ ID NO: 423904 - RNA, 32 nt, Human
gagcccagcugucugcaguggcugacagcagg

SEQ ID NO: 423905 - RNA, 21 nt, Human
gagcccagcuugaccuccccu

SEQ ID NO: 423906 - RNA, 21 nt, Human
gagcccagcuuggcucccccu

SEQ ID NO: 423907 - RNA, 32 nt, Human
gagcccagcuuuagaguccacagggaaagcua

SEQ ID NO: 423908 - RNA, 32 nt, Human
gagcccaggaaauugaggcugcagugagccau

SEQ ID NO: 423909 - RNA, 32 nt, Human
gagcccaggaagcagagauuccagugaguuga

SEQ ID NO: 423910 - RNA, 24 nt, Human
gagcccaggaagcagagguugcag

SEQ ID NO: 423911 - RNA, 32 nt, Human
gagcccaggaagcagagguugcagugagccuc

SEQ ID NO: 423912 - RNA, 32 nt, Human
gagcccaggaagcaucccauaaccaaccuuca

SEQ ID NO: 423913 - RNA, 18 nt, Human
gagcccaggaagccccuc

SEQ ID NO: 423914 - RNA, 32 nt, Human
gagcccaggaagcggagguuacagugagcuga

SEQ ID NO: 423915 - RNA, 23 nt, Human
gagcccaggaagcggagguugca

SEQ ID NO: 423916 - RNA, 32 nt, Human
gagcccaggaagcggagguugcaaugagccga

SEQ ID NO: 423917 - RNA, 22 nt, Human
gagcccaggaagcucagccccu

SEQ ID NO: 423918 - RNA, 32 nt, Human
gagcccaggaagucaaggcugcagugagcugu

SEQ ID NO: 423919 - RNA, 22 nt, Human
gagcccaggaagugcguccccu

SEQ ID NO: 423920 - RNA, 32 nt, Human
gagcccaggaaguggaggcugcagugaccuau

SEQ ID NO: 423921 - RNA, 24 nt, Human
gagcccaggaaguggagguugcag

SEQ ID NO: 423922 - RNA, 32 nt, Human
gagcccaggaaguggagguugcagugagcaga

SEQ ID NO: 423923 - RNA, 32 nt, Human
gagcccaggaaguugaggcugcagugagcugu

SEQ ID NO: 423924 - RNA, 32 nt, Human
gagcccaggaauucaaggcugcagugaacuau

SEQ ID NO: 423925 - RNA, 32 nt, Human
gagcccaggaauucgagaccagccugggcaac

SEQ ID NO: 423926 - RNA, 32 nt, Human
gagcccaggaauucgagaccagccugggccac

SEQ ID NO: 423927 - RNA, 32 nt, Human
gagcccaggaauuggaaagcagccuggccaac

SEQ ID NO: 423928 - RNA, 32 nt, Human
gagcccaggaauuggaggcugcagugagcuau

SEQ ID NO: 423929 - RNA, 32 nt, Human
gagcccaggaauuugagaccagccuggacaac

SEQ ID NO: 423930 - RNA, 32 nt, Human
gagcccaggaauuugagaccagccugggcaac

SEQ ID NO: 423931 - RNA, 32 nt, Human
gagcccaggaauuugaggcugcagugagcuau

SEQ ID NO: 423932 - RNA, 21 nt, Human
gagcccaggacacuugucccu

SEQ ID NO: 423933 - RNA, 25 nt, Human
gagcccaggaccccaccacugcacu

SEQ ID NO: 423934 - RNA, 32 nt, Human
gagcccaggacucuaaggcugcagugagcuau

SEQ ID NO: 423935 - RNA, 32 nt, Human
gagcccaggacugagggcuccucccgggcgcu

SEQ ID NO: 423936 - RNA, 32 nt, Human
gagcccaggagaugcaggcuugcagugagcca

SEQ ID NO: 423937 - RNA, 24 nt, Human
gagcccaggagauggagguugcag

SEQ ID NO: 423938 - RNA, 32 nt, Human
gagcccaggagauugaggcugcagugagcaug

SEQ ID NO: 423939 - RNA, 32 nt, Human
gagcccaggagauugaggcugcagugagccau

SEQ ID NO: 423940 - RNA, 32 nt, Human
gagcccaggagcucaagauugcagugagcuau

SEQ ID NO: 423941 - RNA, 22 nt, Human
gagcccaggagcugagucaccu

SEQ ID NO: 423942 - RNA, 32 nt, Human
gagcccaggagcuggagaucagccugggcaac

SEQ ID NO: 423943 - RNA, 32 nt, Human
gagcccaggagcuggaggcugcagugaacuau

SEQ ID NO: 423944 - RNA, 32 nt, Human
gagcccaggaggaggaggcugcagugagcuaa

SEQ ID NO: 423945 - RNA, 32 nt, Human
gagcccaggaggcacaggcugcagugagcaga

SEQ ID NO: 423946 - RNA, 32 nt, Human
gagcccaggaggcagaauuugcagugagcuga

SEQ ID NO: 423947 - RNA, 24 nt, Human
gagcccaggaggcagaggcugcag

SEQ ID NO: 423948 - RNA, 32 nt, Human
gagcccaggaggcagaggcugcagugagccau

SEQ ID NO: 423949 - RNA, 32 nt, Human
gagcccaggaggcagaggcugcagugagccga

SEQ ID NO: 423950 - RNA, 24 nt, Human
gagcccaggaggcagagguugcag

SEQ ID NO: 423951 - RNA, 32 nt, Human
gagcccaggaggcagagguugcaguaagccga

SEQ ID NO: 423952 - RNA, 32 nt, Human
gagcccaggaggcagagguugcagugagccaa

SEQ ID NO: 423953 - RNA, 32 nt, Human
gagcccaggaggccaagguugcagugggccca

SEQ ID NO: 423954 - RNA, 32 nt, Human
gagcccaggaggcggagauugcagugagccga

SEQ ID NO: 423955 - RNA, 32 nt, Human
gagcccaggaggcggagcuugcagugagucga

SEQ ID NO: 423956 - RNA, 32 nt, Human
gagcccaggaggcggaggcugcagugagcuga

SEQ ID NO: 423957 - RNA, 24 nt, Human
gagcccaggaggcggagguugcag

SEQ ID NO: 423958 - RNA, 32 nt, Human
gagcccaggaggcggagguugcagugagcuga

SEQ ID NO: 423959 - RNA, 32 nt, Human
gagcccaggaggcugaggcugcaaugacugau

SEQ ID NO: 423960 - RNA, 32 nt, Human
gagcccaggaggucaagacugcagugagcuau

SEQ ID NO: 423961 - RNA, 32 nt, Human
gagcccaggaggucaaggcuacagugagccgu

SEQ ID NO: 423962 - RNA, 32 nt, Human
gagcccaggaggucaaggcugaagugagcugu

SEQ ID NO: 423963 - RNA, 32 nt, Human
gagcccaggaggucaaggcugcagugagccgu

SEQ ID NO: 423964 - RNA, 32 nt, Human
gagcccaggaggucaaggcugcagugagcugc

SEQ ID NO: 423965 - RNA, 32 nt, Human
gagcccaggaggucaaggcugcagugagcugu

SEQ ID NO: 423966 - RNA, 32 nt, Human
gagcccaggaggucaaggcugcagugagcuuu

SEQ ID NO: 423967 - RNA, 32 nt, Human
gagcccaggaggucaaggguacagugagccga

SEQ ID NO: 423968 - RNA, 32 nt, Human
gagcccaggaggucagggcugcagugagccga

SEQ ID NO: 423969 - RNA, 32 nt, Human
gagcccaggaggucgaagcugcagugagguau

SEQ ID NO: 423970 - RNA, 18 nt, Human
gagcccaggaggucgagg

SEQ ID NO: 423971 - RNA, 32 nt, Human
gagcccaggaggucgaggcugcagugagccau

SEQ ID NO: 423972 - RNA, 32 nt, Human
gagcccaggaggucgaggcugcagugagcccu

SEQ ID NO: 423973 - RNA, 32 nt, Human
gagcccaggaggucgaggcugcagugagcuau

SEQ ID NO: 423974 - RNA, 32 nt, Human
gagcccaggaggucgaggcugcagugagcugu

SEQ ID NO: 423975 - RNA, 32 nt, Human
gagcccaggaggucgaggcugcagugggccau

SEQ ID NO: 423976 - RNA, 32 nt, Human
gagcccaggaggucgaggcugcagugugcugu

SEQ ID NO: 423977 - RNA, 32 nt, Human
gagcccaggaggucgagguugcagugagcagu

SEQ ID NO: 423978 - RNA, 32 nt, Human
gagcccaggaggucuaggcugcagugagcuua

SEQ ID NO: 423979 - RNA, 24 nt, Human
gagcccaggagguggaaacugcag

SEQ ID NO: 423980 - RNA, 32 nt, Human
gagcccaggagguggaaacugcagagagucau

SEQ ID NO: 423981 - RNA, 23 nt, Human
gagcccaggagguggaggcugca

SEQ ID NO: 423982 - RNA, 32 nt, Human
gagcccaggagguggaggcugcaaugagcuga

SEQ ID NO: 423983 - RNA, 24 nt, Human
gagcccaggagguggaggcugcag

SEQ ID NO: 423984 - RNA, 32 nt, Human
gagcccaggagguggaggcugcagugagccau

SEQ ID NO: 423985 - RNA, 32 nt, Human
gagcccaggagguggagguugcaaugagccga

SEQ ID NO: 423986 - RNA, 32 nt, Human
gagcccaggagguggagguugcacugagcgga

SEQ ID NO: 423987 - RNA, 24 nt, Human
gagcccaggagguggagguugcag

SEQ ID NO: 423988 - RNA, 32 nt, Human
gagcccaggagguggagguugcagugagcaga

SEQ ID NO: 423989 - RNA, 32 nt, Human
gagcccaggagguggagguugcagugagccaa

SEQ ID NO: 423990 - RNA, 32 nt, Human
gagcccaggagguggagguugcagugagccau

SEQ ID NO: 423991 - RNA, 32 nt, Human
gagcccaggagguggagguugcagugagccga

SEQ ID NO: 423992 - RNA, 32 nt, Human
gagcccaggagguggagguugcagugagcgga

SEQ ID NO: 423993 - RNA, 32 nt, Human
gagcccaggagguggagguugcagugagcuga

SEQ ID NO: 423994 - RNA, 32 nt, Human
gagcccaggagguggagguuucagcgagcuga

SEQ ID NO: 423995 - RNA, 32 nt, Human
gagcccaggagguugagaaugcagugagcuug

SEQ ID NO: 423996 - RNA, 18 nt, Human
gagcccaggagguugagg

SEQ ID NO: 423997 - RNA, 32 nt, Human
gagcccaggagguugaggcugcagugaacuaa

SEQ ID NO: 423998 - RNA, 32 nt, Human
gagcccaggagguugaggcugcagugagcaga

SEQ ID NO: 423999 - RNA, 32 nt, Human
gagcccaggagguugaggcugcagugagccau

SEQ ID NO: 424000 - RNA, 32 nt, Human
gagcccaggagguugaggcugcagugagcuau

SEQ ID NO: 424001 - RNA, 32 nt, Human
gagcccaggagguugaggcugcagugagguau

SEQ ID NO: 424002 - RNA, 32 nt, Human
gagcccaggagguugaggcugcagugaggugu

SEQ ID NO: 424003 - RNA, 32 nt, Human
gagcccaggagguugaggcugcagugaguucu

SEQ ID NO: 424004 - RNA, 32 nt, Human
gagcccaggagguugaggucacagugagcugu

SEQ ID NO: 424005 - RNA, 32 nt, Human
gagcccaggagguuguggcugcagugagcugu

SEQ ID NO: 424006 - RNA, 32 nt, Human
gagcccaggagucuaggaccagccuggacaac

SEQ ID NO: 424007 - RNA, 32 nt, Human
gagcccaggagucugagaccagccuggccaac

SEQ ID NO: 424008 - RNA, 32 nt, Human
gagcccaggagucugagaccagccugggcaac

SEQ ID NO: 424009 - RNA, 32 nt, Human
gagcccaggagugcaaggcugcaaugagccag

SEQ ID NO: 424010 - RNA, 32 nt, Human
gagcccaggaguuagagaccagccugggcaac

SEQ ID NO: 424011 - RNA, 32 nt, Human
gagcccaggaguucaaaaccagccugggcaau

SEQ ID NO: 424012 - RNA, 32 nt, Human
gagcccaggaguucaaagcugcagugagucau

SEQ ID NO: 424013 - RNA, 32 nt, Human
gagcccaggaguucaagaacagccuggguaac

SEQ ID NO: 424014 - RNA, 32 nt, Human
gagcccaggaguucaagaccagccuggacaac

SEQ ID NO: 424015 - RNA, 32 nt, Human
gagcccaggaguucaagaccagccuggacagc

SEQ ID NO: 424016 - RNA, 32 nt, Human
gagcccaggaguucaagaccagccugggaaca

SEQ ID NO: 424017 - RNA, 32 nt, Human
gagcccaggaguucaagaccagccugggcaac

SEQ ID NO: 424018 - RNA, 32 nt, Human
gagcccaggaguucaagaccagccugggcaau

SEQ ID NO: 424019 - RNA, 32 nt, Human
gagcccaggaguucaagaccagccugggcuac

SEQ ID NO: 424020 - RNA, 24 nt, Human
gagcccaggaguucaagaccagcu

SEQ ID NO: 424021 - RNA, 32 nt, Human
gagcccaggaguucaagagcagccugggcaau

SEQ ID NO: 424022 - RNA, 32 nt, Human
gagcccaggaguucaaggccagccugggcaac

SEQ ID NO: 424023 - RNA, 32 nt, Human
gagcccaggaguucaaggcugcaaugagcugu

SEQ ID NO: 424024 - RNA, 32 nt, Human
gagcccaggaguucagaaucagccugggcaac

SEQ ID NO: 424025 - RNA, 24 nt, Human
gagcccaggaguucagggccagcu

SEQ ID NO: 424026 - RNA, 32 nt, Human
gagcccaggaguucagggcugcagugagccuu

SEQ ID NO: 424027 - RNA, 32 nt, Human
gagcccaggaguucagggcugcagugagguac

SEQ ID NO: 424028 - RNA, 23 nt, Human
gagcccaggaguuccagaccagc

SEQ ID NO: 424029 - RNA, 32 nt, Human
gagcccaggaguuccagaccagccugggcaau

SEQ ID NO: 424030 - RNA, 23 nt, Human
gagcccaggaguuccagaccagu

SEQ ID NO: 424031 - RNA, 32 nt, Human
gagcccaggaguucgacaccagccuggccaac

SEQ ID NO: 424032 - RNA, 32 nt, Human
gagcccaggaguucgagaccagccuggacaac

SEQ ID NO: 424033 - RNA, 32 nt, Human
gagcccaggaguucgagaccagccugggcaac

SEQ ID NO: 424034 - RNA, 24 nt, Human
gagcccaggaguucgagaccagcu

SEQ ID NO: 424035 - RNA, 32 nt, Human
gagcccaggaguucgaggcugcaaugagcuag

SEQ ID NO: 424036 - RNA, 32 nt, Human
gagcccaggaguucgaggcugcagugagcuau

SEQ ID NO: 424037 - RNA, 32 nt, Human
gagcccaggaguucgauaccagccugggcaac

SEQ ID NO: 424038 - RNA, 32 nt, Human
gagcccaggaguucgggaccagccugggaaau

SEQ ID NO: 424039 - RNA, 32 nt, Human
gagcccaggaguugaagaccagccugggcaac

SEQ ID NO: 424040 - RNA, 32 nt, Human
gagcccaggaguuggagaccagccuggauaac

SEQ ID NO: 424041 - RNA, 32 nt, Human
gagcccaggaguuggaggccagccugggcaac

SEQ ID NO: 424042 - RNA, 32 nt, Human
gagcccaggaguuggaggcugaagagagcuau

SEQ ID NO: 424043 - RNA, 32 nt, Human
gagcccaggaguuuaagaccagccugggcaac

SEQ ID NO: 424044 - RNA, 32 nt, Human
gagcccaggaguuuaaggcugcagugagcuug

SEQ ID NO: 424045 - RNA, 32 nt, Human
gagcccaggaguuugaaaccagccugggcaac

SEQ ID NO: 424046 - RNA, 32 nt, Human
gagcccaggaguuugaaaccagccuggguaac

SEQ ID NO: 424047 - RNA, 32 nt, Human
gagcccaggaguuugaagcugcagugagcuau

SEQ ID NO: 424048 - RNA, 32 nt, Human
gagcccaggaguuugaauccauccugggcagc

SEQ ID NO: 424049 - RNA, 32 nt, Human
gagcccaggaguuugacaccagccugggcaac

SEQ ID NO: 424050 - RNA, 32 nt, Human
gagcccaggaguuugagaccagccuggacaac

SEQ ID NO: 424051 - RNA, 32 nt, Human
gagcccaggaguuugagaccagccuggccaac

SEQ ID NO: 424052 - RNA, 32 nt, Human
gagcccaggaguuugagaccagccugggcaaa

SEQ ID NO: 424053 - RNA, 32 nt, Human
gagcccaggaguuugagaccagccugggcaac

SEQ ID NO: 424054 - RNA, 32 nt, Human
gagcccaggaguuugagaccagccugggcaau

SEQ ID NO: 424055 - RNA, 32 nt, Human
gagcccaggaguuugagaccagccuggguaac

SEQ ID NO: 424056 - RNA, 24 nt, Human
gagcccaggaguuugagaccagcu

SEQ ID NO: 424057 - RNA, 32 nt, Human
gagcccaggaguuugagaucagccuggucaac

SEQ ID NO: 424058 - RNA, 32 nt, Human
gagcccaggaguuugaggaugcagugagcuau

SEQ ID NO: 424059 - RNA, 32 nt, Human
gagcccaggaguuugaggccagccugggcaac

SEQ ID NO: 424060 - RNA, 32 nt, Human
gagcccaggaguuugaggcugcagugaacuau

SEQ ID NO: 424061 - RNA, 32 nt, Human
gagcccaggaguuugaggcugcagugagccau

SEQ ID NO: 424062 - RNA, 32 nt, Human
gagcccaggaguuugaggcugcagugagcuau

SEQ ID NO: 424063 - RNA, 32 nt, Human
gagcccaggaguuugaggcugcagugagcugu

SEQ ID NO: 424064 - RNA, 32 nt, Human
gagcccaggaguuugaggcugcagugaguuau

SEQ ID NO: 424065 - RNA, 32 nt, Human
gagcccaggaguuugagggcagccugggaaac

SEQ ID NO: 424066 - RNA, 32 nt, Human
gagcccaggaguuugagguugcagugagcuga

SEQ ID NO: 424067 - RNA, 32 nt, Human
gagcccaggaguuugagguugcagugagcugu

SEQ ID NO: 424068 - RNA, 32 nt, Human
gagcccaggaguuugagguugcagugcacuau

SEQ ID NO: 424069 - RNA, 32 nt, Human
gagcccaggaguuugaguccagccuggacgau

SEQ ID NO: 424070 - RNA, 32 nt, Human
gagcccaggaguuugcgaccagccugggcaga

SEQ ID NO: 424071 - RNA, 23 nt, Human
gagcccaggaguuuuagacuagc

SEQ ID NO: 424072 - RNA, 32 nt, Human
gagcccaggaugcagagguugaagugagccaa

SEQ ID NO: 424073 - RNA, 32 nt, Human
gagcccaggcacuaguauuuuccucuugccau

SEQ ID NO: 424074 - RNA, 32 nt, Human
gagcccaggcagcuguguccagugagaggugc

SEQ ID NO: 424075 - RNA, 19 nt, Human
gagcccaggccaggacucu

SEQ ID NO: 424076 - RNA, 19 nt, Human
gagcccaggcccccucccu

SEQ ID NO: 424077 - RNA, 17 nt, Human
gagcccaggcccucccu

SEQ ID NO: 424078 - RNA, 19 nt, Human
gagcccaggcccuggcccu

SEQ ID NO: 424079 - RNA, 20 nt, Human
gagcccaggccgaguucccc

SEQ ID NO: 424080 - RNA, 18 nt, Human
gagcccaggccgggcccu

SEQ ID NO: 424081 - RNA, 20 nt, Human
gagcccaggccugagacccu

SEQ ID NO: 424082 - RNA, 32 nt, Human
gagcccaggccuggcaggcucccagaacuuga

SEQ ID NO: 424083 - RNA, 32 nt, Human
gagcccaggccuguuccuggcagcuguggcug

SEQ ID NO: 424084 - RNA, 19 nt, Human
gagcccaggccuguugccc

SEQ ID NO: 424085 - RNA, 32 nt, Human
gagcccaggcgguugaggcugcagugagccau

SEQ ID NO: 424086 - RNA, 24 nt, Human
gagcccaggcguucgcccuguccc

SEQ ID NO: 424087 - RNA, 32 nt, Human
gagcccaggcuccagcccugagugcuuccgag

SEQ ID NO: 424088 - RNA, 19 nt, Human
gagcccaggcuccgccccu

SEQ ID NO: 424089 - RNA, 32 nt, Human
gagcccaggcuguguggaaacagcugcucuca

SEQ ID NO: 424090 - RNA, 22 nt, Human
gagcccagggaacaccgccccu

SEQ ID NO: 424091 - RNA, 20 nt, Human
gagcccagggacaggucccu

SEQ ID NO: 424092 - RNA, 32 nt, Human
gagcccagggagacuccgcugugggaaaccuc

SEQ ID NO: 424093 - RNA, 32 nt, Human
gagcccagggaggcagagguugcuguaaguug

SEQ ID NO: 424094 - RNA, 23 nt, Human
gagcccagggagucccagaggca

SEQ ID NO: 424095 - RNA, 32 nt, Human
gagcccagggcagaggcagcucagaguggagg

SEQ ID NO: 424096 - RNA, 19 nt, Human
gagcccagggccaaccccu

SEQ ID NO: 424097 - RNA, 20 nt, Human
gagcccagggccacccggag

SEQ ID NO: 424098 - RNA, 18 nt, Human
gagcccagggccugcacc

SEQ ID NO: 424099 - RNA, 32 nt, Human
gagcccagggcgacagaggggcacugguuuac

SEQ ID NO: 424100 - RNA, 32 nt, Human
gagcccagggcuccacggucccuaccuagacc

SEQ ID NO: 424101 - RNA, 18 nt, Human
gagcccaggggguccccu

SEQ ID NO: 424102 - RNA, 32 nt, Human
gagcccagggguucacagcugcagugagcugc

SEQ ID NO: 424103 - RNA, 24 nt, Human
gagcccagggguucuagaccagcu

SEQ ID NO: 424104 - RNA, 32 nt, Human
gagcccagggguuugaggcugcagugagccac

SEQ ID NO: 424105 - RNA, 32 nt, Human
gagcccagggguuugcggcugcagugagcugu

SEQ ID NO: 424106 - RNA, 22 nt, Human
gagcccaggguacccgccuccu

SEQ ID NO: 424107 - RNA, 32 nt, Human
gagcccaggguaggggacagagcugcuggggc

SEQ ID NO: 424108 - RNA, 32 nt, Human
gagcccaggguggcagagcuguggugcagggu

SEQ ID NO: 424109 - RNA, 32 nt, Human
gagcccagguauuaucaugcaggagaccuggg

SEQ ID NO: 424110 - RNA, 32 nt, Human
gagcccagguauucaagaccagccugggaaac

SEQ ID NO: 424111 - RNA, 17 nt, Human
gagcccaggucaccucc

SEQ ID NO: 424112 - RNA, 21 nt, Human
gagcccagguccagcaccccu

SEQ ID NO: 424113 - RNA, 21 nt, Human
gagcccagguccagcguuccc

SEQ ID NO: 424114 - RNA, 23 nt, Human
gagcccaggucugccgacacccu

SEQ ID NO: 424115 - RNA, 18 nt, Human
gagcccaggugagcuccc

SEQ ID NO: 424116 - RNA, 18 nt, Human
gagcccaggugauccccu

SEQ ID NO: 424117 - RNA, 19 nt, Human
gagcccaggugauccuccu

SEQ ID NO: 424118 - RNA, 32 nt, Human
gagcccaguacaacaaaggugacggguggugu

SEQ ID NO: 424119 - RNA, 21 nt, Human
gagcccaguaccugacaucaa

SEQ ID NO: 424120 - RNA, 32 nt, Human
gagcccaguaggucgaggcugcagugagcugu

SEQ ID NO: 424121 - RNA, 20 nt, Human
gagcccagucccacccuccc

SEQ ID NO: 424122 - RNA, 32 nt, Human
gagcccaguccuggaccccaugccugugucag

SEQ ID NO: 424123 - RNA, 32 nt, Human
gagcccagugagcucagcuuuaaggauggagu

SEQ ID NO: 424124 - RNA, 20 nt, Human
gagcccagugucauccgccc

SEQ ID NO: 424125 - RNA, 26 nt, Human
gagcccagugucauccgcccgccacg

SEQ ID NO: 424126 - RNA, 19 nt, Human
gagcccagugugccaccaa

SEQ ID NO: 424127 - RNA, 32 nt, Human
gagcccaguuggggagggagugaggagugguc

SEQ ID NO: 424128 - RNA, 20 nt, Human
gagcccauacaccugucucc

SEQ ID NO: 424129 - RNA, 18 nt, Human
gagcccaucaaauccuga

SEQ ID NO: 424130 - RNA, 32 nt, Human
gagcccaucaccuguaaauccccacacugcag

SEQ ID NO: 424131 - RNA, 32 nt, Human
gagcccauccaggacacuccacacugccagga

SEQ ID NO: 424132 - RNA, 32 nt, Human
gagcccaucucaccugggaugccugcagccag

SEQ ID NO: 424133 - RNA, 22 nt, Human
gagcccaucuguccuuccugcc

SEQ ID NO: 424134 - RNA, 32 nt, Human
gagcccaucuuccauuguccucaacgaguuuc

SEQ ID NO: 424135 - RNA, 32 nt, Human
gagcccaucuuucugccuccauccaaagaggc

SEQ ID NO: 424136 - RNA, 32 nt, Human
gagcccaugagauugaggcugcagugagcugu

SEQ ID NO: 424137 - RNA, 32 nt, Human
gagcccaugaguucaaggcugcagugagucgu

SEQ ID NO: 424138 - RNA, 32 nt, Human
gagcccaugaguuugagaccagccuggguaac

SEQ ID NO: 424139 - RNA, 32 nt, Human
gagcccaugccugccuuccuccuuucaucgcc

SEQ ID NO: 424140 - RNA, 32 nt, Human
gagcccaugcugggacaugccuccuccaaagu

SEQ ID NO: 424141 - RNA, 32 nt, Human
gagcccauggagggggugggaggcucaggcau

SEQ ID NO: 424142 - RNA, 32 nt, Human
gagcccauggcuucaggagagggucucucucc

SEQ ID NO: 424143 - RNA, 32 nt, Human
gagcccauuaaaaagugaggcagccacauggc

SEQ ID NO: 424144 - RNA, 31 nt, Human
gagcccauugcuauggaaaccaaagcguuag

SEQ ID NO: 424145 - RNA, 31 nt, Human
gagcccauuggcagggguaccaaagugaucc

SEQ ID NO: 424146 - RNA, 32 nt, Human
gagccccacauucuagccaacuugagggaagg

SEQ ID NO: 424147 - RNA, 32 nt, Human
gagccccacccccgccagaccuggugaagagg

SEQ ID NO: 424148 - RNA, 32 nt, Human
gagccccaccuucugcuacuauuauguucuuc

SEQ ID NO: 424149 - RNA, 32 nt, Human
gagccccacggacaugcagggccccgcagccu

SEQ ID NO: 424150 - RNA, 32 nt, Human
gagccccacugcuuccagccucuggugccaac

SEQ ID NO: 424151 - RNA, 32 nt, Human
gagccccacuucuuccuugacagugggguccu

SEQ ID NO: 424152 - RNA, 32 nt, Human
gagccccagagaaucaugccacccucaaagcc

SEQ ID NO: 424153 - RNA, 32 nt, Human
gagccccagaggcagagguuguggugagccga

SEQ ID NO: 424154 - RNA, 24 nt, Human
gagccccagaggucaaggcugcag

SEQ ID NO: 424155 - RNA, 32 nt, Human
gagccccagaggucaaggcugcagugagcugu

SEQ ID NO: 424156 - RNA, 32 nt, Human
gagccccagaguucaagaccagccugggcaau

SEQ ID NO: 424157 - RNA, 22 nt, Human
gagccccagcgucuccugccca

SEQ ID NO: 424158 - RNA, 32 nt, Human
gagccccagcuggggguggaagcugagccaga

SEQ ID NO: 424159 - RNA, 32 nt, Human
gagccccagcuggggguggaagcugagccagg

SEQ ID NO: 424160 - RNA, 32 nt, Human
gagccccaggaaggcagcauucauaagccccu

SEQ ID NO: 424161 - RNA, 18 nt, Human
gagccccaggacuggcug

SEQ ID NO: 424162 - RNA, 32 nt, Human
gagccccaggagacaucggcuagagugaccau

SEQ ID NO: 424163 - RNA, 22 nt, Human
gagccccaggccagaacccccu

SEQ ID NO: 424164 - RNA, 32 nt, Human
gagccccaggccucgggauaccacagagaaac

SEQ ID NO: 424165 - RNA, 23 nt, Human
gagccccagggguggaggcugca

SEQ ID NO: 424166 - RNA, 32 nt, Human
gagccccagggguggaggcugcaaugaacugu

SEQ ID NO: 424167 - RNA, 32 nt, Human
gagccccaguucaaggcccaggaacaaagggg

SEQ ID NO: 424168 - RNA, 32 nt, Human
gagccccaucuaggcugacagagcagggcugu

SEQ ID NO: 424169 - RNA, 18 nt, Human
gagccccaugcuuggccu

SEQ ID NO: 424170 - RNA, 26 nt, Human
gagccccauucacccccaccugccca

SEQ ID NO: 424171 - RNA, 32 nt, Human
gagccccauucccagcucuucucccugcugac

SEQ ID NO: 424172 - RNA, 32 nt, Human
gagcccccaccaggaaccaaauuggcuggcac

SEQ ID NO: 424173 - RNA, 32 nt, Human
gagcccccaccaggcagggcaaggagacuccg

SEQ ID NO: 424174 - RNA, 32 nt, Human
gagcccccaccuucaagucucuccagugugug

SEQ ID NO: 424175 - RNA, 22 nt, Human
gagcccccaccuucccugccca

SEQ ID NO: 424176 - RNA, 32 nt, Human
gagcccccagaacuucagaacuguguggaggc

SEQ ID NO: 424177 - RNA, 32 nt, Human
gagcccccagcacuuguguguacagcccccgu

SEQ ID NO: 424178 - RNA, 32 nt, Human
gagcccccagcagggcccuccgagguggaaca

SEQ ID NO: 424179 - RNA, 32 nt, Human
gagcccccagcagggcccuccgagguggagca

SEQ ID NO: 424180 - RNA, 19 nt, Human
gagcccccagccccaugca

SEQ ID NO: 424181 - RNA, 17 nt, Human
gagcccccagcccccag

SEQ ID NO: 424182 - RNA, 18 nt, Human
gagcccccagcccuggga

SEQ ID NO: 424183 - RNA, 32 nt, Human
gagcccccaggccgcagguggagggugauaaa

SEQ ID NO: 424184 - RNA, 32 nt, Human
gagcccccaggccucauggcgcagaaaccucu

SEQ ID NO: 424185 - RNA, 32 nt, Human
gagcccccaguucucuguccccuagcacuaga

SEQ ID NO: 424186 - RNA, 24 nt, Human
gagcccccauccugccccugccca

SEQ ID NO: 424187 - RNA, 32 nt, Human
gagcccccaugcuggggcuacuaaugaggaac

SEQ ID NO: 424188 - RNA, 20 nt, Human
gagcccccauuccaccacag

SEQ ID NO: 424189 - RNA, 21 nt, Human
gagccccccaacccugucccc

SEQ ID NO: 424190 - RNA, 18 nt, Human
gagccccccgacccggca

SEQ ID NO: 424191 - RNA, 25 nt, Human
gagcccccgccccucccccuacaga

SEQ ID NO: 424192 - RNA, 32 nt, Human
gagcccccuagauggugggggaauggcaaacu

SEQ ID NO: 424193 - RNA, 32 nt, Human
gagcccccucgaggaaccuggucuccgcaucc

SEQ ID NO: 424194 - RNA, 32 nt, Human
gagcccccucucagccuuaccugggccccucc

SEQ ID NO: 424195 - RNA, 32 nt, Human
gagcccccugacugguccagaacacucgagga

SEQ ID NO: 424196 - RNA, 32 nt, Human
gagcccccugacugguccagaacacuggagga

SEQ ID NO: 424197 - RNA, 32 nt, Human
gagcccccugcuccagccacaucuggacccau

SEQ ID NO: 424198 - RNA, 32 nt, Human
gagcccccugcucugcugcucugccuguccgc

SEQ ID NO: 424199 - RNA, 32 nt, Human
gagcccccugcuuccuggccuaggcgaggguu

SEQ ID NO: 424200 - RNA, 32 nt, Human
gagcccccuggggcugcuggagcugcugccuc

SEQ ID NO: 424201 - RNA, 32 nt, Human
gagcccccuuaaccuggagguggaccccaaua

SEQ ID NO: 424202 - RNA, 32 nt, Human
gagcccccuuuucagggaccccagucgcugga

SEQ ID NO: 424203 - RNA, 32 nt, Human
gagccccgccccucaggcccagccucuggcaa

SEQ ID NO: 424204 - RNA, 23 nt, Human
gagccccgcccucccaggcacag

SEQ ID NO: 424205 - RNA, 21 nt, Human
gagccccgcucagcgcgggga

SEQ ID NO: 424206 - RNA, 20 nt, Human
gagccccgcucggccuuggg

SEQ ID NO: 424207 - RNA, 32 nt, Human
gagccccggagggucuggaggagccaggaggg

SEQ ID NO: 424208 - RNA, 32 nt, Human
gagccccggaggucgaggcugcagugggcuau

SEQ ID NO: 424209 - RNA, 32 nt, Human
gagccccggccuggcccggcccccgcgugccu

SEQ ID NO: 424210 - RNA, 32 nt, Human
gagccccgggccggcccugccaaccgccucgc

SEQ ID NO: 424211 - RNA, 32 nt, Human
gagccccgggcgcggcaagaggcggcgggagc

SEQ ID NO: 424212 - RNA, 32 nt, Human
gagccccgggggcugagguugcugugagccga

SEQ ID NO: 424213 - RNA, 32 nt, Human
gagccccggugugucccaggagucggagaagc

SEQ ID NO: 424214 - RNA, 21 nt, Human
gagccccgugcugugcgggaa

SEQ ID NO: 424215 - RNA, 19 nt, Human
gagccccuaaucuaugcua

SEQ ID NO: 424216 - RNA, 32 nt, Human
gagccccuagcucuucucuagccuggggccuu

SEQ ID NO: 424217 - RNA, 32 nt, Human
gagccccucagaccugcacucugggugucucc

SEQ ID NO: 424218 - RNA, 32 nt, Human
gagccccucauccuuccucugggaccagaugu

SEQ ID NO: 424219 - RNA, 32 nt, Human
gagccccucauuugugcccagcauuuugugug

SEQ ID NO: 424220 - RNA, 32 nt, Human
gagccccuccagccucuccaagucgcugugaa

SEQ ID NO: 424221 - RNA, 32 nt, Human
gagccccuccucccaguauucccauccccgca

SEQ ID NO: 424222 - RNA, 19 nt, Human
gagccccucgcccuuggca

SEQ ID NO: 424223 - RNA, 32 nt, Human
gagccccucggcggcgccaccauguacucggg

SEQ ID NO: 424224 - RNA, 32 nt, Human
gagccccucuccugccuggccuggggacauga

SEQ ID NO: 424225 - RNA, 24 nt, Human
gagccccugaccgucccccacagg

SEQ ID NO: 424226 - RNA, 32 nt, Human
gagccccugagcgcggaucugcagugacccac

SEQ ID NO: 424227 - RNA, 32 nt, Human
gagccccugcaaggagcgaaccggucagcacc

SEQ ID NO: 424228 - RNA, 32 nt, Human
gagccccugcacuccauccugcugaccaugug

SEQ ID NO: 424229 - RNA, 32 nt, Human
gagccccugcccacugcacucuuugguucucu

SEQ ID NO: 424230 - RNA, 32 nt, Human
gagccccugccugggggagcuggcggaaugcg

SEQ ID NO: 424231 - RNA, 32 nt, Human
gagccccugcggguuugaggccuuguuuuuag

SEQ ID NO: 424232 - RNA, 32 nt, Human
gagccccuggguguucaggaggcugccccggg

SEQ ID NO: 424233 - RNA, 32 nt, Human
gagccccugguguggaaagaggccccaaggua

SEQ ID NO: 424234 - RNA, 32 nt, Human
gagccccuguaaucccagcuacuugggaggcu

SEQ ID NO: 424235 - RNA, 23 nt, Human
gagccccuguccuccccucuguc

SEQ ID NO: 424236 - RNA, 27 nt, Human
gagccccugucucgggcuccccaccga

SEQ ID NO: 424237 - RNA, 32 nt, Human
gagccccuucacuuaccugucucuccacaagu

SEQ ID NO: 424238 - RNA, 32 nt, Human
gagccccuuccagggacagcacuggagcuaga

SEQ ID NO: 424239 - RNA, 32 nt, Human
gagccccuuugccccaacacacucuucgucug

SEQ ID NO: 424240 - RNA, 32 nt, Human
gagcccgaagggagagacugagacugacuccc

SEQ ID NO: 424241 - RNA, 32 nt, Human
gagcccgagagacagagguugcagugagccga

SEQ ID NO: 424242 - RNA, 32 nt, Human
gagcccgagagguggaggcuggagugaacaga

SEQ ID NO: 424243 - RNA, 32 nt, Human
gagcccgagagguggagguugcagugagccga

SEQ ID NO: 424244 - RNA, 32 nt, Human
gagcccgagccgcgggacaccgucgcuccugc

SEQ ID NO: 424245 - RNA, 32 nt, Human
gagcccgcaaguuugagaccacccugggcaac

SEQ ID NO: 424246 - RNA, 32 nt, Human
gagcccgcaccaggagaggccagggaggguuc

SEQ ID NO: 424247 - RNA, 23 nt, Human
gagcccgcccgcuccccuccccu

SEQ ID NO: 424248 - RNA, 32 nt, Human
gagcccgcccuuccuucgcccgcuacaccacu

SEQ ID NO: 424249 - RNA, 32 nt, Human
gagcccgcgagccuggccagcgaggguagccg

SEQ ID NO: 424250 - RNA, 32 nt, Human
gagcccgcgccagccggaugcccagcuccgcg

SEQ ID NO: 424251 - RNA, 32 nt, Human
gagcccgcgccgccccgaugcccagcuccgcg

SEQ ID NO: 424252 - RNA, 32 nt, Human
gagcccggaaggcagagguugcagugagcuga

SEQ ID NO: 424253 - RNA, 32 nt, Human
gagcccggaaggcggagguugcagugagcuga

SEQ ID NO: 424254 - RNA, 22 nt, Human
gagcccggaccuggcggggaga

SEQ ID NO: 424255 - RNA, 32 nt, Human
gagcccggagcccggcccugcgcucggcucga

SEQ ID NO: 424256 - RNA, 32 nt, Human
gagcccggcccaggccgcggaacggugaugcu

SEQ ID NO: 424257 - RNA, 20 nt, Human
gagcccggccccaccucccu

SEQ ID NO: 424258 - RNA, 18 nt, Human
gagcccggcccgcggcgg

SEQ ID NO: 424259 - RNA, 20 nt, Human
gagcccggccggcccagcca

SEQ ID NO: 424260 - RNA, 18 nt, Human
gagcccggcgcagcagca

SEQ ID NO: 424261 - RNA, 32 nt, Human
gagcccggcggaggcagcgguggguuugggac

SEQ ID NO: 424262 - RNA, 32 nt, Human
gagcccggcugccucugcugcaguucagagca

SEQ ID NO: 424263 - RNA, 32 nt, Human
gagcccgggaagcagagguugcagugaacuga

SEQ ID NO: 424264 - RNA, 32 nt, Human
gagcccgggaaguggagguugcacugagcuga

SEQ ID NO: 424265 - RNA, 22 nt, Human
gagcccgggagccccucacaga

SEQ ID NO: 424266 - RNA, 32 nt, Human
gagcccgggagccggagguguagcggcagaga

SEQ ID NO: 424267 - RNA, 24 nt, Human
gagcccgggaggcagaggcugcag

SEQ ID NO: 424268 - RNA, 32 nt, Human
gagcccgggaggcagaggcugcagugaaccaa

SEQ ID NO: 424269 - RNA, 24 nt, Human
gagcccgggaggcagagguugcag

SEQ ID NO: 424270 - RNA, 32 nt, Human
gagcccgggaggcagagguugcagugagccau

SEQ ID NO: 424271 - RNA, 32 nt, Human
gagcccgggaggcagagguugcagugagccgu

SEQ ID NO: 424272 - RNA, 32 nt, Human
gagcccgggaggcggagauugcggugagccaa

SEQ ID NO: 424273 - RNA, 32 nt, Human
gagcccgggaggcggagcuuacagugagcuga

SEQ ID NO: 424274 - RNA, 32 nt, Human
gagcccgggaggcggagcuugcagugagcuga

SEQ ID NO: 424275 - RNA, 32 nt, Human
gagcccgggaggcggagcuugcggugggccgg

SEQ ID NO: 424276 - RNA, 32 nt, Human
gagcccgggaggcggaggcgggaggcggcggc

SEQ ID NO: 424277 - RNA, 32 nt, Human
gagcccgggaggcggagguugcagugagcuga

SEQ ID NO: 424278 - RNA, 32 nt, Human
gagcccgggaggucaagguugcagugagucau

SEQ ID NO: 424279 - RNA, 19 nt, Human
gagcccgggccccgccccu

SEQ ID NO: 424280 - RNA, 19 nt, Human
gagcccggggaccaccccc

SEQ ID NO: 424281 - RNA, 20 nt, Human
gagcccgggucccugucccc

SEQ ID NO: 424282 - RNA, 19 nt, Human
gagcccggguuuccugccu

SEQ ID NO: 424283 - RNA, 32 nt, Human
gagcccggguuuuucugcaaaacucagaggac

SEQ ID NO: 424284 - RNA, 32 nt, Human
gagcccggucagcucuuagacaggagggcugu

SEQ ID NO: 424285 - RNA, 32 nt, Human
gagcccgucagccugcgccaugggcugcgacg

SEQ ID NO: 424286 - RNA, 32 nt, Human
gagcccguccauugccccaggagacugcuucg

SEQ ID NO: 424287 - RNA, 32 nt, Human
gagcccgucuuccaccaugagaugacacacag

SEQ ID NO: 424288 - RNA, 32 nt, Human
gagcccgucuuccgacgugcagccuggcagug

SEQ ID NO: 424289 - RNA, 32 nt, Human
gagcccgugaagucgaggcugcagugagccca

SEQ ID NO: 424290 - RNA, 21 nt, Human
gagcccgugagccuagccccu

SEQ ID NO: 424291 - RNA, 32 nt, Human
gagcccguggacugggcuggccuaagggccag

SEQ ID NO: 424292 - RNA, 32 nt, Human
gagcccguuggccgugguugguggggguggac

SEQ ID NO: 424293 - RNA, 32 nt, Human
gagcccuaccagggaagaucauuggguucaaa

SEQ ID NO: 424294 - RNA, 32 nt, Human
gagcccuagaggucgaggcugcagugagcuau

SEQ ID NO: 424295 - RNA, 32 nt, Human
gagcccuagagguugaggcugcagugagcuau

SEQ ID NO: 424296 - RNA, 32 nt, Human
gagcccuaggagagucuaagcuggggcauccc

SEQ ID NO: 424297 - RNA, 21 nt, Human
gagcccucagcauuccugccc

SEQ ID NO: 424298 - RNA, 28 nt, Human
gagcccucagugccagccucaucacugu

SEQ ID NO: 424299 - RNA, 32 nt, Human
gagcccucauccccucucccaggcugggcugg

SEQ ID NO: 424300 - RNA, 32 nt, Human
gagcccuccaaaccuggacucugggacuuagg

SEQ ID NO: 424301 - RNA, 32 nt, Human
gagcccuccaucucaagugacacucgaacaga

SEQ ID NO: 424302 - RNA, 22 nt, Human
gagcccucccugcgggcugcug

SEQ ID NO: 424303 - RNA, 32 nt, Human
gagcccucuccucuggagcacacaccaccccu

SEQ ID NO: 424304 - RNA, 32 nt, Human
gagcccucucugcaccugcucaagagaaaccc

SEQ ID NO: 424305 - RNA, 20 nt, Human
gagcccucugcccuguccuc

SEQ ID NO: 424306 - RNA, 32 nt, Human
gagcccucuggccccucguugccuuuucacuu

SEQ ID NO: 424307 - RNA, 32 nt, Human
gagcccucugggaggcaugcgggcuccagggu

SEQ ID NO: 424308 - RNA, 32 nt, Human
gagcccucugugaggaggcccucuuugcuggc

SEQ ID NO: 424309 - RNA, 32 nt, Human
gagcccugaaaccaagucggagccaggccagg

SEQ ID NO: 424310 - RNA, 32 nt, Human
gagcccugaaagucgagguugcagugagccuu

SEQ ID NO: 424311 - RNA, 18 nt, Human
gagcccugaagaagggac

SEQ ID NO: 424312 - RNA, 32 nt, Human
gagcccugacugccuuuguuuuggaaaucagc

SEQ ID NO: 424313 - RNA, 32 nt, Human
gagcccugagcccuucagcugccugcacaacc

SEQ ID NO: 424314 - RNA, 19 nt, Human
gagcccugagccuguccuc

SEQ ID NO: 424315 - RNA, 32 nt, Human
gagcccugagcucaggcugagcccagccaccu

SEQ ID NO: 424316 - RNA, 32 nt, Human
gagcccugagguaaacuuuuauuucuuagcug

SEQ ID NO: 424317 - RNA, 24 nt, Human
gagcccugauugcaccacuguacu

SEQ ID NO: 424318 - RNA, 32 nt, Human
gagcccugcaccugccuagcugccuuccuggg

SEQ ID NO: 424319 - RNA, 18 nt, Human
gagcccugcacuguccca

SEQ ID NO: 424320 - RNA, 32 nt, Human
gagcccugcagaaucucagagcaaaguggcug

SEQ ID NO: 424321 - RNA, 18 nt, Human
gagcccugcagcuggcug

SEQ ID NO: 424322 - RNA, 32 nt, Human
gagcccugcagggcuuggucagcugccuguuc

SEQ ID NO: 424323 - RNA, 23 nt, Human
gagcccugcccucccaggcacag

SEQ ID NO: 424324 - RNA, 32 nt, Human
gagcccugcccugagcccccuguggagagacu

SEQ ID NO: 424325 - RNA, 32 nt, Human
gagcccugcccugagugucugucccucuucag

SEQ ID NO: 424326 - RNA, 18 nt, Human
gagcccugccuggccuaa

SEQ ID NO: 424327 - RNA, 32 nt, Human
gagcccugcucccucugccacuguggacacau

SEQ ID NO: 424328 - RNA, 32 nt, Human
gagcccugcuuccaaggggcgcgcccgguuau

SEQ ID NO: 424329 - RNA, 32 nt, Human
gagcccugcuucccuucucugaccucacaaag

SEQ ID NO: 424330 - RNA, 32 nt, Human
gagcccugcuucugugcacagccacaccaccc

SEQ ID NO: 424331 - RNA, 32 nt, Human
gagcccuggaaauguagcuuguccaaauugag

SEQ ID NO: 424332 - RNA, 32 nt, Human
gagcccuggaauggggcuccauggagaggugc

SEQ ID NO: 424333 - RNA, 32 nt, Human
gagcccuggaggucaaagcugaggugagccau

SEQ ID NO: 424334 - RNA, 32 nt, Human
gagcccuggaggucaaggcugcagugagccau

SEQ ID NO: 424335 - RNA, 32 nt, Human
gagcccuggagguugaggcugcagugagcugg

SEQ ID NO: 424336 - RNA, 32 nt, Human
gagcccuggagugggcaagaccaggccaccug

SEQ ID NO: 424337 - RNA, 32 nt, Human
gagcccuggaguucaaggcugcagugagcugu

SEQ ID NO: 424338 - RNA, 32 nt, Human
gagcccuggaguuggagguugcagugagcaga

SEQ ID NO: 424339 - RNA, 32 nt, Human
gagcccuggaguuugaguccagccugggugac

SEQ ID NO: 424340 - RNA, 32 nt, Human
gagcccuggauaggaagccacugagucugccc

SEQ ID NO: 424341 - RNA, 24 nt, Human
gagcccuggaucccggcgcgggaa

SEQ ID NO: 424342 - RNA, 32 nt, Human
gagcccuggccagacauguccacaggguucuc

SEQ ID NO: 424343 - RNA, 32 nt, Human
gagcccuggcggcagagguugcagugagccaa

SEQ ID NO: 424344 - RNA, 29 nt, Human
gagcccuggcugcuuguccuccucgcaac

SEQ ID NO: 424345 - RNA, 32 nt, Human
gagcccuggcuguccccucucccucaguccuu

SEQ ID NO: 424346 - RNA, 32 nt, Human
gagcccugggaggcuggagccccaggugcagu

SEQ ID NO: 424347 - RNA, 32 nt, Human
gagcccugggagggcccaggagccagaccucg

SEQ ID NO: 424348 - RNA, 19 nt, Human
gagcccugggccugucccc

SEQ ID NO: 424349 - RNA, 21 nt, Human
gagcccugggcuggaggcuga

SEQ ID NO: 424350 - RNA, 32 nt, Human
gagcccugggcuggggcaggagccgcaauguc

SEQ ID NO: 424351 - RNA, 32 nt, Human
gagcccuggggaaauggucugaggcagguggu

SEQ ID NO: 424352 - RNA, 32 nt, Human
gagcccuggggacugcggaagguggagugugc

SEQ ID NO: 424353 - RNA, 32 nt, Human
gagcccugggggugggaggcugugggaggcug

SEQ ID NO: 424354 - RNA, 32 nt, Human
gagcccugggucagcauugcucuggcacuggc

SEQ ID NO: 424355 - RNA, 22 nt, Human
gagcccuggguguccccacagg

SEQ ID NO: 424356 - RNA, 32 nt, Human
gagcccuggguuaaagucagugugaagggcag

SEQ ID NO: 424357 - RNA, 31 nt, Human
gagcccugguuucagcccccucagucugaug

SEQ ID NO: 424358 - RNA, 32 nt, Human
gagcccuguaaggacugaggccccggccagcc

SEQ ID NO: 424359 - RNA, 32 nt, Human
gagcccugucauccacaguggagggagaagaa

SEQ ID NO: 424360 - RNA, 21 nt, Human
gagcccugugaaaugcaucaa

SEQ ID NO: 424361 - RNA, 32 nt, Human
gagcccuguggaggggaaggggaagcuugggg

SEQ ID NO: 424362 - RNA, 32 nt, Human
gagcccugugggugucuggggaaaggugggcc

SEQ ID NO: 424363 - RNA, 32 nt, Human
gagcccuuauuuuguggcagaugcuaugaaag

SEQ ID NO: 424364 - RNA, 32 nt, Human
gagcccuucaagaagguaccagaaggaacccu

SEQ ID NO: 424365 - RNA, 23 nt, Human
gagcccuucaaggucuccacaga

SEQ ID NO: 424366 - RNA, 32 nt, Human
gagcccuucagagcccacacugccagucgagg

SEQ ID NO: 424367 - RNA, 25 nt, Human
gagcccuucagcccgccacugcacu

SEQ ID NO: 424368 - RNA, 32 nt, Human
gagcccuucccuggaaacucuuacaggccagg

SEQ ID NO: 424369 - RNA, 32 nt, Human
gagcccuucucccuccugccugcccucuugca

SEQ ID NO: 424370 - RNA, 32 nt, Human
gagcccuucucccugacccugggcugcuuccu

SEQ ID NO: 424371 - RNA, 23 nt, Human
gagcccuucucucccucucugcc

SEQ ID NO: 424372 - RNA, 32 nt, Human
gagcccuugccagaucucccucccucucucug

SEQ ID NO: 424373 - RNA, 21 nt, Human
gagcccuugccccuguccaca

SEQ ID NO: 424374 - RNA, 32 nt, Human
gagcccuugccuugguuucuggaaguucuuuu

SEQ ID NO: 424375 - RNA, 26 nt, Human
gagcccuugcucacguuuccccacag

SEQ ID NO: 424376 - RNA, 32 nt, Human
gagcccuuggcauucauggggccagugacccg

SEQ ID NO: 424377 - RNA, 32 nt, Human
gagcccuuggcgggggcaugcgugcgacaugg

SEQ ID NO: 424378 - RNA, 32 nt, Human
gagcccuuucuguagugggggaaagguggcug

SEQ ID NO: 424379 - RNA, 32 nt, Human
gagcccuuuuccccacggcccuugccacuguc

SEQ ID NO: 424380 - RNA, 19 nt, Human
gagcccuuuugcuauucca

SEQ ID NO: 424381 - RNA, 32 nt, Human
gagccgaaaaugcaccacugcacuccagcaug

SEQ ID NO: 424382 - RNA, 24 nt, Human
gagccgaaaucacaccauugcacu

SEQ ID NO: 424383 - RNA, 24 nt, Human
gagccgaaaucgcaccacugcacu

SEQ ID NO: 424384 - RNA, 32 nt, Human
gagccgaaaucgcaccacugcacuccagccug

SEQ ID NO: 424385 - RNA, 24 nt, Human
gagccgaaaucgcgccacugcacu

SEQ ID NO: 424386 - RNA, 24 nt, Human
gagccgaaauugcaccauugcacu

SEQ ID NO: 424387 - RNA, 32 nt, Human
gagccgaagagaccgacacagagaaggaaacg

SEQ ID NO: 424388 - RNA, 32 nt, Human
gagccgaaggcagaccugcagcagguccuggu

SEQ ID NO: 424389 - RNA, 24 nt, Human
gagccgacaucaugccacugcacu

SEQ ID NO: 424390 - RNA, 24 nt, Human
gagccgacaucgcgccauugcacu

SEQ ID NO: 424391 - RNA, 21 nt, Human
gagccgaccccugggcugcug

SEQ ID NO: 424392 - RNA, 24 nt, Human
gagccgacugcccuucugccccca

SEQ ID NO: 424393 - RNA, 22 nt, Human
gagccgacugucuccucugccu

SEQ ID NO: 424394 - RNA, 24 nt, Human
gagccgagaccacgccacugcacu

SEQ ID NO: 424395 - RNA, 24 nt, Human
gagccgagaccgcaccacugcacu

SEQ ID NO: 424396 - RNA, 24 nt, Human
gagccgagaccgcgccacugcacu

SEQ ID NO: 424397 - RNA, 32 nt, Human
gagccgagaccgugccacugcacuccagccug

SEQ ID NO: 424398 - RNA, 24 nt, Human
gagccgagacgacaccacugcacu

SEQ ID NO: 424399 - RNA, 24 nt, Human
gagccgagacugcgccaccgcgcu

SEQ ID NO: 424400 - RNA, 32 nt, Human
gagccgagagaagagaccugggaaauuaaguu

SEQ ID NO: 424401 - RNA, 32 nt, Human
gagccgagauagcaccauugcacuccagccug

SEQ ID NO: 424402 - RNA, 24 nt, Human
gagccgagauagcgccacugcacu

SEQ ID NO: 424403 - RNA, 32 nt, Human
gagccgagauagcggcacugcacuccagccug

SEQ ID NO: 424404 - RNA, 32 nt, Human
gagccgagauagcggcauugcacuccagccug

SEQ ID NO: 424405 - RNA, 24 nt, Human
gagccgagauaucgccacugcacu

SEQ ID NO: 424406 - RNA, 24 nt, Human
gagccgagaucacaccaccgcacu

SEQ ID NO: 424407 - RNA, 24 nt, Human
gagccgagaucacaccacuacacu

SEQ ID NO: 424408 - RNA, 32 nt, Human
gagccgagaucacaccacuacacuccagccua

SEQ ID NO: 424409 - RNA, 24 nt, Human
gagccgagaucacaccacugcacu

SEQ ID NO: 424410 - RNA, 24 nt, Human
gagccgagaucacaccauugcacu

SEQ ID NO: 424411 - RNA, 24 nt, Human
gagccgagaucacacuacugcacu

SEQ ID NO: 424412 - RNA, 24 nt, Human
gagccgagaucacgccacugcacu

SEQ ID NO: 424413 - RNA, 24 nt, Human
gagccgagaucacgccauugcacu

SEQ ID NO: 424414 - RNA, 24 nt, Human
gagccgagaucacgcuacugcacu

SEQ ID NO: 424415 - RNA, 32 nt, Human
gagccgagaucaugcugaaggaaggaagggag

SEQ ID NO: 424416 - RNA, 23 nt, Human
gagccgagaucgcaccacugcac

SEQ ID NO: 424417 - RNA, 24 nt, Human
gagccgagaucgcaccacugcacu

SEQ ID NO: 424418 - RNA, 24 nt, Human
gagccgagaucgcaccagugcacu

SEQ ID NO: 424419 - RNA, 24 nt, Human
gagccgagaucgcaccauugcacu

SEQ ID NO: 424420 - RNA, 24 nt, Human
gagccgagaucgccccacugcacu

SEQ ID NO: 424421 - RNA, 24 nt, Human
gagccgagaucgcgccaccacacu

SEQ ID NO: 424422 - RNA, 32 nt, Human
gagccgagaucgcgccaccacacuccagccug

SEQ ID NO: 424423 - RNA, 23 nt, Human
gagccgagaucgcgccacccacu

SEQ ID NO: 424424 - RNA, 23 nt, Human
gagccgagaucgcgccacugcac

SEQ ID NO: 424425 - RNA, 24 nt, Human
gagccgagaucgcgccacugcacu

SEQ ID NO: 424426 - RNA, 24 nt, Human
gagccgagaucgcgccaucacacu

SEQ ID NO: 424427 - RNA, 32 nt, Human
gagccgagaucgcgccaucacacuccagccua

SEQ ID NO: 424428 - RNA, 24 nt, Human
gagccgagaucgcgccaucgcacu

SEQ ID NO: 424429 - RNA, 24 nt, Human
gagccgagaucgcgccauuacacu

SEQ ID NO: 424430 - RNA, 24 nt, Human
gagccgagaucgcgccauugcacu

SEQ ID NO: 424431 - RNA, 24 nt, Human
gagccgagaucgcgcuacugcacu

SEQ ID NO: 424432 - RNA, 32 nt, Human
gagccgagaucucaccauuacacuccagccug

SEQ ID NO: 424433 - RNA, 32 nt, Human
gagccgagauggagccacugcacuccagccca

SEQ ID NO: 424434 - RNA, 32 nt, Human
gagccgagauggagccacugcacuccagccug

SEQ ID NO: 424435 - RNA, 24 nt, Human
gagccgagauggcaccacugcacu

SEQ ID NO: 424436 - RNA, 24 nt, Human
gagccgagauggcgccacugcacu

SEQ ID NO: 424437 - RNA, 32 nt, Human
gagccgagauggugccacugcacuccagccua

SEQ ID NO: 424438 - RNA, 32 nt, Human
gagccgagauggugccacugcacuccagccug

SEQ ID NO: 424439 - RNA, 32 nt, Human
gagccgagauggugccguugcacuccagccgg

SEQ ID NO: 424440 - RNA, 24 nt, Human
gagccgagauuacaccacugcacu

SEQ ID NO: 424441 - RNA, 32 nt, Human
gagccgagauuacuccagccuaggcaacagag

SEQ ID NO: 424442 - RNA, 24 nt, Human
gagccgagauugcaccaccgcacu

SEQ ID NO: 424443 - RNA, 24 nt, Human
gagccgagauugcaccacugcacu

SEQ ID NO: 424444 - RNA, 24 nt, Human
gagccgagauugcaccauugcacu

SEQ ID NO: 424445 - RNA, 24 nt, Human
gagccgagauugccccacugcacu

SEQ ID NO: 424446 - RNA, 24 nt, Human
gagccgagauugcgccaccgcacu

SEQ ID NO: 424447 - RNA, 24 nt, Human
gagccgagauugcgccacuccacu

SEQ ID NO: 424448 - RNA, 24 nt, Human
gagccgagauugcgccacugcacu

SEQ ID NO: 424449 - RNA, 24 nt, Human
gagccgagauugcgccacugcgcu

SEQ ID NO: 424450 - RNA, 24 nt, Human
gagccgagauugcgccacuucacu

SEQ ID NO: 424451 - RNA, 24 nt, Human
gagccgagauugcgccauugcacu

SEQ ID NO: 424452 - RNA, 24 nt, Human
gagccgagauugcgcuacugcacu

SEQ ID NO: 424453 - RNA, 32 nt, Human
gagccgagauugugcacuccagccuggguaac

SEQ ID NO: 424454 - RNA, 32 nt, Human
gagccgagauugugccacuacacuccagccug

SEQ ID NO: 424455 - RNA, 32 nt, Human
gagccgagauugugccacugcacuccaaccug

SEQ ID NO: 424456 - RNA, 32 nt, Human
gagccgagauugugccacugcacuccagccua

SEQ ID NO: 424457 - RNA, 32 nt, Human
gagccgagauugugccacugcacuccagccug

SEQ ID NO: 424458 - RNA, 32 nt, Human
gagccgagauugugccacugcacuccagccuu

SEQ ID NO: 424459 - RNA, 32 nt, Human
gagccgagauugugccacugcacuccagcugg

SEQ ID NO: 424460 - RNA, 23 nt, Human
gagccgagcagccugcugggagg

SEQ ID NO: 424461 - RNA, 32 nt, Human
gagccgagcgacgcugccuccuuggggccggg

SEQ ID NO: 424462 - RNA, 32 nt, Human
gagccgaggaguucaagaccagccuggguauc

SEQ ID NO: 424463 - RNA, 32 nt, Human
gagccgaggaguucgagaccagccugggcaac

SEQ ID NO: 424464 - RNA, 32 nt, Human
gagccgaggaguuugagucugcagugagcuau

SEQ ID NO: 424465 - RNA, 32 nt, Human
gagccgaggcauuccagccugggcaacagagu

SEQ ID NO: 424466 - RNA, 24 nt, Human
gagccgaggccgcaccacugcacu

SEQ ID NO: 424467 - RNA, 22 nt, Human
gagccgagggggccacccgagg

SEQ ID NO: 424468 - RNA, 32 nt, Human
gagccgaggggguggggguugcagugagccaa

SEQ ID NO: 424469 - RNA, 24 nt, Human
gagccgaggucacgccacugcacu

SEQ ID NO: 424470 - RNA, 24 nt, Human
gagccgaggucaugccacugcacu

SEQ ID NO: 424471 - RNA, 24 nt, Human
gagccgaggucgcaccacugcacu

SEQ ID NO: 424472 - RNA, 24 nt, Human
gagccgaggucgugccacugcacu

SEQ ID NO: 424473 - RNA, 24 nt, Human
gagccgagguugugccacugcacu

SEQ ID NO: 424474 - RNA, 23 nt, Human
gagccgagucacgccacugcacu

SEQ ID NO: 424475 - RNA, 24 nt, Human
gagccgagucgggcuggccggggg

SEQ ID NO: 424476 - RNA, 22 nt, Human
gagccgagugccccaccagagg

SEQ ID NO: 424477 - RNA, 32 nt, Human
gagccgagugugaagaaagcuccagacuuggc

SEQ ID NO: 424478 - RNA, 24 nt, Human
gagccgaguuugggccacugcacu

SEQ ID NO: 424479 - RNA, 32 nt, Human
gagccgauggccccagcaucccccaggugccu

SEQ ID NO: 424480 - RNA, 32 nt, Human
gagccgaugggcccuggaggcagcccauuaaa

SEQ ID NO: 424481 - RNA, 22 nt, Human
gagccgauugcaccacugcacu

SEQ ID NO: 424482 - RNA, 32 nt, Human
gagccgcacaaaccagggcucgccaugaagcc

SEQ ID NO: 424483 - RNA, 32 nt, Human
gagccgcacacagccacaucuuccuagaccua

SEQ ID NO: 424484 - RNA, 32 nt, Human
gagccgcacagugauaauccauuuucuucauu

SEQ ID NO: 424485 - RNA, 32 nt, Human
gagccgcaccuugucauguaccaucaauaaag

SEQ ID NO: 424486 - RNA, 32 nt, Human
gagccgcagccccugugcacaccuaacacagg

SEQ ID NO: 424487 - RNA, 23 nt, Human
gagccgcagccgcggcccggaga

SEQ ID NO: 424488 - RNA, 32 nt, Human
gagccgcagccugcucugauucuauggcuugg

SEQ ID NO: 424489 - RNA, 32 nt, Human
gagccgcagcggcgccucucccagaaguauua

SEQ ID NO: 424490 - RNA, 18 nt, Human
gagccgcagcugcaucaa

SEQ ID NO: 424491 - RNA, 32 nt, Human
gagccgcaggccagggaccugcagugacucgc

SEQ ID NO: 424492 - RNA, 32 nt, Human
gagccgcaucuucuccaucuggcaggguggga

SEQ ID NO: 424493 - RNA, 32 nt, Human
gagccgcauggcacucuucccaccucagugcc

SEQ ID NO: 424494 - RNA, 32 nt, Human
gagccgcauucaaagccguccugggccuaagu

SEQ ID NO: 424495 - RNA, 32 nt, Human
gagccgccacuuccagcgaacacacacaggug

SEQ ID NO: 424496 - RNA, 32 nt, Human
gagccgcccagcccugucagcugcgccgggac

SEQ ID NO: 424497 - RNA, 32 nt, Human
gagccgccccacccacuccaucaucuccaggu

SEQ ID NO: 424498 - RNA, 32 nt, Human
gagccgccccgggcgggcccaagccuuuggau

SEQ ID NO: 424499 - RNA, 32 nt, Human
gagccgccgcaccccgacuccuggggccgcgg

SEQ ID NO: 424500 - RNA, 32 nt, Human
gagccgccgcgggccugcugagcuccggagcg

SEQ ID NO: 424501 - RNA, 32 nt, Human
gagccgccggccuccggccuccugggccccuc

SEQ ID NO: 424502 - RNA, 28 nt, Human
gagccgccgggcgcugccucgccagacc

SEQ ID NO: 424503 - RNA, 21 nt, Human
gagccgccucgcuccucuuca

SEQ ID NO: 424504 - RNA, 32 nt, Human
gagccgccucucacccccgacccuccacccag

SEQ ID NO: 424505 - RNA, 32 nt, Human
gagccgccucuccaaaauaccggccacacucc

SEQ ID NO: 424506 - RNA, 32 nt, Human
gagccgccugccgucagggcagugccaugcug

SEQ ID NO: 424507 - RNA, 32 nt, Human
gagccgccugccugaggcucccagacagacug

SEQ ID NO: 424508 - RNA, 23 nt, Human
gagccgccuggcuuucccuucca

SEQ ID NO: 424509 - RNA, 32 nt, Human
gagccgccugucucccugcuucaccucccuaa

SEQ ID NO: 424510 - RNA, 32 nt, Human
gagccgcgacugcgcucgccuagguggugggc

SEQ ID NO: 424511 - RNA, 19 nt, Human
gagccgcgagccgcggcgg

SEQ ID NO: 424512 - RNA, 32 nt, Human
gagccgcgagugagauauugagggagcgcaga

SEQ ID NO: 424513 - RNA, 32 nt, Human
gagccgcggaggaggacagugagggaggaaug

SEQ ID NO: 424514 - RNA, 23 nt, Human
gagccgcgggccggcggggccga

SEQ ID NO: 424515 - RNA, 18 nt, Human
gagccgcggggcgcagag

SEQ ID NO: 424516 - RNA, 32 nt, Human
gagccgcgucuucucccggcuccgccaccagc

SEQ ID NO: 424517 - RNA, 32 nt, Human
gagccgcucugggccuugaggcugccugaugg

SEQ ID NO: 424518 - RNA, 32 nt, Human
gagccgcugcgcacagaugucaggauuuccgu

SEQ ID NO: 424519 - RNA, 20 nt, Human
gagccgcugggccuuagaga

SEQ ID NO: 424520 - RNA, 32 nt, Human
gagccgcuggggcugcagccaccggaucugcu

SEQ ID NO: 424521 - RNA, 20 nt, Human
gagccgcuuccuuccugccc

SEQ ID NO: 424522 - RNA, 32 nt, Human
gagccggaacugcggcagucucucccugccag

SEQ ID NO: 424523 - RNA, 25 nt, Human
gagccggacacccagcacaggugug

SEQ ID NO: 424524 - RNA, 32 nt, Human
gagccggagagggaaugaguaauggacucagu

SEQ ID NO: 424525 - RNA, 32 nt, Human
gagccggagagggaaugaguauggacucaguu

SEQ ID NO: 424526 - RNA, 32 nt, Human
gagccggagagggagcgcgagccgcgccggcc

SEQ ID NO: 424527 - RNA, 32 nt, Human
gagccggagagggugaagcaggcaggaagcug

SEQ ID NO: 424528 - RNA, 32 nt, Human
gagccggagcagcccccgccccggagacaccc

SEQ ID NO: 424529 - RNA, 32 nt, Human
gagccggagcccgaacugcagcuccagcccca

SEQ ID NO: 424530 - RNA, 23 nt, Human
gagccggagccgccugggauguu

SEQ ID NO: 424531 - RNA, 32 nt, Human
gagccggagccugcuuguugcagcugugggug

SEQ ID NO: 424532 - RNA, 32 nt, Human
gagccggagcgagagcgcgcgggcgcggccga

SEQ ID NO: 424533 - RNA, 21 nt, Human
gagccggagcuggcgagccga

SEQ ID NO: 424534 - RNA, 32 nt, Human
gagccggaggaggaggaggaggaggaggcaaa

SEQ ID NO: 424535 - RNA, 32 nt, Human
gagccggcagggggaaggugggaaggaggucg

SEQ ID NO: 424536 - RNA, 32 nt, Human
gagccggcccccggucccagcacacaguauga

SEQ ID NO: 424537 - RNA, 19 nt, Human
gagccggccccugcugcug

SEQ ID NO: 424538 - RNA, 32 nt, Human
gagccggcccucccugcaggacugccuggccc

SEQ ID NO: 424539 - RNA, 32 nt, Human
gagccggcccuccugggcucucuccuuggguc

SEQ ID NO: 424540 - RNA, 32 nt, Human
gagccggccugccucucuccgcuuugcugcuc

SEQ ID NO: 424541 - RNA, 32 nt, Human
gagccggcgccccuggccagcaggcgaggcua

SEQ ID NO: 424542 - RNA, 32 nt, Human
gagccggcgcugggcgcugcagcugcucccgg

SEQ ID NO: 424543 - RNA, 32 nt, Human
gagccggcggggcugcggagggccaguggacu

SEQ ID NO: 424544 - RNA, 32 nt, Human
gagccggcuggcugagcuuagcguccgaggag

SEQ ID NO: 424545 - RNA, 32 nt, Human
gagccgggacgggagagcagcgcacgcgggug

SEQ ID NO: 424546 - RNA, 32 nt, Human
gagccgggagaagaguuugagaucguggaccg

SEQ ID NO: 424547 - RNA, 32 nt, Human
gagccgggagagaggugggcaaggacgagggc

SEQ ID NO: 424548 - RNA, 32 nt, Human
gagccgggaggcagagggaguagugaccgccu

SEQ ID NO: 424549 - RNA, 23 nt, Human
gagccgggaggccugcgggcuga

SEQ ID NO: 424550 - RNA, 24 nt, Human
gagccgggaucacaccacugcacu

SEQ ID NO: 424551 - RNA, 24 nt, Human
gagccgggaucacgccacugaacu

SEQ ID NO: 424552 - RNA, 24 nt, Human
gagccgggaucgcaccacugcacu

SEQ ID NO: 424553 - RNA, 24 nt, Human
gagccgggaucgcgccacuguacu

SEQ ID NO: 424554 - RNA, 24 nt, Human
gagccgggauugcaccacugcacu

SEQ ID NO: 424555 - RNA, 24 nt, Human
gagccgggauugcgccagugcacu

SEQ ID NO: 424556 - RNA, 32 nt, Human
gagccgggcaacagguggccccggcaccuugu

SEQ ID NO: 424557 - RNA, 32 nt, Human
gagccgggcaauucuuugcugcgugggcuucu

SEQ ID NO: 424558 - RNA, 26 nt, Human
gagccgggcagccaggccgcucaggg

SEQ ID NO: 424559 - RNA, 32 nt, Human
gagccgggcagggccccugccucugcuacggc

SEQ ID NO: 424560 - RNA, 22 nt, Human
gagccgggccaucacccaggga

SEQ ID NO: 424561 - RNA, 32 nt, Human
gagccgggccuggcacauggggcaggaggcug

SEQ ID NO: 424562 - RNA, 32 nt, Human
gagccgggcgcggggcccugcgcacucggagc

SEQ ID NO: 424563 - RNA, 25 nt, Human
gagccgggcggaucaccugugguca

SEQ ID NO: 424564 - RNA, 32 nt, Human
gagccgggcgggcggaggggcgguugggacgg

SEQ ID NO: 424565 - RNA, 18 nt, Human
gagccggggaccagcuug

SEQ ID NO: 424566 - RNA, 32 nt, Human
gagccggggaggaggggguugcagugagccga

SEQ ID NO: 424567 - RNA, 32 nt, Human
gagccggggaggcagagguugcagugagccga

SEQ ID NO: 424568 - RNA, 32 nt, Human
gagccggggagguggaggcugcagugaacuga

SEQ ID NO: 424569 - RNA, 32 nt, Human
gagccggggcugggaguucuccugagggaaga

SEQ ID NO: 424570 - RNA, 32 nt, Human
gagccgggggcaggcccaggauccucagagga

SEQ ID NO: 424571 - RNA, 32 nt, Human
gagccggggugagguggggaggaggacaugga

SEQ ID NO: 424572 - RNA, 32 nt, Human
gagccggggugcaguggcagcgggagaguacc

SEQ ID NO: 424573 - RNA, 22 nt, Human
gagccggguggaucgccugagg

SEQ ID NO: 424574 - RNA, 25 nt, Human
gagccggguggaucgccugagguca

SEQ ID NO: 424575 - RNA, 32 nt, Human
gagccggguugcuaggcgacaucgagagagga

SEQ ID NO: 424576 - RNA, 32 nt, Human
gagccgguagcgagguugggagagacggagcg

SEQ ID NO: 424577 - RNA, 32 nt, Human
gagccguagggaggacugggacaccuggaagc

SEQ ID NO: 424578 - RNA, 24 nt, Human
gagccguaguacauccacuacaga

SEQ ID NO: 424579 - RNA, 32 nt, Human
gagccgucaguguggcugaauaaaggcucucu

SEQ ID NO: 424580 - RNA, 32 nt, Human
gagccguccagccacaccagcuuuccucccac

SEQ ID NO: 424581 - RNA, 21 nt, Human
gagccgugaaaggccacugca

SEQ ID NO: 424582 - RNA, 23 nt, Human
gagccgugaaaggccacugcacu

SEQ ID NO: 424583 - RNA, 24 nt, Human
gagccgugaucaugccacugcacu

SEQ ID NO: 424584 - RNA, 24 nt, Human
gagccgugauugagccacugcacu

SEQ ID NO: 424585 - RNA, 32 nt, Human
gagccgugauugagccacugcacuccagccuc

SEQ ID NO: 424586 - RNA, 24 nt, Human
gagccgugauugcaccacugcacu

SEQ ID NO: 424587 - RNA, 32 nt, Human
gagccgugccucuugggcaggcucccauagug

SEQ ID NO: 424588 - RNA, 32 nt, Human
gagccgugggaagaaaagagggagcagcuagg

SEQ ID NO: 424589 - RNA, 22 nt, Human
gagccguguuuccccucucccu

SEQ ID NO: 424590 - RNA, 32 nt, Human
gagccguguuuccccucucccucccucuccac

SEQ ID NO: 424591 - RNA, 32 nt, Human
gagccguuccagccggugacugugguggcucc

SEQ ID NO: 424592 - RNA, 32 nt, Human
gagccguugugcuccagccugggcgacagaag

SEQ ID NO: 424593 - RNA, 32 nt, Human
gagccguuuacgcggcccuggagcgcaugggg

SEQ ID NO: 424594 - RNA, 32 nt, Human
gagccguuugugucuugggaguuuguggccca

SEQ ID NO: 424595 - RNA, 32 nt, Human
gagccuaaaaccucauuugauaagcacuccua

SEQ ID NO: 424596 - RNA, 32 nt, Human
gagccuaaaggaccagguacaggagcugcacc

SEQ ID NO: 424597 - RNA, 32 nt, Human
gagccuaagagaucaaggcugcagugagccau

SEQ ID NO: 424598 - RNA, 32 nt, Human
gagccuaagcagucgcggcugcagugaacaag

SEQ ID NO: 424599 - RNA, 23 nt, Human
gagccuaagcuggcuccugggga

SEQ ID NO: 424600 - RNA, 32 nt, Human
gagccuaaguaccuuucuuccuucccugcccc

SEQ ID NO: 424601 - RNA, 32 nt, Human
gagccuacacagaggaaggaaggcauucagcu

SEQ ID NO: 424602 - RNA, 32 nt, Human
gagccuacuccaagaauggaggcuguaggaau

SEQ ID NO: 424603 - RNA, 32 nt, Human
gagccuacuugaggugggcaucugggaauaca

SEQ ID NO: 424604 - RNA, 32 nt, Human
gagccuagaaguucaagaccagccugggcaaa

SEQ ID NO: 424605 - RNA, 32 nt, Human
gagccuagagacaucaguuugauuuucuuucu

SEQ ID NO: 424606 - RNA, 32 nt, Human
gagccuagagcaccaugucccuucccuguagc

SEQ ID NO: 424607 - RNA, 24 nt, Human
gagccuagaucacgccauugcacu

SEQ ID NO: 424608 - RNA, 24 nt, Human
gagccuagaucgcgccacugcacu

SEQ ID NO: 424609 - RNA, 24 nt, Human
gagccuagaucgcgccacuguacu

SEQ ID NO: 424610 - RNA, 24 nt, Human
gagccuagauugcgcuacugcacu

SEQ ID NO: 424611 - RNA, 32 nt, Human
gagccuagcaguucgagaccagccugggcaac

SEQ ID NO: 424612 - RNA, 32 nt, Human
gagccuagccaggagguguuuggggcucuauc

SEQ ID NO: 424613 - RNA, 19 nt, Human
gagccuagcccaggccuaa

SEQ ID NO: 424614 - RNA, 32 nt, Human
gagccuagccccggcgagagggucgaggacgc

SEQ ID NO: 424615 - RNA, 32 nt, Human
gagccuaggaagucgaggcugcagugagcuga

SEQ ID NO: 424616 - RNA, 32 nt, Human
gagccuaggacucaggcuggaggcaauuccuu

SEQ ID NO: 424617 - RNA, 32 nt, Human
gagccuaggaggucaaggcugcagugagccau

SEQ ID NO: 424618 - RNA, 18 nt, Human
gagccuaggaggucgagg

SEQ ID NO: 424619 - RNA, 32 nt, Human
gagccuaggaggucgaggcugcagugggaugu

SEQ ID NO: 424620 - RNA, 32 nt, Human
gagccuaggagguugaggcugcagugagcuau

SEQ ID NO: 424621 - RNA, 32 nt, Human
gagccuaggaguucaagaucagccugggcaac

SEQ ID NO: 424622 - RNA, 22 nt, Human
gagccuaggaguuccagaccgc

SEQ ID NO: 424623 - RNA, 32 nt, Human
gagccuaggaguucgagaccagccugggcaac

SEQ ID NO: 424624 - RNA, 24 nt, Human
gagccuaggaguucgagaccagcu

SEQ ID NO: 424625 - RNA, 32 nt, Human
gagccuaggaguugaaggccagccugggaaac

SEQ ID NO: 424626 - RNA, 32 nt, Human
gagccuaggaguuuaagaccagccugggcaac

SEQ ID NO: 424627 - RNA, 32 nt, Human
gagccuagggaagauuugugcagauggggcua

SEQ ID NO: 424628 - RNA, 32 nt, Human
gagccuagguggugccacugcacuccaaccug

SEQ ID NO: 424629 - RNA, 24 nt, Human
gagccuagugaugcccuguccuca

SEQ ID NO: 424630 - RNA, 32 nt, Human
gagccuauaaagccaagggugguguccauuuc

SEQ ID NO: 424631 - RNA, 32 nt, Human
gagccucaaugccaccuccccacaccacccaa

SEQ ID NO: 424632 - RNA, 32 nt, Human
gagccucaauuuccucaucugggucucccagg

SEQ ID NO: 424633 - RNA, 32 nt, Human
gagccucacaagaggacuacagcuggaaccau

SEQ ID NO: 424634 - RNA, 32 nt, Human
gagccucacaguuacaguuccaagaagaaaac

SEQ ID NO: 424635 - RNA, 21 nt, Human
gagccucacauucuucuucca

SEQ ID NO: 424636 - RNA, 32 nt, Human
gagccucacccagggucuguggcucugacuaa

SEQ ID NO: 424637 - RNA, 32 nt, Human
gagccucagaggacccagcccaugagagaacg

SEQ ID NO: 424638 - RNA, 32 nt, Human
gagccucagauucuccucacacagccacagcu

SEQ ID NO: 424639 - RNA, 32 nt, Human
gagccucagcauggcuggcagcgcggcugaca

SEQ ID NO: 424640 - RNA, 32 nt, Human
gagccucagccgggucaucucaucucagcugu

SEQ ID NO: 424641 - RNA, 32 nt, Human
gagccucaggagguugaggcugcagugagcug

SEQ ID NO: 424642 - RNA, 32 nt, Human
gagccucaggcucuccugcccugggccuccca

SEQ ID NO: 424643 - RNA, 32 nt, Human
gagccucaggugcucccccucucaccuggcag

SEQ ID NO: 424644 - RNA, 32 nt, Human
gagccucagucaggaggcucugugggaugcug

SEQ ID NO: 424645 - RNA, 32 nt, Human
gagccucagucugcccuugggcucaggccccu

SEQ ID NO: 424646 - RNA, 32 nt, Human
gagccucaguuuccucuauucuccaccagacu

SEQ ID NO: 424647 - RNA, 32 nt, Human
gagccucauccuggcggaaagggggcuguuug

SEQ ID NO: 424648 - RNA, 32 nt, Human
gagccucauguccugcugcccagaucuggcug

SEQ ID NO: 424649 - RNA, 32 nt, Human
gagccuccacagacuucucuucagccuccgcu

SEQ ID NO: 424650 - RNA, 32 nt, Human
gagccuccagaaggaaccuugguguuggugga

SEQ ID NO: 424651 - RNA, 32 nt, Human
gagccuccagcccucuccuacuuugaucacca

SEQ ID NO: 424652 - RNA, 32 nt, Human
gagccuccagccugcccuguggcacauaccac

SEQ ID NO: 424653 - RNA, 32 nt, Human
gagccuccagcuguuaaaagacaaugcuauua

SEQ ID NO: 424654 - RNA, 32 nt, Human
gagccuccaggcgugaguggagcccaguccag

SEQ ID NO: 424655 - RNA, 32 nt, Human
gagccuccaguagcuucucugggccuggcaga

SEQ ID NO: 424656 - RNA, 32 nt, Human
gagccuccccucgcagauaucucccggggcca

SEQ ID NO: 424657 - RNA, 32 nt, Human
gagccucccuuucuuugcgucucccuuucuuu

SEQ ID NO: 424658 - RNA, 32 nt, Human
gagccuccgacacccaucccacucccaaccac

SEQ ID NO: 424659 - RNA, 21 nt, Human
gagccuccgugaccuguccuc

SEQ ID NO: 424660 - RNA, 32 nt, Human
gagccuccucacccuauccuguuccucccacc

SEQ ID NO: 424661 - RNA, 32 nt, Human
gagccuccuccaggccaaacagccccaaaguc

SEQ ID NO: 424662 - RNA, 32 nt, Human
gagccuccugaagagccccgccuaggagugcu

SEQ ID NO: 424663 - RNA, 32 nt, Human
gagccuccugcccagcccuggccaguucaaag

SEQ ID NO: 424664 - RNA, 18 nt, Human
gagccuccugccucccca

SEQ ID NO: 424665 - RNA, 32 nt, Human
gagccuccugcucuccuggaccagcugcagac

SEQ ID NO: 424666 - RNA, 32 nt, Human
gagccuccuggaccaggagaacuguaacgcga

SEQ ID NO: 424667 - RNA, 32 nt, Human
gagccuccuggcugcuugggguuccaguaaau

SEQ ID NO: 424668 - RNA, 32 nt, Human
gagccuccugggacaagccucaggaugaaaag

SEQ ID NO: 424669 - RNA, 32 nt, Human
gagccuccuuucucugcugccugcccgggcug

SEQ ID NO: 424670 - RNA, 32 nt, Human
gagccucgaggaugacgguguugcaggaaccc

SEQ ID NO: 424671 - RNA, 24 nt, Human
gagccucgauuguaccacugcacu

SEQ ID NO: 424672 - RNA, 32 nt, Human
gagccucgauuguaccacugcacuccagccug

SEQ ID NO: 424673 - RNA, 32 nt, Human
gagccucgccuggaugcuggggcggggaaggc

SEQ ID NO: 424674 - RNA, 32 nt, Human
gagccucgcugugguuucuuccuuccccgaug

SEQ ID NO: 424675 - RNA, 32 nt, Human
gagccucggaggcggagguugcagugagcuga

SEQ ID NO: 424676 - RNA, 32 nt, Human
gagccucgucuggcaagucggggccugggaca

SEQ ID NO: 424677 - RNA, 32 nt, Human
gagccucuaguuccucacucuuccuuuucaga

SEQ ID NO: 424678 - RNA, 32 nt, Human
gagccucuauuucucauuccuaagccuuacca

SEQ ID NO: 424679 - RNA, 32 nt, Human
gagccucucaacauaagacagugaccagucug

SEQ ID NO: 424680 - RNA, 32 nt, Human
gagccucucaggaagcauugugaaucauucca

SEQ ID NO: 424681 - RNA, 32 nt, Human
gagccucucccuuaccccaccccacacacacg

SEQ ID NO: 424682 - RNA, 32 nt, Human
gagccucuccugccaucucuuuugcagcugag

SEQ ID NO: 424683 - RNA, 32 nt, Human
gagccucuccuggcagcuucucaggucucccu

SEQ ID NO: 424684 - RNA, 32 nt, Human
gagccucucuccccaccccaaucuaaauaugg

SEQ ID NO: 424685 - RNA, 32 nt, Human
gagccucucuguaucuucccauggcccagucu

SEQ ID NO: 424686 - RNA, 32 nt, Human
gagccucugacccucuggagaugauguccugc

SEQ ID NO: 424687 - RNA, 32 nt, Human
gagccucugauuuccaauucccugcuccuucc

SEQ ID NO: 424688 - RNA, 32 nt, Human
gagccucugcccuccuccagcccggauggcuc

SEQ ID NO: 424689 - RNA, 32 nt, Human
gagccucugccucuuccucugucuccuguggg

SEQ ID NO: 424690 - RNA, 32 nt, Human
gagccucugccuggccccugcugcuguccugu

SEQ ID NO: 424691 - RNA, 32 nt, Human
gagccucugcuggcuuccucauccccugucca

SEQ ID NO: 424692 - RNA, 19 nt, Human
gagccucugguccaucuca

SEQ ID NO: 424693 - RNA, 24 nt, Human
gagccucuucucgacacuauccca

SEQ ID NO: 424694 - RNA, 32 nt, Human
gagccucuucuguccccuucuuugcuaggacc

SEQ ID NO: 424695 - RNA, 32 nt, Human
gagccucuugagggagaugagaggccucuuug

SEQ ID NO: 424696 - RNA, 32 nt, Human
gagccugaacugguugugcagaacaaacaagg

SEQ ID NO: 424697 - RNA, 23 nt, Human
gagccugaagcaccuccugccca

SEQ ID NO: 424698 - RNA, 19 nt, Human
gagccugaccaacaugcua

SEQ ID NO: 424699 - RNA, 32 nt, Human
gagccugaccaacaugcuaaaauccccucucu

SEQ ID NO: 424700 - RNA, 32 nt, Human
gagccugacucugagggguuccgccuccuccg

SEQ ID NO: 424701 - RNA, 32 nt, Human
gagccugagaacuccuccuccugggacucuca

SEQ ID NO: 424702 - RNA, 32 nt, Human
gagccugagagaugaagguugcagugagccgu

SEQ ID NO: 424703 - RNA, 32 nt, Human
gagccugagagccacagguaaggacaacugca

SEQ ID NO: 424704 - RNA, 32 nt, Human
gagccugagaugggggacugggccccugccug

SEQ ID NO: 424705 - RNA, 21 nt, Human
gagccugagcggcuucaggga

SEQ ID NO: 424706 - RNA, 23 nt, Human
gagccugagcugguccccagaga

SEQ ID NO: 424707 - RNA, 32 nt, Human
gagccugaggacugccuuuaacugaauuugaa

SEQ ID NO: 424708 - RNA, 32 nt, Human
gagccugaggggcaccuuggcuuccgccugug

SEQ ID NO: 424709 - RNA, 32 nt, Human
gagccugaguacaguuuccuuccaaauggaca

SEQ ID NO: 424710 - RNA, 32 nt, Human
gagccugaucauaauacgaagaccagcuucug

SEQ ID NO: 424711 - RNA, 32 nt, Human
gagccugauccuggcggaccauggggagcacc

SEQ ID NO: 424712 - RNA, 32 nt, Human
gagccugauuccucagucucaccagaauucug

SEQ ID NO: 424713 - RNA, 32 nt, Human
gagccugauucugcugcugcuucuccagcuaa

SEQ ID NO: 424714 - RNA, 32 nt, Human
gagccugcaacaaacucugggcagccucagga

SEQ ID NO: 424715 - RNA, 32 nt, Human
gagccugcaagauggagguugcagugagcuca

SEQ ID NO: 424716 - RNA, 32 nt, Human
gagccugcaccauggagguggccacaucugcg

SEQ ID NO: 424717 - RNA, 32 nt, Human
gagccugcacccuuccgagggccauaggcgac

SEQ ID NO: 424718 - RNA, 32 nt, Human
gagccugcaccuaggcaaaacaugcucuuccu

SEQ ID NO: 424719 - RNA, 32 nt, Human
gagccugcacuuccuguucaggugcagacacu

SEQ ID NO: 424720 - RNA, 31 nt, Human
gagccugcacuuuacucugaauguugguggc

SEQ ID NO: 424721 - RNA, 32 nt, Human
gagccugcagaaccuguccaggcacaguggcu

SEQ ID NO: 424722 - RNA, 32 nt, Human
gagccugcagagccucuguuggucaggcaucc

SEQ ID NO: 424723 - RNA, 22 nt, Human
gagccugcagcagcugcaguaa

SEQ ID NO: 424724 - RNA, 16 nt, Human
gagccugcaggguggg

SEQ ID NO: 424725 - RNA, 32 nt, Human
gagccugcagugagaguuuggcccagccucag

SEQ ID NO: 424726 - RNA, 32 nt, Human
gagccugcagugagccgagaucgcgccacugc

SEQ ID NO: 424727 - RNA, 32 nt, Human
gagccugcagugagcuaugacgaugccacucg

SEQ ID NO: 424728 - RNA, 32 nt, Human
gagccugcauuuccucgcagccucucagugcc

SEQ ID NO: 424729 - RNA, 15 nt, Human
gagccugccagugga

SEQ ID NO: 424730 - RNA, 32 nt, Human
gagccugccggugggagcuggaagcaggcucc

SEQ ID NO: 424731 - RNA, 32 nt, Human
gagccugccugcucccccuggccagcaccugc

SEQ ID NO: 424732 - RNA, 32 nt, Human
gagccugccuggucucuggggguguugaguga

SEQ ID NO: 424733 - RNA, 32 nt, Human
gagccugccugucugggcaccugcugcaacca

SEQ ID NO: 424734 - RNA, 32 nt, Human
gagccugcuggaggcccugccuucacagagau

SEQ ID NO: 424735 - RNA, 32 nt, Human
gagccugcuggggcuggaggagcgagaagggu

SEQ ID NO: 424736 - RNA, 32 nt, Human
gagccugcuucgccaucuccgagccccaccgc

SEQ ID NO: 424737 - RNA, 32 nt, Human
gagccuggaagacauagguugcaguguaaugg

SEQ ID NO: 424738 - RNA, 32 nt, Human
gagccuggaagcuuccacagggcaggagggug

SEQ ID NO: 424739 - RNA, 32 nt, Human
gagccuggacucaggaugacuuggaacuaggg

SEQ ID NO: 424740 - RNA, 32 nt, Human
gagccuggagagaaggcgcugggcugcgaggg

SEQ ID NO: 424741 - RNA, 32 nt, Human
gagccuggagcaagguggagggugcagagggg

SEQ ID NO: 424742 - RNA, 32 nt, Human
gagccuggagccagaaccugugaagagcggaa

SEQ ID NO: 424743 - RNA, 32 nt, Human
gagccuggagcccaggcccaggaacugaagaa

SEQ ID NO: 424744 - RNA, 32 nt, Human
gagccuggagguagggagagcauugagaauuu

SEQ ID NO: 424745 - RNA, 24 nt, Human
gagccuggaucaugccacugcacu

SEQ ID NO: 424746 - RNA, 32 nt, Human
gagccuggcaagcuggaugugggagccacgga

SEQ ID NO: 424747 - RNA, 32 nt, Human
gagccuggcacacaguaggagcacagaaaggu

SEQ ID NO: 424748 - RNA, 22 nt, Human
gagccuggccaacauagcgaaa

SEQ ID NO: 424749 - RNA, 32 nt, Human
gagccuggccaacauagcgaaaccccgucucu

SEQ ID NO: 424750 - RNA, 32 nt, Human
gagccuggccaacauggugaaaccccaucucu

SEQ ID NO: 424751 - RNA, 32 nt, Human
gagccuggccaacauggugaaacccugucucu

SEQ ID NO: 424752 - RNA, 18 nt, Human
gagccuggccacccagug

SEQ ID NO: 424753 - RNA, 32 nt, Human
gagccuggcuguuucacaguauuucaugaauu

SEQ ID NO: 424754 - RNA, 32 nt, Human
gagccuggcuuagugcugggccuucucuuaaa

SEQ ID NO: 424755 - RNA, 32 nt, Human
gagccugggaagucaagccugcagugagccau

SEQ ID NO: 424756 - RNA, 32 nt, Human
gagccugggaaguggaaguugcagugagccaa

SEQ ID NO: 424757 - RNA, 32 nt, Human
gagccugggaaguggaggcugcagugagccua

SEQ ID NO: 424758 - RNA, 32 nt, Human
gagccugggaaguggagguugcaguaggcuga

SEQ ID NO: 424759 - RNA, 32 nt, Human
gagccugggaaguugaggcugcagugagccgu

SEQ ID NO: 424760 - RNA, 32 nt, Human
gagccugggaaugggggugaguggagggcucc

SEQ ID NO: 424761 - RNA, 32 nt, Human
gagccugggaauucgaagcugcagugagcuau

SEQ ID NO: 424762 - RNA, 32 nt, Human
gagccugggacauugaggcugcagugaacugu

SEQ ID NO: 424763 - RNA, 32 nt, Human
gagccugggagaucgaggcugcagugagccaa

SEQ ID NO: 424764 - RNA, 32 nt, Human
gagccugggagauggagguugcagugagcuga

SEQ ID NO: 424765 - RNA, 32 nt, Human
gagccugggagcaaggguugcagugagcugag

SEQ ID NO: 424766 - RNA, 32 nt, Human
gagccugggagcacgcagaggccuguguucac

SEQ ID NO: 424767 - RNA, 32 nt, Human
gagccugggagcgcagguugcaaugagccaag

SEQ ID NO: 424768 - RNA, 32 nt, Human
gagccugggaggaagagguugcagugagccga

SEQ ID NO: 424769 - RNA, 32 nt, Human
gagccugggaggcagagauugcacugagccga

SEQ ID NO: 424770 - RNA, 32 nt, Human
gagccugggaggcagaggcugcagugagccga

SEQ ID NO: 424771 - RNA, 32 nt, Human
gagccugggaggcagagguugcagugagccaa

SEQ ID NO: 424772 - RNA, 32 nt, Human
gagccugggaggcagagguugcagugagccga

SEQ ID NO: 424773 - RNA, 32 nt, Human
gagccugggaggcagagguugcagugagcuga

SEQ ID NO: 424774 - RNA, 32 nt, Human
gagccugggaggcagagguugcugugagccga

SEQ ID NO: 424775 - RNA, 32 nt, Human
gagccugggaggcggagguugcagugagccga

SEQ ID NO: 424776 - RNA, 32 nt, Human
gagccugggaggcggggguuguggugagccga

SEQ ID NO: 424777 - RNA, 32 nt, Human
gagccugggaggcugaggcgggagaaucaccu

SEQ ID NO: 424778 - RNA, 32 nt, Human
gagccugggaggucaaggcaucagugagcgau

SEQ ID NO: 424779 - RNA, 32 nt, Human
gagccugggaggucaaggcugcagugaaccau

SEQ ID NO: 424780 - RNA, 32 nt, Human
gagccugggaggucaaggcugcagugagccau

SEQ ID NO: 424781 - RNA, 32 nt, Human
gagccugggaggucaaggcugcagugagccga

SEQ ID NO: 424782 - RNA, 32 nt, Human
gagccugggaggucaaggcugcagugagccgu

SEQ ID NO: 424783 - RNA, 32 nt, Human
gagccugggaggucaaggcugcagugagcugu

SEQ ID NO: 424784 - RNA, 32 nt, Human
gagccugggaggucauggcugcagagagccau

SEQ ID NO: 424785 - RNA, 32 nt, Human
gagccugggaggucgaggcugcagugagcugu

SEQ ID NO: 424786 - RNA, 32 nt, Human
gagccugggagguggaggcuacugugagccau

SEQ ID NO: 424787 - RNA, 32 nt, Human
gagccugggagguggagguugcacugaguaga

SEQ ID NO: 424788 - RNA, 32 nt, Human
gagccugggagguggagguugcagugagcuaa

SEQ ID NO: 424789 - RNA, 32 nt, Human
gagccugggagguggagguugcagugagugga

SEQ ID NO: 424790 - RNA, 32 nt, Human
gagccugggagguggagguugccagugagucg

SEQ ID NO: 424791 - RNA, 32 nt, Human
gagccugggagguggagguuucagugagcugg

SEQ ID NO: 424792 - RNA, 32 nt, Human
gagccugggagguggaguuugcagugagcuaa

SEQ ID NO: 424793 - RNA, 32 nt, Human
gagccugggaggugguagggugucugaaaugc

SEQ ID NO: 424794 - RNA, 32 nt, Human
gagccugggagguugaggcugcagugagccau

SEQ ID NO: 424795 - RNA, 32 nt, Human
gagccugggagguugugguugcagugagcuau

SEQ ID NO: 424796 - RNA, 32 nt, Human
gagccugggaguucaagaccagccugggcaac

SEQ ID NO: 424797 - RNA, 32 nt, Human
gagccugggaguucgaggcugcagugagcaau

SEQ ID NO: 424798 - RNA, 18 nt, Human
gagccugggaguuggaga

SEQ ID NO: 424799 - RNA, 32 nt, Human
gagccugggaguuggagaccagccugggcaac

SEQ ID NO: 424800 - RNA, 32 nt, Human
gagccugggaguuugagaccagccugggcaac

SEQ ID NO: 424801 - RNA, 32 nt, Human
gagccugggaguuugaggcugcagugagcuau

SEQ ID NO: 424802 - RNA, 21 nt, Human
gagccugggaugggcagggag

SEQ ID NO: 424803 - RNA, 32 nt, Human
gagccugggaugucaaggcugcagugagcugu

SEQ ID NO: 424804 - RNA, 32 nt, Human
gagccugggcauccugacgcuggacuugggcg

SEQ ID NO: 424805 - RNA, 32 nt, Human
gagccugggccagcucaaggugggcacggggg

SEQ ID NO: 424806 - RNA, 32 nt, Human
gagccugggccaggagcccacagugccuguac

SEQ ID NO: 424807 - RNA, 32 nt, Human
gagccugggcugcuccuccugcucuggggagu

SEQ ID NO: 424808 - RNA, 32 nt, Human
gagccuggggaguucaaggccagcauggacaa

SEQ ID NO: 424809 - RNA, 32 nt, Human
gagccugggggacugaggcugcagugagccau

SEQ ID NO: 424810 - RNA, 32 nt, Human
gagccugggugagaaacaccauccaaagcugg

SEQ ID NO: 424811 - RNA, 32 nt, Human
gagccugguaggcugaggcugcagugagccaa

SEQ ID NO: 424812 - RNA, 32 nt, Human
gagccugguguuuaugccccacugcuguccua

SEQ ID NO: 424813 - RNA, 32 nt, Human
gagccugguuugucaucccugcccuagcccaa

SEQ ID NO: 424814 - RNA, 24 nt, Human
gagccuguacuucucugcugguuu

SEQ ID NO: 424815 - RNA, 32 nt, Human
gagccuguaugcagcccagugcagccuugcag

SEQ ID NO: 424816 - RNA, 32 nt, Human
gagccugucauccccagaucuaaauccugaag

SEQ ID NO: 424817 - RNA, 32 nt, Human
gagccugugaccaccugugcuguggagaugga

SEQ ID NO: 424818 - RNA, 32 nt, Human
gagccugugaggucgaggcugcagugagccga

SEQ ID NO: 424819 - RNA, 32 nt, Human
gagccugugcagcugcuggagcacggcccaac

SEQ ID NO: 424820 - RNA, 32 nt, Human
gagccugugccugcugcgugggagacuggucc

SEQ ID NO: 424821 - RNA, 32 nt, Human
gagccugugcucaugacagcugcucuguuacu

SEQ ID NO: 424822 - RNA, 32 nt, Human
gagccuguggcuguggugccgggcuccagaca

SEQ ID NO: 424823 - RNA, 32 nt, Human
gagccugugucaggaaagcaugucagagcaga

SEQ ID NO: 424824 - RNA, 32 nt, Human
gagccuguguggccaccaugccuguggccuca

SEQ ID NO: 424825 - RNA, 22 nt, Human
gagccuguguggcccucggagg

SEQ ID NO: 424826 - RNA, 32 nt, Human
gagccugugugugucgggcagcugcaggacau

SEQ ID NO: 424827 - RNA, 32 nt, Human
gagccuguuccccugaggguauuugaaguaua

SEQ ID NO: 424828 - RNA, 32 nt, Human
gagccuguucuucuacuuaccugggcccggag

SEQ ID NO: 424829 - RNA, 32 nt, Human
gagccuguugacuuuguaucucugccugugau

SEQ ID NO: 424830 - RNA, 32 nt, Human
gagccuguuucccuggccuccccaccccaucu

SEQ ID NO: 424831 - RNA, 32 nt, Human
gagccuguuuggaugauggaugccauuccuuu

SEQ ID NO: 424832 - RNA, 32 nt, Human
gagccuuagaaucaaugcucccaacccaccca

SEQ ID NO: 424833 - RNA, 32 nt, Human
gagccuuagagaggaggaggaaagggggagag

SEQ ID NO: 424834 - RNA, 32 nt, Human
gagccuuagcagcugcaccgccauccccaugc

SEQ ID NO: 424835 - RNA, 32 nt, Human
gagccuuaguguguccacaaagggacuccuga

SEQ ID NO: 424836 - RNA, 32 nt, Human
gagccuucagugagcuaugaucgcgccacugu

SEQ ID NO: 424837 - RNA, 32 nt, Human
gagccuucauauuuucuucuuugcugccuucu

SEQ ID NO: 424838 - RNA, 32 nt, Human
gagccuuccagccuucugguguguucuaagag

SEQ ID NO: 424839 - RNA, 32 nt, Human
gagccuuccauucaaaagugaacacacuuggu

SEQ ID NO: 424840 - RNA, 32 nt, Human
gagccuuccuccccaucuggaauucacagcug

SEQ ID NO: 424841 - RNA, 32 nt, Human
gagccuuccuuucuaaauguaaaugacugagu

SEQ ID NO: 424842 - RNA, 32 nt, Human
gagccuucuacuugcugacgacugccucaucu

SEQ ID NO: 424843 - RNA, 23 nt, Human
gagccuucugcaugccuguccuc

SEQ ID NO: 424844 - RNA, 32 nt, Human
gagccuugaaggucaaucugggugacacccga

SEQ ID NO: 424845 - RNA, 32 nt, Human
gagccuugacccuggccccagacggagcccag

SEQ ID NO: 424846 - RNA, 32 nt, Human
gagccuugagccccaaccccgugaaaagaucu

SEQ ID NO: 424847 - RNA, 24 nt, Human
gagccuugaucacgccacugcacu

SEQ ID NO: 424848 - RNA, 24 nt, Human
gagccuugaucgugccacugcacu

SEQ ID NO: 424849 - RNA, 24 nt, Human
gagccuugauuauaccacugcacu

SEQ ID NO: 424850 - RNA, 32 nt, Human
gagccuugcaggauggagcaccucugggacaa

SEQ ID NO: 424851 - RNA, 19 nt, Human
gagccuugcccaccuuccu

SEQ ID NO: 424852 - RNA, 24 nt, Human
gagccuugccuuuccccucugccu

SEQ ID NO: 424853 - RNA, 32 nt, Human
gagccuugcuucuguuuaccucagacaggagg

SEQ ID NO: 424854 - RNA, 32 nt, Human
gagccuuggaaccucagacugagcuagcaugu

SEQ ID NO: 424855 - RNA, 19 nt, Human
gagccuuggaaucuacugc

SEQ ID NO: 424856 - RNA, 32 nt, Human
gagccuuggaggcggagguugcagugagcuga

SEQ ID NO: 424857 - RNA, 32 nt, Human
gagccuuggagugcugaaggaggugcuguucc

SEQ ID NO: 424858 - RNA, 32 nt, Human
gagccuuggaugggguggggaccuggaauggg

SEQ ID NO: 424859 - RNA, 32 nt, Human
gagccuuggcuccccucucgucuccuccccuc

SEQ ID NO: 424860 - RNA, 32 nt, Human
gagccuugguaggguuaaagggaggugacagg

SEQ ID NO: 424861 - RNA, 23 nt, Human
gagccuugugcagaggcccagug

SEQ ID NO: 424862 - RNA, 32 nt, Human
gagccuugugcucuccacuuugccacaguacc

SEQ ID NO: 424863 - RNA, 32 nt, Human
gagccuuucccuagggcuagaccuaagaccag

SEQ ID NO: 424864 - RNA, 32 nt, Human
gagccuuucugccucacaucagcccuguguau

SEQ ID NO: 424865 - RNA, 32 nt, Human
gagccuuucuugcacuuuaaagugagauuaau

SEQ ID NO: 424866 - RNA, 32 nt, Human
gagccuuugaagcaggaggaggggaggagaga

SEQ ID NO: 424867 - RNA, 32 nt, Human
gagccuuugaaggaugcgauguugucauucuu

SEQ ID NO: 424868 - RNA, 32 nt, Human
gagccuuugacucagacauuuuugccaaggag

SEQ ID NO: 424869 - RNA, 32 nt, Human
gagccuuuggaacgugagccacugugggcugg

SEQ ID NO: 424870 - RNA, 18 nt, Human
gagccuuuuccuguccca

SEQ ID NO: 424871 - RNA, 32 nt, Human
gagccuuuuuagaagaaaucgugcugaauuau

SEQ ID NO: 424872 - RNA, 32 nt, Human
gagcgaaccgggcgccagaggcugcgaccccc

SEQ ID NO: 424873 - RNA, 23 nt, Human
gagcgaagaucgcaccacugcac

SEQ ID NO: 424874 - RNA, 32 nt, Human
gagcgaagcagugggagcaucgagcacuagag

SEQ ID NO: 424875 - RNA, 32 nt, Human
gagcgaagcuggauaacaggggaccgaugaug

SEQ ID NO: 424876 - RNA, 32 nt, Human
gagcgaagggauuuauacaacauuuuuaucau

SEQ ID NO: 424877 - RNA, 32 nt, Human
gagcgaagugccggcuacagcaggugucggau

SEQ ID NO: 424878 - RNA, 19 nt, Human
gagcgacagaggcagcucc

SEQ ID NO: 424879 - RNA, 32 nt, Human
gagcgaccaccacuugcacugugugaaaagau

SEQ ID NO: 424880 - RNA, 32 nt, Human
gagcgaccggagaaagaaaaaguggucaaggg

SEQ ID NO: 424881 - RNA, 32 nt, Human
gagcgacuagaagaaaaagagagggagaugca

SEQ ID NO: 424882 - RNA, 32 nt, Human
gagcgagaaaaauguggauguacuguuuguau

SEQ ID NO: 424883 - RNA, 32 nt, Human
gagcgagaagagagagagggcgagcugggccg

SEQ ID NO: 424884 - RNA, 32 nt, Human
gagcgagaccauccuggcuacauggugaaacc

SEQ ID NO: 424885 - RNA, 32 nt, Human
gagcgagacuccguaucagaaagaaaaagagg

SEQ ID NO: 424886 - RNA, 21 nt, Human
gagcgagagaaaagagaggac

SEQ ID NO: 424887 - RNA, 32 nt, Human
gagcgagagagccgggaggcagagggaguagu

SEQ ID NO: 424888 - RNA, 32 nt, Human
gagcgagagagggagaaacaggcgcggggucu

SEQ ID NO: 424889 - RNA, 32 nt, Human
gagcgagagcagagcaaacugcgcagcaggca

SEQ ID NO: 424890 - RNA, 23 nt, Human
gagcgagagcgagagagccggga

SEQ ID NO: 424891 - RNA, 32 nt, Human
gagcgagagguggaucggggcgguguguggcc

SEQ ID NO: 424892 - RNA, 20 nt, Human
gagcgagauccacgugcaca

SEQ ID NO: 424893 - RNA, 20 nt, Human
gagcgagcaagcugaggcca

SEQ ID NO: 424894 - RNA, 20 nt, Human
gagcgagcacggcgcccgca

SEQ ID NO: 424895 - RNA, 32 nt, Human
gagcgagcaggggagagcgagaccaguuuuaa

SEQ ID NO: 424896 - RNA, 32 nt, Human
gagcgagcccccagcccagccuggcgacuggg

SEQ ID NO: 424897 - RNA, 21 nt, Human
gagcgagccggcuagaggcca

SEQ ID NO: 424898 - RNA, 32 nt, Human
gagcgagcgagagagaaaggguucuggauugg

SEQ ID NO: 424899 - RNA, 32 nt, Human
gagcgagcgagagagaagcuaggugugaugau

SEQ ID NO: 424900 - RNA, 22 nt, Human
gagcgagcgccgagccggguca

SEQ ID NO: 424901 - RNA, 32 nt, Human
gagcgagcggcgccugaacacacggcggcugc

SEQ ID NO: 424902 - RNA, 32 nt, Human
gagcgagcugugcucucugaagccacugccug

SEQ ID NO: 424903 - RNA, 32 nt, Human
gagcgaggaacaggcucgaaggcuccggggua

SEQ ID NO: 424904 - RNA, 32 nt, Human
gagcgaggcguggccucaggagcggaggaccc

SEQ ID NO: 424905 - RNA, 32 nt, Human
gagcgagggaaguugaggcugcagugaacuau

SEQ ID NO: 424906 - RNA, 32 nt, Human
gagcgagguauucccagucuuccugcuaagcc

SEQ ID NO: 424907 - RNA, 32 nt, Human
gagcgagucgugaccgguugggccacacucaa

SEQ ID NO: 424908 - RNA, 32 nt, Human
gagcgagugagcgagcggaggagcagcgacac

SEQ ID NO: 424909 - RNA, 32 nt, Human
gagcgagugcagcugccuccgcggggccgcgc

SEQ ID NO: 424910 - RNA, 32 nt, Human
gagcgaguggacuuagggcugggcaggcagua

SEQ ID NO: 424911 - RNA, 32 nt, Human
gagcgaguucucucuuccucccagaccaaguu

SEQ ID NO: 424912 - RNA, 32 nt, Human
gagcgauccuccugccuccaccucccaaagug

SEQ ID NO: 424913 - RNA, 32 nt, Human
gagcgaugacaucagagauuccgaccuuccug

SEQ ID NO: 424914 - RNA, 30 nt, Human
gagcgauggaaagcaaaaugggugaauugc

SEQ ID NO: 424915 - RNA, 32 nt, Human
gagcgcaaaggauaguggacacacuggaauaa

SEQ ID NO: 424916 - RNA, 32 nt, Human
gagcgcaccauugcacuccagccuugggcgac

SEQ ID NO: 424917 - RNA, 32 nt, Human
gagcgcagaggacgcagggccgcuggaggcgc

SEQ ID NO: 424918 - RNA, 20 nt, Human
gagcgcagcccagcgcccgc

SEQ ID NO: 424919 - RNA, 32 nt, Human
gagcgcagccuccacaugcccauguaccucuu

SEQ ID NO: 424920 - RNA, 32 nt, Human
gagcgcagccugggcugcuggcagggaagagg

SEQ ID NO: 424921 - RNA, 32 nt, Human
gagcgcagcgccgaggaugaggaggugcaaca

SEQ ID NO: 424922 - RNA, 32 nt, Human
gagcgcagcuggguuccaggagacucucagcu

SEQ ID NO: 424923 - RNA, 32 nt, Human
gagcgcaggacagcgcaggagccccggcgcau

SEQ ID NO: 424924 - RNA, 32 nt, Human
gagcgcaggcagcccccgccccucggcccucc

SEQ ID NO: 424925 - RNA, 32 nt, Human
gagcgcaggcagcgcagggcuggcacgugaca

SEQ ID NO: 424926 - RNA, 32 nt, Human
gagcgcaggccgcggccggcgggccucagcuc

SEQ ID NO: 424927 - RNA, 32 nt, Human
gagcgcagggccagagcggagccccagccggc

SEQ ID NO: 424928 - RNA, 22 nt, Human
gagcgcaggucgcacacugcac

SEQ ID NO: 424929 - RNA, 32 nt, Human
gagcgcagugagccgggcccagcuucucuccu

SEQ ID NO: 424930 - RNA, 32 nt, Human
gagcgcaugucccagcccugguggccaggcuc

SEQ ID NO: 424931 - RNA, 32 nt, Human
gagcgccaaagccacaggcuggggcgcuaacg

SEQ ID NO: 424932 - RNA, 22 nt, Human
gagcgccacccacgcaggcaca

SEQ ID NO: 424933 - RNA, 32 nt, Human
gagcgccaggcagagcccaaucagggucucgu

SEQ ID NO: 424934 - RNA, 32 nt, Human
gagcgccagggacacacucaguucaccuucua

SEQ ID NO: 424935 - RNA, 32 nt, Human
gagcgcccaugcagcaaggcuuggaggaagcg

SEQ ID NO: 424936 - RNA, 32 nt, Human
gagcgccccacccuucccguggcgugggguga

SEQ ID NO: 424937 - RNA, 21 nt, Human
gagcgcccccuccccucaccu

SEQ ID NO: 424938 - RNA, 18 nt, Human
gagcgccccggagcagca

SEQ ID NO: 424939 - RNA, 32 nt, Human
gagcgcccuccagggacuaugcgugcggggac

SEQ ID NO: 424940 - RNA, 20 nt, Human
gagcgccgcccccugcucca

SEQ ID NO: 424941 - RNA, 23 nt, Human
gagcgccgccuuuguucccugca

SEQ ID NO: 424942 - RNA, 32 nt, Human
gagcgccgcugcuuaccugggugcaggagaca

SEQ ID NO: 424943 - RNA, 32 nt, Human
gagcgccgcuucugcaaccugcgagccugccc

SEQ ID NO: 424944 - RNA, 32 nt, Human
gagcgccgggcagagggggagggggacgaagc

SEQ ID NO: 424945 - RNA, 32 nt, Human
gagcgccggggagggggcgggacagagcuggg

SEQ ID NO: 424946 - RNA, 31 nt, Human
gagcgccgguccucugggcccaguguucuuu

SEQ ID NO: 424947 - RNA, 32 nt, Human
gagcgccguguucuucagccucagcuggaagg

SEQ ID NO: 424948 - RNA, 32 nt, Human
gagcgccguuuccaggcugccuucccuggggu

SEQ ID NO: 424949 - RNA, 32 nt, Human
gagcgccuacugggcauccggccugugcuggg

SEQ ID NO: 424950 - RNA, 32 nt, Human
gagcgccuccaggccagcaucucggccuuccg

SEQ ID NO: 424951 - RNA, 32 nt, Human
gagcgccucugccuggccacccugucugggag

SEQ ID NO: 424952 - RNA, 32 nt, Human
gagcgccugagauccuguucaccaggacucca

SEQ ID NO: 424953 - RNA, 32 nt, Human
gagcgccugcagucccagcuacuugggaggcu

SEQ ID NO: 424954 - RNA, 32 nt, Human
gagcgccugccugccugccgcugcugcgggcg

SEQ ID NO: 424955 - RNA, 32 nt, Human
gagcgccugccugguggcggcggcaacaaugc

SEQ ID NO: 424956 - RNA, 18 nt, Human
gagcgccuggcagcagca

SEQ ID NO: 424957 - RNA, 32 nt, Human
gagcgccuguaaucccagguauuccggaagcu

SEQ ID NO: 424958 - RNA, 32 nt, Human
gagcgccuguagucccagcuacucgagagccu

SEQ ID NO: 424959 - RNA, 32 nt, Human
gagcgccuguagucccagcuacucgggaggcu

SEQ ID NO: 424960 - RNA, 32 nt, Human
gagcgcgcccaggacaucggcaucugguucca

SEQ ID NO: 424961 - RNA, 32 nt, Human
gagcgcgcgucccuucgugccuaggcgagagc

SEQ ID NO: 424962 - RNA, 32 nt, Human
gagcgcgcucugcucccugccuuugccucacu

SEQ ID NO: 424963 - RNA, 32 nt, Human
gagcgcgggagagagugagagagagugagagc

SEQ ID NO: 424964 - RNA, 32 nt, Human
gagcgcgggaggcggcggcggcgcggagccca

SEQ ID NO: 424965 - RNA, 32 nt, Human
gagcgcggggcgccggaggcaggugugggaca

SEQ ID NO: 424966 - RNA, 32 nt, Human
gagcgcuaccggcugaggguggggaagcgcag

SEQ ID NO: 424967 - RNA, 32 nt, Human
gagcgcucgggucaugucugcccagggggacu

SEQ ID NO: 424968 - RNA, 32 nt, Human
gagcgcucucuugauucugggauuucucccuc

SEQ ID NO: 424969 - RNA, 26 nt, Human
gagcgcucuuaaucuccccucuacuu

SEQ ID NO: 424970 - RNA, 32 nt, Human
gagcgcugaaaaguuguuccugaccaggcucu

SEQ ID NO: 424971 - RNA, 32 nt, Human
gagcgcugaugggaaaggaacaaagagggaag

SEQ ID NO: 424972 - RNA, 32 nt, Human
gagcgcugggcgcugggcugugcaccgacggc

SEQ ID NO: 424973 - RNA, 32 nt, Human
gagcgcuggucccaccuccuuccuuccaaacu

SEQ ID NO: 424974 - RNA, 18 nt, Human
gagcgcugguggccccgg

SEQ ID NO: 424975 - RNA, 32 nt, Human
gagcgcuuggaaguuucucuucuaccugggca

SEQ ID NO: 424976 - RNA, 32 nt, Human
gagcggaaaccggccgggcgguuuccagggag

SEQ ID NO: 424977 - RNA, 32 nt, Human
gagcggaaagaaugucggagcgggccgcggau

SEQ ID NO: 424978 - RNA, 32 nt, Human
gagcggaaagagaagagagaagagugagcaga

SEQ ID NO: 424979 - RNA, 32 nt, Human
gagcggaaaugaggggccuggccuggcagccc

SEQ ID NO: 424980 - RNA, 24 nt, Human
gagcggacaucgcgccacugcacu

SEQ ID NO: 424981 - RNA, 21 nt, Human
gagcggagaccauggccccca

SEQ ID NO: 424982 - RNA, 32 nt, Human
gagcggagagagaaggaagaggcgaugugagc

SEQ ID NO: 424983 - RNA, 32 nt, Human
gagcggagagggaaggaggaggaggaggagca

SEQ ID NO: 424984 - RNA, 24 nt, Human
gagcggagaucgcaccacugcacu

SEQ ID NO: 424985 - RNA, 32 nt, Human
gagcggagaucgccccacuacacuccagccug

SEQ ID NO: 424986 - RNA, 24 nt, Human
gagcggagaucgcgccacugcacu

SEQ ID NO: 424987 - RNA, 19 nt, Human
gagcggagauugcagugag

SEQ ID NO: 424988 - RNA, 32 nt, Human
gagcggagcccugcacccuggagaccacaucc

SEQ ID NO: 424989 - RNA, 32 nt, Human
gagcggagcgccgcacguucccaaccgcgagg

SEQ ID NO: 424990 - RNA, 32 nt, Human
gagcggagcuuccuccucugagggccgugccg

SEQ ID NO: 424991 - RNA, 32 nt, Human
gagcggaggaggaggaggaggcgaggaggaga

SEQ ID NO: 424992 - RNA, 32 nt, Human
gagcggauaggggcggcccggagccagccagg

SEQ ID NO: 424993 - RNA, 32 nt, Human
gagcggaugaugaagcagacccccucccuguc

SEQ ID NO: 424994 - RNA, 32 nt, Human
gagcggaugccaccccguuuccagccuccggu

SEQ ID NO: 424995 - RNA, 32 nt, Human
gagcggcaauaugcaggcgccaggccuugcaa

SEQ ID NO: 424996 - RNA, 32 nt, Human
gagcggcacugcacccucacuagccagggugu

SEQ ID NO: 424997 - RNA, 32 nt, Human
gagcggcagagcaguggccuugauuugucuuu

SEQ ID NO: 424998 - RNA, 32 nt, Human
gagcggcagcuccggcgccugguagcgagagg

SEQ ID NO: 424999 - RNA, 32 nt, Human
gagcggcaggacuggauggagcuguucauuga

SEQ ID NO: 425000 - RNA, 19 nt, Human
gagcggcaggggcugcagg

SEQ ID NO: 425001 - RNA, 32 nt, Human
gagcggcaggguggcugcucuccaggagccca

SEQ ID NO: 425002 - RNA, 32 nt, Human
gagcggccaagcagguugggggcgccugcccc

SEQ ID NO: 425003 - RNA, 21 nt, Human
gagcggccaccgagccggcag

SEQ ID NO: 425004 - RNA, 32 nt, Human
gagcggcccauagagguggacggagggcgcga

SEQ ID NO: 425005 - RNA, 32 nt, Human
gagcggccccgccucugcucccaccgagcccu

SEQ ID NO: 425006 - RNA, 32 nt, Human
gagcggccccuggacaguugcagagaaacaca

SEQ ID NO: 425007 - RNA, 32 nt, Human
gagcggcccgggagcggaaagcggcagugucc

SEQ ID NO: 425008 - RNA, 32 nt, Human
gagcggcccugcagggggccagccugggggaa

SEQ ID NO: 425009 - RNA, 32 nt, Human
gagcggccgcaccuugcucucccucgggcugc

SEQ ID NO: 425010 - RNA, 24 nt, Human
gagcggccggcccaccuguccccu

SEQ ID NO: 425011 - RNA, 32 nt, Human
gagcggccgggcuugguaggggagccgagccc

SEQ ID NO: 425012 - RNA, 32 nt, Human
gagcggcgacagcaugagccugugcugaccuc

SEQ ID NO: 425013 - RNA, 32 nt, Human
gagcggcgagcgcagccaugccccaggccgcc

SEQ ID NO: 425014 - RNA, 32 nt, Human
gagcggcgaguggauggggagucuguguggca

SEQ ID NO: 425015 - RNA, 32 nt, Human
gagcggcgccacccagggcugaccucacggcc

SEQ ID NO: 425016 - RNA, 32 nt, Human
gagcggcgccgcgcacuccaacccggcgggca

SEQ ID NO: 425017 - RNA, 32 nt, Human
gagcggcgcgagaaagcuaaaggugauguggc

SEQ ID NO: 425018 - RNA, 32 nt, Human
gagcggcggcgacuugccaguaaggguuugga

SEQ ID NO: 425019 - RNA, 32 nt, Human
gagcggcggcggcggcaacauggcagagaccg

SEQ ID NO: 425020 - RNA, 20 nt, Human
gagcggcgggcccgcagcgg

SEQ ID NO: 425021 - RNA, 32 nt, Human
gagcggcggggguggcuccagcaacggcuggg

SEQ ID NO: 425022 - RNA, 15 nt, Human
gagcggcucucggug

SEQ ID NO: 425023 - RNA, 32 nt, Human
gagcggcugcaacgccggugccugaggagcga

SEQ ID NO: 425024 - RNA, 32 nt, Human
gagcggcugcgggccugcaggggugagcgggg

SEQ ID NO: 425025 - RNA, 22 nt, Human
gagcggcugguaccuguccccu

SEQ ID NO: 425026 - RNA, 32 nt, Human
gagcgggagagggaggagagcuccgaagcgag

SEQ ID NO: 425027 - RNA, 32 nt, Human
gagcgggaggacugcuugaggccaggaguuug

SEQ ID NO: 425028 - RNA, 32 nt, Human
gagcgggagggcagaggugaggagggggaaga

SEQ ID NO: 425029 - RNA, 21 nt, Human
gagcgggaucaagaauuucac

SEQ ID NO: 425030 - RNA, 22 nt, Human
gagcgggcagagcccgcggcgg

SEQ ID NO: 425031 - RNA, 32 nt, Human
gagcgggcagaguggcccagccccaggcagug

SEQ ID NO: 425032 - RNA, 32 nt, Human
gagcgggcccuggagcuugcagucggagggcc

SEQ ID NO: 425033 - RNA, 18 nt, Human
gagcgggccgagccagca

SEQ ID NO: 425034 - RNA, 32 nt, Human
gagcgggcgccucugaaguggagggcgggccg

SEQ ID NO: 425035 - RNA, 32 nt, Human
gagcgggcuccggggcucgggugcagcggcca

SEQ ID NO: 425036 - RNA, 32 nt, Human
gagcggggaccccggagagggagucagccgag

SEQ ID NO: 425037 - RNA, 32 nt, Human
gagcggggacuucgcgcccccaggggaacggg

SEQ ID NO: 425038 - RNA, 32 nt, Human
gagcggggaggcgaggagggggcugugagucc

SEQ ID NO: 425039 - RNA, 32 nt, Human
gagcggggagggaggaagaggggaaugcacau

SEQ ID NO: 425040 - RNA, 32 nt, Human
gagcggggcaggcagggaggcaaggacuggag

SEQ ID NO: 425041 - RNA, 32 nt, Human
gagcggggccugauggcccugaggcaguucgg

SEQ ID NO: 425042 - RNA, 32 nt, Human
gagcggggcugcagaguauccgaggugcugcc

SEQ ID NO: 425043 - RNA, 32 nt, Human
gagcgggggagggagaauccggccggacagau

SEQ ID NO: 425044 - RNA, 32 nt, Human
gagcgggggccgcggccgcgccgcagagaugu

SEQ ID NO: 425045 - RNA, 32 nt, Human
gagcgggggcgagggagcaggagcggccagug

SEQ ID NO: 425046 - RNA, 32 nt, Human
gagcgggggugaggagagucgagggaggugac

SEQ ID NO: 425047 - RNA, 32 nt, Human
gagcggguaggcagagcuucgggaggagauga

SEQ ID NO: 425048 - RNA, 32 nt, Human
gagcgggugggugggugugaagggaugagaau

SEQ ID NO: 425049 - RNA, 32 nt, Human
gagcgguacucgcuuccuccagcguggggagu

SEQ ID NO: 425050 - RNA, 17 nt, Human
gagcgguaggagcagca

SEQ ID NO: 425051 - RNA, 32 nt, Human
gagcgguccaguuucaccugaagaacuuugau

SEQ ID NO: 425052 - RNA, 24 nt, Human
gagcggugauugugccacugcacu

SEQ ID NO: 425053 - RNA, 32 nt, Human
gagcgguggacccaggcggccaugucccgccc

SEQ ID NO: 425054 - RNA, 32 nt, Human
gagcgguggccacagggcugaauggucgcuga

SEQ ID NO: 425055 - RNA, 32 nt, Human
gagcgguggccacagggcugaaugguugcuga

SEQ ID NO: 425056 - RNA, 32 nt, Human
gagcguagccauucgagagcagccugggcaac

SEQ ID NO: 425057 - RNA, 32 nt, Human
gagcguagccugggcaacacagcaagacccca

SEQ ID NO: 425058 - RNA, 32 nt, Human
gagcguaucaaauuugcacuucaugaggauuu

SEQ ID NO: 425059 - RNA, 32 nt, Human
gagcgucauugccaacaagcugggcaaagcug

SEQ ID NO: 425060 - RNA, 32 nt, Human
gagcguccaggaccaggcagagcugggccuua

SEQ ID NO: 425061 - RNA, 21 nt, Human
gagcguccaggcccagaagca

SEQ ID NO: 425062 - RNA, 17 nt, Human
gagcguccggagcagca

SEQ ID NO: 425063 - RNA, 32 nt, Human
gagcguccuggagcuuggggaugcagccagcu

SEQ ID NO: 425064 - RNA, 32 nt, Human
gagcgucgccgagguuugagggcgccggagac

SEQ ID NO: 425065 - RNA, 32 nt, Human
gagcgucucugccuggccacucauugucuggg

SEQ ID NO: 425066 - RNA, 32 nt, Human
gagcgucucugccuggcugcccauugucuggg

SEQ ID NO: 425067 - RNA, 32 nt, Human
gagcgucuggcgcgaucucugccugcuuacuc

SEQ ID NO: 425068 - RNA, 32 nt, Human
gagcgucuucacugacaguggccugagagacg

SEQ ID NO: 425069 - RNA, 32 nt, Human
gagcgugagggccuuccuaucccuccacccac

SEQ ID NO: 425070 - RNA, 32 nt, Human
gagcgugccauccugcccgcacugaagcagac

SEQ ID NO: 425071 - RNA, 32 nt, Human
gagcgugccugccugcucacagaagcugccua

SEQ ID NO: 425072 - RNA, 20 nt, Human
gagcgugcggacuggccucc

SEQ ID NO: 425073 - RNA, 32 nt, Human
gagcgugggaggcgggaguggaguggaagaag

SEQ ID NO: 425074 - RNA, 16 nt, Human
gagcgugggccucaga

SEQ ID NO: 425075 - RNA, 32 nt, Human
gagcguggggccgcuggaaugggugaauuuaa

SEQ ID NO: 425076 - RNA, 32 nt, Human
gagcguguccacagaguuugaguaaauauuau

SEQ ID NO: 425077 - RNA, 32 nt, Human
gagcguguggcaucuccaccucaagggugcag

SEQ ID NO: 425078 - RNA, 32 nt, Human
gagcguguggcugcaggagcuucugugggagu

SEQ ID NO: 425079 - RNA, 32 nt, Human
gagcguguugcggcagcggcugggcuugcaag

SEQ ID NO: 425080 - RNA, 32 nt, Human
gagcguuacauccugauauccuuccaggcugc

SEQ ID NO: 425081 - RNA, 21 nt, Human
gagcguucaccagugaccugg

SEQ ID NO: 425082 - RNA, 32 nt, Human
gagcguuucguuuggacuucucgacuugagug

SEQ ID NO: 425083 - RNA, 32 nt, Human
gagcuaaaagagaccugucucauggucugccc

SEQ ID NO: 425084 - RNA, 19 nt, Human
gagcuaaaccagcccccac

SEQ ID NO: 425085 - RNA, 32 nt, Human
gagcuaaccugggaggugcugaaggggcauug

SEQ ID NO: 425086 - RNA, 32 nt, Human
gagcuaaccuugcccagccucugggaacacuu

SEQ ID NO: 425087 - RNA, 32 nt, Human
gagcuaagauagagucccugccccacugccac

SEQ ID NO: 425088 - RNA, 24 nt, Human
gagcuaagaucacaccacuacacu

SEQ ID NO: 425089 - RNA, 32 nt, Human
gagcuaagaucacaccacuacacuccagccug

SEQ ID NO: 425090 - RNA, 24 nt, Human
gagcuaagaucacaccacugcacu

SEQ ID NO: 425091 - RNA, 24 nt, Human
gagcuaagaucacgccacugcacu

SEQ ID NO: 425092 - RNA, 24 nt, Human
gagcuaagaucacgccauugcacu

SEQ ID NO: 425093 - RNA, 24 nt, Human
gagcuaagaucgcaccacugcacu

SEQ ID NO: 425094 - RNA, 24 nt, Human
gagcuaagauugcaccacugcacu

SEQ ID NO: 425095 - RNA, 32 nt, Human
gagcuaaggaagcgcggcgcgcccccuggugg

SEQ ID NO: 425096 - RNA, 32 nt, Human
gagcuaauaacaccgaggugguggugaggguu

SEQ ID NO: 425097 - RNA, 32 nt, Human
gagcuacaacaacaggucgccuuuuugagacu

SEQ ID NO: 425098 - RNA, 32 nt, Human
gagcuacaaccaucuguuugguuugauguuuu

SEQ ID NO: 425099 - RNA, 32 nt, Human
gagcuacaaugcagaaaagccauggauuaaua

SEQ ID NO: 425100 - RNA, 32 nt, Human
gagcuacacggcaggggcagacacugugagua

SEQ ID NO: 425101 - RNA, 32 nt, Human
gagcuacacguccuuggcgcccagugugagcc

SEQ ID NO: 425102 - RNA, 32 nt, Human
gagcuacagugggacuuggaauccagaugugu

SEQ ID NO: 425103 - RNA, 32 nt, Human
gagcuacaucacacguuuauugugcauugauu

SEQ ID NO: 425104 - RNA, 32 nt, Human
gagcuacauuaaggcucuuucucuaaucgccu

SEQ ID NO: 425105 - RNA, 32 nt, Human
gagcuaccacuggcuacucagaggaggcucau

SEQ ID NO: 425106 - RNA, 32 nt, Human
gagcuaccagcccgggcagacacugaggaccc

SEQ ID NO: 425107 - RNA, 18 nt, Human
gagcuaccaugcccggcu

SEQ ID NO: 425108 - RNA, 32 nt, Human
gagcuaccgcgaggaggagcggcggaggcgac

SEQ ID NO: 425109 - RNA, 17 nt, Human
gagcuaccugagcagca

SEQ ID NO: 425110 - RNA, 19 nt, Human
gagcuacgagccgcggcgg

SEQ ID NO: 425111 - RNA, 24 nt, Human
gagcuacgaucaugccacugcacu

SEQ ID NO: 425112 - RNA, 24 nt, Human
gagcuacgaucgcaccacugcauu

SEQ ID NO: 425113 - RNA, 32 nt, Human
gagcuacgggcugcuguccuggggcgggcacu

SEQ ID NO: 425114 - RNA, 32 nt, Human
gagcuacucaggaaggugggagagagccaagc

SEQ ID NO: 425115 - RNA, 21 nt, Human
gagcuacugcacccggccuaa

SEQ ID NO: 425116 - RNA, 32 nt, Human
gagcuacugccuugcccuuccuucccucccug

SEQ ID NO: 425117 - RNA, 32 nt, Human
gagcuagaacuguucugaauuguuaaaccaca

SEQ ID NO: 425118 - RNA, 32 nt, Human
gagcuagaccacacugaggcgguggucgggac

SEQ ID NO: 425119 - RNA, 32 nt, Human
gagcuagagacaccaucugcaaugaucucuac

SEQ ID NO: 425120 - RNA, 32 nt, Human
gagcuagagcaagggucucuuuaaauguugaa

SEQ ID NO: 425121 - RNA, 32 nt, Human
gagcuagagccaagcccuaggcuugagagaca

SEQ ID NO: 425122 - RNA, 32 nt, Human
gagcuagagcuaagggcgccaggccccaggcu

SEQ ID NO: 425123 - RNA, 32 nt, Human
gagcuagaugaagaaggagcaggcggguucac

SEQ ID NO: 425124 - RNA, 32 nt, Human
gagcuagaugcagagcugaaacccaccuagga

SEQ ID NO: 425125 - RNA, 32 nt, Human
gagcuagccagccagcagagccaaaccuuggc

SEQ ID NO: 425126 - RNA, 32 nt, Human
gagcuagccagccugggcaauaccagaggcgg

SEQ ID NO: 425127 - RNA, 32 nt, Human
gagcuagccauaaagaaauucucugacuuauc

SEQ ID NO: 425128 - RNA, 24 nt, Human
gagcuaggaucacgccacugcacu

SEQ ID NO: 425129 - RNA, 24 nt, Human
gagcuaggaucaggccacugcacu

SEQ ID NO: 425130 - RNA, 24 nt, Human
gagcuaggaucgugccacugcacu

SEQ ID NO: 425131 - RNA, 32 nt, Human
gagcuaggcugaagcagcagaaccacagaggu

SEQ ID NO: 425132 - RNA, 26 nt, Human
gagcuaggcugaaugccucccaggga

SEQ ID NO: 425133 - RNA, 32 nt, Human
gagcuaggcugcagaagacuuaaaaaguugau

SEQ ID NO: 425134 - RNA, 32 nt, Human
gagcuaggcuguuuugcuagagauaauugcaa

SEQ ID NO: 425135 - RNA, 32 nt, Human
gagcuagggagaaaggagacucccccgcggag

SEQ ID NO: 425136 - RNA, 32 nt, Human
gagcuagggcuaagcaguuauuucuuucaagu

SEQ ID NO: 425137 - RNA, 32 nt, Human
gagcuagggcugcugccucagcuccaagacaa

SEQ ID NO: 425138 - RNA, 32 nt, Human
gagcuagggcugcugcuucugcuccagccccu

SEQ ID NO: 425139 - RNA, 31 nt, Human
gagcuagggcuggaaagaagggggagccagg

SEQ ID NO: 425140 - RNA, 32 nt, Human
gagcuagggcuggagggacagggagcagggca

SEQ ID NO: 425141 - RNA, 32 nt, Human
gagcuagggggaggggagggagaugucuuguu

SEQ ID NO: 425142 - RNA, 32 nt, Human
gagcuagugagaggaggaggaggugggcagag

SEQ ID NO: 425143 - RNA, 32 nt, Human
gagcuagugguguuuguccugcuccguccccg

SEQ ID NO: 425144 - RNA, 24 nt, Human
gagcuauaaucgugccacugcacu

SEQ ID NO: 425145 - RNA, 32 nt, Human
gagcuaucacaccuggccccagaaguguuuca

SEQ ID NO: 425146 - RNA, 32 nt, Human
gagcuaucauuaucgacuugggagaaaauuaa

SEQ ID NO: 425147 - RNA, 32 nt, Human
gagcuaucucucucauagcuuuuaugcccuua

SEQ ID NO: 425148 - RNA, 32 nt, Human
gagcuaucuuuugauuccuuuuucaaaccaca

SEQ ID NO: 425149 - RNA, 32 nt, Human
gagcuaugaaccugacaugucaguggccagga

SEQ ID NO: 425150 - RNA, 24 nt, Human
gagcuaugacugcaucacugcacu

SEQ ID NO: 425151 - RNA, 24 nt, Human
gagcuaugacugugccacugcacu

SEQ ID NO: 425152 - RNA, 24 nt, Human
gagcuaugaucacaccacuguacu

SEQ ID NO: 425153 - RNA, 24 nt, Human
gagcuaugaucacgccacugcacu

SEQ ID NO: 425154 - RNA, 24 nt, Human
gagcuaugaucaugccacugcacu

SEQ ID NO: 425155 - RNA, 24 nt, Human
gagcuaugaucgcaccacugcauu

SEQ ID NO: 425156 - RNA, 24 nt, Human
gagcuaugaucgcgccacuacacu

SEQ ID NO: 425157 - RNA, 24 nt, Human
gagcuaugaucgcgccacugcacu

SEQ ID NO: 425158 - RNA, 24 nt, Human
gagcuaugaucgcgccacuguacu

SEQ ID NO: 425159 - RNA, 24 nt, Human
gagcuaugauuacaccacugcacu

SEQ ID NO: 425160 - RNA, 24 nt, Human
gagcuaugauugcaccacugcacu

SEQ ID NO: 425161 - RNA, 24 nt, Human
gagcuaugauuguaccacugcacu

SEQ ID NO: 425162 - RNA, 24 nt, Human
gagcuaugauugugccacugcacu

SEQ ID NO: 425163 - RNA, 32 nt, Human
gagcuaugcuacagcuaugggacccuuucuua

SEQ ID NO: 425164 - RNA, 32 nt, Human
gagcuaugcucacaccacugcacuccauccug

SEQ ID NO: 425165 - RNA, 24 nt, Human
gagcuaugguaacaccacugcacu

SEQ ID NO: 425166 - RNA, 32 nt, Human
gagcuauuggguggaccaagcgggugaggcgc

SEQ ID NO: 425167 - RNA, 21 nt, Human
gagcucaaacacgccaaggca

SEQ ID NO: 425168 - RNA, 32 nt, Human
gagcucaacaguuccagaccagccugggcaau

SEQ ID NO: 425169 - RNA, 32 nt, Human
gagcucaaccaaaggcuggcaagcucugggcc

SEQ ID NO: 425170 - RNA, 32 nt, Human
gagcucaacuucgcacagcccuucccagcucc

SEQ ID NO: 425171 - RNA, 32 nt, Human
gagcucaagaggccgagguugcagugagccgu

SEQ ID NO: 425172 - RNA, 32 nt, Human
gagcucaagagguugaggcugcagugagcccu

SEQ ID NO: 425173 - RNA, 32 nt, Human
gagcucaagaguucaagaccagccugggaaac

SEQ ID NO: 425174 - RNA, 32 nt, Human
gagcucaagcacuccgggggcuccgagacagc

SEQ ID NO: 425175 - RNA, 24 nt, Human
gagcucaagccaagcccagaggca

SEQ ID NO: 425176 - RNA, 32 nt, Human
gagcucaagccuuucuccugugcucaaguccc

SEQ ID NO: 425177 - RNA, 17 nt, Human
gagcucacaaggcagca

SEQ ID NO: 425178 - RNA, 32 nt, Human
gagcucacacccucaaacuccucaauaaacgc

SEQ ID NO: 425179 - RNA, 32 nt, Human
gagcucacagaguucuuggaauaaaagcaacc

SEQ ID NO: 425180 - RNA, 32 nt, Human
gagcucaccacugagcuuccugggaugggcac

SEQ ID NO: 425181 - RNA, 32 nt, Human
gagcucacccacccuuccaacaugcgcuucau

SEQ ID NO: 425182 - RNA, 32 nt, Human
gagcucacuaaaaugcuaauuaggcaaaaaca

SEQ ID NO: 425183 - RNA, 32 nt, Human
gagcucacugaaaagcaaaugugaauuaaaau

SEQ ID NO: 425184 - RNA, 32 nt, Human
gagcucacugagccuccaccuggggucucugc

SEQ ID NO: 425185 - RNA, 32 nt, Human
gagcucacugagcuccuugccucccacaacaa

SEQ ID NO: 425186 - RNA, 32 nt, Human
gagcucacugcaaccucugacucccagacuca

SEQ ID NO: 425187 - RNA, 32 nt, Human
gagcucacugcaaccucugccucccaaguuca

SEQ ID NO: 425188 - RNA, 32 nt, Human
gagcucacugcacuccagcagucaugggaccc

SEQ ID NO: 425189 - RNA, 32 nt, Human
gagcucacugcagcuucaacaccccagggcuc

SEQ ID NO: 425190 - RNA, 32 nt, Human
gagcucacugcagcuucaaucuccuggcucaa

SEQ ID NO: 425191 - RNA, 32 nt, Human
gagcucacugcauccuugaccucccagacuca

SEQ ID NO: 425192 - RNA, 32 nt, Human
gagcucacugccuaccuggccuggggcugucu

SEQ ID NO: 425193 - RNA, 21 nt, Human
gagcucagaaaccuacuguua

SEQ ID NO: 425194 - RNA, 32 nt, Human
gagcucagaaucugacagccucucccccauuc

SEQ ID NO: 425195 - RNA, 20 nt, Human
gagcucagaggagucuggga

SEQ ID NO: 425196 - RNA, 32 nt, Human
gagcucagaguccugacagcagcuucagagga

SEQ ID NO: 425197 - RNA, 32 nt, Human
gagcucagauagugccacugcacuccagccug

SEQ ID NO: 425198 - RNA, 24 nt, Human
gagcucagaucacaccacugcacu

SEQ ID NO: 425199 - RNA, 32 nt, Human
gagcucagauggugccacugcacuccagccug

SEQ ID NO: 425200 - RNA, 24 nt, Human
gagcucagauugcgucacugcacu

SEQ ID NO: 425201 - RNA, 32 nt, Human
gagcucagcaggcagacgaaugaggaauaaag

SEQ ID NO: 425202 - RNA, 32 nt, Human
gagcucagcaguguuuaaugauccucuuccac

SEQ ID NO: 425203 - RNA, 32 nt, Human
gagcucagcauagacccagcucucugggggau

SEQ ID NO: 425204 - RNA, 32 nt, Human
gagcucagccaagaaauagccacagaagguac

SEQ ID NO: 425205 - RNA, 32 nt, Human
gagcucagccugugggcagggugccggacaaa

SEQ ID NO: 425206 - RNA, 32 nt, Human
gagcucagcgaggcagaggguggggcugcaca

SEQ ID NO: 425207 - RNA, 32 nt, Human
gagcucagcggccucagauccugggaccccug

SEQ ID NO: 425208 - RNA, 32 nt, Human
gagcucagcucaggccagggcugggcugugca

SEQ ID NO: 425209 - RNA, 32 nt, Human
gagcucagcugcaggaaggacaucccagaagc

SEQ ID NO: 425210 - RNA, 32 nt, Human
gagcucaggagaaggggagagacaggucgccc

SEQ ID NO: 425211 - RNA, 32 nt, Human
gagcucaggagcuugagaccagccugggcaac

SEQ ID NO: 425212 - RNA, 32 nt, Human
gagcucaggaggcagagguugcagugagccaa

SEQ ID NO: 425213 - RNA, 32 nt, Human
gagcucaggaggcagagguugcagugagcuga

SEQ ID NO: 425214 - RNA, 18 nt, Human
gagcucaggaggucgagg

SEQ ID NO: 425215 - RNA, 32 nt, Human
gagcucaggagguugaggcugcagagaguggu

SEQ ID NO: 425216 - RNA, 32 nt, Human
gagcucaggagguugggucugcagugagcuau

SEQ ID NO: 425217 - RNA, 32 nt, Human
gagcucaggaguucaagaccagccuggacaac

SEQ ID NO: 425218 - RNA, 32 nt, Human
gagcucaggaguucaagaccagccugggcaac

SEQ ID NO: 425219 - RNA, 32 nt, Human
gagcucaggaguucaagaccagccugggcagc

SEQ ID NO: 425220 - RNA, 23 nt, Human
gagcucaggaguuccagaccagc

SEQ ID NO: 425221 - RNA, 23 nt, Human
gagcucaggaguucgaaccaguu

SEQ ID NO: 425222 - RNA, 18 nt, Human
gagcucaggaguucgaga

SEQ ID NO: 425223 - RNA, 24 nt, Human
gagcucaggaguucgagaccagcu

SEQ ID NO: 425224 - RNA, 32 nt, Human
gagcucaggaguucgagagcagccugggcaac

SEQ ID NO: 425225 - RNA, 32 nt, Human
gagcucaggaguuugaaaccagucuggacaac

SEQ ID NO: 425226 - RNA, 32 nt, Human
gagcucaggaguuugagaccagccugggcaac

SEQ ID NO: 425227 - RNA, 32 nt, Human
gagcucaggaguuugagaccagccugggcaau

SEQ ID NO: 425228 - RNA, 24 nt, Human
gagcucaggaguuugagaccagcu

SEQ ID NO: 425229 - RNA, 32 nt, Human
gagcucaggaguuugagaccagcugggcaaca

SEQ ID NO: 425230 - RNA, 32 nt, Human
gagcucaggcagaucacuugaggucaggaguu

SEQ ID NO: 425231 - RNA, 32 nt, Human
gagcucaggcccaaguggaguuugcagacaua

SEQ ID NO: 425232 - RNA, 19 nt, Human
gagcucagggcacccagug

SEQ ID NO: 425233 - RNA, 32 nt, Human
gagcucagggccugucagaccuggugacaagu

SEQ ID NO: 425234 - RNA, 18 nt, Human
gagcucaggggccgcagg

SEQ ID NO: 425235 - RNA, 32 nt, Human
gagcucagggggccaaggcugcagugagucau

SEQ ID NO: 425236 - RNA, 23 nt, Human
gagcucagggguuucagaccagc

SEQ ID NO: 425237 - RNA, 32 nt, Human
gagcucagggguuugagaccagccugggcaac

SEQ ID NO: 425238 - RNA, 32 nt, Human
gagcucaguaguucaaaaucagccugggguau

SEQ ID NO: 425239 - RNA, 32 nt, Human
gagcucaucacugugggauggugaccugcaga

SEQ ID NO: 425240 - RNA, 25 nt, Human
gagcucaugaucauaccacugcacu

SEQ ID NO: 425241 - RNA, 32 nt, Human
gagcucaugcccuuccuuccucuuuauucgag

SEQ ID NO: 425242 - RNA, 32 nt, Human
gagcucaugcgacugcacuccagccuggguga

SEQ ID NO: 425243 - RNA, 18 nt, Human
gagcucauuccaccagug

SEQ ID NO: 425244 - RNA, 32 nt, Human
gagcuccaaagugcacaucugguuccaacuug

SEQ ID NO: 425245 - RNA, 32 nt, Human
gagcuccaaauuuuggauuaucgggccugugc

SEQ ID NO: 425246 - RNA, 32 nt, Human
gagcuccacucugcuucucugacuucugccug

SEQ ID NO: 425247 - RNA, 32 nt, Human
gagcuccacuuggacaugggccccagauacca

SEQ ID NO: 425248 - RNA, 32 nt, Human
gagcuccagagaaaaagagagcgagagagaac

SEQ ID NO: 425249 - RNA, 32 nt, Human
gagcuccagccgcgcucucucccggcaguggc

SEQ ID NO: 425250 - RNA, 32 nt, Human
gagcuccagccugucugcuccccagcucugua

SEQ ID NO: 425251 - RNA, 17 nt, Human
gagcuccaggcuggcug

SEQ ID NO: 425252 - RNA, 18 nt, Human
gagcuccagggcuggcug

SEQ ID NO: 425253 - RNA, 32 nt, Human
gagcuccagucugcaagagucaggagccgaaa

SEQ ID NO: 425254 - RNA, 32 nt, Human
gagcuccauaaauccuucuugggugaagccua

SEQ ID NO: 425255 - RNA, 32 nt, Human
gagcuccauccuguggcugcucaggggcugaa

SEQ ID NO: 425256 - RNA, 32 nt, Human
gagcuccauuaauguaaucaaaaugaaauaua

SEQ ID NO: 425257 - RNA, 32 nt, Human
gagcucccaagugccggccaccgcugucaggg

SEQ ID NO: 425258 - RNA, 22 nt, Human
gagcucccacaagccugaggga

SEQ ID NO: 425259 - RNA, 32 nt, Human
gagcucccaccacugcacuccagccugggcga

SEQ ID NO: 425260 - RNA, 21 nt, Human
gagcucccacugcuccuuggg

SEQ ID NO: 425261 - RNA, 24 nt, Human
gagcucccagagcagcuucaggga

SEQ ID NO: 425262 - RNA, 32 nt, Human
gagcucccagcacuggagacccacggacucaa

SEQ ID NO: 425263 - RNA, 19 nt, Human
gagcucccaggcgcccggg

SEQ ID NO: 425264 - RNA, 32 nt, Human
gagcucccauguccaaaccauccugaagggcu

SEQ ID NO: 425265 - RNA, 22 nt, Human
gagcucccccagccucagugga

SEQ ID NO: 425266 - RNA, 32 nt, Human
gagcucccccuuccucucggucucccucucgg

SEQ ID NO: 425267 - RNA, 32 nt, Human
gagcucccccuucggagcucuucccugggccu

SEQ ID NO: 425268 - RNA, 32 nt, Human
gagcuccccugcccucuggcuuccugcugagg

SEQ ID NO: 425269 - RNA, 22 nt, Human
gagcucccgagaggcccccggg

SEQ ID NO: 425270 - RNA, 32 nt, Human
gagcucccggcggcccagccccgaggcucugc

SEQ ID NO: 425271 - RNA, 32 nt, Human
gagcucccgggcuccggcagcgggcuggcggg

SEQ ID NO: 425272 - RNA, 20 nt, Human
gagcucccggggcgcccggg

SEQ ID NO: 425273 - RNA, 32 nt, Human
gagcucccucaaagaccucuggcugcagugug

SEQ ID NO: 425274 - RNA, 32 nt, Human
gagcucccugaaggcagaucugagggaggaga

SEQ ID NO: 425275 - RNA, 32 nt, Human
gagcuccgagaguucaacaccagccugggcca

SEQ ID NO: 425276 - RNA, 32 nt, Human
gagcuccgcccuagcccgcagcucuuccgccu

SEQ ID NO: 425277 - RNA, 18 nt, Human
gagcuccgccgaguagca

SEQ ID NO: 425278 - RNA, 32 nt, Human
gagcuccuaggaccaggcugaggcccagggac

SEQ ID NO: 425279 - RNA, 32 nt, Human
gagcuccuagucacagcagguggaccucgugc

SEQ ID NO: 425280 - RNA, 32 nt, Human
gagcuccuagucuguguucccugaagggacac

SEQ ID NO: 425281 - RNA, 32 nt, Human
gagcuccuccaccccugucauucacuuccaau

SEQ ID NO: 425282 - RNA, 32 nt, Human
gagcuccugaaggccacugaaggaggugcagc

SEQ ID NO: 425283 - RNA, 24 nt, Human
gagcuccugaccucaggugaucua

SEQ ID NO: 425284 - RNA, 24 nt, Human
gagcuccugagcucaaacaaucca

SEQ ID NO: 425285 - RNA, 20 nt, Human
gagcuccugaguguucucau

SEQ ID NO: 425286 - RNA, 32 nt, Human
gagcuccugcagccacagcugcagccgcaggc

SEQ ID NO: 425287 - RNA, 32 nt, Human
gagcuccugcagcucaccugagcccacagacu

SEQ ID NO: 425288 - RNA, 32 nt, Human
gagcuccugccugagcuggaccuuaugcaaac

SEQ ID NO: 425289 - RNA, 32 nt, Human
gagcuccugccuggauucccagcacuuuggga

SEQ ID NO: 425290 - RNA, 32 nt, Human
gagcuccugcgaccuggcugagcuccugccuc

SEQ ID NO: 425291 - RNA, 32 nt, Human
gagcuccuggaccaaugcaucuucccaccacc

SEQ ID NO: 425292 - RNA, 32 nt, Human
gagcuccuggagaagagaggagacaugucagg

SEQ ID NO: 425293 - RNA, 29 nt, Human
gagcuccuggcuuccgcaucccccaaggc

SEQ ID NO: 425294 - RNA, 32 nt, Human
gagcuccugggugagcagcugcucugagacaa

SEQ ID NO: 425295 - RNA, 32 nt, Human
gagcuccuuagccugccugccaccucacuggc

SEQ ID NO: 425296 - RNA, 32 nt, Human
gagcuccuuaucuguaggaugugcaguaaaca

SEQ ID NO: 425297 - RNA, 32 nt, Human
gagcuccuuuaaucuucccagcagguuuuugc

SEQ ID NO: 425298 - RNA, 20 nt, Human
gagcucgagaccagcuuggc

SEQ ID NO: 425299 - RNA, 32 nt, Human
gagcucgcagugagccgagaucacgccacugc

SEQ ID NO: 425300 - RNA, 23 nt, Human
gagcucgccccuccccucagccu

SEQ ID NO: 425301 - RNA, 20 nt, Human
gagcucgccggggcgccggg

SEQ ID NO: 425302 - RNA, 32 nt, Human
gagcucgcgccauugcacuccagccuuggaac

SEQ ID NO: 425303 - RNA, 32 nt, Human
gagcucgcgccgcggcagcccagccgcucggc

SEQ ID NO: 425304 - RNA, 32 nt, Human
gagcucggaagauggaggcugcagugagccau

SEQ ID NO: 425305 - RNA, 32 nt, Human
gagcucggagcacagccaucugcucguguccc

SEQ ID NO: 425306 - RNA, 32 nt, Human
gagcucggaucccaguguggaccuggacucga

SEQ ID NO: 425307 - RNA, 32 nt, Human
gagcucuagccaucucucggucacuggcaaua

SEQ ID NO: 425308 - RNA, 32 nt, Human
gagcucuagcugcaggcugccuggguggccuu

SEQ ID NO: 425309 - RNA, 32 nt, Human
gagcucuagggaggcugguggaagcggcuggg

SEQ ID NO: 425310 - RNA, 32 nt, Human
gagcucuauuaugcaauacucucuccauacug

SEQ ID NO: 425311 - RNA, 32 nt, Human
gagcucuauucuguaccugccacucuauuucu

SEQ ID NO: 425312 - RNA, 32 nt, Human
gagcucuauucuugccccuacucuccaacuca

SEQ ID NO: 425313 - RNA, 32 nt, Human
gagcucucaccaggaguaggcagguggauccu

SEQ ID NO: 425314 - RNA, 32 nt, Human
gagcucucacccagagcgucagugaguuggug

SEQ ID NO: 425315 - RNA, 32 nt, Human
gagcucuccaaggagcaggagcugggugaucu

SEQ ID NO: 425316 - RNA, 32 nt, Human
gagcucuccagcccugccuagugggcgcccug

SEQ ID NO: 425317 - RNA, 32 nt, Human
gagcucuccagccucggcgccuggggcagcgg

SEQ ID NO: 425318 - RNA, 32 nt, Human
gagcucucccacucucagacccucuuuugucu

SEQ ID NO: 425319 - RNA, 32 nt, Human
gagcucucccuaugcuaccagaaggccuugcu

SEQ ID NO: 425320 - RNA, 32 nt, Human
gagcucuccuauauuaucauacucagauaacc

SEQ ID NO: 425321 - RNA, 32 nt, Human
gagcucuccugcaguuucuuccuugcuccuuc

SEQ ID NO: 425322 - RNA, 32 nt, Human
gagcucucgccaggaccccaaggcuguugguc

SEQ ID NO: 425323 - RNA, 32 nt, Human
gagcucucuaaggagcuaagguccaugggaau

SEQ ID NO: 425324 - RNA, 32 nt, Human
gagcucucucaggaccaaacacugagcauguu

SEQ ID NO: 425325 - RNA, 32 nt, Human
gagcucucuguggugcuggcagcgacaugugg

SEQ ID NO: 425326 - RNA, 19 nt, Human
gagcucugagaaaagggac

SEQ ID NO: 425327 - RNA, 32 nt, Human
gagcucugagcagcagcaggcaacuucgagaa

SEQ ID NO: 425328 - RNA, 32 nt, Human
gagcucugagguggcacccugccugacuccaa

SEQ ID NO: 425329 - RNA, 32 nt, Human
gagcucugagucugucacucucccucugcuac

SEQ ID NO: 425330 - RNA, 31 nt, Human
gagcucugaguguccacgggugaagaaguga

SEQ ID NO: 425331 - RNA, 24 nt, Human
gagcucugaucacuccacugcacu

SEQ ID NO: 425332 - RNA, 24 nt, Human
gagcucugauugcgccacugcacu

SEQ ID NO: 425333 - RNA, 32 nt, Human
gagcucuggaaagaaggaugucaagaagguga

SEQ ID NO: 425334 - RNA, 32 nt, Human
gagcucuggacagagaaaaacaggcccuagaa

SEQ ID NO: 425335 - RNA, 32 nt, Human
gagcucuggaggcugggcuggccaagcgcccc

SEQ ID NO: 425336 - RNA, 32 nt, Human
gagcucuggagguggaggcugccaugagccau

SEQ ID NO: 425337 - RNA, 32 nt, Human
gagcucuggaguuugagaccagccugggcaac

SEQ ID NO: 425338 - RNA, 32 nt, Human
gagcucuggaucucagcugugguuccuuucua

SEQ ID NO: 425339 - RNA, 19 nt, Human
gagcucuggauucgucuug

SEQ ID NO: 425340 - RNA, 32 nt, Human
gagcucuggccaccagcugaccuuuagcaaga

SEQ ID NO: 425341 - RNA, 32 nt, Human
gagcucuggccacuucugcccacuucauuagg

SEQ ID NO: 425342 - RNA, 32 nt, Human
gagcucuggccaggcugugccagugugucccg

SEQ ID NO: 425343 - RNA, 29 nt, Human
gagcucuggcugcaggcaucuccauggcc

SEQ ID NO: 425344 - RNA, 32 nt, Human
gagcucugggagcaaggaccaccugguaacaa

SEQ ID NO: 425345 - RNA, 32 nt, Human
gagcucugggagguggaagcauggggugggau

SEQ ID NO: 425346 - RNA, 32 nt, Human
gagcucugggcaacaggaggaggcccggugcc

SEQ ID NO: 425347 - RNA, 32 nt, Human
gagcucugggcagaggcaggggagaggacaca

SEQ ID NO: 425348 - RNA, 19 nt, Human
gagcucuggugauaaggac

SEQ ID NO: 425349 - RNA, 32 nt, Human
gagcucuguagccagccucuucugcgcaccca

SEQ ID NO: 425350 - RNA, 32 nt, Human
gagcucuguagccuggucugugcauuguggcu

SEQ ID NO: 425351 - RNA, 20 nt, Human
gagcucuguaggccucagag

SEQ ID NO: 425352 - RNA, 32 nt, Human
gagcucugucucccucccaacccaggguugcc

SEQ ID NO: 425353 - RNA, 32 nt, Human
gagcucugugccaggcccaccuugcggcccug

SEQ ID NO: 425354 - RNA, 32 nt, Human
gagcucuguggugucugugggucccccugagg

SEQ ID NO: 425355 - RNA, 32 nt, Human
gagcucuuagccaauccuaugcagagagcauc

SEQ ID NO: 425356 - RNA, 32 nt, Human
gagcucuucaauucugaauugucugccacuua

SEQ ID NO: 425357 - RNA, 32 nt, Human
gagcucuucaucuuaccgguggagauucauua

SEQ ID NO: 425358 - RNA, 32 nt, Human
gagcucuuccaggagccaccuugccacccauu

SEQ ID NO: 425359 - RNA, 32 nt, Human
gagcucuuccccucaacuugucugggcccauc

SEQ ID NO: 425360 - RNA, 32 nt, Human
gagcucuuccugcuucucuccccaucaccaug

SEQ ID NO: 425361 - RNA, 25 nt, Human
gagcucuugaaaggccacccaggag

SEQ ID NO: 425362 - RNA, 32 nt, Human
gagcucuuggacccuccucuucacggacccaa

SEQ ID NO: 425363 - RNA, 32 nt, Human
gagcucuuggagagccaaggccagccaagagc

SEQ ID NO: 425364 - RNA, 32 nt, Human
gagcucuugugaauauuguggcucccuggggg

SEQ ID NO: 425365 - RNA, 32 nt, Human
gagcucuugugacgcggaccucagugccagga

SEQ ID NO: 425366 - RNA, 32 nt, Human
gagcucuuucccucagggucucagggagccag

SEQ ID NO: 425367 - RNA, 32 nt, Human
gagcucuuuuugaaagaacuaguuucuuuuua

SEQ ID NO: 425368 - RNA, 32 nt, Human
gagcugaaaaacacagcaugagaacuucguga

SEQ ID NO: 425369 - RNA, 32 nt, Human
gagcugaaaaucugaaucagaaagcuuucuca

SEQ ID NO: 425370 - RNA, 32 nt, Human
gagcugaaaaugcagauuuagcaucaagcaca

SEQ ID NO: 425371 - RNA, 32 nt, Human
gagcugaaaccaggggugcagcugucagguag

SEQ ID NO: 425372 - RNA, 24 nt, Human
gagcugaaaucacgccacugcacu

SEQ ID NO: 425373 - RNA, 24 nt, Human
gagcugaaaucgcgccauugcacu

SEQ ID NO: 425374 - RNA, 32 nt, Human
gagcugaaaucgcguaccacacuccagccugg

SEQ ID NO: 425375 - RNA, 32 nt, Human
gagcugaaauggugccacugcacuccagucug

SEQ ID NO: 425376 - RNA, 32 nt, Human
gagcugaaauuguaccaacuccucuggcccuc

SEQ ID NO: 425377 - RNA, 32 nt, Human
gagcugaacaccaagggaagcaaauucauguc

SEQ ID NO: 425378 - RNA, 32 nt, Human
gagcugaagagggaggaaggggcggcugcuca

SEQ ID NO: 425379 - RNA, 32 nt, Human
gagcugaagcccuaaggaaggcugggcccgua

SEQ ID NO: 425380 - RNA, 32 nt, Human
gagcugaaggcaggagccgccgccacgggcag

SEQ ID NO: 425381 - RNA, 32 nt, Human
gagcugaauccuucaaaggcacagcaggcaga

SEQ ID NO: 425382 - RNA, 32 nt, Human
gagcugaauuuacuuggcucccauuagaaacu

SEQ ID NO: 425383 - RNA, 32 nt, Human
gagcugaauuuuuccuuuuuguauuuucuuag

SEQ ID NO: 425384 - RNA, 18 nt, Human
gagcugacaaucaauuca

SEQ ID NO: 425385 - RNA, 24 nt, Human
gagcugacaccacgccacugcacu

SEQ ID NO: 425386 - RNA, 24 nt, Human
gagcugacauugcgccacugcacu

SEQ ID NO: 425387 - RNA, 32 nt, Human
gagcugacccagagguggaggccacggaggca

SEQ ID NO: 425388 - RNA, 32 nt, Human
gagcugaccccacuccaggaccuaggcccagc

SEQ ID NO: 425389 - RNA, 32 nt, Human
gagcugaccugaccaggcaaggcugcugucuc

SEQ ID NO: 425390 - RNA, 32 nt, Human
gagcugacgggaggggaaacggaggggcaggu

SEQ ID NO: 425391 - RNA, 32 nt, Human
gagcugacggucaagaaagaagagaagauaug

SEQ ID NO: 425392 - RNA, 32 nt, Human
gagcugacugagggaagaugcaccuugaucuc

SEQ ID NO: 425393 - RNA, 32 nt, Human
gagcugacugccuccagggcuggaauccugug

SEQ ID NO: 425394 - RNA, 19 nt, Human
gagcugagaagacagcuca

SEQ ID NO: 425395 - RNA, 32 nt, Human
gagcugagaagcagggucaaagcacaauacug

SEQ ID NO: 425396 - RNA, 23 nt, Human
gagcugagacagccacccagggg

SEQ ID NO: 425397 - RNA, 24 nt, Human
gagcugagaccacaccacugcacu

SEQ ID NO: 425398 - RNA, 32 nt, Human
gagcugagacggugucacugcacuccagccug

SEQ ID NO: 425399 - RNA, 32 nt, Human
gagcugagagagaagaaaaauuaccagauauc

SEQ ID NO: 425400 - RNA, 32 nt, Human
gagcugagauagugccucugcacuccagccug

SEQ ID NO: 425401 - RNA, 24 nt, Human
gagcugagaucacaccacugcacu

SEQ ID NO: 425402 - RNA, 32 nt, Human
gagcugagaucacaccacuguauuccagccug

SEQ ID NO: 425403 - RNA, 24 nt, Human
gagcugagaucacaccauugcacu

SEQ ID NO: 425404 - RNA, 24 nt, Human
gagcugagaucacacuacugcacu

SEQ ID NO: 425405 - RNA, 24 nt, Human
gagcugagaucacgccacuacacu

SEQ ID NO: 425406 - RNA, 32 nt, Human
gagcugagaucacgccacuacacuccaaccug

SEQ ID NO: 425407 - RNA, 24 nt, Human
gagcugagaucacgccacugcacu

SEQ ID NO: 425408 - RNA, 32 nt, Human
gagcugagaucacgccauuacacuccagccug

SEQ ID NO: 425409 - RNA, 24 nt, Human
gagcugagaucacgccauugcacu

SEQ ID NO: 425410 - RNA, 32 nt, Human
gagcugagaucaggcacuucagccugggcgac

SEQ ID NO: 425411 - RNA, 32 nt, Human
gagcugagaucaugccauuacacuccagccug

SEQ ID NO: 425412 - RNA, 32 nt, Human
gagcugagaucgcaccaccacacuccagccug

SEQ ID NO: 425413 - RNA, 24 nt, Human
gagcugagaucgcaccacugcacu

SEQ ID NO: 425414 - RNA, 24 nt, Human
gagcugagaucgcaccagugcacu

SEQ ID NO: 425415 - RNA, 24 nt, Human
gagcugagaucgcaccauuacacu

SEQ ID NO: 425416 - RNA, 32 nt, Human
gagcugagaucgcaccauuacacuccagccug

SEQ ID NO: 425417 - RNA, 24 nt, Human
gagcugagaucgcaccauugcacu

SEQ ID NO: 425418 - RNA, 32 nt, Human
gagcugagaucgccccacugcuuuucaaccug

SEQ ID NO: 425419 - RNA, 24 nt, Human
gagcugagaucgcgccacugcacu

SEQ ID NO: 425420 - RNA, 21 nt, Human
gagcugagaucgcgccaguac

SEQ ID NO: 425421 - RNA, 32 nt, Human
gagcugagaucgcgccaguacacuccagccug

SEQ ID NO: 425422 - RNA, 24 nt, Human
gagcugagaucgcgccauugcacu

SEQ ID NO: 425423 - RNA, 32 nt, Human
gagcugagaucgcgucaguacacuccagccug

SEQ ID NO: 425424 - RNA, 32 nt, Human
gagcugagaucgugccauuacacuccagccug

SEQ ID NO: 425425 - RNA, 32 nt, Human
gagcugagaucgugccguuacucuccaaccug

SEQ ID NO: 425426 - RNA, 32 nt, Human
gagcugagaucgugucacuacacuccaggcug

SEQ ID NO: 425427 - RNA, 32 nt, Human
gagcugagaugguaccacugcacuccagccug

SEQ ID NO: 425428 - RNA, 32 nt, Human
gagcugagauggugccacugcacuccagauga

SEQ ID NO: 425429 - RNA, 32 nt, Human
gagcugagauggugccacugcacuccagccug

SEQ ID NO: 425430 - RNA, 32 nt, Human
gagcugagauggugccacugcacuccagcuua

SEQ ID NO: 425431 - RNA, 19 nt, Human
gagcugagaugugacugca

SEQ ID NO: 425432 - RNA, 24 nt, Human
gagcugagauuacaccacugcacu

SEQ ID NO: 425433 - RNA, 24 nt, Human
gagcugagauugcaccacuacacu

SEQ ID NO: 425434 - RNA, 32 nt, Human
gagcugagauugcaccacuacacuccagccug

SEQ ID NO: 425435 - RNA, 24 nt, Human
gagcugagauugcaccacugcacu

SEQ ID NO: 425436 - RNA, 24 nt, Human
gagcugagauugcaccauugcacu

SEQ ID NO: 425437 - RNA, 24 nt, Human
gagcugagauugcgccaccgcacu

SEQ ID NO: 425438 - RNA, 23 nt, Human
gagcugagauugcgccacugcac

SEQ ID NO: 425439 - RNA, 24 nt, Human
gagcugagauugcgccacugcacu

SEQ ID NO: 425440 - RNA, 24 nt, Human
gagcugagauugcgccauugcacu

SEQ ID NO: 425441 - RNA, 32 nt, Human
gagcugagauugugccacuacacuccagccug

SEQ ID NO: 425442 - RNA, 21 nt, Human
gagcugagcaagaacauccca

SEQ ID NO: 425443 - RNA, 32 nt, Human
gagcugagcacugccuagccugggccagaggg

SEQ ID NO: 425444 - RNA, 32 nt, Human
gagcugagcagcgggggagaugaaucaccucc

SEQ ID NO: 425445 - RNA, 32 nt, Human
gagcugagccaaggaaaaucagcugagcccag

SEQ ID NO: 425446 - RNA, 32 nt, Human
gagcugagccaauguguggccuagcggaagcu

SEQ ID NO: 425447 - RNA, 32 nt, Human
gagcugagcccaggcugcguagugaccacaag

SEQ ID NO: 425448 - RNA, 32 nt, Human
gagcugagccgaagcuucaccaaccagaucau

SEQ ID NO: 425449 - RNA, 32 nt, Human
gagcugagccggacccuccaccuggaggaggu

SEQ ID NO: 425450 - RNA, 32 nt, Human
gagcugagccugauucaaaugguuuuucugcu

SEQ ID NO: 425451 - RNA, 32 nt, Human
gagcugaggaaggcagaucuggccucagcuau

SEQ ID NO: 425452 - RNA, 32 nt, Human
gagcugaggacuuggcccugccugcacuguau

SEQ ID NO: 425453 - RNA, 32 nt, Human
gagcugaggagaaauaugaaaucucccugcuc

SEQ ID NO: 425454 - RNA, 32 nt, Human
gagcugaggaggagcugaaaaugcagauuuag

SEQ ID NO: 425455 - RNA, 32 nt, Human
gagcugaggaguuugagaccagccugggcaac

SEQ ID NO: 425456 - RNA, 32 nt, Human
gagcugaggccaucuguguggugguggcugau

SEQ ID NO: 425457 - RNA, 32 nt, Human
gagcugagggagcagucuccacgaggacccag

SEQ ID NO: 425458 - RNA, 19 nt, Human
gagcugaguacucaggcca

SEQ ID NO: 425459 - RNA, 25 nt, Human
gagcugaguaguggggauccagaga

SEQ ID NO: 425460 - RNA, 32 nt, Human
gagcugaguauaaaggggucaccagagaaccc

SEQ ID NO: 425461 - RNA, 32 nt, Human
gagcugagucaggucugcaguccuggugaggg

SEQ ID NO: 425462 - RNA, 32 nt, Human
gagcugaguggagccaggcuggcccagagcug

SEQ ID NO: 425463 - RNA, 32 nt, Human
gagcugaguuccagggcuguguccugcagugg

SEQ ID NO: 425464 - RNA, 24 nt, Human
gagcugauauugugccacugcacu

SEQ ID NO: 425465 - RNA, 22 nt, Human
gagcugaucaugccacugcacu

SEQ ID NO: 425466 - RNA, 32 nt, Human
gagcugaugagccguccccugggcuugaaauc

SEQ ID NO: 425467 - RNA, 31 nt, Human
gagcugaugggcuccccucuggcuaccuggg

SEQ ID NO: 425468 - RNA, 20 nt, Human
gagcugcaagcccguggccu

SEQ ID NO: 425469 - RNA, 22 nt, Human
gagcugcacagccacucagagg

SEQ ID NO: 425470 - RNA, 32 nt, Human
gagcugcacagcugcucccagagccugagcau

SEQ ID NO: 425471 - RNA, 32 nt, Human
gagcugcacguuggaggggaagugaauucacc

SEQ ID NO: 425472 - RNA, 23 nt, Human
gagcugcacucucccuccugccu

SEQ ID NO: 425473 - RNA, 31 nt, Human
gagcugcacugcaccagccagggcugucaag

SEQ ID NO: 425474 - RNA, 32 nt, Human
gagcugcacugcauuccagccugggugacaga

SEQ ID NO: 425475 - RNA, 32 nt, Human
gagcugcacuuaacuguucucuuucuggcuau

SEQ ID NO: 425476 - RNA, 32 nt, Human
gagcugcagaagcagggggcugguggggugga

SEQ ID NO: 425477 - RNA, 32 nt, Human
gagcugcagaagcguagggaagaagcugaaga

SEQ ID NO: 425478 - RNA, 32 nt, Human
gagcugcagagagcuccuccagccuggagacg

SEQ ID NO: 425479 - RNA, 32 nt, Human
gagcugcagagggcuacaacuuccauauaagg

SEQ ID NO: 425480 - RNA, 32 nt, Human
gagcugcagcagagagggaugagggauuuagc

SEQ ID NO: 425481 - RNA, 32 nt, Human
gagcugcagcagcacguaaagucagugacaug

SEQ ID NO: 425482 - RNA, 32 nt, Human
gagcugcagcagcauguaaagucagugacagc

SEQ ID NO: 425483 - RNA, 20 nt, Human
gagcugcagcaggagcagca

SEQ ID NO: 425484 - RNA, 25 nt, Human
gagcugcaggaaucaccccucugcc

SEQ ID NO: 425485 - RNA, 32 nt, Human
gagcugcaggcgcgcgucauggcugcuuugag

SEQ ID NO: 425486 - RNA, 32 nt, Human
gagcugcagggcugugugugguccuucccugg

SEQ ID NO: 425487 - RNA, 32 nt, Human
gagcugcagggugaggcauagggaaugugggg

SEQ ID NO: 425488 - RNA, 31 nt, Human
gagcugcaguuucagccgcgacagcaagaac

SEQ ID NO: 425489 - RNA, 18 nt, Human
gagcugcauccacaugcu

SEQ ID NO: 425490 - RNA, 32 nt, Human
gagcugcaucuccuacccucagucucccuguc

SEQ ID NO: 425491 - RNA, 32 nt, Human
gagcugccacacagcaccuuugccaugccccg

SEQ ID NO: 425492 - RNA, 18 nt, Human
gagcugccaccagcagca

SEQ ID NO: 425493 - RNA, 32 nt, Human
gagcugccaggcuccuuuucugaucucccagc

SEQ ID NO: 425494 - RNA, 32 nt, Human
gagcugccagggacaaagggcucucagacauc

SEQ ID NO: 425495 - RNA, 32 nt, Human
gagcugccaucccggcuggccgcccggauggc

SEQ ID NO: 425496 - RNA, 32 nt, Human
gagcugccauuuuaugugucucuugcacuaca

SEQ ID NO: 425497 - RNA, 32 nt, Human
gagcugcccacagcaggccagguccagagaga

SEQ ID NO: 425498 - RNA, 32 nt, Human
gagcugcccacugugcccccagugcccacaga

SEQ ID NO: 425499 - RNA, 32 nt, Human
gagcugcccagaccuggaaagccaggcugagc

SEQ ID NO: 425500 - RNA, 32 nt, Human
gagcugcccaggcuucacggagcgguguuggu

SEQ ID NO: 425501 - RNA, 32 nt, Human
gagcugcccccagggguaugagggcaccagcu

SEQ ID NO: 425502 - RNA, 28 nt, Human
gagcugccccgugcugccuucuccaggc

SEQ ID NO: 425503 - RNA, 32 nt, Human
gagcugcccugacccccaaagugaggagaagc

SEQ ID NO: 425504 - RNA, 32 nt, Human
gagcugcccugagugaguccaaccuuggagga

SEQ ID NO: 425505 - RNA, 23 nt, Human
gagcugccgagccucccucugcc

SEQ ID NO: 425506 - RNA, 32 nt, Human
gagcugccuaggaucagagagccuucauggaa

SEQ ID NO: 425507 - RNA, 20 nt, Human
gagcugccugcagguucccu

SEQ ID NO: 425508 - RNA, 32 nt, Human
gagcugccuggaauaagaguuugagcuugugc

SEQ ID NO: 425509 - RNA, 32 nt, Human
gagcugccugucugcauguauccucuggcgcg

SEQ ID NO: 425510 - RNA, 32 nt, Human
gagcugcgcccucccugaccucccaggcugcg

SEQ ID NO: 425511 - RNA, 24 nt, Human
gagcugcggucaugccacugcacu

SEQ ID NO: 425512 - RNA, 32 nt, Human
gagcugcggucccucuggugucugccaucccc

SEQ ID NO: 425513 - RNA, 32 nt, Human
gagcugcggucugaggccccugcccagcugga

SEQ ID NO: 425514 - RNA, 31 nt, Human
gagcugcucaauaaauguuuguugaacgaau

SEQ ID NO: 425515 - RNA, 21 nt, Human
gagcugcucagcacgcccugg

SEQ ID NO: 425516 - RNA, 32 nt, Human
gagcugcucauggagaaagugccaggcgagau

SEQ ID NO: 425517 - RNA, 21 nt, Human
gagcugcucuccgcgggcuga

SEQ ID NO: 425518 - RNA, 32 nt, Human
gagcugcucuccuaucagaagcucccagcuga

SEQ ID NO: 425519 - RNA, 32 nt, Human
gagcugcucugcccugacccugccucaccccc

SEQ ID NO: 425520 - RNA, 32 nt, Human
gagcugcugaaugaagugucccuucccaucag

SEQ ID NO: 425521 - RNA, 32 nt, Human
gagcugcugagcaucaacaaggugacauuuuu

SEQ ID NO: 425522 - RNA, 32 nt, Human
gagcugcugcaagugccgccugugcuggggaa

SEQ ID NO: 425523 - RNA, 32 nt, Human
gagcugcugcacagagccugguguccacaagc

SEQ ID NO: 425524 - RNA, 32 nt, Human
gagcugcugccacuccagcaagggaaauaaug

SEQ ID NO: 425525 - RNA, 32 nt, Human
gagcugcugcccccuuucuuccuggccucggc

SEQ ID NO: 425526 - RNA, 32 nt, Human
gagcugcugccucuauccugggugccugccuc

SEQ ID NO: 425527 - RNA, 32 nt, Human
gagcugcugcuggcucuguccuggcucuuggc

SEQ ID NO: 425528 - RNA, 32 nt, Human
gagcugcuggcuuuguucucucaagucagguc

SEQ ID NO: 425529 - RNA, 32 nt, Human
gagcugcugggaacauccacaaagaaagagaa

SEQ ID NO: 425530 - RNA, 32 nt, Human
gagcugcugggucucugucacuguggacucca

SEQ ID NO: 425531 - RNA, 32 nt, Human
gagcugcugggugggaggaggagggugggauu

SEQ ID NO: 425532 - RNA, 32 nt, Human
gagcugcuggugcugcugcugcugcugcugcc

SEQ ID NO: 425533 - RNA, 32 nt, Human
gagcugcuguggagccucauccaccgcuucuc

SEQ ID NO: 425534 - RNA, 32 nt, Human
gagcugcuguggcucccuagccuaaggggccu

SEQ ID NO: 425535 - RNA, 32 nt, Human
gagcugcuguuuucugaaggugagaagccauu

SEQ ID NO: 425536 - RNA, 32 nt, Human
gagcugcuucaguccaucucccagaggcauuu

SEQ ID NO: 425537 - RNA, 32 nt, Human
gagcugcuucagugaauguacagugcccggca

SEQ ID NO: 425538 - RNA, 32 nt, Human
gagcugcuugccuuuccaccuccagggcauga

SEQ ID NO: 425539 - RNA, 32 nt, Human
gagcugcuuggcagugccagagcccaggcccc

SEQ ID NO: 425540 - RNA, 32 nt, Human
gagcugcuugggaggcacagguccugggacau

SEQ ID NO: 425541 - RNA, 32 nt, Human
gagcugcuuugugaugcugaaggauacugccg

SEQ ID NO: 425542 - RNA, 32 nt, Human
gagcuggaaaccugggguggguuggccaaagg

SEQ ID NO: 425543 - RNA, 32 nt, Human
gagcuggaaacugagcuuuaagaaauaacuau

SEQ ID NO: 425544 - RNA, 32 nt, Human
gagcuggaaagccggguugggguggggugggg

SEQ ID NO: 425545 - RNA, 32 nt, Human
gagcuggaacaugcccugucugugcugucccu

SEQ ID NO: 425546 - RNA, 32 nt, Human
gagcuggaagaggaggaggaggagaggcggcg

SEQ ID NO: 425547 - RNA, 32 nt, Human
gagcuggaagccggagagcaagcccuggaggu

SEQ ID NO: 425548 - RNA, 19 nt, Human
gagcuggaagcuguggggg

SEQ ID NO: 425549 - RNA, 25 nt, Human
gagcuggaauagguccucugggaug

SEQ ID NO: 425550 - RNA, 32 nt, Human
gagcuggaauccucuuucagguaccaaauguc

SEQ ID NO: 425551 - RNA, 32 nt, Human
gagcuggaaucgugccacuccacuccagccug

SEQ ID NO: 425552 - RNA, 32 nt, Human
gagcuggacacuccuggcuggacgccaggcca

SEQ ID NO: 425553 - RNA, 32 nt, Human
gagcuggacagauucugugaugccaugaucag

SEQ ID NO: 425554 - RNA, 32 nt, Human
gagcuggaccagccuggguuucaucucccaca

SEQ ID NO: 425555 - RNA, 17 nt, Human
gagcuggacgaggagca

SEQ ID NO: 425556 - RNA, 23 nt, Human
gagcuggacgcucuucaggacgu

SEQ ID NO: 425557 - RNA, 32 nt, Human
gagcuggacuuuggucagccuaggugagacuc

SEQ ID NO: 425558 - RNA, 21 nt, Human
gagcuggagaggacagaggcg

SEQ ID NO: 425559 - RNA, 32 nt, Human
gagcuggagagggugcguuucacuguggggug

SEQ ID NO: 425560 - RNA, 32 nt, Human
gagcuggaggagcaaugcuguuggugaauaaa

SEQ ID NO: 425561 - RNA, 32 nt, Human
gagcuggaggcugcagugaacuaugaucaaac

SEQ ID NO: 425562 - RNA, 32 nt, Human
gagcuggagggaggggcgggagagaggcaagg

SEQ ID NO: 425563 - RNA, 32 nt, Human
gagcuggaggggacacuggcccagggagagcu

SEQ ID NO: 425564 - RNA, 32 nt, Human
gagcuggaggggccgugcagagucuccauggg

SEQ ID NO: 425565 - RNA, 31 nt, Human
gagcuggagucaaaagauuuaucuucaaguu

SEQ ID NO: 425566 - RNA, 21 nt, Human
gagcuggaucacuugaguuca

SEQ ID NO: 425567 - RNA, 32 nt, Human
gagcuggaucacuugaguucaggaguuggaga

SEQ ID NO: 425568 - RNA, 32 nt, Human
gagcuggauggggacuguggccgccacccuuc

SEQ ID NO: 425569 - RNA, 32 nt, Human
gagcuggauuugaacccaggcagggcagcugc

SEQ ID NO: 425570 - RNA, 20 nt, Human
gagcuggcacaccagcagca

SEQ ID NO: 425571 - RNA, 32 nt, Human
gagcuggcacagacccgggcagagggacagca

SEQ ID NO: 425572 - RNA, 20 nt, Human
gagcuggcaccgcgagcugg

SEQ ID NO: 425573 - RNA, 32 nt, Human
gagcuggcaccgcgcaagggccccugccuccc

SEQ ID NO: 425574 - RNA, 32 nt, Human
gagcuggcaccugugccggugccuggagcugc

SEQ ID NO: 425575 - RNA, 21 nt, Human
gagcuggcaggcggagggcug

SEQ ID NO: 425576 - RNA, 22 nt, Human
gagcuggcaggggaggggcuga

SEQ ID NO: 425577 - RNA, 32 nt, Human
gagcuggcagugagcugagaucacaccacugc

SEQ ID NO: 425578 - RNA, 23 nt, Human
gagcuggcagugugcggagcuga

SEQ ID NO: 425579 - RNA, 23 nt, Human
gagcuggcauccuccgcugguuu

SEQ ID NO: 425580 - RNA, 32 nt, Human
gagcuggcauuugcacaaacacggcaacacug

SEQ ID NO: 425581 - RNA, 32 nt, Human
gagcuggccagcccacgggaaugcauugaguu

SEQ ID NO: 425582 - RNA, 22 nt, Human
gagcuggccagccccucggggc

SEQ ID NO: 425583 - RNA, 22 nt, Human
gagcuggccaguaauaggcuga

SEQ ID NO: 425584 - RNA, 26 nt, Human
gagcuggcccugcacauccauacaga

SEQ ID NO: 425585 - RNA, 31 nt, Human
gagcuggccgugucucccacucaggggcuga

SEQ ID NO: 425586 - RNA, 18 nt, Human
gagcuggccuuuaacuca

SEQ ID NO: 425587 - RNA, 23 nt, Human
gagcuggcgcccucucgcuccug

SEQ ID NO: 425588 - RNA, 19 nt, Human
gagcuggcggaaggggcug

SEQ ID NO: 425589 - RNA, 23 nt, Human
gagcuggcggccaccggaucuga

SEQ ID NO: 425590 - RNA, 18 nt, Human
gagcuggcgggcgcuggc

SEQ ID NO: 425591 - RNA, 21 nt, Human
gagcuggcgggcuggcaaggg

SEQ ID NO: 425592 - RNA, 23 nt, Human
gagcuggcgggcuggccuucugg

SEQ ID NO: 425593 - RNA, 21 nt, Human
gagcuggcgggucccgcgggc

SEQ ID NO: 425594 - RNA, 19 nt, Human
gagcuggcgguccgagcug

SEQ ID NO: 425595 - RNA, 21 nt, Human
gagcuggcugaggccggcuga

SEQ ID NO: 425596 - RNA, 22 nt, Human
gagcuggcugccuggcagauga

SEQ ID NO: 425597 - RNA, 32 nt, Human
gagcuggcuggagagaaaggucuggagguugg

SEQ ID NO: 425598 - RNA, 32 nt, Human
gagcuggcuuugcaaacaccugccucaugaca

SEQ ID NO: 425599 - RNA, 32 nt, Human
gagcugggaaggaaggaagggggcgcuagcca

SEQ ID NO: 425600 - RNA, 32 nt, Human
gagcugggaaguaaguucuuccccagccucca

SEQ ID NO: 425601 - RNA, 32 nt, Human
gagcugggaauaucagaucugcugcguguucu

SEQ ID NO: 425602 - RNA, 32 nt, Human
gagcugggaccccuccccuccaacacacauac

SEQ ID NO: 425603 - RNA, 19 nt, Human
gagcugggacuccagcuca

SEQ ID NO: 425604 - RNA, 32 nt, Human
gagcugggagaaccccagcccccaggaggccc

SEQ ID NO: 425605 - RNA, 32 nt, Human
gagcugggagagagcugccugcuuuucuuaau

SEQ ID NO: 425606 - RNA, 32 nt, Human
gagcugggagagaggccgggguuagggugauc

SEQ ID NO: 425607 - RNA, 23 nt, Human
gagcugggagcaagauggacaga

SEQ ID NO: 425608 - RNA, 32 nt, Human
gagcugggagccaccauaggugacccugguca

SEQ ID NO: 425609 - RNA, 32 nt, Human
gagcugggagcuagguccucggagugggccgg

SEQ ID NO: 425610 - RNA, 32 nt, Human
gagcugggaggcggcgaucgcagcugggccgg

SEQ ID NO: 425611 - RNA, 32 nt, Human
gagcugggagggugacagggagggcgggcgcu

SEQ ID NO: 425612 - RNA, 32 nt, Human
gagcugggaggguggaggugugggagcugaug

SEQ ID NO: 425613 - RNA, 24 nt, Human
gagcugggaucgcgccauugcacu

SEQ ID NO: 425614 - RNA, 24 nt, Human
gagcugggaucguaccacugcacu

SEQ ID NO: 425615 - RNA, 32 nt, Human
gagcugggauggagaagauggaagcacuggug

SEQ ID NO: 425616 - RNA, 24 nt, Human
gagcugggauugcaucacugcacu

SEQ ID NO: 425617 - RNA, 25 nt, Human
gagcugggcagaucaccugagguca

SEQ ID NO: 425618 - RNA, 22 nt, Human
gagcugggccgggcugggaugu

SEQ ID NO: 425619 - RNA, 32 nt, Human
gagcugggcgagcugggcuggggagagccugu

SEQ ID NO: 425620 - RNA, 32 nt, Human
gagcugggcuaacaggcugacacuucggcagg

SEQ ID NO: 425621 - RNA, 32 nt, Human
gagcugggcucaggcccugggcucugaaccug

SEQ ID NO: 425622 - RNA, 18 nt, Human
gagcugggcucuauccca

SEQ ID NO: 425623 - RNA, 32 nt, Human
gagcugggcuggggcucagggguccuaacccu

SEQ ID NO: 425624 - RNA, 32 nt, Human
gagcugggcuucuguccuccucugugucccgg

SEQ ID NO: 425625 - RNA, 32 nt, Human
gagcugggcuuggguccagcugcuccagguga

SEQ ID NO: 425626 - RNA, 32 nt, Human
gagcuggggagaggguaggggaaagguuuuuc

SEQ ID NO: 425627 - RNA, 32 nt, Human
gagcuggggagauggaggcugcagugagcuau

SEQ ID NO: 425628 - RNA, 21 nt, Human
gagcuggggagcccgcagcgg

SEQ ID NO: 425629 - RNA, 32 nt, Human
gagcuggggagggagagccaucaccuugauaa

SEQ ID NO: 425630 - RNA, 32 nt, Human
gagcuggggcagaagagggucucacuuuguca

SEQ ID NO: 425631 - RNA, 32 nt, Human
gagcuggggcagcagagcauggaggacucaga

SEQ ID NO: 425632 - RNA, 32 nt, Human
gagcuggggccucugucccugucaugugagga

SEQ ID NO: 425633 - RNA, 32 nt, Human
gagcuggggccuggccuuucugcccauucuca

SEQ ID NO: 425634 - RNA, 18 nt, Human
gagcuggggcucugggaa

SEQ ID NO: 425635 - RNA, 21 nt, Human
gagcuggggcugcuggacguu

SEQ ID NO: 425636 - RNA, 16 nt, Human
gagcuggggcugggag

SEQ ID NO: 425637 - RNA, 32 nt, Human
gagcugggggagaggacucuccccugugagac

SEQ ID NO: 425638 - RNA, 32 nt, Human
gagcugggggcaccagggagaaucagagaugc

SEQ ID NO: 425639 - RNA, 32 nt, Human
gagcugggggcagggcagcacagggaauauuu

SEQ ID NO: 425640 - RNA, 18 nt, Human
gagcugggggcucuggaa

SEQ ID NO: 425641 - RNA, 32 nt, Human
gagcuggggucuagccaggagccccagcacag

SEQ ID NO: 425642 - RNA, 32 nt, Human
gagcugggguguuccuggaagaggucggggag

SEQ ID NO: 425643 - RNA, 32 nt, Human
gagcuggguaauaccuggugucugagugauuc

SEQ ID NO: 425644 - RNA, 32 nt, Human
gagcugggucuagggugcgaagaacugcaaug

SEQ ID NO: 425645 - RNA, 21 nt, Human
gagcugggucuccagguacgu

SEQ ID NO: 425646 - RNA, 32 nt, Human
gagcugggugaauuccagccuggggagaggac

SEQ ID NO: 425647 - RNA, 21 nt, Human
gagcugggugagcggaaaugu

SEQ ID NO: 425648 - RNA, 32 nt, Human
gagcugggugcuggguucacagguguguucag

SEQ ID NO: 425649 - RNA, 32 nt, Human
gagcuggguggccuggcuucaggggaagacag

SEQ ID NO: 425650 - RNA, 32 nt, Human
gagcugggugggcugagaccagcaucccagcu

SEQ ID NO: 425651 - RNA, 20 nt, Human
gagcugguccaggggacuga

SEQ ID NO: 425652 - RNA, 32 nt, Human
gagcuggugagaagaagcgugaagggggaggu

SEQ ID NO: 425653 - RNA, 32 nt, Human
gagcuggugagagagagcaguuaaggcaagca

SEQ ID NO: 425654 - RNA, 32 nt, Human
gagcuggugcacaccuggaggagagugcuggu

SEQ ID NO: 425655 - RNA, 20 nt, Human
gagcuggugcgacggccuga

SEQ ID NO: 425656 - RNA, 32 nt, Human
gagcuggugcuaaaaacccagagcagaagcag

SEQ ID NO: 425657 - RNA, 32 nt, Human
gagcugguggccuucaaccucugccugcaucu

SEQ ID NO: 425658 - RNA, 32 nt, Human
gagcuggugguuugaucauuucugccaugaug

SEQ ID NO: 425659 - RNA, 21 nt, Human
gagcugguuuccuggaauguu

SEQ ID NO: 425660 - RNA, 32 nt, Human
gagcugguuucugcaugugcacaagucuguuu

SEQ ID NO: 425661 - RNA, 22 nt, Human
gagcugguuuuuugaaaagguc

SEQ ID NO: 425662 - RNA, 24 nt, Human
gagcuguaauugcaucacugcacu

SEQ ID NO: 425663 - RNA, 32 nt, Human
gagcuguagccugucgguugccuacucugcug

SEQ ID NO: 425664 - RNA, 32 nt, Human
gagcuguagggggcuggaguggaaguggagag

SEQ ID NO: 425665 - RNA, 32 nt, Human
gagcuguagucauacaaucacauaacuuuuac

SEQ ID NO: 425666 - RNA, 32 nt, Human
gagcuguaguugcccccuaccucucccaccuc

SEQ ID NO: 425667 - RNA, 32 nt, Human
gagcugucacaugacugcauccugccugccag

SEQ ID NO: 425668 - RNA, 32 nt, Human
gagcugucaucacgagugugggagagggagga

SEQ ID NO: 425669 - RNA, 32 nt, Human
gagcuguccaauaacugccuguaacuucaucu

SEQ ID NO: 425670 - RNA, 32 nt, Human
gagcuguccuacagcauucuggaaacuugagg

SEQ ID NO: 425671 - RNA, 32 nt, Human
gagcugucgacaaccgcaucucuucggaacuu

SEQ ID NO: 425672 - RNA, 32 nt, Human
gagcugucuccaggauggugcaggauggcuuu

SEQ ID NO: 425673 - RNA, 22 nt, Human
gagcugucucggucacucagga

SEQ ID NO: 425674 - RNA, 32 nt, Human
gagcugucucuucaucucuccucucucuccug

SEQ ID NO: 425675 - RNA, 32 nt, Human
gagcugucuggccugugauacuugggcuguga

SEQ ID NO: 425676 - RNA, 32 nt, Human
gagcugucugucucuuaccugccuguauuugu

SEQ ID NO: 425677 - RNA, 32 nt, Human
gagcugucuguucacccucccaucccagcuga

SEQ ID NO: 425678 - RNA, 32 nt, Human
gagcugucuuccuguguaccucuagaauccca

SEQ ID NO: 425679 - RNA, 32 nt, Human
gagcugucuugugccaucuguauguucugaca

SEQ ID NO: 425680 - RNA, 32 nt, Human
gagcugugaaguuugguggugucaaguuaugc

SEQ ID NO: 425681 - RNA, 23 nt, Human
gagcugugacugcaccacugcac

SEQ ID NO: 425682 - RNA, 24 nt, Human
gagcugugacugcgccacugcacu

SEQ ID NO: 425683 - RNA, 32 nt, Human
gagcugugagagaccagcacagcagcguccag

SEQ ID NO: 425684 - RNA, 32 nt, Human
gagcugugagauucgcuuuucccuaggcuguu

SEQ ID NO: 425685 - RNA, 32 nt, Human
gagcugugaggagaagucagugaagaacacca

SEQ ID NO: 425686 - RNA, 32 nt, Human
gagcugugaggguggcugcauccugcaaagcc

SEQ ID NO: 425687 - RNA, 24 nt, Human
gagcugugaucacaccacugcacu

SEQ ID NO: 425688 - RNA, 24 nt, Human
gagcugugaucauaccacugcacu

SEQ ID NO: 425689 - RNA, 24 nt, Human
gagcugugaucaugccacugcacu

SEQ ID NO: 425690 - RNA, 24 nt, Human
gagcugugaucgcaccacugcacu

SEQ ID NO: 425691 - RNA, 24 nt, Human
gagcugugaucgcaccacuguacu

SEQ ID NO: 425692 - RNA, 32 nt, Human
gagcugugaucgcaccacuguauuccagccug

SEQ ID NO: 425693 - RNA, 24 nt, Human
gagcugugaucgcgcuacugcacu

SEQ ID NO: 425694 - RNA, 24 nt, Human
gagcugugaucgugccacugcacu

SEQ ID NO: 425695 - RNA, 32 nt, Human
gagcugugaugaagaaaaauacauggccgacu

SEQ ID NO: 425696 - RNA, 24 nt, Human
gagcugugaugacaccacugcacu

SEQ ID NO: 425697 - RNA, 32 nt, Human
gagcugugauucagacccaguucugucagcuc

SEQ ID NO: 425698 - RNA, 24 nt, Human
gagcugugauugagccacugcacu

SEQ ID NO: 425699 - RNA, 24 nt, Human
gagcugugauugcaccacugcacu

SEQ ID NO: 425700 - RNA, 24 nt, Human
gagcugugauugcaccacuguacu

SEQ ID NO: 425701 - RNA, 24 nt, Human
gagcugugauugcacgacugcacu

SEQ ID NO: 425702 - RNA, 32 nt, Human
gagcugugauugccacagugcaagaccccauc

SEQ ID NO: 425703 - RNA, 24 nt, Human
gagcugugauuguaccacugcacu

SEQ ID NO: 425704 - RNA, 24 nt, Human
gagcugugauugugccacugcacu

SEQ ID NO: 425705 - RNA, 32 nt, Human
gagcugugcagacugacucucuucugaagagu

SEQ ID NO: 425706 - RNA, 32 nt, Human
gagcuguggagugcaggccagagcagggugug

SEQ ID NO: 425707 - RNA, 32 nt, Human
gagcuguggcagcggcgaaaggaagcggcuga

SEQ ID NO: 425708 - RNA, 32 nt, Human
gagcuguggcggaggauccaggaagcuacgga

SEQ ID NO: 425709 - RNA, 32 nt, Human
gagcuguggcuacugaaccacagccauccugg

SEQ ID NO: 425710 - RNA, 32 nt, Human
gagcugugguaugggcauaggaaagguggaug

SEQ ID NO: 425711 - RNA, 32 nt, Human
gagcuguggucacaccacuguauuccagccug

SEQ ID NO: 425712 - RNA, 23 nt, Human
gagcuguggugcccgacgguggc

SEQ ID NO: 425713 - RNA, 24 nt, Human
gagcuguguucaugccacugcacu

SEQ ID NO: 425714 - RNA, 32 nt, Human
gagcuguguuguaccacugcacuccagccugg

SEQ ID NO: 425715 - RNA, 24 nt, Human
gagcuguguuugcaucacugcacu

SEQ ID NO: 425716 - RNA, 32 nt, Human
gagcuguucccagggcuggagcagguguaccc

SEQ ID NO: 425717 - RNA, 32 nt, Human
gagcuguuccuauuugcccauccucucccugc

SEQ ID NO: 425718 - RNA, 32 nt, Human
gagcuguuccugcuuugaguuucccuagagcu

SEQ ID NO: 425719 - RNA, 32 nt, Human
gagcuguucuguagccgggaugacagcucucg

SEQ ID NO: 425720 - RNA, 25 nt, Human
gagcuguugauugcaccacugcacu

SEQ ID NO: 425721 - RNA, 23 nt, Human
gagcuguuggcuggaggccuccu

SEQ ID NO: 425722 - RNA, 32 nt, Human
gagcuguuguaggagagauugccugagcucaa

SEQ ID NO: 425723 - RNA, 32 nt, Human
gagcuguugucuauagagcaguuuacagacuu

SEQ ID NO: 425724 - RNA, 32 nt, Human
gagcuguuuauggccucagcugccucacuucc

SEQ ID NO: 425725 - RNA, 32 nt, Human
gagcuguuugaggcauuucugcucugagccuu

SEQ ID NO: 425726 - RNA, 18 nt, Human
gagcuguuuguucaauca

SEQ ID NO: 425727 - RNA, 32 nt, Human
gagcuguuuugaaauuguaauucuuuucagcu

SEQ ID NO: 425728 - RNA, 32 nt, Human
gagcuuacagugagcugagaucacacgccacu

SEQ ID NO: 425729 - RNA, 32 nt, Human
gagcuuagaaagcuucuccuccccaugucagu

SEQ ID NO: 425730 - RNA, 32 nt, Human
gagcuuagagagaggugcagaauuccugguuc

SEQ ID NO: 425731 - RNA, 32 nt, Human
gagcuuagccugagagggguucuuggccuccc

SEQ ID NO: 425732 - RNA, 32 nt, Human
gagcuuaggaaacauugaacuggagaacaacg

SEQ ID NO: 425733 - RNA, 32 nt, Human
gagcuuaggaagcaugagggcaacuauaguga

SEQ ID NO: 425734 - RNA, 32 nt, Human
gagcuuaggagguugaggcugcagugagcugu

SEQ ID NO: 425735 - RNA, 32 nt, Human
gagcuuaggaguuugagaccagccugggcaac

SEQ ID NO: 425736 - RNA, 32 nt, Human
gagcuuagggcuuugcauugugucuaauacau

SEQ ID NO: 425737 - RNA, 16 nt, Human
gagcuuaguaacuugu

SEQ ID NO: 425738 - RNA, 20 nt, Human
gagcuuaguaaguggugcua

SEQ ID NO: 425739 - RNA, 21 nt, Human
gagcuuaguauguauuuacug

SEQ ID NO: 425740 - RNA, 32 nt, Human
gagcuuauggguggaugggggugggauggaag

SEQ ID NO: 425741 - RNA, 31 nt, Human
gagcuucaaaaacaugugaggagggaagagu

SEQ ID NO: 425742 - RNA, 32 nt, Human
gagcuucaaagccccaaauuccugggcugggg

SEQ ID NO: 425743 - RNA, 32 nt, Human
gagcuucaacagccuggagacacugccggccu

SEQ ID NO: 425744 - RNA, 32 nt, Human
gagcuucaagacuuugcauuuccuaguauuuc

SEQ ID NO: 425745 - RNA, 32 nt, Human
gagcuucacaucucagguaacuggagaagucu

SEQ ID NO: 425746 - RNA, 32 nt, Human
gagcuucagagggcagcuccagugagugccaa

SEQ ID NO: 425747 - RNA, 20 nt, Human
gagcuucagagguugcccca

SEQ ID NO: 425748 - RNA, 32 nt, Human
gagcuucagcuguggcuccucuugccuacaau

SEQ ID NO: 425749 - RNA, 32 nt, Human
gagcuucagcuuccaggaugcuucucuggaac

SEQ ID NO: 425750 - RNA, 32 nt, Human
gagcuucaggcuugcagagaaauacucacauc

SEQ ID NO: 425751 - RNA, 32 nt, Human
gagcuucagggcaguccuucuggcacugcucc

SEQ ID NO: 425752 - RNA, 32 nt, Human
gagcuuccaacagcugcuuggccccgcagcug

SEQ ID NO: 425753 - RNA, 32 nt, Human
gagcuuccaagaagucagguugccaaaggaag

SEQ ID NO: 425754 - RNA, 32 nt, Human
gagcuuccagaacaaaggagaauggggagccc

SEQ ID NO: 425755 - RNA, 32 nt, Human
gagcuuccaucuuucucauauuuccuaagcaa

SEQ ID NO: 425756 - RNA, 32 nt, Human
gagcuuccccacugccugacccugcucucugg

SEQ ID NO: 425757 - RNA, 32 nt, Human
gagcuuccguccuuccuuccucccucucuccc

SEQ ID NO: 425758 - RNA, 32 nt, Human
gagcuuccuaaagcugacccugggucugguga

SEQ ID NO: 425759 - RNA, 32 nt, Human
gagcuuccuccaggaagucaggauugaacuca

SEQ ID NO: 425760 - RNA, 20 nt, Human
gagcuuccucuccuguccca

SEQ ID NO: 425761 - RNA, 32 nt, Human
gagcuuccugagcuuucuccugucgguuuggu

SEQ ID NO: 425762 - RNA, 32 nt, Human
gagcuuccugcagccuguggauguccugcagc

SEQ ID NO: 425763 - RNA, 32 nt, Human
gagcuuccuggcggcaucucccccucuugccu

SEQ ID NO: 425764 - RNA, 32 nt, Human
gagcuuccuuacugcuccucugggugauccaa

SEQ ID NO: 425765 - RNA, 32 nt, Human
gagcuucgcggugccagccucugcagguccuc

SEQ ID NO: 425766 - RNA, 32 nt, Human
gagcuucuaucuugcugaaauauugcuucaua

SEQ ID NO: 425767 - RNA, 32 nt, Human
gagcuucucacaccuaccccuaccguccagcc

SEQ ID NO: 425768 - RNA, 32 nt, Human
gagcuucuccagccacaugccuaccaugcaga

SEQ ID NO: 425769 - RNA, 32 nt, Human
gagcuucucccaggcacagguguugcaccagg

SEQ ID NO: 425770 - RNA, 32 nt, Human
gagcuucuccgccgauccuccuuuucuagcag

SEQ ID NO: 425771 - RNA, 32 nt, Human
gagcuucuccucagcuccucugagcagccacc

SEQ ID NO: 425772 - RNA, 32 nt, Human
gagcuucuccugcuccucucugccucaucucc

SEQ ID NO: 425773 - RNA, 32 nt, Human
gagcuucucugccuccugauccugucuugcag

SEQ ID NO: 425774 - RNA, 32 nt, Human
gagcuucucugggcugaauguaugucagugcu

SEQ ID NO: 425775 - RNA, 32 nt, Human
gagcuucugaagagcugaacauguggagggag

SEQ ID NO: 425776 - RNA, 32 nt, Human
gagcuucugagggcagcaagcccuguagaucc

SEQ ID NO: 425777 - RNA, 32 nt, Human
gagcuucuuagcaggccuggggcuuccaggga

SEQ ID NO: 425778 - RNA, 32 nt, Human
gagcuucuuuggacaugcccagcuccaaacug

SEQ ID NO: 425779 - RNA, 32 nt, Human
gagcuugaagagagggauucugagggagagcu

SEQ ID NO: 425780 - RNA, 32 nt, Human
gagcuugaagagugaaaacuguugugaaugag

SEQ ID NO: 425781 - RNA, 32 nt, Human
gagcuugaaguccuuuuccccaaaaagaggga

SEQ ID NO: 425782 - RNA, 32 nt, Human
gagcuugaccuccaucuagguuucuuuuaucu

SEQ ID NO: 425783 - RNA, 32 nt, Human
gagcuugagagcccuccucuucuaagcagcau

SEQ ID NO: 425784 - RNA, 32 nt, Human
gagcuugagagguugaagcugcagugagcugu

SEQ ID NO: 425785 - RNA, 32 nt, Human
gagcuugaugugguagaagaaucucacuauau

SEQ ID NO: 425786 - RNA, 32 nt, Human
gagcuugcaccauugcacuccagccugggcga

SEQ ID NO: 425787 - RNA, 32 nt, Human
gagcuugcacuacugcacuccagccuggguga

SEQ ID NO: 425788 - RNA, 32 nt, Human
gagcuugcaggacuggaaguugcucuggguga

SEQ ID NO: 425789 - RNA, 32 nt, Human
gagcuugcagucagccgagaucacgccacugc

SEQ ID NO: 425790 - RNA, 32 nt, Human
gagcuugcagugaaccgagaucgcuccacugc

SEQ ID NO: 425791 - RNA, 32 nt, Human
gagcuugcagugaaccgagaucugccacugca

SEQ ID NO: 425792 - RNA, 32 nt, Human
gagcuugcagugagcagagaucacgccacugc

SEQ ID NO: 425793 - RNA, 32 nt, Human
gagcuugcagugagcagagaucgcgccacugc

SEQ ID NO: 425794 - RNA, 32 nt, Human
gagcuugcagugagcagagauugagccacugc

SEQ ID NO: 425795 - RNA, 32 nt, Human
gagcuugcagugagccaagaccgcaccacugc

SEQ ID NO: 425796 - RNA, 32 nt, Human
gagcuugcagugagccaagauagugccacugc

SEQ ID NO: 425797 - RNA, 32 nt, Human
gagcuugcagugagccaagaucacacgacugc

SEQ ID NO: 425798 - RNA, 32 nt, Human
gagcuugcagugagccaagaucacgccacugc

SEQ ID NO: 425799 - RNA, 32 nt, Human
gagcuugcagugagccaagaucgcaccacugc

SEQ ID NO: 425800 - RNA, 32 nt, Human
gagcuugcagugagccaagaucgcgccacugc

SEQ ID NO: 425801 - RNA, 32 nt, Human
gagcuugcagugagccaagaucgcgccacugu

SEQ ID NO: 425802 - RNA, 32 nt, Human
gagcuugcagugagccaagaucgcgccauugc

SEQ ID NO: 425803 - RNA, 32 nt, Human
gagcuugcagugagccaagaucguaccacugc

SEQ ID NO: 425804 - RNA, 32 nt, Human
gagcuugcagugagccaagaucgugccacugc

SEQ ID NO: 425805 - RNA, 32 nt, Human
gagcuugcagugagccaagauuacgccacugc

SEQ ID NO: 425806 - RNA, 32 nt, Human
gagcuugcagugagccaaggucacaccacugc

SEQ ID NO: 425807 - RNA, 32 nt, Human
gagcuugcagugagccaugaucgcgccacugc

SEQ ID NO: 425808 - RNA, 32 nt, Human
gagcuugcagugagcccagaucaugccacugu

SEQ ID NO: 425809 - RNA, 32 nt, Human
gagcuugcagugagcccagauggcgccacugc

SEQ ID NO: 425810 - RNA, 32 nt, Human
gagcuugcagugagccgaaaucgcgccacugc

SEQ ID NO: 425811 - RNA, 32 nt, Human
gagcuugcagugagccgagaccgugccacugc

SEQ ID NO: 425812 - RNA, 32 nt, Human
gagcuugcagugagccgagauagcgccacugc

SEQ ID NO: 425813 - RNA, 32 nt, Human
gagcuugcagugagccgagauaucgccacugc

SEQ ID NO: 425814 - RNA, 32 nt, Human
gagcuugcagugagccgagaucacaccaccac

SEQ ID NO: 425815 - RNA, 32 nt, Human
gagcuugcagugagccgagaucacaccacugc

SEQ ID NO: 425816 - RNA, 32 nt, Human
gagcuugcagugagccgagaucacacuacugc

SEQ ID NO: 425817 - RNA, 32 nt, Human
gagcuugcagugagccgagaucacgccacugc

SEQ ID NO: 425818 - RNA, 32 nt, Human
gagcuugcagugagccgagaucaggccauugc

SEQ ID NO: 425819 - RNA, 32 nt, Human
gagcuugcagugagccgagaucaugccacacc

SEQ ID NO: 425820 - RNA, 32 nt, Human
gagcuugcagugagccgagaucaugccacugc

SEQ ID NO: 425821 - RNA, 32 nt, Human
gagcuugcagugagccgagaucccgccacugc

SEQ ID NO: 425822 - RNA, 32 nt, Human
gagcuugcagugagccgagaucgcaccacugc

SEQ ID NO: 425823 - RNA, 32 nt, Human
gagcuugcagugagccgagaucgcgccaaugc

SEQ ID NO: 425824 - RNA, 32 nt, Human
gagcuugcagugagccgagaucgcgccaccac

SEQ ID NO: 425825 - RNA, 32 nt, Human
gagcuugcagugagccgagaucgcgccaccgc

SEQ ID NO: 425826 - RNA, 32 nt, Human
gagcuugcagugagccgagaucgcgccacggc

SEQ ID NO: 425827 - RNA, 32 nt, Human
gagcuugcagugagccgagaucgcgccacugc

SEQ ID NO: 425828 - RNA, 32 nt, Human
gagcuugcagugagccgagaucgcgccaucac

SEQ ID NO: 425829 - RNA, 32 nt, Human
gagcuugcagugagccgagaucgugccacugc

SEQ ID NO: 425830 - RNA, 32 nt, Human
gagcuugcagugagccgagaucgugcugcugc

SEQ ID NO: 425831 - RNA, 32 nt, Human
gagcuugcagugagccgagaucgugucacugc

SEQ ID NO: 425832 - RNA, 32 nt, Human
gagcuugcagugagccgagauggagccacugc

SEQ ID NO: 425833 - RNA, 32 nt, Human
gagcuugcagugagccgagauggcgccacugc

SEQ ID NO: 425834 - RNA, 32 nt, Human
gagcuugcagugagccgagauggcgccauugc

SEQ ID NO: 425835 - RNA, 32 nt, Human
gagcuugcagugagccgagauggugccacugc

SEQ ID NO: 425836 - RNA, 32 nt, Human
gagcuugcagugagccgagauugcgccacugc

SEQ ID NO: 425837 - RNA, 32 nt, Human
gagcuugcagugagccgagauugugccacugc

SEQ ID NO: 425838 - RNA, 32 nt, Human
gagcuugcagugagccgaggucgugccacugc

SEQ ID NO: 425839 - RNA, 32 nt, Human
gagcuugcagugagccuagauagcgccacugc

SEQ ID NO: 425840 - RNA, 32 nt, Human
gagcuugcagugagccuagaucgcgucacugc

SEQ ID NO: 425841 - RNA, 32 nt, Human
gagcuugcagugagccuugaucacgccacugc

SEQ ID NO: 425842 - RNA, 32 nt, Human
gagcuugcagugagcggacaucgcgccacugc

SEQ ID NO: 425843 - RNA, 32 nt, Human
gagcuugcagugagcggagaucacgccacagc

SEQ ID NO: 425844 - RNA, 32 nt, Human
gagcuugcagugagcggagaucgcgccacugc

SEQ ID NO: 425845 - RNA, 32 nt, Human
gagcuugcagugagcugaaauggugccacugc

SEQ ID NO: 425846 - RNA, 32 nt, Human
gagcuugcagugagcugagauagcgccauugc

SEQ ID NO: 425847 - RNA, 32 nt, Human
gagcuugcagugagcugagaucacgccacuac

SEQ ID NO: 425848 - RNA, 32 nt, Human
gagcuugcagugagcugagaucacgccacugc

SEQ ID NO: 425849 - RNA, 32 nt, Human
gagcuugcagugagcugagaucacgccauugc

SEQ ID NO: 425850 - RNA, 32 nt, Human
gagcuugcagugagcugagaucaugccaccgc

SEQ ID NO: 425851 - RNA, 32 nt, Human
gagcuugcagugagcugagauccagccacagc

SEQ ID NO: 425852 - RNA, 32 nt, Human
gagcuugcagugagcugagaucccgccacugc

SEQ ID NO: 425853 - RNA, 32 nt, Human
gagcuugcagugagcugagaucgcaccacugc

SEQ ID NO: 425854 - RNA, 32 nt, Human
gagcuugcagugagcugagaucgcaccacugu

SEQ ID NO: 425855 - RNA, 32 nt, Human
gagcuugcagugagcugagaucgcgccacugc

SEQ ID NO: 425856 - RNA, 32 nt, Human
gagcuugcagugagcugagaucgggccacggc

SEQ ID NO: 425857 - RNA, 32 nt, Human
gagcuugcagugagcugagaucgugccacugc

SEQ ID NO: 425858 - RNA, 32 nt, Human
gagcuugcagugagcugagauggcaccacugc

SEQ ID NO: 425859 - RNA, 32 nt, Human
gagcuugcagugagcugagauggcaccacugg

SEQ ID NO: 425860 - RNA, 32 nt, Human
gagcuugcagugagcugagauggcgccacugc

SEQ ID NO: 425861 - RNA, 32 nt, Human
gagcuugcagugagcugagauggugccacugc

SEQ ID NO: 425862 - RNA, 32 nt, Human
gagcuugcagugagcugagauugcgccacugc

SEQ ID NO: 425863 - RNA, 32 nt, Human
gagcuugcagugagcugagauugugccauugc

SEQ ID NO: 425864 - RNA, 32 nt, Human
gagcuugcagugagcugagauuuugcaacugc

SEQ ID NO: 425865 - RNA, 32 nt, Human
gagcuugcagugagcugggauugcaucacugc

SEQ ID NO: 425866 - RNA, 32 nt, Human
gagcuugcagugagucgagaucgcgccacugc

SEQ ID NO: 425867 - RNA, 32 nt, Human
gagcuugcagugaguggagaugcgccacugca

SEQ ID NO: 425868 - RNA, 32 nt, Human
gagcuugcagugauuggagaucgcgccacugc

SEQ ID NO: 425869 - RNA, 17 nt, Human
gagcuugccgagcagca

SEQ ID NO: 425870 - RNA, 32 nt, Human
gagcuugccgcgagggcagcugccucagcggg

SEQ ID NO: 425871 - RNA, 32 nt, Human
gagcuugccugccuggccacagacaguguauc

SEQ ID NO: 425872 - RNA, 32 nt, Human
gagcuugcggugagccaagaucgugccacugc

SEQ ID NO: 425873 - RNA, 32 nt, Human
gagcuugcggugagccgagauugcgcuacugc

SEQ ID NO: 425874 - RNA, 32 nt, Human
gagcuugcucuccacuuccuccgugcaguggc

SEQ ID NO: 425875 - RNA, 32 nt, Human
gagcuugcugaggggugggagagccagcugug

SEQ ID NO: 425876 - RNA, 25 nt, Human
gagcuugcuuuuucucugcugguuu

SEQ ID NO: 425877 - RNA, 32 nt, Human
gagcuuggagcagcacggacagcagcauuguu

SEQ ID NO: 425878 - RNA, 32 nt, Human
gagcuuggcaaaacuguccagcaaaaugaaaa

SEQ ID NO: 425879 - RNA, 32 nt, Human
gagcuuggcagguucuuugucucacugaauuc

SEQ ID NO: 425880 - RNA, 32 nt, Human
gagcuuggcggggcagacucuggguuuccagc

SEQ ID NO: 425881 - RNA, 32 nt, Human
gagcuuggcugcuucuggggccuguguggccc

SEQ ID NO: 425882 - RNA, 32 nt, Human
gagcuugggaaaucaagguugcagugagcuau

SEQ ID NO: 425883 - RNA, 32 nt, Human
gagcuugggcagcaggggcaggagggucaagc

SEQ ID NO: 425884 - RNA, 32 nt, Human
gagcuugggcugggaacgcgccugaugucuaa

SEQ ID NO: 425885 - RNA, 32 nt, Human
gagcuuggugggagccaaggcugagucggaug

SEQ ID NO: 425886 - RNA, 32 nt, Human
gagcuugguguuuugucuuuuucagaaacuau

SEQ ID NO: 425887 - RNA, 32 nt, Human
gagcuuguacuauacaucucccaaagaaaccc

SEQ ID NO: 425888 - RNA, 19 nt, Human
gagcuugucaccuaucuca

SEQ ID NO: 425889 - RNA, 32 nt, Human
gagcuugucauccccagccuggugucccgcag

SEQ ID NO: 425890 - RNA, 32 nt, Human
gagcuuguccccagagaggaggauguggugag

SEQ ID NO: 425891 - RNA, 32 nt, Human
gagcuugucuucaggaaaccagagcguugcuu

SEQ ID NO: 425892 - RNA, 32 nt, Human
gagcuugugacuggacuccagccugggcaaca

SEQ ID NO: 425893 - RNA, 32 nt, Human
gagcuuguggugagccgagaucgcgccacugc

SEQ ID NO: 425894 - RNA, 32 nt, Human
gagcuugugugaaaaucagaccugagauggcu

SEQ ID NO: 425895 - RNA, 32 nt, Human
gagcuuguguguggugucguggucacaucucc

SEQ ID NO: 425896 - RNA, 32 nt, Human
gagcuuguuuucucucaguguguucucagagu

SEQ ID NO: 425897 - RNA, 32 nt, Human
gagcuuuaaaaauuaaaaggagagagauucga

SEQ ID NO: 425898 - RNA, 32 nt, Human
gagcuuuagaagcagccaggucuggugagaaa

SEQ ID NO: 425899 - RNA, 32 nt, Human
gagcuuucaccacuacugauauuugagaauca

SEQ ID NO: 425900 - RNA, 32 nt, Human
gagcuuucacucugcuggcuucucccaggccu

SEQ ID NO: 425901 - RNA, 32 nt, Human
gagcuuucaguuauaaauuugcauccuuuuca

SEQ ID NO: 425902 - RNA, 32 nt, Human
gagcuuucaucuccugaagaaaaaugaaaagc

SEQ ID NO: 425903 - RNA, 20 nt, Human
gagcuuucaugaguuuccca

SEQ ID NO: 425904 - RNA, 32 nt, Human
gagcuuuccagaacaggcagagcucuagagac

SEQ ID NO: 425905 - RNA, 32 nt, Human
gagcuuuccagaaccuucuccauuccagaauc

SEQ ID NO: 425906 - RNA, 32 nt, Human
gagcuuuccagccguguuguagcuaauuagga

SEQ ID NO: 425907 - RNA, 27 nt, Human
gagcuuuccgcgauggccgcucggagg

SEQ ID NO: 425908 - RNA, 19 nt, Human
gagcuuuccucauaucuca

SEQ ID NO: 425909 - RNA, 21 nt, Human
gagcuuuccuguccauuccca

SEQ ID NO: 425910 - RNA, 17 nt, Human
gagcuuucuaaaucuca

SEQ ID NO: 425911 - RNA, 19 nt, Human
gagcuuucuaccgaugcca

SEQ ID NO: 425912 - RNA, 32 nt, Human
gagcuuucuccgcccaccucacugcaucccaa

SEQ ID NO: 425913 - RNA, 32 nt, Human
gagcuuucuccucuggcugaguuugagaagcu

SEQ ID NO: 425914 - RNA, 32 nt, Human
gagcuuucugagcuuucuccugucgguuuggu

SEQ ID NO: 425915 - RNA, 18 nt, Human
gagcuuucugcaccccca

SEQ ID NO: 425916 - RNA, 19 nt, Human
gagcuuucugugcuaccca

SEQ ID NO: 425917 - RNA, 32 nt, Human
gagcuuucuuaguuggugaagacuuaaacauc

SEQ ID NO: 425918 - RNA, 32 nt, Human
gagcuuucuuccacugacauaaaaugccagcu

SEQ ID NO: 425919 - RNA, 18 nt, Human
gagcuuucuuuugaccca

SEQ ID NO: 425920 - RNA, 32 nt, Human
gagcuuugaagugcuggugguccagagggguu

SEQ ID NO: 425921 - RNA, 23 nt, Human
gagcuuugaucacgccacuguac

SEQ ID NO: 425922 - RNA, 32 nt, Human
gagcuuugcugcaugacuucagccuggccucu

SEQ ID NO: 425923 - RNA, 32 nt, Human
gagcuuugcuuuuucucuccugcagcacuuaa

SEQ ID NO: 425924 - RNA, 19 nt, Human
gagcuuuggaagccuguca

SEQ ID NO: 425925 - RNA, 32 nt, Human
gagcuuuggugaggacaagaucgagaugaaag

SEQ ID NO: 425926 - RNA, 32 nt, Human
gagcuuuggugaggacgagaucgagaugaaag

SEQ ID NO: 425927 - RNA, 32 nt, Human
gagcuuuuagugggucacagagcgggaacuac

SEQ ID NO: 425928 - RNA, 18 nt, Human
gagcuuuuaugccuccca

SEQ ID NO: 425929 - RNA, 26 nt, Human
gagcuuuuccacccacuucucuucca

SEQ ID NO: 425930 - RNA, 25 nt, Human
gagcuuuucuaguuggcauccggca

SEQ ID NO: 425931 - RNA, 32 nt, Human
gagcuuuucucuaucuuccgacuuuguuggag

SEQ ID NO: 425932 - RNA, 19 nt, Human
gagcuuuuguacuagccca

SEQ ID NO: 425933 - RNA, 32 nt, Human
gagcuuuuugacaauugaaauuucucagaaua

SEQ ID NO: 425934 - RNA, 32 nt, Human
gaggaaaaaccagcuuaccuggcuaaucaacc

SEQ ID NO: 425935 - RNA, 32 nt, Human
gaggaaaaaugacuugccuucuuggagccuca

SEQ ID NO: 425936 - RNA, 32 nt, Human
gaggaaaacuucuuccuggccugggcuccgug

SEQ ID NO: 425937 - RNA, 18 nt, Human
gaggaaaagaacauucca

SEQ ID NO: 425938 - RNA, 32 nt, Human
gaggaaaagaagagaaaagaagaagaaaggaa

SEQ ID NO: 425939 - RNA, 32 nt, Human
gaggaaaagaagagccuuugcugauaaagagu

SEQ ID NO: 425940 - RNA, 32 nt, Human
gaggaaaagacacaaggaauguuugcauacag

SEQ ID NO: 425941 - RNA, 32 nt, Human
gaggaaaagaggaggagacggaggagaacuga

SEQ ID NO: 425942 - RNA, 32 nt, Human
gaggaaaagcaggugccggugccuguccccgg

SEQ ID NO: 425943 - RNA, 32 nt, Human
gaggaaaagcuuucggacugcugaaggcccag

SEQ ID NO: 425944 - RNA, 32 nt, Human
gaggaaaaggaaaagggaagggagagaaaaag

SEQ ID NO: 425945 - RNA, 31 nt, Human
gaggaaaaggagagagagggggcucugguca

SEQ ID NO: 425946 - RNA, 32 nt, Human
gaggaaaaggagcuaauauaagaaagagcaag

SEQ ID NO: 425947 - RNA, 32 nt, Human
gaggaaaaggaguucuggagaggcgccgccau

SEQ ID NO: 425948 - RNA, 19 nt, Human
gaggaaaagggaaggggga

SEQ ID NO: 425949 - RNA, 32 nt, Human
gaggaaacaagccccugucccacgccgucugc

SEQ ID NO: 425950 - RNA, 21 nt, Human
gaggaaacacuaugauaggau

SEQ ID NO: 425951 - RNA, 32 nt, Human
gaggaaacaggcugagagaagaaaaaugacug

SEQ ID NO: 425952 - RNA, 32 nt, Human
gaggaaacaguacagggucugaguucugaaug

SEQ ID NO: 425953 - RNA, 32 nt, Human
gaggaaaccagcuccagauggguuuucucugg

SEQ ID NO: 425954 - RNA, 31 nt, Human
gaggaaacccccugccuucuggccccaucua

SEQ ID NO: 425955 - RNA, 32 nt, Human
gaggaaacccccuugggugccccacacagggc

SEQ ID NO: 425956 - RNA, 32 nt, Human
gaggaaacugagacccagaaagguggaagcac

SEQ ID NO: 425957 - RNA, 18 nt, Human
gaggaaacugagcauuuc

SEQ ID NO: 425958 - RNA, 32 nt, Human
gaggaaacugaggucuagagaggucaagauua

SEQ ID NO: 425959 - RNA, 32 nt, Human
gaggaaacugaggucuggaggggugagcggaa

SEQ ID NO: 425960 - RNA, 32 nt, Human
gaggaaacugaggugcaaagggguugaggaau

SEQ ID NO: 425961 - RNA, 19 nt, Human
gaggaaacuuugauaggau

SEQ ID NO: 425962 - RNA, 32 nt, Human
gaggaaagaaaccagaguuucucuccaacucc

SEQ ID NO: 425963 - RNA, 32 nt, Human
gaggaaagaggaaagacacagagagacgggag

SEQ ID NO: 425964 - RNA, 21 nt, Human
gaggaaagaggcgggggcggg

SEQ ID NO: 425965 - RNA, 32 nt, Human
gaggaaagcacugcaggagcaggcuggcacag

SEQ ID NO: 425966 - RNA, 32 nt, Human
gaggaaagcuccggaagaaggagaaacauugc

SEQ ID NO: 425967 - RNA, 32 nt, Human
gaggaaagcugcauuugaaccaaaacuugcca

SEQ ID NO: 425968 - RNA, 32 nt, Human
gaggaaagcuggaaguccuggagggacagggu

SEQ ID NO: 425969 - RNA, 32 nt, Human
gaggaaaggacaccugucaaugcuggaguuag

SEQ ID NO: 425970 - RNA, 19 nt, Human
gaggaaaggauaucacaga

SEQ ID NO: 425971 - RNA, 19 nt, Human
gaggaaagggaaggaggag

SEQ ID NO: 425972 - RNA, 32 nt, Human
gaggaaagggagcaggcgcagggggacuggaa

SEQ ID NO: 425973 - RNA, 32 nt, Human
gaggaaagggccugcgcaguccugguccuggc

SEQ ID NO: 425974 - RNA, 32 nt, Human
gaggaaaggggcaucuggucucaggcccgugc

SEQ ID NO: 425975 - RNA, 19 nt, Human
gaggaaaggggccuggagg

SEQ ID NO: 425976 - RNA, 32 nt, Human
gaggaaagguaucagggauuuuuaaguccguu

SEQ ID NO: 425977 - RNA, 22 nt, Human
gaggaaagugcaccuccucacu

SEQ ID NO: 425978 - RNA, 32 nt, Human
gaggaaaguguggccuggacugagggaggaaa

SEQ ID NO: 425979 - RNA, 32 nt, Human
gaggaaaucaccgaaaacguggcugcuucaag

SEQ ID NO: 425980 - RNA, 19 nt, Human
gaggaaaucacugaggcca

SEQ ID NO: 425981 - RNA, 32 nt, Human
gaggaaaucaguaacaaaaagacaauuaaauc

SEQ ID NO: 425982 - RNA, 19 nt, Human
gaggaaauccagaugagac

SEQ ID NO: 425983 - RNA, 32 nt, Human
gaggaaauccaggaggcagaagugaggacccu

SEQ ID NO: 425984 - RNA, 32 nt, Human
gaggaaaucucucauuuggggcauuugaagga

SEQ ID NO: 425985 - RNA, 32 nt, Human
gaggaaaugagagaggaaugcucuugaaaggu

SEQ ID NO: 425986 - RNA, 32 nt, Human
gaggaaauggcagaagaugagccagaaaaaga

SEQ ID NO: 425987 - RNA, 23 nt, Human
gaggaaaugucacaggggcuaug

SEQ ID NO: 425988 - RNA, 23 nt, Human
gaggaaaugugacgacagaagca

SEQ ID NO: 425989 - RNA, 32 nt, Human
gaggaaauguggcugauuuucuuaauuauaau

SEQ ID NO: 425990 - RNA, 32 nt, Human
gaggaacaaagagauugugguggugcuaaagg

SEQ ID NO: 425991 - RNA, 32 nt, Human
gaggaacaacuucaucuucaacuuuuuauuuc

SEQ ID NO: 425992 - RNA, 32 nt, Human
gaggaacaagaacccaggcugaucccagacau

SEQ ID NO: 425993 - RNA, 32 nt, Human
gaggaacaaucaguaaaucagauucuguccuc

SEQ ID NO: 425994 - RNA, 32 nt, Human
gaggaacacaaagaagcuuagaagagggucca

SEQ ID NO: 425995 - RNA, 32 nt, Human
gaggaacacagcaacggaaauccauccacaaa

SEQ ID NO: 425996 - RNA, 31 nt, Human
gaggaacacgcuuucuuuacaucacuagugu

SEQ ID NO: 425997 - RNA, 32 nt, Human
gaggaacacugcacucuuaagcuuccgccguc

SEQ ID NO: 425998 - RNA, 32 nt, Human
gaggaacagcagcagaggcagcaggagcagga

SEQ ID NO: 425999 - RNA, 32 nt, Human
gaggaacauucaacacccccaucucuaggaca

SEQ ID NO: 426000 - RNA, 21 nt, Human
gaggaacauuguagcauuuca

SEQ ID NO: 426001 - RNA, 32 nt, Human
gaggaaccaacugcuccaccuucuagggaccc

SEQ ID NO: 426002 - RNA, 32 nt, Human
gaggaaccacugcaccaccgagagaggcuggg

SEQ ID NO: 426003 - RNA, 32 nt, Human
gaggaaccagaagaaagagaaacucgcgacaa

SEQ ID NO: 426004 - RNA, 32 nt, Human
gaggaaccagaccucaucagcccaacaucaaa

SEQ ID NO: 426005 - RNA, 32 nt, Human
gaggaaccagaggcacuuccaccuuggcuggg

SEQ ID NO: 426006 - RNA, 32 nt, Human
gaggaaccagaggggagagacagagcagcaag

SEQ ID NO: 426007 - RNA, 32 nt, Human
gaggaacccuacccugaauccugcacuuuaga

SEQ ID NO: 426008 - RNA, 22 nt, Human
gaggaaccggcgcccccggcgg

SEQ ID NO: 426009 - RNA, 25 nt, Human
gaggaaccuccuuccaggccuggga

SEQ ID NO: 426010 - RNA, 32 nt, Human
gaggaaccugggucccuguccugcccugcucc

SEQ ID NO: 426011 - RNA, 19 nt, Human
gaggaacgagagcauucca

SEQ ID NO: 426012 - RNA, 32 nt, Human
gaggaacggaagaacggagggagcuacgaccu

SEQ ID NO: 426013 - RNA, 32 nt, Human
gaggaacggaagggagcccugcuggagcugcu

SEQ ID NO: 426014 - RNA, 32 nt, Human
gaggaacgggagcugcaggagguggagaggua

SEQ ID NO: 426015 - RNA, 25 nt, Human
gaggaacgggcagccugggccuggg

SEQ ID NO: 426016 - RNA, 32 nt, Human
gaggaacggggguuacgggcagaggagaaagc

SEQ ID NO: 426017 - RNA, 21 nt, Human
gaggaacguggaacaggagca

SEQ ID NO: 426018 - RNA, 32 nt, Human
gaggaacuaacaacuccagacgcaccaccuuu

SEQ ID NO: 426019 - RNA, 31 nt, Human
gaggaacucaauaaagugcuuugaaaaugcu

SEQ ID NO: 426020 - RNA, 32 nt, Human
gaggaacucugccucucugcuucuucaucuuc

SEQ ID NO: 426021 - RNA, 32 nt, Human
gaggaacucuucugcacucugagcuggccagc

SEQ ID NO: 426022 - RNA, 32 nt, Human
gaggaacugcucccaccucuccuucucuuucc

SEQ ID NO: 426023 - RNA, 32 nt, Human
gaggaacuucaaaacauacuccugcuugggcc

SEQ ID NO: 426024 - RNA, 32 nt, Human
gaggaacuugcugcugugccugcgucgcggcg

SEQ ID NO: 426025 - RNA, 32 nt, Human
gaggaagaaaaacaggccgagugaaggugcug

SEQ ID NO: 426026 - RNA, 32 nt, Human
gaggaagaaacacugaaccagauggaauggcc

SEQ ID NO: 426027 - RNA, 32 nt, Human
gaggaagaaaggagagaggggagccaggggag

SEQ ID NO: 426028 - RNA, 32 nt, Human
gaggaagaaagggagagagaagaaaagaaaaa

SEQ ID NO: 426029 - RNA, 32 nt, Human
gaggaagaaagggagagagggccaggcagucg

SEQ ID NO: 426030 - RNA, 32 nt, Human
gaggaagaagaaaaagaggaagaagaagaagg

SEQ ID NO: 426031 - RNA, 20 nt, Human
gaggaagaagaagagacaga

SEQ ID NO: 426032 - RNA, 32 nt, Human
gaggaagaagaggaggaggagaaagaagcagc

SEQ ID NO: 426033 - RNA, 32 nt, Human
gaggaagaagaggaggaggaggaagaggagga

SEQ ID NO: 426034 - RNA, 32 nt, Human
gaggaagaagaggaggaggaggagaugguggc

SEQ ID NO: 426035 - RNA, 32 nt, Human
gaggaagaagaggaggaggaggaggaggagga

SEQ ID NO: 426036 - RNA, 32 nt, Human
gaggaagaaggcagugucccuuuugcuagagc

SEQ ID NO: 426037 - RNA, 18 nt, Human
gaggaagaagggagcggg

SEQ ID NO: 426038 - RNA, 31 nt, Human
gaggaagacaacacaacacaggaggggauaa

SEQ ID NO: 426039 - RNA, 32 nt, Human
gaggaagacagagagaaacugaguuccugaca

SEQ ID NO: 426040 - RNA, 32 nt, Human
gaggaagacagauauugacauuucucagcacu

SEQ ID NO: 426041 - RNA, 32 nt, Human
gaggaagacagcuuuuaacacaguucccugcc

SEQ ID NO: 426042 - RNA, 32 nt, Human
gaggaagacagugggagucaucaggagaggag

SEQ ID NO: 426043 - RNA, 32 nt, Human
gaggaagacaguuguguuuucucuuuaaaccu

SEQ ID NO: 426044 - RNA, 32 nt, Human
gaggaagaccuccagcauuggucauaaccuuc

SEQ ID NO: 426045 - RNA, 32 nt, Human
gaggaagacgagacaggacgaggcagaaaagc

SEQ ID NO: 426046 - RNA, 17 nt, Human
gaggaagacucaguaaa

SEQ ID NO: 426047 - RNA, 32 nt, Human
gaggaagacugcgcagugccaccccgcagccc

SEQ ID NO: 426048 - RNA, 32 nt, Human
gaggaagacuucagaauugggaacuaaaccau

SEQ ID NO: 426049 - RNA, 32 nt, Human
gaggaagagaaaagguaccugaggaugcagaa

SEQ ID NO: 426050 - RNA, 32 nt, Human
gaggaagagaaagaggaggagaauuaagaaga

SEQ ID NO: 426051 - RNA, 32 nt, Human
gaggaagagaagcagcagcugaggagacaggu

SEQ ID NO: 426052 - RNA, 32 nt, Human
gaggaagagaagcaggagagagaaagccacag

SEQ ID NO: 426053 - RNA, 32 nt, Human
gaggaagagacccaagaggcccagggaauccu

SEQ ID NO: 426054 - RNA, 32 nt, Human
gaggaagagagggaggagggguaggacugcag

SEQ ID NO: 426055 - RNA, 32 nt, Human
gaggaagagagggaggcacguaggaacaagca

SEQ ID NO: 426056 - RNA, 32 nt, Human
gaggaagagagggagggaggcgggaggagcgc

SEQ ID NO: 426057 - RNA, 32 nt, Human
gaggaagagauagaggaggaggagggggagga

SEQ ID NO: 426058 - RNA, 32 nt, Human
gaggaagagcauccccuuccuccuuucccugg

SEQ ID NO: 426059 - RNA, 32 nt, Human
gaggaagaggaaaggaaggaaagccaggggca

SEQ ID NO: 426060 - RNA, 32 nt, Human
gaggaagaggaagaggaggaggaggagaccgg

SEQ ID NO: 426061 - RNA, 32 nt, Human
gaggaagaggagaaagccagagagucacucuu

SEQ ID NO: 426062 - RNA, 32 nt, Human
gaggaagaggagagagaagagauggacagacc

SEQ ID NO: 426063 - RNA, 32 nt, Human
gaggaagaggaggaggaggagaccggcagcaa

SEQ ID NO: 426064 - RNA, 32 nt, Human
gaggaagaggaggaggaggaggaggaagcuga

SEQ ID NO: 426065 - RNA, 32 nt, Human
gaggaagaggaggaggaggaggaggcuggguu

SEQ ID NO: 426066 - RNA, 19 nt, Human
gaggaagaggcaaggggag

SEQ ID NO: 426067 - RNA, 19 nt, Human
gaggaagaggccugcucca

SEQ ID NO: 426068 - RNA, 32 nt, Human
gaggaagaggcugcucugggagcuacugaugc

SEQ ID NO: 426069 - RNA, 32 nt, Human
gaggaagagggcaguggggaaggggccucggg

SEQ ID NO: 426070 - RNA, 19 nt, Human
gaggaagagggcauggcgg

SEQ ID NO: 426071 - RNA, 32 nt, Human
gaggaagagggcccugagcuggcuccagaagc

SEQ ID NO: 426072 - RNA, 32 nt, Human
gaggaagaggggaaggaggaggaagaagugua

SEQ ID NO: 426073 - RNA, 32 nt, Human
gaggaagagguggaggaggaggaggaagaggu

SEQ ID NO: 426074 - RNA, 32 nt, Human
gaggaagagguggaggaggaggaggaggaggu

SEQ ID NO: 426075 - RNA, 32 nt, Human
gaggaagaucaggaggaggaggaagaagagga

SEQ ID NO: 426076 - RNA, 32 nt, Human
gaggaagaugacgaguaacuccccucagggau

SEQ ID NO: 426077 - RNA, 32 nt, Human
gaggaagaugacgaguaacuccccucggggau

SEQ ID NO: 426078 - RNA, 32 nt, Human
gaggaagauucccaucucuacaaucuuugagu

SEQ ID NO: 426079 - RNA, 32 nt, Human
gaggaagauugcaggggcgggaagaaacuauu

SEQ ID NO: 426080 - RNA, 32 nt, Human
gaggaagcacacuggguaacaaugaacaguga

SEQ ID NO: 426081 - RNA, 32 nt, Human
gaggaagcacagagcugggcauaugcugcuug

SEQ ID NO: 426082 - RNA, 32 nt, Human
gaggaagcacagaucucuagagcuguccuguc

SEQ ID NO: 426083 - RNA, 22 nt, Human
gaggaagcacauuuugaaccug

SEQ ID NO: 426084 - RNA, 22 nt, Human
gaggaagcaccuuggacauucu

SEQ ID NO: 426085 - RNA, 32 nt, Human
gaggaagcagaagagcaguauguggaucuuuc

SEQ ID NO: 426086 - RNA, 32 nt, Human
gaggaagcaguuuaaauagcccuguucucauu

SEQ ID NO: 426087 - RNA, 24 nt, Human
gaggaagcauauguggaaggagca

SEQ ID NO: 426088 - RNA, 32 nt, Human
gaggcugcagugagcccagaucacgccacugc

SEQ ID NO: 426089 - RNA, 32 nt, Human
gaggcugcagugagcccagaucgaaccauugu

SEQ ID NO: 426090 - RNA, 32 nt, Human
gaggcugcagugagcccagaucgagccacugc

SEQ ID NO: 426091 - RNA, 32 nt, Human
gaggcugcagugagcccugauugcaccacugg

SEQ ID NO: 426092 - RNA, 32 nt, Human
gaggcugcagugagcccugauugugccagugc

SEQ ID NO: 426093 - RNA, 32 nt, Human
gaggcugcagugagccgagaucacaccacugc

SEQ ID NO: 426094 - RNA, 32 nt, Human
gaggcugcagugagccgagaucacaccacugu

SEQ ID NO: 426095 - RNA, 32 nt, Human
gaggcugcagugagccgagaucaugccacugc

SEQ ID NO: 426096 - RNA, 32 nt, Human
gaggcugcagugagccgagaucaugccauuac

SEQ ID NO: 426097 - RNA, 32 nt, Human
gaggcugcagugagccgagaucgcaccacugc

SEQ ID NO: 426098 - RNA, 32 nt, Human
gaggcugcagugagccgagaucgcgccacuac

SEQ ID NO: 426099 - RNA, 32 nt, Human
gaggcugcagugagccgagaucgcgccacugc

SEQ ID NO: 426100 - RNA, 32 nt, Human
gaggcugcagugagccgagaucgugccaccua

SEQ ID NO: 426101 - RNA, 32 nt, Human
gaggcugcagugagccgagaucgugccacugc

SEQ ID NO: 426102 - RNA, 32 nt, Human
gaggcugcagugagccgagauugcgccacugc

SEQ ID NO: 426103 - RNA, 32 nt, Human
gaggcugcagugagccgagauugugccacugc

SEQ ID NO: 426104 - RNA, 32 nt, Human
gaggcugcagugagccgggaucgcaccacugc

SEQ ID NO: 426105 - RNA, 32 nt, Human
gaggcugcagugagccgggauugcaccacugc

SEQ ID NO: 426106 - RNA, 32 nt, Human
gaggcugcagugagccgucaucacaccaguac

SEQ ID NO: 426107 - RNA, 32 nt, Human
gaggcugcagugagccgugaucaugccacugc

SEQ ID NO: 426108 - RNA, 32 nt, Human
gaggcugcagugagccgugauggugccacugc

SEQ ID NO: 426109 - RNA, 32 nt, Human
gaggcugcagugagccgugauuucaccaccac

SEQ ID NO: 426110 - RNA, 32 nt, Human
gaggcugcagugagccuagguggugccacugc

SEQ ID NO: 426111 - RNA, 32 nt, Human
gaggcugcagugagcuaagauugcaccacugc

SEQ ID NO: 426112 - RNA, 18 nt, Human
gaggcugcagugagcuau

SEQ ID NO: 426113 - RNA, 32 nt, Human
gaggcugcagugagcuauaaucacgccacugc

SEQ ID NO: 426114 - RNA, 32 nt, Human
gaggcugcagugagcuauaaucgcgccacuca

SEQ ID NO: 426115 - RNA, 32 nt, Human
gaggcugcagugagcuaugaccauaccagugc

SEQ ID NO: 426116 - RNA, 32 nt, Human
gaggcugcagugagcuaugacugugccacugc

SEQ ID NO: 426117 - RNA, 32 nt, Human
gaggcugcagugagcuaugaucacaccaccac

SEQ ID NO: 426118 - RNA, 32 nt, Human
gaggcugcagugagcuaugaucacaccacugu

SEQ ID NO: 426119 - RNA, 32 nt, Human
gaggcugcagugagcuaugaucacacugcugu

SEQ ID NO: 426120 - RNA, 32 nt, Human
gaggcugcagugagcuaugaucacgccacugc

SEQ ID NO: 426121 - RNA, 32 nt, Human
gaggcugcagugagcuaugaucgcaccacugc

SEQ ID NO: 426122 - RNA, 32 nt, Human
gaggcugcagugagcuaugaucgcaucagucc

SEQ ID NO: 426123 - RNA, 32 nt, Human
gaggcugcagugagcuaugaucucaccacuac

SEQ ID NO: 426124 - RNA, 32 nt, Human
gaggcugcagugagcuaugauuaugccaccgc

SEQ ID NO: 426125 - RNA, 32 nt, Human
gaggcugcagugagcuaugauuaugccccugc

SEQ ID NO: 426126 - RNA, 32 nt, Human
gaggcugcagugagcuaugauuccaccauugc

SEQ ID NO: 426127 - RNA, 32 nt, Human
gaggcugcagugagcuaugauugcacagcugc

SEQ ID NO: 426128 - RNA, 32 nt, Human
gaggcugcagugagcuaugauugcaccacugc

SEQ ID NO: 426129 - RNA, 32 nt, Human
gaggcugcagugagcuaugauugugccacugc

SEQ ID NO: 426130 - RNA, 32 nt, Human
gaggcugcagugagcuaugauugugccacugu

SEQ ID NO: 426131 - RNA, 32 nt, Human
gaggcugcagugagcuaugauugugccacuuc

SEQ ID NO: 426132 - RNA, 32 nt, Human
gaggcugcagugagcuauguucaugacacugc

SEQ ID NO: 426133 - RNA, 32 nt, Human
gaggcugcagugagcuauuaucacaccauugc

SEQ ID NO: 426134 - RNA, 32 nt, Human
gaggcugcagugagcugagaucacgccacugc

SEQ ID NO: 426135 - RNA, 32 nt, Human
gaggcugcagugagcugagaucacgccauugc

SEQ ID NO: 426136 - RNA, 32 nt, Human
gaggcugcagugagcugagaucgcaacacugc

SEQ ID NO: 426137 - RNA, 32 nt, Human
gaggcugcagugagcugagaucgcgccacugc

SEQ ID NO: 426138 - RNA, 32 nt, Human
gaggcugcagugagcugagaugguaccacugc

SEQ ID NO: 426139 - RNA, 32 nt, Human
gaggcugcagugagcugagauugugccacugc

SEQ ID NO: 426140 - RNA, 32 nt, Human
gaggcugcagugagcugagauugugccacuuc

SEQ ID NO: 426141 - RNA, 32 nt, Human
gaggcugcagugagcugggaucacaccacugc

SEQ ID NO: 426142 - RNA, 32 nt, Human
gaggcugcagugagcugggaucguaccacugc

SEQ ID NO: 426143 - RNA, 32 nt, Human
gaggcugcagugagcugggauuacaccauugc

SEQ ID NO: 426144 - RNA, 18 nt, Human
gaggcugcagugagcugu

SEQ ID NO: 426145 - RNA, 32 nt, Human
gaggcugcagugagcugugacugcgccacugc

SEQ ID NO: 426146 - RNA, 32 nt, Human
gaggcugcagugagcugugauagcaccacugc

SEQ ID NO: 426147 - RNA, 32 nt, Human
gaggcugcagugagcugugaucaugccaccgc

SEQ ID NO: 426148 - RNA, 32 nt, Human
gaggcugcagugagcugugauccgccauuaca

SEQ ID NO: 426149 - RNA, 32 nt, Human
gaggcugcagugagcugugaucgcaccacugu

SEQ ID NO: 426150 - RNA, 32 nt, Human
gaggcugcagugagcugugaucgugccacuga

SEQ ID NO: 426151 - RNA, 32 nt, Human
gaggcugcagugagcugugauuaccucacugc

SEQ ID NO: 426152 - RNA, 32 nt, Human
gaggcugcagugagcugugauuaugccauugc

SEQ ID NO: 426153 - RNA, 32 nt, Human
gaggcugcagugagcugugauugcaccacugc

SEQ ID NO: 426154 - RNA, 32 nt, Human
gaggcugcagugagcugugauugugccacugc

SEQ ID NO: 426155 - RNA, 32 nt, Human
gaggcugcagugagcugugauugugccacugu

SEQ ID NO: 426156 - RNA, 32 nt, Human
gaggcugcagugagcugugcucccaccacugc

SEQ ID NO: 426157 - RNA, 32 nt, Human
gaggcugcagugagcuguguucacaccacugc

SEQ ID NO: 426158 - RNA, 32 nt, Human
gaggcugcagugagcuguguuguaccacugca

SEQ ID NO: 426159 - RNA, 32 nt, Human
gaggcugcagugagcuguguuucgccacugca

SEQ ID NO: 426160 - RNA, 32 nt, Human
gaggcugcagugagguaugaucgcgccacugc

SEQ ID NO: 426161 - RNA, 32 nt, Human
gaggcugcagugaggugugauugcgccacugc

SEQ ID NO: 426162 - RNA, 32 nt, Human
gaggcugcagugagucaugauugcgccacugc

SEQ ID NO: 426163 - RNA, 32 nt, Human
gaggcugcagugagucaugauuguaugacugc

SEQ ID NO: 426164 - RNA, 32 nt, Human
gaggcugcagugagucgagaucgugccacugc

SEQ ID NO: 426165 - RNA, 32 nt, Human
gaggcugcagugaguuaagauugugccacugc

SEQ ID NO: 426166 - RNA, 18 nt, Human
gaggcugcagugaguuau

SEQ ID NO: 426167 - RNA, 32 nt, Human
gaggcugcagugaguuaugacagcaccacugc

SEQ ID NO: 426168 - RNA, 32 nt, Human
gaggcugcagugaguuaugauggcacugcugc

SEQ ID NO: 426169 - RNA, 32 nt, Human
gaggcugcagugaguuauggccucugcacucc

SEQ ID NO: 426170 - RNA, 32 nt, Human
gaggcugcagugaguucuaauugcgccacugc

SEQ ID NO: 426171 - RNA, 32 nt, Human
gaggcugcagugaguugugaucgugucagugc

SEQ ID NO: 426172 - RNA, 32 nt, Human
gaggcugcagugaguugugauugcaccacugc

SEQ ID NO: 426173 - RNA, 32 nt, Human
gaggcugcagugauugugauucucauccuggu

SEQ ID NO: 426174 - RNA, 32 nt, Human
gaggcugcaguggcuaugaucaugccacugca

SEQ ID NO: 426175 - RNA, 32 nt, Human
gaggcugcagugggccgggaucguacuacugc

SEQ ID NO: 426176 - RNA, 18 nt, Human
gaggcugcagugggcuau

SEQ ID NO: 426177 - RNA, 32 nt, Human
gaggcugcagugggcuaugauugcaccacugc

SEQ ID NO: 426178 - RNA, 32 nt, Human
gaggcugcaguggugucguggguguuacgugc

SEQ ID NO: 426179 - RNA, 32 nt, Human
gaggcugcauuuccagcuggacguaccucagu

SEQ ID NO: 426180 - RNA, 32 nt, Human
gaggcugccaugagccaugaucgugccacuac

SEQ ID NO: 426181 - RNA, 32 nt, Human
gaggcugcccagucucugcccugcugcccacc

SEQ ID NO: 426182 - RNA, 18 nt, Human
gaggcugcccuaguggcc

SEQ ID NO: 426183 - RNA, 32 nt, Human
gaggcugcccugacccuuccacagucauuucu

SEQ ID NO: 426184 - RNA, 32 nt, Human
gaggcugcccugcgauggccugggugggagag

SEQ ID NO: 426185 - RNA, 23 nt, Human
gaggcugccgacuuuggacucca

SEQ ID NO: 426186 - RNA, 19 nt, Human
gaggcugccgccuccgcca

SEQ ID NO: 426187 - RNA, 32 nt, Human
gaggcugccguccgucucuccugcugcgcucg

SEQ ID NO: 426188 - RNA, 22 nt, Human
gaggcugccguccucuccuccu

SEQ ID NO: 426189 - RNA, 32 nt, Human
gaggcugccucgaggaugaagugcaaacccaa

SEQ ID NO: 426190 - RNA, 32 nt, Human
gaggcugccucgaggucacugccuuccggagc

SEQ ID NO: 426191 - RNA, 32 nt, Human
gaggcugccugaucgagcuggcacaggagcuc

SEQ ID NO: 426192 - RNA, 32 nt, Human
gaggcugccugauggugccugugcuuggggga

SEQ ID NO: 426193 - RNA, 32 nt, Human
gaggcugcgcccaggauuugucgggagccacg

SEQ ID NO: 426194 - RNA, 22 nt, Human
gaggcugcgccccuccaguucu

SEQ ID NO: 426195 - RNA, 32 nt, Human
gaggcugcgcuggagcccgcugggcagcgccg

SEQ ID NO: 426196 - RNA, 32 nt, Human
gaggcugcggcggccucggagcgcggcggagc

SEQ ID NO: 426197 - RNA, 27 nt, Human
gaggcugcggcgggagaaucgcuugaa

SEQ ID NO: 426198 - RNA, 21 nt, Human
gaggcugcggcggguggauca

SEQ ID NO: 426199 - RNA, 32 nt, Human
gaggcugcggugagccaagaucaugccauugc

SEQ ID NO: 426200 - RNA, 32 nt, Human
gaggcugcggugagccauaagcaugccacuau

SEQ ID NO: 426201 - RNA, 32 nt, Human
gaggcugcggugagccgagaccacaccauugc

SEQ ID NO: 426202 - RNA, 32 nt, Human
gaggcugcggugagccgagauugcgccauugc

SEQ ID NO: 426203 - RNA, 18 nt, Human
gaggcugcggugagcuau

SEQ ID NO: 426204 - RNA, 32 nt, Human
gaggcugcggugagcuaugaucgcgccacugc

SEQ ID NO: 426205 - RNA, 32 nt, Human
gaggcugcgguggaaggaucaccugagcccag

SEQ ID NO: 426206 - RNA, 32 nt, Human
gaggcugcggugucugcugcuauucuccgagc

SEQ ID NO: 426207 - RNA, 32 nt, Human
gaggcugcgguucugcuuccuccuggggcuga

SEQ ID NO: 426208 - RNA, 22 nt, Human
gaggcugcguacaguguuucac

SEQ ID NO: 426209 - RNA, 24 nt, Human
gaggcugcuacagccuugaguucc

SEQ ID NO: 426210 - RNA, 20 nt, Human
gaggcugcucacucuuggca

SEQ ID NO: 426211 - RNA, 32 nt, Human
gaggcugcucugagaaguacacacaggaauac

SEQ ID NO: 426212 - RNA, 22 nt, Human
gaggcugcugccagggcugcug

SEQ ID NO: 426213 - RNA, 32 nt, Human
gaggcugcugccuccuuccugcccauggcacc

SEQ ID NO: 426214 - RNA, 21 nt, Human
gaggcugcugcugggccgcug

SEQ ID NO: 426215 - RNA, 32 nt, Human
gaggcugcuggcagagagagaggacucuggag

SEQ ID NO: 426216 - RNA, 32 nt, Human
gaggcugcugugggauacguccaggagacucu

SEQ ID NO: 426217 - RNA, 32 nt, Human
gaggcugcuguggguuuaacuccuggguuggc

SEQ ID NO: 426218 - RNA, 32 nt, Human
gaggcugcugugguggggauccccaggggcuu

SEQ ID NO: 426219 - RNA, 32 nt, Human
gaggcugcuuaaaccucugucucugacggucc

SEQ ID NO: 426220 - RNA, 19 nt, Human
gaggcugcuuccguuucca

SEQ ID NO: 426221 - RNA, 32 nt, Human
gaggcugcuugugcaaguuucaacuuguccuu

SEQ ID NO: 426222 - RNA, 24 nt, Human
gaggcuggaaaagcaccccaagag

SEQ ID NO: 426223 - RNA, 32 nt, Human
gaggcuggaagaggaagaugccuagcacagac

SEQ ID NO: 426224 - RNA, 21 nt, Human
gaggcuggaagaucacuugaa

SEQ ID NO: 426225 - RNA, 32 nt, Human
gaggcuggacaguaguuuucccuugugacuuc

SEQ ID NO: 426226 - RNA, 32 nt, Human
gaggcuggaccucuucaucacauugcuuacgc

SEQ ID NO: 426227 - RNA, 32 nt, Human
gaggcuggacucggggagagaccccucuccac

SEQ ID NO: 426228 - RNA, 32 nt, Human
gaggcuggagaaagggaaguggaaggcaguga

SEQ ID NO: 426229 - RNA, 32 nt, Human
gaggcuggagaccccaggcucgccaaggcacg

SEQ ID NO: 426230 - RNA, 32 nt, Human
gaggcuggagaccugggcuggggccuuccucc

SEQ ID NO: 426231 - RNA, 22 nt, Human
gaggcuggagcaugcccaggag

SEQ ID NO: 426232 - RNA, 32 nt, Human
gaggcuggagccaagauccugccugauaucca

SEQ ID NO: 426233 - RNA, 18 nt, Human
gaggcuggagcccuggga

SEQ ID NO: 426234 - RNA, 21 nt, Human
gaggcuggaggcagacaggcu

SEQ ID NO: 426235 - RNA, 32 nt, Human
gaggcuggaggcaggccuugcccagagaugcc

SEQ ID NO: 426236 - RNA, 21 nt, Human
gaggcuggaggccaagcagcu

SEQ ID NO: 426237 - RNA, 32 nt, Human
gaggcuggaggggacaggaugggguggcuggg

SEQ ID NO: 426238 - RNA, 32 nt, Human
gaggcuggagguggagauggggucaggaacau

SEQ ID NO: 426239 - RNA, 23 nt, Human
gaggcuggaguaaucagauuacu

SEQ ID NO: 426240 - RNA, 32 nt, Human
gaggcuggaguuggggcagaggagaacuugcu

SEQ ID NO: 426241 - RNA, 25 nt, Human
gaggcuggauaaagccaaaccugcu

SEQ ID NO: 426242 - RNA, 32 nt, Human
gaggcuggauccuagccuuauccucugaucuc

SEQ ID NO: 426243 - RNA, 24 nt, Human
gaggcuggaugcagugguggugag

SEQ ID NO: 426244 - RNA, 32 nt, Human
gaggcuggauucacuacacaagaugaacuuca

SEQ ID NO: 426245 - RNA, 31 nt, Human
gaggcuggcaaugcuguuucacuggaggaca

SEQ ID NO: 426246 - RNA, 22 nt, Human
gaggcuggcagaucacaagguc

SEQ ID NO: 426247 - RNA, 23 nt, Human
gaggcuggcagcccagccaggaa

SEQ ID NO: 426248 - RNA, 32 nt, Human
gaggcuggcaggaguuggcaagagaacccccu

SEQ ID NO: 426249 - RNA, 32 nt, Human
gaggcuggcagugcugauucagccuggccauc

SEQ ID NO: 426250 - RNA, 31 nt, Human
gaggcuggccucucuggcugggugcagugaa

SEQ ID NO: 426251 - RNA, 21 nt, Human
gaggcuggccugaguauucua

SEQ ID NO: 426252 - RNA, 32 nt, Human
gaggcuggccuuucaucucagcaccagggugc

SEQ ID NO: 426253 - RNA, 22 nt, Human
gaggcuggcggaucacgagguc

SEQ ID NO: 426254 - RNA, 21 nt, Human
gaggcuggcggccucgauucc

SEQ ID NO: 426255 - RNA, 20 nt, Human
gaggcuggcuuggcuguucc

SEQ ID NO: 426256 - RNA, 21 nt, Human
gaggcuggcuuguccccuccu

SEQ ID NO: 426257 - RNA, 27 nt, Human
gaggcuggcuuuugugcuuuggguuuc

SEQ ID NO: 426258 - RNA, 21 nt, Human
gaggcugggaaaucguuugaa

SEQ ID NO: 426259 - RNA, 23 nt, Human
gaggcugggacacuaaccaagaa

SEQ ID NO: 426260 - RNA, 24 nt, Human
gaggcugggaccuccgggccagcu

SEQ ID NO: 426261 - RNA, 23 nt, Human
gaggcugggagccuggccaggaa

SEQ ID NO: 426262 - RNA, 32 nt, Human
gaggcugggaggacacgcaaguucagcuccag

SEQ ID NO: 426263 - RNA, 32 nt, Human
gaggcugggaggaucacuugagcccaggaguc

SEQ ID NO: 426264 - RNA, 32 nt, Human
gaggcugggaggcagagguugcagugagcuga

SEQ ID NO: 426265 - RNA, 32 nt, Human
gaggcugggaggcggagguugcagugagcuga

SEQ ID NO: 426266 - RNA, 23 nt, Human
gaggcugggagucccuaccugcu

SEQ ID NO: 426267 - RNA, 23 nt, Human
gaggcugggaguucaaaaccagc

SEQ ID NO: 426268 - RNA, 32 nt, Human
gaggcugggcacagaggucaggaagcaggggu

SEQ ID NO: 426269 - RNA, 32 nt, Human
gaggcugggccaagcccuuaagucaggagcag

SEQ ID NO: 426270 - RNA, 32 nt, Human
gaggcugggccagccucagcucagccuccccc

SEQ ID NO: 426271 - RNA, 32 nt, Human
gaggcugggcuguucccuucugugcucccaca

SEQ ID NO: 426272 - RNA, 27 nt, Human
gaggcuggggcagcagaaucgcuugaa

SEQ ID NO: 426273 - RNA, 27 nt, Human
gaggcuggggcaggagaaucgcuugaa

SEQ ID NO: 426274 - RNA, 32 nt, Human
gaggcuggggcauuggcaagaucacagguuga

SEQ ID NO: 426275 - RNA, 23 nt, Human
gaggcuggggccagaugacagcu

SEQ ID NO: 426276 - RNA, 32 nt, Human
gaggcuggggcugagguccccaugggguuugg

SEQ ID NO: 426277 - RNA, 23 nt, Human
gaggcuggggcugcucccaggaa

SEQ ID NO: 426278 - RNA, 20 nt, Human
gaggcugggggaucaccagc

SEQ ID NO: 426279 - RNA, 32 nt, Human
gaggcugggggucuuguggggagccaggcccc

SEQ ID NO: 426280 - RNA, 32 nt, Human
gaggcugggguccugacacaacaggaguacau

SEQ ID NO: 426281 - RNA, 32 nt, Human
gaggcuggggugagaggugauagaggcagcac

SEQ ID NO: 426282 - RNA, 32 nt, Human
gaggcugggucugagccuugcucgagauuagc

SEQ ID NO: 426283 - RNA, 32 nt, Human
gaggcugggugagcuggggugggaucuucacc

SEQ ID NO: 426284 - RNA, 32 nt, Human
gaggcugggugguugcacaggccaggugcaca

SEQ ID NO: 426285 - RNA, 32 nt, Human
gaggcuggucccauggccuuccucuuccacca

SEQ ID NO: 426286 - RNA, 32 nt, Human
gaggcuggucucaaacuccuaggaucaagcca

SEQ ID NO: 426287 - RNA, 32 nt, Human
gaggcugguggagcagcacacugugugaaccu

SEQ ID NO: 426288 - RNA, 32 nt, Human
gaggcugguggagggugggcugggcaugggau

SEQ ID NO: 426289 - RNA, 22 nt, Human
gaggcugguggaucacaagguc

SEQ ID NO: 426290 - RNA, 22 nt, Human
gaggcugguggaucacgagguc

SEQ ID NO: 426291 - RNA, 21 nt, Human
gaggcugguggaucacuugaa

SEQ ID NO: 426292 - RNA, 22 nt, Human
gaggcugguuucuggaaaucca

SEQ ID NO: 426293 - RNA, 32 nt, Human
gaggcuguacggcuacagccugggcaacaucu

SEQ ID NO: 426294 - RNA, 32 nt, Human
gaggcuguagcccagaggacauauagugauga

SEQ ID NO: 426295 - RNA, 18 nt, Human
gaggcuguaggcugugcc

SEQ ID NO: 426296 - RNA, 32 nt, Human
gaggcuguagugagccaagauagcaccacugc

SEQ ID NO: 426297 - RNA, 32 nt, Human
gaggcuguagugagcuaugauugcagacagag

SEQ ID NO: 426298 - RNA, 32 nt, Human
gaggcuguagugagcugagauggugccacugc

SEQ ID NO: 426299 - RNA, 32 nt, Human
gaggcuguagugagcugugauugccacagugc

SEQ ID NO: 426300 - RNA, 32 nt, Human
gaggcugucacacugugguggaggguccccuc

SEQ ID NO: 426301 - RNA, 32 nt, Human
gaggcugucaccaugccggccugcugcagcug

SEQ ID NO: 426302 - RNA, 32 nt, Human
gaggcuguccuccucacagagagcucagagau

SEQ ID NO: 426303 - RNA, 32 nt, Human
gaggcugucgugagcuaugauuaugccacugc

SEQ ID NO: 426304 - RNA, 32 nt, Human
gaggcugucuccccacagcuuuauccaagccu

SEQ ID NO: 426305 - RNA, 32 nt, Human
gaggcugucugaggaggagcagcgccuggugc

SEQ ID NO: 426306 - RNA, 32 nt, Human
gaggcugugaagccagaggggucgaggaggcu

SEQ ID NO: 426307 - RNA, 32 nt, Human
gaggcugugagcaaaguggccgccggggaacg

SEQ ID NO: 426308 - RNA, 32 nt, Human
gaggcugugccgucccgcugcugcacaggucg

SEQ ID NO: 426309 - RNA, 28 nt, Human
gaggcuguggcaggcgaaaucgcuugaa

SEQ ID NO: 426310 - RNA, 32 nt, Human
gaggcuguggcagguggaucaccugaggucag

SEQ ID NO: 426311 - RNA, 21 nt, Human
gaggcuguggccaggccagcu

SEQ ID NO: 426312 - RNA, 32 nt, Human
gaggcuguggcggacuccuuccaacucacgau

SEQ ID NO: 426313 - RNA, 32 nt, Human
gaggcuguggggcucgcuugcccacaugaccu

SEQ ID NO: 426314 - RNA, 32 nt, Human
gaggcuguggugauuugugauugcgccaccac

SEQ ID NO: 426315 - RNA, 32 nt, Human
gaggcuguucccuguccugccucagugccucc

SEQ ID NO: 426316 - RNA, 32 nt, Human
gaggcuguuccuucaguucuucuccagacugu

SEQ ID NO: 426317 - RNA, 32 nt, Human
gaggcuuacaaaccaacacguuuucugccaug

SEQ ID NO: 426318 - RNA, 32 nt, Human
gaggcuuacaagacuagggucuggaccagaau

SEQ ID NO: 426319 - RNA, 32 nt, Human
gaggcuuaccaugcugcucccuaggagggcca

SEQ ID NO: 426320 - RNA, 32 nt, Human
gaggcuuagagaucuguaauuucucugugaga

SEQ ID NO: 426321 - RNA, 32 nt, Human
gaggcuuaggagagagguuauggguauucaug

SEQ ID NO: 426322 - RNA, 32 nt, Human
gaggcuuaggagagagguuauggguauuggug

SEQ ID NO: 426323 - RNA, 32 nt, Human
gaggcuucacacauuuucccacucuuacaguu

SEQ ID NO: 426324 - RNA, 32 nt, Human
gaggcuucacaguauuucagagaagccaaaga

SEQ ID NO: 426325 - RNA, 32 nt, Human
gaggcuucagaaccagccacacgaagaccaaa

SEQ ID NO: 426326 - RNA, 32 nt, Human
gaggcuucaggggcccccuccccaccaaaggg

SEQ ID NO: 426327 - RNA, 32 nt, Human
gaggcuucagugagcggugauugugccacugc

SEQ ID NO: 426328 - RNA, 32 nt, Human
gaggcuucaucaggcuguggugggcgggggug

SEQ ID NO: 426329 - RNA, 32 nt, Human
gaggcuuccagcugcccaguggcucuuaaaca

SEQ ID NO: 426330 - RNA, 32 nt, Human
gaggcuuccauggggugggggaggccagcuuc

SEQ ID NO: 426331 - RNA, 32 nt, Human
gaggcuuccuucauuuccuccgucaccucaga

SEQ ID NO: 426332 - RNA, 32 nt, Human
gaggcuucgcggaacgcucucggcgccaggac

SEQ ID NO: 426333 - RNA, 32 nt, Human
gaggcuucgugccauguucagccugccccuua

SEQ ID NO: 426334 - RNA, 32 nt, Human
gaggcuucguggacuguguccugguccaugug

SEQ ID NO: 426335 - RNA, 32 nt, Human
gaggcuucucagacuguaagaggccgggaggg

SEQ ID NO: 426336 - RNA, 32 nt, Human
gaggcuucuccaaggaaaaggcagagaccagg

SEQ ID NO: 426337 - RNA, 32 nt, Human
gaggcuugaacccagaccccagcacugugaug

SEQ ID NO: 426338 - RNA, 32 nt, Human
gaggcuugaauccauuuccucucaucucagcc

SEQ ID NO: 426339 - RNA, 32 nt, Human
gaggcuugagccacugcaccuggccucauguc

SEQ ID NO: 426340 - RNA, 32 nt, Human
gaggcuugagcccaggagguggagguugcaau

SEQ ID NO: 426341 - RNA, 32 nt, Human
gaggcuugcuuucucaaaaaguggccaaggau

SEQ ID NO: 426342 - RNA, 32 nt, Human
gaggcuuggaccugggcagcuccugccccuca

SEQ ID NO: 426343 - RNA, 32 nt, Human
gaggcuuggccacaucccucauggccccauuu

SEQ ID NO: 426344 - RNA, 20 nt, Human
gaggcuugggaacagcagca

SEQ ID NO: 426345 - RNA, 31 nt, Human
gaggcuugggaugaagggugggugaaguuga

SEQ ID NO: 426346 - RNA, 32 nt, Human
gaggcuugucaugggucgggggugcccacuca

SEQ ID NO: 426347 - RNA, 32 nt, Human
gaggcuuguggccuggcuguucauggccacug

SEQ ID NO: 426348 - RNA, 32 nt, Human
gaggcuuuaagcuccagcuuuaaggguuguga

SEQ ID NO: 426349 - RNA, 32 nt, Human
gaggcuuuagccccaagaagguucuggaaagc

SEQ ID NO: 426350 - RNA, 32 nt, Human
gaggcuuuaggagaaggaagauccucucucag

SEQ ID NO: 426351 - RNA, 32 nt, Human
gaggcuuuaugaaauaaguuugcauugcacau

SEQ ID NO: 426352 - RNA, 32 nt, Human
gaggcuuuccacccucuuccugaccccuaaag

SEQ ID NO: 426353 - RNA, 32 nt, Human
gaggcuuucucaucuuuuaguucucagaucau

SEQ ID NO: 426354 - RNA, 32 nt, Human
gaggcuuucucccaucaguugucucacacuua

SEQ ID NO: 426355 - RNA, 20 nt, Human
gaggcuuucucugggugcca

SEQ ID NO: 426356 - RNA, 32 nt, Human
gaggcuuugagaaaggaguaggagccuagcau

SEQ ID NO: 426357 - RNA, 32 nt, Human
gaggcuuuuggaacaggagggauaggaggugc

SEQ ID NO: 426358 - RNA, 22 nt, Human
gagggaaaaaacccacagggac

SEQ ID NO: 426359 - RNA, 32 nt, Human
gagggaaaacucagggaagcccaggaggaagu

SEQ ID NO: 426360 - RNA, 32 nt, Human
gagggaaaagagucaggcagagcuguggaucc

SEQ ID NO: 426361 - RNA, 32 nt, Human
gagggaaaaggaaccaagaaguagaaggaguc

SEQ ID NO: 426362 - RNA, 32 nt, Human
gagggaaagaggaggaaggaagaugcgagaag

SEQ ID NO: 426363 - RNA, 31 nt, Human
gagggaaaggagagagaaggaaaggagugag

SEQ ID NO: 426364 - RNA, 32 nt, Human
gagggaaaggaggagggagagagauggagagg

SEQ ID NO: 426365 - RNA, 32 nt, Human
gagggaaagggauaggagaaggauguggacug

SEQ ID NO: 426366 - RNA, 32 nt, Human
gagggaaaggggacaggcauccuagcuaaggg

SEQ ID NO: 426367 - RNA, 32 nt, Human
gagggaaaguauccuccaacaggaugaagcag

SEQ ID NO: 426368 - RNA, 32 nt, Human
gagggaaauggaacucauuuggaacuccccgu

SEQ ID NO: 426369 - RNA, 18 nt, Human
gagggaaauuuauagcac

SEQ ID NO: 426370 - RNA, 32 nt, Human
gagggaacagaaguuaggaggcaacuuuggga

SEQ ID NO: 426371 - RNA, 19 nt, Human
gagggaacagggcauucca

SEQ ID NO: 426372 - RNA, 32 nt, Human
gagggaaccagccugccucccagggcaagagc

SEQ ID NO: 426373 - RNA, 32 nt, Human
gagggaaccagcugggagguccuccgagcugg

SEQ ID NO: 426374 - RNA, 32 nt, Human
gagggaacugaggacuaggggagagggugugu

SEQ ID NO: 426375 - RNA, 32 nt, Human
gagggaacugcacuucggcagaguugaaugaa

SEQ ID NO: 426376 - RNA, 21 nt, Human
gagggaacuggggacaggaau

SEQ ID NO: 426377 - RNA, 22 nt, Human
gagggaagaaacucuucccaga

SEQ ID NO: 426378 - RNA, 32 nt, Human
gagggaagaagaggaagcgggaggagcuuggc

SEQ ID NO: 426379 - RNA, 32 nt, Human
gagggaagaagaggagaggggaggggaccugc

SEQ ID NO: 426380 - RNA, 32 nt, Human
gagggaagaagcaggaggucucagcaugaaac

SEQ ID NO: 426381 - RNA, 32 nt, Human
gagggaagaagcuuugcagcaaccucugugcc

SEQ ID NO: 426382 - RNA, 32 nt, Human
gagggaagaccacccuccugucacccggaccu

SEQ ID NO: 426383 - RNA, 32 nt, Human
gagggaagacuugauccucagccccgagguug

SEQ ID NO: 426384 - RNA, 32 nt, Human
gagggaagagagaagagguaggaagaaaggug

SEQ ID NO: 426385 - RNA, 32 nt, Human
gagggaagagaugggagccagggcacgauaga

SEQ ID NO: 426386 - RNA, 32 nt, Human
gagggaagaggaagcuggaacgaggguuaagg

SEQ ID NO: 426387 - RNA, 32 nt, Human
gagggaagaggaaggaagguggguggggcugg

SEQ ID NO: 426388 - RNA, 32 nt, Human
gagggaagaugagagggggaggugagagcuuc

SEQ ID NO: 426389 - RNA, 32 nt, Human
gagggaagauggcggacgaggagaagcugccg

SEQ ID NO: 426390 - RNA, 32 nt, Human
gagggaagcaggccuugugaguggacacugac

SEQ ID NO: 426391 - RNA, 17 nt, Human
gagggaagcgagccggg

SEQ ID NO: 426392 - RNA, 32 nt, Human
gagggaagcggcuagaggaucggggagaagga

SEQ ID NO: 426393 - RNA, 32 nt, Human
gagggaagcuggaggaggugggggagacagag

SEQ ID NO: 426394 - RNA, 32 nt, Human
gagggaagcugggaaguuaaggcugcaggcuc

SEQ ID NO: 426395 - RNA, 32 nt, Human
gagggaaggaaagagagaaggaaagagagaga

SEQ ID NO: 426396 - RNA, 32 nt, Human
gagggaaggaagcagauucggagggguggaga

SEQ ID NO: 426397 - RNA, 32 nt, Human
gagggaaggaaggaagagagggaggcgggcaa

SEQ ID NO: 426398 - RNA, 32 nt, Human
gagggaaggagaggagaggaacagguuuugau

SEQ ID NO: 426399 - RNA, 32 nt, Human
gagggaaggagagggaggguggguggguggga

SEQ ID NO: 426400 - RNA, 32 nt, Human
gagggaaggagcccggcccugccuugucagcg

SEQ ID NO: 426401 - RNA, 32 nt, Human
gagggaaggaggaggaggaggagcaaaggugu

SEQ ID NO: 426402 - RNA, 32 nt, Human
gagggaaggaggcaggggugcugagaaggcgg

SEQ ID NO: 426403 - RNA, 32 nt, Human
gagggaaggagggagaggaaggcaggggaguu

SEQ ID NO: 426404 - RNA, 24 nt, Human
gagggaaggagggaugccaccaga

SEQ ID NO: 426405 - RNA, 32 nt, Human
gagggaaggcaggaaggaggcagccgaaggcc

SEQ ID NO: 426406 - RNA, 32 nt, Human
gagggaaggcgagacagcagugaacagcuggu

SEQ ID NO: 426407 - RNA, 23 nt, Human
gagggaaggcgggggagggcugg

SEQ ID NO: 426408 - RNA, 32 nt, Human
gagggaaggcuaagcauaggguuccugcagcc

SEQ ID NO: 426409 - RNA, 32 nt, Human
gagggaagggagcaggguggcgguugaggaac

SEQ ID NO: 426410 - RNA, 17 nt, Human
gagggaagggcaccgga

SEQ ID NO: 426411 - RNA, 32 nt, Human
gagggaagggcugggagccaugacauggagaa

SEQ ID NO: 426412 - RNA, 17 nt, Human
gagggaaggucagcaga

SEQ ID NO: 426413 - RNA, 32 nt, Human
gagggaaggugaugacuuaaauggcagggggu

SEQ ID NO: 426414 - RNA, 32 nt, Human
gagggaaguuuccagaaagaagagaggacaca

SEQ ID NO: 426415 - RNA, 32 nt, Human
gagggaauccggggaggaaggaaagagaaaua

SEQ ID NO: 426416 - RNA, 32 nt, Human
gagggaauuucuuuucgcagaagccauuacuc

SEQ ID NO: 426417 - RNA, 17 nt, Human
gagggacaagauaggac

SEQ ID NO: 426418 - RNA, 32 nt, Human
gagggacaaguggugcccuguccccugcuccc

SEQ ID NO: 426419 - RNA, 31 nt, Human
gagggacaagugugcaugcagauguccucag

SEQ ID NO: 426420 - RNA, 32 nt, Human
gagggacacgcgagaggcaggccaggcugcac

SEQ ID NO: 426421 - RNA, 32 nt, Human
gagggacacuggagggguguguuugcaauuua

SEQ ID NO: 426422 - RNA, 32 nt, Human
gagggacagaguguuccaggaggagguuugag

SEQ ID NO: 426423 - RNA, 32 nt, Human
gagggacagcagauuacugggcccgagacgca

SEQ ID NO: 426424 - RNA, 32 nt, Human
gagggacaggcugaagagagggacaggcacuc

SEQ ID NO: 426425 - RNA, 32 nt, Human
gagggacauggcacuggcugggccucagggga

SEQ ID NO: 426426 - RNA, 32 nt, Human
gagggacauguacugccucucaucuagaauuu

SEQ ID NO: 426427 - RNA, 32 nt, Human
gagggaccagauggaggaggccagcagcuagc

SEQ ID NO: 426428 - RNA, 21 nt, Human
gagggaccagcuggggggcag

SEQ ID NO: 426429 - RNA, 32 nt, Human
gagggaccagggugggagagcugauugcagaa

SEQ ID NO: 426430 - RNA, 32 nt, Human
gagggaccauccagacccucccuucuugcugg

SEQ ID NO: 426431 - RNA, 32 nt, Human
gagggaccauuuauuucccuucgaaacuguau

SEQ ID NO: 426432 - RNA, 32 nt, Human
gagggacccagcucuguuucugcugcuuccau

SEQ ID NO: 426433 - RNA, 32 nt, Human
gagggacccaggagcugccgccggccucagcc

SEQ ID NO: 426434 - RNA, 32 nt, Human
gagggacccccagagcugaaccgucagagccc

SEQ ID NO: 426435 - RNA, 32 nt, Human
gagggacccccagugccaacagugcuuuauca

SEQ ID NO: 426436 - RNA, 32 nt, Human
gagggaccgagcugcuggggaggaccucaguu

SEQ ID NO: 426437 - RNA, 32 nt, Human
gagggaccuaacuggagccucagucugacauu

SEQ ID NO: 426438 - RNA, 32 nt, Human
gagggaccucugcuuuccaggcugccuuuuau

SEQ ID NO: 426439 - RNA, 32 nt, Human
gagggaccugaggagggaggagggagaccaac

SEQ ID NO: 426440 - RNA, 32 nt, Human
gagggaccuggcaggcagagcuccagaaggga

SEQ ID NO: 426441 - RNA, 32 nt, Human
gagggacgauggcuuuccucagccugggauga

SEQ ID NO: 426442 - RNA, 32 nt, Human
gagggacgcaggcaggcggcgggcagcgggag

SEQ ID NO: 426443 - RNA, 32 nt, Human
gagggacgggcccuggggcuaggccaucucug

SEQ ID NO: 426444 - RNA, 32 nt, Human
gagggacguccugugagaaggcagcggcaagu

SEQ ID NO: 426445 - RNA, 32 nt, Human
gagggacuacagcccugaggggcugcuccaug

SEQ ID NO: 426446 - RNA, 32 nt, Human
gagggacuagaauacaaugucacuuuaagauu

SEQ ID NO: 426447 - RNA, 32 nt, Human
gagggacuagcucccggauguggagaagcugg

SEQ ID NO: 426448 - RNA, 22 nt, Human
gagggacuauucaggggcuaug

SEQ ID NO: 426449 - RNA, 32 nt, Human
gagggacucggccggagagcugaggggagggg

SEQ ID NO: 426450 - RNA, 32 nt, Human
gagggacucuggggucaugucuugcucugaga

SEQ ID NO: 426451 - RNA, 32 nt, Human
gagggacugagcacagcaccaacuagagaggg

SEQ ID NO: 426452 - RNA, 32 nt, Human
gagggacugcacucuugucagggaagcccuaa

SEQ ID NO: 426453 - RNA, 32 nt, Human
gagggacugcugcagcuagagcugagaugaug

SEQ ID NO: 426454 - RNA, 32 nt, Human
gagggacuggaguuccaggcagagggaacagc

SEQ ID NO: 426455 - RNA, 32 nt, Human
gagggacuggccagggcacccugugcugcagg

SEQ ID NO: 426456 - RNA, 32 nt, Human
gagggacuggguuccucucuccccuggcauga

SEQ ID NO: 426457 - RNA, 32 nt, Human
gagggacuguucugccagccuaacaaagcaac

SEQ ID NO: 426458 - RNA, 32 nt, Human
gagggacuugacuuucuuucuggacuguuugu

SEQ ID NO: 426459 - RNA, 32 nt, Human
gagggagaaaagaagauugaccagcuugcuag

SEQ ID NO: 426460 - RNA, 32 nt, Human
gagggagaaagcuacuuccagccauuagacua

SEQ ID NO: 426461 - RNA, 32 nt, Human
gagggagaaauguucauugcacagagaauguc

SEQ ID NO: 426462 - RNA, 32 nt, Human
gagggagaacacaagaggacagagcuaaggug

SEQ ID NO: 426463 - RNA, 32 nt, Human
gagggagaacaggcacauuagccuugaagcug

SEQ ID NO: 426464 - RNA, 23 nt, Human
gagggagaagggaacacauuucc

SEQ ID NO: 426465 - RNA, 32 nt, Human
gagggagaagggagaguggcagagagaggagc

SEQ ID NO: 426466 - RNA, 32 nt, Human
gagggagaaguuggggaaaauggaauugacgg

SEQ ID NO: 426467 - RNA, 32 nt, Human
gagggagaaugggaagaucaggaagcucuaga

SEQ ID NO: 426468 - RNA, 32 nt, Human
gagggagacaacggcagagggagugagcaggg

SEQ ID NO: 426469 - RNA, 32 nt, Human
gagggagacgucauugcaggguuguuugucag

SEQ ID NO: 426470 - RNA, 32 nt, Human
gagggagacuccgucucagaaaaaggaaaaga

SEQ ID NO: 426471 - RNA, 32 nt, Human
gagggagagagaagaagaggaagaagaggagg

SEQ ID NO: 426472 - RNA, 32 nt, Human
gagggagagagaaggugacacggauggaagag

SEQ ID NO: 426473 - RNA, 32 nt, Human
gagggagagagacagagagagcagggaucagg

SEQ ID NO: 426474 - RNA, 32 nt, Human
gagggagagagaggacaccgaagccgggagcu

SEQ ID NO: 426475 - RNA, 32 nt, Human
gagggagagaggcagagagggagagaggcaga

SEQ ID NO: 426476 - RNA, 32 nt, Human
gagggagagagggagaaaacgaaggggagcuc

SEQ ID NO: 426477 - RNA, 32 nt, Human
gagggagagagggagagagccuauaccccuua

SEQ ID NO: 426478 - RNA, 32 nt, Human
gagggagagagggagagugacagcagcgcucg

SEQ ID NO: 426479 - RNA, 18 nt, Human
gagggagagcaguguucu

SEQ ID NO: 426480 - RNA, 32 nt, Human
gagggagagcuggggccugcucccggagagau

SEQ ID NO: 426481 - RNA, 32 nt, Human
gagggagaggagaagagacgcaaaagaccggg

SEQ ID NO: 426482 - RNA, 19 nt, Human
gagggagaggagacaggaa

SEQ ID NO: 426483 - RNA, 32 nt, Human
gagggagaggagagagagugcgagaccgagcg

SEQ ID NO: 426484 - RNA, 32 nt, Human
gagggagagggaggacagggagagaaaauacc

SEQ ID NO: 426485 - RNA, 32 nt, Human
gagggagagugcagccaggcucagggaucccc

SEQ ID NO: 426486 - RNA, 32 nt, Human
gagggagauaaagagagagggcaaagaggcag

SEQ ID NO: 426487 - RNA, 32 nt, Human
gagggagauggaaguugagcaagagcagcggc

SEQ ID NO: 426488 - RNA, 32 nt, Human
gagggagauggaccagcccacgccuggcaccu

SEQ ID NO: 426489 - RNA, 32 nt, Human
gagggagaugggcaaggcgcugagggaggaug

SEQ ID NO: 426490 - RNA, 32 nt, Human
gagggagcaagggagagcaggggaggugucag

SEQ ID NO: 426491 - RNA, 32 nt, Human
gagggagcaaugagggguggucccagcucugc

SEQ ID NO: 426492 - RNA, 32 nt, Human
gagggagcaaugcagacucguagggcccuuag

SEQ ID NO: 426493 - RNA, 32 nt, Human
gagggagcagcggggagcuugcagugaccaag

SEQ ID NO: 426494 - RNA, 32 nt, Human
gagggagcaggcggagcgagagagggagaaac

SEQ ID NO: 426495 - RNA, 32 nt, Human
gagggagcagggagcccucacucuccacgccc

SEQ ID NO: 426496 - RNA, 32 nt, Human
gagggagcagucuucguucuuccuccccucag

SEQ ID NO: 426497 - RNA, 18 nt, Human
gagggagcagugccggga

SEQ ID NO: 426498 - RNA, 32 nt, Human
gagggagcauggcaaagucgguuucucucugg

SEQ ID NO: 426499 - RNA, 32 nt, Human
gagggagccacauccugaccccagcagccuca

SEQ ID NO: 426500 - RNA, 32 nt, Human
gagggagccagaccucuggcccagaaagccag

SEQ ID NO: 426501 - RNA, 32 nt, Human
gagggagcccugaaacaggaggcuggcaucug

SEQ ID NO: 426502 - RNA, 32 nt, Human
gagggagccguggagguccaggugacugcuua

SEQ ID NO: 426503 - RNA, 32 nt, Human
gagggagccugaguacaggcuuggagaaaugg

SEQ ID NO: 426504 - RNA, 19 nt, Human
gagggagccugccggcaaa

SEQ ID NO: 426505 - RNA, 32 nt, Human
gagggagcgagggagagaggaccggucccagc

SEQ ID NO: 426506 - RNA, 32 nt, Human
gagggagcuauacaaugaugucuuuauuagug

SEQ ID NO: 426507 - RNA, 32 nt, Human
gagggagcuauacaauuuaaucuauugccauu

SEQ ID NO: 426508 - RNA, 32 nt, Human
gagggagcucacugccuaccuggccuggggcu

SEQ ID NO: 426509 - RNA, 17 nt, Human
gagggagcucgcucugu

SEQ ID NO: 426510 - RNA, 32 nt, Human
gagggagcugcuggcugaccugggcccacaga

SEQ ID NO: 426511 - RNA, 32 nt, Human
gagggagcugggaaggaaggaagggggcgcua

SEQ ID NO: 426512 - RNA, 32 nt, Human
gagggagcuggucuccagccaggugagcaaca

SEQ ID NO: 426513 - RNA, 32 nt, Human
gagggagcuucuccaggaucagcagagcucga

SEQ ID NO: 426514 - RNA, 32 nt, Human
gagggagcuuggagaacucacugugggcuagg

SEQ ID NO: 426515 - RNA, 32 nt, Human
gagggaggaaaagaggaggagacggaggagaa

SEQ ID NO: 426516 - RNA, 32 nt, Human
gagggaggaacggaagaacggagggagcuacg

SEQ ID NO: 426517 - RNA, 32 nt, Human
gagggaggaagaaggaagagaggcagaagacu

SEQ ID NO: 426518 - RNA, 32 nt, Human
gagggaggaaggcagagcaaguggagcagggc

SEQ ID NO: 426519 - RNA, 32 nt, Human
gagggaggaauagcuucuuguauguccacugg

SEQ ID NO: 426520 - RNA, 32 nt, Human
gagggaggaaucgaggaaccagagccauggac

SEQ ID NO: 426521 - RNA, 32 nt, Human
gagggaggacacaucuggaggaaauggccuuc

SEQ ID NO: 426522 - RNA, 32 nt, Human
gagggaggacacccuccccugcagaagucagg

SEQ ID NO: 426523 - RNA, 32 nt, Human
gagggaggacaggccaguagggggagggaaag

SEQ ID NO: 426524 - RNA, 19 nt, Human
gagggaggacaugucggga

SEQ ID NO: 426525 - RNA, 18 nt, Human
gagggaggacccuggggu

SEQ ID NO: 426526 - RNA, 32 nt, Human
gagggaggaccugcuggcugcagugaggagcg

SEQ ID NO: 426527 - RNA, 32 nt, Human
gagggaggaccuguuguguuccagccauucug

SEQ ID NO: 426528 - RNA, 32 nt, Human
gagggaggagaaggagcagccgccacagcugu

SEQ ID NO: 426529 - RNA, 32 nt, Human
gagggaggagagaagggcggcagugggagggg

SEQ ID NO: 426530 - RNA, 32 nt, Human
gagggaggagaggacccaggaacccggcuagg

SEQ ID NO: 426531 - RNA, 32 nt, Human
gagggaggagagggguuggaguaggugggaag

SEQ ID NO: 426532 - RNA, 32 nt, Human
gagggaggagaggucacuggggaguggugggg

SEQ ID NO: 426533 - RNA, 32 nt, Human
gagggaggaggaagaagacaaagguguggagg

SEQ ID NO: 426534 - RNA, 32 nt, Human
gagggaggaggaagaagcggaggaggcggcuc

SEQ ID NO: 426535 - RNA, 32 nt, Human
gagggaggaggaagaaggaaguaaggaggaaa

SEQ ID NO: 426536 - RNA, 32 nt, Human
gagggaggaggaagagagggagggaggcggga

SEQ ID NO: 426537 - RNA, 32 nt, Human
gagggaggaggaagagauagaggaggaggagg

SEQ ID NO: 426538 - RNA, 32 nt, Human
gagggaggaggccaggccagagccagaagacg

SEQ ID NO: 426539 - RNA, 32 nt, Human
gagggaggaggugagagugauuagugggagaa

SEQ ID NO: 426540 - RNA, 32 nt, Human
gagggaggagucaggcugucccagcgaggccc

SEQ ID NO: 426541 - RNA, 32 nt, Human
gagggaggaucuccagaggucaggaguucgag

SEQ ID NO: 426542 - RNA, 21 nt, Human
gagggaggauucaagucggga

SEQ ID NO: 426543 - RNA, 32 nt, Human
gagggaggcagaggagacuugaaacagaugga

SEQ ID NO: 426544 - RNA, 32 nt, Human
gagggaggcaggcaauaugcagugaaaaccuu

SEQ ID NO: 426545 - RNA, 32 nt, Human
gagggaggcaucaccauugcaaucacuucugg

SEQ ID NO: 426546 - RNA, 32 nt, Human
gagggaggccaagggugagggaagagagcccg

SEQ ID NO: 426547 - RNA, 32 nt, Human
gagggaggccagugucagggucggaguggccu

SEQ ID NO: 426548 - RNA, 32 nt, Human
gagggaggcccaggugcagggagcaggcgagg

SEQ ID NO: 426549 - RNA, 23 nt, Human
gagggaggcccggguggggggca

SEQ ID NO: 426550 - RNA, 32 nt, Human
gagggaggccggagcgggcagcgcggcggcgc

SEQ ID NO: 426551 - RNA, 22 nt, Human
gagggaggccugagcacacugc

SEQ ID NO: 426552 - RNA, 32 nt, Human
gagggaggcgaacccgcacuuccaggcuuggg

SEQ ID NO: 426553 - RNA, 32 nt, Human
gagggaggcgaacuucucauggggaagaagug

SEQ ID NO: 426554 - RNA, 24 nt, Human
gagggaggcggacagccagaugca

SEQ ID NO: 426555 - RNA, 32 nt, Human
gagggaggcuuccugacugacacaggccagcc

SEQ ID NO: 426556 - RNA, 32 nt, Human
gagggaggcuuccugacugacacaggcuagcc

SEQ ID NO: 426557 - RNA, 32 nt, Human
gagggagggaaagaggaggaaggaagaugcga

SEQ ID NO: 426558 - RNA, 32 nt, Human
gagggagggaagagaagaaagcgagcgguuag

SEQ ID NO: 426559 - RNA, 32 nt, Human
gagggagggagagagaaagacgaagggagaga

SEQ ID NO: 426560 - RNA, 32 nt, Human
gagggagggagagagagugaaagaagaaaaua

SEQ ID NO: 426561 - RNA, 32 nt, Human
gagggagggagaggagagagagugcgagaccg

SEQ ID NO: 426562 - RNA, 32 nt, Human
gagggagggagcgagcgagcagugaguaagcc

SEQ ID NO: 426563 - RNA, 32 nt, Human
gagggagggagggcuccagacacauguccaag

SEQ ID NO: 426564 - RNA, 32 nt, Human
gagggagggagguggagaaggacgggagaggc

SEQ ID NO: 426565 - RNA, 32 nt, Human
gagggagggauggggaaguguagccacaguuc

SEQ ID NO: 426566 - RNA, 22 nt, Human
gagggagggcagagccugagga

SEQ ID NO: 426567 - RNA, 22 nt, Human
gagggagggcaggcgggaggga

SEQ ID NO: 426568 - RNA, 32 nt, Human
gagggagggcaggcgggagggagggcauuggc

SEQ ID NO: 426569 - RNA, 23 nt, Human
gagggagggccgggaagccagga

SEQ ID NO: 426570 - RNA, 32 nt, Human
gagggagggccgggaagccaggaaagcuuggu

SEQ ID NO: 426571 - RNA, 20 nt, Human
gagggagggccgggccagga

SEQ ID NO: 426572 - RNA, 18 nt, Human
gagggagggcgccccggg

SEQ ID NO: 426573 - RNA, 19 nt, Human
gagggagggcggagggcgg

SEQ ID NO: 426574 - RNA, 32 nt, Human
gagggagggcgggagagagggaacggaggaug

SEQ ID NO: 426575 - RNA, 32 nt, Human
gagggagggcuggggccuccuuguccuggauu

SEQ ID NO: 426576 - RNA, 32 nt, Human
gagggaggggagugucagagugugagcggggu

SEQ ID NO: 426577 - RNA, 32 nt, Human
gagggaggggccgccggggaagaggaggagga

SEQ ID NO: 426578 - RNA, 32 nt, Human
gagggaggggcgggggcuggaggcagcagcgc

SEQ ID NO: 426579 - RNA, 32 nt, Human
gagggagggggcuuguuucccuucccucccgg

SEQ ID NO: 426580 - RNA, 32 nt, Human
gagggagggggugggagaauccaaauaguauu

SEQ ID NO: 426581 - RNA, 32 nt, Human
gagggaggggugggggacagugggugggcauu

SEQ ID NO: 426582 - RNA, 32 nt, Human
gagggaggguacuuugccccagaagggagggu

SEQ ID NO: 426583 - RNA, 32 nt, Human
gagggaggguugugucaggcuugggggauggg

SEQ ID NO: 426584 - RNA, 23 nt, Human
gagggaggugccggagccaggga

SEQ ID NO: 426585 - RNA, 32 nt, Human
gagggagguggagggaggaaggugggaauuau

SEQ ID NO: 426586 - RNA, 32 nt, Human
gagggaggugggccaccauguuuggacccggg

SEQ ID NO: 426587 - RNA, 17 nt, Human
gagggagguugcaguga

SEQ ID NO: 426588 - RNA, 32 nt, Human
gagggaguaugggagagagggacugccacaca

SEQ ID NO: 426589 - RNA, 32 nt, Human
gagggagucccagagcccuggaccuugggccu

SEQ ID NO: 426590 - RNA, 32 nt, Human
gagggagucggaggcgccagcccacuggggag

SEQ ID NO: 426591 - RNA, 32 nt, Human
gagggagugcccugaaacucuaaucucauugc

SEQ ID NO: 426592 - RNA, 32 nt, Human
gagggagugccuggccaggccggccugucugc

SEQ ID NO: 426593 - RNA, 32 nt, Human
gagggaguggagaaggaggugagggggcccag

SEQ ID NO: 426594 - RNA, 32 nt, Human
gagggagugggcacgugagcacauaauggcac

SEQ ID NO: 426595 - RNA, 32 nt, Human
gagggagugggcaugugagcacauaauggcac

SEQ ID NO: 426596 - RNA, 18 nt, Human
gagggagugggcauucca

SEQ ID NO: 426597 - RNA, 32 nt, Human
gagggaguuagggagagagaagcaggcagaua

SEQ ID NO: 426598 - RNA, 32 nt, Human
gagggaguuccugcuacccaucgugggaggcc

SEQ ID NO: 426599 - RNA, 32 nt, Human
gagggaguucucuucuggcccugggggccgca

SEQ ID NO: 426600 - RNA, 32 nt, Human
gagggaguuggacuucagaucugcaaucuggc

SEQ ID NO: 426601 - RNA, 30 nt, Human
gagggaguuggcucuagggcacagucccug

SEQ ID NO: 426602 - RNA, 32 nt, Human
gagggauaaucaguugaacccaggagguggag

SEQ ID NO: 426603 - RNA, 32 nt, Human
gagggauacugaggcccaggcauggagcugcc

SEQ ID NO: 426604 - RNA, 22 nt, Human
gagggaucuaaggagacauggc

SEQ ID NO: 426605 - RNA, 32 nt, Human
gagggaucuauacuugcuuuguguucuuugug

SEQ ID NO: 426606 - RNA, 32 nt, Human
gagggaugaggagguggagugcaggggauguu

SEQ ID NO: 426607 - RNA, 32 nt, Human
gagggaugcagugccuuuccccauucauuccu

SEQ ID NO: 426608 - RNA, 32 nt, Human
gagggaugccaguucugccuguucaucuggaa

SEQ ID NO: 426609 - RNA, 32 nt, Human
gagggaugccgcaaccucgacuucucagccuc

SEQ ID NO: 426610 - RNA, 32 nt, Human
gagggaugccuagggcggggugggcaguggcu

SEQ ID NO: 426611 - RNA, 32 nt, Human
gagggaugcucaucuuuaacagucucccucau

SEQ ID NO: 426612 - RNA, 32 nt, Human
gagggauggaaaugaccuccuggcaccaggcu

SEQ ID NO: 426613 - RNA, 32 nt, Human
gagggauggcacacugauguguuuaugcaccu

SEQ ID NO: 426614 - RNA, 32 nt, Human
gagggaugggguggcgaggacaggguacgucg

SEQ ID NO: 426615 - RNA, 19 nt, Human
gagggauguauacugcaga

SEQ ID NO: 426616 - RNA, 17 nt, Human
gagggaugucuuuggga

SEQ ID NO: 426617 - RNA, 32 nt, Human
gagggaugugccagugccuucucaccaccacg

SEQ ID NO: 426618 - RNA, 32 nt, Human
gagggaugugugugugcagcuuauuguagacc

SEQ ID NO: 426619 - RNA, 32 nt, Human
gagggauuauuuuucuacaaaguaauuuauga

SEQ ID NO: 426620 - RNA, 28 nt, Human
gagggauuccaugcugccuucuccggac

SEQ ID NO: 426621 - RNA, 32 nt, Human
gagggauugaugcugguuaucucucugaaucu

SEQ ID NO: 426622 - RNA, 19 nt, Human
gagggauuuagaauucccu

SEQ ID NO: 426623 - RNA, 19 nt, Human
gagggauuugcacaggaac

SEQ ID NO: 426624 - RNA, 24 nt, Human
gagggauuuuauugugaaauucua

SEQ ID NO: 426625 - RNA, 32 nt, Human
gagggcaaacuagacauuguaaugcauaagau

SEQ ID NO: 426626 - RNA, 32 nt, Human
gagggcaaaucacuugagcucaggaguuugag

SEQ ID NO: 426627 - RNA, 32 nt, Human
gagggcaaauucaccagcaggggcuaggaauu

SEQ ID NO: 426628 - RNA, 32 nt, Human
gagggcaacagagccagcaucuugccagggcc

SEQ ID NO: 426629 - RNA, 19 nt, Human
gagggcaagagugagcaag

SEQ ID NO: 426630 - RNA, 32 nt, Human
gagggcaagagugagcaagagauggaaguugc

SEQ ID NO: 426631 - RNA, 19 nt, Human
gagggcaaggacacuucca

SEQ ID NO: 426632 - RNA, 32 nt, Human
gagggcaaggcaagagcuugagcuugagccua

SEQ ID NO: 426633 - RNA, 22 nt, Human
gagggcaaggcaggcggaucac

SEQ ID NO: 426634 - RNA, 19 nt, Human
gagggcaauauauguuuca

SEQ ID NO: 426635 - RNA, 32 nt, Human
gagggcaaucgcuuccuggugcugagcuccuu

SEQ ID NO: 426636 - RNA, 32 nt, Human
gagggcacccagccuucuaaaacacaauguau

SEQ ID NO: 426637 - RNA, 32 nt, Human
gagggcacccaggagugucuggcugcauuacc

SEQ ID NO: 426638 - RNA, 32 nt, Human
gagggcaccccgaggaacauggcauggccucu

SEQ ID NO: 426639 - RNA, 32 nt, Human
gagggcaccucgcugcuccagccucuggggcg

SEQ ID NO: 426640 - RNA, 20 nt, Human
gagggcacgucuaugaucca

SEQ ID NO: 426641 - RNA, 18 nt, Human
gagggcacugaacuguca

SEQ ID NO: 426642 - RNA, 32 nt, Human
gagggcacugaccacaccccacacaaccucaa

SEQ ID NO: 426643 - RNA, 19 nt, Human
gagggcacugcaaauacca

SEQ ID NO: 426644 - RNA, 32 nt, Human
gagggcacugccaggcuguguucaguuagcac

SEQ ID NO: 426645 - RNA, 32 nt, Human
gagggcacugccucagggcuuacaguguucug

SEQ ID NO: 426646 - RNA, 32 nt, Human
gagggcacugcuguggugugggagcaguccug

SEQ ID NO: 426647 - RNA, 19 nt, Human
gagggcacuggacagaaac

SEQ ID NO: 426648 - RNA, 20 nt, Human
gagggcacugugaaggcucc

SEQ ID NO: 426649 - RNA, 32 nt, Human
gagggcagaaggcagaagugagcaugugagac

SEQ ID NO: 426650 - RNA, 32 nt, Human
gagggcagacagauuccugcuagcagcuuagu

SEQ ID NO: 426651 - RNA, 23 nt, Human
gagggcagacugugcacauuuca

SEQ ID NO: 426652 - RNA, 32 nt, Human
gagggcagagagaggggagcccccucuuccac

SEQ ID NO: 426653 - RNA, 32 nt, Human
gagggcagaggaggagagagccuggcagcgga

SEQ ID NO: 426654 - RNA, 32 nt, Human
gagggcagagggcagagcucuggccacuucug

SEQ ID NO: 426655 - RNA, 22 nt, Human
gagggcagaggggccagaagga

SEQ ID NO: 426656 - RNA, 32 nt, Human
gagggcagaguccucauagccuaaucaccucc

SEQ ID NO: 426657 - RNA, 32 nt, Human
gagggcagagucuuagcuguuuucuuuaagca

SEQ ID NO: 426658 - RNA, 32 nt, Human
gagggcagagugaggccaccuggcgggggugc

SEQ ID NO: 426659 - RNA, 18 nt, Human
gagggcagcaacguuuca

SEQ ID NO: 426660 - RNA, 32 nt, Human
gagggcagcacagaggccccugggacaccuac

SEQ ID NO: 426661 - RNA, 20 nt, Human
gagggcagcauccccuaacu

SEQ ID NO: 426662 - RNA, 32 nt, Human
gagggcagccaguagccucggaggcuuggaug

SEQ ID NO: 426663 - RNA, 30 nt, Human
gagggcagccucuccagcucucuuguuuau

SEQ ID NO: 426664 - RNA, 31 nt, Human
gagggcagccuucugccaccugugucgccuc

SEQ ID NO: 426665 - RNA, 32 nt, Human
gagggcagccuucugccaccugugucgccucc

SEQ ID NO: 426666 - RNA, 32 nt, Human
gagggcagcucuacaaagcauaccucagcagc

SEQ ID NO: 426667 - RNA, 32 nt, Human
gagggcagcugacagccgggagagugcacaga

SEQ ID NO: 426668 - RNA, 32 nt, Human
gagggcagcuguagaaacuuucccucuguggg

SEQ ID NO: 426669 - RNA, 18 nt, Human
gagggcagcuuacguguu

SEQ ID NO: 426670 - RNA, 32 nt, Human
gagggcaggaacacccuugguuuuauuuacuu

SEQ ID NO: 426671 - RNA, 19 nt, Human
gagggcaggaggacuacuu

SEQ ID NO: 426672 - RNA, 32 nt, Human
gagggcaggagugggagcagaugacaaccauu

SEQ ID NO: 426673 - RNA, 32 nt, Human
gagggcaggccaggauggagcccaggguagac

SEQ ID NO: 426674 - RNA, 32 nt, Human
gagggcaggcccccaagagcugugcugauccg

SEQ ID NO: 426675 - RNA, 32 nt, Human
gagggcaggcccugugcucauagcuuuacgau

SEQ ID NO: 426676 - RNA, 32 nt, Human
gagggcaggccuguaucuuuuacuucugugua

SEQ ID NO: 426677 - RNA, 32 nt, Human
gagggcaggcguugggacaggagggcaggggu

SEQ ID NO: 426678 - RNA, 32 nt, Human
gagggcaggcugggugagggacaggaggcccc

SEQ ID NO: 426679 - RNA, 32 nt, Human
gagggcagggaagacucacagcagagcaggag

SEQ ID NO: 426680 - RNA, 32 nt, Human
gagggcagggaccacacccuguacuguucugu

SEQ ID NO: 426681 - RNA, 32 nt, Human
gagggcagggagucaguacaacacagugcuca

SEQ ID NO: 426682 - RNA, 32 nt, Human
gagggcagggcuagguguagcggugucuccuc

SEQ ID NO: 426683 - RNA, 32 nt, Human
gagggcagggcugcggggaggccaggccgagc

SEQ ID NO: 426684 - RNA, 31 nt, Human
gagggcagggcuggaccaugggugagggcag

SEQ ID NO: 426685 - RNA, 32 nt, Human
gagggcaggggucgggugggagagggaugcau

SEQ ID NO: 426686 - RNA, 32 nt, Human
gagggcaggggugagagagcaagggggcaggg

SEQ ID NO: 426687 - RNA, 32 nt, Human
gagggcaggggugggaaggcaggagggaggug

SEQ ID NO: 426688 - RNA, 32 nt, Human
gagggcagggugagacauucagaggaaacgac

SEQ ID NO: 426689 - RNA, 18 nt, Human
gagggcagggugcaucca

SEQ ID NO: 426690 - RNA, 23 nt, Human
gagggcagguccagccuucagca

SEQ ID NO: 426691 - RNA, 32 nt, Human
gagggcagguugagaccuggaggcagggucca

SEQ ID NO: 426692 - RNA, 32 nt, Human
gagggcaguagcucaguguggaagaaaauccu

SEQ ID NO: 426693 - RNA, 19 nt, Human
gagggcaguaucuuuggga

SEQ ID NO: 426694 - RNA, 32 nt, Human
gagggcagucagugucacuucugggaugugcc

SEQ ID NO: 426695 - RNA, 32 nt, Human
gagggcaguggcagaaaagugaccacucugca

SEQ ID NO: 426696 - RNA, 32 nt, Human
gagggcauagggcagccuaccaccuccaaggg

SEQ ID NO: 426697 - RNA, 32 nt, Human
gagggcaucugcaauaggaggggacccgagcc

SEQ ID NO: 426698 - RNA, 32 nt, Human
gagggcaugaguucgagaccagccuggccaac

SEQ ID NO: 426699 - RNA, 32 nt, Human
gagggcauggggugaggcauggcgauggggga

SEQ ID NO: 426700 - RNA, 20 nt, Human
gagggcaugugauauuuuca

SEQ ID NO: 426701 - RNA, 21 nt, Human
gagggcauuagccccauuuca

SEQ ID NO: 426702 - RNA, 32 nt, Human
gagggcauuggcgagguagagcuuaaagguac

SEQ ID NO: 426703 - RNA, 20 nt, Human
gagggcauugugacauauca

SEQ ID NO: 426704 - RNA, 26 nt, Human
gagggccaaggggcgugggcgucuuc

SEQ ID NO: 426705 - RNA, 31 nt, Human
gagggccaaguguccauucagacucggguau

SEQ ID NO: 426706 - RNA, 32 nt, Human
gagggccaauccagacacacucacacucucau

SEQ ID NO: 426707 - RNA, 32 nt, Human
gagggccaaugccacuucacucagcacuuuaa

SEQ ID NO: 426708 - RNA, 32 nt, Human
gagggccacacaugcauacacaugcacacuca

SEQ ID NO: 426709 - RNA, 32 nt, Human
gagggccaccacugcaguucugcuaggucugc

SEQ ID NO: 426710 - RNA, 32 nt, Human
gagggccaccuugcuuuauagcauauuacuca

SEQ ID NO: 426711 - RNA, 32 nt, Human
gagggccacuacacuccagccugggugacaga

SEQ ID NO: 426712 - RNA, 23 nt, Human
gagggccagaagccacauccucu

SEQ ID NO: 426713 - RNA, 31 nt, Human
gagggccagagaggcaguuggaagauggcgg

SEQ ID NO: 426714 - RNA, 24 nt, Human
gagggccagagagugaauaucuuu

SEQ ID NO: 426715 - RNA, 32 nt, Human
gagggccagcacuggcgucugcggccgcagca

SEQ ID NO: 426716 - RNA, 32 nt, Human
gagggccagcucccagccucuugcuuccuggg

SEQ ID NO: 426717 - RNA, 22 nt, Human
gagggccaggcacccacauccc

SEQ ID NO: 426718 - RNA, 32 nt, Human
gagggccagggaggaggagaaaggaauugagc

SEQ ID NO: 426719 - RNA, 32 nt, Human
gagggccaggucgggggcaggcauggagggga

SEQ ID NO: 426720 - RNA, 32 nt, Human
gagggccaugauuucccucccggggccccugg

SEQ ID NO: 426721 - RNA, 32 nt, Human
gagggccaugcucuccuuggacccaguuaacu

SEQ ID NO: 426722 - RNA, 32 nt, Human
gagggccaugcuguggacagugaggggaggag

SEQ ID NO: 426723 - RNA, 21 nt, Human
gagggccauuugaacauuaca

SEQ ID NO: 426724 - RNA, 32 nt, Human
gagggcccaccuccugccuccugguggccugu

SEQ ID NO: 426725 - RNA, 32 nt, Human
gagggcccagagaggcgguggggugggcgacc

SEQ ID NO: 426726 - RNA, 32 nt, Human
gagggcccagcuggggcaaccacgcucgggac

SEQ ID NO: 426727 - RNA, 32 nt, Human
gagggcccaggaggucaaggcuucagugagcc

SEQ ID NO: 426728 - RNA, 32 nt, Human
gagggcccaggccacggaaacaagacugcaga

SEQ ID NO: 426729 - RNA, 32 nt, Human
gagggccccacgugguucccagccagacaguu

SEQ ID NO: 426730 - RNA, 18 nt, Human
gagggccccggccggggg

SEQ ID NO: 426731 - RNA, 32 nt, Human
gagggccccucagagccaggugcuggccagau

SEQ ID NO: 426732 - RNA, 32 nt, Human
gagggccccucaggcagagauggaccaggcgg

SEQ ID NO: 426733 - RNA, 32 nt, Human
gagggccccucggcaccugccuggcacaagug

SEQ ID NO: 426734 - RNA, 32 nt, Human
gagggccccucgggagccccuggccauguuag

SEQ ID NO: 426735 - RNA, 32 nt, Human
gagggcccggcgcagaggauugaggaggaggg

SEQ ID NO: 426736 - RNA, 32 nt, Human
gagggcccguguccccgcggaggucaaggccg

SEQ ID NO: 426737 - RNA, 32 nt, Human
gagggcccugggauccccuugacccuggucau

SEQ ID NO: 426738 - RNA, 21 nt, Human
gagggccgaggauaauguugc

SEQ ID NO: 426739 - RNA, 21 nt, Human
gagggccgagggcgggagcug

SEQ ID NO: 426740 - RNA, 32 nt, Human
gagggccgaucuguuacaggcaaguuuggcaa

SEQ ID NO: 426741 - RNA, 32 nt, Human
gagggccggaggcccaaggagggcgcgccuug

SEQ ID NO: 426742 - RNA, 32 nt, Human
gagggccgggcagaggggcagauggaaaggag

SEQ ID NO: 426743 - RNA, 18 nt, Human
gagggccgggcccuggga

SEQ ID NO: 426744 - RNA, 24 nt, Human
gagggccggggaguacacugaucc

SEQ ID NO: 426745 - RNA, 20 nt, Human
gagggccuaggguauugcca

SEQ ID NO: 426746 - RNA, 32 nt, Human
gagggccucaaggagcagaggaaggggcuggu

SEQ ID NO: 426747 - RNA, 32 nt, Human
gagggccuccugaaggaggagaugaguaaaua

SEQ ID NO: 426748 - RNA, 32 nt, Human
gagggccucugacugcugggacugaccaaaga

SEQ ID NO: 426749 - RNA, 24 nt, Human
gagggccugaggguacauuucucc

SEQ ID NO: 426750 - RNA, 32 nt, Human
gagggccugcagcccacacacugacugauaca

SEQ ID NO: 426751 - RNA, 32 nt, Human
gagggccugcuacaaacuccuccuggaaacgc

SEQ ID NO: 426752 - RNA, 32 nt, Human
gagggccuggacugagggggaccaggucuucu

SEQ ID NO: 426753 - RNA, 32 nt, Human
gagggccuggcccaauccuggagccucagaaa

SEQ ID NO: 426754 - RNA, 32 nt, Human
gagggccuggcucucccugggaggcuggggcc

SEQ ID NO: 426755 - RNA, 17 nt, Human
gagggccugggaucuga

SEQ ID NO: 426756 - RNA, 32 nt, Human
gagggccuggggacaguggagcauaugggugg

SEQ ID NO: 426757 - RNA, 28 nt, Human
gagggccuucuugcugccucaccucaug

SEQ ID NO: 426758 - RNA, 32 nt, Human
gagggccuugaacaagucauuuucuucacauu

SEQ ID NO: 426759 - RNA, 32 nt, Human
gagggccuugaggaagcagcccccaggccugg

SEQ ID NO: 426760 - RNA, 32 nt, Human
gagggccuugggcgucccuccugguccugcgc

SEQ ID NO: 426761 - RNA, 32 nt, Human
gagggccuuguccuugaacacuacugggguau

SEQ ID NO: 426762 - RNA, 32 nt, Human
gagggccuuucugggauucagugcuucagaga

SEQ ID NO: 426763 - RNA, 25 nt, Human
gagggcgaauugcuaugacauucca

SEQ ID NO: 426764 - RNA, 32 nt, Human
gagggcgagagguggaaggucagaggagaugg

SEQ ID NO: 426765 - RNA, 32 nt, Human
gagggcgagggccaccaccugcagcacaucag

SEQ ID NO: 426766 - RNA, 32 nt, Human
gagggcgauucugggccuuucugaccuacucc

SEQ ID NO: 426767 - RNA, 32 nt, Human
gagggcgcagaccuguggugaggacacccgag

SEQ ID NO: 426768 - RNA, 32 nt, Human
gagggcgcaggcggcgggugcgcgaggagaaa

SEQ ID NO: 426769 - RNA, 32 nt, Human
gagggcgccagaaguggcggcagcagcagccg

SEQ ID NO: 426770 - RNA, 32 nt, Human
gagggcgcccccugccccaccagccugagugc

SEQ ID NO: 426771 - RNA, 32 nt, Human
gagggcgcgcggguacugacagccauggugca

SEQ ID NO: 426772 - RNA, 32 nt, Human
gagggcgcggagccaugaagcuguacagccuc

SEQ ID NO: 426773 - RNA, 32 nt, Human
gagggcgcgggagccacacucucaggugccug

SEQ ID NO: 426774 - RNA, 32 nt, Human
gagggcgcggggcggggagcgagccccaggcg

SEQ ID NO: 426775 - RNA, 22 nt, Human
gagggcgcgucuccccuccgcc

SEQ ID NO: 426776 - RNA, 32 nt, Human
gagggcgcuacuggagccuggucagaggagga

SEQ ID NO: 426777 - RNA, 32 nt, Human
gagggcggaaggcugcuggggugcgcaggugg

SEQ ID NO: 426778 - RNA, 32 nt, Human
gagggcggagggcggaggggcggcgggaggag

SEQ ID NO: 426779 - RNA, 32 nt, Human
gagggcggcgagggcgcagggaagaagaggga

SEQ ID NO: 426780 - RNA, 22 nt, Human
gagggcggcgcaggagguggga

SEQ ID NO: 426781 - RNA, 32 nt, Human
gagggcggcggggacaagauggguggagaaug

SEQ ID NO: 426782 - RNA, 20 nt, Human
gagggcgggaggaggcgcgg

SEQ ID NO: 426783 - RNA, 32 nt, Human
gagggcgggagguagauauaggccuguucuuu

SEQ ID NO: 426784 - RNA, 32 nt, Human
gagggcgggccggccggcccggaugggcgcgg

SEQ ID NO: 426785 - RNA, 32 nt, Human
gagggcggggccugagggugggggcggggccu

SEQ ID NO: 426786 - RNA, 32 nt, Human
gagggcgggggagagcgcgccgcugcucccgg

SEQ ID NO: 426787 - RNA, 32 nt, Human
gagggcggucaccugccagaaggucuggggcg

SEQ ID NO: 426788 - RNA, 32 nt, Human
gagggcgguuuugagcuuucuauaagcuauag

SEQ ID NO: 426789 - RNA, 32 nt, Human
gagggcgucaggcagaggcaacugacuucauu

SEQ ID NO: 426790 - RNA, 23 nt, Human
gagggcuaaauauauuuauucuc

SEQ ID NO: 426791 - RNA, 23 nt, Human
gagggcuaaauggguccaucucu

SEQ ID NO: 426792 - RNA, 32 nt, Human
gagggcuacaucugguuccuggggaggaguca

SEQ ID NO: 426793 - RNA, 22 nt, Human
gagggcuagagaaagcaucuuc

SEQ ID NO: 426794 - RNA, 28 nt, Human
gagggcuaucuacaaggguaauauuucu

SEQ ID NO: 426795 - RNA, 32 nt, Human
gagggcucaaucuaaccagcagcuguccccug

SEQ ID NO: 426796 - RNA, 32 nt, Human
gagggcucaggccacaucacgaaaugugacag

SEQ ID NO: 426797 - RNA, 22 nt, Human
gagggcucccucagcccuggga

SEQ ID NO: 426798 - RNA, 22 nt, Human
gagggcucccuuucccuccccu

SEQ ID NO: 426799 - RNA, 32 nt, Human
gagggcuccuguggcugccaggagggcuugac

SEQ ID NO: 426800 - RNA, 32 nt, Human
gagggcucgagcuggacacuccuggcuggacg

SEQ ID NO: 426801 - RNA, 21 nt, Human
gagggcucucuuuugguucca

SEQ ID NO: 426802 - RNA, 32 nt, Human
gagggcucugcugcuucuuuccagaaagugau

SEQ ID NO: 426803 - RNA, 22 nt, Human
gagggcucuggggacacuucca

SEQ ID NO: 426804 - RNA, 32 nt, Human
gagggcugaacaaagcagggaggcccacgguu

SEQ ID NO: 426805 - RNA, 32 nt, Human
gagggcugaagcaggaggauugcuugaggccg

SEQ ID NO: 426806 - RNA, 32 nt, Human
gagggcugagagggucugguccuggcccaggc

SEQ ID NO: 426807 - RNA, 32 nt, Human
gagggcugaggccgaccaugcccagccugcug

SEQ ID NO: 426808 - RNA, 32 nt, Human
gagggcugcaagcuggaggguggugcaggccu

SEQ ID NO: 426809 - RNA, 32 nt, Human
gagggcugccaggggaacuuggaaaggaccac

SEQ ID NO: 426810 - RNA, 32 nt, Human
gagggcugccuaaaauauuuuauuucuagcau

SEQ ID NO: 426811 - RNA, 31 nt, Human
gagggcugccucucugccagucagccacaga

SEQ ID NO: 426812 - RNA, 32 nt, Human
gagggcugcgagcauuucccucccgggagagg

SEQ ID NO: 426813 - RNA, 32 nt, Human
gagggcugcugggugagggccuggagaugugg

SEQ ID NO: 426814 - RNA, 21 nt, Human
gagggcugcuugguguaguca

SEQ ID NO: 426815 - RNA, 32 nt, Human
gagggcuggaaccugaggauagagcgaaaaug

SEQ ID NO: 426816 - RNA, 32 nt, Human
gagggcuggaggcagagaguguaagugugcag

SEQ ID NO: 426817 - RNA, 32 nt, Human
gagggcuggagugcaguggcgugaucugggcu

SEQ ID NO: 426818 - RNA, 22 nt, Human
gagggcuggauccugggccaaa

SEQ ID NO: 426819 - RNA, 32 nt, Human
gagggcugggcccuaugacuguggucugggcu

SEQ ID NO: 426820 - RNA, 32 nt, Human
gagggcugguccagagagaugaugugaucccc

SEQ ID NO: 426821 - RNA, 32 nt, Human
gagggcuggucugcaugcuggaagagguugag

SEQ ID NO: 426822 - RNA, 19 nt, Human
gagggcugucaacaggaac

SEQ ID NO: 426823 - RNA, 32 nt, Human
gagggcugugaaggauccagagacaagacuua

SEQ ID NO: 426824 - RNA, 32 nt, Human
gagggcugugggcuccucugucucuggagagu

SEQ ID NO: 426825 - RNA, 32 nt, Human
gagggcuguggggaggauggaggcaggagcug

SEQ ID NO: 426826 - RNA, 32 nt, Human
gagggcuuagaauugcagggcgagccaggcau

SEQ ID NO: 426827 - RNA, 32 nt, Human
gagggcuuagcacaucgccuaucauuucuaug

SEQ ID NO: 426828 - RNA, 32 nt, Human
gagggcuucucagcaggaugaugaagguggcc

SEQ ID NO: 426829 - RNA, 18 nt, Human
gaggggaaaaauguuaca

SEQ ID NO: 426830 - RNA, 32 nt, Human
gaggggaaaaggacaggugaucuggggaaaac

SEQ ID NO: 426831 - RNA, 32 nt, Human
gaggggaaacugagucccagccccaggguccu

SEQ ID NO: 426832 - RNA, 32 nt, Human
gaggggaacaaaaaucacucacaagcaaucca

SEQ ID NO: 426833 - RNA, 17 nt, Human
gaggggaacaaguagca

SEQ ID NO: 426834 - RNA, 18 nt, Human
gaggggaacagaugggac

SEQ ID NO: 426835 - RNA, 21 nt, Human
gaggggaacagggaacggaac

SEQ ID NO: 426836 - RNA, 23 nt, Human
gaggggaacccugggacaggcac

SEQ ID NO: 426837 - RNA, 32 nt, Human
gaggggaagagaagagaaagagggggaaagga

SEQ ID NO: 426838 - RNA, 31 nt, Human
gaggggaagaggccuguuucgcugucggguc

SEQ ID NO: 426839 - RNA, 32 nt, Human
gaggggaagagggagaguggcauagcucugug

SEQ ID NO: 426840 - RNA, 32 nt, Human
gaggggaagcugggagaaaggaggucgaggag

SEQ ID NO: 426841 - RNA, 32 nt, Human
gaggggaaggaacuaaagguguuugcacuuca

SEQ ID NO: 426842 - RNA, 32 nt, Human
gaggggaaggaagcccuggggagcagcugcuc

SEQ ID NO: 426843 - RNA, 32 nt, Human
gaggggaaggagccccgaggaggcucugaguu

SEQ ID NO: 426844 - RNA, 32 nt, Human
gaggggaaggagccgcccucccuaucuugcug

SEQ ID NO: 426845 - RNA, 32 nt, Human
gaggggaaggagcugguagugacauuguuaau

SEQ ID NO: 426846 - RNA, 32 nt, Human
gaggggaaggcgacguaguuucccuggagcgg

SEQ ID NO: 426847 - RNA, 32 nt, Human
gaggggaagggagggggcgggcaggugcagcg

SEQ ID NO: 426848 - RNA, 32 nt, Human
gaggggaagggcccuguggugccgccgcccuu

SEQ ID NO: 426849 - RNA, 32 nt, Human
gaggggaagguggcuucccccaagcacugugu

SEQ ID NO: 426850 - RNA, 32 nt, Human
gaggggaagugaagcaacagcccagcuggaag

SEQ ID NO: 426851 - RNA, 32 nt, Human
gaggggacagggggcaggugugugacuggguu

SEQ ID NO: 426852 - RNA, 32 nt, Human
gaggggacaucugagggcuucacagggcugca

SEQ ID NO: 426853 - RNA, 32 nt, Human
gaggggacaucuggauuugcucugguugggag

SEQ ID NO: 426854 - RNA, 32 nt, Human
gaggggacaucuggcagcaucucucccaagca

SEQ ID NO: 426855 - RNA, 32 nt, Human
gaggggaccacaagcccaaaaaggacaaaaau

SEQ ID NO: 426856 - RNA, 17 nt, Human
gaggggaccagaagcca

SEQ ID NO: 426857 - RNA, 32 nt, Human
gaggggacccgggaacaguaguagaagagcug

SEQ ID NO: 426858 - RNA, 32 nt, Human
gaggggacggagagggugggaaagaccuugga

SEQ ID NO: 426859 - RNA, 32 nt, Human
gaggggagaaaacaccaggaaagaggaacccu

SEQ ID NO: 426860 - RNA, 32 nt, Human
gaggggagaaacaggagaggagaggccaggag

SEQ ID NO: 426861 - RNA, 32 nt, Human
gaggggagaagagaguaggaaaaaggagggaa

SEQ ID NO: 426862 - RNA, 32 nt, Human
gaggggagaaucaacucugaaugugauguagu

SEQ ID NO: 426863 - RNA, 21 nt, Human
gaggggagaauuuuaggcaaa

SEQ ID NO: 426864 - RNA, 32 nt, Human
gaggggagacacaccuacugcuuccucagaug

SEQ ID NO: 426865 - RNA, 23 nt, Human
gaggggagacagaggggauuaaa

SEQ ID NO: 426866 - RNA, 32 nt, Human
gaggggagaccuggccaagggagccagccagc

SEQ ID NO: 426867 - RNA, 32 nt, Human
gaggggagagaagggagagggugggccugcug

SEQ ID NO: 426868 - RNA, 32 nt, Human
gaggggagagcagagagcagaaccuggugugu

SEQ ID NO: 426869 - RNA, 32 nt, Human
gaggggagaggaggggaaggggaggcagagga

SEQ ID NO: 426870 - RNA, 32 nt, Human
gaggggagagugaggagaggaggagagaggcu

SEQ ID NO: 426871 - RNA, 32 nt, Human
gaggggagaugaagcccacagagcuggaaaga

SEQ ID NO: 426872 - RNA, 32 nt, Human
gaggggagcaaaccaagguggggaaacugcuc

SEQ ID NO: 426873 - RNA, 32 nt, Human
gaggggagcaggcagagaggggcgguugaagg

SEQ ID NO: 426874 - RNA, 32 nt, Human
gaggggagcaggcagcgguccuagccaguucc

SEQ ID NO: 426875 - RNA, 32 nt, Human
gaggggagcaggcccguggcaggaggagggcu

SEQ ID NO: 426876 - RNA, 32 nt, Human
gaggggagccaccugagggcuguggaacccag

SEQ ID NO: 426877 - RNA, 32 nt, Human
gaggggagccccaucuccccagaagagcagug

SEQ ID NO: 426878 - RNA, 18 nt, Human
gaggggagcccgccgcgg

SEQ ID NO: 426879 - RNA, 32 nt, Human
gaggggagcccuggaagcagggcuuuuccgga

SEQ ID NO: 426880 - RNA, 32 nt, Human
gaggggagcgcggacggcugggcugcugcugg

SEQ ID NO: 426881 - RNA, 32 nt, Human
gaggggagcucugacacacagagacacgcucc

SEQ ID NO: 426882 - RNA, 32 nt, Human
gaggggagcugcuggccauggcugcuuuguag

SEQ ID NO: 426883 - RNA, 32 nt, Human
gaggggagcuugaacuaggggaaaggccacuc

SEQ ID NO: 426884 - RNA, 32 nt, Human
gaggggaggaagcacacagagcucccugagca

SEQ ID NO: 426885 - RNA, 32 nt, Human
gaggggaggaagggcagggcagacugcaggug

SEQ ID NO: 426886 - RNA, 32 nt, Human
gaggggaggacccugagggcucagccagggag

SEQ ID NO: 426887 - RNA, 32 nt, Human
gaggggaggagaggagaggagaggaaccguca

SEQ ID NO: 426888 - RNA, 32 nt, Human
gaggggaggaggaggagcaggccgagcgcauu

SEQ ID NO: 426889 - RNA, 32 nt, Human
gaggggaggaggaggaggaggagaggagcagu

SEQ ID NO: 426890 - RNA, 32 nt, Human
gaggggaggaggaggaggaggaggaggucgug

SEQ ID NO: 426891 - RNA, 32 nt, Human
gaggggaggaggugguggccguggguuccuga

SEQ ID NO: 426892 - RNA, 15 nt, Human
gaggggaggauagga

SEQ ID NO: 426893 - RNA, 32 nt, Human
gaggggaggauggggcacauucuaguccccua

SEQ ID NO: 426894 - RNA, 32 nt, Human
gaggggaggcucugccccaggccgcggccuug

SEQ ID NO: 426895 - RNA, 32 nt, Human
gaggggagggagcagcugggcaaggaaguggc

SEQ ID NO: 426896 - RNA, 32 nt, Human
gaggggagggcagaggaggagagagccuggca

SEQ ID NO: 426897 - RNA, 32 nt, Human
gaggggagggcugcuuccaugguacuuagggc

SEQ ID NO: 426898 - RNA, 32 nt, Human
gaggggagggcuuucacgcccacccacccccu

SEQ ID NO: 426899 - RNA, 32 nt, Human
gaggggaggggaggggagcaggcacugggcgg

SEQ ID NO: 426900 - RNA, 32 nt, Human
gaggggaggggaggggaggggagcaggcacug

SEQ ID NO: 426901 - RNA, 32 nt, Human
gaggggaggggaugggaagcaccaccagccag

SEQ ID NO: 426902 - RNA, 20 nt, Human
gaggggaggugugcaggaac

SEQ ID NO: 426903 - RNA, 32 nt, Human
gaggggaguagagaaguuuacacagaaaugcu

SEQ ID NO: 426904 - RNA, 32 nt, Human
gaggggaguagagggcaccagggaaugcugug

SEQ ID NO: 426905 - RNA, 32 nt, Human
gaggggauaggccugguuuccuuuguacuaau

SEQ ID NO: 426906 - RNA, 32 nt, Human
gaggggaugaaucacccuuggcccagccuccc

SEQ ID NO: 426907 - RNA, 19 nt, Human
gaggggaugcccgcgcccg

SEQ ID NO: 426908 - RNA, 32 nt, Human
gaggggaugggggaggucucagguccucuugc

SEQ ID NO: 426909 - RNA, 32 nt, Human
gaggggauguaaugaguugacaugcaccagaa

SEQ ID NO: 426910 - RNA, 32 nt, Human
gaggggcaaaaacggcccacacugucuaagac

SEQ ID NO: 426911 - RNA, 32 nt, Human
gaggggcaacccagagguggggaacaacaaca

SEQ ID NO: 426912 - RNA, 21 nt, Human
gaggggcaacucaggauuuua

SEQ ID NO: 426913 - RNA, 31 nt, Human
gaggggcaaguguccagcaggagggagaaac

SEQ ID NO: 426914 - RNA, 32 nt, Human
gaggggcacacagagagcagcagccagcacag

SEQ ID NO: 426915 - RNA, 32 nt, Human
gaggggcacacagugaggcggccacuggcucu

SEQ ID NO: 426916 - RNA, 32 nt, Human
gaggggcaccacuacuccagcccagaaggaaa

SEQ ID NO: 426917 - RNA, 32 nt, Human
gaggggcacgagaagagaggagcagggaggag

SEQ ID NO: 426918 - RNA, 22 nt, Human
gaggggcacucagccagcucug

SEQ ID NO: 426919 - RNA, 32 nt, Human
gaggggcacucgccgguuaagacaggguggga

SEQ ID NO: 426920 - RNA, 21 nt, Human
gaggggcacuguggacaggaa

SEQ ID NO: 426921 - RNA, 32 nt, Human
gaggggcacuucagaugagaauggagagguag

SEQ ID NO: 426922 - RNA, 20 nt, Human
gaggggcacuuggcaggaac

SEQ ID NO: 426923 - RNA, 22 nt, Human
gaggggcagaccugguggccag

SEQ ID NO: 426924 - RNA, 22 nt, Human
gaggggcagagccaaaaugaga

SEQ ID NO: 426925 - RNA, 32 nt, Human
gaggggcagagccaggaggcaguggggcugug

SEQ ID NO: 426926 - RNA, 26 nt, Human
gaggggcagagcccuuuggggggcag

SEQ ID NO: 426927 - RNA, 32 nt, Human
gaggggcagagcugucggugacugaggacugg

SEQ ID NO: 426928 - RNA, 32 nt, Human
gaggggcagaggaggggaaggaggagggccug

SEQ ID NO: 426929 - RNA, 32 nt, Human
gaggggcagcagccgaguuaaagugggggcca

SEQ ID NO: 426930 - RNA, 32 nt, Human
gaggggcagcauggcguccgugacgcugagcg

SEQ ID NO: 426931 - RNA, 32 nt, Human
gaggggcagccugaucucaccuccaccuagua

SEQ ID NO: 426932 - RNA, 32 nt, Human
gaggggcagccugugccugccuuugugucaga

SEQ ID NO: 426933 - RNA, 21 nt, Human
gaggggcagcgcagggcgcag

SEQ ID NO: 426934 - RNA, 32 nt, Human
gaggggcaggagcgugaugcagacaaggacuu

SEQ ID NO: 426935 - RNA, 32 nt, Human
gaggggcaggauuccgggcaggagccuugccu

SEQ ID NO: 426936 - RNA, 32 nt, Human
gaggggcagggagaugccaccaugcuucucug

SEQ ID NO: 426937 - RNA, 24 nt, Human
gaggggcagggaggcaaaaugaga

SEQ ID NO: 426938 - RNA, 19 nt, Human
gaggggcaguguucccacc

SEQ ID NO: 426939 - RNA, 32 nt, Human
gaggggcaucccucccugccggccucagggag

SEQ ID NO: 426940 - RNA, 32 nt, Human
gaggggcaucugaauggcaucuucaucagguc

SEQ ID NO: 426941 - RNA, 26 nt, Human
gaggggcaugguuagggagggcucua

SEQ ID NO: 426942 - RNA, 32 nt, Human
gaggggccaaggggccuguggaagaggagugg

SEQ ID NO: 426943 - RNA, 32 nt, Human
gaggggccagccugggaccagcagaguggaaa

SEQ ID NO: 426944 - RNA, 32 nt, Human
gaggggccagggaggaaggaggccacggagcg

SEQ ID NO: 426945 - RNA, 32 nt, Human
gaggggccaggggaucccucucucccuagugc

SEQ ID NO: 426946 - RNA, 32 nt, Human
gaggggccaugcugugugagaccaggggacca

SEQ ID NO: 426947 - RNA, 32 nt, Human
gaggggcccagccuggacugacuguacuuccu

SEQ ID NO: 426948 - RNA, 32 nt, Human
gaggggcccaggcugcagccugccacaccucc

SEQ ID NO: 426949 - RNA, 32 nt, Human
gaggggcccagggaagccugggugucaagugc

SEQ ID NO: 426950 - RNA, 32 nt, Human
gaggggccccacccugucucuuucaucaaacc

SEQ ID NO: 426951 - RNA, 32 nt, Human
gaggggccccggguccucucagucuuuccccu

SEQ ID NO: 426952 - RNA, 19 nt, Human
gaggggccccugcaggcac

SEQ ID NO: 426953 - RNA, 32 nt, Human
gaggggccccugcuucuccagccuggaccccc

SEQ ID NO: 426954 - RNA, 32 nt, Human
gaggggccccuggcccaggaggaggauugugc

SEQ ID NO: 426955 - RNA, 32 nt, Human
gaggggcccugaccacugugagcaggagggug

SEQ ID NO: 426956 - RNA, 32 nt, Human
gaggggcccugcaggcaggucuguggguucug

SEQ ID NO: 426957 - RNA, 32 nt, Human
gaggggcccugccuuccucaguagggagucaa

SEQ ID NO: 426958 - RNA, 32 nt, Human
gaggggccggagaagcagaaccagcugcauag

SEQ ID NO: 426959 - RNA, 19 nt, Human
gaggggccgggucuuggca

SEQ ID NO: 426960 - RNA, 32 nt, Human
gaggggccuaaccuagagcagguuuccauagu

SEQ ID NO: 426961 - RNA, 32 nt, Human
gaggggccuagacaaggcuccaggccccaccu

SEQ ID NO: 426962 - RNA, 32 nt, Human
gaggggccuaucuuccaagccccacccuaagg

SEQ ID NO: 426963 - RNA, 17 nt, Human
gaggggccugccaggga

SEQ ID NO: 426964 - RNA, 32 nt, Human
gaggggccugggagggaggagcuuggugcagc

SEQ ID NO: 426965 - RNA, 32 nt, Human
gaggggccuugugucugugccugccugucuga

SEQ ID NO: 426966 - RNA, 32 nt, Human
gaggggccuuucucaccuggagagaaacuucc

SEQ ID NO: 426967 - RNA, 32 nt, Human
gaggggccuuucucaccuggagagaaauuucc

SEQ ID NO: 426968 - RNA, 32 nt, Human
gaggggcggagcuuguggaggaagauggcugc

SEQ ID NO: 426969 - RNA, 32 nt, Human
gaggggcggccuggcccgggaccugcugcugc

SEQ ID NO: 426970 - RNA, 23 nt, Human
gaggggcgggagaaagggccugg

SEQ ID NO: 426971 - RNA, 22 nt, Human
gaggggcgggcucagagcuuug

SEQ ID NO: 426972 - RNA, 32 nt, Human
gaggggcgugaggaggggaggggcuguggacu

SEQ ID NO: 426973 - RNA, 19 nt, Human
gaggggcgugugcauggga

SEQ ID NO: 426974 - RNA, 22 nt, Human
gaggggcucagcacucauuagg

SEQ ID NO: 426975 - RNA, 32 nt, Human
gaggggcucagggcucucgaauugugauagua

SEQ ID NO: 426976 - RNA, 20 nt, Human
gaggggcucaguuuuacgca

SEQ ID NO: 426977 - RNA, 32 nt, Human
gaggggcuccggcuuucucugaaaugaacacu

SEQ ID NO: 426978 - RNA, 32 nt, Human
gaggggcucguguggccgccuaccucccccac

SEQ ID NO: 426979 - RNA, 32 nt, Human
gaggggcucugccacucccagccugggaauga

SEQ ID NO: 426980 - RNA, 32 nt, Human
gaggggcugcagccacacacucuuccccaccu

SEQ ID NO: 426981 - RNA, 32 nt, Human
gaggggcugccuggucuggggccugacaggcg

SEQ ID NO: 426982 - RNA, 20 nt, Human
gaggggcugcgccccaccag

SEQ ID NO: 426983 - RNA, 21 nt, Human
gaggggcugcuccaugcggca

SEQ ID NO: 426984 - RNA, 32 nt, Human
gaggggcugcuguggccagggugcacggucac

SEQ ID NO: 426985 - RNA, 32 nt, Human
gaggggcuggaggacuuccgcacgcuuccacc

SEQ ID NO: 426986 - RNA, 23 nt, Human
gaggggcugggccucucuuugca

SEQ ID NO: 426987 - RNA, 32 nt, Human
gaggggcuggggaaagggaugggagccaggaa

SEQ ID NO: 426988 - RNA, 32 nt, Human
gaggggcuggggaccggccaggaaggaggggu

SEQ ID NO: 426989 - RNA, 18 nt, Human
gaggggcuguccauggca

SEQ ID NO: 426990 - RNA, 32 nt, Human
gaggggcugugggccaggcugcucagacuccu

SEQ ID NO: 426991 - RNA, 32 nt, Human
gaggggcuguuucuuuuuccgugugggugguu

SEQ ID NO: 426992 - RNA, 32 nt, Human
gaggggcuucauaccagcugaagagcgacaag

SEQ ID NO: 426993 - RNA, 32 nt, Human
gaggggcuucucuuccuggcuggggcuggggu

SEQ ID NO: 426994 - RNA, 22 nt, Human
gaggggcuugcccuucacggca

SEQ ID NO: 426995 - RNA, 32 nt, Human
gaggggcuuuucucccccagaggcucagaacu

SEQ ID NO: 426996 - RNA, 19 nt, Human
gagggggaaaccagaagga

SEQ ID NO: 426997 - RNA, 19 nt, Human
gagggggaaaccgggggaa

SEQ ID NO: 426998 - RNA, 32 nt, Human
gagggggaacaguauggaaaagacuggaaggg

SEQ ID NO: 426999 - RNA, 20 nt, Human
gagggggaagaaacaaaaac

SEQ ID NO: 427000 - RNA, 32 nt, Human
gagggggaagccccauccucugacugaagcgg

SEQ ID NO: 427001 - RNA, 20 nt, Human
gagggggaagugaaagaaac

SEQ ID NO: 427002 - RNA, 17 nt, Human
gagggggacagauagga

SEQ ID NO: 427003 - RNA, 32 nt, Human
gagggggacuccaggaaaagccguugagagga

SEQ ID NO: 427004 - RNA, 32 nt, Human
gagggggacugcugcugccuggccacugcucc

SEQ ID NO: 427005 - RNA, 32 nt, Human
gagggggagagaagcagagggagagagaaggu

SEQ ID NO: 427006 - RNA, 19 nt, Human
gagggggagcaaacaggaa

SEQ ID NO: 427007 - RNA, 32 nt, Human
gagggggagcagguuugcggggccaaguguug

SEQ ID NO: 427008 - RNA, 18 nt, Human
gagggggagccgcggcgg

SEQ ID NO: 427009 - RNA, 20 nt, Human
gagggggagcuugcaggaac

SEQ ID NO: 427010 - RNA, 32 nt, Human
gagggggaggaaaaggagagggaagagguaga

SEQ ID NO: 427011 - RNA, 32 nt, Human
gagggggaggagaagagagaagaaacuggagc

SEQ ID NO: 427012 - RNA, 32 nt, Human
gagggggaggagaaggaggaagagggggagga

SEQ ID NO: 427013 - RNA, 32 nt, Human
gagggggaggagagagguaggagcuggagaug

SEQ ID NO: 427014 - RNA, 32 nt, Human
gagggggaggcaggaggauugcugucagccua

SEQ ID NO: 427015 - RNA, 32 nt, Human
gagggggagggaggggagacagagccuuuaac

SEQ ID NO: 427016 - RNA, 32 nt, Human
gagggggaggggcaggagcuuggaccuuggua

SEQ ID NO: 427017 - RNA, 32 nt, Human
gagggggaucgcuugaguccaggaguuugaga

SEQ ID NO: 427018 - RNA, 32 nt, Human
gagggggaugcagaggugaugcagcugggguc

SEQ ID NO: 427019 - RNA, 32 nt, Human
gagggggaugcuggagggaacagugaagugca

SEQ ID NO: 427020 - RNA, 32 nt, Human
gagggggcaagcuuugcuccuucaguucugcu

SEQ ID NO: 427021 - RNA, 32 nt, Human
gagggggcaccaugcagagauggcaguugcuu

SEQ ID NO: 427022 - RNA, 21 nt, Human
gagggggcagcuccgcggcgg

SEQ ID NO: 427023 - RNA, 32 nt, Human
gagggggcagggccagggcagggaggcuucca

SEQ ID NO: 427024 - RNA, 32 nt, Human
gagggggcaggugggagaccagccuggggcuc

SEQ ID NO: 427025 - RNA, 32 nt, Human
gagggggcaguuugcugugcucuguucugucu

SEQ ID NO: 427026 - RNA, 32 nt, Human
gagggggcaugccuggaaugaauggccagaau

SEQ ID NO: 427027 - RNA, 23 nt, Human
gagggggccugaagcuacaugca

SEQ ID NO: 427028 - RNA, 32 nt, Human
gagggggccugagacuggaccugggucugccu

SEQ ID NO: 427029 - RNA, 32 nt, Human
gagggggcggcagggcugggccuugugacaau

SEQ ID NO: 427030 - RNA, 32 nt, Human
gagggggcgggcaggugcagcggccgggcuag

SEQ ID NO: 427031 - RNA, 17 nt, Human
gagggggcuagaaggac

SEQ ID NO: 427032 - RNA, 32 nt, Human
gagggggcucaguucuggacuguggguuugug

SEQ ID NO: 427033 - RNA, 20 nt, Human
gagggggcucccagaaggac

SEQ ID NO: 427034 - RNA, 19 nt, Human
gagggggcugggaaagaac

SEQ ID NO: 427035 - RNA, 32 nt, Human
gagggggcugguugggagaggaaaggcuggaa

SEQ ID NO: 427036 - RNA, 32 nt, Human
gagggggcuucuaacagucugcuuuaaguggu

SEQ ID NO: 427037 - RNA, 32 nt, Human
gagggggcuuggcuuguccgggcgagguggga

SEQ ID NO: 427038 - RNA, 32 nt, Human
gagggggcuugguucucaggcccagccacauu

SEQ ID NO: 427039 - RNA, 32 nt, Human
gagggggcuuugcuggucuuucuuggacuauu

SEQ ID NO: 427040 - RNA, 18 nt, Human
gaggggggacagaaggac

SEQ ID NO: 427041 - RNA, 20 nt, Human
gaggggggacggagaggaac

SEQ ID NO: 427042 - RNA, 23 nt, Human
gaggggggaguggaggccugaga

SEQ ID NO: 427043 - RNA, 32 nt, Human
gaggggguagagggagccaggagcacuggguu

SEQ ID NO: 427044 - RNA, 32 nt, Human
gaggggguagugacaguggcagcugcuacuca

SEQ ID NO: 427045 - RNA, 23 nt, Human
gagggggucaaccuuggaccaaa

SEQ ID NO: 427046 - RNA, 32 nt, Human
gaggggguccagucaccagagagaccagccag

SEQ ID NO: 427047 - RNA, 21 nt, Human
gagggggucgaggagagccgg

SEQ ID NO: 427048 - RNA, 32 nt, Human
gagggggugagaggcaggaaugggggucagaa

SEQ ID NO: 427049 - RNA, 32 nt, Human
gagggggugagguggaauggggugggggaaca

SEQ ID NO: 427050 - RNA, 32 nt, Human
gaggggguggaggauacucucaucccaccucc

SEQ ID NO: 427051 - RNA, 32 nt, Human
gaggggguggggugggggagaauauaagaugu

SEQ ID NO: 427052 - RNA, 32 nt, Human
gagggggugggguggggugagaguguguggag

SEQ ID NO: 427053 - RNA, 32 nt, Human
gaggggguggguugggcggggguggggccggg

SEQ ID NO: 427054 - RNA, 19 nt, Human
gaggggguuucaccauguu

SEQ ID NO: 427055 - RNA, 20 nt, Human
gaggggguuucaucauguua

SEQ ID NO: 427056 - RNA, 32 nt, Human
gagggguaaacaagccaacagaaauuaaucag

SEQ ID NO: 427057 - RNA, 32 nt, Human
gagggguaacuugcaccucugaccuaucacuu

SEQ ID NO: 427058 - RNA, 32 nt, Human
gagggguagggcaagggccuucucaaugccuc

SEQ ID NO: 427059 - RNA, 22 nt, Human
gagggguagucgaagagcucug

SEQ ID NO: 427060 - RNA, 32 nt, Human
gagggguaugucuggcuccugagucagccacg

SEQ ID NO: 427061 - RNA, 32 nt, Human
gaggggucaaagaaggaggaggagggugggga

SEQ ID NO: 427062 - RNA, 18 nt, Human
gaggggucaacaaugaga

SEQ ID NO: 427063 - RNA, 19 nt, Human
gaggggucaccugagguca

SEQ ID NO: 427064 - RNA, 22 nt, Human
gaggggucagcggcgaauucuu

SEQ ID NO: 427065 - RNA, 32 nt, Human
gagggguccagccuguuccagccagugccuga

SEQ ID NO: 427066 - RNA, 18 nt, Human
gagggguccgcugggagg

SEQ ID NO: 427067 - RNA, 20 nt, Human
gagggguccuaggguguuuc

SEQ ID NO: 427068 - RNA, 32 nt, Human
gaggggucucuggaggcagacagggugggcug

SEQ ID NO: 427069 - RNA, 32 nt, Human
gaggggucugcaccuccugggagcaggugggu

SEQ ID NO: 427070 - RNA, 32 nt, Human
gaggggucuguuggggacgcugggagagucuc

SEQ ID NO: 427071 - RNA, 32 nt, Human
gaggggucuuuagauucugggaaaugucugau

SEQ ID NO: 427072 - RNA, 32 nt, Human
gaggggugaaggagauugguggaggagaguaa

SEQ ID NO: 427073 - RNA, 32 nt, Human
gaggggugagcagcagggagagugggaaggag

SEQ ID NO: 427074 - RNA, 32 nt, Human
gaggggugaggaggcaucagcaguugagcccc

SEQ ID NO: 427075 - RNA, 32 nt, Human
gaggggugccuuucauggacagugaugcuuug

SEQ ID NO: 427076 - RNA, 32 nt, Human
gaggggugcgugcgcgugugcccagcucgccu

SEQ ID NO: 427077 - RNA, 32 nt, Human
gaggggugcugggccuuggaccuucucccuug

SEQ ID NO: 427078 - RNA, 32 nt, Human
gagggguggaagggaucucuggggucuggaau

SEQ ID NO: 427079 - RNA, 32 nt, Human
gagggguggagggaaaugcaucggcacucauu

SEQ ID NO: 427080 - RNA, 32 nt, Human
gagggguggauuugcccuugacaugcagauag

SEQ ID NO: 427081 - RNA, 32 nt, Human
gagggguggcaaaaucacagguugcugggccu

SEQ ID NO: 427082 - RNA, 19 nt, Human
gagggguggcagacaggaa

SEQ ID NO: 427083 - RNA, 32 nt, Human
gagggguggccucugcugcuggauuucauguc

SEQ ID NO: 427084 - RNA, 32 nt, Human
gagggguggcgcgcggccaggagcacgcaugg

SEQ ID NO: 427085 - RNA, 32 nt, Human
gaggggugggcugugcucagggcaacacagcg

SEQ ID NO: 427086 - RNA, 32 nt, Human
gagggguggggagggggagggggaagugucug

SEQ ID NO: 427087 - RNA, 32 nt, Human
gaggggugggggccucccccuccugggugcaa

SEQ ID NO: 427088 - RNA, 19 nt, Human
gaggggugguggggggcag

SEQ ID NO: 427089 - RNA, 32 nt, Human
gaggggugucggccauuacggaggcuugaaua

SEQ ID NO: 427090 - RNA, 24 nt, Human
gagggguuaaagaagaggugggga

SEQ ID NO: 427091 - RNA, 32 nt, Human
gagggguuagcugugcguggggagagggugaa

SEQ ID NO: 427092 - RNA, 32 nt, Human
gagggguucgcugccagcaauugccaagcugc

SEQ ID NO: 427093 - RNA, 32 nt, Human
gagggguucuuuagggagugcuucuggggaac

SEQ ID NO: 427094 - RNA, 32 nt, Human
gagggguuggacccagggcugaggcaggcccc

SEQ ID NO: 427095 - RNA, 32 nt, Human
gagggguuggucuuggugucucagggauggca

SEQ ID NO: 427096 - RNA, 32 nt, Human
gagggguuguuggcugggcacgguggcucaug

SEQ ID NO: 427097 - RNA, 20 nt, Human
gagggguuucacaguguugg

SEQ ID NO: 427098 - RNA, 20 nt, Human
gagggguuucacuuuccucu

SEQ ID NO: 427099 - RNA, 21 nt, Human
gagggguuuggggacagggac

SEQ ID NO: 427100 - RNA, 19 nt, Human
gagggguuuggucucgggg

SEQ ID NO: 427101 - RNA, 32 nt, Human
gaggguacaacaguggcaucacagugacagug

SEQ ID NO: 427102 - RNA, 32 nt, Human
gaggguagacguguggggaaaauaaaucauua

SEQ ID NO: 427103 - RNA, 32 nt, Human
gaggguaggcgggugggaaugggguacuuggg

SEQ ID NO: 427104 - RNA, 32 nt, Human
gagggucaaccagcagcagaccagucacaaaa

SEQ ID NO: 427105 - RNA, 26 nt, Human
gagggucaaguggaggugcauauucc

SEQ ID NO: 427106 - RNA, 32 nt, Human
gagggucaauugugcgggauccuggccauucc

SEQ ID NO: 427107 - RNA, 32 nt, Human
gagggucacacagcauggucucucuggcagcg

SEQ ID NO: 427108 - RNA, 32 nt, Human
gagggucacagagcaggcugacccagaggccu

SEQ ID NO: 427109 - RNA, 19 nt, Human
gagggucacagagcguucc

SEQ ID NO: 427110 - RNA, 32 nt, Human
gagggucacugaccaggcagggccucugggua

SEQ ID NO: 427111 - RNA, 23 nt, Human
gagggucacuugaugccuggaga

SEQ ID NO: 427112 - RNA, 32 nt, Human
gagggucagagcuggcucuggggagcugggcu

SEQ ID NO: 427113 - RNA, 21 nt, Human
gagggucagccucuguccccu

SEQ ID NO: 427114 - RNA, 32 nt, Human
gagggucagcggcggggaguccuggccuucaa

SEQ ID NO: 427115 - RNA, 32 nt, Human
gagggucaggagagaaugggggaggaggcggu

SEQ ID NO: 427116 - RNA, 32 nt, Human
gagggucagggaccugagcugaccccaggcuu

SEQ ID NO: 427117 - RNA, 32 nt, Human
gagggucagggcuggccuuccucugugcauca

SEQ ID NO: 427118 - RNA, 18 nt, Human
gagggucaucaccaggug

SEQ ID NO: 427119 - RNA, 32 nt, Human
gaggguccagaaggagggggugaccuccggcc

SEQ ID NO: 427120 - RNA, 32 nt, Human
gaggguccagagagaagggagugggugggcag

SEQ ID NO: 427121 - RNA, 32 nt, Human
gaggguccagagagccggcaggaggggacccu

SEQ ID NO: 427122 - RNA, 32 nt, Human
gaggguccagcagaaggaaacauggcugccaa

SEQ ID NO: 427123 - RNA, 32 nt, Human
gagggucccaaaggagcugccccagagcaccc

SEQ ID NO: 427124 - RNA, 32 nt, Human
gagggucccagaggaacgcuggagccaagaga

SEQ ID NO: 427125 - RNA, 32 nt, Human
gagggucccagaggggcugaguccucaaaucc

SEQ ID NO: 427126 - RNA, 32 nt, Human
gaggguccccagagaagacuggcggggaccug

SEQ ID NO: 427127 - RNA, 32 nt, Human
gagggucccugcaggcucccugggcagggaga

SEQ ID NO: 427128 - RNA, 22 nt, Human
gaggguccggcgcggccccggg

SEQ ID NO: 427129 - RNA, 32 nt, Human
gaggguccuccacacccucugccgacuaccac

SEQ ID NO: 427130 - RNA, 32 nt, Human
gaggguccuccaggguccugaagagcacugga

SEQ ID NO: 427131 - RNA, 32 nt, Human
gaggguccugguuccuccucccaccaacccca

SEQ ID NO: 427132 - RNA, 32 nt, Human
gaggguccuucccacaccuuuguuuaggaguc

SEQ ID NO: 427133 - RNA, 32 nt, Human
gagggucgagcagcaggggcccauucaguccc

SEQ ID NO: 427134 - RNA, 32 nt, Human
gagggucgagccgaagucuccggcgggccgca

SEQ ID NO: 427135 - RNA, 23 nt, Human
gagggucgggagaaacgcugcuc

SEQ ID NO: 427136 - RNA, 32 nt, Human
gagggucuccaucgccgucuccagcucagagc

SEQ ID NO: 427137 - RNA, 32 nt, Human
gagggucugagcuguaucugcugguggcuuau

SEQ ID NO: 427138 - RNA, 32 nt, Human
gagggucugaggacgcagggaggguggaggug

SEQ ID NO: 427139 - RNA, 32 nt, Human
gagggucugccuccccuuccucgcccuguguc

SEQ ID NO: 427140 - RNA, 32 nt, Human
gagggucugcucccacugcagcucccggugcu

SEQ ID NO: 427141 - RNA, 32 nt, Human
gagggucuggguccaguuagggacauggaggc

SEQ ID NO: 427142 - RNA, 32 nt, Human
gagggucuuauugccauugucuuuuccucugc

SEQ ID NO: 427143 - RNA, 32 nt, Human
gagggucuucgggugcuucccagcacaagcug

SEQ ID NO: 427144 - RNA, 32 nt, Human
gagggucuuuauacaucucuccuccaacccca

SEQ ID NO: 427145 - RNA, 32 nt, Human
gagggucuuuuucuccugccuucuccuggaga

SEQ ID NO: 427146 - RNA, 32 nt, Human
gagggugaacuggggacccugcacccuccggg

SEQ ID NO: 427147 - RNA, 32 nt, Human
gagggugaaggugggacgggaggcgggagggg

SEQ ID NO: 427148 - RNA, 32 nt, Human
gagggugaaugaagggcaugcaggcccucagc

SEQ ID NO: 427149 - RNA, 32 nt, Human
gagggugaaugccugcagaugagaaccagccg

SEQ ID NO: 427150 - RNA, 22 nt, Human
gagggugacauacagcguuucc

SEQ ID NO: 427151 - RNA, 20 nt, Human
gagggugacauagcuagaaa

SEQ ID NO: 427152 - RNA, 32 nt, Human
gagggugacaugucccugagggcacagaaacu

SEQ ID NO: 427153 - RNA, 32 nt, Human
gagggugaccacaccuuggccuucugggaacu

SEQ ID NO: 427154 - RNA, 32 nt, Human
gagggugacuccaaggcagcugagcugaucgc

SEQ ID NO: 427155 - RNA, 23 nt, Human
gagggugagagggugccguuucc

SEQ ID NO: 427156 - RNA, 32 nt, Human
gagggugaggcagguggaucaccugaggucgg

SEQ ID NO: 427157 - RNA, 32 nt, Human
gagggugagggagugaguguucaaggaggaag

SEQ ID NO: 427158 - RNA, 32 nt, Human
gagggugagggcaagaggacugaugguuacug

SEQ ID NO: 427159 - RNA, 32 nt, Human
gagggugagggguuuggggaaaggggaagcag

SEQ ID NO: 427160 - RNA, 32 nt, Human
gagggugaggugggaggaucaccugaggucga

SEQ ID NO: 427161 - RNA, 32 nt, Human
gagggugcacacacagccaugagcccaccugc

SEQ ID NO: 427162 - RNA, 32 nt, Human
gagggugcagaacgaaccacucgaaaacgagu

SEQ ID NO: 427163 - RNA, 32 nt, Human
gagggugcaggcaggagagggaaaggcagcag

SEQ ID NO: 427164 - RNA, 32 nt, Human
gagggugcccuccuagcuccacccucaccagg

SEQ ID NO: 427165 - RNA, 23 nt, Human
gagggugccgcgagcccaggcgg

SEQ ID NO: 427166 - RNA, 32 nt, Human
gagggugccguggcucacaccuguaaucccag

SEQ ID NO: 427167 - RNA, 32 nt, Human
gagggugccuguaaucccagcuccuugggagg

SEQ ID NO: 427168 - RNA, 32 nt, Human
gagggugcgccacuuucagagccucuggucac

SEQ ID NO: 427169 - RNA, 32 nt, Human
gagggugcucacugaggagcagccaggugcau

SEQ ID NO: 427170 - RNA, 32 nt, Human
gagggugcuccaccccuugcuggccccacucc

SEQ ID NO: 427171 - RNA, 32 nt, Human
gagggugcuggggcagccacuggugaggaggg

SEQ ID NO: 427172 - RNA, 32 nt, Human
gaggguggaagaggagaggguggaaggggaau

SEQ ID NO: 427173 - RNA, 32 nt, Human
gaggguggaccaaugagguugccguggugacg

SEQ ID NO: 427174 - RNA, 21 nt, Human
gaggguggagaaucgcuugaa

SEQ ID NO: 427175 - RNA, 32 nt, Human
gaggguggagaguccugcaucauagccaccaa

SEQ ID NO: 427176 - RNA, 32 nt, Human
gaggguggagcaggaggcucucacuggugagu

SEQ ID NO: 427177 - RNA, 32 nt, Human
gaggguggagccagguagaugcagcgguagca

SEQ ID NO: 427178 - RNA, 24 nt, Human
gaggguggagccgagcggugcgga

SEQ ID NO: 427179 - RNA, 32 nt, Human
gaggguggagccuccuggaagugaccagagcc

SEQ ID NO: 427180 - RNA, 32 nt, Human
gaggguggaggacagcagggaggaaggcuccu

SEQ ID NO: 427181 - RNA, 32 nt, Human
gaggguggaggagggagcaggaacagccccug

SEQ ID NO: 427182 - RNA, 32 nt, Human
gaggguggagugaggccccugcagagcugcug

SEQ ID NO: 427183 - RNA, 32 nt, Human
gaggguggauuucuugagcccagggguuugag

SEQ ID NO: 427184 - RNA, 32 nt, Human
gaggguggcaggcagugguuguggcaguggag

SEQ ID NO: 427185 - RNA, 32 nt, Human
gaggguggcagugagcuggcacuuuggucuca

SEQ ID NO: 427186 - RNA, 21 nt, Human
gaggguggccacagaggcgga

SEQ ID NO: 427187 - RNA, 31 nt, Human
gaggguggccucucuguggugguguguuggu

SEQ ID NO: 427188 - RNA, 32 nt, Human
gaggguggcugaggcuguugugcaguagggca

SEQ ID NO: 427189 - RNA, 20 nt, Human
gaggguggcugcugagcggg

SEQ ID NO: 427190 - RNA, 22 nt, Human
gaggguggcuggaaguucgaga

SEQ ID NO: 427191 - RNA, 32 nt, Human
gaggguggcuugagcccgggaggcagagguug

SEQ ID NO: 427192 - RNA, 32 nt, Human
gagggugggaaagaccuuggaaagugggaugg

SEQ ID NO: 427193 - RNA, 32 nt, Human
gagggugggaggcagaaaagaggcacaggugg

SEQ ID NO: 427194 - RNA, 32 nt, Human
gagggugggaggugggauuuagccaggaaagg

SEQ ID NO: 427195 - RNA, 32 nt, Human
gagggugggcaccagauggggaccagccuugc

SEQ ID NO: 427196 - RNA, 32 nt, Human
gagggugggcucuauauuuucauuccaaauaa

SEQ ID NO: 427197 - RNA, 32 nt, Human
gaggguggggcagagguugggaagauggcgug

SEQ ID NO: 427198 - RNA, 32 nt, Human
gagggugggucaccagcagaagaagccgaacc

SEQ ID NO: 427199 - RNA, 32 nt, Human
gaggguggguggagggguuugcagugugggaa

SEQ ID NO: 427200 - RNA, 32 nt, Human
gagggugguagaggagauaagacaguagggaa

SEQ ID NO: 427201 - RNA, 32 nt, Human
gagggugguagccccuccccagccuucuuucu

SEQ ID NO: 427202 - RNA, 32 nt, Human
gaggguggugggaggggaucaccuggguucca

SEQ ID NO: 427203 - RNA, 22 nt, Human
gagggugguuacugugggugga

SEQ ID NO: 427204 - RNA, 23 nt, Human
gagggugguugggauacaccgga

SEQ ID NO: 427205 - RNA, 32 nt, Human
gaggguguccuaaagauccugauguccaugac

SEQ ID NO: 427206 - RNA, 32 nt, Human
gagggugucugcacuaaggauuuagaaacacu

SEQ ID NO: 427207 - RNA, 32 nt, Human
gagggugucugggcuuaagcauguggaccccu

SEQ ID NO: 427208 - RNA, 32 nt, Human
gagggugugaugucuguagcuauguggaaggu

SEQ ID NO: 427209 - RNA, 24 nt, Human
gaggguguggacuggcauccagca

SEQ ID NO: 427210 - RNA, 32 nt, Human
gaggguguggugagccgggaucgcaccgcugc

SEQ ID NO: 427211 - RNA, 32 nt, Human
gaggguuaaaugggaugaggucauguaucugc

SEQ ID NO: 427212 - RNA, 32 nt, Human
gaggguuacaugcacaacaauuacaccgccuu

SEQ ID NO: 427213 - RNA, 32 nt, Human
gaggguucacucuucuuguuguacaugcugug

SEQ ID NO: 427214 - RNA, 32 nt, Human
gaggguucauauuuaauauauguguucaugug

SEQ ID NO: 427215 - RNA, 32 nt, Human
gaggguuccgggaaaagagcagaggaaagagg

SEQ ID NO: 427216 - RNA, 32 nt, Human
gaggguucugggugggaguggggagggcgagg

SEQ ID NO: 427217 - RNA, 32 nt, Human
gaggguugagccacccacuugccauuugcucc

SEQ ID NO: 427218 - RNA, 32 nt, Human
gaggguuggggaggggcggcaggagggagguu

SEQ ID NO: 427219 - RNA, 32 nt, Human
gaggguugugccaagguauugaugacaaaugg

SEQ ID NO: 427220 - RNA, 32 nt, Human
gaggguuuagaagaaacgcaggaacauucugg

SEQ ID NO: 427221 - RNA, 32 nt, Human
gaggguuucuucucacacaucaaacaagcaag

SEQ ID NO: 427222 - RNA, 32 nt, Human
gaggguuugccuggaaguuaagagaguggcau

SEQ ID NO: 427223 - RNA, 32 nt, Human
gaggguuuuagaaaccgguugccuuagagguu

SEQ ID NO: 427224 - RNA, 32 nt, Human
gagguaaaagagacaucugcagugugacagaa

SEQ ID NO: 427225 - RNA, 26 nt, Human
gagguaaaagugugagcagugaguua

SEQ ID NO: 427226 - RNA, 32 nt, Human
gagguaaagauggaccagugggauuugcugau

SEQ ID NO: 427227 - RNA, 32 nt, Human
gagguaaaggguggggcauugagaauggaggc

SEQ ID NO: 427228 - RNA, 32 nt, Human
gagguaacuccaauucuugcacaaacacaaag

SEQ ID NO: 427229 - RNA, 32 nt, Human
gagguaagaaguuugagacuagccuggguccc

SEQ ID NO: 427230 - RNA, 32 nt, Human
gagguaagauggcaccacuacacuccagcccg

SEQ ID NO: 427231 - RNA, 32 nt, Human
gagguaagcacagcuggugagcacacggggac

SEQ ID NO: 427232 - RNA, 25 nt, Human
gagguaagcuaauuaaugcagugaa

SEQ ID NO: 427233 - RNA, 32 nt, Human
gagguaaggaguuugagaccagccuggccaac

SEQ ID NO: 427234 - RNA, 32 nt, Human
gagguaagucaaggaauagggguggcuucuag

SEQ ID NO: 427235 - RNA, 32 nt, Human
gagguaaguguauuguuucucacuuugauuag

SEQ ID NO: 427236 - RNA, 32 nt, Human
gagguaaugauccugagaccacucccuaauaa

SEQ ID NO: 427237 - RNA, 32 nt, Human
gagguaauuauagggauuuuagcaauaacauu

SEQ ID NO: 427238 - RNA, 31 nt, Human
gagguaauucacuucuuauuccuuuccaaua

SEQ ID NO: 427239 - RNA, 32 nt, Human
gagguacacaguucaauccaucuggaaggugg

SEQ ID NO: 427240 - RNA, 32 nt, Human
gagguacagaggccaggggcccagggcaggac

SEQ ID NO: 427241 - RNA, 32 nt, Human
gagguacaggcaggggcaggcaggaccaccag

SEQ ID NO: 427242 - RNA, 32 nt, Human
gagguaccagugccaugggaagggcccaggaa

SEQ ID NO: 427243 - RNA, 32 nt, Human
gagguaccccaggagcacuguuacaaauccuu

SEQ ID NO: 427244 - RNA, 24 nt, Human
gagguacgaucaagccacugcacu

SEQ ID NO: 427245 - RNA, 32 nt, Human
gagguacggggccauccagccugugaaugacc

SEQ ID NO: 427246 - RNA, 32 nt, Human
gagguacuaaaugcgauucaguucaccgcuaa

SEQ ID NO: 427247 - RNA, 32 nt, Human
gagguacugcagcuuccuccacagccggcugu

SEQ ID NO: 427248 - RNA, 32 nt, Human
gagguacuggggacacaggaaggacgaggcag

SEQ ID NO: 427249 - RNA, 32 nt, Human
gagguacuucucagcccucuagcuccaacuga

SEQ ID NO: 427250 - RNA, 32 nt, Human
gagguagaagaggggaaggaagaugguuucua

SEQ ID NO: 427251 - RNA, 32 nt, Human
gagguagaagcagauagaagguaauuuuaaag

SEQ ID NO: 427252 - RNA, 21 nt, Human
gagguagaaguugcagugagc

SEQ ID NO: 427253 - RNA, 32 nt, Human
gagguagaauacuuucauuauucuugcagcua

SEQ ID NO: 427254 - RNA, 32 nt, Human
gagguagacaguguuuccuuaauauggcugca

SEQ ID NO: 427255 - RNA, 32 nt, Human
gagguagagaguuugagaccagccuggccaac

SEQ ID NO: 427256 - RNA, 21 nt, Human
gagguagagauugcaaugagc

SEQ ID NO: 427257 - RNA, 32 nt, Human
gagguagagcccacugaagaaggagcagaaua

SEQ ID NO: 427258 - RNA, 21 nt, Human
gagguagaggcugcaaugggc

SEQ ID NO: 427259 - RNA, 21 nt, Human
gagguagaggcugcagugagc

SEQ ID NO: 427260 - RNA, 32 nt, Human
gagguagaggcugcagugagcuaugaucacac

SEQ ID NO: 427261 - RNA, 23 nt, Human
gagguagaggcugcagugagcug

SEQ ID NO: 427262 - RNA, 21 nt, Human
gagguagaggcugcauugagc

SEQ ID NO: 427263 - RNA, 32 nt, Human
gagguagagggccaggaugguggugggggacc

SEQ ID NO: 427264 - RNA, 21 nt, Human
gagguagagguuacagcgagc

SEQ ID NO: 427265 - RNA, 21 nt, Human
gagguagagguugcagugagc

SEQ ID NO: 427266 - RNA, 32 nt, Human
gagguagagguugcagugagccaaggucacac

SEQ ID NO: 427267 - RNA, 32 nt, Human
gagguagagucagaguagggaaaacaacuaau

SEQ ID NO: 427268 - RNA, 32 nt, Human
gagguagauguggcugaggagggacagaugaa

SEQ ID NO: 427269 - RNA, 32 nt, Human
gagguagauguuugguacauuuuauggcuccc

SEQ ID NO: 427270 - RNA, 32 nt, Human
gagguagcaaggccacuggguugcuauccucu

SEQ ID NO: 427271 - RNA, 32 nt, Human
gagguagcagcccuggguucuccucagugagg

SEQ ID NO: 427272 - RNA, 32 nt, Human
gagguagcagucugggacucaagggugggucu

SEQ ID NO: 427273 - RNA, 32 nt, Human
gagguagcagugagccgagaucacuccacugc

SEQ ID NO: 427274 - RNA, 32 nt, Human
gagguagcagugagccgagaucgcgccacugc

SEQ ID NO: 427275 - RNA, 32 nt, Human
gagguagccgagccucucaagcagaccuacaa

SEQ ID NO: 427276 - RNA, 32 nt, Human
gagguagccgagccucucaaggcagaccuaca

SEQ ID NO: 427277 - RNA, 32 nt, Human
gagguagcugcucuccccacugagagcugagc

SEQ ID NO: 427278 - RNA, 32 nt, Human
gagguagcuuucucagagccccuuggugguuc

SEQ ID NO: 427279 - RNA, 32 nt, Human
gagguaggagaaucacuugaaccucagcggcg

SEQ ID NO: 427280 - RNA, 32 nt, Human
gagguaggaggcggagguggggguggggguag

SEQ ID NO: 427281 - RNA, 32 nt, Human
gagguaggagucagggaaccccagagacaugc

SEQ ID NO: 427282 - RNA, 22 nt, Human
gagguaggcagaucacgagguc

SEQ ID NO: 427283 - RNA, 32 nt, Human
gagguaggcagaucacuugagcucaagaguuc

SEQ ID NO: 427284 - RNA, 30 nt, Human
gagguaggcagccaaagggcacagaacccu

SEQ ID NO: 427285 - RNA, 32 nt, Human
gagguaggccggaagugguguugcggagggaa

SEQ ID NO: 427286 - RNA, 25 nt, Human
gagguagggcagugggcucugcagg

SEQ ID NO: 427287 - RNA, 32 nt, Human
gagguagggcucagagagguuuaguuacuuuc

SEQ ID NO: 427288 - RNA, 19 nt, Human
gagguaggugaacauucca

SEQ ID NO: 427289 - RNA, 32 nt, Human
gagguagguuuuagagcuagucuucuaacucg

SEQ ID NO: 427290 - RNA, 32 nt, Human
gagguaguagugagcugaagucccgccacugc

SEQ ID NO: 427291 - RNA, 32 nt, Human
gagguagugauacugucuucuagaauagcuac

SEQ ID NO: 427292 - RNA, 32 nt, Human
gagguaguggugagcaaagaucguaccgcugc

SEQ ID NO: 427293 - RNA, 32 nt, Human
gagguaguucugacacugucucaguuuugcag

SEQ ID NO: 427294 - RNA, 32 nt, Human
gagguauaacgaggaggagaagaaaugggagg

SEQ ID NO: 427295 - RNA, 22 nt, Human
gagguauaaguuucaaaccagu

SEQ ID NO: 427296 - RNA, 32 nt, Human
gagguauaguugggggacaggggucuggguuu

SEQ ID NO: 427297 - RNA, 21 nt, Human
gagguauaucgaugauggaaa

SEQ ID NO: 427298 - RNA, 32 nt, Human
gagguaucacugcagucaccucuucuacccuc

SEQ ID NO: 427299 - RNA, 32 nt, Human
gagguauccaacagggcagcacaugguccucc

SEQ ID NO: 427300 - RNA, 32 nt, Human
gagguauccugaagcaaaagacaggaguucuc

SEQ ID NO: 427301 - RNA, 20 nt, Human
gagguaucuuacuuuccucu

SEQ ID NO: 427302 - RNA, 32 nt, Human
gagguaugaacuguauuucucauugcaaauac

SEQ ID NO: 427303 - RNA, 24 nt, Human
gagguaugaucaugccacugcacu

SEQ ID NO: 427304 - RNA, 24 nt, Human
gagguaugaucgcgccacugcacu

SEQ ID NO: 427305 - RNA, 32 nt, Human
gagguauggaaagaaccaugcagaggaauauu

SEQ ID NO: 427306 - RNA, 32 nt, Human
gagguauggagccuccaucaucaugcucuuuu

SEQ ID NO: 427307 - RNA, 32 nt, Human
gagguauggugggucagugagaacaaagccag

SEQ ID NO: 427308 - RNA, 32 nt, Human
gagguauguggacaaguagaaggugagcaagg

SEQ ID NO: 427309 - RNA, 32 nt, Human
gagguauugaaggacaggagagaugucaggug

SEQ ID NO: 427310 - RNA, 23 nt, Human
gaggucaacccccacaaucagcu

SEQ ID NO: 427311 - RNA, 32 nt, Human
gaggucaacguaggaggaucacuugaguucaa

SEQ ID NO: 427312 - RNA, 32 nt, Human
gaggucaagacaauuuaauuuauuuacaugcu

SEQ ID NO: 427313 - RNA, 32 nt, Human
gaggucaagagaucgagaccagccuggccaac

SEQ ID NO: 427314 - RNA, 25 nt, Human
gaggucaagaguuccagaccaggcu

SEQ ID NO: 427315 - RNA, 23 nt, Human
gaggucaagaguuucagaccagc

SEQ ID NO: 427316 - RNA, 32 nt, Human
gaggucaagaguuugagaccagccuggccaac

SEQ ID NO: 427317 - RNA, 24 nt, Human
gaggucaagaguuugagaccagcu

SEQ ID NO: 427318 - RNA, 32 nt, Human
gaggucaagauaaaugcagaaaauguuuagag

SEQ ID NO: 427319 - RNA, 22 nt, Human
gaggucaaggcaggaagaucac

SEQ ID NO: 427320 - RNA, 21 nt, Human
gaggucaaggcugcagugagc

SEQ ID NO: 427321 - RNA, 32 nt, Human
gaggucaaggcugcagugagccauguucauga

SEQ ID NO: 427322 - RNA, 22 nt, Human
gaggucaagguagguggaucac

SEQ ID NO: 427323 - RNA, 32 nt, Human
gaggucaagucggguggaucaccugaggucaa

SEQ ID NO: 427324 - RNA, 32 nt, Human
gaggucaauaguucgagaccagccuggccaac

SEQ ID NO: 427325 - RNA, 32 nt, Human
gaggucacaaguucaagaccagccuggcaaac

SEQ ID NO: 427326 - RNA, 32 nt, Human
gaggucacaccgcugcacuccagccugggcaa

SEQ ID NO: 427327 - RNA, 32 nt, Human
gaggucacaggcaggcagucugcagaccagau

SEQ ID NO: 427328 - RNA, 32 nt, Human
gaggucacagugagcugugauugcaccacuug

SEQ ID NO: 427329 - RNA, 32 nt, Human
gaggucaccaggcggaggcgcggagaugcccc

SEQ ID NO: 427330 - RNA, 18 nt, Human
gaggucaccccgcgcccg

SEQ ID NO: 427331 - RNA, 32 nt, Human
gaggucaccgggaugggggaaguggccucugu

SEQ ID NO: 427332 - RNA, 32 nt, Human
gaggucacgaguuggagaccagccuggccaag

SEQ ID NO: 427333 - RNA, 32 nt, Human
gaggucacuccaccauccccaccccaccccac

SEQ ID NO: 427334 - RNA, 32 nt, Human
gaggucacugaagacugugauuacaugcaccu

SEQ ID NO: 427335 - RNA, 32 nt, Human
gaggucacugcaaccuccaccucccggguuca

SEQ ID NO: 427336 - RNA, 32 nt, Human
gaggucacugcugagcuucagugagcacccau

SEQ ID NO: 427337 - RNA, 20 nt, Human
gaggucacuguggaugucua

SEQ ID NO: 427338 - RNA, 32 nt, Human
gaggucagaaagagauagaauuuggaaccagu

SEQ ID NO: 427339 - RNA, 32 nt, Human
gaggucagaaguccaagaccagccuggccaac

SEQ ID NO: 427340 - RNA, 32 nt, Human
gaggucagaaguuugaaaccagccuggacuac

SEQ ID NO: 427341 - RNA, 32 nt, Human
gaggucagaaguuugagaccagccuggccaac

SEQ ID NO: 427342 - RNA, 32 nt, Human
gaggucagaaguuugagaccagccuggccaau

SEQ ID NO: 427343 - RNA, 32 nt, Human
gaggucagacguuugagaccagccuggccaac

SEQ ID NO: 427344 - RNA, 32 nt, Human
gaggucagacuggagugaauguuguaaaaguu

SEQ ID NO: 427345 - RNA, 32 nt, Human
gaggucagacuggcuaggcugcagggggaauu

SEQ ID NO: 427346 - RNA, 23 nt, Human
gaggucagagcugucuugugcca

SEQ ID NO: 427347 - RNA, 32 nt, Human
gaggucagaguuccgucauuuugcauuacuug

SEQ ID NO: 427348 - RNA, 32 nt, Human
gaggucagcagaauauacucagugauggaaga

SEQ ID NO: 427349 - RNA, 32 nt, Human
gaggucagcaguuugagaccagccuggccaac

SEQ ID NO: 427350 - RNA, 32 nt, Human
gaggucagccuccuccgaagcuucaucucuug

SEQ ID NO: 427351 - RNA, 25 nt, Human
gaggucaggaaaaacacuggcuggg

SEQ ID NO: 427352 - RNA, 32 nt, Human
gaggucaggaauucaaaaccagccuggccaac

SEQ ID NO: 427353 - RNA, 32 nt, Human
gaggucaggaauuugagaccagccuggccaau

SEQ ID NO: 427354 - RNA, 23 nt, Human
gaggucaggacuuccagaccagc

SEQ ID NO: 427355 - RNA, 32 nt, Human
gaggucaggacuuugagaccagccuggccaac

SEQ ID NO: 427356 - RNA, 24 nt, Human
gaggucaggagacugagaccagcu

SEQ ID NO: 427357 - RNA, 24 nt, Human
gaggucaggagaucaagaccaucu

SEQ ID NO: 427358 - RNA, 32 nt, Human
gaggucaggagaucgagaacagccuggcuaac

SEQ ID NO: 427359 - RNA, 21 nt, Human
gaggucaggagaucgagacca

SEQ ID NO: 427360 - RNA, 23 nt, Human
gaggucaggagaucgagaccagc

SEQ ID NO: 427361 - RNA, 24 nt, Human
gaggucaggagaucgagaccaucu

SEQ ID NO: 427362 - RNA, 23 nt, Human
gaggucaggagaucgagaucagc

SEQ ID NO: 427363 - RNA, 23 nt, Human
gaggucaggagauugagaccagc

SEQ ID NO: 427364 - RNA, 32 nt, Human
gaggucaggagauugagaccagccuggccaac

SEQ ID NO: 427365 - RNA, 22 nt, Human
gaggucaggagcacaucgggcu

SEQ ID NO: 427366 - RNA, 32 nt, Human
gaggucaggagccuggccaacauagcgaaacc

SEQ ID NO: 427367 - RNA, 23 nt, Human
gaggucaggagcucaagaccagc

SEQ ID NO: 427368 - RNA, 23 nt, Human
gaggucaggagcuccagaccagc

SEQ ID NO: 427369 - RNA, 23 nt, Human
gaggucaggagcucgagaccagc

SEQ ID NO: 427370 - RNA, 24 nt, Human
gaggucaggagcucgagaccagcu

SEQ ID NO: 427371 - RNA, 32 nt, Human
gaggucaggagcuugaaaccagccuggccaac

SEQ ID NO: 427372 - RNA, 23 nt, Human
gaggucaggagcuugagaccagc

SEQ ID NO: 427373 - RNA, 32 nt, Human
gaggucaggagcuugagaccagccuggccaaa

SEQ ID NO: 427374 - RNA, 22 nt, Human
gaggucaggagggcuggcagcu

SEQ ID NO: 427375 - RNA, 23 nt, Human
gaggucaggaggucaagaccagc

SEQ ID NO: 427376 - RNA, 32 nt, Human
gaggucaggagguggaagugagaggagauccc

SEQ ID NO: 427377 - RNA, 23 nt, Human
gaggucaggaguacgagaucagc

SEQ ID NO: 427378 - RNA, 23 nt, Human
gaggucaggagucaggagucgcu

SEQ ID NO: 427379 - RNA, 23 nt, Human
gaggucaggaguccaagaccagc

SEQ ID NO: 427380 - RNA, 23 nt, Human
gaggucaggaguuaaacaccagc

SEQ ID NO: 427381 - RNA, 23 nt, Human
gaggucaggaguuagaggccagc

SEQ ID NO: 427382 - RNA, 23 nt, Human
gaggucaggaguucaaaaccagc

SEQ ID NO: 427383 - RNA, 23 nt, Human
gaggucaggaguucaacaccagc

SEQ ID NO: 427384 - RNA, 23 nt, Human
gaggucaggaguucaacaucagc

SEQ ID NO: 427385 - RNA, 20 nt, Human
gaggucaggaguucaagacc

SEQ ID NO: 427386 - RNA, 23 nt, Human
gaggucaggaguucaagaccagc

SEQ ID NO: 427387 - RNA, 24 nt, Human
gaggucaggaguucaagaccagcu

SEQ ID NO: 427388 - RNA, 23 nt, Human
gaggucaggaguucaagaccagu

SEQ ID NO: 427389 - RNA, 23 nt, Human
gaggucaggaguucaagacuagc

SEQ ID NO: 427390 - RNA, 20 nt, Human
gaggucaggaguucaagagc

SEQ ID NO: 427391 - RNA, 23 nt, Human
gaggucaggaguucaagaucagc

SEQ ID NO: 427392 - RNA, 23 nt, Human
gaggucaggaguucaagauuagc

SEQ ID NO: 427393 - RNA, 23 nt, Human
gaggucaggaguucaaggccagc

SEQ ID NO: 427394 - RNA, 23 nt, Human
gaggucaggaguucaauaccagc

SEQ ID NO: 427395 - RNA, 23 nt, Human
gaggucaggaguucacgaccagc

SEQ ID NO: 427396 - RNA, 23 nt, Human
gaggucaggaguuccagaccagc

SEQ ID NO: 427397 - RNA, 23 nt, Human
gaggucaggaguuccuaaccagc

SEQ ID NO: 427398 - RNA, 23 nt, Human
gaggucaggaguucgaaaccagc

SEQ ID NO: 427399 - RNA, 24 nt, Human
gaggucaggaguucgaaacucguu

SEQ ID NO: 427400 - RNA, 23 nt, Human
gaggucaggaguucgaagucagc

SEQ ID NO: 427401 - RNA, 23 nt, Human
gaggucaggaguucgagaccagc

SEQ ID NO: 427402 - RNA, 24 nt, Human
gaggucaggaguucgagaccagcu

SEQ ID NO: 427403 - RNA, 32 nt, Human
gaggucaggaguucgagaccagcugggcaaca

SEQ ID NO: 427404 - RNA, 23 nt, Human
gaggucaggaguucgagaccagu

SEQ ID NO: 427405 - RNA, 23 nt, Human
gaggucaggaguucgagaccggc

SEQ ID NO: 427406 - RNA, 23 nt, Human
gaggucaggaguucgagacuagc

SEQ ID NO: 427407 - RNA, 24 nt, Human
gaggucaggaguucgagacuagcu

SEQ ID NO: 427408 - RNA, 32 nt, Human
gaggucaggaguucgagagcagccuggccaac

SEQ ID NO: 427409 - RNA, 32 nt, Human
gaggucaggaguucgagagcagccuggccaau

SEQ ID NO: 427410 - RNA, 23 nt, Human
gaggucaggaguucgagaucagc

SEQ ID NO: 427411 - RNA, 23 nt, Human
gaggucaggaguucgagcccagc

SEQ ID NO: 427412 - RNA, 23 nt, Human
gaggucaggaguucgaggccagc

SEQ ID NO: 427413 - RNA, 20 nt, Human
gaggucaggaguucgagggc

SEQ ID NO: 427414 - RNA, 23 nt, Human
gaggucaggaguucgaguccagc

SEQ ID NO: 427415 - RNA, 23 nt, Human
gaggucaggaguucgauaccagc

SEQ ID NO: 427416 - RNA, 23 nt, Human
gaggucaggaguucgcaaccagc

SEQ ID NO: 427417 - RNA, 23 nt, Human
gaggucaggaguucgcgaccagc

SEQ ID NO: 427418 - RNA, 23 nt, Human
gaggucaggaguucgggaccagc

SEQ ID NO: 427419 - RNA, 23 nt, Human
gaggucaggaguucuagaccagc

SEQ ID NO: 427420 - RNA, 23 nt, Human
gaggucaggaguugaagaccagc

SEQ ID NO: 427421 - RNA, 32 nt, Human
gaggucaggaguugaagaccagccuggccaac

SEQ ID NO: 427422 - RNA, 23 nt, Human
gaggucaggaguuggagaccagc

SEQ ID NO: 427423 - RNA, 32 nt, Human
gaggucaggaguuggagaccagccuggccaac

SEQ ID NO: 427424 - RNA, 23 nt, Human
gaggucaggaguuggagaccagu

SEQ ID NO: 427425 - RNA, 23 nt, Human
gaggucaggaguuuaagaccagc

SEQ ID NO: 427426 - RNA, 23 nt, Human
gaggucaggaguuuaagacuagc

SEQ ID NO: 427427 - RNA, 21 nt, Human
gaggucaggaguuucagacca

SEQ ID NO: 427428 - RNA, 23 nt, Human
gaggucaggaguuucagaccagc

SEQ ID NO: 427429 - RNA, 23 nt, Human
gaggucaggaguuucagacuagu

SEQ ID NO: 427430 - RNA, 23 nt, Human
gaggucaggaguuugaaaccagc

SEQ ID NO: 427431 - RNA, 32 nt, Human
gaggucaggaguuugaaaccagccuggccaac

SEQ ID NO: 427432 - RNA, 23 nt, Human
gaggucaggaguuugaaacuagc

SEQ ID NO: 427433 - RNA, 32 nt, Human
gaggucaggaguuugaaacuagccuggccaac

SEQ ID NO: 427434 - RNA, 32 nt, Human
gaggucaggaguuugagaacagccuggccaac

SEQ ID NO: 427435 - RNA, 24 nt, Human
gaggucaggaguuugagaccaccu

SEQ ID NO: 427436 - RNA, 25 nt, Human
gaggucaggaguuugagaccagacu

SEQ ID NO: 427437 - RNA, 23 nt, Human
gaggucaggaguuugagaccagc

SEQ ID NO: 427438 - RNA, 32 nt, Human
gaggucaggaguuugagaccagccuggacaac

SEQ ID NO: 427439 - RNA, 32 nt, Human
gaggucaggaguuugagaccagccuggccaaa

SEQ ID NO: 427440 - RNA, 32 nt, Human
gaggucaggaguuugagaccagccuggccaac

SEQ ID NO: 427441 - RNA, 32 nt, Human
gaggucaggaguuugagaccagccuggccaau

SEQ ID NO: 427442 - RNA, 32 nt, Human
gaggucaggaguuugagaccagccuggccacc

SEQ ID NO: 427443 - RNA, 32 nt, Human
gaggucaggaguuugagaccagccuggccagc

SEQ ID NO: 427444 - RNA, 32 nt, Human
gaggucaggaguuugagaccagccuggccgac

SEQ ID NO: 427445 - RNA, 32 nt, Human
gaggucaggaguuugagaccagccuggcuaac

SEQ ID NO: 427446 - RNA, 32 nt, Human
gaggucaggaguuugagaccagccugggcaau

SEQ ID NO: 427447 - RNA, 32 nt, Human
gaggucaggaguuugagaccagccuggguaau

SEQ ID NO: 427448 - RNA, 32 nt, Human
gaggucaggaguuugagaccagccuggucaac

SEQ ID NO: 427449 - RNA, 24 nt, Human
gaggucaggaguuugagaccagcu

SEQ ID NO: 427450 - RNA, 23 nt, Human
gaggucaggaguuugagaccagu

SEQ ID NO: 427451 - RNA, 23 nt, Human
gaggucaggaguuugagaccggc

SEQ ID NO: 427452 - RNA, 23 nt, Human
gaggucaggaguuugagacuagc

SEQ ID NO: 427453 - RNA, 23 nt, Human
gaggucaggaguuugagacuagu

SEQ ID NO: 427454 - RNA, 32 nt, Human
gaggucaggaguuugagagcagccuggcuaac

SEQ ID NO: 427455 - RNA, 23 nt, Human
gaggucaggaguuugagaucagc

SEQ ID NO: 427456 - RNA, 32 nt, Human
gaggucaggaguuugagaucagccuggacaac

SEQ ID NO: 427457 - RNA, 32 nt, Human
gaggucaggaguuugagaucagccuggcaaac

SEQ ID NO: 427458 - RNA, 32 nt, Human
gaggucaggaguuugagaucagccuggccaac

SEQ ID NO: 427459 - RNA, 23 nt, Human
gaggucaggaguuugagauuagc

SEQ ID NO: 427460 - RNA, 22 nt, Human
gaggucaggaguuugagccagc

SEQ ID NO: 427461 - RNA, 23 nt, Human
gaggucaggaguuugaggccagc

SEQ ID NO: 427462 - RNA, 32 nt, Human
gaggucaggaguuugaggccagccuggccaac

SEQ ID NO: 427463 - RNA, 23 nt, Human
gaggucaggaguuugauaccagc

SEQ ID NO: 427464 - RNA, 23 nt, Human
gaggucaggaguuugugaccagc

SEQ ID NO: 427465 - RNA, 23 nt, Human
gaggucaggaguuuuagaccagc

SEQ ID NO: 427466 - RNA, 24 nt, Human
gaggucaggaguuuugagaccagc

SEQ ID NO: 427467 - RNA, 21 nt, Human
gaggucaggauggaacuaccu

SEQ ID NO: 427468 - RNA, 25 nt, Human
gaggucaggaugucaagaucagacu

SEQ ID NO: 427469 - RNA, 22 nt, Human
gaggucaggauucaaaaccagc

SEQ ID NO: 427470 - RNA, 20 nt, Human
gaggucaggcacggaccagu

SEQ ID NO: 427471 - RNA, 32 nt, Human
gaggucaggcaggacaagcaggaagcacuggg

SEQ ID NO: 427472 - RNA, 23 nt, Human
gaggucaggcaggaggccuggcu

SEQ ID NO: 427473 - RNA, 24 nt, Human
gaggucaggcaggguaagccaguu

SEQ ID NO: 427474 - RNA, 24 nt, Human
gaggucaggcccagcugcucagga

SEQ ID NO: 427475 - RNA, 32 nt, Human
gaggucaggccccacuccuuccugauuguuua

SEQ ID NO: 427476 - RNA, 19 nt, Human
gaggucaggcccgcgcccg

SEQ ID NO: 427477 - RNA, 24 nt, Human
gaggucaggcguuuaagaccagcu

SEQ ID NO: 427478 - RNA, 32 nt, Human
gaggucaggcguuugagaccagccuggccaac

SEQ ID NO: 427479 - RNA, 22 nt, Human
gaggucaggcugcugaaccagc

SEQ ID NO: 427480 - RNA, 26 nt, Human
gaggucaggggaaugcuaagccaguu

SEQ ID NO: 427481 - RNA, 23 nt, Human
gaggucagggguucaagaccagc

SEQ ID NO: 427482 - RNA, 32 nt, Human
gaggucagggguucaagaccagccuggccaac

SEQ ID NO: 427483 - RNA, 23 nt, Human
gaggucagggguucaagacuagc

SEQ ID NO: 427484 - RNA, 23 nt, Human
gaggucagggguucgaaaccagc

SEQ ID NO: 427485 - RNA, 23 nt, Human
gaggucagggguucgacaccagc

SEQ ID NO: 427486 - RNA, 23 nt, Human
gaggucagggguucgagaccagc

SEQ ID NO: 427487 - RNA, 23 nt, Human
gaggucagggguuugagaccagc

SEQ ID NO: 427488 - RNA, 32 nt, Human
gaggucagggguuugagaccagccuggcuuga

SEQ ID NO: 427489 - RNA, 32 nt, Human
gaggucaguaguucaagaccagccuggccaac

SEQ ID NO: 427490 - RNA, 32 nt, Human
gaggucaguaguucgagaccagccuggccaau

SEQ ID NO: 427491 - RNA, 32 nt, Human
gaggucaguaguucgagaccagccuggucaau

SEQ ID NO: 427492 - RNA, 32 nt, Human
gaggucaguaguuugagaccagccuggccaau

SEQ ID NO: 427493 - RNA, 32 nt, Human
gaggucagugcugaagccagggaggcagcucu

SEQ ID NO: 427494 - RNA, 32 nt, Human
gaggucagugugccucacuacagagcuucaaa

SEQ ID NO: 427495 - RNA, 32 nt, Human
gaggucaguucagaugccaacagggaaaaugc

SEQ ID NO: 427496 - RNA, 32 nt, Human
gaggucaucuugaucucccagaagugcuggcc

SEQ ID NO: 427497 - RNA, 32 nt, Human
gaggucaugaaacucuggaugugcaaagcagg

SEQ ID NO: 427498 - RNA, 32 nt, Human
gaggucaugaauuugagaccagccuggccaac

SEQ ID NO: 427499 - RNA, 32 nt, Human
gaggucaugaguucgaaaccagccuggccaaa

SEQ ID NO: 427500 - RNA, 32 nt, Human
gaggucaugaguucgagaccagccuggccaac

SEQ ID NO: 427501 - RNA, 32 nt, Human
gaggucaugaguuugagaucagccuggccaac

SEQ ID NO: 427502 - RNA, 32 nt, Human
gaggucaugccacugcacuccagccuggccug

SEQ ID NO: 427503 - RNA, 32 nt, Human
gaggucaugccacugcacugcagccugggcga

SEQ ID NO: 427504 - RNA, 32 nt, Human
gaggucaugccauuguacuccagccugggcaa

SEQ ID NO: 427505 - RNA, 31 nt, Human
gaggucauggccacucagggcccggacaagg

SEQ ID NO: 427506 - RNA, 32 nt, Human
gaggucauguucaauaugaauaccucacagag

SEQ ID NO: 427507 - RNA, 32 nt, Human
gaggucauuccuucuuuucuucuccgaucuuu

SEQ ID NO: 427508 - RNA, 32 nt, Human
gagguccaagccccuugccaagggaguugggg

SEQ ID NO: 427509 - RNA, 22 nt, Human
gagguccaaggcugcagugagc

SEQ ID NO: 427510 - RNA, 32 nt, Human
gagguccaccugcguugugagcucucaccggg

SEQ ID NO: 427511 - RNA, 32 nt, Human
gagguccagaugagagcagagauacagugaga

SEQ ID NO: 427512 - RNA, 32 nt, Human
gagguccagccucugugggccugugaccugca

SEQ ID NO: 427513 - RNA, 21 nt, Human
gagguccaggcugcaaugagc

SEQ ID NO: 427514 - RNA, 32 nt, Human
gaggucccaccauguugcccaggcugguguca

SEQ ID NO: 427515 - RNA, 22 nt, Human
gaggucccacuguggcguuuca

SEQ ID NO: 427516 - RNA, 32 nt, Human
gaggucccagaaucuagggcaagagcuggccc

SEQ ID NO: 427517 - RNA, 23 nt, Human
gagguccccaagggcaguauuca

SEQ ID NO: 427518 - RNA, 32 nt, Human
gaggucccccuucuccagaccuccuucauuca

SEQ ID NO: 427519 - RNA, 32 nt, Human
gagguccccucagcaucaagcagcccaaccaa

SEQ ID NO: 427520 - RNA, 32 nt, Human
gaggucccgccacugcacuccagccuggguga

SEQ ID NO: 427521 - RNA, 23 nt, Human
gagguccgcgcagcugcugggga

SEQ ID NO: 427522 - RNA, 32 nt, Human
gagguccggagaccagccuggccaacauggug

SEQ ID NO: 427523 - RNA, 32 nt, Human
gagguccggaguucgagaccagccuggccaau

SEQ ID NO: 427524 - RNA, 32 nt, Human
gagguccggcucccggcucuccggacccgccu

SEQ ID NO: 427525 - RNA, 22 nt, Human
gagguccuaaaacgauugcaga

SEQ ID NO: 427526 - RNA, 32 nt, Human
gagguccuaaagaugcugacuggggagucuga

SEQ ID NO: 427527 - RNA, 32 nt, Human
gagguccucuacuggugauacccucaccuugg

SEQ ID NO: 427528 - RNA, 32 nt, Human
gagguccugagcgcgguggcucugcgucuccu

SEQ ID NO: 427529 - RNA, 22 nt, Human
gagguccugaggaacagugucc

SEQ ID NO: 427530 - RNA, 32 nt, Human
gagguccugaggaacaguguccccaggaacca

SEQ ID NO: 427531 - RNA, 32 nt, Human
gagguccugcugcgcacagugcuggaggucgg

SEQ ID NO: 427532 - RNA, 32 nt, Human
gagguccuggcuucugccgucccuggaggcuc

SEQ ID NO: 427533 - RNA, 32 nt, Human
gagguccuucagccuccaucuguucucccacc

SEQ ID NO: 427534 - RNA, 32 nt, Human
gagguccuuccugaacaugucacuccacagca

SEQ ID NO: 427535 - RNA, 32 nt, Human
gagguccuucggccuggcucagcugggcugca

SEQ ID NO: 427536 - RNA, 32 nt, Human
gagguccuuucacucagcacauggacaguagu

SEQ ID NO: 427537 - RNA, 32 nt, Human
gaggucgaaaguuugagaccagccuggcccac

SEQ ID NO: 427538 - RNA, 32 nt, Human
gaggucgaagucuucagaguccgcacccuccg

SEQ ID NO: 427539 - RNA, 22 nt, Human
gaggucgaggcaggcagaucac

SEQ ID NO: 427540 - RNA, 32 nt, Human
gaggucgaggcaggcagaucaccugaggucag

SEQ ID NO: 427541 - RNA, 22 nt, Human
gaggucgaggcaggcggaucac

SEQ ID NO: 427542 - RNA, 32 nt, Human
gaggucgaggcaggcggaucaccugaggucgg

SEQ ID NO: 427543 - RNA, 22 nt, Human
gaggucgaggcagguagaucac

SEQ ID NO: 427544 - RNA, 22 nt, Human
gaggucgaggcagguggaucac

SEQ ID NO: 427545 - RNA, 21 nt, Human
gaggucgaggcuacagugagc

SEQ ID NO: 427546 - RNA, 21 nt, Human
gaggucgaggcugcagugagc

SEQ ID NO: 427547 - RNA, 24 nt, Human
gaggucgaggcugcagugagcuau

SEQ ID NO: 427548 - RNA, 32 nt, Human
gaggucgaggcugcagugagcuaugaucacac

SEQ ID NO: 427549 - RNA, 32 nt, Human
gaggucgaggcugcagugagcuauguucauga

SEQ ID NO: 427550 - RNA, 32 nt, Human
gaggucgaggcugcagugggcuaugauugcac

SEQ ID NO: 427551 - RNA, 32 nt, Human
gaggucgaggcugcagugugcugugauuguga

SEQ ID NO: 427552 - RNA, 24 nt, Human
gaggucgaggcuguagugagcuau

SEQ ID NO: 427553 - RNA, 32 nt, Human
gaggucgagguagguggaucaccugaggucag

SEQ ID NO: 427554 - RNA, 32 nt, Human
gaggucgagguagguggaucaccugaggucgg

SEQ ID NO: 427555 - RNA, 32 nt, Human
gaggucgaggugggcagaucaccugagguuag

SEQ ID NO: 427556 - RNA, 32 nt, Human
gaggucgaggugggcggaucaccugaggucag

SEQ ID NO: 427557 - RNA, 32 nt, Human
gaggucgagguggguggaucaccugaggucug

SEQ ID NO: 427558 - RNA, 32 nt, Human
gaggucgcaccacugcacuccagccuggguga

SEQ ID NO: 427559 - RNA, 32 nt, Human
gaggucgcaccacugcacuccagucuggguaa

SEQ ID NO: 427560 - RNA, 32 nt, Human
gaggucgcaccacugcacugcagccuggguga

SEQ ID NO: 427561 - RNA, 32 nt, Human
gaggucgcaccguuguacuccagccuggugau

SEQ ID NO: 427562 - RNA, 32 nt, Human
gaggucgcagugagccgagaucgugccacugc

SEQ ID NO: 427563 - RNA, 32 nt, Human
gaggucgcgccacugcacuccagccugggaga

SEQ ID NO: 427564 - RNA, 32 nt, Human
gaggucgcgccacugcacuucagccuggguga

SEQ ID NO: 427565 - RNA, 32 nt, Human
gaggucgcgccauugcacuccagccugggcaa

SEQ ID NO: 427566 - RNA, 32 nt, Human
gaggucgcggugagccgagaucgagccauugc

SEQ ID NO: 427567 - RNA, 22 nt, Human
gaggucgcguuccccaguguua

SEQ ID NO: 427568 - RNA, 32 nt, Human
gaggucgcuccauugcacuccagccugggcaa

SEQ ID NO: 427569 - RNA, 23 nt, Human
gaggucgggagcgcgagaccagc

SEQ ID NO: 427570 - RNA, 23 nt, Human
gaggucgggaguucaagaccagc

SEQ ID NO: 427571 - RNA, 23 nt, Human
gaggucgggaguucacaaccagc

SEQ ID NO: 427572 - RNA, 23 nt, Human
gaggucgggaguuccagaccagc

SEQ ID NO: 427573 - RNA, 23 nt, Human
gaggucgggaguucgagaccagc

SEQ ID NO: 427574 - RNA, 23 nt, Human
gaggucgggaguucgagaccagu

SEQ ID NO: 427575 - RNA, 23 nt, Human
gaggucgggaguucuagaccagc

SEQ ID NO: 427576 - RNA, 23 nt, Human
gaggucgggaguuggaggccagc

SEQ ID NO: 427577 - RNA, 32 nt, Human
gaggucgggaguuggaggccagccuggccaaa

SEQ ID NO: 427578 - RNA, 23 nt, Human
gaggucgggaguuugaaaccagu

SEQ ID NO: 427579 - RNA, 32 nt, Human
gaggucgggaguuugagaacagccuggccaac

SEQ ID NO: 427580 - RNA, 23 nt, Human
gaggucgggaguuugagaccagc

SEQ ID NO: 427581 - RNA, 32 nt, Human
gaggucgggaguuugagaccagccuggccaac

SEQ ID NO: 427582 - RNA, 32 nt, Human
gaggucgggaguuugagaucagccuggccaau

SEQ ID NO: 427583 - RNA, 21 nt, Human
gaggucggggcugcagugagc

SEQ ID NO: 427584 - RNA, 23 nt, Human
gaggucggggguuugagaccggc

SEQ ID NO: 427585 - RNA, 23 nt, Human
gaggucggggguuugcgaccagc

SEQ ID NO: 427586 - RNA, 32 nt, Human
gaggucggugcagacucgggggccaguccugc

SEQ ID NO: 427587 - RNA, 21 nt, Human
gaggucguagcggaaccagcu

SEQ ID NO: 427588 - RNA, 30 nt, Human
gaggucguccucuccaucugcuguguuugg

SEQ ID NO: 427589 - RNA, 32 nt, Human
gaggucgugccacugcacuccagccugggcag

SEQ ID NO: 427590 - RNA, 32 nt, Human
gaggucgugccacugcacuccagccugggcga

SEQ ID NO: 427591 - RNA, 32 nt, Human
gaggucgugccacugcacuucagccuggguga

SEQ ID NO: 427592 - RNA, 32 nt, Human
gaggucgugccacugcaugccagccugggcaa

SEQ ID NO: 427593 - RNA, 32 nt, Human
gaggucgugccacugcgcuccagccuggguga

SEQ ID NO: 427594 - RNA, 32 nt, Human
gaggucgugccauugcacuccagccuggguga

SEQ ID NO: 427595 - RNA, 32 nt, Human
gaggucgugcuacugcacucccgccuggguga

SEQ ID NO: 427596 - RNA, 21 nt, Human
gaggucguguaauuggccuaa

SEQ ID NO: 427597 - RNA, 22 nt, Human
gaggucuaggcugcagugagcu

SEQ ID NO: 427598 - RNA, 32 nt, Human
gaggucuaggcugcagugagcuuauguucaug

SEQ ID NO: 427599 - RNA, 32 nt, Human
gaggucuagggauugagaccagccuggccaac

SEQ ID NO: 427600 - RNA, 32 nt, Human
gaggucucaauaccagcucagaccauguggac

SEQ ID NO: 427601 - RNA, 23 nt, Human
gaggucucacaggaggcagugcc

SEQ ID NO: 427602 - RNA, 32 nt, Human
gaggucucaccauguugcccaggcuggucuug

SEQ ID NO: 427603 - RNA, 32 nt, Human
gaggucucacuacacuuugaggaaggcagcuu

SEQ ID NO: 427604 - RNA, 32 nt, Human
gaggucucagagccaauaagcaaccaggagua

SEQ ID NO: 427605 - RNA, 20 nt, Human
gaggucucaggggcaaugcc

SEQ ID NO: 427606 - RNA, 32 nt, Human
gaggucucauaguaguacccuguggcuacuuu

SEQ ID NO: 427607 - RNA, 32 nt, Human
gaggucucccuauguggcccaggcuggccuug

SEQ ID NO: 427608 - RNA, 32 nt, Human
gaggucucccuauguugcccaggcuggucuag

SEQ ID NO: 427609 - RNA, 32 nt, Human
gaggucucccucaauccuccccuuuagggaag

SEQ ID NO: 427610 - RNA, 32 nt, Human
gaggucucccucugucaaccaggcuggagugc

SEQ ID NO: 427611 - RNA, 32 nt, Human
gaggucucccuguguugcccagccuggucuug

SEQ ID NO: 427612 - RNA, 32 nt, Human
gaggucuccucuuccggcuuucccacuuccca

SEQ ID NO: 427613 - RNA, 32 nt, Human
gaggucuccugggaacccugucugccccuucc

SEQ ID NO: 427614 - RNA, 32 nt, Human
gaggucucgaacugccgaccucaggcugucug

SEQ ID NO: 427615 - RNA, 32 nt, Human
gaggucucuuccuaugcugugaacccccugcc

SEQ ID NO: 427616 - RNA, 23 nt, Human
gaggucucuucugccauugugcu

SEQ ID NO: 427617 - RNA, 25 nt, Human
gaggucucuugcuguuuggauucca

SEQ ID NO: 427618 - RNA, 32 nt, Human
gaggucugacagccccucccucccagagcugg

SEQ ID NO: 427619 - RNA, 32 nt, Human
gaggucugagagacagaggcagcguguuugag

SEQ ID NO: 427620 - RNA, 32 nt, Human
gaggucugagagaucuggacuccaacccaagg

SEQ ID NO: 427621 - RNA, 32 nt, Human
gaggucugcccagggugggagcagugucacug

SEQ ID NO: 427622 - RNA, 32 nt, Human
gaggucugccuguuucguccccagaaacuuga

SEQ ID NO: 427623 - RNA, 32 nt, Human
gaggucugcugcuccaguuggcugcaaauaau

SEQ ID NO: 427624 - RNA, 32 nt, Human
gaggucuggaaggcgcagaaauggagcaagag

SEQ ID NO: 427625 - RNA, 32 nt, Human
gaggucuggagcuguggcugagccaccucugg

SEQ ID NO: 427626 - RNA, 32 nt, Human
gaggucuggaguuugagaccagccuggccaac

SEQ ID NO: 427627 - RNA, 32 nt, Human
gaggucugggagaaggguggugagaaugguaa

SEQ ID NO: 427628 - RNA, 32 nt, Human
gaggucugggagagagagcagagggcggcagg

SEQ ID NO: 427629 - RNA, 32 nt, Human
gaggucugggggccaggccacauggcuggaga

SEQ ID NO: 427630 - RNA, 32 nt, Human
gaggucugugaugugacccuuuuccucaccug

SEQ ID NO: 427631 - RNA, 32 nt, Human
gaggucuguguacagugacaggcuccacuuug

SEQ ID NO: 427632 - RNA, 32 nt, Human
gaggucugugugauuuacucaaguugaagaca

SEQ ID NO: 427633 - RNA, 32 nt, Human
gaggucuucccaacagacucucccucuuccaa

SEQ ID NO: 427634 - RNA, 32 nt, Human
gaggucuugccauguuacccaggcuggucuca

SEQ ID NO: 427635 - RNA, 32 nt, Human
gaggucuugguuccaggguuccuggccaggug

SEQ ID NO: 427636 - RNA, 32 nt, Human
gaggucuuugcuuaaguaugagauacuugaug

SEQ ID NO: 427637 - RNA, 32 nt, Human
gaggugaaagaaugggcugcagcgcaggcaaa

SEQ ID NO: 427638 - RNA, 32 nt, Human
gaggugaaagaauugcuugagcccaggacucu

SEQ ID NO: 427639 - RNA, 32 nt, Human
gaggugaagaauuuugcaggugggagauuugg

SEQ ID NO: 427640 - RNA, 18 nt, Human
gaggugaagaggcugcuu

SEQ ID NO: 427641 - RNA, 32 nt, Human
gaggugaaggcagagguggaggacauggacga

SEQ ID NO: 427642 - RNA, 32 nt, Human
gaggugaagggccccgcugcgcaggaccagcg

SEQ ID NO: 427643 - RNA, 32 nt, Human
gaggugaauaucugggagcagagaucaugaau

SEQ ID NO: 427644 - RNA, 24 nt, Human
gaggugaaugacaggaaugaugaa

SEQ ID NO: 427645 - RNA, 32 nt, Human
gaggugacagugagcugagaucacaccacugc

SEQ ID NO: 427646 - RNA, 32 nt, Human
gaggugacauguugggcugugggaucccagcg

SEQ ID NO: 427647 - RNA, 32 nt, Human
gaggugaccaagaggcagaagagcagagcagu

SEQ ID NO: 427648 - RNA, 32 nt, Human
gaggugaccccaggccccaggaaagggagcga

SEQ ID NO: 427649 - RNA, 32 nt, Human
gaggugaccuggagggacuauaagaucaacag

SEQ ID NO: 427650 - RNA, 32 nt, Human
gaggugacguggccuucuccuccagcacugug

SEQ ID NO: 427651 - RNA, 32 nt, Human
gaggugagaauccugcugaccccagucccauc

SEQ ID NO: 427652 - RNA, 32 nt, Human
gaggugagagacugaagaagcagagccuguau

SEQ ID NO: 427653 - RNA, 32 nt, Human
gaggugagaguaagccuuguguuagucagaac

SEQ ID NO: 427654 - RNA, 32 nt, Human
gaggugagagugauuagugggagaagaaaagc

SEQ ID NO: 427655 - RNA, 22 nt, Human
gaggugagcggaucacaagguc

SEQ ID NO: 427656 - RNA, 32 nt, Human
gaggugagcgugauccuagcuccuuguggcag

SEQ ID NO: 427657 - RNA, 32 nt, Human
gaggugaggaagagagcccugcagauacccag

SEQ ID NO: 427658 - RNA, 32 nt, Human
gaggugaggaaggaagggguugcuguccagug

SEQ ID NO: 427659 - RNA, 32 nt, Human
gaggugaggaguuugagaacagccuggccaac

SEQ ID NO: 427660 - RNA, 32 nt, Human
gaggugaggaguuugagaccagccuggccaac

SEQ ID NO: 427661 - RNA, 18 nt, Human
gaggugagguugcaguga

SEQ ID NO: 427662 - RNA, 20 nt, Human
gaggugaguagaggggccug

SEQ ID NO: 427663 - RNA, 32 nt, Human
gaggugaguggagacucagcccagcugcucuu

SEQ ID NO: 427664 - RNA, 22 nt, Human
gaggugaguggaucacgagguc

SEQ ID NO: 427665 - RNA, 32 nt, Human
gaggugauagcugaggaggagcggggauuugg

SEQ ID NO: 427666 - RNA, 32 nt, Human
gaggugaugcccaaggugcaccaccuuucaag

SEQ ID NO: 427667 - RNA, 32 nt, Human
gaggugauuaaaaccaacaaggaguuucaugu

SEQ ID NO: 427668 - RNA, 24 nt, Human
gaggugcaaagaaugcacuuuucc

SEQ ID NO: 427669 - RNA, 32 nt, Human
gaggugcacaggcuggaguuucaggcacugca

SEQ ID NO: 427670 - RNA, 32 nt, Human
gaggugcagcacaagcguggccccgcggggag

SEQ ID NO: 427671 - RNA, 32 nt, Human
gaggugcagcacacuccaccuggguggccuuc

SEQ ID NO: 427672 - RNA, 32 nt, Human
gaggugcagcugccgaaagugucagagauucg

SEQ ID NO: 427673 - RNA, 32 nt, Human
gaggugcaggccucgucaccugcagaggugcc

SEQ ID NO: 427674 - RNA, 32 nt, Human
gaggugcagggcagcggggcccagggaggggc

SEQ ID NO: 427675 - RNA, 32 nt, Human
gaggugcagggcuuggguaacagcugccuucc

SEQ ID NO: 427676 - RNA, 22 nt, Human
gaggugcagggggcaguacuca

SEQ ID NO: 427677 - RNA, 17 nt, Human
gaggugcaguggggaga

SEQ ID NO: 427678 - RNA, 32 nt, Human
gaggugcaucucaccaaccauccuccugcaga

SEQ ID NO: 427679 - RNA, 32 nt, Human
gaggugcauggugagaggugauuggaucaugg

SEQ ID NO: 427680 - RNA, 32 nt, Human
gaggugcauguguucccuaggagcucaacagg

SEQ ID NO: 427681 - RNA, 21 nt, Human
gaggugcauugaaauguucca

SEQ ID NO: 427682 - RNA, 32 nt, Human
gaggugccaaagcauguucaaccaacgcuguc

SEQ ID NO: 427683 - RNA, 32 nt, Human
gaggugccacccaguagcccagagugagcuuu

SEQ ID NO: 427684 - RNA, 32 nt, Human
gaggugccaccugggccccacgcaugcuuccu

SEQ ID NO: 427685 - RNA, 32 nt, Human
gaggugccagaggcggcggcugcucuggaccu

SEQ ID NO: 427686 - RNA, 23 nt, Human
gaggugccagcugccauuugcca

SEQ ID NO: 427687 - RNA, 32 nt, Human
gaggugccagcugccauuugccaaacucugca

SEQ ID NO: 427688 - RNA, 22 nt, Human
gaggugccagggguacauuuuu

SEQ ID NO: 427689 - RNA, 32 nt, Human
gaggugcccaaccuccuccacccccuuccccu

SEQ ID NO: 427690 - RNA, 32 nt, Human
gaggugcccgcucuucccuccugggcccacaa

SEQ ID NO: 427691 - RNA, 32 nt, Human
gaggugccggcugaggcagaggagaaacuaug

SEQ ID NO: 427692 - RNA, 32 nt, Human
gaggugccgucuggcccuucccugcaggccag

SEQ ID NO: 427693 - RNA, 32 nt, Human
gaggugccuacaccugccgagcguacagcauu

SEQ ID NO: 427694 - RNA, 32 nt, Human
gaggugccuccaggagcagcaggagcauggcc

SEQ ID NO: 427695 - RNA, 32 nt, Human
gaggugccugaaagcugggagcgugggcucag

SEQ ID NO: 427696 - RNA, 32 nt, Human
gaggugcggagacugcagaccagugcuucacu

SEQ ID NO: 427697 - RNA, 32 nt, Human
gaggugcggugacuugcccgggguuccaggua

SEQ ID NO: 427698 - RNA, 32 nt, Human
gaggugcggugccccgaagcgcucgcuucccg

SEQ ID NO: 427699 - RNA, 32 nt, Human
gaggugcucauccugacucgauuguucugcca

SEQ ID NO: 427700 - RNA, 32 nt, Human
gaggugcugcagcugcuccugcucucugaucu

SEQ ID NO: 427701 - RNA, 32 nt, Human
gaggugcugcugucucuccuccagcaaggaaa

SEQ ID NO: 427702 - RNA, 32 nt, Human
gaggugcuggaaggcacggguccacuucuuaa

SEQ ID NO: 427703 - RNA, 32 nt, Human
gaggugcugggcaagggcugcuucggccaggc

SEQ ID NO: 427704 - RNA, 32 nt, Human
gaggugcugucugcugccuccaccuguucccc

SEQ ID NO: 427705 - RNA, 32 nt, Human
gaggugcuuauccaggugugauuuauguguua

SEQ ID NO: 427706 - RNA, 32 nt, Human
gaggugcuuuacgcaucagcugccuuagacag

SEQ ID NO: 427707 - RNA, 32 nt, Human
gagguggaagcauggggugggaucgguggacc

SEQ ID NO: 427708 - RNA, 32 nt, Human
gagguggaaggccauacagaauggagccguga

SEQ ID NO: 427709 - RNA, 32 nt, Human
gagguggaaguuacagaagaggagguaccugg

SEQ ID NO: 427710 - RNA, 24 nt, Human
gagguggacagguccgagccagcu

SEQ ID NO: 427711 - RNA, 21 nt, Human
gagguggaccuguuugcuggg

SEQ ID NO: 427712 - RNA, 32 nt, Human
gagguggacgucugggcugggcgccggacaag

SEQ ID NO: 427713 - RNA, 32 nt, Human
gagguggagaaggacgggagaggcagagagag

SEQ ID NO: 427714 - RNA, 21 nt, Human
gagguggagacugcagugagc

SEQ ID NO: 427715 - RNA, 32 nt, Human
gagguggagagggagacaugacagcuuuuugu

SEQ ID NO: 427716 - RNA, 32 nt, Human
gagguggagauggggucaggaacaucuggcag

SEQ ID NO: 427717 - RNA, 32 nt, Human
gagguggagaugguggaggugguggugguggu

SEQ ID NO: 427718 - RNA, 19 nt, Human
gagguggagauugcaguga

SEQ ID NO: 427719 - RNA, 32 nt, Human
gagguggagcagcuacaagaugagaccaacca

SEQ ID NO: 427720 - RNA, 19 nt, Human
gagguggagcagguaggac

SEQ ID NO: 427721 - RNA, 32 nt, Human
gagguggagccaagugguccagcgucacucca

SEQ ID NO: 427722 - RNA, 19 nt, Human
gagguggagcuugcaguga

SEQ ID NO: 427723 - RNA, 32 nt, Human
gagguggaggaggaggaggaggaggaggaggu

SEQ ID NO: 427724 - RNA, 32 nt, Human
gagguggaggaggaggaggaggagguggugga

SEQ ID NO: 427725 - RNA, 32 nt, Human
gagguggaggaggaggggccagggcagucguu

SEQ ID NO: 427726 - RNA, 32 nt, Human
gagguggaggcagagauuacugugggccaagg

SEQ ID NO: 427727 - RNA, 32 nt, Human
gagguggaggcaggagaaucacuugacccagg

SEQ ID NO: 427728 - RNA, 32 nt, Human
gagguggaggcaguacccuggacucuauucug

SEQ ID NO: 427729 - RNA, 32 nt, Human
gagguggaggcagugagcugagaucgugccac

SEQ ID NO: 427730 - RNA, 32 nt, Human
gagguggaggcugcagcgagccaagaucacac

SEQ ID NO: 427731 - RNA, 32 nt, Human
gagguggaggcugcagcugaagguggcaggaa

SEQ ID NO: 427732 - RNA, 19 nt, Human
gagguggaggcugcaguga

SEQ ID NO: 427733 - RNA, 21 nt, Human
gagguggaggcugcagugagc

SEQ ID NO: 427734 - RNA, 24 nt, Human
gagguggaggcugcagugagcuau

SEQ ID NO: 427735 - RNA, 32 nt, Human
gagguggaggcugcagugagcuaugauugugc

SEQ ID NO: 427736 - RNA, 32 nt, Human
gagguggaggcuggagugaacagagaucgcgc

SEQ ID NO: 427737 - RNA, 32 nt, Human
gagguggaggggaggcugcagugagcugagau

SEQ ID NO: 427738 - RNA, 32 nt, Human
gagguggagguggaaaacgugauugaguggac

SEQ ID NO: 427739 - RNA, 32 nt, Human
gagguggagguggagguugcagugagccgaga

SEQ ID NO: 427740 - RNA, 32 nt, Human
gagguggagguggcagugagccgagauagcac

SEQ ID NO: 427741 - RNA, 32 nt, Human
gagguggagguggcagugagccgagaucacgc

SEQ ID NO: 427742 - RNA, 32 nt, Human
gagguggaggugggcggaucacgugaggucag

SEQ ID NO: 427743 - RNA, 19 nt, Human
gagguggagguugcaguga

SEQ ID NO: 427744 - RNA, 32 nt, Human
gagguggagguugcagugagccaagguugcgc

SEQ ID NO: 427745 - RNA, 19 nt, Human
gagguggagguugcagugg

SEQ ID NO: 427746 - RNA, 20 nt, Human
gagguggagucuugcucugu

SEQ ID NO: 427747 - RNA, 18 nt, Human
gagguggaguugcaguga

SEQ ID NO: 427748 - RNA, 32 nt, Human
gagguggaguuucacucuuguugcccaagcug

SEQ ID NO: 427749 - RNA, 32 nt, Human
gagguggaguuucgcucuuguugcccgggcug

SEQ ID NO: 427750 - RNA, 27 nt, Human
gagguggauaggucggugaugugugga

SEQ ID NO: 427751 - RNA, 32 nt, Human
gagguggaucgacgcccaggaggagaaacagg

SEQ ID NO: 427752 - RNA, 23 nt, Human
gagguggauugcgccacugcacu

SEQ ID NO: 427753 - RNA, 32 nt, Human
gagguggcaaaguggcaccgggcgccgaggcu

SEQ ID NO: 427754 - RNA, 32 nt, Human
gagguggcaaauaaaccugggcaauuuuguuu

SEQ ID NO: 427755 - RNA, 30 nt, Human
gagguggcaagccacaccccacggugcccg

SEQ ID NO: 427756 - RNA, 32 nt, Human
gagguggcacaucugcucagccaucucauuuu

SEQ ID NO: 427757 - RNA, 32 nt, Human
gagguggcaccugcaucaccuccuccucuugc

SEQ ID NO: 427758 - RNA, 32 nt, Human
gagguggcagagccaagaaucgacccaggcgg

SEQ ID NO: 427759 - RNA, 32 nt, Human
gagguggcagaggcagggccauaccaucaucu

SEQ ID NO: 427760 - RNA, 32 nt, Human
gagguggcaggcaccuguaaucccagccaccu

SEQ ID NO: 427761 - RNA, 32 nt, Human
gagguggcaggcagggguucuccucaggguuc

SEQ ID NO: 427762 - RNA, 32 nt, Human
gagguggcaggcgcguuugcaggaggggcgca

SEQ ID NO: 427763 - RNA, 32 nt, Human
gagguggcaggcggauggccagggagccauga

SEQ ID NO: 427764 - RNA, 32 nt, Human
gagguggcagugagccgagaucacaccauugc

SEQ ID NO: 427765 - RNA, 32 nt, Human
gagguggcagugagccgagaucacgccacugu

SEQ ID NO: 427766 - RNA, 32 nt, Human
gagguggcagugagccgagauugcgccauugc

SEQ ID NO: 427767 - RNA, 32 nt, Human
gagguggcauccagaggagacuggcuggcccc

SEQ ID NO: 427768 - RNA, 32 nt, Human
gagguggccauggagggggcacuggacugggc

SEQ ID NO: 427769 - RNA, 32 nt, Human
gagguggccccaaaugcagaccagcugugugc

SEQ ID NO: 427770 - RNA, 32 nt, Human
gagguggcccucagcugggacaguggggaccc

SEQ ID NO: 427771 - RNA, 32 nt, Human
gagguggcgcucugggcagcgccccuuuggac

SEQ ID NO: 427772 - RNA, 32 nt, Human
gagguggcgggaacaggggugugggaugaggu

SEQ ID NO: 427773 - RNA, 32 nt, Human
gagguggcggggaccagcugggcagaugagag

SEQ ID NO: 427774 - RNA, 32 nt, Human
gagguggcgucugagcaacuuucguccacaag

SEQ ID NO: 427775 - RNA, 32 nt, Human
gagguggcuacagggcaggcagaggaggcacc

SEQ ID NO: 427776 - RNA, 32 nt, Human
gagguggcuacucaacagguuugaggccccac

SEQ ID NO: 427777 - RNA, 32 nt, Human
gagguggcucaugccuguaaaucccagcacuu

SEQ ID NO: 427778 - RNA, 19 nt, Human
gagguggcuggagccccgg

SEQ ID NO: 427779 - RNA, 32 nt, Human
gaggugggaagaggaugaggagcaaaguuggg

SEQ ID NO: 427780 - RNA, 32 nt, Human
gaggugggaaggcagagcaucaggagggaaca

SEQ ID NO: 427781 - RNA, 22 nt, Human
gaggugggagaaucacaagguc

SEQ ID NO: 427782 - RNA, 32 nt, Human
gaggugggagagaaaggaggggaguucagggu

SEQ ID NO: 427783 - RNA, 32 nt, Human
gaggugggagagacuagagugaccagcaggag

SEQ ID NO: 427784 - RNA, 32 nt, Human
gaggugggagagagaagcagagcgagagagag

SEQ ID NO: 427785 - RNA, 32 nt, Human
gaggugggagcacgggcaggcucaggcgggaa

SEQ ID NO: 427786 - RNA, 32 nt, Human
gaggugggagcguguguggaagggggagagau

SEQ ID NO: 427787 - RNA, 32 nt, Human
gaggugggaggaucacuugaacucaggaguuu

SEQ ID NO: 427788 - RNA, 32 nt, Human
gaggugggaggaucacuugagcacaggaguuu

SEQ ID NO: 427789 - RNA, 32 nt, Human
gaggugggaggcaugggaaacagugcagugac

SEQ ID NO: 427790 - RNA, 32 nt, Human
gaggugggaggcgucucacugcucucaggguu

SEQ ID NO: 427791 - RNA, 32 nt, Human
gaggugggagggcuggaucuuuucccccacca

SEQ ID NO: 427792 - RNA, 32 nt, Human
gaggugggauagaggaagggagguuugagcca

SEQ ID NO: 427793 - RNA, 32 nt, Human
gaggugggcagagggguguggagcagccugga

SEQ ID NO: 427794 - RNA, 32 nt, Human
gaggugggcagaucaacugaguucaggaguuu

SEQ ID NO: 427795 - RNA, 22 nt, Human
gaggugggcagaucacaagguc

SEQ ID NO: 427796 - RNA, 32 nt, Human
gaggugggcagaucaccugagaucgggaguuu

SEQ ID NO: 427797 - RNA, 22 nt, Human
gaggugggcagaucacgagguc

SEQ ID NO: 427798 - RNA, 32 nt, Human
gaggugggcagaucacuugagaucaggaccag

SEQ ID NO: 427799 - RNA, 22 nt, Human
gaggugggcagaucauaagguc

SEQ ID NO: 427800 - RNA, 32 nt, Human
gaggugggcagaucauuugagaucaggaguuu

SEQ ID NO: 427801 - RNA, 32 nt, Human
gaggugggcagaucauuugagaucaggauuuu

SEQ ID NO: 427802 - RNA, 32 nt, Human
gaggugggcagccggccagggaagcacggucc

SEQ ID NO: 427803 - RNA, 32 nt, Human
gaggugggcaggcagaagagccuggauugcuc

SEQ ID NO: 427804 - RNA, 22 nt, Human
gaggugggcggaucacaagguc

SEQ ID NO: 427805 - RNA, 22 nt, Human
gaggugggcggaucacgagguc

SEQ ID NO: 427806 - RNA, 22 nt, Human
gaggugggcggaucgccugaga

SEQ ID NO: 427807 - RNA, 32 nt, Human
gaggugggcggaucgccugagaucaggaguuc

SEQ ID NO: 427808 - RNA, 32 nt, Human
gaggugggcuagcuauauagcagcgggggaga

SEQ ID NO: 427809 - RNA, 32 nt, Human
gaggugggcuaucugcauacuccagucuugga

SEQ ID NO: 427810 - RNA, 32 nt, Human
gaggugggcugacugcuugagcucaggaguuc

SEQ ID NO: 427811 - RNA, 32 nt, Human
gaggugggcugguagagcaggaagcucuguga

SEQ ID NO: 427812 - RNA, 32 nt, Human
gaggugggcuugcccaugaccaggaggggugu

SEQ ID NO: 427813 - RNA, 32 nt, Human
gagguggggaaagaugggcuaagaggcuucug

SEQ ID NO: 427814 - RNA, 32 nt, Human
gagguggggaagcaaggacaagaggcaaagag

SEQ ID NO: 427815 - RNA, 32 nt, Human
gagguggggagggagacagagacagaaacaga

SEQ ID NO: 427816 - RNA, 32 nt, Human
gagguggggagggggagcaggaacuuugagcc

SEQ ID NO: 427817 - RNA, 22 nt, Human
gagguggggauccugccuaagg

SEQ ID NO: 427818 - RNA, 32 nt, Human
gagguggggcaggcggagguugcaguaagcca

SEQ ID NO: 427819 - RNA, 19 nt, Human
gagguggggccccugcugg

SEQ ID NO: 427820 - RNA, 18 nt, Human
gagguggggcucagcagg

SEQ ID NO: 427821 - RNA, 18 nt, Human
gagguggggcugcccagg

SEQ ID NO: 427822 - RNA, 32 nt, Human
gaggugggggaacacaacacgcuuagcccugu

SEQ ID NO: 427823 - RNA, 32 nt, Human
gaggugggggagugggaagugggaagucacca

SEQ ID NO: 427824 - RNA, 23 nt, Human
gaggugggggcgguggugcugga

SEQ ID NO: 427825 - RNA, 22 nt, Human
gagguggggggagagccugagg

SEQ ID NO: 427826 - RNA, 32 nt, Human
gagguggggguuuugcuauguugccuaucugg

SEQ ID NO: 427827 - RNA, 32 nt, Human
gagguggggugagacagagugggagagauuac

SEQ ID NO: 427828 - RNA, 32 nt, Human
gaggugggguuccaugaccugcccugagguca

SEQ ID NO: 427829 - RNA, 19 nt, Human
gaggugggguuucaccaug

SEQ ID NO: 427830 - RNA, 23 nt, Human
gaggugggguuucaccaugcugg

SEQ ID NO: 427831 - RNA, 32 nt, Human
gagguggguaucucacuuuguugcccaggcug

SEQ ID NO: 427832 - RNA, 32 nt, Human
gagguggguccucuggccucagggggcucugc

SEQ ID NO: 427833 - RNA, 32 nt, Human
gaggugggucugggacauccuagaggcccuac

SEQ ID NO: 427834 - RNA, 22 nt, Human
gagguggguggaucacaagguc

SEQ ID NO: 427835 - RNA, 22 nt, Human
gagguggguggaucacaagguu

SEQ ID NO: 427836 - RNA, 32 nt, Human
gagguggguggaucaccugagaucaggaguuc

SEQ ID NO: 427837 - RNA, 22 nt, Human
gagguggguggaucacgaaguc

SEQ ID NO: 427838 - RNA, 22 nt, Human
gagguggguggaucacgagguc

SEQ ID NO: 427839 - RNA, 32 nt, Human
gagguggucaugcccgggcaaaggcccugcuu

SEQ ID NO: 427840 - RNA, 32 nt, Human
gagguggugaaaaagagggauuuggaaauaaa

SEQ ID NO: 427841 - RNA, 32 nt, Human
gaggugguggaggaggaggaggaggaggaagg

SEQ ID NO: 427842 - RNA, 32 nt, Human
gaggugguggccaugacacuggagaccaagcc

SEQ ID NO: 427843 - RNA, 32 nt, Human
gagguggugggagggagaaggaagggaagaaa

SEQ ID NO: 427844 - RNA, 32 nt, Human
gaggugguggugaaagagguucuggcgggaga

SEQ ID NO: 427845 - RNA, 32 nt, Human
gagguggugguguugauuggcuugucucguuc

SEQ ID NO: 427846 - RNA, 19 nt, Human
gagguggugguugcaguga

SEQ ID NO: 427847 - RNA, 32 nt, Human
gaggugguguguggauaccucugucucacgcc

SEQ ID NO: 427848 - RNA, 32 nt, Human
gagguguaagcccuuaaaagggccaagaauuu

SEQ ID NO: 427849 - RNA, 32 nt, Human
gagguguaguggucuaacauuuaggaagccuu

SEQ ID NO: 427850 - RNA, 32 nt, Human
gaggugucacccaaaccggcaggugcgauuuu

SEQ ID NO: 427851 - RNA, 32 nt, Human
gagguguccagccugcaaagcuauuccagcuc

SEQ ID NO: 427852 - RNA, 20 nt, Human
gaggugucgguccucuggga

SEQ ID NO: 427853 - RNA, 32 nt, Human
gaggugucuguggagcacccugcccucaccac

SEQ ID NO: 427854 - RNA, 32 nt, Human
gaggugugagccacugugcccagcccaucaau

SEQ ID NO: 427855 - RNA, 24 nt, Human
gaggugugauugcgccacugcauu

SEQ ID NO: 427856 - RNA, 22 nt, Human
gaggugugcagaucacaagguc

SEQ ID NO: 427857 - RNA, 32 nt, Human
gaggugugcaggaaccagcaaugagaaggcca

SEQ ID NO: 427858 - RNA, 32 nt, Human
gagguguggccaccccagcugcaggagcaggc

SEQ ID NO: 427859 - RNA, 32 nt, Human
gaggugugggaugucagaacauccaagucaga

SEQ ID NO: 427860 - RNA, 32 nt, Human
gaggugugggcagaggagggaggcaagugucc

SEQ ID NO: 427861 - RNA, 32 nt, Human
gaggugugggguaugcaccugagcuccugcuu

SEQ ID NO: 427862 - RNA, 32 nt, Human
gagguguguguaugucuuuaugaaauguuuga

SEQ ID NO: 427863 - RNA, 32 nt, Human
gagguguuagggaagaggaagagggugguaga

SEQ ID NO: 427864 - RNA, 32 nt, Human
gagguguucaaggagcaagagcuucagccuga

SEQ ID NO: 427865 - RNA, 32 nt, Human
gagguguucacacauccucuugugugcuaggu

SEQ ID NO: 427866 - RNA, 32 nt, Human
gagguguucuugaagacaggaggaggcucccg

SEQ ID NO: 427867 - RNA, 32 nt, Human
gagguguugcggcagagguuugagugaacccu

SEQ ID NO: 427868 - RNA, 32 nt, Human
gagguguuggagagcacaauggcugaacaagu

SEQ ID NO: 427869 - RNA, 32 nt, Human
gagguguuggggcaggaagugagucucuccau

SEQ ID NO: 427870 - RNA, 32 nt, Human
gagguguuuacaccagcaaaauacucauuuuu

SEQ ID NO: 427871 - RNA, 32 nt, Human
gagguguuuacuuaagaauaguaauuuaaaag

SEQ ID NO: 427872 - RNA, 18 nt, Human
gagguuaaaauauucaga

SEQ ID NO: 427873 - RNA, 32 nt, Human
gagguuaagaguuugagaacagccuggccaac

SEQ ID NO: 427874 - RNA, 22 nt, Human
gagguuaaggcaggcggaucac

SEQ ID NO: 427875 - RNA, 32 nt, Human
gagguuaaggcugaggaaaggccagcuggcag

SEQ ID NO: 427876 - RNA, 32 nt, Human
gagguuacaauuagaacuccugaccccagauu

SEQ ID NO: 427877 - RNA, 17 nt, Human
gagguuacacucuggga

SEQ ID NO: 427878 - RNA, 32 nt, Human
gagguuacagcgagccaagaucgcgccacugc

SEQ ID NO: 427879 - RNA, 32 nt, Human
gagguuacagggagccaagaucgcgcuacugc

SEQ ID NO: 427880 - RNA, 32 nt, Human
gagguuacagugagcagagaucaugccacugc

SEQ ID NO: 427881 - RNA, 32 nt, Human
gagguuacagugagccaagaucacaccacugu

SEQ ID NO: 427882 - RNA, 32 nt, Human
gagguuacagugagccaagaucgcgccaucgc

SEQ ID NO: 427883 - RNA, 32 nt, Human
gagguuacagugagccaagaucgugccacugc

SEQ ID NO: 427884 - RNA, 32 nt, Human
gagguuacagugagccaagaucgugccauugc

SEQ ID NO: 427885 - RNA, 32 nt, Human
gagguuacagugagccgagaucaugccauugc

SEQ ID NO: 427886 - RNA, 32 nt, Human
gagguuacagugagccgagaucgugccacugc

SEQ ID NO: 427887 - RNA, 32 nt, Human
gagguuacagugagcuaugauugcaccacugc

SEQ ID NO: 427888 - RNA, 32 nt, Human
gagguuacagugagcugagaucaugccacugc

SEQ ID NO: 427889 - RNA, 32 nt, Human
gagguuacagugagcugagaucgugccacugc

SEQ ID NO: 427890 - RNA, 32 nt, Human
gagguuacagugagcugagauugugccacugc

SEQ ID NO: 427891 - RNA, 32 nt, Human
gagguuacagugagcugauacugugccauugc

SEQ ID NO: 427892 - RNA, 21 nt, Human
gagguuacaugcagcugcuuu

SEQ ID NO: 427893 - RNA, 22 nt, Human
gagguuaccaccauugugauca

SEQ ID NO: 427894 - RNA, 32 nt, Human
gagguuacugcacugaggccaaguuaggaugg

SEQ ID NO: 427895 - RNA, 32 nt, Human
gagguuagaaguuugagaccagccuggccaac

SEQ ID NO: 427896 - RNA, 32 nt, Human
gagguuagagagaagagagucagcaacagcaa

SEQ ID NO: 427897 - RNA, 23 nt, Human
gagguuaggaguucaaaaccagc

SEQ ID NO: 427898 - RNA, 23 nt, Human
gagguuaggaguucaagaccagc

SEQ ID NO: 427899 - RNA, 23 nt, Human
gagguuaggaguucaagaucagc

SEQ ID NO: 427900 - RNA, 23 nt, Human
gagguuaggaguuccagaccagc

SEQ ID NO: 427901 - RNA, 23 nt, Human
gagguuaggaguucgagaccagc

SEQ ID NO: 427902 - RNA, 32 nt, Human
gagguuaggaguucgagagcagccuggccaac

SEQ ID NO: 427903 - RNA, 23 nt, Human
gagguuaggaguucgagaucagc

SEQ ID NO: 427904 - RNA, 23 nt, Human
gagguuaggaguucgaggccagc

SEQ ID NO: 427905 - RNA, 23 nt, Human
gagguuaggaguucgauaccagc

SEQ ID NO: 427906 - RNA, 32 nt, Human
gagguuaggaguugaaaagaagagucgacugu

SEQ ID NO: 427907 - RNA, 23 nt, Human
gagguuaggaguuugagaccagc

SEQ ID NO: 427908 - RNA, 32 nt, Human
gagguuaggaguuugagaccagccuggccaac

SEQ ID NO: 427909 - RNA, 23 nt, Human
gagguuaggaguuugagaucagc

SEQ ID NO: 427910 - RNA, 23 nt, Human
gagguuaggcguuccagaccagc

SEQ ID NO: 427911 - RNA, 23 nt, Human
gagguuagggguuucaccauguu

SEQ ID NO: 427912 - RNA, 32 nt, Human
gagguuauggagagccaagaucgcaccacugc

SEQ ID NO: 427913 - RNA, 32 nt, Human
gagguuauuuguguccuccugacacacacuuu

SEQ ID NO: 427914 - RNA, 32 nt, Human
gagguuauuuguuccuuagacccuggaauaac

SEQ ID NO: 427915 - RNA, 32 nt, Human
gagguucacagaggcccuugucuaggcagaag

SEQ ID NO: 427916 - RNA, 32 nt, Human
gagguucacugguaaucccagcacuuugggag

SEQ ID NO: 427917 - RNA, 32 nt, Human
gagguuccagacagccccucuucaccagcgau

SEQ ID NO: 427918 - RNA, 32 nt, Human
gagguuccagugagccaaaaucaugccaaugu

SEQ ID NO: 427919 - RNA, 32 nt, Human
gagguuccagugagcugagauggugccauuga

SEQ ID NO: 427920 - RNA, 21 nt, Human
gagguucccaaggccuacuga

SEQ ID NO: 427921 - RNA, 32 nt, Human
gagguucccagccgcugggaagccccuagacg

SEQ ID NO: 427922 - RNA, 32 nt, Human
gagguuccugggaguuagagggguaaugggag

SEQ ID NO: 427923 - RNA, 32 nt, Human
gagguuccuggguacacuccauuugaaaagcu

SEQ ID NO: 427924 - RNA, 32 nt, Human
gagguuccuguuugaacccaggagaguggaag

SEQ ID NO: 427925 - RNA, 24 nt, Human
gagguucuaaggccuaggauucua

SEQ ID NO: 427926 - RNA, 32 nt, Human
gagguucuccaggaccuuagguuugaugcgga

SEQ ID NO: 427927 - RNA, 32 nt, Human
gagguucucccagcccaucugaacacaaccag

SEQ ID NO: 427928 - RNA, 32 nt, Human
gagguucucucagcccuuccucccucucccug

SEQ ID NO: 427929 - RNA, 21 nt, Human
gagguucugcagcgucuccug

SEQ ID NO: 427930 - RNA, 19 nt, Human
gagguucugccacaugccc

SEQ ID NO: 427931 - RNA, 32 nt, Human
gagguucugcuugggauaaugaagagcugccu

SEQ ID NO: 427932 - RNA, 32 nt, Human
gagguucuggaagacuggggcagcaguugggg

SEQ ID NO: 427933 - RNA, 32 nt, Human
gagguucuuacagacaucuuuccucuuuguag

SEQ ID NO: 427934 - RNA, 23 nt, Human
gagguucuuaggggccgugccca

SEQ ID NO: 427935 - RNA, 24 nt, Human
gagguucuuccugccauccugcca

SEQ ID NO: 427936 - RNA, 32 nt, Human
gagguucuuccugccauccugccaucauuugu

SEQ ID NO: 427937 - RNA, 32 nt, Human
gagguucuugcagccaugcaggauccagaagu

SEQ ID NO: 427938 - RNA, 32 nt, Human
gagguugaacccuuuccccuggggguugguga

SEQ ID NO: 427939 - RNA, 32 nt, Human
gagguugaagaaaggaaccugggaugaggggu

SEQ ID NO: 427940 - RNA, 32 nt, Human
gagguugaagugagccaagaucgugccacugc

SEQ ID NO: 427941 - RNA, 32 nt, Human
gagguugaagugagccaagaucgugccauugc

SEQ ID NO: 427942 - RNA, 32 nt, Human
gagguugaaguggguggaucaccugaggucag

SEQ ID NO: 427943 - RNA, 17 nt, Human
gagguugacucuucuga

SEQ ID NO: 427944 - RNA, 32 nt, Human
gagguugagaauuccuuccuccucauccuugg

SEQ ID NO: 427945 - RNA, 22 nt, Human
gagguugaggcagguggaucac

SEQ ID NO: 427946 - RNA, 32 nt, Human
gagguugaggcccacaacacggugaccucugg

SEQ ID NO: 427947 - RNA, 32 nt, Human
gagguugaggcugaacugagccaggaucuugc

SEQ ID NO: 427948 - RNA, 23 nt, Human
gagguugaggcugcagugaacua

SEQ ID NO: 427949 - RNA, 32 nt, Human
gagguugaggcugcagugaauuaugauugugg

SEQ ID NO: 427950 - RNA, 21 nt, Human
gagguugaggcugcagugagc

SEQ ID NO: 427951 - RNA, 24 nt, Human
gagguugaggcugcagugagcuau

SEQ ID NO: 427952 - RNA, 32 nt, Human
gagguugaggcugcagugagcuaugaccauac

SEQ ID NO: 427953 - RNA, 32 nt, Human
gagguugaggcugcagugagcuaugaucacac

SEQ ID NO: 427954 - RNA, 32 nt, Human
gagguugaggcugcagugagcuaugaucgcau

SEQ ID NO: 427955 - RNA, 32 nt, Human
gagguugaggcugcagugagcuaugauuaugc

SEQ ID NO: 427956 - RNA, 32 nt, Human
gagguugaggcugcagugagcuauguucauga

SEQ ID NO: 427957 - RNA, 32 nt, Human
gagguugaggcugcagugagcuguguuucgcc

SEQ ID NO: 427958 - RNA, 32 nt, Human
gagguugaggcugcaguggcuaugaucaugcc

SEQ ID NO: 427959 - RNA, 32 nt, Human
gagguugaggugagagguuugccagaguuugu

SEQ ID NO: 427960 - RNA, 32 nt, Human
gagguugaggugggaggauuugcuugaaccca

SEQ ID NO: 427961 - RNA, 32 nt, Human
gagguugaggugggcggaucaccugaggucag

SEQ ID NO: 427962 - RNA, 19 nt, Human
gagguugagguugcaguga

SEQ ID NO: 427963 - RNA, 32 nt, Human
gagguugcaaugagccaagaucgcgccacugc

SEQ ID NO: 427964 - RNA, 25 nt, Human
gagguugcacagaccuggaauuuca

SEQ ID NO: 427965 - RNA, 32 nt, Human
gagguugcaccauuguacuccagccugggcaa

SEQ ID NO: 427966 - RNA, 32 nt, Human
gagguugcagagcaggccaggcagacaguggg

SEQ ID NO: 427967 - RNA, 32 nt, Human
gagguugcagcaagccaagaucacgccauugu

SEQ ID NO: 427968 - RNA, 32 nt, Human
gagguugcagcgagccaagaucaugccacugc

SEQ ID NO: 427969 - RNA, 32 nt, Human
gagguugcagcgagcugagaucacgccacugu

SEQ ID NO: 427970 - RNA, 32 nt, Human
gagguugcagggagccgagaucacgccacugc

SEQ ID NO: 427971 - RNA, 32 nt, Human
gagguugcagggagcugagaucacgccacugc

SEQ ID NO: 427972 - RNA, 32 nt, Human
gagguugcaguaagccaagaucgcgccauugc

SEQ ID NO: 427973 - RNA, 32 nt, Human
gagguugcaguaagccgagaucacgccacugc

SEQ ID NO: 427974 - RNA, 32 nt, Human
gagguugcaguaagccgagaucacgccacugu

SEQ ID NO: 427975 - RNA, 32 nt, Human
gagguugcaguaagcuaugauugugccacugu

SEQ ID NO: 427976 - RNA, 32 nt, Human
gagguugcagucagcuaugaucgugccacugc

SEQ ID NO: 427977 - RNA, 32 nt, Human
gagguugcagugaaccaagaucaugccacuga

SEQ ID NO: 427978 - RNA, 32 nt, Human
gagguugcagugaaccgagaucaugccaccgc

SEQ ID NO: 427979 - RNA, 32 nt, Human
gagguugcagugaaccgagauugugccacuac

SEQ ID NO: 427980 - RNA, 32 nt, Human
gagguugcagugaaccgagauugugccauugc

SEQ ID NO: 427981 - RNA, 32 nt, Human
gagguugcagugaacugagaucgugccauugu

SEQ ID NO: 427982 - RNA, 32 nt, Human
gagguugcagugaacugaggucgugcugccac

SEQ ID NO: 427983 - RNA, 32 nt, Human
gagguugcagugaacugauagugccgcugcac

SEQ ID NO: 427984 - RNA, 32 nt, Human
gagguugcagugacagagaucgugccacugca

SEQ ID NO: 427985 - RNA, 32 nt, Human
gagguugcagugacccaagaucgugccacuuc

SEQ ID NO: 427986 - RNA, 32 nt, Human
gagguugcagugagacaagaucacgucacugu

SEQ ID NO: 427987 - RNA, 32 nt, Human
gagguugcagugagacgagauugugccacugc

SEQ ID NO: 427988 - RNA, 32 nt, Human
gagguugcagugagcagagaccgagccacugu

SEQ ID NO: 427989 - RNA, 32 nt, Human
gagguugcagugagcagagaucacaccacugc

SEQ ID NO: 427990 - RNA, 32 nt, Human
gagguugcagugagcagagaucaugccacugc

SEQ ID NO: 427991 - RNA, 32 nt, Human
gagguugcagugagcagagaucgugccacugc

SEQ ID NO: 427992 - RNA, 32 nt, Human
gagguugcagugagcagagauugcccccgcua

SEQ ID NO: 427993 - RNA, 32 nt, Human
gagguugcagugagcagagauugcgccacugc

SEQ ID NO: 427994 - RNA, 32 nt, Human
gagguugcagugagcagagauugcgccacugu

SEQ ID NO: 427995 - RNA, 32 nt, Human
gagguugcagugagcagagauugcgccauugu

SEQ ID NO: 427996 - RNA, 32 nt, Human
gagguugcagugagcagagauugugccacugc

SEQ ID NO: 427997 - RNA, 32 nt, Human
gagguugcagugagcaguaaucccgccacugc

SEQ ID NO: 427998 - RNA, 32 nt, Human
gagguugcagugagcaguuaucacaccacugc

SEQ ID NO: 427999 - RNA, 32 nt, Human
gagguugcagugagccaaaaucccaccacugc

SEQ ID NO: 428000 - RNA, 32 nt, Human
gagguugcagugagccaaaauuacgccacugc

SEQ ID NO: 428001 - RNA, 32 nt, Human
gagguugcagugagccaagacagugccauugc

SEQ ID NO: 428002 - RNA, 32 nt, Human
gagguugcagugagccaagacuacgccacugc

SEQ ID NO: 428003 - RNA, 32 nt, Human
gagguugcagugagccaagacugugccacugc

SEQ ID NO: 428004 - RNA, 32 nt, Human
gagguugcagugagccaagauagugccacugc

SEQ ID NO: 428005 - RNA, 32 nt, Human
gagguugcagugagccaagaucaagccauugc

SEQ ID NO: 428006 - RNA, 32 nt, Human
gagguugcagugagccaagaucacaccacuga

SEQ ID NO: 428007 - RNA, 32 nt, Human
gagguugcagugagccaagaucacaccacugc

SEQ ID NO: 428008 - RNA, 32 nt, Human
gagguugcagugagccaagaucacaccagugc

SEQ ID NO: 428009 - RNA, 32 nt, Human
gagguugcagugagccaagaucacaccauugc

SEQ ID NO: 428010 - RNA, 32 nt, Human
gagguugcagugagccaagaucacacuacugc

SEQ ID NO: 428011 - RNA, 32 nt, Human
gagguugcagugagccaagaucacacuauugc

SEQ ID NO: 428012 - RNA, 32 nt, Human
gagguugcagugagccaagaucacaggagcca

SEQ ID NO: 428013 - RNA, 32 nt, Human
gagguugcagugagccaagaucacgccacugc

SEQ ID NO: 428014 - RNA, 32 nt, Human
gagguugcagugagccaagaucacgccauuac

SEQ ID NO: 428015 - RNA, 32 nt, Human
gagguugcagugagccaagaucacgccauugc

SEQ ID NO: 428016 - RNA, 32 nt, Human
gagguugcagugagccaagaucacgucauugc

SEQ ID NO: 428017 - RNA, 32 nt, Human
gagguugcagugagccaagaucagaccacugc

SEQ ID NO: 428018 - RNA, 32 nt, Human
gagguugcagugagccaagaucauaccacggc

SEQ ID NO: 428019 - RNA, 32 nt, Human
gagguugcagugagccaagaucauaccacugc

SEQ ID NO: 428020 - RNA, 32 nt, Human
gagguugcagugagccaagaucaugccacauc

SEQ ID NO: 428021 - RNA, 32 nt, Human
gagguugcagugagccaagaucaugccacugc

SEQ ID NO: 428022 - RNA, 32 nt, Human
gagguugcagugagccaagaucaugccacuuu

SEQ ID NO: 428023 - RNA, 32 nt, Human
gagguugcagugagccaagaucaugccauuau

SEQ ID NO: 428024 - RNA, 32 nt, Human
gagguugcagugagccaagaucaugccauugc

SEQ ID NO: 428025 - RNA, 32 nt, Human
gagguugcagugagccaagaucaugccuacug

SEQ ID NO: 428026 - RNA, 32 nt, Human
gagguugcagugagccaagaucaugucauugc

SEQ ID NO: 428027 - RNA, 32 nt, Human
gagguugcagugagccaagauccugccacugc

SEQ ID NO: 428028 - RNA, 32 nt, Human
gagguugcagugagccaagaucgcaccacuga

SEQ ID NO: 428029 - RNA, 32 nt, Human
gagguugcagugagccaagaucgcaccacugc

SEQ ID NO: 428030 - RNA, 32 nt, Human
gagguugcagugagccaagaucgcaccacugu

SEQ ID NO: 428031 - RNA, 32 nt, Human
gagguugcagugagccaagaucgcaccauugc

SEQ ID NO: 428032 - RNA, 32 nt, Human
gagguugcagugagccaagaucgcaccauugu

SEQ ID NO: 428033 - RNA, 32 nt, Human
gagguugcagugagccaagaucgcccacugca

SEQ ID NO: 428034 - RNA, 32 nt, Human
gagguugcagugagccaagaucgcgccacugc

SEQ ID NO: 428035 - RNA, 32 nt, Human
gagguugcagugagccaagaucgcgccauucu

SEQ ID NO: 428036 - RNA, 32 nt, Human
gagguugcagugagccaagaucgcgccauugc

SEQ ID NO: 428037 - RNA, 32 nt, Human
gagguugcagugagccaagaucgcgcuauugc

SEQ ID NO: 428038 - RNA, 32 nt, Human
gagguugcagugagccaagaucguaccacugc

SEQ ID NO: 428039 - RNA, 32 nt, Human
gagguugcagugagccaagaucgugccaaugc

SEQ ID NO: 428040 - RNA, 32 nt, Human
gagguugcagugagccaagaucgugccacgca

SEQ ID NO: 428041 - RNA, 32 nt, Human
gagguugcagugagccaagaucgugccacuac

SEQ ID NO: 428042 - RNA, 32 nt, Human
gagguugcagugagccaagaucgugccacugc

SEQ ID NO: 428043 - RNA, 32 nt, Human
gagguugcagugagccaagaucgugccauugc

SEQ ID NO: 428044 - RNA, 32 nt, Human
gagguugcagugagccaagaucgugucacugc

SEQ ID NO: 428045 - RNA, 32 nt, Human
gagguugcagugagccaagauggcgccacuac

SEQ ID NO: 428046 - RNA, 32 nt, Human
gagguugcagugagccaagauggcgccacugc

SEQ ID NO: 428047 - RNA, 32 nt, Human
gagguugcagugagccaagauggcgccauugc

SEQ ID NO: 428048 - RNA, 32 nt, Human
gagguugcagugagccaagauuacgccacugc

SEQ ID NO: 428049 - RNA, 32 nt, Human
gagguugcagugagccaagauuaugccacugc

SEQ ID NO: 428050 - RNA, 32 nt, Human
gagguugcagugagccaagauuaugccauugc

SEQ ID NO: 428051 - RNA, 32 nt, Human
gagguugcagugagccaagauuaugucacugc

SEQ ID NO: 428052 - RNA, 32 nt, Human
gagguugcagugagccaagauugcaccacugc

SEQ ID NO: 428053 - RNA, 32 nt, Human
gagguugcagugagccaagauugcacccugca

SEQ ID NO: 428054 - RNA, 32 nt, Human
gagguugcagugagccaagauugcaucacugc

SEQ ID NO: 428055 - RNA, 32 nt, Human
gagguugcagugagccaagauugccccacugc

SEQ ID NO: 428056 - RNA, 32 nt, Human
gagguugcagugagccaagauugcgccacugc

SEQ ID NO: 428057 - RNA, 32 nt, Human
gagguugcagugagccaagauugcgccacugu

SEQ ID NO: 428058 - RNA, 32 nt, Human
gagguugcagugagccaagauugcgccauugc

SEQ ID NO: 428059 - RNA, 32 nt, Human
gagguugcagugagccaagauugcgcccccug

SEQ ID NO: 428060 - RNA, 32 nt, Human
gagguugcagugagccaagauugcgccgcuac

SEQ ID NO: 428061 - RNA, 32 nt, Human
gagguugcagugagccaagauugcgccguugu

SEQ ID NO: 428062 - RNA, 32 nt, Human
gagguugcagugagccaagauugugccacugc

SEQ ID NO: 428063 - RNA, 32 nt, Human
gagguugcagugagccaagauugugccacugu

SEQ ID NO: 428064 - RNA, 32 nt, Human
gagguugcagugagccaagauugugccauugc

SEQ ID NO: 428065 - RNA, 32 nt, Human
gagguugcagugagccaaggucacaccauugc

SEQ ID NO: 428066 - RNA, 32 nt, Human
gagguugcagugagccaaggucacgucacugc

SEQ ID NO: 428067 - RNA, 32 nt, Human
gagguugcagugagccaaggucauaccagugc

SEQ ID NO: 428068 - RNA, 32 nt, Human
gagguugcagugagccaagguugcgccacugu

SEQ ID NO: 428069 - RNA, 32 nt, Human
gagguugcagugagccaaguucgaacuccugc

SEQ ID NO: 428070 - RNA, 32 nt, Human
gagguugcagugagccaauaucgugccacugc

SEQ ID NO: 428071 - RNA, 32 nt, Human
gagguugcagugagccacugcacuccagccug

SEQ ID NO: 428072 - RNA, 32 nt, Human
gagguugcagugagccaggaucacaccauugc

SEQ ID NO: 428073 - RNA, 32 nt, Human
gagguugcagugagccaggaucgcgccauugc

SEQ ID NO: 428074 - RNA, 32 nt, Human
gagguugcagugagccaggauugcgccaccac

SEQ ID NO: 428075 - RNA, 32 nt, Human
gagguugcagugagccaggauugugccacugc

SEQ ID NO: 428076 - RNA, 32 nt, Human
gagguugcagugagccaggauugugccauugc

SEQ ID NO: 428077 - RNA, 32 nt, Human
gagguugcagugagccaugaucaugccacugc

SEQ ID NO: 428078 - RNA, 32 nt, Human
gagguugcagugagccaugaucgagccacugc

SEQ ID NO: 428079 - RNA, 32 nt, Human
gagguugcagugagccaugaucgcaccacugc

SEQ ID NO: 428080 - RNA, 32 nt, Human
gagguugcagugagccaugauugcaccacugc

SEQ ID NO: 428081 - RNA, 32 nt, Human
gagguugcagugagcccagauaaagccacugc

SEQ ID NO: 428082 - RNA, 32 nt, Human
gagguugcagugagcccagaucacgccagugc

SEQ ID NO: 428083 - RNA, 32 nt, Human
gagguugcagugagcccagaucgcaccauugc

SEQ ID NO: 428084 - RNA, 32 nt, Human
gagguugcagugagcccagauggcgcugcugc

SEQ ID NO: 428085 - RNA, 32 nt, Human
gagguugcagugagcccagauugugccacugc

SEQ ID NO: 428086 - RNA, 32 nt, Human
gagguugcagugagccgaaauuaugccacugc

SEQ ID NO: 428087 - RNA, 32 nt, Human
gagguugcagugagccgacaucaugccacugc

SEQ ID NO: 428088 - RNA, 32 nt, Human
gagguugcagugagccgacaucaugccauugc

SEQ ID NO: 428089 - RNA, 32 nt, Human
gagguugcagugagccgacaucgcgccauugc

SEQ ID NO: 428090 - RNA, 32 nt, Human
gagguugcagugagccgagaaugccacugcac

SEQ ID NO: 428091 - RNA, 32 nt, Human
gagguugcagugagccgagaccacgccauugc

SEQ ID NO: 428092 - RNA, 32 nt, Human
gagguugcagugagccgagaccauaccacugc

SEQ ID NO: 428093 - RNA, 32 nt, Human
gagguugcagugagccgagaccaugccacugc

SEQ ID NO: 428094 - RNA, 32 nt, Human
gagguugcagugagccgagaccgcgccacugc

SEQ ID NO: 428095 - RNA, 32 nt, Human
gagguugcagugagccgagaccgugccacugc

SEQ ID NO: 428096 - RNA, 32 nt, Human
gagguugcagugagccgagagcaugccgcugc

SEQ ID NO: 428097 - RNA, 32 nt, Human
gagguugcagugagccgagauaaugccacugc

SEQ ID NO: 428098 - RNA, 32 nt, Human
gagguugcagugagccgagauagugccacagc

SEQ ID NO: 428099 - RNA, 32 nt, Human
gagguugcagugagccgagauagugccacugc

SEQ ID NO: 428100 - RNA, 32 nt, Human
gagguugcagugagccgagauagugccacugu

SEQ ID NO: 428101 - RNA, 32 nt, Human
gagguugcagugagccgagaucacaccaccgc

SEQ ID NO: 428102 - RNA, 32 nt, Human
gagguugcagugagccgagaucacaccacugc

SEQ ID NO: 428103 - RNA, 32 nt, Human
gagguugcagugagccgagaucacaccacugu

SEQ ID NO: 428104 - RNA, 32 nt, Human
gagguugcagugagccgagaucacaccauugc

SEQ ID NO: 428105 - RNA, 32 nt, Human
gagguugcagugagccgagaucaccccauuuc

SEQ ID NO: 428106 - RNA, 32 nt, Human
gagguugcagugagccgagaucacgccacugc

SEQ ID NO: 428107 - RNA, 32 nt, Human
gagguugcagugagccgagaucacgccauugc

SEQ ID NO: 428108 - RNA, 32 nt, Human
gagguugcagugagccgagaucacgccgcugc

SEQ ID NO: 428109 - RNA, 32 nt, Human
gagguugcagugagccgagaucacgccucugc

SEQ ID NO: 428110 - RNA, 32 nt, Human
gagguugcagugagccgagaucacgcuccugc

SEQ ID NO: 428111 - RNA, 32 nt, Human
gagguugcagugagccgagaucacgucacugc

SEQ ID NO: 428112 - RNA, 32 nt, Human
gagguugcagugagccgagaucacgucauugc

SEQ ID NO: 428113 - RNA, 32 nt, Human
gagguugcagugagccgagaucauaccauugc

SEQ ID NO: 428114 - RNA, 32 nt, Human
gagguugcagugagccgagaucaugccacugc

SEQ ID NO: 428115 - RNA, 32 nt, Human
gagguugcagugagccgagaucaugccauugc

SEQ ID NO: 428116 - RNA, 32 nt, Human
gagguugcagugagccgagaucaugcuacugc

SEQ ID NO: 428117 - RNA, 32 nt, Human
gagguugcagugagccgagaucaugcugaagg

SEQ ID NO: 428118 - RNA, 32 nt, Human
gagguugcagugagccgagaucaugucacugc

SEQ ID NO: 428119 - RNA, 32 nt, Human
gagguugcagugagccgagaucccccgaccgc

SEQ ID NO: 428120 - RNA, 32 nt, Human
gagguugcagugagccgagaucccgccacuca

SEQ ID NO: 428121 - RNA, 32 nt, Human
gagguugcagugagccgagaucgagccacugc

SEQ ID NO: 428122 - RNA, 32 nt, Human
gagguugcagugagccgagaucgagccauugc

SEQ ID NO: 428123 - RNA, 32 nt, Human
gagguugcagugagccgagaucgcaccacgcc

SEQ ID NO: 428124 - RNA, 32 nt, Human
gagguugcagugagccgagaucgcaccacugc

SEQ ID NO: 428125 - RNA, 32 nt, Human
gagguugcagugagccgagaucgcaccacugu

SEQ ID NO: 428126 - RNA, 32 nt, Human
gagguugcagugagccgagaucgcaccauugc

SEQ ID NO: 428127 - RNA, 32 nt, Human
gagguugcagugagccgagaucgcaucacugc

SEQ ID NO: 428128 - RNA, 32 nt, Human
gagguugcagugagccgagaucgcauuacugc

SEQ ID NO: 428129 - RNA, 32 nt, Human
gagguugcagugagccgagaucgccccacugc

SEQ ID NO: 428130 - RNA, 32 nt, Human
gagguugcagugagccgagaucgcccugcugc

SEQ ID NO: 428131 - RNA, 32 nt, Human
gagguugcagugagccgagaucgcgccaccca

SEQ ID NO: 428132 - RNA, 32 nt, Human
gagguugcagugagccgagaucgcgccacugc

SEQ ID NO: 428133 - RNA, 32 nt, Human
gagguugcagugagccgagaucgcgccauagc

SEQ ID NO: 428134 - RNA, 32 nt, Human
gagguugcagugagccgagaucgcgccauuac

SEQ ID NO: 428135 - RNA, 32 nt, Human
gagguugcagugagccgagaucgcgccauugc

SEQ ID NO: 428136 - RNA, 32 nt, Human
gagguugcagugagccgagaucgcgccuuugc

SEQ ID NO: 428137 - RNA, 32 nt, Human
gagguugcagugagccgagaucgcgucacugc

SEQ ID NO: 428138 - RNA, 32 nt, Human
gagguugcagugagccgagaucgcuccacugc

SEQ ID NO: 428139 - RNA, 32 nt, Human
gagguugcagugagccgagaucgucccacugc

SEQ ID NO: 428140 - RNA, 32 nt, Human
gagguugcagugagccgagaucgugccacugc

SEQ ID NO: 428141 - RNA, 32 nt, Human
gagguugcagugagccgagaucgugccauugc

SEQ ID NO: 428142 - RNA, 32 nt, Human
gagguugcagugagccgagaucgugccuuugc

SEQ ID NO: 428143 - RNA, 32 nt, Human
gagguugcagugagccgagaucgugcuacugc

SEQ ID NO: 428144 - RNA, 32 nt, Human
gagguugcagugagccgagaucucaccauuac

SEQ ID NO: 428145 - RNA, 32 nt, Human
gagguugcagugagccgagauggcgccacugc

SEQ ID NO: 428146 - RNA, 32 nt, Human
gagguugcagugagccgagaugguaccucugc

SEQ ID NO: 428147 - RNA, 32 nt, Human
gagguugcagugagccgagauggugccacugc

SEQ ID NO: 428148 - RNA, 32 nt, Human
gagguugcagugagccgagauuaugccacugc

SEQ ID NO: 428149 - RNA, 32 nt, Human
gagguugcagugagccgagauuaugccacugu

SEQ ID NO: 428150 - RNA, 32 nt, Human
gagguugcagugagccgagauuaugucacucc

SEQ ID NO: 428151 - RNA, 32 nt, Human
gagguugcagugagccgagauugcaccccugc

SEQ ID NO: 428152 - RNA, 32 nt, Human
gagguugcagugagccgagauugccacugcac

SEQ ID NO: 428153 - RNA, 32 nt, Human
gagguugcagugagccgagauugcgccacuac

SEQ ID NO: 428154 - RNA, 32 nt, Human
gagguugcagugagccgagauugcgccacugc

SEQ ID NO: 428155 - RNA, 32 nt, Human
gagguugcagugagccgagauugcgccacugg

SEQ ID NO: 428156 - RNA, 32 nt, Human
gagguugcagugagccgagauugcgccacugu

SEQ ID NO: 428157 - RNA, 32 nt, Human
gagguugcagugagccgagauugcgccauugc

SEQ ID NO: 428158 - RNA, 32 nt, Human
gagguugcagugagccgagauugcgccccugc

SEQ ID NO: 428159 - RNA, 32 nt, Human
gagguugcagugagccgagauugcuccauugc

SEQ ID NO: 428160 - RNA, 32 nt, Human
gagguugcagugagccgagauuggccauugca

SEQ ID NO: 428161 - RNA, 32 nt, Human
gagguugcagugagccgagauuggucccaccg

SEQ ID NO: 428162 - RNA, 32 nt, Human
gagguugcagugagccgagauugugccacuac

SEQ ID NO: 428163 - RNA, 32 nt, Human
gagguugcagugagccgagauugugccacugc

SEQ ID NO: 428164 - RNA, 32 nt, Human
gagguugcagugagccgagauugugccacugu

SEQ ID NO: 428165 - RNA, 32 nt, Human
gagguugcagugagccgagauugugccauugc

SEQ ID NO: 428166 - RNA, 32 nt, Human
gagguugcagugagccgagauugugccccugc

SEQ ID NO: 428167 - RNA, 32 nt, Human
gagguugcagugagccgagauugugcugcugc

SEQ ID NO: 428168 - RNA, 32 nt, Human
gagguugcagugagccgagcucgcgccauugc

SEQ ID NO: 428169 - RNA, 32 nt, Human
gagguugcagugagccgaggucccgccacugc

SEQ ID NO: 428170 - RNA, 32 nt, Human
gagguugcagugagccgaggucgcaccacugc

SEQ ID NO: 428171 - RNA, 32 nt, Human
gagguugcagugagccgaggucgcaccguugu

SEQ ID NO: 428172 - RNA, 32 nt, Human
gagguugcagugagccgaggucgcuccauugc

SEQ ID NO: 428173 - RNA, 32 nt, Human
gagguugcagugagccgaggucgugccauugc

SEQ ID NO: 428174 - RNA, 32 nt, Human
gagguugcagugagccgagucacgccacugca

SEQ ID NO: 428175 - RNA, 32 nt, Human
gagguugcagugagccgaguuugggccacugc

SEQ ID NO: 428176 - RNA, 32 nt, Human
gagguugcagugagccgauaucgugccacugc

SEQ ID NO: 428177 - RNA, 28 nt, Human
gagguugcagugagccgucaucgcgcca

SEQ ID NO: 428178 - RNA, 32 nt, Human
gagguugcagugagccgugauugugccauugu

SEQ ID NO: 428179 - RNA, 32 nt, Human
gagguugcagugagccgugauugugccgcaac

SEQ ID NO: 428180 - RNA, 32 nt, Human
gagguugcagugagccucgauuguaccacugc

SEQ ID NO: 428181 - RNA, 32 nt, Human
gagguugcagugagccuggaucaugccacugc

SEQ ID NO: 428182 - RNA, 32 nt, Human
gagguugcagugagccugucaucgcuccacug

SEQ ID NO: 428183 - RNA, 32 nt, Human
gagguugcagugagccuugaucgugccacugc

SEQ ID NO: 428184 - RNA, 32 nt, Human
gagguugcagugagcgagaucaugccauugca

SEQ ID NO: 428185 - RNA, 32 nt, Human
gagguugcagugagcggagaucaugccacugc

SEQ ID NO: 428186 - RNA, 32 nt, Human
gagguugcagugagcggagaucaugccagugc

SEQ ID NO: 428187 - RNA, 32 nt, Human
gagguugcagugagcggagaucgccccacuac

SEQ ID NO: 428188 - RNA, 32 nt, Human
gagguugcagugagcggagaucgugccauugc

SEQ ID NO: 428189 - RNA, 32 nt, Human
gagguugcagugagcggagaucuugccacugc

SEQ ID NO: 428190 - RNA, 32 nt, Human
gagguugcagugagcuaagacugacccacugc

SEQ ID NO: 428191 - RNA, 32 nt, Human
gagguugcagugagcuaagacugugccacugc

SEQ ID NO: 428192 - RNA, 32 nt, Human
gagguugcagugagcuaagaucacaccacuac

SEQ ID NO: 428193 - RNA, 32 nt, Human
gagguugcagugagcuaagaucacaccacugc

SEQ ID NO: 428194 - RNA, 32 nt, Human
gagguugcagugagcuaagaucacaucacugc

SEQ ID NO: 428195 - RNA, 32 nt, Human
gagguugcagugagcuaagaucacgccacugc

SEQ ID NO: 428196 - RNA, 32 nt, Human
gagguugcagugagcuaagaucgcaccacugc

SEQ ID NO: 428197 - RNA, 32 nt, Human
gagguugcagugagcuaagaucgcgccacugu

SEQ ID NO: 428198 - RNA, 32 nt, Human
gagguugcagugagcuaagaucgugccacugc

SEQ ID NO: 428199 - RNA, 32 nt, Human
gagguugcagugagcuaugauaacaccacugc

SEQ ID NO: 428200 - RNA, 32 nt, Human
gagguugcagugagcucagauagugccacugc

SEQ ID NO: 428201 - RNA, 32 nt, Human
gagguugcagugagcucagaucucaccauugc

SEQ ID NO: 428202 - RNA, 32 nt, Human
gagguugcagugagcucagauggugccacugc

SEQ ID NO: 428203 - RNA, 32 nt, Human
gagguugcagugagcucagauugcgucacugc

SEQ ID NO: 428204 - RNA, 32 nt, Human
gagguugcagugagcugaaauccugccacugc

SEQ ID NO: 428205 - RNA, 32 nt, Human
gagguugcagugagcugagaacucaccauugc

SEQ ID NO: 428206 - RNA, 32 nt, Human
gagguugcagugagcugagaccaugccacugc

SEQ ID NO: 428207 - RNA, 32 nt, Human
gagguugcagugagcugagacggugccauugc

SEQ ID NO: 428208 - RNA, 32 nt, Human
gagguugcagugagcugagacugugccacugc

SEQ ID NO: 428209 - RNA, 32 nt, Human
gagguugcagugagcugagacugugccauugc

SEQ ID NO: 428210 - RNA, 32 nt, Human
gagguugcagugagcugagagcacgccauugc

SEQ ID NO: 428211 - RNA, 32 nt, Human
gagguugcagugagcugagagugugccauugc

SEQ ID NO: 428212 - RNA, 32 nt, Human
gagguugcagugagcugagauaacgccacugc

SEQ ID NO: 428213 - RNA, 32 nt, Human
gagguugcagugagcugagauagcgccauugc

SEQ ID NO: 428214 - RNA, 32 nt, Human
gagguugcagugagcugagaucacaccacugc

SEQ ID NO: 428215 - RNA, 32 nt, Human
gagguugcagugagcugagaucacaccauugc

SEQ ID NO: 428216 - RNA, 32 nt, Human
gagguugcagugagcugagaucacacuacugu

SEQ ID NO: 428217 - RNA, 32 nt, Human
gagguugcagugagcugagaucacaucacugc

SEQ ID NO: 428218 - RNA, 32 nt, Human
gagguugcagugagcugagaucaccccacugu

SEQ ID NO: 428219 - RNA, 32 nt, Human
gagguugcagugagcugagaucacgccacugc

SEQ ID NO: 428220 - RNA, 32 nt, Human
gagguugcagugagcugagaucacgccauugc

SEQ ID NO: 428221 - RNA, 32 nt, Human
gagguugcagugagcugagaucacgccauugu

SEQ ID NO: 428222 - RNA, 32 nt, Human
gagguugcagugagcugagaucacgcuacugc

SEQ ID NO: 428223 - RNA, 32 nt, Human
gagguugcagugagcugagaucacgucauugc

SEQ ID NO: 428224 - RNA, 32 nt, Human
gagguugcagugagcugagaucaggccacugc

SEQ ID NO: 428225 - RNA, 32 nt, Human
gagguugcagugagcugagaucaugccacugc

SEQ ID NO: 428226 - RNA, 32 nt, Human
gagguugcagugagcugagaucaugccaucgc

SEQ ID NO: 428227 - RNA, 32 nt, Human
gagguugcagugagcugagaucaugccauugc

SEQ ID NO: 428228 - RNA, 32 nt, Human
gagguugcagugagcugagaucaugucacugu

SEQ ID NO: 428229 - RNA, 32 nt, Human
gagguugcagugagcugagaucauguuucugc

SEQ ID NO: 428230 - RNA, 32 nt, Human
gagguugcagugagcugagaucccaccacugc

SEQ ID NO: 428231 - RNA, 32 nt, Human
gagguugcagugagcugagaucgagccacugc

SEQ ID NO: 428232 - RNA, 32 nt, Human
gagguugcagugagcugagaucgcaccacugc

SEQ ID NO: 428233 - RNA, 32 nt, Human
gagguugcagugagcugagaucgcaccauuac

SEQ ID NO: 428234 - RNA, 32 nt, Human
gagguugcagugagcugagaucgcaccauugc

SEQ ID NO: 428235 - RNA, 32 nt, Human
gagguugcagugagcugagaucgcgccacugc

SEQ ID NO: 428236 - RNA, 32 nt, Human
gagguugcagugagcugagaucgcgccacugg

SEQ ID NO: 428237 - RNA, 32 nt, Human
gagguugcagugagcugagaucgcgccaguac

SEQ ID NO: 428238 - RNA, 32 nt, Human
gagguugcagugagcugagaucgcgccauugc

SEQ ID NO: 428239 - RNA, 32 nt, Human
gagguugcagugagcugagaucgcgcuacugc

SEQ ID NO: 428240 - RNA, 32 nt, Human
gagguugcagugagcugagaucguaccuauug

SEQ ID NO: 428241 - RNA, 32 nt, Human
gagguugcagugagcugagaucguagcacugc

SEQ ID NO: 428242 - RNA, 32 nt, Human
gagguugcagugagcugagaucgucccacugc

SEQ ID NO: 428243 - RNA, 32 nt, Human
gagguugcagugagcugagaucgugccacugc

SEQ ID NO: 428244 - RNA, 32 nt, Human
gagguugcagugagcugagaucgugccauuac

SEQ ID NO: 428245 - RNA, 32 nt, Human
gagguugcagugagcugagaucgugccauugu

SEQ ID NO: 428246 - RNA, 32 nt, Human
gagguugcagugagcugagaucgugccguuac

SEQ ID NO: 428247 - RNA, 32 nt, Human
gagguugcagugagcugagaucgugcuacugc

SEQ ID NO: 428248 - RNA, 32 nt, Human
gagguugcagugagcugagaucgugcuauugc

SEQ ID NO: 428249 - RNA, 32 nt, Human
gagguugcagugagcugagaucguggccacug

SEQ ID NO: 428250 - RNA, 32 nt, Human
gagguugcagugagcugagaucgugucacuac

SEQ ID NO: 428251 - RNA, 32 nt, Human
gagguugcagugagcugagaucucaccacugc

SEQ ID NO: 428252 - RNA, 32 nt, Human
gagguugcagugagcugagaucucgccauugc

SEQ ID NO: 428253 - RNA, 32 nt, Human
gagguugcagugagcugagaucuggccucugc

SEQ ID NO: 428254 - RNA, 32 nt, Human
gagguugcagugagcugagaucuucccacugc

SEQ ID NO: 428255 - RNA, 32 nt, Human
gagguugcagugagcugagaucuugccacugc

SEQ ID NO: 428256 - RNA, 32 nt, Human
gagguugcagugagcugagauggcaccacugc

SEQ ID NO: 428257 - RNA, 32 nt, Human
gagguugcagugagcugagauggcaccacuua

SEQ ID NO: 428258 - RNA, 32 nt, Human
gagguugcagugagcugagauggugccacugc

SEQ ID NO: 428259 - RNA, 32 nt, Human
gagguugcagugagcugagauggugccacugu

SEQ ID NO: 428260 - RNA, 32 nt, Human
gagguugcagugagcugagauuacaccccugg

SEQ ID NO: 428261 - RNA, 32 nt, Human
gagguugcagugagcugagauugcaccacggc

SEQ ID NO: 428262 - RNA, 32 nt, Human
gagguugcagugagcugagauugcaccacuac

SEQ ID NO: 428263 - RNA, 32 nt, Human
gagguugcagugagcugagauugcaccacugc

SEQ ID NO: 428264 - RNA, 32 nt, Human
gagguugcagugagcugagauugcaccacugu

SEQ ID NO: 428265 - RNA, 32 nt, Human
gagguugcagugagcugagauugcaccauugc

SEQ ID NO: 428266 - RNA, 32 nt, Human
gagguugcagugagcugagauugcgccacugc

SEQ ID NO: 428267 - RNA, 32 nt, Human
gagguugcagugagcugagauugcgccauugc

SEQ ID NO: 428268 - RNA, 32 nt, Human
gagguugcagugagcugagauugcgccauugu

SEQ ID NO: 428269 - RNA, 32 nt, Human
gagguugcagugagcugagauugggccacugc

SEQ ID NO: 428270 - RNA, 32 nt, Human
gagguugcagugagcugagauuguaccacugc

SEQ ID NO: 428271 - RNA, 32 nt, Human
gagguugcagugagcugagauuguaccaugca

SEQ ID NO: 428272 - RNA, 32 nt, Human
gagguugcagugagcugagauuguaccauugc

SEQ ID NO: 428273 - RNA, 32 nt, Human
gagguugcagugagcugagauugugccacuac

SEQ ID NO: 428274 - RNA, 32 nt, Human
gagguugcagugagcugagauugugccacugc

SEQ ID NO: 428275 - RNA, 32 nt, Human
gagguugcagugagcugagauugugccacugu

SEQ ID NO: 428276 - RNA, 32 nt, Human
gagguugcagugagcugagauugugccacuuc

SEQ ID NO: 428277 - RNA, 32 nt, Human
gagguugcagugagcugagauugugccauugc

SEQ ID NO: 428278 - RNA, 32 nt, Human
gagguugcagugagcugaggucgugccacugc

SEQ ID NO: 428279 - RNA, 32 nt, Human
gagguugcagugagcugagguugugccacugc

SEQ ID NO: 428280 - RNA, 32 nt, Human
gagguugcagugagcugaguuugcaucacugc

SEQ ID NO: 428281 - RNA, 32 nt, Human
gagguugcagugagcugauauugugccacugc

SEQ ID NO: 428282 - RNA, 32 nt, Human
gagguugcagugagcugaucaugccacugcac

SEQ ID NO: 428283 - RNA, 32 nt, Human
gagguugcagugagcugggaucgcgccauugc

SEQ ID NO: 428284 - RNA, 32 nt, Human
gagguugcagugagcugugaucacaccacugc

SEQ ID NO: 428285 - RNA, 32 nt, Human
gagguugcagugagcugugaucaccucacugc

SEQ ID NO: 428286 - RNA, 32 nt, Human
gagguugcagugagcugugaucacgccacugc

SEQ ID NO: 428287 - RNA, 32 nt, Human
gagguugcagugagcugugauugugccacugu

SEQ ID NO: 428288 - RNA, 32 nt, Human
gagguugcagugagcuuagaucaugccaccau

SEQ ID NO: 428289 - RNA, 32 nt, Human
gagguugcagugaggcgagauuaggccauugc

SEQ ID NO: 428290 - RNA, 32 nt, Human
gagguugcagugagguaugaucaugccauugc

SEQ ID NO: 428291 - RNA, 32 nt, Human
gagguugcagugaggugacaucgcgccacugc

SEQ ID NO: 428292 - RNA, 32 nt, Human
gagguugcagugaggugagauagcgccauugc

SEQ ID NO: 428293 - RNA, 32 nt, Human
gagguugcagugaggugagaucgugccauugc

SEQ ID NO: 428294 - RNA, 32 nt, Human
gagguugcagugagucaagaucacgccacugc

SEQ ID NO: 428295 - RNA, 32 nt, Human
gagguugcagugagucaagaucgcgccacugc

SEQ ID NO: 428296 - RNA, 32 nt, Human
gagguugcagugagucagaucgugccacugca

SEQ ID NO: 428297 - RNA, 32 nt, Human
gagguugcagugagucgagaucacgccauugc

SEQ ID NO: 428298 - RNA, 32 nt, Human
gagguugcagugagucgagaucaugccauugc

SEQ ID NO: 428299 - RNA, 32 nt, Human
gagguugcagugagucgagaucgcgccacugc

SEQ ID NO: 428300 - RNA, 32 nt, Human
gagguugcagugagucgagaucgcgccagugc

SEQ ID NO: 428301 - RNA, 32 nt, Human
gagguugcagugagugaagaucacgccacugc

SEQ ID NO: 428302 - RNA, 32 nt, Human
gagguugcagugaguggagaucacgccacugc

SEQ ID NO: 428303 - RNA, 32 nt, Human
gagguugcagugaguggagaucgcaccacugc

SEQ ID NO: 428304 - RNA, 32 nt, Human
gagguugcagugaguggagaucgcgccaacac

SEQ ID NO: 428305 - RNA, 32 nt, Human
gagguugcagugaguggagaucgcgccauugc

SEQ ID NO: 428306 - RNA, 32 nt, Human
gagguugcagugaguggagauggcgccacugc

SEQ ID NO: 428307 - RNA, 32 nt, Human
gagguugcagugaguugagaucacgccacugc

SEQ ID NO: 428308 - RNA, 32 nt, Human
gagguugcagugaguugagaucaugccacugc

SEQ ID NO: 428309 - RNA, 32 nt, Human
gagguugcagugaguugagaucgcacuccagc

SEQ ID NO: 428310 - RNA, 32 nt, Human
gagguugcagugaguugagaucgcgccacugc

SEQ ID NO: 428311 - RNA, 32 nt, Human
gagguugcagugaguugagaucgugccauugu

SEQ ID NO: 428312 - RNA, 32 nt, Human
gagguugcagugaguugagauugugccauugc

SEQ ID NO: 428313 - RNA, 32 nt, Human
gagguugcagugauccaagaucacgccacugc

SEQ ID NO: 428314 - RNA, 32 nt, Human
gagguugcagugauugaguaggauuggccugc

SEQ ID NO: 428315 - RNA, 32 nt, Human
gagguugcagugggccaagaucacgccacuac

SEQ ID NO: 428316 - RNA, 32 nt, Human
gagguugcagugggccaagaucgugcuacugc

SEQ ID NO: 428317 - RNA, 32 nt, Human
gagguugcaguuagcugagauccugccacugc

SEQ ID NO: 428318 - RNA, 32 nt, Human
gagguugcauugagccaagaucacgccacugc

SEQ ID NO: 428319 - RNA, 32 nt, Human
gagguugccgugagccaagaucacgccacugc

SEQ ID NO: 428320 - RNA, 32 nt, Human
gagguugccgugagccaagaucgcaccacugc

SEQ ID NO: 428321 - RNA, 32 nt, Human
gagguugcgccacuacacuccagccuggguga

SEQ ID NO: 428322 - RNA, 32 nt, Human
gagguugcgccacugcacucuagccugggcua

SEQ ID NO: 428323 - RNA, 32 nt, Human
gagguugcgcuacugcacuccagccuggacaa

SEQ ID NO: 428324 - RNA, 32 nt, Human
gagguugcggugagccaagagcgcaccauugc

SEQ ID NO: 428325 - RNA, 32 nt, Human
gagguugcggugagccaagaucacgccauagc

SEQ ID NO: 428326 - RNA, 32 nt, Human
gagguugcggugagccaagaucauaccauugc

SEQ ID NO: 428327 - RNA, 32 nt, Human
gagguugcggugagccaagaucaugccacugc

SEQ ID NO: 428328 - RNA, 32 nt, Human
gagguugcggugagccaagaucgcaccauugc

SEQ ID NO: 428329 - RNA, 32 nt, Human
gagguugcggugagccaagaucgugccacugc

SEQ ID NO: 428330 - RNA, 32 nt, Human
gagguugcggugagccaagauggcaccauugc

SEQ ID NO: 428331 - RNA, 32 nt, Human
gagguugcggugagccaagauugcgccacugc

SEQ ID NO: 428332 - RNA, 32 nt, Human
gagguugcggugagccaagauugcgccauugc

SEQ ID NO: 428333 - RNA, 32 nt, Human
gagguugcggugagccaaggucgcgccacugc

SEQ ID NO: 428334 - RNA, 32 nt, Human
gagguugcggugagcccagaucgcgccauugc

SEQ ID NO: 428335 - RNA, 32 nt, Human
gagguugcggugagccgagaucacgccacugc

SEQ ID NO: 428336 - RNA, 32 nt, Human
gagguugcggugagccgagaucaugccacugc

SEQ ID NO: 428337 - RNA, 32 nt, Human
gagguugcggugagccgagaucaugccauggc

SEQ ID NO: 428338 - RNA, 32 nt, Human
gagguugcggugagccgagaucgcaccacugc

SEQ ID NO: 428339 - RNA, 32 nt, Human
gagguugcggugagccgagaucgcgccauugc

SEQ ID NO: 428340 - RNA, 32 nt, Human
gagguugcggugagccgagaucgcgcuacugc

SEQ ID NO: 428341 - RNA, 32 nt, Human
gagguugcggugagccgagauggugccguugc

SEQ ID NO: 428342 - RNA, 32 nt, Human
gagguugcggugagccgagauugcaccacugc

SEQ ID NO: 428343 - RNA, 32 nt, Human
gagguugcggugagccgagauugugccauugc

SEQ ID NO: 428344 - RNA, 32 nt, Human
gagguugcggugagcugagaucacgccauugc

SEQ ID NO: 428345 - RNA, 32 nt, Human
gagguugcggugagucgagaucacgccauugc

SEQ ID NO: 428346 - RNA, 32 nt, Human
gagguugcguugagccaagaucgcgccacugc

SEQ ID NO: 428347 - RNA, 32 nt, Human
gagguugcugugagccaagaucgcaccauugc

SEQ ID NO: 428348 - RNA, 32 nt, Human
gagguuggaaacauugguaaacucuguugauu

SEQ ID NO: 428349 - RNA, 32 nt, Human
gagguuggaaagagaagagaggcugggagcgg

SEQ ID NO: 428350 - RNA, 32 nt, Human
gagguuggagagaaagaacagaccagcgcccu

SEQ ID NO: 428351 - RNA, 32 nt, Human
gagguuggaggaucacuugaguccaggagucc

SEQ ID NO: 428352 - RNA, 32 nt, Human
gagguuggauuuaaccacagaggcagaaaguu

SEQ ID NO: 428353 - RNA, 32 nt, Human
gagguuggcuuuaacccaggaggcagagguug

SEQ ID NO: 428354 - RNA, 23 nt, Human
gagguugggaguucaagaccagc

SEQ ID NO: 428355 - RNA, 23 nt, Human
gagguugggaguucaagaccagu

SEQ ID NO: 428356 - RNA, 23 nt, Human
gagguugggaguucgagaccagc

SEQ ID NO: 428357 - RNA, 23 nt, Human
gagguugggaguucgaggccagc

SEQ ID NO: 428358 - RNA, 23 nt, Human
gagguugggaguucgcgaccagc

SEQ ID NO: 428359 - RNA, 24 nt, Human
gagguuggggcagaauugcuugaa

SEQ ID NO: 428360 - RNA, 32 nt, Human
gagguugggggcccuggccagggacaucugcc

SEQ ID NO: 428361 - RNA, 32 nt, Human
gagguuggguacgggaugcggggucuuugacu

SEQ ID NO: 428362 - RNA, 32 nt, Human
gagguuggguuucagaccaagacacuggauuc

SEQ ID NO: 428363 - RNA, 32 nt, Human
gagguugguccacagcacuccauucugggugg

SEQ ID NO: 428364 - RNA, 32 nt, Human
gagguugguuccuugucugugaugauuugcaa

SEQ ID NO: 428365 - RNA, 32 nt, Human
gagguuguaccacugcacuccagccuggcuga

SEQ ID NO: 428366 - RNA, 32 nt, Human
gagguuguagcgagccaagaucacaccauugc

SEQ ID NO: 428367 - RNA, 32 nt, Human
gagguuguagggagcuaugaucuugccauugc

SEQ ID NO: 428368 - RNA, 32 nt, Human
gagguuguagugagccaagauccagccugggc

SEQ ID NO: 428369 - RNA, 32 nt, Human
gagguuguagugagccaagaucgcaccauugc

SEQ ID NO: 428370 - RNA, 32 nt, Human
gagguuguagugagccaagaucgugccacugc

SEQ ID NO: 428371 - RNA, 32 nt, Human
gagguuguagugagccaaggucgcgccacugc

SEQ ID NO: 428372 - RNA, 32 nt, Human
gagguuguagugagcuacgaucaugccacugc

SEQ ID NO: 428373 - RNA, 32 nt, Human
gagguuguagugagcugagaucgcaccacugc

SEQ ID NO: 428374 - RNA, 32 nt, Human
gagguuguagugagcugagaucgcgccacugc

SEQ ID NO: 428375 - RNA, 32 nt, Human
gagguuguagugagcugagaucgugccacugc

SEQ ID NO: 428376 - RNA, 32 nt, Human
gagguuguagugagcugagauggggccacugc

SEQ ID NO: 428377 - RNA, 32 nt, Human
gagguuguagugagcugagauugcaccacugc

SEQ ID NO: 428378 - RNA, 32 nt, Human
gagguuguagugagcugagauugugccauugc

SEQ ID NO: 428379 - RNA, 32 nt, Human
gagguuguauaagguguucuuggaaggaaggg

SEQ ID NO: 428380 - RNA, 32 nt, Human
gagguugucaccacucagacuucaccuauuca

SEQ ID NO: 428381 - RNA, 32 nt, Human
gagguugucucugaaccaggagagaagguacu

SEQ ID NO: 428382 - RNA, 32 nt, Human
gagguugugaugagccaagauugagccaaaaa

SEQ ID NO: 428383 - RNA, 32 nt, Human
gagguugugaugagccaaggucaugccacugc

SEQ ID NO: 428384 - RNA, 32 nt, Human
gagguugugccacugcacuccagccuggguga

SEQ ID NO: 428385 - RNA, 32 nt, Human
gagguugugccacugcacugcagccugggcua

SEQ ID NO: 428386 - RNA, 32 nt, Human
gagguuguggcggagguuguggugagcugaga

SEQ ID NO: 428387 - RNA, 24 nt, Human
gagguuguggcugcagugagcugu

SEQ ID NO: 428388 - RNA, 32 nt, Human
gagguuguggugagccaacaucacaccauugc

SEQ ID NO: 428389 - RNA, 32 nt, Human
gagguuguggugagccaagaucaugccacugc

SEQ ID NO: 428390 - RNA, 32 nt, Human
gagguuguggugagccaagaucgcgccguugc

SEQ ID NO: 428391 - RNA, 32 nt, Human
gagguuguggugagccaagaucgugccacugc

SEQ ID NO: 428392 - RNA, 32 nt, Human
gagguuguggugagccaagaucgugccauugc

SEQ ID NO: 428393 - RNA, 32 nt, Human
gagguuguggugagccaagguugcgccacugc

SEQ ID NO: 428394 - RNA, 32 nt, Human
gagguuguggugagccaauaucaugccacugc

SEQ ID NO: 428395 - RNA, 32 nt, Human
gagguuguggugagccaugaucgcaccacugc

SEQ ID NO: 428396 - RNA, 32 nt, Human
gagguuguggugagccgagaucacgccacugc

SEQ ID NO: 428397 - RNA, 32 nt, Human
gagguuguggugagccgagaucgcaccauugc

SEQ ID NO: 428398 - RNA, 32 nt, Human
gagguuguggugagccgagaucgcgccaguac

SEQ ID NO: 428399 - RNA, 32 nt, Human
gagguuguggugagccgagaucgcgccauugc

SEQ ID NO: 428400 - RNA, 32 nt, Human
gagguuguggugagccgagaucgugccacugu

SEQ ID NO: 428401 - RNA, 32 nt, Human
gagguuguggugagccgagaucgugccauugc

SEQ ID NO: 428402 - RNA, 32 nt, Human
gagguuguggugagccgagauugcaccacugc

SEQ ID NO: 428403 - RNA, 32 nt, Human
gagguuguggugagccgagauugcaccauugc

SEQ ID NO: 428404 - RNA, 32 nt, Human
gagguuguggugagccgagauugcaccuuugu

SEQ ID NO: 428405 - RNA, 32 nt, Human
gagguuguggugagccgagauugcuccauugc

SEQ ID NO: 428406 - RNA, 32 nt, Human
gagguuguggugagcuaagaucacgccauugc

SEQ ID NO: 428407 - RNA, 32 nt, Human
gagguuguggugagcugaaaugacgccauugc

SEQ ID NO: 428408 - RNA, 32 nt, Human
gagguuguggugagcugagaucacacuacugc

SEQ ID NO: 428409 - RNA, 32 nt, Human
gagguuguggugagcugagaucacgccauugc

SEQ ID NO: 428410 - RNA, 32 nt, Human
gagguuguggugagcugagaucaugccacugc

SEQ ID NO: 428411 - RNA, 32 nt, Human
gagguuguggugagcugagaucgcaccauugc

SEQ ID NO: 428412 - RNA, 32 nt, Human
gagguuguggugagcugagaucgcgccacugc

SEQ ID NO: 428413 - RNA, 32 nt, Human
gagguuguggugagcugagaucgugccauugc

SEQ ID NO: 428414 - RNA, 32 nt, Human
gagguuguggugagcugagauggugccauugc

SEQ ID NO: 428415 - RNA, 32 nt, Human
gagguuguggugagcugagauugcaccauugc

SEQ ID NO: 428416 - RNA, 32 nt, Human
gagguuguggugagcugagauugcgccauugc

SEQ ID NO: 428417 - RNA, 32 nt, Human
gagguuguggugaggcgagauagugccacugc

SEQ ID NO: 428418 - RNA, 32 nt, Human
gagguuguggugagucgagaucauugcacucc

SEQ ID NO: 428419 - RNA, 24 nt, Human
gagguugugguugcagugagcuau

SEQ ID NO: 428420 - RNA, 32 nt, Human
gagguugugucauugcacuccagccuggggaa

SEQ ID NO: 428421 - RNA, 32 nt, Human
gagguuguguugagccaagaucgugccauucc

SEQ ID NO: 428422 - RNA, 32 nt, Human
gagguuguuaagauuuacaguaagaaugaauc

SEQ ID NO: 428423 - RNA, 32 nt, Human
gagguuguuauuguucagagaugagggauguc

SEQ ID NO: 428424 - RNA, 32 nt, Human
gagguuuagaacuuacccaauauuggacagca

SEQ ID NO: 428425 - RNA, 32 nt, Human
gagguuucagugagccaagaucacaccacugc

SEQ ID NO: 428426 - RNA, 32 nt, Human
gagguuucagugagccaagaucgcaccacugc

SEQ ID NO: 428427 - RNA, 32 nt, Human
gagguuucagugagccgagaucaugccacugc

SEQ ID NO: 428428 - RNA, 32 nt, Human
gagguuucccuguguugcccaggcuggucuug

SEQ ID NO: 428429 - RNA, 32 nt, Human
gagguuuccucacuagacaacucucuuucgca

SEQ ID NO: 428430 - RNA, 32 nt, Human
gagguuuccugccuccuucccgaggcuacagc

SEQ ID NO: 428431 - RNA, 32 nt, Human
gagguuuccuucucccuguggccuuuucccag

SEQ ID NO: 428432 - RNA, 32 nt, Human
gagguuucucaaggagcuggagacuucaggga

SEQ ID NO: 428433 - RNA, 32 nt, Human
gagguuucuccauguuggucaggcuggucucg

SEQ ID NO: 428434 - RNA, 32 nt, Human
gagguuucuccauuuuggucaggcuggucuca

SEQ ID NO: 428435 - RNA, 32 nt, Human
gagguuucucugcuucggcugugcuugaagug

SEQ ID NO: 428436 - RNA, 32 nt, Human
gagguuugcugccugccuucuugccaugucua

SEQ ID NO: 428437 - RNA, 32 nt, Human
gagguuuggggccagacccccacuagcuggga

SEQ ID NO: 428438 - RNA, 32 nt, Human
gagguuugguucacaucauaaaagaaaaggga

SEQ ID NO: 428439 - RNA, 32 nt, Human
gagguuuucaaaugaugagggacccaagggcu

SEQ ID NO: 428440 - RNA, 32 nt, Human
gagguuuugaacaccacucaugugccaggugu

SEQ ID NO: 428441 - RNA, 32 nt, Human
gagguuuugccucauuccacacagcuuccaua

SEQ ID NO: 428442 - RNA, 32 nt, Human
gagguuuugcuggccagguaugguggcucacg

SEQ ID NO: 428443 - RNA, 32 nt, Human
gagguuuugguaauuuuuccuaugcauugggc

SEQ ID NO: 428444 - RNA, 32 nt, Human
gagguuuuucuucuugguccuuccugagaccu

SEQ ID NO: 428445 - RNA, 32 nt, Human
gaguaaaagagugcuuaugggaaagcaaauga

SEQ ID NO: 428446 - RNA, 32 nt, Human
gaguaaacaugagccucugguagauaagagaa

SEQ ID NO: 428447 - RNA, 32 nt, Human
gaguaaacccagaccuggucaccugucuggag

SEQ ID NO: 428448 - RNA, 19 nt, Human
gaguaaacccagcucccac

SEQ ID NO: 428449 - RNA, 32 nt, Human
gaguaaaguuagggagcuagaugaguaaacau

SEQ ID NO: 428450 - RNA, 32 nt, Human
gaguaaaguuugaagagauaaaaauagccaaa

SEQ ID NO: 428451 - RNA, 32 nt, Human
gaguaaaugcagccaguuuacaggcaugcugg

SEQ ID NO: 428452 - RNA, 32 nt, Human
gaguaaaugccacaacuguacuuuuccaaaga

SEQ ID NO: 428453 - RNA, 32 nt, Human
gaguaaauuuugcuugcaugugcuaauaugaa

SEQ ID NO: 428454 - RNA, 32 nt, Human
gaguaacaggaaaauuuuaaaaauacagauag

SEQ ID NO: 428455 - RNA, 32 nt, Human
gaguaacagggcagaaaugauuaaaauguuug

SEQ ID NO: 428456 - RNA, 32 nt, Human
gaguaacaugaugagacccccaucucuacaaa

SEQ ID NO: 428457 - RNA, 32 nt, Human
gaguaacauggugaaaccccaucucuacgaaa

SEQ ID NO: 428458 - RNA, 32 nt, Human
gaguaaccaaagagaguauggaccagagugaa

SEQ ID NO: 428459 - RNA, 32 nt, Human
gaguaaccaaggaggggguaguugaaaaaucc

SEQ ID NO: 428460 - RNA, 32 nt, Human
gaguaaccacugaccugugagcuggguccagg

SEQ ID NO: 428461 - RNA, 32 nt, Human
gaguaaccaggcgaaugugcccccaggagagu

SEQ ID NO: 428462 - RNA, 32 nt, Human
gaguaaccccucuuuccuguuaauccagaggg

SEQ ID NO: 428463 - RNA, 32 nt, Human
gaguaaccuugagauugggaggaauagaggag

SEQ ID NO: 428464 - RNA, 32 nt, Human
gaguaacgaugaagucaugagaggagguucaa

SEQ ID NO: 428465 - RNA, 32 nt, Human
gaguaacuacacaaagauaauguaauaagccu

SEQ ID NO: 428466 - RNA, 32 nt, Human
gaguaacugcaagaucuccuacggggaugggc

SEQ ID NO: 428467 - RNA, 32 nt, Human
gaguaacugcugguagugccuucuuugguugu

SEQ ID NO: 428468 - RNA, 32 nt, Human
gaguaacuggacauuucaccuucaccuuacac

SEQ ID NO: 428469 - RNA, 21 nt, Human
gaguaacugggacuacaggug

SEQ ID NO: 428470 - RNA, 19 nt, Human
gaguaacugggauuacagg

SEQ ID NO: 428471 - RNA, 23 nt, Human
gaguaagagagcagagcagaacc

SEQ ID NO: 428472 - RNA, 32 nt, Human
gaguaagcccuugcucaguaaauuuaauugaa

SEQ ID NO: 428473 - RNA, 19 nt, Human
gaguaagggggcugggaga

SEQ ID NO: 428474 - RNA, 32 nt, Human
gaguaaguccucugucuuggcacagcaauaua

SEQ ID NO: 428475 - RNA, 21 nt, Human
gaguaagucugcccuuugcca

SEQ ID NO: 428476 - RNA, 32 nt, Human
gaguaauaaagauacaaaauguuacugcugau

SEQ ID NO: 428477 - RNA, 32 nt, Human
gaguaauaaugucucuucaaagggagcuggag

SEQ ID NO: 428478 - RNA, 32 nt, Human
gaguaauaguuggaaucaaaagagucaacgca

SEQ ID NO: 428479 - RNA, 32 nt, Human
gaguaaugcuuuugagauaaaggaaccuugug

SEQ ID NO: 428480 - RNA, 32 nt, Human
gaguaauggaaagacuaauggaagaauugaua

SEQ ID NO: 428481 - RNA, 32 nt, Human
gaguaauggagacaaaucaaagagacauaaag

SEQ ID NO: 428482 - RNA, 25 nt, Human
gaguaauggucccccaagauaucca

SEQ ID NO: 428483 - RNA, 32 nt, Human
gaguaauucugugcuugacaaaggacgauuuc

SEQ ID NO: 428484 - RNA, 32 nt, Human
gaguacaaacugcaccaagcccuggagaccca

SEQ ID NO: 428485 - RNA, 32 nt, Human
gaguacaaaggccauguggugaaaggaaguau

SEQ ID NO: 428486 - RNA, 32 nt, Human
gaguacacaaguauaguggcccaggauguagu

SEQ ID NO: 428487 - RNA, 32 nt, Human
gaguacagcagugccaucauagcucacugaag

SEQ ID NO: 428488 - RNA, 32 nt, Human
gaguacagccuauuauauucccacauccugag

SEQ ID NO: 428489 - RNA, 32 nt, Human
gaguacagccucccuccuggcugcuuucucag

SEQ ID NO: 428490 - RNA, 21 nt, Human
gaguacaucaagaagaaacug

SEQ ID NO: 428491 - RNA, 32 nt, Human
gaguacauccagccuuaguucuuggggugcag

SEQ ID NO: 428492 - RNA, 32 nt, Human
gaguacauggcagaagugggcauauuucagag

SEQ ID NO: 428493 - RNA, 32 nt, Human
gaguacauguauuauauacaagcacaacaggg

SEQ ID NO: 428494 - RNA, 32 nt, Human
gaguaccacaaccaccaccagugcuaccaccg

SEQ ID NO: 428495 - RNA, 32 nt, Human
gaguaccacauccugaccccacuuguuugcaa

SEQ ID NO: 428496 - RNA, 32 nt, Human
gaguacccauaacuacccaucguuuagauaca

SEQ ID NO: 428497 - RNA, 32 nt, Human
gaguacccggaugggaauggcaauggccuagc

SEQ ID NO: 428498 - RNA, 32 nt, Human
gaguacccugcagugugaggugucagugugca

SEQ ID NO: 428499 - RNA, 18 nt, Human
gaguaccgaccuauccca

SEQ ID NO: 428500 - RNA, 32 nt, Human
gaguaccugcuguugcucucaugccucuugcc

SEQ ID NO: 428501 - RNA, 19 nt, Human
gaguaccugggauuacagg

SEQ ID NO: 428502 - RNA, 32 nt, Human
gaguaccuucuaaagcaccauaugaggaaaaa

SEQ ID NO: 428503 - RNA, 32 nt, Human
gaguaccuuuguuuucuugaucuguuacuuuu

SEQ ID NO: 428504 - RNA, 32 nt, Human
gaguaccuuuucucccuggccuucugcuccaa

SEQ ID NO: 428505 - RNA, 32 nt, Human
gaguacgaggggcacccugggggcucccaccc

SEQ ID NO: 428506 - RNA, 32 nt, Human
gaguacgcaccccagacccauggcagcagaac

SEQ ID NO: 428507 - RNA, 25 nt, Human
gaguacgucgggcaggaagggaagc

SEQ ID NO: 428508 - RNA, 32 nt, Human
gaguacguggaggaacuccuacauuuuaggcu

SEQ ID NO: 428509 - RNA, 32 nt, Human
gaguacguugaagaagaaagaagagaaaggua

SEQ ID NO: 428510 - RNA, 32 nt, Human
gaguacuaacagcuuccuucagaucuggaagc

SEQ ID NO: 428511 - RNA, 32 nt, Human
gaguacuaacagguuguccugucccauaccug

SEQ ID NO: 428512 - RNA, 32 nt, Human
gaguacuaauugauuccuccauccuugaauca

SEQ ID NO: 428513 - RNA, 32 nt, Human
gaguacuagaauuuguauuuugcuuaaaauuu

SEQ ID NO: 428514 - RNA, 32 nt, Human
gaguacuauggauaggccugaaugaagucaua

SEQ ID NO: 428515 - RNA, 32 nt, Human
gaguacuccacacugcacaauaacuccuccca

SEQ ID NO: 428516 - RNA, 32 nt, Human
gaguacucuccccagacagccagaaggcccuu

SEQ ID NO: 428517 - RNA, 32 nt, Human
gaguacucugcagcuggcgaggaguugguuga

SEQ ID NO: 428518 - RNA, 32 nt, Human
gaguacugacaccagacaaagacuccaaaguc

SEQ ID NO: 428519 - RNA, 32 nt, Human
gaguacugcagaacugacauuuugacggucua

SEQ ID NO: 428520 - RNA, 18 nt, Human
gaguacugggauuacagg

SEQ ID NO: 428521 - RNA, 32 nt, Human
gaguacugggauuacaggcgcccaccaccacg

SEQ ID NO: 428522 - RNA, 32 nt, Human
gaguacugucucaucucaucauauucacgggu

SEQ ID NO: 428523 - RNA, 22 nt, Human
gaguacuguuuuuuaaaagguc

SEQ ID NO: 428524 - RNA, 32 nt, Human
gaguacuuaacaccaucauccaucuguguggc

SEQ ID NO: 428525 - RNA, 32 nt, Human
gaguacuuagucuucucccccuucccuggggc

SEQ ID NO: 428526 - RNA, 32 nt, Human
gaguacuucauuaggacaagugagaaucagcu

SEQ ID NO: 428527 - RNA, 32 nt, Human
gaguacuucuucuguuggcagcuaugauuuaa

SEQ ID NO: 428528 - RNA, 32 nt, Human
gaguacuuguaacugucagaagaaggauggug

SEQ ID NO: 428529 - RNA, 32 nt, Human
gaguagaaaccaaaugugaauagccacaucuu

SEQ ID NO: 428530 - RNA, 32 nt, Human
gaguagaaagaugcucauagcacacgcaauau

SEQ ID NO: 428531 - RNA, 20 nt, Human
gaguagaaaucuggugaccu

SEQ ID NO: 428532 - RNA, 32 nt, Human
gaguagaaaugggguuucaccauguuagccag

SEQ ID NO: 428533 - RNA, 32 nt, Human
gaguagaacuucauggaggaacacggagugac

SEQ ID NO: 428534 - RNA, 32 nt, Human
gaguagaagcccagaguggagaugccugcuga

SEQ ID NO: 428535 - RNA, 32 nt, Human
gaguagaaggcagggagaaacuggguucuggu

SEQ ID NO: 428536 - RNA, 20 nt, Human
gaguagaagguggugaccuc

SEQ ID NO: 428537 - RNA, 32 nt, Human
gaguagagaaaaugguuucucaaggagauugg

SEQ ID NO: 428538 - RNA, 32 nt, Human
gaguagagaaugcacagguguuggugagggcg

SEQ ID NO: 428539 - RNA, 32 nt, Human
gaguagagacgggguuucaccauguuggccag

SEQ ID NO: 428540 - RNA, 32 nt, Human
gaguagagacgggguuucaccguguuagccag

SEQ ID NO: 428541 - RNA, 32 nt, Human
gaguagagaucugccaaguugccuuacagagc

SEQ ID NO: 428542 - RNA, 32 nt, Human
gaguagagaugcugggacugaggguggagcag

SEQ ID NO: 428543 - RNA, 32 nt, Human
gaguagagaugggaguuucaccauguuggcca

SEQ ID NO: 428544 - RNA, 32 nt, Human
gaguagagcgaaggcauuugguggaucgguca

SEQ ID NO: 428545 - RNA, 32 nt, Human
gaguagaggaagaggaaggacuaacgcagagg

SEQ ID NO: 428546 - RNA, 32 nt, Human
gaguagaggacacuggcaggagaguagcugga

SEQ ID NO: 428547 - RNA, 32 nt, Human
gaguagaucagaccucuugaaaaugcuuauuc

SEQ ID NO: 428548 - RNA, 32 nt, Human
gaguagaugaugaggcccaugccccucacccc

SEQ ID NO: 428549 - RNA, 19 nt, Human
gaguagaugggauuacagg

SEQ ID NO: 428550 - RNA, 32 nt, Human
gaguagauuccaccccugcugcccaccaaugg

SEQ ID NO: 428551 - RNA, 32 nt, Human
gaguagcacaugccaccaugccuggcuaauuu

SEQ ID NO: 428552 - RNA, 32 nt, Human
gaguagcacugcacugucaccugaugauuggc

SEQ ID NO: 428553 - RNA, 18 nt, Human
gaguagcaggagggucuu

SEQ ID NO: 428554 - RNA, 31 nt, Human
gaguagcaggggcagcaccucucacaggggc

SEQ ID NO: 428555 - RNA, 32 nt, Human
gaguagcaggguggggcgccugaguuggcagc

SEQ ID NO: 428556 - RNA, 31 nt, Human
gaguagcauaauaaauauuuucugugaaugu

SEQ ID NO: 428557 - RNA, 32 nt, Human
gaguagccaagcugcuuguccugggccugccc

SEQ ID NO: 428558 - RNA, 32 nt, Human
gaguagccacugcacuccagccugggcaacgu

SEQ ID NO: 428559 - RNA, 32 nt, Human
gaguagccccagaaaaaggcaggcagugggag

SEQ ID NO: 428560 - RNA, 19 nt, Human
gaguagcggggauuacagg

SEQ ID NO: 428561 - RNA, 31 nt, Human
gaguagcggguggaaagcuggacuggaguuc

SEQ ID NO: 428562 - RNA, 32 nt, Human
gaguagcgugugccaccaugccuggcuaauuu

SEQ ID NO: 428563 - RNA, 32 nt, Human
gaguagcuaaagcugagauuacaggcaugcgc

SEQ ID NO: 428564 - RNA, 32 nt, Human
gaguagcuaaugcaccuugagaaaaaucuggc

SEQ ID NO: 428565 - RNA, 21 nt, Human
gaguagcuaggacuacaggca

SEQ ID NO: 428566 - RNA, 21 nt, Human
gaguagcuaggacuacaggug

SEQ ID NO: 428567 - RNA, 21 nt, Human
gaguagcuaggacugcaggug

SEQ ID NO: 428568 - RNA, 19 nt, Human
gaguagcuaggauuacagg

SEQ ID NO: 428569 - RNA, 21 nt, Human
gaguagcuaggauuacaggug

SEQ ID NO: 428570 - RNA, 32 nt, Human
gaguagcucccagggguucaggugguggagca

SEQ ID NO: 428571 - RNA, 32 nt, Human
gaguagcucuucuguccaaaccaugauuugag

SEQ ID NO: 428572 - RNA, 21 nt, Human
gaguagcugagaccacaggug

SEQ ID NO: 428573 - RNA, 21 nt, Human
gaguagcugagacuacaggug

SEQ ID NO: 428574 - RNA, 19 nt, Human
gaguagcugagauuacagg

SEQ ID NO: 428575 - RNA, 20 nt, Human
gaguagcugagauuacaggu

SEQ ID NO: 428576 - RNA, 21 nt, Human
gaguagcugagauuacaggug

SEQ ID NO: 428577 - RNA, 21 nt, Human
gaguagcuggaaccacaggug

SEQ ID NO: 428578 - RNA, 21 nt, Human
gaguagcuggaacuacaggug

SEQ ID NO: 428579 - RNA, 19 nt, Human
gaguagcuggaauuacagg

SEQ ID NO: 428580 - RNA, 20 nt, Human
gaguagcuggaauuacaggu

SEQ ID NO: 428581 - RNA, 21 nt, Human
gaguagcuggaauuacaggug

SEQ ID NO: 428582 - RNA, 21 nt, Human
gaguagcuggaauuauaggug

SEQ ID NO: 428583 - RNA, 32 nt, Human
gaguagcuggauuacaggcaugugccacccac

SEQ ID NO: 428584 - RNA, 19 nt, Human
gaguagcuggcauuacagg

SEQ ID NO: 428585 - RNA, 20 nt, Human
gaguagcugggacaacaggu

SEQ ID NO: 428586 - RNA, 21 nt, Human
gaguagcugggaccacaggug

SEQ ID NO: 428587 - RNA, 21 nt, Human
gaguagcugggaccacaguug

SEQ ID NO: 428588 - RNA, 21 nt, Human
gaguagcugggaccacaugug

SEQ ID NO: 428589 - RNA, 21 nt, Human
gaguagcugggacuacaagug

SEQ ID NO: 428590 - RNA, 19 nt, Human
gaguagcugggacuacagg

SEQ ID NO: 428591 - RNA, 32 nt, Human
gaguagcugggacuacaggaauuaguaaccuu

SEQ ID NO: 428592 - RNA, 32 nt, Human
gaguagcugggacuacaggauuacaguuuaaa

SEQ ID NO: 428593 - RNA, 20 nt, Human
gaguagcugggacuacaggu

SEQ ID NO: 428594 - RNA, 21 nt, Human
gaguagcugggacuacaggug

SEQ ID NO: 428595 - RNA, 21 nt, Human
gaguagcugggacuacaguug

SEQ ID NO: 428596 - RNA, 21 nt, Human
gaguagcugggacuauaggug

SEQ ID NO: 428597 - RNA, 19 nt, Human
gaguagcugggacugcagg

SEQ ID NO: 428598 - RNA, 21 nt, Human
gaguagcugggacugcaggug

SEQ ID NO: 428599 - RNA, 19 nt, Human
gaguagcugggacugcggg

SEQ ID NO: 428600 - RNA, 21 nt, Human
gaguagcugggacuucaggug

SEQ ID NO: 428601 - RNA, 19 nt, Human
gaguagcugggaguacagg

SEQ ID NO: 428602 - RNA, 21 nt, Human
gaguagcugggaguacaggug

SEQ ID NO: 428603 - RNA, 21 nt, Human
gaguagcugggaucacaggug

SEQ ID NO: 428604 - RNA, 21 nt, Human
gaguagcugggauuacaagug

SEQ ID NO: 428605 - RNA, 18 nt, Human
gaguagcugggauuacag

SEQ ID NO: 428606 - RNA, 19 nt, Human
gaguagcugggauuacagg

SEQ ID NO: 428607 - RNA, 32 nt, Human
gaguagcugggauuacaggccuguauggugga

SEQ ID NO: 428608 - RNA, 20 nt, Human
gaguagcugggauuacaggu

SEQ ID NO: 428609 - RNA, 21 nt, Human
gaguagcugggauuacaggug

SEQ ID NO: 428610 - RNA, 19 nt, Human
gaguagcugggauuacggg

SEQ ID NO: 428611 - RNA, 21 nt, Human
gaguagcugggauuacgggug

SEQ ID NO: 428612 - RNA, 21 nt, Human
gaguagcugggauuacuggug

SEQ ID NO: 428613 - RNA, 19 nt, Human
gaguagcugggauuauagg

SEQ ID NO: 428614 - RNA, 21 nt, Human
gaguagcugggauuccaggug

SEQ ID NO: 428615 - RNA, 19 nt, Human
gaguagcugggauugcagg

SEQ ID NO: 428616 - RNA, 20 nt, Human
gaguagcugggauugcaggu

SEQ ID NO: 428617 - RNA, 21 nt, Human
gaguagcugggauugcaggug

SEQ ID NO: 428618 - RNA, 21 nt, Human
gaguagcugggauuuuaggug

SEQ ID NO: 428619 - RNA, 19 nt, Human
gaguagcugggguuacagg

SEQ ID NO: 428620 - RNA, 21 nt, Human
gaguagcugguacuacaggug

SEQ ID NO: 428621 - RNA, 19 nt, Human
gaguagcugguauuacagg

SEQ ID NO: 428622 - RNA, 19 nt, Human
gaguagcuuggauuacagg

SEQ ID NO: 428623 - RNA, 32 nt, Human
gaguaggaagcagcuucccagcugcagucugc

SEQ ID NO: 428624 - RNA, 32 nt, Human
gaucauaccacugcacuccagccugggcgaca

SEQ ID NO: 428625 - RNA, 32 nt, Human
gaucauaccacugcacuccagccugggugaca

SEQ ID NO: 428626 - RNA, 32 nt, Human
gaucauaccacugcacuccagucugggcaaca

SEQ ID NO: 428627 - RNA, 32 nt, Human
gaucauaccacugcacugcagccugagugaca

SEQ ID NO: 428628 - RNA, 32 nt, Human
gaucauaccacuucauuccagccugggugaca

SEQ ID NO: 428629 - RNA, 32 nt, Human
gaucauaccauugcacuccagccuaggcaaca

SEQ ID NO: 428630 - RNA, 32 nt, Human
gaucauaccauugcacuccagccugggcaaca

SEQ ID NO: 428631 - RNA, 32 nt, Human
gaucauacuacugcacuccagccugggcgaca

SEQ ID NO: 428632 - RNA, 32 nt, Human
gaucauagcacacugcagccuggaacuccugg

SEQ ID NO: 428633 - RNA, 32 nt, Human
gaucauagcucacaccuguaaucccagccugg

SEQ ID NO: 428634 - RNA, 32 nt, Human
gaucauagcucacuccagccugaagcaagccu

SEQ ID NO: 428635 - RNA, 21 nt, Human
gaucauagcucacugcagcuu

SEQ ID NO: 428636 - RNA, 27 nt, Human
gaucauagcuccccuucacuucugucu

SEQ ID NO: 428637 - RNA, 32 nt, Human
gaucauagcuuacugcagccucgaacuccuga

SEQ ID NO: 428638 - RNA, 31 nt, Human
gaucauaggaaacugccccugagcucacaca

SEQ ID NO: 428639 - RNA, 31 nt, Human
gaucauaggcacugauuuccuaugcuaaggu

SEQ ID NO: 428640 - RNA, 32 nt, Human
gaucauaggcagcaagggcugauucuaggaua

SEQ ID NO: 428641 - RNA, 32 nt, Human
gaucauaggcucuucagagaacugaauggcag

SEQ ID NO: 428642 - RNA, 32 nt, Human
gaucauaucacugcacuccagccuggcugaca

SEQ ID NO: 428643 - RNA, 32 nt, Human
gaucauauccucucucacccugcugcauccag

SEQ ID NO: 428644 - RNA, 32 nt, Human
gaucauauuuugcuuucuauggcuucuccuua

SEQ ID NO: 428645 - RNA, 21 nt, Human
gaucaucagaaggcgcggacc

SEQ ID NO: 428646 - RNA, 32 nt, Human
gaucaucagaggcugaaaucuagaacuucauc

SEQ ID NO: 428647 - RNA, 32 nt, Human
gaucaucagccacugaggccaguggaauuucc

SEQ ID NO: 428648 - RNA, 32 nt, Human
gaucaucauuagcugugaagauuugaguugua

SEQ ID NO: 428649 - RNA, 32 nt, Human
gaucaucauuuauuuuccauugucugucuucg

SEQ ID NO: 428650 - RNA, 32 nt, Human
gaucaucugccgugccuggauccugaaauaga

SEQ ID NO: 428651 - RNA, 23 nt, Human
gaucaucuggaggccggcuuugu

SEQ ID NO: 428652 - RNA, 32 nt, Human
gaucaucugggcaggacauggggacgaguguc

SEQ ID NO: 428653 - RNA, 32 nt, Human
gaucaucugugcuuggggcugccugaggcucc

SEQ ID NO: 428654 - RNA, 32 nt, Human
gaucaugaagucaggaguucgagaccagccug

SEQ ID NO: 428655 - RNA, 32 nt, Human
gaucaugacacugcacuccagccugggcaaca

SEQ ID NO: 428656 - RNA, 32 nt, Human
gaucaugaggaguuacuaugcccagccaacau

SEQ ID NO: 428657 - RNA, 32 nt, Human
gaucaugagguuaggagagcgagaccauccug

SEQ ID NO: 428658 - RNA, 32 nt, Human
gaucaugauauuccuucuauccaugugccaaa

SEQ ID NO: 428659 - RNA, 32 nt, Human
gaucaugcagagcgaagccaccaagacuuuau

SEQ ID NO: 428660 - RNA, 32 nt, Human
gaucaugccacaccguacuccagccugggcga

SEQ ID NO: 428661 - RNA, 32 nt, Human
gaucaugccacaucacuccagccugggcaaca

SEQ ID NO: 428662 - RNA, 32 nt, Human
gaucaugccaccgcacuccagccugggcaaca

SEQ ID NO: 428663 - RNA, 32 nt, Human
gaucaugccaccgcacuucagccugggugaca

SEQ ID NO: 428664 - RNA, 32 nt, Human
gaucaugccaccgcacuuccagccugggugac

SEQ ID NO: 428665 - RNA, 32 nt, Human
gaucaugccacuacacuccagccuggcgacag

SEQ ID NO: 428666 - RNA, 32 nt, Human
gaucaugccacuccacuccagucugggcgaca

SEQ ID NO: 428667 - RNA, 32 nt, Human
gaucaugccacugaacuccagccugggcaaca

SEQ ID NO: 428668 - RNA, 32 nt, Human
gaucaugccacugaacuccagccugggugaca

SEQ ID NO: 428669 - RNA, 32 nt, Human
gaucaugccacugcaaucuagccugggugaca

SEQ ID NO: 428670 - RNA, 32 nt, Human
gaucaugccacugcacccaucuugggcaacag

SEQ ID NO: 428671 - RNA, 32 nt, Human
gaucaugccacugcaccccagcaccuggcuac

SEQ ID NO: 428672 - RNA, 32 nt, Human
gaucaugccacugcaccccagccugggcaaca

SEQ ID NO: 428673 - RNA, 32 nt, Human
gaucaugccacugcacccuagcuuggguggca

SEQ ID NO: 428674 - RNA, 32 nt, Human
gaucaugccacugcacuagagccugggcaaca

SEQ ID NO: 428675 - RNA, 32 nt, Human
gaucaugccacugcacuccaaccugggcaaca

SEQ ID NO: 428676 - RNA, 32 nt, Human
gaucaugccacugcacuccaaccugggcagca

SEQ ID NO: 428677 - RNA, 32 nt, Human
gaucaugccacugcacuccaaccugggcgaca

SEQ ID NO: 428678 - RNA, 32 nt, Human
gaucaugccacugcacuccaaccugggugaca

SEQ ID NO: 428679 - RNA, 32 nt, Human
gaucaugccacugcacuccacucugggcaaca

SEQ ID NO: 428680 - RNA, 32 nt, Human
gaucaugccacugcacuccagcaugggugaug

SEQ ID NO: 428681 - RNA, 32 nt, Human
gaucaugccacugcacuccagcccaggugaca

SEQ ID NO: 428682 - RNA, 32 nt, Human
gaucaugccacugcacuccagccuaugugacu

SEQ ID NO: 428683 - RNA, 32 nt, Human
gaucaugccacugcacuccagccugagugaca

SEQ ID NO: 428684 - RNA, 32 nt, Human
gaucaugccacugcacuccagccuggacaaca

SEQ ID NO: 428685 - RNA, 32 nt, Human
gaucaugccacugcacuccagccuggaugaca

SEQ ID NO: 428686 - RNA, 32 nt, Human
gaucaugccacugcacuccagccugggcaaca

SEQ ID NO: 428687 - RNA, 32 nt, Human
gaucaugccacugcacuccagccugggcaacc

SEQ ID NO: 428688 - RNA, 32 nt, Human
gaucaugccacugcacuccagccugggcaaug

SEQ ID NO: 428689 - RNA, 32 nt, Human
gaucaugccacugcacuccagccugggcagca

SEQ ID NO: 428690 - RNA, 32 nt, Human
gaucaugccacugcacuccagccugggcauga

SEQ ID NO: 428691 - RNA, 32 nt, Human
gaucaugccacugcacuccagccugggccaga

SEQ ID NO: 428692 - RNA, 32 nt, Human
gaucaugccacugcacuccagccugggcgaca

SEQ ID NO: 428693 - RNA, 32 nt, Human
gaucaugccacugcacuccagccugggcgacg

SEQ ID NO: 428694 - RNA, 32 nt, Human
gaucaugccacugcacuccagccugggcgaug

SEQ ID NO: 428695 - RNA, 32 nt, Human
gaucaugccacugcacuccagccugggcggca

SEQ ID NO: 428696 - RNA, 32 nt, Human
gaucaugccacugcacuccagccugggugaca

SEQ ID NO: 428697 - RNA, 32 nt, Human
gaucaugccacugcacuccagcuugggcgaca

SEQ ID NO: 428698 - RNA, 32 nt, Human
gaucaugccacugcacuccagcuugggugaga

SEQ ID NO: 428699 - RNA, 32 nt, Human
gaucaugccacugcacuccagucuggaugaca

SEQ ID NO: 428700 - RNA, 32 nt, Human
gaucaugccacugcacuccagucugggugaca

SEQ ID NO: 428701 - RNA, 32 nt, Human
gaucaugccacugcacuccauccugggcaaca

SEQ ID NO: 428702 - RNA, 32 nt, Human
gaucaugccacugcacuccauccugggugaca

SEQ ID NO: 428703 - RNA, 32 nt, Human
gaucaugccacugcacuccggccuaggugaca

SEQ ID NO: 428704 - RNA, 32 nt, Human
gaucaugccacugcacuccuccgugggugaca

SEQ ID NO: 428705 - RNA, 32 nt, Human
gaucaugccacugcacuccugccugggugaca

SEQ ID NO: 428706 - RNA, 32 nt, Human
gaucaugccacugcacucuagccuaggcuaca

SEQ ID NO: 428707 - RNA, 32 nt, Human
gaucaugccacugcacucugggcuggguaaca

SEQ ID NO: 428708 - RNA, 32 nt, Human
gaucaugccacugcacugcacuccagccuggg

SEQ ID NO: 428709 - RNA, 32 nt, Human
gaucaugccacugcacugcagcccgggcgaca

SEQ ID NO: 428710 - RNA, 32 nt, Human
gaucaugccacugcacuuccagccugggugac

SEQ ID NO: 428711 - RNA, 24 nt, Human
gaucaugccacugcacuuuagccu

SEQ ID NO: 428712 - RNA, 32 nt, Human
gaucaugccacugcacuuuagccugggcaaca

SEQ ID NO: 428713 - RNA, 32 nt, Human
gaucaugccacugcacuuuagccugggugaca

SEQ ID NO: 428714 - RNA, 32 nt, Human
gaucaugccacugcaugccagccugggcaaca

SEQ ID NO: 428715 - RNA, 32 nt, Human
gaucaugccacugcauuccagccugggcaaca

SEQ ID NO: 428716 - RNA, 32 nt, Human
gaucaugccacugcauuccagccugggcgaca

SEQ ID NO: 428717 - RNA, 32 nt, Human
gaucaugccacugcauuccagccugugugaug

SEQ ID NO: 428718 - RNA, 32 nt, Human
gaucaugccacugcauucuagccugggcaaca

SEQ ID NO: 428719 - RNA, 32 nt, Human
gaucaugccacuggacuccagccugggugaaa

SEQ ID NO: 428720 - RNA, 32 nt, Human
gaucaugccacuguacuccagccuaggugaca

SEQ ID NO: 428721 - RNA, 32 nt, Human
gaucaugccacuguacuccagccugggcgaca

SEQ ID NO: 428722 - RNA, 32 nt, Human
gaucaugccagugcacuccagccugggcaaca

SEQ ID NO: 428723 - RNA, 32 nt, Human
gaucaugccauggcacuccauccugggugaca

SEQ ID NO: 428724 - RNA, 32 nt, Human
gaucaugccauggcagucuagccugggcaaca

SEQ ID NO: 428725 - RNA, 32 nt, Human
gaucaugccauuacacuccagccugggcgaca

SEQ ID NO: 428726 - RNA, 32 nt, Human
gaucaugccauuacuccagccugggugacaua

SEQ ID NO: 428727 - RNA, 32 nt, Human
gaucaugccauuauacuccagccugggugaca

SEQ ID NO: 428728 - RNA, 32 nt, Human
gaucaugccauugcacagcagccugggugaca

SEQ ID NO: 428729 - RNA, 32 nt, Human
gaucaugccauugcacuccaaccugggugaca

SEQ ID NO: 428730 - RNA, 32 nt, Human
gaucaugccauugcacuccagcccagguaaca

SEQ ID NO: 428731 - RNA, 32 nt, Human
gaucaugccauugcacuccagcccggguuaca

SEQ ID NO: 428732 - RNA, 32 nt, Human
gaucaugccauugcacuccagccuaggcaaca

SEQ ID NO: 428733 - RNA, 32 nt, Human
gaucaugccauugcacuccagccugagugaca

SEQ ID NO: 428734 - RNA, 32 nt, Human
gaucaugccauugcacuccagccuggacaaca

SEQ ID NO: 428735 - RNA, 32 nt, Human
gaucaugccauugcacuccagccugggcaaca

SEQ ID NO: 428736 - RNA, 32 nt, Human
gaucaugccauugcacuccagccugggcaacg

SEQ ID NO: 428737 - RNA, 32 nt, Human
gaucaugccauugcacuccagccugggcgaca

SEQ ID NO: 428738 - RNA, 32 nt, Human
gaucaugccauugcacuccagccugggugaca

SEQ ID NO: 428739 - RNA, 32 nt, Human
gaucaugccauugcacuccagccugggugaua

SEQ ID NO: 428740 - RNA, 32 nt, Human
gaucaugccauugcacuccagcuugggugaca

SEQ ID NO: 428741 - RNA, 32 nt, Human
gaucaugccauugcacuccagucugggcgaca

SEQ ID NO: 428742 - RNA, 32 nt, Human
gaucaugccauugcacuccgacucugggcaac

SEQ ID NO: 428743 - RNA, 32 nt, Human
gaucaugccauugcacucgagccugggcaaca

SEQ ID NO: 428744 - RNA, 32 nt, Human
gaucaugccauugcacucuagccuagcaacaa

SEQ ID NO: 428745 - RNA, 29 nt, Human
gaucaugccauugcacucuagccugggug

SEQ ID NO: 428746 - RNA, 32 nt, Human
gaucaugccauugcauuccagccuaggcaaca

SEQ ID NO: 428747 - RNA, 32 nt, Human
gaucaugccauugcauuccagccuuggcgaca

SEQ ID NO: 428748 - RNA, 32 nt, Human
gaucaugccccugcauuccagccuaggcgaca

SEQ ID NO: 428749 - RNA, 29 nt, Human
gaucaugccgcugcauuccagccugggug

SEQ ID NO: 428750 - RNA, 32 nt, Human
gaucaugccguuguacuccagcuugggcaaca

SEQ ID NO: 428751 - RNA, 32 nt, Human
gaucaugccuacugcacuccagccugggcaac

SEQ ID NO: 428752 - RNA, 32 nt, Human
gaucaugccucacugcagccucgaccucccug

SEQ ID NO: 428753 - RNA, 32 nt, Human
gaucaugccucucuacuccagccugggcaaua

SEQ ID NO: 428754 - RNA, 19 nt, Human
gaucaugccuguaauccca

SEQ ID NO: 428755 - RNA, 32 nt, Human
gaucaugccuguaaucccagcacuuugggaag

SEQ ID NO: 428756 - RNA, 32 nt, Human
gaucaugccuguaaucccaguacuuugggagg

SEQ ID NO: 428757 - RNA, 32 nt, Human
gaucaugccuucugugucuggaagaggcggca

SEQ ID NO: 428758 - RNA, 32 nt, Human
gaucaugcuacugcacuccagccuaggugaca

SEQ ID NO: 428759 - RNA, 32 nt, Human
gaucaugcuacugcacuccagccugggcgaca

SEQ ID NO: 428760 - RNA, 32 nt, Human
gaucaugcuacugcacuccagccugggugaca

SEQ ID NO: 428761 - RNA, 32 nt, Human
gaucaugcuacugcacuccagcuuagguggca

SEQ ID NO: 428762 - RNA, 32 nt, Human
gaucaugcuacugcacucuagccugagcgaca

SEQ ID NO: 428763 - RNA, 32 nt, Human
gaucaugcuacugcaugccagccugggugaca

SEQ ID NO: 428764 - RNA, 32 nt, Human
gaucaugcuagugcgcuccagccugggcaaca

SEQ ID NO: 428765 - RNA, 32 nt, Human
gaucauggacaaugaauaaaugcacacuucug

SEQ ID NO: 428766 - RNA, 32 nt, Human
gaucauggagcuuaguuuuaauuuagauagca

SEQ ID NO: 428767 - RNA, 32 nt, Human
gaucauggauuuucugggcauaaguggcuguu

SEQ ID NO: 428768 - RNA, 32 nt, Human
gaucauggcacugcacuccagccugggcaaca

SEQ ID NO: 428769 - RNA, 29 nt, Human
gaucauggcuaccucagagcugagcugcg

SEQ ID NO: 428770 - RNA, 27 nt, Human
gaucauggcucacugcaaccucugccu

SEQ ID NO: 428771 - RNA, 32 nt, Human
gaucauggcuuacugcagccuugaucucccag

SEQ ID NO: 428772 - RNA, 32 nt, Human
gaucaugggacugcacuccagccugggugaca

SEQ ID NO: 428773 - RNA, 32 nt, Human
gaucauggugcuguagggccaggcucccucug

SEQ ID NO: 428774 - RNA, 32 nt, Human
gaucaugucacugcacuccagccugggugaca

SEQ ID NO: 428775 - RNA, 32 nt, Human
gaucaugucacugcacucuagcuugggagaca

SEQ ID NO: 428776 - RNA, 32 nt, Human
gaucaugucacuguacuccagccugggcaaca

SEQ ID NO: 428777 - RNA, 32 nt, Human
gaucaugucauucauuuguucaaaaccuucaa

SEQ ID NO: 428778 - RNA, 32 nt, Human
gaucaugucuacuaggaggaacagugacucug

SEQ ID NO: 428779 - RNA, 32 nt, Human
gaucaugucuguaauccuagcacugugggagg

SEQ ID NO: 428780 - RNA, 32 nt, Human
gaucauguuuugcuacaguuugcaggugaaaa

SEQ ID NO: 428781 - RNA, 22 nt, Human
gaucauuaaccacuguauacuu

SEQ ID NO: 428782 - RNA, 24 nt, Human
gaucauuccacugcauuucagccu

SEQ ID NO: 428783 - RNA, 32 nt, Human
gaucauuccacugcauuucagccugggggaua

SEQ ID NO: 428784 - RNA, 32 nt, Human
gaucauuccagcccacagcaauggagccacau

SEQ ID NO: 428785 - RNA, 32 nt, Human
gaucauuccauuacacuccagccugggcacca

SEQ ID NO: 428786 - RNA, 32 nt, Human
gaucauucucacuucaaauuccuggggcugau

SEQ ID NO: 428787 - RNA, 32 nt, Human
gaucauugcacuccagccugggcaauaagagu

SEQ ID NO: 428788 - RNA, 32 nt, Human
gaucauugucucauuuuagugauuguuccuua

SEQ ID NO: 428789 - RNA, 32 nt, Human
gaucauuuacccaaggauagguguuugguaau

SEQ ID NO: 428790 - RNA, 32 nt, Human
gaucauuuagacucaacaacaaaacagaaaac

SEQ ID NO: 428791 - RNA, 32 nt, Human
gaucauuucaccucacuccagccugggugaca

SEQ ID NO: 428792 - RNA, 32 nt, Human
gaucauuuccacugcacauuucuccucaagaa

SEQ ID NO: 428793 - RNA, 32 nt, Human
gaucauuucccaagauacuuucccaaaaucag

SEQ ID NO: 428794 - RNA, 32 nt, Human
gaucauuuccuaaaaucuccagucccaaguau

SEQ ID NO: 428795 - RNA, 32 nt, Human
gaucauuucuacuugcugugcauuuuaaccaa

SEQ ID NO: 428796 - RNA, 32 nt, Human
gaucauuuucccuugccugaguuuugagcuga

SEQ ID NO: 428797 - RNA, 32 nt, Human
gaucauuuucuuaucuccuuuucuuaagcagu

SEQ ID NO: 428798 - RNA, 20 nt, Human
gauccaaacugauuaaguua

SEQ ID NO: 428799 - RNA, 32 nt, Human
gauccaacagacagaaauucacccucauacau

SEQ ID NO: 428800 - RNA, 32 nt, Human
gauccaacgugugccagccacugggauacaaa

SEQ ID NO: 428801 - RNA, 32 nt, Human
gauccaagaaccacagcucaucugccaacaau

SEQ ID NO: 428802 - RNA, 24 nt, Human
gauccaagaucgcaccacugcacu

SEQ ID NO: 428803 - RNA, 32 nt, Human
gauccaagguaacuggguaggaaaucuuuuga

SEQ ID NO: 428804 - RNA, 32 nt, Human
gauccacaaauaccaccagcugcuucauccac

SEQ ID NO: 428805 - RNA, 32 nt, Human
gauccacacccucccuucauccuucccuccca

SEQ ID NO: 428806 - RNA, 32 nt, Human
gauccacacucagcauuuuuccuugccucuau

SEQ ID NO: 428807 - RNA, 32 nt, Human
gauccacagaauguuucuucucugccuuaaag

SEQ ID NO: 428808 - RNA, 32 nt, Human
gauccacagaguuucauauuugaagucuccgg

SEQ ID NO: 428809 - RNA, 32 nt, Human
gauccacagcaggcacauaucucuccaaggga

SEQ ID NO: 428810 - RNA, 32 nt, Human
gauccacaggaccaaagggugcagugaugggc

SEQ ID NO: 428811 - RNA, 32 nt, Human
gauccaccccggaaaccggcaggaugaagggg

SEQ ID NO: 428812 - RNA, 32 nt, Human
gauccacccuccacaguacuccagaaaggacu

SEQ ID NO: 428813 - RNA, 32 nt, Human
gauccacccuccucagccucccaaagugcugg

SEQ ID NO: 428814 - RNA, 32 nt, Human
gauccacccuccucccuucucaugggacuuug

SEQ ID NO: 428815 - RNA, 32 nt, Human
gauccaccuaagaucuugccccuguuaagugg

SEQ ID NO: 428816 - RNA, 32 nt, Human
gauccaccuuggccuccugaagugcugggguu

SEQ ID NO: 428817 - RNA, 32 nt, Human
gauccacgugcucgccucugcccagccugccc

SEQ ID NO: 428818 - RNA, 32 nt, Human
gauccacugugagcaccaaccugcugcagucu

SEQ ID NO: 428819 - RNA, 19 nt, Human
gauccacuuucagccucca

SEQ ID NO: 428820 - RNA, 32 nt, Human
gauccagaaagcccaggacauaacagagccgc

SEQ ID NO: 428821 - RNA, 32 nt, Human
gauccagaccaucuuggcuaacagggugaaac

SEQ ID NO: 428822 - RNA, 32 nt, Human
gauccagaccuccugagcccacuuccccaucu

SEQ ID NO: 428823 - RNA, 32 nt, Human
gauccagaccuccugagcccacuuuccccauc

SEQ ID NO: 428824 - RNA, 32 nt, Human
gauccagagacauagaggaaguaggggguggu

SEQ ID NO: 428825 - RNA, 32 nt, Human
gauccagagagcuuccugaaggaccuguugaa

SEQ ID NO: 428826 - RNA, 32 nt, Human
gauccagagcugcugcugcucacugccagucc

SEQ ID NO: 428827 - RNA, 22 nt, Human
gauccagaggcggagguugcag

SEQ ID NO: 428828 - RNA, 32 nt, Human
gauccagaggcugauggcggagggcggcauga

SEQ ID NO: 428829 - RNA, 32 nt, Human
gauccagauccuggacucagagcuguuugagc

SEQ ID NO: 428830 - RNA, 32 nt, Human
gauccagauguuaaaagccaauggugugcuga

SEQ ID NO: 428831 - RNA, 32 nt, Human
gauccagcaccuauugaauuaccauagaguaa

SEQ ID NO: 428832 - RNA, 32 nt, Human
gauccagccacagcacuccagccugggugaca

SEQ ID NO: 428833 - RNA, 32 nt, Human
gauccagcucuccuacccucaggccaggaugc

SEQ ID NO: 428834 - RNA, 32 nt, Human
gauccagcuuucccuucucuuaccuguacagu

SEQ ID NO: 428835 - RNA, 32 nt, Human
gauccaggagaugcucacaggccacaggaccu

SEQ ID NO: 428836 - RNA, 32 nt, Human
gauccaggcaucaaugguuggccacagauggg

SEQ ID NO: 428837 - RNA, 32 nt, Human
gauccaggcugcacgcggcggacugggcaggc

SEQ ID NO: 428838 - RNA, 32 nt, Human
gauccaggugugagagcucuugagucaagagu

SEQ ID NO: 428839 - RNA, 32 nt, Human
gauccagguugauagaaguccagauccugagg

SEQ ID NO: 428840 - RNA, 32 nt, Human
gauccaguagcccuuuccacauacuguggcua

SEQ ID NO: 428841 - RNA, 32 nt, Human
gauccaguagccugggguggggcacaggaugu

SEQ ID NO: 428842 - RNA, 32 nt, Human
gauccagugucagcuccagccuauucaauuuc

SEQ ID NO: 428843 - RNA, 32 nt, Human
gauccauaaagaacccagccaacccgcagagg

SEQ ID NO: 428844 - RNA, 32 nt, Human
gauccauaaagaacccagccaacucgcagagg

SEQ ID NO: 428845 - RNA, 32 nt, Human
gauccauacaauagagcacagcagggagacug

SEQ ID NO: 428846 - RNA, 32 nt, Human
gauccauacauacuauaaggcacuuuuaacag

SEQ ID NO: 428847 - RNA, 32 nt, Human
gauccauagacuuagcaagucuugccuuaucu

SEQ ID NO: 428848 - RNA, 32 nt, Human
gauccaucauccaggcugcagugcagcagcgc

SEQ ID NO: 428849 - RNA, 32 nt, Human
gauccauccuuuugcuucaucuggagucccuc

SEQ ID NO: 428850 - RNA, 32 nt, Human
gauccaucucuagccaaaucacaccccagagc

SEQ ID NO: 428851 - RNA, 32 nt, Human
gauccaucuuaauccagauccaugaagaccuu

SEQ ID NO: 428852 - RNA, 32 nt, Human
gauccaugagcaggaccgccuccaugauuggg

SEQ ID NO: 428853 - RNA, 32 nt, Human
gauccaugaguuguuucuccaacucuucgagc

SEQ ID NO: 428854 - RNA, 30 nt, Human
gauccaugcugcugcugacucggagcccca

SEQ ID NO: 428855 - RNA, 23 nt, Human
gauccauggaauagaccuugaca

SEQ ID NO: 428856 - RNA, 32 nt, Human
gauccaugguuauuagagaaagagaaaggauu

SEQ ID NO: 428857 - RNA, 32 nt, Human
gauccaugguuauuccuuacucaugaacagug

SEQ ID NO: 428858 - RNA, 32 nt, Human
gauccaugucuggaauggagagagcgguauaa

SEQ ID NO: 428859 - RNA, 32 nt, Human
gauccauucucucuuucucugcauacucucca

SEQ ID NO: 428860 - RNA, 32 nt, Human
gauccauuguggucugccuuccaggcucauua

SEQ ID NO: 428861 - RNA, 32 nt, Human
gaucccaaaacgaaccaacagaccaggcauca

SEQ ID NO: 428862 - RNA, 32 nt, Human
gaucccaaaaggauuuugguggaaaacuaguu

SEQ ID NO: 428863 - RNA, 32 nt, Human
gaucccaacuacucgggaggccgaggcaggaa

SEQ ID NO: 428864 - RNA, 32 nt, Human
gaucccaaggccaacagaagcugcagugggca

SEQ ID NO: 428865 - RNA, 32 nt, Human
gaucccaagggagagaaggaaaauggcugaua

SEQ ID NO: 428866 - RNA, 32 nt, Human
gaucccaagggcccagauaacgcccccaacuu

SEQ ID NO: 428867 - RNA, 32 nt, Human
gaucccacaaagugcugggauuacagguguga

SEQ ID NO: 428868 - RNA, 32 nt, Human
gaucccacaccaugccucacaugguagacccc

SEQ ID NO: 428869 - RNA, 32 nt, Human
gaucccacacuggcagagauggggccaccccu

SEQ ID NO: 428870 - RNA, 32 nt, Human
gaucccaccacugcacuccagccugggcgaca

SEQ ID NO: 428871 - RNA, 32 nt, Human
gaucccaccauggucauaucuugaaguauggu

SEQ ID NO: 428872 - RNA, 32 nt, Human
gaucccaccauugcacuccagccugggcaaca

SEQ ID NO: 428873 - RNA, 19 nt, Human
gaucccaccgucgggccug

SEQ ID NO: 428874 - RNA, 32 nt, Human
gaucccaccuacucgggaggcuaaggcaagag

SEQ ID NO: 428875 - RNA, 32 nt, Human
gaucccaccugccgcuaggcacguggaggagg

SEQ ID NO: 428876 - RNA, 22 nt, Human
gaucccacugcccccgccucuc

SEQ ID NO: 428877 - RNA, 32 nt, Human
gaucccacugccuuucccuccuaggcaugugc

SEQ ID NO: 428878 - RNA, 32 nt, Human
gaucccacugcugcacuuuagccugggugaaa

SEQ ID NO: 428879 - RNA, 32 nt, Human
gaucccacuggcauuugagugugcaaaccuug

SEQ ID NO: 428880 - RNA, 32 nt, Human
gaucccacuugcagccuccccaggugucugcc

SEQ ID NO: 428881 - RNA, 32 nt, Human
gaucccagaggaggaaguccagagacagagca

SEQ ID NO: 428882 - RNA, 32 nt, Human
gaucccagagucaguaaaucugccugugaagu

SEQ ID NO: 428883 - RNA, 32 nt, Human
gaucccagauuuucucccuccugacucacuga

SEQ ID NO: 428884 - RNA, 32 nt, Human
gaucccagcaacagcaagccuuucaugaguua

SEQ ID NO: 428885 - RNA, 32 nt, Human
gaucccagcacuggcgugacugacggcugagg

SEQ ID NO: 428886 - RNA, 32 nt, Human
gaucccagcacuuugggagacugaggcggauc

SEQ ID NO: 428887 - RNA, 19 nt, Human
gaucccagcagcccucccu

SEQ ID NO: 428888 - RNA, 30 nt, Human
gaucccagccucuccccugcucccgugcuc

SEQ ID NO: 428889 - RNA, 32 nt, Human
gaucccagcgagacccagagaugccuguaaug

SEQ ID NO: 428890 - RNA, 32 nt, Human
gaucccagcuacucaggaagcugaggcagaaa

SEQ ID NO: 428891 - RNA, 32 nt, Human
gaucccagcuacucaggaggcugagacaggag

SEQ ID NO: 428892 - RNA, 32 nt, Human
gaucccagcuacucaggaggcugaggcaggag

SEQ ID NO: 428893 - RNA, 32 nt, Human
gaucccagcuacucgggaggcuaaggcaggag

SEQ ID NO: 428894 - RNA, 32 nt, Human
gaucccagcuacucgggaggcugaggcaggag

SEQ ID NO: 428895 - RNA, 32 nt, Human
gaucccagcuacugaggaggcugaggcaggag

SEQ ID NO: 428896 - RNA, 32 nt, Human
gaucccagcuacuggagaggcugaggcaggag

SEQ ID NO: 428897 - RNA, 32 nt, Human
gaucccagcuacuggggagacugaggugggag

SEQ ID NO: 428898 - RNA, 32 nt, Human
gaucccagcuacuggggaggcugaggcaggag

SEQ ID NO: 428899 - RNA, 32 nt, Human
gaucccagcuacuuaggagguugaggcuggga

SEQ ID NO: 428900 - RNA, 32 nt, Human
gaucccagcuacuugagaggcugaggugggaa

SEQ ID NO: 428901 - RNA, 32 nt, Human
gaucccagcuacuuggaaggcugaggugagag

SEQ ID NO: 428902 - RNA, 32 nt, Human
gaucccagcuacuuggaggcugaggcagaaga

SEQ ID NO: 428903 - RNA, 32 nt, Human
gaucccagcuacuugggaggcugaggcaggag

SEQ ID NO: 428904 - RNA, 32 nt, Human
gaucccagcuacuugggaggcugagguagaag

SEQ ID NO: 428905 - RNA, 32 nt, Human
gaucccagcuacuugggaggcugaggugggag

SEQ ID NO: 428906 - RNA, 32 nt, Human
gaucccagcucucugccagacugagagggcaa

SEQ ID NO: 428907 - RNA, 32 nt, Human
gaucccaggaaacaccaguagagugaggaagu

SEQ ID NO: 428908 - RNA, 32 nt, Human
gaucccaggaggcggagguugcagugaguugc

SEQ ID NO: 428909 - RNA, 32 nt, Human
gaucccaggaggucgagaccagccuggggaac

SEQ ID NO: 428910 - RNA, 32 nt, Human
gaucccaggaguuuaagaccagccugggcaac

SEQ ID NO: 428911 - RNA, 32 nt, Human
gaucccaggaguuugagaccagccugggcacc

SEQ ID NO: 428912 - RNA, 32 nt, Human
gaucccaggcuggauggaguggcuggaaggaa

SEQ ID NO: 428913 - RNA, 32 nt, Human
gaucccagggcugaggagccuccgggaccggg

SEQ ID NO: 428914 - RNA, 32 nt, Human
gaucccaggggaggggaaacgggaauagugag

SEQ ID NO: 428915 - RNA, 32 nt, Human
gaucccaguuuacucuguggccaggccccacc

SEQ ID NO: 428916 - RNA, 32 nt, Human
gaucccaguuugcagcaaaccccacaccccag

SEQ ID NO: 428917 - RNA, 32 nt, Human
gaucccaucagccuggccauagcagaacaccc

SEQ ID NO: 428918 - RNA, 32 nt, Human
gaucccaucugccuagauggaagaggauccua

SEQ ID NO: 428919 - RNA, 32 nt, Human
gaucccaugacagauucuguugucacgucucc

SEQ ID NO: 428920 - RNA, 32 nt, Human
gaucccaugagguuggggcagggcagggcuuc

SEQ ID NO: 428921 - RNA, 32 nt, Human
gaucccauuucagccugugcucugccucgauu

SEQ ID NO: 428922 - RNA, 32 nt, Human
gauccccaaguggugaaugacacgccuaaggu

SEQ ID NO: 428923 - RNA, 32 nt, Human
gauccccacagcuguguacuuguuugcauuug

SEQ ID NO: 428924 - RNA, 32 nt, Human
gauccccagccagacucuguacccacaggauu

SEQ ID NO: 428925 - RNA, 32 nt, Human
gauccccaggaagccgaggagccccaggaagg

SEQ ID NO: 428926 - RNA, 32 nt, Human
gauccccaguuccuauacccuaccccugaccu

SEQ ID NO: 428927 - RNA, 32 nt, Human
gauccccaucuauuaaguaaggggaaagauga

SEQ ID NO: 428928 - RNA, 32 nt, Human
gaucccccaaguguccuggacccuggccuaaa

SEQ ID NO: 428929 - RNA, 20 nt, Human
gaucccccacgggcuggcug

SEQ ID NO: 428930 - RNA, 32 nt, Human
gaucccccagagagcuacaggucugcucccga

SEQ ID NO: 428931 - RNA, 32 nt, Human
gaucccccgaccgcacuccagccugggcgaca

SEQ ID NO: 428932 - RNA, 32 nt, Human
gaucccccugaaccugcaccuccaucacgacc

SEQ ID NO: 428933 - RNA, 32 nt, Human
gaucccccuucucuccugcuuccuccagggaa

SEQ ID NO: 428934 - RNA, 32 nt, Human
gauccccgccuccugggcggaucugaguuauu

SEQ ID NO: 428935 - RNA, 32 nt, Human
gauccccggccuucccaugcaggaugacugcu

SEQ ID NO: 428936 - RNA, 32 nt, Human
gauccccggcgccgucgccaggcgcuggccgu

SEQ ID NO: 428937 - RNA, 32 nt, Human
gauccccucaacaaggauggaacugaaggccg

SEQ ID NO: 428938 - RNA, 32 nt, Human
gauccccucauuaaaagaacagugaugauggu

SEQ ID NO: 428939 - RNA, 32 nt, Human
gauccccuccuuggaccuggcaucugcuaaug

SEQ ID NO: 428940 - RNA, 32 nt, Human
gauccccucucuuccuacccuuccucaccacu

SEQ ID NO: 428941 - RNA, 32 nt, Human
gauccccucuucucagcuucccaaggagcugg

SEQ ID NO: 428942 - RNA, 32 nt, Human
gauccccugccuggugcccacacugccucgca

SEQ ID NO: 428943 - RNA, 32 nt, Human
gauccccuggcuuuucugaagugguggcaggu

SEQ ID NO: 428944 - RNA, 32 nt, Human
gauccccuuccagagccaccuccccauucagg

SEQ ID NO: 428945 - RNA, 32 nt, Human
gauccccuucccacccucuccguuggccucag

SEQ ID NO: 428946 - RNA, 32 nt, Human
gauccccuuccccauuccgcccccgccucaac

SEQ ID NO: 428947 - RNA, 24 nt, Human
gaucccgaguccccggaucccgga

SEQ ID NO: 428948 - RNA, 32 nt, Human
gaucccgccacucacuccagccuggauaaaag

SEQ ID NO: 428949 - RNA, 32 nt, Human
gaucccgccacugcacgccagccugggcgaca

SEQ ID NO: 428950 - RNA, 32 nt, Human
gaucccgccacugcacuccagacugggcgaca

SEQ ID NO: 428951 - RNA, 32 nt, Human
gaucccgccacugcacuccagcccaggugaca

SEQ ID NO: 428952 - RNA, 32 nt, Human
gaucccgccacugcacuccagccugggcgaca

SEQ ID NO: 428953 - RNA, 24 nt, Human
gaucccgcugacccgaauccugga

SEQ ID NO: 428954 - RNA, 32 nt, Human
gaucccggcagaagcuaugaaagggaauaaag

SEQ ID NO: 428955 - RNA, 32 nt, Human
gaucccggccccugccacccagccucaugcaa

SEQ ID NO: 428956 - RNA, 32 nt, Human
gaucccggcgcuguucaucggcuucagccagu

SEQ ID NO: 428957 - RNA, 32 nt, Human
gaucccgggcaggcagcguccacccagcgugg

SEQ ID NO: 428958 - RNA, 32 nt, Human
gaucccuaauauccccagccccagccagaagc

SEQ ID NO: 428959 - RNA, 32 nt, Human
gaucccuagcuccagccucuuccugggccagc

SEQ ID NO: 428960 - RNA, 32 nt, Human
gaucccuagguccugcccuccugguccguggg

SEQ ID NO: 428961 - RNA, 32 nt, Human
gaucccuccacuguccaggcugucucaggagg

SEQ ID NO: 428962 - RNA, 32 nt, Human
gaucccucccaucucacaguaccucacagguc

SEQ ID NO: 428963 - RNA, 32 nt, Human
gaucccucuccucgccugccuucuggaagacu

SEQ ID NO: 428964 - RNA, 32 nt, Human
gaucccucuggggaggacaggaaggggacucc

SEQ ID NO: 428965 - RNA, 32 nt, Human
gaucccucuuuuccaguucuccuuccucuagg

SEQ ID NO: 428966 - RNA, 32 nt, Human
gaucccugaaaccaaaaagcuccugcugcuuc

SEQ ID NO: 428967 - RNA, 32 nt, Human
gaucccugagcguguggcagcagugcggucgu

SEQ ID NO: 428968 - RNA, 32 nt, Human
gaucccugaggcgggagaaucgcuugaaccca

SEQ ID NO: 428969 - RNA, 32 nt, Human
gaucccugcagccugccacuaccccgagucuc

SEQ ID NO: 428970 - RNA, 32 nt, Human
gaucccugcugggcaccaacagcuccaccaug

SEQ ID NO: 428971 - RNA, 32 nt, Human
gaucccuggaaaauaaugauguccaaagcaaa

SEQ ID NO: 428972 - RNA, 32 nt, Human
gaucccuggaguucaggaaccaacacaagcac

SEQ ID NO: 428973 - RNA, 32 nt, Human
gaucccugggaaugugcucugggcggaagcag

SEQ ID NO: 428974 - RNA, 22 nt, Human
gaucccugggcccugcugcuca

SEQ ID NO: 428975 - RNA, 32 nt, Human
gaucccugguuuccuacccaugggaaacccca

SEQ ID NO: 428976 - RNA, 32 nt, Human
gaucccuguauuucaagaccucugugcacuua

SEQ ID NO: 428977 - RNA, 32 nt, Human
gaucccugucuucugaccuccaacauuaagag

SEQ ID NO: 428978 - RNA, 32 nt, Human
gaucccuguggaccccgaugccugcauccuuc

SEQ ID NO: 428979 - RNA, 32 nt, Human
gaucccuguguugucucuagagcagggauuaa

SEQ ID NO: 428980 - RNA, 32 nt, Human
gaucccuuagguucaggaagcuucuguguaag

SEQ ID NO: 428981 - RNA, 32 nt, Human
gaucccuucccaaccccuuugcaccgguccca

SEQ ID NO: 428982 - RNA, 32 nt, Human
gaucccuugacccugagagguagaggcugcau

SEQ ID NO: 428983 - RNA, 32 nt, Human
gaucccuuuccagauugcaaccuggccugcau

SEQ ID NO: 428984 - RNA, 32 nt, Human
gaucccuuucuaaggucccuuccagcccagcc

SEQ ID NO: 428985 - RNA, 32 nt, Human
gauccgaccucgcagucuccccagguccgcca

SEQ ID NO: 428986 - RNA, 32 nt, Human
gauccgagccuguagaagggaggcaugaaacu

SEQ ID NO: 428987 - RNA, 32 nt, Human
gauccgagggagcaaugguggggcgagugagg

SEQ ID NO: 428988 - RNA, 32 nt, Human
gauccgcacaugcugaccuuccugcagcaacu

SEQ ID NO: 428989 - RNA, 32 nt, Human
gauccgcagagcugccucugggcgccugaccc

SEQ ID NO: 428990 - RNA, 32 nt, Human
gauccgccaccauggcugaaggagagaaugaa

SEQ ID NO: 428991 - RNA, 32 nt, Human
gauccgccacugcacuccagccugggugacag

SEQ ID NO: 428992 - RNA, 32 nt, Human
gauccgccauuacacuccagccugggugacag

SEQ ID NO: 428993 - RNA, 32 nt, Human
gauccgcgguggacccagggaagcggaggagc

SEQ ID NO: 428994 - RNA, 32 nt, Human
gauccgcgucccgccucagcggccggaggaca

SEQ ID NO: 428995 - RNA, 32 nt, Human
gauccgcuccagcgucaagguggcauccgaag

SEQ ID NO: 428996 - RNA, 32 nt, Human
gauccgcucuacugucuucuccgaggcccacc

SEQ ID NO: 428997 - RNA, 32 nt, Human
gauccggaacucgccaacucaccccgggcauc

SEQ ID NO: 428998 - RNA, 32 nt, Human
gauccggaagcugaucaaagaugggcugauca

SEQ ID NO: 428999 - RNA, 32 nt, Human
gauccggaccagccaaggaaggguccaggugc

SEQ ID NO: 429000 - RNA, 32 nt, Human
gauccggagagggggcuccgggagcggcggga

SEQ ID NO: 429001 - RNA, 32 nt, Human
gauccggagcgggacccaggagccggcgcggg

SEQ ID NO: 429002 - RNA, 32 nt, Human
gauccggcagccucucuucacugcuacaugug

SEQ ID NO: 429003 - RNA, 32 nt, Human
gauccggcgaguagcuggcggucccgggugcu

SEQ ID NO: 429004 - RNA, 32 nt, Human
gauccgggccuugcgugcagccucccaaccau

SEQ ID NO: 429005 - RNA, 32 nt, Human
gauccggggagacaggaacacgggcaagacag

SEQ ID NO: 429006 - RNA, 32 nt, Human
gauccggggagguggaaguugcagugggccaa

SEQ ID NO: 429007 - RNA, 32 nt, Human
gauccgguguugcauccuuggagagagcugag

SEQ ID NO: 429008 - RNA, 32 nt, Human
gauccguaccuccaaggcucccaugggcccaa

SEQ ID NO: 429009 - RNA, 17 nt, Human
gauccguccuccuuggg

SEQ ID NO: 429010 - RNA, 32 nt, Human
gauccuaaaaaucccuuccuguucccuccugg

SEQ ID NO: 429011 - RNA, 32 nt, Human
gauccuaaaagugcccuuggcugccugcugga

SEQ ID NO: 429012 - RNA, 32 nt, Human
gauccuaacuaaaaacagacuugaguggauau

SEQ ID NO: 429013 - RNA, 32 nt, Human
gauccuaacuaagcaggagcugcggcugccgg

SEQ ID NO: 429014 - RNA, 32 nt, Human
gauccuaaggaaauauguguggguucuucuga

SEQ ID NO: 429015 - RNA, 32 nt, Human
gauccuaagucucuuacaaaagcuuugaauac

SEQ ID NO: 429016 - RNA, 32 nt, Human
gauccuaauacuuggccaucuccacacaaguu

SEQ ID NO: 429017 - RNA, 28 nt, Human
gauccuaauggugcugcccuauuuauac

SEQ ID NO: 429018 - RNA, 32 nt, Human
gauccuacagaagcccugcuaaauuuuacucc

SEQ ID NO: 429019 - RNA, 32 nt, Human
gauccuaccacugcacuucagccuaggugaca

SEQ ID NO: 429020 - RNA, 32 nt, Human
gauccuacggauugagguccucaggccacgcc

SEQ ID NO: 429021 - RNA, 32 nt, Human
gauccuacguguaugcacccuacagcagcagu

SEQ ID NO: 429022 - RNA, 32 nt, Human
gauccuacucaacaaaaggaaggguggucaga

SEQ ID NO: 429023 - RNA, 32 nt, Human
gauccuagagugagacgggagguaaagucacc

SEQ ID NO: 429024 - RNA, 32 nt, Human
gauccuagcgugagaggucauccugcccuugc

SEQ ID NO: 429025 - RNA, 32 nt, Human
gauccuagcuacucaggaggcugaagugggag

SEQ ID NO: 429026 - RNA, 32 nt, Human
gauccuagcugcagaucgcaucccacaaugcg

SEQ ID NO: 429027 - RNA, 23 nt, Human
gauccuaguuggggagcugcuca

SEQ ID NO: 429028 - RNA, 32 nt, Human
gauccuaucagcuucucucccacccaauuagg

SEQ ID NO: 429029 - RNA, 32 nt, Human
gauccuaucaggaugaggagcagcagcccagg

SEQ ID NO: 429030 - RNA, 32 nt, Human
gauccucaaaggacuguggccaaggccucugc

SEQ ID NO: 429031 - RNA, 32 nt, Human
gauccucaaguaccccaguuucacacauacca

SEQ ID NO: 429032 - RNA, 32 nt, Human
gauccucacaucugggggaaaucauagacaau

SEQ ID NO: 429033 - RNA, 32 nt, Human
gauccucacaugcugagaaacagccucuacuc

SEQ ID NO: 429034 - RNA, 32 nt, Human
gauccucaccucagugccccagagaugcccca

SEQ ID NO: 429035 - RNA, 32 nt, Human
gauccucacugcaacauuccuuauccaauccc

SEQ ID NO: 429036 - RNA, 32 nt, Human
gauccucagaacuucucugggacaauuucagu

SEQ ID NO: 429037 - RNA, 32 nt, Human
gauccucagccauguucaagugaaguaagccu

SEQ ID NO: 429038 - RNA, 32 nt, Human
gauccucauggaaacagugaaagagaaaaauc

SEQ ID NO: 429039 - RNA, 32 nt, Human
gauccuccaaugucuaauuuucuuuccgacac

SEQ ID NO: 429040 - RNA, 32 nt, Human
gauccuccacggucagcgccggggcccggaga

SEQ ID NO: 429041 - RNA, 32 nt, Human
gauccuccacucauggcuguaucugcagcuuc

SEQ ID NO: 429042 - RNA, 32 nt, Human
gauccucccaccucagcuucccaaguagcuag

SEQ ID NO: 429043 - RNA, 32 nt, Human
gauccucccaccucagcuuccugggaccaccc

SEQ ID NO: 429044 - RNA, 32 nt, Human
gauccucccaccucagcuucucaaaguucugg

SEQ ID NO: 429045 - RNA, 23 nt, Human
gauccucccacuucagccuuuca

SEQ ID NO: 429046 - RNA, 32 nt, Human
gauccucccacuucagcuuccugaguuccuga

SEQ ID NO: 429047 - RNA, 32 nt, Human
gauccucccaucucagcuuccugaggagcugg

SEQ ID NO: 429048 - RNA, 18 nt, Human
gauccucccccaccucuc

SEQ ID NO: 429049 - RNA, 32 nt, Human
gauccucccccuacuucuccccaagggccaag

SEQ ID NO: 429050 - RNA, 22 nt, Human
gauccucccgcuucagccuccc

SEQ ID NO: 429051 - RNA, 23 nt, Human
gauccucccgcuucggccuccca

SEQ ID NO: 429052 - RNA, 32 nt, Human
gauccucccuggggaccccuguggccugucuc

SEQ ID NO: 429053 - RNA, 32 nt, Human
gauccucccuuuccauugcuucuccuagugau

SEQ ID NO: 429054 - RNA, 32 nt, Human
gauccuccuaccucagccuccuggaagcucgg

SEQ ID NO: 429055 - RNA, 32 nt, Human
gauccuccucuuugggaguccagugucuuuga

SEQ ID NO: 429056 - RNA, 32 nt, Human
gauccuccuuaaaucccacagucccccagacc

SEQ ID NO: 429057 - RNA, 32 nt, Human
gauccuccuucuuuuuccuuuuucuucaccuu

SEQ ID NO: 429058 - RNA, 32 nt, Human
gauccuccuugcaaagcugugccuugcagaga

SEQ ID NO: 429059 - RNA, 32 nt, Human
gauccucgggaauacagggauuacaggaauga

SEQ ID NO: 429060 - RNA, 32 nt, Human
gauccucuaccucauaacaaaaggacaguggg

SEQ ID NO: 429061 - RNA, 32 nt, Human
gauccucucaccucagcucccgagcagcuagg

SEQ ID NO: 429062 - RNA, 32 nt, Human
gauccucuccacccuacccccaauccacucga

SEQ ID NO: 429063 - RNA, 32 nt, Human
gauccucuccacccuccucuagccaucccuug

SEQ ID NO: 429064 - RNA, 32 nt, Human
gauccucuccguagcaccuccauagauaguag

SEQ ID NO: 429065 - RNA, 32 nt, Human
gauccucucucccagggaauccgacacaggag

SEQ ID NO: 429066 - RNA, 32 nt, Human
gauccucucugccuuuguacuugaagagcgca

SEQ ID NO: 429067 - RNA, 32 nt, Human
gauccucugagaugauuguggacugggugcug

SEQ ID NO: 429068 - RNA, 32 nt, Human
gauccucugccgcccucucugccacgcgggac

SEQ ID NO: 429069 - RNA, 32 nt, Human
gauccucugcgugggagggcuugggggcagcc

SEQ ID NO: 429070 - RNA, 32 nt, Human
gauccucugcucccgucucugucucccacagu

SEQ ID NO: 429071 - RNA, 32 nt, Human
gauccucugcugcaaacagaugaauugaauca

SEQ ID NO: 429072 - RNA, 32 nt, Human
gauccucuggccaacacacaucugccaugucc

SEQ ID NO: 429073 - RNA, 32 nt, Human
gauccucuucccucagcuucccagaaugccga

SEQ ID NO: 429074 - RNA, 32 nt, Human
gauccucuucucaaagcugggauuacaggugu

SEQ ID NO: 429075 - RNA, 32 nt, Human
gauccugaaacugucucucacauuauauagua

SEQ ID NO: 429076 - RNA, 32 nt, Human
gauccugaaauggcaauugcacaugucugcau

SEQ ID NO: 429077 - RNA, 32 nt, Human
gauccugaagaaaaaggugacaagaaucagca

SEQ ID NO: 429078 - RNA, 32 nt, Human
gauccugaagagaccuucaccugggugccacg

SEQ ID NO: 429079 - RNA, 19 nt, Human
gauccugaagggccugcug

SEQ ID NO: 429080 - RNA, 32 nt, Human
gauccugaaugagacaaaagagagaaccaguc

SEQ ID NO: 429081 - RNA, 32 nt, Human
gauccugaccccugcagggcucaggggucagc

SEQ ID NO: 429082 - RNA, 32 nt, Human
gauccugagucauguguuccaguggcuugggu

SEQ ID NO: 429083 - RNA, 32 nt, Human
gauccugcacacacagacacagcgucugcccc

SEQ ID NO: 429084 - RNA, 32 nt, Human
gauccugcacacacccagacagcuggcgcuca

SEQ ID NO: 429085 - RNA, 32 nt, Human
gauccugccacugcacuccagccugggcaaca

SEQ ID NO: 429086 - RNA, 32 nt, Human
gauccugccacugcacuccagccugggcgaca

SEQ ID NO: 429087 - RNA, 32 nt, Human
gauccugccacugcacuccagccugugccaca

SEQ ID NO: 429088 - RNA, 32 nt, Human
gauccugccagggccaggugggguggacuggg

SEQ ID NO: 429089 - RNA, 32 nt, Human
gauccugccccuuccuucuugccuguagcucc

SEQ ID NO: 429090 - RNA, 32 nt, Human
gauccugccucuggucccagcauccagcugcc

SEQ ID NO: 429091 - RNA, 32 nt, Human
gauccugccuguuguaggccccuucaggaugc

SEQ ID NO: 429092 - RNA, 32 nt, Human
gauccugcggcagggcaagcugugcgacguga

SEQ ID NO: 429093 - RNA, 32 nt, Human
gauccugcuaagcagagaaucgcuguggccgg

SEQ ID NO: 429094 - RNA, 32 nt, Human
gauccugcuacccagagggugaauggguaucu

SEQ ID NO: 429095 - RNA, 32 nt, Human
gauccugcuaucuuugccuuuugagauaccau

SEQ ID NO: 429096 - RNA, 32 nt, Human
gauccugcucagccucugccucggcugcuucc

SEQ ID NO: 429097 - RNA, 32 nt, Human
gauccugcuguggccucacuucccugggaacu

SEQ ID NO: 429098 - RNA, 32 nt, Human
gauccuggaaagaaaaugcacaauaugacuau

SEQ ID NO: 429099 - RNA, 32 nt, Human
gauccuggaaaugagaccugguggaauauuau

SEQ ID NO: 429100 - RNA, 32 nt, Human
gauccuggaaccagggcugaggcucgcauccu

SEQ ID NO: 429101 - RNA, 32 nt, Human
gauccuggacuuggaccugggccugcaguucc

SEQ ID NO: 429102 - RNA, 32 nt, Human
gauccuggagugauaugauccagagcagaguu

SEQ ID NO: 429103 - RNA, 32 nt, Human
gauccuggccaacacggugaaacccccgucuc

SEQ ID NO: 429104 - RNA, 32 nt, Human
gauccuggcucacugcaacugcagccucccgg

SEQ ID NO: 429105 - RNA, 32 nt, Human
gauccugggacccccuacucuauccgccaccg

SEQ ID NO: 429106 - RNA, 32 nt, Human
gauccugggaggaugugacgucaggugagaag

SEQ ID NO: 429107 - RNA, 32 nt, Human
gauccugggaggcagagguuguagugagccga

SEQ ID NO: 429108 - RNA, 32 nt, Human
gauccugggaguucgagaccagccugggcaac

SEQ ID NO: 429109 - RNA, 32 nt, Human
gauccugggcuugcggcugccagaccugugag

SEQ ID NO: 429110 - RNA, 32 nt, Human
gauccuggggcaggcaggaggcagugggcuuc

SEQ ID NO: 429111 - RNA, 32 nt, Human
gauccuggggguaugugcuggcuuccaaccug

SEQ ID NO: 429112 - RNA, 32 nt, Human
gauccuggguuucuagucauccuuuuuaagcu

SEQ ID NO: 429113 - RNA, 32 nt, Human
gauccuggucuuucagguccaucaggguccca

SEQ ID NO: 429114 - RNA, 32 nt, Human
gauccugguggaagcgagauucaggggacuca

SEQ ID NO: 429115 - RNA, 32 nt, Human
gauccugguggacggaucaggagaaugggcag

SEQ ID NO: 429116 - RNA, 32 nt, Human
gauccugguuuguacugcuguguggucuuaau

SEQ ID NO: 429117 - RNA, 32 nt, Human
gauccuguacaacccuuuguggacccuuuugg

SEQ ID NO: 429118 - RNA, 18 nt, Human
gauccugucaggcuguug

SEQ ID NO: 429119 - RNA, 32 nt, Human
gauccugucggcugggggcggcuggucuccuu

SEQ ID NO: 429120 - RNA, 32 nt, Human
gauccugugaauaaaauggcgcagacgugcuu

SEQ ID NO: 429121 - RNA, 32 nt, Human
gauccuguggcucucccguugcagaggccaca

SEQ ID NO: 429122 - RNA, 32 nt, Human
gauccuguuaauuaaaccacagacaccauaua

SEQ ID NO: 429123 - RNA, 32 nt, Human
gauccuuauuaucucuauguaaauaaaguuug

SEQ ID NO: 429124 - RNA, 32 nt, Human
gauccuucagcacagggauucucaagaccuga

SEQ ID NO: 429125 - RNA, 32 nt, Human
gauccuucaguucuggccauuccagggacccu

SEQ ID NO: 429126 - RNA, 32 nt, Human
gauccuuccaaaccagcaccaacagagccaag

SEQ ID NO: 429127 - RNA, 32 nt, Human
gauccuucccagcuggcauccccacccuaagc

SEQ ID NO: 429128 - RNA, 32 nt, Human
gauccuuccccaccaucuucagaucuguuccu

SEQ ID NO: 429129 - RNA, 32 nt, Human
gauccuuccugccucuuccagcucccaggggc

SEQ ID NO: 429130 - RNA, 32 nt, Human
gauccuucugcccaggaagccugcugcauccc

SEQ ID NO: 429131 - RNA, 32 nt, Human
gauccuugagcccaggagguugaggcugcagu

SEQ ID NO: 429132 - RNA, 31 nt, Human
gauccuugccucucugcccugcuucucgaca

SEQ ID NO: 429133 - RNA, 32 nt, Human
gauccuugcuaccccucuaccugcugcuguuc

SEQ ID NO: 429134 - RNA, 32 nt, Human
gauccuuggaggaggaggaagaggaggccacu

SEQ ID NO: 429135 - RNA, 32 nt, Human
gauccuuggcagcaugacuguaccaaaugucc

SEQ ID NO: 429136 - RNA, 29 nt, Human
gauccuuggcugcuucauugucuuccccc

SEQ ID NO: 429137 - RNA, 32 nt, Human
gauccuugucugccuucacuucccuaggcugg

SEQ ID NO: 429138 - RNA, 32 nt, Human
gauccuuguguucagcucuuuccaaauuaaaa

SEQ ID NO: 429139 - RNA, 31 nt, Human
gauccuuucaauaaacaagacuuguagaaaa

SEQ ID NO: 429140 - RNA, 32 nt, Human
gauccuuugaagcaugaguucuuaccagcaga

SEQ ID NO: 429141 - RNA, 32 nt, Human
gaucgaaccauuguacuccagccugggugaca

SEQ ID NO: 429142 - RNA, 32 nt, Human
gaucgaagcgccgccuccgccgccgagagguc

SEQ ID NO: 429143 - RNA, 32 nt, Human
gaucgacgugcugagacauucuucugauaaag

SEQ ID NO: 429144 - RNA, 32 nt, Human
gaucgagaccagccugaccaacauggugaaac

SEQ ID NO: 429145 - RNA, 32 nt, Human
gaucgagaccagccuggccaacauaguaaaac

SEQ ID NO: 429146 - RNA, 32 nt, Human
gaucgagaccagccuggccaacauggugaaac

SEQ ID NO: 429147 - RNA, 32 nt, Human
gaucgagaccagccuggccaacguggugaaac

SEQ ID NO: 429148 - RNA, 32 nt, Human
gaucgagaccaucuuggccaacauggugaaac

SEQ ID NO: 429149 - RNA, 32 nt, Human
gaucgagaccaucuuggcuaacaaggugaaac

SEQ ID NO: 429150 - RNA, 32 nt, Human
gaucgagaccaucuuggcuaacauggugaaac

SEQ ID NO: 429151 - RNA, 32 nt, Human
gaucgagaccaucuuggcuaauauggugaaac

SEQ ID NO: 429152 - RNA, 32 nt, Human
gaucgagaucagccuggccaacauggugaaac

SEQ ID NO: 429153 - RNA, 32 nt, Human
gaucgagccacugcacuccagccugggcaaca

SEQ ID NO: 429154 - RNA, 32 nt, Human
gaucgagccacugcacuccagccugggcagcu

SEQ ID NO: 429155 - RNA, 32 nt, Human
gaucgagccacugcacuccagccugggcgaca

SEQ ID NO: 429156 - RNA, 32 nt, Human
gaucgagccacugcacuccagccugggugaca

SEQ ID NO: 429157 - RNA, 32 nt, Human
gaucgagccacugcacuccagccugggugaug

SEQ ID NO: 429158 - RNA, 32 nt, Human
gaucgagccacugcacuccugggcaacagagc

SEQ ID NO: 429159 - RNA, 32 nt, Human
gaucgagccacugcauuccagccugggcgaaa

SEQ ID NO: 429160 - RNA, 32 nt, Human
gaucgagccauugcacuccagccuggacagca

SEQ ID NO: 429161 - RNA, 32 nt, Human
gaucgagccauugcacuccagccugggcaaca

SEQ ID NO: 429162 - RNA, 18 nt, Human
gaucgaggacuuccgggg

SEQ ID NO: 429163 - RNA, 32 nt, Human
gaucgaggagcagaagagacagcuggaggagc

SEQ ID NO: 429164 - RNA, 32 nt, Human
gaucgaggccaguagugugagccaagcgcagc

SEQ ID NO: 429165 - RNA, 32 nt, Human
gaucgaguaguaacagccacuccaacucucca

SEQ ID NO: 429166 - RNA, 32 nt, Human
gaucgaguccuggcuugggaaggaaggucuga

SEQ ID NO: 429167 - RNA, 32 nt, Human
gaucgagugucuugccccagaccggcagccug

SEQ ID NO: 429168 - RNA, 32 nt, Human
gaucgaguguucacccuucaccucagcucaac

SEQ ID NO: 429169 - RNA, 32 nt, Human
gaucgaguuacugcacuccagccugggugaca

SEQ ID NO: 429170 - RNA, 32 nt, Human
gaucgaugacaccaccagaguuacucacuuaa

SEQ ID NO: 429171 - RNA, 32 nt, Human
gaucgaugugcugcuguuaacccgugaggagg

SEQ ID NO: 429172 - RNA, 32 nt, Human
gaucgcaacacuacacuccagccugggcgaca

SEQ ID NO: 429173 - RNA, 32 nt, Human
gaucgcaacacugcacuccagccugggcgaca

SEQ ID NO: 429174 - RNA, 32 nt, Human
gaucgcaacacugcacuccagccugggugaca

SEQ ID NO: 429175 - RNA, 32 nt, Human
gaucgcaacacugcccuccagccugggcaaca

SEQ ID NO: 429176 - RNA, 32 nt, Human
gaucgcaacauugcacuccaggcugggcagca

SEQ ID NO: 429177 - RNA, 32 nt, Human
gaucgcaccacagcacuccagcccaggcggca

SEQ ID NO: 429178 - RNA, 32 nt, Human
gaucgcaccaccacacuccagccugggugaca

SEQ ID NO: 429179 - RNA, 32 nt, Human
gaucgcaccacggcacuccagccuggcgacag

SEQ ID NO: 429180 - RNA, 32 nt, Human
gaucgcaccacugaacuccagccugggcgaca

SEQ ID NO: 429181 - RNA, 32 nt, Human
gaucgcaccacugcacccaaaccuggggagag

SEQ ID NO: 429182 - RNA, 32 nt, Human
gaucgcaccacugcaccccagccugggcaaca

SEQ ID NO: 429183 - RNA, 32 nt, Human
gaucgcaccacugcaccccagcgugggcaaca

SEQ ID NO: 429184 - RNA, 32 nt, Human
gaucgcaccacugcacgcacuccagccugggu

SEQ ID NO: 429185 - RNA, 32 nt, Human
gaucgcaccacugcacuacagccugggcgaca

SEQ ID NO: 429186 - RNA, 32 nt, Human
gaucgcaccacugcacucaagccugggcgaca

SEQ ID NO: 429187 - RNA, 32 nt, Human
gaucgcaccacugcacuccaaccugggcaaca

SEQ ID NO: 429188 - RNA, 32 nt, Human
gaucgcaccacugcacuccaaccugggugacg

SEQ ID NO: 429189 - RNA, 32 nt, Human
gaucgcaccacugcacuccaaucugggcaaga

SEQ ID NO: 429190 - RNA, 32 nt, Human
gaucgcaccacugcacuccagcaugagugaca

SEQ ID NO: 429191 - RNA, 32 nt, Human
gaucgcaccacugcacuccagccuaggcgacg

SEQ ID NO: 429192 - RNA, 32 nt, Human
gaucgcaccacugcacuccagccuggaagacc

SEQ ID NO: 429193 - RNA, 32 nt, Human
gaucgcaccacugcacuccagccuggacaaca

SEQ ID NO: 429194 - RNA, 32 nt, Human
gaucgcaccacugcacuccagccugggagaca

SEQ ID NO: 429195 - RNA, 32 nt, Human
gaucgcaccacugcacuccagccugggagaua

SEQ ID NO: 429196 - RNA, 32 nt, Human
gaucgcaccacugcacuccagccugggcaaca

SEQ ID NO: 429197 - RNA, 32 nt, Human
gaucgcaccacugcacuccagccugggcgaaa

SEQ ID NO: 429198 - RNA, 32 nt, Human
gaucgcaccacugcacuccagccugggcgaca

SEQ ID NO: 429199 - RNA, 32 nt, Human
gaucgcaccacugcacuccagccugggcggca

SEQ ID NO: 429200 - RNA, 32 nt, Human
gaucgcaccacugcacuccagccugggcuaca

SEQ ID NO: 429201 - RNA, 32 nt, Human
gaucgcaccacugcacuccagccugggugaca

SEQ ID NO: 429202 - RNA, 32 nt, Human
gaucgcaccacugcacuccagccugggugaug

SEQ ID NO: 429203 - RNA, 32 nt, Human
gaucgcaccacugcacuccagccuggguuaca

SEQ ID NO: 429204 - RNA, 32 nt, Human
gaucgcaccacugcacuccagccuggucgaca

SEQ ID NO: 429205 - RNA, 32 nt, Human
gaucgcaccacugcacuccagccuggugacag

SEQ ID NO: 429206 - RNA, 32 nt, Human
gaucgcaccacugcacuccagccugguuacag

SEQ ID NO: 429207 - RNA, 32 nt, Human
gaucgcaccacugcacuccagcucgggugaca

SEQ ID NO: 429208 - RNA, 32 nt, Human
gaucgcaccacugcacuccagcuuggaggaaa

SEQ ID NO: 429209 - RNA, 32 nt, Human
gaucgcaccacugcacuccagcuugguucaug

SEQ ID NO: 429210 - RNA, 32 nt, Human
gaucgcaccacugcacuccagucuggcaacag

SEQ ID NO: 429211 - RNA, 32 nt, Human
gaucgcaccacugcacucccgcuuggcaauag

SEQ ID NO: 429212 - RNA, 32 nt, Human
gaucgcaccacugcacucuagccugggugaaa

SEQ ID NO: 429213 - RNA, 32 nt, Human
gaucgcaccacugcacucuagccugggugacc

SEQ ID NO: 429214 - RNA, 32 nt, Human
gaucgcaccacugcacucuagcuugggcaaca

SEQ ID NO: 429215 - RNA, 32 nt, Human
gaucgcaccacugcacugcagccuggcaacaa

SEQ ID NO: 429216 - RNA, 24 nt, Human
gaucgcaccacugcacuucagccu

SEQ ID NO: 429217 - RNA, 32 nt, Human
gaucgcaccacugcacuucagccugggugaca

SEQ ID NO: 429218 - RNA, 32 nt, Human
gaucgcaccacugcauucagccugagcaacag

SEQ ID NO: 429219 - RNA, 32 nt, Human
gaucgcaccacugcauuccagccuaagcaaua

SEQ ID NO: 429220 - RNA, 32 nt, Human
gaucgcaccacugcauuccagccugggcaaca

SEQ ID NO: 429221 - RNA, 32 nt, Human
gaucgcaccacugcauuccagccugggugaca

SEQ ID NO: 429222 - RNA, 32 nt, Human
gaucgcaccacugcauucuagccuuagugaua

SEQ ID NO: 429223 - RNA, 32 nt, Human
gaucgcaccacugcauugcagccuggugacag

SEQ ID NO: 429224 - RNA, 32 nt, Human
gaucgcaccacugcccuccagccuaggugaca

SEQ ID NO: 429225 - RNA, 32 nt, Human
gaucgcaccacugcucuccagccuggcgacag

SEQ ID NO: 429226 - RNA, 32 nt, Human
gaucgcaccacuguacuccagccugggcaaca

SEQ ID NO: 429227 - RNA, 32 nt, Human
gaucgcaccacuguacuccagccugggcgacg

SEQ ID NO: 429228 - RNA, 32 nt, Human
gaucgcaccacuguacuccagccugggugaca

SEQ ID NO: 429229 - RNA, 32 nt, Human
gaucgcaccacuguacuccagccugggugacu

SEQ ID NO: 429230 - RNA, 32 nt, Human
gaucgcaccacuguauccagcucgggcaacaa

SEQ ID NO: 429231 - RNA, 32 nt, Human
gaucgcaccacuguauuccagccuggaugaca

SEQ ID NO: 429232 - RNA, 32 nt, Human
gaucgcaccauuacacuccagccugggcaaca

SEQ ID NO: 429233 - RNA, 32 nt, Human
gaucgcaccauugcacuccagcccgggcaaca

SEQ ID NO: 429234 - RNA, 32 nt, Human
gaucgcaccauugcacuccagccuaggcaaaa

SEQ ID NO: 429235 - RNA, 32 nt, Human
gaucgcaccauugcacuccagccugagugaca

SEQ ID NO: 429236 - RNA, 32 nt, Human
gaucgcaccauugcacuccagccuggaugaua

SEQ ID NO: 429237 - RNA, 32 nt, Human
gaucgcaccauugcacuccagccuggcgaccg

SEQ ID NO: 429238 - RNA, 32 nt, Human
gaucgcaccauugcacuccagccugggcaaca

SEQ ID NO: 429239 - RNA, 32 nt, Human
gaucgcaccauugcacuccagccugggcaacg

SEQ ID NO: 429240 - RNA, 32 nt, Human
gaucgcaccauugcacuccagccugugcaaca

SEQ ID NO: 429241 - RNA, 32 nt, Human
gaucgcaccauugcacuccagcugggagacac

SEQ ID NO: 429242 - RNA, 32 nt, Human
gaucgcaccauugcacuccugccugggcaaca

SEQ ID NO: 429243 - RNA, 32 nt, Human
gaucgcaccauugcacucuagccugggcaacg

SEQ ID NO: 429244 - RNA, 32 nt, Human
gaucgcaccauugcacuucagccugggcaaca

SEQ ID NO: 429245 - RNA, 32 nt, Human
gaucgcaccauugcauuccagccugggcaaca

SEQ ID NO: 429246 - RNA, 32 nt, Human
gaucgcaccauugcccuccagccugggcaaca

SEQ ID NO: 429247 - RNA, 32 nt, Human
gaucgcaccauuguacuccagccugggcaaca

SEQ ID NO: 429248 - RNA, 32 nt, Human
gaucgcaccccugcacuccagccugggcaaca

SEQ ID NO: 429249 - RNA, 32 nt, Human
gaucgcacccuuacacuucagccugggcgacc

SEQ ID NO: 429250 - RNA, 32 nt, Human
gaucgcacccuuacacuuuagccugggcgacc

SEQ ID NO: 429251 - RNA, 32 nt, Human
gaucgcaccgcugcacuccagccugggcaaca

SEQ ID NO: 429252 - RNA, 32 nt, Human
gaucgcaccgcugcacuccagccugggcaaga

SEQ ID NO: 429253 - RNA, 32 nt, Human
gaucgcaccgcugcacuccagccugggugaca

SEQ ID NO: 429254 - RNA, 32 nt, Human
gaucgcaccgcugcccuccagccugggcaaca

SEQ ID NO: 429255 - RNA, 32 nt, Human
gaucgcaccuguaaucccagucacugggaagc

SEQ ID NO: 429256 - RNA, 32 nt, Human
gaucgcacuacugcacuccagccugggugaca

SEQ ID NO: 429257 - RNA, 32 nt, Human
gaucgcacuauugcacucaagccugggcgaca

SEQ ID NO: 429258 - RNA, 32 nt, Human
gaucgcacuugaggcuggaggcaugaguccug

SEQ ID NO: 429259 - RNA, 32 nt, Human
gaucgcagcacuguacuccagccugggcgaug

SEQ ID NO: 429260 - RNA, 22 nt, Human
gaucgcagccagcccuucgccu

SEQ ID NO: 429261 - RNA, 32 nt, Human
gaucgcagcuacucgggagguggagguugcag

SEQ ID NO: 429262 - RNA, 27 nt, Human
gaucgcagcucacugcaaucucugccu

SEQ ID NO: 429263 - RNA, 32 nt, Human
gaucgcagcucacugcaaucucugccuccugg

SEQ ID NO: 429264 - RNA, 32 nt, Human
gaucgcaucacugcaguccagccuggaugaca

SEQ ID NO: 429265 - RNA, 32 nt, Human
gaucgcaucauugcacucuagccugggccaca

SEQ ID NO: 429266 - RNA, 32 nt, Human
gaucgcaugcuacugcacuccagccugggaga

SEQ ID NO: 429267 - RNA, 32 nt, Human
gaucgcauuacugcacuccagccuggguaaca

SEQ ID NO: 429268 - RNA, 32 nt, Human
gaucgccaccccgcacagccuggguagcgugu

SEQ ID NO: 429269 - RNA, 32 nt, Human
gaucgccacugcacuccagccugggaaauaga

SEQ ID NO: 429270 - RNA, 32 nt, Human
gaucgccagaacuuaggacacaugggauggag

SEQ ID NO: 429271 - RNA, 32 nt, Human
gaucgcccacugcacuccagguugggcuacag

SEQ ID NO: 429272 - RNA, 32 nt, Human
gaucgccccacuacacuccagccuggucaaca

SEQ ID NO: 429273 - RNA, 32 nt, Human
gaucgccccacugcacuccagccuggcaauag

SEQ ID NO: 429274 - RNA, 32 nt, Human
gaucgccccacugcacuccagccugggcgaca

SEQ ID NO: 429275 - RNA, 32 nt, Human
gaucgccccacugcacuccagccuggugacuc

SEQ ID NO: 429276 - RNA, 32 nt, Human
gaucgccccauuguacuccagccuggggaaca

SEQ ID NO: 429277 - RNA, 32 nt, Human
gaucgcccgccccagcccggggccgcucaggu

SEQ ID NO: 429278 - RNA, 32 nt, Human
gaucgcccugcugcacuccagccugggcaaca

SEQ ID NO: 429279 - RNA, 32 nt, Human
gaucgcccugcugcacuccagccugggugaca

SEQ ID NO: 429280 - RNA, 32 nt, Human
gaucgccggcuguuuggcauguucccaccggg

SEQ ID NO: 429281 - RNA, 32 nt, Human
gaucgccggggagggggaccagagagccgcgc

SEQ ID NO: 429282 - RNA, 32 nt, Human
gaucgcgacacugcacuccagccugggcaaca

SEQ ID NO: 429283 - RNA, 32 nt, Human
gaucgcgacacugcacuccagccugggugacg

SEQ ID NO: 429284 - RNA, 32 nt, Human
gaucgcgacacugcgcuccagccugggcaaca

SEQ ID NO: 429285 - RNA, 32 nt, Human
gaucgcgcaauugcgcuccagccugggcgaca

SEQ ID NO: 429286 - RNA, 32 nt, Human
gaucgcgcagcugcacuccagccugggcaaca

SEQ ID NO: 429287 - RNA, 32 nt, Human
gaucgcgccaaugcacuccagccugggcgaca

SEQ ID NO: 429288 - RNA, 32 nt, Human
gaucgcgccacccacuccagcccgggugacag

SEQ ID NO: 429289 - RNA, 32 nt, Human
gaucgcgccaccgcauuccagccugggcgaca

SEQ ID NO: 429290 - RNA, 32 nt, Human
gaucgcgccaccgcccuccagccugggcgaca

SEQ ID NO: 429291 - RNA, 32 nt, Human
gaucgcgccacggcacuccagccugggagaca

SEQ ID NO: 429292 - RNA, 32 nt, Human
gaucgcgccacuacacuccagccugagcaaca

SEQ ID NO: 429293 - RNA, 32 nt, Human
gaucgcgccacuacuccagccugggugacaaa

SEQ ID NO: 429294 - RNA, 32 nt, Human
gaucgcgccacuauacuccagccugggcaaca

SEQ ID NO: 429295 - RNA, 32 nt, Human
gaucgcgccacugcaacccagccugggugaca

SEQ ID NO: 429296 - RNA, 32 nt, Human
gaucgcgccacugcacagccagggcgacggug

SEQ ID NO: 429297 - RNA, 32 nt, Human
gaucgcgccacugcacucaagccugggcaaca

SEQ ID NO: 429298 - RNA, 32 nt, Human
gaucgcgccacugcacuccaaccugggugaca

SEQ ID NO: 429299 - RNA, 32 nt, Human
gaucgcgccacugcacuccacccuggguaacg

SEQ ID NO: 429300 - RNA, 32 nt, Human
gaucgcgccacugcacuccagcagucugggcg

SEQ ID NO: 429301 - RNA, 32 nt, Human
gaucgcgccacugcacuccagcccgggugaca

SEQ ID NO: 429302 - RNA, 32 nt, Human
gaucgcgccacugcacuccagccuagacgaca

SEQ ID NO: 429303 - RNA, 32 nt, Human
gaucgcgccacugcacuccagccuaggggaca

SEQ ID NO: 429304 - RNA, 32 nt, Human
gaucgcgccacugcacuccagccuaggugaca

SEQ ID NO: 429305 - RNA, 32 nt, Human
gaucgcgccacugcacuccagccucagcaaua

SEQ ID NO: 429306 - RNA, 32 nt, Human
gaucgcgccacugcacuccagccucggcaaca

SEQ ID NO: 429307 - RNA, 32 nt, Human
gaucgcgccacugcacuccagccucggugaca

SEQ ID NO: 429308 - RNA, 32 nt, Human
gaucgcgccacugcacuccagccuggacgaca

SEQ ID NO: 429309 - RNA, 32 nt, Human
gaucgcgccacugcacuccagccuggcaacag

SEQ ID NO: 429310 - RNA, 32 nt, Human
gaucgcgccacugcacuccagccuggcgacaa

SEQ ID NO: 429311 - RNA, 32 nt, Human
gaucgcgccacugcacuccagccuggcgacag

SEQ ID NO: 429312 - RNA, 32 nt, Human
gaucgcgccacugcacuccagccugggcaaca

SEQ ID NO: 429313 - RNA, 32 nt, Human
gaucgcgccacugcacuccagccugggcgaca

SEQ ID NO: 429314 - RNA, 32 nt, Human
gaucgcgccacugcacuccagccugggcgacg

SEQ ID NO: 429315 - RNA, 32 nt, Human
gaucgcgccacugcacuccagccugggcgaga

SEQ ID NO: 429316 - RNA, 32 nt, Human
gaucgcgccacugcacuccagccugggcgaua

SEQ ID NO: 429317 - RNA, 32 nt, Human
gaucgcgccacugcacuccagccuggguaaca

SEQ ID NO: 429318 - RNA, 32 nt, Human
gaucgcgccacugcacuccagccugggugaca

SEQ ID NO: 429319 - RNA, 32 nt, Human
gaucgcgccacugcacuccagccugggugaua

SEQ ID NO: 429320 - RNA, 32 nt, Human
gaucgcgccacugcacuccagccuggugacag

SEQ ID NO: 429321 - RNA, 32 nt, Human
gaucgcgccacugcacuccagcuugggcaaca

SEQ ID NO: 429322 - RNA, 32 nt, Human
gaucgcgccacugcacuccaggccugggugac

SEQ ID NO: 429323 - RNA, 32 nt, Human
gaucgcgccacugcacuccaggcugggcaacg

SEQ ID NO: 429324 - RNA, 32 nt, Human
gaucgcgccacugcacuccaggcugggcgaca

SEQ ID NO: 429325 - RNA, 32 nt, Human
gaucgcgccacugcacuccagucugggcaaca

SEQ ID NO: 429326 - RNA, 32 nt, Human
gaucgcgccacugcacuccaguuugggcaaca

SEQ ID NO: 429327 - RNA, 32 nt, Human
gaucgcgccacugcacuccggccugaugacag

SEQ ID NO: 429328 - RNA, 32 nt, Human
gaucgcgccacugcacuccugccugggacaca

SEQ ID NO: 429329 - RNA, 32 nt, Human
gaucgcgccacugcacuccugccugggcaacu

SEQ ID NO: 429330 - RNA, 32 nt, Human
gaucgcgccacugcacucuagccggagugaca

SEQ ID NO: 429331 - RNA, 32 nt, Human
gaucgcgccacugcacucuagccugagugaca

SEQ ID NO: 429332 - RNA, 32 nt, Human
gaucgcgccacugcacucuagccugggccaua

SEQ ID NO: 429333 - RNA, 32 nt, Human
gaucgcgccacugcacucuagccugggugaca

SEQ ID NO: 429334 - RNA, 24 nt, Human
gaucgcgccacugcacuuccgccu

SEQ ID NO: 429335 - RNA, 32 nt, Human
gaucgcgccacugcaguccagccugggcaaca

SEQ ID NO: 429336 - RNA, 32 nt, Human
gaucgcgccacugcauuccagccuggacgaca

SEQ ID NO: 429337 - RNA, 32 nt, Human
gaucgcgccacugcccuccagccugggcgaca

SEQ ID NO: 429338 - RNA, 32 nt, Human
gaucgcgccacugcgcuucagccugggagaca

SEQ ID NO: 429339 - RNA, 32 nt, Human
gaucgcgccacugcucuccagccuggguggca

SEQ ID NO: 429340 - RNA, 32 nt, Human
gaucgcgccacuggacuccagccuggacaaca

SEQ ID NO: 429341 - RNA, 32 nt, Human
gaucgcgccacugggcuccagccugggcgaca

SEQ ID NO: 429342 - RNA, 32 nt, Human
gaucgcgccacuguacuccagccuggacaaca

SEQ ID NO: 429343 - RNA, 32 nt, Human
gaucgcgccacuguacuccagccugggcaaca

SEQ ID NO: 429344 - RNA, 32 nt, Human
gaucgcgccacuguacuccagccugggugaca

SEQ ID NO: 429345 - RNA, 32 nt, Human
gaucgcgccacugugcuccagccugggcaaca

SEQ ID NO: 429346 - RNA, 32 nt, Human
gaucgcgccaguacacuccagccuggguaaca

SEQ ID NO: 429347 - RNA, 32 nt, Human
gaucgcgccagugcacuccagccugggcaaga

SEQ ID NO: 429348 - RNA, 32 nt, Human
gaucgcgccaucacacuccagccuaggcgaca

SEQ ID NO: 429349 - RNA, 32 nt, Human
gaucgcgccaucgcacuccagccugggcaaca

SEQ ID NO: 429350 - RNA, 32 nt, Human
gaucgcgccaucgcacuccagccugggugaca

SEQ ID NO: 429351 - RNA, 32 nt, Human
gaucgcgccauuacacuucagccugggcaaca

SEQ ID NO: 429352 - RNA, 32 nt, Human
gaucgcgccauucuacuccagccugggccaca

SEQ ID NO: 429353 - RNA, 32 nt, Human
gaucgcgccauugcacuccaaccuaggugaca

SEQ ID NO: 429354 - RNA, 32 nt, Human
gaucgcgccauugcacuccaaccuggacgaca

SEQ ID NO: 429355 - RNA, 32 nt, Human
gaucgcgccauugcacuccagccuggacaaca

SEQ ID NO: 429356 - RNA, 32 nt, Human
gaucgcgccauugcacuccagccuggccuaua

SEQ ID NO: 429357 - RNA, 32 nt, Human
gaucgcgccauugcacuccagccuggcugaca

SEQ ID NO: 429358 - RNA, 32 nt, Human
gaucgcgccauugcacuccagccugggcaaca

SEQ ID NO: 429359 - RNA, 32 nt, Human
gaucgcgccauugcacuccagccugggcaacg

SEQ ID NO: 429360 - RNA, 32 nt, Human
gaucgcgccauugcacuccagccugggcaacu

SEQ ID NO: 429361 - RNA, 32 nt, Human
gaucgcgccauugcacuccagccugggcgaca

SEQ ID NO: 429362 - RNA, 32 nt, Human
gaucgcgccauugcacuccagccugggcggca

SEQ ID NO: 429363 - RNA, 32 nt, Human
gaucgcgccauugcacuccagccugggggaca

SEQ ID NO: 429364 - RNA, 32 nt, Human
gaucgcgccauugcacuccagccuggguaaca

SEQ ID NO: 429365 - RNA, 32 nt, Human
gaucgcgccauugcacuccagccugggugaca

SEQ ID NO: 429366 - RNA, 32 nt, Human
gaucgcgccauugcacuccauccuggacaaca

SEQ ID NO: 429367 - RNA, 32 nt, Human
gaucgcgccauugcacucccgccugggcgacu

SEQ ID NO: 429368 - RNA, 32 nt, Human
gaucgcgccauugcacuccggccuggggacaa

SEQ ID NO: 429369 - RNA, 32 nt, Human
gaucgcgccauugcacucuagccugggcaaca

SEQ ID NO: 429370 - RNA, 32 nt, Human
gaucgcgccauuguacuccagccugggcgaug

SEQ ID NO: 429371 - RNA, 32 nt, Human
gaucgcgccccugcacuccagccugggugaca

SEQ ID NO: 429372 - RNA, 32 nt, Human
gaucgcgccgcugcacuccagccugggccaca

SEQ ID NO: 429373 - RNA, 32 nt, Human
gaucgcgccgcugcacuccagccugggcgaca

SEQ ID NO: 429374 - RNA, 32 nt, Human
gaucgcgccgcugcacuccagccugggcggca

SEQ ID NO: 429375 - RNA, 32 nt, Human
gaucgcgccgcugcacuccagccugggugaca

SEQ ID NO: 429376 - RNA, 32 nt, Human
gaucgcgccgcugcauuccagccugggugaca

SEQ ID NO: 429377 - RNA, 32 nt, Human
gaucgcgccguugcacuccagccugggcaaca

SEQ ID NO: 429378 - RNA, 32 nt, Human
gaucgcgccuuugcacuccagccuggaagaca

SEQ ID NO: 429379 - RNA, 32 nt, Human
gaucgcgcuacugcacuccagccugggcgaca

SEQ ID NO: 429380 - RNA, 32 nt, Human
gaucgcgcuacugcacuccagccugggugaca

SEQ ID NO: 429381 - RNA, 32 nt, Human
gaucgcgcuacugcauuccagccugggcgccg

SEQ ID NO: 429382 - RNA, 32 nt, Human
gaucgcgcuauugcacuccagccugggugaca

SEQ ID NO: 429383 - RNA, 32 nt, Human
gaucgcgcugcugcacuccagccugggugaca

SEQ ID NO: 429384 - RNA, 24 nt, Human
gaucgcggcauugcacuucagccu

SEQ ID NO: 429385 - RNA, 32 nt, Human
gaucgcggcauugcacuucagccugggcgaua

SEQ ID NO: 429386 - RNA, 32 nt, Human
gaucgcggcgcugcacucuagccugggugaca

SEQ ID NO: 429387 - RNA, 32 nt, Human
gaucgcggcggccccgggcucugggugcggag

SEQ ID NO: 429388 - RNA, 32 nt, Human
gaucgcggcucacugcagccuccauccucugg

SEQ ID NO: 429389 - RNA, 32 nt, Human
gaucgcgucacugcacuccagccuggacaaca

SEQ ID NO: 429390 - RNA, 32 nt, Human
gaucgcgucacugcacuccagccugggagaca

SEQ ID NO: 429391 - RNA, 32 nt, Human
gaucgcgucacugcacuccagccugggcgaca

SEQ ID NO: 429392 - RNA, 32 nt, Human
gaucgcgucacugcacuccagcgugggcgaca

SEQ ID NO: 429393 - RNA, 32 nt, Human
gaucgcgucaguacacuccagccugggcaaca

SEQ ID NO: 429394 - RNA, 32 nt, Human
gaucgcgucauugcacuccagccugggcaaca

SEQ ID NO: 429395 - RNA, 32 nt, Human
gaucgcgucgcuggacuccagcccgggcgaca

SEQ ID NO: 429396 - RNA, 32 nt, Human
gaucgcuacuauucaggacuaaucuauacuua

SEQ ID NO: 429397 - RNA, 32 nt, Human
gaucgcucauucuucuuuuaugauucauacgu

SEQ ID NO: 429398 - RNA, 32 nt, Human
gaucgcucauucuucuuuuauuauucauacgu

SEQ ID NO: 429399 - RNA, 32 nt, Human
gaucgcuccacugcacuccagcccaggugaca

SEQ ID NO: 429400 - RNA, 32 nt, Human
gaucgcuccacugcacuccagccugggugaca

SEQ ID NO: 429401 - RNA, 32 nt, Human
gaucgcuccauugcacuccagccugggugaca

SEQ ID NO: 429402 - RNA, 32 nt, Human
gaucgcucccacugcacuccagccugggcgac

SEQ ID NO: 429403 - RNA, 32 nt, Human
gaucgcugacucugcucuguuucauauuucag

SEQ ID NO: 429404 - RNA, 32 nt, Human
gaucgcugcacuccagccugggcgacaagagc

SEQ ID NO: 429405 - RNA, 32 nt, Human
gaucgcugcucaccgcaaccuccgccuuccag

SEQ ID NO: 429406 - RNA, 32 nt, Human
gaucgcugggcugggcuaacggcgacggagag

SEQ ID NO: 429407 - RNA, 31 nt, Human
gaucgcuguuccaaggaggcugagaacaagu

SEQ ID NO: 429408 - RNA, 32 nt, Human
gaucgcuugaacccgggaggcagcaguugcag

SEQ ID NO: 429409 - RNA, 32 nt, Human
gaucgcuugagaccagccuggggaacauagug

SEQ ID NO: 429410 - RNA, 31 nt, Human
gaucgcuugaggcaaggaguuggagacaugc

SEQ ID NO: 429411 - RNA, 32 nt, Human
gaucgcuugagugcaagaguucaagaucagac

SEQ ID NO: 429412 - RNA, 17 nt, Human
gaucggaagguggugaa

SEQ ID NO: 429413 - RNA, 32 nt, Human
gaucggaggugccaaguagcagagaaagcauc

SEQ ID NO: 429414 - RNA, 32 nt, Human
gaucggauuugcuuuucucuucugccucggau

SEQ ID NO: 429415 - RNA, 32 nt, Human
gaucggcauggugaaaccccguuucuacuaaa

SEQ ID NO: 429416 - RNA, 32 nt, Human
gaucggccacugcacuccgggcugggcgacag

SEQ ID NO: 429417 - RNA, 32 nt, Human
gaucggccaugcuccgccccagaggcagaauu

SEQ ID NO: 429418 - RNA, 32 nt, Human
gaucggcccuggcaaguaggugacccugacuu

SEQ ID NO: 429419 - RNA, 32 nt, Human
gaucgggaacuccugcuucuccuugccucgaa

SEQ ID NO: 429420 - RNA, 32 nt, Human
gaucgggagcuccagccuucaccagaagcuga

SEQ ID NO: 429421 - RNA, 32 nt, Human
gaucgggauuacaggcaagagccuccacgccc

SEQ ID NO: 429422 - RNA, 32 nt, Human
gaucgggccacggcacuccagccugggugaca

SEQ ID NO: 429423 - RNA, 32 nt, Human
gaucgggccacugcacuccagcuugggugaca

SEQ ID NO: 429424 - RNA, 32 nt, Human
gaucgggccgcugcacuccagccugggggaca

SEQ ID NO: 429425 - RNA, 32 nt, Human
gaucggggauucaggaaggagcccaggagcag

SEQ ID NO: 429426 - RNA, 32 nt, Human
gaucggggguuggagugcgggugggcuccugg

SEQ ID NO: 429427 - RNA, 32 nt, Human
gaucgggucucccuccugugcacccucagguc

SEQ ID NO: 429428 - RNA, 32 nt, Human
gaucggucauuggggugcugcagccccgccac

SEQ ID NO: 429429 - RNA, 32 nt, Human
gaucgguuccuucacuucuucaugccacaagu

SEQ ID NO: 429430 - RNA, 32 nt, Human
gaucguaccacuacacuccagccugggcaacg

SEQ ID NO: 429431 - RNA, 32 nt, Human
gaucguaccacugcacuccagccuaggugaca

SEQ ID NO: 429432 - RNA, 32 nt, Human
gaucguaccacugcacuccagccugggcgaca

SEQ ID NO: 429433 - RNA, 32 nt, Human
gaucguaccacugcacuccagccugggcuaca

SEQ ID NO: 429434 - RNA, 32 nt, Human
gaucguaccacugcacuccagccugggugaca

SEQ ID NO: 429435 - RNA, 32 nt, Human
gaucguaccacugcacuccagucugggcgaca

SEQ ID NO: 429436 - RNA, 32 nt, Human
gaucguaccacugcacucuggccugggcaaca

SEQ ID NO: 429437 - RNA, 32 nt, Human
gaucguaccauugcacuccagccugggcaaca

SEQ ID NO: 429438 - RNA, 32 nt, Human
gaucguaccgcugcacuccagccugggugaua

SEQ ID NO: 429439 - RNA, 32 nt, Human
gaucguaccuauugcacuccauccuggaugaa

SEQ ID NO: 429440 - RNA, 32 nt, Human
gaucguacuacugcacuccagcauggaagaca

SEQ ID NO: 429441 - RNA, 32 nt, Human
gaucguagaguggcacaugcuuacagggcauu

SEQ ID NO: 429442 - RNA, 32 nt, Human
gaucguagcacugcaguccagccugggcgaca

SEQ ID NO: 429443 - RNA, 32 nt, Human
gaucgucccacugcacuccagcccgggcaaca

SEQ ID NO: 429444 - RNA, 32 nt, Human
gaucgucccacugcacuccagccugggcaaca

SEQ ID NO: 429445 - RNA, 32 nt, Human
gaucguccuggcccccagcccuaagggauccg

SEQ ID NO: 429446 - RNA, 32 nt, Human
gaucgucugggagcccagugucaagucugcug

SEQ ID NO: 429447 - RNA, 32 nt, Human
gaucgugaagucaggagaucgagaccauccug

SEQ ID NO: 429448 - RNA, 32 nt, Human
gaucgugaauguuuaucuugggacugucuugc

SEQ ID NO: 429449 - RNA, 32 nt, Human
gaucgugacacugcacuccagccugggcgaca

SEQ ID NO: 429450 - RNA, 32 nt, Human
gaucgugacaggccccucccuaugugcaggag

SEQ ID NO: 429451 - RNA, 32 nt, Human
gaucgugacauggccuccagccugggugaccg

SEQ ID NO: 429452 - RNA, 25 nt, Human
gaucgugacccugcuauuuucuccu

SEQ ID NO: 429453 - RNA, 32 nt, Human
gaucgugaggcugcggcaggagaggggccgcc

SEQ ID NO: 429454 - RNA, 32 nt, Human
gaucgugcaacugcacuccaaccugggcaaca

SEQ ID NO: 429455 - RNA, 32 nt, Human
gaucgugcaacugcacuccagccugggcaaaa

SEQ ID NO: 429456 - RNA, 32 nt, Human
gaucgugcagcugcugggcacgcccagugaga

SEQ ID NO: 429457 - RNA, 32 nt, Human
gaucgugccaaugcacuccauccugggcaaaa

SEQ ID NO: 429458 - RNA, 32 nt, Human
gaucgugccaccuacacuccagccugggugac

SEQ ID NO: 429459 - RNA, 32 nt, Human
gaucgugccacuacacuccagccugggcaaaa

SEQ ID NO: 429460 - RNA, 32 nt, Human
gaucgugccacuacacuccagccugggggaca

SEQ ID NO: 429461 - RNA, 32 nt, Human
gaucgugccacuacacuccagccugggugaca

SEQ ID NO: 429462 - RNA, 32 nt, Human
gaucgugccacugaccuccagccugggggaca

SEQ ID NO: 429463 - RNA, 32 nt, Human
gaucgugccacugcaccacuccagccugggca

SEQ ID NO: 429464 - RNA, 32 nt, Human
gaucgugccacugcaccccagccugggcaaca

SEQ ID NO: 429465 - RNA, 32 nt, Human
gaucgugccacugcaccguagccugggugaua

SEQ ID NO: 429466 - RNA, 32 nt, Human
gaucgugccacugcacgccagccugggcaaca

SEQ ID NO: 429467 - RNA, 32 nt, Human
gaucgugccacugcacuacaaccugggugaua

SEQ ID NO: 429468 - RNA, 32 nt, Human
gaucgugccacugcacucaagccugggugaca

SEQ ID NO: 429469 - RNA, 32 nt, Human
gaucgugccacugcacucaagccuggugacag

SEQ ID NO: 429470 - RNA, 32 nt, Human
gaucgugccacugcacuccaaccugggugaga

SEQ ID NO: 429471 - RNA, 32 nt, Human
gaucgugccacugcacuccagacugggggaga

SEQ ID NO: 429472 - RNA, 32 nt, Human
gaucgugccacugcacuccagacuuggugaca

SEQ ID NO: 429473 - RNA, 32 nt, Human
gaucgugccacugcacuccagagccugggcga

SEQ ID NO: 429474 - RNA, 32 nt, Human
gaucgugccacugcacuccagcccaggcaaca

SEQ ID NO: 429475 - RNA, 32 nt, Human
gaucgugccacugcacuccagccugaagacag

SEQ ID NO: 429476 - RNA, 32 nt, Human
gaucgugccacugcacuccagccugagcaaca

SEQ ID NO: 429477 - RNA, 32 nt, Human
gaucgugccacugcacuccagccugcgggaca

SEQ ID NO: 429478 - RNA, 32 nt, Human
gaucgugccacugcacuccagccuggacaacg

SEQ ID NO: 429479 - RNA, 32 nt, Human
gaucgugccacugcacuccagccuggauuaca

SEQ ID NO: 429480 - RNA, 32 nt, Human
gaucgugccacugcacuccagccuggcgacac

SEQ ID NO: 429481 - RNA, 32 nt, Human
gaucgugccacugcacuccagccugggagaca

SEQ ID NO: 429482 - RNA, 32 nt, Human
gaucgugccacugcacuccagccugggcaaca

SEQ ID NO: 429483 - RNA, 32 nt, Human
gaucgugccacugcacuccagccugggcacca

SEQ ID NO: 429484 - RNA, 32 nt, Human
gaucgugccacugcacuccagccugggccaca

SEQ ID NO: 429485 - RNA, 32 nt, Human
gaucgugccacugcacuccagccugggcgaca

SEQ ID NO: 429486 - RNA, 32 nt, Human
gaucgugccacugcacuccagccugggcgacg

SEQ ID NO: 429487 - RNA, 32 nt, Human
gaucgugccacugcacuccagccugggcuaca

SEQ ID NO: 429488 - RNA, 32 nt, Human
gaucgugccacugcacuccagccuggggaaca

SEQ ID NO: 429489 - RNA, 32 nt, Human
gaucgugccacugcacuccagccugggggaca

SEQ ID NO: 429490 - RNA, 32 nt, Human
gaucgugccacugcacuccagccugggugaca

SEQ ID NO: 429491 - RNA, 32 nt, Human
gaucgugccacugcacuccagccugggugaua

SEQ ID NO: 429492 - RNA, 32 nt, Human
gaucgugccacugcacuccagccuggguggac

SEQ ID NO: 429493 - RNA, 32 nt, Human
gaucgugccacugcacuccagccuggucaaca

SEQ ID NO: 429494 - RNA, 32 nt, Human
gaucgugccacugcacuccagccuggugacag

SEQ ID NO: 429495 - RNA, 32 nt, Human
gaucgugccacugcacuccagccuggugagag

SEQ ID NO: 429496 - RNA, 32 nt, Human
gaucgugccacugcacuccagccugguugaca

SEQ ID NO: 429497 - RNA, 32 nt, Human
gaucgugccacugcacuccagcuugggcaaca

SEQ ID NO: 429498 - RNA, 32 nt, Human
gaucgugccacugcacuccaggcugggcgaca

SEQ ID NO: 429499 - RNA, 32 nt, Human
gaucgugccacugcacuccaggcugggugaca

SEQ ID NO: 429500 - RNA, 32 nt, Human
gaucgugccacugcacuccagucugggcaaca

SEQ ID NO: 429501 - RNA, 32 nt, Human
gaucgugccacugcacuccagucugggugaca

SEQ ID NO: 429502 - RNA, 32 nt, Human
gaucgugccacugcacuccauccuggacgaca

SEQ ID NO: 429503 - RNA, 32 nt, Human
gaucgugccacugcacucccagccugggcaac

SEQ ID NO: 429504 - RNA, 32 nt, Human
gaucgugccacugcacuccggccugggugaug

SEQ ID NO: 429505 - RNA, 32 nt, Human
gaucgugccacugcacucuagccggggcgaca

SEQ ID NO: 429506 - RNA, 32 nt, Human
gaucgugccacugcacucuagccugggcgaca

SEQ ID NO: 429507 - RNA, 32 nt, Human
gaucgugccacugcacucuagccugggugaca

SEQ ID NO: 429508 - RNA, 32 nt, Human
gaucgugccacugcacucuauccuggguaaca

SEQ ID NO: 429509 - RNA, 24 nt, Human
gaucgugccacugcacuucagccu

SEQ ID NO: 429510 - RNA, 32 nt, Human
gaucgugccacugcacuucagccugggugaca

SEQ ID NO: 429511 - RNA, 32 nt, Human
gaucgugccacugcauuccagccugggagaga

SEQ ID NO: 429512 - RNA, 32 nt, Human
gaucgugccacugcauuccagccugggcgaca

SEQ ID NO: 429513 - RNA, 32 nt, Human
gaucgugccacugcauuccagccugguugaca

SEQ ID NO: 429514 - RNA, 32 nt, Human
gaucgugccacugcgcuccagccugggugaca

SEQ ID NO: 429515 - RNA, 32 nt, Human
gaucgugccacugcgcuccagccuggguggca

SEQ ID NO: 429516 - RNA, 32 nt, Human
gaucgugccacugcucuccagccugggugaca

SEQ ID NO: 429517 - RNA, 32 nt, Human
gaucgugccacuucacuccagccugggcaaaa

SEQ ID NO: 429518 - RNA, 32 nt, Human
gaucgugccagcccgggggaaaaggcugaguc

SEQ ID NO: 429519 - RNA, 32 nt, Human
gaucgugccagugcacuccagccugggugaca

SEQ ID NO: 429520 - RNA, 32 nt, Human
gaucgugccauuacacuccagccugggcgaaa

SEQ ID NO: 429521 - RNA, 32 nt, Human
gaucgugccauuccacuccagccugggcaacg

SEQ ID NO: 429522 - RNA, 32 nt, Human
gaucgugccauugcacuacagccugggcaaca

SEQ ID NO: 429523 - RNA, 32 nt, Human
gaucgugccauugcacuccagcccaggcgaca

SEQ ID NO: 429524 - RNA, 32 nt, Human
gaucgugccauugcacuccagccuaggcaaca

SEQ ID NO: 429525 - RNA, 32 nt, Human
gaucgugccauugcacuccagccuaggcaaga

SEQ ID NO: 429526 - RNA, 32 nt, Human
gaucgugccauugcacuccagccuaggcaaua

SEQ ID NO: 429527 - RNA, 32 nt, Human
gaucgugccauugcacuccagccuggaugaca

SEQ ID NO: 429528 - RNA, 32 nt, Human
gaucgugccauugcacuccagccuggccacag

SEQ ID NO: 429529 - RNA, 32 nt, Human
gaucgugccauugcacuccagccuggcgacaa

SEQ ID NO: 429530 - RNA, 32 nt, Human
gaucgugccauugcacuccagccuggcgacag

SEQ ID NO: 429531 - RNA, 32 nt, Human
gaucgugccauugcacuccagccugggcaaca

SEQ ID NO: 429532 - RNA, 32 nt, Human
gaucgugccauugcacuccagccugggcaaua

SEQ ID NO: 429533 - RNA, 32 nt, Human
gaucgugccauugcacuccagccugggcgaca

SEQ ID NO: 429534 - RNA, 32 nt, Human
gaucgugccauugcacuccagccugggugaca

SEQ ID NO: 429535 - RNA, 32 nt, Human
gaucgugccauugcacuccagucugggagaca

SEQ ID NO: 429536 - RNA, 32 nt, Human
gaucgugccauugcacuccagucuggguaaga

SEQ ID NO: 429537 - RNA, 32 nt, Human
gaucgugccauugcacuccggccugggcaaca

SEQ ID NO: 429538 - RNA, 32 nt, Human
gaucgugccauugcacucuagccugggcaaca

SEQ ID NO: 429539 - RNA, 32 nt, Human
gaucgugccauugcauuccagccugggagacg

SEQ ID NO: 429540 - RNA, 32 nt, Human
gaucgugccauugcgcuccagccuaggugaca

SEQ ID NO: 429541 - RNA, 32 nt, Human
gaucgugccauugcgcuccagccugggcaaca

SEQ ID NO: 429542 - RNA, 32 nt, Human
gaucgugccauuguauuccagccucggcaaca

SEQ ID NO: 429543 - RNA, 32 nt, Human
gaucgugccauugugcuccagccugggcaaca

SEQ ID NO: 429544 - RNA, 32 nt, Human
gaucgugccgcuaaauucuagccugggcaaca

SEQ ID NO: 429545 - RNA, 32 nt, Human
gaucgugccguugcacuccagccugggcaaca

SEQ ID NO: 429546 - RNA, 32 nt, Human
gaucgugccguugcacuccagccugggcgaca

SEQ ID NO: 429547 - RNA, 32 nt, Human
gaucgugccucugcacuccaaccugggugaug

SEQ ID NO: 429548 - RNA, 32 nt, Human
gaucgugcuacugcacuccagccccagcuggg

SEQ ID NO: 429549 - RNA, 32 nt, Human
gaucgugcuacugcacuccagccugggcaaca

SEQ ID NO: 429550 - RNA, 32 nt, Human
gaucgugcuacugcacuccagccugggggaca

SEQ ID NO: 429551 - RNA, 32 nt, Human
gaucgugcuacugcacuccagucugggugaca

SEQ ID NO: 429552 - RNA, 32 nt, Human
gaucgugcuacugcaguccagccugggcuaca

SEQ ID NO: 429553 - RNA, 32 nt, Human
gaucgugcuauugcacuccagccugggcgaca

SEQ ID NO: 429554 - RNA, 32 nt, Human
gaucgugcugcugcacuccagccugggcaaua

SEQ ID NO: 429555 - RNA, 32 nt, Human
gaucguggcauugcacucuagccugggcaacc

SEQ ID NO: 429556 - RNA, 32 nt, Human
gaucguggccacugcaauccagccugggcgau

SEQ ID NO: 429557 - RNA, 19 nt, Human
gaucguggguuuuggugga

SEQ ID NO: 429558 - RNA, 32 nt, Human
gaucgugguacagaagaaggacggcugcgacu

SEQ ID NO: 429559 - RNA, 32 nt, Human
gaucgugucacuacacuccaggcugggugaca

SEQ ID NO: 429560 - RNA, 32 nt, Human
gaucgugucacugcacuccagccggggcaaca

SEQ ID NO: 429561 - RNA, 32 nt, Human
gaucgugucacugcacuccagccuggcgacag

SEQ ID NO: 429562 - RNA, 32 nt, Human
gaucgugucacugcacuccagccugggcgaca

SEQ ID NO: 429563 - RNA, 32 nt, Human
gaucgugucacugcacuccagccugggugaca

SEQ ID NO: 429564 - RNA, 32 nt, Human
gaucgugucacugcacuccagccuggugacag

SEQ ID NO: 429565 - RNA, 32 nt, Human
gaucguucucccgcugagcuguuuucaagggc

SEQ ID NO: 429566 - RNA, 32 nt, Human
gaucguuuucuuucccuuuucucugguggccu

SEQ ID NO: 429567 - RNA, 32 nt, Human
gaucuaaacacgaggaaacauuauucauugga

SEQ ID NO: 429568 - RNA, 32 nt, Human
gaucuaaacuggccccuuccuccucugccugg

SEQ ID NO: 429569 - RNA, 32 nt, Human
gaucuaaaucauuuuguugucuucccagcgua

SEQ ID NO: 429570 - RNA, 32 nt, Human
gaucuaacauggcaccucgucuccacagggua

SEQ ID NO: 429571 - RNA, 31 nt, Human
gaucuaaccaggaggccaucacuggaugguc

SEQ ID NO: 429572 - RNA, 32 nt, Human
gaucuaagcugcuuuccaucuuuucucccagc

SEQ ID NO: 429573 - RNA, 32 nt, Human
gaucuaauuaaacuaaauagcuucugcacagc

SEQ ID NO: 429574 - RNA, 32 nt, Human
gaucuacagagauccaggaaaccaaagcccug

SEQ ID NO: 429575 - RNA, 32 nt, Human
gaucuacaggcaggguaggcacaggugcagcc

SEQ ID NO: 429576 - RNA, 21 nt, Human
gaucuacccgccucggccucc

SEQ ID NO: 429577 - RNA, 32 nt, Human
gaucuacccugaguauccuccaaacuguggau

SEQ ID NO: 429578 - RNA, 32 nt, Human
gaucuaccucuaagccaggcugugaagaaaag

SEQ ID NO: 429579 - RNA, 32 nt, Human
gaucuaccuggcuucucaguucuuugguugga

SEQ ID NO: 429580 - RNA, 32 nt, Human
gaucuacuacagggaagggaagagggugcugg

SEQ ID NO: 429581 - RNA, 32 nt, Human
gaucuacuccacugucuaccacucauuccugc

SEQ ID NO: 429582 - RNA, 32 nt, Human
gaucuacuguuugcauguaagagaccaggaua

SEQ ID NO: 429583 - RNA, 32 nt, Human
gaucuagaaagccaaguauuugagcaacaucu

SEQ ID NO: 429584 - RNA, 32 nt, Human
gaucuagaacagccuggucaacauggugaaac

SEQ ID NO: 429585 - RNA, 32 nt, Human
gaucuagaacgagagaccagggguguggaggg

SEQ ID NO: 429586 - RNA, 32 nt, Human
gaucuagacaucaagaggaagaaaaaugaugg

SEQ ID NO: 429587 - RNA, 32 nt, Human
gaucuagagugcaaagaggugccugaggagca

SEQ ID NO: 429588 - RNA, 32 nt, Human
gaucuagauugaaacucagcuaccuuucuucc

SEQ ID NO: 429589 - RNA, 32 nt, Human
gaucuagcuccucagaguuggaggaaggcuga

SEQ ID NO: 429590 - RNA, 32 nt, Human
gaucuaggacaugccacugaauugaagaccac

SEQ ID NO: 429591 - RNA, 32 nt, Human
gaucuaggagagugacugggugugccaaaaua

SEQ ID NO: 429592 - RNA, 32 nt, Human
gaucuaggcaccugcugucugaagggaccgug

SEQ ID NO: 429593 - RNA, 32 nt, Human
gaucuaggcccucagcaaccagcucuguaggg

SEQ ID NO: 429594 - RNA, 32 nt, Human
gaucuagggaaaggaggagcuaucgaaguaca

SEQ ID NO: 429595 - RNA, 32 nt, Human
gaucuagggcaggagucagcagucugggcagg

SEQ ID NO: 429596 - RNA, 32 nt, Human
gaucuauccacacagaacuagagcaaggaggu

SEQ ID NO: 429597 - RNA, 32 nt, Human
gaucuauccagugacguggccuggugggcguu

SEQ ID NO: 429598 - RNA, 32 nt, Human
gaucuaucuauaugcacauacauacauauaua

SEQ ID NO: 429599 - RNA, 32 nt, Human
gaucuauggcauggugaaaaggucagucugag

SEQ ID NO: 429600 - RNA, 32 nt, Human
gaucuaugucgagacugaggcugcucagcagc

SEQ ID NO: 429601 - RNA, 32 nt, Human
gaucucaaacuccugggcucaaguauccaccu

SEQ ID NO: 429602 - RNA, 32 nt, Human
gaucucaagugucaaccuugaggucccagcuc

SEQ ID NO: 429603 - RNA, 32 nt, Human
gaucucaaugggcagagaugcuucuaugaucu

SEQ ID NO: 429604 - RNA, 32 nt, Human
gaucucacagugaaaaauguuugcugacccuu

SEQ ID NO: 429605 - RNA, 32 nt, Human
gaucucacaguuugccuuccagaagccagccu

SEQ ID NO: 429606 - RNA, 32 nt, Human
gaucucaccacuacacuccagccugggugaca

SEQ ID NO: 429607 - RNA, 32 nt, Human
gaucucaccacugaacuccagccugggcgaca

SEQ ID NO: 429608 - RNA, 32 nt, Human
gaucucaccacugcacuccagccugggcagca

SEQ ID NO: 429609 - RNA, 32 nt, Human
gaucucaccacuguacuccagccugggugaca

SEQ ID NO: 429610 - RNA, 32 nt, Human
gaucucaccaugcacuccagccuagacaacag

SEQ ID NO: 429611 - RNA, 32 nt, Human
gaucucaccauuacacuccagccugggcgaca

SEQ ID NO: 429612 - RNA, 32 nt, Human
gaucucaccauugcacuccagccugggcgacu

SEQ ID NO: 429613 - RNA, 32 nt, Human
gaucucaccccugcacuccagccugggcaaca

SEQ ID NO: 429614 - RNA, 32 nt, Human
gaucucacuauguugcccaggcuggucuccug

SEQ ID NO: 429615 - RNA, 19 nt, Human
gaucucacuauguugcuca

SEQ ID NO: 429616 - RNA, 32 nt, Human
gaucucacugcaaccuccaucuccugucucag

SEQ ID NO: 429617 - RNA, 32 nt, Human
gaucucacugcaaccucugccucccgggcuug

SEQ ID NO: 429618 - RNA, 32 nt, Human
gaucucacugcacacagccuagggccccaccc

SEQ ID NO: 429619 - RNA, 32 nt, Human
gaucucacuguguuggccaggcuggucucaaa

SEQ ID NO: 429620 - RNA, 32 nt, Human
gaucucagaaaaucacaucuaucacgguuggu

SEQ ID NO: 429621 - RNA, 32 nt, Human
gaucucagacuauccugauuaaucuggggaag

SEQ ID NO: 429622 - RNA, 32 nt, Human
gaucucagacuggcuggauucagaucagugug

SEQ ID NO: 429623 - RNA, 32 nt, Human
gaucucagaggacuggcauugucuggagacgg

SEQ ID NO: 429624 - RNA, 32 nt, Human
gaucucagaguuuagaaucagcagagcacaga

SEQ ID NO: 429625 - RNA, 32 nt, Human
gaucucagcucaccaaaucucugccucccagg

SEQ ID NO: 429626 - RNA, 32 nt, Human
gaucucagcucaccacaaccuccgccucccag

SEQ ID NO: 429627 - RNA, 32 nt, Human
gaucucagcucacuacaaccuccgccucccau

SEQ ID NO: 429628 - RNA, 32 nt, Human
gaucucagcucacugcaaccuccgccucccaa

SEQ ID NO: 429629 - RNA, 32 nt, Human
gaucucagcucacugcaaccuccgccucccag

SEQ ID NO: 429630 - RNA, 32 nt, Human
gaucucagcucacugcaaccuccgucuccagg

SEQ ID NO: 429631 - RNA, 32 nt, Human
gaucucagcucacugcaaucuccaccuccugg

SEQ ID NO: 429632 - RNA, 32 nt, Human
gaucucagcucacugcagccacugccucccag

SEQ ID NO: 429633 - RNA, 32 nt, Human
gaucucagcucacugcagccuccgucucccag

SEQ ID NO: 429634 - RNA, 32 nt, Human
gaucucagcucacuguacuccagcccggguuc

SEQ ID NO: 429635 - RNA, 32 nt, Human
gaucucagcugcugcaaccuccaccucccggg

SEQ ID NO: 429636 - RNA, 32 nt, Human
gaucucaggaaaaugaguuucucuucccucag

SEQ ID NO: 429637 - RNA, 32 nt, Human
gaucucaggaagcacaaagggaccuuccuagc

SEQ ID NO: 429638 - RNA, 32 nt, Human
gaucucaggagguugaggcugcagugaauuau

SEQ ID NO: 429639 - RNA, 32 nt, Human
gaucucaggaguuggagaucagcaugggccac

SEQ ID NO: 429640 - RNA, 32 nt, Human
gaucucaggcuggagugcaguggcacaaucac

SEQ ID NO: 429641 - RNA, 32 nt, Human
gaucucaggucgcuguaaccuccgucuccugg

SEQ ID NO: 429642 - RNA, 32 nt, Human
gaucucagguucugaggcggcugugguggcug

SEQ ID NO: 429643 - RNA, 32 nt, Human
gaucucaguucaacuccugucucuccauauac

SEQ ID NO: 429644 - RNA, 32 nt, Human
gaucucaguucaugcaaccuccgccuccuggg

SEQ ID NO: 429645 - RNA, 32 nt, Human
gaucucaguuuaugcaacuucugccuccccag

SEQ ID NO: 429646 - RNA, 31 nt, Human
gaucucaugcggcagacugaaggacgggugc

SEQ ID NO: 429647 - RNA, 31 nt, Human
gaucucauguccucuauaccuguguccgaug

SEQ ID NO: 429648 - RNA, 32 nt, Human
gaucuccacaggcuucuggaugaagaaccugu

SEQ ID NO: 429649 - RNA, 32 nt, Human
gaucuccacugcacugcugugggcugaacugu

SEQ ID NO: 429650 - RNA, 32 nt, Human
gaucuccacugcuggguaugaguaaaugugug

SEQ ID NO: 429651 - RNA, 32 nt, Human
gaucuccagaaaccuagcccagcagguuaauc

SEQ ID NO: 429652 - RNA, 32 nt, Human
gaucuccagauuugaagacacucugaagcauu

SEQ ID NO: 429653 - RNA, 32 nt, Human
gaucuccagcugguucugugggcugcugcagu

SEQ ID NO: 429654 - RNA, 32 nt, Human
gaucuccagguucuggagguuggagguuccgc

SEQ ID NO: 429655 - RNA, 32 nt, Human
gaucuccauaaauuacuuagucuucuauguau

SEQ ID NO: 429656 - RNA, 32 nt, Human
gaucuccaugaagacgcggucacgcagccucc

SEQ ID NO: 429657 - RNA, 32 nt, Human
gaucuccauggcagacaagcuaaagcaucugc

SEQ ID NO: 429658 - RNA, 32 nt, Human
gaucucccccugcccauugccugcuugagggg

SEQ ID NO: 429659 - RNA, 32 nt, Human
gaucucccuagggccccaccuggaccauuuuc

SEQ ID NO: 429660 - RNA, 16 nt, Human
gaucucccuccaggga

SEQ ID NO: 429661 - RNA, 32 nt, Human
gaucucccuccagggaauccgccugcagagga

SEQ ID NO: 429662 - RNA, 32 nt, Human
gaucucccuccugcuaagucugcgcugcugca

SEQ ID NO: 429663 - RNA, 32 nt, Human
gaucucccucugggcaucuggcuuugcugcgu

SEQ ID NO: 429664 - RNA, 32 nt, Human
gaucuccgacgaggcccuggacccccgggcgg

SEQ ID NO: 429665 - RNA, 32 nt, Human
gaucuccgcucacugccaccuccgccucucua

SEQ ID NO: 429666 - RNA, 32 nt, Human
gaucuccucccagaggccagcacugccaaaug

SEQ ID NO: 429667 - RNA, 32 nt, Human
gaucuccucucaccugcccccauuaaagcucu

SEQ ID NO: 429668 - RNA, 19 nt, Human
gaucuccucugcaguguag

SEQ ID NO: 429669 - RNA, 18 nt, Human
gaucuccugaccuuguga

SEQ ID NO: 429670 - RNA, 32 nt, Human
gaucuccugaguacacugaagccacaggcugg

SEQ ID NO: 429671 - RNA, 32 nt, Human
gaucuccugcccucucugagccuugucacuug

SEQ ID NO: 429672 - RNA, 32 nt, Human
gaucuccugcccugcaggaauaggugggaagu

SEQ ID NO: 429673 - RNA, 22 nt, Human
gaucuccugccucagccuugca

SEQ ID NO: 429674 - RNA, 31 nt, Human
gaucuccuguucucugggcuuccuggucagu

SEQ ID NO: 429675 - RNA, 32 nt, Human
gaucuccuguucucugggcuuccuggucagug

SEQ ID NO: 429676 - RNA, 32 nt, Human
gaucuccuugccugaccccuggaccuggaaau

SEQ ID NO: 429677 - RNA, 18 nt, Human
gaucucgacagcuguuca

SEQ ID NO: 429678 - RNA, 32 nt, Human
gaucucgaggagguggugaaaaagagggauuu

SEQ ID NO: 429679 - RNA, 26 nt, Human
gaucucgaucaccaaucuagaucuuu

SEQ ID NO: 429680 - RNA, 32 nt, Human
gaucucgccacugcacuccaggcugggcgaca

SEQ ID NO: 429681 - RNA, 32 nt, Human
gaucucgccacugcgcuccagccugggcaaca

SEQ ID NO: 429682 - RNA, 32 nt, Human
gaucucgccacugugcuccagccugggcaaca

SEQ ID NO: 429683 - RNA, 32 nt, Human
gaucucgccaugguuagcaccagggacaaguc

SEQ ID NO: 429684 - RNA, 32 nt, Human
gaucucgccauugcacuccauucugggcaaca

SEQ ID NO: 429685 - RNA, 32 nt, Human
gaucucgccgccaacugguagacauggagacc

SEQ ID NO: 429686 - RNA, 32 nt, Human
gaucucgccuccuggguucaagcgauucuccu

SEQ ID NO: 429687 - RNA, 32 nt, Human
gaucucgcucacugcaaccuccgccucccggg

SEQ ID NO: 429688 - RNA, 32 nt, Human
gaucucggcacaccuccgccuucuggguucaa

SEQ ID NO: 429689 - RNA, 32 nt, Human
gaucucggcucaccgcaaccuccgccucccag

SEQ ID NO: 429690 - RNA, 32 nt, Human
gaucucggcucacuacaaccuccgccucccag

SEQ ID NO: 429691 - RNA, 32 nt, Human
gaucucggcucacugcaaccuagguggagguc

SEQ ID NO: 429692 - RNA, 32 nt, Human
gaucucggcucacugcaaccuccagcucccag

SEQ ID NO: 429693 - RNA, 32 nt, Human
gaucucggcucacugcaaccuccgccucccaa

SEQ ID NO: 429694 - RNA, 32 nt, Human
gaucucggcucacugcaaccuccgccucccag

SEQ ID NO: 429695 - RNA, 32 nt, Human
gaucucggcucacugcaaccuccgccuccuga

SEQ ID NO: 429696 - RNA, 32 nt, Human
gaucucggcucacugcaaccuccgccuuccug

SEQ ID NO: 429697 - RNA, 32 nt, Human
gaucucggcucacugcaaccuccgccuuucca

SEQ ID NO: 429698 - RNA, 32 nt, Human
gaucucggcucacugcaaccuccgucucccag

SEQ ID NO: 429699 - RNA, 32 nt, Human
gaucucggcucacugcaacucugccucccggg

SEQ ID NO: 429700 - RNA, 32 nt, Human
gaucucggcucacugcaaucucugccucccag

SEQ ID NO: 429701 - RNA, 32 nt, Human
gaucucggcucacugcaaucucugccucccgg

SEQ ID NO: 429702 - RNA, 32 nt, Human
gaucucggcucacugcaccuccgccucccagg

SEQ ID NO: 429703 - RNA, 32 nt, Human
gaucucggcucacugcaccucugccuccugga

SEQ ID NO: 429704 - RNA, 32 nt, Human
gaucucggcucacugccaccucucccucaugg

SEQ ID NO: 429705 - RNA, 32 nt, Human
gaucucggcucacugcgaccuccgucucccgg

SEQ ID NO: 429706 - RNA, 32 nt, Human
gaucucggcucacuguaaccuccgccuccuga

SEQ ID NO: 429707 - RNA, 32 nt, Human
gaucucggcucacugugaccucugccuccugg

SEQ ID NO: 429708 - RNA, 32 nt, Human
gaucucggcuccuggguucaagcaauucuccu

SEQ ID NO: 429709 - RNA, 32 nt, Human
gaucucuaaaugcagcaaaacacugccugaaa

SEQ ID NO: 429710 - RNA, 32 nt, Human
gaucucuaggccuuguuccucuuccagggaaa

SEQ ID NO: 429711 - RNA, 32 nt, Human
gaucucucacugugauuccucuccuuccuccg

SEQ ID NO: 429712 - RNA, 32 nt, Human
gaucucucauacuuucucccugucuacacagu

SEQ ID NO: 429713 - RNA, 32 nt, Human
gaucucuccacucaccguggaaguugccuugu

SEQ ID NO: 429714 - RNA, 32 nt, Human
gaucucuccauucagaagugugcagucuuaaa

SEQ ID NO: 429715 - RNA, 32 nt, Human
gaucucucccagagaacuacuggauuuccuca

SEQ ID NO: 429716 - RNA, 32 nt, Human
gaucucucccaugaagugaccaggauagagaa

SEQ ID NO: 429717 - RNA, 32 nt, Human
gaucucuccuucagucugcucuguuuaauucu

SEQ ID NO: 429718 - RNA, 16 nt, Human
gaucucucuccaggaa

SEQ ID NO: 429719 - RNA, 32 nt, Human
gaucucucuugcauccuuaaagggccugaguc

SEQ ID NO: 429720 - RNA, 32 nt, Human
gaucucugacacaccaaccucucuccucuuac

SEQ ID NO: 429721 - RNA, 32 nt, Human
gaucucugaccucugcugagugcugggcacug

SEQ ID NO: 429722 - RNA, 32 nt, Human
gaucucugaggccucagagugcuuggcugcug

SEQ ID NO: 429723 - RNA, 31 nt, Human
gaucucugccucucuucucucugccucgucc

SEQ ID NO: 429724 - RNA, 32 nt, Human
gaucucugcucacugcaaccucugccuccugg

SEQ ID NO: 429725 - RNA, 32 nt, Human
gaucucugcuuagggugguuugaggugaguuc

SEQ ID NO: 429726 - RNA, 32 nt, Human
gaucucugcuuccuguaccuugacaugcaaaa

SEQ ID NO: 429727 - RNA, 32 nt, Human
gaucucuggaguguugcaguuagaggguuguu

SEQ ID NO: 429728 - RNA, 32 nt, Human
gaucucugggugucugagggcaagugaaagcc

SEQ ID NO: 429729 - RNA, 32 nt, Human
gaucucuguaucauccagagccugaguacagu

SEQ ID NO: 429730 - RNA, 32 nt, Human
gaucucuguuuuaagugcucagcuucaugauu

SEQ ID NO: 429731 - RNA, 32 nt, Human
gaucucuuaagauuaauguagcagaaauuucu

SEQ ID NO: 429732 - RNA, 24 nt, Human
gaucucuugaccucaggugaucca

SEQ ID NO: 429733 - RNA, 32 nt, Human
gaucucuugccucugcugaugggggcuggcaa

SEQ ID NO: 429734 - RNA, 32 nt, Human
gaucucuugcugucuucucugucaagauugca

SEQ ID NO: 429735 - RNA, 32 nt, Human
gaucucuuggccucaugaucagccugccucgg

SEQ ID NO: 429736 - RNA, 22 nt, Human
gaucucuuuugaggugauggug

SEQ ID NO: 429737 - RNA, 32 nt, Human
gaucugaaaacacacauacacaaaugcacaca

SEQ ID NO: 429738 - RNA, 32 nt, Human
gaucugaaaacacaugucccagacugcauacu

SEQ ID NO: 429739 - RNA, 32 nt, Human
gaucugaagaugcaaacauuucaacuaugaag

SEQ ID NO: 429740 - RNA, 23 nt, Human
gaucugaagauuuuggcguucaa

SEQ ID NO: 429741 - RNA, 32 nt, Human
gaucugaaggggcgggguuagagccaagcugc

SEQ ID NO: 429742 - RNA, 32 nt, Human
gaucugaauauuuacacacauagcacacuaua

SEQ ID NO: 429743 - RNA, 32 nt, Human
gaucugacaaccaggccuagccccagacagcc

SEQ ID NO: 429744 - RNA, 32 nt, Human
gaucugacacuuaucacuaucuuaccauguuu

SEQ ID NO: 429745 - RNA, 32 nt, Human
gaucugaccccgaggggcagagcugucgguga

SEQ ID NO: 429746 - RNA, 32 nt, Human
gaucugacgagcagcucuugaaacccagggag

SEQ ID NO: 429747 - RNA, 32 nt, Human
gaucugagacacaguaagccuccaucauccac

SEQ ID NO: 429748 - RNA, 32 nt, Human
gaucugagagcaccugcuaucgggugaguccu

SEQ ID NO: 429749 - RNA, 32 nt, Human
gaucugagccugaagagagggaacaagucagu

SEQ ID NO: 429750 - RNA, 32 nt, Human
gaucugaggagguucuggaagacuggggcagc

SEQ ID NO: 429751 - RNA, 32 nt, Human
gaucugaggcccaaauccuuccucacuaaggg

SEQ ID NO: 429752 - RNA, 31 nt, Human
gaucugaggccuuucccuugccauagaaaug

SEQ ID NO: 429753 - RNA, 32 nt, Human
gaucugcaacacagaaaugcucugccugaaau

SEQ ID NO: 429754 - RNA, 32 nt, Human
gaucugcaaugccaauaucaagggccauguau

SEQ ID NO: 429755 - RNA, 32 nt, Human
gaucugcaccaagcacucacacacaugcaaug

SEQ ID NO: 429756 - RNA, 32 nt, Human
gaucugcaccagaacccggaugacugucaccu

SEQ ID NO: 429757 - RNA, 32 nt, Human
gaucugcaggaaaacaccaaacacacuaugga

SEQ ID NO: 429758 - RNA, 32 nt, Human
gaucugcaugccacgcugccgucuguguuaca

SEQ ID NO: 429759 - RNA, 32 nt, Human
gaucugccacugcacuccagccuggcgacaga

SEQ ID NO: 429760 - RNA, 32 nt, Human
gaucugccagcccugccuguucucucaccccg

SEQ ID NO: 429761 - RNA, 32 nt, Human
gaucugccaggaggaggagcucaggcgguaau

SEQ ID NO: 429762 - RNA, 23 nt, Human
gaucugcccaccccagccuccca

SEQ ID NO: 429763 - RNA, 23 nt, Human
gaucugcccaccucagucuccca

SEQ ID NO: 429764 - RNA, 23 nt, Human
gaucugcccaccucggccuccca

SEQ ID NO: 429765 - RNA, 32 nt, Human
gaucugcccaggcugaaggcacacgcucaaug

SEQ ID NO: 429766 - RNA, 32 nt, Human
gaucugcccaucacuuuggccuagggacaggg

SEQ ID NO: 429767 - RNA, 32 nt, Human
gaucugcccccugccagccucccacagugcug

SEQ ID NO: 429768 - RNA, 32 nt, Human
gaucugccccugaacaucucccgagaaaugcu

SEQ ID NO: 429769 - RNA, 23 nt, Human
gaucugcccgccucggccuccca

SEQ ID NO: 429770 - RNA, 32 nt, Human
gaucugcccucccaggggucuccaauuuucuu

SEQ ID NO: 429771 - RNA, 19 nt, Human
gaucugccucuugcugcca

SEQ ID NO: 429772 - RNA, 32 nt, Human
gaucugccugccucagcuucucaggugugacc

SEQ ID NO: 429773 - RNA, 23 nt, Human
gaucugccugcuucagccuccca

SEQ ID NO: 429774 - RNA, 32 nt, Human
gaucugcgggaaugugggcuggagagguccug

SEQ ID NO: 429775 - RNA, 32 nt, Human
gaucugcucacugccaggcuccucuccccuuu

SEQ ID NO: 429776 - RNA, 32 nt, Human
gaucugcucagcccuggaggugccagcaaagc

SEQ ID NO: 429777 - RNA, 32 nt, Human
gaucugcucugaggcccucgaggcucagcaga

SEQ ID NO: 429778 - RNA, 32 nt, Human
gaucugcugcaccugcucacgcucucccugga

SEQ ID NO: 429779 - RNA, 32 nt, Human
gaucugcugcagccacagcuccuccagaaagg

SEQ ID NO: 429780 - RNA, 32 nt, Human
gaucugcugcagcuuggcguuucauccaacca

SEQ ID NO: 429781 - RNA, 32 nt, Human
gaucugcugcguccugcaggagcauugcgcuu

SEQ ID NO: 429782 - RNA, 19 nt, Human
gaucugcuggaguggggug

SEQ ID NO: 429783 - RNA, 32 nt, Human
gaucugcugggccaccuccuguuguuccguga

SEQ ID NO: 429784 - RNA, 32 nt, Human
gaucuggaaaauacuggaaaaugugauacuua

SEQ ID NO: 429785 - RNA, 32 nt, Human
gaucuggaaagaaaggaaggaaaacaaaggcg

SEQ ID NO: 429786 - RNA, 32 nt, Human
gaucuggaaggagagggauuauguuauagcuu

SEQ ID NO: 429787 - RNA, 32 nt, Human
gaucuggaauuggacauugcucugucagagca

SEQ ID NO: 429788 - RNA, 32 nt, Human
gaucuggacuccaacccaagggcccucucuug

SEQ ID NO: 429789 - RNA, 32 nt, Human
gaucuggagcccaccugcuuugaaagaaauga

SEQ ID NO: 429790 - RNA, 32 nt, Human
gaucuggagccccuguggagccacaucugagc

SEQ ID NO: 429791 - RNA, 32 nt, Human
gaucuggagcugcaucucuaaggggccaggcu

SEQ ID NO: 429792 - RNA, 32 nt, Human
gaucuggagguuuuuguugaaauguggcuuca

SEQ ID NO: 429793 - RNA, 32 nt, Human
gaucuggaugaagagagagggggugagagagg

SEQ ID NO: 429794 - RNA, 32 nt, Human
gaucuggaugcuuaagugucauggacaguaaa

SEQ ID NO: 429795 - RNA, 32 nt, Human
gaucuggccauugcacuccagcgugggcaaca

SEQ ID NO: 429796 - RNA, 32 nt, Human
gaucuggcccuagggagcuuccuguucccaga

SEQ ID NO: 429797 - RNA, 32 nt, Human
gaucuggccucagcuaugaggguggguagcac

SEQ ID NO: 429798 - RNA, 32 nt, Human
gaucuggccuugccccugaguccacgggaugu

SEQ ID NO: 429799 - RNA, 32 nt, Human
gaucuggcucucuuccccuuggacuuuagaac

SEQ ID NO: 429800 - RNA, 32 nt, Human
gaucuggcuuugccagagguugcaacauguug

SEQ ID NO: 429801 - RNA, 17 nt, Human
gaucugggacccagggg

SEQ ID NO: 429802 - RNA, 32 nt, Human
gaucugggacccuuuccuuccuucccuggcuu

SEQ ID NO: 429803 - RNA, 32 nt, Human
gaucugggaggcaauuaccuucggagaaaaac

SEQ ID NO: 429804 - RNA, 32 nt, Human
gaucugggcacuguacuuuagccugggcgaca

SEQ ID NO: 429805 - RNA, 32 nt, Human
gaucugggccagaagccaaaccccuacuucua

SEQ ID NO: 429806 - RNA, 32 nt, Human
gaucuggggagagaggaacaaaggaccgugaa

SEQ ID NO: 429807 - RNA, 32 nt, Human
gaucuggggaggcagaggugacagugagcuga

SEQ ID NO: 429808 - RNA, 32 nt, Human
gaucugggggaagaggaggaggagggccgauc

SEQ ID NO: 429809 - RNA, 32 nt, Human
gaucugggggagggaucacuguucuucuugcu

SEQ ID NO: 429810 - RNA, 21 nt, Human
gaucuggggguugcaccaggg

SEQ ID NO: 429811 - RNA, 31 nt, Human
gaucugggucucggugggccugugcaggucu

SEQ ID NO: 429812 - RNA, 32 nt, Human
gaucuggugcuggcaugggcaccccgcggcca

SEQ ID NO: 429813 - RNA, 32 nt, Human
gaucugguggaugacuguggugaucguacuga

SEQ ID NO: 429814 - RNA, 32 nt, Human
gaucugguggcuauuuccacauuuugaaaagg

SEQ ID NO: 429815 - RNA, 32 nt, Human
gaucuguaaauaaaacuuacauuuuucaauaa

SEQ ID NO: 429816 - RNA, 23 nt, Human
gaucuguaccucauugcugcuca

SEQ ID NO: 429817 - RNA, 32 nt, Human
gaucugucacccaggcuggagugcaguggcac

SEQ ID NO: 429818 - RNA, 32 nt, Human
gaucugucgcccaggcuggagugcaguagcgu

SEQ ID NO: 429819 - RNA, 32 nt, Human
gaucugucguggggugcugcaauguuccucca

SEQ ID NO: 429820 - RNA, 32 nt, Human
gaucugucguugccaucaccuccagggggcgc

SEQ ID NO: 429821 - RNA, 32 nt, Human
gaucugucucacuggcaucuuguugagggccu

SEQ ID NO: 429822 - RNA, 32 nt, Human
gaucugucucuaauuagaggugcaaugucaaa

SEQ ID NO: 429823 - RNA, 32 nt, Human
gaucugucucucccuuccccuccugggaccau

SEQ ID NO: 429824 - RNA, 32 nt, Human
gaucugucuguccuguaaacugugccaacuuc

SEQ ID NO: 429825 - RNA, 32 nt, Human
gaucugugaacaaaguacugugcagaaugcua

SEQ ID NO: 429826 - RNA, 32 nt, Human
gaucugugaaugggauuaagguggacaagauc

SEQ ID NO: 429827 - RNA, 32 nt, Human
gaucugugcgacugaaggugggaagaggagua

SEQ ID NO: 429828 - RNA, 32 nt, Human
gaucugugggacugucugggccuguuacucau

SEQ ID NO: 429829 - RNA, 32 nt, Human
gaucugugucaaaagagcuucucuccagagua

SEQ ID NO: 429830 - RNA, 32 nt, Human
gaucugugucaucugggaauuuccuugggcug

SEQ ID NO: 429831 - RNA, 32 nt, Human
gaucuguguguauguacauaguagacaugugu

SEQ ID NO: 429832 - RNA, 32 nt, Human
gaucuguguuaacucuuucaugccacugguga

SEQ ID NO: 429833 - RNA, 32 nt, Human
gaucuguuacccaggcuggagugcagugacac

SEQ ID NO: 429834 - RNA, 32 nt, Human
gaucuguuacccaggcuggagugcaguggcau

SEQ ID NO: 429835 - RNA, 32 nt, Human
gaucuguuccagggucaucuuuuccuuacagu

SEQ ID NO: 429836 - RNA, 32 nt, Human
gaucuguugcccaggcuggagugcaguggagc

SEQ ID NO: 429837 - RNA, 32 nt, Human
gaucuguugccuaaacuaaagcuuaaaaguuu

SEQ ID NO: 429838 - RNA, 32 nt, Human
gaucuguuuagugcuuauuauuuuccaguaaa

SEQ ID NO: 429839 - RNA, 32 nt, Human
gaucuguuucaaggagauuuacugcuauuuua

SEQ ID NO: 429840 - RNA, 32 nt, Human
gaucuguuuucauuuuuaggcaugucagaccc

SEQ ID NO: 429841 - RNA, 32 nt, Human
gaucuuaaagcacaguuaucaugacgagaaga

SEQ ID NO: 429842 - RNA, 32 nt, Human
gaucuuaaccaguuucuaucccuuaccugcuu

SEQ ID NO: 429843 - RNA, 32 nt, Human
gaucuuaacucacugcaaccuccgcuucccag

SEQ ID NO: 429844 - RNA, 32 nt, Human
gaucuuaauuuaaaagacagaggcuccaaaau

SEQ ID NO: 429845 - RNA, 32 nt, Human
gaucuuacccccucagccucuggaguagcugg

SEQ ID NO: 429846 - RNA, 32 nt, Human
gaucuuagcuuggcuaaaucaccaauauagca

SEQ ID NO: 429847 - RNA, 32 nt, Human
gaucuuaggccccuguaacaaaacaacacaaa

SEQ ID NO: 429848 - RNA, 32 nt, Human
gaucuuagggaugauuaaaggcagcauuugau

SEQ ID NO: 429849 - RNA, 20 nt, Human
gaucuuauggcccugcgaga

SEQ ID NO: 429850 - RNA, 32 nt, Human
gaucuucaaacaguaacuuuccaaaagccagg

SEQ ID NO: 429851 - RNA, 32 nt, Human
gaucuucacccaugcagaauagcaagaguggg

SEQ ID NO: 429852 - RNA, 32 nt, Human
gaucuucagagaacccaucacugugagggaua

SEQ ID NO: 429853 - RNA, 19 nt, Human
gaucuucagagugcuggaa

SEQ ID NO: 429854 - RNA, 19 nt, Human
gaucuucagaguguuggaa

SEQ ID NO: 429855 - RNA, 21 nt, Human
gaucuucagauggugcuggug

SEQ ID NO: 429856 - RNA, 32 nt, Human
gaucuucagcagcaggaugacgauggccgcca

SEQ ID NO: 429857 - RNA, 32 nt, Human
gaucuucagcagcauaaugacaauccagagga

SEQ ID NO: 429858 - RNA, 18 nt, Human
gaucuucagccuguuaaa

SEQ ID NO: 429859 - RNA, 32 nt, Human
gaucuucauguaccugcucuucuguuugcaca

SEQ ID NO: 429860 - RNA, 32 nt, Human
gaucuuccaacuuuuuagccccggcuguggaa

SEQ ID NO: 429861 - RNA, 32 nt, Human
gaucuuccagccucagccuccccaguagcuga

SEQ ID NO: 429862 - RNA, 32 nt, Human
gaucuucccacugcacuccagccuggccaaua

SEQ ID NO: 429863 - RNA, 32 nt, Human
gaucuucccugguggcugcuccaccuccagca

SEQ ID NO: 429864 - RNA, 32 nt, Human
gaucuuccuccacccugccccaccccuagguc

SEQ ID NO: 429865 - RNA, 32 nt, Human
gaucuucgggaccuggcuucauuuggaguuca

SEQ ID NO: 429866 - RNA, 32 nt, Human
gaucuucguuccaaccgcgcaggauggggccc

SEQ ID NO: 429867 - RNA, 32 nt, Human
gaucuucuccaccuagucugcccuaauaauga

SEQ ID NO: 429868 - RNA, 32 nt, Human
gaucuucucuguaacaugcacacuuuggccug

SEQ ID NO: 429869 - RNA, 32 nt, Human
gaucuucugagcuuguuucccugcuggguggg

SEQ ID NO: 429870 - RNA, 18 nt, Human
gaucuucugccuccgcca

SEQ ID NO: 429871 - RNA, 32 nt, Human
gaucuugaacagcuccuguacuugcucuuugu

SEQ ID NO: 429872 - RNA, 20 nt, Human
gaucuugaacaugcugcuua

SEQ ID NO: 429873 - RNA, 21 nt, Human
gaucuugaaccuugcugucca

SEQ ID NO: 429874 - RNA, 32 nt, Human
gaucuugacucacuacaaccuccgccucccag

SEQ ID NO: 429875 - RNA, 32 nt, Human
gaucuugacucacugcaaccuccgccucacag

SEQ ID NO: 429876 - RNA, 32 nt, Human
gaucuugacucacugcaaccuccgccucccag

SEQ ID NO: 429877 - RNA, 22 nt, Human
gaucuugaugcuucugcugcuc

SEQ ID NO: 429878 - RNA, 32 nt, Human
gaucuugauuuugccagccuugcucgagguuu

SEQ ID NO: 429879 - RNA, 32 nt, Human
gaucuugcagaaguccuugcugcuccucucag

SEQ ID NO: 429880 - RNA, 32 nt, Human
gaucuugcauugagccaagaucacgccacugc

SEQ ID NO: 429881 - RNA, 32 nt, Human
gaucuugccacauuucugaucagagguguaca

SEQ ID NO: 429882 - RNA, 32 nt, Human
gaucuugccacugcacaccagccugggcaaca

SEQ ID NO: 429883 - RNA, 32 nt, Human
gaucuugccacugcacuccagccugggcaaca

SEQ ID NO: 429884 - RNA, 18 nt, Human
gaucuugccucuuuccuc

SEQ ID NO: 429885 - RNA, 32 nt, Human
gaucuugccucuuuccuccucaugaaagcagc

SEQ ID NO: 429886 - RNA, 32 nt, Human
gaucuugcuauguuauccaggcuggucuugaa

SEQ ID NO: 429887 - RNA, 32 nt, Human
gaucuugcuuccugccagcaccaaacauuaca

SEQ ID NO: 429888 - RNA, 17 nt, Human
gaucuugcuuugcugcu

SEQ ID NO: 429889 - RNA, 19 nt, Human
gaucuuggacugacacuca

SEQ ID NO: 429890 - RNA, 21 nt, Human
gaucuuggcaguggacugcca

SEQ ID NO: 429891 - RNA, 32 nt, Human
gaucuuggccagggucucagaagugugugugg

SEQ ID NO: 429892 - RNA, 32 nt, Human
gaucuuggcuaacugcaaccuccagcuccugg

SEQ ID NO: 429893 - RNA, 32 nt, Human
gaucuuggcucacugcaaccuccgucucccag

SEQ ID NO: 429894 - RNA, 32 nt, Human
gaucuuggcucacugcaaccuccgucuccugg

SEQ ID NO: 429895 - RNA, 32 nt, Human
gaucuuggcucacugcaaccuccugcuuccug

SEQ ID NO: 429896 - RNA, 17 nt, Human
gaucuuggcucacugcu

SEQ ID NO: 429897 - RNA, 32 nt, Human
gaucuuggcucugcaaccuccacuucccaggu

SEQ ID NO: 429898 - RNA, 32 nt, Human
gaucuuggcucugcaaccuccgccucccgguu

SEQ ID NO: 429899 - RNA, 18 nt, Human
gaucuuggcugucuguca

SEQ ID NO: 429900 - RNA, 21 nt, Human
gaucuuggcuucuguuacuca

SEQ ID NO: 429901 - RNA, 32 nt, Human
gaucuuggcuuucugcaaccucugccucccag

SEQ ID NO: 429902 - RNA, 32 nt, Human
gaucuuggcuuucugcaacgucugccuuccag

SEQ ID NO: 429903 - RNA, 21 nt, Human
gaucuugggacccaccgcugc

SEQ ID NO: 429904 - RNA, 32 nt, Human
gaucuugggacccaccgcugcccucagcuccg

SEQ ID NO: 429905 - RNA, 19 nt, Human
gaucuugggacuuccucuc

SEQ ID NO: 429906 - RNA, 32 nt, Human
gaucuuggggagguggccgggugcaguggcuc

SEQ ID NO: 429907 - RNA, 20 nt, Human
gaucuuggggcuaccgccca

SEQ ID NO: 429908 - RNA, 32 nt, Human
gaucuugggggugggcgggcuguggggcuggg

SEQ ID NO: 429909 - RNA, 19 nt, Human
gaucuugggugacuucuca

SEQ ID NO: 429910 - RNA, 32 nt, Human
gaucuugggugacuucucaucacucuggaccu

SEQ ID NO: 429911 - RNA, 21 nt, Human
gaucuuggugcugagccgcca

SEQ ID NO: 429912 - RNA, 32 nt, Human
gaucuugucucucaggcuggguugcaauggca

SEQ ID NO: 429913 - RNA, 29 nt, Human
gaucuugugucuguugugccugaauuugg

SEQ ID NO: 429914 - RNA, 32 nt, Human
gaucuuguuggaugcacuuagauauggaaaau

SEQ ID NO: 429915 - RNA, 32 nt, Human
gaucuuuaacgggaaggcugcuuucuccuuuu

SEQ ID NO: 429916 - RNA, 19 nt, Human
gaucuuuagaacuguaaaa

SEQ ID NO: 429917 - RNA, 31 nt, Human
gaucuuuaguaucuuuaccuaccucaauuuc

SEQ ID NO: 429918 - RNA, 32 nt, Human
gaucuuuauggggcuuaagcuugggugggagc

SEQ ID NO: 429919 - RNA, 18 nt, Human
gaucuuuauugcugcuua

SEQ ID NO: 429920 - RNA, 32 nt, Human
gaucuuucaaaggacacccaugaugucuacuc

SEQ ID NO: 429921 - RNA, 32 nt, Human
gaucuuucagcuucccagaguguugugggaau

SEQ ID NO: 429922 - RNA, 31 nt, Human
gaucuuuccucuucugggccucugcuccccu

SEQ ID NO: 429923 - RNA, 32 nt, Human
gaucuuuccuuugacagaugugguacucugug

SEQ ID NO: 429924 - RNA, 32 nt, Human
gaucuuucucacuuacuccucucccauucagc

SEQ ID NO: 429925 - RNA, 32 nt, Human
gaucuuucucucugacuauacuuaguuugaaa

SEQ ID NO: 429926 - RNA, 32 nt, Human
gaucuuugcuucaguccuugaaucaccugugg

SEQ ID NO: 429927 - RNA, 32 nt, Human
gaucuuuggaaaugucaguccuggaggcugag

SEQ ID NO: 429928 - RNA, 32 nt, Human
gaucuuuggagagaaggagguggggauccgag

SEQ ID NO: 429929 - RNA, 32 nt, Human
gaucuuuggcaaagccagaggaagaaaggagc

SEQ ID NO: 429930 - RNA, 32 nt, Human
gaucuuugugggccaaggugggcugggagggc

SEQ ID NO: 429931 - RNA, 32 nt, Human
gaucuuuguguucugaaggcuucacucaggug

SEQ ID NO: 429932 - RNA, 32 nt, Human
gaucuuuguugugugggagggcagcagggaug

SEQ ID NO: 429933 - RNA, 32 nt, Human
gaucuuuuauuggcucugggcugugcucagug

SEQ ID NO: 429934 - RNA, 32 nt, Human
gaucuuuucaaaaucaccucaggagccacaga

SEQ ID NO: 429935 - RNA, 32 nt, Human
gaucuuuucaaggucacacaucaggugguuag

SEQ ID NO: 429936 - RNA, 32 nt, Human
gaucuuuuccuauauuuagaagagugauucuc

SEQ ID NO: 429937 - RNA, 32 nt, Human
gaucuuuucuauaccagaacugcggucacuau

SEQ ID NO: 429938 - RNA, 32 nt, Human
gaucuuuucucuuccaaucaaaugucuaggcu

SEQ ID NO: 429939 - RNA, 32 nt, Human
gaucuuuuuauuuugcaauccugggccagcua

SEQ ID NO: 429940 - RNA, 32 nt, Human
gaucuuuuuccauccagcaguggaguuuagua

SEQ ID NO: 429941 - RNA, 32 nt, Human
gaugaaaaagucacaucagagcacucaguuug

SEQ ID NO: 429942 - RNA, 32 nt, Human
gaugaaaacauagcaucucaggagauuucaug

SEQ ID NO: 429943 - RNA, 32 nt, Human
gaugaaaaccggcucccuugcuuacacuauau

SEQ ID NO: 429944 - RNA, 32 nt, Human
gaugaaaaccuacaggguggcccccugugcca

SEQ ID NO: 429945 - RNA, 32 nt, Human
gaugaaaacuaaggauuuuucaagagaucuuu

SEQ ID NO: 429946 - RNA, 32 nt, Human
gaugaaaacucaaaacaaaaagaaauaccuca

SEQ ID NO: 429947 - RNA, 32 nt, Human
gaugaaaacucauuaagcaguuccucugacag

SEQ ID NO: 429948 - RNA, 32 nt, Human
gaugaaaacucauuaagcaguuccucugacug

SEQ ID NO: 429949 - RNA, 32 nt, Human
gaugaaaagaaaacuuaaagaggaauggcccu

SEQ ID NO: 429950 - RNA, 32 nt, Human
gaugaaaagauccagacccgggaagggaaguc

SEQ ID NO: 429951 - RNA, 32 nt, Human
gaugaaaagauggcacaggcacuguugguacc

SEQ ID NO: 429952 - RNA, 32 nt, Human
gaugaaaagauggcacagucagugcugguacc

SEQ ID NO: 429953 - RNA, 32 nt, Human
gaugaaaauaauggaaggaauguggagcaaua

SEQ ID NO: 429954 - RNA, 32 nt, Human
gaugaaaauacuacugcugagcauuuuugaag

SEQ ID NO: 429955 - RNA, 32 nt, Human
gaugaaaauguucaguuuguacccauuuuucc

SEQ ID NO: 429956 - RNA, 32 nt, Human
gaugaaacaaauuuguccccacgggcuaguuu

SEQ ID NO: 429957 - RNA, 32 nt, Human
gaugaaacacgauggucagauucuuccgugac

SEQ ID NO: 429958 - RNA, 32 nt, Human
gaugaaacaucagucuaccagcuuugggcuga

SEQ ID NO: 429959 - RNA, 32 nt, Human
gaugaaacccagcaucagagagguuuucagca

SEQ ID NO: 429960 - RNA, 32 nt, Human
gaugaaagaaaagaucgggaucccagggucca

SEQ ID NO: 429961 - RNA, 32 nt, Human
gaugaaagacaaacacaucugcccaaugaucc

SEQ ID NO: 429962 - RNA, 32 nt, Human
gaugaaaggaagagaggggccaauugggcagg

SEQ ID NO: 429963 - RNA, 32 nt, Human
gaugaaauuaugguuugcacugucuauuaaau

SEQ ID NO: 429964 - RNA, 32 nt, Human
gaugaaauuuguuuccuggugagcacagaauc

SEQ ID NO: 429965 - RNA, 32 nt, Human
gaugaacagcuaccucccucagcuucagagau

SEQ ID NO: 429966 - RNA, 32 nt, Human
gaugaacaggaugacaagauucaugccaucag

SEQ ID NO: 429967 - RNA, 32 nt, Human
gaugaacauggagaaaccccgucucuacuaaa

SEQ ID NO: 429968 - RNA, 19 nt, Human
gaugaacccuggcauuugg

SEQ ID NO: 429969 - RNA, 32 nt, Human
gaugaaccuccacccccaccccacccccgcac

SEQ ID NO: 429970 - RNA, 32 nt, Human
gaugaacuaaggcugcuggugcccugagcaac

SEQ ID NO: 429971 - RNA, 32 nt, Human
gaugaacucacugagcagccagagccaaaugc

SEQ ID NO: 429972 - RNA, 32 nt, Human
gaugaacugccucuccuccucccugccugggg

SEQ ID NO: 429973 - RNA, 24 nt, Human
gaugaagaaacugaggcucuagga

SEQ ID NO: 429974 - RNA, 24 nt, Human
gaugaagaaacugagguucagaga

SEQ ID NO: 429975 - RNA, 32 nt, Human
gaugaagaacagcaagaaaucuccaagaagcu

SEQ ID NO: 429976 - RNA, 32 nt, Human
gaugaagaagugaaaaugacaauaaugacucu

SEQ ID NO: 429977 - RNA, 32 nt, Human
gaugaagacaagaaggaggaggggacggggag

SEQ ID NO: 429978 - RNA, 23 nt, Human
gaugaagacuuagaaucugugga

SEQ ID NO: 429979 - RNA, 32 nt, Human
gaugaagagaauauaauugcucugcuuuucca

SEQ ID NO: 429980 - RNA, 32 nt, Human
gaugaagagaggaggacaucaagacagguggc

SEQ ID NO: 429981 - RNA, 32 nt, Human
gaugaagaugaaugcaggaagaauugugucca

SEQ ID NO: 429982 - RNA, 32 nt, Human
gaugaagauggaaacacagauaccuacacugg

SEQ ID NO: 429983 - RNA, 32 nt, Human
gaugaagauguggcaggagaaagaaagaaaac

SEQ ID NO: 429984 - RNA, 32 nt, Human
gaugaagaugugggagaggagcagcccccagu

SEQ ID NO: 429985 - RNA, 25 nt, Human
gaugaagcaaacugaggcccagaga

SEQ ID NO: 429986 - RNA, 32 nt, Human
gaugaagcaaacugaggcccagagaagggaaa

SEQ ID NO: 429987 - RNA, 32 nt, Human
gaugaagcuaggggaggaaggaaggaaggaag

SEQ ID NO: 429988 - RNA, 32 nt, Human
gaugaagcucuaauuucuauuacauguaauuu

SEQ ID NO: 429989 - RNA, 32 nt, Human
gaugaagcucuggagaaauuuaaacacuggca

SEQ ID NO: 429990 - RNA, 32 nt, Human
gaugaagcuggggcugcaagacugccucuccu

SEQ ID NO: 429991 - RNA, 32 nt, Human
gaugaagcuuccaaaggugccugagaugaaac

SEQ ID NO: 429992 - RNA, 32 nt, Human
gaugaaggaauccguggcucuaccugcccagc

SEQ ID NO: 429993 - RNA, 32 nt, Human
gaugaaggcaaaaguuuuuaauaaaaggcauu

SEQ ID NO: 429994 - RNA, 32 nt, Human
gaugaaggcguuucugagggcuugccuacacu

SEQ ID NO: 429995 - RNA, 32 nt, Human
gaugaagggaauucacucuguuuugcagaaaa

SEQ ID NO: 429996 - RNA, 32 nt, Human
gaugaagggagcucaggagagccgucuucagc

SEQ ID NO: 429997 - RNA, 32 nt, Human
gaugaagguaauccggaguggcaauggagugg

SEQ ID NO: 429998 - RNA, 32 nt, Human
gaugaaguagacagcuuuacucaguaucucag

SEQ ID NO: 429999 - RNA, 32 nt, Human
gaugaaguagauaggggcuagagcagauugua

SEQ ID NO: 430000 - RNA, 32 nt, Human
gaugaagucacugcacccuccacuaccucuac

SEQ ID NO: 430001 - RNA, 32 nt, Human
gaugaagucucacugcacucaggcuggagugc

SEQ ID NO: 430002 - RNA, 32 nt, Human
gaugaagugaaaaaggaguaagacgacccaga

SEQ ID NO: 430003 - RNA, 32 nt, Human
gaugaagugcccuccagccucagagcuagcca

SEQ ID NO: 430004 - RNA, 32 nt, Human
gaugaaguuuucauccccaucugccuguuaau

SEQ ID NO: 430005 - RNA, 32 nt, Human
gaugaauaaccaguaccaguuccaguucaagu

SEQ ID NO: 430006 - RNA, 32 nt, Human
gaugaauaagaaagggagagcacaugaagcuu

SEQ ID NO: 430007 - RNA, 32 nt, Human
gaugaauacauggcuuggcauuuucuaugguu

SEQ ID NO: 430008 - RNA, 32 nt, Human
gaugaauacguugccagcuugcaucugccauc

SEQ ID NO: 430009 - RNA, 32 nt, Human
gaugaauagaaaaccuguaagcuuugauguuc

SEQ ID NO: 430010 - RNA, 32 nt, Human
gaugaauauuggucaccuaccucggcaguagg

SEQ ID NO: 430011 - RNA, 32 nt, Human
gaugaaucaaggaagcagggcccugucuuaug

SEQ ID NO: 430012 - RNA, 32 nt, Human
gaugaauccauaggauagagaaaaaucugcuu

SEQ ID NO: 430013 - RNA, 32 nt, Human
gaugaaucccaggugcucuggagcuggauggu

SEQ ID NO: 430014 - RNA, 32 nt, Human
gaugaaugagccccagcaguccaaggugugau

SEQ ID NO: 430015 - RNA, 32 nt, Human
gaugaaugcuuagugcccucacuucuucucuc

SEQ ID NO: 430016 - RNA, 32 nt, Human
gaugaaugggaaaguauuuuugaaagaauucu

SEQ ID NO: 430017 - RNA, 32 nt, Human
gaugaaugggggugccuggugaggccccaacc

SEQ ID NO: 430018 - RNA, 31 nt, Human
gaugaauguggagggggaaaagacugcugga

SEQ ID NO: 430019 - RNA, 32 nt, Human
gaugaauguguccugcuucuucccaggcucca

SEQ ID NO: 430020 - RNA, 32 nt, Human
gaugaauguuaucagcuauuuauccaaauuac

SEQ ID NO: 430021 - RNA, 32 nt, Human
gaugaauucuggauauaugaccaauaaaacug

SEQ ID NO: 430022 - RNA, 30 nt, Human
gaugaauuuggcauuaguaggcauuuuacu

SEQ ID NO: 430023 - RNA, 32 nt, Human
gaugacaaaaggaggcugggcgcggugucuca

SEQ ID NO: 430024 - RNA, 32 nt, Human
gaugacaaauaccugaaugucaucacauccuc

SEQ ID NO: 430025 - RNA, 32 nt, Human
gaugacaaguuagggagagaucagaggucaua

SEQ ID NO: 430026 - RNA, 32 nt, Human
gaugacaaguuccguggucuuccuaagaaaca

SEQ ID NO: 430027 - RNA, 32 nt, Human
gaugacacaacugcacuccagcuugggcaaca

SEQ ID NO: 430028 - RNA, 32 nt, Human
gaugacacagcaguugccaucuugaaaaaugc

SEQ ID NO: 430029 - RNA, 32 nt, Human
gaugacaccacugcacuccaaccuagguaaca

SEQ ID NO: 430030 - RNA, 32 nt, Human
gaugacacugugggugcuaucuuccauauuuu

SEQ ID NO: 430031 - RNA, 30 nt, Human
gaugacagaaagcaaucagagggauggagg

SEQ ID NO: 430032 - RNA, 32 nt, Human
gaugacagacagggacgaagcagagaccucua

SEQ ID NO: 430033 - RNA, 32 nt, Human
gaugacagagcugagacccagagaggggaaga

SEQ ID NO: 430034 - RNA, 32 nt, Human
gaugacagagugaggagggcccagagcagaau

SEQ ID NO: 430035 - RNA, 32 nt, Human
gaugacagcuagaggcuggagcagggccggcc

SEQ ID NO: 430036 - RNA, 32 nt, Human
gaugacagcuauggggcacacaggccauuugc

SEQ ID NO: 430037 - RNA, 32 nt, Human
gaugacaggagaaucuagauaccuuuggaccc

SEQ ID NO: 430038 - RNA, 32 nt, Human
gaugacaggcgcacaucaccacgcccagcuga

SEQ ID NO: 430039 - RNA, 32 nt, Human
gaugacagucaauguggagaaacuuuuggcca

SEQ ID NO: 430040 - RNA, 32 nt, Human
gaugacagugcugugugggucucugucagagu

SEQ ID NO: 430041 - RNA, 32 nt, Human
gaugacauccaccuucuccaucucuucgaagu

SEQ ID NO: 430042 - RNA, 32 nt, Human
gaugacauggagaucccuuaaagagaaccaga

SEQ ID NO: 430043 - RNA, 32 nt, Human
gaugacauggaugcagcacagacucagccuug

SEQ ID NO: 430044 - RNA, 32 nt, Human
gaugacauugcccgcccucccccuaggcccag

SEQ ID NO: 430045 - RNA, 32 nt, Human
gaugacauugguguguuccucagcaagucguc

SEQ ID NO: 430046 - RNA, 26 nt, Human
gaugaccacuucuccauugguguggg

SEQ ID NO: 430047 - RNA, 32 nt, Human
gaugaccagaugcccugcuccaucacaaccuc

SEQ ID NO: 430048 - RNA, 32 nt, Human
gaugaccagauggggaggggauguccaggcag

SEQ ID NO: 430049 - RNA, 32 nt, Human
gaugaccagguucugucucuauggaagucacu

SEQ ID NO: 430050 - RNA, 32 nt, Human
gaugacccaaaggauaagaaagaaaagagagc

SEQ ID NO: 430051 - RNA, 32 nt, Human
gaugaccccaacgagguauaacaugccacggc

SEQ ID NO: 430052 - RNA, 32 nt, Human
gaugaccccacccccgcacacgcacacgcaca

SEQ ID NO: 430053 - RNA, 32 nt, Human
gaugacccccaucccucauaccauggagucau

SEQ ID NO: 430054 - RNA, 32 nt, Human
gaugaccccuucucccccgucugugcccuucc

SEQ ID NO: 430055 - RNA, 32 nt, Human
gaugaccuccacccuccuuggacaugaauccu

SEQ ID NO: 430056 - RNA, 32 nt, Human
gaugaccucuacucggggucgggcucgggcug

SEQ ID NO: 430057 - RNA, 32 nt, Human
gaugaccugaccaugccugccugcugaucagu

SEQ ID NO: 430058 - RNA, 32 nt, Human
gaugaccugcugugucccucugagcacuaccc

SEQ ID NO: 430059 - RNA, 32 nt, Human
gaugaccuggagaucuaauacaggcuugaaag

SEQ ID NO: 430060 - RNA, 32 nt, Human
gaugaccuguacgcugugccacacagaaauca

SEQ ID NO: 430061 - RNA, 32 nt, Human
gaugaccuguguaauaaucuuuguuaguaguc

SEQ ID NO: 430062 - RNA, 32 nt, Human
gaugaccuuguagacaugcacacaacuauacc

SEQ ID NO: 430063 - RNA, 32 nt, Human
gaugacgccauugcacuccagccugggugaga

SEQ ID NO: 430064 - RNA, 32 nt, Human
gaugacggagcacgacugugucccaaacaaac

SEQ ID NO: 430065 - RNA, 32 nt, Human
gaugacggagcugccaagggcucuccuggccc

SEQ ID NO: 430066 - RNA, 32 nt, Human
gaugacgggaaggccagaugcagagaggagcu

SEQ ID NO: 430067 - RNA, 32 nt, Human
gaugacgguacuggucaagaugggucaagcaa

SEQ ID NO: 430068 - RNA, 32 nt, Human
gaugacucagccugcuuugaaauuagcuugua

SEQ ID NO: 430069 - RNA, 32 nt, Human
gaugacuccuacuccauuguuuaccccaaagc

SEQ ID NO: 430070 - RNA, 32 nt, Human
gaugacucgcaguaccacagcacugggacaga

SEQ ID NO: 430071 - RNA, 32 nt, Human
gaugacucugccccucagagcuugcagacggc

SEQ ID NO: 430072 - RNA, 32 nt, Human
gaugacucugggggcagaggugggcucuguuu

SEQ ID NO: 430073 - RNA, 32 nt, Human
gaugacugaaguauuugugagccacauauugg

SEQ ID NO: 430074 - RNA, 32 nt, Human
gaugacugcagcccuggcuggcaccuugauug

SEQ ID NO: 430075 - RNA, 32 nt, Human
gaugacuggaaaccauacaagcuuagaagacu

SEQ ID NO: 430076 - RNA, 32 nt, Human
gaugacugggcuggggaagcagaugcuugcug

SEQ ID NO: 430077 - RNA, 32 nt, Human
gaugacuggugcugugcuccagccuuaucagu

SEQ ID NO: 430078 - RNA, 32 nt, Human
gaugacuguacaacaggaagacuugaaaaauc

SEQ ID NO: 430079 - RNA, 32 nt, Human
gaugacuguagccuguggauuguacugcagua

SEQ ID NO: 430080 - RNA, 32 nt, Human
gaugacuguguuaagugcaucuguauuguaag

SEQ ID NO: 430081 - RNA, 32 nt, Human
gaugacuuagggcuucccaucuguguacaucc

SEQ ID NO: 430082 - RNA, 32 nt, Human
gaugacuucuaacauucugugaugccuaauuu

SEQ ID NO: 430083 - RNA, 32 nt, Human
gaugacuuggcaggacuugccccaccaggguc

SEQ ID NO: 430084 - RNA, 32 nt, Human
gaugacuugguugaaccuguggcuaggggaag

SEQ ID NO: 430085 - RNA, 32 nt, Human
gaugacuuuggugaaaccccgucucuacuaaa

SEQ ID NO: 430086 - RNA, 32 nt, Human
gaugacuuuugucccauguggcuuuugugaag

SEQ ID NO: 430087 - RNA, 32 nt, Human
gaugacuuuuguccuucuuucuuccaaucugu

SEQ ID NO: 430088 - RNA, 24 nt, Human
gaugagaaaacugaggcucaggga

SEQ ID NO: 430089 - RNA, 32 nt, Human
gaugagaaaggucuccucucuccuggcauaac

SEQ ID NO: 430090 - RNA, 32 nt, Human
gaugagaacuucuccuggaagcagggguaaau

SEQ ID NO: 430091 - RNA, 22 nt, Human
gaugagaagacaaccucaggga

SEQ ID NO: 430092 - RNA, 32 nt, Human
gaugagaagccauauaauggcgguuuggggga

SEQ ID NO: 430093 - RNA, 32 nt, Human
gaugagaagggagcagggagaguuccagaaag

SEQ ID NO: 430094 - RNA, 32 nt, Human
gaugagaagguggcaggagugcacuggggaua

SEQ ID NO: 430095 - RNA, 19 nt, Human
gaugagaaugccccaggac

SEQ ID NO: 430096 - RNA, 32 nt, Human
gaugagaauggagagguagggagccaggugca

SEQ ID NO: 430097 - RNA, 32 nt, Human
gaugagaaugugcuuugguguauugaggaguc

SEQ ID NO: 430098 - RNA, 32 nt, Human
gaugagaaugugcuuugguguauugagguguc

SEQ ID NO: 430099 - RNA, 32 nt, Human
gaugagaaugugcuuugguguauugagucuga

SEQ ID NO: 430100 - RNA, 32 nt, Human
gaugagaccagaggagguauggauggaaacaa

SEQ ID NO: 430101 - RNA, 32 nt, Human
gaugagacccuccccaacacagugagacccca

SEQ ID NO: 430102 - RNA, 32 nt, Human
gaugagaccuggagucuaaaauucagacugaa

SEQ ID NO: 430103 - RNA, 32 nt, Human
gaugagacgcugggcaucucuccucuguggcu

SEQ ID NO: 430104 - RNA, 32 nt, Human
gaugagacggaugcucugaugcucugaggcuu

SEQ ID NO: 430105 - RNA, 32 nt, Human
gaugagacuggggcccagggaggggcaggugu

SEQ ID NO: 430106 - RNA, 32 nt, Human
gaugagacuuccaaaccugacagaugucagcc

SEQ ID NO: 430107 - RNA, 32 nt, Human
gaugagagaccccagcccuggaggugcccucg

SEQ ID NO: 430108 - RNA, 32 nt, Human
gaugagaggaaggaaacccuuacauuaugcua

SEQ ID NO: 430109 - RNA, 32 nt, Human
gaugagaggagagagcaacuguucuuucuuuu

SEQ ID NO: 430110 - RNA, 32 nt, Human
gaugagaggcacccuucccuucuucccuccac

SEQ ID NO: 430111 - RNA, 32 nt, Human
gaugagaggccaaacuccguuuuucacgagau

SEQ ID NO: 430112 - RNA, 32 nt, Human
gaugagaggguaaaagaugcucagggaaacac

SEQ ID NO: 430113 - RNA, 32 nt, Human
gaugagaggucugaagccuuccuggccacagg

SEQ ID NO: 430114 - RNA, 31 nt, Human
gaugagagugagagaggaaugaaggugauag

SEQ ID NO: 430115 - RNA, 23 nt, Human
gaugagaguggguaaaucaggga

SEQ ID NO: 430116 - RNA, 32 nt, Human
gaugagagugucuaugggaaauggugguugga

SEQ ID NO: 430117 - RNA, 23 nt, Human
gaugagaguuugagauucaggga

SEQ ID NO: 430118 - RNA, 32 nt, Human
gaugagaugagauaugauuuccuagagaugua

SEQ ID NO: 430119 - RNA, 32 nt, Human
gaugagauggaagaggaggaggaggaggagcu

SEQ ID NO: 430120 - RNA, 32 nt, Human
gaugagauugcgaaggguggcagauggagguu

SEQ ID NO: 430121 - RNA, 32 nt, Human
gaugagauuucugcuuguuucuuuuuguuuuu

SEQ ID NO: 430122 - RNA, 32 nt, Human
gaugagcaaaacucagagccuguggaguugac

SEQ ID NO: 430123 - RNA, 32 nt, Human
gaugagcaaauucuacccuaaaaauguucuag

SEQ ID NO: 430124 - RNA, 32 nt, Human
gaugagcaacacauuuuucagcugccagucag

SEQ ID NO: 430125 - RNA, 32 nt, Human
gaugagcacacagaagagacccugccacagga

SEQ ID NO: 430126 - RNA, 24 nt, Human
gaugagcagaaugagacucaaggg

SEQ ID NO: 430127 - RNA, 32 nt, Human
gaugagcagccugaugcaucucagccccugca

SEQ ID NO: 430128 - RNA, 20 nt, Human
gaugagcauacgacugggga

SEQ ID NO: 430129 - RNA, 32 nt, Human
gaugagccaguggaaguaucccuuucccuggc

SEQ ID NO: 430130 - RNA, 32 nt, Human
gaugagcccagcccuguucugggugcagcuga

SEQ ID NO: 430131 - RNA, 32 nt, Human
gaugagcccaggaaaagggaauuccagaaugg

SEQ ID NO: 430132 - RNA, 32 nt, Human
gaugagccggcgaggccaggugcggggcgcgc

SEQ ID NO: 430133 - RNA, 32 nt, Human
gaugagccuggaaaacgcagacaggagaggaa

SEQ ID NO: 430134 - RNA, 32 nt, Human
gaugagcgcuuccaggcuucaggcucagaagg

SEQ ID NO: 430135 - RNA, 32 nt, Human
gaugagcgggucuguccucuucacggcgggag

SEQ ID NO: 430136 - RNA, 32 nt, Human
gaugagcucacaguccaggucucuugcugugu

SEQ ID NO: 430137 - RNA, 21 nt, Human
gaugagcucagccuuuacuca

SEQ ID NO: 430138 - RNA, 32 nt, Human
gaugagcugcaacaggcugagcuccagagagc

SEQ ID NO: 430139 - RNA, 32 nt, Human
gaugagcugcagcuggcucauggccuucuuag

SEQ ID NO: 430140 - RNA, 32 nt, Human
gaugagcugcuuagggagggaauauauucaaa

SEQ ID NO: 430141 - RNA, 32 nt, Human
gaugagcugggaacaagggaagagagagcagg

SEQ ID NO: 430142 - RNA, 32 nt, Human
gaugagcuucuuuccuccauuucaccuggugg

SEQ ID NO: 430143 - RNA, 32 nt, Human
gaugagcuugcagccucauaggaggucagcac

SEQ ID NO: 430144 - RNA, 32 nt, Human
gaugagcuuucagcugaggccugauggaaauu

SEQ ID NO: 430145 - RNA, 32 nt, Human
gaugagcuuuguagacacucaccagaauaugg

SEQ ID NO: 430146 - RNA, 32 nt, Human
gaugaggaaaauauaaaggaaaagagggagau

SEQ ID NO: 430147 - RNA, 32 nt, Human
gaugaggaaaaucaggccagaggacaacaggc

SEQ ID NO: 430148 - RNA, 22 nt, Human
gaugaggaaacaggcucagaga

SEQ ID NO: 430149 - RNA, 24 nt, Human
gaugaggaaacuaaggcuccuagg

SEQ ID NO: 430150 - RNA, 22 nt, Human
gaugaggaaacuaaggcuugga

SEQ ID NO: 430151 - RNA, 22 nt, Human
gaugaggaaacugaagcuugga

SEQ ID NO: 430152 - RNA, 23 nt, Human
gaugaggaaacugaaguugagga

SEQ ID NO: 430153 - RNA, 32 nt, Human
gaugaggaaacugagacucaagaaauauuuca

SEQ ID NO: 430154 - RNA, 24 nt, Human
gaugaggaaacugaggcccagaga

SEQ ID NO: 430155 - RNA, 24 nt, Human
gaugaggaaacugaggccuggaga

SEQ ID NO: 430156 - RNA, 24 nt, Human
gaugaggaaacugaggcgcagaga

SEQ ID NO: 430157 - RNA, 32 nt, Human
gaugaggaaacugaggcgcagagacuugcuua

SEQ ID NO: 430158 - RNA, 24 nt, Human
gaugaggaaacugaggcucagaga

SEQ ID NO: 430159 - RNA, 25 nt, Human
gaugaggaaacugaggcugagcggg

SEQ ID NO: 430160 - RNA, 21 nt, Human
gaugaggaaacugaguccgga

SEQ ID NO: 430161 - RNA, 24 nt, Human
gaugaggaaacuggaauuuuuuaa

SEQ ID NO: 430162 - RNA, 23 nt, Human
gaugaggaacugaggcucaagga

SEQ ID NO: 430163 - RNA, 32 nt, Human
gaugaggaagagaagaaaugaggagccugucu

SEQ ID NO: 430164 - RNA, 22 nt, Human
gaugaggaagaggacuuugggg

SEQ ID NO: 430165 - RNA, 32 nt, Human
gaugaggaaggcggccggucaccccgccuccg

SEQ ID NO: 430166 - RNA, 22 nt, Human
gaugaggaagugagcucaggga

SEQ ID NO: 430167 - RNA, 32 nt, Human
gaugaggaauauuaccgcauggaguugcuggc

SEQ ID NO: 430168 - RNA, 32 nt, Human
gaugaggaauccuccauuuucuguccgaagcu

SEQ ID NO: 430169 - RNA, 21 nt, Human
gaugaggacaagaucuguggg

SEQ ID NO: 430170 - RNA, 32 nt, Human
gaugaggacagaagcaucucuacagaugaaaa

SEQ ID NO: 430171 - RNA, 32 nt, Human
gaugaggacaggcauccuauccccagccucuu

SEQ ID NO: 430172 - RNA, 22 nt, Human
gaugaggacaugggcccagaga

SEQ ID NO: 430173 - RNA, 23 nt, Human
gaugaggagacaaggaaacagga

SEQ ID NO: 430174 - RNA, 24 nt, Human
gaugaggagacugaggcucagagg

SEQ ID NO: 430175 - RNA, 32 nt, Human
gaugaggaggcagaugaugcagaugcugcugg

SEQ ID NO: 430176 - RNA, 32 nt, Human
gaugaggaggcuggccccagagaugaucuugc

SEQ ID NO: 430177 - RNA, 23 nt, Human
gaugaggaggcuucuaucuugga

SEQ ID NO: 430178 - RNA, 32 nt, Human
gaugaggagguggagugcaggggauguuaggg

SEQ ID NO: 430179 - RNA, 32 nt, Human
gaugaggaucggaacaccauguucuuucccac

SEQ ID NO: 430180 - RNA, 26 nt, Human
gaugaggauggaggccggggaggcag

SEQ ID NO: 430181 - RNA, 32 nt, Human
gaugaggauguggcuguauuuguuuugaguuc

SEQ ID NO: 430182 - RNA, 24 nt, Human
gaugaggcaacugagguucaggga

SEQ ID NO: 430183 - RNA, 32 nt, Human
gaugaggcagaaguccaaguaaccgcuagcuu

SEQ ID NO: 430184 - RNA, 32 nt, Human
gaugaggcagaggcaugaugcuuccugcucac

SEQ ID NO: 430185 - RNA, 32 nt, Human
gaugaggcagguaaggguggaacaggaggggu

SEQ ID NO: 430186 - RNA, 31 nt, Human
gaugaggccacaauccuagccaacauuuuca

SEQ ID NO: 430187 - RNA, 32 nt, Human
gaugaggccagccucagccucuauggcaaggc

SEQ ID NO: 430188 - RNA, 32 nt, Human
gaugaggccgagguaaaagagacaucugcagu

SEQ ID NO: 430189 - RNA, 32 nt, Human
gaugaggccuuccuggacucagcugggagcaa

SEQ ID NO: 430190 - RNA, 32 nt, Human
gaugaggcgagaggaggaggaggaggaggaga

SEQ ID NO: 430191 - RNA, 26 nt, Human
gaugaggcgugcaggccugggugaag

SEQ ID NO: 430192 - RNA, 32 nt, Human
gaugaggcuacucuuaacgcacugccuuuagg

SEQ ID NO: 430193 - RNA, 32 nt, Human
gaugaggcugcuggcucagggugcguggguuc

SEQ ID NO: 430194 - RNA, 32 nt, Human
gaugaggcuggaaaucauccuucugaaagccc

SEQ ID NO: 430195 - RNA, 32 nt, Human
gaugagggaacagcaggugucaaggcuggcag

SEQ ID NO: 430196 - RNA, 32 nt, Human
gaugagggaacagcaguggcugcagcuccagg

SEQ ID NO: 430197 - RNA, 24 nt, Human
gaugagggaacugaggcucaguga

SEQ ID NO: 430198 - RNA, 22 nt, Human
gaugagggaaguuuccagcaga

SEQ ID NO: 430199 - RNA, 32 nt, Human
gaugagggagagagagccagagacaguguugc

SEQ ID NO: 430200 - RNA, 32 nt, Human
gaugagggagagaggagagaggagaggaaagg

SEQ ID NO: 430201 - RNA, 32 nt, Human
gaugagggaggucggggcugcagugagccaag

SEQ ID NO: 430202 - RNA, 32 nt, Human
gaugagggauggaggccaggcaugcuggcuua

SEQ ID NO: 430203 - RNA, 32 nt, Human
gaugagggcaauguccugccuccuggagaaga

SEQ ID NO: 430204 - RNA, 32 nt, Human
gaugagggcucacuccagcuucauauggugcc

SEQ ID NO: 430205 - RNA, 32 nt, Human
gaugaggggccgggacacugcccccuaccuuc

SEQ ID NO: 430206 - RNA, 23 nt, Human
gaugagggggcucccucugugga

SEQ ID NO: 430207 - RNA, 32 nt, Human
gaugaggggucugaaaggccaacccgaggcug

SEQ ID NO: 430208 - RNA, 32 nt, Human
gaugagggguggaaccgagggaagaagguaga

SEQ ID NO: 430209 - RNA, 32 nt, Human
gaugagggugacugucaaguacaagcaagacu

SEQ ID NO: 430210 - RNA, 32 nt, Human
gaugaggucagggaugggcauggugcauaacu

SEQ ID NO: 430211 - RNA, 32 nt, Human
gaugaggucaugcuguaauagggugggccccc

SEQ ID NO: 430212 - RNA, 32 nt, Human
gaugaggucugcacucgggccggggugggugc

SEQ ID NO: 430213 - RNA, 32 nt, Human
gaugaggugaagaucaccauaaucuaaaaggc

SEQ ID NO: 430214 - RNA, 32 nt, Human
gaugaggugaagaucacugucaucuaaaagca

SEQ ID NO: 430215 - RNA, 32 nt, Human
gaugaggugaagaucacugucaucuaaaagcu

SEQ ID NO: 430216 - RNA, 32 nt, Human
gaugaggugggauguggaggucagagcaucuc

SEQ ID NO: 430217 - RNA, 32 nt, Human
gaugagguggugagcccagagcccgagccccu

SEQ ID NO: 430218 - RNA, 24 nt, Human
gaugaguaaacugaggcacagaga

SEQ ID NO: 430219 - RNA, 32 nt, Human
gaugaguagaucaccuggcaucaggaguucaa

SEQ ID NO: 430220 - RNA, 32 nt, Human
gaugagucagugccaugacugagaaggaaccg

SEQ ID NO: 430221 - RNA, 32 nt, Human
gaugagucccaugugacuccugccuuccagga

SEQ ID NO: 430222 - RNA, 32 nt, Human
gaugagucucacuauguugcccaggcuggucu

SEQ ID NO: 430223 - RNA, 32 nt, Human
gaugagucucgcucugcacuccagccuggcga

SEQ ID NO: 430224 - RNA, 32 nt, Human
gaugagucucugcuugcugagcucaucacugu

SEQ ID NO: 430225 - RNA, 32 nt, Human
gaugagucuuccugccugaaacugagagagug

SEQ ID NO: 430226 - RNA, 32 nt, Human
gaugagugaaguuauagcaaaucaagcugcac

SEQ ID NO: 430227 - RNA, 32 nt, Human
gaugagugacuucagggacagagcagaggaaa

SEQ ID NO: 430228 - RNA, 32 nt, Human
gaugagugcagggcagaggugagggaacccaa

SEQ ID NO: 430229 - RNA, 32 nt, Human
gaugagugcccuuacacaaaagccuggaggga

SEQ ID NO: 430230 - RNA, 32 nt, Human
gaugagugccuguaguccaagcuacucaagag

SEQ ID NO: 430231 - RNA, 32 nt, Human
gaugaguggauugcuugagccuaggaguucga

SEQ ID NO: 430232 - RNA, 32 nt, Human
gaugagugguccaagacccuugcuggccucag

SEQ ID NO: 430233 - RNA, 32 nt, Human
gaugaguucuggcagucuguguuuucauuuga

SEQ ID NO: 430234 - RNA, 31 nt, Human
gaugaguuugagagagaaaaaguguaauuga

SEQ ID NO: 430235 - RNA, 32 nt, Human
gaugauaaacuugcacugauagaucuuaaugu

SEQ ID NO: 430236 - RNA, 32 nt, Human
gaugauaaagagacagugauauuggaacuugc

SEQ ID NO: 430237 - RNA, 32 nt, Human
gaugauaaauaguugcuucuagugcaguuuuu

SEQ ID NO: 430238 - RNA, 32 nt, Human
gaugauaaucucaagacuccucccuuagcuac

SEQ ID NO: 430239 - RNA, 32 nt, Human
gaugauaauguuccuggccuaucgcagcugau

SEQ ID NO: 430240 - RNA, 32 nt, Human
gaugauacagaagcuguaaacauacugaaaug

SEQ ID NO: 430241 - RNA, 32 nt, Human
gaugauacagguaagauuggaacucaugaaga

SEQ ID NO: 430242 - RNA, 32 nt, Human
gaugauaccacacaugguuauuggaaaauacu

SEQ ID NO: 430243 - RNA, 32 nt, Human
gaugauacuucaggagauuauauuucacucaa

SEQ ID NO: 430244 - RNA, 32 nt, Human
gaugauaggugagcucaccccugucagguucu

SEQ ID NO: 430245 - RNA, 32 nt, Human
gaugauaugguuauucucucuaauccauuaau

SEQ ID NO: 430246 - RNA, 32 nt, Human
gaugauauugaauuuaaaaacugcacaacugu

SEQ ID NO: 430247 - RNA, 31 nt, Human
gaugaucacagcugccaaggcuaccuaaaag

SEQ ID NO: 430248 - RNA, 32 nt, Human
gaugaucauauuuacagacacuacugugcuaa

SEQ ID NO: 430249 - RNA, 32 nt, Human
gaugaucaugccacugcacuccagcuugggug

SEQ ID NO: 430250 - RNA, 32 nt, Human
gaugaucccaagaagcauguguguacaaugga

SEQ ID NO: 430251 - RNA, 32 nt, Human
gaugaucccuuugcacagaacuaugcuuaucu

SEQ ID NO: 430252 - RNA, 32 nt, Human
gaugauccgcaccaucuucacugaugugcuuc

SEQ ID NO: 430253 - RNA, 32 nt, Human
gaugauccuaaccugcagcacggugguuuuac

SEQ ID NO: 430254 - RNA, 32 nt, Human
gaugauccucaaggaaauacaaccuagggugc

SEQ ID NO: 430255 - RNA, 32 nt, Human
gaugauccucuucaacccugaggucuuaauug

SEQ ID NO: 430256 - RNA, 32 nt, Human
gaugauccuggaguguggaggcagcagcggca

SEQ ID NO: 430257 - RNA, 32 nt, Human
gaugaucgucaccucugugccugaguucuccc

SEQ ID NO: 430258 - RNA, 32 nt, Human
gaugaucuaagagguauugauuucugaauauu

SEQ ID NO: 430259 - RNA, 22 nt, Human
gaugaucuagcucauaccaaag

SEQ ID NO: 430260 - RNA, 32 nt, Human
gaugaucucucuccgcccuggagcucagcgcu

SEQ ID NO: 430261 - RNA, 32 nt, Human
gaugaucugaggauuuaaauucacaaaaccug

SEQ ID NO: 430262 - RNA, 32 nt, Human
gaugaucuggaggaagagugugagccagaaga

SEQ ID NO: 430263 - RNA, 32 nt, Human
gaugaucugugcagcaaagcaccaugguacau

SEQ ID NO: 430264 - RNA, 32 nt, Human
gaugaucuguuuuaaaugugaggcgauuauuu

SEQ ID NO: 430265 - RNA, 32 nt, Human
gaugaucuuagaggagggaagaagagagagag

SEQ ID NO: 430266 - RNA, 32 nt, Human
gaugaugaaccagcuguaaaacuacaacuacu

SEQ ID NO: 430267 - RNA, 32 nt, Human
gaugaugaagaagaugggaauuaccuucaucc

SEQ ID NO: 430268 - RNA, 31 nt, Human
gaugaugaagcaucucccauggggaggugau

SEQ ID NO: 430269 - RNA, 32 nt, Human
gaugaugacuccagaggugcuggcagaggcau

SEQ ID NO: 430270 - RNA, 32 nt, Human
gaugaugacugcacugccaucgugggcagaug

SEQ ID NO: 430271 - RNA, 32 nt, Human
gaugaugagagcuuuccuaagguaauucuuuc

SEQ ID NO: 430272 - RNA, 32 nt, Human
gaugaugagagggagggcugcugccacagacu

SEQ ID NO: 430273 - RNA, 16 nt, Human
gaugaugauauguuga

SEQ ID NO: 430274 - RNA, 32 nt, Human
gaugaugaugaugacuguuaccagggcucugu

SEQ ID NO: 430275 - RNA, 32 nt, Human
gaugaugcaagagagaaugagaaggaauuugg

SEQ ID NO: 430276 - RNA, 32 nt, Human
gaugaugcaugcuggcguuuucuaaaguuuuc

SEQ ID NO: 430277 - RNA, 32 nt, Human
gaugaugccacugcacuccagccugggcuaca

SEQ ID NO: 430278 - RNA, 32 nt, Human
gaugaugccauugcacuccagccugggcaaca

SEQ ID NO: 430279 - RNA, 32 nt, Human
gaugaugcucauaccaauggcuucagugaugg

SEQ ID NO: 430280 - RNA, 32 nt, Human
gaugaugcugccucuccucucuguguugucug

SEQ ID NO: 430281 - RNA, 32 nt, Human
gaugauggaauuagagaggugggcucaaaucu

SEQ ID NO: 430282 - RNA, 32 nt, Human
gaugauggagccaaagaggggaugcuuugaga

SEQ ID NO: 430283 - RNA, 32 nt, Human
gaugauggagcucagcccuccaccuccacagc

SEQ ID NO: 430284 - RNA, 21 nt, Human
gaugauggccaggaguggccu

SEQ ID NO: 430285 - RNA, 32 nt, Human
gaugauggcgagaagucggauuacagggggcc

SEQ ID NO: 430286 - RNA, 32 nt, Human
gaugauggcgguggagguggugguuguagugu

SEQ ID NO: 430287 - RNA, 26 nt, Human
gaugauggcugcagacaucccgagag

SEQ ID NO: 430288 - RNA, 32 nt, Human
gaugauggcugcaguccaguuuuaugauucug

SEQ ID NO: 430289 - RNA, 32 nt, Human
gaugauggcuugagcccaggaguucgagacca

SEQ ID NO: 430290 - RNA, 32 nt, Human
gaugaugggaauugugugauguuuaacaggaa

SEQ ID NO: 430291 - RNA, 32 nt, Human
gaugaugggaggcagugagucuugaugauaag

SEQ ID NO: 430292 - RNA, 32 nt, Human
gaugaugggauuauagguguuugcuacuuauu

SEQ ID NO: 430293 - RNA, 32 nt, Human
gaugaugggggaggggcaggaagcugaauuca

SEQ ID NO: 430294 - RNA, 32 nt, Human
gaugauguaagcaaccaggacuucagagagug

SEQ ID NO: 430295 - RNA, 32 nt, Human
gaugauguacucugggucaagagaccagggau

SEQ ID NO: 430296 - RNA, 32 nt, Human
gaugaugucaccaacaggaugaugucaccagg

SEQ ID NO: 430297 - RNA, 32 nt, Human
gaugauguccauugcugugugauggcuuggaa

SEQ ID NO: 430298 - RNA, 32 nt, Human
gaugaugugcaauuucauguuuuaacuuggga

SEQ ID NO: 430299 - RNA, 32 nt, Human
gaugauguggcagaacugccaaacaagcucug

SEQ ID NO: 430300 - RNA, 32 nt, Human
gaugauguuggaagucauggguccucagagug

SEQ ID NO: 430301 - RNA, 32 nt, Human
gaugauguuuccaucuccaaccccuucaugcc

SEQ ID NO: 430302 - RNA, 32 nt, Human
gaugauuaagagugacagccugagggagcuga

SEQ ID NO: 430303 - RNA, 19 nt, Human
gaugauuacgcauuuugaa

SEQ ID NO: 430304 - RNA, 32 nt, Human
gaugauucagcaucagaagaagaaggaaccca

SEQ ID NO: 430305 - RNA, 32 nt, Human
gaugauucagggcauacucuucaaggucacga

SEQ ID NO: 430306 - RNA, 32 nt, Human
gaugauucagucuguaccagacaugacaacac

SEQ ID NO: 430307 - RNA, 32 nt, Human
gaugauuccauuucauauauacacucauuuuc

SEQ ID NO: 430308 - RNA, 32 nt, Human
gaugauucuaacuccugcuccuucucuugucc

SEQ ID NO: 430309 - RNA, 32 nt, Human
gaugauucucaccuuuacuucucuccagaaca

SEQ ID NO: 430310 - RNA, 32 nt, Human
gaugauucuuaagggcccuucuaggaccaaag

SEQ ID NO: 430311 - RNA, 32 nt, Human
gaugauucuucaaccuuuugggguugaugugg

SEQ ID NO: 430312 - RNA, 32 nt, Human
gaugauucuuccagauaauguccuugcuuuac

SEQ ID NO: 430313 - RNA, 32 nt, Human
gaugauugagaugaaaguuaacauagugugaa

SEQ ID NO: 430314 - RNA, 32 nt, Human
gaugauuggaagauggaaguggaggguuaaau

SEQ ID NO: 430315 - RNA, 32 nt, Human
gaugauuuaaaguauaggcauaccucaaagau

SEQ ID NO: 430316 - RNA, 22 nt, Human
gaugauuuccaaacauucaaag

SEQ ID NO: 430317 - RNA, 32 nt, Human
gaugauuucccuuaaggagcauuucuccugau

SEQ ID NO: 430318 - RNA, 32 nt, Human
gaugauuugcuguauucuccugaaaggucgua

SEQ ID NO: 430319 - RNA, 32 nt, Human
gaugauuuggaaaaucucuggagagacugaaa

SEQ ID NO: 430320 - RNA, 32 nt, Human
gaugauuuuauguuauguggauuucauuucaa

SEQ ID NO: 430321 - RNA, 32 nt, Human
gaugauuuucacccucucuagcugagguaacu

SEQ ID NO: 430322 - RNA, 32 nt, Human
gaugauuuucagggacuuguuggcaacucagc

SEQ ID NO: 430323 - RNA, 32 nt, Human
gaugauuuugcacuuugagauuaaaaugccau

SEQ ID NO: 430324 - RNA, 32 nt, Human
gaugauuuuguaaaaguacuauuuuaaauauc

SEQ ID NO: 430325 - RNA, 32 nt, Human
gaugcaaaccuugagaaaucaacuuggagaac

SEQ ID NO: 430326 - RNA, 32 nt, Human
gaugcaaagacuauagacuguaaaccugagga

SEQ ID NO: 430327 - RNA, 32 nt, Human
gaugcaaaucaauuucauaaaugcuaaaaugu

SEQ ID NO: 430328 - RNA, 32 nt, Human
gaugcaaccucacuaugguaugcuggccagca

SEQ ID NO: 430329 - RNA, 26 nt, Human
gaugcaagcagcugcccagacaugug

SEQ ID NO: 430330 - RNA, 32 nt, Human
gaugcaagccacucgggaccugaugucggcag

SEQ ID NO: 430331 - RNA, 32 nt, Human
gaugcaagggaagccgagaaguugccgaaagg

SEQ ID NO: 430332 - RNA, 32 nt, Human
gaugcaauccagggugggauuucuugaggaag

SEQ ID NO: 430333 - RNA, 32 nt, Human
gaugcacaaccaagggguuacaggcaucgccc

SEQ ID NO: 430334 - RNA, 26 nt, Human
gaugcacacacgugcacaccuacaca

SEQ ID NO: 430335 - RNA, 32 nt, Human
gaugcacaccaccacacccagccuagaaugaa

SEQ ID NO: 430336 - RNA, 32 nt, Human
gaugcacaccuguaaucccagcuacucgggag

SEQ ID NO: 430337 - RNA, 32 nt, Human
gaugcacacgcaugcacacacgcacacaugca

SEQ ID NO: 430338 - RNA, 32 nt, Human
gaugcacagaugccauggccugugcugggcca

SEQ ID NO: 430339 - RNA, 32 nt, Human
gaugcacagcuaccuggugagcugugccaccc

SEQ ID NO: 430340 - RNA, 24 nt, Human
gaugcacagcugccuugugugcga

SEQ ID NO: 430341 - RNA, 19 nt, Human
gaugcacagguggcuccug

SEQ ID NO: 430342 - RNA, 32 nt, Human
gaugcacagucucccugcucaugcccuucagu

SEQ ID NO: 430343 - RNA, 32 nt, Human
gaugcacagugcaguagguuuugguaagugca

SEQ ID NO: 430344 - RNA, 32 nt, Human
gaugcacauaauccauuugcacugcagacaau

SEQ ID NO: 430345 - RNA, 32 nt, Human
gaugcacaucucauucugucaugaauguccag

SEQ ID NO: 430346 - RNA, 21 nt, Human
gaugcacaugcuuuuguguga

SEQ ID NO: 430347 - RNA, 32 nt, Human
gaugcaccaaaccaagugccucauuucugugc

SEQ ID NO: 430348 - RNA, 32 nt, Human
gaugcaccaaggccaggcuuaccgauggucug

SEQ ID NO: 430349 - RNA, 32 nt, Human
gaugcaccacugcaccccagccugggcgacgg

SEQ ID NO: 430350 - RNA, 32 nt, Human
gaugcaccagugccugugccauaaaguuccga

SEQ ID NO: 430351 - RNA, 17 nt, Human
gaugcaccucuggccuc

SEQ ID NO: 430352 - RNA, 32 nt, Human
gaugcaccuugaucucacccucacuccaaggc

SEQ ID NO: 430353 - RNA, 32 nt, Human
gaugcacgaacuuugaacauucguuaugggga

SEQ ID NO: 430354 - RNA, 32 nt, Human
gaugcacgccuguaaacccagcuacucgggag

SEQ ID NO: 430355 - RNA, 32 nt, Human
gaugcacguccucagagggagcagccuaucuc

SEQ ID NO: 430356 - RNA, 32 nt, Human
gaugcacuaccugaacacuccccugccaaaac

SEQ ID NO: 430357 - RNA, 32 nt, Human
gaugcacuguuccugcuguggguccucaucau

SEQ ID NO: 430358 - RNA, 32 nt, Human
gaugcagagagcuguggggcgaucuuucuuag

SEQ ID NO: 430359 - RNA, 32 nt, Human
gaugcagagauggagacaugagacucagugca

SEQ ID NO: 430360 - RNA, 19 nt, Human
gaugcagaggcuggggagu

SEQ ID NO: 430361 - RNA, 32 nt, Human
gaugcagaggggaauccgaggccaucaaccuu

SEQ ID NO: 430362 - RNA, 32 nt, Human
gaugcagagguggagguugaggccgugacucc

SEQ ID NO: 430363 - RNA, 32 nt, Human
gaugcagauuccagcauccccuccucagagau

SEQ ID NO: 430364 - RNA, 32 nt, Human
gaugcagcaagccucagggcuggggauuuuca

SEQ ID NO: 430365 - RNA, 32 nt, Human
gaugcagcacagacucagccuuggccuggagc

SEQ ID NO: 430366 - RNA, 32 nt, Human
gaugcagcaguuauugcaagaaaaugaaacua

SEQ ID NO: 430367 - RNA, 32 nt, Human
gaugcagcauuuugcugcuaccuuacaagcuu

SEQ ID NO: 430368 - RNA, 32 nt, Human
gaugcagccauggaaaaugucuuauaagcacc

SEQ ID NO: 430369 - RNA, 32 nt, Human
gaugcagcuuuaagaugguggggaggaugggg

SEQ ID NO: 430370 - RNA, 32 nt, Human
gaugcagcuuucuccuccgucuggucuccugu

SEQ ID NO: 430371 - RNA, 32 nt, Human
gaugcaggaugggaggacaggaaggcagccug

SEQ ID NO: 430372 - RNA, 32 nt, Human
gaugcaggcugguucaugccacuuuuucagag

SEQ ID NO: 430373 - RNA, 32 nt, Human
gaugcagggacugccuucuccuuccugcuuca

SEQ ID NO: 430374 - RNA, 32 nt, Human
gaugcagggaggaggaaggcugaggaaugacu

SEQ ID NO: 430375 - RNA, 32 nt, Human
gaugcagggcaggaccacccagcuggucagac

SEQ ID NO: 430376 - RNA, 32 nt, Human
gaugcagggcuggaggccagaggugucagcaa

SEQ ID NO: 430377 - RNA, 32 nt, Human
gaugcagggucugagucaggccuucugguuau

SEQ ID NO: 430378 - RNA, 32 nt, Human
gaugcaggucauuuugggggagggaggaagau

SEQ ID NO: 430379 - RNA, 32 nt, Human
gaugcaggucuaaugacugucuuuggaagagg

SEQ ID NO: 430380 - RNA, 18 nt, Human
gaugcagucuggggagug

SEQ ID NO: 430381 - RNA, 32 nt, Human
gaugcauauagacacacauacauaaugguacu

SEQ ID NO: 430382 - RNA, 32 nt, Human
gaugcaucaagaaaacccaagcugugaugcug

SEQ ID NO: 430383 - RNA, 32 nt, Human
gaugcauccuccccuucucuuuucuccacaug

SEQ ID NO: 430384 - RNA, 32 nt, Human
gaugcaucuguuucagcccuaaccccagugug

SEQ ID NO: 430385 - RNA, 32 nt, Human
gaugcaugaugaaaaccugagugaagaggcug

SEQ ID NO: 430386 - RNA, 32 nt, Human
gaugcaugccuguaaucccagcuacucgggag

SEQ ID NO: 430387 - RNA, 32 nt, Human
gaugcaugccuguggucccaguuacuugggag

SEQ ID NO: 430388 - RNA, 32 nt, Human
gaugcauggggguggcacugagcuaggcagag

SEQ ID NO: 430389 - RNA, 32 nt, Human
gaugcauguaugcacacacaugcgcgcacacg

SEQ ID NO: 430390 - RNA, 32 nt, Human
gaugcauguucugauugccucuuuggagaagc

SEQ ID NO: 430391 - RNA, 32 nt, Human
gaugccaaaauuagggucuugguaagaaauuu

SEQ ID NO: 430392 - RNA, 32 nt, Human
gaugccaaaggauuuuuggaagguaaagaagg

SEQ ID NO: 430393 - RNA, 32 nt, Human
gaugccaaauagaaaagaagcaaauggaggaa

SEQ ID NO: 430394 - RNA, 32 nt, Human
gaugccaaauauuuuugccagcacuuuuucag

SEQ ID NO: 430395 - RNA, 22 nt, Human
gaugccaaggggcugagugagu

SEQ ID NO: 430396 - RNA, 32 nt, Human
gaugccacaaagaaauccgacauaucagauag

SEQ ID NO: 430397 - RNA, 23 nt, Human
gaugccacagcaugaaccagaug

SEQ ID NO: 430398 - RNA, 16 nt, Human
gaugccacaggaugcc

SEQ ID NO: 430399 - RNA, 32 nt, Human
gaugccacauuuuucaugcagaaaagaaccac

SEQ ID NO: 430400 - RNA, 32 nt, Human
gaugccaccuucagauccuuuuauucuccaga

SEQ ID NO: 430401 - RNA, 32 nt, Human
gaugccacuaccccuugauuuuccaucuaaaa

SEQ ID NO: 430402 - RNA, 32 nt, Human
gaugccacugcacuccagccugggcuacagag

SEQ ID NO: 430403 - RNA, 32 nt, Human
gaugccagacuugccucacacccaggagcugc

SEQ ID NO: 430404 - RNA, 32 nt, Human
gaugccagagaaggcuugggaaauuguacuuc

SEQ ID NO: 430405 - RNA, 32 nt, Human
gaugccagaguccuugagcugucaguucccac

SEQ ID NO: 430406 - RNA, 32 nt, Human
gaugccagaucccaaguccacccuccccuuca

SEQ ID NO: 430407 - RNA, 32 nt, Human
gaugccagcacucaguuauccaagcaagaaau

SEQ ID NO: 430408 - RNA, 30 nt, Human
gaugccagccucucacugucuccugugcuu

SEQ ID NO: 430409 - RNA, 32 nt, Human
gaugccaggagcuuagggcuuugcauuguguc

SEQ ID NO: 430410 - RNA, 32 nt, Human
gaugccaggaguucaagaccagccugggcaac

SEQ ID NO: 430411 - RNA, 32 nt, Human
gaugccaggaguucgagaccagccuggccaac

SEQ ID NO: 430412 - RNA, 32 nt, Human
gaugccaggggaguuugccaaugaaguaaagg

SEQ ID NO: 430413 - RNA, 32 nt, Human
gaugccaucaaauacuuccuccugccagucau

SEQ ID NO: 430414 - RNA, 32 nt, Human
gaugccauggcagacaguagacagaacaacac

SEQ ID NO: 430415 - RNA, 32 nt, Human
gaugccaugugcuugcuggaggucccaggugc

SEQ ID NO: 430416 - RNA, 32 nt, Human
gaugccauuacagaaccaaaucauggcaggua

SEQ ID NO: 430417 - RNA, 32 nt, Human
gaugccauuacagaaccaaaucguggcacgua

SEQ ID NO: 430418 - RNA, 32 nt, Human
gaugccauugcacuccagccugggcaacaaga

SEQ ID NO: 430419 - RNA, 32 nt, Human
gaugccauugcacuccagccugggcaacagag

SEQ ID NO: 430420 - RNA, 32 nt, Human
gaugcccacugaggaaucaugaagcuuccuuu

SEQ ID NO: 430421 - RNA, 32 nt, Human
gaugcccacuucccuccacccccacaccccag

SEQ ID NO: 430422 - RNA, 23 nt, Human
gaugcccagagcaaccgcccaca

SEQ ID NO: 430423 - RNA, 32 nt, Human
gaugcccagcagcguggggagcuggccguuaa

SEQ ID NO: 430424 - RNA, 32 nt, Human
gaugcccaggcagaacacaaacaggaccaccu

SEQ ID NO: 430425 - RNA, 32 nt, Human
gaugccccacuggccucugccuugccuagguc

SEQ ID NO: 430426 - RNA, 30 nt, Human
gaugccccagcacaaucagagagaucguuu

SEQ ID NO: 430427 - RNA, 32 nt, Human
gaugcccccugccuucucugcuccccaucaug

SEQ ID NO: 430428 - RNA, 32 nt, Human
gaugcccccuguccaagccaucccacagcugg

SEQ ID NO: 430429 - RNA, 26 nt, Human
gaugccccucucugucuugagauccc

SEQ ID NO: 430430 - RNA, 32 nt, Human
gaugccccucugucugcugaaggaccuguugc

SEQ ID NO: 430431 - RNA, 32 nt, Human
gaugccccugauggccgcacagaaggacuucu

SEQ ID NO: 430432 - RNA, 32 nt, Human
gaugccccugcucccucuggguuccagcagag

SEQ ID NO: 430433 - RNA, 32 nt, Human
gaugcccgccacccugagcuccaggcugaagc

SEQ ID NO: 430434 - RNA, 32 nt, Human
gaugcccucaaaaggauaagacaugaguauaa

SEQ ID NO: 430435 - RNA, 32 nt, Human
gaugcccucagggcugcuguguggguguguua

SEQ ID NO: 430436 - RNA, 32 nt, Human
gaugcccucccaggaguggaggggcuggagag

SEQ ID NO: 430437 - RNA, 32 nt, Human
gaugcccuccucauccauuaccagcuucacaa

SEQ ID NO: 430438 - RNA, 32 nt, Human
gaugcccugaaagcuuccggaauugacuguga

SEQ ID NO: 430439 - RNA, 32 nt, Human
gaugcccuggugucuuucuccugggcuucuau

SEQ ID NO: 430440 - RNA, 32 nt, Human
gaugccgaggcaggaagaauugcuugaaccug

SEQ ID NO: 430441 - RNA, 32 nt, Human
gaugccgcaaccucgacuucucagccuccugg

SEQ ID NO: 430442 - RNA, 32 nt, Human
gaugccggcaggcagagcagcuacugacuuug

SEQ ID NO: 430443 - RNA, 32 nt, Human
gaugccggcaguuuaggauccaaagcuucucu

SEQ ID NO: 430444 - RNA, 32 nt, Human
gaugccggcugcagcaggggagauauggccag

SEQ ID NO: 430445 - RNA, 32 nt, Human
gaugccggggaccugggccgcgcugccaggac

SEQ ID NO: 430446 - RNA, 32 nt, Human
gaugccgguuggugucaaagauagagggcuuc

SEQ ID NO: 430447 - RNA, 32 nt, Human
gaugccgucagcugauacaaauggguaaccuu

SEQ ID NO: 430448 - RNA, 32 nt, Human
gaugccgucuaaggaaccaauguauucaguau

SEQ ID NO: 430449 - RNA, 32 nt, Human
gaugccgugaucuccagcgccggccuccucag

SEQ ID NO: 430450 - RNA, 32 nt, Human
gaugccguuuggcugugucuccacccaaaucu

SEQ ID NO: 430451 - RNA, 32 nt, Human
gaugccuagaggcugaaggacagggaacucuc

SEQ ID NO: 430452 - RNA, 32 nt, Human
gaugccuaugucugugcuucauuggcgucauc

SEQ ID NO: 430453 - RNA, 32 nt, Human
gaugccucaacauuuugagcugcucugucgga

SEQ ID NO: 430454 - RNA, 32 nt, Human
gaugccuccguccuccccaaccccaugacccc

SEQ ID NO: 430455 - RNA, 32 nt, Human
gaugccucucccacccuuaccuccaucucaca

SEQ ID NO: 430456 - RNA, 32 nt, Human
gaugccucuccucuucuuguucugcuguugcu

SEQ ID NO: 430457 - RNA, 32 nt, Human
gaugccucugcagccacaauucugaccuaagu

SEQ ID NO: 430458 - RNA, 26 nt, Human
gaugccucuggagguggugguggagc

SEQ ID NO: 430459 - RNA, 32 nt, Human
gaugccucugguguguugcugugugacaucuc

SEQ ID NO: 430460 - RNA, 32 nt, Human
gaugccugaggccacaucugaacagaccuguc

SEQ ID NO: 430461 - RNA, 32 nt, Human
gaugccugcccuccaggauggcugguuuaguc

SEQ ID NO: 430462 - RNA, 32 nt, Human
gaugccugcugcugaagagcugcucacaggag

SEQ ID NO: 430463 - RNA, 32 nt, Human
gaugccugcuucugaacaauuuuaccuccuga

SEQ ID NO: 430464 - RNA, 26 nt, Human
gaugccuggacccagaguguggggga

SEQ ID NO: 430465 - RNA, 32 nt, Human
gaugccuggagccacagcagccacuuugcuac

SEQ ID NO: 430466 - RNA, 32 nt, Human
gaugccuggagcuguggccugagggccugcug

SEQ ID NO: 430467 - RNA, 32 nt, Human
gaugccugggcgucaccaugccacagcuaccc

SEQ ID NO: 430468 - RNA, 32 nt, Human
gaugccugggcgugagggagugcaaggcaccc

SEQ ID NO: 430469 - RNA, 32 nt, Human
gaugccugggcugacugggcagaggaaccucu

SEQ ID NO: 430470 - RNA, 32 nt, Human
gaugccuggggccugccagcugugcugcaaag

SEQ ID NO: 430471 - RNA, 32 nt, Human
gaugccuggggcugcaggauccuaguugguuc

SEQ ID NO: 430472 - RNA, 32 nt, Human
gaugccuguaaucccagcuacuugggaggcug

SEQ ID NO: 430473 - RNA, 32 nt, Human
gaugccuguagucccagcuacuugugaggcug

SEQ ID NO: 430474 - RNA, 26 nt, Human
gaugccugucucaaaaacaguguggg

SEQ ID NO: 430475 - RNA, 32 nt, Human
gaugccugugggcauggcuuucucuggggacc

SEQ ID NO: 430476 - RNA, 32 nt, Human
gaugccugugguuccagcuauucgggaggcug

SEQ ID NO: 430477 - RNA, 32 nt, Human
gaugccuguugcaaaguggaccauggucuagc

SEQ ID NO: 430478 - RNA, 32 nt, Human
gaugccuuccacaucagccucugagggcuggg

SEQ ID NO: 430479 - RNA, 32 nt, Human
gaugccuucccaaacuccccaucugaagcugg

SEQ ID NO: 430480 - RNA, 32 nt, Human
gaugccuuccuggaaguucagugagggaaagu

SEQ ID NO: 430481 - RNA, 21 nt, Human
gaugccuucuuuggggcucug

SEQ ID NO: 430482 - RNA, 32 nt, Human
gaugccuuugccagauaaaccccaggcucaug

SEQ ID NO: 430483 - RNA, 32 nt, Human
gaugccuuuggcaauucuucuucucaagcacu

SEQ ID NO: 430484 - RNA, 32 nt, Human
gaugcgaagaacccugcugcugugcugccccu

SEQ ID NO: 430485 - RNA, 32 nt, Human
gaugcgagaaggcagaggaggagggagggagg

SEQ ID NO: 430486 - RNA, 32 nt, Human
gaugcgccacugcacuccagccugggcgacag

SEQ ID NO: 430487 - RNA, 23 nt, Human
gaugcgccgcgggaccccugucc

SEQ ID NO: 430488 - RNA, 32 nt, Human
gaugcgcgcugcggcccagggugcgggucugg

SEQ ID NO: 430489 - RNA, 32 nt, Human
gaugcgcugggcggagggugcaggggagggca

SEQ ID NO: 430490 - RNA, 32 nt, Human
gaugcggaaagggucagagcagggcucggcgu

SEQ ID NO: 430491 - RNA, 32 nt, Human
gaugcggacuccugggucccuggccaagaagc

SEQ ID NO: 430492 - RNA, 32 nt, Human
gaugcggccguggcugucucaggcuccaggac

SEQ ID NO: 430493 - RNA, 32 nt, Human
gaugcgggaaccuggucccagcuugaguuccu

SEQ ID NO: 430494 - RNA, 20 nt, Human
gaugcgggacugcuggcaug

SEQ ID NO: 430495 - RNA, 32 nt, Human
gaugcgggagggugcaccugucccgggcgccg

SEQ ID NO: 430496 - RNA, 32 nt, Human
gaugcggggugaggcccgagcgcucacacuuc

SEQ ID NO: 430497 - RNA, 31 nt, Human
gaugcgggugagagacauggaggacugguca

SEQ ID NO: 430498 - RNA, 32 nt, Human
gaugcgugccuguaaucccagcuacccaggaa

SEQ ID NO: 430499 - RNA, 32 nt, Human
gaugcguucagcagacugguuugcagugaauu

SEQ ID NO: 430500 - RNA, 32 nt, Human
gaugcuacauaggauucugguauuccacaucc

SEQ ID NO: 430501 - RNA, 32 nt, Human
gaugcuaccaugccucuccaacaucuucaacc

SEQ ID NO: 430502 - RNA, 32 nt, Human
gaugcuacgugauuuccucuggcuuccaaccc

SEQ ID NO: 430503 - RNA, 32 nt, Human
gaugcuacuauuuccaaaaugucaacaacacu

SEQ ID NO: 430504 - RNA, 32 nt, Human
gaugcuagaagagcugaacaaacagaucgagg

SEQ ID NO: 430505 - RNA, 32 nt, Human
gaugcucaaauccuaaggugccaagcucuagg

SEQ ID NO: 430506 - RNA, 32 nt, Human
gaugcucaauccaagacaugcaucagggcggu

SEQ ID NO: 430507 - RNA, 20 nt, Human
gaugcucacagggcccccag

SEQ ID NO: 430508 - RNA, 32 nt, Human
gaugcucacgcugggcccucugccugggacgc

SEQ ID NO: 430509 - RNA, 32 nt, Human
gaugcucacuuggccuuucccugcaggaugag

SEQ ID NO: 430510 - RNA, 32 nt, Human
gaugcucagacucccugauaccaccuuuccug

SEQ ID NO: 430511 - RNA, 32 nt, Human
gaugcucagauagcugguaaaauauuauuucu

SEQ ID NO: 430512 - RNA, 32 nt, Human
gaugcucagcagcccugggguggcggccgcug

SEQ ID NO: 430513 - RNA, 32 nt, Human
gaugcucauagagaacaaguggcuggggccag

SEQ ID NO: 430514 - RNA, 32 nt, Human
gaugcucaucuucucaaccucuacccagggca

SEQ ID NO: 430515 - RNA, 32 nt, Human
gaugcucaugcaccugugcacacucacaucca

SEQ ID NO: 430516 - RNA, 24 nt, Human
gaugcuccagccaaccccugugga

SEQ ID NO: 430517 - RNA, 32 nt, Human
gaugcucccuuuucucuucucucuccuccugg

SEQ ID NO: 430518 - RNA, 32 nt, Human
gaugcuccuagaggugguucaugaggaaugga

SEQ ID NO: 430519 - RNA, 32 nt, Human
gaugcuccuuucucccaugcauugagcuccca

SEQ ID NO: 430520 - RNA, 32 nt, Human
gaugcucgauuuccucugccucucucuuugcu

SEQ ID NO: 430521 - RNA, 32 nt, Human
gaugcucggccugcugcugcucugcaccccca

SEQ ID NO: 430522 - RNA, 32 nt, Human
gaugcucucaguuucucugccuucccuaucag

SEQ ID NO: 430523 - RNA, 32 nt, Human
gaugcucucccucccuucaucauccgcccucc

SEQ ID NO: 430524 - RNA, 32 nt, Human
gaugcucuggcccuccccaauacgcugcuucg

SEQ ID NO: 430525 - RNA, 32 nt, Human
gaugcucuguuggggugggugagcagaguuca

SEQ ID NO: 430526 - RNA, 32 nt, Human
gaugcucuuccagagaccaccuucccagcucu

SEQ ID NO: 430527 - RNA, 32 nt, Human
gaugcucuucugcuuuguuuuauucuaaauug

SEQ ID NO: 430528 - RNA, 32 nt, Human
gaugcucuuguuuauucugggcucagacccuc

SEQ ID NO: 430529 - RNA, 32 nt, Human
gaugcugaaagcagauuucuucuugauuucac

SEQ ID NO: 430530 - RNA, 32 nt, Human
gaugcugaaagccauaguuucauggcaggcuu

SEQ ID NO: 430531 - RNA, 32 nt, Human
gaugcugaaggcagagcagcugagggaggggc

SEQ ID NO: 430532 - RNA, 32 nt, Human
gaugcugaaggugagaggaaauguugacuggc

SEQ ID NO: 430533 - RNA, 32 nt, Human
gaugcugacaugagccucagagaccccaaucc

SEQ ID NO: 430534 - RNA, 32 nt, Human
gaugcugagaguugguggaggggccaggcugg

SEQ ID NO: 430535 - RNA, 32 nt, Human
gaugcugagauucuucaggcuuccugcaauuu

SEQ ID NO: 430536 - RNA, 32 nt, Human
gaugcugagcacagccccacagagucagguga

SEQ ID NO: 430537 - RNA, 32 nt, Human
gaugcugagcagggguugggauaucaaagaau

SEQ ID NO: 430538 - RNA, 32 nt, Human
gaugcugaggccacagcuggugaacagcucag

SEQ ID NO: 430539 - RNA, 32 nt, Human
gaugcugagggcauggggccaggaccagggga

SEQ ID NO: 430540 - RNA, 32 nt, Human
gaugcugaggugggagaaucaccugagccugg

SEQ ID NO: 430541 - RNA, 32 nt, Human
gaugcugaguccaggaggugaugagcaagugu

SEQ ID NO: 430542 - RNA, 32 nt, Human
gaugcugaucacucaaauaaugcuuuuaagcu

SEQ ID NO: 430543 - RNA, 32 nt, Human
gaugcugauccaguugaauuauuugaaauucc

SEQ ID NO: 430544 - RNA, 20 nt, Human
gaugcugaucgggccaggga

SEQ ID NO: 430545 - RNA, 32 nt, Human
gaugcugaucgggccagggacaggcuugccca

SEQ ID NO: 430546 - RNA, 32 nt, Human
gaugcugaugcugcuggcccugggacugcacu

SEQ ID NO: 430547 - RNA, 32 nt, Human
gaugcugauggguuggagugccuaauggcuca

SEQ ID NO: 430548 - RNA, 32 nt, Human
gaugcugcagaacugccaccuccuggucaagu

SEQ ID NO: 430549 - RNA, 32 nt, Human
gaugcugcagauggaauagggcccugccuugc

SEQ ID NO: 430550 - RNA, 32 nt, Human
gaugcugcagggaaaauuguuuugaagcuggc

SEQ ID NO: 430551 - RNA, 32 nt, Human
gaugcugcaguccaggucugaggucccgcugg

SEQ ID NO: 430552 - RNA, 32 nt, Human
gaugcugcagugagcagugauugcaccacugc

SEQ ID NO: 430553 - RNA, 32 nt, Human
gaugcugcagugagcuaugguagcaccacugc

SEQ ID NO: 430554 - RNA, 32 nt, Human
gaugcugcaguuccaaaagagaaggacucuuc

SEQ ID NO: 430555 - RNA, 32 nt, Human
gaugcugccaaaacaagucuagcagggaaaac

SEQ ID NO: 430556 - RNA, 32 nt, Human
gaugcugccccugggaaaucccagaagaggaa

SEQ ID NO: 430557 - RNA, 32 nt, Human
gaugcugcccuaucaauuaauuuugguuuauu

SEQ ID NO: 430558 - RNA, 32 nt, Human
gaugcugccucaucuuccucaguuucaucccc

SEQ ID NO: 430559 - RNA, 32 nt, Human
gaugcugccuccacuuuccauccugucugggu

SEQ ID NO: 430560 - RNA, 30 nt, Human
gaugcugccuccuccaugcucuugagcagg

SEQ ID NO: 430561 - RNA, 23 nt, Human
gaugcugcuaucucaaccagaug

SEQ ID NO: 430562 - RNA, 32 nt, Human
gaugcugcuaucucaaccagaugcccaggaca

SEQ ID NO: 430563 - RNA, 32 nt, Human
gaugcugcuaugaacauauuucuacaagauuu

SEQ ID NO: 430564 - RNA, 26 nt, Human
gaugcugcugacggggaagcuguggg

SEQ ID NO: 430565 - RNA, 32 nt, Human
gaugcuggacuucuagcuuagugagaaugcag

SEQ ID NO: 430566 - RNA, 32 nt, Human
gaugcuggaguccagcccugccucucugcgga

SEQ ID NO: 430567 - RNA, 32 nt, Human
gaugcuggagugaaaggaagggagaaagggaa

SEQ ID NO: 430568 - RNA, 32 nt, Human
gaugcuggcaccgcaugugcucuguuuauucu

SEQ ID NO: 430569 - RNA, 32 nt, Human
gaugcuggcaguuuccagcagggaggcauucg

SEQ ID NO: 430570 - RNA, 32 nt, Human
gaugcuggcuuggaggccgggugcaguggcuc

SEQ ID NO: 430571 - RNA, 32 nt, Human
gaugcugggauuauaggugugagccaccgugc

SEQ ID NO: 430572 - RNA, 32 nt, Human
gaugcugggauuuacacuugaggcuuagcuuu

SEQ ID NO: 430573 - RNA, 32 nt, Human
gaugcugggcugggacauggcauccugcaugc

SEQ ID NO: 430574 - RNA, 32 nt, Human
gaugcugggcuucauaccugggugaugagaug

SEQ ID NO: 430575 - RNA, 32 nt, Human
gaugcuggggagccccucacugcccugaccga

SEQ ID NO: 430576 - RNA, 32 nt, Human
gaugcuggggagguguuugugauucuugacaa

SEQ ID NO: 430577 - RNA, 32 nt, Human
gaugcuggggaugccagagcaagacucaaaga

SEQ ID NO: 430578 - RNA, 32 nt, Human
gaugcugggggaggcagcugggaugggagcca

SEQ ID NO: 430579 - RNA, 32 nt, Human
gaugcuggggguguggggguuggaagcugucu

SEQ ID NO: 430580 - RNA, 32 nt, Human
gaugcugggugaggaccaaggaccuggcuggu

SEQ ID NO: 430581 - RNA, 32 nt, Human
gaugcuggguuaugagaaccagcgaaaucccc

SEQ ID NO: 430582 - RNA, 32 nt, Human
gaugcugguauucuccucuuuaccugguaggg

SEQ ID NO: 430583 - RNA, 32 nt, Human
gaugcuggucagacccagagguugucaggagg

SEQ ID NO: 430584 - RNA, 32 nt, Human
gaugcugguggaggaagggcugggccaccagg

SEQ ID NO: 430585 - RNA, 32 nt, Human
gaugcuggugggauggacaugguucuggaucu

SEQ ID NO: 430586 - RNA, 32 nt, Human
gaugcuggugggcauuugaacaugcuccucca

SEQ ID NO: 430587 - RNA, 32 nt, Human
gaugcuguacccaugacaaagacagagucuua

SEQ ID NO: 430588 - RNA, 32 nt, Human
gaugcuguccugagaauaacuugcugucccgg

SEQ ID NO: 430589 - RNA, 32 nt, Human
gaugcugugaugaauacccuccuucacguucu

SEQ ID NO: 430590 - RNA, 32 nt, Human
gaugcugugccauuguguaugucugcagauuu

SEQ ID NO: 430591 - RNA, 32 nt, Human
gaugcugugccucccaagcucagagcagccuc

SEQ ID NO: 430592 - RNA, 32 nt, Human
gaugcugugccuggccuccgaugccuggccug

SEQ ID NO: 430593 - RNA, 32 nt, Human
gaugcugugcugcgcccugccucggccuugcg

SEQ ID NO: 430594 - RNA, 32 nt, Human
gaugcuuaaaugcagaguuuggaaaagauggg

SEQ ID NO: 430595 - RNA, 32 nt, Human
gaugcuuagaggcuucucaccagagauuggug

SEQ ID NO: 430596 - RNA, 32 nt, Human
gaugcuuauaccaaauagggcaugugcgcugg

SEQ ID NO: 430597 - RNA, 32 nt, Human
gaugcuuaugguguuuugaggcaucccuccaa

SEQ ID NO: 430598 - RNA, 32 nt, Human
gaugcuucagggacauggugccugcucuggag

SEQ ID NO: 430599 - RNA, 32 nt, Human
gaugcuucauccaggucuccuacuaccacugc

SEQ ID NO: 430600 - RNA, 32 nt, Human
gaugcuuccaaaguucacacugggugcacuug

SEQ ID NO: 430601 - RNA, 20 nt, Human
gaugcuuccugcccuugaac

SEQ ID NO: 430602 - RNA, 32 nt, Human
gaugcuucugcucucccugcucuggcauccug

SEQ ID NO: 430603 - RNA, 32 nt, Human
gaugcuucugggagacaccaaagggugaagcu

SEQ ID NO: 430604 - RNA, 32 nt, Human
gaugcuugcaccauuagacccagaggcuuccu

SEQ ID NO: 430605 - RNA, 32 nt, Human
gaugcuugcuaccuccaggugagcuuccaggg

SEQ ID NO: 430606 - RNA, 32 nt, Human
gaugcuuggaugacagaugagaggggauggcu

SEQ ID NO: 430607 - RNA, 32 nt, Human
gaugcuuggcucccucugcugaucucagaguu

SEQ ID NO: 430608 - RNA, 32 nt, Human
gaugcuuggcucccucugcugaucucaguuuc

SEQ ID NO: 430609 - RNA, 32 nt, Human
gaugcuugggaaccuuggguucuuagguuugg

SEQ ID NO: 430610 - RNA, 32 nt, Human
gaugcuugguguggggaucugggugaaggggg

SEQ ID NO: 430611 - RNA, 24 nt, Human
gaugcuugugucucuaccagcugu

SEQ ID NO: 430612 - RNA, 28 nt, Human
gaugcuuuccccaaacucccugaagaug

SEQ ID NO: 430613 - RNA, 32 nt, Human
gaugcuuuccccucaaauaaaacaucugcauu

SEQ ID NO: 430614 - RNA, 32 nt, Human
gaugcuuucucucaucaagacuuugcagcauu

SEQ ID NO: 430615 - RNA, 32 nt, Human
gaugcuuucugauuuuccucucccaggucacu

SEQ ID NO: 430616 - RNA, 32 nt, Human
gaugcuuugcagcaacgcccuaggguuugcag

SEQ ID NO: 430617 - RNA, 32 nt, Human
gaugcuuuugaguuggcagcaggacagggauc

SEQ ID NO: 430618 - RNA, 32 nt, Human
gaugcuuuugcaccuuugacugaugccaagac

SEQ ID NO: 430619 - RNA, 26 nt, Human
gaugcuuuugcagucaugcagcaagg

SEQ ID NO: 430620 - RNA, 32 nt, Human
gaugcuuuugucgcauuuugcuucacugugag

SEQ ID NO: 430621 - RNA, 32 nt, Human
gaugcuuuuucccugcccaacccuguggccuu

SEQ ID NO: 430622 - RNA, 32 nt, Human
gauggaaaaacauguaagacaaacuaaagaca

SEQ ID NO: 430623 - RNA, 24 nt, Human
gauggaaaaacugaggcuuagaga

SEQ ID NO: 430624 - RNA, 32 nt, Human
gauggaaaagcugaggcauagagaggugacgg

SEQ ID NO: 430625 - RNA, 32 nt, Human
gauggaaagagcaagaaaauugugucagugcu

SEQ ID NO: 430626 - RNA, 32 nt, Human
gauggaaaggcugaggcauagagaggugacgg

SEQ ID NO: 430627 - RNA, 32 nt, Human
gauggaaauaagagggugccugauaaauggag

SEQ ID NO: 430628 - RNA, 22 nt, Human
gauggaaaucuggauccacaca

SEQ ID NO: 430629 - RNA, 24 nt, Human
gauggaaaucuuauuacuaccaca

SEQ ID NO: 430630 - RNA, 32 nt, Human
gauggaaaugggagaugggagcuguuuuguca

SEQ ID NO: 430631 - RNA, 32 nt, Human
gauggaacagaggaggugugagcagcugaagg

SEQ ID NO: 430632 - RNA, 32 nt, Human
gauggaacagcaucugaagauggccgggugag

SEQ ID NO: 430633 - RNA, 32 nt, Human
gauggaacgacaucuaaaucugugauaaagca

SEQ ID NO: 430634 - RNA, 32 nt, Human
gauggaacuaauucuucugugcccagauccua

SEQ ID NO: 430635 - RNA, 32 nt, Human
gauggaacuccacccuuucuuguuuuaaguau

SEQ ID NO: 430636 - RNA, 32 nt, Human
gauggaacucggccucauccccgaggccccag

SEQ ID NO: 430637 - RNA, 32 nt, Human
gauggaacugauuugaggcuaaacuggauuag

SEQ ID NO: 430638 - RNA, 32 nt, Human
gauggaacuucaggucuuaagugcaaaucaaa

SEQ ID NO: 430639 - RNA, 32 nt, Human
gauggaagaggaggaggaggaggagcuggagg

SEQ ID NO: 430640 - RNA, 32 nt, Human
gauggaagcaggcagagccuggugggugauuc

SEQ ID NO: 430641 - RNA, 32 nt, Human
gauggaagcagggggacacaacagaaaugaaa

SEQ ID NO: 430642 - RNA, 32 nt, Human
gauggaagccugagcaagucaccugguuauug

SEQ ID NO: 430643 - RNA, 32 nt, Human
gauggaaggaagacuggguugcagggacugug

SEQ ID NO: 430644 - RNA, 32 nt, Human
gauggaaggaagagaguagggccagugaaggc

SEQ ID NO: 430645 - RNA, 32 nt, Human
gauggaaggaaggcuauuacauuauuuccgaa

SEQ ID NO: 430646 - RNA, 32 nt, Human
gauggaaggaagggaggaaggaaaggaggaga

SEQ ID NO: 430647 - RNA, 32 nt, Human
gauggaaggauggagaaaaacagacuguggga

SEQ ID NO: 430648 - RNA, 18 nt, Human
gauggaaggcuggagaga

SEQ ID NO: 430649 - RNA, 32 nt, Human
gauggaagguggccuuucucccaagcuggugg

SEQ ID NO: 430650 - RNA, 31 nt, Human
gauggaagguuggauggauggguggauggcc

SEQ ID NO: 430651 - RNA, 32 nt, Human
gauggaauaaaacauaugaaguagaaggacug

SEQ ID NO: 430652 - RNA, 32 nt, Human
gauggaauauccaggggaagacgucuaaggag

SEQ ID NO: 430653 - RNA, 32 nt, Human
gauggaaucucuagcuauuuuaucagcuaaga

SEQ ID NO: 430654 - RNA, 32 nt, Human
gauggaaucucuuuggggcuaagagaaagguu

SEQ ID NO: 430655 - RNA, 32 nt, Human
gauggaaucugccagaacauuuucaucuuauu

SEQ ID NO: 430656 - RNA, 32 nt, Human
gauggaauuucacucuuguugccuagcuggag

SEQ ID NO: 430657 - RNA, 26 nt, Human
gauggacaacagcaacuggaccagug

SEQ ID NO: 430658 - RNA, 32 nt, Human
gauggacacuuuucagaagucacugcaguauu

SEQ ID NO: 430659 - RNA, 32 nt, Human
gauggacagacaccucccccuacccauauccc

SEQ ID NO: 430660 - RNA, 32 nt, Human
gauggacagacagacaccacagccuccccuuc

SEQ ID NO: 430661 - RNA, 32 nt, Human
gauggacagcaggcucugccuucuggaggcgg

SEQ ID NO: 430662 - RNA, 32 nt, Human
gauggacaggaaagggcaaaguagggcgugug

SEQ ID NO: 430663 - RNA, 32 nt, Human
gauggacaguaucagucuugaucuaaauugua

SEQ ID NO: 430664 - RNA, 32 nt, Human
gauggacagugaucauuagaaacugaauuuug

SEQ ID NO: 430665 - RNA, 32 nt, Human
gauggacaucucuccgaugaccagcuucuuuu

SEQ ID NO: 430666 - RNA, 32 nt, Human
gauggacauuaguugaaccccuucagugucua

SEQ ID NO: 430667 - RNA, 23 nt, Human
gauggaccaaguggggccgggga

SEQ ID NO: 430668 - RNA, 32 nt, Human
gauggaccaggauaauucaggcaagguuaccu

SEQ ID NO: 430669 - RNA, 17 nt, Human
gauggacccaggaggga

SEQ ID NO: 430670 - RNA, 32 nt, Human
gauggacccaggagggagggcagcugaguaac

SEQ ID NO: 430671 - RNA, 32 nt, Human
gauggaccccguggaaagauucagagacugcg

SEQ ID NO: 430672 - RNA, 26 nt, Human
gauggaccugagucagccgaauccua

SEQ ID NO: 430673 - RNA, 32 nt, Human
gauggacgcaaucuuaagccacccuggccuug

SEQ ID NO: 430674 - RNA, 32 nt, Human
gauggacgccuucagccccaggcacccagcug

SEQ ID NO: 430675 - RNA, 32 nt, Human
gauggacuagccccugcuccagcccaguucuc

SEQ ID NO: 430676 - RNA, 32 nt, Human
gauggacuccacccuuuacuaccuugaacuuc

SEQ ID NO: 430677 - RNA, 32 nt, Human
gauggacugcaaccuuaauuuacuugccggag

SEQ ID NO: 430678 - RNA, 32 nt, Human
gauggacugggacucauaaucccuggguuuug

SEQ ID NO: 430679 - RNA, 22 nt, Human
gauggacuugcccacaccucca

SEQ ID NO: 430680 - RNA, 32 nt, Human
gauggacuugcccacaccuccaccuccccuga

SEQ ID NO: 430681 - RNA, 32 nt, Human
gauggagaaaggcaaagucagauggaggauag

SEQ ID NO: 430682 - RNA, 32 nt, Human
gauggagaaaugaauuucuucccacugaagga

SEQ ID NO: 430683 - RNA, 26 nt, Human
gauggagaacgacccccaggaggcgg

SEQ ID NO: 430684 - RNA, 32 nt, Human
gauggagaaggggagagcaucuaggcaggcaa

SEQ ID NO: 430685 - RNA, 26 nt, Human
gauggagaaguuagaaguuuuagagg

SEQ ID NO: 430686 - RNA, 32 nt, Human
gauggagaauguuucuugcaugaguuauaccu

SEQ ID NO: 430687 - RNA, 32 nt, Human
gauggagaccaugucugugccaucucuguuuc

SEQ ID NO: 430688 - RNA, 32 nt, Human
gauggagacccagcagagggaggcagaagggc

SEQ ID NO: 430689 - RNA, 21 nt, Human
gauggagacucuuaagcaaag

SEQ ID NO: 430690 - RNA, 20 nt, Human
gauggagagaccaccuucac

SEQ ID NO: 430691 - RNA, 32 nt, Human
gauggagagccagccaguggggcugucagcag

SEQ ID NO: 430692 - RNA, 32 nt, Human
gauggagaggagaucagagagagugcugguuc

SEQ ID NO: 430693 - RNA, 32 nt, Human
gauggagaggggaggggagggugcaggcaucu

SEQ ID NO: 430694 - RNA, 32 nt, Human
gauggagagguggcucugagauuagcaucccc

SEQ ID NO: 430695 - RNA, 32 nt, Human
gauggagagguuaaagauuauggggaagaaga

SEQ ID NO: 430696 - RNA, 32 nt, Human
gauggagauccggcagcacgaguggcucucgg

SEQ ID NO: 430697 - RNA, 32 nt, Human
gauggagaugagagagggugagagauggaggg

SEQ ID NO: 430698 - RNA, 32 nt, Human
gauggagauggaggggaaggaggaugcccuuu

SEQ ID NO: 430699 - RNA, 32 nt, Human
gauggagaugggcuucccauugauuacaagcu

SEQ ID NO: 430700 - RNA, 32 nt, Human
gauggagcaaggcaugucugcacagggccuag

SEQ ID NO: 430701 - RNA, 32 nt, Human
gauggagcagaacauggagaggaagauuucau

SEQ ID NO: 430702 - RNA, 32 nt, Human
gauggagcagaggagcgccacacauggaggaa

SEQ ID NO: 430703 - RNA, 32 nt, Human
gauggagcagcccagugucuggggcaaagucc

SEQ ID NO: 430704 - RNA, 32 nt, Human
gauggagcagguggaggugcagaggggauuuc

SEQ ID NO: 430705 - RNA, 32 nt, Human
gauggagccacugcacuccagcccaggugaca

SEQ ID NO: 430706 - RNA, 32 nt, Human
gauggagccacugcacuccagccugggcgaca

SEQ ID NO: 430707 - RNA, 32 nt, Human
gauggagccacugcacuccagccugggggaaa

SEQ ID NO: 430708 - RNA, 32 nt, Human
gauggagccagcacagcacucauugcaguugu

SEQ ID NO: 430709 - RNA, 26 nt, Human
gauggagccagcacccucagagguuc

SEQ ID NO: 430710 - RNA, 32 nt, Human
gauggagcccuagggagccccugugcugcccc

SEQ ID NO: 430711 - RNA, 32 nt, Human
gauggagccuggggcugccuggccacugagca

SEQ ID NO: 430712 - RNA, 32 nt, Human
gauggaggaaaaagaacaaaauaaccuaguuc

SEQ ID NO: 430713 - RNA, 32 nt, Human
gauggaggacagacugcaggaacuuggcccau

SEQ ID NO: 430714 - RNA, 32 nt, Human
gauggaggacaggacaggauggcuggaggggc

SEQ ID NO: 430715 - RNA, 32 nt, Human
gauggaggagagaaaggcagccaggacagagc

SEQ ID NO: 430716 - RNA, 32 nt, Human
gauggaggaucucgugugccuauuggcugucc

SEQ ID NO: 430717 - RNA, 32 nt, Human
gauggaggcaguggcuggagugaaugaacggc

SEQ ID NO: 430718 - RNA, 32 nt, Human
gauggaggccugacgucccuggaguugaaagc

SEQ ID NO: 430719 - RNA, 22 nt, Human
gauggaggcugaggcucagaga

SEQ ID NO: 430720 - RNA, 32 nt, Human
gauggaggcugugcccagagccccaggaaaau

SEQ ID NO: 430721 - RNA, 32 nt, Human
gauggaggcuugguaggguggcugguuuguaa

SEQ ID NO: 430722 - RNA, 32 nt, Human
gauggagggaggcagaguaacagcgaagaggg

SEQ ID NO: 430723 - RNA, 32 nt, Human
gauggagggauggggcucucuccugggauggg

SEQ ID NO: 430724 - RNA, 21 nt, Human
gauggagggcccagcauggga

SEQ ID NO: 430725 - RNA, 32 nt, Human
gauggagguuacuggggaaacagcucagcaga

SEQ ID NO: 430726 - RNA, 32 nt, Human
gauggagguugcagagagccaagaucauauca

SEQ ID NO: 430727 - RNA, 32 nt, Human
gauggagucagguuugggguucguggaaaggg

SEQ ID NO: 430728 - RNA, 32 nt, Human
gauggagucccuucgcugguaggcccuucuuc

SEQ ID NO: 430729 - RNA, 18 nt, Human
gauggagucucacucugu

SEQ ID NO: 430730 - RNA, 18 nt, Human
gauggagucucgcucugu

SEQ ID NO: 430731 - RNA, 32 nt, Human
gauggagucucgcucugucucccaggcuggag

SEQ ID NO: 430732 - RNA, 32 nt, Human
gauggagucucucugcacuccagccuggguga

SEQ ID NO: 430733 - RNA, 32 nt, Human
gauggagucuggcucugucucccaggcuggag

SEQ ID NO: 430734 - RNA, 32 nt, Human
gauggagucuugcccugucacccaggcuggag

SEQ ID NO: 430735 - RNA, 32 nt, Human
gauggagucuugcucugucucccaggcuagag

SEQ ID NO: 430736 - RNA, 32 nt, Human
gauggagucuugcuguugucgccuaggcugga

SEQ ID NO: 430737 - RNA, 32 nt, Human
gauggagugaaauccccaggagaugcagaagg

SEQ ID NO: 430738 - RNA, 32 nt, Human
gauggagugagccacaggaaguuuggggcgug

SEQ ID NO: 430739 - RNA, 32 nt, Human
gauggagugcaguggugagaucacggcucauu

SEQ ID NO: 430740 - RNA, 32 nt, Human
gauggaguuccuucuggugucagccccacagg

SEQ ID NO: 430741 - RNA, 32 nt, Human
gauggaguuggucaaaugagggaacaucuggg

SEQ ID NO: 430742 - RNA, 32 nt, Human
gauggaguuguuuuccccagauaugggguucu

SEQ ID NO: 430743 - RNA, 32 nt, Human
gauggaguuuccucucauagugauuugccaca

SEQ ID NO: 430744 - RNA, 32 nt, Human
gauggauaagugagagagagucagguugcaug

SEQ ID NO: 430745 - RNA, 32 nt, Human
gauggauagaccauugggagggcggagcccgc

SEQ ID NO: 430746 - RNA, 32 nt, Human
gauggauaguuuccagaauuugcccauuucca

SEQ ID NO: 430747 - RNA, 22 nt, Human
gauggauauuggauuugucuaa

SEQ ID NO: 430748 - RNA, 28 nt, Human
gauggaucaagugcuguuacagcucaug

SEQ ID NO: 430749 - RNA, 32 nt, Human
gauggaucacaaggucaggagaucgagaccau

SEQ ID NO: 430750 - RNA, 32 nt, Human
gauggaucacacuagcuacucugacccaugga

SEQ ID NO: 430751 - RNA, 32 nt, Human
gauggaucacuugaggccaggaguucgagacc

SEQ ID NO: 430752 - RNA, 32 nt, Human
gauggaucaucugagccucaggagguugaggc

SEQ ID NO: 430753 - RNA, 26 nt, Human
gauggaucccaaggggcuccucuccu

SEQ ID NO: 430754 - RNA, 32 nt, Human
gauggaucuuucucaggacuggcaguuacccg

SEQ ID NO: 430755 - RNA, 17 nt, Human
gauggaugaucugugaa

SEQ ID NO: 430756 - RNA, 32 nt, Human
gauggaugcaucucucaugguugagaaguggu

SEQ ID NO: 430757 - RNA, 32 nt, Human
gauggauggaaagggagggaaagacaagaugc

SEQ ID NO: 430758 - RNA, 32 nt, Human
gauggauggauggauggauguuggugaaaauu

SEQ ID NO: 430759 - RNA, 29 nt, Human
gauggauggcugcuggaaaccccuugcca

SEQ ID NO: 430760 - RNA, 32 nt, Human
gauggaugggacggacauguggagaggguggg

SEQ ID NO: 430761 - RNA, 31 nt, Human
gauggauggguggauggaggguggcaggugg

SEQ ID NO: 430762 - RNA, 32 nt, Human
gauggauuacugaggcaaucaagucuaaggua

SEQ ID NO: 430763 - RNA, 23 nt, Human
gauggauucccagucauauucua

SEQ ID NO: 430764 - RNA, 32 nt, Human
gauggauugcagaaugaaaagguuauaguucc

SEQ ID NO: 430765 - RNA, 32 nt, Human
gauggcaaaaacaagccugcccaaccagacug

SEQ ID NO: 430766 - RNA, 32 nt, Human
gauggcaacagcuuggaagaugauugcaugca

SEQ ID NO: 430767 - RNA, 32 nt, Human
gauggcaaggcgugaagccacccuggaaggaa

SEQ ID NO: 430768 - RNA, 32 nt, Human
gauggcaagggcagugcguggaaaggccgggg

SEQ ID NO: 430769 - RNA, 32 nt, Human
gauggcaauugaguagcugauaagcugaaaau

SEQ ID NO: 430770 - RNA, 32 nt, Human
gauggcacaauccaggcuguugcaccccuucu

SEQ ID NO: 430771 - RNA, 32 nt, Human
gauggcacaugcugguaauagcagcuacugag

SEQ ID NO: 430772 - RNA, 32 nt, Human
gauggcaccacuacacuccagcccgggcgaca

SEQ ID NO: 430773 - RNA, 32 nt, Human
gauggcaccacuacauuucagccugggcgaaa

SEQ ID NO: 430774 - RNA, 32 nt, Human
gauggcaccacugcacuccagccuaggugaca

SEQ ID NO: 430775 - RNA, 26 nt, Human
gauggcaccacugcacuccagccugg

SEQ ID NO: 430776 - RNA, 32 nt, Human
gauggcaccacugcacuccagccuggacgaca

SEQ ID NO: 430777 - RNA, 32 nt, Human
gauggcaccacugcacuccagccugggagaca

SEQ ID NO: 430778 - RNA, 32 nt, Human
gauggcaccacugcacuccagccugggcaaca

SEQ ID NO: 430779 - RNA, 32 nt, Human
gauggcaccacugcacuccagccugggugaca

SEQ ID NO: 430780 - RNA, 32 nt, Human
gauggcaccacugcacuccagccugggugaga

SEQ ID NO: 430781 - RNA, 32 nt, Human
gauggcaccacugcacuccagcuugggugaca

SEQ ID NO: 430782 - RNA, 32 nt, Human
gauggcaccacugcacuccauccugggugaca

SEQ ID NO: 430783 - RNA, 32 nt, Human
gauggcaccacugcacuccggccuaggcaacg

SEQ ID NO: 430784 - RNA, 32 nt, Human
gauggcaccacugcacuucagccugggugaca

SEQ ID NO: 430785 - RNA, 32 nt, Human
gauggcaccacugcauuccagccugggugaca

SEQ ID NO: 430786 - RNA, 32 nt, Human
gauggcaccacuggacuccagccugggcgaca

SEQ ID NO: 430787 - RNA, 32 nt, Human
gauggcaccacuguacuccagccugggugaca

SEQ ID NO: 430788 - RNA, 32 nt, Human
gauggcaccagcugcuccggaugugccugccc

SEQ ID NO: 430789 - RNA, 32 nt, Human
gauggcaccauuacacuccagccugggcaaca

SEQ ID NO: 430790 - RNA, 32 nt, Human
gauggcaccauugcacccuagccugggcaaca

SEQ ID NO: 430791 - RNA, 32 nt, Human
gauggcaccauugcacuccagccugggugaca

SEQ ID NO: 430792 - RNA, 32 nt, Human
gauggcacccauggcccccacccacggaagga

SEQ ID NO: 430793 - RNA, 32 nt, Human
gauggcaccgcugcacuccaaccugggcaaca

SEQ ID NO: 430794 - RNA, 32 nt, Human
gauggcacugcugcacuccagccugcgggaca

SEQ ID NO: 430795 - RNA, 32 nt, Human
gauggcagagcugggagcaagauggacagagg

SEQ ID NO: 430796 - RNA, 32 nt, Human
gauggcagagggcagagcacauggcccccaga

SEQ ID NO: 430797 - RNA, 32 nt, Human
gauggcagcaaaccaccagcuucagccacuua

SEQ ID NO: 430798 - RNA, 32 nt, Human
gauggcagccacucuggggcagaagagacagu

SEQ ID NO: 430799 - RNA, 32 nt, Human
gauggcagcccagggucacaggcauaggauaa

SEQ ID NO: 430800 - RNA, 32 nt, Human
gauggcagcuuuauaucgagugccucagugcu

SEQ ID NO: 430801 - RNA, 32 nt, Human
gauggcaggaacaggcaugcagagccauauaa

SEQ ID NO: 430802 - RNA, 32 nt, Human
gauggcaggaaggagaacggaugcuugucugg

SEQ ID NO: 430803 - RNA, 32 nt, Human
gauggcaggacagccaguccacagguuugcau

SEQ ID NO: 430804 - RNA, 32 nt, Human
gauggcaggggagcaagagcaaguuaggauua

SEQ ID NO: 430805 - RNA, 32 nt, Human
gauggcaggggcagagugcagguggagagaac

SEQ ID NO: 430806 - RNA, 32 nt, Human
gauggcaggggcagagugcagguggagagaau

SEQ ID NO: 430807 - RNA, 32 nt, Human
gauggcauccccaucagcagcuugcgggaaau

SEQ ID NO: 430808 - RNA, 32 nt, Human
gauggcaucccucaucaggguugccagauggu

SEQ ID NO: 430809 - RNA, 32 nt, Human
gauggcauuucuuaggcuucagcucuugauac

SEQ ID NO: 430810 - RNA, 31 nt, Human
gauggccacagcuagcauggcauucuagcuc

SEQ ID NO: 430811 - RNA, 32 nt, Human
gauggccacaggucaguccucuuucugugccu

SEQ ID NO: 430812 - RNA, 32 nt, Human
gauggccagagugcccugaagcaccacuacca

SEQ ID NO: 430813 - RNA, 23 nt, Human
gauggccagccugugcaugagag

SEQ ID NO: 430814 - RNA, 32 nt, Human
gauggccaggccugugcacacaccagcccacc

SEQ ID NO: 430815 - RNA, 32 nt, Human
gauggccagugcacuccaaugaugggacaggc

SEQ ID NO: 430816 - RNA, 32 nt, Human
gauggcccaaaauggucaggacuuuaauggag

SEQ ID NO: 430817 - RNA, 32 nt, Human
gauggcccagcccagggaaaguccaccugacc

SEQ ID NO: 430818 - RNA, 32 nt, Human
gauggcccaggcaaugcugucgcugcuugaga

SEQ ID NO: 430819 - RNA, 23 nt, Human
gauggcccagggccacacaggga

SEQ ID NO: 430820 - RNA, 32 nt, Human
gauggcccauucuacuugcucuggaccugccc

SEQ ID NO: 430821 - RNA, 20 nt, Human
gauggcccccauugcccuca

SEQ ID NO: 430822 - RNA, 20 nt, Human
gauggcccugagcccacgga

SEQ ID NO: 430823 - RNA, 32 nt, Human
gauggcccuuagggaaagacuggaccucugug

SEQ ID NO: 430824 - RNA, 32 nt, Human
gauggccggcccaggagggaggaggacgacgu

SEQ ID NO: 430825 - RNA, 32 nt, Human
gauggccucagcccuggguggccaggcucugu

SEQ ID NO: 430826 - RNA, 32 nt, Human
gauggccuccagccaggcaccugggcgucccu

SEQ ID NO: 430827 - RNA, 32 nt, Human
gauggccucugguuguucuguugaacuccuug

SEQ ID NO: 430828 - RNA, 32 nt, Human
gauggccugaaccauagcugucacugucuucg

SEQ ID NO: 430829 - RNA, 32 nt, Human
gauggccugcacuccacacaaugcaacagagu

SEQ ID NO: 430830 - RNA, 32 nt, Human
gauggccugccugccuucccuguccguucacc

SEQ ID NO: 430831 - RNA, 32 nt, Human
gauggccuggaccacacacaucacugugugca

SEQ ID NO: 430832 - RNA, 32 nt, Human
gauggccuguaaucccagcacuuugggaggcc

SEQ ID NO: 430833 - RNA, 32 nt, Human
gauggccuucucuccccucagaacuaccggau

SEQ ID NO: 430834 - RNA, 32 nt, Human
gauggccuugcagcacucacacaggacccccu

SEQ ID NO: 430835 - RNA, 32 nt, Human
gauggccuuucaugaaggcagcucuugcggag

SEQ ID NO: 430836 - RNA, 32 nt, Human
gauggcgcacccaucccccaccaggauaaagc

SEQ ID NO: 430837 - RNA, 32 nt, Human
gauggcgccacuacacuccagccugggcaaca

SEQ ID NO: 430838 - RNA, 32 nt, Human
gauggcgccacuacacuccagccugggcgaca

SEQ ID NO: 430839 - RNA, 32 nt, Human
gauggcgccacugcacuccagcccgggcgaca

SEQ ID NO: 430840 - RNA, 32 nt, Human
gauggcgccacugcacuccagccuaggcaaca

SEQ ID NO: 430841 - RNA, 32 nt, Human
gauggcgccacugcacuccagccugagugaca

SEQ ID NO: 430842 - RNA, 32 nt, Human
gauggcgccacugcacuccagccugggcgaca

SEQ ID NO: 430843 - RNA, 32 nt, Human
gauggcgccacugcacuccagccugggcguca

SEQ ID NO: 430844 - RNA, 32 nt, Human
gauggcgccacugcacuccagccugggugaca

SEQ ID NO: 430845 - RNA, 32 nt, Human
gauggcgccacugcacuccagccugggugaga

SEQ ID NO: 430846 - RNA, 32 nt, Human
gauggcgccacugcacuccagucugggcaaca

SEQ ID NO: 430847 - RNA, 32 nt, Human
gauggcgccacugcacuccagucugggcgaua

SEQ ID NO: 430848 - RNA, 32 nt, Human
gauggcgccacugcacucccgucugggggaga

SEQ ID NO: 430849 - RNA, 32 nt, Human
gauggcgccacugcauuccagccugggcaaca

SEQ ID NO: 430850 - RNA, 32 nt, Human
gauggcgccacugcgcuccagccugggcaaca

SEQ ID NO: 430851 - RNA, 32 nt, Human
gauggcgccacuucacugcagccuggguggca

SEQ ID NO: 430852 - RNA, 32 nt, Human
gauggcgccauugcacuccagccugggcaaaa

SEQ ID NO: 430853 - RNA, 32 nt, Human
gauggcgccauugcacuccagccugggugaca

SEQ ID NO: 430854 - RNA, 32 nt, Human
gauggcgccauuucacuccagccugggcgaca

SEQ ID NO: 430855 - RNA, 32 nt, Human
gauggcgcgacugcacuccagccugggcgaga

SEQ ID NO: 430856 - RNA, 32 nt, Human
gauggcgcuauugcacuccagucuggguaaca

SEQ ID NO: 430857 - RNA, 26 nt, Human
gauggcggaagguggaggcugccgug

SEQ ID NO: 430858 - RNA, 32 nt, Human
gauggcggagucggugcacaccuggcaggacc

SEQ ID NO: 430859 - RNA, 32 nt, Human
gauggcggcgcacacguguaaucccagcuacu

SEQ ID NO: 430860 - RNA, 21 nt, Human
gauggcggcucccguccugcu

SEQ ID NO: 430861 - RNA, 32 nt, Human
gauggcgggaauucucgcuucuggccugggug

SEQ ID NO: 430862 - RNA, 32 nt, Human
gauggcgggagaagaggcgagugaagaugcaa

SEQ ID NO: 430863 - RNA, 32 nt, Human
gauggcggugggcacuggcacucuuguccaga

SEQ ID NO: 430864 - RNA, 32 nt, Human
gauggcguagggguagaugagaagcuaucuuu

SEQ ID NO: 430865 - RNA, 32 nt, Human
gauggcgucaguguucuccagccugggcaaca

SEQ ID NO: 430866 - RNA, 32 nt, Human
gauggcgugcuuguuggagaccccaauccgca

SEQ ID NO: 430867 - RNA, 31 nt, Human
gauggcuaagaguccaucaggcagaugaaau

SEQ ID NO: 430868 - RNA, 32 nt, Human
gauggcuaagauacugcugaugcugaaauaaa

SEQ ID NO: 430869 - RNA, 32 nt, Human
gauggcuaaguccuugaaacccuagagcugug

SEQ ID NO: 430870 - RNA, 32 nt, Human
gauggcuaaugggucugggcagcaucccuuca

SEQ ID NO: 430871 - RNA, 32 nt, Human
gauggcucacaucugucaucccugcacuuuga

SEQ ID NO: 430872 - RNA, 32 nt, Human
gauggcucagcagacaggccagcccagcucca

SEQ ID NO: 430873 - RNA, 32 nt, Human
gauggcucagcagugccugcucagguucauca

SEQ ID NO: 430874 - RNA, 32 nt, Human
gauggcucaggguggucauccagguugaaaac

SEQ ID NO: 430875 - RNA, 21 nt, Human
gauggcucaugccugucaucc

SEQ ID NO: 430876 - RNA, 32 nt, Human
gauggcucauuuccacccaaccccaggauuuc

SEQ ID NO: 430877 - RNA, 32 nt, Human
gauggcucauuuccacccagccccaggauuuc

SEQ ID NO: 430878 - RNA, 32 nt, Human
gauggcuccgaagccagaaaugccuuaaacug

SEQ ID NO: 430879 - RNA, 32 nt, Human
gauggcucuccuccauuuugguuuguuuccuc

SEQ ID NO: 430880 - RNA, 32 nt, Human
gauggcucuuccagaggauucccucagauggg

SEQ ID NO: 430881 - RNA, 32 nt, Human
gauggcucuuucuauccugcucuucuguugaa

SEQ ID NO: 430882 - RNA, 32 nt, Human
gauggcugaaccugcauguagagccaccagcu

SEQ ID NO: 430883 - RNA, 32 nt, Human
gauggcugaaguguaacaguacaucuucaggu

SEQ ID NO: 430884 - RNA, 32 nt, Human
gauggcugaauuggcaagucuguggugcugcu

SEQ ID NO: 430885 - RNA, 26 nt, Human
gauggcugagaagcagaagcacgacg

SEQ ID NO: 430886 - RNA, 32 nt, Human
gauggcugagaugggaggauuguuugagcccu

SEQ ID NO: 430887 - RNA, 32 nt, Human
gauggcugaggcaggagaaucgcuugaaccca

SEQ ID NO: 430888 - RNA, 32 nt, Human
gauggcugaggguggucacaccugagccuuca

SEQ ID NO: 430889 - RNA, 32 nt, Human
gauggcugaggugaacucauguucuuugggaa

SEQ ID NO: 430890 - RNA, 32 nt, Human
gauggcugaguugcacaaacguggcucagaug

SEQ ID NO: 430891 - RNA, 21 nt, Human
gauggcugauccugcaaagag

SEQ ID NO: 430892 - RNA, 32 nt, Human
gauggcugcagcccucgaccuccugggcucaa

SEQ ID NO: 430893 - RNA, 32 nt, Human
gauggcugccccuuccccagacagggcuggac

SEQ ID NO: 430894 - RNA, 32 nt, Human
gauggcugcuacucugaguacccccuccagug

SEQ ID NO: 430895 - RNA, 32 nt, Human
gauggcugcugacuucugacuggcugagcagu

SEQ ID NO: 430896 - RNA, 32 nt, Human
gauggcugcugagcaaggggaucagggaagac

SEQ ID NO: 430897 - RNA, 32 nt, Human
gauggcuggcccaggagggaggaggacgacgu

SEQ ID NO: 430898 - RNA, 32 nt, Human
gauggcugggcacugccaucucuagaauugcc

SEQ ID NO: 430899 - RNA, 32 nt, Human
gauggcugggcuguaguuuagccugggccuug

SEQ ID NO: 430900 - RNA, 32 nt, Human
gauggcuggggagagguggaggcugacagcug

SEQ ID NO: 430901 - RNA, 32 nt, Human
gauggcuguaaaucuauuggccaucugggcuu

SEQ ID NO: 430902 - RNA, 32 nt, Human
gauggcuguaucucccuucacugucucuuccu

SEQ ID NO: 430903 - RNA, 32 nt, Human
gauggcuguggagcugggcgugcugcucgucc

SEQ ID NO: 430904 - RNA, 32 nt, Human
gauggcuuagaaaagugauaccagcccaagaa

SEQ ID NO: 430905 - RNA, 32 nt, Human
gauggcuucccacuggccuccaccaccugacc

SEQ ID NO: 430906 - RNA, 32 nt, Human
gauggcuucuuucugucacaugggugcuaaac

SEQ ID NO: 430907 - RNA, 32 nt, Human
gauggcuugguagccccucgaggcagaugcac

SEQ ID NO: 430908 - RNA, 32 nt, Human
gauggcuuucugcuuuggaucacuguucccua

SEQ ID NO: 430909 - RNA, 32 nt, Human
gauggcuuugggccuaguaguucgaguccagc

SEQ ID NO: 430910 - RNA, 32 nt, Human
gauggcuuuucucuguccccugcugcucugag

SEQ ID NO: 430911 - RNA, 32 nt, Human
gaugggaaacacauugagcaucauaucugaca

SEQ ID NO: 430912 - RNA, 32 nt, Human
gaugggaaaccagcccaagaggcagugaagga

SEQ ID NO: 430913 - RNA, 23 nt, Human
gaugggaaacugaggcucagaga

SEQ ID NO: 430914 - RNA, 32 nt, Human
gaugggaacaguccuggcugccccugacagug

SEQ ID NO: 430915 - RNA, 26 nt, Human
gaugggaaccggauugguugcagugu

SEQ ID NO: 430916 - RNA, 32 nt, Human
gaugggaacugcccuuuucaccugccagggag

SEQ ID NO: 430917 - RNA, 32 nt, Human
gaugggaagagggagaggagcagaaaaaguac

SEQ ID NO: 430918 - RNA, 32 nt, Human
gaugggaaggagcagggugagggaggggcccc

SEQ ID NO: 430919 - RNA, 32 nt, Human
gaugggaagggcccagcgaaugccaauaggag

SEQ ID NO: 430920 - RNA, 32 nt, Human
gaugggaaguaaacgcuuccagaggaacucag

SEQ ID NO: 430921 - RNA, 32 nt, Human
gaugggaaguauguuuucaaguguggggagga

SEQ ID NO: 430922 - RNA, 32 nt, Human
gaugggaaguguauuuuacucugaucaaauaa

SEQ ID NO: 430923 - RNA, 32 nt, Human
gaugggaaugaggaaggagugaggggaagaac

SEQ ID NO: 430924 - RNA, 32 nt, Human
gaugggaaugauugcuaugcuugcuacugaac

SEQ ID NO: 430925 - RNA, 32 nt, Human
gaugggaccacguguucugauguggcaguaga

SEQ ID NO: 430926 - RNA, 32 nt, Human
gaugggaccagcuggaauuuccaagcugcuuc

SEQ ID NO: 430927 - RNA, 32 nt, Human
gaugggacccuugugccaccugggccagcaaa

SEQ ID NO: 430928 - RNA, 32 nt, Human
gaugggaccgagauuucagcgagcccuccugg

SEQ ID NO: 430929 - RNA, 32 nt, Human
gaugggaccugaggacacaaagaugagcucaa

SEQ ID NO: 430930 - RNA, 32 nt, Human
gaugggacguguggucaggagggaccucaccg

SEQ ID NO: 430931 - RNA, 32 nt, Human
gaugggacucagacccugugccccagagcucc

SEQ ID NO: 430932 - RNA, 32 nt, Human
gaugggagaaaccucuagagagaguaaaaaug

SEQ ID NO: 430933 - RNA, 26 nt, Human
gaugggagagucccguucacacccag

SEQ ID NO: 430934 - RNA, 32 nt, Human
gaugggagaguguuguuuuugucacuugcccc

SEQ ID NO: 430935 - RNA, 32 nt, Human
gaugggagcggggaccccggagagggagucag

SEQ ID NO: 430936 - RNA, 32 nt, Human
gaugggaggaaagagagcaggacucacagguu

SEQ ID NO: 430937 - RNA, 32 nt, Human
gaugggaggaaggcuggucauugccuauucca

SEQ ID NO: 430938 - RNA, 32 nt, Human
gaugggaggaucacuugaggccaagaguuuga

SEQ ID NO: 430939 - RNA, 32 nt, Human
gaugggagggaggugggaauacuccuugccua

SEQ ID NO: 430940 - RNA, 32 nt, Human
gaugggaggggagagacagaaguugagggcau

SEQ ID NO: 430941 - RNA, 32 nt, Human
gaugggagguguucaagcacagcaaucccauu

SEQ ID NO: 430942 - RNA, 32 nt, Human
gaugggagguugggggaggugagcauaaacgc

SEQ ID NO: 430943 - RNA, 32 nt, Human
gaugggauaucacccugaagaguugugucuuu

SEQ ID NO: 430944 - RNA, 32 nt, Human
gaugggaucgaggcugcaccaccaccaucccc

SEQ ID NO: 430945 - RNA, 32 nt, Human
gaugggaucuguauuagacuugagugcagguc

SEQ ID NO: 430946 - RNA, 32 nt, Human
gaugggaugaaugaccaucugggguauggugg

SEQ ID NO: 430947 - RNA, 32 nt, Human
gaugggaugaggagagggcaggaaggcauuuc

SEQ ID NO: 430948 - RNA, 32 nt, Human
gaugggaugcuugccuagggccugguccauga

SEQ ID NO: 430949 - RNA, 32 nt, Human
gaugggcaaagcaucuuucgagagcuugccug

SEQ ID NO: 430950 - RNA, 26 nt, Human
gaugggcaagguuucucgaaccugca

SEQ ID NO: 430951 - RNA, 32 nt, Human
gaugggcaccggagauacaucaccgagaauaa

SEQ ID NO: 430952 - RNA, 32 nt, Human
gaugggcaccuguaaucucagcuacucaggag

SEQ ID NO: 430953 - RNA, 26 nt, Human
gaugggcacugaggggucagagccag

SEQ ID NO: 430954 - RNA, 32 nt, Human
gaugggcagaugggccuggccuugagaaaggc

SEQ ID NO: 430955 - RNA, 32 nt, Human
gaugggcagccugcaguguggccggcgacugc

SEQ ID NO: 430956 - RNA, 32 nt, Human
gaugggcagcucccacucuugccuuagaauau

SEQ ID NO: 430957 - RNA, 32 nt, Human
gaugggcagcuugcacucaccaauagaccaaa

SEQ ID NO: 430958 - RNA, 32 nt, Human
gaugggcaggaaaaacaaaggccaccacaaag

SEQ ID NO: 430959 - RNA, 32 nt, Human
gaugggcaggaaaaacaaaggccaccacagag

SEQ ID NO: 430960 - RNA, 32 nt, Human
gaugggcaggaggaugggagacaggaauugag

SEQ ID NO: 430961 - RNA, 32 nt, Human
gaugggcaucacagcaaggcaggcuuuuugau

SEQ ID NO: 430962 - RNA, 32 nt, Human
gaugggcauuaugcaaaagcacaaagauuaua

SEQ ID NO: 430963 - RNA, 32 nt, Human
gaugggccaccgccuugcccagccuggaugcc

SEQ ID NO: 430964 - RNA, 32 nt, Human
gaugggccaccugacuuagacucucauuagua

SEQ ID NO: 430965 - RNA, 32 nt, Human
gaugggccagccugccccaaggcucuuuacug

SEQ ID NO: 430966 - RNA, 32 nt, Human
gaugggccagugacucacagggucaggcacuc

SEQ ID NO: 430967 - RNA, 32 nt, Human
gaugggcccaggagccagcaggagaccuuucu

SEQ ID NO: 430968 - RNA, 32 nt, Human
gaugggccccuguaaucccagcuacuugggag

SEQ ID NO: 430969 - RNA, 32 nt, Human
gaugggcccugagcucuucuguuugcuuuugg

SEQ ID NO: 430970 - RNA, 32 nt, Human
gaugggccgugggcccuugugggugaagcucg

SEQ ID NO: 430971 - RNA, 32 nt, Human
gaugggccucaaacuccuagcuucaagcaguc

SEQ ID NO: 430972 - RNA, 32 nt, Human
gaugggccugagaggccggggcucagggaagg

SEQ ID NO: 430973 - RNA, 32 nt, Human
gaugggcgaggacagagcagggcccgagcgcc

SEQ ID NO: 430974 - RNA, 32 nt, Human
gaugggcgcaaggggugcugggggaggccugc

SEQ ID NO: 430975 - RNA, 32 nt, Human
gaugggcggcagcugcucagcaucccccgggc

SEQ ID NO: 430976 - RNA, 32 nt, Human
gaugggcucaagcaucuacacaccucagccuc

SEQ ID NO: 430977 - RNA, 32 nt, Human
gaugggcuccacugucuucuggcucccaugug

SEQ ID NO: 430978 - RNA, 32 nt, Human
gaugggcuccugcccuugaaccccugcugggg

SEQ ID NO: 430979 - RNA, 32 nt, Human
gaugggcugggcugggcugugguggggugggg

SEQ ID NO: 430980 - RNA, 32 nt, Human
gaugggcugggcugggcuguuuuaccuaaucc

SEQ ID NO: 430981 - RNA, 32 nt, Human
gaugggcuggggcuuagcaccacccaccaaau

SEQ ID NO: 430982 - RNA, 24 nt, Human
gauggggaaacugaggcccagaga

SEQ ID NO: 430983 - RNA, 24 nt, Human
gauggggaaacugaggccuugaga

SEQ ID NO: 430984 - RNA, 24 nt, Human
gauggggaaacugaggcucaagga

SEQ ID NO: 430985 - RNA, 24 nt, Human
gauggggaaacugaggcucagaga

SEQ ID NO: 430986 - RNA, 22 nt, Human
gauggggaaacugaggcuuagg

SEQ ID NO: 430987 - RNA, 23 nt, Human
gauggggaaacugaggcuuagga

SEQ ID NO: 430988 - RNA, 32 nt, Human
gauggggaagaagggacaagauucccagagag

SEQ ID NO: 430989 - RNA, 32 nt, Human
gauggggaagcauugcaaggaaauugugcuuu

SEQ ID NO: 430990 - RNA, 31 nt, Human
gauggggaagcucuggagcauuuugugagca

SEQ ID NO: 430991 - RNA, 21 nt, Human
gauggggaagcugcuggagga

SEQ ID NO: 430992 - RNA, 32 nt, Human
gauggggaaugagggggagaagaagagcagcu

SEQ ID NO: 430993 - RNA, 32 nt, Human
gauggggacauggagaacaacccaagcuccuu

SEQ ID NO: 430994 - RNA, 22 nt, Human
gauggggaccccagcgaagcag

SEQ ID NO: 430995 - RNA, 32 nt, Human
gauggggagaaaggaaaaggagagacaaauau

SEQ ID NO: 430996 - RNA, 32 nt, Human
gauggggagacaacgugcucuuuguuuugugu

SEQ ID NO: 430997 - RNA, 32 nt, Human
gauggggagaucggggccagaggcagaacccu

SEQ ID NO: 430998 - RNA, 32 nt, Human
gauggggaggcagcccccgcaguggacagccc

SEQ ID NO: 430999 - RNA, 23 nt, Human
gauggggaggccuggcucuggga

SEQ ID NO: 431000 - RNA, 23 nt, Human
gauggggaggcuggggccugggg

SEQ ID NO: 431001 - RNA, 32 nt, Human
gauggggagggaagaagaggagaggggagggg

SEQ ID NO: 431002 - RNA, 32 nt, Human
gauggggagggaagaggaggagaggggagggg

SEQ ID NO: 431003 - RNA, 20 nt, Human
gauggggcacuggccagagg

SEQ ID NO: 431004 - RNA, 32 nt, Human
gauggggcacuguggagagaccccaggaaaac

SEQ ID NO: 431005 - RNA, 32 nt, Human
gauggggccacugcacugcagccugugugaca

SEQ ID NO: 431006 - RNA, 32 nt, Human
gauggggccugccugcaccccggggcggaauu

SEQ ID NO: 431007 - RNA, 32 nt, Human
gauggggcgagugcugggcgugcuguuggaga

SEQ ID NO: 431008 - RNA, 32 nt, Human
gauggggcucagauggacugggaggaggggga

SEQ ID NO: 431009 - RNA, 32 nt, Human
gauggggcuccaggauuccaggccuggcaaca

SEQ ID NO: 431010 - RNA, 32 nt, Human
gauggggcucuuacucccuccugaggccagcu

SEQ ID NO: 431011 - RNA, 32 nt, Human
gauggggcugacugcacuggugggccggcugg

SEQ ID NO: 431012 - RNA, 32 nt, Human
gauggggcugcugcuugagugcagagggcugc

SEQ ID NO: 431013 - RNA, 32 nt, Human
gauggggcugugucccccucagacuggggcug

SEQ ID NO: 431014 - RNA, 32 nt, Human
gauggggcuucaccaucuugaccaggcugguc

SEQ ID NO: 431015 - RNA, 19 nt, Human
gaugggggaaacugaggaa

SEQ ID NO: 431016 - RNA, 22 nt, Human
gaugggggacaagcugugugga

SEQ ID NO: 431017 - RNA, 32 nt, Human
gaugggggaggcaagagagggcaaagaguaaa

SEQ ID NO: 431018 - RNA, 32 nt, Human
gaugggggagggaaagugugcuuuuguguaca

SEQ ID NO: 431019 - RNA, 32 nt, Human
gaugggggaggggagggguagagcacacccag

SEQ ID NO: 431020 - RNA, 23 nt, Human
gaugggggagucugaagcagaug

SEQ ID NO: 431021 - RNA, 32 nt, Human
gaugggggagugaaauugugagguggaugggg

SEQ ID NO: 431022 - RNA, 32 nt, Human
gaugggggauggggcaggauggggcaggacac

SEQ ID NO: 431023 - RNA, 32 nt, Human
gaugggggcacauagcacuggggaaagcagaa

SEQ ID NO: 431024 - RNA, 32 nt, Human
gaugggggcagggggagcagcauccugccacg

SEQ ID NO: 431025 - RNA, 32 nt, Human
gaugggggcuguuccccaacaggccuggcaga

SEQ ID NO: 431026 - RNA, 32 nt, Human
gaugggggucaaagcaaagaagauucuuccug

SEQ ID NO: 431027 - RNA, 21 nt, Human
gaugggggucucaccauguug

SEQ ID NO: 431028 - RNA, 32 nt, Human
gauggggguggagaggaugacaaguagaauga

SEQ ID NO: 431029 - RNA, 32 nt, Human
gauggggucacaaugcugcagaaaagugaaga

SEQ ID NO: 431030 - RNA, 32 nt, Human
gauggggucccggcacccaucuguaucaucag

SEQ ID NO: 431031 - RNA, 32 nt, Human
gauggggucuugcuaugucucccaggcuggag

SEQ ID NO: 431032 - RNA, 32 nt, Human
gauggggugcaggaguggaggagaaacguggc

SEQ ID NO: 431033 - RNA, 32 nt, Human
gauggggugggauggagaguggguucaguuuu

SEQ ID NO: 431034 - RNA, 32 nt, Human
gauggggugggcaggggugguccuggcuggca

SEQ ID NO: 431035 - RNA, 19 nt, Human
gaugggguguccuggugga

SEQ ID NO: 431036 - RNA, 26 nt, Human
gauggggugugcugaaguugaagugu

SEQ ID NO: 431037 - RNA, 20 nt, Human
gaugggguuaaacauucuca

SEQ ID NO: 431038 - RNA, 32 nt, Human
gaugggguugacuucaugugggucugaguguu

SEQ ID NO: 431039 - RNA, 32 nt, Human
gaugggguuucaccauacuggcuaggcugguc

SEQ ID NO: 431040 - RNA, 21 nt, Human
gaugggguuucaccauauugg

SEQ ID NO: 431041 - RNA, 20 nt, Human
gaugggguuucaccauguug

SEQ ID NO: 431042 - RNA, 21 nt, Human
gaugggguuucaccauguugg

SEQ ID NO: 431043 - RNA, 21 nt, Human
gaugggguuucacuauguugg

SEQ ID NO: 431044 - RNA, 32 nt, Human
gaugggguuucaucauauuggucagggugguc

SEQ ID NO: 431045 - RNA, 32 nt, Human
gaugggguuucaucauguuggccaggcuaguc

SEQ ID NO: 431046 - RNA, 32 nt, Human
gaugggguuucaucauguuggccaggcugguc

SEQ ID NO: 431047 - RNA, 32 nt, Human
gaugggguuucaucauguuggccagguugguc

SEQ ID NO: 431048 - RNA, 32 nt, Human
gauggguagggagugagaucagagggaaggcc

SEQ ID NO: 431049 - RNA, 32 nt, Human
gaugggucaaagcuggugaccgacuggggccu

SEQ ID NO: 431050 - RNA, 32 nt, Human
gaugggucccacccucccuccagagccaccag

SEQ ID NO: 431051 - RNA, 32 nt, Human
gaugggucccaggaaagugaauacucaaccaa

SEQ ID NO: 431052 - RNA, 32 nt, Human
gaugggucggccucuaagcucaugugguugua

SEQ ID NO: 431053 - RNA, 32 nt, Human
gaugggucucugcucugcuucuaguucuccac

SEQ ID NO: 431054 - RNA, 32 nt, Human
gaugggucuuccaugauacugaagggagagcc

SEQ ID NO: 431055 - RNA, 32 nt, Human
gaugggugaaaagacgccagugagccuccugg

SEQ ID NO: 431056 - RNA, 32 nt, Human
gaugggugaggagcagcacagagcagcaggga

SEQ ID NO: 431057 - RNA, 32 nt, Human
gaugggugccuccccucugccucccauuucug

SEQ ID NO: 431058 - RNA, 32 nt, Human
gaugggugccuguaaucccagcuacgugggag

SEQ ID NO: 431059 - RNA, 32 nt, Human
gauggguggacagaagggcucaccaaggauug

SEQ ID NO: 431060 - RNA, 32 nt, Human
gauggguggaucaucugaggucaggaguuuga

SEQ ID NO: 431061 - RNA, 32 nt, Human
gauggguggcucagccucgaaucccaggcccc

SEQ ID NO: 431062 - RNA, 32 nt, Human
gauggguggcuuuccaaaaugcugugcaaaug

SEQ ID NO: 431063 - RNA, 32 nt, Human
gaugggugggagaaggaaccugagccuggcug

SEQ ID NO: 431064 - RNA, 32 nt, Human
gauggguggggccugcucuggagcugagcccg

SEQ ID NO: 431065 - RNA, 32 nt, Human
gaugggugggggagcagguuggagaggggacc

SEQ ID NO: 431066 - RNA, 32 nt, Human
gaugggugggguggggagggaaucacuggugc

SEQ ID NO: 431067 - RNA, 31 nt, Human
gauggguguguaaugcauaugccaaggaaau

SEQ ID NO: 431068 - RNA, 32 nt, Human
gauggguucaucuuuucuuccuuucccauuca

SEQ ID NO: 431069 - RNA, 32 nt, Human
gauggguucucuuaccuguaguagccuuaucc

SEQ ID NO: 431070 - RNA, 32 nt, Human
gauggguugcagccggccugcugcuuaaggug

SEQ ID NO: 431071 - RNA, 32 nt, Human
gaugguaaugccagucccaggggaggguguga

SEQ ID NO: 431072 - RNA, 32 nt, Human
gaugguaccacugcacuccagccugggugaca

SEQ ID NO: 431073 - RNA, 32 nt, Human
gaugguaccccugcacuccagcccagguuaca

SEQ ID NO: 431074 - RNA, 32 nt, Human
gaugguaccucugcacugcagccugggcaaca

SEQ ID NO: 431075 - RNA, 32 nt, Human
gaugguacugacuaugagcugaagccucugcc

SEQ ID NO: 431076 - RNA, 32 nt, Human
gaugguagaaaugcauaugauccauggcagga

SEQ ID NO: 431077 - RNA, 32 nt, Human
gaugguagacaguguuuauguagauguguugu

SEQ ID NO: 431078 - RNA, 31 nt, Human
gaugguagggagagagagccacuggaucggc

SEQ ID NO: 431079 - RNA, 32 nt, Human
gaugguauggugagccacagaguacaccuuuc

SEQ ID NO: 431080 - RNA, 32 nt, Human
gaugguauugcagcuucacugccugcguuccu

SEQ ID NO: 431081 - RNA, 32 nt, Human
gauggucaggguggggagcagggacggccaug

SEQ ID NO: 431082 - RNA, 32 nt, Human
gauggucaucacauuggugagcuggagucauc

SEQ ID NO: 431083 - RNA, 26 nt, Human
gauggucauccagaaagagaagaaga

SEQ ID NO: 431084 - RNA, 32 nt, Human
gauggucauugaaacucacuucuuuucaggug

SEQ ID NO: 431085 - RNA, 32 nt, Human
gaugguccaaguguccauccagagaugagacu

SEQ ID NO: 431086 - RNA, 32 nt, Human
gaugguccacucuguacacaggcauuccuccu

SEQ ID NO: 431087 - RNA, 32 nt, Human
gauggucccagaagucaaacagaagggaguga

SEQ ID NO: 431088 - RNA, 32 nt, Human
gauggucccaucugcagggccccgcaccaguu

SEQ ID NO: 431089 - RNA, 32 nt, Human
gauggucccuuccauuccccugaaaccugcau

SEQ ID NO: 431090 - RNA, 31 nt, Human
gcaagaaugaacuccuuccuggaauacccca

SEQ ID NO: 431091 - RNA, 32 nt, Human
gcaagaauucaucaaccagcugccuuuguuuc

SEQ ID NO: 431092 - RNA, 32 nt, Human
gcaagaauucuugggacacagguuuguuuucu

SEQ ID NO: 431093 - RNA, 32 nt, Human
gcaagacacuuuuccucuccccaggccucuga

SEQ ID NO: 431094 - RNA, 32 nt, Human
gcaagacagaaaagugccugagcuggggaagc

SEQ ID NO: 431095 - RNA, 32 nt, Human
gcaagacagcacuugagugcacuggcaggaag

SEQ ID NO: 431096 - RNA, 32 nt, Human
gcaagacagggucagugcuuacauuuuguggu

SEQ ID NO: 431097 - RNA, 32 nt, Human
gcaagacaguuguuucuccuccuccuugcaua

SEQ ID NO: 431098 - RNA, 32 nt, Human
gcaagaccaccagcuccuggaagcugaguuac

SEQ ID NO: 431099 - RNA, 32 nt, Human
gcaagaccagacugaagaacacgguugagucc

SEQ ID NO: 431100 - RNA, 32 nt, Human
gcaagaccauuuuucuccaagccaugggggac

SEQ ID NO: 431101 - RNA, 18 nt, Human
gcaagaccccagauucuc

SEQ ID NO: 431102 - RNA, 19 nt, Human
gcaagaccccuuccucacc

SEQ ID NO: 431103 - RNA, 32 nt, Human
gcaagacccuccccaaacagccaucuccccag

SEQ ID NO: 431104 - RNA, 32 nt, Human
gcaagacccugcugugauuacuauguuguaca

SEQ ID NO: 431105 - RNA, 32 nt, Human
gcaagacccuguaugaauaguaccaaagcauu

SEQ ID NO: 431106 - RNA, 32 nt, Human
gcaagaccuggcacuccuccaagcuuggcaca

SEQ ID NO: 431107 - RNA, 32 nt, Human
gcaagaccuguauuuauaagccgagggcucag

SEQ ID NO: 431108 - RNA, 31 nt, Human
gcaagacgccucucggggccugugccgcacu

SEQ ID NO: 431109 - RNA, 32 nt, Human
gcaagacggaaucgagggcaccucuggguguu

SEQ ID NO: 431110 - RNA, 32 nt, Human
gcaagacuaacucaagccccagccucuuucca

SEQ ID NO: 431111 - RNA, 32 nt, Human
gcaagacuccagcacaagaggugggauugcug

SEQ ID NO: 431112 - RNA, 20 nt, Human
gcaagacugacauccacuua

SEQ ID NO: 431113 - RNA, 32 nt, Human
gcaagagaacaguacuggccuucaguauaugc

SEQ ID NO: 431114 - RNA, 32 nt, Human
gcaagagaaguuacaguccaggugaacuugga

SEQ ID NO: 431115 - RNA, 32 nt, Human
gcaagagaaucucuugagcucaggaggcagag

SEQ ID NO: 431116 - RNA, 32 nt, Human
gcaagagagaaaaguguauuagugcaggagcu

SEQ ID NO: 431117 - RNA, 32 nt, Human
gcaagagagcuucccauugcuucugcucuccu

SEQ ID NO: 431118 - RNA, 32 nt, Human
gcaagagaggggcaagucuggggcuccaacug

SEQ ID NO: 431119 - RNA, 32 nt, Human
gcaagagaggguggaggaaauucugcaggaga

SEQ ID NO: 431120 - RNA, 32 nt, Human
gcaagagauccagcuagagagguauucaggga

SEQ ID NO: 431121 - RNA, 32 nt, Human
gcaagagaugaacuuaaguacucugaaguacu

SEQ ID NO: 431122 - RNA, 32 nt, Human
gcaagagcacaucaacgggaaagagaaagaga

SEQ ID NO: 431123 - RNA, 32 nt, Human
gcaagagccaagcacugaauaccuacauaggu

SEQ ID NO: 431124 - RNA, 32 nt, Human
gcaagagccaggggugucccagucccagccuc

SEQ ID NO: 431125 - RNA, 28 nt, Human
gcaagagccggugguugggggucugaga

SEQ ID NO: 431126 - RNA, 32 nt, Human
gcaagagccugagaaguuuccuugaggucugu

SEQ ID NO: 431127 - RNA, 32 nt, Human
gcaagagccuguaaucucagcuacucaggagg

SEQ ID NO: 431128 - RNA, 32 nt, Human
gcaagagcuuauaaaugauugaugcaaauuug

SEQ ID NO: 431129 - RNA, 32 nt, Human
gcaagaggacaagaugggggauaucugaggcc

SEQ ID NO: 431130 - RNA, 24 nt, Human
gcaagaggaucacuugaggccagg

SEQ ID NO: 431131 - RNA, 32 nt, Human
gcaagaggauuacuugagcucaggaguuuaac

SEQ ID NO: 431132 - RNA, 32 nt, Human
gcaagaggccaaggcuggagaggcgugccagc

SEQ ID NO: 431133 - RNA, 32 nt, Human
gcaagaggcgugggcuugcaggguggggcacg

SEQ ID NO: 431134 - RNA, 22 nt, Human
gcaagaggcuccagaagaaaug

SEQ ID NO: 431135 - RNA, 32 nt, Human
gcaagaggcugaggcaggagaaugacaugaac

SEQ ID NO: 431136 - RNA, 32 nt, Human
gcaagaggcugaugcaggagaauggccagcac

SEQ ID NO: 431137 - RNA, 32 nt, Human
gcaagagggagaaaggacgcugccgccuaaga

SEQ ID NO: 431138 - RNA, 32 nt, Human
gcaagagggagaagaaagagccauggagauag

SEQ ID NO: 431139 - RNA, 32 nt, Human
gcaagagggagggaaggaaggagagcaaaauc

SEQ ID NO: 431140 - RNA, 32 nt, Human
gcaagagggccagauaccuaacagguuuuucu

SEQ ID NO: 431141 - RNA, 32 nt, Human
gcaagaggggguggaggcgccaggcugaaacc

SEQ ID NO: 431142 - RNA, 32 nt, Human
gcaagaggguguauggaucagagcagagacgu

SEQ ID NO: 431143 - RNA, 22 nt, Human
gcaagaggugggaggagguagg

SEQ ID NO: 431144 - RNA, 21 nt, Human
gcaagagguggggcaggcaga

SEQ ID NO: 431145 - RNA, 32 nt, Human
gcaagagguugcuuuucugugaacgaaucucu

SEQ ID NO: 431146 - RNA, 32 nt, Human
gcaagaguaaaggaaauaagagcauucacaac

SEQ ID NO: 431147 - RNA, 20 nt, Human
gcaagaguagcaagaugcug

SEQ ID NO: 431148 - RNA, 32 nt, Human
gcaagaguauuugucucucaccaccaggguug

SEQ ID NO: 431149 - RNA, 32 nt, Human
gcaagagucuguuacaaagcuugcugugcaug

SEQ ID NO: 431150 - RNA, 32 nt, Human
gcaagagugugaggcaggaagacugagucagc

SEQ ID NO: 431151 - RNA, 23 nt, Human
gcaagaguucuguggagagagug

SEQ ID NO: 431152 - RNA, 32 nt, Human
gcaagaguugagcuuggaaaccuucaccuaga

SEQ ID NO: 431153 - RNA, 32 nt, Human
gcaagauacauacugcauuuuuaaaauagugu

SEQ ID NO: 431154 - RNA, 32 nt, Human
gcaagaucaccaggaaggaacacagggcuugc

SEQ ID NO: 431155 - RNA, 32 nt, Human
gcaagauccacuucugugauuaaguaaaugga

SEQ ID NO: 431156 - RNA, 32 nt, Human
gcaagauccucuuguuacaaagcuguccaaca

SEQ ID NO: 431157 - RNA, 32 nt, Human
gcaagaugaagaagaucuacauauaaugaaau

SEQ ID NO: 431158 - RNA, 32 nt, Human
gcaagaugaagaggaaaaacaaacaaacaaac

SEQ ID NO: 431159 - RNA, 30 nt, Human
gcaagaugcuguccuugcggcugcagacgg

SEQ ID NO: 431160 - RNA, 32 nt, Human
gcaagauggaggugggggcugggggaauaugc

SEQ ID NO: 431161 - RNA, 32 nt, Human
gcaagauggagguugcagugagcucagauggu

SEQ ID NO: 431162 - RNA, 30 nt, Human
gcaagauggccacggucauccccagccccc

SEQ ID NO: 431163 - RNA, 32 nt, Human
gcaagauggccuguaaucccagcacuuuggga

SEQ ID NO: 431164 - RNA, 24 nt, Human
gcaagauggcucacaccugugauc

SEQ ID NO: 431165 - RNA, 32 nt, Human
gcaagaugggagaguugagaagguucccagaa

SEQ ID NO: 431166 - RNA, 32 nt, Human
gcaagaugguaucagagagaaacccaucaauu

SEQ ID NO: 431167 - RNA, 32 nt, Human
gcaagaugguuugucacucugcaccugugucu

SEQ ID NO: 431168 - RNA, 32 nt, Human
gcaagaugucggcggucagucaggaugcuauu

SEQ ID NO: 431169 - RNA, 32 nt, Human
gcaagaugugggcagugaugucacuagggcag

SEQ ID NO: 431170 - RNA, 32 nt, Human
gcaagauuacuguuaucucugcucuuccaugu

SEQ ID NO: 431171 - RNA, 32 nt, Human
gcaagauugauguuuccuugaggggagccagg

SEQ ID NO: 431172 - RNA, 21 nt, Human
gcaagauuucggcucacugca

SEQ ID NO: 431173 - RNA, 24 nt, Human
gcaagcaaaucacuugagcucagg

SEQ ID NO: 431174 - RNA, 32 nt, Human
gcaagcaacaaggcaauagaaaagccaggguu

SEQ ID NO: 431175 - RNA, 32 nt, Human
gcaagcaagccuagccuuccagggagaaagag

SEQ ID NO: 431176 - RNA, 32 nt, Human
gcaagcaagccugagaggcauuacaugggcug

SEQ ID NO: 431177 - RNA, 32 nt, Human
gcaagcaauaaugccagcaccuucugcaagga

SEQ ID NO: 431178 - RNA, 32 nt, Human
gcaagcacaagaaagggacccuccaguucggg

SEQ ID NO: 431179 - RNA, 32 nt, Human
gcaagcacagcagucugaguugaccugggaug

SEQ ID NO: 431180 - RNA, 17 nt, Human
gcaagcaccugccacca

SEQ ID NO: 431181 - RNA, 32 nt, Human
gcaagcacucccccaccaacgggugcaucaca

SEQ ID NO: 431182 - RNA, 32 nt, Human
gcaagcacucucuccagcacucaggaagcccg

SEQ ID NO: 431183 - RNA, 32 nt, Human
gcaagcacugaggagguggauggaagggagca

SEQ ID NO: 431184 - RNA, 32 nt, Human
gcaagcacugccucccuccggggucuguaaga

SEQ ID NO: 431185 - RNA, 32 nt, Human
gcaagcacuggaaaagaggcccugccauacac

SEQ ID NO: 431186 - RNA, 32 nt, Human
gcaagcacuuugcacacuugcuucacugauuc

SEQ ID NO: 431187 - RNA, 32 nt, Human
gcaagcagagggcugagcagucaaauaacaga

SEQ ID NO: 431188 - RNA, 24 nt, Human
gcaagcagaucaccugaagucagg

SEQ ID NO: 431189 - RNA, 24 nt, Human
gcaagcagaucaccugagguuggg

SEQ ID NO: 431190 - RNA, 24 nt, Human
gcaagcagaucacuugaggucagg

SEQ ID NO: 431191 - RNA, 22 nt, Human
gcaagcagaucaugaggucagg

SEQ ID NO: 431192 - RNA, 32 nt, Human
gcaagcagaugaacuaauuucauuucaaggca

SEQ ID NO: 431193 - RNA, 32 nt, Human
gcaagcagaugggggugggcaccugaggccca

SEQ ID NO: 431194 - RNA, 32 nt, Human
gcaagcagcccaggcagcugugggcagugcug

SEQ ID NO: 431195 - RNA, 20 nt, Human
gcaagcagcgcucgcuccuc

SEQ ID NO: 431196 - RNA, 30 nt, Human
gcaagcagcuugcauuuccaaagacaaaua

SEQ ID NO: 431197 - RNA, 32 nt, Human
gcaagcaggacgccgggcugagugcuaacugc

SEQ ID NO: 431198 - RNA, 18 nt, Human
gcaagcagggcagggggu

SEQ ID NO: 431199 - RNA, 31 nt, Human
gcaagcaggugugagcaccuauuucacuacc

SEQ ID NO: 431200 - RNA, 32 nt, Human
gcaagcagugccugcuggcgcccccgaggcug

SEQ ID NO: 431201 - RNA, 28 nt, Human
gcaagcaucuaggcugccucuucacuuu

SEQ ID NO: 431202 - RNA, 32 nt, Human
gcaagcaucugcccgcaggccccagcccuucc

SEQ ID NO: 431203 - RNA, 32 nt, Human
gcaagcauugggaaggaugaaugccaacuaug

SEQ ID NO: 431204 - RNA, 32 nt, Human
gcaagcauuguuucacacacuccccucagcug

SEQ ID NO: 431205 - RNA, 32 nt, Human
gcaagccacagucaucauacugugaguguccc

SEQ ID NO: 431206 - RNA, 32 nt, Human
gcaagccagaaacacaucccugucuccaaauu

SEQ ID NO: 431207 - RNA, 26 nt, Human
gcaagccagaccacgaugauuguaga

SEQ ID NO: 431208 - RNA, 32 nt, Human
gcaagccaggagacccugggagcuguggcugu

SEQ ID NO: 431209 - RNA, 21 nt, Human
gcaagccagugcugcgugcuc

SEQ ID NO: 431210 - RNA, 21 nt, Human
gcaagccagugcugugugcuc

SEQ ID NO: 431211 - RNA, 21 nt, Human
gcaagcccauauccugcagcu

SEQ ID NO: 431212 - RNA, 32 nt, Human
gcaagcccauugucccuguccaacacaccccc

SEQ ID NO: 431213 - RNA, 32 nt, Human
gcaagccccaugacugugaguccucuacuguu

SEQ ID NO: 431214 - RNA, 32 nt, Human
gcaagcccccguccacccuugugggucucugc

SEQ ID NO: 431215 - RNA, 32 nt, Human
gcaagccccucagguugggccuugccacggug

SEQ ID NO: 431216 - RNA, 32 nt, Human
gcaagccccuuuccugccuucuuacccccaac

SEQ ID NO: 431217 - RNA, 32 nt, Human
gcaagcccucauucaccuucugggccacagcc

SEQ ID NO: 431218 - RNA, 32 nt, Human
gcaagcccuccugggccaccugcugaucugac

SEQ ID NO: 431219 - RNA, 32 nt, Human
gcaagcccucucucagagcugccaucaucacu

SEQ ID NO: 431220 - RNA, 32 nt, Human
gcaagcccucuuccuuucuucacaaagcugcg

SEQ ID NO: 431221 - RNA, 24 nt, Human
gcaagcccugacccaauaaaggcu

SEQ ID NO: 431222 - RNA, 22 nt, Human
gcaagcccugcccacagaaagc

SEQ ID NO: 431223 - RNA, 32 nt, Human
gcaagcccugcucuccacaggcaccucugggg

SEQ ID NO: 431224 - RNA, 22 nt, Human
gcaagcccugggaccaagagcu

SEQ ID NO: 431225 - RNA, 32 nt, Human
gcaagccgaaaccacuuggcucuggaaaucua

SEQ ID NO: 431226 - RNA, 32 nt, Human
gcaagccgccucggcgcugccugcguugcaaa

SEQ ID NO: 431227 - RNA, 32 nt, Human
gcaagccguggauuuugcacauggugacuuuc

SEQ ID NO: 431228 - RNA, 32 nt, Human
gcaagccuaagcugggcacauaggaacggaaa

SEQ ID NO: 431229 - RNA, 32 nt, Human
gcaagccucacugccacugugccuuuggggca

SEQ ID NO: 431230 - RNA, 32 nt, Human
gcaagccucccuggaagcagacucuucagcac

SEQ ID NO: 431231 - RNA, 32 nt, Human
gcaagccucuguauuacacugcagcuuaacaa

SEQ ID NO: 431232 - RNA, 32 nt, Human
gcaagccugacuccugaaacugugcauuguac

SEQ ID NO: 431233 - RNA, 32 nt, Human
gcaagccugacuccugagacugugcauuguac

SEQ ID NO: 431234 - RNA, 32 nt, Human
gcaagccugcagcagcaggugcccccacguca

SEQ ID NO: 431235 - RNA, 32 nt, Human
gcaagccugggagcgcggagcccggcuaggga

SEQ ID NO: 431236 - RNA, 32 nt, Human
gcaagccugguguugcuccuguccucagaguc

SEQ ID NO: 431237 - RNA, 32 nt, Human
gcaagccuguaaucccagcuacucaggaggcu

SEQ ID NO: 431238 - RNA, 32 nt, Human
gcaagccuguaaucccagcuauuugggaggcu

SEQ ID NO: 431239 - RNA, 32 nt, Human
gcaagccuguagucccagcuacucgggaggcu

SEQ ID NO: 431240 - RNA, 32 nt, Human
gcaagccuugagcugcucagcugcccucugcu

SEQ ID NO: 431241 - RNA, 32 nt, Human
gcaagccuugcugguccaagugcaauauguaa

SEQ ID NO: 431242 - RNA, 32 nt, Human
gcaagcgcuguggugugcagcucuuauugucu

SEQ ID NO: 431243 - RNA, 32 nt, Human
gcaagcgcuugggcgaacaucuucccaaggca

SEQ ID NO: 431244 - RNA, 32 nt, Human
gcaagcggcccuggugggucugcgggggcagg

SEQ ID NO: 431245 - RNA, 32 nt, Human
gcaagcgggagagagcggcgaggcggcggcgc

SEQ ID NO: 431246 - RNA, 21 nt, Human
gcaagcgugagcuggcaccca

SEQ ID NO: 431247 - RNA, 32 nt, Human
gcaagcgugggcaagaugugcguggugcagcg

SEQ ID NO: 431248 - RNA, 32 nt, Human
gcaagcuaaucagucagacauucuuuaaugac

SEQ ID NO: 431249 - RNA, 32 nt, Human
gcaagcuaauuuaaaaacaugaugggcuguuu

SEQ ID NO: 431250 - RNA, 32 nt, Human
gcaagcuaccugcgacagcuugaacuuuuccu

SEQ ID NO: 431251 - RNA, 20 nt, Human
gcaagcucacauugcucucc

SEQ ID NO: 431252 - RNA, 32 nt, Human
gcaagcucagagccgcugccacccugcaugug

SEQ ID NO: 431253 - RNA, 32 nt, Human
gcaagcucagagcgcacggacagagcgguagc

SEQ ID NO: 431254 - RNA, 32 nt, Human
gcaagcucuuaaguucacagggugccugggcu

SEQ ID NO: 431255 - RNA, 32 nt, Human
gcaagcucuucagaaaaguuauggaguaguac

SEQ ID NO: 431256 - RNA, 32 nt, Human
gcaagcugagagagccggcucuggccuuggcc

SEQ ID NO: 431257 - RNA, 32 nt, Human
gcaagcugagcgccuccgcccgccaggcgcgc

SEQ ID NO: 431258 - RNA, 32 nt, Human
gcaagcugcacugugagcuggcugugggauac

SEQ ID NO: 431259 - RNA, 32 nt, Human
gcaagcugccagucggcucuuuuucgcaagcc

SEQ ID NO: 431260 - RNA, 32 nt, Human
gcaagcuggaaaggcaaaaaugagaaagaaaa

SEQ ID NO: 431261 - RNA, 19 nt, Human
gcaagcugggacuggcagg

SEQ ID NO: 431262 - RNA, 32 nt, Human
gcaagcuggguagcaggcagauccaaaggaua

SEQ ID NO: 431263 - RNA, 32 nt, Human
gcaagcuguaccagcagcuccuggggacgugc

SEQ ID NO: 431264 - RNA, 32 nt, Human
gcaagcuugcccugcccagccccaccaacuaa

SEQ ID NO: 431265 - RNA, 32 nt, Human
gcaagcuuuuacucuugcacuuucuuaagcag

SEQ ID NO: 431266 - RNA, 32 nt, Human
gcaaggaaaccagcuugguuuggcaaacagcu

SEQ ID NO: 431267 - RNA, 31 nt, Human
gcaaggaaaguguuucuaucacuggaaggag

SEQ ID NO: 431268 - RNA, 20 nt, Human
gcaaggaagaacccaagcaa

SEQ ID NO: 431269 - RNA, 32 nt, Human
gcaaggaagagaguuugaguuguuuaugggac

SEQ ID NO: 431270 - RNA, 32 nt, Human
gcaaggaagcaguuccagggagagucagguuc

SEQ ID NO: 431271 - RNA, 32 nt, Human
gcaaggaagcuauuuaacauggugcugagcua

SEQ ID NO: 431272 - RNA, 32 nt, Human
gcaaggaagugauuaucaggguugugaaggag

SEQ ID NO: 431273 - RNA, 32 nt, Human
gcaaggaaugggaacauuuccccaucagcaac

SEQ ID NO: 431274 - RNA, 32 nt, Human
gcaaggacaauccaggguccuggcuucagcuu

SEQ ID NO: 431275 - RNA, 20 nt, Human
gcaaggacacgcucucccca

SEQ ID NO: 431276 - RNA, 32 nt, Human
gcaaggaccagguguaccuggacggcaucgug

SEQ ID NO: 431277 - RNA, 32 nt, Human
gcaaggacccacaugaaaucaacucgacagau

SEQ ID NO: 431278 - RNA, 32 nt, Human
gcaaggacccgaaaucacagacauuagcaaug

SEQ ID NO: 431279 - RNA, 32 nt, Human
gcaaggaccguguuugacuuucuuggagaggu

SEQ ID NO: 431280 - RNA, 32 nt, Human
gcaaggacguuucuuucaucugccuuucaucc

SEQ ID NO: 431281 - RNA, 32 nt, Human
gcaaggacugcacuaguccagggaguagggga

SEQ ID NO: 431282 - RNA, 32 nt, Human
gcaaggagaaggauuucuguguuuuacucauu

SEQ ID NO: 431283 - RNA, 23 nt, Human
gcaaggagacuaaggcacuggaa

SEQ ID NO: 431284 - RNA, 32 nt, Human
gcaaggagagaggccucuagcagaucaugcaa

SEQ ID NO: 431285 - RNA, 31 nt, Human
gcaaggagagugcaugacucacuggaaccgc

SEQ ID NO: 431286 - RNA, 32 nt, Human
gcaaggagcacaagccacaagucuuccagagg

SEQ ID NO: 431287 - RNA, 32 nt, Human
gcaaggagcacauaccaucaagccacacuauc

SEQ ID NO: 431288 - RNA, 24 nt, Human
gcaaggagcugaccaggagguguc

SEQ ID NO: 431289 - RNA, 32 nt, Human
gcaaggagcugcugagaaggagcacuccacug

SEQ ID NO: 431290 - RNA, 32 nt, Human
gcaaggagcuguagauggaaggugucaaguuc

SEQ ID NO: 431291 - RNA, 32 nt, Human
gcaaggaggaagaggacucaaaagucuggccu

SEQ ID NO: 431292 - RNA, 32 nt, Human
gcaaggaggcgagggaccuggcccagcaccuc

SEQ ID NO: 431293 - RNA, 32 nt, Human
gcaaggagggagcacaacccccagcucccgcu

SEQ ID NO: 431294 - RNA, 20 nt, Human
gcaaggagguggcagagcca

SEQ ID NO: 431295 - RNA, 32 nt, Human
gcaaggaguacgugggcaagacuagccuggug

SEQ ID NO: 431296 - RNA, 32 nt, Human
gcaaggauaugaugagauuuugcucacaguca

SEQ ID NO: 431297 - RNA, 32 nt, Human
gcaaggaucucuuggaaugacaaaugauaggu

SEQ ID NO: 431298 - RNA, 32 nt, Human
gcaaggaugacucagcagggaugauucagcag

SEQ ID NO: 431299 - RNA, 32 nt, Human
gcaaggauggagcugaaaacauaacccacucu

SEQ ID NO: 431300 - RNA, 32 nt, Human
gcaaggauggcagaggaaaauaaacuuuacuu

SEQ ID NO: 431301 - RNA, 32 nt, Human
gcaaggaugucacugcugcucuugccugauga

SEQ ID NO: 431302 - RNA, 32 nt, Human
gcaaggauugcacguccugccugaccaccauc

SEQ ID NO: 431303 - RNA, 32 nt, Human
gcaaggcaaggaaagcugcuucccuggaagug

SEQ ID NO: 431304 - RNA, 32 nt, Human
gcaaggcacacacugcucaucuccgcuuuuua

SEQ ID NO: 431305 - RNA, 32 nt, Human
gcaaggcacauacauaaugacuuucuuuuucc

SEQ ID NO: 431306 - RNA, 32 nt, Human
gcaaggcaccugcuggcaauggcaggaggcgg

SEQ ID NO: 431307 - RNA, 32 nt, Human
gcaaggcacucaaaacaugucauucauuaaau

SEQ ID NO: 431308 - RNA, 32 nt, Human
gcaaggcagagaggacacaggagagccagccc

SEQ ID NO: 431309 - RNA, 32 nt, Human
gcaaggcagccgugggccccacccucggggau

SEQ ID NO: 431310 - RNA, 32 nt, Human
gcaaggcagggguggaggggagggaccagccc

SEQ ID NO: 431311 - RNA, 32 nt, Human
gcaaggcauggagccugcacuuuacucugaau

SEQ ID NO: 431312 - RNA, 32 nt, Human
gcaaggccacaaccuccauucucccagaaaag

SEQ ID NO: 431313 - RNA, 26 nt, Human
gcaaggccacagcccucuuccugcca

SEQ ID NO: 431314 - RNA, 32 nt, Human
gcaaggccacggucagcacaggcacggucccg

SEQ ID NO: 431315 - RNA, 32 nt, Human
gcaaggccacuggguugcuauccucuugcugg

SEQ ID NO: 431316 - RNA, 32 nt, Human
gcaaggccagugcugugccaagcccgguaagg

SEQ ID NO: 431317 - RNA, 32 nt, Human
gcaaggcccagccgaaguuccacuaaaaaugc

SEQ ID NO: 431318 - RNA, 32 nt, Human
gcaaggcccagcugaggugguggagggagccc

SEQ ID NO: 431319 - RNA, 32 nt, Human
gcaaggcccaggaguuccagcccucagguucc

SEQ ID NO: 431320 - RNA, 18 nt, Human
gcaaggcccccgacagca

SEQ ID NO: 431321 - RNA, 32 nt, Human
gcaaggccccuggagcagcggagagacaagau

SEQ ID NO: 431322 - RNA, 32 nt, Human
gcaaggcccucugaagcaugggccgugccagc

SEQ ID NO: 431323 - RNA, 23 nt, Human
gcaaggcccugagggcaacagca

SEQ ID NO: 431324 - RNA, 32 nt, Human
gcaaggcccugcgugccugcugcuggccgggc

SEQ ID NO: 431325 - RNA, 32 nt, Human
gcaaggccgguggaugcagaggccaguccaua

SEQ ID NO: 431326 - RNA, 32 nt, Human
gcaaggccucugccccuggccuuugaggcaaa

SEQ ID NO: 431327 - RNA, 32 nt, Human
gcaaggccucuuuguucucaaaccgggccgug

SEQ ID NO: 431328 - RNA, 32 nt, Human
gcaaggccugggaagaguuucgaugucucuag

SEQ ID NO: 431329 - RNA, 19 nt, Human
gcaaggccugugggucuuc

SEQ ID NO: 431330 - RNA, 20 nt, Human
gcaaggccuuaguaacagca

SEQ ID NO: 431331 - RNA, 32 nt, Human
gcaaggccuucacugcagccccaucuccuccu

SEQ ID NO: 431332 - RNA, 32 nt, Human
gcaaggccuugcaaaugcauuuauaccuguaa

SEQ ID NO: 431333 - RNA, 24 nt, Human
gcaaggcgaagggguggagaguga

SEQ ID NO: 431334 - RNA, 32 nt, Human
gcaaggcgggcagaucauuugaggucagaaau

SEQ ID NO: 431335 - RNA, 32 nt, Human
gcaaggcucucgggggcaacgcucagcuuucu

SEQ ID NO: 431336 - RNA, 18 nt, Human
gcaaggcucugaccagug

SEQ ID NO: 431337 - RNA, 32 nt, Human
gcaaggcugagucuccagcccaggccuccuuc

SEQ ID NO: 431338 - RNA, 32 nt, Human
gcaaggcuggggcaucccagcccacacacccu

SEQ ID NO: 431339 - RNA, 21 nt, Human
gcaaggcugggggaggguguc

SEQ ID NO: 431340 - RNA, 19 nt, Human
gcaaggcugggugcagugg

SEQ ID NO: 431341 - RNA, 32 nt, Human
gcaaggcuucccaucccucccuuccucuucuc

SEQ ID NO: 431342 - RNA, 32 nt, Human
gcaaggcuugcuuuccccuugggugcuggccu

SEQ ID NO: 431343 - RNA, 32 nt, Human
gcaaggcuuggagagcugcucuuuaggaucca

SEQ ID NO: 431344 - RNA, 32 nt, Human
gcaaggcuugggaggcggggcccugcaggacg

SEQ ID NO: 431345 - RNA, 32 nt, Human
gcaagggaagagagcugaggagagggaaguga

SEQ ID NO: 431346 - RNA, 32 nt, Human
gcaagggacacagaauaugcagaggaaccugg

SEQ ID NO: 431347 - RNA, 32 nt, Human
gcaagggaccucaggcugccccucucuccucc

SEQ ID NO: 431348 - RNA, 32 nt, Human
gcaagggacguggacggggcagugagccaggc

SEQ ID NO: 431349 - RNA, 32 nt, Human
gcaagggagaggguuccagaagcauugccuuu

SEQ ID NO: 431350 - RNA, 32 nt, Human
gcaagggagauggucucaagucagagggaagc

SEQ ID NO: 431351 - RNA, 32 nt, Human
gcaagggaggcuuccuggaggaagcggcauug

SEQ ID NO: 431352 - RNA, 32 nt, Human
gcaagggagggggagagaagcagagggagaga

SEQ ID NO: 431353 - RNA, 32 nt, Human
gcaagggagguguuacagcugguucugagccg

SEQ ID NO: 431354 - RNA, 32 nt, Human
gcaagggaguccgcagccuccgggaggagggg

SEQ ID NO: 431355 - RNA, 32 nt, Human
gcaagggaugcagcuauuuggggaagaguguu

SEQ ID NO: 431356 - RNA, 32 nt, Human
gcaagggauucugcucauguguuugcagaccg

SEQ ID NO: 431357 - RNA, 32 nt, Human
gcaagggcaggcaaucuugguugugaauauuu

SEQ ID NO: 431358 - RNA, 20 nt, Human
gcaagggcaggcuggcugca

SEQ ID NO: 431359 - RNA, 32 nt, Human
gcaagggcaggggucccugagcuguucuucug

SEQ ID NO: 431360 - RNA, 32 nt, Human
gcaagggcaggguucagaaagacugaauguaa

SEQ ID NO: 431361 - RNA, 32 nt, Human
gcaagggcagugagaggaagggagggaugagg

SEQ ID NO: 431362 - RNA, 32 nt, Human
gcaagggcaguggccccaggaguguggagagu

SEQ ID NO: 431363 - RNA, 32 nt, Human
gcaagggcucggucggcccacccaggaccaaa

SEQ ID NO: 431364 - RNA, 32 nt, Human
gcaagggcugccucuaacaccuccagguucuc

SEQ ID NO: 431365 - RNA, 32 nt, Human
gcaagggcuuagggguuggagguggcagauaa

SEQ ID NO: 431366 - RNA, 32 nt, Human
gcaaggggaaaggucuccuugccccucucccu

SEQ ID NO: 431367 - RNA, 32 nt, Human
gcaaggggaccagggaccuggaacccucuugg

SEQ ID NO: 431368 - RNA, 32 nt, Human
gcaaggggaggcaggaggguggccuggaccuc

SEQ ID NO: 431369 - RNA, 32 nt, Human
gcaaggggagggaagagagagguguggggugg

SEQ ID NO: 431370 - RNA, 32 nt, Human
gcaaggggccguggcuucauucuugaagucag

SEQ ID NO: 431371 - RNA, 32 nt, Human
gcaagggggaacaaaucacaccucugggcuuc

SEQ ID NO: 431372 - RNA, 32 nt, Human
gcaagggggaguguagagcagagcagaagccu

SEQ ID NO: 431373 - RNA, 18 nt, Human
gcaaggggugcaugggaa

SEQ ID NO: 431374 - RNA, 32 nt, Human
gcaagggguuuguccagguggccccugaauuc

SEQ ID NO: 431375 - RNA, 32 nt, Human
gcaagggugguuuggaugaagucugacuacuu

SEQ ID NO: 431376 - RNA, 32 nt, Human
gcaaggguucccucaagaggaaguggcggugc

SEQ ID NO: 431377 - RNA, 18 nt, Human
gcaaggguugcggugcag

SEQ ID NO: 431378 - RNA, 32 nt, Human
gcaagguagagugccuaggagcccuggacuca

SEQ ID NO: 431379 - RNA, 24 nt, Human
gcaagguagcucaugucuguaauc

SEQ ID NO: 431380 - RNA, 32 nt, Human
gcaaggucaagaaaucccacaguuugauguau

SEQ ID NO: 431381 - RNA, 32 nt, Human
gcaaggucagcgagagacaguucuccaugcca

SEQ ID NO: 431382 - RNA, 32 nt, Human
gcaagguccuagcauggagaaacuccaagcuc

SEQ ID NO: 431383 - RNA, 32 nt, Human
gcaaggucuaccuggcacgguggggcauccaa

SEQ ID NO: 431384 - RNA, 32 nt, Human
gcaaggucuggaccaucucucugcaacugacc

SEQ ID NO: 431385 - RNA, 22 nt, Human
gcaaggucuuaccugaaucagg

SEQ ID NO: 431386 - RNA, 18 nt, Human
gcaaggugauggcugcag

SEQ ID NO: 431387 - RNA, 32 nt, Human
gcaaggugcccugagcuccccugggcagcacc

SEQ ID NO: 431388 - RNA, 32 nt, Human
gcaaggugcugccccagggaaaaggcccacag

SEQ ID NO: 431389 - RNA, 32 nt, Human
gcaagguggaaagauaagaagcagaggggucc

SEQ ID NO: 431390 - RNA, 32 nt, Human
gcaagguggcggcugaggaagagcagagcccc

SEQ ID NO: 431391 - RNA, 24 nt, Human
gcaagguggcucacaccuauaauc

SEQ ID NO: 431392 - RNA, 32 nt, Human
gcaaggugguggcgccgagaggcgugucugug

SEQ ID NO: 431393 - RNA, 32 nt, Human
gcaaggugucccacccuccccuccugacccuc

SEQ ID NO: 431394 - RNA, 32 nt, Human
gcaaggugucccugccuucacugugcuccaac

SEQ ID NO: 431395 - RNA, 32 nt, Human
gcaagguguggaauauuucuggcuucuagucc

SEQ ID NO: 431396 - RNA, 32 nt, Human
gcaagguugugccaauggcauggaaucaggac

SEQ ID NO: 431397 - RNA, 32 nt, Human
gcaagguugugucuugcgcaugguuaaaaaua

SEQ ID NO: 431398 - RNA, 32 nt, Human
gcaagguuucaaggaggggaaaaagaacgggu

SEQ ID NO: 431399 - RNA, 32 nt, Human
gcaaguacagcacuuucuagauugcuccugga

SEQ ID NO: 431400 - RNA, 32 nt, Human
gcaaguaccacuccauccagccuugggcaaga

SEQ ID NO: 431401 - RNA, 21 nt, Human
gcaaguagcuaugacugcaga

SEQ ID NO: 431402 - RNA, 32 nt, Human
gcaaguaggacagagagaugacuggggaaggu

SEQ ID NO: 431403 - RNA, 32 nt, Human
gcaaguaguagaaaagaauaggcaagaugggg

SEQ ID NO: 431404 - RNA, 32 nt, Human
gcaaguaucugugaauccuuagcacugacggg

SEQ ID NO: 431405 - RNA, 32 nt, Human
gcaaguauuugcccacuuguguucugugagca

SEQ ID NO: 431406 - RNA, 32 nt, Human
gcaagucacaaaggaauggaggcucuaauuga

SEQ ID NO: 431407 - RNA, 32 nt, Human
gcaagucacagaaauugcaccucauuccaguc

SEQ ID NO: 431408 - RNA, 32 nt, Human
gcaagucacaggaucacuggguggugaaagaa

SEQ ID NO: 431409 - RNA, 32 nt, Human
gcaagucaucccucagugaaagcaccagucuc

SEQ ID NO: 431410 - RNA, 32 nt, Human
gcaagucauucagcuaauacaaagcuguuuua

SEQ ID NO: 431411 - RNA, 32 nt, Human
gcaagucauuguccucugagcugcaguuuccu

SEQ ID NO: 431412 - RNA, 32 nt, Human
gcaaguccagccucgucuuggguuacucugac

SEQ ID NO: 431413 - RNA, 32 nt, Human
gcaaguccagggagagcuaaagagguuuuauc

SEQ ID NO: 431414 - RNA, 22 nt, Human
gcaagucccccgcugagggcca

SEQ ID NO: 431415 - RNA, 32 nt, Human
gcaaguccccuccuggggccccagacgccccc

SEQ ID NO: 431416 - RNA, 23 nt, Human
gcaagucccggagagcaacagca

SEQ ID NO: 431417 - RNA, 32 nt, Human
gcaaguccuccaggguugcaccagguuuaccu

SEQ ID NO: 431418 - RNA, 32 nt, Human
gcaaguccucccagccagagcuggcgggcugg

SEQ ID NO: 431419 - RNA, 32 nt, Human
gcaaguccugcacaccugagagcccagggagc

SEQ ID NO: 431420 - RNA, 32 nt, Human
gcaaguccuggacccggaggaggaggagcggc

SEQ ID NO: 431421 - RNA, 32 nt, Human
gcaaguccugucucacuugaucuuugggagca

SEQ ID NO: 431422 - RNA, 32 nt, Human
gcaaguccugugggagauggcagaggccuggu

SEQ ID NO: 431423 - RNA, 32 nt, Human
gcaagucggaccuauggcgccagccugcucca

SEQ ID NO: 431424 - RNA, 24 nt, Human
gcaagucuccuacggcuuccuggg

SEQ ID NO: 431425 - RNA, 24 nt, Human
gcaagucuucaugauucugucaua

SEQ ID NO: 431426 - RNA, 32 nt, Human
gcaagucuuucuguagagaugcagcauuugua

SEQ ID NO: 431427 - RNA, 32 nt, Human
gcaagugaaagcuuccugaggucuccccggaa

SEQ ID NO: 431428 - RNA, 32 nt, Human
gcaagugaaaggaggaggcuucuguguaaaug

SEQ ID NO: 431429 - RNA, 32 nt, Human
gcaagugaacucagcacucugcagugagaggg

SEQ ID NO: 431430 - RNA, 32 nt, Human
gcaagugaagccagaggagggucccccagcug

SEQ ID NO: 431431 - RNA, 32 nt, Human
gcaagugacagaccuuccccaggcucugcuuc

SEQ ID NO: 431432 - RNA, 18 nt, Human
gcaagugacaugccaucc

SEQ ID NO: 431433 - RNA, 32 nt, Human
gcaagugagacuccacccuccccaccuggcuc

SEQ ID NO: 431434 - RNA, 32 nt, Human
gcaagugagcaacuucaggcucucugggcaga

SEQ ID NO: 431435 - RNA, 32 nt, Human
gcaagugagccaagaaccuaggagcagggcca

SEQ ID NO: 431436 - RNA, 32 nt, Human
gcaagugagccccagcuggacucauggaugug

SEQ ID NO: 431437 - RNA, 21 nt, Human
gcaagugaggcaagagaaaug

SEQ ID NO: 431438 - RNA, 24 nt, Human
gcaagugagggaaaaagcugaggu

SEQ ID NO: 431439 - RNA, 32 nt, Human
gcaagugauagugagagaagaggcagaggaau

SEQ ID NO: 431440 - RNA, 32 nt, Human
gcaagugcaagccuggcugacacaggugugaa

SEQ ID NO: 431441 - RNA, 32 nt, Human
gcaagugccaagcagaacagaccuuaucaucu

SEQ ID NO: 431442 - RNA, 32 nt, Human
gcaagugccacauggcucguggagggugggua

SEQ ID NO: 431443 - RNA, 32 nt, Human
gcaagugccacauuuucccuggcagagaucuc

SEQ ID NO: 431444 - RNA, 32 nt, Human
gcaagugcccaucuuuccccagccucucauca

SEQ ID NO: 431445 - RNA, 31 nt, Human
gcaagugcgcagagagaagacuggcagugga

SEQ ID NO: 431446 - RNA, 32 nt, Human
gcaagugcgcgguuggggccacugcgaggccg

SEQ ID NO: 431447 - RNA, 32 nt, Human
gcaagugcuauuucagcaacaaccaucucauc

SEQ ID NO: 431448 - RNA, 32 nt, Human
gcaagugcugccuaugcugagaacaagucaga

SEQ ID NO: 431449 - RNA, 24 nt, Human
gcaaguggaucacuugaggucagg

SEQ ID NO: 431450 - RNA, 32 nt, Human
gcaaguggcaccugcaccuggccacgccgcgc

SEQ ID NO: 431451 - RNA, 32 nt, Human
gcaagugggagagggaaaaugacucgggacgc

SEQ ID NO: 431452 - RNA, 32 nt, Human
gcaagugggaggauuguuugagcccaggaauc

SEQ ID NO: 431453 - RNA, 32 nt, Human
gcaaguggguaugucauaaggagucagauuau

SEQ ID NO: 431454 - RNA, 32 nt, Human
gcaaguggucucaggauucucuggagauuuug

SEQ ID NO: 431455 - RNA, 32 nt, Human
gcaaguggugcuggugacaucccagcuccugu

SEQ ID NO: 431456 - RNA, 32 nt, Human
gcaagugucauugacucucuaaacuugaaguc

SEQ ID NO: 431457 - RNA, 32 nt, Human
gcaagugucuaacuucugugccuguuaaucau

SEQ ID NO: 431458 - RNA, 32 nt, Human
gcaagugugcacacccuccgccagaccucacu

SEQ ID NO: 431459 - RNA, 32 nt, Human
gcaagugugcgucuauuuccauggcgcccugg

SEQ ID NO: 431460 - RNA, 32 nt, Human
gcaaguucaacagucaaacuguuuucauucca

SEQ ID NO: 431461 - RNA, 32 nt, Human
gcaaguucccuaaccucucccaacacagccuc

SEQ ID NO: 431462 - RNA, 32 nt, Human
gcaaguucuacgugggagucugugcauuugug

SEQ ID NO: 431463 - RNA, 28 nt, Human
gcaaguugaaagaucuaguuuuaucuua

SEQ ID NO: 431464 - RNA, 32 nt, Human
gcaaguugacuucauccugucauuccagccug

SEQ ID NO: 431465 - RNA, 32 nt, Human
gcaaguugcaauuuagaagaugccauacgucg

SEQ ID NO: 431466 - RNA, 32 nt, Human
gcaaguugccuauguccauguucugugagaug

SEQ ID NO: 431467 - RNA, 32 nt, Human
gcaaguuggacacaccccuccucgcuggagag

SEQ ID NO: 431468 - RNA, 22 nt, Human
gcaaguuguccaucaguauccu

SEQ ID NO: 431469 - RNA, 32 nt, Human
gcaaguugugccuauuuccuccaagucagaua

SEQ ID NO: 431470 - RNA, 32 nt, Human
gcaaguuuaaaacaaaaauuaggagguuguau

SEQ ID NO: 431471 - RNA, 32 nt, Human
gcaaguuuacauguauucccugggcaacacug

SEQ ID NO: 431472 - RNA, 32 nt, Human
gcaaguuucaagauguuuugggugacaaugca

SEQ ID NO: 431473 - RNA, 32 nt, Human
gcaaguuucauuuuugucaugacaauguagga

SEQ ID NO: 431474 - RNA, 32 nt, Human
gcaaguuucuggcuugccugugaugggugaug

SEQ ID NO: 431475 - RNA, 32 nt, Human
gcaaguuuucccuucugcucuggugccaggga

SEQ ID NO: 431476 - RNA, 32 nt, Human
gcaauaaaaagcauacuuucagacaaacgggg

SEQ ID NO: 431477 - RNA, 23 nt, Human
gcaauaaaccagaaccaaagucg

SEQ ID NO: 431478 - RNA, 32 nt, Human
gcaauaaacugcauuugaaauucuccaugucu

SEQ ID NO: 431479 - RNA, 32 nt, Human
gcaauaaagucucccugaguggugaguucucc

SEQ ID NO: 431480 - RNA, 20 nt, Human
gcaauaacagaucugccaca

SEQ ID NO: 431481 - RNA, 32 nt, Human
gcaauaacaucaacaucaacaaaaaggaggac

SEQ ID NO: 431482 - RNA, 32 nt, Human
gcaauaacuccaugggcucugggacccuaccc

SEQ ID NO: 431483 - RNA, 32 nt, Human
gcaauaacuggaccagggggagcugcugucac

SEQ ID NO: 431484 - RNA, 24 nt, Human
gcaauaacuuguggccacuggaaa

SEQ ID NO: 431485 - RNA, 32 nt, Human
gcaauaaggcuggagaaggaaaagccggcgcg

SEQ ID NO: 431486 - RNA, 32 nt, Human
gcaauaaguauuagucuuuuuggacuauggua

SEQ ID NO: 431487 - RNA, 31 nt, Human
gcaauaagugagaguuagaaaggugucaaag

SEQ ID NO: 431488 - RNA, 21 nt, Human
gcaauaaguggaccuuuguua

SEQ ID NO: 431489 - RNA, 20 nt, Human
gcaauaauaggauucauuua

SEQ ID NO: 431490 - RNA, 32 nt, Human
gcaauaauuuuacaggcauuuugaggugucuc

SEQ ID NO: 431491 - RNA, 32 nt, Human
gcaauaccauucaggacacaggcaugggcaag

SEQ ID NO: 431492 - RNA, 32 nt, Human
gcaauaccccgaagcacaggcaaccaaagcaa

SEQ ID NO: 431493 - RNA, 32 nt, Human
gcaauacucccuucagcuucagcaggugaaaa

SEQ ID NO: 431494 - RNA, 32 nt, Human
gcaauacuguucugucaucuggagcuauuuuu

SEQ ID NO: 431495 - RNA, 32 nt, Human
gcaauagaagugauuaauucauuaagcauuua

SEQ ID NO: 431496 - RNA, 32 nt, Human
gcaauagacuaggaggucucugauuucuucuu

SEQ ID NO: 431497 - RNA, 32 nt, Human
gcaauagcaaucuucaugaugccuagaagggc

SEQ ID NO: 431498 - RNA, 32 nt, Human
gcaauaggugugaacagggaacucagaauaca

SEQ ID NO: 431499 - RNA, 32 nt, Human
gcaauaguccuuuccacuacaggccaggggau

SEQ ID NO: 431500 - RNA, 32 nt, Human
gcaauaguuucaucaauuccaaguuaugugga

SEQ ID NO: 431501 - RNA, 32 nt, Human
gcaauauaaugcugcauguucaagaugaacag

SEQ ID NO: 431502 - RNA, 32 nt, Human
gcaauaugccgccgcggcccucuggcucuagg

SEQ ID NO: 431503 - RNA, 32 nt, Human
gcaauauuguauauuuuuaagaacaaauuuaa

SEQ ID NO: 431504 - RNA, 32 nt, Human
gcaaucaaguccuggaaacacuuucaaccuag

SEQ ID NO: 431505 - RNA, 32 nt, Human
gcaaucaaguuucuucuuuuccacuuuuacuu

SEQ ID NO: 431506 - RNA, 32 nt, Human
gcaaucaauguucacgcaacuugaaauuauau

SEQ ID NO: 431507 - RNA, 32 nt, Human
gcaaucaccaugggacugcggaagagaaaucc

SEQ ID NO: 431508 - RNA, 32 nt, Human
gcaaucacuuuugcuccaaccuaguaauugca

SEQ ID NO: 431509 - RNA, 23 nt, Human
gcaaucagaccuuccagcugccu

SEQ ID NO: 431510 - RNA, 32 nt, Human
gcaaucagccccuaccaugagcauuaaugcca

SEQ ID NO: 431511 - RNA, 32 nt, Human
gcaaucaggaagggagagagcuggggaccaua

SEQ ID NO: 431512 - RNA, 32 nt, Human
gcaaucaggcaacccaggaauguggccaucaa

SEQ ID NO: 431513 - RNA, 32 nt, Human
gcaaucauugcagcuucuucuuucuucugcuc

SEQ ID NO: 431514 - RNA, 32 nt, Human
gcaaucauuggggaagagagccugaggcuggc

SEQ ID NO: 431515 - RNA, 32 nt, Human
gcaauccacagacgcaccuguguccaucagac

SEQ ID NO: 431516 - RNA, 32 nt, Human
gcaauccagcacuuugggaagcugaggcaggu

SEQ ID NO: 431517 - RNA, 32 nt, Human
gcaauccaugcacacucuguacaguuguuuuu

SEQ ID NO: 431518 - RNA, 32 nt, Human
gcaaucccagcaccaugggaggcugagcagga

SEQ ID NO: 431519 - RNA, 32 nt, Human
gcaaucccagcacuuugggagacugaggcggg

SEQ ID NO: 431520 - RNA, 32 nt, Human
gcaaucccccaugcccuuaggagcaagcaguu

SEQ ID NO: 431521 - RNA, 32 nt, Human
gcaauccucaagaggggagacagagcggcagc

SEQ ID NO: 431522 - RNA, 32 nt, Human
gcaauccuccacgaucucauggcuccaccugc

SEQ ID NO: 431523 - RNA, 32 nt, Human
gcaauccucccaccucagccucccaagaagcu

SEQ ID NO: 431524 - RNA, 32 nt, Human
gcaauccucccaucucagccuccugaguagcu

SEQ ID NO: 431525 - RNA, 32 nt, Human
gcaauccucccaucucagccucuuaaaguguu

SEQ ID NO: 431526 - RNA, 32 nt, Human
gcaauccuccugccucagccuccugaguagcu

SEQ ID NO: 431527 - RNA, 32 nt, Human
gcaauccuuccucuuuggccucccaaaauguu

SEQ ID NO: 431528 - RNA, 32 nt, Human
gcaauccuuccucuuuggccucccaacauguu

SEQ ID NO: 431529 - RNA, 32 nt, Human
gcaauccuuccucuuuggccucccaacuuguu

SEQ ID NO: 431530 - RNA, 32 nt, Human
gcaauccuugugccucagccuccugaguagcu

SEQ ID NO: 431531 - RNA, 32 nt, Human
gcaaucgggcagugaaacuugauauuguauua

SEQ ID NO: 431532 - RNA, 32 nt, Human
gcaaucuaccucuucuuugucuaguuaccccc

SEQ ID NO: 431533 - RNA, 32 nt, Human
gcaaucucacugcaaccuccgccuuccaguug

SEQ ID NO: 431534 - RNA, 32 nt, Human
gcaaucucacugcaagcuccacuuccuggguu

SEQ ID NO: 431535 - RNA, 32 nt, Human
gcaaucucacugcaagcucugccucccagguu

SEQ ID NO: 431536 - RNA, 32 nt, Human
gcaaucucacugcauccuccgccucccggguu

SEQ ID NO: 431537 - RNA, 32 nt, Human
gcaaucuccagccugcugcugcuggcugcaac

SEQ ID NO: 431538 - RNA, 19 nt, Human
gcaaucucuagcguccucu

SEQ ID NO: 431539 - RNA, 32 nt, Human
gcaaucucuuugaacagagguuuauucaauga

SEQ ID NO: 431540 - RNA, 32 nt, Human
gcaaucugcacuguccagccuagcaggccgcc

SEQ ID NO: 431541 - RNA, 32 nt, Human
gcaaucuggacucucuggacacugugcaugcu

SEQ ID NO: 431542 - RNA, 32 nt, Human
gcaaucugggagguggaaguugcagugagccg

SEQ ID NO: 431543 - RNA, 32 nt, Human
gcaaucugguggcugcugucaucuguccccag

SEQ ID NO: 431544 - RNA, 32 nt, Human
gcaaucuucaaaagcacuuucaguggauuggu

SEQ ID NO: 431545 - RNA, 32 nt, Human
gcaaucuuguaacuuugauaaugaacagugag

SEQ ID NO: 431546 - RNA, 32 nt, Human
gcaaucuuucugccuccaccucccgaguggcu

SEQ ID NO: 431547 - RNA, 32 nt, Human
gcaaucuuugccuuuaucucugaggcuaugga

SEQ ID NO: 431548 - RNA, 32 nt, Human
gcaaugaagcagaaauagaguaugugucccuu

SEQ ID NO: 431549 - RNA, 32 nt, Human
gcaaugaagcggagguugcagugagccgagag

SEQ ID NO: 431550 - RNA, 32 nt, Human
gcaaugaagugacaagaugagagcagaaucgu

SEQ ID NO: 431551 - RNA, 32 nt, Human
gcaaugacacaaauagguuuuggggaucuacc

SEQ ID NO: 431552 - RNA, 32 nt, Human
gcaaugacauaaaaacugcuauggagagaaag

SEQ ID NO: 431553 - RNA, 32 nt, Human
gcaaugacugcagcaccuccugggcuuacaca

SEQ ID NO: 431554 - RNA, 32 nt, Human
gcaaugacuugacuuuaaacagucuucuuuuu

SEQ ID NO: 431555 - RNA, 32 nt, Human
gcaaugagaccugaagacaggagccagccucc

SEQ ID NO: 431556 - RNA, 32 nt, Human
gcaaugagaucagcagcauggagugucugugu

SEQ ID NO: 431557 - RNA, 32 nt, Human
gcaaugagcuacucgggccagaugggggccug

SEQ ID NO: 431558 - RNA, 32 nt, Human
gcaaugaugcaaucucaguucacugcagucuc

SEQ ID NO: 431559 - RNA, 32 nt, Human
gcaaugauuccuaugggaucauugauuggucc

SEQ ID NO: 431560 - RNA, 32 nt, Human
gcaaugcagacacgagaaggagggcucagccu

SEQ ID NO: 431561 - RNA, 32 nt, Human
gcaaugcagacuggaauccuccccacaaggau

SEQ ID NO: 431562 - RNA, 32 nt, Human
gcaaugcaucuucucccccagaucaucacaga

SEQ ID NO: 431563 - RNA, 32 nt, Human
gcaaugccaagacagugaagaaugacaacucc

SEQ ID NO: 431564 - RNA, 32 nt, Human
gcaaugccagggcacagcuggggaagaucuug

SEQ ID NO: 431565 - RNA, 32 nt, Human
gcaaugccaguaaacuuaaauuacguaacuuc

SEQ ID NO: 431566 - RNA, 32 nt, Human
gcaaugccauccucgccauauaccaaauaauc

SEQ ID NO: 431567 - RNA, 32 nt, Human
gcaaugccgaguggaggaaggaggaaccggag

SEQ ID NO: 431568 - RNA, 28 nt, Human
gcaaugccuaaaggaggaagaaagggag

SEQ ID NO: 431569 - RNA, 21 nt, Human
gcaaugccuaagacuuuguua

SEQ ID NO: 431570 - RNA, 32 nt, Human
gcaaugccucaagggagugagcucucaaccac

SEQ ID NO: 431571 - RNA, 32 nt, Human
gcaaugcguguuguacauacagagguaacuau

SEQ ID NO: 431572 - RNA, 32 nt, Human
gcaaugcuccaaugcugagcuagaucuuucuu

SEQ ID NO: 431573 - RNA, 32 nt, Human
gcaaugcugaagaagcuauggaagcaagaagg

SEQ ID NO: 431574 - RNA, 32 nt, Human
gcaaugcuguaaccuggugccugcugcugugc

SEQ ID NO: 431575 - RNA, 32 nt, Human
gcaaugcuuugcaagucuuuacugcuuggagg

SEQ ID NO: 431576 - RNA, 32 nt, Human
gcaauggagaaggcaggaaggcaggggccuug

SEQ ID NO: 431577 - RNA, 32 nt, Human
gcaauggagguggucagaaauggauggauucu

SEQ ID NO: 431578 - RNA, 22 nt, Human
gcaauggagugggcagcugggg

SEQ ID NO: 431579 - RNA, 32 nt, Human
gcaauggauggcuucaauauccuugggcccag

SEQ ID NO: 431580 - RNA, 32 nt, Human
gcaauggcaaaaauauuuccaguugcacugua

SEQ ID NO: 431581 - RNA, 32 nt, Human
gcaauggcagcugcugugugaggaccaguguc

SEQ ID NO: 431582 - RNA, 32 nt, Human
gcaauggcaggaucucagaucacugcaaccuc

SEQ ID NO: 431583 - RNA, 19 nt, Human
gcaauggcagggccagcag

SEQ ID NO: 431584 - RNA, 32 nt, Human
gcaauggcaugaucucgccuccuggguucaag

SEQ ID NO: 431585 - RNA, 20 nt, Human
gcaauggccagcggcuccgg

SEQ ID NO: 431586 - RNA, 25 nt, Human
gcaauggccaucacaguaaagggaa

SEQ ID NO: 431587 - RNA, 32 nt, Human
gcaauggccuuagcugucccacacaacucagu

SEQ ID NO: 431588 - RNA, 22 nt, Human
gcaauggcucacaccuauaauc

SEQ ID NO: 431589 - RNA, 22 nt, Human
gcaauggcucacaccuguaauu

SEQ ID NO: 431590 - RNA, 32 nt, Human
gcaauggcucacaccuguuaaucccagcacuu

SEQ ID NO: 431591 - RNA, 22 nt, Human
gcaauggcucacaccuguuauc

SEQ ID NO: 431592 - RNA, 22 nt, Human
gcaauggcucacacuuguaauc

SEQ ID NO: 431593 - RNA, 22 nt, Human
gcaauggcucacgccuguaauc

SEQ ID NO: 431594 - RNA, 32 nt, Human
gcaauggcucacgccuguaauccuagcauuuu

SEQ ID NO: 431595 - RNA, 32 nt, Human
gcaauggcucacugcagccucaaccuccugag

SEQ ID NO: 431596 - RNA, 22 nt, Human
gcaauggcucaugccuauaauc

SEQ ID NO: 431597 - RNA, 22 nt, Human
gcaauggcucaugccuguaauc

SEQ ID NO: 431598 - RNA, 22 nt, Human
gcaauggcucgcaccuguaauc

SEQ ID NO: 431599 - RNA, 31 nt, Human
gcaaugggcaaaggggcugugccuugcagcc

SEQ ID NO: 431600 - RNA, 32 nt, Human
gcaaugggcagagagagcagagacagguggac

SEQ ID NO: 431601 - RNA, 28 nt, Human
gcaaugggcauccugaagcugcaaguau

SEQ ID NO: 431602 - RNA, 32 nt, Human
gcaaugggcucccuacccacacuggcuuccug

SEQ ID NO: 431603 - RNA, 32 nt, Human
gcaaugggggagaagagguuaguggaucgggg

SEQ ID NO: 431604 - RNA, 32 nt, Human
gcaauggguaacugaagcuuuugggcucgggg

SEQ ID NO: 431605 - RNA, 32 nt, Human
gcaaugggugagaugagauccuggagagagaa

SEQ ID NO: 431606 - RNA, 32 nt, Human
gcaauggguggguagugcagugggcggugccg

SEQ ID NO: 431607 - RNA, 32 nt, Human
gcaaugguaaauuaaguugucuuccaaaacug

SEQ ID NO: 431608 - RNA, 32 nt, Human
gcaaugguaauuccuuuccucuuuuccuucca

SEQ ID NO: 431609 - RNA, 32 nt, Human
gcaauggugcaaucucaguucacugcagucuc

SEQ ID NO: 431610 - RNA, 32 nt, Human
gcaauggugcaaucuuggcucacuauagccuu

SEQ ID NO: 431611 - RNA, 32 nt, Human
gcaauguauacauguaucaaaacaucacacug

SEQ ID NO: 431612 - RNA, 32 nt, Human
gcaaugucugagccccuagcugugcugguccg

SEQ ID NO: 431613 - RNA, 28 nt, Human
gcaauguggcugaggaagggagccaaaa

SEQ ID NO: 431614 - RNA, 32 nt, Human
gcaauguggcugcuuugacuguacuggacaua

SEQ ID NO: 431615 - RNA, 32 nt, Human
gcaaugugggacaaugaaaaaugcuuuacagg

SEQ ID NO: 431616 - RNA, 32 nt, Human
gcaaugugugaucccagcucucugccagacug

SEQ ID NO: 431617 - RNA, 32 nt, Human
gcaaugugugcaccuccacacacugcuaaaug

SEQ ID NO: 431618 - RNA, 32 nt, Human
gcaauguuacggugaauucucaggugaacuuu

SEQ ID NO: 431619 - RNA, 32 nt, Human
gcaauguuccaucauguuccaugcugcugacg

SEQ ID NO: 431620 - RNA, 32 nt, Human
gcaauguuccaucauguuccaugcugcugcug

SEQ ID NO: 431621 - RNA, 23 nt, Human
gcaauguuggguuggggaagaca

SEQ ID NO: 431622 - RNA, 32 nt, Human
gcaauguuuccauuaaguagagacucagcugu

SEQ ID NO: 431623 - RNA, 19 nt, Human
gcaauguuuucuucacuca

SEQ ID NO: 431624 - RNA, 32 nt, Human
gcaauuagcauccaguuccugcagccuggugc

SEQ ID NO: 431625 - RNA, 32 nt, Human
gcaauuauguguaucauaacaugcucauuuaa

SEQ ID NO: 431626 - RNA, 32 nt, Human
gcaauucacagaauugacauuuuggcagauga

SEQ ID NO: 431627 - RNA, 32 nt, Human
gcaauucacaugccucagccaccugaguagca

SEQ ID NO: 431628 - RNA, 32 nt, Human
gcaauucaccaacgacugaucucuccauucag

SEQ ID NO: 431629 - RNA, 32 nt, Human
gcaauucaccaccaacuaggugugugaccgug

SEQ ID NO: 431630 - RNA, 32 nt, Human
gcaauucagacuucagugaucuccagugguca

SEQ ID NO: 431631 - RNA, 32 nt, Human
gcaauucauguccucagucuccggacacaaug

SEQ ID NO: 431632 - RNA, 32 nt, Human
gcaauuccaacccucugggaggccaaggcagg

SEQ ID NO: 431633 - RNA, 32 nt, Human
gcaauuccucaaggaucuagaaccagaaauac

SEQ ID NO: 431634 - RNA, 32 nt, Human
gcaauucuaaauccgcccuugauauuagagaa

SEQ ID NO: 431635 - RNA, 32 nt, Human
gcaauucuagucuuccacaaaacaucuagcca

SEQ ID NO: 431636 - RNA, 32 nt, Human
gcaauucucaugccucagccuccugaguagcu

SEQ ID NO: 431637 - RNA, 32 nt, Human
gcaauucucccaucucagccuccugaguagcu

SEQ ID NO: 431638 - RNA, 32 nt, Human
gcaauucuccugccccagccuccugaguagcu

SEQ ID NO: 431639 - RNA, 32 nt, Human
gcaauucuccugccgcagccucccaagaagcu

SEQ ID NO: 431640 - RNA, 32 nt, Human
gcaauucuccugccucagccucccagauagcu

SEQ ID NO: 431641 - RNA, 32 nt, Human
gcaauucuccugccucagccucccagguggcu

SEQ ID NO: 431642 - RNA, 32 nt, Human
gcaauucuccugccucagccuccugagcagcu

SEQ ID NO: 431643 - RNA, 32 nt, Human
gcaauucuccugccucagccuccugaguagcu

SEQ ID NO: 431644 - RNA, 32 nt, Human
gcaauucuccugccucagcuacucaagaggcu

SEQ ID NO: 431645 - RNA, 32 nt, Human
gcaauucuccugccucaggcuccuggguggcu

SEQ ID NO: 431646 - RNA, 32 nt, Human
gcaauucuccugccucggcuucccaaguagcu

SEQ ID NO: 431647 - RNA, 32 nt, Human
gcaauucuccugcuucugccuccugaguagcu

SEQ ID NO: 431648 - RNA, 32 nt, Human
gcaauucuccuguaaucccagcuacucgggag

SEQ ID NO: 431649 - RNA, 32 nt, Human
gcaauucucgugccucagccuccugaguagcu

SEQ ID NO: 431650 - RNA, 32 nt, Human
gcaauucucuugccucagccuccugaguagcu

SEQ ID NO: 431651 - RNA, 32 nt, Human
gcaauucuguuuuucuccaaguacauuaugac

SEQ ID NO: 431652 - RNA, 32 nt, Human
gcaauucuuacgccucagccuccugaguagau

SEQ ID NO: 431653 - RNA, 32 nt, Human
gcaauucuuauuagagcuuacucaggacuuuu

SEQ ID NO: 431654 - RNA, 32 nt, Human
gcaauucuucugccucagccuccugaguagcu

SEQ ID NO: 431655 - RNA, 32 nt, Human
gcaauucuugugccucagccucccggguagcu

SEQ ID NO: 431656 - RNA, 32 nt, Human
gcaauugaagaaagggaggagccagauuaguu

SEQ ID NO: 431657 - RNA, 32 nt, Human
gcaauugaggugugcagagcacuguacagacc

SEQ ID NO: 431658 - RNA, 32 nt, Human
gcaauugauggggccauugcaggucacccuga

SEQ ID NO: 431659 - RNA, 32 nt, Human
gcaauugcaccacugcacuccagccuggguga

SEQ ID NO: 431660 - RNA, 32 nt, Human
gcaauugcacuccugggccucugacagagcuu

SEQ ID NO: 431661 - RNA, 32 nt, Human
gcaauugcagcagcagcagucacugcagcucc

SEQ ID NO: 431662 - RNA, 32 nt, Human
gcaauugccacuuugucaucaguggcuccuuu

SEQ ID NO: 431663 - RNA, 32 nt, Human
gcaauugcgaccuuaauuuaacuuuccagucu

SEQ ID NO: 431664 - RNA, 32 nt, Human
gcaauugguaauccccaaaauggguguaucug

SEQ ID NO: 431665 - RNA, 32 nt, Human
gcaauugguguuuucucuugaauuugggggcu

SEQ ID NO: 431666 - RNA, 32 nt, Human
gcaauuguaugaccaauuuccuuacuuuucuu

SEQ ID NO: 431667 - RNA, 19 nt, Human
gcaauuguugcaagaugaa

SEQ ID NO: 431668 - RNA, 32 nt, Human
gcaauuuaacuagacacagauaauaauggguu

SEQ ID NO: 431669 - RNA, 32 nt, Human
gcaauuucauguuuuaacuugggaaacugaaa

SEQ ID NO: 431670 - RNA, 32 nt, Human
gcaauuuccaacacaagggggaagggaugcag

SEQ ID NO: 431671 - RNA, 32 nt, Human
gcaauuucuauucuaccagcacucugccacag

SEQ ID NO: 431672 - RNA, 32 nt, Human
gcaauuugaaauauauucugguuguuuuucua

SEQ ID NO: 431673 - RNA, 32 nt, Human
gcaauuugauacauuuuuaaagcugcuuccug

SEQ ID NO: 431674 - RNA, 32 nt, Human
gcaauuuuaaccuuuuucugguacaguccaga

SEQ ID NO: 431675 - RNA, 32 nt, Human
gcaauuuuagaaagcagguggugcuaggaagg

SEQ ID NO: 431676 - RNA, 32 nt, Human
gcaauuuucaaaacuucuccccaaacuacaac

SEQ ID NO: 431677 - RNA, 32 nt, Human
gcaauuuuccugccuugggccucccagugcug

SEQ ID NO: 431678 - RNA, 32 nt, Human
gcaauuuugucauuuauaugggagaaauagcu

SEQ ID NO: 431679 - RNA, 32 nt, Human
gcaauuuuucuuucuccaccccaaaccugugc

SEQ ID NO: 431680 - RNA, 23 nt, Human
gcacaaaaagaaacuuucaggca

SEQ ID NO: 431681 - RNA, 21 nt, Human
gcacaaaaauaaacuauggua

SEQ ID NO: 431682 - RNA, 32 nt, Human
gcacaaaaauggaaacaaauauauaaaauuuu

SEQ ID NO: 431683 - RNA, 32 nt, Human
gcacaaaacugaucaguuuugagagaucguua

SEQ ID NO: 431684 - RNA, 32 nt, Human
gcacaaaagcagauacuugaggaaaacacuau

SEQ ID NO: 431685 - RNA, 32 nt, Human
gcacaaaauacugguuucuaagugguuuugcu

SEQ ID NO: 431686 - RNA, 32 nt, Human
gcacaaaaucuuagggaagucauaaaauagua

SEQ ID NO: 431687 - RNA, 32 nt, Human
gcacaaacaaaguagggggaaaagaauaagca

SEQ ID NO: 431688 - RNA, 32 nt, Human
gcacaaacaucacauggugugugggauacaag

SEQ ID NO: 431689 - RNA, 22 nt, Human
gcacaaacuccuccugcuucau

SEQ ID NO: 431690 - RNA, 24 nt, Human
gcacaaacugccaucucgcuucau

SEQ ID NO: 431691 - RNA, 19 nt, Human
gcacaaagaaguccacuua

SEQ ID NO: 431692 - RNA, 32 nt, Human
gcacaaagauggauguaaugcacuuugggagg

SEQ ID NO: 431693 - RNA, 32 nt, Human
gcacaaagcaauacuaggcugaaggagagacc

SEQ ID NO: 431694 - RNA, 32 nt, Human
gcacaaagcacuggccuugccuccaggaccuu

SEQ ID NO: 431695 - RNA, 32 nt, Human
gcacaaagggagcacaguugaccugugaacag

SEQ ID NO: 431696 - RNA, 32 nt, Human
gcacaaaguacugggaaaugggagcacagagu

SEQ ID NO: 431697 - RNA, 32 nt, Human
gcacaaaguggggaaggcuguacugggucgaa

SEQ ID NO: 431698 - RNA, 32 nt, Human
gcacaaaguguuguccuccagguccaagugga

SEQ ID NO: 431699 - RNA, 28 nt, Human
gcacaaaguuuaugcauuuuuucaugca

SEQ ID NO: 431700 - RNA, 32 nt, Human
gcacaaauugcccagaccuaacaaaagcggca

SEQ ID NO: 431701 - RNA, 32 nt, Human
gcacaacaaaaacagugaaagaaaugcuuauc

SEQ ID NO: 431702 - RNA, 32 nt, Human
gcacaacaaggaacaaaacaaagcuuugaaaa

SEQ ID NO: 431703 - RNA, 32 nt, Human
gcacaacacagcccuuggugggaggggaaggc

SEQ ID NO: 431704 - RNA, 32 nt, Human
gcacaacagaauagagcugaacagggcaccuu

SEQ ID NO: 431705 - RNA, 32 nt, Human
gcacaacagccccacugcaagccugggauauc

SEQ ID NO: 431706 - RNA, 20 nt, Human
gcacaacaggcccuugggug

SEQ ID NO: 431707 - RNA, 32 nt, Human
gcacaacagguggcagugguggugacugauag

SEQ ID NO: 431708 - RNA, 32 nt, Human
gcacaacaucccucaccacucucccccagcac

SEQ ID NO: 431709 - RNA, 27 nt, Human
gcacaacauuauucgacuuuucccuca

SEQ ID NO: 431710 - RNA, 32 nt, Human
gcacaaccccucucucacuuugcuccuauuuc

SEQ ID NO: 431711 - RNA, 32 nt, Human
gcacaacccuagguccuggugccucgagcucc

SEQ ID NO: 431712 - RNA, 32 nt, Human
gcacaacccuggcaaauggccacagacuccuu

SEQ ID NO: 431713 - RNA, 32 nt, Human
gcacaacccugggguuugcugcagagcuauuu

SEQ ID NO: 431714 - RNA, 32 nt, Human
gcacaaccucaacccagccagaaaguacuucc

SEQ ID NO: 431715 - RNA, 17 nt, Human
gcacaaccuguguaauc

SEQ ID NO: 431716 - RNA, 32 nt, Human
gcacaacuaagcucacaaccaaaacugcacuu

SEQ ID NO: 431717 - RNA, 32 nt, Human
gcacaacuaccucggccugaccacagagcucu

SEQ ID NO: 431718 - RNA, 32 nt, Human
gcacaacuccaggaacuccaugguaugcucac

SEQ ID NO: 431719 - RNA, 32 nt, Human
gcacaacugugugagaguguagaagggaaggc

SEQ ID NO: 431720 - RNA, 32 nt, Human
gcacaacuuguccugguccaaguccuuauucu

SEQ ID NO: 431721 - RNA, 32 nt, Human
gcacaagaaucaauagaacccaggagguggag

SEQ ID NO: 431722 - RNA, 32 nt, Human
gcacaagaggaucugugacacugacauggcug

SEQ ID NO: 431723 - RNA, 32 nt, Human
gcacaagauaaauugagcuaguuaaggcaaau

SEQ ID NO: 431724 - RNA, 32 nt, Human
gcacaagauacagaucacaaagaccuugcuga

SEQ ID NO: 431725 - RNA, 32 nt, Human
gcacaagcacacacaugcaaggcauauacaug

SEQ ID NO: 431726 - RNA, 25 nt, Human
gcacaagcacugagcugacuguuga

SEQ ID NO: 431727 - RNA, 32 nt, Human
gcacaagccagccagcgcaccugcaguccucg

SEQ ID NO: 431728 - RNA, 32 nt, Human
gcacaagccuguaaucucugcacuuugggaug

SEQ ID NO: 431729 - RNA, 32 nt, Human
gcacaaggaacaguuugauacacuuuuaaaag

SEQ ID NO: 431730 - RNA, 30 nt, Human
gcacaaggaagcccagaggccacacuccgc

SEQ ID NO: 431731 - RNA, 32 nt, Human
gcacaaggacugacucaagcugugucuuucag

SEQ ID NO: 431732 - RNA, 32 nt, Human
gcacaaggaggaacccugucccagugcuucca

SEQ ID NO: 431733 - RNA, 25 nt, Human
gcacaaggccaagaacuccuggcca

SEQ ID NO: 431734 - RNA, 20 nt, Human
gcacaaggcgcccauggcgu

SEQ ID NO: 431735 - RNA, 32 nt, Human
gcacaaggcuggcagagauuuauguaugacuu

SEQ ID NO: 431736 - RNA, 24 nt, Human
gcacaagggcucacgccuguaauc

SEQ ID NO: 431737 - RNA, 32 nt, Human
gcacaagggcuggagcccagagaugagagugc

SEQ ID NO: 431738 - RNA, 20 nt, Human
gcacaaggggacuggaggca

SEQ ID NO: 431739 - RNA, 32 nt, Human
gcacaaguaaagccuugcacagaaaagccugc

SEQ ID NO: 431740 - RNA, 32 nt, Human
gcacaaguacagauugaccaggaaaagacaag

SEQ ID NO: 431741 - RNA, 23 nt, Human
gcacaaguaccacucuuggucag

SEQ ID NO: 431742 - RNA, 32 nt, Human
gcacaagugaacgagggugaggacuggagagc

SEQ ID NO: 431743 - RNA, 32 nt, Human
gcacaagugcccucuagggcagccaggggaau

SEQ ID NO: 431744 - RNA, 32 nt, Human
gcacaaguuuaauccugagucuuuauuuggaa

SEQ ID NO: 431745 - RNA, 32 nt, Human
gcacaauacauggccuaaguucccucuguucc

SEQ ID NO: 431746 - RNA, 32 nt, Human
gcacaaucaacuuuucugagcugguguaagcc

SEQ ID NO: 431747 - RNA, 32 nt, Human
gcacaaucacagcucacugcagccuggaccuc

SEQ ID NO: 431748 - RNA, 21 nt, Human
gcacaaucacggcucacugca

SEQ ID NO: 431749 - RNA, 32 nt, Human
gcacaaucagccagggagaacugggcggguuu

SEQ ID NO: 431750 - RNA, 32 nt, Human
gcacaaucauggcucacugcagucucugccuc

SEQ ID NO: 431751 - RNA, 24 nt, Human
gcacaaucgcucaugccuguaauc

SEQ ID NO: 431752 - RNA, 17 nt, Human
gcacaaucuagucggua

SEQ ID NO: 431753 - RNA, 32 nt, Human
gcacaaucucagcucacagcaaccucugccuc

SEQ ID NO: 431754 - RNA, 32 nt, Human
gcacaaucucagcucacugcaaccuccguuuc

SEQ ID NO: 431755 - RNA, 32 nt, Human
gcacaaucucagcucagugcaaccuccgccuc

SEQ ID NO: 431756 - RNA, 21 nt, Human
gcacaaucucggcucacugca

SEQ ID NO: 431757 - RNA, 32 nt, Human
gcacaaugacauuccaaccaccaccagccaga

SEQ ID NO: 431758 - RNA, 32 nt, Human
gcacaaugaccagcaggaggggagaagagagu

SEQ ID NO: 431759 - RNA, 32 nt, Human
gcacaaugaccggaggaggggccgcugugguc

SEQ ID NO: 431760 - RNA, 24 nt, Human
gcacaaugacucacgccuguaauc

SEQ ID NO: 431761 - RNA, 23 nt, Human
gcacaaugagcguguaugugcuu

SEQ ID NO: 431762 - RNA, 18 nt, Human
gcacaaugcuugccacca

SEQ ID NO: 431763 - RNA, 19 nt, Human
gcacaauggcaggguccug

SEQ ID NO: 431764 - RNA, 23 nt, Human
gcacaauggcucacaccuguaau

SEQ ID NO: 431765 - RNA, 24 nt, Human
gcacaauggcucaugccuauaauc

SEQ ID NO: 431766 - RNA, 24 nt, Human
gcacaauggcucaugccuguaauc

SEQ ID NO: 431767 - RNA, 24 nt, Human
gcacaauggcucgugcuuguaauc

SEQ ID NO: 431768 - RNA, 32 nt, Human
gcacaaugguuucaaagaaagacuguaagcuc

SEQ ID NO: 431769 - RNA, 32 nt, Human
gcacaaugucaugucugugauugccuucuuac

SEQ ID NO: 431770 - RNA, 32 nt, Human
gcacaauuauagcucacugcagccuggaacuc

SEQ ID NO: 431771 - RNA, 32 nt, Human
gcacaauucucccaguuaaggggcuggaagac

SEQ ID NO: 431772 - RNA, 32 nt, Human
gcacaauugcacuccagcccgagugacagaau

SEQ ID NO: 431773 - RNA, 32 nt, Human
gcacaauugcacuccagccuggcgacagagcg

SEQ ID NO: 431774 - RNA, 24 nt, Human
gcacacaaacuaugagcagaccac

SEQ ID NO: 431775 - RNA, 32 nt, Human
gcacacaaaguauauguauaauauugcaauau

SEQ ID NO: 431776 - RNA, 32 nt, Human
gcacacaaauggacuucucugaagcuguguuu

SEQ ID NO: 431777 - RNA, 32 nt, Human
gcacacaaauggccaggaggcccagugguggc

SEQ ID NO: 431778 - RNA, 32 nt, Human
gcacacaacugcacugaagccuuguuccucuc

SEQ ID NO: 431779 - RNA, 32 nt, Human
gcacacaacuugaaccuggcuuauuuucugca

SEQ ID NO: 431780 - RNA, 32 nt, Human
gcacacaauggguuuggagcugacugggaaca

SEQ ID NO: 431781 - RNA, 32 nt, Human
gcacacacaagaccgccaagcauuagauucuc

SEQ ID NO: 431782 - RNA, 32 nt, Human
gcacacacacaaagaugaccugggacaugauu

SEQ ID NO: 431783 - RNA, 32 nt, Human
gcacacacaggcccagccucugugcugucucc

SEQ ID NO: 431784 - RNA, 32 nt, Human
gcacacacaucucuggcucuccaggcuucgug

SEQ ID NO: 431785 - RNA, 32 nt, Human
gcacacacaucuucccuuccaaagggcuuuuu

SEQ ID NO: 431786 - RNA, 32 nt, Human
gcacacacauguaugcacacacacaugcaccg

SEQ ID NO: 431787 - RNA, 32 nt, Human
gcacacaccacacacauacacacacgcauuau

SEQ ID NO: 431788 - RNA, 32 nt, Human
gcacacacccccaucacauggaaugggcuggu

SEQ ID NO: 431789 - RNA, 32 nt, Human
gcacacacccugcaguggggcaauggccaauu

SEQ ID NO: 431790 - RNA, 32 nt, Human
gcacacaccuauaaucucagcacuuugggagg

SEQ ID NO: 431791 - RNA, 32 nt, Human
gcacacaccuguaaucccagcuacucuggagg

SEQ ID NO: 431792 - RNA, 32 nt, Human
gcacacaccuguaaucccagcuauuugggagg

SEQ ID NO: 431793 - RNA, 32 nt, Human
gcacacacgaugcacacgcaugcacacacgca

SEQ ID NO: 431794 - RNA, 32 nt, Human
gcacacacgcaugcacacacacaaagccuuaa

SEQ ID NO: 431795 - RNA, 32 nt, Human
gcacacacucaugcucacacacacagagauau

SEQ ID NO: 431796 - RNA, 22 nt, Human
gcacacacuuguagccccagcu

SEQ ID NO: 431797 - RNA, 22 nt, Human
gcacacacuuguaguccgagcu

SEQ ID NO: 431798 - RNA, 32 nt, Human
gcacacacuuguaguccgagcuacucgggagg

SEQ ID NO: 431799 - RNA, 32 nt, Human
gcacacagaaaacaggcucugccuucacaugu

SEQ ID NO: 431800 - RNA, 32 nt, Human
gcacacagacaggcagcauggcuagcaaacga

SEQ ID NO: 431801 - RNA, 31 nt, Human
gcacacagacagugcccuaggagggaaacag

SEQ ID NO: 431802 - RNA, 32 nt, Human
gcacacagagaagggaagaaggggccaucaca

SEQ ID NO: 431803 - RNA, 20 nt, Human
gcacacagaguugacccagc

SEQ ID NO: 431804 - RNA, 32 nt, Human
gcacacagaugccacccuacaagugccauugc

SEQ ID NO: 431805 - RNA, 20 nt, Human
gcacacagcaaugaagguag

SEQ ID NO: 431806 - RNA, 23 nt, Human
gcacacagcacgagcaaagccac

SEQ ID NO: 431807 - RNA, 32 nt, Human
gcacacagcagaauggguggucacaguguucu

SEQ ID NO: 431808 - RNA, 32 nt, Human
gcacacagcaugcacacacacgcacccuaccc

SEQ ID NO: 431809 - RNA, 32 nt, Human
gcacacagccaagggccuggaccauagaaaau

SEQ ID NO: 431810 - RNA, 32 nt, Human
gcacacagcucaccacgagggguuuccccaga

SEQ ID NO: 431811 - RNA, 32 nt, Human
gcacacagcugcagagacagagaggacguggg

SEQ ID NO: 431812 - RNA, 32 nt, Human
gcacacagcugcucagcaccauuucauucugg

SEQ ID NO: 431813 - RNA, 32 nt, Human
gcacacagcuggcacuggcacacaccuguccc

SEQ ID NO: 431814 - RNA, 32 nt, Human
gcacacaggagccaggaggagcccaacagagc

SEQ ID NO: 431815 - RNA, 29 nt, Human
gcacacaggcagcccggcccagugaaaaa

SEQ ID NO: 431816 - RNA, 32 nt, Human
gcacacagggcacgucuucgauucagagcugg

SEQ ID NO: 431817 - RNA, 32 nt, Human
gcacacagguguuggugauggggcuguugaga

SEQ ID NO: 431818 - RNA, 32 nt, Human
gcacacauacacaugcacacacacaugcacac

SEQ ID NO: 431819 - RNA, 32 nt, Human
gcacacauaccuguaaucccagcuacuuuggu

SEQ ID NO: 431820 - RNA, 32 nt, Human
gcacacaucucuagucccaauuacucaggagg

SEQ ID NO: 431821 - RNA, 32 nt, Human
gcacacaugcacacacgcacacacaugcacac

SEQ ID NO: 431822 - RNA, 32 nt, Human
gcacacaugggugggagggaagaggggcacau

SEQ ID NO: 431823 - RNA, 32 nt, Human
gcacaccaacugccaaguuauuaguuccuaaa

SEQ ID NO: 431824 - RNA, 32 nt, Human
gcacaccacagcugugguagagcuugguaaaa

SEQ ID NO: 431825 - RNA, 32 nt, Human
gcacaccaccaugcccggcaaauguuuguauu

SEQ ID NO: 431826 - RNA, 32 nt, Human
gcacaccacugcacuccagccugggcaacaaa

SEQ ID NO: 431827 - RNA, 19 nt, Human
gcacaccacuguccauuua

SEQ ID NO: 431828 - RNA, 32 nt, Human
gcacaccagccaagaugcucugcucacaguca

SEQ ID NO: 431829 - RNA, 32 nt, Human
gcacaccaggauagacaaggcaggggauacug

SEQ ID NO: 431830 - RNA, 32 nt, Human
gcacaccagggcccuaggaaagcagcaucagg

SEQ ID NO: 431831 - RNA, 20 nt, Human
gcacaccaguagucccagcu

SEQ ID NO: 431832 - RNA, 32 nt, Human
gcacaccaguagucccagcuacucaggaggcu

SEQ ID NO: 431833 - RNA, 32 nt, Human
gcacaccaguauucccagcuacucuggaggcu

SEQ ID NO: 431834 - RNA, 23 nt, Human
gcacaccaguguguuaggcacug

SEQ ID NO: 431835 - RNA, 32 nt, Human
gcacaccauccuggaugacagagcaagacucc

SEQ ID NO: 431836 - RNA, 32 nt, Human
gcacacccagaagucuuuggacccauuugguu

SEQ ID NO: 431837 - RNA, 32 nt, Human
gcacacccagcccagccccaaagagaaagaag

SEQ ID NO: 431838 - RNA, 22 nt, Human
gcacacccagcucccauggcgu

SEQ ID NO: 431839 - RNA, 32 nt, Human
gcacaccccaagagacaagaauguguaguuua

SEQ ID NO: 431840 - RNA, 32 nt, Human
gcacaccccaggagggugaguggccugaggua

SEQ ID NO: 431841 - RNA, 18 nt, Human
gcacacccuccagcacgc

SEQ ID NO: 431842 - RNA, 32 nt, Human
gcacacccucugccagcaccuacuggggaaag

SEQ ID NO: 431843 - RNA, 32 nt, Human
gcacacccugcagccaagggccaggaagugga

SEQ ID NO: 431844 - RNA, 32 nt, Human
gcacacccugcuuccaaaauggcccauguggu

SEQ ID NO: 431845 - RNA, 28 nt, Human
gcacaccgagcggcuccgucuucugcuc

SEQ ID NO: 431846 - RNA, 22 nt, Human
gcacaccguugagcacagcagc

SEQ ID NO: 431847 - RNA, 32 nt, Human
gcacaccuauaaucucagcuacucaggaggcu

SEQ ID NO: 431848 - RNA, 32 nt, Human
gcacaccuauagucgcagcuacuugggaggcu

SEQ ID NO: 431849 - RNA, 32 nt, Human
gcacaccuauagucucagcuacucagaggcug

SEQ ID NO: 431850 - RNA, 32 nt, Human
gcacaccuauguuccugccuuuauacuaccuc

SEQ ID NO: 431851 - RNA, 32 nt, Human
gcacaccucacaccaguuccuccugcugagca

SEQ ID NO: 431852 - RNA, 32 nt, Human
gcacaccucauuuuauugaaccuugcuuuaca

SEQ ID NO: 431853 - RNA, 21 nt, Human
gcacaccuccccaacagaagc

SEQ ID NO: 431854 - RNA, 22 nt, Human
gcacaccucccccagaggcugc

SEQ ID NO: 431855 - RNA, 32 nt, Human
gcacaccuccgcucuagggcauaguacaugcc

SEQ ID NO: 431856 - RNA, 32 nt, Human
gcacaccucuaagugcagcugugugucugguu

SEQ ID NO: 431857 - RNA, 32 nt, Human
gcacaccugaaaucccagcuacugaagaggcu

SEQ ID NO: 431858 - RNA, 32 nt, Human
gcacaccugaguacgugcacuuccuggugggu

SEQ ID NO: 431859 - RNA, 32 nt, Human
gcacaccugcauucccagcuacuugggagguu

SEQ ID NO: 431860 - RNA, 32 nt, Human
gcacaccugccgucuucacuuccccacaggcu

SEQ ID NO: 431861 - RNA, 32 nt, Human
gcacaccugccugccaucgcuguuccuucaac

SEQ ID NO: 431862 - RNA, 17 nt, Human
gcacaccuguaauccca

SEQ ID NO: 431863 - RNA, 32 nt, Human
gcacaccuguaaucccaaagugcugggauuac

SEQ ID NO: 431864 - RNA, 32 nt, Human
gcacaccuguaaucccagcuaccugggaggcu

SEQ ID NO: 431865 - RNA, 32 nt, Human
gcacaccuguaaucccagcuacuagggaggau

SEQ ID NO: 431866 - RNA, 32 nt, Human
gcacaccuguaaucccagcuacucaggaagcu

SEQ ID NO: 431867 - RNA, 32 nt, Human
gcacaccuguaaucccagcuacucaggaggcu

SEQ ID NO: 431868 - RNA, 32 nt, Human
gcacaccuguaaucccagcuacucgggaggcg

SEQ ID NO: 431869 - RNA, 32 nt, Human
gcacaccuguaaucccagcuacucgggaggcu

SEQ ID NO: 431870 - RNA, 32 nt, Human
gcacaccuguaaucccagcuacucugaagccu

SEQ ID NO: 431871 - RNA, 32 nt, Human
gcacaccuguaaucccagcuacucuggaggcu

SEQ ID NO: 431872 - RNA, 32 nt, Human
gcacaccuguaaucccagcuacuugggagacu

SEQ ID NO: 431873 - RNA, 32 nt, Human
gcacaccuguaaucccagcuacuugggaggcc

SEQ ID NO: 431874 - RNA, 32 nt, Human
gcacaccuguaaucccagcuacuugggaggcu

SEQ ID NO: 431875 - RNA, 32 nt, Human
gcacaccuguaaucccagcuauucaggagguu

SEQ ID NO: 431876 - RNA, 32 nt, Human
gcacaccuguaaucccagcuauucggcugagg

SEQ ID NO: 431877 - RNA, 32 nt, Human
gcacaccuguaaucccagguacucgggaggcu

SEQ ID NO: 431878 - RNA, 32 nt, Human
gcacaccuguaaucccaguuacucaggaggcu

SEQ ID NO: 431879 - RNA, 32 nt, Human
gcacaccuguaauccuagcuacucgggaggcu

SEQ ID NO: 431880 - RNA, 32 nt, Human
gcacaccuguaaucucagcuacucgggaggcu

SEQ ID NO: 431881 - RNA, 32 nt, Human
gcacaccuguaaucucagguacucaggaggcu

SEQ ID NO: 431882 - RNA, 20 nt, Human
gcacaccuguaauuccagcu

SEQ ID NO: 431883 - RNA, 32 nt, Human
gcacaccuguaauuccagcuacucgggaggcu

SEQ ID NO: 431884 - RNA, 32 nt, Human
gcacaccuguacccucugcccaccuugacugc

SEQ ID NO: 431885 - RNA, 32 nt, Human
gcacaccuguacucccagcuacucgggugguu

SEQ ID NO: 431886 - RNA, 22 nt, Human
gcacaccuguaguagucccagc

SEQ ID NO: 431887 - RNA, 20 nt, Human
gcacaccuguagucacagcu

SEQ ID NO: 431888 - RNA, 32 nt, Human
gcacaccuguagucacagcuacuccagaggcu

SEQ ID NO: 431889 - RNA, 17 nt, Human
gcacaccuguaguccca

SEQ ID NO: 431890 - RNA, 20 nt, Human
gcacaccuguagucccagcu

SEQ ID NO: 431891 - RNA, 32 nt, Human
gcacaccuguagucccagcuacuccggaggcu

SEQ ID NO: 431892 - RNA, 32 nt, Human
gcacaccuguagucccagcuacucggcaggcu

SEQ ID NO: 431893 - RNA, 32 nt, Human
gcacaccuguagucccagcuacucgggaggcu

SEQ ID NO: 431894 - RNA, 32 nt, Human
gcacaccuguagucccagcuacucuggaggcu

SEQ ID NO: 431895 - RNA, 32 nt, Human
gcacaccuguagucccagcuacugggaaagcu

SEQ ID NO: 431896 - RNA, 32 nt, Human
gcacaccuguagucccagcuacuggggaggcu

SEQ ID NO: 431897 - RNA, 32 nt, Human
gcacaccuguagucccagcuacuugggaggcu

SEQ ID NO: 431898 - RNA, 32 nt, Human
gcacaccuguagucccagcugcucaggaggcu

SEQ ID NO: 431899 - RNA, 20 nt, Human
gcacaccuguaguccuagcu

SEQ ID NO: 431900 - RNA, 32 nt, Human
gcacaccuguagucucagcuacucggaaggcu

SEQ ID NO: 431901 - RNA, 20 nt, Human
gcacaccuguagugccagcu

SEQ ID NO: 431902 - RNA, 20 nt, Human
gcacaccuguaguuccagcu

SEQ ID NO: 431903 - RNA, 20 nt, Human
gcacaccugugaucccagcu

SEQ ID NO: 431904 - RNA, 32 nt, Human
gcacaccugugaucccagcuacuugggaggcu

SEQ ID NO: 431905 - RNA, 20 nt, Human
gcacaccuguggccccagcu

SEQ ID NO: 431906 - RNA, 32 nt, Human
gcacaccuguguccaagaacucuaaccagugu

SEQ ID NO: 431907 - RNA, 32 nt, Human
gcacaccuguuauccuagcuacucaggaggcu

SEQ ID NO: 431908 - RNA, 20 nt, Human
gcacaccuguugucccagcu

SEQ ID NO: 431909 - RNA, 32 nt, Human
gcacaccuguugucccagcuauucaggaggcu

SEQ ID NO: 431910 - RNA, 32 nt, Human
gcacaccuuccuccacccuccacccugggcug

SEQ ID NO: 431911 - RNA, 32 nt, Human
gcacaccuucgcuucucucaccaggaacauuc

SEQ ID NO: 431912 - RNA, 32 nt, Human
gcacaccuucucccgggcacugaggcccaggg

SEQ ID NO: 431913 - RNA, 32 nt, Human
gcacaccuugccaaaugcauaugucuguugag

SEQ ID NO: 431914 - RNA, 32 nt, Human
gcacacgaagccgccugacggcacccagcgcu

SEQ ID NO: 431915 - RNA, 32 nt, Human
gcacacgaccaccacacgagcacgugccacgc

SEQ ID NO: 431916 - RNA, 32 nt, Human
gcacacgcacacacacgcacacuuacaauaag

SEQ ID NO: 431917 - RNA, 32 nt, Human
gcacacgcacacugaugcacacggaccuggac

SEQ ID NO: 431918 - RNA, 32 nt, Human
gcacacgccuguaaucacagcuacuugggagg

SEQ ID NO: 431919 - RNA, 19 nt, Human
gcacacgccuguaauccca

SEQ ID NO: 431920 - RNA, 22 nt, Human
gcacacgccuguaaucccagcu

SEQ ID NO: 431921 - RNA, 32 nt, Human
gcacacgccuguaaucccagcuacucgggaag

SEQ ID NO: 431922 - RNA, 32 nt, Human
gcacacgccuguaaucccagcuacucuggagg

SEQ ID NO: 431923 - RNA, 32 nt, Human
gcacacgccuguaaucccagcuacuugggagg

SEQ ID NO: 431924 - RNA, 32 nt, Human
gcacacgccuguaaucucagcuacucaggagg

SEQ ID NO: 431925 - RNA, 19 nt, Human
gcacacgccuguaauucca

SEQ ID NO: 431926 - RNA, 22 nt, Human
gcacacgccuguaauuccagcu

SEQ ID NO: 431927 - RNA, 22 nt, Human
gcacacgcucauaguucuagcu

SEQ ID NO: 431928 - RNA, 32 nt, Human
gcacacgcuccgcuccgggccugggugccuac

SEQ ID NO: 431929 - RNA, 32 nt, Human
gcacacgcuuguaaucuuagcuacuugggagg

SEQ ID NO: 431930 - RNA, 32 nt, Human
gcacacggcagggcccggcacccaugguugcg

SEQ ID NO: 431931 - RNA, 32 nt, Human
gcacacggcccugccccauccugggccauacc

SEQ ID NO: 431932 - RNA, 32 nt, Human
gcacacggcccugccccauccugggccuuacc

SEQ ID NO: 431933 - RNA, 32 nt, Human
gcacacggcccuucggagccugggcagccugg

SEQ ID NO: 431934 - RNA, 32 nt, Human
gcacacggcuguaaucccagcacuuugggagg

SEQ ID NO: 431935 - RNA, 18 nt, Human
gcacacgggaccaggcug

SEQ ID NO: 431936 - RNA, 32 nt, Human
gcacacgggagguggguucuugccuuguggca

SEQ ID NO: 431937 - RNA, 32 nt, Human
gcacacgggcuggggcucagcuccuuggagag

SEQ ID NO: 431938 - RNA, 32 nt, Human
gcacacguauaaucccagcuacuugagagaug

SEQ ID NO: 431939 - RNA, 32 nt, Human
gcacacgucuauaauuccagcuacucaggagg

SEQ ID NO: 431940 - RNA, 32 nt, Human
gcacacgugcucacucaggcccagcaaugacc

SEQ ID NO: 431941 - RNA, 32 nt, Human
gcacacguguaaucccagcuacucaggaggcu

SEQ ID NO: 431942 - RNA, 32 nt, Human
gcacacguucaucaagggugaagcauggucaa

SEQ ID NO: 431943 - RNA, 22 nt, Human
gcacacguugaaauuuucccca

SEQ ID NO: 431944 - RNA, 32 nt, Human
gcacacuaacacagccuucuguccucaauaac

SEQ ID NO: 431945 - RNA, 32 nt, Human
gcacacuagggagcaucucuguaaacacagug

SEQ ID NO: 431946 - RNA, 32 nt, Human
gcacacucagaagccuuugggaaggggugcua

SEQ ID NO: 431947 - RNA, 32 nt, Human
gcacacucagcccugucaguggggucuggcuu

SEQ ID NO: 431948 - RNA, 32 nt, Human
gcacacucagucaggaggcugcagucucccgu

SEQ ID NO: 431949 - RNA, 32 nt, Human
gcacacucauacacucacgcacucaacuugca

SEQ ID NO: 431950 - RNA, 32 nt, Human
gcacacuccccugcacuggaguccagucucuu

SEQ ID NO: 431951 - RNA, 32 nt, Human
gcacacuccuaaauugcuggaugacugaacuu

SEQ ID NO: 431952 - RNA, 32 nt, Human
gcacacuccucgcacuuccagccuuggagccc

SEQ ID NO: 431953 - RNA, 19 nt, Human
gcacacuccucguccacuu

SEQ ID NO: 431954 - RNA, 32 nt, Human
gcacacuccugcugcccccggacugcuucaga

SEQ ID NO: 431955 - RNA, 32 nt, Human
gcacacucuggucuuggaauuccauuugagga

SEQ ID NO: 431956 - RNA, 24 nt, Human
gcacacucuuguguuuuuugcuca

SEQ ID NO: 431957 - RNA, 32 nt, Human
gcacacucuuugacagcaugcuguuuugugga

SEQ ID NO: 431958 - RNA, 32 nt, Human
gcacacugaucaaccacugaacugccuucuuc

SEQ ID NO: 431959 - RNA, 32 nt, Human
gcacacugaugcacacggaccuggacacagac

SEQ ID NO: 431960 - RNA, 32 nt, Human
gcacacugcacuccagccugggugacuagcaa

SEQ ID NO: 431961 - RNA, 32 nt, Human
gcacacugcacuccauccugggcgacagucug

SEQ ID NO: 431962 - RNA, 32 nt, Human
gcacacugcagccuggaacuccugggaucagg

SEQ ID NO: 431963 - RNA, 32 nt, Human
gcacacugcaucucuccugugaguuggagacu

SEQ ID NO: 431964 - RNA, 23 nt, Human
gcacacugcccaggcccugggug

SEQ ID NO: 431965 - RNA, 32 nt, Human
gcacacugccccucucacacauguggggccgg

SEQ ID NO: 431966 - RNA, 32 nt, Human
gcacacugcucuggcccuuccccaggcccagg

SEQ ID NO: 431967 - RNA, 19 nt, Human
gcacacugcuuaucacuug

SEQ ID NO: 431968 - RNA, 21 nt, Human
gcacacugcuuggcuugggug

SEQ ID NO: 431969 - RNA, 16 nt, Human
gcacacuggaguccac

SEQ ID NO: 431970 - RNA, 32 nt, Human
gcacacuggggucugcacaaggcuuugucaac

SEQ ID NO: 431971 - RNA, 19 nt, Human
gcacacugucuggaacuua

SEQ ID NO: 431972 - RNA, 32 nt, Human
gcacacugugccccugaugaugugggagagga

SEQ ID NO: 431973 - RNA, 20 nt, Human
gcacacugugcucauggcgu

SEQ ID NO: 431974 - RNA, 19 nt, Human
gcacacuguggucccagcu

SEQ ID NO: 431975 - RNA, 32 nt, Human
gcacacuguggucccagcuacucgggaggcug

SEQ ID NO: 431976 - RNA, 19 nt, Human
gcacacuguugaguuuucu

SEQ ID NO: 431977 - RNA, 20 nt, Human
gcacacuguuuuugaacuug

SEQ ID NO: 431978 - RNA, 32 nt, Human
gcacacuuagggaagcuguucucuccagacag

SEQ ID NO: 431979 - RNA, 32 nt, Human
gcacacuucacaguaagacguugcagaggucu

SEQ ID NO: 431980 - RNA, 32 nt, Human
gcacacuucaguguuucucuccuguucaauaa

SEQ ID NO: 431981 - RNA, 32 nt, Human
gcacacuuggggccuugagcuccagggaguuc

SEQ ID NO: 431982 - RNA, 32 nt, Human
gcacacuuuccaggugucagcaggugugauca

SEQ ID NO: 431983 - RNA, 22 nt, Human
gcacacuuugugagaaccaaug

SEQ ID NO: 431984 - RNA, 32 nt, Human
gcacagaaagagccagauggaccugagugucg

SEQ ID NO: 431985 - RNA, 20 nt, Human
gcacagaaaggcacagggca

SEQ ID NO: 431986 - RNA, 19 nt, Human
gcacagaaaugcaaggucu

SEQ ID NO: 431987 - RNA, 22 nt, Human
gcacagaaccagcagagucucc

SEQ ID NO: 431988 - RNA, 32 nt, Human
gcacagaacucagcucaaggguucuggggaug

SEQ ID NO: 431989 - RNA, 32 nt, Human
gcacagaacucccuggaggguggagauggagc

SEQ ID NO: 431990 - RNA, 32 nt, Human
gcacagaacuuagcaacagcaugugaauugug

SEQ ID NO: 431991 - RNA, 20 nt, Human
gcacagaagaaaaguacaga

SEQ ID NO: 431992 - RNA, 20 nt, Human
gcacagaagacagugucuug

SEQ ID NO: 431993 - RNA, 32 nt, Human
gcacagaagaggagucaaguaauggagguccc

SEQ ID NO: 431994 - RNA, 32 nt, Human
gcacagaagaggccccugccacccuagggacg

SEQ ID NO: 431995 - RNA, 32 nt, Human
gcacagaagccgcgcccaccgccugccaguuc

SEQ ID NO: 431996 - RNA, 20 nt, Human
gcacagaagcgaauugaaga

SEQ ID NO: 431997 - RNA, 21 nt, Human
gcacagaagggaaaggucuca

SEQ ID NO: 431998 - RNA, 32 nt, Human
gcacagaaguuugcugcaucacuggugagcug

SEQ ID NO: 431999 - RNA, 22 nt, Human
gcacagaauaucaccauugcag

SEQ ID NO: 432000 - RNA, 32 nt, Human
gcacagaaugcuggagagaugcguccugguga

SEQ ID NO: 432001 - RNA, 19 nt, Human
gcacagaauuuggagucuu

SEQ ID NO: 432002 - RNA, 20 nt, Human
gcacagaauuuugcagaucu

SEQ ID NO: 432003 - RNA, 32 nt, Human
gcacagacaacucccucccugccuugcacaag

SEQ ID NO: 432004 - RNA, 32 nt, Human
gcacagacacuacagaccacagcauucagccc

SEQ ID NO: 432005 - RNA, 32 nt, Human
gcacagacagacccuguaaacaugucaggguu

SEQ ID NO: 432006 - RNA, 32 nt, Human
gcacagacaggaaccucagcagugacagaaga

SEQ ID NO: 432007 - RNA, 32 nt, Human
gcacagacgguggaucucugcccaguguggug

SEQ ID NO: 432008 - RNA, 32 nt, Human
gcacagacucaucgccucccacacgccugggc

SEQ ID NO: 432009 - RNA, 32 nt, Human
gcacagacugcuaaucuacaucuugcugcguu

SEQ ID NO: 432010 - RNA, 32 nt, Human
gcacagacugggagguuuaguggugcauuucu

SEQ ID NO: 432011 - RNA, 32 nt, Human
gcacagagaaaauuccccaguauuccaagccg

SEQ ID NO: 432012 - RNA, 32 nt, Human
gcacagagaaucaagagguggccuuugggcag

SEQ ID NO: 432013 - RNA, 23 nt, Human
gcacagagaccccccacuguguc

SEQ ID NO: 432014 - RNA, 32 nt, Human
gcacagagagagcugggaugaagaaugccuac

SEQ ID NO: 432015 - RNA, 32 nt, Human
gcacagagcaacauugggguaacaggaugggu

SEQ ID NO: 432016 - RNA, 32 nt, Human
gcacagagcaggaggggccugucuccugggag

SEQ ID NO: 432017 - RNA, 32 nt, Human
gcacagagcagggaaaggcagccccagaggau

SEQ ID NO: 432018 - RNA, 32 nt, Human
gcacagagcagggaaaggcagccccagaggga

SEQ ID NO: 432019 - RNA, 32 nt, Human
gcacagagccaagaggaggggcucuguguugg

SEQ ID NO: 432020 - RNA, 32 nt, Human
gcacagagcuauuucagccacaugaaaagcau

SEQ ID NO: 432021 - RNA, 32 nt, Human
gcacagagcucugcggagaccacgccgacauc

SEQ ID NO: 432022 - RNA, 21 nt, Human
gcacagagcugggaaggccuu

SEQ ID NO: 432023 - RNA, 32 nt, Human
gcacagagcugucagugguggagagugucuuc

SEQ ID NO: 432024 - RNA, 18 nt, Human
gcacagaggacccuguac

SEQ ID NO: 432025 - RNA, 32 nt, Human
gcacagaggagagagaucggggugagucgcca

SEQ ID NO: 432026 - RNA, 32 nt, Human
gcacagaggagaugggagccugccuggugagg

SEQ ID NO: 432027 - RNA, 32 nt, Human
gcacagaggauggcuuccccauugccuucugg

SEQ ID NO: 432028 - RNA, 32 nt, Human
gcacagaggauugccccuucucuuuucagagc

SEQ ID NO: 432029 - RNA, 18 nt, Human
gcacagaggcacagggca

SEQ ID NO: 432030 - RNA, 32 nt, Human
gcacagaggcagccuggcuuucccuggaggcc

SEQ ID NO: 432031 - RNA, 32 nt, Human
gcacagaggcuguagcccagaggacauauagu

SEQ ID NO: 432032 - RNA, 32 nt, Human
gcacagagggacccaaacccaaaaggcccaga

SEQ ID NO: 432033 - RNA, 32 nt, Human
gcacagagggcccaggaggagccucaggagcc

SEQ ID NO: 432034 - RNA, 32 nt, Human
gcacagagggcugcucacaagauggcuuuaga

SEQ ID NO: 432035 - RNA, 32 nt, Human
gcacagagggcuguggggaggaggcaggaauc

SEQ ID NO: 432036 - RNA, 20 nt, Human
gcacagagggucagguccug

SEQ ID NO: 432037 - RNA, 32 nt, Human
gcacagagggucagguccugucaagaggagcu

SEQ ID NO: 432038 - RNA, 19 nt, Human
gcacagagucaggaucuca

SEQ ID NO: 432039 - RNA, 32 nt, Human
gcacagauaugcugucuggacaugcacacacg

SEQ ID NO: 432040 - RNA, 32 nt, Human
gcacagauauuuccauuucuuccucacuauga

SEQ ID NO: 432041 - RNA, 32 nt, Human
gcacagaucuucucucagcaccacauggcagc

SEQ ID NO: 432042 - RNA, 32 nt, Human
gcacagaugaaacugagcugggacuggaaagg

SEQ ID NO: 432043 - RNA, 32 nt, Human
gcacagaugaacaccaugagcuugcuggaagg

SEQ ID NO: 432044 - RNA, 32 nt, Human
gcacagaugacaccucacugaccauucccacu

SEQ ID NO: 432045 - RNA, 18 nt, Human
gcacagaugaccaaaguc

SEQ ID NO: 432046 - RNA, 32 nt, Human
gcacagaugaucaacagaaaauccaagcagcu

SEQ ID NO: 432047 - RNA, 32 nt, Human
gcacagaugcaugcuacaacacgaaugaacuu

SEQ ID NO: 432048 - RNA, 32 nt, Human
gcacagaugccuauacauacauauacaaauaa

SEQ ID NO: 432049 - RNA, 18 nt, Human
gcacagaugcugccacca

SEQ ID NO: 432050 - RNA, 32 nt, Human
gcacagcaaugccauugcugccaugaccagca

SEQ ID NO: 432051 - RNA, 32 nt, Human
gcacagcaccuccagaacagugccccggauga

SEQ ID NO: 432052 - RNA, 32 nt, Human
gcacagcagaagccucacugggcugcuauguc

SEQ ID NO: 432053 - RNA, 32 nt, Human
gcacagcagaguucaggcagggcacagccagg

SEQ ID NO: 432054 - RNA, 21 nt, Human
gcacagcagcauccuuggcca

SEQ ID NO: 432055 - RNA, 32 nt, Human
gcacagcagccacuccaacaccagcuguaggu

SEQ ID NO: 432056 - RNA, 32 nt, Human
gcacagcagccacugcucguuguaaaugccaa

SEQ ID NO: 432057 - RNA, 24 nt, Human
gcacagcagcucacgccuguaauc

SEQ ID NO: 432058 - RNA, 24 nt, Human
gcacagcagcucaugccuguaauc

SEQ ID NO: 432059 - RNA, 32 nt, Human
gcacagcaggcagaaugagggccacaggcagg

SEQ ID NO: 432060 - RNA, 20 nt, Human
gcacagcaguaaacuauggg

SEQ ID NO: 432061 - RNA, 32 nt, Human
gcacagccaccagcaucucuccccucagcccu

SEQ ID NO: 432062 - RNA, 32 nt, Human
gcacagccacuuccugccuccugggacuccuc

SEQ ID NO: 432063 - RNA, 32 nt, Human
gcacagccagcccuucuuggguccccagucag

SEQ ID NO: 432064 - RNA, 18 nt, Human
gcacagccagcggccgcg

SEQ ID NO: 432065 - RNA, 32 nt, Human
gcacagccaggaaggcgagcgagcccagccag

SEQ ID NO: 432066 - RNA, 17 nt, Human
gcacagccaggacucca

SEQ ID NO: 432067 - RNA, 32 nt, Human
gcacagccagucccuggugaaggcuuaaagau

SEQ ID NO: 432068 - RNA, 32 nt, Human
gcacagccagugccaucagggagcugaagggg

SEQ ID NO: 432069 - RNA, 32 nt, Human
gcacagccccacugcuuccaaacucugccugu

SEQ ID NO: 432070 - RNA, 32 nt, Human
gcacagccccagcuaauuuucauauuuuuagu

SEQ ID NO: 432071 - RNA, 32 nt, Human
gcacagccccggggcuccacauugcuguacgc

SEQ ID NO: 432072 - RNA, 32 nt, Human
gcacagccccuggaagcaggcagaggaagaca

SEQ ID NO: 432073 - RNA, 32 nt, Human
gcacagcccugacuugaacucugggugacccu

SEQ ID NO: 432074 - RNA, 32 nt, Human
gcacagcccuugccuggagcccaggaacccca

SEQ ID NO: 432075 - RNA, 32 nt, Human
gcacagccuccccuccuauccauaucccccag

SEQ ID NO: 432076 - RNA, 20 nt, Human
gcacagccuccugccuccca

SEQ ID NO: 432077 - RNA, 32 nt, Human
gcacagccucuuucacucagaagcucaggucg

SEQ ID NO: 432078 - RNA, 32 nt, Human
gcacagccugcucucggggaccggggcgcugc

SEQ ID NO: 432079 - RNA, 17 nt, Human
gcacagccuggccacca

SEQ ID NO: 432080 - RNA, 32 nt, Human
gcacagccuggcccugaucuccgggcagccac

SEQ ID NO: 432081 - RNA, 32 nt, Human
gcacagcgaaccugggcuccugcccaggacag

SEQ ID NO: 432082 - RNA, 32 nt, Human
gcacagcggcuucuccuaacaucccccuggca

SEQ ID NO: 432083 - RNA, 32 nt, Human
gcacagcgguuccgccuguaaucccagcacuu

SEQ ID NO: 432084 - RNA, 32 nt, Human
gcacagcguuugcucuuagacucugaucugcu

SEQ ID NO: 432085 - RNA, 32 nt, Human
gcacagcuaaaggacacuaucucuacauagaa

SEQ ID NO: 432086 - RNA, 32 nt, Human
gcacagcuaagacugcaggcacgcgccauccu

SEQ ID NO: 432087 - RNA, 32 nt, Human
gcacagcuacacccugccuggccacauggggu

SEQ ID NO: 432088 - RNA, 19 nt, Human
gcacagcuacagccuggac

SEQ ID NO: 432089 - RNA, 32 nt, Human
gcacagcucccucucugggggcugagggaccc

SEQ ID NO: 432090 - RNA, 32 nt, Human
gcacagcuccuagucugcuuucaguuccaaaa

SEQ ID NO: 432091 - RNA, 26 nt, Human
gcacagcugaacaugccgcuguccga

SEQ ID NO: 432092 - RNA, 32 nt, Human
gcacagcugaggacccucagccccaggagaag

SEQ ID NO: 432093 - RNA, 32 nt, Human
gcacagcugagggagaggaagugagcgccacu

SEQ ID NO: 432094 - RNA, 19 nt, Human
gcacagcugcucugugacc

SEQ ID NO: 432095 - RNA, 32 nt, Human
gcacagcugcugcugacaggucuaccugaagu

SEQ ID NO: 432096 - RNA, 32 nt, Human
gcacagcuggacuguguggcuggggccugaca

SEQ ID NO: 432097 - RNA, 32 nt, Human
gcacagcuggccaaugaaaagcagaaguguau

SEQ ID NO: 432098 - RNA, 25 nt, Human
gcacagcugucugccaggcacucuc

SEQ ID NO: 432099 - RNA, 32 nt, Human
gcacagcugugaggacagacagaaggcaaagu

SEQ ID NO: 432100 - RNA, 32 nt, Human
gcacagcuguggguugcaggggagacagccag

SEQ ID NO: 432101 - RNA, 32 nt, Human
gcacagcuucagcuccgugcaggauggaugca

SEQ ID NO: 432102 - RNA, 18 nt, Human
gcacaggaaagaagggga

SEQ ID NO: 432103 - RNA, 17 nt, Human
gcacaggaagcaggucu

SEQ ID NO: 432104 - RNA, 32 nt, Human
gcacaggaagucugagugugaggggcucuuuu

SEQ ID NO: 432105 - RNA, 32 nt, Human
gcacaggacucuggguuccugcucuguucugg

SEQ ID NO: 432106 - RNA, 32 nt, Human
gcacaggacuggauaaauaauuaagaacagag

SEQ ID NO: 432107 - RNA, 32 nt, Human
gcacaggagacagcaguggcccagaggaagcc

SEQ ID NO: 432108 - RNA, 32 nt, Human
gcacaggagacggagguugcugugagcugaga

SEQ ID NO: 432109 - RNA, 32 nt, Human
gcacaggagagaaagaagaaguuguccacggg

SEQ ID NO: 432110 - RNA, 32 nt, Human
gcacaggagaucugcuggcucgggggaagggg

SEQ ID NO: 432111 - RNA, 32 nt, Human
gcacaggagccaggcugaguuuaauuaaagaa

SEQ ID NO: 432112 - RNA, 32 nt, Human
gcacaggaggauaccgcaucaccaccagcagc

SEQ ID NO: 432113 - RNA, 32 nt, Human
gcacaggaggcaggcauggcccugggcggggc

SEQ ID NO: 432114 - RNA, 32 nt, Human
gcacaggagggguggaggggaaaugagaguug

SEQ ID NO: 432115 - RNA, 22 nt, Human
gcacaggagguggcagcccuug

SEQ ID NO: 432116 - RNA, 32 nt, Human
gcacaggaguucaaggcuucagugagcuaugg

SEQ ID NO: 432117 - RNA, 21 nt, Human
gcacaggaguuccagaccagc

SEQ ID NO: 432118 - RNA, 32 nt, Human
gcacaggaguucgagaccagccuggacaacau

SEQ ID NO: 432119 - RNA, 32 nt, Human
gcacaggaguuggaggauacagugagccauga

SEQ ID NO: 432120 - RNA, 32 nt, Human
gcacaggauacagugggaaucuugagacucuu

SEQ ID NO: 432121 - RNA, 32 nt, Human
gcacaggauagaggcagagccacccacgccgc

SEQ ID NO: 432122 - RNA, 18 nt, Human
gcacaggaucacagagca

SEQ ID NO: 432123 - RNA, 32 nt, Human
gcacaggauccuucccuggaacaucagcaucc

SEQ ID NO: 432124 - RNA, 32 nt, Human
gcacaggauggaaacuucuauucccucucugg

SEQ ID NO: 432125 - RNA, 21 nt, Human
gcacaggauggggcaggcucu

SEQ ID NO: 432126 - RNA, 32 nt, Human
gcacaggcacacagcagagccguccacagacc

SEQ ID NO: 432127 - RNA, 32 nt, Human
gcacaggcacacagggcccggccacacccagc

SEQ ID NO: 432128 - RNA, 32 nt, Human
gcacaggcaggaaaacaugagccagcaacuga

SEQ ID NO: 432129 - RNA, 21 nt, Human
gcacaggcaggcccuugggug

SEQ ID NO: 432130 - RNA, 32 nt, Human
gcacaggcaguagggccacucacuuuggccau

SEQ ID NO: 432131 - RNA, 32 nt, Human
gcacaggccacaucugccccaagagcaugagc

SEQ ID NO: 432132 - RNA, 25 nt, Human
gcacaggccaggaggccacagugua

SEQ ID NO: 432133 - RNA, 32 nt, Human
gcacaggccccggaguggagggggcaggggag

SEQ ID NO: 432134 - RNA, 32 nt, Human
gcacaggccuggcccugcuccaggugcaggaa

SEQ ID NO: 432135 - RNA, 20 nt, Human
gcacaggcggagugcagcgg

SEQ ID NO: 432136 - RNA, 32 nt, Human
gcacaggcuccuggagggcugccugggggagg

SEQ ID NO: 432137 - RNA, 32 nt, Human
gcacaggcugugagccagggugcugggaaacu

SEQ ID NO: 432138 - RNA, 32 nt, Human
gcacaggcugugcacagccuugcagaugauaa

SEQ ID NO: 432139 - RNA, 22 nt, Human
gcacaggcuuggagugcagugg

SEQ ID NO: 432140 - RNA, 21 nt, Human
gcacagggaaggcuugaggug

SEQ ID NO: 432141 - RNA, 32 nt, Human
gcacagggacagcaugucuccagccagcgcca

SEQ ID NO: 432142 - RNA, 32 nt, Human
gcacagggaggaacuuguccauuaguuuggaa

SEQ ID NO: 432143 - RNA, 21 nt, Human
gcacagggcacagcucuuagg

SEQ ID NO: 432144 - RNA, 32 nt, Human
gcacagggcacuguucacagacugccuuugcu

SEQ ID NO: 432145 - RNA, 32 nt, Human
gcacagggccacuguccuccaggcaggcuuuu

SEQ ID NO: 432146 - RNA, 32 nt, Human
gcacagggcccuccccuccagcccccaguggg

SEQ ID NO: 432147 - RNA, 23 nt, Human
gcacagggccuggcaggguccug

SEQ ID NO: 432148 - RNA, 32 nt, Human
gcacagggcugcacagagugacuuugggacag

SEQ ID NO: 432149 - RNA, 32 nt, Human
gcacagggcugcagaaaauaaaccuccagauu

SEQ ID NO: 432150 - RNA, 32 nt, Human
gcacagggcuuuguuagcagagagaagccccu

SEQ ID NO: 432151 - RNA, 21 nt, Human
gcacaggggacugcaguggug

SEQ ID NO: 432152 - RNA, 22 nt, Human
gcacaggggaggcagguccuug

SEQ ID NO: 432153 - RNA, 32 nt, Human
gcacaggggcagccgcagggaggcagggaugg

SEQ ID NO: 432154 - RNA, 32 nt, Human
gcacaggggcccugaauuuaugugguuuuuau

SEQ ID NO: 432155 - RNA, 32 nt, Human
gcacaggggcucugagcuccugaccugaguca

SEQ ID NO: 432156 - RNA, 32 nt, Human
gcacaggggcuuguuucauugguacaagaaua

SEQ ID NO: 432157 - RNA, 18 nt, Human
gcacagggggccuccagg

SEQ ID NO: 432158 - RNA, 32 nt, Human
gcacagggguaaucccagcacuuggggaggcu

SEQ ID NO: 432159 - RNA, 23 nt, Human
gcacaggggucacaccuguaauc

SEQ ID NO: 432160 - RNA, 32 nt, Human
gcacaggggucacaccuguaaucccagcacuu

SEQ ID NO: 432161 - RNA, 32 nt, Human
gcacaggggugugcacaaagaaaaugacauga

SEQ ID NO: 432162 - RNA, 32 nt, Human
gcacaggguccccgagugccuagguuuuggag

SEQ ID NO: 432163 - RNA, 19 nt, Human
gcacagggugcaggcauug

SEQ ID NO: 432164 - RNA, 32 nt, Human
gcacagguacagcuuggcuucucagcuuugcu

SEQ ID NO: 432165 - RNA, 32 nt, Human
gcacagguauagaacauuuccaucaacacgga

SEQ ID NO: 432166 - RNA, 32 nt, Human
gcacaggucccaccuccagcccggggagccua

SEQ ID NO: 432167 - RNA, 32 nt, Human
gcacaggugagggagagcaggcuggcuuagag

SEQ ID NO: 432168 - RNA, 32 nt, Human
gcacagguggcugaggggacccgccugggacg

SEQ ID NO: 432169 - RNA, 32 nt, Human
gcacaggugugcauugaggaaggggccccagg

SEQ ID NO: 432170 - RNA, 32 nt, Human
gcacagguuaggcaagcgauuagaagauuugc

SEQ ID NO: 432171 - RNA, 32 nt, Human
gcacagguuccagugggccaagguugugccac

SEQ ID NO: 432172 - RNA, 21 nt, Human
gcacaguaaucccagcaccca

SEQ ID NO: 432173 - RNA, 24 nt, Human
gcacaguagcucacaccuauaauc

SEQ ID NO: 432174 - RNA, 24 nt, Human
gcacaguagcucacaccugaaauc

SEQ ID NO: 432175 - RNA, 24 nt, Human
gcacaguagcucacgccuguauuc

SEQ ID NO: 432176 - RNA, 24 nt, Human
gcacaguagcucaugccuguaauc

SEQ ID NO: 432177 - RNA, 24 nt, Human
gcacaguagcuuauaccuguaauc

SEQ ID NO: 432178 - RNA, 21 nt, Human
gcacaguaggggcacaaggca

SEQ ID NO: 432179 - RNA, 32 nt, Human
gcacaguagugcgggccugggcccugcuccac

SEQ ID NO: 432180 - RNA, 25 nt, Human
gcacaguagugcugaauuuuccuca

SEQ ID NO: 432181 - RNA, 23 nt, Human
gcacaguaguuuacccuguuauc

SEQ ID NO: 432182 - RNA, 32 nt, Human
gcacagucacucuggugacugccugcgggcag

SEQ ID NO: 432183 - RNA, 32 nt, Human
gcacagucagggccaagagagcagugaccacu

SEQ ID NO: 432184 - RNA, 31 nt, Human
gcacagucaggggcugagguuggaggaggaa

SEQ ID NO: 432185 - RNA, 18 nt, Human
gcacagucauacaaguca

SEQ ID NO: 432186 - RNA, 32 nt, Human
gcacaguccagaaauggagacaucccaccccc

SEQ ID NO: 432187 - RNA, 21 nt, Human
gcacaguccagacccaaguca

SEQ ID NO: 432188 - RNA, 20 nt, Human
gcacaguccaugcagaggca

SEQ ID NO: 432189 - RNA, 19 nt, Human
gcacaguccugggaaaggc

SEQ ID NO: 432190 - RNA, 24 nt, Human
gcacagucgcucacaccuguaauc

SEQ ID NO: 432191 - RNA, 32 nt, Human
gcacagucggagacaaagggaggcgagggcca

SEQ ID NO: 432192 - RNA, 17 nt, Human
gcacagucuaguuuaag

SEQ ID NO: 432193 - RNA, 21 nt, Human
gcacagucucaccucauugca

SEQ ID NO: 432194 - RNA, 32 nt, Human
gcacagucucuacucaggaggcugaggcagua

SEQ ID NO: 432195 - RNA, 32 nt, Human
gcacagucucuccugcugggggcuuucugucg

SEQ ID NO: 432196 - RNA, 18 nt, Human
gcacagucugagcugcuc

SEQ ID NO: 432197 - RNA, 32 nt, Human
gcacagucugcagcuuccugaguccuguucug

SEQ ID NO: 432198 - RNA, 16 nt, Human
gcacagucugggaagg

SEQ ID NO: 432199 - RNA, 32 nt, Human
gcacagucugugcacacauacucucaggucac

SEQ ID NO: 432200 - RNA, 24 nt, Human
gcacagugaccaaaucugacaauc

SEQ ID NO: 432201 - RNA, 24 nt, Human
gcacagugacucacaccuguaauc

SEQ ID NO: 432202 - RNA, 22 nt, Human
gcacagugacucacgccuguaa

SEQ ID NO: 432203 - RNA, 24 nt, Human
gcacagugacucacgccuguaauc

SEQ ID NO: 432204 - RNA, 24 nt, Human
gcacagugacucacuccuguaguc

SEQ ID NO: 432205 - RNA, 24 nt, Human
gcacagugacucaugccuguaauc

SEQ ID NO: 432206 - RNA, 32 nt, Human
gcacagugccagcggaggcugcacugagccuu

SEQ ID NO: 432207 - RNA, 24 nt, Human
gcacaguggcacacaccuguaguc

SEQ ID NO: 432208 - RNA, 24 nt, Human
gcacaguggcacaugccuguaauc

SEQ ID NO: 432209 - RNA, 24 nt, Human
gcacaguggcaugcgccugugauc

SEQ ID NO: 432210 - RNA, 24 nt, Human
gcacaguggcccaugccuauaauc

SEQ ID NO: 432211 - RNA, 24 nt, Human
gcacaguggcgcaugccuguaauc

SEQ ID NO: 432212 - RNA, 32 nt, Human
gcacaguggcuacgccuguaaucccagcacuu

SEQ ID NO: 432213 - RNA, 24 nt, Human
gcacaguggcucacacccauaauc

SEQ ID NO: 432214 - RNA, 22 nt, Human
gcacaguggcucacaccuaauc

SEQ ID NO: 432215 - RNA, 24 nt, Human
gcacaguggcucacaccuacgauc

SEQ ID NO: 432216 - RNA, 24 nt, Human
gcacaguggcucacaccugcaauc

SEQ ID NO: 432217 - RNA, 22 nt, Human
gcacaguggcucacaccuguaa

SEQ ID NO: 432218 - RNA, 24 nt, Human
gcacaguggcucacaccuguaauc

SEQ ID NO: 432219 - RNA, 32 nt, Human
gcacaguggcucacacuguaauccccacugga

SEQ ID NO: 432220 - RNA, 24 nt, Human
gcacaguggcucacgacuguaauu

SEQ ID NO: 432221 - RNA, 24 nt, Human
gcacaguggcucacgccaguaauc

SEQ ID NO: 432222 - RNA, 23 nt, Human
gcacaguggcucacgccuguaau

SEQ ID NO: 432223 - RNA, 24 nt, Human
gcacaguggcucacgccuguaauc

SEQ ID NO: 432224 - RNA, 24 nt, Human
gcacaguggcucacgccuguaguc

SEQ ID NO: 432225 - RNA, 24 nt, Human
gcacaguggcucacgcuuacaguc

SEQ ID NO: 432226 - RNA, 32 nt, Human
gcacaguggcucacgcuuacagucccagcacu

SEQ ID NO: 432227 - RNA, 24 nt, Human
gcacaguggcucacgcuuguaauc

SEQ ID NO: 432228 - RNA, 23 nt, Human
gcacaguggcucauaccuguaau

SEQ ID NO: 432229 - RNA, 24 nt, Human
gcacaguggcucauaccuguaauc

SEQ ID NO: 432230 - RNA, 24 nt, Human
gcacaguggcucaucccuguaauu

SEQ ID NO: 432231 - RNA, 24 nt, Human
gcacaguggcucaugcccguaauu

SEQ ID NO: 432232 - RNA, 24 nt, Human
gcacaguggcucaugccgauaauc

SEQ ID NO: 432233 - RNA, 24 nt, Human
gcacaguggcucaugccuauaauc

SEQ ID NO: 432234 - RNA, 24 nt, Human
gcacaguggcucaugccuauaauu

SEQ ID NO: 432235 - RNA, 24 nt, Human
gcacaguggcucaugccugaaauc

SEQ ID NO: 432236 - RNA, 24 nt, Human
gcacaguggcucaugccuguaauc

SEQ ID NO: 432237 - RNA, 24 nt, Human
gcacaguggcucaugccuguaauu

SEQ ID NO: 432238 - RNA, 24 nt, Human
gcacaguggcucaugucugcaauc

SEQ ID NO: 432239 - RNA, 24 nt, Human
gcacaguggcucccaccuauaauc

SEQ ID NO: 432240 - RNA, 24 nt, Human
gcacaguggcucccgccuguaauc

SEQ ID NO: 432241 - RNA, 24 nt, Human
gcacaguggcucuugucuguaauc

SEQ ID NO: 432242 - RNA, 24 nt, Human
gcacaguggcuuacaccuguaauc

SEQ ID NO: 432243 - RNA, 24 nt, Human
gcacaguggcuuacgccuguaauc

SEQ ID NO: 432244 - RNA, 23 nt, Human
gcacaguggcuuaugcccauaau

SEQ ID NO: 432245 - RNA, 24 nt, Human
gcacaguggcuuauuccuguaauc

SEQ ID NO: 432246 - RNA, 24 nt, Human
gcacaguggcuugcaccuguaauc

SEQ ID NO: 432247 - RNA, 24 nt, Human
gcacaguggcuugugccuguaauc

SEQ ID NO: 432248 - RNA, 24 nt, Human
gcacaguggcuuuugccuguaauc

SEQ ID NO: 432249 - RNA, 24 nt, Human
gcacagugguucacaccuguaauc

SEQ ID NO: 432250 - RNA, 24 nt, Human
gcacagugguucacgccuguaauc

SEQ ID NO: 432251 - RNA, 24 nt, Human
gcacagugguucauaccuauaguc

SEQ ID NO: 432252 - RNA, 24 nt, Human
gcacagugguuuauagcuguaauc

SEQ ID NO: 432253 - RNA, 32 nt, Human
gcacagugugagcccgcccccacgucgugggg

SEQ ID NO: 432254 - RNA, 32 nt, Human
gcacagugugggcaaccggacaggauggauuu

SEQ ID NO: 432255 - RNA, 32 nt, Human
gcacaguguuagugggaccugggggcaagucc

SEQ ID NO: 432256 - RNA, 32 nt, Human
gcacaguguuugacaggaguggaaaagcgguu

SEQ ID NO: 432257 - RNA, 32 nt, Human
gcacaguuauggggaggacucccacugcugug

SEQ ID NO: 432258 - RNA, 32 nt, Human
gcacaguugauuuucgguguguuccuguauaa

SEQ ID NO: 432259 - RNA, 20 nt, Human
gcacaguugcaaccaaggca

SEQ ID NO: 432260 - RNA, 32 nt, Human
gcacaguuuaacuccacccucauuuaaacuuc

SEQ ID NO: 432261 - RNA, 18 nt, Human
gcacaguuuccacaagca

SEQ ID NO: 432262 - RNA, 32 nt, Human
gcacaguuugguuuuugcacaaaagucauuua

SEQ ID NO: 432263 - RNA, 32 nt, Human
gcacauaacauguuggaagaugagcaccugcu

SEQ ID NO: 432264 - RNA, 32 nt, Human
gcacauacaagaaacauacaguguaccucaaa

SEQ ID NO: 432265 - RNA, 24 nt, Human
gcacauacacacaugcacauaugu

SEQ ID NO: 432266 - RNA, 32 nt, Human
gcacauacacauauacauacauacacacauac

SEQ ID NO: 432267 - RNA, 32 nt, Human
gcacauacagaccucagaucuuacuugguagu

SEQ ID NO: 432268 - RNA, 32 nt, Human
gcacauacagccgcuuccuggaagccgccugg

SEQ ID NO: 432269 - RNA, 23 nt, Human
gcacauacauacaaacacaugca

SEQ ID NO: 432270 - RNA, 24 nt, Human
gcacauacauacacagaaugcagu

SEQ ID NO: 432271 - RNA, 18 nt, Human
gcacauacccaguccuua

SEQ ID NO: 432272 - RNA, 19 nt, Human
gcacauaccuguaauccca

SEQ ID NO: 432273 - RNA, 22 nt, Human
gcacauaccuguaaucccagcu

SEQ ID NO: 432274 - RNA, 26 nt, Human
gcacauagauucacugaaccauguuc

SEQ ID NO: 432275 - RNA, 32 nt, Human
gcacauagcuaaaucacaaaacauccaauuuc

SEQ ID NO: 432276 - RNA, 32 nt, Human
gcacauauauaagaaugcuucauuaauaagua

SEQ ID NO: 432277 - RNA, 32 nt, Human
gcacauaugaccaugauguucagggcuuuaua

SEQ ID NO: 432278 - RNA, 32 nt, Human
gcacauauuuucuguuuggaaacacacuguug

SEQ ID NO: 432279 - RNA, 32 nt, Human
gcacaucacaccauuuccuguuucuuuauaac

SEQ ID NO: 432280 - RNA, 32 nt, Human
gcacaucacagaaaauccucaaaccacaggga

SEQ ID NO: 432281 - RNA, 32 nt, Human
gcacaucacaugacaaaagcaggaacaagacu

SEQ ID NO: 432282 - RNA, 32 nt, Human
gcacaucaggcagagcaggccacgggcaggga

SEQ ID NO: 432283 - RNA, 23 nt, Human
gcacaucagggaggccacugcgg

SEQ ID NO: 432284 - RNA, 23 nt, Human
gcacaucagucauaugcccagug

SEQ ID NO: 432285 - RNA, 23 nt, Human
gcacaucaucagauuccacauca

SEQ ID NO: 432286 - RNA, 32 nt, Human
gcacauccagaaucaccugaggaacuucaaaa

SEQ ID NO: 432287 - RNA, 32 nt, Human
gcacauccaggauuuccgccacccugaauuua

SEQ ID NO: 432288 - RNA, 32 nt, Human
gcacaucccaucucaggcagcaagacaaucuu

SEQ ID NO: 432289 - RNA, 32 nt, Human
gcacaucccauucaggcagaggccaguacaga

SEQ ID NO: 432290 - RNA, 22 nt, Human
gcacaucccuguaauuccagcu

SEQ ID NO: 432291 - RNA, 32 nt, Human
gcacaucccuuuccuuacuuugcccugugcua

SEQ ID NO: 432292 - RNA, 32 nt, Human
gcacaucuacacacaaacaaacaaugcauagg

SEQ ID NO: 432293 - RNA, 32 nt, Human
gcacaucuauaaucccaguuacccgggagccu

SEQ ID NO: 432294 - RNA, 32 nt, Human
gcacaucuccagaaaaaugaaaagcaauacaa

SEQ ID NO: 432295 - RNA, 32 nt, Human
gcacaucuccaucucuuccaccucaggcagug

SEQ ID NO: 432296 - RNA, 19 nt, Human
gcacaucucccuugcccuu

SEQ ID NO: 432297 - RNA, 32 nt, Human
gcacaucuguaagggggaaaaacaguauauca

SEQ ID NO: 432298 - RNA, 32 nt, Human
gcacaucuguaaucccagcuacucaggaggcu

SEQ ID NO: 432299 - RNA, 32 nt, Human
gcacaucuguaaucccagcuacucgggaggcu

SEQ ID NO: 432300 - RNA, 32 nt, Human
gcacaucuguaaucccaguuacuugggaggcc

SEQ ID NO: 432301 - RNA, 20 nt, Human
gcacaucuguggucccagcu

SEQ ID NO: 432302 - RNA, 32 nt, Human
gcacaucuguggucccagcuacuggggaggcu

SEQ ID NO: 432303 - RNA, 32 nt, Human
gcacaucuguggucccagcuacuugagaggcu

SEQ ID NO: 432304 - RNA, 32 nt, Human
gcacaucuguggucccagcugcuggggaggcu

SEQ ID NO: 432305 - RNA, 32 nt, Human
gcacaugaacagcuugccagggaugggcagcc

SEQ ID NO: 432306 - RNA, 32 nt, Human
gcacaugaagccaccaguuucauuccaaagug

SEQ ID NO: 432307 - RNA, 32 nt, Human
gcacaugacagcaacuccccgaagccuucccu

SEQ ID NO: 432308 - RNA, 32 nt, Human
gcacaugacauauacaugguggcagguccuag

SEQ ID NO: 432309 - RNA, 19 nt, Human
gcacaugaggcagguccug

SEQ ID NO: 432310 - RNA, 32 nt, Human
gcacaugaggcugaggcugaggggcagucacc

SEQ ID NO: 432311 - RNA, 32 nt, Human
gcacaugcacacagcaugcacacacacgcacc

SEQ ID NO: 432312 - RNA, 32 nt, Human
gcacaugcacacauacacaugcaugcacacau

SEQ ID NO: 432313 - RNA, 32 nt, Human
gcacaugcaccuguaaucccagcuacucagga

SEQ ID NO: 432314 - RNA, 32 nt, Human
gcacaugcacgugugugcacguacacacacau

SEQ ID NO: 432315 - RNA, 32 nt, Human
gcacaugcagugagccugugucucugaggccg

SEQ ID NO: 432316 - RNA, 32 nt, Human
gcacaugccaggcuaauuuuuguauuuuuagu

SEQ ID NO: 432317 - RNA, 32 nt, Human
gcacaugccuauaaucccagcacuuugggagg

SEQ ID NO: 432318 - RNA, 32 nt, Human
gcacaugccucgcguucuucccagaaagucag

SEQ ID NO: 432319 - RNA, 32 nt, Human
gcacaugccuguaacccagcuacucgggaggc

SEQ ID NO: 432320 - RNA, 32 nt, Human
gcacaugccuguaacuccagcuacuugggagg

SEQ ID NO: 432321 - RNA, 32 nt, Human
gcacaugccuguaaucccagcacuuugggaag

SEQ ID NO: 432322 - RNA, 32 nt, Human
gcacaugccuguaaucccagcacuuugggagg

SEQ ID NO: 432323 - RNA, 32 nt, Human
gcacaugccuguaaucccagcacuuugggggu

SEQ ID NO: 432324 - RNA, 27 nt, Human
gcacaugccuguaaucccagcuacuca

SEQ ID NO: 432325 - RNA, 32 nt, Human
gcacaugccuguaaucccagcuacucggaggc

SEQ ID NO: 432326 - RNA, 32 nt, Human
gcacaugccuguaaucccagcuacucgggagg

SEQ ID NO: 432327 - RNA, 32 nt, Human
gcacaugccuguaaucccagcuacuuggcagg

SEQ ID NO: 432328 - RNA, 32 nt, Human
gcacaugccuguaaucccagcuacuugggagg

SEQ ID NO: 432329 - RNA, 32 nt, Human
gcacaugccuguaauccgagugcuuugggagg

SEQ ID NO: 432330 - RNA, 32 nt, Human
gcacaugccuguaauccuagcacuuugggagg

SEQ ID NO: 432331 - RNA, 32 nt, Human
gcacaugccuguaauccuagcuacucgggagg

SEQ ID NO: 432332 - RNA, 32 nt, Human
gcacaugccuguaaucucagcgacuugggagg

SEQ ID NO: 432333 - RNA, 32 nt, Human
gcacaugccuguaaucucagcuacuagagagg

SEQ ID NO: 432334 - RNA, 32 nt, Human
gcacaugccuguaaucucagcuacucaggagg

SEQ ID NO: 432335 - RNA, 32 nt, Human
gcacaugccuguaaucucagcuacuugggagg

SEQ ID NO: 432336 - RNA, 32 nt, Human
gcacaugccuguaaugccagcuacucgggagg

SEQ ID NO: 432337 - RNA, 32 nt, Human
gcacaugccuguagucccaccuuugagcggcu

SEQ ID NO: 432338 - RNA, 32 nt, Human
gcacaugccuguagucccagcuacucgggagg

SEQ ID NO: 432339 - RNA, 32 nt, Human
gcacaugccuguagucccagcuacuggggagg

SEQ ID NO: 432340 - RNA, 32 nt, Human
gcacaugccuguagucccagcuacuugagagg

SEQ ID NO: 432341 - RNA, 32 nt, Human
gcacaugccugugaucccagcacuuugggaug

SEQ ID NO: 432342 - RNA, 32 nt, Human
gcacaugcucuuucugcuuucucuguacugua

SEQ ID NO: 432343 - RNA, 32 nt, Human
gcacaugcugcccagcuguccaugccuucaga

SEQ ID NO: 432344 - RNA, 32 nt, Human
gcacaugcugguaaucucagcuauugaggagg

SEQ ID NO: 432345 - RNA, 32 nt, Human
gcacaugcuucaauaguucaaggaacuugaaa

SEQ ID NO: 432346 - RNA, 23 nt, Human
gcacaugcuucugucuccuccuc

SEQ ID NO: 432347 - RNA, 32 nt, Human
gcacaugcuuguaaucccagcuacucgggagc

SEQ ID NO: 432348 - RNA, 32 nt, Human
gcacaugcuuguaaucccagcuacucgggagg

SEQ ID NO: 432349 - RNA, 32 nt, Human
gcacauggagguggacuggcuacaggagaaag

SEQ ID NO: 432350 - RNA, 32 nt, Human
gcacauggagugagcugggggacggggacuaa

SEQ ID NO: 432351 - RNA, 32 nt, Human
gcacauggagugccuguacaagcugauguuuu

SEQ ID NO: 432352 - RNA, 32 nt, Human
gcacauggauuuucccuuuuguuuucaguguu

SEQ ID NO: 432353 - RNA, 32 nt, Human
gcacauggccacucuuggccuaauaaaggagg

SEQ ID NO: 432354 - RNA, 32 nt, Human
gcacauggcccuuagacugagauucagagaua

SEQ ID NO: 432355 - RNA, 32 nt, Human
gcacaugggacuguguagagcuugguuaucgg

SEQ ID NO: 432356 - RNA, 32 nt, Human
gcacaugggauaagccaaggcuugccuucagg

SEQ ID NO: 432357 - RNA, 32 nt, Human
gcacauggggagcuggcagucaguaaaggaga

SEQ ID NO: 432358 - RNA, 32 nt, Human
gcacaugggugagcuccgugaguccagacaug

SEQ ID NO: 432359 - RNA, 26 nt, Human
gcacauguagucugugugccugguca

SEQ ID NO: 432360 - RNA, 32 nt, Human
gcacaugucaccccugcacuccugccuucccg

SEQ ID NO: 432361 - RNA, 32 nt, Human
gcacaugucuauaauuccagcuacucaggagg

SEQ ID NO: 432362 - RNA, 32 nt, Human
gcacaugucuguaaucccagcuacucgggagg

SEQ ID NO: 432363 - RNA, 32 nt, Human
gcacaugucuguaauccuagcacuuugggagg

SEQ ID NO: 432364 - RNA, 32 nt, Human
gcacauguggcucugugggugucuccuagaga

SEQ ID NO: 432365 - RNA, 32 nt, Human
gcacauguguguguuuuccaugaggcacugcu

SEQ ID NO: 432366 - RNA, 32 nt, Human
gcacauguuccaaggcuacgcgcuccccuuuc

SEQ ID NO: 432367 - RNA, 26 nt, Human
gcacauguuggcgcacaccugcaauc

SEQ ID NO: 432368 - RNA, 32 nt, Human
gcacauuaacuggaaaagauguuaacaguaaa

SEQ ID NO: 432369 - RNA, 32 nt, Human
gcacauucaaucugaaggugacccuggccugg

SEQ ID NO: 432370 - RNA, 32 nt, Human
gcacauucaguguggcuaugaagagcgaaucc

SEQ ID NO: 432371 - RNA, 32 nt, Human
gcacauuccaaacuuuagcaacaguuaucaca

SEQ ID NO: 432372 - RNA, 32 nt, Human
gcacauuccacccuagaaaugguucagaaacu

SEQ ID NO: 432373 - RNA, 32 nt, Human
gcacauuccauggaggaaggaguccugcuuug

SEQ ID NO: 432374 - RNA, 32 nt, Human
gcacauucucaagcuaguaucauuucaagaag

SEQ ID NO: 432375 - RNA, 18 nt, Human
gcacauucugauguggug

SEQ ID NO: 432376 - RNA, 32 nt, Human
gcacauucuuaucuaccaacauauacagcagu

SEQ ID NO: 432377 - RNA, 22 nt, Human
gcacauugcagccccaacggug

SEQ ID NO: 432378 - RNA, 32 nt, Human
gcacauuguggguggagagcgggaaagagagg

SEQ ID NO: 432379 - RNA, 32 nt, Human
gcacauuguuccccucacccacgccuccccag

SEQ ID NO: 432380 - RNA, 32 nt, Human
gcacauuuauuuccucccucuaccccaauuuc

SEQ ID NO: 432381 - RNA, 31 nt, Human
gcacauuucaauaaaauuguuuggaaaauaa

SEQ ID NO: 432382 - RNA, 32 nt, Human
gcacauuugagaccaaggauagagauugggaa

SEQ ID NO: 432383 - RNA, 32 nt, Human
gcacauuugaguacauuugaaaaguagaaaaa

SEQ ID NO: 432384 - RNA, 18 nt, Human
gcacauuugccuaccacc

SEQ ID NO: 432385 - RNA, 24 nt, Human
gcacauuugcucaugccuguaauc

SEQ ID NO: 432386 - RNA, 32 nt, Human
gcaccaaaacuuggcagcugugccagaaacca

SEQ ID NO: 432387 - RNA, 32 nt, Human
gcaccaaacagcccugugacaucugcauucac

SEQ ID NO: 432388 - RNA, 32 nt, Human
gcaccaaaccacugccccucggagccugguag

SEQ ID NO: 432389 - RNA, 17 nt, Human
gcaccaaacugucacca

SEQ ID NO: 432390 - RNA, 32 nt, Human
gcaccaaagcuccccaccccagccugguggca

SEQ ID NO: 432391 - RNA, 32 nt, Human
gcaccaaagcuucacucauacccaguuuuguu

SEQ ID NO: 432392 - RNA, 32 nt, Human
gcaccaaauucaaccaucaucugucaagaaau

SEQ ID NO: 432393 - RNA, 32 nt, Human
gcaccaacagcguuccuccuccccaaggagca

SEQ ID NO: 432394 - RNA, 32 nt, Human
gcaccaacaucuacagcuggacugccuggagg

SEQ ID NO: 432395 - RNA, 32 nt, Human
gcaccaacauggagaaaccccgucucuacuaa

SEQ ID NO: 432396 - RNA, 19 nt, Human
gcaccaaccacugccucca

SEQ ID NO: 432397 - RNA, 32 nt, Human
gcaccaaccucacugcccucccucggccccac

SEQ ID NO: 432398 - RNA, 32 nt, Human
gcaccaacuaaugacacuuuaauuguuuuucu

SEQ ID NO: 432399 - RNA, 32 nt, Human
gcaccaacucaaccuuugcuuuuuggaugagu

SEQ ID NO: 432400 - RNA, 21 nt, Human
gcaccaagaaaaccuggcaua

SEQ ID NO: 432401 - RNA, 32 nt, Human
gcaccaagaacaaugcuggagugcaguggcgu

SEQ ID NO: 432402 - RNA, 32 nt, Human
gcaccaagcagacaaagucaauaaaagagcug

SEQ ID NO: 432403 - RNA, 22 nt, Human
gcaccaaggagaagaucugccu

SEQ ID NO: 432404 - RNA, 18 nt, Human
gcaccaaggccuaccacc

SEQ ID NO: 432405 - RNA, 18 nt, Human
gcaccaaggcugucacca

SEQ ID NO: 432406 - RNA, 32 nt, Human
gcaccaagggagcgagggggaauaagagcagg

SEQ ID NO: 432407 - RNA, 32 nt, Human
gcaccaagggugaacccgggggaaagauggca

SEQ ID NO: 432408 - RNA, 32 nt, Human
gcaccaagugcugaggcuggaagaaaaacgca

SEQ ID NO: 432409 - RNA, 32 nt, Human
gcaccaagugugaaagugacuuucacgguucc

SEQ ID NO: 432410 - RNA, 32 nt, Human
gcaccaaguugguuuggaauucugucaaguac

SEQ ID NO: 432411 - RNA, 32 nt, Human
gcaccaauaaaggcgucuuuugugcuugaaaa

SEQ ID NO: 432412 - RNA, 32 nt, Human
gcaccacaacaacccugugggcacugaauggc

SEQ ID NO: 432413 - RNA, 32 nt, Human
gcaccacaauggcuuuucucccaacuuuuugu

SEQ ID NO: 432414 - RNA, 19 nt, Human
gcaccacacauuugcccca

SEQ ID NO: 432415 - RNA, 32 nt, Human
gcaccacacccaggcgguggccccagacccuc

SEQ ID NO: 432416 - RNA, 32 nt, Human
gcaccacacgggggaggaaggaaggagcuccc

SEQ ID NO: 432417 - RNA, 32 nt, Human
gcaccacagagugcuugggcugagggacugac

SEQ ID NO: 432418 - RNA, 32 nt, Human
gcaccacagcacuccagcccaggcggcaguga

SEQ ID NO: 432419 - RNA, 32 nt, Human
gcaccacagcacugcagccuagacaacagagc

SEQ ID NO: 432420 - RNA, 32 nt, Human
gcaccacagcgcuccagccuggucgacagagu

SEQ ID NO: 432421 - RNA, 18 nt, Human
gcaccacagcucaagaaa

SEQ ID NO: 432422 - RNA, 32 nt, Human
gcaccacaggaaauagaacgaguacuguuaau

SEQ ID NO: 432423 - RNA, 32 nt, Human
gcaccacagucugaagucucucugccaauucc

SEQ ID NO: 432424 - RNA, 18 nt, Human
gcaccaccaaucacccca

SEQ ID NO: 432425 - RNA, 18 nt, Human
gcaccaccacacggccac

SEQ ID NO: 432426 - RNA, 19 nt, Human
gcaccaccacacggccaca

SEQ ID NO: 432427 - RNA, 17 nt, Human
gcaccaccaccaccacc

SEQ ID NO: 432428 - RNA, 18 nt, Human
gcaccaccaccaccacca

SEQ ID NO: 432429 - RNA, 21 nt, Human
gcaccaccaccaccaccacca

SEQ ID NO: 432430 - RNA, 18 nt, Human
gcaccaccaccaucacca

SEQ ID NO: 432431 - RNA, 32 nt, Human
gcaccaccaccauuuaaccacccugccgcugg

SEQ ID NO: 432432 - RNA, 25 nt, Human
gcaccaccacccucaaguacuucca

SEQ ID NO: 432433 - RNA, 21 nt, Human
gcaccaccaccgacacgucca

SEQ ID NO: 432434 - RNA, 18 nt, Human
gcaccaccacgcccagca

SEQ ID NO: 432435 - RNA, 32 nt, Human
gcaccaccacugaccugggacagugaaucgac

SEQ ID NO: 432436 - RNA, 19 nt, Human
gcaccaccagaggcugcgg

SEQ ID NO: 432437 - RNA, 20 nt, Human
gcaccaccagauggcuacca

SEQ ID NO: 432438 - RNA, 18 nt, Human
gcaccaccagcaccacca

SEQ ID NO: 432439 - RNA, 17 nt, Human
gcaccaccaugcccacc

SEQ ID NO: 432440 - RNA, 18 nt, Human
gcaccaccauggccucca

SEQ ID NO: 432441 - RNA, 18 nt, Human
gcaccaccauugccgcca

SEQ ID NO: 432442 - RNA, 18 nt, Human
gcaccacccacaccccca

SEQ ID NO: 432443 - RNA, 20 nt, Human
gcaccacccacauggcauca

SEQ ID NO: 432444 - RNA, 23 nt, Human
gcaccacccacuugcaaccacca

SEQ ID NO: 432445 - RNA, 32 nt, Human
gcaccacccagccugaccuguguuuuggcaag

SEQ ID NO: 432446 - RNA, 32 nt, Human
gcaccacccaggcccccugggcaccaagggag

SEQ ID NO: 432447 - RNA, 32 nt, Human
gcaccacccaggggcucccuugcuuuggcuag

SEQ ID NO: 432448 - RNA, 18 nt, Human
gcaccaccccacccucca

SEQ ID NO: 432449 - RNA, 18 nt, Human
gcaccacccccacccacc

SEQ ID NO: 432450 - RNA, 16 nt, Human
gcaccacccccgcacc

SEQ ID NO: 432451 - RNA, 17 nt, Human
gcaccacccccuccacc

SEQ ID NO: 432452 - RNA, 18 nt, Human
gcaccaccccucacccca

SEQ ID NO: 432453 - RNA, 32 nt, Human
gcaccaccccucucacucuuggguuggaugcu

SEQ ID NO: 432454 - RNA, 19 nt, Human
gcaccaccccugggcagca

SEQ ID NO: 432455 - RNA, 19 nt, Human
gcaccacccucccaccacc

SEQ ID NO: 432456 - RNA, 17 nt, Human
gcaccacccucucccca

SEQ ID NO: 432457 - RNA, 32 nt, Human
gcaccacccugcaacaccucaggccagggaaa

SEQ ID NO: 432458 - RNA, 32 nt, Human
gcaccacccugccuucacuucaucuacauaaa

SEQ ID NO: 432459 - RNA, 32 nt, Human
gcaccacccuggcaguuccagccuguagggga

SEQ ID NO: 432460 - RNA, 32 nt, Human
gcaccaccgcacuccagccugggugacagagc

SEQ ID NO: 432461 - RNA, 32 nt, Human
gcaccaccgcguggacaggaacaccguggcgc

SEQ ID NO: 432462 - RNA, 18 nt, Human
gcaccaccgcucacccca

SEQ ID NO: 432463 - RNA, 20 nt, Human
gcaccaccuaacgcaccacc

SEQ ID NO: 432464 - RNA, 19 nt, Human
gcaccaccuacccugaucc

SEQ ID NO: 432465 - RNA, 20 nt, Human
gcaccaccuaccuggcuucc

SEQ ID NO: 432466 - RNA, 17 nt, Human
gcaccaccucucccacc

SEQ ID NO: 432467 - RNA, 17 nt, Human
gcaccaccucugcgcac

SEQ ID NO: 432468 - RNA, 32 nt, Human
gcaccaccuggauguugagguagaucacagcc

SEQ ID NO: 432469 - RNA, 18 nt, Human
gcaccaccuugucuccac

SEQ ID NO: 432470 - RNA, 32 nt, Human
gcaccacgccacugcacuccagcgugggcaac

SEQ ID NO: 432471 - RNA, 32 nt, Human
gcaccacgcccgggaccccacccagcggcccg

SEQ ID NO: 432472 - RNA, 20 nt, Human
gcaccacggaagcugccacc

SEQ ID NO: 432473 - RNA, 32 nt, Human
gcaccacggcacacaccuccagccucgagccc

SEQ ID NO: 432474 - RNA, 32 nt, Human
gcaccacggcacuccagccuggcgacagagca

SEQ ID NO: 432475 - RNA, 32 nt, Human
gcaccacggcacuccagccugggugacagagu

SEQ ID NO: 432476 - RNA, 32 nt, Human
gcaccacggcagcaggagguuucggcuaaguu

SEQ ID NO: 432477 - RNA, 24 nt, Human
gcaccacggcucacaccuauaauc

SEQ ID NO: 432478 - RNA, 32 nt, Human
gcaccacuacacuccagcccgggcgacagagc

SEQ ID NO: 432479 - RNA, 32 nt, Human
gcaccacuacacuccagccuggaugacagagu

SEQ ID NO: 432480 - RNA, 32 nt, Human
gcaccacuacacuccagccugggcaacagaga

SEQ ID NO: 432481 - RNA, 32 nt, Human
gcaccacuacacuccagccugggcaacagagc

SEQ ID NO: 432482 - RNA, 32 nt, Human
gcaccacuacacuccagccugggugacaaagc

SEQ ID NO: 432483 - RNA, 32 nt, Human
gcaccacucagccugcacugggagcacagcca

SEQ ID NO: 432484 - RNA, 32 nt, Human
gcaccacucagugaagcccagccuggcgccug

SEQ ID NO: 432485 - RNA, 18 nt, Human
gcaccacuccacccacca

SEQ ID NO: 432486 - RNA, 22 nt, Human
gcaccacuccgggagaggcggc

SEQ ID NO: 432487 - RNA, 32 nt, Human
gcaccacucuagacuggcaagggccuccacag

SEQ ID NO: 432488 - RNA, 19 nt, Human
gcaccacucugcugcccca

SEQ ID NO: 432489 - RNA, 32 nt, Human
gcaccacugaacuccagccugggccacauagc

SEQ ID NO: 432490 - RNA, 32 nt, Human
gcaccacugaacuccagccugggcgacaagag

SEQ ID NO: 432491 - RNA, 32 nt, Human
gcaccacugcacgcacuccagccugggugaca

SEQ ID NO: 432492 - RNA, 32 nt, Human
gcaccacugcacuacagccugggcgacagaac

SEQ ID NO: 432493 - RNA, 32 nt, Human
gcaccacugcacuacagcuugggugacagcgc

SEQ ID NO: 432494 - RNA, 32 nt, Human
gcaccacugcacucaagccugggcaacagagu

SEQ ID NO: 432495 - RNA, 32 nt, Human
gcaccacugcacucaagccugggcgacagagc

SEQ ID NO: 432496 - RNA, 32 nt, Human
gcaccacugcacucaagccugggcgacagagg

SEQ ID NO: 432497 - RNA, 32 nt, Human
gcaccacugcacuccaaccugggcaacagagc

SEQ ID NO: 432498 - RNA, 32 nt, Human
gcaccacugcacuccaaccugggugacaagag

SEQ ID NO: 432499 - RNA, 32 nt, Human
gcaccacugcacuccaaccugggugacagagu

SEQ ID NO: 432500 - RNA, 32 nt, Human
gcaccacugcacuccaaccugggugacgagug

SEQ ID NO: 432501 - RNA, 32 nt, Human
gcaccacugcacuccaaucugggcaagagaac

SEQ ID NO: 432502 - RNA, 32 nt, Human
gcaccacugcacuccacccugggcagaggugg

SEQ ID NO: 432503 - RNA, 32 nt, Human
gcaccacugcacuccagcaugagugacagaga

SEQ ID NO: 432504 - RNA, 32 nt, Human
gcaccacugcacuccagcaugggcaacacagu

SEQ ID NO: 432505 - RNA, 20 nt, Human
gcaccacugcacuccagcca

SEQ ID NO: 432506 - RNA, 32 nt, Human
gcaccacugcacuccagccaggaaugaggcag

SEQ ID NO: 432507 - RNA, 32 nt, Human
gcaccacugcacuccagcccaggcaacagagu

SEQ ID NO: 432508 - RNA, 32 nt, Human
gcaccacugcacuccagccggggugacagagu

SEQ ID NO: 432509 - RNA, 32 nt, Human
gcaccacugcacuccagccuaggcgacagagc

SEQ ID NO: 432510 - RNA, 32 nt, Human
gcaccacugcacuccagccuaggcgacggggc

SEQ ID NO: 432511 - RNA, 32 nt, Human
gcaccacugcacuccagccuaggugacagagu

SEQ ID NO: 432512 - RNA, 32 nt, Human
gcaccacugcacuccagccugagugacagagc

SEQ ID NO: 432513 - RNA, 32 nt, Human
gcaccacugcacuccagccuggaaaacggagu

SEQ ID NO: 432514 - RNA, 32 nt, Human
gcaccacugcacuccagccuggaagaccaaac

SEQ ID NO: 432515 - RNA, 32 nt, Human
gcaccacugcacuccagccuggacaacagagu

SEQ ID NO: 432516 - RNA, 32 nt, Human
gcaccacugcacuccagccuggacgacagagc

SEQ ID NO: 432517 - RNA, 32 nt, Human
gcaccacugcacuccagccuggcgacaaagug

SEQ ID NO: 432518 - RNA, 32 nt, Human
gcaccacugcacuccagccugggaaacagagu

SEQ ID NO: 432519 - RNA, 32 nt, Human
gcaccacugcacuccagccugggagacacagc

SEQ ID NO: 432520 - RNA, 32 nt, Human
gcaccacugcacuccagccugggagacagagc

SEQ ID NO: 432521 - RNA, 32 nt, Human
gcaccacugcacuccagccugggagacagagu

SEQ ID NO: 432522 - RNA, 32 nt, Human
gcaccacugcacuccagccugggagauacagc

SEQ ID NO: 432523 - RNA, 32 nt, Human
gcaccacugcacuccagccugggcaacaaagc

SEQ ID NO: 432524 - RNA, 32 nt, Human
gcaccacugcacuccagccugggcaacaaagu

SEQ ID NO: 432525 - RNA, 32 nt, Human
gcaccacugcacuccagccugggcaacaagag

SEQ ID NO: 432526 - RNA, 32 nt, Human
gcaccacugcacuccagccugggcaacacagu

SEQ ID NO: 432527 - RNA, 32 nt, Human
gcaccacugcacuccagccugggcaacagagc

SEQ ID NO: 432528 - RNA, 32 nt, Human
gcaccacugcacuccagccugggcaacagagg

SEQ ID NO: 432529 - RNA, 32 nt, Human
gcaccacugcacuccagccugggcaacagagu

SEQ ID NO: 432530 - RNA, 32 nt, Human
gcaccacugcacuccagccugggcaacauagc

SEQ ID NO: 432531 - RNA, 32 nt, Human
gcaccacugcacuccagccugggcaauagagu

SEQ ID NO: 432532 - RNA, 32 nt, Human
gcaccacugcacuccagccugggcgaaagggc

SEQ ID NO: 432533 - RNA, 32 nt, Human
gcaccacugcacuccagccugggcgacaaagu

SEQ ID NO: 432534 - RNA, 32 nt, Human
gcaccacugcacuccagccugggcgacagacc

SEQ ID NO: 432535 - RNA, 32 nt, Human
gcaccacugcacuccagccugggcgacagagc

SEQ ID NO: 432536 - RNA, 32 nt, Human
gcaccacugcacuccagccugggcgacagagg

SEQ ID NO: 432537 - RNA, 32 nt, Human
gcaccacugcacuccagccugggcgacagagu

SEQ ID NO: 432538 - RNA, 32 nt, Human
gcaccacugcacuccagccugggcgacuguga

SEQ ID NO: 432539 - RNA, 32 nt, Human
gcaccacugcacuccagccugggcggcagagc

SEQ ID NO: 432540 - RNA, 32 nt, Human
gcaccacugcacuccagccugggcuacagauc

SEQ ID NO: 432541 - RNA, 32 nt, Human
gcaccacugcacuccagccuggggacagagca

SEQ ID NO: 432542 - RNA, 32 nt, Human
gcaccacugcacuccagccuggguaacaagag

SEQ ID NO: 432543 - RNA, 32 nt, Human
gcaccacugcacuccagccugggugacaagag

SEQ ID NO: 432544 - RNA, 32 nt, Human
gcaccacugcacuccagccugggugacagaga

SEQ ID NO: 432545 - RNA, 32 nt, Human
gcaccacugcacuccagccugggugacagagc

SEQ ID NO: 432546 - RNA, 32 nt, Human
gcaccacugcacuccagccugggugacagagu

SEQ ID NO: 432547 - RNA, 32 nt, Human
gcaccacugcacuccagccugggugagagagc

SEQ ID NO: 432548 - RNA, 32 nt, Human
gcaccacugcacuccagccugggugauagagc

SEQ ID NO: 432549 - RNA, 32 nt, Human
gcaccacugcacuccagccugggugauagagu

SEQ ID NO: 432550 - RNA, 32 nt, Human
gcaccacugcacuccagccugggugauggagc

SEQ ID NO: 432551 - RNA, 32 nt, Human
gcaccacugcacuccagccuggguggcagagu

SEQ ID NO: 432552 - RNA, 32 nt, Human
gcaccacugcacuccagccugggugucagagc

SEQ ID NO: 432553 - RNA, 32 nt, Human
gcaccacugcacuccagccuggguuacagauc

SEQ ID NO: 432554 - RNA, 32 nt, Human
gcaccacugcacuccagccuggucgacagcga

SEQ ID NO: 432555 - RNA, 31 nt, Human
gcaccacugcacuccagccuggugacagagc

SEQ ID NO: 432556 - RNA, 32 nt, Human
gcaccacugcacuccagccuggugacagagcu

SEQ ID NO: 432557 - RNA, 32 nt, Human
gcaccacugcacuccagccuggugacagggcg

SEQ ID NO: 432558 - RNA, 32 nt, Human
gcaccacugcacuccagccugguuacagagca

SEQ ID NO: 432559 - RNA, 32 nt, Human
gcaccacugcacuccagcucgggugacaagag

SEQ ID NO: 432560 - RNA, 32 nt, Human
gcaccacugcacuccagcuugggugacagagu

SEQ ID NO: 432561 - RNA, 32 nt, Human
gcaccacugcacuccaggcuggguaacagaau

SEQ ID NO: 432562 - RNA, 32 nt, Human
gcaccacugcacuccaggcugggugacagagc

SEQ ID NO: 432563 - RNA, 32 nt, Human
gcaccacugcacuccagucuggcaacagagca

SEQ ID NO: 432564 - RNA, 32 nt, Human
gcaccacugcacuccagucugggcaacagagc

SEQ ID NO: 432565 - RNA, 32 nt, Human
gcaccacugcacuccagucuggguaacagagc

SEQ ID NO: 432566 - RNA, 32 nt, Human
gcaccacugcacuccagucugggugagaguga

SEQ ID NO: 432567 - RNA, 32 nt, Human
gcaccacugcacuccauccugggcaacagagu

SEQ ID NO: 432568 - RNA, 32 nt, Human
gcaccacugcacuccauccugggugacagagc

SEQ ID NO: 432569 - RNA, 32 nt, Human
gcaccacugcacucccgcuuggcaauagagug

SEQ ID NO: 432570 - RNA, 32 nt, Human
gcaccacugcacuccggccuaggcaacgagag

SEQ ID NO: 432571 - RNA, 32 nt, Human
gcaccacugcacucuaacuugggcaacaaagc

SEQ ID NO: 432572 - RNA, 32 nt, Human
gcaccacugcacucuacucugggugacagaau

SEQ ID NO: 432573 - RNA, 32 nt, Human
gcaccacugcacucuagccugcgugacacaac

SEQ ID NO: 432574 - RNA, 32 nt, Human
gcaccacugcacucuagccugggcaagagaac

SEQ ID NO: 432575 - RNA, 32 nt, Human
gcaccacugcacucuagccuggggaacagagu

SEQ ID NO: 432576 - RNA, 32 nt, Human
gcaccacugcacucuagccuggguaacaagca

SEQ ID NO: 432577 - RNA, 32 nt, Human
gcaccacugcacucuagccugggugaaagagc

SEQ ID NO: 432578 - RNA, 32 nt, Human
gcaccacugcacucuagccugggugaccgagg

SEQ ID NO: 432579 - RNA, 32 nt, Human
gcaccacugcacucuagccuuggcaacagugc

SEQ ID NO: 432580 - RNA, 32 nt, Human
gcaccacugcacucuagcuugggcaacagagc

SEQ ID NO: 432581 - RNA, 32 nt, Human
gcaccacugcacugcagccuggcaacaagagc

SEQ ID NO: 432582 - RNA, 32 nt, Human
gcaccacugcacugcagccugggaaacagagu

SEQ ID NO: 432583 - RNA, 32 nt, Human
gcaccacugcacugcagccugggugacagagu

SEQ ID NO: 432584 - RNA, 32 nt, Human
gcaccacugcacuucagccuggacaacagagu

SEQ ID NO: 432585 - RNA, 32 nt, Human
gcaccacugcacuucagccugggugacagagg

SEQ ID NO: 432586 - RNA, 32 nt, Human
gcaccacugcacuucagccugggugacagagu

SEQ ID NO: 432587 - RNA, 32 nt, Human
gcaccacugcacuucagccuggugacagagcg

SEQ ID NO: 432588 - RNA, 32 nt, Human
gcaccacugcacuucagcuugggcaacagagc

SEQ ID NO: 432589 - RNA, 32 nt, Human
gcaccacugcacuuuagccugggcgacaagag

SEQ ID NO: 432590 - RNA, 32 nt, Human
gcaccacugcacuuuagucugggugacagagc

SEQ ID NO: 432591 - RNA, 17 nt, Human
gcaccacugcagccacc

SEQ ID NO: 432592 - RNA, 32 nt, Human
gcaccacugcaguccagccuaggcaacaguga

SEQ ID NO: 432593 - RNA, 32 nt, Human
gcaccacugcaguccagccugggcgacagagu

SEQ ID NO: 432594 - RNA, 32 nt, Human
gcaccacugcauuccagcauggccacaaagca

SEQ ID NO: 432595 - RNA, 32 nt, Human
gcaccacugcauuccagccuaagcaauagagc

SEQ ID NO: 432596 - RNA, 32 nt, Human
gcaccacugcauuccagccuggaugacagagc

SEQ ID NO: 432597 - RNA, 32 nt, Human
gcaccacugcauuccagccuggcgacagagug

SEQ ID NO: 432598 - RNA, 32 nt, Human
gcaccacugcauuccagccugggcaacagagc

SEQ ID NO: 432599 - RNA, 32 nt, Human
gcaccacugcauuccagccugggugacagagc

SEQ ID NO: 432600 - RNA, 32 nt, Human
gcaccacugcccuccagccuaggugacagaau

SEQ ID NO: 432601 - RNA, 32 nt, Human
gcaccacugcccuccagccuggaugacagagu

SEQ ID NO: 432602 - RNA, 32 nt, Human
gcaccacugcgcuccagccugggugaggagac

SEQ ID NO: 432603 - RNA, 32 nt, Human
gcaccacugcucuccagccuggcgacagaggg

SEQ ID NO: 432604 - RNA, 32 nt, Human
gcaccacugcucuccagccuggggaacagagc

SEQ ID NO: 432605 - RNA, 32 nt, Human
gcaccacuggacgccagccuaggcaacacuau

SEQ ID NO: 432606 - RNA, 32 nt, Human
gcaccacuggacuccagccugggcgacagagu

SEQ ID NO: 432607 - RNA, 32 nt, Human
gcaccacuguacgacagagcaagacuccgucu

SEQ ID NO: 432608 - RNA, 32 nt, Human
gcaccacuguacuccaaccuggaugacagagu

SEQ ID NO: 432609 - RNA, 32 nt, Human
gcaccacuguacuccagccugggcaacagaag

SEQ ID NO: 432610 - RNA, 32 nt, Human
gcaccacuguacuccagccugggcaacagagg

SEQ ID NO: 432611 - RNA, 32 nt, Human
gcaccacuguacuccagccugggcaacagagu

SEQ ID NO: 432612 - RNA, 32 nt, Human
gcaccacuguacuccagccugggcgacggagu

SEQ ID NO: 432613 - RNA, 32 nt, Human
gcaccacuguacuccagccugggcgauacaac

SEQ ID NO: 432614 - RNA, 32 nt, Human
gcaccacuguacuccagccugggugacaaagu

SEQ ID NO: 432615 - RNA, 32 nt, Human
gcaccacuguacuccagccugggugacagagc

SEQ ID NO: 432616 - RNA, 32 nt, Human
gcaccacuguacuccagccugggugacagggc

SEQ ID NO: 432617 - RNA, 32 nt, Human
gcaccacuguacuccagccugggugacugagc

SEQ ID NO: 432618 - RNA, 25 nt, Human
gcaccacuguagucccagcuacuca

SEQ ID NO: 432619 - RNA, 32 nt, Human
gcaccacuguagucccagcuacucaggcugag

SEQ ID NO: 432620 - RNA, 32 nt, Human
gcaccacuguauuccagccuggaugacaaagc

SEQ ID NO: 432621 - RNA, 32 nt, Human
gcaccacuguguauuuaacugccuuguguaca

SEQ ID NO: 432622 - RNA, 32 nt, Human
gcaccacuuacuccagccugggcaacagagca

SEQ ID NO: 432623 - RNA, 32 nt, Human
gcaccacuuauugcacuccagcccgggcgaca

SEQ ID NO: 432624 - RNA, 32 nt, Human
gcaccacuucacuccagccugggugacggagu

SEQ ID NO: 432625 - RNA, 19 nt, Human
gcaccacuucccgccucca

SEQ ID NO: 432626 - RNA, 19 nt, Human
gcaccacuuccugccccca

SEQ ID NO: 432627 - RNA, 32 nt, Human
gcaccacuugaaggagcucuaucaccagccug

SEQ ID NO: 432628 - RNA, 32 nt, Human
gcaccacuuguaacuccagccugggcaacaga

SEQ ID NO: 432629 - RNA, 32 nt, Human
gcaccacuuuacuuagccugggugacagagug

SEQ ID NO: 432630 - RNA, 22 nt, Human
gcaccacuuuuaccuucugcuc

SEQ ID NO: 432631 - RNA, 32 nt, Human
gcaccacuuuuacuguugccuacuucugacca

SEQ ID NO: 432632 - RNA, 32 nt, Human
gcaccagaaucccuguaaccauucauccaggu

SEQ ID NO: 432633 - RNA, 32 nt, Human
gcaccagaaucucuugaacccaggaggccgag

SEQ ID NO: 432634 - RNA, 32 nt, Human
gcaccagaauugcuugaacccaggagguggag

SEQ ID NO: 432635 - RNA, 32 nt, Human
gcaccagacaaacaccagacgucaaggucauu

SEQ ID NO: 432636 - RNA, 32 nt, Human
gcaccagacuaaaucuguauuaugugauauug

SEQ ID NO: 432637 - RNA, 25 nt, Human
gcaccagacucaccaggccgugcuc

SEQ ID NO: 432638 - RNA, 32 nt, Human
gcaccagagagggaggccacugcaacauuuua

SEQ ID NO: 432639 - RNA, 32 nt, Human
gcaccagagcaaaaccaacagagccacugggu

SEQ ID NO: 432640 - RNA, 32 nt, Human
gcaccagagcacccccuccacccccaccuugg

SEQ ID NO: 432641 - RNA, 32 nt, Human
gcaccagagccacugagcccagucccauaaac

SEQ ID NO: 432642 - RNA, 21 nt, Human
gcaccagaggcacucagggca

SEQ ID NO: 432643 - RNA, 32 nt, Human
gcaccagaggggcaagagaauguuccggaacu

SEQ ID NO: 432644 - RNA, 32 nt, Human
gcaccagaguccauuuucaaggcaccauucuc

SEQ ID NO: 432645 - RNA, 32 nt, Human
gcaccagcaaacucuggacugguggaagaauu

SEQ ID NO: 432646 - RNA, 32 nt, Human
gcaccagcaacuacacuccagacccgugcuga

SEQ ID NO: 432647 - RNA, 19 nt, Human
gcaccagcaacugcaguga

SEQ ID NO: 432648 - RNA, 20 nt, Human
gcaccagcaccuuccuacaa

SEQ ID NO: 432649 - RNA, 32 nt, Human
gcaccagcacuggcacuggcacuggcacacgc

SEQ ID NO: 432650 - RNA, 32 nt, Human
gcaccagcacuuccgguacggaaaacucgcug

SEQ ID NO: 432651 - RNA, 32 nt, Human
gcaccagcagccgccuccaugcccuagguugg

SEQ ID NO: 432652 - RNA, 21 nt, Human
gcaccagcagcuaccaaccac

SEQ ID NO: 432653 - RNA, 17 nt, Human
gcaccagcaucgcccca

SEQ ID NO: 432654 - RNA, 20 nt, Human
gcaccagccaggaggacccu

SEQ ID NO: 432655 - RNA, 32 nt, Human
gcaccagccccaggggucuaauuacuugagaa

SEQ ID NO: 432656 - RNA, 18 nt, Human
gcaccagcccugccccca

SEQ ID NO: 432657 - RNA, 18 nt, Human
gcaccagccgccauggcc

SEQ ID NO: 432658 - RNA, 32 nt, Human
gcaccagccuccacgaagucguggaaaaggag

SEQ ID NO: 432659 - RNA, 22 nt, Human
gcaccagccuggaccuaccacc

SEQ ID NO: 432660 - RNA, 22 nt, Human
gcaccagccugggcaacaagag

SEQ ID NO: 432661 - RNA, 23 nt, Human
gcaccagcgcgcaagggacccuu

SEQ ID NO: 432662 - RNA, 21 nt, Human
gcaccagcggcggcggacccu

SEQ ID NO: 432663 - RNA, 19 nt, Human
gcaccagcuaccacuacca

SEQ ID NO: 432664 - RNA, 32 nt, Human
gcaccagcucccugcaggaagaguggagaggu

SEQ ID NO: 432665 - RNA, 32 nt, Human
gcaccagcucccugccccacccuccagugccu

SEQ ID NO: 432666 - RNA, 32 nt, Human
gcaccagcugccucuuugcugcuuuguuuucc

SEQ ID NO: 432667 - RNA, 17 nt, Human
gcaccagcugcggcugc

SEQ ID NO: 432668 - RNA, 21 nt, Human
gcaccagcuggaaagacccuu

SEQ ID NO: 432669 - RNA, 18 nt, Human
gcaccagcuucccugacc

SEQ ID NO: 432670 - RNA, 22 nt, Human
gcaccagcuucuccaggcucuu

SEQ ID NO: 432671 - RNA, 32 nt, Human
gcaccagcuuuccagucccuuccaaguuucca

SEQ ID NO: 432672 - RNA, 32 nt, Human
gcaccagcuuuuccuuucaguauugguagagc

SEQ ID NO: 432673 - RNA, 32 nt, Human
gcaccaggaaaccaaaugaugucccugcccgc

SEQ ID NO: 432674 - RNA, 32 nt, Human
gcaccaggagaaaugaauaugcugggcugugc

SEQ ID NO: 432675 - RNA, 32 nt, Human
gcaccaggaggaggcuaacaaaagagggcagg

SEQ ID NO: 432676 - RNA, 32 nt, Human
gcaccaggaggcggcccccagcgcggccacaa

SEQ ID NO: 432677 - RNA, 18 nt, Human
gcaccaggcaaagaaaug

SEQ ID NO: 432678 - RNA, 20 nt, Human
gcaccaggcagaugaugcag

SEQ ID NO: 432679 - RNA, 32 nt, Human
gcaccaggccagagauagucuucuuuuugucc

SEQ ID NO: 432680 - RNA, 32 nt, Human
gcaccaggccagggguugauuugaaacgugaa

SEQ ID NO: 432681 - RNA, 32 nt, Human
gcaccaggcgcugagcugaacccuggaagcag

SEQ ID NO: 432682 - RNA, 32 nt, Human
gcaccaggcucugccuucacucccccaagucu

SEQ ID NO: 432683 - RNA, 19 nt, Human
gcaccagggacucggccca

SEQ ID NO: 432684 - RNA, 32 nt, Human
gcaccagggaggacagcugcuggcagggacua

SEQ ID NO: 432685 - RNA, 32 nt, Human
gcaccagggaggugggaagccagcauugagca

SEQ ID NO: 432686 - RNA, 18 nt, Human
gcaccagggcacagugga

SEQ ID NO: 432687 - RNA, 32 nt, Human
gcaccagggcagacacucgcccccaggggagg

SEQ ID NO: 432688 - RNA, 31 nt, Human
gcaccagggcauagucuacucacuuauaucu

SEQ ID NO: 432689 - RNA, 32 nt, Human
gcaccagggcucggugugugugguguuggagu

SEQ ID NO: 432690 - RNA, 32 nt, Human
gcaccaggggucuaaagugugagccacugaga

SEQ ID NO: 432691 - RNA, 32 nt, Human
gcaccagguguccucagguggccagccuggau

SEQ ID NO: 432692 - RNA, 32 nt, Human
gcaccagguugcucuggaagagcuugaggaug

SEQ ID NO: 432693 - RNA, 32 nt, Human
gcaccagugcacuccagccuuggugacaaugg

SEQ ID NO: 432694 - RNA, 32 nt, Human
gcaccagugcacuccagcugggcgacagagcg

SEQ ID NO: 432695 - RNA, 32 nt, Human
gcaccagugccacccagggcccugcacaaagg

SEQ ID NO: 432696 - RNA, 32 nt, Human
gcaccagugcccccuucucugccuucacuucu

SEQ ID NO: 432697 - RNA, 18 nt, Human
gcaccauaaccaagaaau

SEQ ID NO: 432698 - RNA, 32 nt, Human
gcaccauaccaaaguguugcagccuggaacuc

SEQ ID NO: 432699 - RNA, 17 nt, Human
gcaccauacuuaaaguc

SEQ ID NO: 432700 - RNA, 32 nt, Human
gcaccaucaacuggcagcaacagagcaggcgc

SEQ ID NO: 432701 - RNA, 17 nt, Human
gcaccaucaccaaggca

SEQ ID NO: 432702 - RNA, 18 nt, Human
gcaccaucaccaucacca

SEQ ID NO: 432703 - RNA, 21 nt, Human
gcaccaucaccccgcucacca

SEQ ID NO: 432704 - RNA, 32 nt, Human
gcaccaucagagccaggagagugacaacaggu

SEQ ID NO: 432705 - RNA, 32 nt, Human
gcaccaucaggcagcacccaugggcuccacca

SEQ ID NO: 432706 - RNA, 18 nt, Human
gcaccaucaucaccauca

SEQ ID NO: 432707 - RNA, 32 nt, Human
gcaccaucauucaucuuucucacugcagggcc

SEQ ID NO: 432708 - RNA, 21 nt, Human
gcaccauccccaccugccacc

SEQ ID NO: 432709 - RNA, 32 nt, Human
gcaccaucccgcaggcuucucccaccugaugg

SEQ ID NO: 432710 - RNA, 32 nt, Human
gcaccauccgcaucuggagcaccaaggacuuc

SEQ ID NO: 432711 - RNA, 32 nt, Human
gcaccauccuugguugcccuccuggagaaggc

SEQ ID NO: 432712 - RNA, 32 nt, Human
gcaccaucucagcucacugcaaccucugucuc

SEQ ID NO: 432713 - RNA, 18 nt, Human
gcaccaucugcaccccca

SEQ ID NO: 432714 - RNA, 32 nt, Human
gcaccaucuguccggucccagcaugccuucug

SEQ ID NO: 432715 - RNA, 32 nt, Human
gcaccaucuguucuccccagggaccugcugac

SEQ ID NO: 432716 - RNA, 30 nt, Human
gcaccaugaacccagagagcaguaucuuua

SEQ ID NO: 432717 - RNA, 32 nt, Human
gcaccaugccuggcuaauuuuguauuuguagu

SEQ ID NO: 432718 - RNA, 32 nt, Human
gcaccaugcucacuguugcugcgugggagagu

SEQ ID NO: 432719 - RNA, 30 nt, Human
gcaccauggacaaccccaccaccacccagu

SEQ ID NO: 432720 - RNA, 32 nt, Human
gcaccauggaggaaccagcagcccagaaacac

SEQ ID NO: 432721 - RNA, 32 nt, Human
gcaccauggccgcugggcucugccuuccacac

SEQ ID NO: 432722 - RNA, 32 nt, Human
gcaccaugggccacuccaggaugggacacggc

SEQ ID NO: 432723 - RNA, 32 nt, Human
gcaccaugucccaucacccagcggccagccau

SEQ ID NO: 432724 - RNA, 32 nt, Human
gcaccauguuagguauuggggaagagagacug

SEQ ID NO: 432725 - RNA, 32 nt, Human
gcaccauuaauuuagcaaaggccaucuacaag

SEQ ID NO: 432726 - RNA, 32 nt, Human
gcaccauuacacuccagccugggcaacagagc

SEQ ID NO: 432727 - RNA, 32 nt, Human
gcaccauuacacuccagccugggcaacaguga

SEQ ID NO: 432728 - RNA, 32 nt, Human
gcaccauucacucauuuauaccagcucccuuu

SEQ ID NO: 432729 - RNA, 19 nt, Human
gcaccauucauaauagcca

SEQ ID NO: 432730 - RNA, 32 nt, Human
gcaccauucggaguaaggaugacagcaggccc

SEQ ID NO: 432731 - RNA, 19 nt, Human
gcaccauucuugaugucca

SEQ ID NO: 432732 - RNA, 32 nt, Human
gcaccauugaacuccagccugggcaacaagag

SEQ ID NO: 432733 - RNA, 32 nt, Human
gcaccauugcacccgagccuaggcaacaagag

SEQ ID NO: 432734 - RNA, 32 nt, Human
gcaccauugcaccuccagccugggcaacagag

SEQ ID NO: 432735 - RNA, 32 nt, Human
gcaccauugcacuccacccugggcgacagagc

SEQ ID NO: 432736 - RNA, 32 nt, Human
gcaccauugcacuccagcccgggcaacaacag

SEQ ID NO: 432737 - RNA, 32 nt, Human
gcaccauugcacuccagccuaggcaaaaagag

SEQ ID NO: 432738 - RNA, 32 nt, Human
gcaccauugcacuccagccugagugacagagu

SEQ ID NO: 432739 - RNA, 32 nt, Human
gcaccauugcacuccagccugcgcaacaagag

SEQ ID NO: 432740 - RNA, 32 nt, Human
gcaccauugcacuccagccuggaugauagagu

SEQ ID NO: 432741 - RNA, 32 nt, Human
gcaccauugcacuccagccuggcgacagagca

SEQ ID NO: 432742 - RNA, 32 nt, Human
gcaccauugcacuccagccuggcgaccgagcg

SEQ ID NO: 432743 - RNA, 32 nt, Human
gcaccauugcacuccagccugggcaaaaagag

SEQ ID NO: 432744 - RNA, 32 nt, Human
gcaccauugcacuccagccugggcaacaagag

SEQ ID NO: 432745 - RNA, 32 nt, Human
gcaccauugcacuccagccugggcaacaagug

SEQ ID NO: 432746 - RNA, 32 nt, Human
gcaccauugcacuccagccugggcaacagagu

SEQ ID NO: 432747 - RNA, 32 nt, Human
gcaccauugcacuccagccugggcaacagcag

SEQ ID NO: 432748 - RNA, 32 nt, Human
gcaccauugcacuccagccugggcaacgagug

SEQ ID NO: 432749 - RNA, 32 nt, Human
gcaccauugcacuccagccugggcaauaagag

SEQ ID NO: 432750 - RNA, 32 nt, Human
gcaccauugcacuccagccugggcgacaagag

SEQ ID NO: 432751 - RNA, 32 nt, Human
gcaccauugcacuccagccugggcgacagagc

SEQ ID NO: 432752 - RNA, 32 nt, Human
gcaccauugcacuccagccugggcgacuccau

SEQ ID NO: 432753 - RNA, 32 nt, Human
gcaccauugcacuccagccugggugacaagag

SEQ ID NO: 432754 - RNA, 32 nt, Human
gcaccauugcacuccagccugggugacagagc

SEQ ID NO: 432755 - RNA, 32 nt, Human
gcaccauugcacuccagccugugcaacaagag

SEQ ID NO: 432756 - RNA, 32 nt, Human
gcaccauugcacuccagccugugcaacaagcg

SEQ ID NO: 432757 - RNA, 32 nt, Human
gcaccauugcacuccagccuugggcgacaaaa

SEQ ID NO: 432758 - RNA, 32 nt, Human
gcaccauugcacuccagcugggagacacagca

SEQ ID NO: 432759 - RNA, 32 nt, Human
gcaccauugcacuccagcuugggugacagagc

SEQ ID NO: 432760 - RNA, 32 nt, Human
gcaccauugcacuccugccugggcaacaagag

SEQ ID NO: 432761 - RNA, 32 nt, Human
gcaccauugcauuccagccugggcaacaagag

SEQ ID NO: 432762 - RNA, 32 nt, Human
gcaccauugcauuccagccugggugacagagc

SEQ ID NO: 432763 - RNA, 32 nt, Human
gcaccauugcccuccagccugagcaacagaac

SEQ ID NO: 432764 - RNA, 32 nt, Human
gcaccauugcccuccagccugggcaacaagag

SEQ ID NO: 432765 - RNA, 32 nt, Human
gcaccauuguacuccagccugggcaacaagag

SEQ ID NO: 432766 - RNA, 32 nt, Human
gcaccauuguacuccagccugggcaauaagag

SEQ ID NO: 432767 - RNA, 32 nt, Human
gcaccauuguacuccagccugugugacagagc

SEQ ID NO: 432768 - RNA, 32 nt, Human
gcaccauuucauuccagccugggcaacaugag

SEQ ID NO: 432769 - RNA, 21 nt, Human
gcaccauuuguugaaaaggcg

SEQ ID NO: 432770 - RNA, 18 nt, Human
gcaccauuuucuacacca

SEQ ID NO: 432771 - RNA, 16 nt, Human
gcaccauuuugaccca

SEQ ID NO: 432772 - RNA, 32 nt, Human
gcacccaaaccgcaggcccugcucuggcaggc

SEQ ID NO: 432773 - RNA, 32 nt, Human
gcacccaaaccucccuucccuuucgugucgaa

SEQ ID NO: 432774 - RNA, 32 nt, Human
gcacccaacacccucccucuuucugggguuug

SEQ ID NO: 432775 - RNA, 32 nt, Human
gcacccaacauacaugacucccgccauuagcu

SEQ ID NO: 432776 - RNA, 32 nt, Human
gcacccaagccucuucucaguuggagggaacu

SEQ ID NO: 432777 - RNA, 32 nt, Human
gcacccaagggcccugaacccauuuuccuccc

SEQ ID NO: 432778 - RNA, 32 nt, Human
gcacccaauguguuauuucuccaucaucggag

SEQ ID NO: 432779 - RNA, 32 nt, Human
gcacccaauuuccaaaagacauuucaugaaac

SEQ ID NO: 432780 - RNA, 32 nt, Human
gcacccacacaaaaugcacacucugcgauaug

SEQ ID NO: 432781 - RNA, 32 nt, Human
gcacccacagagagacacacacaggacacaaa

SEQ ID NO: 432782 - RNA, 32 nt, Human
gcacccacaggcaggucagaagagcacccggg

SEQ ID NO: 432783 - RNA, 32 nt, Human
gcacccacaucugaaaauggucagcaggcagg

SEQ ID NO: 432784 - RNA, 21 nt, Human
gcacccaccacagaauacagu

SEQ ID NO: 432785 - RNA, 32 nt, Human
gcacccaccagcugccaagagaaucccuggac

SEQ ID NO: 432786 - RNA, 32 nt, Human
gcacccacccacccccucacccccuucuuuuu

SEQ ID NO: 432787 - RNA, 32 nt, Human
gcacccaccccucccaucuccaccccacaugg

SEQ ID NO: 432788 - RNA, 32 nt, Human
gcacccaccuaucaccagggugaauggugaac

SEQ ID NO: 432789 - RNA, 32 nt, Human
gcacccacuaacucugugcucccuucccucuc

SEQ ID NO: 432790 - RNA, 32 nt, Human
gcacccacugacuccagccucauggaaccacc

SEQ ID NO: 432791 - RNA, 16 nt, Human
gcacccagaacuccuc

SEQ ID NO: 432792 - RNA, 32 nt, Human
gcacccagacauaagggucaacaggguuagcu

SEQ ID NO: 432793 - RNA, 23 nt, Human
gcacccagacccagccuaggggc

SEQ ID NO: 432794 - RNA, 32 nt, Human
gcacccagagagcucccuaaaggggcucugag

SEQ ID NO: 432795 - RNA, 32 nt, Human
gcacccagaggagcuccuuuccccagcaggcc

SEQ ID NO: 432796 - RNA, 32 nt, Human
gcacccagagggccagccuccagccugacccc

SEQ ID NO: 432797 - RNA, 32 nt, Human
gcacccagagugagcuggaguggguccccaug

SEQ ID NO: 432798 - RNA, 32 nt, Human
gcacccagaucuuccagccauauguggagucg

SEQ ID NO: 432799 - RNA, 21 nt, Human
gcacccagcagcaggcugcgg

SEQ ID NO: 432800 - RNA, 32 nt, Human
gcacccagcaugcuccgacacagcagggaagc

SEQ ID NO: 432801 - RNA, 20 nt, Human
gcacccagcccaccugccac

SEQ ID NO: 432802 - RNA, 20 nt, Human
gcacccagcccgccucggcc

SEQ ID NO: 432803 - RNA, 32 nt, Human
gcacccagcccucaacaccacccucacacacu

SEQ ID NO: 432804 - RNA, 32 nt, Human
gcacccagcccuguccccuugcugccucuacc

SEQ ID NO: 432805 - RNA, 32 nt, Human
gcacccagccucccuucuccuuccacucccuu

SEQ ID NO: 432806 - RNA, 32 nt, Human
gcacccagcuacuggggacgggggcucuccca

SEQ ID NO: 432807 - RNA, 32 nt, Human
gcacccaggagguggagguugcagugagccga

SEQ ID NO: 432808 - RNA, 32 nt, Human
gcacccaggcagcagcaccaggcacugcugac

SEQ ID NO: 432809 - RNA, 32 nt, Human
gcacccaggccugucuuuggcucggaaacggu

SEQ ID NO: 432810 - RNA, 32 nt, Human
gcacccaggcuuuagagaaguauagggggcuu

SEQ ID NO: 432811 - RNA, 32 nt, Human
gcacccagggcccugcaugccaggucguugga

SEQ ID NO: 432812 - RNA, 23 nt, Human
gcacccagggugcugggcugagg

SEQ ID NO: 432813 - RNA, 32 nt, Human
gcacccagguauagaccuuccacgugcagcac

SEQ ID NO: 432814 - RNA, 32 nt, Human
gcacccaggucgggcggugggggcgagcggag

SEQ ID NO: 432815 - RNA, 19 nt, Human
gcacccaggugggccccuc

SEQ ID NO: 432816 - RNA, 32 nt, Human
gcacccaguccccagagugaagcuguugccaa

SEQ ID NO: 432817 - RNA, 32 nt, Human
gcacccaguggauuuguggcagaugaggaaac

SEQ ID NO: 432818 - RNA, 20 nt, Human
gcacccagugggacucacuc

SEQ ID NO: 432819 - RNA, 18 nt, Human
gcacccaucagcacucug

SEQ ID NO: 432820 - RNA, 21 nt, Human
gcacccaucaugcguggacug

SEQ ID NO: 432821 - RNA, 32 nt, Human
gcacccaucuguacuccagcaaagucauagcu

SEQ ID NO: 432822 - RNA, 22 nt, Human
gcacccaucuugggcaacagaa

SEQ ID NO: 432823 - RNA, 18 nt, Human
gcacccaugccugcgcag

SEQ ID NO: 432824 - RNA, 32 nt, Human
gcaccccaaauacgcacuuuuccuggaaggga

SEQ ID NO: 432825 - RNA, 32 nt, Human
gcaccccaacuugggauucuccagagcuagca

SEQ ID NO: 432826 - RNA, 32 nt, Human
gcaccccaccacuguacucugaaauuggcgag

SEQ ID NO: 432827 - RNA, 32 nt, Human
gcaccccacccaggccaggucagagcagccca

SEQ ID NO: 432828 - RNA, 17 nt, Human
gcaccccacccccagcg

SEQ ID NO: 432829 - RNA, 26 nt, Human
gcaccccacggggaaauguucuggca

SEQ ID NO: 432830 - RNA, 32 nt, Human
gcaccccacugcaauccugucuuucugagcac

SEQ ID NO: 432831 - RNA, 32 nt, Human
gcaccccacuggcugcagcuagcccaccauag

SEQ ID NO: 432832 - RNA, 32 nt, Human
gcaccccagccacuccagaaacccaaugggag

SEQ ID NO: 432833 - RNA, 23 nt, Human
gcaccccagcccgggugacagag

SEQ ID NO: 432834 - RNA, 32 nt, Human
gcaccccagccuagcgacagagcaagacucca

SEQ ID NO: 432835 - RNA, 24 nt, Human
gcaccccagccugagcaacaagag

SEQ ID NO: 432836 - RNA, 24 nt, Human
gcaccccagccugggcaacaagag

SEQ ID NO: 432837 - RNA, 23 nt, Human
gcaccccagccugggcaacagag

SEQ ID NO: 432838 - RNA, 22 nt, Human
gcaccccagccugggcaaugag

SEQ ID NO: 432839 - RNA, 23 nt, Human
gcaccccagccugggcgacagag

SEQ ID NO: 432840 - RNA, 23 nt, Human
gcaccccagccugggugacagag

SEQ ID NO: 432841 - RNA, 32 nt, Human
gcaccccaggguggggcagcaagcaggcagga

SEQ ID NO: 432842 - RNA, 32 nt, Human
gcacccccaaagcaaccaacaaauccaaguaa

SEQ ID NO: 432843 - RNA, 32 nt, Human
gcacccccaccacucgcugccucccaggucag

SEQ ID NO: 432844 - RNA, 32 nt, Human
gcacccccacugcaggcuguggcuccaggggc

SEQ ID NO: 432845 - RNA, 32 nt, Human
gcacccccagaggcgcagagguggccgcugug

SEQ ID NO: 432846 - RNA, 23 nt, Human
gcacccccauggugcuguuggag

SEQ ID NO: 432847 - RNA, 21 nt, Human
gcacccccggcaaccaggagu

SEQ ID NO: 432848 - RNA, 32 nt, Human
gcacccccuaccucuguucugccuguccucgc

SEQ ID NO: 432849 - RNA, 32 nt, Human
gcacccccucauuccccucgugugacucucuu

SEQ ID NO: 432850 - RNA, 32 nt, Human
gcacccccuccccaaagaccgggcaguuccug

SEQ ID NO: 432851 - RNA, 32 nt, Human
gcacccccuccccauggguucucuccuuccuc

SEQ ID NO: 432852 - RNA, 32 nt, Human
gcacccccuucacagacacugaccucagaggc

SEQ ID NO: 432853 - RNA, 32 nt, Human
gcaccccggcaggauggacgugguguaccccc

SEQ ID NO: 432854 - RNA, 32 nt, Human
gcaccccuaaaaucccagcuacuugagagacu

SEQ ID NO: 432855 - RNA, 32 nt, Human
gcaccccuagcaccugccguccucacuguaaa

SEQ ID NO: 432856 - RNA, 31 nt, Human
gcaccccuccaccacauuugcuugcaauauc

SEQ ID NO: 432857 - RNA, 32 nt, Human
gcaccccuccacccccacccugcccacgugac

SEQ ID NO: 432858 - RNA, 21 nt, Human
gcaccccucccuuccuggagg

SEQ ID NO: 432859 - RNA, 32 nt, Human
gcaccccucugccuccucucgaugccuuacag

SEQ ID NO: 432860 - RNA, 32 nt, Human
gcaccccucuggcugcucaguccugccucagu

SEQ ID NO: 432861 - RNA, 32 nt, Human
gcaccccugaaaucaauccauaucauguuuga

SEQ ID NO: 432862 - RNA, 18 nt, Human
gcaccccugaccuacggg

SEQ ID NO: 432863 - RNA, 32 nt, Human
gcaccccugcacuccagccugggcaacagagc

SEQ ID NO: 432864 - RNA, 32 nt, Human
gcaccccugcacuccagccugggugacagagu

SEQ ID NO: 432865 - RNA, 32 nt, Human
gcaccccugcacuccaggcugggcaacaguac

SEQ ID NO: 432866 - RNA, 32 nt, Human
gcaccccugcccccugguucaccagagggagc

SEQ ID NO: 432867 - RNA, 17 nt, Human
gcaccccuggcccggca

SEQ ID NO: 432868 - RNA, 18 nt, Human
gcaccccuggcuggagug

SEQ ID NO: 432869 - RNA, 32 nt, Human
gcaccccugggcagagccccuuaaagcugcug

SEQ ID NO: 432870 - RNA, 32 nt, Human
gcaccccugggcucuccaugcccaccgcccug

SEQ ID NO: 432871 - RNA, 32 nt, Human
gcaccccuggggagcacagggaggcagaggcu

SEQ ID NO: 432872 - RNA, 25 nt, Human
gcaccccuguaaucccagcuacuca

SEQ ID NO: 432873 - RNA, 32 nt, Human
gcaccccuguaaucccagcuacucaggaggcu

SEQ ID NO: 432874 - RNA, 32 nt, Human
gcaccccuuagagugaaaguuuggucagucuc

SEQ ID NO: 432875 - RNA, 32 nt, Human
gcaccccuuccaggaacaaggcggcugcuccu

SEQ ID NO: 432876 - RNA, 32 nt, Human
gcaccccuucugucuguccccuuucauggcug

SEQ ID NO: 432877 - RNA, 22 nt, Human
gcaccccuugggcccugcccag

SEQ ID NO: 432878 - RNA, 24 nt, Human
gcacccgagccuaggcaacaagag

SEQ ID NO: 432879 - RNA, 26 nt, Human
gcacccgccuguaaucccagcuacuc

SEQ ID NO: 432880 - RNA, 32 nt, Human
gcacccgccuguaaucccagcuacucgggagg

SEQ ID NO: 432881 - RNA, 32 nt, Human
gcacccgcuaugccugcacugcagcccagccc

SEQ ID NO: 432882 - RNA, 32 nt, Human
gcacccgcugaacaucagccugggagacgcgg

SEQ ID NO: 432883 - RNA, 32 nt, Human
gcacccgcuggccaacagaccccacauccacc

SEQ ID NO: 432884 - RNA, 32 nt, Human
gcacccggaccacuuuguacacauuaacacua

SEQ ID NO: 432885 - RNA, 23 nt, Human
gcacccggagccacagcuggcgg

SEQ ID NO: 432886 - RNA, 22 nt, Human
gcacccggccgggccggcgcgg

SEQ ID NO: 432887 - RNA, 32 nt, Human
gcacccggcugugggcagaggcugcggggccu

SEQ ID NO: 432888 - RNA, 30 nt, Human
gcacccggcuugcaauuuagaaagggcacu

SEQ ID NO: 432889 - RNA, 32 nt, Human
gcacccgggcaggggugccagauacaguauug

SEQ ID NO: 432890 - RNA, 32 nt, Human
gcacccgguuuacagggaggugauugaggacg

SEQ ID NO: 432891 - RNA, 23 nt, Human
gcacccguaaucccagcuacuca

SEQ ID NO: 432892 - RNA, 23 nt, Human
gcacccguauucccagcuacuca

SEQ ID NO: 432893 - RNA, 32 nt, Human
gcacccgugaagccccacgggucaaggcuggu

SEQ ID NO: 432894 - RNA, 32 nt, Human
gcacccguuccagggcuaacagaugaagcaug

SEQ ID NO: 432895 - RNA, 32 nt, Human
gcacccguuucuguccccuccuuuccugcucc

SEQ ID NO: 432896 - RNA, 32 nt, Human
gcacccuaagucuuguuagccuccuuuuuaaa

SEQ ID NO: 432897 - RNA, 32 nt, Human
gcacccuauaugcugcugccucaggcagagcc

SEQ ID NO: 432898 - RNA, 17 nt, Human
gcacccucaccccacca

SEQ ID NO: 432899 - RNA, 32 nt, Human
gcacccucauuccccucucccacccaccccac

SEQ ID NO: 432900 - RNA, 32 nt, Human
gcacccuccacuucucuccuaggcaaugagac

SEQ ID NO: 432901 - RNA, 32 nt, Human
gcacccuccccagggauuggaaacggaugacg

SEQ ID NO: 432902 - RNA, 32 nt, Human
gcacccuccuccaccuccaccucucuucccag

SEQ ID NO: 432903 - RNA, 32 nt, Human
gcacccucgcccagggcuggggcgcagugcgc

SEQ ID NO: 432904 - RNA, 21 nt, Human
gcacccucuccaggugcacuc

SEQ ID NO: 432905 - RNA, 32 nt, Human
gcacccucucugagaggcaacagaagcagcaa

SEQ ID NO: 432906 - RNA, 32 nt, Human
gcacccucucuuccucugcucuuccacccuuu

SEQ ID NO: 432907 - RNA, 32 nt, Human
gcacccucugaccucagcagagcuccugggcc

SEQ ID NO: 432908 - RNA, 32 nt, Human
gcacccucugcagccccacuccugggccuucu

SEQ ID NO: 432909 - RNA, 32 nt, Human
gcacccucugcagccuuggugccuguagcucu

SEQ ID NO: 432910 - RNA, 18 nt, Human
gcacccucuuguacuuca

SEQ ID NO: 432911 - RNA, 32 nt, Human
gcacccugaaauggacuaaggccagcuuucau

SEQ ID NO: 432912 - RNA, 32 nt, Human
gcacccugagccuguaccuuggguggcacuug

SEQ ID NO: 432913 - RNA, 32 nt, Human
gcacccugcaagccagccuggccagcugcuca

SEQ ID NO: 432914 - RNA, 32 nt, Human
gcacccugcacucccucccuugccuguagaug

SEQ ID NO: 432915 - RNA, 32 nt, Human
gcacccugcacucuagccugggcaacaagagc

SEQ ID NO: 432916 - RNA, 21 nt, Human
gcacccugccaggccccuggg

SEQ ID NO: 432917 - RNA, 32 nt, Human
gcacccugcccagaaugcccagaagagaacca

SEQ ID NO: 432918 - RNA, 32 nt, Human
gcacccugccccacccccgccaugucccacua

SEQ ID NO: 432919 - RNA, 32 nt, Human
gcacccuggagaccacauccuguccaucgaug

SEQ ID NO: 432920 - RNA, 32 nt, Human
gcacccuggccuggccccugguccuucacugg

SEQ ID NO: 432921 - RNA, 32 nt, Human
gcacccugggaggccagcuggucagucccuug

SEQ ID NO: 432922 - RNA, 32 nt, Human
gcacccugggauggcgaggagggaacuuggcg

SEQ ID NO: 432923 - RNA, 32 nt, Human
gcacccuggggagauugauuguccuuaaaccu

SEQ ID NO: 432924 - RNA, 32 nt, Human
gcacccuggggaggggacccagugcagugaug

SEQ ID NO: 432925 - RNA, 32 nt, Human
gcacccugggggcacagcuggaagagaggccu

SEQ ID NO: 432926 - RNA, 32 nt, Human
gcacccuggggucuacacggguuaaaaacgcg

SEQ ID NO: 432927 - RNA, 31 nt, Human
gcacccugguuggaaagaggggugaggauuc

SEQ ID NO: 432928 - RNA, 32 nt, Human
gcacccuguagcuccugcucccugugacccca

SEQ ID NO: 432929 - RNA, 32 nt, Human
gcacccuguagucccagcuacucaggaggcug

SEQ ID NO: 432930 - RNA, 32 nt, Human
gcacccugugcacuuuaaucuccugucgguac

SEQ ID NO: 432931 - RNA, 32 nt, Human
gcacccuguucugagacuucugaggcugcccc

SEQ ID NO: 432932 - RNA, 32 nt, Human
gcacccuucuuuccucuuccccuugcccuugc

SEQ ID NO: 432933 - RNA, 32 nt, Human
gcacccuugaagcaugucauugucagugauac

SEQ ID NO: 432934 - RNA, 32 nt, Human
gcacccuugaugagcugagauaaggccaacau

SEQ ID NO: 432935 - RNA, 32 nt, Human
gcacccuuguacagugucugugccauggauuu

SEQ ID NO: 432936 - RNA, 32 nt, Human
gcacccuuucugggucccuccugguucccugu

SEQ ID NO: 432937 - RNA, 20 nt, Human
gcaccgaagggacccugggc

SEQ ID NO: 432938 - RNA, 32 nt, Human
gcaccgacaaaucugauuugccauaaagcauu

SEQ ID NO: 432939 - RNA, 32 nt, Human
gcaccgacaccccgacagagacagagacacag

SEQ ID NO: 432940 - RNA, 17 nt, Human
gcaccgaccccaccacc

SEQ ID NO: 432941 - RNA, 32 nt, Human
gcaccgagaacaagagccauacucugaugaaa

SEQ ID NO: 432942 - RNA, 32 nt, Human
gcaccgagagggcuggagugcaguggcgugau

SEQ ID NO: 432943 - RNA, 32 nt, Human
gcaccgagagugagcagcaggaguuccuggaa

SEQ ID NO: 432944 - RNA, 32 nt, Human
gcaccgagagugagcgagggcugugaggacug

SEQ ID NO: 432945 - RNA, 32 nt, Human
gcaccgaggcaggggugggggaauguguacug

SEQ ID NO: 432946 - RNA, 32 nt, Human
gcaccgaggcggggcuccccaggaucccacgg

SEQ ID NO: 432947 - RNA, 32 nt, Human
gcaccgaggucuucaccugcaagugggccagg

SEQ ID NO: 432948 - RNA, 32 nt, Human
gcaccgauccacucagcggagccccaggcccc

SEQ ID NO: 432949 - RNA, 32 nt, Human
gcaccgauccuuaccagagaacucucuggaac

SEQ ID NO: 432950 - RNA, 32 nt, Human
gcaccgauugagcccucagagccugacacgua

SEQ ID NO: 432951 - RNA, 32 nt, Human
gcaccgauuggcuucucuagaaacccgacacc

SEQ ID NO: 432952 - RNA, 32 nt, Human
gcaccgcacacauauccaugcacacaaacaca

SEQ ID NO: 432953 - RNA, 32 nt, Human
gcaccgcagccugucagccaacauugccuugc

SEQ ID NO: 432954 - RNA, 32 nt, Human
gcaccgccagccgccucuuccccacgcacagg

SEQ ID NO: 432955 - RNA, 32 nt, Human
gcaccgccaggcgcggagcccagaucgccccc

SEQ ID NO: 432956 - RNA, 32 nt, Human
gcaccgcccccacuccuggaguccagcccggc

SEQ ID NO: 432957 - RNA, 19 nt, Human
gcaccgcccgcccugccag

SEQ ID NO: 432958 - RNA, 32 nt, Human
gcaccgcccuccugcugccagagacgaggcag

SEQ ID NO: 432959 - RNA, 32 nt, Human
gcaccgccgaguuaaagaggagaaggaaaaca

SEQ ID NO: 432960 - RNA, 32 nt, Human
gcaccgccgcagaagcagccccucgaggccua

SEQ ID NO: 432961 - RNA, 32 nt, Human
gcaccgccuauccugagaacacagucagugag

SEQ ID NO: 432962 - RNA, 32 nt, Human
gcaccgccuccccaccuccaggcuuucccacu

SEQ ID NO: 432963 - RNA, 19 nt, Human
gcaccgcgauaaaaggggc

SEQ ID NO: 432964 - RNA, 18 nt, Human
gcaccgcgcaccugccac

SEQ ID NO: 432965 - RNA, 32 nt, Human
gcaccgcgcccggccccuccucccuuucaauc

SEQ ID NO: 432966 - RNA, 32 nt, Human
gcaccgcgcccggccucguccucugccccagg

SEQ ID NO: 432967 - RNA, 32 nt, Human
gcaccgcgcguccugcacucaaccccgccugg

SEQ ID NO: 432968 - RNA, 32 nt, Human
gcaccgcggaggcuggagccgcaauggugcug

SEQ ID NO: 432969 - RNA, 32 nt, Human
gcaccgcggcccgggacgacagccugggcuca

SEQ ID NO: 432970 - RNA, 32 nt, Human
gcaccgcuacacuccagccugggugacagagu

SEQ ID NO: 432971 - RNA, 32 nt, Human
gcaccgcuauacucccagcuguuggggaggcu

SEQ ID NO: 432972 - RNA, 32 nt, Human
gcaccgcucaccgacaccgaggcggacuggca

SEQ ID NO: 432973 - RNA, 18 nt, Human
gcaccgcuccccacccca

SEQ ID NO: 432974 - RNA, 19 nt, Human
gcaccgcuccugcgugcgc

SEQ ID NO: 432975 - RNA, 32 nt, Human
gcaccgcucguuuguagcgucaccucaggucu

SEQ ID NO: 432976 - RNA, 20 nt, Human
gcaccgcucugcagcgcggc

SEQ ID NO: 432977 - RNA, 32 nt, Human
gcaccgcugcacuccaaccugggcaacagagu

SEQ ID NO: 432978 - RNA, 32 nt, Human
gcaccgcugcacuccagccuggcaacagagca

SEQ ID NO: 432979 - RNA, 32 nt, Human
gcaccgcugcacuccagccuggcgacagagcg

SEQ ID NO: 432980 - RNA, 32 nt, Human
gcaccgcugcacuccagccugggcaacagagu

SEQ ID NO: 432981 - RNA, 32 nt, Human
gcaccgcugcacuccagccugggcaagagaau

SEQ ID NO: 432982 - RNA, 32 nt, Human
gcaccgcugcacuccagccugggugacagaau

SEQ ID NO: 432983 - RNA, 32 nt, Human
gcaccgcugcacuccagccugggugacagagc

SEQ ID NO: 432984 - RNA, 32 nt, Human
gcaccgcugcacucgcggccggcgaugcggga

SEQ ID NO: 432985 - RNA, 32 nt, Human
gcaccgcugcagcugccgauguagccucggua

SEQ ID NO: 432986 - RNA, 32 nt, Human
gcaccgcugcccuccagccugggcaacaagag

SEQ ID NO: 432987 - RNA, 19 nt, Human
gcaccgcugcuacggcggc

SEQ ID NO: 432988 - RNA, 32 nt, Human
gcaccgcuggccacagaugaacagccuccuca

SEQ ID NO: 432989 - RNA, 32 nt, Human
gcaccgcuggguucugacucuggaccaugcug

SEQ ID NO: 432990 - RNA, 32 nt, Human
gcaccgcuguacuccagccugggcaacagagg

SEQ ID NO: 432991 - RNA, 32 nt, Human
gcaccgcuucagggacggagacaggaccggcg

SEQ ID NO: 432992 - RNA, 22 nt, Human
gcaccgcuucuguugaagcagg

SEQ ID NO: 432993 - RNA, 32 nt, Human
gcaccgcuuguccuagggaaguccugcgugga

SEQ ID NO: 432994 - RNA, 32 nt, Human
gcaccggaccauugagacauuugccaaggagg

SEQ ID NO: 432995 - RNA, 20 nt, Human
gcaccggagccuugccacca

SEQ ID NO: 432996 - RNA, 19 nt, Human
gcaccggcagaggcugcgg

SEQ ID NO: 432997 - RNA, 32 nt, Human
gcaccggcagcucuuggcaagguguuuaauaa

SEQ ID NO: 432998 - RNA, 32 nt, Human
gcaccggccagcugcgagacgugacuugggga

SEQ ID NO: 432999 - RNA, 32 nt, Human
gcaccggcgaaccugccugggcaggcagcucg

SEQ ID NO: 433000 - RNA, 32 nt, Human
gcaccggcggagaugccugggaagaaggcgcg

SEQ ID NO: 433001 - RNA, 21 nt, Human
gcaccggcggcggcagggcga

SEQ ID NO: 433002 - RNA, 22 nt, Human
gcaccggcucccaccuggcugg

SEQ ID NO: 433003 - RNA, 32 nt, Human
gcaccggcucccaccuggcugggaacauggga

SEQ ID NO: 433004 - RNA, 32 nt, Human
gcaccgggaccugcugaugguggagaaugagc

SEQ ID NO: 433005 - RNA, 32 nt, Human
gcaccgggaggcgggcccugcguggggccgcg

SEQ ID NO: 433006 - RNA, 32 nt, Human
gcaccgggcauggugcaugccuguaaucccag

SEQ ID NO: 433007 - RNA, 32 nt, Human
gcaccgguccaaccccuucauccccagcugcu

SEQ ID NO: 433008 - RNA, 32 nt, Human
gcaccgguuccaguggaucagaaaccugguuc

SEQ ID NO: 433009 - RNA, 32 nt, Human
gcaccguaaccagcgccgcggacaccggcacc

SEQ ID NO: 433010 - RNA, 31 nt, Human
gcaccguagugccuugggccuguguguuaaa

SEQ ID NO: 433011 - RNA, 32 nt, Human
gcaccgucccaccucugccacccuccgauggg

SEQ ID NO: 433012 - RNA, 24 nt, Human
gcaccguccucagcaguccacaaa

SEQ ID NO: 433013 - RNA, 32 nt, Human
gcaccgugacacuccagccugggcaacagaag

SEQ ID NO: 433014 - RNA, 32 nt, Human
gcaccgugagcguccuuccuccuuccucuccg

SEQ ID NO: 433015 - RNA, 32 nt, Human
gcaccgugauggagaggacagagcaggggcuc

SEQ ID NO: 433016 - RNA, 32 nt, Human
gcaccgugccaaccccacccagcuccaggccc

SEQ ID NO: 433017 - RNA, 32 nt, Human
gcaccgugccaucccugcucccagcugaggcu

SEQ ID NO: 433018 - RNA, 17 nt, Human
gcaccgugccuaccacc

SEQ ID NO: 433019 - RNA, 32 nt, Human
gcaccgugcuagaggaacuguaaugcuucaga

SEQ ID NO: 433020 - RNA, 24 nt, Human
gcaccguggcucacgccuguaauc

SEQ ID NO: 433021 - RNA, 24 nt, Human
gcaccguggcucacgucuguaauc

SEQ ID NO: 433022 - RNA, 29 nt, Human
gcaccguggcugcuauuaucugcucuccg

SEQ ID NO: 433023 - RNA, 32 nt, Human
gcaccguggcugcuauuaucugcucuccgcgc

SEQ ID NO: 433024 - RNA, 32 nt, Human
gcaccguguaccuggaaaaguugcagucacuc

SEQ ID NO: 433025 - RNA, 32 nt, Human
gcaccguguggcuccgccuccuggcccccagc

SEQ ID NO: 433026 - RNA, 32 nt, Human
gcaccguucugugcacaaaacccagaccuguu

SEQ ID NO: 433027 - RNA, 32 nt, Human
gcaccguuguacuccagccuggugauagaacg

SEQ ID NO: 433028 - RNA, 32 nt, Human
gcaccuaagccugucucugccucccugucuac

SEQ ID NO: 433029 - RNA, 32 nt, Human
gcaccuaaggaaccucugcugccagcccuucc

SEQ ID NO: 433030 - RNA, 32 nt, Human
gcaccuaaggguucugaggaaauaaauguaua

SEQ ID NO: 433031 - RNA, 32 nt, Human
gcaccuacgugcuugauucucuuaauucugug

SEQ ID NO: 433032 - RNA, 32 nt, Human
gcaccuacguuuccaccuccucccccuccuuc

SEQ ID NO: 433033 - RNA, 19 nt, Human
gcaccuacucaccauggca

SEQ ID NO: 433034 - RNA, 32 nt, Human
gcaccuacugaggaugucggcggucggggacu

SEQ ID NO: 433035 - RNA, 32 nt, Human
gcaccuagagcccuccucccagccucccguca

SEQ ID NO: 433036 - RNA, 32 nt, Human
gcaccuagccuugagcaccuuccacauagcaa

SEQ ID NO: 433037 - RNA, 32 nt, Human
gcaccuagcucaggaagccuuccuuucuaguc

SEQ ID NO: 433038 - RNA, 32 nt, Human
gcaccuaggacagugcccagcacacagugggc

SEQ ID NO: 433039 - RNA, 32 nt, Human
gcaccuagggcgcaauggaauauuccauugcc

SEQ ID NO: 433040 - RNA, 23 nt, Human
gcaccuauaauuccagcuacuca

SEQ ID NO: 433041 - RNA, 23 nt, Human
gcaccuauagucccagcuacuca

SEQ ID NO: 433042 - RNA, 32 nt, Human
gcaccuaucacccaggcuggaguggaguggca

SEQ ID NO: 433043 - RNA, 23 nt, Human
gcaccuaugguuccagcuacuca

SEQ ID NO: 433044 - RNA, 22 nt, Human
gcaccuauuaucccagcuacuc

SEQ ID NO: 433045 - RNA, 32 nt, Human
gcaccuauuugggaucauuugaggucaagaau

SEQ ID NO: 433046 - RNA, 32 nt, Human
gcaccucacagaacaaauuagcccauaaauuc

SEQ ID NO: 433047 - RNA, 32 nt, Human
gcaccucagccccuucacacauuuacacauac

SEQ ID NO: 433048 - RNA, 22 nt, Human
gcaccucagccuuuagggcuua

SEQ ID NO: 433049 - RNA, 32 nt, Human
gcaccucagcucccagcaucugggccuccucc

SEQ ID NO: 433050 - RNA, 17 nt, Human
gcaccucagcuccugcc

SEQ ID NO: 433051 - RNA, 32 nt, Human
gcaccucaugaagcuuuccuggagcacugucu

SEQ ID NO: 433052 - RNA, 32 nt, Human
gcaccucauggacucaggauccuccuggagca

SEQ ID NO: 433053 - RNA, 32 nt, Human
gcaccuccacacucccaaccacugacccuucc

SEQ ID NO: 433054 - RNA, 18 nt, Human
gcaccuccaccugcccca

SEQ ID NO: 433055 - RNA, 32 nt, Human
gcaccuccagccugggcaacagagugagacuc

SEQ ID NO: 433056 - RNA, 32 nt, Human
gcaccucccacacuccuauggucacagacuuc

SEQ ID NO: 433057 - RNA, 20 nt, Human
gcaccucccagcccucggcc

SEQ ID NO: 433058 - RNA, 32 nt, Human
gcaccucccgacaauggcgccucccagugaug

SEQ ID NO: 433059 - RNA, 32 nt, Human
gcaccucccugcagucaucucuuugcacuuug

SEQ ID NO: 433060 - RNA, 25 nt, Human
gcaccucccugccuguccuugggga

SEQ ID NO: 433061 - RNA, 32 nt, Human
gcaccucccuguggcccaaggcucucuucaca

SEQ ID NO: 433062 - RNA, 32 nt, Human
gcaccuccggaugcaguuuugauguccaucuu

SEQ ID NO: 433063 - RNA, 32 nt, Human
gcaccuccuccuggccccgcccugcccagccc

SEQ ID NO: 433064 - RNA, 32 nt, Human
gcaccuccucuccuccccagcccuguaggccu

SEQ ID NO: 433065 - RNA, 32 nt, Human
gcaccuccucucuucuccuuuugcccaaacuc

SEQ ID NO: 433066 - RNA, 19 nt, Human
gcaccuccugaaagcccca

SEQ ID NO: 433067 - RNA, 32 nt, Human
gcaccuccuucucaccugcuccucuaccugcu

SEQ ID NO: 433068 - RNA, 32 nt, Human
gcaccucgcccugccacugccucccaggaccu

SEQ ID NO: 433069 - RNA, 32 nt, Human
gcaccucggcuucggagcacccugccaggccc

SEQ ID NO: 433070 - RNA, 20 nt, Human
gcaccucguggagcggcugc

SEQ ID NO: 433071 - RNA, 20 nt, Human
gcaccucuagcagccuggac

SEQ ID NO: 433072 - RNA, 32 nt, Human
gcaccucuagggccucuccagacugugcccug

SEQ ID NO: 433073 - RNA, 32 nt, Human
gcaccucucaucacagucuaguuccaaggaaa

SEQ ID NO: 433074 - RNA, 32 nt, Human
gcaccucucccaggaagugguggggcaccggu

SEQ ID NO: 433075 - RNA, 32 nt, Human
gcaccucuccuccccucagccaccuuuuaggg

SEQ ID NO: 433076 - RNA, 32 nt, Human
gcaccucuccuccccucuuacaccuacucaga

SEQ ID NO: 433077 - RNA, 19 nt, Human
gcaccucuccuuugcccuu

SEQ ID NO: 433078 - RNA, 32 nt, Human
gcaccucucuccccaugguguuuuccacauuu

SEQ ID NO: 433079 - RNA, 32 nt, Human
gcaccucugcucccuucuccucacuacccacc

SEQ ID NO: 433080 - RNA, 23 nt, Human
gcaccucugucccaaaaccucau

SEQ ID NO: 433081 - RNA, 21 nt, Human
gcaccugaacgccaccuggcc

SEQ ID NO: 433082 - RNA, 21 nt, Human
gcaccugaagggguccacagc

SEQ ID NO: 433083 - RNA, 19 nt, Human
gcaccugacacugccauca

SEQ ID NO: 433084 - RNA, 20 nt, Human
gcaccugaccaaaggcuuca

SEQ ID NO: 433085 - RNA, 24 nt, Human
gcaccugagaaucccagcuacuca

SEQ ID NO: 433086 - RNA, 19 nt, Human
gcaccugagaccaccagcc

SEQ ID NO: 433087 - RNA, 32 nt, Human
gcaccugagcacggccccugcccgagccuggc

SEQ ID NO: 433088 - RNA, 32 nt, Human
gcaccugagguaggaggcaugggagagagugg

SEQ ID NO: 433089 - RNA, 19 nt, Human
gcaccugagguggcugagg

SEQ ID NO: 433090 - RNA, 22 nt, Human
gcaccugcaaucccagcuacuc

SEQ ID NO: 433091 - RNA, 32 nt, Human
gcaccugcaauggcuugugcuccugcuccugu

SEQ ID NO: 433092 - RNA, 32 nt, Human
gcaccugcacaaggaagacggcugggcacagg

SEQ ID NO: 433093 - RNA, 32 nt, Human
gcaccugcagcuuccgcaccuccugguccgcg

SEQ ID NO: 433094 - RNA, 32 nt, Human
gcaccugcaggaccagcaucaucuggaggcug

SEQ ID NO: 433095 - RNA, 32 nt, Human
gcaccugcagucucuuuccacuggcacuuccc

SEQ ID NO: 433096 - RNA, 32 nt, Human
gcaccugcaugcuucccgccucccacucccca

SEQ ID NO: 433097 - RNA, 20 nt, Human
gcaccugccaugugcagacu

SEQ ID NO: 433098 - RNA, 17 nt, Human
gcaccugcccaagguca

SEQ ID NO: 433099 - RNA, 19 nt, Human
gcaccugccccccauggca

SEQ ID NO: 433100 - RNA, 32 nt, Human
gcaccugcccugggcugaggccaggcugcucc

SEQ ID NO: 433101 - RNA, 21 nt, Human
gcaccugccuccagccgccgg

SEQ ID NO: 433102 - RNA, 32 nt, Human
gcaccugccuguaaucccagcuacuugggagg

SEQ ID NO: 433103 - RNA, 32 nt, Human
gcaccugccuguaaucucagcuacucaggagg

SEQ ID NO: 433104 - RNA, 32 nt, Human
gcaccugcgaauagccacugcacuccagccug

SEQ ID NO: 433105 - RNA, 25 nt, Human
gcaccugcgacaagacgcagcugaa

SEQ ID NO: 433106 - RNA, 23 nt, Human
gcaccugcgaucagcggcugggg

SEQ ID NO: 433107 - RNA, 32 nt, Human
gcaccugcgugcagccuccuguucucggcagc

SEQ ID NO: 433108 - RNA, 32 nt, Human
gcaccugcguguccagccucuccugcaugcca

SEQ ID NO: 433109 - RNA, 32 nt, Human
gcaccugcuggcugcuggaagcauaccccaag

SEQ ID NO: 433110 - RNA, 20 nt, Human
gcaccuggaacgggagccgg

SEQ ID NO: 433111 - RNA, 32 nt, Human
gcaccuggaauuggggcgcacagggaggggcg

SEQ ID NO: 433112 - RNA, 21 nt, Human
gcaccuggacaccuggcacgg

SEQ ID NO: 433113 - RNA, 20 nt, Human
gcaccuggaccagcagcugc

SEQ ID NO: 433114 - RNA, 20 nt, Human
gcaccuggaccagcuauggg

SEQ ID NO: 433115 - RNA, 20 nt, Human
gcaccuggacgcuggcgcgg

SEQ ID NO: 433116 - RNA, 32 nt, Human
gcaccuggagagaauuaacucgggaggaggug

SEQ ID NO: 433117 - RNA, 20 nt, Human
gcaccuggagccacagccgg

SEQ ID NO: 433118 - RNA, 18 nt, Human
gcaccuggaggccagcag

SEQ ID NO: 433119 - RNA, 20 nt, Human
gcaccuggaggcggccccgg

SEQ ID NO: 433120 - RNA, 32 nt, Human
gcaccuggauuccccagcuacuuggaaggcug

SEQ ID NO: 433121 - RNA, 32 nt, Human
gcaccuggcacaacaguugccccuggaaguuu

SEQ ID NO: 433122 - RNA, 22 nt, Human
gcaccuggcaucccagcuacuc

SEQ ID NO: 433123 - RNA, 32 nt, Human
gcaccuggcccugcgauggugcacugacguca

SEQ ID NO: 433124 - RNA, 23 nt, Human
gcaccuggccugaauuuuccuca

SEQ ID NO: 433125 - RNA, 32 nt, Human
gcaccuggccuggagcucaguucugaaauaag

SEQ ID NO: 433126 - RNA, 32 nt, Human
gcaccuggccuuucuguacugagcaccugguc

SEQ ID NO: 433127 - RNA, 19 nt, Human
gcaccuggcucagcuccgg

SEQ ID NO: 433128 - RNA, 32 nt, Human
gcaccuggcuccagggccaguguuacaguguu

SEQ ID NO: 433129 - RNA, 21 nt, Human
gcaccuggcucucggcugagg

SEQ ID NO: 433130 - RNA, 19 nt, Human
gcaccugggaacgcuaugg

SEQ ID NO: 433131 - RNA, 32 nt, Human
gcaccugggacccugcuccggguuagcuucac

SEQ ID NO: 433132 - RNA, 32 nt, Human
gcaccugggaggcaggcaggcaugcauguggg

SEQ ID NO: 433133 - RNA, 19 nt, Human
gcaccugggagggagcugc

SEQ ID NO: 433134 - RNA, 18 nt, Human
gcaccugggaggggcugc

SEQ ID NO: 433135 - RNA, 32 nt, Human
gcaccugggauuacaagcaugagucacuacgc

SEQ ID NO: 433136 - RNA, 21 nt, Human
gcaccugggcagccgccgcgg

SEQ ID NO: 433137 - RNA, 21 nt, Human
gcaccugggccaaagggugug

SEQ ID NO: 433138 - RNA, 18 nt, Human
gcaccugggccaccaugc

SEQ ID NO: 433139 - RNA, 20 nt, Human
gcaccugggccagcagcugc

SEQ ID NO: 433140 - RNA, 19 nt, Human
gcaccugggccagcggcug

SEQ ID NO: 433141 - RNA, 16 nt, Human
gcaccugggccccugc

SEQ ID NO: 433142 - RNA, 20 nt, Human
gcaccugggccuggaaccgg

SEQ ID NO: 433143 - RNA, 20 nt, Human
gcaccugggccuggaacugg

SEQ ID NO: 433144 - RNA, 19 nt, Human
gcaccugggcuccggccgc

SEQ ID NO: 433145 - RNA, 16 nt, Human
gcaccugggcuccugc

SEQ ID NO: 433146 - RNA, 32 nt, Human
gcaccugggcuggccucaguugaaggaucaug

SEQ ID NO: 433147 - RNA, 21 nt, Human
gcaccugggcuggcugcgcgg

SEQ ID NO: 433148 - RNA, 32 nt, Human
gcaccuggggacccagagcgagauggguuugu

SEQ ID NO: 433149 - RNA, 22 nt, Human
gcaccuggggcgccagcugcug

SEQ ID NO: 433150 - RNA, 22 nt, Human
gcaccuggggcuccagcugcug

SEQ ID NO: 433151 - RNA, 19 nt, Human
gcaccugggggccaaggca

SEQ ID NO: 433152 - RNA, 21 nt, Human
gcaccugggggcgggcugggg

SEQ ID NO: 433153 - RNA, 32 nt, Human
gcaccuggguugagagggagcagcagguaacu

SEQ ID NO: 433154 - RNA, 21 nt, Human
gcaccugguccugacgcccuu

SEQ ID NO: 433155 - RNA, 32 nt, Human
gcaccugguucacauguggcacugaccgcguc

SEQ ID NO: 433156 - RNA, 22 nt, Human
gcaccuguaaccccagcuacuc

SEQ ID NO: 433157 - RNA, 23 nt, Human
gcaccuguaaccccagcuacuca

SEQ ID NO: 433158 - RNA, 23 nt, Human
gcaccuguaaucccaacuacgca

SEQ ID NO: 433159 - RNA, 22 nt, Human
gcaccuguaaucccaacuacuc

SEQ ID NO: 433160 - RNA, 23 nt, Human
gcaccuguaaucccaacuacuca

SEQ ID NO: 433161 - RNA, 23 nt, Human
gcaccuguaaucccaccuacuca

SEQ ID NO: 433162 - RNA, 19 nt, Human
gcaccuguaaucccagcua

SEQ ID NO: 433163 - RNA, 23 nt, Human
gcaccuguaaucccagcuacccg

SEQ ID NO: 433164 - RNA, 22 nt, Human
gcaccuguaaucccagcuacuc

SEQ ID NO: 433165 - RNA, 23 nt, Human
gcaccuguaaucccagcuacuca

SEQ ID NO: 433166 - RNA, 23 nt, Human
gcaccuguaaucccagcuacucg

SEQ ID NO: 433167 - RNA, 23 nt, Human
gcaccuguaaucccagcuacuua

SEQ ID NO: 433168 - RNA, 23 nt, Human
gcaccuguaaucccagcugccca

SEQ ID NO: 433169 - RNA, 32 nt, Human
gcaccuguacacaagccccaucuccaguccug

SEQ ID NO: 433170 - RNA, 23 nt, Human
gcaccuguagucccagcuacuca

SEQ ID NO: 433171 - RNA, 19 nt, Human
gcaccuguaguccccgcua

SEQ ID NO: 433172 - RNA, 23 nt, Human
gcaccugucaccccagcuccuca

SEQ ID NO: 433173 - RNA, 22 nt, Human
gcaccugucaucccagcuacuc

SEQ ID NO: 433174 - RNA, 32 nt, Human
gcaccuguccaggcuuccuuagguacaucuuc

SEQ ID NO: 433175 - RNA, 23 nt, Human
gcaccugucgucccagcaaccca

SEQ ID NO: 433176 - RNA, 21 nt, Human
gcaccugucgucccagcuacu

SEQ ID NO: 433177 - RNA, 19 nt, Human
gcaccugugaucccagcua

SEQ ID NO: 433178 - RNA, 23 nt, Human
gcaccugugaucccagcuacuua

SEQ ID NO: 433179 - RNA, 32 nt, Human
gcaccugugccuguagucccagauacuuggga

SEQ ID NO: 433180 - RNA, 32 nt, Human
gcaccuguggccaggccuccuccugggagcuc

SEQ ID NO: 433181 - RNA, 23 nt, Human
gcaccuguggucacagcuacuca

SEQ ID NO: 433182 - RNA, 23 nt, Human
gcaccuguggucccagcuacccg

SEQ ID NO: 433183 - RNA, 22 nt, Human
gcaccuguggucccagcuacuc

SEQ ID NO: 433184 - RNA, 23 nt, Human
gcaccuguggucccagguacuca

SEQ ID NO: 433185 - RNA, 32 nt, Human
gcaccugugugugcucagcuuccagaagcugu

SEQ ID NO: 433186 - RNA, 22 nt, Human
gcaccuguugucccagcuacuc

SEQ ID NO: 433187 - RNA, 23 nt, Human
gcaccuguugucccagcuacuca

SEQ ID NO: 433188 - RNA, 32 nt, Human
gcaccuuaagccaccacccucagccacaauuu

SEQ ID NO: 433189 - RNA, 19 nt, Human
gcaccuuacgaaaggcggc

SEQ ID NO: 433190 - RNA, 32 nt, Human
gcaccuuaggaguauagggaggccccauauag

SEQ ID NO: 433191 - RNA, 32 nt, Human
gcaccuuagugccaaccugaaccaaagagacc

SEQ ID NO: 433192 - RNA, 19 nt, Human
gcaccuuccacccccagca

SEQ ID NO: 433193 - RNA, 32 nt, Human
gcaccuuccucgggggcgggccccacgcaccc

SEQ ID NO: 433194 - RNA, 20 nt, Human
gcaccuucucagccagcagc

SEQ ID NO: 433195 - RNA, 32 nt, Human
gcaccuucugggguaaugcacacaccaguaaa

SEQ ID NO: 433196 - RNA, 21 nt, Human
gcaccuucuugaaaaggaagc

SEQ ID NO: 433197 - RNA, 32 nt, Human
gcaccuucuuggaagaaaucaugucugagggu

SEQ ID NO: 433198 - RNA, 32 nt, Human
gcaccuugacuuguagauuugccuucagacag

SEQ ID NO: 433199 - RNA, 32 nt, Human
gcaccuugaggcacagaugagaagcuuggccu

SEQ ID NO: 433200 - RNA, 19 nt, Human
gcaccuugaggggcugcgg

SEQ ID NO: 433201 - RNA, 32 nt, Human
gcaccuugaguugagaggacuacauguagaaa

SEQ ID NO: 433202 - RNA, 32 nt, Human
gcaccuugcacacagucacugcagccuccuug

SEQ ID NO: 433203 - RNA, 32 nt, Human
gcaccuugcuaccugcuugcggcuuucagugg

SEQ ID NO: 433204 - RNA, 32 nt, Human
gcaccuugcugggucuguggcauuuuccaagg

SEQ ID NO: 433205 - RNA, 32 nt, Human
gcaccuuggaaagaaaaaugaagaacaacuuu

SEQ ID NO: 433206 - RNA, 32 nt, Human
gcaccuugggcacuguugaagugccuuacauu

SEQ ID NO: 433207 - RNA, 32 nt, Human
gcaccuuguccaaggagacaccacuuucaccc

SEQ ID NO: 433208 - RNA, 32 nt, Human
gcaccuuguuauuugggagacuuugagaguca

SEQ ID NO: 433209 - RNA, 32 nt, Human
gcaccuuuaaggcuuuugacaagcauaugaau

SEQ ID NO: 433210 - RNA, 32 nt, Human
gcaccuuucaugagucagguugcuuagcagau

SEQ ID NO: 433211 - RNA, 32 nt, Human
gcaccuuuccauccuccagguuucaaaauagc

SEQ ID NO: 433212 - RNA, 32 nt, Human
gcaccuuugaaucccaaguucaguacgcccgg

SEQ ID NO: 433213 - RNA, 32 nt, Human
gcaccuuugcucccccuuauccuccuuccucu

SEQ ID NO: 433214 - RNA, 32 nt, Human
gcaccuuuguacuccagccugggcaacgagca

SEQ ID NO: 433215 - RNA, 32 nt, Human
gcaccuuuguugaauugugguagcuuaggagg

SEQ ID NO: 433216 - RNA, 32 nt, Human
gcaccuuuucuccuccccagacuguccugggc

SEQ ID NO: 433217 - RNA, 20 nt, Human
gcaccuuuuucugccaucca

SEQ ID NO: 433218 - RNA, 32 nt, Human
gcacgaaauguccuccaugagcuggcuucguc

SEQ ID NO: 433219 - RNA, 32 nt, Human
gcacgaagggagcaccguggagaagacggugg

SEQ ID NO: 433220 - RNA, 18 nt, Human
gcacgaagucacaaugca

SEQ ID NO: 433221 - RNA, 32 nt, Human
gcacgaaucacugcacccagccuauggaacau

SEQ ID NO: 433222 - RNA, 21 nt, Human
gcacgaaucaugauucugcuu

SEQ ID NO: 433223 - RNA, 17 nt, Human
gcacgaaucccccacca

SEQ ID NO: 433224 - RNA, 32 nt, Human
gcacgacagggcugauggugaggaucagagca

SEQ ID NO: 433225 - RNA, 32 nt, Human
gcacgacccagccuggccacacacuguggugc

SEQ ID NO: 433226 - RNA, 32 nt, Human
gcacgacccaguucagcugucuguaaagugga

SEQ ID NO: 433227 - RNA, 21 nt, Human
gcacgacucgcguagccgugc

SEQ ID NO: 433228 - RNA, 32 nt, Human
gcacgacugcacuccagccugggcaauggagu

SEQ ID NO: 433229 - RNA, 32 nt, Human
gcacgacugugggcauaugcaaagcugaaccu

SEQ ID NO: 433230 - RNA, 32 nt, Human
gcacgagaaucacuugaacccaggaagcgggg

SEQ ID NO: 433231 - RNA, 32 nt, Human
gcacgagaaucacuugaacccaggaaguggag

SEQ ID NO: 433232 - RNA, 19 nt, Human
gcacgagaaucgcuugaac

SEQ ID NO: 433233 - RNA, 32 nt, Human
gcacgagaaugucccugagacccagaagggcc

SEQ ID NO: 433234 - RNA, 32 nt, Human
gcacgagagucccagccccauuuucuuuccua

SEQ ID NO: 433235 - RNA, 32 nt, Human
gcacgagauucacuugaaccugggagguggag

SEQ ID NO: 433236 - RNA, 20 nt, Human
gcacgagcagcggccggcgg

SEQ ID NO: 433237 - RNA, 32 nt, Human
gcacgagcaguaggaagcagucacccggaagc

SEQ ID NO: 433238 - RNA, 32 nt, Human
gcacgagcuggugggaguggugcuccagaggg

SEQ ID NO: 433239 - RNA, 32 nt, Human
gcacgaggaagagauggcagcagaggcugggg

SEQ ID NO: 433240 - RNA, 32 nt, Human
gcacgaggagagugcggcugcugagagccgag

SEQ ID NO: 433241 - RNA, 32 nt, Human
gcacgaggauuuccagcucagcgaugccccca

SEQ ID NO: 433242 - RNA, 32 nt, Human
gcacgaggcagcggcugcaggucuccaaguug

SEQ ID NO: 433243 - RNA, 32 nt, Human
gcacgaggcccagcuccuggcggagcgagcua

SEQ ID NO: 433244 - RNA, 22 nt, Human
gcacgaggcccuggguuuauua

SEQ ID NO: 433245 - RNA, 32 nt, Human
gcacgaggccgccauugacacgcacagauaga

SEQ ID NO: 433246 - RNA, 32 nt, Human
gcacgaggcugcuuaaaccucugucucugacg

SEQ ID NO: 433247 - RNA, 32 nt, Human
gcacgagggaaaugcuguuugcucgaagacgu

SEQ ID NO: 433248 - RNA, 32 nt, Human
gcacgagggagagagcgagaccugggagggag

SEQ ID NO: 433249 - RNA, 32 nt, Human
gcacgagggcacgggcggucagcugggccgca

SEQ ID NO: 433250 - RNA, 22 nt, Human
gcacgagggcccaaaggucuug

SEQ ID NO: 433251 - RNA, 19 nt, Human
gcacgagggccccaggaga

SEQ ID NO: 433252 - RNA, 32 nt, Human
gcacgagggcuacggcccuggaacggggccau

SEQ ID NO: 433253 - RNA, 32 nt, Human
gcacgagggcuggcaucucuccuuccagccca

SEQ ID NO: 433254 - RNA, 32 nt, Human
gcacgaggggaggaggaggaggaggagaggag

SEQ ID NO: 433255 - RNA, 32 nt, Human
gcacgaguccaguacuccuacuucgccaaguc

SEQ ID NO: 433256 - RNA, 21 nt, Human
gcacgagucuugccagugcuu

SEQ ID NO: 433257 - RNA, 21 nt, Human
gcacgaucucagcucacugca

SEQ ID NO: 433258 - RNA, 32 nt, Human
gcacgaucucagcucacugcaaccuccgccuc

SEQ ID NO: 433259 - RNA, 32 nt, Human
gcacgaucucagcucacugcaaccuccgucuc

SEQ ID NO: 433260 - RNA, 32 nt, Human
gcacgaucucagcucacugcaaccuuugucuc

SEQ ID NO: 433261 - RNA, 32 nt, Human
gcacgaucucagcucauugcaaccucugucuc

SEQ ID NO: 433262 - RNA, 21 nt, Human
gcacgaucucggcucacugca

SEQ ID NO: 433263 - RNA, 21 nt, Human
gcacgaucuuggcucaccgca

SEQ ID NO: 433264 - RNA, 21 nt, Human
gcacgaucuuggcucacugca

SEQ ID NO: 433265 - RNA, 30 nt, Human
gcacgauggcggcaggccuggccacguggc

SEQ ID NO: 433266 - RNA, 24 nt, Human
gcacgauggcucaaaccuguaauc

SEQ ID NO: 433267 - RNA, 24 nt, Human
gcacgauggcucacgccuguaauc

SEQ ID NO: 433268 - RNA, 30 nt, Human
gcacgauguccagcaaagcugagaagaagc

SEQ ID NO: 433269 - RNA, 32 nt, Human
gcacgcaaagcugcaggcuacaguauuggucc

SEQ ID NO: 433270 - RNA, 32 nt, Human
gcacgcaacgcagcauguggcuucauugaggc

SEQ ID NO: 433271 - RNA, 32 nt, Human
gcacgcacacacacauacagagcucucugagg

SEQ ID NO: 433272 - RNA, 32 nt, Human
gcacgcacacacuggucagucuggacccgggc

SEQ ID NO: 433273 - RNA, 32 nt, Human
gcacgcacagcgcccggagccucggcaagggg

SEQ ID NO: 433274 - RNA, 32 nt, Human
gcacgcaccacugcuucccacuggggccggcg

SEQ ID NO: 433275 - RNA, 32 nt, Human
gcacgcaccuguaaucccagcugcucuggagg

SEQ ID NO: 433276 - RNA, 32 nt, Human
gcacgcagagcaccccuucuccagcgguggga

SEQ ID NO: 433277 - RNA, 32 nt, Human
gcacgcaggcggggcaguaugugauggacugg

SEQ ID NO: 433278 - RNA, 32 nt, Human
gcacgcagggccugagaucuggccgcccauuc

SEQ ID NO: 433279 - RNA, 32 nt, Human
gcacgcagggcguggagggggaccacugcgug

SEQ ID NO: 433280 - RNA, 22 nt, Human
gcacgcauaucaaacuaugcuc

SEQ ID NO: 433281 - RNA, 22 nt, Human
gcacgcaucuguaguuccagcu

SEQ ID NO: 433282 - RNA, 32 nt, Human
gcacgcauggcugagcaugugugggugggagu

SEQ ID NO: 433283 - RNA, 32 nt, Human
gcacgcaugugcacaaacacauugcaggcagg

SEQ ID NO: 433284 - RNA, 32 nt, Human
gcacgccacugcacuccagccugggugacaga

SEQ ID NO: 433285 - RNA, 32 nt, Human
gcacgccagguggggaagggugggggugggcc

SEQ ID NO: 433286 - RNA, 32 nt, Human
gcacgccauugcacuccacacuccagccugag

SEQ ID NO: 433287 - RNA, 32 nt, Human
gcacgcccuccccagccaugucguccauccug

SEQ ID NO: 433288 - RNA, 18 nt, Human
gcacgcccuggcccggca

SEQ ID NO: 433289 - RNA, 32 nt, Human
gcacgccuauagucccagcuacacaggaggcu

SEQ ID NO: 433290 - RNA, 32 nt, Human
gcacgccuauagucccagcuacucgggaggcu

SEQ ID NO: 433291 - RNA, 32 nt, Human
gcacgccucucccugcacucccuccuggagcu

SEQ ID NO: 433292 - RNA, 32 nt, Human
gcacgccucuggucccagcugcucgggaggcc

SEQ ID NO: 433293 - RNA, 32 nt, Human
gcacgccugcagucccagcuacucaggagguu

SEQ ID NO: 433294 - RNA, 32 nt, Human
gcacgccugccugccagggccucucuggggca

SEQ ID NO: 433295 - RNA, 32 nt, Human
gcacgccuggaaucccagcacugugggaggcc

SEQ ID NO: 433296 - RNA, 32 nt, Human
gcacgccuguaaacccagcuacucgggagguu

SEQ ID NO: 433297 - RNA, 32 nt, Human
gcacgccuguaacccagcuacucaggaggcug

SEQ ID NO: 433298 - RNA, 32 nt, Human
gcacgccuguaaucccagcacuuggggaggcc

SEQ ID NO: 433299 - RNA, 32 nt, Human
gcacgccuguaaucccagcacuuugggaggcc

SEQ ID NO: 433300 - RNA, 32 nt, Human
gcacgccuguaaucccagcuacucaagagguu

SEQ ID NO: 433301 - RNA, 32 nt, Human
gcacgccuguaaucccagcuacucaggaggcu

SEQ ID NO: 433302 - RNA, 32 nt, Human
gcacgccuguaaucccagcuacucgggaggcu

SEQ ID NO: 433303 - RNA, 32 nt, Human
gcacgccuguaaucccagcuccuugggaggcu

SEQ ID NO: 433304 - RNA, 32 nt, Human
gcacgccuguaaucccagcuucuugggaggcu

SEQ ID NO: 433305 - RNA, 32 nt, Human
gcacgccuguaauccccagauacucgggaggc

SEQ ID NO: 433306 - RNA, 32 nt, Human
gcacgccuguaaucccugcuacucgggaggcu

SEQ ID NO: 433307 - RNA, 32 nt, Human
gcacgccuguaaucucagcuacuagggacgcu

SEQ ID NO: 433308 - RNA, 32 nt, Human
gcacgccuguaaucucagcuacuugggaggcu

SEQ ID NO: 433309 - RNA, 32 nt, Human
gcacgccuguaaugccagcuacuugggaggcu

SEQ ID NO: 433310 - RNA, 20 nt, Human
gcacgccuguagucccagcu

SEQ ID NO: 433311 - RNA, 32 nt, Human
gcacgccuguagucccagcuacucaggaggcu

SEQ ID NO: 433312 - RNA, 32 nt, Human
gcacgccuguagucccagcuacucgggaggcu

SEQ ID NO: 433313 - RNA, 32 nt, Human
gcacgccuguagucccagcuacuugggaggcu

SEQ ID NO: 433314 - RNA, 32 nt, Human
gcacgccuguagucucagcuacucaggaggcu

SEQ ID NO: 433315 - RNA, 20 nt, Human
gcacgccuguaguuccagcu

SEQ ID NO: 433316 - RNA, 32 nt, Human
gcacgccuguaguuccagcuacucaggaggcu

SEQ ID NO: 433317 - RNA, 32 nt, Human
gcacgccuguauucccagcuacuugggaggcu

SEQ ID NO: 433318 - RNA, 32 nt, Human
gcacgccugugacucaaggggacuucuguuuu

SEQ ID NO: 433319 - RNA, 32 nt, Human
gcacgccugugaucacagcuacucgggaggcu

SEQ ID NO: 433320 - RNA, 32 nt, Human
gcacgccugugaucccagcuacucgggaggcu

SEQ ID NO: 433321 - RNA, 32 nt, Human
gcacgccugugaucccagcuacuggggagacu

SEQ ID NO: 433322 - RNA, 32 nt, Human
gcacgccuguggucccagcuacacaggaggcu

SEQ ID NO: 433323 - RNA, 32 nt, Human
gcacgccuguggucccagcuauucaggaggcu

SEQ ID NO: 433324 - RNA, 32 nt, Human
gcacgccuguggucccagcugcuggggaggcu

SEQ ID NO: 433325 - RNA, 32 nt, Human
gcacgccuguuaucacagcuacuugggaggca

SEQ ID NO: 433326 - RNA, 32 nt, Human
gcacgccuuagucccagcuacuugggaggcug

SEQ ID NO: 433327 - RNA, 32 nt, Human
gcacgccuuuaaucccagcuacucgggaggcu

SEQ ID NO: 433328 - RNA, 32 nt, Human
gcacgcgcacacacucacgcacacacaagcag

SEQ ID NO: 433329 - RNA, 15 nt, Human
gcacgcgcagcuggg

SEQ ID NO: 433330 - RNA, 32 nt, Human
gcacgcgcagggagagauccaucucugcuguc

SEQ ID NO: 433331 - RNA, 32 nt, Human
gcacgcgccaccuguauuuuuguauuuuuagu

SEQ ID NO: 433332 - RNA, 32 nt, Human
gcacgcgccuguaaucccagcuacucgggagg

SEQ ID NO: 433333 - RNA, 32 nt, Human
gcacgcgccuguaaucccagcuacuugggagg

SEQ ID NO: 433334 - RNA, 22 nt, Human
gcacgcggcucugcacccgcgc

SEQ ID NO: 433335 - RNA, 32 nt, Human
gcacgcgggucacucauucccacugaggcccg

SEQ ID NO: 433336 - RNA, 32 nt, Human
gcacgcuccgcagcccagcccagccgggagac

SEQ ID NO: 433337 - RNA, 32 nt, Human
gcacgcucuggccccaggcuugugccccaccc

SEQ ID NO: 433338 - RNA, 32 nt, Human
gcacgcucuguucccucaggugccauucuccc

SEQ ID NO: 433339 - RNA, 32 nt, Human
gcacgcugcagcccggaguccccguucacacu

SEQ ID NO: 433340 - RNA, 32 nt, Human
gcacgcugcugccaagcugcaggauggugcac

SEQ ID NO: 433341 - RNA, 32 nt, Human
gcacgcuggcuggcucguagccccagaauggc

SEQ ID NO: 433342 - RNA, 32 nt, Human
gcacgcugguccugggggcuggagaggaaccg

SEQ ID NO: 433343 - RNA, 32 nt, Human
gcacgcugugccccugaugaugugggagagga

SEQ ID NO: 433344 - RNA, 32 nt, Human
gcacgcuuguaaucccagcuacucaggagucu

SEQ ID NO: 433345 - RNA, 32 nt, Human
gcacgcuuguaaucccagcuacucuggaggcu

SEQ ID NO: 433346 - RNA, 32 nt, Human
gcacggaagaguuugucuugcuuuaagauuag

SEQ ID NO: 433347 - RNA, 32 nt, Human
gcacggacgaggcagaggaguggccgguccca

SEQ ID NO: 433348 - RNA, 32 nt, Human
gcacggacgaucccuaaacugccuuguaaaca

SEQ ID NO: 433349 - RNA, 32 nt, Human
gcacggagagaagggcagaugugcagggagac

SEQ ID NO: 433350 - RNA, 32 nt, Human
gcacggagauugaagagcagaggcagaaacuu

SEQ ID NO: 433351 - RNA, 32 nt, Human
gcacggagcaggguuucuacagcugcucccca

SEQ ID NO: 433352 - RNA, 32 nt, Human
gcacggagccgucaguccacuguuacgggaga

SEQ ID NO: 433353 - RNA, 32 nt, Human
gcacggagcggaagggagagcaggggagagaa

SEQ ID NO: 433354 - RNA, 32 nt, Human
gcacggaggaaagacaugcccaagaggaagga

SEQ ID NO: 433355 - RNA, 32 nt, Human
gcacggaggacccccuacccacccuggaauga

SEQ ID NO: 433356 - RNA, 24 nt, Human
gcacggaggcucacgccuguaauc

SEQ ID NO: 433357 - RNA, 32 nt, Human
gcacggaugagcacaacccuggagcugcacag

SEQ ID NO: 433358 - RNA, 32 nt, Human
gcacggcaccuguuccaacaccuacugugccu

SEQ ID NO: 433359 - RNA, 31 nt, Human
gcacggcagagagucuggugggguggagggg

SEQ ID NO: 433360 - RNA, 32 nt, Human
gcacggcagccacacaccgguauuccaaaccu

SEQ ID NO: 433361 - RNA, 32 nt, Human
gcacggcagcuguucuuggaacagggcgacaa

SEQ ID NO: 433362 - RNA, 27 nt, Human
gcacggccaacccucaaugaacuacca

SEQ ID NO: 433363 - RNA, 23 nt, Human
gcacggccacccugcccuggcua

SEQ ID NO: 433364 - RNA, 24 nt, Human
gcacggccacugcggccgccggcc

SEQ ID NO: 433365 - RNA, 32 nt, Human
gcacggcccgaccuguacccagccuggcagga

SEQ ID NO: 433366 - RNA, 32 nt, Human
gcacggcccgggaagugcagcaggcagcuuuu

SEQ ID NO: 433367 - RNA, 32 nt, Human
gcacggcccuaaaaccauggaggagggcggca

SEQ ID NO: 433368 - RNA, 32 nt, Human
gcacggcccuggaagagacgucgccuccccuu

SEQ ID NO: 433369 - RNA, 32 nt, Human
gcacggcccuggaagagacgucgccucgccuu

SEQ ID NO: 433370 - RNA, 32 nt, Human
gcacggccggcccugggcaggcgguagccaug

SEQ ID NO: 433371 - RNA, 23 nt, Human
gcacggccgggccccuccugcca

SEQ ID NO: 433372 - RNA, 32 nt, Human
gcacggccucaagguagugaggcuaggagguu

SEQ ID NO: 433373 - RNA, 32 nt, Human
gcacggccuguccgcugcacaccagcuuguug

SEQ ID NO: 433374 - RNA, 21 nt, Human
gcacggccugugcuccugaca

SEQ ID NO: 433375 - RNA, 32 nt, Human
gcacggcgccagccccuccagcccaccagggc

SEQ ID NO: 433376 - RNA, 32 nt, Human
gcacggcggcggcagaggcggcggcggccggg

SEQ ID NO: 433377 - RNA, 24 nt, Human
gcacggcggcucacgccuguaauc

SEQ ID NO: 433378 - RNA, 32 nt, Human
gcacggcgucccugagggcccuucccaaccuc

SEQ ID NO: 433379 - RNA, 32 nt, Human
gcacggcuauaaaccacuagcugcuucaacug

SEQ ID NO: 433380 - RNA, 24 nt, Human
gcacggcucucucaugaccagcuc

SEQ ID NO: 433381 - RNA, 18 nt, Human
gcacggcucuguccccag

SEQ ID NO: 433382 - RNA, 32 nt, Human
gcacggcugcugcgcggguaaggaaccucgcu

SEQ ID NO: 433383 - RNA, 32 nt, Human
gcacggcugggaugugagggaggacucagauc

SEQ ID NO: 433384 - RNA, 32 nt, Human
gcacggcuucccuuuuugaaaccagggaggcu

SEQ ID NO: 433385 - RNA, 32 nt, Human
gcacgggagagggaggggcaacagagguccag

SEQ ID NO: 433386 - RNA, 21 nt, Human
gcacgggaggcgaccgugcuc

SEQ ID NO: 433387 - RNA, 32 nt, Human
gcacgggaggggaggugacggcuggugacuga

SEQ ID NO: 433388 - RNA, 22 nt, Human
gcacgggcaaggcggagaguga

SEQ ID NO: 433389 - RNA, 32 nt, Human
gcacgggcggagccgcacagggcggggaagag

SEQ ID NO: 433390 - RNA, 22 nt, Human
gcacgggcggcggcggcgugga

SEQ ID NO: 433391 - RNA, 32 nt, Human
gcacggggcauuccugcuucucucucaggcca

SEQ ID NO: 433392 - RNA, 32 nt, Human
gcacggggcccaggcuagagugcaguggcgug

SEQ ID NO: 433393 - RNA, 17 nt, Human
gcacggggccuuuccca

SEQ ID NO: 433394 - RNA, 32 nt, Human
gcacggggccuuucccacccacccucagccag

SEQ ID NO: 433395 - RNA, 32 nt, Human
gcacgggggaggaggagguagggggcaguaaa

SEQ ID NO: 433396 - RNA, 24 nt, Human
gcacggguauacacauaaugcagu

SEQ ID NO: 433397 - RNA, 31 nt, Human
gcacggguccacuucuuaaccuuccuuuuaa

SEQ ID NO: 433398 - RNA, 32 nt, Human
gcacgggucggccgcaauccagccugggcgga

SEQ ID NO: 433399 - RNA, 24 nt, Human
gcacgguaccucacaccuguaauc

SEQ ID NO: 433400 - RNA, 18 nt, Human
gcacgguaccugccacca

SEQ ID NO: 433401 - RNA, 24 nt, Human
gcacgguagcucacaccuguaauc

SEQ ID NO: 433402 - RNA, 32 nt, Human
gcacggucgguacaaaugcauggcagguguga

SEQ ID NO: 433403 - RNA, 24 nt, Human
gcacggugacucacacuuguaauc

SEQ ID NO: 433404 - RNA, 32 nt, Human
gcacggugcaaagugggccuucccugggcugu

SEQ ID NO: 433405 - RNA, 32 nt, Human
gcacggugccaccuccacacucaccucaccuc

SEQ ID NO: 433406 - RNA, 32 nt, Human
gcacggugcccagguuggccuccugcugggug

SEQ ID NO: 433407 - RNA, 32 nt, Human
gcacggugccucagcacuccccaaaacauccc

SEQ ID NO: 433408 - RNA, 32 nt, Human
gcacgguggcagggaggcggcguugcgguggc

SEQ ID NO: 433409 - RNA, 24 nt, Human
gcacgguggcucacaccuauaauc

SEQ ID NO: 433410 - RNA, 22 nt, Human
gcacgguggcucacaccuguaa

SEQ ID NO: 433411 - RNA, 24 nt, Human
gcacgguggcucacaccuguaauc

SEQ ID NO: 433412 - RNA, 24 nt, Human
gcacgguggcucacaccugugauc

SEQ ID NO: 433413 - RNA, 24 nt, Human
gcacgguggcucacagcuauaauc

SEQ ID NO: 433414 - RNA, 24 nt, Human
gcacgguggcucacgccuauaauc

SEQ ID NO: 433415 - RNA, 22 nt, Human
gcacgguggcucacgccuguaa

SEQ ID NO: 433416 - RNA, 24 nt, Human
gcacgguggcucacgccuguaauc

SEQ ID NO: 433417 - RNA, 24 nt, Human
gcacgguggcucacuccuguaauc

SEQ ID NO: 433418 - RNA, 24 nt, Human
gcacgguggcucauaccuguaauc

SEQ ID NO: 433419 - RNA, 32 nt, Human
gcacgguggcugcuggccacaccacggcaagu

SEQ ID NO: 433420 - RNA, 22 nt, Human
gcacgguggcuuacaccuguaa

SEQ ID NO: 433421 - RNA, 32 nt, Human
gcacgguggugaggcaguugagaaaauuugaa

SEQ ID NO: 433422 - RNA, 24 nt, Human
gcacggugucucacaucuguaauc

SEQ ID NO: 433423 - RNA, 32 nt, Human
gcacgguuccuccucuccccagccugggaaga

SEQ ID NO: 433424 - RNA, 18 nt, Human
gcacgguugccugagguc

SEQ ID NO: 433425 - RNA, 32 nt, Human
gcacguacggccgccucuuccagaagcucugc

SEQ ID NO: 433426 - RNA, 32 nt, Human
gcacguagaagguaggaguaagaaaagcuaag

SEQ ID NO: 433427 - RNA, 32 nt, Human
gcacguaggugucuaacacagaggagaguagg

SEQ ID NO: 433428 - RNA, 23 nt, Human
gcacgucaaagaggcuccagaaa

SEQ ID NO: 433429 - RNA, 32 nt, Human
gcacgucaggaggaaaaagugaggaaaaagga

SEQ ID NO: 433430 - RNA, 21 nt, Human
gcacgucccggaccugugggg

SEQ ID NO: 433431 - RNA, 32 nt, Human
gcacguccggccagggcaggcggugcggcauc

SEQ ID NO: 433432 - RNA, 32 nt, Human
gcacguccgggcaguggagggagggacacagc

SEQ ID NO: 433433 - RNA, 32 nt, Human
gcacgucggccccagcccugaggagccggacc

SEQ ID NO: 433434 - RNA, 32 nt, Human
gcacgucuaggaagaagggaagagguggaaac

SEQ ID NO: 433435 - RNA, 32 nt, Human
gcacgucuccccagguccugggaguggcuacc

SEQ ID NO: 433436 - RNA, 32 nt, Human
gcacgucucuagucucagcuacucaggaggcu

SEQ ID NO: 433437 - RNA, 32 nt, Human
gcacgucuguaaucccagcuacuccagaggcu

SEQ ID NO: 433438 - RNA, 32 nt, Human
gcacgucuguaaucccagcugcucgggaggcu

SEQ ID NO: 433439 - RNA, 25 nt, Human
gcacgucuguagucccagcuacuca

SEQ ID NO: 433440 - RNA, 32 nt, Human
gcacgucuguagucccagcuacucaggaggcu

SEQ ID NO: 433441 - RNA, 32 nt, Human
gcacgucuucauugaucuccccacgcugcaga

SEQ ID NO: 433442 - RNA, 32 nt, Human
gcacgucuucccuucucucccugcugcggcac

SEQ ID NO: 433443 - RNA, 32 nt, Human
gcacgugaagucacggguaggggccaggcccc

SEQ ID NO: 433444 - RNA, 32 nt, Human
gcacgugaagucauugaggcccugcugcgaaa

SEQ ID NO: 433445 - RNA, 32 nt, Human
gcacgugcacacacauacacacacauccauua

SEQ ID NO: 433446 - RNA, 32 nt, Human
gcacgugcacacacgcacgcacgcgugcacac

SEQ ID NO: 433447 - RNA, 32 nt, Human
gcacgugcccggcccugcuccacacgagcuuc

SEQ ID NO: 433448 - RNA, 32 nt, Human
gcacgugccucucugaauccagccugccauuc

SEQ ID NO: 433449 - RNA, 32 nt, Human
gcacgugccuguaaucccagcuacucgggagg

SEQ ID NO: 433450 - RNA, 32 nt, Human
gcacgugccuguaaucucagcuacucaggagg

SEQ ID NO: 433451 - RNA, 32 nt, Human
gcacgugccuguaauuccagcuacuugggagg

SEQ ID NO: 433452 - RNA, 32 nt, Human
gcacgugccuguagucccagcuacucgggaag

SEQ ID NO: 433453 - RNA, 32 nt, Human
gcacgugccuguagucccagcuacucgggagg

SEQ ID NO: 433454 - RNA, 32 nt, Human
gcacgugccuguagucccagcuccuugggagg

SEQ ID NO: 433455 - RNA, 32 nt, Human
gcacgugccuguuaucucagcuacuugggaag

SEQ ID NO: 433456 - RNA, 32 nt, Human
gcacgugcuggaccccggcgucuccggcugca

SEQ ID NO: 433457 - RNA, 32 nt, Human
gcacgugcugggccugcuggagcugcugcagc

SEQ ID NO: 433458 - RNA, 32 nt, Human
gcacgugcuguaagauuuccugagcauuacag

SEQ ID NO: 433459 - RNA, 25 nt, Human
gcacgugcuuggcauuaccugguca

SEQ ID NO: 433460 - RNA, 32 nt, Human
gcacguggagccacggcgugggaguagggggc

SEQ ID NO: 433461 - RNA, 32 nt, Human
gcacguggagcuucuugaaaugacagggugaa

SEQ ID NO: 433462 - RNA, 32 nt, Human
gcacguggccauguaugcuuuaaccuuaaacu

SEQ ID NO: 433463 - RNA, 32 nt, Human
gcacguggcccaggcgucuccugucaauccgu

SEQ ID NO: 433464 - RNA, 16 nt, Human
gcacguggcucacugc

SEQ ID NO: 433465 - RNA, 32 nt, Human
gcacgugggacccucuggacagccaccaagau

SEQ ID NO: 433466 - RNA, 32 nt, Human
gcacgugggugcucucucgggguggggugacu

SEQ ID NO: 433467 - RNA, 32 nt, Human
gcacgugguggguggggugcagcuggucugga

SEQ ID NO: 433468 - RNA, 32 nt, Human
gcacgugucuguaaucccagcuacucuggaga

SEQ ID NO: 433469 - RNA, 32 nt, Human
gcacguuaaagaagacagaaagcggacuaugc

SEQ ID NO: 433470 - RNA, 32 nt, Human
gcacguuacuagcugcuacauacugucugaac

SEQ ID NO: 433471 - RNA, 32 nt, Human
gcacguuauaaauaugagaaugcagcacacaa

SEQ ID NO: 433472 - RNA, 32 nt, Human
gcacguuccuuuaaucccagcuacucgggagg

SEQ ID NO: 433473 - RNA, 32 nt, Human
gcacguucgagaccagccugaccaacauggag

SEQ ID NO: 433474 - RNA, 32 nt, Human
gcacguucucaccccugucaucucagcccccu

SEQ ID NO: 433475 - RNA, 32 nt, Human
gcacguucucagcucacugcaaccuccgccuc

SEQ ID NO: 433476 - RNA, 32 nt, Human
gcacguucucugccccguuucuugccccagug

SEQ ID NO: 433477 - RNA, 32 nt, Human
gcacguugcccaagguugcacagcaagaaaag

SEQ ID NO: 433478 - RNA, 18 nt, Human
gcacguugccucccacca

SEQ ID NO: 433479 - RNA, 32 nt, Human
gcacguuggucuuugauuguucuguccucaca

SEQ ID NO: 433480 - RNA, 32 nt, Human
gcacguuuccccucauucauguggcuguacuu

SEQ ID NO: 433481 - RNA, 21 nt, Human
gcacguuugugagaagaaaug

SEQ ID NO: 433482 - RNA, 24 nt, Human
gcacguuuucucaaguaucuucuu

SEQ ID NO: 433483 - RNA, 32 nt, Human
gcacuaaacaguugccccagaaagacaugucu

SEQ ID NO: 433484 - RNA, 32 nt, Human
gcacuaaacugccucugcucucuugucuucag

SEQ ID NO: 433485 - RNA, 32 nt, Human
gcacuaacauggcacacacauacacuccugcg

SEQ ID NO: 433486 - RNA, 31 nt, Human
gcacuaacccagccucucccugugucccaca

SEQ ID NO: 433487 - RNA, 32 nt, Human
gcacuaaccccagcugccggcagugcugguuc

SEQ ID NO: 433488 - RNA, 32 nt, Human
gcacuaacucaggccagguagcccuggcagca

SEQ ID NO: 433489 - RNA, 32 nt, Human
gcacuaagcacuuuccaggcaggccuggccau

SEQ ID NO: 433490 - RNA, 32 nt, Human
gcacuaagccguagcggcagcagcagccacag

SEQ ID NO: 433491 - RNA, 32 nt, Human
gcacuaagcugguuauuucuccauuuugcaua

SEQ ID NO: 433492 - RNA, 32 nt, Human
gcacuaaugucuggugacagaguuggacucug

SEQ ID NO: 433493 - RNA, 32 nt, Human
gcacuacagacacgcgccaccaugcccggcua

SEQ ID NO: 433494 - RNA, 32 nt, Human
gcacuacagccuggacgacagagcaagacucu

SEQ ID NO: 433495 - RNA, 24 nt, Human
gcacuacagccugggcaacaagag

SEQ ID NO: 433496 - RNA, 32 nt, Human
gcacuacaggaggcaacuguggcauugcuucc

SEQ ID NO: 433497 - RNA, 32 nt, Human
gcacuacaggcacccgccaccaugcccggcua

SEQ ID NO: 433498 - RNA, 32 nt, Human
gcacuaccuucuuccucuuccuccuccuccgg

SEQ ID NO: 433499 - RNA, 32 nt, Human
gcacuacuacacuccagccuggugacagagug

SEQ ID NO: 433500 - RNA, 32 nt, Human
gcacuacuauaaucccagcugcuggggcggcu

SEQ ID NO: 433501 - RNA, 32 nt, Human
gcacuacugcacuccagacuggugacggagcg

SEQ ID NO: 433502 - RNA, 32 nt, Human
gcacuacugcacuccagccugggugacagagu

SEQ ID NO: 433503 - RNA, 32 nt, Human
gcacuacugcauuccagccugggugacauauc

SEQ ID NO: 433504 - RNA, 32 nt, Human
gcacuacuguacuccagccagggcaagagagc

SEQ ID NO: 433505 - RNA, 19 nt, Human
gcacuagacagaguggcug

SEQ ID NO: 433506 - RNA, 32 nt, Human
gcacuagagagggagggggaagagcagaaguu

SEQ ID NO: 433507 - RNA, 17 nt, Human
gcacuagagcuaaauca

SEQ ID NO: 433508 - RNA, 22 nt, Human
gcacuagcaacauuuggcuaua

SEQ ID NO: 433509 - RNA, 28 nt, Human
gcacuagcaagugcugccuaugcugaga

SEQ ID NO: 433510 - RNA, 32 nt, Human
gcacuagccaaaccucaccaacuccuaguucu

SEQ ID NO: 433511 - RNA, 32 nt, Human
gcacuaggacagggauagccugggccauggag

SEQ ID NO: 433512 - RNA, 32 nt, Human
gcacuaggaucucuggucuacaguggagggag

SEQ ID NO: 433513 - RNA, 32 nt, Human
gcacuagggauaguaacaguaccaccucguag

SEQ ID NO: 433514 - RNA, 32 nt, Human
gcacuagucaccgacagcggccuugaagacag

SEQ ID NO: 433515 - RNA, 18 nt, Human
gcacuaguuuuaaaguca

SEQ ID NO: 433516 - RNA, 18 nt, Human
gcacuauaagaaaaguua

SEQ ID NO: 433517 - RNA, 16 nt, Human
gcacuauacccuguca

SEQ ID NO: 433518 - RNA, 18 nt, Human
gcacuauacugggaguca

SEQ ID NO: 433519 - RNA, 19 nt, Human
gcacuauagagucaaguca

SEQ ID NO: 433520 - RNA, 19 nt, Human
gcacuauagcacucaagca

SEQ ID NO: 433521 - RNA, 18 nt, Human
gcacuauauauaaaguua

SEQ ID NO: 433522 - RNA, 16 nt, Human
gcacuauaucauaguc

SEQ ID NO: 433523 - RNA, 17 nt, Human
gcacuauauucuaguca

SEQ ID NO: 433524 - RNA, 32 nt, Human
gcacuauauugguaauucuuacaauggcauua

SEQ ID NO: 433525 - RNA, 32 nt, Human
gcacuaucacccaggcuggagugcaguggcau

SEQ ID NO: 433526 - RNA, 32 nt, Human
gcacuaucacugcaaccuccgccuccuggguu

SEQ ID NO: 433527 - RNA, 32 nt, Human
gcacuaucauacacacuggcugagaacuggaa

SEQ ID NO: 433528 - RNA, 32 nt, Human
gcacuaucucagcucacugcaaccuccgccuc

SEQ ID NO: 433529 - RNA, 24 nt, Human
gcacuauggcucacaccuauaauc

SEQ ID NO: 433530 - RNA, 32 nt, Human
gcacuaugggaccugcaucuccauuccuacua

SEQ ID NO: 433531 - RNA, 32 nt, Human
gcacuaugggaggccgcugcugcguggagcac

SEQ ID NO: 433532 - RNA, 32 nt, Human
gcacuauguaaauacuaguggggauucuucug

SEQ ID NO: 433533 - RNA, 32 nt, Human
gcacuauuacugcuaacguuugagugccagcu

SEQ ID NO: 433534 - RNA, 32 nt, Human
gcacuauucaaaucuacagaaaaugcucucuc

SEQ ID NO: 433535 - RNA, 25 nt, Human
gcacuauugcaaaacggguguauua

SEQ ID NO: 433536 - RNA, 32 nt, Human
gcacuauugcacuccagccugggcaacaggag

SEQ ID NO: 433537 - RNA, 32 nt, Human
gcacuauugcagcuccaguuuccugcagugau

SEQ ID NO: 433538 - RNA, 22 nt, Human
gcacucaaacauaacugugcuu

SEQ ID NO: 433539 - RNA, 32 nt, Human
gcacucaaagcccacugcggaagagggcagcc

SEQ ID NO: 433540 - RNA, 32 nt, Human
gcacucaacaugagucaagagcauccugcuuc

SEQ ID NO: 433541 - RNA, 24 nt, Human
gcacucaagccugagcaauaagaa

SEQ ID NO: 433542 - RNA, 32 nt, Human
gcacucaagccuggcgacagagcgagacuccg

SEQ ID NO: 433543 - RNA, 24 nt, Human
gcacucaagccugggcaauaagaa

SEQ ID NO: 433544 - RNA, 32 nt, Human
gcacucaagccuggugacagagcgaaacuccg

SEQ ID NO: 433545 - RNA, 32 nt, Human
gcacucaagccuugccaccgccgagccgggcu

SEQ ID NO: 433546 - RNA, 32 nt, Human
gcacucaaugcuggaaucaaauccaaagcuuu

SEQ ID NO: 433547 - RNA, 32 nt, Human
gcacucaccccucgcgcaccagucccggcccg

SEQ ID NO: 433548 - RNA, 32 nt, Human
gcacucacugcacauugcccaugugggcagcg

SEQ ID NO: 433549 - RNA, 32 nt, Human
gcacucacuucugcuucuggccaggccguagu

SEQ ID NO: 433550 - RNA, 31 nt, Human
gcacucagacaaugccuucuccauuacuuga

SEQ ID NO: 433551 - RNA, 32 nt, Human
gcacucagcacagugccuuguguauaauaggc

SEQ ID NO: 433552 - RNA, 32 nt, Human
gcacucagcaucaccccuuccuggguggcaug

SEQ ID NO: 433553 - RNA, 23 nt, Human
gcacucagcccugcccugugcag

SEQ ID NO: 433554 - RNA, 32 nt, Human
gcacucagccgcccugcccuguccucguggug

SEQ ID NO: 433555 - RNA, 32 nt, Human
gcacucagccugggugacagagcaagacuccg

SEQ ID NO: 433556 - RNA, 32 nt, Human
gcacucagcgccgaaauguccucugcaccaau

SEQ ID NO: 433557 - RNA, 20 nt, Human
gcacucaggaccacagggca

SEQ ID NO: 433558 - RNA, 32 nt, Human
gcacucaggcuggagugcagugguacgaucuu

SEQ ID NO: 433559 - RNA, 32 nt, Human
gcacucagggugggggacagcaggaucaagac

SEQ ID NO: 433560 - RNA, 32 nt, Human
gcacucaggguugaguggaguggagggaggag

SEQ ID NO: 433561 - RNA, 32 nt, Human
gcacucagguggccucgcuucccugcggguca

SEQ ID NO: 433562 - RNA, 32 nt, Human
gcacucaguguucugccucuggcagcugugcu

SEQ ID NO: 433563 - RNA, 32 nt, Human
gcacucaguucucagccuccuuccucaugccu

SEQ ID NO: 433564 - RNA, 32 nt, Human
gcacucaucaaaauguacuaauggguacucug

SEQ ID NO: 433565 - RNA, 32 nt, Human
gcacucaucugacagaaucccugaguuacagu

SEQ ID NO: 433566 - RNA, 32 nt, Human
gcacucauggccagugcuuuccaguaucuuga

SEQ ID NO: 433567 - RNA, 32 nt, Human
gcacucauggcccucucugcucugcuucuccu

SEQ ID NO: 433568 - RNA, 32 nt, Human
gcacucauuaaagugcaucacagccagagccu

SEQ ID NO: 433569 - RNA, 32 nt, Human
gcacucauuuccuccagggaacagugaaaugu

SEQ ID NO: 433570 - RNA, 23 nt, Human
gcacuccaaccuagguaacagag

SEQ ID NO: 433571 - RNA, 23 nt, Human
gcacuccaaccuggacaacagag

SEQ ID NO: 433572 - RNA, 23 nt, Human
gcacuccaaccuggacgacagag

SEQ ID NO: 433573 - RNA, 24 nt, Human
gcacuccaaccugggcaacaagag

SEQ ID NO: 433574 - RNA, 23 nt, Human
gcacuccaaccugggcaacagaa

SEQ ID NO: 433575 - RNA, 23 nt, Human
gcacuccaaccugggcaacagag

SEQ ID NO: 433576 - RNA, 32 nt, Human
gcacuccaaccugggcaacagagcaagacucg

SEQ ID NO: 433577 - RNA, 24 nt, Human
gcacuccaaccugggcaauaagag

SEQ ID NO: 433578 - RNA, 23 nt, Human
gcacuccaaccugggcagcagag

SEQ ID NO: 433579 - RNA, 20 nt, Human
gcacuccaaccugggcgaca

SEQ ID NO: 433580 - RNA, 23 nt, Human
gcacuccaaccugggcgacagag

SEQ ID NO: 433581 - RNA, 24 nt, Human
gcacuccaaccugggugacaagag

SEQ ID NO: 433582 - RNA, 23 nt, Human
gcacuccaaccugggugacagag

SEQ ID NO: 433583 - RNA, 22 nt, Human
gcacuccaaccugggugacgag

SEQ ID NO: 433584 - RNA, 23 nt, Human
gcacuccaaccugggugagagag

SEQ ID NO: 433585 - RNA, 32 nt, Human
gcacuccaaucuggcaacagagcgagaccuug

SEQ ID NO: 433586 - RNA, 32 nt, Human
gcacuccacacuccagccugagcaacaagagc

SEQ ID NO: 433587 - RNA, 32 nt, Human
gcacuccacccugggcaacagagcaagacccc

SEQ ID NO: 433588 - RNA, 32 nt, Human
gcacuccacccugggcaacagagcaagacucc

SEQ ID NO: 433589 - RNA, 32 nt, Human
gcacuccacccugggcgacagagcaagauucu

SEQ ID NO: 433590 - RNA, 23 nt, Human
gcacuccacucugggcaacagaa

SEQ ID NO: 433591 - RNA, 32 nt, Human
gcacuccacugcagcaggagggacuuaagcua

SEQ ID NO: 433592 - RNA, 32 nt, Human
gcacuccagacugggggagagagcaagacucu

SEQ ID NO: 433593 - RNA, 32 nt, Human
gcacuccagacuggugacggagcgagacgcug

SEQ ID NO: 433594 - RNA, 32 nt, Human
gcacuccagcacuccagccugggugacagagc

SEQ ID NO: 433595 - RNA, 32 nt, Human
gcacuccagccagagugacagagcaagacucc

SEQ ID NO: 433596 - RNA, 23 nt, Human
gcacuccagcccaggcaacagag

SEQ ID NO: 433597 - RNA, 23 nt, Human
gcacuccagcccaggcaauagag

SEQ ID NO: 433598 - RNA, 21 nt, Human
gcacuccagcccaggggacaa

SEQ ID NO: 433599 - RNA, 23 nt, Human
gcacuccagcccagguaacagag

SEQ ID NO: 433600 - RNA, 23 nt, Human
gcacuccagcccaggugacagag

SEQ ID NO: 433601 - RNA, 32 nt, Human
gcacuccagcccaggugacagagcaagacucc

SEQ ID NO: 433602 - RNA, 32 nt, Human
gcacuccagcccagguuacagagcaagggccu

SEQ ID NO: 433603 - RNA, 23 nt, Human
gcacuccagcccgagugacagaa

SEQ ID NO: 433604 - RNA, 32 nt, Human
gcacuccagcccggaugacagagcaagacucu

SEQ ID NO: 433605 - RNA, 20 nt, Human
gcacuccagcccgggcgaca

SEQ ID NO: 433606 - RNA, 23 nt, Human
gcacuccagcccgggcgacagag

SEQ ID NO: 433607 - RNA, 32 nt, Human
gcacuccagcccggggacagagcaagacacug

SEQ ID NO: 433608 - RNA, 21 nt, Human
gcacuccagcccgggugacaa

SEQ ID NO: 433609 - RNA, 23 nt, Human
gcacuccagcccgggugacagag

SEQ ID NO: 433610 - RNA, 32 nt, Human
gcacuccagcccgggugacagagcaagacucc

SEQ ID NO: 433611 - RNA, 32 nt, Human
gcacuccagccggggcaacagagcaagacucu

SEQ ID NO: 433612 - RNA, 27 nt, Human
gcacuccagccuaagcaaauagcaaga

SEQ ID NO: 433613 - RNA, 23 nt, Human
gcacuccagccuaagcaacagag

SEQ ID NO: 433614 - RNA, 23 nt, Human
gcacuccagccuagacaacaggg

SEQ ID NO: 433615 - RNA, 32 nt, Human
gcacuccagccuagacgacagagcaagacuau

SEQ ID NO: 433616 - RNA, 24 nt, Human
gcacuccagccuaggcaacaagag

SEQ ID NO: 433617 - RNA, 23 nt, Human
gcacuccagccuaggcaacagag

SEQ ID NO: 433618 - RNA, 24 nt, Human
gcacuccagccuaggcaauaagag

SEQ ID NO: 433619 - RNA, 25 nt, Human
gcacuccagccuaggcauggugaga

SEQ ID NO: 433620 - RNA, 23 nt, Human
gcacuccagccuaggcgacagag

SEQ ID NO: 433621 - RNA, 23 nt, Human
gcacuccagccuaggugacagag

SEQ ID NO: 433622 - RNA, 32 nt, Human
gcacuccagccuaggugacagagcaagacucu

SEQ ID NO: 433623 - RNA, 23 nt, Human
gcacuccagccuaggugauagag

SEQ ID NO: 433624 - RNA, 24 nt, Human
gcacuccagccucagcaacaagag

SEQ ID NO: 433625 - RNA, 32 nt, Human
gcacuccagccugaagacagagcaaggcucca

SEQ ID NO: 433626 - RNA, 20 nt, Human
gcacuccagccugacgacaa

SEQ ID NO: 433627 - RNA, 21 nt, Human
gcacuccagccugagcaacaa

SEQ ID NO: 433628 - RNA, 23 nt, Human
gcacuccagccugagcaacagag

SEQ ID NO: 433629 - RNA, 32 nt, Human
gcacuccagccugagcaacagagcaagacucu

SEQ ID NO: 433630 - RNA, 23 nt, Human
gcacuccagccugagcgacagag

SEQ ID NO: 433631 - RNA, 23 nt, Human
gcacuccagccugagugacagaa

SEQ ID NO: 433632 - RNA, 23 nt, Human
gcacuccagccugagugacagag

SEQ ID NO: 433633 - RNA, 22 nt, Human
gcacuccagccugaugacagag

SEQ ID NO: 433634 - RNA, 32 nt, Human
gcacuccagccugaugacagagcaagacucag

SEQ ID NO: 433635 - RNA, 24 nt, Human
gcacuccagccugcacaacaagag

SEQ ID NO: 433636 - RNA, 21 nt, Human
gcacuccagccugcgugacaa

SEQ ID NO: 433637 - RNA, 21 nt, Human
gcacuccagccuggaaaacaa

SEQ ID NO: 433638 - RNA, 23 nt, Human
gcacuccagccuggaaggcagag

SEQ ID NO: 433639 - RNA, 24 nt, Human
gcacuccagccuggacaacaagag

SEQ ID NO: 433640 - RNA, 23 nt, Human
gcacuccagccuggacaacagag

SEQ ID NO: 433641 - RNA, 32 nt, Human
gcacuccagccuggacaacagagcaagaccuu

SEQ ID NO: 433642 - RNA, 32 nt, Human
gcacuccagccuggacaacagagcaagacucc

SEQ ID NO: 433643 - RNA, 23 nt, Human
gcacuccagccuggacaacggag

SEQ ID NO: 433644 - RNA, 24 nt, Human
gcacuccagccuggacagcaggag

SEQ ID NO: 433645 - RNA, 23 nt, Human
gcacuccagccuggacgacagag

SEQ ID NO: 433646 - RNA, 32 nt, Human
gcacuccagccuggacgacagagcaagacuca

SEQ ID NO: 433647 - RNA, 23 nt, Human
gcacuccagccuggaggccagag

SEQ ID NO: 433648 - RNA, 24 nt, Human
gcacuccagccuggaugacaagag

SEQ ID NO: 433649 - RNA, 23 nt, Human
gcacuccagccuggaugacagag

SEQ ID NO: 433650 - RNA, 32 nt, Human
gcacuccagccuggaugacagagcaagacucu

SEQ ID NO: 433651 - RNA, 23 nt, Human
gcacuccagccuggaugacggga

SEQ ID NO: 433652 - RNA, 23 nt, Human
gcacuccagccuggaugauagag

SEQ ID NO: 433653 - RNA, 32 nt, Human
gcacuccagccuggcaacagagcgagacucca

SEQ ID NO: 433654 - RNA, 21 nt, Human
gcacuccagccuggcagucag

SEQ ID NO: 433655 - RNA, 21 nt, Human
gcacuccagccuggccaauaa

SEQ ID NO: 433656 - RNA, 32 nt, Human
gcacuccagccuggccacagagcgagacucca

SEQ ID NO: 433657 - RNA, 32 nt, Human
gcaggacuccggcacuaugagcggcuucagca

SEQ ID NO: 433658 - RNA, 32 nt, Human
gcaggacucggguggcucugaggucgccuggg

SEQ ID NO: 433659 - RNA, 21 nt, Human
gcaggacugaccccgggcugc

SEQ ID NO: 433660 - RNA, 32 nt, Human
gcaggacugcaacuggcgucuccaucuacugg

SEQ ID NO: 433661 - RNA, 32 nt, Human
gcaggacugccuggcccacccaugguugcagg

SEQ ID NO: 433662 - RNA, 32 nt, Human
gcaggacugccugggcccugcuaggccugcuc

SEQ ID NO: 433663 - RNA, 32 nt, Human
gcaggacugcgccguccgccucgaauucgggg

SEQ ID NO: 433664 - RNA, 32 nt, Human
gcaggacuggaagcuggcucugggugagucag

SEQ ID NO: 433665 - RNA, 25 nt, Human
gcaggacuggaggccuguggcgguc

SEQ ID NO: 433666 - RNA, 32 nt, Human
gcaggacugggcagaucccaggcugggcaugg

SEQ ID NO: 433667 - RNA, 22 nt, Human
gcaggacuguaaacuggauucc

SEQ ID NO: 433668 - RNA, 21 nt, Human
gcaggacuucugcaguccuca

SEQ ID NO: 433669 - RNA, 22 nt, Human
gcaggacuugacaagggcaagc

SEQ ID NO: 433670 - RNA, 18 nt, Human
gcaggacuugaguucuca

SEQ ID NO: 433671 - RNA, 32 nt, Human
gcaggacuugcagacuggccaggggcugcagg

SEQ ID NO: 433672 - RNA, 32 nt, Human
gcaggagaaaagugugaacccaggaggcggag

SEQ ID NO: 433673 - RNA, 19 nt, Human
gcaggagaaccgcuugaac

SEQ ID NO: 433674 - RNA, 32 nt, Human
gcaggagaagacagacugcugcuuuggaccug

SEQ ID NO: 433675 - RNA, 32 nt, Human
gcaggagaaggagacuugggaggcagcgaugg

SEQ ID NO: 433676 - RNA, 32 nt, Human
gcaggagaaggguggagaggaggcaggggccg

SEQ ID NO: 433677 - RNA, 32 nt, Human
gcaggagaauagugugaacccaggaggcggag

SEQ ID NO: 433678 - RNA, 24 nt, Human
gcaggagaaucaccugaacccagg

SEQ ID NO: 433679 - RNA, 32 nt, Human
gcaggagaaucaccugaacccaggaggcagag

SEQ ID NO: 433680 - RNA, 19 nt, Human
gcaggagaaucacuugaac

SEQ ID NO: 433681 - RNA, 32 nt, Human
gcaggagaaucacuugaacccaggaagcggag

SEQ ID NO: 433682 - RNA, 32 nt, Human
gcaggagaaucacuugaacccaggaaguggag

SEQ ID NO: 433683 - RNA, 32 nt, Human
gcaggagaaucacuugaacccaggaggcagag

SEQ ID NO: 433684 - RNA, 32 nt, Human
gcaggagaaucacuugaacccaggaggcagcu

SEQ ID NO: 433685 - RNA, 32 nt, Human
gcaggagaaucacuugaacccaggaggcggag

SEQ ID NO: 433686 - RNA, 32 nt, Human
gcaggagaaucacuugaacccaggagguagag

SEQ ID NO: 433687 - RNA, 32 nt, Human
gcaggagaaucacuugaacccaggagguggag

SEQ ID NO: 433688 - RNA, 32 nt, Human
gcaggagaaucacuugaacccaggaggugggc

SEQ ID NO: 433689 - RNA, 32 nt, Human
gcaggagaaucacuugaacccaggagguggug

SEQ ID NO: 433690 - RNA, 32 nt, Human
gcaggagaaucacuugaacccaggagguguug

SEQ ID NO: 433691 - RNA, 24 nt, Human
gcaggagaaucacuugagaccagg

SEQ ID NO: 433692 - RNA, 32 nt, Human
gcaggagaaucacuugagcccaggaaguggag

SEQ ID NO: 433693 - RNA, 32 nt, Human
gcaggagaaucagagguugcagugaaccgaga

SEQ ID NO: 433694 - RNA, 19 nt, Human
gcaggagaaucccuugaac

SEQ ID NO: 433695 - RNA, 32 nt, Human
gcaggagaaucgcaugaacccgggaggugcag

SEQ ID NO: 433696 - RNA, 32 nt, Human
gcaggagaaucgccugaacccaggaagcagau

SEQ ID NO: 433697 - RNA, 19 nt, Human
gcaggagaaucgcgugaac

SEQ ID NO: 433698 - RNA, 32 nt, Human
gcaggagaaucgcgugaacccaggaggcggag

SEQ ID NO: 433699 - RNA, 32 nt, Human
gcaggagaaucgcgugaacccaggaggcggcg

SEQ ID NO: 433700 - RNA, 19 nt, Human
gcaggagaaucgcuucaac

SEQ ID NO: 433701 - RNA, 18 nt, Human
gcaggagaaucgcuugaa

SEQ ID NO: 433702 - RNA, 19 nt, Human
gcaggagaaucgcuugaac

SEQ ID NO: 433703 - RNA, 32 nt, Human
gcaggagaaucgcuugaacccaggaagcagug

SEQ ID NO: 433704 - RNA, 19 nt, Human
gcaggagaaucgcuugagc

SEQ ID NO: 433705 - RNA, 32 nt, Human
gcaggagaaucguuugaacccaggaggcggag

SEQ ID NO: 433706 - RNA, 32 nt, Human
gcaggagaaucguuugaacccaggaggcugag

SEQ ID NO: 433707 - RNA, 19 nt, Human
gcaggagaaucucuugaac

SEQ ID NO: 433708 - RNA, 32 nt, Human
gcaggagaaugacaugaacccaggaggcggag

SEQ ID NO: 433709 - RNA, 32 nt, Human
gcaggagaaugagacuccagcacagucauucc

SEQ ID NO: 433710 - RNA, 32 nt, Human
gcaggagaauggcauaaacccaggaggccgag

SEQ ID NO: 433711 - RNA, 32 nt, Human
gcaggagaauggcaugaacccaggaggcagag

SEQ ID NO: 433712 - RNA, 32 nt, Human
gcaggagaauggcaugaacccggaaggcagag

SEQ ID NO: 433713 - RNA, 32 nt, Human
gcaggagaauggcaugaacccgggaggcagag

SEQ ID NO: 433714 - RNA, 32 nt, Human
gcaggagaauggcaugaacccgggaggcggaa

SEQ ID NO: 433715 - RNA, 32 nt, Human
gcaggagaauggcaugaacccgggaggcggag

SEQ ID NO: 433716 - RNA, 32 nt, Human
gcaggagaauggcaugaacccgggaggcggau

SEQ ID NO: 433717 - RNA, 32 nt, Human
gcaggagaauggcaugaacccgggagguagag

SEQ ID NO: 433718 - RNA, 32 nt, Human
gcaggagaauggcaugaacccgggagguggag

SEQ ID NO: 433719 - RNA, 32 nt, Human
gcaggagaauggcgugaacccaggaggaggag

SEQ ID NO: 433720 - RNA, 32 nt, Human
gcaggagaauggcgugaacccaggaggcagag

SEQ ID NO: 433721 - RNA, 32 nt, Human
gcaggagaauggcgugaacccaggaggcggag

SEQ ID NO: 433722 - RNA, 32 nt, Human
gcaggagaauggcgugaacccaggaggcguag

SEQ ID NO: 433723 - RNA, 32 nt, Human
gcaggagaauggcgugaacccaggagguggag

SEQ ID NO: 433724 - RNA, 32 nt, Human
gcaggagaauggcuugaacccaggagguggag

SEQ ID NO: 433725 - RNA, 32 nt, Human
gcaggagaauggugugaacccaggaggcacag

SEQ ID NO: 433726 - RNA, 32 nt, Human
gcaggagaauggugugaacccaggaggcagag

SEQ ID NO: 433727 - RNA, 32 nt, Human
gcaggagaaugguguggacccaggaggcagag

SEQ ID NO: 433728 - RNA, 32 nt, Human
gcaggagaauucuuugaacccaggaggcagag

SEQ ID NO: 433729 - RNA, 32 nt, Human
gcaggagaauugcaugaacccgggaggaggag

SEQ ID NO: 433730 - RNA, 32 nt, Human
gcaggagaauugcaugaacccgggaggcggag

SEQ ID NO: 433731 - RNA, 32 nt, Human
gcaggagaauugccugaacccaggaagaggag

SEQ ID NO: 433732 - RNA, 19 nt, Human
gcaggagaauugcuugaac

SEQ ID NO: 433733 - RNA, 32 nt, Human
gcaggagaauugcuugaacccaggaagcagag

SEQ ID NO: 433734 - RNA, 32 nt, Human
gcaggagaauugcuugaacccaggaagcggag

SEQ ID NO: 433735 - RNA, 32 nt, Human
gcaggagaauugcuugaacccaggaaguggca

SEQ ID NO: 433736 - RNA, 32 nt, Human
gcaggagaauugcuugagccugggagauggag

SEQ ID NO: 433737 - RNA, 32 nt, Human
gcaggagaauuguuugaacccaggaggcacag

SEQ ID NO: 433738 - RNA, 32 nt, Human
gcaggagaauuguuugaacccaggagguggac

SEQ ID NO: 433739 - RNA, 18 nt, Human
gcaggagacagcauguca

SEQ ID NO: 433740 - RNA, 32 nt, Human
gcaggagacccagaaagcagugcagugcagcu

SEQ ID NO: 433741 - RNA, 32 nt, Human
gcaggagaccccaggcccuggaggcugcaaca

SEQ ID NO: 433742 - RNA, 32 nt, Human
gcaggagacucgcuugaaccugggaggcagag

SEQ ID NO: 433743 - RNA, 32 nt, Human
gcaggagagaaaacucccucaaagucauaaau

SEQ ID NO: 433744 - RNA, 21 nt, Human
gcaggagagaaucgcuugaac

SEQ ID NO: 433745 - RNA, 18 nt, Human
gcaggagagacugagcag

SEQ ID NO: 433746 - RNA, 32 nt, Human
gcaggagagagggagggaaggucuguccaucc

SEQ ID NO: 433747 - RNA, 32 nt, Human
gcaggagagcagugaggagcugcugugugacc

SEQ ID NO: 433748 - RNA, 32 nt, Human
gcaggagagccuguccugccuccaguccaccu

SEQ ID NO: 433749 - RNA, 32 nt, Human
gcaggagaggaaagaccugcagcucuucuagu

SEQ ID NO: 433750 - RNA, 22 nt, Human
gcaggagaggaaugcagaccug

SEQ ID NO: 433751 - RNA, 32 nt, Human
gcaggagaggauccccgaccacccuagggaaa

SEQ ID NO: 433752 - RNA, 32 nt, Human
gcaggagaggaugugggggcuccacccgauca

SEQ ID NO: 433753 - RNA, 20 nt, Human
gcaggagaggccccccagca

SEQ ID NO: 433754 - RNA, 16 nt, Human
gcaggagaggcugcug

SEQ ID NO: 433755 - RNA, 19 nt, Human
gcaggagagggaaaggcag

SEQ ID NO: 433756 - RNA, 32 nt, Human
gcaggagaggggcauuuggaggcucccucccu

SEQ ID NO: 433757 - RNA, 32 nt, Human
gcaggagaguagcuggagaugaggcaggagag

SEQ ID NO: 433758 - RNA, 19 nt, Human
gcaggagagucgcuugaac

SEQ ID NO: 433759 - RNA, 32 nt, Human
gcaggagaguugcuugaacugaggagaugaag

SEQ ID NO: 433760 - RNA, 32 nt, Human
gcaggagaugcugcaggauaagggccuguccg

SEQ ID NO: 433761 - RNA, 32 nt, Human
gcaggagauguggugugcuguugcaaaguuuu

SEQ ID NO: 433762 - RNA, 32 nt, Human
gcaggagauucaccuuccccagucccagggga

SEQ ID NO: 433763 - RNA, 32 nt, Human
gcaggagauucgcuugaaccugggaggcugaa

SEQ ID NO: 433764 - RNA, 32 nt, Human
gcaggagcacguggagaggccggguagccaca

SEQ ID NO: 433765 - RNA, 32 nt, Human
gcaggagcagagccaggugggcccuggacauu

SEQ ID NO: 433766 - RNA, 32 nt, Human
gcaggagcagaggaaggcagacacccacaaga

SEQ ID NO: 433767 - RNA, 32 nt, Human
gcaggagcagcuguugugcacugugagguuga

SEQ ID NO: 433768 - RNA, 32 nt, Human
gcaggagcaggagaacuaaggaagggaaaagg

SEQ ID NO: 433769 - RNA, 32 nt, Human
gcaggagcaggaggccagaggagagugugagu

SEQ ID NO: 433770 - RNA, 32 nt, Human
gcaggagcagucgccuuucccacccacagcgc

SEQ ID NO: 433771 - RNA, 32 nt, Human
gcaggagcagugacuuucuucccacugugugu

SEQ ID NO: 433772 - RNA, 32 nt, Human
gcaggagcaguggaugaaugucuguguuggug

SEQ ID NO: 433773 - RNA, 24 nt, Human
gcaggagcaucacccagagagcag

SEQ ID NO: 433774 - RNA, 32 nt, Human
gcaggagccagagggcagcccagcuccaggua

SEQ ID NO: 433775 - RNA, 32 nt, Human
gcaggagccccacugcuuccagccucuggugc

SEQ ID NO: 433776 - RNA, 21 nt, Human
gcaggagcccggcguggagga

SEQ ID NO: 433777 - RNA, 32 nt, Human
gcaggagcccucucauggugaacagcaacuau

SEQ ID NO: 433778 - RNA, 18 nt, Human
gcaggagccugcaggaga

SEQ ID NO: 433779 - RNA, 32 nt, Human
gcaggagccugggaaagaggcccucgccaggu

SEQ ID NO: 433780 - RNA, 32 nt, Human
gcaggagcggagccccgagggagcgcgggccc

SEQ ID NO: 433781 - RNA, 22 nt, Human
gcaggagcggcggcagcagcga

SEQ ID NO: 433782 - RNA, 17 nt, Human
gcaggagcgucauggcc

SEQ ID NO: 433783 - RNA, 32 nt, Human
gcaggagcuauccugacuuaauauccaguugu

SEQ ID NO: 433784 - RNA, 21 nt, Human
gcaggagcucacgcugggagg

SEQ ID NO: 433785 - RNA, 23 nt, Human
gcaggagcuccgcgcggcugcag

SEQ ID NO: 433786 - RNA, 32 nt, Human
gcaggagcuccuggugccacaggugggguggg

SEQ ID NO: 433787 - RNA, 32 nt, Human
gcaggagcugaaaaccagaaguugaggcguga

SEQ ID NO: 433788 - RNA, 32 nt, Human
gcaggagcugcagcucugccagcuugggccga

SEQ ID NO: 433789 - RNA, 32 nt, Human
gcaggagcugcggcgccaagaugaguggagag

SEQ ID NO: 433790 - RNA, 21 nt, Human
gcaggagcuggcgcugggagg

SEQ ID NO: 433791 - RNA, 32 nt, Human
gcaggagcuguucugggcagccuucaucccgc

SEQ ID NO: 433792 - RNA, 18 nt, Human
gcaggagcuucuguggga

SEQ ID NO: 433793 - RNA, 32 nt, Human
gcaggaggaaagcacagcugagcccagcugcu

SEQ ID NO: 433794 - RNA, 32 nt, Human
gcaggaggaagacagccaccagcggcugcuca

SEQ ID NO: 433795 - RNA, 32 nt, Human
gcaggaggaccucacccacacccauggcaaag

SEQ ID NO: 433796 - RNA, 32 nt, Human
gcaggaggacgaggcagggcgggcgggcgcuc

SEQ ID NO: 433797 - RNA, 27 nt, Human
gcaggaggacuauguccuuugaugcua

SEQ ID NO: 433798 - RNA, 19 nt, Human
gcaggaggaggaagagcgg

SEQ ID NO: 433799 - RNA, 32 nt, Human
gcaggaggaggcggaggcggggguacgacggg

SEQ ID NO: 433800 - RNA, 24 nt, Human
gcaggaggaucaccugaggucagg

SEQ ID NO: 433801 - RNA, 24 nt, Human
gcaggaggaucaccuuaggucagg

SEQ ID NO: 433802 - RNA, 32 nt, Human
gcaggaggaucaccuuaggucaggaguucgag

SEQ ID NO: 433803 - RNA, 32 nt, Human
gcaggaggaucacgaggucagaagaucgagac

SEQ ID NO: 433804 - RNA, 24 nt, Human
gcaggaggaucacucaaggccagg

SEQ ID NO: 433805 - RNA, 24 nt, Human
gcaggaggaucacuuaaggccagg

SEQ ID NO: 433806 - RNA, 24 nt, Human
gcaggaggaucacuugagaccagg

SEQ ID NO: 433807 - RNA, 32 nt, Human
gcaggaggaucacuugagcuuaggaguuugag

SEQ ID NO: 433808 - RNA, 32 nt, Human
gcaggaggaucacuugagcuugggaguucaag

SEQ ID NO: 433809 - RNA, 24 nt, Human
gcaggaggaucacuugaggccagg

SEQ ID NO: 433810 - RNA, 22 nt, Human
gcaggaggaucacuugagguca

SEQ ID NO: 433811 - RNA, 24 nt, Human
gcaggaggaucacuugaggucagg

SEQ ID NO: 433812 - RNA, 32 nt, Human
gcaggaggaucauuugagcucaugagggccca

SEQ ID NO: 433813 - RNA, 19 nt, Human
gcaggaggaucgcuugaac

SEQ ID NO: 433814 - RNA, 32 nt, Human
gcaggaggaucgcuugaacccaggaagcagag

SEQ ID NO: 433815 - RNA, 32 nt, Human
gcaggaggaucgcuugaacccaggaaguggag

SEQ ID NO: 433816 - RNA, 32 nt, Human
gcaggaggaucguuugagcucaggagguuggg

SEQ ID NO: 433817 - RNA, 32 nt, Human
gcaggaggaucucuugagcccaggaggucaag

SEQ ID NO: 433818 - RNA, 32 nt, Human
gcaggaggaucucuugagcccaggaguuugag

SEQ ID NO: 433819 - RNA, 32 nt, Human
gcaggaggaucucuugagcccaggauuuugaa

SEQ ID NO: 433820 - RNA, 32 nt, Human
gcaggaggaucucuugaggccaggaguugcag

SEQ ID NO: 433821 - RNA, 32 nt, Human
gcaggaggaugggguagcacucacagggacga

SEQ ID NO: 433822 - RNA, 32 nt, Human
gcaggaggauggugccuggacaacccuccacc

SEQ ID NO: 433823 - RNA, 32 nt, Human
gcaggaggauugcuugagcucaggaguucaag

SEQ ID NO: 433824 - RNA, 32 nt, Human
gcaggaggcacagaaaacuccugcugaugguc

SEQ ID NO: 433825 - RNA, 21 nt, Human
gcaggaggcauccaaaggcuc

SEQ ID NO: 433826 - RNA, 32 nt, Human
gcaggaggccaagaagagcuagggagggugca

SEQ ID NO: 433827 - RNA, 32 nt, Human
gcaggaggccaaggcaggagaaucacuugaac

SEQ ID NO: 433828 - RNA, 32 nt, Human
gcaggaggcccaggccaaguaccaagggcaaa

SEQ ID NO: 433829 - RNA, 32 nt, Human
gcaggaggccucagcagagaucaccaagaccc

SEQ ID NO: 433830 - RNA, 32 nt, Human
gcaggaggcuaaucccacaagaaggguagcau

SEQ ID NO: 433831 - RNA, 32 nt, Human
gcaggaggcuacaguucucccuaaggauggug

SEQ ID NO: 433832 - RNA, 32 nt, Human
gcaggaggcucagcauacaucaggaggucugc

SEQ ID NO: 433833 - RNA, 20 nt, Human
gcaggaggcugaggcugcag

SEQ ID NO: 433834 - RNA, 32 nt, Human
gcaggaggcuggauccuagccccugggaucug

SEQ ID NO: 433835 - RNA, 32 nt, Human
gcaggaggcuuucugggcucuggacuccacgg

SEQ ID NO: 433836 - RNA, 32 nt, Human
gcaggagggaaacacacuucacacaacaggcu

SEQ ID NO: 433837 - RNA, 32 nt, Human
gcaggagggaagggcaucuggggaagggcagg

SEQ ID NO: 433838 - RNA, 32 nt, Human
gcaggagggaccaaggcugggcccagaacaca

SEQ ID NO: 433839 - RNA, 32 nt, Human
gcaggagggacugaggcccucuaggaggaaag

SEQ ID NO: 433840 - RNA, 20 nt, Human
gcaggagggauggcuggggc

SEQ ID NO: 433841 - RNA, 32 nt, Human
gcaggagggcaggaguugggggagcaggaggg

SEQ ID NO: 433842 - RNA, 32 nt, Human
gcaggagggcaggcgagacaaggagggugucc

SEQ ID NO: 433843 - RNA, 23 nt, Human
gcaggagggcaugugcagacacu

SEQ ID NO: 433844 - RNA, 32 nt, Human
gcaggagggcccuaccugauuggugcaacccu

SEQ ID NO: 433845 - RNA, 32 nt, Human
gcaggagggcccucagcuccuagggcugucga

SEQ ID NO: 433846 - RNA, 22 nt, Human
gcaggagggcccucagcuguga

SEQ ID NO: 433847 - RNA, 32 nt, Human
gcaggaggggagaagagaguaggaaaaaggag

SEQ ID NO: 433848 - RNA, 21 nt, Human
gcaggagggggcccugaggca

SEQ ID NO: 433849 - RNA, 32 nt, Human
gcaggagggucucuugagcccaggaguuugag

SEQ ID NO: 433850 - RNA, 32 nt, Human
gcaggaggguuacuugagcccaggaagucaag

SEQ ID NO: 433851 - RNA, 32 nt, Human
gcaggaggguuagagugaguaguaagagaugc

SEQ ID NO: 433852 - RNA, 32 nt, Human
gcaggagguccaggcuauagagucaggcacug

SEQ ID NO: 433853 - RNA, 32 nt, Human
gcaggagguccucagaaggugucaggagguuc

SEQ ID NO: 433854 - RNA, 20 nt, Human
gcaggagguggagcggcaga

SEQ ID NO: 433855 - RNA, 23 nt, Human
gcaggagguggcagcggcagcag

SEQ ID NO: 433856 - RNA, 32 nt, Human
gcaggagguggccccugcccucccucuggacc

SEQ ID NO: 433857 - RNA, 21 nt, Human
gcaggaggugggagugaggag

SEQ ID NO: 433858 - RNA, 23 nt, Human
gcaggaggugggggaagagcuga

SEQ ID NO: 433859 - RNA, 21 nt, Human
gcaggaggugggggagacaca

SEQ ID NO: 433860 - RNA, 32 nt, Human
gcaggaggugguggaaacggggugaacuccgu

SEQ ID NO: 433861 - RNA, 32 nt, Human
gcaggaguaaagggagugaugggccaguacaa

SEQ ID NO: 433862 - RNA, 32 nt, Human
gcaggaguaccaggggaggaguguggaggaag

SEQ ID NO: 433863 - RNA, 32 nt, Human
gcaggaguaggccuccugcuuuucaaaagcag

SEQ ID NO: 433864 - RNA, 32 nt, Human
gcaggaguauugugaggccaggaguuccagau

SEQ ID NO: 433865 - RNA, 32 nt, Human
gcaggaguccacaggggaaccugcccugccuc

SEQ ID NO: 433866 - RNA, 32 nt, Human
gcaggagucggagaggauggcaggggccggag

SEQ ID NO: 433867 - RNA, 29 nt, Human
gcaggagucuacuucuugguccccaggga

SEQ ID NO: 433868 - RNA, 32 nt, Human
gcaggagucuguccuucaggccccacagugca

SEQ ID NO: 433869 - RNA, 32 nt, Human
gcaggagugccacccccagggcccugucaacc

SEQ ID NO: 433870 - RNA, 32 nt, Human
gcaggagugcuuuugcucugccagucggccuu

SEQ ID NO: 433871 - RNA, 32 nt, Human
gcaggagugggagaaggaggagagaaaagcug

SEQ ID NO: 433872 - RNA, 32 nt, Human
gcaggagugggccacuccacacccagcccugu

SEQ ID NO: 433873 - RNA, 32 nt, Human
gcaggaguggggagggaagggagccaagggau

SEQ ID NO: 433874 - RNA, 32 nt, Human
gcaggaguuugagaccagccugggcaacaugg

SEQ ID NO: 433875 - RNA, 32 nt, Human
gcaggauaucuucucccccagggaucuucuau

SEQ ID NO: 433876 - RNA, 32 nt, Human
gcaggauauugcugaagucuccuggcauaugu

SEQ ID NO: 433877 - RNA, 32 nt, Human
gcaggaucacaggccaguggaaaaagggcagg

SEQ ID NO: 433878 - RNA, 32 nt, Human
gcaggaucaggccacccagggacaaagggugc

SEQ ID NO: 433879 - RNA, 32 nt, Human
gcaggaucauggcugccaucaagccuuuucug

SEQ ID NO: 433880 - RNA, 32 nt, Human
gcaggaucauuccagcccaggaguucaagacc

SEQ ID NO: 433881 - RNA, 32 nt, Human
gcaggauccaaaggagaccuauagugacuccc

SEQ ID NO: 433882 - RNA, 19 nt, Human
gcaggauccccgcguccuc

SEQ ID NO: 433883 - RNA, 32 nt, Human
gcaggaucuccccaagguggcagaaggaggcc

SEQ ID NO: 433884 - RNA, 32 nt, Human
gcaggaugacugcucaggcccaggacaguggg

SEQ ID NO: 433885 - RNA, 25 nt, Human
gcaggaugagaauggggcagaggcu

SEQ ID NO: 433886 - RNA, 32 nt, Human
gcaggaugagagaaggggaaccagaagcuccg

SEQ ID NO: 433887 - RNA, 32 nt, Human
gcaggaugagccugaacugguugugcagaaca

SEQ ID NO: 433888 - RNA, 32 nt, Human
gcaggaugcccagggcucggaagcaguaagga

SEQ ID NO: 433889 - RNA, 32 nt, Human
gcaggauggagcuggagugagguggaggggcc

SEQ ID NO: 433890 - RNA, 30 nt, Human
gcaggauggaggaaagcauggaagaggagg

SEQ ID NO: 433891 - RNA, 20 nt, Human
gcaggauggagggcugagcc

SEQ ID NO: 433892 - RNA, 20 nt, Human
gcaggauggcgcuggcccug

SEQ ID NO: 433893 - RNA, 32 nt, Human
gcaggauggguagggagugagaucagagggaa

SEQ ID NO: 433894 - RNA, 32 nt, Human
gcaggaugguauaguuauguugccuggacugg

SEQ ID NO: 433895 - RNA, 32 nt, Human
gcaggaugucaccauguuuuccaggcuggucu

SEQ ID NO: 433896 - RNA, 30 nt, Human
gcaggauguccuuccagggcaagaaaagca

SEQ ID NO: 433897 - RNA, 32 nt, Human
gcaggaugugugagccaggaucccucuuugca

SEQ ID NO: 433898 - RNA, 32 nt, Human
gcaggaugugugcuucaguugcucuguguauu

SEQ ID NO: 433899 - RNA, 30 nt, Human
gcaggauguuagggcagcagcagcagcaac

SEQ ID NO: 433900 - RNA, 32 nt, Human
gcaggauucagagcugcucuccccaguugcac

SEQ ID NO: 433901 - RNA, 32 nt, Human
gcaggauucucagcaggcauggccgugggugc

SEQ ID NO: 433902 - RNA, 32 nt, Human
gcaggauugagggagccaggggaggggcagga

SEQ ID NO: 433903 - RNA, 32 nt, Human
gcaggauugccugagcccuggaguucgauacu

SEQ ID NO: 433904 - RNA, 32 nt, Human
gcaggauuucaccauguuuuccaggcuggucu

SEQ ID NO: 433905 - RNA, 32 nt, Human
gcaggauuuucagcagagcgucgguggggcug

SEQ ID NO: 433906 - RNA, 32 nt, Human
gcaggcaaagagagaggccucccuggcuucga

SEQ ID NO: 433907 - RNA, 32 nt, Human
gcaggcaaaucucuugagcccaggaguuugag

SEQ ID NO: 433908 - RNA, 32 nt, Human
gcaggcaaccuuuccauugcuggcuuugcaga

SEQ ID NO: 433909 - RNA, 32 nt, Human
gcaggcaagaagcggaggcagugaguacagca

SEQ ID NO: 433910 - RNA, 32 nt, Human
gcaggcaagagugcuggagggcggcagcggcg

SEQ ID NO: 433911 - RNA, 32 nt, Human
gcaggcaagccuggccacuguuggcugcagca

SEQ ID NO: 433912 - RNA, 32 nt, Human
gcaggcaaggagaccaaagauugaugagaaga

SEQ ID NO: 433913 - RNA, 32 nt, Human
gcaggcaauggguggaaaucaggggaacguuu

SEQ ID NO: 433914 - RNA, 32 nt, Human
gcaggcaauucuagucuuccacaaaacaucua

SEQ ID NO: 433915 - RNA, 32 nt, Human
gcaggcacagacugcaacccugcucagugcuc

SEQ ID NO: 433916 - RNA, 32 nt, Human
gcaggcacagccagggagaggggaggaguggg

SEQ ID NO: 433917 - RNA, 32 nt, Human
gcaggcacccagcagauagcgaaugcacgacu

SEQ ID NO: 433918 - RNA, 32 nt, Human
gcaggcacccaggguggggaggccacccuucc

SEQ ID NO: 433919 - RNA, 32 nt, Human
gcaggcaccccagcccuccaccucucucuaca

SEQ ID NO: 433920 - RNA, 28 nt, Human
gcaggcaccccaguggccucauccuagu

SEQ ID NO: 433921 - RNA, 32 nt, Human
gcaggcacccuuggccuuccaggcagcaggcu

SEQ ID NO: 433922 - RNA, 19 nt, Human
gcaggcaccuguaguccca

SEQ ID NO: 433923 - RNA, 32 nt, Human
gcaggcacucaguacuuauguaaagaaugaaa

SEQ ID NO: 433924 - RNA, 19 nt, Human
gcaggcacugcuccaggug

SEQ ID NO: 433925 - RNA, 32 nt, Human
gcaggcacuggcagugggaagaggcagacgac

SEQ ID NO: 433926 - RNA, 32 nt, Human
gcaggcacugugcuggcugucuucccagacac

SEQ ID NO: 433927 - RNA, 17 nt, Human
gcaggcacuugccacca

SEQ ID NO: 433928 - RNA, 22 nt, Human
gcaggcagacaucagaggccag

SEQ ID NO: 433929 - RNA, 22 nt, Human
gcaggcagaccacgaggucagg

SEQ ID NO: 433930 - RNA, 32 nt, Human
gcaggcagaccuggacucacagccuggcugug

SEQ ID NO: 433931 - RNA, 24 nt, Human
gcaggcagacuugacaggcccagg

SEQ ID NO: 433932 - RNA, 32 nt, Human
gcaggcagagacaauggaagaaaaugaaagcc

SEQ ID NO: 433933 - RNA, 32 nt, Human
gcaggcagagaggggcgguugaaggaagcacg

SEQ ID NO: 433934 - RNA, 20 nt, Human
gcaggcagagcugcagucag

SEQ ID NO: 433935 - RNA, 22 nt, Human
gcaggcagauaacaaagucagg

SEQ ID NO: 433936 - RNA, 24 nt, Human
gcaggcagauaacuugagaucagg

SEQ ID NO: 433937 - RNA, 20 nt, Human
gcaggcagaucacaagguca

SEQ ID NO: 433938 - RNA, 22 nt, Human
gcaggcagaucacaaggucagg

SEQ ID NO: 433939 - RNA, 24 nt, Human
gcaggcagaucaccugaaaucagg

SEQ ID NO: 433940 - RNA, 24 nt, Human
gcaggcagaucaccugaggccagg

SEQ ID NO: 433941 - RNA, 24 nt, Human
gcaggcagaucaccugaggcuagg

SEQ ID NO: 433942 - RNA, 22 nt, Human
gcaggcagaucaccugagguca

SEQ ID NO: 433943 - RNA, 23 nt, Human
gcaggcagaucaccugaggucag

SEQ ID NO: 433944 - RNA, 24 nt, Human
gcaggcagaucaccugaggucagg

SEQ ID NO: 433945 - RNA, 24 nt, Human
gcaggcagaucaccugaggucggg

SEQ ID NO: 433946 - RNA, 22 nt, Human
gcaggcagaucaccugagguua

SEQ ID NO: 433947 - RNA, 24 nt, Human
gcaggcagaucaccugagguuggg

SEQ ID NO: 433948 - RNA, 24 nt, Human
gcaggcagaucaccuggggucagg

SEQ ID NO: 433949 - RNA, 24 nt, Human
gcaggcagaucaccuuaggucagg

SEQ ID NO: 433950 - RNA, 32 nt, Human
gcaggcagaucacgaggucaagagauagagac

SEQ ID NO: 433951 - RNA, 22 nt, Human
gcaggcagaucacgaggucagg

SEQ ID NO: 433952 - RNA, 22 nt, Human
gcaggcagaucacggggucagg

SEQ ID NO: 433953 - RNA, 24 nt, Human
gcaggcagaucacgugaggucagg

SEQ ID NO: 433954 - RNA, 24 nt, Human
gcaggcagaucacuuaaggccagg

SEQ ID NO: 433955 - RNA, 23 nt, Human
gcaggcagaucacuuaggcuagg

SEQ ID NO: 433956 - RNA, 24 nt, Human
gcaggcagaucacuugaacucagg

SEQ ID NO: 433957 - RNA, 23 nt, Human
gcaggcagaucacuugagaccag

SEQ ID NO: 433958 - RNA, 24 nt, Human
gcaggcagaucacuugaggccagg

SEQ ID NO: 433959 - RNA, 24 nt, Human
gcaggcagaucacuugaggucagg

SEQ ID NO: 433960 - RNA, 24 nt, Human
gcaggcagaucacuugaggucggg

SEQ ID NO: 433961 - RNA, 24 nt, Human
gcaggcagaucagcugaggucagg

SEQ ID NO: 433962 - RNA, 22 nt, Human
gcaggcagaucaucugagguca

SEQ ID NO: 433963 - RNA, 24 nt, Human
gcaggcagaucaucugaggucagg

SEQ ID NO: 433964 - RNA, 20 nt, Human
gcaggcagaucaugagguca

SEQ ID NO: 433965 - RNA, 22 nt, Human
gcaggcagaucaugaggucagg

SEQ ID NO: 433966 - RNA, 24 nt, Human
gcaggcagaucauuugagaucagg

SEQ ID NO: 433967 - RNA, 24 nt, Human
gcaggcagaucauuugaggucagg

SEQ ID NO: 433968 - RNA, 23 nt, Human
gcaggcagaucccugaaggucag

SEQ ID NO: 433969 - RNA, 24 nt, Human
gcaggcagaucgcaugaaaucagg

SEQ ID NO: 433970 - RNA, 24 nt, Human
gcaggcagaucgccugaggucagg

SEQ ID NO: 433971 - RNA, 24 nt, Human
gcaggcagaucgcuugagcccagg

SEQ ID NO: 433972 - RNA, 24 nt, Human
gcaggcagaucgcuugagcucagg

SEQ ID NO: 433973 - RNA, 32 nt, Human
gcaggcagaucgcuugagcucaggaguucaag

SEQ ID NO: 433974 - RNA, 24 nt, Human
gcaggcagaucgcuugaggucagg

SEQ ID NO: 433975 - RNA, 24 nt, Human
gcaggcagauuauuugagcucagg

SEQ ID NO: 433976 - RNA, 23 nt, Human
gcaggcagauucauggagaccag

SEQ ID NO: 433977 - RNA, 24 nt, Human
gcaggcagauugcuugagcucagg

SEQ ID NO: 433978 - RNA, 24 nt, Human
gcaggcagauugcuugaggccagg

SEQ ID NO: 433979 - RNA, 22 nt, Human
gcaggcagcaacgcaagucagg

SEQ ID NO: 433980 - RNA, 32 nt, Human
gcaggcagcaacugaggcagcggcaggcucag

SEQ ID NO: 433981 - RNA, 19 nt, Human
gcaggcagccaacguccuc

SEQ ID NO: 433982 - RNA, 22 nt, Human
gcaggcagccacgaaguacagg

SEQ ID NO: 433983 - RNA, 24 nt, Human
gcaggcagccgaccugaggccugg

SEQ ID NO: 433984 - RNA, 32 nt, Human
gcaggcagccuccguuccucccgcucucuugc

SEQ ID NO: 433985 - RNA, 22 nt, Human
gcaggcagcgccuggaggccag

SEQ ID NO: 433986 - RNA, 32 nt, Human
gcaggcagcucagcccagccugggcacagcca

SEQ ID NO: 433987 - RNA, 19 nt, Human
gcaggcaggaagaaugggg

SEQ ID NO: 433988 - RNA, 32 nt, Human
gcaggcaggaaggggaggggcagugagguugg

SEQ ID NO: 433989 - RNA, 32 nt, Human
gcaggcaggagagagcaugugcaggggaacuc

SEQ ID NO: 433990 - RNA, 32 nt, Human
gcaggcaggagcaucucugccucccaaagcau

SEQ ID NO: 433991 - RNA, 32 nt, Human
gcaggcaggaggagcaggaggauuauuaaaua

SEQ ID NO: 433992 - RNA, 32 nt, Human
gcaggcaggagguggaguugcagcuguuggcc

SEQ ID NO: 433993 - RNA, 32 nt, Human
gcaggcaggaguggggacagagggagagcuug

SEQ ID NO: 433994 - RNA, 32 nt, Human
gcaggcaggauguuuugaaauggugcagccaa

SEQ ID NO: 433995 - RNA, 32 nt, Human
gcaggcaggauugggcuuuucuggcuucuacc

SEQ ID NO: 433996 - RNA, 32 nt, Human
gcaggcaggccccagccucugaacucagcugg

SEQ ID NO: 433997 - RNA, 32 nt, Human
gcaggcaggcggccugugcagcgcggcccccg

SEQ ID NO: 433998 - RNA, 32 nt, Human
gcaggcagggaaaguguacaguauuuauuuug

SEQ ID NO: 433999 - RNA, 16 nt, Human
gcaggcagggcaguuu

SEQ ID NO: 434000 - RNA, 17 nt, Human
gcaggcagggcccgggg

SEQ ID NO: 434001 - RNA, 18 nt, Human
gcaggcagggcucugggg

SEQ ID NO: 434002 - RNA, 32 nt, Human
gcaggcaggggaaggagaagagacugaggggc

SEQ ID NO: 434003 - RNA, 32 nt, Human
gcaggcaggggcauuuaaaaauguaggaccua

SEQ ID NO: 434004 - RNA, 18 nt, Human
gcaggcagggggcugggg

SEQ ID NO: 434005 - RNA, 32 nt, Human
gcaggcaggguucauucuggugacacagcaac

SEQ ID NO: 434006 - RNA, 24 nt, Human
gcaggcaggucacuugaggucagg

SEQ ID NO: 434007 - RNA, 32 nt, Human
gcaggcaggucagcuuacugcccaggguaaca

SEQ ID NO: 434008 - RNA, 23 nt, Human
gcaggcagguggacgaguccagg

SEQ ID NO: 434009 - RNA, 32 nt, Human
gcaggcagucaguggcuggugccaugggguga

SEQ ID NO: 434010 - RNA, 32 nt, Human
gcaggcagucugcagaccagaucugacccaga

SEQ ID NO: 434011 - RNA, 25 nt, Human
gcaggcauaucaacuugaggccagg

SEQ ID NO: 434012 - RNA, 23 nt, Human
gcaggcaucagagacacuggugg

SEQ ID NO: 434013 - RNA, 32 nt, Human
gcaggcaucaggacaggaguaggaggagaaag

SEQ ID NO: 434014 - RNA, 32 nt, Human
gcaggcaugagccacuucgccuagccaagccu

SEQ ID NO: 434015 - RNA, 32 nt, Human
gcaggcauggaucagacugcaagcuaggggca

SEQ ID NO: 434016 - RNA, 32 nt, Human
gcaggcauggcucucugccucugaucaccauc

SEQ ID NO: 434017 - RNA, 32 nt, Human
gcaggcaugguggcucaugccuguagucccag

SEQ ID NO: 434018 - RNA, 32 nt, Human
gcaggcauguguuucaucaucauccagagccu

SEQ ID NO: 434019 - RNA, 32 nt, Human
gcaggcauguugaagaguugagugaucacgcu

SEQ ID NO: 434020 - RNA, 32 nt, Human
gcaggccaaggaccuggcagggccagacgcug

SEQ ID NO: 434021 - RNA, 32 nt, Human
gcaggccaaggcugugcucaagcauuucaacg

SEQ ID NO: 434022 - RNA, 24 nt, Human
gcaggccaaucaccugaggucggg

SEQ ID NO: 434023 - RNA, 32 nt, Human
gcaggccacccagguccugcaggaaaugagag

SEQ ID NO: 434024 - RNA, 19 nt, Human
gcaggccacucagaggcuc

SEQ ID NO: 434025 - RNA, 32 nt, Human
gcaggccagacacagucugaugccagcuggga

SEQ ID NO: 434026 - RNA, 32 nt, Human
gcaggccagcagcagagggcggcggaggaagg

SEQ ID NO: 434027 - RNA, 30 nt, Human
gcaggccagcagccgucagagcguccggcu

SEQ ID NO: 434028 - RNA, 21 nt, Human
gcaggccagccaagcaggaag

SEQ ID NO: 434029 - RNA, 17 nt, Human
gcaggccaggccuccca

SEQ ID NO: 434030 - RNA, 26 nt, Human
gcaggccaguggcagggccggcccca

SEQ ID NO: 434031 - RNA, 21 nt, Human
gcaggccaucagcgugcacug

SEQ ID NO: 434032 - RNA, 32 nt, Human
gcaggccauugcugagggcacaggugcuuuau

SEQ ID NO: 434033 - RNA, 32 nt, Human
gcaggcccagaacuugccuccagucagccucu

SEQ ID NO: 434034 - RNA, 32 nt, Human
gcaggcccaguucuggaaaggccaggaugugg

SEQ ID NO: 434035 - RNA, 32 nt, Human
gcaggccccagccucugaacucagcuggcuug

SEQ ID NO: 434036 - RNA, 24 nt, Human
gcaggcccccagggaggcaguggg

SEQ ID NO: 434037 - RNA, 32 nt, Human
gcaggccccucgggcgcaggcagcucacacca

SEQ ID NO: 434038 - RNA, 32 nt, Human
gcaggcccgggagccgggaggcugcgggcggc

SEQ ID NO: 434039 - RNA, 32 nt, Human
gcaggcccuaccaagaggaaggaugguacagc

SEQ ID NO: 434040 - RNA, 18 nt, Human
gcaggcccucaagggcuc

SEQ ID NO: 434041 - RNA, 32 nt, Human
gcaggcccuccugcccagcugcucuugucagc

SEQ ID NO: 434042 - RNA, 32 nt, Human
gcaggcccugcucuugccucccaggggcuuuu

SEQ ID NO: 434043 - RNA, 32 nt, Human
gcaggcccugggccuccaccucugugcagggc

SEQ ID NO: 434044 - RNA, 26 nt, Human
gcaggcccuguccgaggaguuggggg

SEQ ID NO: 434045 - RNA, 25 nt, Human
gcaggcccugucuggacacugggga

SEQ ID NO: 434046 - RNA, 32 nt, Human
gcaggcccuuagaaguccagcagcagcaacuc

SEQ ID NO: 434047 - RNA, 32 nt, Human
gcaggcccuucccucuccgccugccucauucc

SEQ ID NO: 434048 - RNA, 32 nt, Human
gcaggcccuucugaauuuccuggaccuacgca

SEQ ID NO: 434049 - RNA, 32 nt, Human
gcaggcccuucugaauuuccuggaccuacucu

SEQ ID NO: 434050 - RNA, 22 nt, Human
gcaggcccuuguugcagcugaa

SEQ ID NO: 434051 - RNA, 32 nt, Human
gcaggcccuuucucuuucaggagccucgacca

SEQ ID NO: 434052 - RNA, 32 nt, Human
gcaggccgagugggccgccaggaccaagcgag

SEQ ID NO: 434053 - RNA, 32 nt, Human
gcaggccgcaggagugcugguggaggggcuuc

SEQ ID NO: 434054 - RNA, 21 nt, Human
gcaggccgcccacacugugga

SEQ ID NO: 434055 - RNA, 22 nt, Human
gcaggccgcgcucggccagcag

SEQ ID NO: 434056 - RNA, 25 nt, Human
gcaggccgggcccgggcacuggugg

SEQ ID NO: 434057 - RNA, 22 nt, Human
gcaggccggggcgggacgagga

SEQ ID NO: 434058 - RNA, 32 nt, Human
gcaggccguggucagggauggcaccaacaucu

SEQ ID NO: 434059 - RNA, 32 nt, Human
gcaggccuagcauggugccugccaccauggug

SEQ ID NO: 434060 - RNA, 32 nt, Human
gcaggccucagaacggugaggggccagggcaa

SEQ ID NO: 434061 - RNA, 32 nt, Human
gcaggccuccacccuagcacaucugggcucua

SEQ ID NO: 434062 - RNA, 22 nt, Human
gcaggccuccggggggccgggg

SEQ ID NO: 434063 - RNA, 32 nt, Human
gcaggccuccuggaggaggaaguggaggccgc

SEQ ID NO: 434064 - RNA, 32 nt, Human
gcaggccucugaggcaguggacaggaagacuu

SEQ ID NO: 434065 - RNA, 32 nt, Human
gcaggccucugggguccagccugggagcccag

SEQ ID NO: 434066 - RNA, 23 nt, Human
gcaggccugaagccuaggucagg

SEQ ID NO: 434067 - RNA, 32 nt, Human
gcaggccugaugcucagggguucgugccggga

SEQ ID NO: 434068 - RNA, 32 nt, Human
gcaggccugauggcuucccacuggccuccacc

SEQ ID NO: 434069 - RNA, 32 nt, Human
gcaggccugcaagcugccuuuuggacaggcug

SEQ ID NO: 434070 - RNA, 32 nt, Human
gcaggccugcaucuuaccuguacaguauuugc

SEQ ID NO: 434071 - RNA, 20 nt, Human
gcaggccugcguggcugcag

SEQ ID NO: 434072 - RNA, 32 nt, Human
gcaggccugcuggucgugcuguguggccgcgg

SEQ ID NO: 434073 - RNA, 32 nt, Human
gcaggccuggagggcucccuguuccagcugcu

SEQ ID NO: 434074 - RNA, 32 nt, Human
gcaggccuggcugggugcaguggcucacgccu

SEQ ID NO: 434075 - RNA, 32 nt, Human
gcaggccuggguuuggauuucagaauccuagc

SEQ ID NO: 434076 - RNA, 32 nt, Human
gcaggccuguaaucccagcuacucgggaggcu

SEQ ID NO: 434077 - RNA, 32 nt, Human
gcaggccugucccagccugugccuucugcugg

SEQ ID NO: 434078 - RNA, 32 nt, Human
gcaggccuguuacacucuccccaaccuccuug

SEQ ID NO: 434079 - RNA, 32 nt, Human
gcaggccuuauuccaacacacccggcccagcc

SEQ ID NO: 434080 - RNA, 32 nt, Human
gcaggccuucacugcagcacugagccucaaau

SEQ ID NO: 434081 - RNA, 21 nt, Human
gcaggccuuuccaccugggga

SEQ ID NO: 434082 - RNA, 32 nt, Human
gcaggccuuucccaugcuguucuggugauagu

SEQ ID NO: 434083 - RNA, 32 nt, Human
gcaggccuuuguuuuccaauggugcuauauuc

SEQ ID NO: 434084 - RNA, 32 nt, Human
gcaggcgaacauccuggcugauggacuggaug

SEQ ID NO: 434085 - RNA, 22 nt, Human
gcaggcgaaucacgaggucagg

SEQ ID NO: 434086 - RNA, 32 nt, Human
gcaggcgagaccccuccagaaucugcaggcgc

SEQ ID NO: 434087 - RNA, 32 nt, Human
gcaggcgaugaagaagaagcagcagcaucccg

SEQ ID NO: 434088 - RNA, 32 nt, Human
gcaggcgcacgguacccgugcugcagucgggc

SEQ ID NO: 434089 - RNA, 24 nt, Human
gcaggcgcagaggucccagcccca

SEQ ID NO: 434090 - RNA, 32 nt, Human
gcaggcgcagcucgcuccucaggccugcgaga

SEQ ID NO: 434091 - RNA, 18 nt, Human
gcaggcgcccccauggcc

SEQ ID NO: 434092 - RNA, 32 nt, Human
gcaggcgcccgccaccacacccggcuaauuuu

SEQ ID NO: 434093 - RNA, 32 nt, Human
gcaggcgcccgccaccacgcccggcuaauuuu

SEQ ID NO: 434094 - RNA, 32 nt, Human
gcaggcgccuauaaucccagcuacucaggagg

SEQ ID NO: 434095 - RNA, 32 nt, Human
gcaggcgccuauaaucccagcuacucaggagu

SEQ ID NO: 434096 - RNA, 32 nt, Human
gcaggcgccuguaauccagcuacucgggaggc

SEQ ID NO: 434097 - RNA, 32 nt, Human
gcaggcgccuguaaucccagcuacucgggagg

SEQ ID NO: 434098 - RNA, 32 nt, Human
gcaggcgccuguaaucccagcuacuggggagg

SEQ ID NO: 434099 - RNA, 32 nt, Human
gcaggcgccuguaaucccagcuacuuggaagg

SEQ ID NO: 434100 - RNA, 32 nt, Human
gcaggcgccuguaaucccagcuacuugggagg

SEQ ID NO: 434101 - RNA, 32 nt, Human
gcaggcgccuguaaucccagcuauuugggagg

SEQ ID NO: 434102 - RNA, 32 nt, Human
gcaggcgccuguagucccagcacuuugggagg

SEQ ID NO: 434103 - RNA, 22 nt, Human
gcaggcgcguccccgcuccuca

SEQ ID NO: 434104 - RNA, 32 nt, Human
gcaggcgcugggaugggggcuuaugggguggc

SEQ ID NO: 434105 - RNA, 24 nt, Human
gcaggcggaccaccugaagucggg

SEQ ID NO: 434106 - RNA, 32 nt, Human
gcaggcggaggcggaggcggcgggggcaggag

SEQ ID NO: 434107 - RNA, 32 nt, Human
gcaggcggagggcugucuccugcgcccgccug

SEQ ID NO: 434108 - RNA, 20 nt, Human
gcaggcggaucacaagguca

SEQ ID NO: 434109 - RNA, 32 nt, Human
gcaggcggaucacaaggucaagagauagagac

SEQ ID NO: 434110 - RNA, 22 nt, Human
gcaggcggaucacaaggucagg

SEQ ID NO: 434111 - RNA, 24 nt, Human
gcaggcggaucacaugaggccagg

SEQ ID NO: 434112 - RNA, 24 nt, Human
gcaggcggaucaccugaaaucagg

SEQ ID NO: 434113 - RNA, 23 nt, Human
gcaggcggaucaccugaagucag

SEQ ID NO: 434114 - RNA, 22 nt, Human
gcaggcggaucaccugagauca

SEQ ID NO: 434115 - RNA, 24 nt, Human
gcaggcggaucaccugagaucggg

SEQ ID NO: 434116 - RNA, 24 nt, Human
gcaggcggaucaccugaggucagg

SEQ ID NO: 434117 - RNA, 24 nt, Human
gcaggcggaucaccugaggucggg

SEQ ID NO: 434118 - RNA, 24 nt, Human
gcaggcggaucaccugaggugagg

SEQ ID NO: 434119 - RNA, 24 nt, Human
gcaggcggaucaccugagguuagg

SEQ ID NO: 434120 - RNA, 24 nt, Human
gcaggcggaucaccuuaggucagg

SEQ ID NO: 434121 - RNA, 22 nt, Human
gcaggcggaucacgaagucagg

SEQ ID NO: 434122 - RNA, 24 nt, Human
gcaggcggaucacuuaagaucagg

SEQ ID NO: 434123 - RNA, 24 nt, Human
gcaggcggaucacuugaagccagg

SEQ ID NO: 434124 - RNA, 32 nt, Human
gcaggcggaucacuugagcucaggaguccuaa

SEQ ID NO: 434125 - RNA, 24 nt, Human
gcaggcggaucacuugaggccagg

SEQ ID NO: 434126 - RNA, 24 nt, Human
gcaggcggaucacuugaggucagg

SEQ ID NO: 434127 - RNA, 24 nt, Human
gcaggcggaucaucugaggucagg

SEQ ID NO: 434128 - RNA, 22 nt, Human
gcaggcggaucaugagaucagg

SEQ ID NO: 434129 - RNA, 32 nt, Human
gcaggcggaucgcuugagcucaggaguuugag

SEQ ID NO: 434130 - RNA, 24 nt, Human
gcaggcggaucuccugaggucagg

SEQ ID NO: 434131 - RNA, 24 nt, Human
gcaggcggauuaccugaggucagg

SEQ ID NO: 434132 - RNA, 24 nt, Human
gcaggcggauuaccuuaggucagg

SEQ ID NO: 434133 - RNA, 32 nt, Human
gcaggcggcaggcacgguccgugcggagaggc

SEQ ID NO: 434134 - RNA, 32 nt, Human
gcaggcggcaggcagcaggcuguggaggaggc

SEQ ID NO: 434135 - RNA, 32 nt, Human
gcaggcggcccaggcacauagcaugguuggcu

SEQ ID NO: 434136 - RNA, 32 nt, Human
gcaggcggccuauccugauccuuggaggagga

SEQ ID NO: 434137 - RNA, 20 nt, Human
gcaggcggcggcgguggcgg

SEQ ID NO: 434138 - RNA, 32 nt, Human
gcaggcggcugcaggcuaggggcggcucggag

SEQ ID NO: 434139 - RNA, 24 nt, Human
gcaggcggcugcuugacagcugag

SEQ ID NO: 434140 - RNA, 32 nt, Human
gcaggcgggaggaucucuugagcccaggaguu

SEQ ID NO: 434141 - RNA, 32 nt, Human
gcaggcgggcaggccggcaggcgggugcgcgg

SEQ ID NO: 434142 - RNA, 32 nt, Human
gcaggcggggacugcaaccucaguccacagac

SEQ ID NO: 434143 - RNA, 32 nt, Human
gcaggcgggggaccucuacaccucugcugugg

SEQ ID NO: 434144 - RNA, 24 nt, Human
gcaggcgggucaccugaggucagg

SEQ ID NO: 434145 - RNA, 32 nt, Human
gcaggcgguuccugggcugcuccgguagguuu

SEQ ID NO: 434146 - RNA, 32 nt, Human
gcaggcgugagcauggggccaggugugcacgu

SEQ ID NO: 434147 - RNA, 32 nt, Human
gcaggcguggggacccagguguguucaggggu

SEQ ID NO: 434148 - RNA, 24 nt, Human
gcaggcgugucacuugaggccagg

SEQ ID NO: 434149 - RNA, 32 nt, Human
gcaggcgugugcauggggccaggugugcacgu

SEQ ID NO: 434150 - RNA, 32 nt, Human
gcaggcguuccucagagucacagggaauggcg

SEQ ID NO: 434151 - RNA, 32 nt, Human
gcaggcuacugugcuggagcaucccccagcug

SEQ ID NO: 434152 - RNA, 32 nt, Human
gcaggcucaaaucuaguggaacagucaguuua

SEQ ID NO: 434153 - RNA, 32 nt, Human
gcaggcucacugcccgcuucuuuuccuucuuu

SEQ ID NO: 434154 - RNA, 32 nt, Human
gcaggcucauagggaagaccugcugagggacc

SEQ ID NO: 434155 - RNA, 28 nt, Human
gcaggcuccaguggggccucaucauaca

SEQ ID NO: 434156 - RNA, 23 nt, Human
gcaggcucccagggacaccuggg

SEQ ID NO: 434157 - RNA, 32 nt, Human
gcaggcuccuuuagcugcaccaugaaguuuac

SEQ ID NO: 434158 - RNA, 32 nt, Human
gcaggcucuaagccuuucauguguagagaaga

SEQ ID NO: 434159 - RNA, 32 nt, Human
gcaggcucucagaaccgcuaccggcgaugcua

SEQ ID NO: 434160 - RNA, 32 nt, Human
gcaggcucuccucucguuagugcccccugugu

SEQ ID NO: 434161 - RNA, 32 nt, Human
gcaggcucucuccccuccccuccccuccccuc

SEQ ID NO: 434162 - RNA, 32 nt, Human
gcaggcucugcugcccugaggugccaugccgg

SEQ ID NO: 434163 - RNA, 32 nt, Human
gcaggcucuguggagcucaccaagagagcugg

SEQ ID NO: 434164 - RNA, 21 nt, Human
gcaggcucuguucagaugcug

SEQ ID NO: 434165 - RNA, 32 nt, Human
gcaggcugaagcaggagaauggcgugaaccug

SEQ ID NO: 434166 - RNA, 32 nt, Human
gcaggcugaggcaggagaauugcuugaacccg

SEQ ID NO: 434167 - RNA, 32 nt, Human
gcaggcugaggcaguagaaucgcuugaaccug

SEQ ID NO: 434168 - RNA, 32 nt, Human
gcaggcugaggcaugagaaucgcuugaaccca

SEQ ID NO: 434169 - RNA, 32 nt, Human
gcaggcugaggugagaagaucauuggaguuua

SEQ ID NO: 434170 - RNA, 32 nt, Human
gcaggcugaggugggagaaucgcuugagcuca

SEQ ID NO: 434171 - RNA, 32 nt, Human
gcaggcugaggugggaggaucacuugaacccc

SEQ ID NO: 434172 - RNA, 32 nt, Human
gcaggcugcacccaccuccuccccuuccuacc

SEQ ID NO: 434173 - RNA, 32 nt, Human
gcaggcugcauggcuucaccuuucuuugcuuu

SEQ ID NO: 434174 - RNA, 32 nt, Human
gcaggcugcauggucuagagguugugggcagc

SEQ ID NO: 434175 - RNA, 32 nt, Human
gcaggcugccagcuggugccucuuguuuggga

SEQ ID NO: 434176 - RNA, 32 nt, Human
gcaggcugccugucugugguccaggcuucagg

SEQ ID NO: 434177 - RNA, 32 nt, Human
gcaggcugccuuguccccacucugccuacaug

SEQ ID NO: 434178 - RNA, 32 nt, Human
gcaggcugccuuucugccccuuuggugaucug

SEQ ID NO: 434179 - RNA, 32 nt, Human
gcaggcugcugcaggcccaggugaauggagua

SEQ ID NO: 434180 - RNA, 32 nt, Human
gcaggcugcugggcaguucugcucuguggagg

SEQ ID NO: 434181 - RNA, 32 nt, Human
gcaggcugcugucucacagagcgagaaggugu

SEQ ID NO: 434182 - RNA, 30 nt, Human
gcaggcugcuugcaaugcagaagaucacag

SEQ ID NO: 434183 - RNA, 32 nt, Human
gcaggcuggaaccugggcugccccagaacaca

SEQ ID NO: 434184 - RNA, 32 nt, Human
gcaggcuggaagggagggugcccagggaccac

SEQ ID NO: 434185 - RNA, 32 nt, Human
gcaggcuggagugcagugggacagcgcuggug

SEQ ID NO: 434186 - RNA, 25 nt, Human
gcaggcuggaucaccugaggacagg

SEQ ID NO: 434187 - RNA, 25 nt, Human
gcaggcuggaucaccugagggcagg

SEQ ID NO: 434188 - RNA, 32 nt, Human
gcaggcuggaucuuugccuugagagcuccgug

SEQ ID NO: 434189 - RNA, 19 nt, Human
gcaggcuggccgggccucc

SEQ ID NO: 434190 - RNA, 21 nt, Human
gcaggcuggccuggggucagg

SEQ ID NO: 434191 - RNA, 31 nt, Human
gcaggcuggcuucucccucccuccugccgag

SEQ ID NO: 434192 - RNA, 32 nt, Human
gcaggcuguccaggcugggcuugguggucagg

SEQ ID NO: 434193 - RNA, 32 nt, Human
gcaggcuguggcccaggccuccugggugacag

SEQ ID NO: 434194 - RNA, 32 nt, Human
gcaggcugugggaggcagcggagcaggcgaug

SEQ ID NO: 434195 - RNA, 18 nt, Human
gcaggcuguggggcagcu

SEQ ID NO: 434196 - RNA, 32 nt, Human
gcaggcuucaaacuaggggacaaagcaaaaag

SEQ ID NO: 434197 - RNA, 32 nt, Human
gcaggcuucucccuucuuucugggacucagag

SEQ ID NO: 434198 - RNA, 32 nt, Human
gcaggcuugauuugccuggugaccgaauuacu

SEQ ID NO: 434199 - RNA, 32 nt, Human
gcaggcuugcaaucccagcuacuugggacgcu

SEQ ID NO: 434200 - RNA, 32 nt, Human
gcaggcuugccuggcagagaaccuguucagau

SEQ ID NO: 434201 - RNA, 32 nt, Human
gcaggcuuggagggaggccucaguguggcuug

SEQ ID NO: 434202 - RNA, 32 nt, Human
gcaggcuuggggagcuuuaagccucaguuaua

SEQ ID NO: 434203 - RNA, 32 nt, Human
gcaggcuugugcagacacucagggauggagcu

SEQ ID NO: 434204 - RNA, 32 nt, Human
gcaggcuuguuuccaccaauagugccaaaaag

SEQ ID NO: 434205 - RNA, 32 nt, Human
gcaggcuuuccucuuguguuggcaagauggcu

SEQ ID NO: 434206 - RNA, 32 nt, Human
gcaggcuuugccuggcugcuaucucuagaggc

SEQ ID NO: 434207 - RNA, 32 nt, Human
gcaggcuuugggaacacuggccugggucuccc

SEQ ID NO: 434208 - RNA, 32 nt, Human
gcagggaaaaugucagaaaauucauccaaauc

SEQ ID NO: 434209 - RNA, 32 nt, Human
gcagggaaagacuggcaaggaggcucaggugc

SEQ ID NO: 434210 - RNA, 32 nt, Human
gcagggaaagagacccgguaauuggaggguga

SEQ ID NO: 434211 - RNA, 32 nt, Human
gcagggaacugaggccagaccacccaggaaga

SEQ ID NO: 434212 - RNA, 20 nt, Human
gcagggaacuuuggcagcuu

SEQ ID NO: 434213 - RNA, 32 nt, Human
gcagggaagaaaauguguuccaggcagaggaa

SEQ ID NO: 434214 - RNA, 32 nt, Human
gcagggaagaagcuuuugagggugauccaggc

SEQ ID NO: 434215 - RNA, 32 nt, Human
gcagggaagagcaguuccucaaccucguggga

SEQ ID NO: 434216 - RNA, 32 nt, Human
gcagggaagaucugggggacagaggaaggccu

SEQ ID NO: 434217 - RNA, 32 nt, Human
gcagggaagccgccgcaacagcugcagugagg

SEQ ID NO: 434218 - RNA, 32 nt, Human
gcagggaagcuuucaccagccacacaaggguc

SEQ ID NO: 434219 - RNA, 32 nt, Human
gcagggaaggcgagaagagggaggagacacug

SEQ ID NO: 434220 - RNA, 32 nt, Human
gcagggaagggccugagugccagcccuggcag

SEQ ID NO: 434221 - RNA, 32 nt, Human
gcagggaaguggagcaaggauggugccguccg

SEQ ID NO: 434222 - RNA, 32 nt, Human
gcagggaaucccauccagcgucccucuacucu

SEQ ID NO: 434223 - RNA, 32 nt, Human
gcagggacacacaaccaacagcucugucggga

SEQ ID NO: 434224 - RNA, 32 nt, Human
gcagggacacuggagagcaauggucccugcca

SEQ ID NO: 434225 - RNA, 32 nt, Human
gcagggacagaccagaccagacccaggagucu

SEQ ID NO: 434226 - RNA, 21 nt, Human
gcagggacagagcauuggggu

SEQ ID NO: 434227 - RNA, 32 nt, Human
gcagggacagcaggcccaggaggaaggauaca

SEQ ID NO: 434228 - RNA, 32 nt, Human
gcagggacagcccacaccugaagagcacgccc

SEQ ID NO: 434229 - RNA, 32 nt, Human
gcagggacagcggggaggcaggaaaagccccg

SEQ ID NO: 434230 - RNA, 20 nt, Human
gcagggacaggcaggcccgg

SEQ ID NO: 434231 - RNA, 32 nt, Human
gcagggacauaguggggcugggcagggauggg

SEQ ID NO: 434232 - RNA, 32 nt, Human
gcagggacaucagcuccugaaggggugaaaga

SEQ ID NO: 434233 - RNA, 32 nt, Human
gcagggacccacugccccaucucccucucccc

SEQ ID NO: 434234 - RNA, 32 nt, Human
gcagggacccacugcugccucuuccaggagcc

SEQ ID NO: 434235 - RNA, 32 nt, Human
gcagggacccccagaagaggagcggggcaccc

SEQ ID NO: 434236 - RNA, 32 nt, Human
gcagggacccuccgaggauguagagagaacug

SEQ ID NO: 434237 - RNA, 19 nt, Human
gcagggacgcugcaugcag

SEQ ID NO: 434238 - RNA, 19 nt, Human
gcagggacucaagauccuc

SEQ ID NO: 434239 - RNA, 23 nt, Human
gcagggacucaccugagcccagg

SEQ ID NO: 434240 - RNA, 32 nt, Human
gcagggacucacucagcugcuggccccaaguc

SEQ ID NO: 434241 - RNA, 32 nt, Human
gcagggacucacugugcuuuucugagcuucuu

SEQ ID NO: 434242 - RNA, 21 nt, Human
gcagggacugcuggcguccuc

SEQ ID NO: 434243 - RNA, 20 nt, Human
gcagggagaaucgcuugaac

SEQ ID NO: 434244 - RNA, 20 nt, Human
gcagggagaauugcuugaac

SEQ ID NO: 434245 - RNA, 32 nt, Human
gcagggagacuggugcugaauuacuggggccu

SEQ ID NO: 434246 - RNA, 32 nt, Human
gcagggagagagaacuggccaggguauaaaaa

SEQ ID NO: 434247 - RNA, 32 nt, Human
gcagggagagagggucucucuccuagcugcua

SEQ ID NO: 434248 - RNA, 32 nt, Human
gcagggagaggaagaucgggagagcuggcuac

SEQ ID NO: 434249 - RNA, 32 nt, Human
gcagggagaggaaggaggugggggagagggcu

SEQ ID NO: 434250 - RNA, 32 nt, Human
gcagggagaggaaggcgcgggagggggacgca

SEQ ID NO: 434251 - RNA, 32 nt, Human
gcagggagcagaggggucccugccugcagcac

SEQ ID NO: 434252 - RNA, 20 nt, Human
gcagggagccagggcugcgg

SEQ ID NO: 434253 - RNA, 21 nt, Human
gcagggagcccugcuguaccc

SEQ ID NO: 434254 - RNA, 32 nt, Human
gcagggagcuagggcagggaccaaaugaacag

SEQ ID NO: 434255 - RNA, 18 nt, Human
gcagggagcuccucaaag

SEQ ID NO: 434256 - RNA, 32 nt, Human
gcagggagcuccucaaagagcucaggaacgga

SEQ ID NO: 434257 - RNA, 20 nt, Human
gcagggagcugaggcugcgg

SEQ ID NO: 434258 - RNA, 32 nt, Human
gcagggaggaagggagaccacugugucaccug

SEQ ID NO: 434259 - RNA, 32 nt, Human
gcagggaggacagcagggcgggcagggggcgg

SEQ ID NO: 434260 - RNA, 32 nt, Human
gcagggaggagaggaagccaauaaaaaguguu

SEQ ID NO: 434261 - RNA, 32 nt, Human
gcagggaggagcugccuguucacugggaucag

SEQ ID NO: 434262 - RNA, 32 nt, Human
gcagggaggcaccauucaggaaccuggaccaa

SEQ ID NO: 434263 - RNA, 32 nt, Human
gcagggaggcagcucuggagggagccgcugcc

SEQ ID NO: 434264 - RNA, 32 nt, Human
gcagggaggcauucgaaagucugcucugccuu

SEQ ID NO: 434265 - RNA, 21 nt, Human
gcagggaggcggagguugcag

SEQ ID NO: 434266 - RNA, 23 nt, Human
gcagggaggcggagguugcagug

SEQ ID NO: 434267 - RNA, 32 nt, Human
gcagggaggcggagguugcagugagccgagau

SEQ ID NO: 434268 - RNA, 31 nt, Human
gcagggagggccagggagguuggggguggga

SEQ ID NO: 434269 - RNA, 32 nt, Human
gcagggagggccugggccccaguuguauuuau

SEQ ID NO: 434270 - RNA, 32 nt, Human
gcagggaggggaggauaagugggaucuaccaa

SEQ ID NO: 434271 - RNA, 32 nt, Human
gcagggaggguguggagaaggccaaaaaccuc

SEQ ID NO: 434272 - RNA, 32 nt, Human
gcagggaggugaggcccagccucaugauaaca

SEQ ID NO: 434273 - RNA, 20 nt, Human
gcagggagguggaaaugcug

SEQ ID NO: 434274 - RNA, 32 nt, Human
gcagggaguacaguucuuuucauucauacaua

SEQ ID NO: 434275 - RNA, 32 nt, Human
gcagggagucaguacaacacagugcucacccg

SEQ ID NO: 434276 - RNA, 32 nt, Human
gcagggagugcuccggagggaggcagagggga

SEQ ID NO: 434277 - RNA, 32 nt, Human
gcagggaguuagcacugaacugcuuuuaaaag

SEQ ID NO: 434278 - RNA, 32 nt, Human
gcagggaguuaggaggguuuucgaggauuuca

SEQ ID NO: 434279 - RNA, 32 nt, Human
gcagggaguugccccaacccuuuccggaacuc

SEQ ID NO: 434280 - RNA, 32 nt, Human
gcagggaguugcccuuccccucccucgggaag

SEQ ID NO: 434281 - RNA, 32 nt, Human
gcagggauagauauggcacuccuucacucccu

SEQ ID NO: 434282 - RNA, 32 nt, Human
gcagggauagccucugugucuccaggcucugc

SEQ ID NO: 434283 - RNA, 32 nt, Human
gcagggaucacacugccagucugguuaauacc

SEQ ID NO: 434284 - RNA, 32 nt, Human
gcagggaucagugguucucccauaucaccauc

SEQ ID NO: 434285 - RNA, 32 nt, Human
gcagggaucugccuggccagcagugagccuga

SEQ ID NO: 434286 - RNA, 32 nt, Human
gcagggaugagugaggcccugcagagagcauc

SEQ ID NO: 434287 - RNA, 32 nt, Human
gcagggaugcuuuccagccugcagcaacagaa

SEQ ID NO: 434288 - RNA, 32 nt, Human
gcagggauggccggcccaggagggaggaggac

SEQ ID NO: 434289 - RNA, 32 nt, Human
gcagggaugguguguccacugguacaaugucc

SEQ ID NO: 434290 - RNA, 32 nt, Human
gcagggaugguucugaggaaggcgcuguuagg

SEQ ID NO: 434291 - RNA, 32 nt, Human
gcagggauguacaaaauaauuuuaauguauua

SEQ ID NO: 434292 - RNA, 32 nt, Human
gcagggauuuacuggaaucuauuggugcugcu

SEQ ID NO: 434293 - RNA, 32 nt, Human
gcagggcaagaggagacagcaccuuguugcca

SEQ ID NO: 434294 - RNA, 31 nt, Human
gcagggcaagggagaucuggcauuuucugcu

SEQ ID NO: 434295 - RNA, 32 nt, Human
gcagggcacagaacuugugccuauuucaccuu

SEQ ID NO: 434296 - RNA, 32 nt, Human
gcagggcaccugcugcgacccagauucuucug

SEQ ID NO: 434297 - RNA, 32 nt, Human
gcagggcaccuugcagggccccuaccagucca

SEQ ID NO: 434298 - RNA, 32 nt, Human
gcagggcagaaugcaucccaggaaaaggaaac

SEQ ID NO: 434299 - RNA, 32 nt, Human
gcagggcagcagcugcugccacagccuccagc

SEQ ID NO: 434300 - RNA, 32 nt, Human
gcagggcagccauccuggaugauggaagccac

SEQ ID NO: 434301 - RNA, 19 nt, Human
gcagggcagcccagaggug

SEQ ID NO: 434302 - RNA, 32 nt, Human
gcagggcagcccagagguggcagcggcaggca

SEQ ID NO: 434303 - RNA, 32 nt, Human
gcagggcagcuggcugccugcccuuggcccgu

SEQ ID NO: 434304 - RNA, 32 nt, Human
gcagggcaggaggugguggaaacggggugaac

SEQ ID NO: 434305 - RNA, 32 nt, Human
gcagggcaggcuuccuggaggaggggcugagg

SEQ ID NO: 434306 - RNA, 32 nt, Human
gcagggcagggagccucagaugggaagaaguc

SEQ ID NO: 434307 - RNA, 32 nt, Human
gcagggcaggggcagucagggagcagcggcgg

SEQ ID NO: 434308 - RNA, 32 nt, Human
gcagggcaggguggccaaacaggucaggugcu

SEQ ID NO: 434309 - RNA, 32 nt, Human
gcagggcagggugggggcagggugggggcacg

SEQ ID NO: 434310 - RNA, 32 nt, Human
gcagggcauguuuggaaaauguuaauacgcca

SEQ ID NO: 434311 - RNA, 32 nt, Human
gcagggccaaccuccucacugugcuucaaggu

SEQ ID NO: 434312 - RNA, 32 nt, Human
gcagggccaagugcccaugagcacagccccag

SEQ ID NO: 434313 - RNA, 18 nt, Human
gcagggccacagcagcuc

SEQ ID NO: 434314 - RNA, 32 nt, Human
gcagggccagaggugacccugccuggccuccc

SEQ ID NO: 434315 - RNA, 21 nt, Human
gcagggccaggccagaagcug

SEQ ID NO: 434316 - RNA, 32 nt, Human
gcagggccagggcaaugccaucagccccuggg

SEQ ID NO: 434317 - RNA, 32 nt, Human
gcagggcccaagaaaucacuggugaugagauc

SEQ ID NO: 434318 - RNA, 20 nt, Human
gcagggcccagccucaaugg

SEQ ID NO: 434319 - RNA, 19 nt, Human
gcagggcccaggcaucuuc

SEQ ID NO: 434320 - RNA, 19 nt, Human
gcagggcccaggcgcccuu

SEQ ID NO: 434321 - RNA, 32 nt, Human
gcagggcccaggggaguggaccagcccccagc

SEQ ID NO: 434322 - RNA, 21 nt, Human
gcagggcccaucuuacauccu

SEQ ID NO: 434323 - RNA, 21 nt, Human
gcagggccccaaaacagccuc

SEQ ID NO: 434324 - RNA, 18 nt, Human
gcagggccccagccccuc

SEQ ID NO: 434325 - RNA, 20 nt, Human
gcagggccccagccugcccu

SEQ ID NO: 434326 - RNA, 18 nt, Human
gcagggccccagguccuc

SEQ ID NO: 434327 - RNA, 18 nt, Human
gcagggccccaucugucc

SEQ ID NO: 434328 - RNA, 31 nt, Human
gcagggcccccacuggagcguguacuacccc

SEQ ID NO: 434329 - RNA, 19 nt, Human
gcagggcccccagccccuc

SEQ ID NO: 434330 - RNA, 19 nt, Human
gcagggccccccugugucc

SEQ ID NO: 434331 - RNA, 20 nt, Human
gcagggccccgggcacccuc

SEQ ID NO: 434332 - RNA, 19 nt, Human
gcagggccccuccacgccc

SEQ ID NO: 434333 - RNA, 18 nt, Human
gcagggccccugacccuc

SEQ ID NO: 434334 - RNA, 21 nt, Human
gcagggccccugggccaucuc

SEQ ID NO: 434335 - RNA, 19 nt, Human
gcagggccccugggcuccc

SEQ ID NO: 434336 - RNA, 20 nt, Human
gcagggccccuggggcgucc

SEQ ID NO: 434337 - RNA, 19 nt, Human
gcagggcccgucuguccuc

SEQ ID NO: 434338 - RNA, 32 nt, Human
gcagggcccucauggagauccucugccagggc

SEQ ID NO: 434339 - RNA, 32 nt, Human
gcagggcccugagguggucgugucccugcccu

SEQ ID NO: 434340 - RNA, 19 nt, Human
gcagggcccugccccccuc

SEQ ID NO: 434341 - RNA, 32 nt, Human
gcagggcccuggagacaggcggaggcggggcc

SEQ ID NO: 434342 - RNA, 32 nt, Human
gcagggccgagccagcauuccaccccaccuuu

SEQ ID NO: 434343 - RNA, 32 nt, Human
gcagggccggaggagguguaggggcgagaggg

SEQ ID NO: 434344 - RNA, 22 nt, Human
gcagggccggccccacguccuc

SEQ ID NO: 434345 - RNA, 20 nt, Human
gcagggccgguggccuccuc

SEQ ID NO: 434346 - RNA, 19 nt, Human
gcagggccguaugcauccu

SEQ ID NO: 434347 - RNA, 18 nt, Human
gcagggccuagagcccuu

SEQ ID NO: 434348 - RNA, 32 nt, Human
gcagggccuaggugccuggacccagggugugc

SEQ ID NO: 434349 - RNA, 18 nt, Human
gcagggccucaaggcccu

SEQ ID NO: 434350 - RNA, 19 nt, Human
gcagggccuccacauccuc

SEQ ID NO: 434351 - RNA, 32 nt, Human
gcagggccuccaggccugggucuggaguuagg

SEQ ID NO: 434352 - RNA, 19 nt, Human
gcagggccuccuaggcccc

SEQ ID NO: 434353 - RNA, 18 nt, Human
gcagggccuccuaguacc

SEQ ID NO: 434354 - RNA, 32 nt, Human
gcagggccuccucuuccuccugguguuugaac

SEQ ID NO: 434355 - RNA, 19 nt, Human
gcagggccucggacucccc

SEQ ID NO: 434356 - RNA, 20 nt, Human
gcagggccucuacgguuccu

SEQ ID NO: 434357 - RNA, 20 nt, Human
gcagggccucuccugucgcc

SEQ ID NO: 434358 - RNA, 29 nt, Human
gcagggccucuguguggcuggauccuccg

SEQ ID NO: 434359 - RNA, 20 nt, Human
gcagggccucuugcucgcuc

SEQ ID NO: 434360 - RNA, 21 nt, Human
gcagggccugaggcccuccuc

SEQ ID NO: 434361 - RNA, 21 nt, Human
gcagggccugcccacgcccuu

SEQ ID NO: 434362 - RNA, 22 nt, Human
gcagggccugccuccugcgucc

SEQ ID NO: 434363 - RNA, 32 nt, Human
gcagggccuggaccagaggcagcugccaccgu

SEQ ID NO: 434364 - RNA, 18 nt, Human
gcagggccuggccaccuc

SEQ ID NO: 434365 - RNA, 20 nt, Human
gcagggccuggccucgccuc

SEQ ID NO: 434366 - RNA, 32 nt, Human
gcagggccuggcucccuguuggucugagugaa

SEQ ID NO: 434367 - RNA, 18 nt, Human
gcagggccugggcauccu

SEQ ID NO: 434368 - RNA, 32 nt, Human
gcagggccuggguuugcagccuggcucugccc

SEQ ID NO: 434369 - RNA, 32 nt, Human
gcagggccuguaaucccagcauuuugggaggc

SEQ ID NO: 434370 - RNA, 22 nt, Human
gcagggccuucuccagcucccu

SEQ ID NO: 434371 - RNA, 32 nt, Human
gcagggccuucugcuugccugcugccauacug

SEQ ID NO: 434372 - RNA, 18 nt, Human
gcagggccuugaaaccuc

SEQ ID NO: 434373 - RNA, 19 nt, Human
gcagggccuugagcgccuc

SEQ ID NO: 434374 - RNA, 19 nt, Human
gcagggccuugcaccccuc

SEQ ID NO: 434375 - RNA, 19 nt, Human
gcagggccuuggaggccuc

SEQ ID NO: 434376 - RNA, 18 nt, Human
gcagggccuuggaguccu

SEQ ID NO: 434377 - RNA, 20 nt, Human
gcagggccuuuccaguccuc

SEQ ID NO: 434378 - RNA, 32 nt, Human
gcagggcgcacacucucgcgcacccgcacgcu

SEQ ID NO: 434379 - RNA, 32 nt, Human
gcagggcgcugggcagucuccggcgagggcaa

SEQ ID NO: 434380 - RNA, 32 nt, Human
gcagggcggcacaugaguguuuuugguuagag

SEQ ID NO: 434381 - RNA, 32 nt, Human
gcagggcggcagccuccuccuggcuguccggg

SEQ ID NO: 434382 - RNA, 32 nt, Human
gcagggcuaaccuccacgggagcccaggagcu

SEQ ID NO: 434383 - RNA, 23 nt, Human
gcagggcuagguguagcgguguc

SEQ ID NO: 434384 - RNA, 21 nt, Human
gcagggcucacaccuguaauc

SEQ ID NO: 434385 - RNA, 32 nt, Human
gcagggcucagcuuccugccuuccauagcugu

SEQ ID NO: 434386 - RNA, 32 nt, Human
gcagggcucagggagcaggaggcugcauccgu

SEQ ID NO: 434387 - RNA, 16 nt, Human
gcagggcuccauggcc

SEQ ID NO: 434388 - RNA, 32 nt, Human
gcagggcucuccguugcucucccuggaucagg

SEQ ID NO: 434389 - RNA, 32 nt, Human
gcagggcucugccacaucccugucuuccuuca

SEQ ID NO: 434390 - RNA, 32 nt, Human
gcagggcucuggugggagagggagacagaugg

SEQ ID NO: 434391 - RNA, 19 nt, Human
gcagggcugaaagaggugu

SEQ ID NO: 434392 - RNA, 18 nt, Human
gcagggcugaacgucuuc

SEQ ID NO: 434393 - RNA, 18 nt, Human
gcagggcugagcauccuc

SEQ ID NO: 434394 - RNA, 32 nt, Human
gcagggcugaggaugggcucugcaucccccaa

SEQ ID NO: 434395 - RNA, 32 nt, Human
gcagggcugaggccucucauuccagaggaagg

SEQ ID NO: 434396 - RNA, 18 nt, Human
gcagggcugcauccgcag

SEQ ID NO: 434397 - RNA, 19 nt, Human
gcagggcugcccagaaguc

SEQ ID NO: 434398 - RNA, 32 nt, Human
gcagggcugccuccagccugcacgcuggcugg

SEQ ID NO: 434399 - RNA, 32 nt, Human
gcagggcugcuggcguugcugcuguugagagg

SEQ ID NO: 434400 - RNA, 20 nt, Human
gcagggcuggaaccagcagg

SEQ ID NO: 434401 - RNA, 23 nt, Human
gcagggcuggagaguauuuggug

SEQ ID NO: 434402 - RNA, 24 nt, Human
gcagggcuggagaucucugcaguc

SEQ ID NO: 434403 - RNA, 32 nt, Human
gcagggcuggagcugggcugggaucccgagcu

SEQ ID NO: 434404 - RNA, 18 nt, Human
gcagggcuggaggcccuc

SEQ ID NO: 434405 - RNA, 23 nt, Human
gcagggcuggaggccugggaguc

SEQ ID NO: 434406 - RNA, 18 nt, Human
gcagggcuggcaaaccuc

SEQ ID NO: 434407 - RNA, 32 nt, Human
gcagggcuggcacuauuuccuuggccagggua

SEQ ID NO: 434408 - RNA, 24 nt, Human
gcagggcuggccacaaggggcguc

SEQ ID NO: 434409 - RNA, 32 nt, Human
gcagggcuggccagggggaagaggguaguauc

SEQ ID NO: 434410 - RNA, 32 nt, Human
gcagggcuggcugggggcuucuccccacuccc

SEQ ID NO: 434411 - RNA, 32 nt, Human
gcagggcugggcauguugggggcaguuguugg

SEQ ID NO: 434412 - RNA, 26 nt, Human
gcagggcugggggcuccggagagcag

SEQ ID NO: 434413 - RNA, 20 nt, Human
gcagggcugguagggaggug

SEQ ID NO: 434414 - RNA, 20 nt, Human
gcagggcugugcauggugca

SEQ ID NO: 434415 - RNA, 21 nt, Human
gcagggcuguggagacacguc

SEQ ID NO: 434416 - RNA, 32 nt, Human
gcagggcugugucccagaugggccacggcuga

SEQ ID NO: 434417 - RNA, 32 nt, Human
gcagggcuuaauaucuaggugauggguugaca

SEQ ID NO: 434418 - RNA, 32 nt, Human
gcagggcuuagaaaaagcccuuuuguccguag

SEQ ID NO: 434419 - RNA, 19 nt, Human
gcagggcuuaucuggggga

SEQ ID NO: 434420 - RNA, 32 nt, Human
gcagggcuucaguucuccagaagaaggagaau

SEQ ID NO: 434421 - RNA, 32 nt, Human
gcagggcuucuccuccucugucuuuuggagaa

SEQ ID NO: 434422 - RNA, 22 nt, Human
gcagggcuugaugcugguggug

SEQ ID NO: 434423 - RNA, 32 nt, Human
gcaggggaaaucaagguguacuuauuucucca

SEQ ID NO: 434424 - RNA, 32 nt, Human
gcaggggaaauugcuuaacauuuucagauauc

SEQ ID NO: 434425 - RNA, 21 nt, Human
gcaggggaacacaaggucagg

SEQ ID NO: 434426 - RNA, 19 nt, Human
gcaggggaaucgcuugaac

SEQ ID NO: 434427 - RNA, 32 nt, Human
gcaggggaauggcuugaacccaggaggcagag

SEQ ID NO: 434428 - RNA, 32 nt, Human
gcaggggacagaaugugcauggaguggagcau

SEQ ID NO: 434429 - RNA, 28 nt, Human
gcaggggacgguugcugagcgggccugg

SEQ ID NO: 434430 - RNA, 32 nt, Human
gcaggggacucaggaagcaggggguccccauc

SEQ ID NO: 434431 - RNA, 32 nt, Human
gcaggggagaggaaugaggggagcagcuggac

SEQ ID NO: 434432 - RNA, 32 nt, Human
gcaggggagagggaaaggaaggccccacuuuu

SEQ ID NO: 434433 - RNA, 32 nt, Human
gcaggggagagggaagcagccgugcugucaac

SEQ ID NO: 434434 - RNA, 32 nt, Human
gcaggggagagggagcgggccagccuuacaga

SEQ ID NO: 434435 - RNA, 32 nt, Human
gcaggggagagggggccaagggggaaaggggc

SEQ ID NO: 434436 - RNA, 32 nt, Human
gcaggggagaggguggggcuggaaggaaggcu

SEQ ID NO: 434437 - RNA, 24 nt, Human
gcaggggagcgccagcggcugcag

SEQ ID NO: 434438 - RNA, 23 nt, Human
gcaggggaggaagccgcagccca

SEQ ID NO: 434439 - RNA, 32 nt, Human
gcaggggaggaggcggcgggaggcggaggagg

SEQ ID NO: 434440 - RNA, 32 nt, Human
gcaggggaggcaggggauggucagccccuaac

SEQ ID NO: 434441 - RNA, 32 nt, Human
gcaggggagggaacccagaggcuggggaugag

SEQ ID NO: 434442 - RNA, 32 nt, Human
gcaggggaggggaagaccuggggaaggaagaa

SEQ ID NO: 434443 - RNA, 32 nt, Human
gcaggggaggugagacagagaugaggagggac

SEQ ID NO: 434444 - RNA, 32 nt, Human
gcaggggagguggaggccagaggacagggaga

SEQ ID NO: 434445 - RNA, 32 nt, Human
gcaggggcaagugaacucagcacucugcagug

SEQ ID NO: 434446 - RNA, 21 nt, Human
gcaggggcagcaacggcugca

SEQ ID NO: 434447 - RNA, 32 nt, Human
gcaggggcagcacagcuggggugcaggccagg

SEQ ID NO: 434448 - RNA, 32 nt, Human
gcaggggcagcagggggcagggugcagggucc

SEQ ID NO: 434449 - RNA, 32 nt, Human
gcaggggcagcaucugucuugcaugcugcucu

SEQ ID NO: 434450 - RNA, 32 nt, Human
gcaggggcaggaggcagggcggggagggcaga

SEQ ID NO: 434451 - RNA, 32 nt, Human
gcaggggcagggcaagcuugaccucucacugu

SEQ ID NO: 434452 - RNA, 32 nt, Human
gcaggggcaguggcuggauggugccuacugua

SEQ ID NO: 434453 - RNA, 22 nt, Human
gcaggggccaccgcguggcugc

SEQ ID NO: 434454 - RNA, 32 nt, Human
gcaggggccaucuccccacuccgcugcccugg

SEQ ID NO: 434455 - RNA, 16 nt, Human
gcaggggccauggcug

SEQ ID NO: 434456 - RNA, 32 nt, Human
gcaggggccauggcugaggcacuugggcuugg

SEQ ID NO: 434457 - RNA, 23 nt, Human
gcaggggcccucacuggcugcag

SEQ ID NO: 434458 - RNA, 18 nt, Human
gcaggggcgcuggcugca

SEQ ID NO: 434459 - RNA, 32 nt, Human
gcaggggcgggcggagggaggggaggggugaa

SEQ ID NO: 434460 - RNA, 32 nt, Human
gcaggggcucagauugggacagaauucuuuug

SEQ ID NO: 434461 - RNA, 32 nt, Human
gcaggggcuccaggugaggagccagcaggcag

SEQ ID NO: 434462 - RNA, 32 nt, Human
gcaggggcugaggaggaggagcagggggugcu

SEQ ID NO: 434463 - RNA, 18 nt, Human
gcaggggcugcaggagca

SEQ ID NO: 434464 - RNA, 19 nt, Human
gcaggggcugcaggcucag

SEQ ID NO: 434465 - RNA, 21 nt, Human
gcaggggcugcagguccccag

SEQ ID NO: 434466 - RNA, 19 nt, Human
gcaggggcugcauccucag

SEQ ID NO: 434467 - RNA, 16 nt, Human
gcaggggcugcgcgca

SEQ ID NO: 434468 - RNA, 20 nt, Human
gcaggggcugcuccuggcug

SEQ ID NO: 434469 - RNA, 21 nt, Human
gcaggggcugcugcagcugca

SEQ ID NO: 434470 - RNA, 17 nt, Human
gcaggggcugcuggugc

SEQ ID NO: 434471 - RNA, 23 nt, Human
gcaggggcugggccagaggugcc

SEQ ID NO: 434472 - RNA, 17 nt, Human
gcaggggcugugcacag

SEQ ID NO: 434473 - RNA, 19 nt, Human
gcaggggcugugccugcgg

SEQ ID NO: 434474 - RNA, 18 nt, Human
gcaggggcuguucugcag

SEQ ID NO: 434475 - RNA, 19 nt, Human
gcaggggcuguugcagcag

SEQ ID NO: 434476 - RNA, 23 nt, Human
gcaggggcuugggauauggcugc

SEQ ID NO: 434477 - RNA, 18 nt, Human
gcaggggcuuggggcagc

SEQ ID NO: 434478 - RNA, 32 nt, Human
gcaggggcuuugugccuuucaucuuuaacugg

SEQ ID NO: 434479 - RNA, 32 nt, Human
gcagggggacugaaggcuggagcggagggacu

SEQ ID NO: 434480 - RNA, 32 nt, Human
gcagggggacugcuugagcucaggaguucgag

SEQ ID NO: 434481 - RNA, 32 nt, Human
gcagggggagcacuugaacccgggagguggag

SEQ ID NO: 434482 - RNA, 32 nt, Human
gcagggggagggcacccuggggugaaggccac

SEQ ID NO: 434483 - RNA, 25 nt, Human
gcagggggaugaaaaacucagcaga

SEQ ID NO: 434484 - RNA, 32 nt, Human
gcagggggauugcuugagcucaggaguucgag

SEQ ID NO: 434485 - RNA, 32 nt, Human
gcagggggcagggagaggagggcggcgggagc

SEQ ID NO: 434486 - RNA, 32 nt, Human
gcagggggccuuccagcccaagagcacgaacc

SEQ ID NO: 434487 - RNA, 32 nt, Human
gcagggggcgcggggcggaggcugcgagggcg

SEQ ID NO: 434488 - RNA, 32 nt, Human
gcagggggcggucggcccuguggaugcaggaa

SEQ ID NO: 434489 - RNA, 32 nt, Human
gcagggggcuacugccauccagaaguuacagu

SEQ ID NO: 434490 - RNA, 32 nt, Human
gcagggggcugagcucugaggggugggugcuc

SEQ ID NO: 434491 - RNA, 19 nt, Human
gcagggggcuggacuucag

SEQ ID NO: 434492 - RNA, 19 nt, Human
gcagggggcugggcuucag

SEQ ID NO: 434493 - RNA, 21 nt, Human
gcagggggcuggggacugcag

SEQ ID NO: 434494 - RNA, 32 nt, Human
gcagggggcuugguacugugaaaugguaacuu

SEQ ID NO: 434495 - RNA, 20 nt, Human
gcaggggggccaggccagca

SEQ ID NO: 434496 - RNA, 32 nt, Human
gcagggggugaaggcaggaguugggggcaggu

SEQ ID NO: 434497 - RNA, 32 nt, Human
gcagggggugggaugugugauuugaauugagg

SEQ ID NO: 434498 - RNA, 32 nt, Human
gcagggggugggggugcugggagccagccacc

SEQ ID NO: 434499 - RNA, 32 nt, Human
gcagggguaguggaggaagugugggcccacuu

SEQ ID NO: 434500 - RNA, 32 nt, Human
gcaggggucccgcuuuccucagccuggaugug

SEQ ID NO: 434501 - RNA, 32 nt, Human
gcaggggucgcggccggcuggagcugggagug

SEQ ID NO: 434502 - RNA, 32 nt, Human
gcaggggucuccugccugugccauccacuggg

SEQ ID NO: 434503 - RNA, 32 nt, Human
gcaggggucugcuucaggaaauggaagcuguc

SEQ ID NO: 434504 - RNA, 32 nt, Human
gcaggggucugguauaaaaacacuccuggaaa

SEQ ID NO: 434505 - RNA, 32 nt, Human
gcaggggugaggagggagcaggagaacgggua

SEQ ID NO: 434506 - RNA, 32 nt, Human
gcaggggugagggggagcaggagggcaggggu

SEQ ID NO: 434507 - RNA, 23 nt, Human
gcaggggugccggcgggcugcag

SEQ ID NO: 434508 - RNA, 32 nt, Human
gcagggguggaggggagggaccagcccgggcu

SEQ ID NO: 434509 - RNA, 32 nt, Human
gcagggguuggaggagcgaggagcaguauagg

SEQ ID NO: 434510 - RNA, 32 nt, Human
gcagggguuggagugagccaggacugugacac

SEQ ID NO: 434511 - RNA, 20 nt, Human
gcagggguugugagcugcag

SEQ ID NO: 434512 - RNA, 32 nt, Human
gcaggguagccauuucucccugacuggggugu

SEQ ID NO: 434513 - RNA, 32 nt, Human
gcaggguagggagguggauaugcagguugccc

SEQ ID NO: 434514 - RNA, 32 nt, Human
gcaggguagggcgccugagccuaggcgguucc

SEQ ID NO: 434515 - RNA, 32 nt, Human
gcagggucaaagcauuucuuuuucuccacaac

SEQ ID NO: 434516 - RNA, 31 nt, Human
gcagggucacucauggaggccuaggggaaca

SEQ ID NO: 434517 - RNA, 32 nt, Human
gcagggucacugcaccucggcccagggccucu

SEQ ID NO: 434518 - RNA, 32 nt, Human
gcagggucaggccacccagggacaaagggugc

SEQ ID NO: 434519 - RNA, 32 nt, Human
gcagggucaggcuccugauaggaggauuucau

SEQ ID NO: 434520 - RNA, 32 nt, Human
gcagggucaggcucuuaccuccaccuccaggg

SEQ ID NO: 434521 - RNA, 20 nt, Human
gcagggucauuaacauccuc

SEQ ID NO: 434522 - RNA, 32 nt, Human
gcagggucauuuccccaugccauccacagugu

SEQ ID NO: 434523 - RNA, 18 nt, Human
gcaggguccacugggagg

SEQ ID NO: 434524 - RNA, 32 nt, Human
gcaggguccaugguuccggaggccgugagacc

SEQ ID NO: 434525 - RNA, 32 nt, Human
gcaggguccccacucccucucuggggucgaug

SEQ ID NO: 434526 - RNA, 32 nt, Human
gcagggucuaggagguaagaccagcugggaug

SEQ ID NO: 434527 - RNA, 32 nt, Human
gcagggucuauggaagcaggaggacuuccaau

SEQ ID NO: 434528 - RNA, 32 nt, Human
gcagggucugauagugggcaagguguguagcc

SEQ ID NO: 434529 - RNA, 22 nt, Human
gcagggucugcucaccccaaca

SEQ ID NO: 434530 - RNA, 32 nt, Human
gcagggucugggugggucucccaggagaggaa

SEQ ID NO: 434531 - RNA, 32 nt, Human
gcagggucuuccuauuuuccccaggcugaucu

SEQ ID NO: 434532 - RNA, 32 nt, Human
gcagggugagcaucuccucuccacaccugccu

SEQ ID NO: 434533 - RNA, 32 nt, Human
gcagggugaggugagaggaucacuugaggcca

SEQ ID NO: 434534 - RNA, 32 nt, Human
gcagggugaugcacagcagucugccuccccua

SEQ ID NO: 434535 - RNA, 32 nt, Human
gcagggugcacucgcuccuggccgcgggccca

SEQ ID NO: 434536 - RNA, 32 nt, Human
gcagggugcccaggggcggaggccgucaagga

SEQ ID NO: 434537 - RNA, 32 nt, Human
gcagggugcuuugguagccaucagagaggaac

SEQ ID NO: 434538 - RNA, 32 nt, Human
gcaggguggaagggacugucaaguuuguaagg

SEQ ID NO: 434539 - RNA, 32 nt, Human
gcaggguggaggcugggcugaggauuaccaua

SEQ ID NO: 434540 - RNA, 18 nt, Human
gcaggguggccccagguc

SEQ ID NO: 434541 - RNA, 24 nt, Human
gcaggguggcucacaccuguaauc

SEQ ID NO: 434542 - RNA, 24 nt, Human
gcaggguggcucacaccuguacuc

SEQ ID NO: 434543 - RNA, 32 nt, Human
gcaggguggggcaggaugcagugagccagccc

SEQ ID NO: 434544 - RNA, 32 nt, Human
gcagggugggggcaauugaaggcccaagcugc

SEQ ID NO: 434545 - RNA, 32 nt, Human
gcagggugggggcacgaagugggcccugggug

SEQ ID NO: 434546 - RNA, 22 nt, Human
gcaggguguccggagagcggug

SEQ ID NO: 434547 - RNA, 32 nt, Human
gcagggugucuguacacguucuucugaaagcu

SEQ ID NO: 434548 - RNA, 32 nt, Human
gcaggguguggaggagauggauaaaaaguugu

SEQ ID NO: 434549 - RNA, 21 nt, Human
gcaggguuccugcuggauccc

SEQ ID NO: 434550 - RNA, 32 nt, Human
gcaggguucuuuuaacucuucucuccacaccc

SEQ ID NO: 434551 - RNA, 32 nt, Human
gcaggguugcccaccccugcuguccaccugcu

SEQ ID NO: 434552 - RNA, 21 nt, Human
gcaggguuggggcgggggcug

SEQ ID NO: 434553 - RNA, 32 nt, Human
gcaggguuguaaaccugcuuuaucuuuuagga

SEQ ID NO: 434554 - RNA, 32 nt, Human
gcagguaacgcguuccuuguauucagcaaggg

SEQ ID NO: 434555 - RNA, 32 nt, Human
gcagguaaugacucaguucccacugaggagcc

SEQ ID NO: 434556 - RNA, 22 nt, Human
gcagguaccacgguccucggcc

SEQ ID NO: 434557 - RNA, 32 nt, Human
gcagguacugcacugggcacuggggagaccaa

SEQ ID NO: 434558 - RNA, 32 nt, Human
gcagguacuuccaaguucccaggucugucugc

SEQ ID NO: 434559 - RNA, 32 nt, Human
gcagguagagcacagcuuuacuggcuguuugu

SEQ ID NO: 434560 - RNA, 32 nt, Human
gcagguagcagggggagugcuggucacacccc

SEQ ID NO: 434561 - RNA, 32 nt, Human
gcagguagcugauguggccaggauuugaaccc

SEQ ID NO: 434562 - RNA, 32 nt, Human
gcagguagguuagauguggguggugcauguua

SEQ ID NO: 434563 - RNA, 32 nt, Human
gcagguaucagaaauuccaaagggcauuuaug

SEQ ID NO: 434564 - RNA, 32 nt, Human
gcagguaucauccucagggaaccagcauggca

SEQ ID NO: 434565 - RNA, 32 nt, Human
gcagguauucaagugauucucccaucucgguc

SEQ ID NO: 434566 - RNA, 32 nt, Human
gcagguauuccugucauuccugacugaggcug

SEQ ID NO: 434567 - RNA, 19 nt, Human
gcaggucacacacagugaa

SEQ ID NO: 434568 - RNA, 32 nt, Human
gcaggucacagaaaggcagguuucauuucuua

SEQ ID NO: 434569 - RNA, 32 nt, Human
gcaggucagagcagagcauggccaugggaaca

SEQ ID NO: 434570 - RNA, 32 nt, Human
gcaggucaggcaggggaugcugguggcuggga

SEQ ID NO: 434571 - RNA, 32 nt, Human
gcaggucaggugagaggggcuagccggcaaaa

SEQ ID NO: 434572 - RNA, 32 nt, Human
gcaggucagugugcagagcccaaaugagggga

SEQ ID NO: 434573 - RNA, 32 nt, Human
gcaggucauucuagguuucuugaaugacuuua

SEQ ID NO: 434574 - RNA, 32 nt, Human
gcagguccacagcaccugggcagaggucagag

SEQ ID NO: 434575 - RNA, 32 nt, Human
gcagguccagcaguccuggcgggcugaggaga

SEQ ID NO: 434576 - RNA, 23 nt, Human
gcagguccagcuccugccuccca

SEQ ID NO: 434577 - RNA, 21 nt, Human
gcaggucccaggagcuggggg

SEQ ID NO: 434578 - RNA, 32 nt, Human
gcagguccccacccuccaacacgugcucaccu

SEQ ID NO: 434579 - RNA, 32 nt, Human
gcaggucccccuuagcgggaacagugaaagca

SEQ ID NO: 434580 - RNA, 32 nt, Human
gcaggucccgagagcugggcgugggaacagcg

SEQ ID NO: 434581 - RNA, 32 nt, Human
gcaggucccuuucuccaugcaggcccugacug

SEQ ID NO: 434582 - RNA, 32 nt, Human
gcagguccuccccuucuguguccugcagaugg

SEQ ID NO: 434583 - RNA, 18 nt, Human
gcagguccugaacacccu

SEQ ID NO: 434584 - RNA, 32 nt, Human
gcagguccugagcggcucggccccagaucccg

SEQ ID NO: 434585 - RNA, 32 nt, Human
gcagguccuggacuuggcaguuucuugcuccc

SEQ ID NO: 434586 - RNA, 20 nt, Human
gcagguccuggugcuggcgg

SEQ ID NO: 434587 - RNA, 32 nt, Human
gcagguccugugagcccugccuucauguuugg

SEQ ID NO: 434588 - RNA, 32 nt, Human
gcagguccuguguucucucccucucucuccug

SEQ ID NO: 434589 - RNA, 32 nt, Human
gcagguccuugcccugucuguaugguguccuc

SEQ ID NO: 434590 - RNA, 32 nt, Human
gcaggucgcacacugcaccaguuugcacauca

SEQ ID NO: 434591 - RNA, 23 nt, Human
gcaggucgggagaguagaguaca

SEQ ID NO: 434592 - RNA, 32 nt, Human
gcaggucgggaggaagaagagguggaggugug

SEQ ID NO: 434593 - RNA, 22 nt, Human
gcaggucgggagugagaaggac

SEQ ID NO: 434594 - RNA, 20 nt, Human
gcaggucggggaggaaggac

SEQ ID NO: 434595 - RNA, 32 nt, Human
gcaggucgugagauagagccugagauggggga

SEQ ID NO: 434596 - RNA, 32 nt, Human
gcaggucgugucuccuccugaccccaguggcu

SEQ ID NO: 434597 - RNA, 32 nt, Human
gcaggucucaaggcggcugagaggguggucuu

SEQ ID NO: 434598 - RNA, 32 nt, Human
gcaggucuccagcugaaucugugccuacaaau

SEQ ID NO: 434599 - RNA, 32 nt, Human
gcaggucuccagcugaaucugugccuacgaau

SEQ ID NO: 434600 - RNA, 32 nt, Human
gcaggucucucaccucucugaccucagcuucc

SEQ ID NO: 434601 - RNA, 32 nt, Human
gcaggucugaagacuaacauuuugugaaguug

SEQ ID NO: 434602 - RNA, 32 nt, Human
gcaggucugaggagcugagaagggaggcuuac

SEQ ID NO: 434603 - RNA, 20 nt, Human
gcaggucugcaggccaccag

SEQ ID NO: 434604 - RNA, 32 nt, Human
gcaggucugcuccccaccccugccucggaaga

SEQ ID NO: 434605 - RNA, 32 nt, Human
gcaggucuggccccagcggcgcgaagucacga

SEQ ID NO: 434606 - RNA, 32 nt, Human
gcaggucugggagccagagccucuguacgcgc

SEQ ID NO: 434607 - RNA, 21 nt, Human
gcaggucugggccagaugcug

SEQ ID NO: 434608 - RNA, 32 nt, Human
gcaggucugugucuccaccuugagccagggga

SEQ ID NO: 434609 - RNA, 32 nt, Human
gcaggucugugugcccaucagcagguucccau

SEQ ID NO: 434610 - RNA, 32 nt, Human
gcaggucuuccagacccugcgauccuuucugu

SEQ ID NO: 434611 - RNA, 32 nt, Human
gcaggucuugacucuaggucucagcuggaacc

SEQ ID NO: 434612 - RNA, 32 nt, Human
gcaggugaaagccaucaaagaauugggugacc

SEQ ID NO: 434613 - RNA, 32 nt, Human
gcaggugaaagccaucaaagaauugggugauc

SEQ ID NO: 434614 - RNA, 32 nt, Human
gcaggugaaccugaagaaagcaaaaggccugu

SEQ ID NO: 434615 - RNA, 32 nt, Human
gcaggugaagggcaacuauaguuuaaaccaag

SEQ ID NO: 434616 - RNA, 32 nt, Human
gcaggugaaugaaaggugaggccaggcugggg

SEQ ID NO: 434617 - RNA, 32 nt, Human
gcaggugacaaucucuguggauggcauucuua

SEQ ID NO: 434618 - RNA, 32 nt, Human
gcaggugacagggcguggcggagcugccacag

SEQ ID NO: 434619 - RNA, 32 nt, Human
gcaggugagagggagguggcuaagcuggcuau

SEQ ID NO: 434620 - RNA, 32 nt, Human
gcaggugagcacugcccugggcucuggcuggu

SEQ ID NO: 434621 - RNA, 31 nt, Human
gcaggugaggagagagauugagaacuaugag

SEQ ID NO: 434622 - RNA, 32 nt, Human
gcaggugagggugggaggcagaaaagaggcac

SEQ ID NO: 434623 - RNA, 32 nt, Human
gcaggugauucagagaccucacuugaaaauau

SEQ ID NO: 434624 - RNA, 17 nt, Human
gcaggugcacaaaguca

SEQ ID NO: 434625 - RNA, 32 nt, Human
gcaggugcacaauccagggcucagagaaauca

SEQ ID NO: 434626 - RNA, 32 nt, Human
gcaggugcaccacugggcuccuggguagugug

SEQ ID NO: 434627 - RNA, 32 nt, Human
gcaggugcagacaucuggaggagagagucgga

SEQ ID NO: 434628 - RNA, 19 nt, Human
gcaggugcaucacauacuu

SEQ ID NO: 434629 - RNA, 32 nt, Human
gcaggugcaugcugggaggucagacccuguga

SEQ ID NO: 434630 - RNA, 32 nt, Human
gcaggugcccugugcucaucucugccugggaa

SEQ ID NO: 434631 - RNA, 32 nt, Human
gcaggugccggaggggaggacagggaacagua

SEQ ID NO: 434632 - RNA, 32 nt, Human
gcaggugccggcugcugcagugcaguagcugc

SEQ ID NO: 434633 - RNA, 32 nt, Human
gcaggugccucaggaacccugaagcugggcug

SEQ ID NO: 434634 - RNA, 32 nt, Human
gcaggugccuguaaucacagcuacucgggagg

SEQ ID NO: 434635 - RNA, 32 nt, Human
gcaggugccuguaaucccagcacuuugggaag

SEQ ID NO: 434636 - RNA, 32 nt, Human
gcaggugccuguaaucccagcuacucgggagg

SEQ ID NO: 434637 - RNA, 32 nt, Human
gcaggugccuguaaucccagcuacucugucuc

SEQ ID NO: 434638 - RNA, 32 nt, Human
gcaggugccuguaaucccagcuacuggggaaa

SEQ ID NO: 434639 - RNA, 32 nt, Human
gcaggugccuguaaucccagcuacuugagagu

SEQ ID NO: 434640 - RNA, 32 nt, Human
gcaggugccuguaaucccagcuacuugggagg

SEQ ID NO: 434641 - RNA, 32 nt, Human
gcaggugccuguaaucccauguacucuggagg

SEQ ID NO: 434642 - RNA, 32 nt, Human
gcaggugccuguagucccagcuacucgggaag

SEQ ID NO: 434643 - RNA, 32 nt, Human
gcaggugccuguagucccagcuacucgggagg

SEQ ID NO: 434644 - RNA, 32 nt, Human
gcaggugccuguagucccagcuacucuggagg

SEQ ID NO: 434645 - RNA, 32 nt, Human
gcaggugccuguagucccagcuacuugggaca

SEQ ID NO: 434646 - RNA, 32 nt, Human
gcaggugccuguagucccagcuacuugggagg

SEQ ID NO: 434647 - RNA, 32 nt, Human
gcaggugccuguagucucagcuacucaggagg

SEQ ID NO: 434648 - RNA, 32 nt, Human
gcaggugcggggccaugaaugggaccgcaaac

SEQ ID NO: 434649 - RNA, 32 nt, Human
gcaggugcggggccgcuaggaucaauaaacgg

SEQ ID NO: 434650 - RNA, 32 nt, Human
gcaggugcucaguaaauacuugcugggugguu

SEQ ID NO: 434651 - RNA, 32 nt, Human
gcaggugcugagcaaagggaacagugaggugc

SEQ ID NO: 434652 - RNA, 32 nt, Human
gcaggugcuggcacaagagcagcggcuugggg

SEQ ID NO: 434653 - RNA, 32 nt, Human
gcaggugcugugguggguggggaccccacugc

SEQ ID NO: 434654 - RNA, 24 nt, Human
gcagguggaacacuugagaucagg

SEQ ID NO: 434655 - RNA, 32 nt, Human
gcagguggaaguggaaagaagccuguggagcu

SEQ ID NO: 434656 - RNA, 22 nt, Human
gcagguggaccaugaggucagg

SEQ ID NO: 434657 - RNA, 32 nt, Human
gcagguggagaacugcacccagcugggggagc

SEQ ID NO: 434658 - RNA, 32 nt, Human
gcagguggagagaacagaaggugggcagggcg

SEQ ID NO: 434659 - RNA, 32 nt, Human
gcagguggagagaauagaaggugggcagggcg

SEQ ID NO: 434660 - RNA, 32 nt, Human
gcagguggaggcagagauuagagaggggcugu

SEQ ID NO: 434661 - RNA, 24 nt, Human
gcagguggaucaacugaggucagg

SEQ ID NO: 434662 - RNA, 24 nt, Human
gcagguggaucaccuaaggucagg

SEQ ID NO: 434663 - RNA, 24 nt, Human
gcagguggaucaccucaagucagg

SEQ ID NO: 434664 - RNA, 24 nt, Human
gcagguggaucaccucaggucagg

SEQ ID NO: 434665 - RNA, 24 nt, Human
gcagguggaucaccugagaucagg

SEQ ID NO: 434666 - RNA, 22 nt, Human
gcagguggaucaccugagguca

SEQ ID NO: 434667 - RNA, 23 nt, Human
gcagguggaucaccugaggucag

SEQ ID NO: 434668 - RNA, 24 nt, Human
gcagguggaucaccugaggucagg

SEQ ID NO: 434669 - RNA, 24 nt, Human
gcagguggaucaccugagguccgg

SEQ ID NO: 434670 - RNA, 24 nt, Human
gcagguggaucaccugaggucggg

SEQ ID NO: 434671 - RNA, 24 nt, Human
gcagguggaucaccugagguuagg

SEQ ID NO: 434672 - RNA, 24 nt, Human
gcagguggaucaccuuaggucagg

SEQ ID NO: 434673 - RNA, 24 nt, Human
gcagguggaucacgugaggucagg

SEQ ID NO: 434674 - RNA, 25 nt, Human
gcagguggaucacucugaggucagg

SEQ ID NO: 434675 - RNA, 23 nt, Human
gcagguggaucacugaggucagg

SEQ ID NO: 434676 - RNA, 24 nt, Human
gcagguggaucacuuaagaucagg

SEQ ID NO: 434677 - RNA, 24 nt, Human
gcagguggaucacuugagaucagg

SEQ ID NO: 434678 - RNA, 32 nt, Human
gcagguggaucacuugagcucaggagcuugag

SEQ ID NO: 434679 - RNA, 32 nt, Human
gcagguggaucacuugagcucaggaguucaag

SEQ ID NO: 434680 - RNA, 32 nt, Human
gcagguggaucacuugagcucaggaguuugag

SEQ ID NO: 434681 - RNA, 24 nt, Human
gcagguggaucacuugaggccagg

SEQ ID NO: 434682 - RNA, 24 nt, Human
gcagguggaucacuugaggucagg

SEQ ID NO: 434683 - RNA, 24 nt, Human
gcagguggaucaucugaggucagg

SEQ ID NO: 434684 - RNA, 32 nt, Human
gcagguggaucccuugagcucaggaguucaag

SEQ ID NO: 434685 - RNA, 24 nt, Human
gcagguggaucgccugaggucagg

SEQ ID NO: 434686 - RNA, 32 nt, Human
gcagguggaucgcuugagcucaggaguuagag

SEQ ID NO: 434687 - RNA, 32 nt, Human
gcagguggaucgcuugagcucaggaguucgag

SEQ ID NO: 434688 - RNA, 32 nt, Human
gcagguggaucucuugagaccaggaggucaag

SEQ ID NO: 434689 - RNA, 32 nt, Human
gcagguggaugacuugagcucaggaguuugag

SEQ ID NO: 434690 - RNA, 24 nt, Human
gcagguggauuacccaaggccagg

SEQ ID NO: 434691 - RNA, 32 nt, Human
gcagguggauucuugcucugucacccaggcug

SEQ ID NO: 434692 - RNA, 32 nt, Human
gcagguggauugcuugagcucgggaguuugag

SEQ ID NO: 434693 - RNA, 21 nt, Human
gcagguggcagcgcggccgaa

SEQ ID NO: 434694 - RNA, 32 nt, Human
gcagguggcccagggaggcagauacagcacac

SEQ ID NO: 434695 - RNA, 19 nt, Human
gcagguggcccggcugcag

SEQ ID NO: 434696 - RNA, 32 nt, Human
gcagguggcgcugccuuccacccauggugaug

SEQ ID NO: 434697 - RNA, 24 nt, Human
gcagguggcucacuugaggucagg

SEQ ID NO: 434698 - RNA, 32 nt, Human
gcagguggcucugaggugagagacugaagaag

SEQ ID NO: 434699 - RNA, 32 nt, Human
gcagguggcugaagcagaagaaucacuugaac

SEQ ID NO: 434700 - RNA, 32 nt, Human
gcaggugggaggcacagauuguccgugggagg

SEQ ID NO: 434701 - RNA, 32 nt, Human
gcaggugggaggcacgggguugcggaucccgc

SEQ ID NO: 434702 - RNA, 32 nt, Human
gcaggugggaggugggacaggggcaagaggcc

SEQ ID NO: 434703 - RNA, 32 nt, Human
gcaggugggaggugugguugcaggugcgggcu

SEQ ID NO: 434704 - RNA, 32 nt, Human
gcaggugggcacaguggcgcagcucuggaucu

SEQ ID NO: 434705 - RNA, 32 nt, Human
gcaggugggcauaggugcagugagugcaggug

SEQ ID NO: 434706 - RNA, 32 nt, Human
gcagguggggcugaggggacucccagccucgc

SEQ ID NO: 434707 - RNA, 32 nt, Human
gcaggugggggcagcaggagggcagagggcag

SEQ ID NO: 434708 - RNA, 32 nt, Human
gcagguggguaggagagggaaagccagagugu

SEQ ID NO: 434709 - RNA, 32 nt, Human
gcaggugguacagagccagcaccaccaucuga

SEQ ID NO: 434710 - RNA, 32 nt, Human
gcagguggucagcuucagcuuucuccaucgaa

SEQ ID NO: 434711 - RNA, 23 nt, Human
gcagguggucccugcugaaaccc

SEQ ID NO: 434712 - RNA, 32 nt, Human
gcagguggugaggaagagugggguagagccag

SEQ ID NO: 434713 - RNA, 17 nt, Human
gcagguggugccugcag

SEQ ID NO: 434714 - RNA, 32 nt, Human
gcaggugguguccucagagcagccucgccugc

SEQ ID NO: 434715 - RNA, 32 nt, Human
gcagguguagccucugugccucguuguccccu

SEQ ID NO: 434716 - RNA, 32 nt, Human
gcagguguaucagaagauucuggguuugcagu

SEQ ID NO: 434717 - RNA, 32 nt, Human
gcaggugucauccugaguucaggcucugcacg

SEQ ID NO: 434718 - RNA, 18 nt, Human
gcagguguccccccagga

SEQ ID NO: 434719 - RNA, 32 nt, Human
gcagguguccuuuccccucucugccccugauc

SEQ ID NO: 434720 - RNA, 32 nt, Human
gcaggugucucugguguucagugaggaggaca

SEQ ID NO: 434721 - RNA, 32 nt, Human
gcaggugugaucaggggcucagagccaggguc

SEQ ID NO: 434722 - RNA, 31 nt, Human
gcaggugugcauguuccagccaacacuccac

SEQ ID NO: 434723 - RNA, 32 nt, Human
gcaggugugggaucuggggagagcggcuggag

SEQ ID NO: 434724 - RNA, 32 nt, Human
gcagguguguguggguccuccaccacucaccu

SEQ ID NO: 434725 - RNA, 32 nt, Human
gcagguguucucagccucacaugcccugccgu

SEQ ID NO: 434726 - RNA, 32 nt, Human
gcagguguugcagacaggagggccacagcgug

SEQ ID NO: 434727 - RNA, 32 nt, Human
gcagguguuguucugaccccagcuccacugug

SEQ ID NO: 434728 - RNA, 32 nt, Human
gcagguuaagacgacagccugcgcccccaacu

SEQ ID NO: 434729 - RNA, 32 nt, Human
gcagguuagcuagcccacccugugcuaguuuu

SEQ ID NO: 434730 - RNA, 32 nt, Human
gcagguucaagaaagcauaugucgaugguuga

SEQ ID NO: 434731 - RNA, 32 nt, Human
gcagguucaagcaauccucccacuucagccuc

SEQ ID NO: 434732 - RNA, 32 nt, Human
gcagguucauucugccacccaucugcauuaag

SEQ ID NO: 434733 - RNA, 32 nt, Human
gcagguuccaugggugacagccugagaucugu

SEQ ID NO: 434734 - RNA, 32 nt, Human
gcagguucccucuggccccaccaggagaagaa

SEQ ID NO: 434735 - RNA, 32 nt, Human
gcagguuccuuuccugggcaugguggcccagc

SEQ ID NO: 434736 - RNA, 24 nt, Human
gcagguucuccuccugagguccuc

SEQ ID NO: 434737 - RNA, 32 nt, Human
gcagguucucucucacugccaucaaacuguaa

SEQ ID NO: 434738 - RNA, 32 nt, Human
gcagguucugcagcauccugccuugcugcucu

SEQ ID NO: 434739 - RNA, 32 nt, Human
gcagguucugcucaccuucggguccuccucgc

SEQ ID NO: 434740 - RNA, 32 nt, Human
gcagguucugguggugggaagggaggcguuuc

SEQ ID NO: 434741 - RNA, 32 nt, Human
gcagguucuucagaugacgcugggugauguua

SEQ ID NO: 434742 - RNA, 32 nt, Human
gcagguugaaggauucacaggguaagaucggg

SEQ ID NO: 434743 - RNA, 32 nt, Human
gcagguugaauccuugcucucuucuccaaauu

SEQ ID NO: 434744 - RNA, 32 nt, Human
gcagguugacucugauauucauucccaaauga

SEQ ID NO: 434745 - RNA, 24 nt, Human
gcagguugaucaccugaggucagg

SEQ ID NO: 434746 - RNA, 19 nt, Human
gcagguugcagauacggug

SEQ ID NO: 434747 - RNA, 32 nt, Human
gcagguugcccaggaggagcugcagcgccagc

SEQ ID NO: 434748 - RNA, 32 nt, Human
gcagguugccccggauggaucucagagaugag

SEQ ID NO: 434749 - RNA, 32 nt, Human
gcagguuggaaggggccuugcugaguggcgca

SEQ ID NO: 434750 - RNA, 32 nt, Human
gcagguuggauggaacacagugccccacuuuu

SEQ ID NO: 434751 - RNA, 32 nt, Human
gcagguugggagggaaagucgggggaggacgc

SEQ ID NO: 434752 - RNA, 32 nt, Human
gcagguuuauacuuagaaauauuugaagaaaa

SEQ ID NO: 434753 - RNA, 32 nt, Human
gcagguuuccaaauccgguacuuaguuugugu

SEQ ID NO: 434754 - RNA, 32 nt, Human
gcagguuucugcccugacauucucuugucugc

SEQ ID NO: 434755 - RNA, 32 nt, Human
gcagguuucuuggcugacauaguggauugagc

SEQ ID NO: 434756 - RNA, 32 nt, Human
gcagguuugaucuggugggucuuugggguggg

SEQ ID NO: 434757 - RNA, 24 nt, Human
gcagguuuggggacggcgaggaca

SEQ ID NO: 434758 - RNA, 32 nt, Human
gcaguaaaaaccagguuugcuacuggaaaaag

SEQ ID NO: 434759 - RNA, 32 nt, Human
gcaguaaacaaagacauuccugccuggcaguc

SEQ ID NO: 434760 - RNA, 32 nt, Human
gcaguaaacuccaccuaaccagauucaggggc

SEQ ID NO: 434761 - RNA, 22 nt, Human
gcaguaacucacgccuguaauc

SEQ ID NO: 434762 - RNA, 20 nt, Human
gcaguaagaagcugcuggca

SEQ ID NO: 434763 - RNA, 32 nt, Human
gcaguaagagggaggggaggaggcaggagggc

SEQ ID NO: 434764 - RNA, 32 nt, Human
gcaguaagaugguaacaaaaccucauauuguc

SEQ ID NO: 434765 - RNA, 32 nt, Human
gcaguaagccaagaucaugcugugccucaagg

SEQ ID NO: 434766 - RNA, 32 nt, Human
gcaguaagcugagaucgcugcacuccagccug

SEQ ID NO: 434767 - RNA, 32 nt, Human
gcaguaagcuggacacagagguguagugugcg

SEQ ID NO: 434768 - RNA, 32 nt, Human
gcaguaaggaagaggaauauauagcaacucag

SEQ ID NO: 434769 - RNA, 32 nt, Human
gcaguaaggccacccuggcaccucuuuaucua

SEQ ID NO: 434770 - RNA, 18 nt, Human
gcaguaagucacacagua

SEQ ID NO: 434771 - RNA, 32 nt, Human
gcaguaaguccccagcagugagcuguguaagc

SEQ ID NO: 434772 - RNA, 32 nt, Human
gcaguaauauaccaccagcccaaggagaaaac

SEQ ID NO: 434773 - RNA, 32 nt, Human
gcaguaaucugucaguguuuguauuuguauuc

SEQ ID NO: 434774 - RNA, 32 nt, Human
gcaguaaucugucaguguuuguauuuguauuu

SEQ ID NO: 434775 - RNA, 31 nt, Human
gcaguacaauuucagcauaucucuggcucag

SEQ ID NO: 434776 - RNA, 32 nt, Human
gcaguacagaggaaaacaggaaccugauuuuu

SEQ ID NO: 434777 - RNA, 32 nt, Human
gcaguaccaguauaagaugacauuccaaagac

SEQ ID NO: 434778 - RNA, 32 nt, Human
gcaguaccagugccaugucccagacaggcucg

SEQ ID NO: 434779 - RNA, 32 nt, Human
gcaguaccauucaggacauaggcacaggcaaa

SEQ ID NO: 434780 - RNA, 32 nt, Human
gcaguacccauguugauuugacaucucucuag

SEQ ID NO: 434781 - RNA, 32 nt, Human
gcaguaccggggcuggagcggagugaagcugu

SEQ ID NO: 434782 - RNA, 32 nt, Human
gcaguaccugcaacugaggauucuucccgggg

SEQ ID NO: 434783 - RNA, 32 nt, Human
gcaguaccugggauuuucccaccaauacaaac

SEQ ID NO: 434784 - RNA, 32 nt, Human
gcaguacucaacccucuccauucaaagccccu

SEQ ID NO: 434785 - RNA, 32 nt, Human
gcaguacugcuccacuucaccuuccuagugac

SEQ ID NO: 434786 - RNA, 32 nt, Human
gcaguacuugcacacauuuuggagauuguauu

SEQ ID NO: 434787 - RNA, 32 nt, Human
gcaguagaaaggaggaaggagggagagggaag

SEQ ID NO: 434788 - RNA, 32 nt, Human
gcaguagaagauggugaaagaaacaacuuacu

SEQ ID NO: 434789 - RNA, 19 nt, Human
gcaguagaaucgcuugaac

SEQ ID NO: 434790 - RNA, 32 nt, Human
gcaguagacuggggcgucaccuccaggccguu

SEQ ID NO: 434791 - RNA, 32 nt, Human
gcaguagagaugcaguuucaucaaagaacaaa

SEQ ID NO: 434792 - RNA, 32 nt, Human
gcaguagaggacugcagcugccuaggucugcg

SEQ ID NO: 434793 - RNA, 32 nt, Human
gcaguagaggacugcagcugucuaggucugcg

SEQ ID NO: 434794 - RNA, 32 nt, Human
gcaguagagugaucucagcucacugcaaccuc

SEQ ID NO: 434795 - RNA, 32 nt, Human
gcaguagagugcuuccagggaggagaaaggac

SEQ ID NO: 434796 - RNA, 32 nt, Human
gcaguagcagaggcuucuacaaauaccaacac

SEQ ID NO: 434797 - RNA, 22 nt, Human
gcaguagcaguugccuguaauc

SEQ ID NO: 434798 - RNA, 32 nt, Human
gcaguagcaugaccacugcuuccugucuaccc

SEQ ID NO: 434799 - RNA, 21 nt, Human
gcaguagccacauggugcugg

SEQ ID NO: 434800 - RNA, 32 nt, Human
gcaguagccaguggauaaacuaaccuguugau

SEQ ID NO: 434801 - RNA, 23 nt, Human
gcaguagcucacacccuguaauc

SEQ ID NO: 434802 - RNA, 32 nt, Human
gcaguagcucacacccuguaaucccagcacuu

SEQ ID NO: 434803 - RNA, 22 nt, Human
gcaguagcucacaccuguaauc

SEQ ID NO: 434804 - RNA, 22 nt, Human
gcaguagcucacaccuguaguc

SEQ ID NO: 434805 - RNA, 21 nt, Human
gcaguagcucacacuguaauc

SEQ ID NO: 434806 - RNA, 22 nt, Human
gcaguagcucacgccuguaauc

SEQ ID NO: 434807 - RNA, 32 nt, Human
gcaguagcugcacucagcugcccgcgcggcaa

SEQ ID NO: 434808 - RNA, 32 nt, Human
gcaguagcugggugggcagcauggcugggauc

SEQ ID NO: 434809 - RNA, 18 nt, Human
gcaguagcuucugggcca

SEQ ID NO: 434810 - RNA, 32 nt, Human
gcaguaggacagagccauacaugugaaaucug

SEQ ID NO: 434811 - RNA, 32 nt, Human
gcaguaggagggagaggaaggggugccaccgu

SEQ ID NO: 434812 - RNA, 24 nt, Human
gcaguaggaucucagccacaaggg

SEQ ID NO: 434813 - RNA, 23 nt, Human
gcaguaggcauuacuacaguaca

SEQ ID NO: 434814 - RNA, 32 nt, Human
gcaguaggcuuaguucuggccuguccccucca

SEQ ID NO: 434815 - RNA, 32 nt, Human
gcaguagggacuggaagauaugucaucugcug

SEQ ID NO: 434816 - RNA, 32 nt, Human
gcaguagggaggcagaguaucuugguggggag

SEQ ID NO: 434817 - RNA, 32 nt, Human
gcaguagggagucucucaccgucgcauggucc

SEQ ID NO: 434818 - RNA, 32 nt, Human
gcaguaggggagagagcagagaaguacagguc

SEQ ID NO: 434819 - RNA, 32 nt, Human
gcaguagugaaaagcuuagaugaguacggaua

SEQ ID NO: 434820 - RNA, 32 nt, Human
gcaguaguucaguucucuucaugguuaugucu

SEQ ID NO: 434821 - RNA, 32 nt, Human
gcaguaguucaugcccuguaauccuagaacuu

SEQ ID NO: 434822 - RNA, 32 nt, Human
gcaguaguuccagugaccagaaaaauuaaacc

SEQ ID NO: 434823 - RNA, 32 nt, Human
gcaguauaccacccggccuggccgccaccacc

SEQ ID NO: 434824 - RNA, 31 nt, Human
gcaguauaggagagagagcaaggauugaguc

SEQ ID NO: 434825 - RNA, 21 nt, Human
gcaguauaugugcacacagua

SEQ ID NO: 434826 - RNA, 32 nt, Human
gcaguauaugugcacacaguaaguacacaaau

SEQ ID NO: 434827 - RNA, 32 nt, Human
gcaguaucuccucugggaccugccaugcugag

SEQ ID NO: 434828 - RNA, 32 nt, Human
gcaguaucugugagaaaaaccugaaaauuaau

SEQ ID NO: 434829 - RNA, 32 nt, Human
gcaguaucuguuucucuuccuaggcucaaguu

SEQ ID NO: 434830 - RNA, 32 nt, Human
gcaguaugaacucugguugcaaucccuccccc

SEQ ID NO: 434831 - RNA, 30 nt, Human
gcaguaugaguguggggaauagugugaaca

SEQ ID NO: 434832 - RNA, 32 nt, Human
gcaguauggaaaccccacaagguggcuguuau

SEQ ID NO: 434833 - RNA, 19 nt, Human
gcaguauguuuacauguca

SEQ ID NO: 434834 - RNA, 32 nt, Human
gcaguauuauuugcaaaagccaagagguguaa

SEQ ID NO: 434835 - RNA, 32 nt, Human
gcaguauuugcuuaggaaacuaauuuagucau

SEQ ID NO: 434836 - RNA, 32 nt, Human
gcagucaagugccucccagccucggcucagca

SEQ ID NO: 434837 - RNA, 32 nt, Human
gcagucacaccccugcacuccagccuggguga

SEQ ID NO: 434838 - RNA, 32 nt, Human
gcagucacaggcccaggaaggcggcaggcaga

SEQ ID NO: 434839 - RNA, 32 nt, Human
gcagucacaggugagggugguauuagcaucuu

SEQ ID NO: 434840 - RNA, 18 nt, Human
gcagucaccaugcucucc

SEQ ID NO: 434841 - RNA, 32 nt, Human
gcagucacccacacucugggccuguggcacca

SEQ ID NO: 434842 - RNA, 18 nt, Human
gcagucaccccucccucc

SEQ ID NO: 434843 - RNA, 32 nt, Human
gcagucaccgcugccucugccaguucgugugu

SEQ ID NO: 434844 - RNA, 32 nt, Human
gcagucacggagugagugaacaugcaugauuc

SEQ ID NO: 434845 - RNA, 32 nt, Human
gcagucacucaaugccagcccaugaaagcagc

SEQ ID NO: 434846 - RNA, 32 nt, Human
gcagucacucugcuaagagucccucccugcca

SEQ ID NO: 434847 - RNA, 17 nt, Human
gcagucagcacauagcc

SEQ ID NO: 434848 - RNA, 32 nt, Human
gcagucagcacuuauuuaccaucaagcaaucc

SEQ ID NO: 434849 - RNA, 32 nt, Human
gcagucagcaucuuaaaguaaauguucaugga

SEQ ID NO: 434850 - RNA, 32 nt, Human
gcagucagcauuaaugaaacucauguuuaaac

SEQ ID NO: 434851 - RNA, 32 nt, Human
gcagucagccaagaucuugccacuguacucca

SEQ ID NO: 434852 - RNA, 32 nt, Human
gcagucagcgcuuauuuaccaucaagcaaucc

SEQ ID NO: 434853 - RNA, 32 nt, Human
gcagucagcucacuccacuccugggcucaagc

SEQ ID NO: 434854 - RNA, 32 nt, Human
gcagucagcucccugccugcagggccgccgcc

SEQ ID NO: 434855 - RNA, 32 nt, Human
gcagucagcuccugagacacagcuggccggca

SEQ ID NO: 434856 - RNA, 32 nt, Human
gcagucaggcagacccagugauaugguaagaa

SEQ ID NO: 434857 - RNA, 32 nt, Human
gcagucaggcuggcaguggcgcgguacaggga

SEQ ID NO: 434858 - RNA, 32 nt, Human
gcagucagggagcagcggcggcagagacaggg

SEQ ID NO: 434859 - RNA, 31 nt, Human
gcagucaguaaaauccucccacugccuccgg

SEQ ID NO: 434860 - RNA, 32 nt, Human
gcagucagucuguucuggaggguggagagaga

SEQ ID NO: 434861 - RNA, 32 nt, Human
gcagucauaagcucuguuucccccucucccca

SEQ ID NO: 434862 - RNA, 32 nt, Human
gcagucauacuagugguuaagauauuugggaa

SEQ ID NO: 434863 - RNA, 32 nt, Human
gcagucaucaacaaaagggagaacauggccaa

SEQ ID NO: 434864 - RNA, 32 nt, Human
gcagucaucaucuucaggauguuucuucagga

SEQ ID NO: 434865 - RNA, 19 nt, Human
gcagucaucccugccacca

SEQ ID NO: 434866 - RNA, 31 nt, Human
gcagucaugaggaaacaggucagggcgaagc

SEQ ID NO: 434867 - RNA, 31 nt, Human
gcagucauggcucagggacacucugaaguag

SEQ ID NO: 434868 - RNA, 32 nt, Human
gcagucauuccucaauuacugccugcagcaau

SEQ ID NO: 434869 - RNA, 32 nt, Human
gcagucauuucagggggcuccugcugaccccg

SEQ ID NO: 434870 - RNA, 32 nt, Human
gcaguccaacagcaccagcacggcuaugacag

SEQ ID NO: 434871 - RNA, 32 nt, Human
gcaguccaacccagauuagugcagcccggagg

SEQ ID NO: 434872 - RNA, 32 nt, Human
gcaguccacucccauguaaccaugaaagagag

SEQ ID NO: 434873 - RNA, 32 nt, Human
gcaguccacugcauagucauucagcucugcaa

SEQ ID NO: 434874 - RNA, 32 nt, Human
gcaguccagaucaaaaauggcgguaguuggug

SEQ ID NO: 434875 - RNA, 32 nt, Human
gcaguccagccucuccccauuugaggccauau

SEQ ID NO: 434876 - RNA, 24 nt, Human
gcaguccagccugggcaacaagag

SEQ ID NO: 434877 - RNA, 18 nt, Human
gcaguccagcgugcaucc

SEQ ID NO: 434878 - RNA, 32 nt, Human
gcaguccaggagauuauuaaggggucgccaug

SEQ ID NO: 434879 - RNA, 32 nt, Human
gcaguccaggucucccuucucccacuugccua

SEQ ID NO: 434880 - RNA, 32 nt, Human
gcaguccagugcaaagccgcccccagagccca

SEQ ID NO: 434881 - RNA, 32 nt, Human
gcaguccauaaauaccucugucagaaucaaag

SEQ ID NO: 434882 - RNA, 19 nt, Human
gcaguccauguggcugcca

SEQ ID NO: 434883 - RNA, 32 nt, Human
gcagucccagagccagcccugcccucagcccu

SEQ ID NO: 434884 - RNA, 32 nt, Human
gcagucccagcaggacccauggaguguccuuc

SEQ ID NO: 434885 - RNA, 32 nt, Human
gcagucccagccucagaacccaggauaggaaa

SEQ ID NO: 434886 - RNA, 32 nt, Human
gcagucccaguuacuugggugccugaggcagg

SEQ ID NO: 434887 - RNA, 32 nt, Human
gcagucccauuuccuacccguaauacuuucuu

SEQ ID NO: 434888 - RNA, 32 nt, Human
gcaguccccagccagggagaccagguguuguc

SEQ ID NO: 434889 - RNA, 19 nt, Human
gcagucccccaacuacccc

SEQ ID NO: 434890 - RNA, 32 nt, Human
gcagucccccucaguucgugcugcaauaaagg

SEQ ID NO: 434891 - RNA, 32 nt, Human
gcagucccccuccacauguauccacaucugag

SEQ ID NO: 434892 - RNA, 32 nt, Human
gcaguccccuucuugcaggucucagcuugcgg

SEQ ID NO: 434893 - RNA, 32 nt, Human
gcagucccuccagguggggcuggagccugcug

SEQ ID NO: 434894 - RNA, 32 nt, Human
gcagucccuccucuccccaguguccacaguca

SEQ ID NO: 434895 - RNA, 32 nt, Human
gcagucccucuucagagacuguuccagccuca

SEQ ID NO: 434896 - RNA, 32 nt, Human
gcagucccugcagauggcccauuuggagaucu

SEQ ID NO: 434897 - RNA, 32 nt, Human
gcagucccugcagcucucuuuccucuggggca

SEQ ID NO: 434898 - RNA, 32 nt, Human
gcaguccgaggcaggggaauugcuugaacuca

SEQ ID NO: 434899 - RNA, 32 nt, Human
gcaguccgcaguccagccugggcgacagagcg

SEQ ID NO: 434900 - RNA, 32 nt, Human
gcaguccgcccaucugagcacagggucugucc

SEQ ID NO: 434901 - RNA, 32 nt, Human
gcaguccggcgccuggcccaggaaaagagugg

SEQ ID NO: 434902 - RNA, 32 nt, Human
gcaguccuacuacagucuggagugggguccua

SEQ ID NO: 434903 - RNA, 32 nt, Human
gcaguccuagccccaaaccagcccagagcagg

SEQ ID NO: 434904 - RNA, 32 nt, Human
gcaguccucaauuaaucucuggugcacuuaac

SEQ ID NO: 434905 - RNA, 32 nt, Human
gcaguccucagagcuucucugccuauggagua

SEQ ID NO: 434906 - RNA, 32 nt, Human
gcaguccuccacuggcccagcacuccaguuuc

SEQ ID NO: 434907 - RNA, 32 nt, Human
gcaguccucccaccucagccuccuggguagcu

SEQ ID NO: 434908 - RNA, 32 nt, Human
gcaguccucccaccucagucuccugaguagcu

SEQ ID NO: 434909 - RNA, 32 nt, Human
gcaguccucccaccuuggccucccagaaugcu

SEQ ID NO: 434910 - RNA, 32 nt, Human
gcaguccugaggacccaggagcaguggcccca

SEQ ID NO: 434911 - RNA, 32 nt, Human
gcaguccugauagcuucucuagccucggucuu

SEQ ID NO: 434912 - RNA, 32 nt, Human
gcaguccugcagcagcaaacacaucaucagcc

SEQ ID NO: 434913 - RNA, 32 nt, Human
gcaguccugggauguggcugcagcagcggugg

SEQ ID NO: 434914 - RNA, 32 nt, Human
gcaguccugugccagggcguuggggcugcucc

SEQ ID NO: 434915 - RNA, 32 nt, Human
gcaguccugugugaggaugaagggacgggggu

SEQ ID NO: 434916 - RNA, 32 nt, Human
gcaguccuucacugcuacccagucagacccuc

SEQ ID NO: 434917 - RNA, 32 nt, Human
gcagucgauucacccagcaucuugccagaagu

SEQ ID NO: 434918 - RNA, 32 nt, Human
gcagucgccgcuccagucuauccggcacuagg

SEQ ID NO: 434919 - RNA, 21 nt, Human
gcagucgccugccugcagcag

SEQ ID NO: 434920 - RNA, 32 nt, Human
gcagucgcuugccaaagcagauuuuccuaagg

SEQ ID NO: 434921 - RNA, 17 nt, Human
gcagucggcccaugucc

SEQ ID NO: 434922 - RNA, 18 nt, Human
gcagucggcugcguccuc

SEQ ID NO: 434923 - RNA, 32 nt, Human
gcagucgggagguggaggcaccggcugcauug

SEQ ID NO: 434924 - RNA, 22 nt, Human
gcagucgggcuggagcuggagu

SEQ ID NO: 434925 - RNA, 21 nt, Human
gcagucgucacgccuguaauc

SEQ ID NO: 434926 - RNA, 21 nt, Human
gcagucgugcccaggagcaga

SEQ ID NO: 434927 - RNA, 31 nt, Human
gcagucguugcuggccagcacuuguguagaa

SEQ ID NO: 434928 - RNA, 32 nt, Human
gcagucuagguggcauagugaugaagaaaggg

SEQ ID NO: 434929 - RNA, 32 nt, Human
gcagucucaagaaauguacucgggcgacaccu

SEQ ID NO: 434930 - RNA, 32 nt, Human
gcagucucaccaagcccuaucacuaauaccac

SEQ ID NO: 434931 - RNA, 32 nt, Human
gcagucucauuucucauaauuuugcaaauuau

SEQ ID NO: 434932 - RNA, 32 nt, Human
gcagucuccacggaggccucaggccucggugu

SEQ ID NO: 434933 - RNA, 32 nt, Human
gcagucuccagccugagccaugggccgccgag

SEQ ID NO: 434934 - RNA, 32 nt, Human
gcagucucccacacggacaccuucuggaggaa

SEQ ID NO: 434935 - RNA, 32 nt, Human
gcagucucccgaagugcugggauuacugacau

SEQ ID NO: 434936 - RNA, 32 nt, Human
gcagucuccucuuuaaaacaaaacaaaacaaa

SEQ ID NO: 434937 - RNA, 32 nt, Human
gcagucuccugcccucuccccuguccugaugg

SEQ ID NO: 434938 - RNA, 32 nt, Human
gcagucuccuggcccgcggcugcuccgggccu

SEQ ID NO: 434939 - RNA, 32 nt, Human
gcagucucuccucucagcuggugucuccagug

SEQ ID NO: 434940 - RNA, 32 nt, Human
gcagucucugcuccagaaucucuggacggagc

SEQ ID NO: 434941 - RNA, 32 nt, Human
gcagucucuuuaccaccuccccaauuacacug

SEQ ID NO: 434942 - RNA, 32 nt, Human
gcagucucuuuagguaggcagggccuuugcug

SEQ ID NO: 434943 - RNA, 32 nt, Human
gcagucugagguauuggguauacuuauacucu

SEQ ID NO: 434944 - RNA, 32 nt, Human
gcagucugcacccugcacucccucccuugccu

SEQ ID NO: 434945 - RNA, 32 nt, Human
gcagucugcugggacaugcacauaucaggggu

SEQ ID NO: 434946 - RNA, 32 nt, Human
gcagucuggaaagaagggaaggcaggaguuuc

SEQ ID NO: 434947 - RNA, 23 nt, Human
gcagucuggaacuccugggccca

SEQ ID NO: 434948 - RNA, 32 nt, Human
gcagucuggccccagccucugugggcuuaacc

SEQ ID NO: 434949 - RNA, 32 nt, Human
gcagucuggcuuccccaaagaccucaagcuca

SEQ ID NO: 434950 - RNA, 32 nt, Human
gcagucugggcaacauggugagaccccaucuc

SEQ ID NO: 434951 - RNA, 32 nt, Human
gcagucugggcaauauagugaggcucccaucu

SEQ ID NO: 434952 - RNA, 32 nt, Human
gcagucuguuucuccccuagacucugggccug

SEQ ID NO: 434953 - RNA, 32 nt, Human
gcagucuucccaggccccgcuuuugcuuuugg

SEQ ID NO: 434954 - RNA, 32 nt, Human
gcagucuucccuagucccccaaauaaguaaua

SEQ ID NO: 434955 - RNA, 32 nt, Human
gcagucuucggcccucuccugucgccgccaug

SEQ ID NO: 434956 - RNA, 32 nt, Human
gcagucuucuaagccaccuuguggaucccaag

SEQ ID NO: 434957 - RNA, 32 nt, Human
gcagucuuugagcuucgccucuugccccgaga

SEQ ID NO: 434958 - RNA, 32 nt, Human
gcagucuuuucccaucucaggccucagcacca

SEQ ID NO: 434959 - RNA, 32 nt, Human
gcagugaacagcccuggcugggggugcagcca

SEQ ID NO: 434960 - RNA, 32 nt, Human
gcagugaagaaagggacggagauacugggaca

SEQ ID NO: 434961 - RNA, 18 nt, Human
gcagugaaguacucagua

SEQ ID NO: 434962 - RNA, 32 nt, Human
gcagugaaguccugccuuguuucaggugggaa

SEQ ID NO: 434963 - RNA, 32 nt, Human
gcagugacaacucugacaccacugacagucau

SEQ ID NO: 434964 - RNA, 32 nt, Human
gcagugacaugaucauagcucacugcagccug

SEQ ID NO: 434965 - RNA, 32 nt, Human
gcagugacaugaucuuagcucacugcaaccuc

SEQ ID NO: 434966 - RNA, 32 nt, Human
gcagugacccacccaccuaccuuugcaucacc

SEQ ID NO: 434967 - RNA, 32 nt, Human
gcagugacccagcccaggacgaaguuuacaaa

SEQ ID NO: 434968 - RNA, 32 nt, Human
gcagugacccuggaaaaccaggaacaauugac

SEQ ID NO: 434969 - RNA, 20 nt, Human
gcagugacgcgcucuccuca

SEQ ID NO: 434970 - RNA, 22 nt, Human
gcagugacucacaucuguaauc

SEQ ID NO: 434971 - RNA, 22 nt, Human
gcagugacucacgccuguaauc

SEQ ID NO: 434972 - RNA, 32 nt, Human
gcagugacucagcuuccuaaauagcuggaauu

SEQ ID NO: 434973 - RNA, 32 nt, Human
gcagugacucugggaaauccuucauuaaucau

SEQ ID NO: 434974 - RNA, 22 nt, Human
gcagugacuuacgccuguaauc

SEQ ID NO: 434975 - RNA, 32 nt, Human
gcagugagaaguugcucuucagccuggaaaau

SEQ ID NO: 434976 - RNA, 32 nt, Human
gcagugagagacauuuacagccuccucucuau

SEQ ID NO: 434977 - RNA, 32 nt, Human
gcagugagagcagacaucugugccucauuccu

SEQ ID NO: 434978 - RNA, 32 nt, Human
gcagugagaggaagggagggaugaggaggugg

SEQ ID NO: 434979 - RNA, 32 nt, Human
gcagugagauaggaaaucaagauggaagcaga

SEQ ID NO: 434980 - RNA, 32 nt, Human
gcagugagcagcugcccaggccccuugcacug

SEQ ID NO: 434981 - RNA, 32 nt, Human
gcagugagccaagaucgugcaacugcacucca

SEQ ID NO: 434982 - RNA, 32 nt, Human
gcagugagccaagaucucgccacugcacucca

SEQ ID NO: 434983 - RNA, 32 nt, Human
gcagugagccacggcacuccacccugggcaac

SEQ ID NO: 434984 - RNA, 32 nt, Human
gcagugagccacugcacuccagccugaugaca

SEQ ID NO: 434985 - RNA, 32 nt, Human
gcagugagccaggcuagccacagaggguuccc

SEQ ID NO: 434986 - RNA, 32 nt, Human
gcagugagccgagaucauugcauugcacucca

SEQ ID NO: 434987 - RNA, 32 nt, Human
gcagugagccgagaucgcgccacccacuccag

SEQ ID NO: 434988 - RNA, 32 nt, Human
gcagugagccuagaucgcgucacugcacucca

SEQ ID NO: 434989 - RNA, 32 nt, Human
gcagugagcuaugguagcaccacugcacuuca

SEQ ID NO: 434990 - RNA, 32 nt, Human
gcagugagcuggaaucgugccacuccacucca

SEQ ID NO: 434991 - RNA, 32 nt, Human
gcagugagcuggagcugggauccugcucugcu

SEQ ID NO: 434992 - RNA, 32 nt, Human
gcagugaggaagagaaaagcagagauaagcaa

SEQ ID NO: 434993 - RNA, 32 nt, Human
gcagugaggcagcaaugcugaguagguaggau

SEQ ID NO: 434994 - RNA, 32 nt, Human
gcagugaggcgccggagaaggccaaggcagac

SEQ ID NO: 434995 - RNA, 32 nt, Human
gcagugagggaaugggagcagcugugggcgcc

SEQ ID NO: 434996 - RNA, 32 nt, Human
gcagugagggccugcagccggccggccagggc

SEQ ID NO: 434997 - RNA, 32 nt, Human
gcagugaggggagaugcugggauagccauuuc

SEQ ID NO: 434998 - RNA, 32 nt, Human
gcagugaggggugggagaaggugaaugauuca

SEQ ID NO: 434999 - RNA, 32 nt, Human
gcagugaggucaagagcccaaccuucuuucac

SEQ ID NO: 435000 - RNA, 32 nt, Human
gcagugaggugggggcgggugggcagggaaug

SEQ ID NO: 435001 - RNA, 32 nt, Human
gcagugagguuuucuucaugucuucuguuccc

SEQ ID NO: 435002 - RNA, 32 nt, Human
gcagugagucuucccagagaaaggacaggguu

SEQ ID NO: 435003 - RNA, 32 nt, Human
gcagugauacagauuggcagccacugcagaga

SEQ ID NO: 435004 - RNA, 32 nt, Human
gcagugauacgaucaugacucacugcagccuc

SEQ ID NO: 435005 - RNA, 32 nt, Human
gcagugauagagcugagagcuccacccccaca

SEQ ID NO: 435006 - RNA, 19 nt, Human
gcagugauaucacauagua

SEQ ID NO: 435007 - RNA, 32 nt, Human
gcagugaucacaucuaaacaaaguuuagguaa

SEQ ID NO: 435008 - RNA, 18 nt, Human
gcagugaucuaugcugua

SEQ ID NO: 435009 - RNA, 32 nt, Human
gcagugaugaagaugaccucccuccagaccug

SEQ ID NO: 435010 - RNA, 32 nt, Human
gcagugaugaugaaaacuuaggaagaagguau

SEQ ID NO: 435011 - RNA, 32 nt, Human
gcagugaugccaugcaugagauccgcugugcc

SEQ ID NO: 435012 - RNA, 32 nt, Human
gcagugaugggaaugaaagaugaguuagaucu

SEQ ID NO: 435013 - RNA, 32 nt, Human
gcagugauguuugccauuugcuggacaaccaa

SEQ ID NO: 435014 - RNA, 19 nt, Human
gcagugauuaguugaacag

SEQ ID NO: 435015 - RNA, 19 nt, Human
gcagugauuugccaaagug

SEQ ID NO: 435016 - RNA, 18 nt, Human
gcagugauuuguuuugua

SEQ ID NO: 435017 - RNA, 21 nt, Human
gcagugcaccugccacagagg

SEQ ID NO: 435018 - RNA, 19 nt, Human
gcagugcacgccuguaauc

SEQ ID NO: 435019 - RNA, 32 nt, Human
gcagugcacucuggaagcaagugcuggcccug

SEQ ID NO: 435020 - RNA, 32 nt, Human
gcagugcacuugccccuccucaugccccuucu

SEQ ID NO: 435021 - RNA, 32 nt, Human
gcagugcagaacuacaagucccagggauccua

SEQ ID NO: 435022 - RNA, 32 nt, Human
gcagugcagaaugggccagcagggcugcaggu

SEQ ID NO: 435023 - RNA, 20 nt, Human
gcagugcagacggccgugag

SEQ ID NO: 435024 - RNA, 21 nt, Human
gcagugcagacgggccugggg

SEQ ID NO: 435025 - RNA, 20 nt, Human
gcagugcagcauggaaaagg

SEQ ID NO: 435026 - RNA, 32 nt, Human
gcagugcagccaaucagaaauggcucuuguga

SEQ ID NO: 435027 - RNA, 21 nt, Human
gcagugcagcuggagaggaag

SEQ ID NO: 435028 - RNA, 32 nt, Human
gcagugcaggggugaucucugcuuccuguacc

SEQ ID NO: 435029 - RNA, 32 nt, Human
gcagugcaguaaguuuguuuacaccaguauca

SEQ ID NO: 435030 - RNA, 32 nt, Human
gcagugccaacggccucugcccgcccacccgc

SEQ ID NO: 435031 - RNA, 32 nt, Human
gcagugccagcccagcucuccccuccacacug

SEQ ID NO: 435032 - RNA, 32 nt, Human
gcagugccagccuggggcagcagguacugccu

SEQ ID NO: 435033 - RNA, 32 nt, Human
gcagugccaggaccacccuugccugcagccuu

SEQ ID NO: 435034 - RNA, 32 nt, Human
gcagugccauggguguggggccagcagcuggu

SEQ ID NO: 435035 - RNA, 20 nt, Human
gcagugcccagcaggcagcg

SEQ ID NO: 435036 - RNA, 32 nt, Human
gcagugcccagccacuaaccugcacaagaucg

SEQ ID NO: 435037 - RNA, 32 nt, Human
gcagugcccgggcugccuccgggccucccgcc

SEQ ID NO: 435038 - RNA, 32 nt, Human
gcagugcccuuuccucccacuuuuccuccccc

SEQ ID NO: 435039 - RNA, 31 nt, Human
gcagugccuccuccugggccugggucuggaa

SEQ ID NO: 435040 - RNA, 32 nt, Human
gcagugccucugcgcaaucuccgggcaaguuc

SEQ ID NO: 435041 - RNA, 32 nt, Human
gcagugccugcucugcugugagccgccaggaa

SEQ ID NO: 435042 - RNA, 32 nt, Human
gcagugccugcugcccgugugcaugaagguac

SEQ ID NO: 435043 - RNA, 32 nt, Human
gcagugccugcuucugcuccaucaggugcagg

SEQ ID NO: 435044 - RNA, 32 nt, Human
gcagugccugggauaaaggcucuuguucaggc

SEQ ID NO: 435045 - RNA, 32 nt, Human
gcagugcgcaacacccucagccucaugcauuc

SEQ ID NO: 435046 - RNA, 32 nt, Human
gcagugcggcagccucggccugggcaggccca

SEQ ID NO: 435047 - RNA, 32 nt, Human
gcagugcgguggaggugagggggugagccugg

SEQ ID NO: 435048 - RNA, 32 nt, Human
gcagugcguuuaccaugugaacccagcaaucc

SEQ ID NO: 435049 - RNA, 31 nt, Human
gcagugcucaauaaaugcuucgaggcugaug

SEQ ID NO: 435050 - RNA, 32 nt, Human
gcagugcuccaaccucagccuccugaguagcu

SEQ ID NO: 435051 - RNA, 32 nt, Human
gcagugcucccaucccccaccagguggcagca

SEQ ID NO: 435052 - RNA, 25 nt, Human
gcagugcucgcagcagcgccagcag

SEQ ID NO: 435053 - RNA, 32 nt, Human
gcagugcucuagggcugccauuacacggucuu

SEQ ID NO: 435054 - RNA, 32 nt, Human
gcagugcugccaggcucugcuccagggcacag

SEQ ID NO: 435055 - RNA, 32 nt, Human
gcagugcuggacugcacagccccggggcucca

SEQ ID NO: 435056 - RNA, 32 nt, Human
gcagugcuggaggaacugggaggcagguuugg

SEQ ID NO: 435057 - RNA, 32 nt, Human
gcagugcuggcccagccccugcggcuuaggcu

SEQ ID NO: 435058 - RNA, 31 nt, Human
gcagugcuggccucugggcgggugccgagga

SEQ ID NO: 435059 - RNA, 31 nt, Human
gcagugcugguuccucugccuguguccccac

SEQ ID NO: 435060 - RNA, 25 nt, Human
gcagugcuguuuggagacugugaga

SEQ ID NO: 435061 - RNA, 32 nt, Human
gcagugcuucagagccucgggcucagguggca

SEQ ID NO: 435062 - RNA, 32 nt, Human
gcagugcuugggaacauacuguauccucgaaa

SEQ ID NO: 435063 - RNA, 32 nt, Human
gcaguggaagucaugagguugcuugauaccca

SEQ ID NO: 435064 - RNA, 32 nt, Human
gcaguggaccuucuuuucuuuuggacaagaua

SEQ ID NO: 435065 - RNA, 21 nt, Human
gcaguggacugaugccuucga

SEQ ID NO: 435066 - RNA, 32 nt, Human
gcaguggagauggggacaaagggcuaagaaaa

SEQ ID NO: 435067 - RNA, 21 nt, Human
gcaguggagccagcacagcgg

SEQ ID NO: 435068 - RNA, 32 nt, Human
gcaguggagcggcccucugccuucaggacccu

SEQ ID NO: 435069 - RNA, 32 nt, Human
gcaguggaggcuggcugcugaaggaugaacgg

SEQ ID NO: 435070 - RNA, 32 nt, Human
gcaguggaggggcccagugggggccccgcagc

SEQ ID NO: 435071 - RNA, 32 nt, Human
gcaguggagguggggguugcuguugauugaag

SEQ ID NO: 435072 - RNA, 32 nt, Human
gcaguggagucucccugucgacaguaaaguug

SEQ ID NO: 435073 - RNA, 22 nt, Human
gcaguggaucgcaccuguaauc

SEQ ID NO: 435074 - RNA, 32 nt, Human
gcaguggaugacugaauaggcaucauauuucu

SEQ ID NO: 435075 - RNA, 32 nt, Human
gcaguggaugguguugaagggcagccagagga

SEQ ID NO: 435076 - RNA, 32 nt, Human
gcaguggcacaaucacaguucacugcagccuc

SEQ ID NO: 435077 - RNA, 32 nt, Human
gcaguggcacaaucucaguucacugcaaccuc

SEQ ID NO: 435078 - RNA, 22 nt, Human
gcaguggcacgcgccuguaauc

SEQ ID NO: 435079 - RNA, 32 nt, Human
gcaguggcaggcaguagugaagucggcucuau

SEQ ID NO: 435080 - RNA, 32 nt, Human
gcaguggcagggcccagcuagcaggcucuucu

SEQ ID NO: 435081 - RNA, 32 nt, Human
gcaguggcaguggcaugauaucagcucacuau

SEQ ID NO: 435082 - RNA, 32 nt, Human
gcaguggcaucggcugccccaggcagaggcuu

SEQ ID NO: 435083 - RNA, 32 nt, Human
gcaguggccacuucugaaucucuguaagguuu

SEQ ID NO: 435084 - RNA, 32 nt, Human
gcaguggccagacaacacucacugcaggccuu

SEQ ID NO: 435085 - RNA, 22 nt, Human
gcaguggcccacagcuguaauc

SEQ ID NO: 435086 - RNA, 22 nt, Human
gcaguggcccacgccuguaauc

SEQ ID NO: 435087 - RNA, 32 nt, Human
gcaguggccccauccuggaacuugaccagauu

SEQ ID NO: 435088 - RNA, 32 nt, Human
gcaguggccgcccgcgccuuucccaggcucaa

SEQ ID NO: 435089 - RNA, 32 nt, Human
gcaguggccgccgccucuuccgccgccgggcu

SEQ ID NO: 435090 - RNA, 23 nt, Human
gcaguggccucacgccuguaauc

SEQ ID NO: 435091 - RNA, 32 nt, Human
gcaguggccucacgccuguaaucccagcacuu

SEQ ID NO: 435092 - RNA, 23 nt, Human
gcaguggccucaugccuauaauc

SEQ ID NO: 435093 - RNA, 32 nt, Human
gcaguggccucaugccuauaaucccagcacuu

SEQ ID NO: 435094 - RNA, 32 nt, Human
gcaguggccuccauccucccugcucagccaca

SEQ ID NO: 435095 - RNA, 32 nt, Human
gcaguggcgagaggagccccuuguggcagcag

SEQ ID NO: 435096 - RNA, 32 nt, Human
gcaguggcgcugaggcccugagggcuccuugg

SEQ ID NO: 435097 - RNA, 22 nt, Human
gcaguggcgggcgccuguaguc

SEQ ID NO: 435098 - RNA, 22 nt, Human
gcaguggcgugcgccuguaguc

SEQ ID NO: 435099 - RNA, 32 nt, Human
gcaguggcucaacaccuguagucccagcacuc

SEQ ID NO: 435100 - RNA, 22 nt, Human
gcaguggcucaagccuguaauc

SEQ ID NO: 435101 - RNA, 32 nt, Human
gcaguggcucaaucuugggcucacugcagccu

SEQ ID NO: 435102 - RNA, 22 nt, Human
gcaguggcucacacauguaauc

SEQ ID NO: 435103 - RNA, 22 nt, Human
gcaguggcucacaccgguaauc

SEQ ID NO: 435104 - RNA, 22 nt, Human
gcaguggcucacaccuauaauc

SEQ ID NO: 435105 - RNA, 22 nt, Human
gcaguggcucacaccuauaguc

SEQ ID NO: 435106 - RNA, 22 nt, Human
gcaguggcucacaccucuaauc

SEQ ID NO: 435107 - RNA, 22 nt, Human
gcaguggcucacaccuggaauc

SEQ ID NO: 435108 - RNA, 21 nt, Human
gcaguggcucacaccuguaau

SEQ ID NO: 435109 - RNA, 22 nt, Human
gcaguggcucacaccuguaauc

SEQ ID NO: 435110 - RNA, 32 nt, Human
gcaguggcucacaccuguaauuccagcacuug

SEQ ID NO: 435111 - RNA, 22 nt, Human
gcaguggcucacaccuguaguc

SEQ ID NO: 435112 - RNA, 22 nt, Human
gcaguggcucacaccuguauuc

SEQ ID NO: 435113 - RNA, 32 nt, Human
gcaguggcucacaccuguauucccagcacuuu

SEQ ID NO: 435114 - RNA, 32 nt, Human
gcaguggcucacaccugucauuccagcacuuu

SEQ ID NO: 435115 - RNA, 32 nt, Human
gcaguggcucacaccugugagcacuuugggag

SEQ ID NO: 435116 - RNA, 22 nt, Human
gcaguggcucacaccugugauc

SEQ ID NO: 435117 - RNA, 23 nt, Human
gcaguggcucacaccuuguaauc

SEQ ID NO: 435118 - RNA, 22 nt, Human
gcaguggcucacaccuuuaauc

SEQ ID NO: 435119 - RNA, 20 nt, Human
gcaguggcucacacuuguaa

SEQ ID NO: 435120 - RNA, 22 nt, Human
gcaguggcucacacuuguaauc

SEQ ID NO: 435121 - RNA, 20 nt, Human
gcaguggcucacaucuguaa

SEQ ID NO: 435122 - RNA, 22 nt, Human
gcaguggcucacaucuguaauc

SEQ ID NO: 435123 - RNA, 22 nt, Human
gcaguggcucaccccuguaauc

SEQ ID NO: 435124 - RNA, 22 nt, Human
gcaguggcucaccucuguaauc

SEQ ID NO: 435125 - RNA, 20 nt, Human
gcaguggcucaccuguaauc

SEQ ID NO: 435126 - RNA, 22 nt, Human
gcaguggcucacgccacuaauc

SEQ ID NO: 435127 - RNA, 22 nt, Human
gcaguggcucacgccuauaauc

SEQ ID NO: 435128 - RNA, 20 nt, Human
gcaguggcucacgccuguaa

SEQ ID NO: 435129 - RNA, 22 nt, Human
gcaguggcucacgccuguaauc

SEQ ID NO: 435130 - RNA, 22 nt, Human
gcaguggcucacgccuguaauu

SEQ ID NO: 435131 - RNA, 22 nt, Human
gcaguggcucacgccuguuauc

SEQ ID NO: 435132 - RNA, 22 nt, Human
gcaguggcucacgcuuguaauc

SEQ ID NO: 435133 - RNA, 22 nt, Human
gcaguggcucacuccuguaauc

SEQ ID NO: 435134 - RNA, 22 nt, Human
gcaguggcucaugcccauaauc

SEQ ID NO: 435135 - RNA, 22 nt, Human
gcaguggcucaugcccguaauc

SEQ ID NO: 435136 - RNA, 22 nt, Human
gcaguggcucaugccuauaauc

SEQ ID NO: 435137 - RNA, 22 nt, Human
gcaguggcucaugccuggaauc

SEQ ID NO: 435138 - RNA, 20 nt, Human
gcaguggcucaugccuguaa

SEQ ID NO: 435139 - RNA, 22 nt, Human
gcaguggcucaugccuguaauc

SEQ ID NO: 435140 - RNA, 32 nt, Human
gcaguggcucaugccuguaauccaagcauuuu

SEQ ID NO: 435141 - RNA, 32 nt, Human
gcaguggcucaugccuguaaucccagcauuuu

SEQ ID NO: 435142 - RNA, 22 nt, Human
gcaguggcucaugccuguauuc

SEQ ID NO: 435143 - RNA, 22 nt, Human
gcaguggcucaugcuuguaauc

SEQ ID NO: 435144 - RNA, 22 nt, Human
gcaguggcucauguguguaauc

SEQ ID NO: 435145 - RNA, 22 nt, Human
gcaguggcucccaccuguaauc

SEQ ID NO: 435146 - RNA, 32 nt, Human
gcaguggcucucugcugacuuugcucaggagc

SEQ ID NO: 435147 - RNA, 22 nt, Human
gcaguggcucuugccuguaauc

SEQ ID NO: 435148 - RNA, 22 nt, Human
gcaguggcugaugccuguaauc

SEQ ID NO: 435149 - RNA, 32 nt, Human
gcaguggcuggcagugccaggccugggggaag

SEQ ID NO: 435150 - RNA, 32 nt, Human
gcaguggcugggaggcagcggcccaauuagug

SEQ ID NO: 435151 - RNA, 32 nt, Human
gcaguggcuggugggccacucucuccaggugc

SEQ ID NO: 435152 - RNA, 32 nt, Human
gcaguggcuguaaucccagcacuuugggaggc

SEQ ID NO: 435153 - RNA, 20 nt, Human
gcaguggcuuacaccuguaa

SEQ ID NO: 435154 - RNA, 32 nt, Human
gcaguggcuuacaccuguaaccccagcacuuu

SEQ ID NO: 435155 - RNA, 22 nt, Human
gcaguggcuuacaccuguaauc

SEQ ID NO: 435156 - RNA, 22 nt, Human
gcaguggcuuacgccuguaauc

SEQ ID NO: 435157 - RNA, 17 nt, Human
gcaguggcuuccuggcc

SEQ ID NO: 435158 - RNA, 32 nt, Human
gcagugggaagacagauucuacggcacugcuu

SEQ ID NO: 435159 - RNA, 32 nt, Human
gcagugggagagaggaugaggagaaacggaau

SEQ ID NO: 435160 - RNA, 19 nt, Human
gcagugggagauggagcug

SEQ ID NO: 435161 - RNA, 32 nt, Human
gcagugggaggaggagaaggaggaggaggaga

SEQ ID NO: 435162 - RNA, 32 nt, Human
gcagugggaggcaucugggggccaaaggucag

SEQ ID NO: 435163 - RNA, 32 nt, Human
gcagugggaggcgacgguggaggagggugguc

SEQ ID NO: 435164 - RNA, 32 nt, Human
gcagugggaucugguguguggcagaaaggucu

SEQ ID NO: 435165 - RNA, 32 nt, Human
gcagugggcggggcgggguggggaaggccgug

SEQ ID NO: 435166 - RNA, 32 nt, Human
gcagugggcucuggcggaggucgggagaacug

SEQ ID NO: 435167 - RNA, 32 nt, Human
gcaguggggacacccuuugugguuacaguuug

SEQ ID NO: 435168 - RNA, 32 nt, Human
gcaguggggcagcugccagagcucaggcgagc

SEQ ID NO: 435169 - RNA, 32 nt, Human
gcaguggggccaacagcccugccucuguuccc

SEQ ID NO: 435170 - RNA, 32 nt, Human
gcaguggggccaggaacacguggccugagagc

SEQ ID NO: 435171 - RNA, 20 nt, Human
gcaguggggcgaagcggggc

SEQ ID NO: 435172 - RNA, 32 nt, Human
gcaguggggucugaggagggcuggggaugagu

SEQ ID NO: 435173 - RNA, 32 nt, Human
gcaguggggucuucccgcugcccagcagccua

SEQ ID NO: 435174 - RNA, 32 nt, Human
gcagugggugccuguagugugaugugucugaa

SEQ ID NO: 435175 - RNA, 32 nt, Human
gcaguggguguguggggaagucacugucccac

SEQ ID NO: 435176 - RNA, 32 nt, Human
gcagugguacaaucauggcucacugcagccuc

SEQ ID NO: 435177 - RNA, 32 nt, Human
gcagugguacagucuuagcucacugcagccuc

SEQ ID NO: 435178 - RNA, 32 nt, Human
gcagugguaccgucugcagagcuugcugcccu

SEQ ID NO: 435179 - RNA, 32 nt, Human
gcagugguacgaucauagcucacugcagacuc

SEQ ID NO: 435180 - RNA, 32 nt, Human
gcagugguacgcucucagcucacugcaaccuc

SEQ ID NO: 435181 - RNA, 32 nt, Human
gcagugguagccugaggaaggccaagcugccc

SEQ ID NO: 435182 - RNA, 32 nt, Human
gcagugguagcggccuuugagcuguggggagg

SEQ ID NO: 435183 - RNA, 23 nt, Human
gcagugguagucccagcuacuca

SEQ ID NO: 435184 - RNA, 32 nt, Human
gcagugguaucuucugguaaaccaucagucug

SEQ ID NO: 435185 - RNA, 32 nt, Human
gcagugguaugaucucagcucacugcaagcuc

SEQ ID NO: 435186 - RNA, 32 nt, Human
gcagugguaugaucucagcucacugcagccuc

SEQ ID NO: 435187 - RNA, 32 nt, Human
gcaguggucccaaagugacgugagaggcugua

SEQ ID NO: 435188 - RNA, 32 nt, Human
gcaguggugagaucucagcucacugcaaccuc

SEQ ID NO: 435189 - RNA, 32 nt, Human
gcaguggugagauuuuggcucacuauaaccuc

SEQ ID NO: 435190 - RNA, 32 nt, Human
gcaguggugcaaucacaggucacugcagcccu

SEQ ID NO: 435191 - RNA, 32 nt, Human
gcaguggugcaaucauagcucacugcagccuu

SEQ ID NO: 435192 - RNA, 32 nt, Human
gcaguggugcaaucucaguucacugcaaccuc

SEQ ID NO: 435193 - RNA, 32 nt, Human
gcaguggugcaaucucgguucacugcaaccuc

SEQ ID NO: 435194 - RNA, 32 nt, Human
gcaguggugcagaauggcugaccucagucuug

SEQ ID NO: 435195 - RNA, 32 nt, Human
gcaguggugcagucuuggcucacuacagccuc

SEQ ID NO: 435196 - RNA, 32 nt, Human
gcaguggugccuguaaucccagcaguuuggga

SEQ ID NO: 435197 - RNA, 32 nt, Human
gcaguggugcgagcucagcucacugcaaccuc

SEQ ID NO: 435198 - RNA, 32 nt, Human
gcaguggugcgaucucaguucacugcaaccuc

SEQ ID NO: 435199 - RNA, 32 nt, Human
gcaguggugcuggcccaagugaaggccagagu

SEQ ID NO: 435200 - RNA, 32 nt, Human
gcagugguggcagcugagcacagcaucacuua

SEQ ID NO: 435201 - RNA, 20 nt, Human
gcagugguggucggggcagc

SEQ ID NO: 435202 - RNA, 32 nt, Human
gcaguggugugaucauagcucacuacagccuu

SEQ ID NO: 435203 - RNA, 32 nt, Human
gcaguggugugaucauagcucacugcacccuc

SEQ ID NO: 435204 - RNA, 32 nt, Human
gcaguggugugaucauagcucacugcagcuuu

SEQ ID NO: 435205 - RNA, 32 nt, Human
gcaguggugugaucucagcucacugcaaccuc

SEQ ID NO: 435206 - RNA, 32 nt, Human
gcaguggugugaucucagcucacugcagccuc

SEQ ID NO: 435207 - RNA, 32 nt, Human
gcaguggugugaucuuggcucacuacaaccuc

SEQ ID NO: 435208 - RNA, 32 nt, Human
gcaguggugugauuucagcucacugcaaccuu

SEQ ID NO: 435209 - RNA, 32 nt, Human
gcagugguguggucugcaggcccuggacccgc

SEQ ID NO: 435210 - RNA, 22 nt, Human
gcagugguucaugccaguaauc

SEQ ID NO: 435211 - RNA, 22 nt, Human
gcagugguucaugccuauaauc

SEQ ID NO: 435212 - RNA, 21 nt, Human
gcagugguucaugcuguaauc

SEQ ID NO: 435213 - RNA, 22 nt, Human
gcagugguucaugucuguaauc

SEQ ID NO: 435214 - RNA, 32 nt, Human
gcaguguaaaggaagccuagagagaaagaguu

SEQ ID NO: 435215 - RNA, 32 nt, Human
gcaguguagacagcaggaggagcaccgggcuu

SEQ ID NO: 435216 - RNA, 32 nt, Human
gcaguguagggaguuguggguaguggggaaga

SEQ ID NO: 435217 - RNA, 32 nt, Human
gcaguguaucucacguauuaauuuuuaaaaau

SEQ ID NO: 435218 - RNA, 32 nt, Human
gcagugucaacaaccacuucugcucuucagag

SEQ ID NO: 435219 - RNA, 32 nt, Human
gcaguguccagugcaguaccuggaccggagcc

SEQ ID NO: 435220 - RNA, 22 nt, Human
gcaguguccccagccuagcccu

SEQ ID NO: 435221 - RNA, 32 nt, Human
gcaguguccuuggcuuccuccuggcuuuaaug

SEQ ID NO: 435222 - RNA, 32 nt, Human
gcaguguccuuuuggaaagggagcugccccag

SEQ ID NO: 435223 - RNA, 22 nt, Human
gcagugucucaugccuguaauc

SEQ ID NO: 435224 - RNA, 32 nt, Human
gcagugucuccucuggcuguccuguuuguuug

SEQ ID NO: 435225 - RNA, 22 nt, Human
gcagugucugaggccuguggga

SEQ ID NO: 435226 - RNA, 32 nt, Human
gcagugucuucugcaccauccugugggacaca

SEQ ID NO: 435227 - RNA, 32 nt, Human
gcagugucuuuuuggaaagggagcugccccag

SEQ ID NO: 435228 - RNA, 32 nt, Human
gcagugugacaugcagaaguaaagcuggugag

SEQ ID NO: 435229 - RNA, 32 nt, Human
gcagugugaccuccugugacccaugaaugugc

SEQ ID NO: 435230 - RNA, 32 nt, Human
gcagugugagcacacgcuggagugcagcguuc

SEQ ID NO: 435231 - RNA, 32 nt, Human
gcagugugagcagaagcugaugccagcauguc

SEQ ID NO: 435232 - RNA, 32 nt, Human
gcagugugaguguggagaggccaugcgcaaug

SEQ ID NO: 435233 - RNA, 23 nt, Human
gcagugugauccagagagcagug

SEQ ID NO: 435234 - RNA, 32 nt, Human
gcagugugcaugcaggcaggaggcagggaaau

SEQ ID NO: 435235 - RNA, 32 nt, Human
gcagugugcccaggauugaagguguaaauggg

SEQ ID NO: 435236 - RNA, 19 nt, Human
gcagugugccuccauggcc

SEQ ID NO: 435237 - RNA, 32 nt, Human
gcagugugcucuggcgggaagggcccaucccg

SEQ ID NO: 435238 - RNA, 32 nt, Human
gcagugugcugugauugugacacugcccucca

SEQ ID NO: 435239 - RNA, 32 nt, Human
gcaguguggaggaagaugagggccaggaaaga

SEQ ID NO: 435240 - RNA, 32 nt, Human
gcaguguggaugcaccagcacccuccaaggga

SEQ ID NO: 435241 - RNA, 21 nt, Human
gcaguguggcccagccugguc

SEQ ID NO: 435242 - RNA, 32 nt, Human
gcaguguggcugcuucuugauucauccaugga

SEQ ID NO: 435243 - RNA, 32 nt, Human
gcaguguggggaggggauggggugcgucaggg

SEQ ID NO: 435244 - RNA, 31 nt, Human
gcagugugggugggggcgcucuggguggagg

SEQ ID NO: 435245 - RNA, 32 nt, Human
gcaguguggguucugugucugucuguucaucc

SEQ ID NO: 435246 - RNA, 22 nt, Human
gcagugugguggccacugguga

SEQ ID NO: 435247 - RNA, 32 nt, Human
gcaguguguggagaacugguaucaggaaaggg

SEQ ID NO: 435248 - RNA, 32 nt, Human
gcaguguguggaggugauggccaguuaaucug

SEQ ID NO: 435249 - RNA, 20 nt, Human
gcaguguguuuggaauccug

SEQ ID NO: 435250 - RNA, 32 nt, Human
gcaguguuaccuguuagcucccuguggggcag

SEQ ID NO: 435251 - RNA, 32 nt, Human
gcaguguucuacugccugaugugaaagagagc

SEQ ID NO: 435252 - RNA, 32 nt, Human
gcaguguugaacuguguguuuaaaaaugugaa

SEQ ID NO: 435253 - RNA, 32 nt, Human
gcaguguugagacucuucauugcugacuggcu

SEQ ID NO: 435254 - RNA, 32 nt, Human
gcaguguugcuguucauagauuuuguuccauu

SEQ ID NO: 435255 - RNA, 32 nt, Human
gcaguguuggccaugguguuggugcuggcucu

SEQ ID NO: 435256 - RNA, 32 nt, Human
gcaguguuucugcaguggcugcagggagaugg

SEQ ID NO: 435257 - RNA, 32 nt, Human
gcaguguuugugucccugauuacuugagauca

SEQ ID NO: 435258 - RNA, 32 nt, Human
gcaguguuugugucccugauuacuugagauua

SEQ ID NO: 435259 - RNA, 32 nt, Human
gcaguguuuuucaaagugugguccucacaccg

SEQ ID NO: 435260 - RNA, 32 nt, Human
gcaguuaaagauggcuaccaucagggaagaga

SEQ ID NO: 435261 - RNA, 32 nt, Human
gcaguuaaagucagaggagacaagcugguucu

SEQ ID NO: 435262 - RNA, 32 nt, Human
gcaguuaacaccuuugacagauuccuggaaaa

SEQ ID NO: 435263 - RNA, 32 nt, Human
gcaguuaaccucuaggauaauguggcuugaac

SEQ ID NO: 435264 - RNA, 20 nt, Human
gcaguuaccagccggcugcg

SEQ ID NO: 435265 - RNA, 21 nt, Human
gcaguuacugccuuugugugg

SEQ ID NO: 435266 - RNA, 32 nt, Human
gcaguuagagcugagcacuuuugaaaagcuug

SEQ ID NO: 435267 - RNA, 32 nt, Human
gcaguuagcagugugcauucccgaccuguggg

SEQ ID NO: 435268 - RNA, 16 nt, Human
gcaguuauccauggcc

SEQ ID NO: 435269 - RNA, 32 nt, Human
gcaguuaucugcaagcaaagagagaggcuuca

SEQ ID NO: 435270 - RNA, 32 nt, Human
gcaguuaugugcagggagacagcugguuacgg

SEQ ID NO: 435271 - RNA, 23 nt, Human
gcaguuauuaacacaauauuccu

SEQ ID NO: 435272 - RNA, 32 nt, Human
gcaguucaaaccuguguuguuugggucaacug

SEQ ID NO: 435273 - RNA, 32 nt, Human
gcaguucaaggcccuuucauuuaaccuuccaa

SEQ ID NO: 435274 - RNA, 32 nt, Human
gcaguucaauuccaaaggcaggaaaaggcuga

SEQ ID NO: 435275 - RNA, 32 nt, Human
gcaguucacagcccugacugucacaguguucc

SEQ ID NO: 435276 - RNA, 32 nt, Human
gcaguucacucugucucccaggcuggagugca

SEQ ID NO: 435277 - RNA, 32 nt, Human
gcaguucagcaacucuuaagugacacaguuca

SEQ ID NO: 435278 - RNA, 23 nt, Human
gcaguucagugccuuuguuggua

SEQ ID NO: 435279 - RNA, 32 nt, Human
gcaguucaugcagcaccucuacccacagaacu

SEQ ID NO: 435280 - RNA, 32 nt, Human
gcaguuccaccagggccagcacugggaccaga

SEQ ID NO: 435281 - RNA, 32 nt, Human
gcaguuccaguuucucuuccauucugugucac

SEQ ID NO: 435282 - RNA, 32 nt, Human
gcaguuccauuuuagagauuuauaaucacauc

SEQ ID NO: 435283 - RNA, 32 nt, Human
gcaguucccaaggacagucagcauuucuagac

SEQ ID NO: 435284 - RNA, 32 nt, Human
gcaguucccagagucgaaucuaguucucaucu

SEQ ID NO: 435285 - RNA, 32 nt, Human
gcaguucccagggacuguuuucaccucugcug

SEQ ID NO: 435286 - RNA, 18 nt, Human
gcaguuccccugccucaa

SEQ ID NO: 435287 - RNA, 32 nt, Human
gcaguuccuccuggggaaacaggcuagguuag

SEQ ID NO: 435288 - RNA, 32 nt, Human
gcaguuccugugagacaggagaggcugagcca

SEQ ID NO: 435289 - RNA, 32 nt, Human
gcaguucuagggcuggagggcaggggugacau

SEQ ID NO: 435290 - RNA, 32 nt, Human
gcaguucucccgccucagccuccugaguagcu

SEQ ID NO: 435291 - RNA, 32 nt, Human
gcaguucuccugccucaaccuccugaguagcu

SEQ ID NO: 435292 - RNA, 32 nt, Human
gcaguucuccugccucagccuccugaguagcu

SEQ ID NO: 435293 - RNA, 32 nt, Human
gcaguucucugugggcaaggccagcuugcuuc

SEQ ID NO: 435294 - RNA, 32 nt, Human
gcaguucucuugccucagccuccuggguagcu

SEQ ID NO: 435295 - RNA, 32 nt, Human
gcaguucucuuuccucagccuccugaguagcu

SEQ ID NO: 435296 - RNA, 21 nt, Human
gcaguucugaagaagauggua

SEQ ID NO: 435297 - RNA, 32 nt, Human
gcaguucugcagcuggccuuguuccuucauca

SEQ ID NO: 435298 - RNA, 18 nt, Human
gcaguucugcucucccca

SEQ ID NO: 435299 - RNA, 32 nt, Human
gcaguucuuaauuuccucuccuccuggggaau

SEQ ID NO: 435300 - RNA, 32 nt, Human
gcaguucuuuccaacuuggagugcucugguca

SEQ ID NO: 435301 - RNA, 32 nt, Human
gcaguugaauuguuuugacaccagaggcugaa

SEQ ID NO: 435302 - RNA, 32 nt, Human
gcaguugacaagacacauccucagugaaucaa

SEQ ID NO: 435303 - RNA, 32 nt, Human
gcaguugaggcggaacacagacaacuugggga

SEQ ID NO: 435304 - RNA, 32 nt, Human
gcaguugaggggugaaaaagaaaacaaacaaa

SEQ ID NO: 435305 - RNA, 32 nt, Human
gcaguugcagugagcugagauggugccacugc

SEQ ID NO: 435306 - RNA, 32 nt, Human
gcaguugcagugagcugagauugcgccacugu

SEQ ID NO: 435307 - RNA, 32 nt, Human
gcaguugcagugaguggagaucgcgccacugc

SEQ ID NO: 435308 - RNA, 22 nt, Human
gcaguugccaacaccuguaauc

SEQ ID NO: 435309 - RNA, 32 nt, Human
gcaguugccuguaaucucaacuacuugggagg

SEQ ID NO: 435310 - RNA, 22 nt, Human
gcaguugcucacaccgguaauc

SEQ ID NO: 435311 - RNA, 22 nt, Human
gcaguugcucaugccuguaauc

SEQ ID NO: 435312 - RNA, 32 nt, Human
gcaguugcuccugaccuauuugcccaccagcu

SEQ ID NO: 435313 - RNA, 32 nt, Human
gcaguugcuucugcccccuugauccaaaugac

SEQ ID NO: 435314 - RNA, 32 nt, Human
gcaguuggacaguucuggaggcuggaaggucc

SEQ ID NO: 435315 - RNA, 24 nt, Human
gcaguuggaucaccugagguuagg

SEQ ID NO: 435316 - RNA, 24 nt, Human
gcaguuggaucacuugaggccagg

SEQ ID NO: 435317 - RNA, 32 nt, Human
gcaguuggcugcagggccaggucuaggggcca

SEQ ID NO: 435318 - RNA, 32 nt, Human
gcaguuggcuguaguagcugaguucuuuucca

SEQ ID NO: 435319 - RNA, 32 nt, Human
gcaguugggacuacaggcgugagccaccaugc

SEQ ID NO: 435320 - RNA, 32 nt, Human
gcaguuggggcagugggcucucugcccacacu

SEQ ID NO: 435321 - RNA, 32 nt, Human
gcaguugggggaggcaguagacacgggacagg

SEQ ID NO: 435322 - RNA, 32 nt, Human
gcaguugggugaggagcaccagaaauucaaug

SEQ ID NO: 435323 - RNA, 32 nt, Human
gcaguugguacuugaaaugaagaucaaaucau

SEQ ID NO: 435324 - RNA, 32 nt, Human
gcaguuggugggggcugggggaagaggcuggc

SEQ ID NO: 435325 - RNA, 32 nt, Human
gcaguugucauugucuucuccaccgggcuguu

SEQ ID NO: 435326 - RNA, 32 nt, Human
gcaguugugcugcugcauauaacacuaccaag

SEQ ID NO: 435327 - RNA, 32 nt, Human
gcaguuuaaucuuuuucuuuaccuccaugguu

SEQ ID NO: 435328 - RNA, 32 nt, Human
gcaguuuaggaagccgaagugugcagaucacc

SEQ ID NO: 435329 - RNA, 32 nt, Human
gcaguuucacaguccaguugggucaccacuua

SEQ ID NO: 435330 - RNA, 32 nt, Human
gcaguuucagcccaggggaagacccagggaga

SEQ ID NO: 435331 - RNA, 32 nt, Human
gcaguuucuaacaaggugaagaacagcuauag

SEQ ID NO: 435332 - RNA, 32 nt, Human
gcaguuucucgaggggucaccgagccucuggu

SEQ ID NO: 435333 - RNA, 22 nt, Human
gcaguuucucuaccugccccca

SEQ ID NO: 435334 - RNA, 32 nt, Human
gcaguuucugguacuccuaugcaauauuacuc

SEQ ID NO: 435335 - RNA, 32 nt, Human
gcaguuucuuuucuaaaacccauuugggugac

SEQ ID NO: 435336 - RNA, 32 nt, Human
gcaguuugggaggcugaggcuaguggaucaug

SEQ ID NO: 435337 - RNA, 22 nt, Human
gcaguuuguauaauuucuguca

SEQ ID NO: 435338 - RNA, 32 nt, Human
gcaguuuuaguucuguguaacacaagcacuca

SEQ ID NO: 435339 - RNA, 32 nt, Human
gcaguuuuccgugggaguagacaggaaggccg

SEQ ID NO: 435340 - RNA, 32 nt, Human
gcaguuuugauuaccacugaccugcuggccag

SEQ ID NO: 435341 - RNA, 32 nt, Human
gcaguuuuguagugaagauugggcuuuggagu

SEQ ID NO: 435342 - RNA, 32 nt, Human
gcaguuuuuaauccucuaccuauugcacuguu

SEQ ID NO: 435343 - RNA, 32 nt, Human
gcaguuuuucaguguucagccaugucaguuga

SEQ ID NO: 435344 - RNA, 32 nt, Human
gcaguuuuugaaaauguuucaagucuaguuuu

SEQ ID NO: 435345 - RNA, 32 nt, Human
gcaguuuuuguuguuguuuauagacacucuug

SEQ ID NO: 435346 - RNA, 32 nt, Human
gcauaaaaagcaugucagcuggcuaaaagauu

SEQ ID NO: 435347 - RNA, 32 nt, Human
gcauaaaaagugccuguagaugacauggugaa

SEQ ID NO: 435348 - RNA, 32 nt, Human
gcauaaaagaugacuaguccucacuucaggcu

SEQ ID NO: 435349 - RNA, 32 nt, Human
gcauaaaauguuccuggucggggcuuggaaga

SEQ ID NO: 435350 - RNA, 32 nt, Human
gcauaaaccucuuuacuccuccagcaggcuuu

SEQ ID NO: 435351 - RNA, 32 nt, Human
gcauaaaccugggggcccucaggacuaggaca

SEQ ID NO: 435352 - RNA, 32 nt, Human
gcauaaagaaaaauggccgggccaggucauug

SEQ ID NO: 435353 - RNA, 32 nt, Human
gcauaaagcugcauacuuuuugucuagcuguu

SEQ ID NO: 435354 - RNA, 32 nt, Human
gcauaaaggacugcaggaggugcuguggguug

SEQ ID NO: 435355 - RNA, 32 nt, Human
gcauaaaggagggcagaaagaaacagcagugu

SEQ ID NO: 435356 - RNA, 32 nt, Human
gcauaaagugcuugcaauuucucuccacaauu

SEQ ID NO: 435357 - RNA, 31 nt, Human
gcauaaauaauaaaaaguaggagggguggag

SEQ ID NO: 435358 - RNA, 32 nt, Human
gcauaaaucugaagugguucagucuagaagaa

SEQ ID NO: 435359 - RNA, 32 nt, Human
gcauaacaaguagcugucuccagacaguggga

SEQ ID NO: 435360 - RNA, 32 nt, Human
gcauaacauacugcuauuggucuuuuuauaua

SEQ ID NO: 435361 - RNA, 32 nt, Human
gcauaaccaguauuagcauuagaaauuagcca

SEQ ID NO: 435362 - RNA, 32 nt, Human
gcauaacgggcuucccuuccagaagcucuccu

SEQ ID NO: 435363 - RNA, 32 nt, Human
gcauaacuauaaucccagcuacuugggaggcu

SEQ ID NO: 435364 - RNA, 32 nt, Human
gcauaacuggggcagaaaguguguaagugaag

SEQ ID NO: 435365 - RNA, 32 nt, Human
gcauaacuuggggguuaaagacaggaauaugg

SEQ ID NO: 435366 - RNA, 32 nt, Human
gcauaagaaaggcuuuucucuccagucauucu

SEQ ID NO: 435367 - RNA, 32 nt, Human
gcauaagaagcagaaagcuaaggaggcagacc

SEQ ID NO: 435368 - RNA, 32 nt, Human
gcauaagacaccaugccuggacuugcaugcug

SEQ ID NO: 435369 - RNA, 32 nt, Human
gcauaagaccuccaccucuagacuagcucuuc

SEQ ID NO: 435370 - RNA, 32 nt, Human
gcauaagaugcaggaaaaagugcagagcauua

SEQ ID NO: 435371 - RNA, 23 nt, Human
gcauaagcaauccucccacuuca

SEQ ID NO: 435372 - RNA, 32 nt, Human
gcauaagcacauccaaugggagaagaugucuu

SEQ ID NO: 435373 - RNA, 32 nt, Human
gcauaagcauuacaaaguccuucucuaguuaa

SEQ ID NO: 435374 - RNA, 32 nt, Human
gcauaagcugaugguauguaaggaaccgaugg

SEQ ID NO: 435375 - RNA, 32 nt, Human
gcauaaggaaauucagugaacuuucaacugga

SEQ ID NO: 435376 - RNA, 32 nt, Human
gcauaaggaagagauaaugagguaguuugugg

SEQ ID NO: 435377 - RNA, 32 nt, Human
gcauaagggcagcagagguggaguagggagga

SEQ ID NO: 435378 - RNA, 32 nt, Human
gcauaaggguuauuugagcaaguaacauuaac

SEQ ID NO: 435379 - RNA, 32 nt, Human
gcauaaggucauucauacuggagagaaauguu

SEQ ID NO: 435380 - RNA, 32 nt, Human
gcauaagguccauggugguggaaaauggaugc

SEQ ID NO: 435381 - RNA, 32 nt, Human
gcauaauaaagugacugauguuuacagaaccc

SEQ ID NO: 435382 - RNA, 32 nt, Human
gcauaauacuguaaaugucuuuuggucaagag

SEQ ID NO: 435383 - RNA, 32 nt, Human
gcauaauauaaauguugaugagacuagacucu

SEQ ID NO: 435384 - RNA, 32 nt, Human
gcauaauaucuacuuagaaagauagugggccc

SEQ ID NO: 435385 - RNA, 32 nt, Human
gcauaaucuaaacaugucaaacguucaguggg

SEQ ID NO: 435386 - RNA, 21 nt, Human
gcauaaugagcuugucaccua

SEQ ID NO: 435387 - RNA, 32 nt, Human
gcauacaaugcaaggcacuggccacaccaggc

SEQ ID NO: 435388 - RNA, 32 nt, Human
gcauacacaguccccaauagugaguaggagcc

SEQ ID NO: 435389 - RNA, 32 nt, Human
gcauacaccgagagagugaggagccagacgac

SEQ ID NO: 435390 - RNA, 32 nt, Human
gcauacacugagagagugaggagccagacgac

SEQ ID NO: 435391 - RNA, 32 nt, Human
gcauacagaggcccuccagagagacugcccug

SEQ ID NO: 435392 - RNA, 20 nt, Human
gcauacagcauggugacugg

SEQ ID NO: 435393 - RNA, 32 nt, Human
gcauacaucugaagaacaaaaacaucaacguc

SEQ ID NO: 435394 - RNA, 31 nt, Human
gcauacauuuggcagaauaaaugaaccaggu

SEQ ID NO: 435395 - RNA, 32 nt, Human
gcauacccagaagaaagaccuauaugaugcgg

SEQ ID NO: 435396 - RNA, 32 nt, Human
gcauaccccaggaguaauuccacuucugggga

SEQ ID NO: 435397 - RNA, 32 nt, Human
gcauaccccggccucucaguucuugagggccu

SEQ ID NO: 435398 - RNA, 32 nt, Human
gcauaccccucuccaccagcccuacuccugcg

SEQ ID NO: 435399 - RNA, 32 nt, Human
gcauaccggacccccauucgcaucuaacaagg

SEQ ID NO: 435400 - RNA, 32 nt, Human
gcauaccuauaaucccagcacuuggggaggcc

SEQ ID NO: 435401 - RNA, 17 nt, Human
gcauaccuguaauccca

SEQ ID NO: 435402 - RNA, 32 nt, Human
gcauaccuguaaucccagcuacucgggaaccu

SEQ ID NO: 435403 - RNA, 32 nt, Human
gcauaccuguaaucccagcuacuugggaggcu

SEQ ID NO: 435404 - RNA, 32 nt, Human
gcauaccuguaaucucugcuauuugggagacu

SEQ ID NO: 435405 - RNA, 17 nt, Human
gcauaccuguaguccca

SEQ ID NO: 435406 - RNA, 32 nt, Human
gcauaccuguagucccagcuacgugagaggcu

SEQ ID NO: 435407 - RNA, 32 nt, Human
gcauaccuguagucccagcuacucaggaggcu

SEQ ID NO: 435408 - RNA, 32 nt, Human
gcauaccuguagucccagcuacuugggaggcu

SEQ ID NO: 435409 - RNA, 32 nt, Human
gcauaccuguagucccagcuauucaggagcug

SEQ ID NO: 435410 - RNA, 32 nt, Human
gcauaccugugguuccagcuacuugggaggcu

SEQ ID NO: 435411 - RNA, 32 nt, Human
gcauaccuuuaagagaagcccuuugaauaauc

SEQ ID NO: 435412 - RNA, 32 nt, Human
gcauacgccuguaaucccagcuacucgggagg

SEQ ID NO: 435413 - RNA, 32 nt, Human
gcauacgggagccuaucucagugaaagagcag

SEQ ID NO: 435414 - RNA, 32 nt, Human
gcauacgucagaggaggcucguaggaauacuc

SEQ ID NO: 435415 - RNA, 19 nt, Human
gcauacugauaaucagcuu

SEQ ID NO: 435416 - RNA, 32 nt, Human
gcauacugaugaagaguuccuuaaacaagcuu

SEQ ID NO: 435417 - RNA, 32 nt, Human
gcauacuucugccucuauccugaacucuaggu

SEQ ID NO: 435418 - RNA, 32 nt, Human
gcauacuuguaaucccagcuacucaggaggcu

SEQ ID NO: 435419 - RNA, 32 nt, Human
gcauacuuguguuccacaguuauggccauaua

SEQ ID NO: 435420 - RNA, 32 nt, Human
gcauacuuugugaaccuggcuccuucuucacu

SEQ ID NO: 435421 - RNA, 32 nt, Human
gcauagaaaaggauucuggugcuuccccuguu

SEQ ID NO: 435422 - RNA, 32 nt, Human
gcauagaaaccucaaaugaaaaaccuaaaauc

SEQ ID NO: 435423 - RNA, 32 nt, Human
gcauagaacagcccuggcagggccaggacuac

SEQ ID NO: 435424 - RNA, 32 nt, Human
gcauagaacaggacuauauuucaugaauaauu

SEQ ID NO: 435425 - RNA, 32 nt, Human
gcauagaauugccucaaguccuggugagagag

SEQ ID NO: 435426 - RNA, 32 nt, Human
gcauagacacacacccccugacccuuaccauc

SEQ ID NO: 435427 - RNA, 32 nt, Human
gcauagacagagcugcagucugugcuaacauu

SEQ ID NO: 435428 - RNA, 32 nt, Human
gcauagaggcuuguuuuacaccuaucugcuca

SEQ ID NO: 435429 - RNA, 32 nt, Human
gcauagaguacuccagcaacuacagcagggag

SEQ ID NO: 435430 - RNA, 32 nt, Human
gcauagagugaguggaugugaugggcugugac

SEQ ID NO: 435431 - RNA, 32 nt, Human
gcauagaguucagagacuggaaacugaauuuu

SEQ ID NO: 435432 - RNA, 32 nt, Human
gcauagaucaccauugacuccuaccuggagag

SEQ ID NO: 435433 - RNA, 32 nt, Human
gcauagauuauuuccauccuuccagagaaguc

SEQ ID NO: 435434 - RNA, 32 nt, Human
gcauagauuuccucuuccacaagcugccgcuu

SEQ ID NO: 435435 - RNA, 32 nt, Human
gcauagauuuccucuuugagaacaucaaccug

SEQ ID NO: 435436 - RNA, 32 nt, Human
gcauagauuucucaagaaggaagacuccccug

SEQ ID NO: 435437 - RNA, 32 nt, Human
gcauagcaaggcagagagaaaccaggagucua

SEQ ID NO: 435438 - RNA, 32 nt, Human
gcauagcaccaugaggaagaccagccaccagu

SEQ ID NO: 435439 - RNA, 32 nt, Human
gcauagccaaaugcuauggaaccaaagaauaa

SEQ ID NO: 435440 - RNA, 32 nt, Human
gcauagccaacacuugaauugcgguguacuaa

SEQ ID NO: 435441 - RNA, 32 nt, Human
gcauagccacacugcccggcacgccacaucca

SEQ ID NO: 435442 - RNA, 32 nt, Human
gcauagccaccuaggggaggaggccgugugaa

SEQ ID NO: 435443 - RNA, 25 nt, Human
gcauagccuaugcugccugcugcca

SEQ ID NO: 435444 - RNA, 32 nt, Human
gcauagccuuucuguauuuaagaaacuuaagc

SEQ ID NO: 435445 - RNA, 32 nt, Human
gcauagcggucaggcccagcaggagcuuggca

SEQ ID NO: 435446 - RNA, 32 nt, Human
gcauagcuaauaacaaccacacauugggccag

SEQ ID NO: 435447 - RNA, 32 nt, Human
gcauagcuacccuucacaggugcuuuggaaac

SEQ ID NO: 435448 - RNA, 32 nt, Human
gcauagcucacuguaggcuagccucugcuuac

SEQ ID NO: 435449 - RNA, 32 nt, Human
gcauagcuguuuuucucccaugaguaugcaaa

SEQ ID NO: 435450 - RNA, 32 nt, Human
gcauaggaccucaaaauacaaaauuagcaggg

SEQ ID NO: 435451 - RNA, 32 nt, Human
gcauaggagcaucucagccuccagguccucuc

SEQ ID NO: 435452 - RNA, 32 nt, Human
gcauaggaggcugcacguucauuuguuguugu

SEQ ID NO: 435453 - RNA, 32 nt, Human
gcauaggaggggucuggacaugugguuacuag

SEQ ID NO: 435454 - RNA, 32 nt, Human
gcauaggcacagaaguuuagguguuuggacca

SEQ ID NO: 435455 - RNA, 32 nt, Human
gcauaggccacuuuuagccauguaaaaauaag

SEQ ID NO: 435456 - RNA, 32 nt, Human
gcauaggccccagaccaaacuagaccaccagc

SEQ ID NO: 435457 - RNA, 32 nt, Human
gcauaggccuguaaucguagcgcuuugagagg

SEQ ID NO: 435458 - RNA, 32 nt, Human
gcauaggccuguaauuccagcuacucuggcug

SEQ ID NO: 435459 - RNA, 32 nt, Human
gcauaggcucuagugcugaaaggauccagguu

SEQ ID NO: 435460 - RNA, 32 nt, Human
gcauaggcuuggcaaauggacaacuugguugu

SEQ ID NO: 435461 - RNA, 32 nt, Human
gcauagggaccuaaggcccacuggagggcgcu

SEQ ID NO: 435462 - RNA, 32 nt, Human
gcauagggcagccuaccaccuccaagggggca

SEQ ID NO: 435463 - RNA, 32 nt, Human
gcauaggggaagagcaugagcuucagagucaa

SEQ ID NO: 435464 - RNA, 32 nt, Human
gcauaggugggacuacaggcaccugccaccac

SEQ ID NO: 435465 - RNA, 32 nt, Human
gcauaguauaaaauuauacccugcaugcugac

SEQ ID NO: 435466 - RNA, 32 nt, Human
gcauagucagugucguuuauauuguagcaguu

SEQ ID NO: 435467 - RNA, 31 nt, Human
gcauagugacuuccuugcagaguauaauaug

SEQ ID NO: 435468 - RNA, 24 nt, Human
gcauaguggcucacgccuguaauc

SEQ ID NO: 435469 - RNA, 32 nt, Human
gcauauaacaaguguacacauauacacauaac

SEQ ID NO: 435470 - RNA, 32 nt, Human
gcauauaaugugaaccaucacagugggagaca

SEQ ID NO: 435471 - RNA, 32 nt, Human
gcauauaggugaauauuugugugcccaugagc

SEQ ID NO: 435472 - RNA, 32 nt, Human
gcauauagugagacaguggcagggaacccaau

SEQ ID NO: 435473 - RNA, 22 nt, Human
gcauauauaaucccagcuacuc

SEQ ID NO: 435474 - RNA, 21 nt, Human
gcauauauccagcugccacca

SEQ ID NO: 435475 - RNA, 32 nt, Human
gcauaucagcagaguaggagagcaaggauuug

SEQ ID NO: 435476 - RNA, 32 nt, Human
gcauaucagcuuucacacuuuccccaugcacu

SEQ ID NO: 435477 - RNA, 32 nt, Human
gcauaucauauuuuuaaaggcuuuuuaaaaau

SEQ ID NO: 435478 - RNA, 22 nt, Human
gcauaucauuagcccucacugu

SEQ ID NO: 435479 - RNA, 32 nt, Human
gcauauccaaaugccagcaucacuguuguauu

SEQ ID NO: 435480 - RNA, 32 nt, Human
gcauauccucaccguuuucaucagucacucac

SEQ ID NO: 435481 - RNA, 32 nt, Human
gcauaucggucaccaggcacccagggccaugc

SEQ ID NO: 435482 - RNA, 32 nt, Human
gcauaucguguggcauggcaagaaacugccug

SEQ ID NO: 435483 - RNA, 32 nt, Human
gcauaucuacugcaugccaagcacuuucugca

SEQ ID NO: 435484 - RNA, 32 nt, Human
gcauaucuccccucugaggcuggaucccucau

SEQ ID NO: 435485 - RNA, 32 nt, Human
gcauaucuguagucccagcuaugugggaggcu

SEQ ID NO: 435486 - RNA, 32 nt, Human
gcauaucuuggguccagguaaaggaggugggu

SEQ ID NO: 435487 - RNA, 32 nt, Human
gcauaugaaaaccgaagguguggggagaggcc

SEQ ID NO: 435488 - RNA, 32 nt, Human
gcauaugcagagccccaaggccaccccaccag

SEQ ID NO: 435489 - RNA, 32 nt, Human
gcauaugccacauauacauacauauaugugua

SEQ ID NO: 435490 - RNA, 32 nt, Human
gcauaugccuguaaaucccagcuauuugggag

SEQ ID NO: 435491 - RNA, 31 nt, Human
gcauaugcugaguuccaccuguugaagggcu

SEQ ID NO: 435492 - RNA, 32 nt, Human
gcauaugcugccucgaauugggauuaugcaug

SEQ ID NO: 435493 - RNA, 32 nt, Human
gcauaugcuuugacuuuccuuugcuguggagg

SEQ ID NO: 435494 - RNA, 32 nt, Human
gcauauggaguagaugcucaccagaggcuggu

SEQ ID NO: 435495 - RNA, 32 nt, Human
gcauauggcucagagcagagccggaucuccca

SEQ ID NO: 435496 - RNA, 32 nt, Human
gcauauggcuuucauacagccagcuccuguuu

SEQ ID NO: 435497 - RNA, 32 nt, Human
gcauaugguucacgccuguaauuccagcacuu

SEQ ID NO: 435498 - RNA, 32 nt, Human
gcauauguauaugcugggugaccuugggcagu

SEQ ID NO: 435499 - RNA, 32 nt, Human
gcauaugucaaggagcacuugcaggcagaaug

SEQ ID NO: 435500 - RNA, 32 nt, Human
gcauaugugguagaaagaaauggagggggaau

SEQ ID NO: 435501 - RNA, 32 nt, Human
gcauauuaaaggcuuuuggcagcaaaguguca

SEQ ID NO: 435502 - RNA, 32 nt, Human
gcauauuagggugggaggggcauggacauuga

SEQ ID NO: 435503 - RNA, 32 nt, Human
gcauauuauuauauacagguugaguaucccuu

SEQ ID NO: 435504 - RNA, 32 nt, Human
gcauauuccaggugcauccaggccuguggcca

SEQ ID NO: 435505 - RNA, 32 nt, Human
gcauauucccugcacacacaugcauacuuaca

SEQ ID NO: 435506 - RNA, 32 nt, Human
gcauauuggauuuaggggaauuuucauuguua

SEQ ID NO: 435507 - RNA, 32 nt, Human
gcauauuggccgucugggguccaucucccucc

SEQ ID NO: 435508 - RNA, 21 nt, Human
gcauauuucacagaaugcagu

SEQ ID NO: 435509 - RNA, 32 nt, Human
gcauauuucugugcuguggaugacauggccuu

SEQ ID NO: 435510 - RNA, 32 nt, Human
gcauauuuguuucucucuaccugauuucucca

SEQ ID NO: 435511 - RNA, 32 nt, Human
gcauauuuuaacuccacugcuuaccuacuuuc

SEQ ID NO: 435512 - RNA, 32 nt, Human
gcauauuuucauuguuuuagagggagacagag

SEQ ID NO: 435513 - RNA, 32 nt, Human
gcaucaaaagacucacucacaaaacuucugaa

SEQ ID NO: 435514 - RNA, 32 nt, Human
gcaucaaaaucaggucagaaaaaugcugcuuu

SEQ ID NO: 435515 - RNA, 32 nt, Human
gcaucaaaggagacugaggaagagugaucagg

SEQ ID NO: 435516 - RNA, 32 nt, Human
gcaucaacaggcuguccagaucaauuggcacc

SEQ ID NO: 435517 - RNA, 32 nt, Human
gcaucaagagaaaaccaaucagcuucaucaaa

SEQ ID NO: 435518 - RNA, 32 nt, Human
gcaucaagaggaagaagaagagggaggacuca

SEQ ID NO: 435519 - RNA, 32 nt, Human
gcaucaagcaguggggcucucaguaggaacuu

SEQ ID NO: 435520 - RNA, 32 nt, Human
gcaucaagccagccugaccaacauggugaaac

SEQ ID NO: 435521 - RNA, 32 nt, Human
gcaucaagguugcuuuuggcuuuuggcuggga

SEQ ID NO: 435522 - RNA, 32 nt, Human
gcaucaauacaaccagcccaaccaucggucca

SEQ ID NO: 435523 - RNA, 32 nt, Human
gcaucaaucccacaaagggagcuguauggugg

SEQ ID NO: 435524 - RNA, 32 nt, Human
gcaucacaccuguaaucccagcacuuugggag

SEQ ID NO: 435525 - RNA, 32 nt, Human
gcaucacagaagcacaggaggccaguucugaa

SEQ ID NO: 435526 - RNA, 20 nt, Human
gcaucacaggcugcaccccc

SEQ ID NO: 435527 - RNA, 32 nt, Human
gcaucacaguuuugcaaccucugcuccaaaga

SEQ ID NO: 435528 - RNA, 26 nt, Human
gcaucaccaccacuccugaaccccca

SEQ ID NO: 435529 - RNA, 32 nt, Human
gcaucaccagaagggaguaagcagggagagaa

SEQ ID NO: 435530 - RNA, 22 nt, Human
gcaucacccaccaaaguuagcu

SEQ ID NO: 435531 - RNA, 32 nt, Human
gcaucacccaggcuggcagaucaugguagcag

SEQ ID NO: 435532 - RNA, 32 nt, Human
gcaucaccccuuacauacucacacugggagcc

SEQ ID NO: 435533 - RNA, 21 nt, Human
gcaucaccgcgggccucgacc

SEQ ID NO: 435534 - RNA, 32 nt, Human
gcaucaccuaccucagagggcuuuucugagga

SEQ ID NO: 435535 - RNA, 18 nt, Human
gcaucaccugaggucagg

SEQ ID NO: 435536 - RNA, 19 nt, Human
gcaucaccugggugcaaaa

SEQ ID NO: 435537 - RNA, 32 nt, Human
gcaucacgagccacuuccacuccuggguggcc

SEQ ID NO: 435538 - RNA, 20 nt, Human
gcaucacuaacgaggucgcc

SEQ ID NO: 435539 - RNA, 32 nt, Human
gcaucacugagaugcucaguccugaauucugc

SEQ ID NO: 435540 - RNA, 32 nt, Human
gcaucacugcacuccaaccugggcaacagagu

SEQ ID NO: 435541 - RNA, 32 nt, Human
gcaucacugcacuccagccugggcaacacagc

SEQ ID NO: 435542 - RNA, 32 nt, Human
gcaucacugcacuccagccugggcaacagagc

SEQ ID NO: 435543 - RNA, 32 nt, Human
gcaucacugcacuccagccugggcagcagagu

SEQ ID NO: 435544 - RNA, 32 nt, Human
gcaucacugcacuccagccugggcgauggagc

SEQ ID NO: 435545 - RNA, 32 nt, Human
gcaucacugcacuccagccugggugacagagc

SEQ ID NO: 435546 - RNA, 32 nt, Human
gcaucacugcacuccagcuugggugacagagc

SEQ ID NO: 435547 - RNA, 32 nt, Human
gcaucacugcacugcagccugggcaacauagc

SEQ ID NO: 435548 - RNA, 32 nt, Human
gcaucacugcaguccagccuggaugacagagu

SEQ ID NO: 435549 - RNA, 32 nt, Human
gcaucacuggcagaggauucguguagguggca

SEQ ID NO: 435550 - RNA, 32 nt, Human
gcaucagaagcacauuuacugugcuauuuaua

SEQ ID NO: 435551 - RNA, 32 nt, Human
gcaucagaaugagaaagccugagaagaaagaa

SEQ ID NO: 435552 - RNA, 32 nt, Human
gcaucagacaaugccauuucuccccaccacgg

SEQ ID NO: 435553 - RNA, 32 nt, Human
gcaucagagaaggccaggaagaaugguguguu

SEQ ID NO: 435554 - RNA, 32 nt, Human
gcaucagagacagagacgcaggugcuuccgaa

SEQ ID NO: 435555 - RNA, 32 nt, Human
gcaucagaggaaaugugacgacagaagcaggg

SEQ ID NO: 435556 - RNA, 21 nt, Human
gcaucagauacugaucugagc

SEQ ID NO: 435557 - RNA, 32 nt, Human
gcaucagauacugaucugagcuguaagcuggu

SEQ ID NO: 435558 - RNA, 32 nt, Human
gcaucagauggaagcuuacucucugcuuccgu

SEQ ID NO: 435559 - RNA, 32 nt, Human
gcaucagauggacaauccccucugaguguccu

SEQ ID NO: 435560 - RNA, 32 nt, Human
gcaucagcacagagucccacuaucugaaauag

SEQ ID NO: 435561 - RNA, 20 nt, Human
gcaucagcaggggcagugag

SEQ ID NO: 435562 - RNA, 20 nt, Human
gcaucagcagucacagagca

SEQ ID NO: 435563 - RNA, 32 nt, Human
gcaucagccauagucuggccucaggcccuggc

SEQ ID NO: 435564 - RNA, 17 nt, Human
gcaucagccggcuggca

SEQ ID NO: 435565 - RNA, 32 nt, Human
gcaucagcuauugugggcacacugccuauggg

SEQ ID NO: 435566 - RNA, 20 nt, Human
gcaucagcucagucagugaa

SEQ ID NO: 435567 - RNA, 32 nt, Human
gcaucagcugccauccuuuccucucuccucag

SEQ ID NO: 435568 - RNA, 32 nt, Human
gcaucagcugccgaggcgcguuccauggcccu

SEQ ID NO: 435569 - RNA, 32 nt, Human
gcaucagcugcugaaacaacaaauaggaauug

SEQ ID NO: 435570 - RNA, 31 nt, Human
gcaucaggaagaaguaaccuguugaaucuau

SEQ ID NO: 435571 - RNA, 32 nt, Human
gcaucaggcccagacagagccuggcaggcauc

SEQ ID NO: 435572 - RNA, 32 nt, Human
gcaucaggccuccgaccuuucuugccucgguu

SEQ ID NO: 435573 - RNA, 32 nt, Human
gcaucaggccugggacacugcucuccuucccc

SEQ ID NO: 435574 - RNA, 22 nt, Human
gcaucaggcgcuguuguuggag

SEQ ID NO: 435575 - RNA, 32 nt, Human
gcaucaggcucugccaaggccccucugacucu

SEQ ID NO: 435576 - RNA, 32 nt, Human
gcaucaggcugcagggugaaggggaggucugg

SEQ ID NO: 435577 - RNA, 32 nt, Human
gcaucagggacccccacccccaccccggcucu

SEQ ID NO: 435578 - RNA, 32 nt, Human
gcaucagggugaccucuggaaggucugaaaau

SEQ ID NO: 435579 - RNA, 32 nt, Human
gcaucagguggcugggacaagcgggugaugcu

SEQ ID NO: 435580 - RNA, 32 nt, Human
gcaucaguacugggauugggaacugcaagaau

SEQ ID NO: 435581 - RNA, 32 nt, Human
gcaucaguccacuccagccugagcaacagagc

SEQ ID NO: 435582 - RNA, 32 nt, Human
gcaucagugccucccuucccaggucaccagcu

SEQ ID NO: 435583 - RNA, 32 nt, Human
gcaucagugguuugguuuaagcuccagagggu

SEQ ID NO: 435584 - RNA, 18 nt, Human
gcaucagugucccgugaa

SEQ ID NO: 435585 - RNA, 31 nt, Human
gcaucaguguucucuggguccugugcccucg

SEQ ID NO: 435586 - RNA, 32 nt, Human
gcaucaguuucaucagcugaucggccacugcc

SEQ ID NO: 435587 - RNA, 21 nt, Human
gcaucaguuugcuacagugag

SEQ ID NO: 435588 - RNA, 21 nt, Human
gcaucaguuuuaacauaugaa

SEQ ID NO: 435589 - RNA, 32 nt, Human
gcaucauaaggaguugguguaaucauuuuaaa

SEQ ID NO: 435590 - RNA, 32 nt, Human
gcaucauacaucuucucuuuccuuguuuuccu

SEQ ID NO: 435591 - RNA, 32 nt, Human
gcaucauacuucucuaguuugccugcauucag

SEQ ID NO: 435592 - RNA, 32 nt, Human
gcaucaucacacugacuguggcgcacugggga

SEQ ID NO: 435593 - RNA, 32 nt, Human
gcaucaucagcccuucuggggcguguaccucu

SEQ ID NO: 435594 - RNA, 32 nt, Human
gcaucaucaguguaaucucugauuggauuccu

SEQ ID NO: 435595 - RNA, 32 nt, Human
gcaucaucccagggacauccucaaauacaugg

SEQ ID NO: 435596 - RNA, 32 nt, Human
gcaucauccucgggagcugacaacagccaggc

SEQ ID NO: 435597 - RNA, 32 nt, Human
gcaucauccucucagcagucuuccugucaccc

SEQ ID NO: 435598 - RNA, 32 nt, Human
gcaucaucucauuuaauccucccuuccucccu

SEQ ID NO: 435599 - RNA, 19 nt, Human
gcaucaucugcaccgggac

SEQ ID NO: 435600 - RNA, 32 nt, Human
gcaucaucuguacuugaagaggccagugggag

SEQ ID NO: 435601 - RNA, 32 nt, Human
gcaucaugauccagagguucagcccgugugca

SEQ ID NO: 435602 - RNA, 32 nt, Human
gcaucaugaugauucucuaacacugucuguca

SEQ ID NO: 435603 - RNA, 30 nt, Human
gcaucauggacaccucgucagagaugcugg

SEQ ID NO: 435604 - RNA, 24 nt, Human
gcaucauggcucacaccuguaauc

SEQ ID NO: 435605 - RNA, 32 nt, Human
gcaucauggcugugcaggaggcugugguuuga

SEQ ID NO: 435606 - RNA, 32 nt, Human
gcaucaugggcaacucgugacagccucugacu

SEQ ID NO: 435607 - RNA, 32 nt, Human
gcaucaugggucuugcuugccugcugcccuga

SEQ ID NO: 435608 - RNA, 32 nt, Human
gcaucauguccaccccugcagauccuuggaaa

SEQ ID NO: 435609 - RNA, 32 nt, Human
gcaucaugucugcauuuuaccauagauuggag

SEQ ID NO: 435610 - RNA, 32 nt, Human
gcaucaugugaggagggcguggggaaggacau

SEQ ID NO: 435611 - RNA, 32 nt, Human
gcaucauugcacuccagccugggcaacaagag

SEQ ID NO: 435612 - RNA, 32 nt, Human
gcaucauugcacuccagccugggcaacagaga

SEQ ID NO: 435613 - RNA, 32 nt, Human
gcaucauugcacuccagccugggugacagagu

SEQ ID NO: 435614 - RNA, 32 nt, Human
gcaucauugcauuccagccugggcaacagagc

SEQ ID NO: 435615 - RNA, 32 nt, Human
gcaucauuucaugccaaagugcugcuaugggc

SEQ ID NO: 435616 - RNA, 32 nt, Human
gcaucauuuccuccucuucacagugugcuggg

SEQ ID NO: 435617 - RNA, 21 nt, Human
gcauccaaaggugcucagaga

SEQ ID NO: 435618 - RNA, 32 nt, Human
gcauccaaauggcugcuuuugucucccuuacc

SEQ ID NO: 435619 - RNA, 32 nt, Human
gcauccaacauggugaagccccgucucuacua

SEQ ID NO: 435620 - RNA, 21 nt, Human
gcauccaagggugcacaggga

SEQ ID NO: 435621 - RNA, 32 nt, Human
gcauccaagucaacucaccaucuugggguccc

SEQ ID NO: 435622 - RNA, 32 nt, Human
gcauccacacgguuagccgugcaugcacuuug

SEQ ID NO: 435623 - RNA, 32 nt, Human
gcauccaccugccucucacugaacacgagcca

SEQ ID NO: 435624 - RNA, 32 nt, Human
gcauccacucucccuuguccuccugggggcau

SEQ ID NO: 435625 - RNA, 32 nt, Human
gcauccacugacuguccaagggccacucccaa

SEQ ID NO: 435626 - RNA, 32 nt, Human
gcauccagaaaucgcugugcauguuugagggg

SEQ ID NO: 435627 - RNA, 32 nt, Human
gcauccagaagcguuuauauucugagcgccag

SEQ ID NO: 435628 - RNA, 32 nt, Human
gcauccagacuuucacaugagcuugcccagau

SEQ ID NO: 435629 - RNA, 32 nt, Human
gcauccagagcaugacccgccugguggugaag

SEQ ID NO: 435630 - RNA, 16 nt, Human
gcauccagagcaugug

SEQ ID NO: 435631 - RNA, 32 nt, Human
gcauccagaggaagagccaggagugugggaag

SEQ ID NO: 435632 - RNA, 32 nt, Human
gcauccagagguggggacacuguggagacaag

SEQ ID NO: 435633 - RNA, 32 nt, Human
gcauccagcagugaccagcagaacagcagcgc

SEQ ID NO: 435634 - RNA, 32 nt, Human
gcauccagccucaucuuucuuuuaaccaauaa

SEQ ID NO: 435635 - RNA, 32 nt, Human
gcauccagccuccugcuaacuccuagcugacu

SEQ ID NO: 435636 - RNA, 32 nt, Human
gcauccagccuggggcugaggcugaggcacug

SEQ ID NO: 435637 - RNA, 32 nt, Human
gcauccaggaacaggcuccagggcaggaaccu

SEQ ID NO: 435638 - RNA, 32 nt, Human
gcauccaggagauagaaguugcagugagcuga

SEQ ID NO: 435639 - RNA, 32 nt, Human
gcauccaggggccuggugagcccccaggcugg

SEQ ID NO: 435640 - RNA, 32 nt, Human
gcauccagguaccacaggacagccuggggcag

SEQ ID NO: 435641 - RNA, 32 nt, Human
gcauccaguccacuuuaccaucaguguuuaag

SEQ ID NO: 435642 - RNA, 32 nt, Human
gcauccagugugcuuagugcugagcaggguuu

SEQ ID NO: 435643 - RNA, 32 nt, Human
gcauccaguuaccaccuccugccucagaggcc

SEQ ID NO: 435644 - RNA, 32 nt, Human
gcauccaugcugcuagaauccaaaaagaauca

SEQ ID NO: 435645 - RNA, 32 nt, Human
gcauccauggauuacaguaccuauagccaagc

SEQ ID NO: 435646 - RNA, 32 nt, Human
gcauccauucucuaucacaccuuucauaugac

SEQ ID NO: 435647 - RNA, 18 nt, Human
gcaucccaaaccugcucc

SEQ ID NO: 435648 - RNA, 23 nt, Human
gcaucccaaagugcugggauuac

SEQ ID NO: 435649 - RNA, 32 nt, Human
gcaucccacacaugcaggcacacacagccugu

SEQ ID NO: 435650 - RNA, 32 nt, Human
gcaucccacaugcauucuuaccaugcugcaga

SEQ ID NO: 435651 - RNA, 32 nt, Human
gcaucccaccuugccaaagcacuuacaccagu

SEQ ID NO: 435652 - RNA, 32 nt, Human
gcaucccagccagugccauguccucugcaggu

SEQ ID NO: 435653 - RNA, 32 nt, Human
gcaucccagcuacuccaggggcugaggugaca

SEQ ID NO: 435654 - RNA, 32 nt, Human
gcaucccagcugggccagagagagccgagugu

SEQ ID NO: 435655 - RNA, 32 nt, Human
gcaucccagugggccucagacacugcccugcc

SEQ ID NO: 435656 - RNA, 32 nt, Human
gcaucccauccagccucagagggcccagagaa

SEQ ID NO: 435657 - RNA, 32 nt, Human
gcaucccauggaaacuuaauucccuccuagca

SEQ ID NO: 435658 - RNA, 32 nt, Human
gcauccccaccuuuugggguaaggggagugcu

SEQ ID NO: 435659 - RNA, 32 nt, Human
gcauccccagcugcucucccaccccaccccag

SEQ ID NO: 435660 - RNA, 32 nt, Human
gcauccccaggauagggcagucggggaagggg

SEQ ID NO: 435661 - RNA, 32 nt, Human
gcauccccaggguguguccuuucuugaucacu

SEQ ID NO: 435662 - RNA, 32 nt, Human
gcaucccccacacagggcucugguuuucacuc

SEQ ID NO: 435663 - RNA, 23 nt, Human
gcaucccccacuacccccuccca

SEQ ID NO: 435664 - RNA, 32 nt, Human
gcaucccccagcugcucccaucuugcuggaau

SEQ ID NO: 435665 - RNA, 32 nt, Human
gcaucccccauguucgucaucucaucucaguc

SEQ ID NO: 435666 - RNA, 32 nt, Human
gcaucccccuggcagagccgcagggcuccauc

SEQ ID NO: 435667 - RNA, 32 nt, Human
gcauccccggcagccaaucagggacaggcugg

SEQ ID NO: 435668 - RNA, 32 nt, Human
gcauccccuaagacagaguccucuguuccucc

SEQ ID NO: 435669 - RNA, 32 nt, Human
gcauccccuccacuccagaguuggguggcacg

SEQ ID NO: 435670 - RNA, 32 nt, Human
gcauccccuccacuccagaguugggugguacg

SEQ ID NO: 435671 - RNA, 32 nt, Human
gcauccccuccagacugcguucuggaagcccu

SEQ ID NO: 435672 - RNA, 32 nt, Human
gcauccccuccccagacugccugcugucaaac

SEQ ID NO: 435673 - RNA, 32 nt, Human
gcauccccuccccaucuccccuuugucuuccu

SEQ ID NO: 435674 - RNA, 32 nt, Human
gcauccccugcuccugccccugcucggcuaca

SEQ ID NO: 435675 - RNA, 32 nt, Human
gcaucccgcaguguacaggacagcccccaaac

SEQ ID NO: 435676 - RNA, 32 nt, Human
gcaucccuccuggaggccugggaugggguagg

SEQ ID NO: 435677 - RNA, 32 nt, Human
gcaucccuccuucuccccuaaagggacucugc

SEQ ID NO: 435678 - RNA, 32 nt, Human
gcaucccucuaacccaggaggagcguggggaa

SEQ ID NO: 435679 - RNA, 32 nt, Human
gcaucccugcaccaggacucaccaagacgccc

SEQ ID NO: 435680 - RNA, 32 nt, Human
gcaucccugcagcaggcacagagccagcagca

SEQ ID NO: 435681 - RNA, 32 nt, Human
gcaucccugcagcugaacccagcacuuuuuau

SEQ ID NO: 435682 - RNA, 32 nt, Human
gcaucccugcccugccuccagccuugguggcu

SEQ ID NO: 435683 - RNA, 32 nt, Human
gcaucccugcuguggcucaccugcugcugucu

SEQ ID NO: 435684 - RNA, 32 nt, Human
gcaucccugcuuguuuuggagccaugggcacu

SEQ ID NO: 435685 - RNA, 32 nt, Human
gcaucccuggccacugccucccagucuugcug

SEQ ID NO: 435686 - RNA, 32 nt, Human
gcaucccuggguucuuggaagcagcucuuaug

SEQ ID NO: 435687 - RNA, 32 nt, Human
gcaucccuggugcuggggacugugccaggcca

SEQ ID NO: 435688 - RNA, 32 nt, Human
gcaucccuguaaucccagcuacuuuacuuggg

SEQ ID NO: 435689 - RNA, 32 nt, Human
gcaucccuuaaccuuaagcaauccaguuccac

SEQ ID NO: 435690 - RNA, 32 nt, Human
gcauccgagccgagggcucugcucggaaaucg

SEQ ID NO: 435691 - RNA, 32 nt, Human
gcauccgaggagcugugguccagccugcgcgg

SEQ ID NO: 435692 - RNA, 32 nt, Human
gcauccgccuucccauccacacugccuuuagu

SEQ ID NO: 435693 - RNA, 19 nt, Human
gcauccggagcugcagcca

SEQ ID NO: 435694 - RNA, 32 nt, Human
gcauccggaguuguucauuccuccugucuggc

SEQ ID NO: 435695 - RNA, 32 nt, Human
gcauccggcuaccugcccucccugccuucccc

SEQ ID NO: 435696 - RNA, 32 nt, Human
gcauccgugaggcuggacagcgauaaaccccu

SEQ ID NO: 435697 - RNA, 32 nt, Human
gcauccguggaguggggcuuugggagaccuug

SEQ ID NO: 435698 - RNA, 32 nt, Human
gcauccguggggaccgaaagagguuuuugcac

SEQ ID NO: 435699 - RNA, 32 nt, Human
gcauccguguggaauugcgugcagccugugug

SEQ ID NO: 435700 - RNA, 28 nt, Human
gcauccuaacuugcugccuuaucgucug

SEQ ID NO: 435701 - RNA, 18 nt, Human
gcauccuaggaauggaga

SEQ ID NO: 435702 - RNA, 32 nt, Human
gcauccuauggggaaguccaggagaacuauaa

SEQ ID NO: 435703 - RNA, 32 nt, Human
gcauccucacggcauggccucugccuucccca

SEQ ID NO: 435704 - RNA, 32 nt, Human
gcauccucagcacaggaaguacccacauggac

SEQ ID NO: 435705 - RNA, 32 nt, Human
gcauccucauugcagugcggcggcccuaccuc

SEQ ID NO: 435706 - RNA, 32 nt, Human
gcauccucauuucccaauggcccuccuguucc

SEQ ID NO: 435707 - RNA, 32 nt, Human
gcauccucauuucucagcccagucucauguuc

SEQ ID NO: 435708 - RNA, 23 nt, Human
gcauccuccaccucccagguuca

SEQ ID NO: 435709 - RNA, 32 nt, Human
gcauccuccacucagccacccuucccacuccc

SEQ ID NO: 435710 - RNA, 32 nt, Human
gcauccuccaggagaccucccuguguguugac

SEQ ID NO: 435711 - RNA, 32 nt, Human
gcauccuccccuccucggacucaaggugcuga

SEQ ID NO: 435712 - RNA, 32 nt, Human
gcauccucuaugggaaagacaacacgcaccua

SEQ ID NO: 435713 - RNA, 32 nt, Human
gcauccucuccucaggccuccuucccacauca

SEQ ID NO: 435714 - RNA, 32 nt, Human
gcauccucugaugaacucacacaugccucagu

SEQ ID NO: 435715 - RNA, 32 nt, Human
gcauccucuguucauccgggggaggccccaau

SEQ ID NO: 435716 - RNA, 32 nt, Human
gcauccugaacaaauacauggagauccauggc

SEQ ID NO: 435717 - RNA, 32 nt, Human
gcauccugagcuccucuucugccgcuuccaac

SEQ ID NO: 435718 - RNA, 32 nt, Human
gcauccugaguggcaccugagguucuuugagc

SEQ ID NO: 435719 - RNA, 32 nt, Human
gcauccugccacccacacagcagccuccagga

SEQ ID NO: 435720 - RNA, 32 nt, Human
gcauccugccagaggugcacaggcuggaguuu

SEQ ID NO: 435721 - RNA, 21 nt, Human
gcauccugccugcguggacug

SEQ ID NO: 435722 - RNA, 32 nt, Human
gcauccuggaaggcuucucugugacugcacuu

SEQ ID NO: 435723 - RNA, 32 nt, Human
gcauccuggaccuuggcguugccgcuccgcgg

SEQ ID NO: 435724 - RNA, 32 nt, Human
gcauccuggaggugaagguugcagugagccaa

SEQ ID NO: 435725 - RNA, 32 nt, Human
gcauccuggaugugugcaccgugcgcugagug

SEQ ID NO: 435726 - RNA, 32 nt, Human
gcauccuggcugcuggggcuacuucauucccc

SEQ ID NO: 435727 - RNA, 32 nt, Human
gcauccugggcugugcugaggcagugcugucu

SEQ ID NO: 435728 - RNA, 32 nt, Human
gcauccugguugccucuacuguggucaccuuu

SEQ ID NO: 435729 - RNA, 32 nt, Human
gcauccugugaauucaugcgcugcgaguggcg

SEQ ID NO: 435730 - RNA, 32 nt, Human
gcauccugugagagaccagagagagaguuugg

SEQ ID NO: 435731 - RNA, 20 nt, Human
gcauccugugcuccgcaggc

SEQ ID NO: 435732 - RNA, 32 nt, Human
gcauccugugugugugaagcacccgccgucag

SEQ ID NO: 435733 - RNA, 32 nt, Human
gcauccugugugugugacgcacccgccgucag

SEQ ID NO: 435734 - RNA, 32 nt, Human
gcauccuucagcuguaccagcgcugccccaau

SEQ ID NO: 435735 - RNA, 32 nt, Human
gcauccuucuacugcucccuccaggucugggg

SEQ ID NO: 435736 - RNA, 32 nt, Human
gcauccuugaaauccugggcucaggugauccu

SEQ ID NO: 435737 - RNA, 32 nt, Human
gcauccuugccaagccuccaccacuaggucag

SEQ ID NO: 435738 - RNA, 32 nt, Human
gcauccuugccccauucagcccggccuuucau

SEQ ID NO: 435739 - RNA, 32 nt, Human
gcauccuugccucagcuaccugcucacagccc

SEQ ID NO: 435740 - RNA, 32 nt, Human
gcauccuugcugcuuuauccuccuggaccuuc

SEQ ID NO: 435741 - RNA, 32 nt, Human
gcauccuugguggccuaagagggaucuuuucu

SEQ ID NO: 435742 - RNA, 32 nt, Human
gcauccuuguucuccccuggguccguaacauu

SEQ ID NO: 435743 - RNA, 32 nt, Human
gcauccuuuacaccauacuuuacuucugguau

SEQ ID NO: 435744 - RNA, 32 nt, Human
gcaucgagacccagaguaaagccaugacaaug

SEQ ID NO: 435745 - RNA, 22 nt, Human
gcaucgagccaaaggggagaug

SEQ ID NO: 435746 - RNA, 23 nt, Human
gcaucgagccccagcgcccggcc

SEQ ID NO: 435747 - RNA, 32 nt, Human
gcaucgaugggagagaaaacagaaucuuaggc

SEQ ID NO: 435748 - RNA, 32 nt, Human
gcaucgcacgaucuagucugugguguagacug

SEQ ID NO: 435749 - RNA, 23 nt, Human
gcaucgcccgcuuaccuucagcc

SEQ ID NO: 435750 - RNA, 32 nt, Human
gcaucgccugcugaagcccacggccgugccau

SEQ ID NO: 435751 - RNA, 32 nt, Human
gcaucgcuccacugucucuccugccucccucu

SEQ ID NO: 435752 - RNA, 32 nt, Human
gcaucgcuccucuccagcccugcagcuauuca

SEQ ID NO: 435753 - RNA, 32 nt, Human
gcaucgcugucucuaguccucugugauaguuc

SEQ ID NO: 435754 - RNA, 32 nt, Human
gcaucgcuuguuuccaccuccugggccggggc

SEQ ID NO: 435755 - RNA, 32 nt, Human
gcaucggaggugggcgggguugcagugacugg

SEQ ID NO: 435756 - RNA, 32 nt, Human
gcaucggaucuaaaacuacuagaucucauccc

SEQ ID NO: 435757 - RNA, 32 nt, Human
gcaucggcuuugacugcagacuguucacccac

SEQ ID NO: 435758 - RNA, 32 nt, Human
gcaucgggaagcaggagcaucuucuuggcagc

SEQ ID NO: 435759 - RNA, 32 nt, Human
gcaucggggaugugagcugagcugcacccaga

SEQ ID NO: 435760 - RNA, 32 nt, Human
gcaucgggguggccccacugagucucggcaua

SEQ ID NO: 435761 - RNA, 32 nt, Human
gcaucggguagccaugccuuucuuggacaucc

SEQ ID NO: 435762 - RNA, 32 nt, Human
gcaucgguaccuuuugccugggugauaccgaa

SEQ ID NO: 435763 - RNA, 32 nt, Human
gcaucgugccuggagccugccuucccaacauc

SEQ ID NO: 435764 - RNA, 32 nt, Human
gcaucgugcuuugcaugagagcaggccaaggu

SEQ ID NO: 435765 - RNA, 32 nt, Human
gcaucguggccccucaccucucccucuccccc

SEQ ID NO: 435766 - RNA, 19 nt, Human
gcaucgugucacaaaguca

SEQ ID NO: 435767 - RNA, 32 nt, Human
gcaucuaagagagguuaaucacacuauagagg

SEQ ID NO: 435768 - RNA, 23 nt, Human
gcaucuacacaccucagccuccu

SEQ ID NO: 435769 - RNA, 32 nt, Human
gcaucuacacacuguacacauaugcacacuuu

SEQ ID NO: 435770 - RNA, 32 nt, Human
gcaucuacagaaaaauuuuaaaauuagcuggg

SEQ ID NO: 435771 - RNA, 32 nt, Human
gcaucuacccucccguccccugcugccagaag

SEQ ID NO: 435772 - RNA, 32 nt, Human
gcaucuacuguuguguaaggaacuucugauuc

SEQ ID NO: 435773 - RNA, 32 nt, Human
gcaucuacuucuagacucccaaaggagcccag

SEQ ID NO: 435774 - RNA, 21 nt, Human
gcaucuagaccccugcacagc

SEQ ID NO: 435775 - RNA, 21 nt, Human
gcaucuagagcagagccuggc

SEQ ID NO: 435776 - RNA, 32 nt, Human
gcaucuagcacauuuaaacugugcaaauauga

SEQ ID NO: 435777 - RNA, 32 nt, Human
gcaucuagcccaaacuuguggucuucccugag

SEQ ID NO: 435778 - RNA, 32 nt, Human
gcaucuaguccagaugggucagccuggaaugg

SEQ ID NO: 435779 - RNA, 32 nt, Human
gcaucuauacccaaggaguccugugauuugag

SEQ ID NO: 435780 - RNA, 23 nt, Human
gcaucucaaagugcugggauuac

SEQ ID NO: 435781 - RNA, 32 nt, Human
gcaucucaagccccaaaugguugggggagggg

SEQ ID NO: 435782 - RNA, 32 nt, Human
gcaucucaagccccaguagcaggagaaagaaa

SEQ ID NO: 435783 - RNA, 32 nt, Human
gcaucucacaaaggaauaacugcucugagcag

SEQ ID NO: 435784 - RNA, 31 nt, Human
gcaucucacagcuaugcaaaaagcuagucaa

SEQ ID NO: 435785 - RNA, 32 nt, Human
gcaucucaccacgacuucuccuggaguccuca

SEQ ID NO: 435786 - RNA, 32 nt, Human
gcaucucauguuugaacccgggugguauccca

SEQ ID NO: 435787 - RNA, 32 nt, Human
gcaucuccaacaucucuccccaccucaugauu

SEQ ID NO: 435788 - RNA, 32 nt, Human
gcaucuccauggagaacugcuaaggcaauuau

SEQ ID NO: 435789 - RNA, 32 nt, Human
gcaucucccaguggacgcgagcagggacacac

SEQ ID NO: 435790 - RNA, 32 nt, Human
gcaucucccugucacugugacacaccuagaug

SEQ ID NO: 435791 - RNA, 32 nt, Human
gcaucucccuguuucagggccagaacuggcug

SEQ ID NO: 435792 - RNA, 32 nt, Human
gcaucucccuuuccucuguccuccauccuucu

SEQ ID NO: 435793 - RNA, 22 nt, Human
gcaucuccgcggccuccugcuc

SEQ ID NO: 435794 - RNA, 32 nt, Human
gcaucuccucauuccccgccgggagcaacauc

SEQ ID NO: 435795 - RNA, 32 nt, Human
gcaucuccuccccuuucugccugaccuuagga

SEQ ID NO: 435796 - RNA, 32 nt, Human
gcaucuccugggcgucaccaggaaggcucuga

SEQ ID NO: 435797 - RNA, 32 nt, Human
gcaucucgaccagccucugccuuaaaggaaau

SEQ ID NO: 435798 - RNA, 32 nt, Human
gcaucucuaaggcccacuugaaugcaaaggaa

SEQ ID NO: 435799 - RNA, 32 nt, Human
gcaucucuacucuuagagacucaggccaagaa

SEQ ID NO: 435800 - RNA, 32 nt, Human
gcaucucucagagaugugaagccagauccuca

SEQ ID NO: 435801 - RNA, 32 nt, Human
gcaucucucagccucacaucuccuggucaacc

SEQ ID NO: 435802 - RNA, 32 nt, Human
gcaucucuccaggguccaaggccacgcuuggu

SEQ ID NO: 435803 - RNA, 32 nt, Human
gcaucucuccccucagcccugucuccucuucu

SEQ ID NO: 435804 - RNA, 32 nt, Human
gcaucucuccuuccagcccaaacugcacagcc

SEQ ID NO: 435805 - RNA, 32 nt, Human
gcaucucugagaaaguggccccagggagagaa

SEQ ID NO: 435806 - RNA, 32 nt, Human
gcaucucugccuuccuguucacggugaccuuc

SEQ ID NO: 435807 - RNA, 32 nt, Human
gcaucucugccuuucaaaaugaaggaacauug

SEQ ID NO: 435808 - RNA, 32 nt, Human
gcaucucugggaaaugauaggaguauugcaaa

SEQ ID NO: 435809 - RNA, 32 nt, Human
gcaucucugggcagcccuuuggugguuugucc

SEQ ID NO: 435810 - RNA, 32 nt, Human
gcaucucuggucuuaucagccaugcuaaauca

SEQ ID NO: 435811 - RNA, 32 nt, Human
gcaucugaaacuugcuucaucucugacgcucg

SEQ ID NO: 435812 - RNA, 32 nt, Human
gcaucugaacagcauucuccuggagaaaacug

SEQ ID NO: 435813 - RNA, 32 nt, Human
gcaucugaagacucaggcagagcagcuccaca

SEQ ID NO: 435814 - RNA, 32 nt, Human
gcaucugaaggccagugcugugcuggcaggaa

SEQ ID NO: 435815 - RNA, 32 nt, Human
gcaucugacagagagaccaaaacuugguugua

SEQ ID NO: 435816 - RNA, 32 nt, Human
gcaucugacauuccaccgauucacaaacuucc

SEQ ID NO: 435817 - RNA, 32 nt, Human
gcaucugaccuuggaaggaagcagaagcagag

SEQ ID NO: 435818 - RNA, 32 nt, Human
gcaucugagauguguguauaugaaaagauuau

SEQ ID NO: 435819 - RNA, 32 nt, Human
gcaucugaucaagcuccggaagaugguggagg

SEQ ID NO: 435820 - RNA, 32 nt, Human
gcaucugcaaaaggcccugcucucuggagugu

SEQ ID NO: 435821 - RNA, 32 nt, Human
gcaucugcaacaaaaagucauuuuucuggagu

SEQ ID NO: 435822 - RNA, 32 nt, Human
gcaucugcaacaacagcaggcucuccaggcag

SEQ ID NO: 435823 - RNA, 32 nt, Human
gcaucugcaagcugagcaacaucaggaauugc

SEQ ID NO: 435824 - RNA, 32 nt, Human
gcaucugcacccagggucccagccuggccacc

SEQ ID NO: 435825 - RNA, 23 nt, Human
gcaucugcaggcccugaccccca

SEQ ID NO: 435826 - RNA, 32 nt, Human
gcaucugcagggaacuuuggcagcuuggggca

SEQ ID NO: 435827 - RNA, 32 nt, Human
gcaucugcaggguggagggggccaccauccag

SEQ ID NO: 435828 - RNA, 32 nt, Human
gcaucugcauauugaaagaacgcuuuccccac

SEQ ID NO: 435829 - RNA, 32 nt, Human
gcaucugcauggcggugguggggaggaggggu

SEQ ID NO: 435830 - RNA, 32 nt, Human
gcaucugccaggacacugccuuggguggacca

SEQ ID NO: 435831 - RNA, 19 nt, Human
gcaucugccaggcagcccc

SEQ ID NO: 435832 - RNA, 32 nt, Human
gcaucugcccacgauggcagugcagucaucau

SEQ ID NO: 435833 - RNA, 32 nt, Human
gcaucugccccaacccauccagccugcauguu

SEQ ID NO: 435834 - RNA, 32 nt, Human
gcaucugccccugcuauauguggggaaaacuc

SEQ ID NO: 435835 - RNA, 32 nt, Human
gcaucugcccucuggagaacacugccucccgc

SEQ ID NO: 435836 - RNA, 32 nt, Human
gcaucugccugggaucaucaagcccuagaagc

SEQ ID NO: 435837 - RNA, 32 nt, Human
gcaucugccuguagucccagcuacucgggagg

SEQ ID NO: 435838 - RNA, 20 nt, Human
gcaucugcuaccugauuuua

SEQ ID NO: 435839 - RNA, 22 nt, Human
gcaucugcucaucugauauuca

SEQ ID NO: 435840 - RNA, 32 nt, Human
gcaucugcucccacucagccuagcccagggaa

SEQ ID NO: 435841 - RNA, 32 nt, Human
gcaucugcuccuaguagaggccagucugggcc

SEQ ID NO: 435842 - RNA, 32 nt, Human
gcaucugcuccuggcauggcgcugcggcaccu

SEQ ID NO: 435843 - RNA, 32 nt, Human
gcaucuggaaauuccccgcacuuucaggcuga

SEQ ID NO: 435844 - RNA, 32 nt, Human
gcaucuggaagaggaagaagagaggaaugaga

SEQ ID NO: 435845 - RNA, 32 nt, Human
gcaucuggagggcagagguccccuucucagug

SEQ ID NO: 435846 - RNA, 21 nt, Human
gcaucuggccccuuccuggca

SEQ ID NO: 435847 - RNA, 32 nt, Human
gcaucuggcggauccaggugucugagggcuuc

SEQ ID NO: 435848 - RNA, 32 nt, Human
gcaucuggcuaccugcccucccugccuucccc

SEQ ID NO: 435849 - RNA, 32 nt, Human
gcaucugggcauuguaggggugcagugguaug

SEQ ID NO: 435850 - RNA, 32 nt, Human
gcaucugggccauggugaccaguguggacggg

SEQ ID NO: 435851 - RNA, 32 nt, Human
gcaucuggggagccugcuggagcuggcagagc

SEQ ID NO: 435852 - RNA, 32 nt, Human
gcaucugguguuucagcauacauaacugaagc

SEQ ID NO: 435853 - RNA, 32 nt, Human
gcaucugguugaccccagccuggggaggaggg

SEQ ID NO: 435854 - RNA, 31 nt, Human
gcaucuguaguguccaucagcaggugaaugg

SEQ ID NO: 435855 - RNA, 32 nt, Human
gcaucuguauauuuuccugcucugccuucugg

SEQ ID NO: 435856 - RNA, 32 nt, Human
gcaucuguauccaccccucaucccacaccugg

SEQ ID NO: 435857 - RNA, 32 nt, Human
gcaucugucuucaagcuuagagucucccacgg

SEQ ID NO: 435858 - RNA, 32 nt, Human
gcaucuguggagauguguagagacagggagag

SEQ ID NO: 435859 - RNA, 32 nt, Human
gcaucuguggggccgggagaccccagcaaagg

SEQ ID NO: 435860 - RNA, 32 nt, Human
gcaucuguucauuuaccuuuguggacuguagc

SEQ ID NO: 435861 - RNA, 32 nt, Human
gcaucuguugcagcagaaggcgcuuguguggg

SEQ ID NO: 435862 - RNA, 32 nt, Human
gcaucuguugggccucacaaggaccagggccu

SEQ ID NO: 435863 - RNA, 20 nt, Human
gcaucuguuuaccugccacc

SEQ ID NO: 435864 - RNA, 32 nt, Human
gcaucuguuuuauuuuccauuuuccacucauu

SEQ ID NO: 435865 - RNA, 32 nt, Human
gcaucuuaauggaagaaaaaugaggggaacuu

SEQ ID NO: 435866 - RNA, 32 nt, Human
gcaucuuacccucccuuucucuuuccucauug

SEQ ID NO: 435867 - RNA, 32 nt, Human
gcaucuuacuggaugagguugcugugauugag

SEQ ID NO: 435868 - RNA, 32 nt, Human
gcaucuuagaacucuuucugaagagaccuuau

SEQ ID NO: 435869 - RNA, 32 nt, Human
gcaucuuauguggcgccacccuccccauccuc

SEQ ID NO: 435870 - RNA, 32 nt, Human
gcaucuucaccugaauucuucaaugccagggu

SEQ ID NO: 435871 - RNA, 31 nt, Human
gcaucuucagcaucucccauguucaagccca

SEQ ID NO: 435872 - RNA, 32 nt, Human
gcaucuucaguuaauacauguuuugagcacau

SEQ ID NO: 435873 - RNA, 32 nt, Human
gcaucuucauuuugacaggccgucccgguggc

SEQ ID NO: 435874 - RNA, 32 nt, Human
gcaucuucccuggauggcuggaggaacuccag

SEQ ID NO: 435875 - RNA, 32 nt, Human
gcaucuucucacuaguaaaacugccuucccuu

SEQ ID NO: 435876 - RNA, 19 nt, Human
gcaucuucucuaccuucaa

SEQ ID NO: 435877 - RNA, 32 nt, Human
gcaucuucucucccacugcaccccuucuccuc

SEQ ID NO: 435878 - RNA, 32 nt, Human
gcaucuucuggagaagcuugugguguuccuga

SEQ ID NO: 435879 - RNA, 32 nt, Human
gcaucuucuggcucacuuucuucuuguuggcu

SEQ ID NO: 435880 - RNA, 32 nt, Human
gcaucuucuguaaugaugccucuuucuuuucu

SEQ ID NO: 435881 - RNA, 31 nt, Human
gcaucuucuguuagucuacaugcagaaagaa

SEQ ID NO: 435882 - RNA, 21 nt, Human
gcaucuugacugaaaauucca

SEQ ID NO: 435883 - RNA, 32 nt, Human
gcaucuugcccagccauaaagcaauaaacuuc

SEQ ID NO: 435884 - RNA, 32 nt, Human
gcaucuugcucaccgcccugauucuguuccuc

SEQ ID NO: 435885 - RNA, 32 nt, Human
gcaucuuggaaaaggaacucuugguucgauac

SEQ ID NO: 435886 - RNA, 32 nt, Human
gcaucuuggcaagggcugggccuggagugaag

SEQ ID NO: 435887 - RNA, 32 nt, Human
gcaucuuggcccuguugccugggcugacagga

SEQ ID NO: 435888 - RNA, 20 nt, Human
gcaucuuggggcaccuggac

SEQ ID NO: 435889 - RNA, 32 nt, Human
gcaucuuucccuccuugggcaggaugaaacag

SEQ ID NO: 435890 - RNA, 32 nt, Human
gcaucuuucucuucccaugcaacacccucuuc

SEQ ID NO: 435891 - RNA, 32 nt, Human
gcaucuuugccugcccugccuugcuuggccca

SEQ ID NO: 435892 - RNA, 32 nt, Human
gcaucuuuuauuuuuguuuaugggcuuuugcc

SEQ ID NO: 435893 - RNA, 32 nt, Human
gcaugaaacccccacccccacucucugcgacg

SEQ ID NO: 435894 - RNA, 32 nt, Human
gcaugaaagguuaaaaaggagauacugcacaa

SEQ ID NO: 435895 - RNA, 32 nt, Human
gcaugaaauugucuagcagagcaggggcaggg

SEQ ID NO: 435896 - RNA, 32 nt, Human
gcaugaacagucuucagccacaguugugaugg

SEQ ID NO: 435897 - RNA, 32 nt, Human
gcaugaaccaaggaaagaguccauuaaaaaga

SEQ ID NO: 435898 - RNA, 32 nt, Human
gcaugaaccaugggaugaugauucuguggagg

SEQ ID NO: 435899 - RNA, 32 nt, Human
gcaugaacccaggaggcagagcuuguagugag

SEQ ID NO: 435900 - RNA, 32 nt, Human
gcaugaacccaggaguuggagcuugcagugag

SEQ ID NO: 435901 - RNA, 32 nt, Human
gcaugaaccccaggcuggagugcaguggcuca

SEQ ID NO: 435902 - RNA, 19 nt, Human
gcaugaacgccaaggaaug

SEQ ID NO: 435903 - RNA, 32 nt, Human
gcaugaacuaacccagcuuccaccuccauaaa

SEQ ID NO: 435904 - RNA, 32 nt, Human
gcaugaacucagcucacugcaaccucugccuc

SEQ ID NO: 435905 - RNA, 32 nt, Human
gcaugaacugaacaggcuuucauuuccacaga

SEQ ID NO: 435906 - RNA, 32 nt, Human
gcaugaagaauuugcuuucuucuuucuuccua

SEQ ID NO: 435907 - RNA, 32 nt, Human
gcaugaagagcuugcuucacacacaacaggau

SEQ ID NO: 435908 - RNA, 32 nt, Human
gcaugaagauaaugccugugguuaugcugaau

SEQ ID NO: 435909 - RNA, 32 nt, Human
gcaugaagcaaaggauuccaggcuccagaaaa

SEQ ID NO: 435910 - RNA, 32 nt, Human
gcaugaagcaccuugcccaaggucucaccagg

SEQ ID NO: 435911 - RNA, 32 nt, Human
gcaugaagccagcagcacccagagccacuccu

SEQ ID NO: 435912 - RNA, 32 nt, Human
gcaugaagccuccucagcucuuggaauugcug

SEQ ID NO: 435913 - RNA, 32 nt, Human
gcaugaaggauuccaggaagaucauggagacc

SEQ ID NO: 435914 - RNA, 32 nt, Human
gcaugaaguucagaauaauagaaaguagagag

SEQ ID NO: 435915 - RNA, 32 nt, Human
gcaugaauaagcauuuucccacacaaugaaca

SEQ ID NO: 435916 - RNA, 21 nt, Human
gcaugaaucaccaugccuagc

SEQ ID NO: 435917 - RNA, 22 nt, Human
gcaugaaucauucugaaugcuu

SEQ ID NO: 435918 - RNA, 32 nt, Human
gcaugaaugaaugagucaugggcaguggcuca

SEQ ID NO: 435919 - RNA, 19 nt, Human
gcaugaaugugacacagua

SEQ ID NO: 435920 - RNA, 20 nt, Human
gcaugaauugcauuauguuc

SEQ ID NO: 435921 - RNA, 32 nt, Human
gcaugacaaauagguugcccaagugggacgga

SEQ ID NO: 435922 - RNA, 17 nt, Human
gcaugacaccaaagcca

SEQ ID NO: 435923 - RNA, 32 nt, Human
gcaugacaggcagaaacgagggcugcuccagg

SEQ ID NO: 435924 - RNA, 32 nt, Human
gcaugacaguggguucaagguagucucugagg

SEQ ID NO: 435925 - RNA, 32 nt, Human
gcaugaccagcuguaucugaaagagaaaagac

SEQ ID NO: 435926 - RNA, 32 nt, Human
gcaugaccaggcugcccccugccccgcacacc

SEQ ID NO: 435927 - RNA, 32 nt, Human
gcaugaccucagcuccacuuuugaggcugcag

SEQ ID NO: 435928 - RNA, 32 nt, Human
gcaugaccugaccugcagcccaugaaucgggc

SEQ ID NO: 435929 - RNA, 32 nt, Human
gcaugaccuuuccuuguggauuuucuuauucu

SEQ ID NO: 435930 - RNA, 32 nt, Human
gcaugacgagggccuccuccuggccgagagcg

SEQ ID NO: 435931 - RNA, 32 nt, Human
gcaugacugcagccuugaacuccugggcuuaa

SEQ ID NO: 435932 - RNA, 32 nt, Human
gcaugacugguucugggagaaggugagagaca

SEQ ID NO: 435933 - RNA, 27 nt, Human
gcaugacuguaaucccagcuacucggg

SEQ ID NO: 435934 - RNA, 32 nt, Human
gcaugacuuugucacguacuugagugcuggcu

SEQ ID NO: 435935 - RNA, 19 nt, Human
gcaugagaaucgcuugaac

SEQ ID NO: 435936 - RNA, 32 nt, Human
gcaugagagaaaagccaccuccggguggggcu

SEQ ID NO: 435937 - RNA, 32 nt, Human
gcaugagagacacgugcaugcagaagacucca

SEQ ID NO: 435938 - RNA, 32 nt, Human
gcaugagagacagcaggguugucacaauauug

SEQ ID NO: 435939 - RNA, 32 nt, Human
gcaugagaggagagguagaaaaauacccuuuu

SEQ ID NO: 435940 - RNA, 32 nt, Human
gcaugagaggcagagugcacaguggucaaggg

SEQ ID NO: 435941 - RNA, 32 nt, Human
gcaugagaugcucagucggcuuggggaaggac

SEQ ID NO: 435942 - RNA, 32 nt, Human
gcaugagcagccguccagcaggcaggcuccgg

SEQ ID NO: 435943 - RNA, 32 nt, Human
gcaugagcaugcaggccuaguguccagggugg

SEQ ID NO: 435944 - RNA, 32 nt, Human
gcaugagcauuuugauuuuaccuguccucaaa

SEQ ID NO: 435945 - RNA, 23 nt, Human
gcaugagccaccacuccuggcca

SEQ ID NO: 435946 - RNA, 32 nt, Human
gcaugagccacugcacccaaccccuggaaaac

SEQ ID NO: 435947 - RNA, 32 nt, Human
gcaugagccacugcacccagcccuguauucuu

SEQ ID NO: 435948 - RNA, 32 nt, Human
gcaugagccacugcacccagccgauaggaagu

SEQ ID NO: 435949 - RNA, 32 nt, Human
gcaugagccacugcacccagccuuggcgggca

SEQ ID NO: 435950 - RNA, 32 nt, Human
gcaugagccacugcacccggccgguggaaagc

SEQ ID NO: 435951 - RNA, 32 nt, Human
gcaugagccacugcaccuggccuaggacuggu

SEQ ID NO: 435952 - RNA, 32 nt, Human
gcaugagccacugcauccggccuguuaaggau

SEQ ID NO: 435953 - RNA, 32 nt, Human
gcaugagccagccagcucagccaggcucccug

SEQ ID NO: 435954 - RNA, 23 nt, Human
gcaugagcugauucacauucuga

SEQ ID NO: 435955 - RNA, 32 nt, Human
gcaugagcugccgauguggugcuuagugauug

SEQ ID NO: 435956 - RNA, 32 nt, Human
gcaugagcuguugcccuccaggggccuggcac

SEQ ID NO: 435957 - RNA, 32 nt, Human
gcaugagcuuccucucgcacaagaccagcugg

SEQ ID NO: 435958 - RNA, 32 nt, Human
gcaugaggaagcuccagggcaggaugguuuac

SEQ ID NO: 435959 - RNA, 27 nt, Human
gcaugaggagaguguguaggggccggg

SEQ ID NO: 435960 - RNA, 32 nt, Human
gcaugaggaguucuagggguccuggcaccugu

SEQ ID NO: 435961 - RNA, 32 nt, Human
gcaugaggaucaguuugcagcagcaaguacaa

SEQ ID NO: 435962 - RNA, 32 nt, Human
gcaugaggccauguuuauaugugugacuaaua

SEQ ID NO: 435963 - RNA, 22 nt, Human
gcaugaggcccacgccacccaa

SEQ ID NO: 435964 - RNA, 32 nt, Human
gcaugaggccuuuccucaguccuguggccucu

SEQ ID NO: 435965 - RNA, 21 nt, Human
gcaugaggcuggaugcagugg

SEQ ID NO: 435966 - RNA, 27 nt, Human
gcaugaggcuggccuucuccagaagcu

SEQ ID NO: 435967 - RNA, 32 nt, Human
gcaugagggaacacuucuuaugagaaaacauu

SEQ ID NO: 435968 - RNA, 32 nt, Human
gcaugagggaggauauuuuaaagggaaguaua

SEQ ID NO: 435969 - RNA, 32 nt, Human
gcaugagggcucuugcgagacugaagugcuau

SEQ ID NO: 435970 - RNA, 24 nt, Human
gcaugagggggagcuggcauagga

SEQ ID NO: 435971 - RNA, 31 nt, Human
gcaugagguggaccuguuugcugggaacccc

SEQ ID NO: 435972 - RNA, 32 nt, Human
gcaugaguagcagguagagcacagcuuuacug

SEQ ID NO: 435973 - RNA, 32 nt, Human
gcaugaguauuugugcaacacaagcacaacua

SEQ ID NO: 435974 - RNA, 21 nt, Human
gcaugagucaccauauccagc

SEQ ID NO: 435975 - RNA, 32 nt, Human
gcaugaguugagugcugcugcagagggaagcu

SEQ ID NO: 435976 - RNA, 32 nt, Human
gcaugauaacaugcaguuucuucaagacaaaa

SEQ ID NO: 435977 - RNA, 32 nt, Human
gcaugauaagcaaagaaaaggcaaacacaagg

SEQ ID NO: 435978 - RNA, 32 nt, Human
gcaugauaggaaaauugagaaagaauacauau

SEQ ID NO: 435979 - RNA, 32 nt, Human
gcaugauaggaaaauugagaaagaauacguau

SEQ ID NO: 435980 - RNA, 32 nt, Human
gcaugaucucacugcaaccuccaucuccuguc

SEQ ID NO: 435981 - RNA, 32 nt, Human
gcaugaucucagcucacugcaaccuccgccuc

SEQ ID NO: 435982 - RNA, 32 nt, Human
gcaugaucucagcucacugcagccuccgucuc

SEQ ID NO: 435983 - RNA, 32 nt, Human
gcaugaucucagcuccgccuccuggguucacg

SEQ ID NO: 435984 - RNA, 27 nt, Human
gcaugaucuccuucuguccagacugug

SEQ ID NO: 435985 - RNA, 21 nt, Human
gcaugaucucggcucacugca

SEQ ID NO: 435986 - RNA, 32 nt, Human
gcaugaucugcaaucucugccucccagguuca

SEQ ID NO: 435987 - RNA, 32 nt, Human
gcaugaugacuucagcagaugccuaaguccug

SEQ ID NO: 435988 - RNA, 32 nt, Human
gcaugaugagcuaugaccacuggagcagccca

SEQ ID NO: 435989 - RNA, 24 nt, Human
gcaugauggcacacaccuguaauc

SEQ ID NO: 435990 - RNA, 24 nt, Human
gcaugauggcucacacguauaauc

SEQ ID NO: 435991 - RNA, 32 nt, Human
gcaugauguggacauccauggagcacaugccg

SEQ ID NO: 435992 - RNA, 32 nt, Human
gcaugauguucuugucuuuggagcuuagccuu

SEQ ID NO: 435993 - RNA, 21 nt, Human
gcaugauucgcaggucagcua

SEQ ID NO: 435994 - RNA, 32 nt, Human
gcaugauuuuggcucacugcagccucugccuc

SEQ ID NO: 435995 - RNA, 32 nt, Human
gcaugcacacacacauucaguauuuuaaaaga

SEQ ID NO: 435996 - RNA, 32 nt, Human
gcaugcacacacauacaccacagccacacacu

SEQ ID NO: 435997 - RNA, 32 nt, Human
gcaugcacacgugcccagcaggaaaagcuucg

SEQ ID NO: 435998 - RNA, 32 nt, Human
gcaugcacaguaaaguuugggaagcacugcuc

SEQ ID NO: 435999 - RNA, 16 nt, Human
gcaugcacccugcucc

SEQ ID NO: 436000 - RNA, 32 nt, Human
gcaugcaccguugucugugcugugacuuccgu

SEQ ID NO: 436001 - RNA, 32 nt, Human
gcaugcacugcacuucuucguuuucuucuugc

SEQ ID NO: 436002 - RNA, 32 nt, Human
gcaugcacuuguagucccagcuacucaagagg

SEQ ID NO: 436003 - RNA, 32 nt, Human
gcaugcacuuuguguugaccucaucccuggcu

SEQ ID NO: 436004 - RNA, 32 nt, Human
gcaugcagaauucuaugacacucuaauuauga

SEQ ID NO: 436005 - RNA, 32 nt, Human
gcaugcagccaucuuggugugugcaugaguau

SEQ ID NO: 436006 - RNA, 32 nt, Human
gcaugcagccuucagucacuuacucccugcuu

SEQ ID NO: 436007 - RNA, 32 nt, Human
gcaugcagcuaacuccucuuuaguuuugucuu

SEQ ID NO: 436008 - RNA, 32 nt, Human
gcaugcaggaagagaagaaggaagaggaggug

SEQ ID NO: 436009 - RNA, 32 nt, Human
gcaugcaggagagugaccucacccugccccuc

SEQ ID NO: 436010 - RNA, 32 nt, Human
gcaugcaggagguggaggaauuaagugaaaca

SEQ ID NO: 436011 - RNA, 32 nt, Human
gcaugcaggccuugggccuggccacucguguc

SEQ ID NO: 436012 - RNA, 27 nt, Human
gcaugcaggugagaggaugcaggaguc

SEQ ID NO: 436013 - RNA, 32 nt, Human
gcaugcagguggccucgcuuugccggguccga

SEQ ID NO: 436014 - RNA, 19 nt, Human
gcaugcaguccuggcccag

SEQ ID NO: 436015 - RNA, 32 nt, Human
gcaugcaucacuucugcauuuauuguaauuuu

SEQ ID NO: 436016 - RNA, 24 nt, Human
gcaugcauguacagaaagacugua

SEQ ID NO: 436017 - RNA, 21 nt, Human
gcaugcauguagaaaauugua

SEQ ID NO: 436018 - RNA, 20 nt, Human
gcaugcauguaguuccagcu

SEQ ID NO: 436019 - RNA, 32 nt, Human
gcaugcauguaguuccagcuacucaggaggcu

SEQ ID NO: 436020 - RNA, 32 nt, Human
gcaugcaugugugguuaaaaucuuucacuaca

SEQ ID NO: 436021 - RNA, 32 nt, Human
gcaugcauugagcugccuccagccugguggcc

SEQ ID NO: 436022 - RNA, 32 nt, Human
gcaugccaccacaguaacacacauuagagaaa

SEQ ID NO: 436023 - RNA, 32 nt, Human
gcaugccacuauacuccagccugggcaacaaa

SEQ ID NO: 436024 - RNA, 32 nt, Human
gcaugccacugcacuccagccugggcgacaga

SEQ ID NO: 436025 - RNA, 32 nt, Human
gcaugccacuguacuccagccugagcuacaga

SEQ ID NO: 436026 - RNA, 32 nt, Human
gcaugccagcuaccgaagucacccagccauuc

SEQ ID NO: 436027 - RNA, 21 nt, Human
gcaugccagggacccaaucaa

SEQ ID NO: 436028 - RNA, 32 nt, Human
gcaugccaguaaucccagcuacuugggaggcc

SEQ ID NO: 436029 - RNA, 32 nt, Human
gcaugccaguaauuccagcuacuugggagguu

SEQ ID NO: 436030 - RNA, 32 nt, Human
gcaugccagucaucccagcaauuugggaggcc

SEQ ID NO: 436031 - RNA, 32 nt, Human
gcaugccagucaucccagcaauuugggaggcu

SEQ ID NO: 436032 - RNA, 32 nt, Human
gcaugccaguguucaaaagauuguguaaaagu

SEQ ID NO: 436033 - RNA, 32 nt, Human
gcaugccaugccauagguacucuuuugugucu

SEQ ID NO: 436034 - RNA, 32 nt, Human
gcaugcccacugcaugugcugggaggcucucc

SEQ ID NO: 436035 - RNA, 32 nt, Human
gcaugcccaggcagaagguggggaggauucug

SEQ ID NO: 436036 - RNA, 32 nt, Human
gcaugcccauaaucccagcuacugaggagacu

SEQ ID NO: 436037 - RNA, 32 nt, Human
gcaugcccauagucccagcuacucaggaggcu

SEQ ID NO: 436038 - RNA, 19 nt, Human
gcaugccccacccaccccu

SEQ ID NO: 436039 - RNA, 20 nt, Human
gcaugccccacccaccccuc

SEQ ID NO: 436040 - RNA, 32 nt, Human
gcaugccccagccuccugggccugcccuuccc

SEQ ID NO: 436041 - RNA, 32 nt, Human
gcaugccccaggccauuucucccaccuuuacu

SEQ ID NO: 436042 - RNA, 32 nt, Human
gcaugccccauucacagcugaagugggugcug

SEQ ID NO: 436043 - RNA, 32 nt, Human
gcaugcccguaaucccagcuacucaggaggcu

SEQ ID NO: 436044 - RNA, 32 nt, Human
gcaugcccguaaucccagcuacucgggaggcu

SEQ ID NO: 436045 - RNA, 32 nt, Human
gcaugcccucaaucccagcuacucaagaggcu

SEQ ID NO: 436046 - RNA, 32 nt, Human
gcaugcccugcaaaccccgccugggccucccu

SEQ ID NO: 436047 - RNA, 32 nt, Human
gcaugcccugcucucugaccuggagacuacca

SEQ ID NO: 436048 - RNA, 32 nt, Human
gcaugccgcugcacuccagccugggagacugc

SEQ ID NO: 436049 - RNA, 32 nt, Human
gcaugccuauaaucccaauacuuuaggaggcc

SEQ ID NO: 436050 - RNA, 32 nt, Human
gcaugccuauaaucccagcuacucaggaggcu

SEQ ID NO: 436051 - RNA, 32 nt, Human
gcaugccuauaaucccagcuacucgagugccu

SEQ ID NO: 436052 - RNA, 32 nt, Human
gcaugccuauaaucccagcuacuugggaggcu

SEQ ID NO: 436053 - RNA, 32 nt, Human
gcaugccuauaaucccagguacucaggaggcu

SEQ ID NO: 436054 - RNA, 32 nt, Human
gcaugccuauaaucccagguacuugggaggcu

SEQ ID NO: 436055 - RNA, 32 nt, Human
gcaugccuauagucccagcuacucgggaggcu

SEQ ID NO: 436056 - RNA, 25 nt, Human
gcaugccuauagucccagcuacuug

SEQ ID NO: 436057 - RNA, 32 nt, Human
gcaugccuauagucccagcuacuugggagguu

SEQ ID NO: 436058 - RNA, 32 nt, Human
gcaugccuauagucccagcuacuugggggccu

SEQ ID NO: 436059 - RNA, 32 nt, Human
gcaugccucccaggccaccucagucucaccug

SEQ ID NO: 436060 - RNA, 32 nt, Human
gcaugccucuaaucccagcuacucaggaggcu

SEQ ID NO: 436061 - RNA, 32 nt, Human
gcaugccucuaguccuagcuacucgggaggcu

SEQ ID NO: 436062 - RNA, 32 nt, Human
gcaugccucuuccuccuucccgucuuccuguc

SEQ ID NO: 436063 - RNA, 32 nt, Human
gcaugccugaaaucccagcuacuugggaggcu

SEQ ID NO: 436064 - RNA, 32 nt, Human
gcaugccugaugcuuaauagaauacuuagugg

SEQ ID NO: 436065 - RNA, 32 nt, Human
gcaugccugcaaucccagcuacucagaggcua

SEQ ID NO: 436066 - RNA, 32 nt, Human
gcaugccugcaaucccagcuacuuggaaggcu

SEQ ID NO: 436067 - RNA, 32 nt, Human
gcaugccugcagucccagcuauucaggaggcu

SEQ ID NO: 436068 - RNA, 27 nt, Human
gcaugccugccccagcaccugcagccu

SEQ ID NO: 436069 - RNA, 32 nt, Human
gcaugccugccugacccaccucagagccugcu

SEQ ID NO: 436070 - RNA, 32 nt, Human
gcaugccugcugcaacggagacugggcccaac

SEQ ID NO: 436071 - RNA, 32 nt, Human
gcaugccuggaaucccagcuacuugagaggcu

SEQ ID NO: 436072 - RNA, 32 nt, Human
gcaugccuggccaauuguuggauuguaugaag

SEQ ID NO: 436073 - RNA, 32 nt, Human
gcaugccuggguauuacaguuguuuaugccau

SEQ ID NO: 436074 - RNA, 32 nt, Human
gcaugccugggugugguuaaggcguggcccag

SEQ ID NO: 436075 - RNA, 32 nt, Human
gcaugccuguaaccccagcuacucgggaagcu

SEQ ID NO: 436076 - RNA, 32 nt, Human
gcaugccuguaagcccagcuauucgggaggcu

SEQ ID NO: 436077 - RNA, 32 nt, Human
gcaugccuguaauccaagauacucaggaggcu

SEQ ID NO: 436078 - RNA, 32 nt, Human
gcaugccuguaauccagcuacuugggaggcug

SEQ ID NO: 436079 - RNA, 32 nt, Human
gcaugccuguaaucccaacuacucaggaggcu

SEQ ID NO: 436080 - RNA, 32 nt, Human
gcaugccuguaaucccacuacuggggugggug

SEQ ID NO: 436081 - RNA, 32 nt, Human
gcaugccuguaaucccagaacuuugggaggcc

SEQ ID NO: 436082 - RNA, 32 nt, Human
gcaugccuguaaucccagaauuuugggaggcc

SEQ ID NO: 436083 - RNA, 32 nt, Human
gcaugccuguaaucccagcacuuugggaggcc

SEQ ID NO: 436084 - RNA, 32 nt, Human
gcaugccuguaaucccagcauuuugggaggcc

SEQ ID NO: 436085 - RNA, 32 nt, Human
gcaugccuguaaucccagccacucaggaggcu

SEQ ID NO: 436086 - RNA, 32 nt, Human
  misc_feature (20)..(20): n is a, c, g or u
  misc_feature (28)..(28): n is a, c, g or u
gcaugccuguaaucccagcnacucgccnggcu

SEQ ID NO: 436087 - RNA, 32 nt, Human
gcaugccuguaaucccagcuacuagagaggcu

SEQ ID NO: 436088 - RNA, 32 nt, Human
gcaugccuguaaucccagcuacuagggaggcu

SEQ ID NO: 436089 - RNA, 32 nt, Human
gcaugccuguaaucccagcuacucaggaaggc

SEQ ID NO: 436090 - RNA, 32 nt, Human
gcaugccuguaaucccagcuacucaggaggcu

SEQ ID NO: 436091 - RNA, 32 nt, Human
gcaugccuguaaucccagcuacucggaaguuu

SEQ ID NO: 436092 - RNA, 32 nt, Human
gcaugccuguaaucccagcuacucgggagacc

SEQ ID NO: 436093 - RNA, 32 nt, Human
gcaugccuguaaucccagcuacucgggaggcu

SEQ ID NO: 436094 - RNA, 32 nt, Human
gcaugccuguaaucccagcuacucgggagguu

SEQ ID NO: 436095 - RNA, 32 nt, Human
gcaugccuguaaucccagcuacucuggaggcu

SEQ ID NO: 436096 - RNA, 32 nt, Human
gcaugccuguaaucccagcuacugggaaggcu

SEQ ID NO: 436097 - RNA, 32 nt, Human
gcaugccuguaaucccagcuacuuaggaggcu

SEQ ID NO: 436098 - RNA, 32 nt, Human
gcaugccuguaaucccagcuacuuggaaggcu

SEQ ID NO: 436099 - RNA, 32 nt, Human
gcaugccuguaaucccagcuacuugggagacu

SEQ ID NO: 436100 - RNA, 32 nt, Human
gcaugccuguaaucccagcuacuugggagccu

SEQ ID NO: 436101 - RNA, 32 nt, Human
gcaugccuguaaucccagcuacuugggaggcc

SEQ ID NO: 436102 - RNA, 32 nt, Human
gcaugccuguaaucccagcuacuugggaggcu

SEQ ID NO: 436103 - RNA, 32 nt, Human
gcaugccuguaaucccagcuacuuggguggcu

SEQ ID NO: 436104 - RNA, 32 nt, Human
gcaugccuguaaucccagcuauuagggaggcu

SEQ ID NO: 436105 - RNA, 32 nt, Human
gcaugccuguaaucccagcuauucggaaggcu

SEQ ID NO: 436106 - RNA, 32 nt, Human
gcaugccuguaaucccagcuauucgggaggcu

SEQ ID NO: 436107 - RNA, 32 nt, Human
gcaugccuguaaucccagcugcucaggagccu

SEQ ID NO: 436108 - RNA, 32 nt, Human
gcaugccuguaaucccagcugcuggggaggcu

SEQ ID NO: 436109 - RNA, 32 nt, Human
gcaugccuguaaucccagcugcuugggaggcu

SEQ ID NO: 436110 - RNA, 32 nt, Human
gcaugccuguaaucccagcuucuugggaggcc

SEQ ID NO: 436111 - RNA, 32 nt, Human
gcaugccuguaaucccaguuacucaggaggcu

SEQ ID NO: 436112 - RNA, 32 nt, Human
gcaugccuguaaucccaguuacuccagaggcu

SEQ ID NO: 436113 - RNA, 32 nt, Human
gcaugccuguaaucccaguuacucgagaggcu

SEQ ID NO: 436114 - RNA, 32 nt, Human
gcaugccuguaaucccaucaucuacucaggag

SEQ ID NO: 436115 - RNA, 32 nt, Human
gcaugccuguaaucccugcuacuugggagacu

SEQ ID NO: 436116 - RNA, 32 nt, Human
gcaugccuguaauccuagcuacucaggagccu

SEQ ID NO: 436117 - RNA, 32 nt, Human
gcaugccuguaauccuagcuacucaggaggcu

SEQ ID NO: 436118 - RNA, 32 nt, Human
gcaugccuguaauccuagcuacucgggaggcu

SEQ ID NO: 436119 - RNA, 32 nt, Human
gcaugccuguaauccuagcuauucgggaggcu

SEQ ID NO: 436120 - RNA, 32 nt, Human
gcaugccuguaauccuagcugcuugggugcug

SEQ ID NO: 436121 - RNA, 32 nt, Human
gcaugccuguaaucucagcuacucaggaggcu

SEQ ID NO: 436122 - RNA, 32 nt, Human
gcaugccuguaaucucagcuacucgggaggcu

SEQ ID NO: 436123 - RNA, 32 nt, Human
gcaugccuguaaucucagcuacuugggaggcu

SEQ ID NO: 436124 - RNA, 32 nt, Human
gcaugccuguaaucucagcugcuccggaggcu

SEQ ID NO: 436125 - RNA, 32 nt, Human
gcaugccuguaaucucggaaggcugaggcagg

SEQ ID NO: 436126 - RNA, 32 nt, Human
gcaugccuguaauuccagcggcuuggaaggcu

SEQ ID NO: 436127 - RNA, 32 nt, Human
gcaugccuguagucacagcuacuugggagacu

SEQ ID NO: 436128 - RNA, 20 nt, Human
gcaugccuguagucccagcu

SEQ ID NO: 436129 - RNA, 32 nt, Human
gcaugccuguagucccagcuaacugggaggcu

SEQ ID NO: 436130 - RNA, 32 nt, Human
gcaugccuguagucccagcuaccugggaggcu

SEQ ID NO: 436131 - RNA, 32 nt, Human
gcaugccuguagucccagcuacucagaagggu

SEQ ID NO: 436132 - RNA, 32 nt, Human
gcaugccuguagucccagcuacucaggaggcu

SEQ ID NO: 436133 - RNA, 32 nt, Human
gcaugccuguagucccagcuacucgggaggcc

SEQ ID NO: 436134 - RNA, 32 nt, Human
gcaugccuguagucccagcuacucgggaggcu

SEQ ID NO: 436135 - RNA, 32 nt, Human
gcaugccuguagucccagcuacucuggaggcu

SEQ ID NO: 436136 - RNA, 32 nt, Human
gcaugccuguagucccagcuacuugaguggcc

SEQ ID NO: 436137 - RNA, 32 nt, Human
gcaugccuguagucccagcuacuugggaggaa

SEQ ID NO: 436138 - RNA, 32 nt, Human
gcaugccuguagucccagcuacuugggaggcu

SEQ ID NO: 436139 - RNA, 32 nt, Human
gcaugccuguagucccagcuacuugggaugcc

SEQ ID NO: 436140 - RNA, 32 nt, Human
gcaugccuguagucccagcuauucgggaggcu

SEQ ID NO: 436141 - RNA, 32 nt, Human
gcaugccuguagucccagcuauucuggaggcu

SEQ ID NO: 436142 - RNA, 32 nt, Human
gcaugccuguagucccagcugaggcacgauaa

SEQ ID NO: 436143 - RNA, 32 nt, Human
gcaugccuguagucccagcugcucaggaggcu

SEQ ID NO: 436144 - RNA, 32 nt, Human
gcaugccuguaguccuagcuacucaggaggcu

SEQ ID NO: 436145 - RNA, 32 nt, Human
gcaugccuguagucgcagcuacucgcgagguu

SEQ ID NO: 436146 - RNA, 32 nt, Human
gcaugccuguagucucagcuacucaggaggcu

SEQ ID NO: 436147 - RNA, 20 nt, Human
gcaugccuguaguuccagcu

SEQ ID NO: 436148 - RNA, 32 nt, Human
gcaugccuguaguuccagcuacucaggacacu

SEQ ID NO: 436149 - RNA, 32 nt, Human
gcaugccuguaguuccagcuacucaggaggca

SEQ ID NO: 436150 - RNA, 32 nt, Human
gcaugccuguaguuccagcuacucaggaggcu

SEQ ID NO: 436151 - RNA, 32 nt, Human
gcaugccuguaguuccagcuacuugggaggcu

SEQ ID NO: 436152 - RNA, 32 nt, Human
gcaugccuguaguuccagcuacuugugaggcu

SEQ ID NO: 436153 - RNA, 32 nt, Human
gcaugccuguaguugcagcuacucauggggcu

SEQ ID NO: 436154 - RNA, 32 nt, Human
gcaugccuguaucccagcuacuugggaggcug

SEQ ID NO: 436155 - RNA, 32 nt, Human
gcaugccuguauucccagcuacucaggagguu

SEQ ID NO: 436156 - RNA, 32 nt, Human
gcaugccuguauucucagcuacucgggaggcu

SEQ ID NO: 436157 - RNA, 32 nt, Human
gcaugccugucauccaagcuacucaagagacu

SEQ ID NO: 436158 - RNA, 32 nt, Human
gcaugccugucaucccagcuacuccagaggcu

SEQ ID NO: 436159 - RNA, 32 nt, Human
gcaugccugucaucccagcuacuugggaggcu

SEQ ID NO: 436160 - RNA, 32 nt, Human
gcaugccugugaucccagcuacucaggaggcu

SEQ ID NO: 436161 - RNA, 32 nt, Human
gcaugccugugaucccagcuacuugagaggcu

SEQ ID NO: 436162 - RNA, 32 nt, Human
gcaugccugugauuccagcuacuugggagguu

SEQ ID NO: 436163 - RNA, 32 nt, Human
gcaugccuguggucccagcuacucaggaggcu

SEQ ID NO: 436164 - RNA, 32 nt, Human
gcaugccuguggucccagcuacuugggaggcu

SEQ ID NO: 436165 - RNA, 32 nt, Human
gcaugccuguggucucagcuacuugggaggcu

SEQ ID NO: 436166 - RNA, 32 nt, Human
gcaugccuguguucccagcuacucaggaggcu

SEQ ID NO: 436167 - RNA, 32 nt, Human
gcaugccuguguucccagcuacuugggaggcu

SEQ ID NO: 436168 - RNA, 32 nt, Human
gcaugccuguucugucugggccacauucacag

SEQ ID NO: 436169 - RNA, 32 nt, Human
gcaugccuguugucccagcuacucaggaggcu

SEQ ID NO: 436170 - RNA, 32 nt, Human
gcaugcgcauguuuaaccacaggccagagaac

SEQ ID NO: 436171 - RNA, 32 nt, Human
gcaugcgccuauaaucucagcuacuugggagg

SEQ ID NO: 436172 - RNA, 32 nt, Human
gcaugcgccuguaaucccagcuacucgggagg

SEQ ID NO: 436173 - RNA, 32 nt, Human
gcaugcgccuguaaucccagcuacucgggagu

SEQ ID NO: 436174 - RNA, 32 nt, Human
gcaugcgccuguaaucccagcuacuucggagg

SEQ ID NO: 436175 - RNA, 32 nt, Human
gcaugcgccuguaaucccggcuacucgggagg

SEQ ID NO: 436176 - RNA, 32 nt, Human
gcaugcgccuguaauccuagcuauucuggagg

SEQ ID NO: 436177 - RNA, 19 nt, Human
gcaugcgccuguaguccca

SEQ ID NO: 436178 - RNA, 32 nt, Human
gcaugcggccccuggcauuucgccaaggguuu

SEQ ID NO: 436179 - RNA, 32 nt, Human
gcaugcgggaggcggaggggugggaccgggug

SEQ ID NO: 436180 - RNA, 27 nt, Human
gcaugcgucuuucugcccugcuggccu

SEQ ID NO: 436181 - RNA, 32 nt, Human
gcaugcguguauaguccaagcuacucaggagg

SEQ ID NO: 436182 - RNA, 32 nt, Human
gcaugcgugugcgugguggccccacccaggca

SEQ ID NO: 436183 - RNA, 32 nt, Human
gcaugcguguucccugggcauggccggcuccg

SEQ ID NO: 436184 - RNA, 32 nt, Human
gcaugcuaagauuuaaaggagccccagauaaa

SEQ ID NO: 436185 - RNA, 32 nt, Human
gcaugcuacagccuuggacuccugggcucaag

SEQ ID NO: 436186 - RNA, 32 nt, Human
gcaugcuacugcacuccagccugggagacaga

SEQ ID NO: 436187 - RNA, 28 nt, Human
gcaugcuaguguugauguuuuuugguca

SEQ ID NO: 436188 - RNA, 32 nt, Human
gcaugcuaugaggaaaguuguauagggaaggc

SEQ ID NO: 436189 - RNA, 27 nt, Human
gcaugcucaaaaggaagcagaguucca

SEQ ID NO: 436190 - RNA, 32 nt, Human
gcaugcucagugccaggcugguagcugggccu

SEQ ID NO: 436191 - RNA, 32 nt, Human
gcaugcucaguuggugcugcuuucuuguugcu

SEQ ID NO: 436192 - RNA, 32 nt, Human
gcaugcucaucucuauuugcagccaggaaugg

SEQ ID NO: 436193 - RNA, 32 nt, Human
gcaugcucuccaggagcaccaacugggaaauc

SEQ ID NO: 436194 - RNA, 32 nt, Human
gcaugcugagauuaaggugguugccaagggaa

SEQ ID NO: 436195 - RNA, 32 nt, Human
gcaugcugcagcccucugccggcugugguguc

SEQ ID NO: 436196 - RNA, 32 nt, Human
gcaugcuggagaaugagagaccacaugaagca

SEQ ID NO: 436197 - RNA, 29 nt, Human
gcaugcuggcugcuaccucgcucacucuu

SEQ ID NO: 436198 - RNA, 32 nt, Human
gcaugcugguuucugccaccuccuuggacucc

SEQ ID NO: 436199 - RNA, 32 nt, Human
gcaugcugugaugcccagcuucccuuuccaca

SEQ ID NO: 436200 - RNA, 32 nt, Human
gcaugcuguggauaucuuugcaagugagugca

SEQ ID NO: 436201 - RNA, 32 nt, Human
gccagcuuccaagaacuggaaugcguacgucu

SEQ ID NO: 436202 - RNA, 32 nt, Human
gccagcuuccacuccuaccugaauagagaacu

SEQ ID NO: 436203 - RNA, 32 nt, Human
gccagcuuccagggcucuuuguguucugugac

SEQ ID NO: 436204 - RNA, 32 nt, Human
gccagcuucccacugcagcagcaccagucugg

SEQ ID NO: 436205 - RNA, 17 nt, Human
gccagcuucccagcaag

SEQ ID NO: 436206 - RNA, 19 nt, Human
gccagcuuccccccugagg

SEQ ID NO: 436207 - RNA, 32 nt, Human
gccagcuuccugcuguguucccugcacccacc

SEQ ID NO: 436208 - RNA, 32 nt, Human
gccagcuugcccacccuccaccuuugcccaau

SEQ ID NO: 436209 - RNA, 22 nt, Human
gccagcuugccccaccccgccc

SEQ ID NO: 436210 - RNA, 32 nt, Human
gccagcuuggcgcgcaccgccgccuccgccac

SEQ ID NO: 436211 - RNA, 32 nt, Human
gccagcuuugugcaaccagggcccacggcgcc

SEQ ID NO: 436212 - RNA, 21 nt, Human
gccaggaaaaagcaaauucug

SEQ ID NO: 436213 - RNA, 32 nt, Human
gccaggaaaggagccagucaugccggaaacac

SEQ ID NO: 436214 - RNA, 32 nt, Human
gccaggaaaggucaguggaggaaagugcucca

SEQ ID NO: 436215 - RNA, 32 nt, Human
gccaggaacagcuugagguaccugagcccugc

SEQ ID NO: 436216 - RNA, 32 nt, Human
gccaggaacuaccccaugaucuucuauucuca

SEQ ID NO: 436217 - RNA, 32 nt, Human
gccaggaagagaagaaagggggugcagucuga

SEQ ID NO: 436218 - RNA, 32 nt, Human
gccaggaagaggaggggaggaggaggaggagg

SEQ ID NO: 436219 - RNA, 32 nt, Human
gccaggaagcagcacagacacagcauagcagg

SEQ ID NO: 436220 - RNA, 32 nt, Human
gccaggaagcaugccaacaaagccacacgggu

SEQ ID NO: 436221 - RNA, 32 nt, Human
gccaggaagccagcaggcucucaggccagcug

SEQ ID NO: 436222 - RNA, 25 nt, Human
gccaggaagcggagguuguggugag

SEQ ID NO: 436223 - RNA, 32 nt, Human
gccaggaaggcccaggguccucagggaccaag

SEQ ID NO: 436224 - RNA, 32 nt, Human
gccaggaagguugagguugcagugagcuauga

SEQ ID NO: 436225 - RNA, 32 nt, Human
gccaggaauucaagaccagccugggcaacaca

SEQ ID NO: 436226 - RNA, 32 nt, Human
gccaggaauucaaggccagccugggcaacaua

SEQ ID NO: 436227 - RNA, 32 nt, Human
gccaggacaaggcagcuccuggaagcuccacc

SEQ ID NO: 436228 - RNA, 32 nt, Human
gccaggacacagauuuugagagcuguguguau

SEQ ID NO: 436229 - RNA, 32 nt, Human
gccaggacacauauaagaaaguugcacuagau

SEQ ID NO: 436230 - RNA, 16 nt, Human
gccaggacacccggga

SEQ ID NO: 436231 - RNA, 18 nt, Human
gccaggacacucccagca

SEQ ID NO: 436232 - RNA, 20 nt, Human
gccaggacagcuggcugcug

SEQ ID NO: 436233 - RNA, 20 nt, Human
gccaggacauucuuccagca

SEQ ID NO: 436234 - RNA, 32 nt, Human
gccaggaccacauucggauucauagugugggc

SEQ ID NO: 436235 - RNA, 32 nt, Human
gccaggaccagcccggcccauggucccccagc

SEQ ID NO: 436236 - RNA, 17 nt, Human
gccaggaccaggccccg

SEQ ID NO: 436237 - RNA, 32 nt, Human
gccaggaccaugaggaagggguaggggucuau

SEQ ID NO: 436238 - RNA, 20 nt, Human
gccaggacccacagcccucc

SEQ ID NO: 436239 - RNA, 32 nt, Human
gccaggacccaccacauugcuuccuaauaccc

SEQ ID NO: 436240 - RNA, 32 nt, Human
gccaggacccaggagcugcauggcuguaagag

SEQ ID NO: 436241 - RNA, 32 nt, Human
gccaggaccccuccucugagacaggguugccu

SEQ ID NO: 436242 - RNA, 32 nt, Human
gccaggacccuaggcuuggagcuggagcuggg

SEQ ID NO: 436243 - RNA, 32 nt, Human
gccaggacccuggaaggaagcaggauggcagc

SEQ ID NO: 436244 - RNA, 32 nt, Human
gccaggaccugcuugaacuaccagggccacag

SEQ ID NO: 436245 - RNA, 32 nt, Human
gccaggaccuggcaaggcuuguuuacuauggc

SEQ ID NO: 436246 - RNA, 20 nt, Human
gccaggacggucuccaucuc

SEQ ID NO: 436247 - RNA, 32 nt, Human
gccaggacuagcucuccuuucucaucuccugu

SEQ ID NO: 436248 - RNA, 32 nt, Human
gccaggacucagaccaccagcacgcagcaccc

SEQ ID NO: 436249 - RNA, 24 nt, Human
gccaggacuccccaggccaggcca

SEQ ID NO: 436250 - RNA, 19 nt, Human
gccaggacucuggcuacug

SEQ ID NO: 436251 - RNA, 32 nt, Human
gccaggacugccggcccugcagcugccuucug

SEQ ID NO: 436252 - RNA, 32 nt, Human
gccaggacuguuuucaugcugccugugccucg

SEQ ID NO: 436253 - RNA, 32 nt, Human
gccaggacuuccuucacuucagcugcggaccc

SEQ ID NO: 436254 - RNA, 32 nt, Human
gccaggacuugugggguggccccaggagcauu

SEQ ID NO: 436255 - RNA, 32 nt, Human
gccaggagaacaggaacagaacugagcagggg

SEQ ID NO: 436256 - RNA, 32 nt, Human
gccaggagagaagaauccaaaaagcaauauuu

SEQ ID NO: 436257 - RNA, 18 nt, Human
gccaggagagcccugagg

SEQ ID NO: 436258 - RNA, 32 nt, Human
gccaggagaggaaggagcggcgggcagguggc

SEQ ID NO: 436259 - RNA, 32 nt, Human
gccaggagaggaaggaggaacuguggcgccca

SEQ ID NO: 436260 - RNA, 32 nt, Human
gccaggagagucaggccaccagggggcgccag

SEQ ID NO: 436261 - RNA, 19 nt, Human
gccaggagcaccgccgcgg

SEQ ID NO: 436262 - RNA, 22 nt, Human
gccaggagcagcagccgcgccu

SEQ ID NO: 436263 - RNA, 32 nt, Human
gccaggagcccgcagcccuggcgcccgccgcc

SEQ ID NO: 436264 - RNA, 18 nt, Human
gccaggagcccucaggug

SEQ ID NO: 436265 - RNA, 32 nt, Human
gccaggagcccugacuucacuuccuuuggucc

SEQ ID NO: 436266 - RNA, 32 nt, Human
gccaggagccgggagagccgagugggaggggc

SEQ ID NO: 436267 - RNA, 32 nt, Human
gccaggagccucuccccuccagaagacuugcc

SEQ ID NO: 436268 - RNA, 32 nt, Human
gccaggagcuaagugccuuuuugugugcaacc

SEQ ID NO: 436269 - RNA, 21 nt, Human
gccaggagcugagacuagcca

SEQ ID NO: 436270 - RNA, 32 nt, Human
gccaggagcugccucccccagcccccgucccg

SEQ ID NO: 436271 - RNA, 32 nt, Human
gccaggaggaaaggaagugacaaguacagaag

SEQ ID NO: 436272 - RNA, 32 nt, Human
gccaggaggaggagguugcagugagccgagau

SEQ ID NO: 436273 - RNA, 25 nt, Human
gccaggaggcagagguugcagugag

SEQ ID NO: 436274 - RNA, 32 nt, Human
gccaggaggcagagguugcagugagccaagcg

SEQ ID NO: 436275 - RNA, 32 nt, Human
gccaggaggcccaggcugggagagggagcagg

SEQ ID NO: 436276 - RNA, 32 nt, Human
gccaggaggccgaagugcauccugaguguccg

SEQ ID NO: 436277 - RNA, 32 nt, Human
gccaggaggccuucccaggucuucccaguuac

SEQ ID NO: 436278 - RNA, 32 nt, Human
gccaggaggcggagcuugcagugagccgagau

SEQ ID NO: 436279 - RNA, 25 nt, Human
gccaggaggcggagguugcagugag

SEQ ID NO: 436280 - RNA, 32 nt, Human
gccaggaggcggagguugcagugagccgagau

SEQ ID NO: 436281 - RNA, 23 nt, Human
gccaggaggcuagucccaccucu

SEQ ID NO: 436282 - RNA, 18 nt, Human
gccaggagggaggccccg

SEQ ID NO: 436283 - RNA, 32 nt, Human
gccaggagggauucuaagugccaaggcucuga

SEQ ID NO: 436284 - RNA, 32 nt, Human
gccaggagggauugaaaggcaucccaguucua

SEQ ID NO: 436285 - RNA, 32 nt, Human
gccaggagggccugggauuguuugugugcugu

SEQ ID NO: 436286 - RNA, 32 nt, Human
gccaggaggggcccugcccaugcccacacuac

SEQ ID NO: 436287 - RNA, 30 nt, Human
gccaggaggucaggucaaggcugcagugag

SEQ ID NO: 436288 - RNA, 21 nt, Human
gccaggaggugaagggccccg

SEQ ID NO: 436289 - RNA, 32 nt, Human
gccaggagguugaggcugcagugagcugugau

SEQ ID NO: 436290 - RNA, 32 nt, Human
gccaggagguugagguugcagugagcugagau

SEQ ID NO: 436291 - RNA, 32 nt, Human
gccaggaguacugcauucaguugacuuucagg

SEQ ID NO: 436292 - RNA, 32 nt, Human
gccaggaguccacccaccuccgcauccacccc

SEQ ID NO: 436293 - RNA, 32 nt, Human
gccaggagucugggaggcagguuuccaagagc

SEQ ID NO: 436294 - RNA, 32 nt, Human
gccaggagugcaagucugaagaaugcugugcc

SEQ ID NO: 436295 - RNA, 21 nt, Human
gccaggagugugggaaggccc

SEQ ID NO: 436296 - RNA, 32 nt, Human
gccaggaguugcagaccagccuggguaacaua

SEQ ID NO: 436297 - RNA, 32 nt, Human
gccaggaguuggagaccagccuaggcaacaca

SEQ ID NO: 436298 - RNA, 32 nt, Human
gccaggaguuugacaccagccugggcaacaua

SEQ ID NO: 436299 - RNA, 32 nt, Human
gccaggaguuugauugcuuacaacagcucuuu

SEQ ID NO: 436300 - RNA, 32 nt, Human
gccaggaguuuggggaaggaaggggugggaag

SEQ ID NO: 436301 - RNA, 32 nt, Human
gccaggaguuugggggcccaccuuccugggcu

SEQ ID NO: 436302 - RNA, 21 nt, Human
gccaggauagucuccaucucu

SEQ ID NO: 436303 - RNA, 32 nt, Human
gccaggauauuaaacagaaacucucaguugua

SEQ ID NO: 436304 - RNA, 18 nt, Human
gccaggaucaacugccca

SEQ ID NO: 436305 - RNA, 19 nt, Human
gccaggauccuucugcucc

SEQ ID NO: 436306 - RNA, 32 nt, Human
gccaggaucuaagcccaugagcacagggacug

SEQ ID NO: 436307 - RNA, 32 nt, Human
gccaggaucugcaguagggagggaaggccccc

SEQ ID NO: 436308 - RNA, 32 nt, Human
gccaggaugcaaccugcuuucaccagacugca

SEQ ID NO: 436309 - RNA, 32 nt, Human
gccaggaugcccaccccgcccucuacacggcc

SEQ ID NO: 436310 - RNA, 22 nt, Human
gccaggauggaacacggccaca

SEQ ID NO: 436311 - RNA, 32 nt, Human
gccaggauggccagggcuguuuuugcuacuga

SEQ ID NO: 436312 - RNA, 23 nt, Human
gccaggauggcuggcugggcccc

SEQ ID NO: 436313 - RNA, 23 nt, Human
gccaggaugggaccaaagucaag

SEQ ID NO: 436314 - RNA, 31 nt, Human
gccaggaugggggacuccagggaccuuugcc

SEQ ID NO: 436315 - RNA, 21 nt, Human
gccaggauggucuccaucucu

SEQ ID NO: 436316 - RNA, 32 nt, Human
gccaggauggucucgauaucugaucucgugau

SEQ ID NO: 436317 - RNA, 32 nt, Human
gccaggauggucucgcccuccugaccuuguga

SEQ ID NO: 436318 - RNA, 32 nt, Human
gccaggauuacagccuaggcugcuccaacuau

SEQ ID NO: 436319 - RNA, 32 nt, Human
gccaggauucaggccucugaggagcccacggg

SEQ ID NO: 436320 - RNA, 19 nt, Human
gccaggauuccacagccca

SEQ ID NO: 436321 - RNA, 32 nt, Human
gccaggauuccuuuuccaucuccucucuuucu

SEQ ID NO: 436322 - RNA, 32 nt, Human
gccaggauugagcugcagaagugggagcuugu

SEQ ID NO: 436323 - RNA, 21 nt, Human
gccaggauugucuccaucucu

SEQ ID NO: 436324 - RNA, 32 nt, Human
gccaggauugugccacuacacuccagccuggc

SEQ ID NO: 436325 - RNA, 32 nt, Human
gccaggauugugccacugcacucaagccuggg

SEQ ID NO: 436326 - RNA, 32 nt, Human
gccaggauugugccacuguacuccagccuggg

SEQ ID NO: 436327 - RNA, 32 nt, Human
gccaggauuugaaagcaggcagccuggcucca

SEQ ID NO: 436328 - RNA, 32 nt, Human
gccaggauuugaggaggagaagggaggaggug

SEQ ID NO: 436329 - RNA, 22 nt, Human
gccaggcaaccagcugcugccu

SEQ ID NO: 436330 - RNA, 17 nt, Human
gccaggcaaccuggcca

SEQ ID NO: 436331 - RNA, 22 nt, Human
gccaggcaagcccagggcacag

SEQ ID NO: 436332 - RNA, 19 nt, Human
gccaggcaagugggaccag

SEQ ID NO: 436333 - RNA, 19 nt, Human
gccaggcacacugagccag

SEQ ID NO: 436334 - RNA, 32 nt, Human
gccaggcacaucuggccuugggaaacucaucc

SEQ ID NO: 436335 - RNA, 19 nt, Human
gccaggcaccaaggcacag

SEQ ID NO: 436336 - RNA, 32 nt, Human
gccaggcaccaccacaccuggcuuuagaguuc

SEQ ID NO: 436337 - RNA, 17 nt, Human
gccaggcacccuccucu

SEQ ID NO: 436338 - RNA, 32 nt, Human
gccaggcaccucagugcugggcaggggcauca

SEQ ID NO: 436339 - RNA, 32 nt, Human
gccaggcaccucucuccccaugguguuuucca

SEQ ID NO: 436340 - RNA, 18 nt, Human
gccaggcacgauggcuca

SEQ ID NO: 436341 - RNA, 19 nt, Human
gccaggcacgcuggaucag

SEQ ID NO: 436342 - RNA, 32 nt, Human
gccaggcacugaggcccuggagacagcuguuc

SEQ ID NO: 436343 - RNA, 20 nt, Human
gccaggcacugauaagccag

SEQ ID NO: 436344 - RNA, 32 nt, Human
gccaggcacuggagggcgcaucaaagaagagu

SEQ ID NO: 436345 - RNA, 22 nt, Human
gccaggcagaaagagugcucag

SEQ ID NO: 436346 - RNA, 32 nt, Human
gccaggcagacacuguuugggaaaguguucca

SEQ ID NO: 436347 - RNA, 32 nt, Human
gccaggcagagcugggauugaaggaccccuau

SEQ ID NO: 436348 - RNA, 19 nt, Human
gccaggcagcaaggaccag

SEQ ID NO: 436349 - RNA, 32 nt, Human
gccaggcagcagcgaggauggugaccgagaag

SEQ ID NO: 436350 - RNA, 19 nt, Human
gccaggcagcagcucucag

SEQ ID NO: 436351 - RNA, 18 nt, Human
gccaggcagcagucucag

SEQ ID NO: 436352 - RNA, 19 nt, Human
gccaggcagccccuggcuc

SEQ ID NO: 436353 - RNA, 21 nt, Human
gccaggcagccgugaccccag

SEQ ID NO: 436354 - RNA, 18 nt, Human
gccaggcagccuccaccu

SEQ ID NO: 436355 - RNA, 22 nt, Human
gccaggcagcgggcaccacuca

SEQ ID NO: 436356 - RNA, 19 nt, Human
gccaggcagcuccacucuc

SEQ ID NO: 436357 - RNA, 23 nt, Human
gccaggcagcugccacaggccua

SEQ ID NO: 436358 - RNA, 19 nt, Human
gccaggcagcuggaaucag

SEQ ID NO: 436359 - RNA, 19 nt, Human
gccaggcagcugggauuca

SEQ ID NO: 436360 - RNA, 21 nt, Human
gccaggcaggaguggucucag

SEQ ID NO: 436361 - RNA, 19 nt, Human
gccaggcaggcaccagcuc

SEQ ID NO: 436362 - RNA, 32 nt, Human
gccaggcaggcagaggauccgauuaugcgccc

SEQ ID NO: 436363 - RNA, 19 nt, Human
gccaggcaggccagcccag

SEQ ID NO: 436364 - RNA, 17 nt, Human
gccaggcaggccagugg

SEQ ID NO: 436365 - RNA, 32 nt, Human
gccaggcaggcugucugucugcuucacauguc

SEQ ID NO: 436366 - RNA, 32 nt, Human
gccaggcagggcggaggccugcugugcaguug

SEQ ID NO: 436367 - RNA, 32 nt, Human
gccaggcaggguggccaaagaggacuggacuc

SEQ ID NO: 436368 - RNA, 18 nt, Human
gccaggcaggguggcuca

SEQ ID NO: 436369 - RNA, 20 nt, Human
gccaggcaggugggccucag

SEQ ID NO: 436370 - RNA, 32 nt, Human
gccaggcagucccuccugccucaguuucucag

SEQ ID NO: 436371 - RNA, 21 nt, Human
gccaggcaguggacucuucag

SEQ ID NO: 436372 - RNA, 20 nt, Human
gccaggcagugggaagucag

SEQ ID NO: 436373 - RNA, 17 nt, Human
gccaggcagugggacuc

SEQ ID NO: 436374 - RNA, 21 nt, Human
gccaggcagugucaggcugag

SEQ ID NO: 436375 - RNA, 32 nt, Human
gccaggcaguuggggcacuuucugagugcugc

SEQ ID NO: 436376 - RNA, 32 nt, Human
gccaggcauccagcuggggccaguggagguca

SEQ ID NO: 436377 - RNA, 32 nt, Human
gccaggcaucuccuccuggccugagauggaag

SEQ ID NO: 436378 - RNA, 21 nt, Human
gccaggcauggcgaggcugag

SEQ ID NO: 436379 - RNA, 32 nt, Human
gccaggcaugguacucaugccuguaaucccag

SEQ ID NO: 436380 - RNA, 19 nt, Human
gccaggcauggugacucag

SEQ ID NO: 436381 - RNA, 31 nt, Human
gccaggcauggugcugcacacuuguaaucac

SEQ ID NO: 436382 - RNA, 18 nt, Human
gccaggcaugguggcuca

SEQ ID NO: 436383 - RNA, 32 nt, Human
gccaggcaugugggugugggugcaaugugggu

SEQ ID NO: 436384 - RNA, 32 nt, Human
gccaggcauucaauccucaggucuccaccaag

SEQ ID NO: 436385 - RNA, 32 nt, Human
gccaggcauucucucccugcccucucuggccu

SEQ ID NO: 436386 - RNA, 20 nt, Human
gccaggcauugcaggcuuag

SEQ ID NO: 436387 - RNA, 23 nt, Human
gccaggccaagcuggacugcaua

SEQ ID NO: 436388 - RNA, 32 nt, Human
gccaggccaaguacucagcugucuuaauagga

SEQ ID NO: 436389 - RNA, 21 nt, Human
gccaggccacacuccaggagc

SEQ ID NO: 436390 - RNA, 21 nt, Human
gccaggccacagggaggaggc

SEQ ID NO: 436391 - RNA, 25 nt, Human
gccaggccagacacagcugcugccu

SEQ ID NO: 436392 - RNA, 22 nt, Human
gccaggccagcugggcucgggg

SEQ ID NO: 436393 - RNA, 32 nt, Human
gccaggccaggaccacacaguccccagacuca

SEQ ID NO: 436394 - RNA, 32 nt, Human
gccaggccaggccagguggggaaagggacacc

SEQ ID NO: 436395 - RNA, 32 nt, Human
gccaggccaguaaaaguauaacagcaaauaac

SEQ ID NO: 436396 - RNA, 32 nt, Human
gccaggccaguccugcuuaaacuccugcuguu

SEQ ID NO: 436397 - RNA, 32 nt, Human
gccaggccaguguguagaacagcugguccaac

SEQ ID NO: 436398 - RNA, 32 nt, Human
gccaggccaucuccaaccauguccgacgaggc

SEQ ID NO: 436399 - RNA, 20 nt, Human
gccaggccaugacccagggg

SEQ ID NO: 436400 - RNA, 21 nt, Human
gccaggccauggccaaggggc

SEQ ID NO: 436401 - RNA, 18 nt, Human
gccaggcccaccaccucu

SEQ ID NO: 436402 - RNA, 17 nt, Human
gccaggcccagccugca

SEQ ID NO: 436403 - RNA, 32 nt, Human
gccaggcccagccugcaccuccacaccggccc

SEQ ID NO: 436404 - RNA, 32 nt, Human
gccaggcccagccugcgcccccacaccggccc

SEQ ID NO: 436405 - RNA, 19 nt, Human
gccaggcccagcugccaca

SEQ ID NO: 436406 - RNA, 32 nt, Human
gccaggcccaggcugggugcccuguggccuga

SEQ ID NO: 436407 - RNA, 22 nt, Human
gccaggcccaugccuggugucu

SEQ ID NO: 436408 - RNA, 32 nt, Human
gccaggcccauggcuggaaggccgggcuggag

SEQ ID NO: 436409 - RNA, 21 nt, Human
gccaggccccaggcagggcca

SEQ ID NO: 436410 - RNA, 20 nt, Human
gccaggcccccagcgcgggc

SEQ ID NO: 436411 - RNA, 19 nt, Human
gccaggccccgccccgcau

SEQ ID NO: 436412 - RNA, 16 nt, Human
gccaggccccggcagc

SEQ ID NO: 436413 - RNA, 21 nt, Human
gccaggcccgcagccgcuacu

SEQ ID NO: 436414 - RNA, 32 nt, Human
gccaggcccgccucuggcuccugggccugggc

SEQ ID NO: 436415 - RNA, 32 nt, Human
gccaggcccuccugccaugucggacccagacg

SEQ ID NO: 436416 - RNA, 32 nt, Human
gccaggcccucgggcaccgcagccaaacaccc

SEQ ID NO: 436417 - RNA, 32 nt, Human
gccaggcccugagagucuggucugcgccuugg

SEQ ID NO: 436418 - RNA, 32 nt, Human
gccaggcccugaggccauguaccaggcccgga

SEQ ID NO: 436419 - RNA, 32 nt, Human
gccaggcccugagguucagacccuggacccca

SEQ ID NO: 436420 - RNA, 21 nt, Human
gccaggcccugccggacccgg

SEQ ID NO: 436421 - RNA, 32 nt, Human
gccaggcccuggagggugauccugccagcagc

SEQ ID NO: 436422 - RNA, 21 nt, Human
gccaggcccuggcccauaggg

SEQ ID NO: 436423 - RNA, 32 nt, Human
gccaggcccuggggccccuugagugcggcagc

SEQ ID NO: 436424 - RNA, 32 nt, Human
gccaggccgagaggcaggccgggcaggggugu

SEQ ID NO: 436425 - RNA, 21 nt, Human
gccaggccgcagcccaggagc

SEQ ID NO: 436426 - RNA, 21 nt, Human
gccaggccgccagcccagagc

SEQ ID NO: 436427 - RNA, 19 nt, Human
gccaggccgccccgcuguc

SEQ ID NO: 436428 - RNA, 24 nt, Human
gccaggccgcgguggcugaugccu

SEQ ID NO: 436429 - RNA, 23 nt, Human
gccaggccggccgggccgagcca

SEQ ID NO: 436430 - RNA, 22 nt, Human
gccaggccggcugccuggugcc

SEQ ID NO: 436431 - RNA, 23 nt, Human
gccaggccgggcaacccuggggc

SEQ ID NO: 436432 - RNA, 24 nt, Human
gccaggccgggcugacccaagggg

SEQ ID NO: 436433 - RNA, 32 nt, Human
gccaggccggguagcuuccuccccagcccuca

SEQ ID NO: 436434 - RNA, 21 nt, Human
gccaggccggucauggugccu

SEQ ID NO: 436435 - RNA, 15 nt, Human
gccaggccucacaga

SEQ ID NO: 436436 - RNA, 32 nt, Human
gccaggccucauucuccucuggccucuaauag

SEQ ID NO: 436437 - RNA, 32 nt, Human
gccaggccuccaggaggcaccaggcaggcccu

SEQ ID NO: 436438 - RNA, 20 nt, Human
gccaggccucucucaccucu

SEQ ID NO: 436439 - RNA, 32 nt, Human
gccaggccucugcgccuggccuagggugcagc

SEQ ID NO: 436440 - RNA, 22 nt, Human
gccaggccugacggccacuccu

SEQ ID NO: 436441 - RNA, 32 nt, Human
gccaggccugagccucugccaccauggccauu

SEQ ID NO: 436442 - RNA, 21 nt, Human
gccaggccugcagccgcugcc

SEQ ID NO: 436443 - RNA, 19 nt, Human
gccaggccugggcccaggg

SEQ ID NO: 436444 - RNA, 22 nt, Human
gccaggccuggggaaggcuccu

SEQ ID NO: 436445 - RNA, 32 nt, Human
gccaggccugggggcagccucuccccagccuc

SEQ ID NO: 436446 - RNA, 32 nt, Human
gccaggccuguagcuccuaccuggggccuauu

SEQ ID NO: 436447 - RNA, 32 nt, Human
gccaggccuugcaagcccagcaucuuggaacu

SEQ ID NO: 436448 - RNA, 22 nt, Human
gccaggcgagcccagggcacag

SEQ ID NO: 436449 - RNA, 32 nt, Human
gccaggcgaggaugacagggaaagggaggcag

SEQ ID NO: 436450 - RNA, 27 nt, Human
gccaggcgaggcugacuccgcgugaga

SEQ ID NO: 436451 - RNA, 20 nt, Human
gccaggcgaguggggcccag

SEQ ID NO: 436452 - RNA, 25 nt, Human
gccaggcgcacaaaugccccuuccc

SEQ ID NO: 436453 - RNA, 32 nt, Human
gccaggcgcaccacuguagucccagcuacuca

SEQ ID NO: 436454 - RNA, 18 nt, Human
gccaggcgcaguggcuca

SEQ ID NO: 436455 - RNA, 19 nt, Human
gccaggcgccggccggcug

SEQ ID NO: 436456 - RNA, 32 nt, Human
gccaggcgccggggcaggaagggaggcggccg

SEQ ID NO: 436457 - RNA, 32 nt, Human
gccaggcgcgcaaccucgggcgccggggcaag

SEQ ID NO: 436458 - RNA, 17 nt, Human
gccaggcgcgggggcuc

SEQ ID NO: 436459 - RNA, 18 nt, Human
gccaggcgcgguggcuca

SEQ ID NO: 436460 - RNA, 19 nt, Human
gccaggcgcgguggcucag

SEQ ID NO: 436461 - RNA, 17 nt, Human
gccaggcgcucaccccu

SEQ ID NO: 436462 - RNA, 20 nt, Human
gccaggcggacaaaguucag

SEQ ID NO: 436463 - RNA, 19 nt, Human
gccaggcggccauccagaa

SEQ ID NO: 436464 - RNA, 17 nt, Human
gccaggcggccgaccuc

SEQ ID NO: 436465 - RNA, 20 nt, Human
gccaggcggccggcuaccug

SEQ ID NO: 436466 - RNA, 32 nt, Human
gccaggcggcgccgucggcugggcccggauuc

SEQ ID NO: 436467 - RNA, 32 nt, Human
gccaggcggggagggggcgagaggccccaggc

SEQ ID NO: 436468 - RNA, 20 nt, Human
gccaggcgggggaggcgcag

SEQ ID NO: 436469 - RNA, 18 nt, Human
gccaggcgugguggcuca

SEQ ID NO: 436470 - RNA, 20 nt, Human
gccaggcguguaagccucag

SEQ ID NO: 436471 - RNA, 19 nt, Human
gccaggcguucccaccucu

SEQ ID NO: 436472 - RNA, 32 nt, Human
gccaggcuagaauggaaaacugccuguuccuu

SEQ ID NO: 436473 - RNA, 32 nt, Human
gccaggcuagcuccaggccaguucucgguguc

SEQ ID NO: 436474 - RNA, 32 nt, Human
gccaggcuagcuggagccugggauuucuaugc

SEQ ID NO: 436475 - RNA, 20 nt, Human
gccaggcucacagggacucc

SEQ ID NO: 436476 - RNA, 19 nt, Human
gccaggcucagccacugcc

SEQ ID NO: 436477 - RNA, 23 nt, Human
gccaggcucaggccauggcuccc

SEQ ID NO: 436478 - RNA, 21 nt, Human
gccaggcucagguggccuccu

SEQ ID NO: 436479 - RNA, 19 nt, Human
gccaggcucaguucuuacc

SEQ ID NO: 436480 - RNA, 18 nt, Human
gccaggcuccaagacacu

SEQ ID NO: 436481 - RNA, 23 nt, Human
gccaggcuccggccaggaucccu

SEQ ID NO: 436482 - RNA, 32 nt, Human
gccaggcuccuggcaaccucucuugcuagagc

SEQ ID NO: 436483 - RNA, 20 nt, Human
gccaggcucgccaggagccc

SEQ ID NO: 436484 - RNA, 22 nt, Human
gccaggcucgcccaugggccuu

SEQ ID NO: 436485 - RNA, 22 nt, Human
gccaggcucgggggagccuccu

SEQ ID NO: 436486 - RNA, 20 nt, Human
gccaggcucuaccucaggga

SEQ ID NO: 436487 - RNA, 24 nt, Human
gccaggcucuaggccaggcucucu

SEQ ID NO: 436488 - RNA, 32 nt, Human
gccaggcucugcccuggccuuccucugugaac

SEQ ID NO: 436489 - RNA, 32 nt, Human
gccaggcucugccuggaggaucccuccauccg

SEQ ID NO: 436490 - RNA, 32 nt, Human
gccaggcucuuugcuuggcuucucuuuccucu

SEQ ID NO: 436491 - RNA, 32 nt, Human
gccaggcugaccaccucugccugacucagaug

SEQ ID NO: 436492 - RNA, 32 nt, Human
gccaggcugagggcaucuggagugccuggcca

SEQ ID NO: 436493 - RNA, 25 nt, Human
gccaggcugauggccagggccgcag

SEQ ID NO: 436494 - RNA, 32 nt, Human
gccaggcugcagccucaggcacuggcaggggc

SEQ ID NO: 436495 - RNA, 32 nt, Human
gccaggcugcagccugcugcuccagggagcac

SEQ ID NO: 436496 - RNA, 32 nt, Human
gccaggcugcccaucagggcccagggagcccc

SEQ ID NO: 436497 - RNA, 32 nt, Human
gccaggcugccuggcaucccuggggcaugagc

SEQ ID NO: 436498 - RNA, 32 nt, Human
gccaggcugccuggccuuguccucagccaguu

SEQ ID NO: 436499 - RNA, 20 nt, Human
gccaggcugcuaggagccag

SEQ ID NO: 436500 - RNA, 19 nt, Human
gccaggcugcuggcugcug

SEQ ID NO: 436501 - RNA, 19 nt, Human
gccaggcuggagugcaaug

SEQ ID NO: 436502 - RNA, 32 nt, Human
gccaggcuggagugcacuggggcuuggcucac

SEQ ID NO: 436503 - RNA, 20 nt, Human
gccaggcuggagugcaguaa

SEQ ID NO: 436504 - RNA, 19 nt, Human
gccaggcuggagugcagug

SEQ ID NO: 436505 - RNA, 20 nt, Human
gccaggcuggagugcagugg

SEQ ID NO: 436506 - RNA, 32 nt, Human
gccaggcuggagugcaguggugccaucucggc

SEQ ID NO: 436507 - RNA, 22 nt, Human
gccaggcuggauccccacucga

SEQ ID NO: 436508 - RNA, 20 nt, Human
gccaggcuggcaggggccag

SEQ ID NO: 436509 - RNA, 32 nt, Human
gccaggcuggccagggcgugggcagguggugu

SEQ ID NO: 436510 - RNA, 32 nt, Human
gccaggcuggcuccuggggauggccagguaca

SEQ ID NO: 436511 - RNA, 32 nt, Human
gccaggcugggagcuggagcuugcugagucuu

SEQ ID NO: 436512 - RNA, 19 nt, Human
gccaggcugggaggcucgg

SEQ ID NO: 436513 - RNA, 24 nt, Human
gccaggcuggguuggggacccagg

SEQ ID NO: 436514 - RNA, 32 nt, Human
gccaggcuggucucaaacuccugggcucaagc

SEQ ID NO: 436515 - RNA, 32 nt, Human
gccaggcuggucucaaacuccuggguucaagc

SEQ ID NO: 436516 - RNA, 32 nt, Human
gccaggcuggucucacacugaccucaggugau

SEQ ID NO: 436517 - RNA, 32 nt, Human
gccaggcuggucucgaacucauggccucaaau

SEQ ID NO: 436518 - RNA, 32 nt, Human
gccaggcuggucucgaucugaccucaugaucc

SEQ ID NO: 436519 - RNA, 32 nt, Human
gccaggcuggucucuaacuccugggcucagug

SEQ ID NO: 436520 - RNA, 32 nt, Human
gccaggcuggucuugaacugaccucaugaucc

SEQ ID NO: 436521 - RNA, 23 nt, Human
gccaggcuguccgcgccgccgcu

SEQ ID NO: 436522 - RNA, 32 nt, Human
gccaggcuuccgggagugguucuuggaugcug

SEQ ID NO: 436523 - RNA, 32 nt, Human
gccaggcuucuguguguccucucacuuaaucc

SEQ ID NO: 436524 - RNA, 21 nt, Human
gccagggaaaaccgccggcga

SEQ ID NO: 436525 - RNA, 21 nt, Human
gccagggaaaggcagaaccac

SEQ ID NO: 436526 - RNA, 32 nt, Human
gccagggaagcagaggaugugagaggcagagg

SEQ ID NO: 436527 - RNA, 32 nt, Human
gccagggaagguagguuucucuggcugacuga

SEQ ID NO: 436528 - RNA, 32 nt, Human
gccagggaagguggaggaaggaagccaggaag

SEQ ID NO: 436529 - RNA, 32 nt, Human
gccagggaaggugggagccacauggacccaca

SEQ ID NO: 436530 - RNA, 32 nt, Human
gccagggaagugggacacgacccccucuugua

SEQ ID NO: 436531 - RNA, 24 nt, Human
gccagggacacucuccuucaggga

SEQ ID NO: 436532 - RNA, 32 nt, Human
gccagggacaguuccaggcacuggagauaaaa

SEQ ID NO: 436533 - RNA, 22 nt, Human
gccagggaccaggaccaggcca

SEQ ID NO: 436534 - RNA, 32 nt, Human
gccagggaccuggccaagacaccugcucaaaa

SEQ ID NO: 436535 - RNA, 32 nt, Human
gccagggacucugccgaggcccugagaacccc

SEQ ID NO: 436536 - RNA, 21 nt, Human
gccagggacuggcuggacccc

SEQ ID NO: 436537 - RNA, 32 nt, Human
gccagggagaagaagagaaagaaaaagagaca

SEQ ID NO: 436538 - RNA, 19 nt, Human
gccagggagaaggcagcac

SEQ ID NO: 436539 - RNA, 32 nt, Human
gccagggagacucagcucuccuugggggcugg

SEQ ID NO: 436540 - RNA, 32 nt, Human
gccagggagaggggagccagagccggugggaa

SEQ ID NO: 436541 - RNA, 32 nt, Human
gccagggagaggggaggagugggcagugaaga

SEQ ID NO: 436542 - RNA, 32 nt, Human
gccagggagagggugaagcagguaucagaguc

SEQ ID NO: 436543 - RNA, 32 nt, Human
gccagggagaugccugaccaacagguguguug

SEQ ID NO: 436544 - RNA, 32 nt, Human
gccagggagcaccuggugagucugccggcggu

SEQ ID NO: 436545 - RNA, 32 nt, Human
gccagggagcacuggaggccacccagucaugg

SEQ ID NO: 436546 - RNA, 32 nt, Human
gccagggagcaguggcugaguagcucugccuu

SEQ ID NO: 436547 - RNA, 32 nt, Human
gccagggagccaaguggucuagcucagcagau

SEQ ID NO: 436548 - RNA, 32 nt, Human
gccagggagccaaguggucuugcucaauggau

SEQ ID NO: 436549 - RNA, 32 nt, Human
gccagggagcggggagcuuccuggaggcuucc

SEQ ID NO: 436550 - RNA, 32 nt, Human
gccagggaggacaugagaagggccaguggggg

SEQ ID NO: 436551 - RNA, 32 nt, Human
gccagggaggaccugguggccuccucauucuc

SEQ ID NO: 436552 - RNA, 32 nt, Human
gccagggaggcagagcgggagggagucucagg

SEQ ID NO: 436553 - RNA, 32 nt, Human
gccagggaggcaggggaggcaggagaggcugg

SEQ ID NO: 436554 - RNA, 32 nt, Human
gccagggagggaggagaaagccgaagcgaaag

SEQ ID NO: 436555 - RNA, 32 nt, Human
gccagggaggggcagcugcagugaccaggccc

SEQ ID NO: 436556 - RNA, 32 nt, Human
gccagggaggucaaggcugcagugagccguga

SEQ ID NO: 436557 - RNA, 32 nt, Human
gccagggagguggaggcuacagugagccauga

SEQ ID NO: 436558 - RNA, 32 nt, Human
gccagggagguggcggccagggccaggaugcc

SEQ ID NO: 436559 - RNA, 32 nt, Human
gccagggagguugaggcugcagugagcuauga

SEQ ID NO: 436560 - RNA, 23 nt, Human
gccagggaguuggggacucagag

SEQ ID NO: 436561 - RNA, 32 nt, Human
gccagggauucccuuucccacucugaggcucu

SEQ ID NO: 436562 - RNA, 32 nt, Human
gccagggcaaaaaggcaagcgaaggaaacccu

SEQ ID NO: 436563 - RNA, 32 nt, Human
gccagggcacagaagugcuguaagucugaagc

SEQ ID NO: 436564 - RNA, 29 nt, Human
gccagggcacauuuuaugacaaccucaga

SEQ ID NO: 436565 - RNA, 32 nt, Human
gccagggcaccgugagccuggugguuggcagc

SEQ ID NO: 436566 - RNA, 32 nt, Human
gccagggcacugaccagagcugggaaauuugu

SEQ ID NO: 436567 - RNA, 32 nt, Human
gccagggcagaggccaugccacuuuauggaaa

SEQ ID NO: 436568 - RNA, 19 nt, Human
gccagggcagcuccuuccc

SEQ ID NO: 436569 - RNA, 16 nt, Human
gccagggcaggccccg

SEQ ID NO: 436570 - RNA, 32 nt, Human
gccagggcagggggcagcuaggacggccccgg

SEQ ID NO: 436571 - RNA, 26 nt, Human
gccagggcaucaccuuccuccgcaca

SEQ ID NO: 436572 - RNA, 32 nt, Human
gccagggcaugaucaucaccacugccagccuc

SEQ ID NO: 436573 - RNA, 21 nt, Human
gccagggccacuagcagcacc

SEQ ID NO: 436574 - RNA, 32 nt, Human
gccagggccaucucccuuuaauguguucaugu

SEQ ID NO: 436575 - RNA, 32 nt, Human
gccagggccaugggcggaccucaacccgugag

SEQ ID NO: 436576 - RNA, 20 nt, Human
gccagggcccaggccaggcc

SEQ ID NO: 436577 - RNA, 32 nt, Human
gccagggcccuggguggggagguguggguucc

SEQ ID NO: 436578 - RNA, 32 nt, Human
gccagggccggcggaggcgcgaggagccgggc

SEQ ID NO: 436579 - RNA, 19 nt, Human
gccagggccgggggcucag

SEQ ID NO: 436580 - RNA, 32 nt, Human
gccagggcgagagggccuuucccuugagcuac

SEQ ID NO: 436581 - RNA, 32 nt, Human
gccagggcggaaggggaagccaggaaggcagg

SEQ ID NO: 436582 - RNA, 32 nt, Human
gccagggcuauuaaauaauaacaggaggggcu

SEQ ID NO: 436583 - RNA, 32 nt, Human
gccagggcucagacccagcaauugagguguga

SEQ ID NO: 436584 - RNA, 19 nt, Human
gccagggcuccagggccug

SEQ ID NO: 436585 - RNA, 32 nt, Human
gccagggcugcugccugccagccugggguccc

SEQ ID NO: 436586 - RNA, 15 nt, Human
gccagggcugugaug

SEQ ID NO: 436587 - RNA, 24 nt, Human
gccagggcuguguccagggcucag

SEQ ID NO: 436588 - RNA, 23 nt, Human
gccagggcuuccucucuuccucu

SEQ ID NO: 436589 - RNA, 32 nt, Human
gccagggcuuccucuuccgggcagaaacaaua

SEQ ID NO: 436590 - RNA, 24 nt, Human
gccaggggaaaggaccacaaggca

SEQ ID NO: 436591 - RNA, 32 nt, Human
gccaggggacuggggugggcugagggaacagg

SEQ ID NO: 436592 - RNA, 32 nt, Human
gccaggggaggcauagcagaaagacuggcccc

SEQ ID NO: 436593 - RNA, 32 nt, Human
gccaggggauggggucccacuuugucacccag

SEQ ID NO: 436594 - RNA, 32 nt, Human
gccaggggcaccucccucccacccuucaggcu

SEQ ID NO: 436595 - RNA, 32 nt, Human
gccaggggcagaacacuggggagccagguaua

SEQ ID NO: 436596 - RNA, 32 nt, Human
gccaggggcaggcagcuaggcagggagggggc

SEQ ID NO: 436597 - RNA, 32 nt, Human
gccaggggcagggugggauggggaagaccagg

SEQ ID NO: 436598 - RNA, 32 nt, Human
gccaggggcaguuuuagcagcacuuuugauag

SEQ ID NO: 436599 - RNA, 19 nt, Human
gccaggggccagggcucgg

SEQ ID NO: 436600 - RNA, 32 nt, Human
gccaggggccugcagggugauggcaggcuuug

SEQ ID NO: 436601 - RNA, 32 nt, Human
gccaggggcggacccgggaguccuccgaaggc

SEQ ID NO: 436602 - RNA, 32 nt, Human
gccaggggcuacaggcauauaccaccaugccc

SEQ ID NO: 436603 - RNA, 21 nt, Human
gccaggggcucagccggacca

SEQ ID NO: 436604 - RNA, 32 nt, Human
gccaggggcucccucugcaugggaugugaccc

SEQ ID NO: 436605 - RNA, 32 nt, Human
gccaggggcuggaggaagaggggaaugggaag

SEQ ID NO: 436606 - RNA, 32 nt, Human
gccaggggcuggugggacaguggugacauagu

SEQ ID NO: 436607 - RNA, 32 nt, Human
gccaggggcuucugaccugugcaggugagagu

SEQ ID NO: 436608 - RNA, 32 nt, Human
gccaggggcuuggaaaucaaauucagcucuuc

SEQ ID NO: 436609 - RNA, 32 nt, Human
gccagggggagguggauguggggguauggcac

SEQ ID NO: 436610 - RNA, 18 nt, Human
gccagggggcccucuuca

SEQ ID NO: 436611 - RNA, 32 nt, Human
gccagggggugacuggcacagagcgggccgua

SEQ ID NO: 436612 - RNA, 32 nt, Human
gccagggggugaggaauuagugcuggauuuga

SEQ ID NO: 436613 - RNA, 24 nt, Human
gccaggggucccagcuacucagga

SEQ ID NO: 436614 - RNA, 19 nt, Human
gccaggggugauggaggaa

SEQ ID NO: 436615 - RNA, 22 nt, Human
gccaggggugauucucaccucu

SEQ ID NO: 436616 - RNA, 32 nt, Human
gccagggguuacaccugcccuccguggucccu

SEQ ID NO: 436617 - RNA, 32 nt, Human
gccagggguuacagauccagagccuagggcag

SEQ ID NO: 436618 - RNA, 32 nt, Human
gccaggguccccagggugggagagcggcuccg

SEQ ID NO: 436619 - RNA, 22 nt, Human
gccagggucucucccucaggug

SEQ ID NO: 436620 - RNA, 32 nt, Human
gccagggucugagcucuccagccuguggcauc

SEQ ID NO: 436621 - RNA, 21 nt, Human
gccagggucuguucuugugga

SEQ ID NO: 436622 - RNA, 32 nt, Human
gccagggucuuccuccccaucuuuccauccuu

SEQ ID NO: 436623 - RNA, 20 nt, Human
gccagggugacuucuaccuc

SEQ ID NO: 436624 - RNA, 20 nt, Human
gccagggugccgggaggaag

SEQ ID NO: 436625 - RNA, 32 nt, Human
gccagggugccgggaggaagggacaucucaug

SEQ ID NO: 436626 - RNA, 32 nt, Human
gccagggugcuagauagagggagacucaagga

SEQ ID NO: 436627 - RNA, 20 nt, Human
gccaggguggccgccccagc

SEQ ID NO: 436628 - RNA, 21 nt, Human
gccagggugucaggggcucag

SEQ ID NO: 436629 - RNA, 32 nt, Human
gccagggugugagggauggggagcagcugggc

SEQ ID NO: 436630 - RNA, 20 nt, Human
gccaggguguggcccugcca

SEQ ID NO: 436631 - RNA, 32 nt, Human
gccaggguuccccagccaugaaucucuuccga

SEQ ID NO: 436632 - RNA, 18 nt, Human
gccaggguuuccucuuca

SEQ ID NO: 436633 - RNA, 32 nt, Human
gccagguaaagaggauagguacaggaguauau

SEQ ID NO: 436634 - RNA, 32 nt, Human
gccagguaaccccaggcugaaggggcccugcu

SEQ ID NO: 436635 - RNA, 21 nt, Human
gccagguaaggccuggugagg

SEQ ID NO: 436636 - RNA, 19 nt, Human
gccagguaccaaagcucag

SEQ ID NO: 436637 - RNA, 32 nt, Human
gccagguaccucuaugaggucauggagcagcc

SEQ ID NO: 436638 - RNA, 32 nt, Human
gccagguacuucagaaccucagagcuccccag

SEQ ID NO: 436639 - RNA, 25 nt, Human
gccagguaggcaacacagagccaag

SEQ ID NO: 436640 - RNA, 32 nt, Human
gccaggucaaugcacagacccaggaagagacu

SEQ ID NO: 436641 - RNA, 32 nt, Human
gccaggucacaccaggagggguggggcagggc

SEQ ID NO: 436642 - RNA, 24 nt, Human
gccagguccagagcgccgaggagc

SEQ ID NO: 436643 - RNA, 21 nt, Human
gccagguccaggcccugguga

SEQ ID NO: 436644 - RNA, 32 nt, Human
gccagguccucaaacaccagcugcugcgcguc

SEQ ID NO: 436645 - RNA, 32 nt, Human
gccagguccucaccuguguguacaccagcagg

SEQ ID NO: 436646 - RNA, 32 nt, Human
gccagguccuuauguugucaccauagagcaac

SEQ ID NO: 436647 - RNA, 17 nt, Human
gccaggucuccaccucu

SEQ ID NO: 436648 - RNA, 18 nt, Human
gccaggucucuccucuca

SEQ ID NO: 436649 - RNA, 21 nt, Human
gccaggucuggcgccaggggc

SEQ ID NO: 436650 - RNA, 32 nt, Human
gccaggugaaguuucacacaaucgaagacugc

SEQ ID NO: 436651 - RNA, 31 nt, Human
gccaggugacuuccuccuugcgugagugagg

SEQ ID NO: 436652 - RNA, 31 nt, Human
gccaggugaggaccauuuucacugggaccca

SEQ ID NO: 436653 - RNA, 32 nt, Human
gccaggugaggacccgcuggccccugggccca

SEQ ID NO: 436654 - RNA, 32 nt, Human
gccaggugaggugggagguuggagagccaggu

SEQ ID NO: 436655 - RNA, 32 nt, Human
gccaggugcacagguuggaaaugcacugaacu

SEQ ID NO: 436656 - RNA, 32 nt, Human
gccaggugcagccuggacaacaugaugagauc

SEQ ID NO: 436657 - RNA, 17 nt, Human
gccaggugcagggcuca

SEQ ID NO: 436658 - RNA, 18 nt, Human
gccaggugcaguggcuca

SEQ ID NO: 436659 - RNA, 19 nt, Human
gccaggugcaguggcucag

SEQ ID NO: 436660 - RNA, 20 nt, Human
gccaggugccaaggcuucag

SEQ ID NO: 436661 - RNA, 24 nt, Human
gccaggugccacccucgccucaca

SEQ ID NO: 436662 - RNA, 32 nt, Human
gccaggugccagggacacucuccuucagggaa

SEQ ID NO: 436663 - RNA, 32 nt, Human
gccaggugcccucaccaccaauggcaucaacc

SEQ ID NO: 436664 - RNA, 32 nt, Human
gccaggugcuggaggagguauaugagaaccag

SEQ ID NO: 436665 - RNA, 22 nt, Human
gccaggugcuggcgccgcugcc

SEQ ID NO: 436666 - RNA, 22 nt, Human
gccaggugcuucuggggcucag

SEQ ID NO: 436667 - RNA, 21 nt, Human
gccagguggagagaccuggag

SEQ ID NO: 436668 - RNA, 32 nt, Human
gccagguggaguuuugcucuugucgcccaggc

SEQ ID NO: 436669 - RNA, 32 nt, Human
gccagguggggaggggcuggggaccggccagg

SEQ ID NO: 436670 - RNA, 32 nt, Human
gccaggugggguggacugggcguggugguccu

SEQ ID NO: 436671 - RNA, 31 nt, Human
gccagguggguggagggagggagaucaugag

SEQ ID NO: 436672 - RNA, 32 nt, Human
gccagguguacucugcgccccacgcuggaaaa

SEQ ID NO: 436673 - RNA, 18 nt, Human
gccagguguccucuugca

SEQ ID NO: 436674 - RNA, 18 nt, Human
gccaggugugcagggcca

SEQ ID NO: 436675 - RNA, 21 nt, Human
gccagguguugccggacccag

SEQ ID NO: 436676 - RNA, 32 nt, Human
gccagguuaaugacauucaauucuaaaugaua

SEQ ID NO: 436677 - RNA, 21 nt, Human
gccagguucaugccuguaauc

SEQ ID NO: 436678 - RNA, 32 nt, Human
gccagguuccuggaccagcccagcugccccca

SEQ ID NO: 436679 - RNA, 32 nt, Human
gccagguuccuugcccuccccaccccauccca

SEQ ID NO: 436680 - RNA, 32 nt, Human
gccagguugcagcugcucuugcaucugggcca

SEQ ID NO: 436681 - RNA, 24 nt, Human
gccagguugcuaagaaaccaggag

SEQ ID NO: 436682 - RNA, 22 nt, Human
gccagguuggcggccggggcuc

SEQ ID NO: 436683 - RNA, 32 nt, Human
gccagguugguggcgcaugccuguaaucccag

SEQ ID NO: 436684 - RNA, 32 nt, Human
gccagguuucacugcagccugcccgaggcuaa

SEQ ID NO: 436685 - RNA, 20 nt, Human
gccagguuugcuuccaccuu

SEQ ID NO: 436686 - RNA, 32 nt, Human
gccagguuuucuggguguccaaaggaagacgu

SEQ ID NO: 436687 - RNA, 23 nt, Human
gccagguuuugcaggccgggcca

SEQ ID NO: 436688 - RNA, 32 nt, Human
gccaguaagaaagugacagaagcaaugaaugu

SEQ ID NO: 436689 - RNA, 32 nt, Human
gccaguacacagagaagcugaggaaauaauac

SEQ ID NO: 436690 - RNA, 32 nt, Human
gccaguacacgcaggaaacuauggcugagcac

SEQ ID NO: 436691 - RNA, 32 nt, Human
gccaguaccccacagagacagccggaaggacu

SEQ ID NO: 436692 - RNA, 32 nt, Human
gccaguaccuaccuggcugcaggaugaagcug

SEQ ID NO: 436693 - RNA, 32 nt, Human
gccaguacuccugcucugcuaacccugcgugc

SEQ ID NO: 436694 - RNA, 24 nt, Human
gccaguagccccagcuacuuggga

SEQ ID NO: 436695 - RNA, 32 nt, Human
gccaguagcugagacgccaccucugccacagg

SEQ ID NO: 436696 - RNA, 32 nt, Human
gccaguaggaguuuccggaaggaguuugaauu

SEQ ID NO: 436697 - RNA, 24 nt, Human
gccaguagggggccaggccuccca

SEQ ID NO: 436698 - RNA, 32 nt, Human
gccaguagguagucccagcuacucgagguugc

SEQ ID NO: 436699 - RNA, 24 nt, Human
gccaguagucccagcuacuuggga

SEQ ID NO: 436700 - RNA, 21 nt, Human
gccaguaucuuccucaccucu

SEQ ID NO: 436701 - RNA, 32 nt, Human
gccaguaucuugauuuuggauuucucaaccuc

SEQ ID NO: 436702 - RNA, 32 nt, Human
gccaguaugccaguuugaauucucagucuccu

SEQ ID NO: 436703 - RNA, 18 nt, Human
gccagucaaccacaaggc

SEQ ID NO: 436704 - RNA, 19 nt, Human
gccagucaacccacuguuc

SEQ ID NO: 436705 - RNA, 25 nt, Human
gccagucaacuuccuggaauccaag

SEQ ID NO: 436706 - RNA, 21 nt, Human
gccagucaaggccacccagga

SEQ ID NO: 436707 - RNA, 32 nt, Human
gccagucaagggcagugggaucucgauggagc

SEQ ID NO: 436708 - RNA, 21 nt, Human
gccagucacagacccauucua

SEQ ID NO: 436709 - RNA, 32 nt, Human
gccagucacaugcaucacagccugcauuaauu

SEQ ID NO: 436710 - RNA, 22 nt, Human
gccagucaccaccaccauccua

SEQ ID NO: 436711 - RNA, 32 nt, Human
gccagucaccagcccucugccugcagccaugg

SEQ ID NO: 436712 - RNA, 32 nt, Human
gccagucaccucuuugucucucucuucuuucu

SEQ ID NO: 436713 - RNA, 32 nt, Human
gccagucaccuuggcuacccacuguggacagc

SEQ ID NO: 436714 - RNA, 32 nt, Human
gccagucagcaaccuguaacucacauucucuu

SEQ ID NO: 436715 - RNA, 32 nt, Human
gccagucaggacuuuugcuauugcaaauagaa

SEQ ID NO: 436716 - RNA, 32 nt, Human
gccagucaggguccaagagcccaucagucucc

SEQ ID NO: 436717 - RNA, 21 nt, Human
gccagucaggugcccagaggg

SEQ ID NO: 436718 - RNA, 17 nt, Human
gccagucauagcaguuc

SEQ ID NO: 436719 - RNA, 19 nt, Human
gccagucaugacagcucug

SEQ ID NO: 436720 - RNA, 32 nt, Human
gccagucaugggaggcagagcugggggagcga

SEQ ID NO: 436721 - RNA, 32 nt, Human
gccaguccagcccaggcggggagagaugugua

SEQ ID NO: 436722 - RNA, 32 nt, Human
gccaguccagccgccccucgcccggugccuag

SEQ ID NO: 436723 - RNA, 32 nt, Human
gccaguccauuucucaaccuuaaauuucagac

SEQ ID NO: 436724 - RNA, 32 nt, Human
gccagucccaaguacagcugucccuuuguauc

SEQ ID NO: 436725 - RNA, 23 nt, Human
gccagucccaccgccgccgccgc

SEQ ID NO: 436726 - RNA, 32 nt, Human
gccaguccccauuggcugacagugccaccugg

SEQ ID NO: 436727 - RNA, 19 nt, Human
gccaguccccgccccgacu

SEQ ID NO: 436728 - RNA, 26 nt, Human
gccagucccgaaccauggccgggcca

SEQ ID NO: 436729 - RNA, 32 nt, Human
gccagucccucguugcaggacagggucaucau

SEQ ID NO: 436730 - RNA, 17 nt, Human
gccagucccuguccccu

SEQ ID NO: 436731 - RNA, 32 nt, Human
gccaguccggucccaggucccuugucccuucc

SEQ ID NO: 436732 - RNA, 32 nt, Human
gccaguccgugucccuccgccuccaggagggg

SEQ ID NO: 436733 - RNA, 32 nt, Human
gccaguccuccccuuuuugugugcuaccucau

SEQ ID NO: 436734 - RNA, 32 nt, Human
gccaguccucugcauguucugcucuugugccc

SEQ ID NO: 436735 - RNA, 21 nt, Human
gccaguccugcacccaccucu

SEQ ID NO: 436736 - RNA, 32 nt, Human
gccaguccugccggaagauggucaacgaccgg

SEQ ID NO: 436737 - RNA, 32 nt, Human
gccagucgcuccuggcaccauggacgaugcca

SEQ ID NO: 436738 - RNA, 32 nt, Human
gccagucggcgccgcgcggagcuggccgcugg

SEQ ID NO: 436739 - RNA, 32 nt, Human
gccagucgugcacccacccccacguccacccg

SEQ ID NO: 436740 - RNA, 32 nt, Human
gccagucguuuuucggaaagcuggcagcggcu

SEQ ID NO: 436741 - RNA, 24 nt, Human
gccagucucaaacuccuggacuca

SEQ ID NO: 436742 - RNA, 32 nt, Human
gccagucucacugcgcccucuccuccaaccuc

SEQ ID NO: 436743 - RNA, 32 nt, Human
gccagucucauggguagauaguggugcagugc

SEQ ID NO: 436744 - RNA, 32 nt, Human
gccagucucccaggcccccugcaucuaucgag

SEQ ID NO: 436745 - RNA, 32 nt, Human
gccagucucuccccacugcuccuaagauccug

SEQ ID NO: 436746 - RNA, 32 nt, Human
gccagucugcauucccacgccaucccaaagcc

SEQ ID NO: 436747 - RNA, 18 nt, Human
gccagucugccaccaccc

SEQ ID NO: 436748 - RNA, 32 nt, Human
gccagucugccuucccccaaccccguguccug

SEQ ID NO: 436749 - RNA, 32 nt, Human
gccagucuuauccugaauuccucagagcaguc

SEQ ID NO: 436750 - RNA, 32 nt, Human
gccagucuuccucuuagccucuggaucuagaa

SEQ ID NO: 436751 - RNA, 32 nt, Human
gccagucuuccugaucuccaucuuucugcccu

SEQ ID NO: 436752 - RNA, 24 nt, Human
gccagucuugaacuccugagcuca

SEQ ID NO: 436753 - RNA, 32 nt, Human
gccagucuugaccccaauacaggggcuggaua

SEQ ID NO: 436754 - RNA, 20 nt, Human
gccagugaaauccucaggug

SEQ ID NO: 436755 - RNA, 16 nt, Human
gccagugaaccuugga

SEQ ID NO: 436756 - RNA, 32 nt, Human
gccagugaacgucuuggugugugcacacauuu

SEQ ID NO: 436757 - RNA, 32 nt, Human
gccagugaacugucaccuucucuucaucacag

SEQ ID NO: 436758 - RNA, 32 nt, Human
gccagugaaugacaggcuuugaggagcuucuc

SEQ ID NO: 436759 - RNA, 32 nt, Human
gccagugaaugugaaggaaacuccccuccuuc

SEQ ID NO: 436760 - RNA, 32 nt, Human
gccagugaccuccuuuugaaggggacauugga

SEQ ID NO: 436761 - RNA, 32 nt, Human
gccagugacucuguccucuguacagcaggcuc

SEQ ID NO: 436762 - RNA, 32 nt, Human
gccagugacuuauuccagagugccucaguuag

SEQ ID NO: 436763 - RNA, 32 nt, Human
gccagugagcccagugugcuugagugucucug

SEQ ID NO: 436764 - RNA, 32 nt, Human
gccagugagccugcggggaggcugguccaagg

SEQ ID NO: 436765 - RNA, 32 nt, Human
gccagugagcuaggguggaggggcuguguuua

SEQ ID NO: 436766 - RNA, 32 nt, Human
gccagugagcuucuaccaucauggaccuauug

SEQ ID NO: 436767 - RNA, 32 nt, Human
gccagugagcuucucguacuuucuuucuuuuu

SEQ ID NO: 436768 - RNA, 32 nt, Human
gccagugagguggcaucuugggaagacauggc

SEQ ID NO: 436769 - RNA, 19 nt, Human
gccagugauggccucgccc

SEQ ID NO: 436770 - RNA, 32 nt, Human
gccagugauuucauaugaaagaugcaugccuc

SEQ ID NO: 436771 - RNA, 32 nt, Human
gccagugcaagaccgagacugagggaaagcau

SEQ ID NO: 436772 - RNA, 32 nt, Human
gccagugcaagaccgagauugagggaaagcau

SEQ ID NO: 436773 - RNA, 32 nt, Human
gccagugcacccccacucccacccucaaccgc

SEQ ID NO: 436774 - RNA, 32 nt, Human
gccagugcacuccagccugggugacagcgaga

SEQ ID NO: 436775 - RNA, 32 nt, Human
gccagugcacuccggccugggugacagaguga

SEQ ID NO: 436776 - RNA, 32 nt, Human
gccagugcaguggcucacaccuguaaucucag

SEQ ID NO: 436777 - RNA, 32 nt, Human
gccagugccacuccuagccagcgccagugcgu

SEQ ID NO: 436778 - RNA, 32 nt, Human
gccagugccagccuggccaaccucacuuguga

SEQ ID NO: 436779 - RNA, 32 nt, Human
gccagugccauuuugauaucaaucucaacuuu

SEQ ID NO: 436780 - RNA, 32 nt, Human
gccagugccuggcaugugucccagggacaagc

SEQ ID NO: 436781 - RNA, 18 nt, Human
gccagugccuguguacuc

SEQ ID NO: 436782 - RNA, 32 nt, Human
gccagugcgcacuacugggccugguggccacc

SEQ ID NO: 436783 - RNA, 22 nt, Human
gccagugcuaguucugacccaa

SEQ ID NO: 436784 - RNA, 32 nt, Human
gccagugcuccuggugucuccaccugccuggg

SEQ ID NO: 436785 - RNA, 32 nt, Human
gccagugcugaggagguuggagagagaaaggg

SEQ ID NO: 436786 - RNA, 32 nt, Human
gccagugcugugcagagcucauuuaaauguau

SEQ ID NO: 436787 - RNA, 32 nt, Human
gccagugcuuuagagcaacuucccgcaaauca

SEQ ID NO: 436788 - RNA, 32 nt, Human
gccaguggacucaggguuguugagaggaguca

SEQ ID NO: 436789 - RNA, 32 nt, Human
gccaguggcccagggugugugcagggcagcuc

SEQ ID NO: 436790 - RNA, 32 nt, Human
gccaguggcgacaucaaagacaggaagggguc

SEQ ID NO: 436791 - RNA, 32 nt, Human
gccaguggcgccugccaggagugaguccaugc

SEQ ID NO: 436792 - RNA, 32 nt, Human
gccaguggcgucgcggccacccugccgggcuc

SEQ ID NO: 436793 - RNA, 21 nt, Human
gccaguggcuccauggacuca

SEQ ID NO: 436794 - RNA, 32 nt, Human
gccaguggcuguggaacaguccugggcccugg

SEQ ID NO: 436795 - RNA, 32 nt, Human
gccaguggcuuccugaacgugccucugcgaag

SEQ ID NO: 436796 - RNA, 32 nt, Human
gccaguggcuuggaaauggucacccacaaauc

SEQ ID NO: 436797 - RNA, 21 nt, Human
gccagugggaaggggcaccgg

SEQ ID NO: 436798 - RNA, 32 nt, Human
gccagugggaggagggaggggccaggcagcug

SEQ ID NO: 436799 - RNA, 32 nt, Human
gccagugggaggaggggcagggcagggcugua

SEQ ID NO: 436800 - RNA, 32 nt, Human
gccagugggaguagccugucuguucuggcaca

SEQ ID NO: 436801 - RNA, 32 nt, Human
gccagugggcagguggacgcucugcugagaca

SEQ ID NO: 436802 - RNA, 32 nt, Human
gccagugggccagccacagagcaaaagagggu

SEQ ID NO: 436803 - RNA, 32 nt, Human
gccaguggucucagaccugccaccccacagcc

SEQ ID NO: 436804 - RNA, 32 nt, Human
gccagugguggagguggguguuugggaaaggc

SEQ ID NO: 436805 - RNA, 32 nt, Human
gccagugguggggcacacggacggcacgcugu

SEQ ID NO: 436806 - RNA, 32 nt, Human
gccaguguacgugccauuucucuuccacuaug

SEQ ID NO: 436807 - RNA, 32 nt, Human
gccagugucaggccucugccucugggccuuug

SEQ ID NO: 436808 - RNA, 32 nt, Human
gccagugucauccucuuuggaaccaacaauau

SEQ ID NO: 436809 - RNA, 32 nt, Human
gccaguguccaccacagcucugccugcccuuc

SEQ ID NO: 436810 - RNA, 32 nt, Human
gccaguguccagccccaccaaggggccuccag

SEQ ID NO: 436811 - RNA, 32 nt, Human
gccaguguccccagcacuuuuaggucauuugg

SEQ ID NO: 436812 - RNA, 32 nt, Human
gccagugucuguucauugccucugccuugccc

SEQ ID NO: 436813 - RNA, 22 nt, Human
gccagugugggcaagggcucag

SEQ ID NO: 436814 - RNA, 32 nt, Human
gccaguguggugucuugcgccuguacucccag

SEQ ID NO: 436815 - RNA, 32 nt, Human
gccagugugugaggacagcuucagccaggagg

SEQ ID NO: 436816 - RNA, 32 nt, Human
gccagugugugcucaccaugcccacccucagu

SEQ ID NO: 436817 - RNA, 32 nt, Human
gccaguguucuaacaaacuaaacucuucaaau

SEQ ID NO: 436818 - RNA, 32 nt, Human
gccaguguugugggcuuccugcugggacugag

SEQ ID NO: 436819 - RNA, 32 nt, Human
gccaguguuguuuccagccucaggccacgggc

SEQ ID NO: 436820 - RNA, 32 nt, Human
gccaguguuucccagcccagaguuuacugacu

SEQ ID NO: 436821 - RNA, 32 nt, Human
gccaguguuuuuaagacagaauacuacuugca

SEQ ID NO: 436822 - RNA, 32 nt, Human
gccaguuaaagaaggucacagaggaggaauga

SEQ ID NO: 436823 - RNA, 21 nt, Human
gccaguuaguucucagcugag

SEQ ID NO: 436824 - RNA, 18 nt, Human
gccaguucauuccacccu

SEQ ID NO: 436825 - RNA, 31 nt, Human
gccaguucauuucagcaugcucuuucaacca

SEQ ID NO: 436826 - RNA, 32 nt, Human
gccaguucauuucagcaugcucuuucaaccag

SEQ ID NO: 436827 - RNA, 32 nt, Human
gccaguucccuacagccauccccagucaaggg

SEQ ID NO: 436828 - RNA, 18 nt, Human
gccaguuccucuuugaua

SEQ ID NO: 436829 - RNA, 32 nt, Human
gccaguuccugccuguugccucuugugagcuc

SEQ ID NO: 436830 - RNA, 32 nt, Human
gccaguuccuggaagguccugguugacagcga

SEQ ID NO: 436831 - RNA, 32 nt, Human
gccaguucuagccccuguccucuuagauauau

SEQ ID NO: 436832 - RNA, 32 nt, Human
gccaguucuccagcacugagguggggcagaua

SEQ ID NO: 436833 - RNA, 32 nt, Human
gccaguucuccucuucucucuaauccauccgu

SEQ ID NO: 436834 - RNA, 32 nt, Human
gccaguugaaacaccacucugaucaggaugug

SEQ ID NO: 436835 - RNA, 32 nt, Human
gccaguugccagggcaagucacugcgcuggga

SEQ ID NO: 436836 - RNA, 32 nt, Human
gccaguugcccaacucuuccagaagagagacu

SEQ ID NO: 436837 - RNA, 18 nt, Human
gccaguugccuccaccuc

SEQ ID NO: 436838 - RNA, 32 nt, Human
gccaguuggcccaggccccuggcagugcuccc

SEQ ID NO: 436839 - RNA, 32 nt, Human
gccaguuggcuucugugccugacucugugcug

SEQ ID NO: 436840 - RNA, 32 nt, Human
gccaguugggagaggagcagagccaggccggu

SEQ ID NO: 436841 - RNA, 32 nt, Human
gccaguugggcuguguuaaaggaagcaguguu

SEQ ID NO: 436842 - RNA, 32 nt, Human
gccaguugguccggguacaaggagaacacuau

SEQ ID NO: 436843 - RNA, 32 nt, Human
gccaguugugagcuugcauuugagugcaugug

SEQ ID NO: 436844 - RNA, 32 nt, Human
gccaguuucacccucuggagugguuggcaagg

SEQ ID NO: 436845 - RNA, 22 nt, Human
gccaguuucagauuuacucuga

SEQ ID NO: 436846 - RNA, 32 nt, Human
gccaguuucuucagauaaguacccccaccucu

SEQ ID NO: 436847 - RNA, 32 nt, Human
gccaguuugaaguagaucuguaccaaaaugaa

SEQ ID NO: 436848 - RNA, 32 nt, Human
gccaguuuggaggcaggcguugagcugugcac

SEQ ID NO: 436849 - RNA, 26 nt, Human
gccaguuuguucucucagaacccaga

SEQ ID NO: 436850 - RNA, 32 nt, Human
gccaguuuucuucccuccuugcuauuaaagcc

SEQ ID NO: 436851 - RNA, 32 nt, Human
gccaguuuuggccugugagcucacuggccuca

SEQ ID NO: 436852 - RNA, 32 nt, Human
gccauaaaaagaauccucugaccuaccuuguc

SEQ ID NO: 436853 - RNA, 32 nt, Human
gccauaaaaccacucaucacacuacugaaaga

SEQ ID NO: 436854 - RNA, 32 nt, Human
gccauaaaagagacacuuuccugcugguggua

SEQ ID NO: 436855 - RNA, 32 nt, Human
gccauaaaguuaaaauagaggccaggcgcggu

SEQ ID NO: 436856 - RNA, 32 nt, Human
gccauaaaugggcuccagggcucuggaucuca

SEQ ID NO: 436857 - RNA, 21 nt, Human
gccauaacaaaauaccaucaa

SEQ ID NO: 436858 - RNA, 32 nt, Human
gccauaaccauucuguuccuuuacagaacuaa

SEQ ID NO: 436859 - RNA, 32 nt, Human
gccauaaccugacaauagugcccacaccuuaa

SEQ ID NO: 436860 - RNA, 32 nt, Human
gccauaacucagacccacugaccaacagggcc

SEQ ID NO: 436861 - RNA, 22 nt, Human
gccauaacuuuucucuugcaga

SEQ ID NO: 436862 - RNA, 32 nt, Human
gccauaaggggaaacuuaauucugcuaaauua

SEQ ID NO: 436863 - RNA, 19 nt, Human
gccauaagugguccaggga

SEQ ID NO: 436864 - RNA, 32 nt, Human
gccauaaucccccuaggaauauaacucaacug

SEQ ID NO: 436865 - RNA, 32 nt, Human
gccauaaugaacuguaguacauggacaauaag

SEQ ID NO: 436866 - RNA, 32 nt, Human
gccauacacacagcaggauuagacggggagag

SEQ ID NO: 436867 - RNA, 21 nt, Human
gccauacauuuuauccucaug

SEQ ID NO: 436868 - RNA, 32 nt, Human
gccauaccauuuuaaaaguaguaagaguuugc

SEQ ID NO: 436869 - RNA, 32 nt, Human
gccauacccacugccccagaccagugcagcca

SEQ ID NO: 436870 - RNA, 32 nt, Human
gccauacccauguccaggugggcacaggccug

SEQ ID NO: 436871 - RNA, 32 nt, Human
gccauaccguguacccuagguaugguggcuac

SEQ ID NO: 436872 - RNA, 32 nt, Human
gccauaccuggaccccgaggagccugcuugcu

SEQ ID NO: 436873 - RNA, 19 nt, Human
gccauacguauuccccucu

SEQ ID NO: 436874 - RNA, 32 nt, Human
gccauacuagucuuugccgccugcgaagcagc

SEQ ID NO: 436875 - RNA, 20 nt, Human
gccauacuccuacaaacuua

SEQ ID NO: 436876 - RNA, 18 nt, Human
gccauacucuggcugccu

SEQ ID NO: 436877 - RNA, 19 nt, Human
gccauacucuguuccagcu

SEQ ID NO: 436878 - RNA, 19 nt, Human
gccauacugccacccagaa

SEQ ID NO: 436879 - RNA, 19 nt, Human
gccauacugcuaguuaacc

SEQ ID NO: 436880 - RNA, 32 nt, Human
gccauacuucuguuuccaucugcugggccacc

SEQ ID NO: 436881 - RNA, 32 nt, Human
gccauagaaauguagguccucagaaaguguau

SEQ ID NO: 436882 - RNA, 32 nt, Human
gccauagaccuuccugggcuucucccuggggc

SEQ ID NO: 436883 - RNA, 32 nt, Human
gccauagagccuggccuggccccuggccuugg

SEQ ID NO: 436884 - RNA, 32 nt, Human
gccauagaggaagugaaaugccuccacggcug

SEQ ID NO: 436885 - RNA, 32 nt, Human
gccauagaggagagaggucuugagggguggga

SEQ ID NO: 436886 - RNA, 32 nt, Human
gccauagcaauugcacuccggccugggcaaca

SEQ ID NO: 436887 - RNA, 21 nt, Human
gccauagcacccagcccagaa

SEQ ID NO: 436888 - RNA, 21 nt, Human
gccauagccagaaaggacaga

SEQ ID NO: 436889 - RNA, 32 nt, Human
gccauagccuucucuucucaggcguggacugc

SEQ ID NO: 436890 - RNA, 32 nt, Human
gccauagggcugggagagaagcauugcacucu

SEQ ID NO: 436891 - RNA, 32 nt, Human
gccauagggggaccagcuucugccagaaguug

SEQ ID NO: 436892 - RNA, 32 nt, Human
gccauagucaagcccagcagguuuccucagga

SEQ ID NO: 436893 - RNA, 22 nt, Human
gccauaguggaagcugugguca

SEQ ID NO: 436894 - RNA, 32 nt, Human
gccauaguggcugucaucccagcacuuuagga

SEQ ID NO: 436895 - RNA, 32 nt, Human
gccauaguuaauaacauuaacacuucaauagc

SEQ ID NO: 436896 - RNA, 32 nt, Human
gccauaguuucucaagugacuaaaguaguuau

SEQ ID NO: 436897 - RNA, 32 nt, Human
gccauauaaugguguguuuucuuaauuuuguu

SEQ ID NO: 436898 - RNA, 32 nt, Human
gccauauacaucuuuucuugucuccauaaucc

SEQ ID NO: 436899 - RNA, 26 nt, Human
gccauauauuuuaaugugcuugcaug

SEQ ID NO: 436900 - RNA, 32 nt, Human
gccauaucaccugucaggauuucagcuucccu

SEQ ID NO: 436901 - RNA, 32 nt, Human
gccauaucagaagacauuggaaagagggauuc

SEQ ID NO: 436902 - RNA, 32 nt, Human
gccauaucagaagacauuggaaagagggauuu

SEQ ID NO: 436903 - RNA, 32 nt, Human
gccauaucccaauacguguagggcgagggucc

SEQ ID NO: 436904 - RNA, 32 nt, Human
gccauauccuacagauccucccauuucuaggg

SEQ ID NO: 436905 - RNA, 32 nt, Human
gccauauuccuuuaagaugauguaauagucau

SEQ ID NO: 436906 - RNA, 24 nt, Human
gccauauugacugggcuggucuca

SEQ ID NO: 436907 - RNA, 24 nt, Human
gccauauuggccuggcugaucuca

SEQ ID NO: 436908 - RNA, 32 nt, Human
gccauauuuaaaccacaguucuccacgccacc

SEQ ID NO: 436909 - RNA, 18 nt, Human
gccauauuucagcuacug

SEQ ID NO: 436910 - RNA, 18 nt, Human
gccaucaaaugcccagga

SEQ ID NO: 436911 - RNA, 19 nt, Human
gccaucaaccuggcugcug

SEQ ID NO: 436912 - RNA, 32 nt, Human
gccaucaaggagggcaaggcagcccagacuga

SEQ ID NO: 436913 - RNA, 32 nt, Human
gccaucaauuuugccuuugaaauuucuuuugu

SEQ ID NO: 436914 - RNA, 32 nt, Human
gccaucacacugcagccuaggugacagagcga

SEQ ID NO: 436915 - RNA, 32 nt, Human
gccaucacaggcucugcauacacaugcacuca

SEQ ID NO: 436916 - RNA, 18 nt, Human
gccaucacauucaccucu

SEQ ID NO: 436917 - RNA, 21 nt, Human
gccaucacauugucacccaga

SEQ ID NO: 436918 - RNA, 18 nt, Human
gccaucaccaccucggaa

SEQ ID NO: 436919 - RNA, 20 nt, Human
gccaucaccagccacagaga

SEQ ID NO: 436920 - RNA, 32 nt, Human
gccaucaccagcuggccagggcauggccuauu

SEQ ID NO: 436921 - RNA, 32 nt, Human
gccaucaccaucagccccaggagcucaggugg

SEQ ID NO: 436922 - RNA, 18 nt, Human
gccaucaccaugugagaa

SEQ ID NO: 436923 - RNA, 18 nt, Human
gccaucaccauuccagag

SEQ ID NO: 436924 - RNA, 17 nt, Human
gccaucacccccuccag

SEQ ID NO: 436925 - RNA, 20 nt, Human
gccaucacccggcaucagag

SEQ ID NO: 436926 - RNA, 18 nt, Human
gccaucacccugucagga

SEQ ID NO: 436927 - RNA, 19 nt, Human
gccaucaccuaauccaaga

SEQ ID NO: 436928 - RNA, 21 nt, Human
gccaucaccuagcugccugaa

SEQ ID NO: 436929 - RNA, 32 nt, Human
gccaucaccugugccagcacugugcagcugau

SEQ ID NO: 436930 - RNA, 19 nt, Human
gccaucacguaucccugaa

SEQ ID NO: 436931 - RNA, 32 nt, Human
gccaucacuaacggauccccagcgucugucua

SEQ ID NO: 436932 - RNA, 18 nt, Human
gccaucacuaccaaccag

SEQ ID NO: 436933 - RNA, 32 nt, Human
gccaucacucaaggacuucucuccaggccccg

SEQ ID NO: 436934 - RNA, 32 nt, Human
gccaucacucacugccaccugggccaucaacu

SEQ ID NO: 436935 - RNA, 18 nt, Human
gccaucacugccagucag

SEQ ID NO: 436936 - RNA, 16 nt, Human
gccaucacugcccagg

SEQ ID NO: 436937 - RNA, 20 nt, Human
gccaucacugcuggacagga

SEQ ID NO: 436938 - RNA, 20 nt, Human
gccaucacugcuuggaagag

SEQ ID NO: 436939 - RNA, 19 nt, Human
gccaucacugucacaagaa

SEQ ID NO: 436940 - RNA, 32 nt, Human
gccaucacuguuuucuccuaugaaggacacaa

SEQ ID NO: 436941 - RNA, 18 nt, Human
gccaucacuuuuucagga

SEQ ID NO: 436942 - RNA, 32 nt, Human
gccaucagagagaguguauguucacccuaucu

SEQ ID NO: 436943 - RNA, 24 nt, Human
gccaucagcagaaagagacccuga

SEQ ID NO: 436944 - RNA, 20 nt, Human
gccaucagcaucacaaggca

SEQ ID NO: 436945 - RNA, 23 nt, Human
gccaucagcugcacagcccucca

SEQ ID NO: 436946 - RNA, 21 nt, Human
gccaucaggccccacccagga

SEQ ID NO: 436947 - RNA, 17 nt, Human
gccaucaggcucccaga

SEQ ID NO: 436948 - RNA, 32 nt, Human
gccaucaggguguauuggaggcugacacuuaa

SEQ ID NO: 436949 - RNA, 32 nt, Human
gccaucaguuccauccugacugcuuguuaaga

SEQ ID NO: 436950 - RNA, 32 nt, Human
gccaucauauccaccuauuugcagccuaacuu

SEQ ID NO: 436951 - RNA, 18 nt, Human
gccaucaucaaccaagaa

SEQ ID NO: 436952 - RNA, 32 nt, Human
gccaucaucacuuuuugaauuucuuugggggu

SEQ ID NO: 436953 - RNA, 32 nt, Human
gccaucaucccucccagccuauuucugcuccu

SEQ ID NO: 436954 - RNA, 20 nt, Human
gccaucaucuccccaccucu

SEQ ID NO: 436955 - RNA, 32 nt, Human
gccaucaucugcaaaagggaggaaagaaugcc

SEQ ID NO: 436956 - RNA, 32 nt, Human
gccaucaugaggaaucaaugagagaucuguga

SEQ ID NO: 436957 - RNA, 32 nt, Human
gccaucaugcacaucugacugcagccccagcg

SEQ ID NO: 436958 - RNA, 31 nt, Human
gccaucaugcaugcuuuugaaaacuuagaga

SEQ ID NO: 436959 - RNA, 32 nt, Human
gccaucaugccugacuaauuuuguauuuuuag

SEQ ID NO: 436960 - RNA, 32 nt, Human
gccaucaugccugacuaauuuuuguauuuuua

SEQ ID NO: 436961 - RNA, 32 nt, Human
gccaucaugccuggcuaauuuuuguauuuuua

SEQ ID NO: 436962 - RNA, 32 nt, Human
gccauccaacuggguccaguucugauggcauu

SEQ ID NO: 436963 - RNA, 32 nt, Human
gccauccaagacaucugcauccuaaucccugg

SEQ ID NO: 436964 - RNA, 32 nt, Human
gccauccaaguugccccuacuuaguggcuugc

SEQ ID NO: 436965 - RNA, 22 nt, Human
gccauccacagcccacccauca

SEQ ID NO: 436966 - RNA, 26 nt, Human
gccauccaccccuucucuucauccuu

SEQ ID NO: 436967 - RNA, 32 nt, Human
gccauccacccuacugguuaucugauagaaca

SEQ ID NO: 436968 - RNA, 32 nt, Human
gccauccacugcagacgccuggagagggacag

SEQ ID NO: 436969 - RNA, 32 nt, Human
gccauccagacccuggaugagaaugacaaugc

SEQ ID NO: 436970 - RNA, 32 nt, Human
gccauccagagggagugcagggcgcacagucu

SEQ ID NO: 436971 - RNA, 17 nt, Human
gccauccagcacccaga

SEQ ID NO: 436972 - RNA, 32 nt, Human
gccauccagccgugccccagccuggaccccug

SEQ ID NO: 436973 - RNA, 19 nt, Human
gccauccaggccggcugcu

SEQ ID NO: 436974 - RNA, 19 nt, Human
gccauccauccauccaucc

SEQ ID NO: 436975 - RNA, 32 nt, Human
gccauccauccauuugauagguuuugcaaaga

SEQ ID NO: 436976 - RNA, 32 nt, Human
gccauccaugccaucccugccugugccuagau

SEQ ID NO: 436977 - RNA, 26 nt, Human
gccauccauuaccuccauccauccuu

SEQ ID NO: 436978 - RNA, 19 nt, Human
gccauccauuccuccaucc

SEQ ID NO: 436979 - RNA, 32 nt, Human
gccaucccagccacagucguccagggaaacgg

SEQ ID NO: 436980 - RNA, 32 nt, Human
gccaucccauagcuccuccucuucuggcugcc

SEQ ID NO: 436981 - RNA, 32 nt, Human
gccaucccauguuguaaacagcuguuccaaag

SEQ ID NO: 436982 - RNA, 32 nt, Human
gccauccccacuuccuccucuaccccaacaca

SEQ ID NO: 436983 - RNA, 32 nt, Human
gccaucccccuucgacuguuuucccaccauaa

SEQ ID NO: 436984 - RNA, 32 nt, Human
gccaucccccuucugugugucccucuccccca

SEQ ID NO: 436985 - RNA, 32 nt, Human
gccauccccucagaacuggaggagccaauuaa

SEQ ID NO: 436986 - RNA, 32 nt, Human
gccauccccugcccccucccaggcugaagauc

SEQ ID NO: 436987 - RNA, 32 nt, Human
gccauccccugccugccaccugccccucggcu

SEQ ID NO: 436988 - RNA, 19 nt, Human
gccaucccgccuuuccucc

SEQ ID NO: 436989 - RNA, 32 nt, Human
gccaucccugcacuugagcucaggggcucagg

SEQ ID NO: 436990 - RNA, 32 nt, Human
gccaucccugcuccuuuggggccucauuagug

SEQ ID NO: 436991 - RNA, 32 nt, Human
gccaucccugggcugcucacaggaaguagcug

SEQ ID NO: 436992 - RNA, 32 nt, Human
gccaucccuucauuuaaccaagcuauucaagu

SEQ ID NO: 436993 - RNA, 32 nt, Human
gccauccgcugcggcuacucuccagggccaca

SEQ ID NO: 436994 - RNA, 20 nt, Human
gccauccgcuggcuuggcca

SEQ ID NO: 436995 - RNA, 32 nt, Human
gccauccgcuugguggaggucgagugggugca

SEQ ID NO: 436996 - RNA, 32 nt, Human
gccauccgggcauguggccacacugcucacca

SEQ ID NO: 436997 - RNA, 32 nt, Human
gccauccgucacugcacucaugccucccucug

SEQ ID NO: 436998 - RNA, 19 nt, Human
gccauccuaggugccaucc

SEQ ID NO: 436999 - RNA, 21 nt, Human
gccauccuccccgccuugggg

SEQ ID NO: 437000 - RNA, 32 nt, Human
gccauccucccgcuuccggaggagcgcagauc

SEQ ID NO: 437001 - RNA, 32 nt, Human
gccauccuccugccucagcuacucaggagaau

SEQ ID NO: 437002 - RNA, 32 nt, Human
gccauccucucaccccagaauauccuaauaaa

SEQ ID NO: 437003 - RNA, 32 nt, Human
gccauccugaggacacagccaggacggcagag

SEQ ID NO: 437004 - RNA, 32 nt, Human
gccauccugcaagcuccacagccucgggcugc

SEQ ID NO: 437005 - RNA, 32 nt, Human
gccauccugcagcagguccgcauccaggagau

SEQ ID NO: 437006 - RNA, 22 nt, Human
gccauccugcccagcugcccca

SEQ ID NO: 437007 - RNA, 32 nt, Human
gccauccugccugcccugagccgcugcuuuga

SEQ ID NO: 437008 - RNA, 32 nt, Human
gccauccugccuggcacuggcugaugggcacc

SEQ ID NO: 437009 - RNA, 32 nt, Human
gccauccuggaacccaggugagggcaagauga

SEQ ID NO: 437010 - RNA, 32 nt, Human
gccauccuggacuucccugaaugaggccgucu

SEQ ID NO: 437011 - RNA, 32 nt, Human
gccauccuggccagacacccuagcaggaaggg

SEQ ID NO: 437012 - RNA, 32 nt, Human
gccauccuggccugguggagguuggggagcug

SEQ ID NO: 437013 - RNA, 32 nt, Human
gccauccugggugcccagggcagagcaggcuu

SEQ ID NO: 437014 - RNA, 16 nt, Human
gccauccuguccaggu

SEQ ID NO: 437015 - RNA, 32 nt, Human
gccauccugugcugugcucaagcgggcagcca

SEQ ID NO: 437016 - RNA, 17 nt, Human
gccauccuuaaagggaa

SEQ ID NO: 437017 - RNA, 21 nt, Human
gccauccuuaaagggaacuga

SEQ ID NO: 437018 - RNA, 32 nt, Human
gccauccuuaagucugcucccacccucaguag

SEQ ID NO: 437019 - RNA, 32 nt, Human
gccauccuuaccccacacuuuuauuguugucg

SEQ ID NO: 437020 - RNA, 32 nt, Human
gccauccuucuuucuaauuccucuaaagcaag

SEQ ID NO: 437021 - RNA, 26 nt, Human
gccauccuuguuuucccuccauccuu

SEQ ID NO: 437022 - RNA, 32 nt, Human
gccaucgacuccugccugaguuuccagccugc

SEQ ID NO: 437023 - RNA, 32 nt, Human
gccaucgcacuccagacuacagccugggugac

SEQ ID NO: 437024 - RNA, 18 nt, Human
gccaucgcaucuggcugc

SEQ ID NO: 437025 - RNA, 19 nt, Human
gccaucgcccagcccagaa

SEQ ID NO: 437026 - RNA, 32 nt, Human
gccaucgccugcucccuccacacggcccuugg

SEQ ID NO: 437027 - RNA, 18 nt, Human
gccaucgccuugggccag

SEQ ID NO: 437028 - RNA, 32 nt, Human
gccaucgcgccacugcacucuagccuggguga

SEQ ID NO: 437029 - RNA, 32 nt, Human
gccaucggaagagagggcugagccaugggggu

SEQ ID NO: 437030 - RNA, 18 nt, Human
gccaucggcccucaggug

SEQ ID NO: 437031 - RNA, 32 nt, Human
gccaucggcuuuguggucaucauguuccaccc

SEQ ID NO: 437032 - RNA, 32 nt, Human
gccaucgggcaggggugacgaggugcugcuuc

SEQ ID NO: 437033 - RNA, 32 nt, Human
gccaucgggccagccaaggcugcucagagagg

SEQ ID NO: 437034 - RNA, 32 nt, Human
gccaucggucuagaaccacuaaccccgcauug

SEQ ID NO: 437035 - RNA, 22 nt, Human
gccaucggugcgccggggccag

SEQ ID NO: 437036 - RNA, 32 nt, Human
gccaucguccccaccuccaccugggccgcccg

SEQ ID NO: 437037 - RNA, 32 nt, Human
gccaucguggguucccugagcccagccagccu

SEQ ID NO: 437038 - RNA, 32 nt, Human
gccaucguguggccgccaccuccgggaagccu

SEQ ID NO: 437039 - RNA, 32 nt, Human
gccaucguuuccaugacaacagacacaacaca

SEQ ID NO: 437040 - RNA, 32 nt, Human
gccaucuaugccaguuacccuggagaggacuc

SEQ ID NO: 437041 - RNA, 32 nt, Human
gccaucucacagucccggcgcuccagagcccc

SEQ ID NO: 437042 - RNA, 32 nt, Human
gccaucucaguuaccagugacauggaagaucg

SEQ ID NO: 437043 - RNA, 32 nt, Human
gccaucucaguugcugcagugcagugaauuac

SEQ ID NO: 437044 - RNA, 20 nt, Human
gccaucuccaccugccccca

SEQ ID NO: 437045 - RNA, 32 nt, Human
gccaucuccagccggccaccucaggccccugu

SEQ ID NO: 437046 - RNA, 18 nt, Human
gccaucuccugucaggua

SEQ ID NO: 437047 - RNA, 32 nt, Human
gccaucucgccacugcagcucggguccagaaa

SEQ ID NO: 437048 - RNA, 32 nt, Human
gccaucucuccucuuuaugcucguguuucugg

SEQ ID NO: 437049 - RNA, 32 nt, Human
gccaucucugcucucacuggggacccuccucc

SEQ ID NO: 437050 - RNA, 32 nt, Human
gccaucucuguucugcaggugagaggauuuaa

SEQ ID NO: 437051 - RNA, 32 nt, Human
gccaucugaagcagcagguugcaggacaaaug

SEQ ID NO: 437052 - RNA, 32 nt, Human
gccaucugaagccaccucucugccuguuccuc

SEQ ID NO: 437053 - RNA, 19 nt, Human
gccaucugacuucuaccuc

SEQ ID NO: 437054 - RNA, 32 nt, Human
gccaucugagcacaccugucauaugcaaacaa

SEQ ID NO: 437055 - RNA, 32 nt, Human
gccaucugcagccagguggcccugccacacug

SEQ ID NO: 437056 - RNA, 17 nt, Human
gccaucugcucgugucc

SEQ ID NO: 437057 - RNA, 32 nt, Human
gccaucugcugcucccuuuuccacuuuucuau

SEQ ID NO: 437058 - RNA, 32 nt, Human
gccaucugggccauucagagacuggagugaga

SEQ ID NO: 437059 - RNA, 32 nt, Human
gccaucugggucugauguucuguuccauugua

SEQ ID NO: 437060 - RNA, 32 nt, Human
gccaucugucacccucuauaucauucagccau

SEQ ID NO: 437061 - RNA, 32 nt, Human
gccaucugucacccucuauauuauucagccau

SEQ ID NO: 437062 - RNA, 32 nt, Human
gccaucugucugcuucagaccaccucaggcuc

SEQ ID NO: 437063 - RNA, 19 nt, Human
gccaucugugcagagccag

SEQ ID NO: 437064 - RNA, 32 nt, Human
gccaucugugcccagcucugcaggccaggcac

SEQ ID NO: 437065 - RNA, 32 nt, Human
gccaucugugugacuccggugcgaguggaguc

SEQ ID NO: 437066 - RNA, 19 nt, Human
gccaucuuagcggcugcug

SEQ ID NO: 437067 - RNA, 32 nt, Human
gccaucuuagcuacauuaaauggcuacacagu

SEQ ID NO: 437068 - RNA, 32 nt, Human
gccaucuuaucacagaccucaggggcuccaac

SEQ ID NO: 437069 - RNA, 32 nt, Human
gccaucuucaaaccagaagaucuuaauuagua

SEQ ID NO: 437070 - RNA, 17 nt, Human
gccaucuucacccagaa

SEQ ID NO: 437071 - RNA, 32 nt, Human
gccaucuucauaauuucuuugucucacagaag

SEQ ID NO: 437072 - RNA, 32 nt, Human
gccaucuucgcugcuagucaggguuccauccu

SEQ ID NO: 437073 - RNA, 32 nt, Human
gccaucuucucccccauccccuucucuggggg

SEQ ID NO: 437074 - RNA, 32 nt, Human
gccaucuuuuccuauguuucuucacaugguuu

SEQ ID NO: 437075 - RNA, 32 nt, Human
gccaucuuuuucacuuuauguaaaggaguguu

SEQ ID NO: 437076 - RNA, 28 nt, Human
gccaugaacagcccugagguucuugagg

SEQ ID NO: 437077 - RNA, 32 nt, Human
gccaugaagaaguaggggcugaagaggaaggu

SEQ ID NO: 437078 - RNA, 20 nt, Human
gccaugaagacaccaaggca

SEQ ID NO: 437079 - RNA, 32 nt, Human
gccaugaagcaauaggagccacgaggaacaga

SEQ ID NO: 437080 - RNA, 32 nt, Human
gccaugaagcagagagggaugcuggggaaaca

SEQ ID NO: 437081 - RNA, 28 nt, Human
gccaugaagggcaaggaggagaaggagg

SEQ ID NO: 437082 - RNA, 32 nt, Human
gccaugaauggugcccuuauuaacaacagugu

SEQ ID NO: 437083 - RNA, 32 nt, Human
gccaugacagcagccacagccuccagggaccc

SEQ ID NO: 437084 - RNA, 20 nt, Human
gccaugacaucagcaugcug

SEQ ID NO: 437085 - RNA, 32 nt, Human
gccaugacccaacugcccuucuugucaguugc

SEQ ID NO: 437086 - RNA, 28 nt, Human
gccaugacccagccggugccccggcucu

SEQ ID NO: 437087 - RNA, 18 nt, Human
gccaugaccuucaccucu

SEQ ID NO: 437088 - RNA, 32 nt, Human
gccaugacuguagcaaggcuugauagcagagg

SEQ ID NO: 437089 - RNA, 32 nt, Human
gccaugacuguugcugcacuccagccugagug

SEQ ID NO: 437090 - RNA, 32 nt, Human
gccaugacuucuacaagcagauuucuuuucuu

SEQ ID NO: 437091 - RNA, 28 nt, Human
gccaugagaacuuccuaccuucugcugu

SEQ ID NO: 437092 - RNA, 32 nt, Human
gccaugagaagacucuuccugggcacggcgug

SEQ ID NO: 437093 - RNA, 28 nt, Human
gccaugagaaugaagagaggaugggaag

SEQ ID NO: 437094 - RNA, 32 nt, Human
gccaugagaaugagcaaagccuagccaaugga

SEQ ID NO: 437095 - RNA, 32 nt, Human
gccaugagagagagcggaaggagcagcugaug

SEQ ID NO: 437096 - RNA, 32 nt, Human
gccaugagagccaagaucgagcagaaccgcaa

SEQ ID NO: 437097 - RNA, 19 nt, Human
gccaugagauggccaggua

SEQ ID NO: 437098 - RNA, 28 nt, Human
gccaugagccggagucucuugcucuggu

SEQ ID NO: 437099 - RNA, 30 nt, Human
gccaugagccucucugagcuuguuuguugc

SEQ ID NO: 437100 - RNA, 31 nt, Human
gccaugagccucucugagcuuguuuguugcu

SEQ ID NO: 437101 - RNA, 18 nt, Human
gccaugagcgcgcugcug

SEQ ID NO: 437102 - RNA, 32 nt, Human
gccaugagcuacaauccgucuguccaugggag

SEQ ID NO: 437103 - RNA, 32 nt, Human
gccaugaggagccaugaggagccucaguuuug

SEQ ID NO: 437104 - RNA, 32 nt, Human
gccaugaggccugcuuggccggggaucgagac

SEQ ID NO: 437105 - RNA, 32 nt, Human
gccaugaggguggaucacuugaggucagaagu

SEQ ID NO: 437106 - RNA, 32 nt, Human
gccaugagugagacaggcuguacugggacaac

SEQ ID NO: 437107 - RNA, 32 nt, Human
gccaugaguggggaagagcaacaggcgagaug

SEQ ID NO: 437108 - RNA, 32 nt, Human
gccaugaguguccaucccaaagcugcccugca

SEQ ID NO: 437109 - RNA, 32 nt, Human
gccaugaguuacucgggaggcugaggcaggag

SEQ ID NO: 437110 - RNA, 32 nt, Human
gccaugauauugccagccugggugacagagca

SEQ ID NO: 437111 - RNA, 28 nt, Human
gccaugaucaagcguuuccuggaggaca

SEQ ID NO: 437112 - RNA, 32 nt, Human
gccaugaucccuuugagagguggcucaaaagc

SEQ ID NO: 437113 - RNA, 32 nt, Human
gccaugauggacugggcgaggggugggacugg

SEQ ID NO: 437114 - RNA, 32 nt, Human
gccaugaugguaccccugcacuccagcccagg

SEQ ID NO: 437115 - RNA, 22 nt, Human
gccaugcaauggugucugugua

SEQ ID NO: 437116 - RNA, 32 nt, Human
gccaugcaauuggcaugacaccugccaugcca

SEQ ID NO: 437117 - RNA, 32 nt, Human
gccaugcacaggcccgucccacccugcaugug

SEQ ID NO: 437118 - RNA, 19 nt, Human
gccaugcaccggggcucag

SEQ ID NO: 437119 - RNA, 32 nt, Human
gccaugcagacaccucauggcacuucaaacua

SEQ ID NO: 437120 - RNA, 28 nt, Human
gccaugcagagcacugaccuaggcaaca

SEQ ID NO: 437121 - RNA, 32 nt, Human
gccaugcagcacuuaaacuugugauaaggaag

SEQ ID NO: 437122 - RNA, 32 nt, Human
gccaugcagcugcacuccccucccaggaaagg

SEQ ID NO: 437123 - RNA, 32 nt, Human
gccaugcagcuggcguagguggcaguugggcc

SEQ ID NO: 437124 - RNA, 32 nt, Human
gccaugcauaguggacccagcacuacagcaag

SEQ ID NO: 437125 - RNA, 32 nt, Human
gccaugcauugucacucugccuccgggacccc

SEQ ID NO: 437126 - RNA, 20 nt, Human
gccaugccaaugcacuccag

SEQ ID NO: 437127 - RNA, 32 nt, Human
gccaugccaaugcacuccagucugggcaacag

SEQ ID NO: 437128 - RNA, 28 nt, Human
gccaugccagcucugugccuggugcugu

SEQ ID NO: 437129 - RNA, 22 nt, Human
gccaugcccaccccagccccag

SEQ ID NO: 437130 - RNA, 32 nt, Human
gccaugcccagaggucugguccugaugcuggc

SEQ ID NO: 437131 - RNA, 32 nt, Human
gccaugcccagccuguuuuucuguucacuaua

SEQ ID NO: 437132 - RNA, 32 nt, Human
gccaugcccaggaggagcacuaaagcaaaggu

SEQ ID NO: 437133 - RNA, 32 nt, Human
gccaugccccacagagcuuacccaggagaaaa

SEQ ID NO: 437134 - RNA, 32 nt, Human
gccaugcccugagccacgucccucccccugca

SEQ ID NO: 437135 - RNA, 32 nt, Human
gccaugccugcuccucugccuggaccaggagg

SEQ ID NO: 437136 - RNA, 32 nt, Human
gccaugcgacgcggagaccacccggccgcggu

SEQ ID NO: 437137 - RNA, 32 nt, Human
gccaugcgagcccagcccuggugccucauggg

SEQ ID NO: 437138 - RNA, 32 nt, Human
gccaugcgagggauuccaugcccaccugcccu

SEQ ID NO: 437139 - RNA, 32 nt, Human
gccaugcgcacucuccagcagaaugucugcuu

SEQ ID NO: 437140 - RNA, 24 nt, Human
gccaugcgcuuguggaccucuaug

SEQ ID NO: 437141 - RNA, 32 nt, Human
gccaugcggcaccauucccggcuaauuuuugu

SEQ ID NO: 437142 - RNA, 32 nt, Human
gccaugcguggaacaucgaagccucagagagu

SEQ ID NO: 437143 - RNA, 23 nt, Human
gccaugcuccccccgaccuccag

SEQ ID NO: 437144 - RNA, 32 nt, Human
gccaugcuccucuuccccagacgccuggcugc

SEQ ID NO: 437145 - RNA, 18 nt, Human
gccaugcucuccccaggg

SEQ ID NO: 437146 - RNA, 28 nt, Human
gccaugcucuggcaaaaacccacagcuc

SEQ ID NO: 437147 - RNA, 32 nt, Human
gccaugcugaccugacaggcuccggccugccc

SEQ ID NO: 437148 - RNA, 22 nt, Human
gccaugcugacugcuugaaccu

SEQ ID NO: 437149 - RNA, 24 nt, Human
gccaugcugcccaggccagucuca

SEQ ID NO: 437150 - RNA, 32 nt, Human
gccaugcugccuccuuacauccuuuuuggaac

SEQ ID NO: 437151 - RNA, 28 nt, Human
gccaugcugcugcugcucacgcuugccc

SEQ ID NO: 437152 - RNA, 18 nt, Human
gccaugcuggcacccaga

SEQ ID NO: 437153 - RNA, 32 nt, Human
gccaugcuggccacccugcagccugaccaccu

SEQ ID NO: 437154 - RNA, 32 nt, Human
gccaugcuggcugcugucacugagcgggacuc

SEQ ID NO: 437155 - RNA, 32 nt, Human
gccaugcugggguccuacccagccuggaucug

SEQ ID NO: 437156 - RNA, 32 nt, Human
gccaugcuugagaagggaggauaaaaacuuuc

SEQ ID NO: 437157 - RNA, 32 nt, Human
gccaugcuugguggucaugccuguaaucccag

SEQ ID NO: 437158 - RNA, 21 nt, Human
gccauggacaggcugggcccc

SEQ ID NO: 437159 - RNA, 32 nt, Human
gccauggacccagcugagcagagcagacgcuu

SEQ ID NO: 437160 - RNA, 32 nt, Human
gccauggacucugcccagagccuucuuguuua

SEQ ID NO: 437161 - RNA, 32 nt, Human
gccauggagcacuguuucucccuuuuuacuau

SEQ ID NO: 437162 - RNA, 32 nt, Human
gccauggagcagaggagccucucaccuccugu

SEQ ID NO: 437163 - RNA, 28 nt, Human
gccauggagcagcuucgcgccgccgccc

SEQ ID NO: 437164 - RNA, 28 nt, Human
gccauggagcugcuaaagcugaaccgga

SEQ ID NO: 437165 - RNA, 28 nt, Human
gccauggagguggugggugacuucgagu

SEQ ID NO: 437166 - RNA, 32 nt, Human
gccauggaguccucuuaagagggacgagggcc

SEQ ID NO: 437167 - RNA, 32 nt, Human
gccauggagugagacccaggagccggacacuu

SEQ ID NO: 437168 - RNA, 28 nt, Human
gccauggaugaggagcgcgcccucuaca

SEQ ID NO: 437169 - RNA, 32 nt, Human
gccauggauggaaaacgcucucugcucugcuu

SEQ ID NO: 437170 - RNA, 32 nt, Human
gccauggauggaggaggaagagauaaggacgu

SEQ ID NO: 437171 - RNA, 23 nt, Human
gccauggcaaagaccacagggaa

SEQ ID NO: 437172 - RNA, 28 nt, Human
gccauggcaaagcaguacgacucggugg

SEQ ID NO: 437173 - RNA, 32 nt, Human
gccauggcacucacuccagccugggcaacaag

SEQ ID NO: 437174 - RNA, 32 nt, Human
gccauggcagagcugacgcuccaccucccacc

SEQ ID NO: 437175 - RNA, 32 nt, Human
gccauggcagauuuccagccuggugaugcugu

SEQ ID NO: 437176 - RNA, 32 nt, Human
gccauggcaggacuuagaguugcgaguuaaga

SEQ ID NO: 437177 - RNA, 17 nt, Human
gccauggccacacagca

SEQ ID NO: 437178 - RNA, 32 nt, Human
gccauggccacagccagauggaggagcccauc

SEQ ID NO: 437179 - RNA, 24 nt, Human
gccauggccacuggcuccagcugg

SEQ ID NO: 437180 - RNA, 22 nt, Human
gccauggccaugggcagaggcg

SEQ ID NO: 437181 - RNA, 21 nt, Human
gccauggccaugguccccagc

SEQ ID NO: 437182 - RNA, 28 nt, Human
gccauggcccaggucagcaucaacaaug

SEQ ID NO: 437183 - RNA, 32 nt, Human
gccauggccccucugccaagccugugugcgau

SEQ ID NO: 437184 - RNA, 28 nt, Human
gccauggccgacuccgagcugcagcugg

SEQ ID NO: 437185 - RNA, 21 nt, Human
gccauggccggggacccgggg

SEQ ID NO: 437186 - RNA, 22 nt, Human
gccauggccugcaggggcucca

SEQ ID NO: 437187 - RNA, 32 nt, Human
gccauggccugggaugcgggcccuucuuccuc

SEQ ID NO: 437188 - RNA, 28 nt, Human
gccauggcgaaggcgaagaaggucgggg

SEQ ID NO: 437189 - RNA, 28 nt, Human
gccauggcgcagcugggaaagcugcuca

SEQ ID NO: 437190 - RNA, 22 nt, Human
gccauggcucacgucuguaauc

SEQ ID NO: 437191 - RNA, 32 nt, Human
gccauggcuggcagagguuucuagggugggcc

SEQ ID NO: 437192 - RNA, 32 nt, Human
gccauggcuucucauuuacaccaacagguuuc

SEQ ID NO: 437193 - RNA, 21 nt, Human
gccaugggaaggagcccaggg

SEQ ID NO: 437194 - RNA, 32 nt, Human
gccaugggaaguguuuacacuugggggacaag

SEQ ID NO: 437195 - RNA, 32 nt, Human
gccaugggaauuccuccaucugcagcggucac

SEQ ID NO: 437196 - RNA, 32 nt, Human
gccaugggagagcacaacagggcacuguguaa

SEQ ID NO: 437197 - RNA, 19 nt, Human
gccaugggagcccaccucu

SEQ ID NO: 437198 - RNA, 32 nt, Human
gccaugggagucccugcugagcucggggcagg

SEQ ID NO: 437199 - RNA, 20 nt, Human
gccaugggcacagggcucag

SEQ ID NO: 437200 - RNA, 32 nt, Human
gccaugggccaggagaagacugugcuggguug

SEQ ID NO: 437201 - RNA, 32 nt, Human
gccaugggcuuguccuggaacugcuucaacuc

SEQ ID NO: 437202 - RNA, 32 nt, Human
gccauggggaacugucugcacagggugaguau

SEQ ID NO: 437203 - RNA, 22 nt, Human
gccauggggaucccaccuccag

SEQ ID NO: 437204 - RNA, 28 nt, Human
gccauggggcaggcgggcugcaaggggc

SEQ ID NO: 437205 - RNA, 32 nt, Human
gccauggggccggagccgcagugagcaccaug

SEQ ID NO: 437206 - RNA, 28 nt, Human
gccauggggcuggggcugcugcucccgc

SEQ ID NO: 437207 - RNA, 32 nt, Human
gccaugggggucuuugaacacaccucucuccu

SEQ ID NO: 437208 - RNA, 32 nt, Human
gccauggguggaggccagcagggcagcguguc

SEQ ID NO: 437209 - RNA, 32 nt, Human
gccauggguucugugcuggagggugcacggcc

SEQ ID NO: 437210 - RNA, 32 nt, Human
gccaugguaagggcuggugagguuggggagaa

SEQ ID NO: 437211 - RNA, 21 nt, Human
gccaugguaccgagggacuca

SEQ ID NO: 437212 - RNA, 28 nt, Human
gccauggucacccacagcaaguuucccg

SEQ ID NO: 437213 - RNA, 28 nt, Human
gccauggucggcagaagagcacugaucg

SEQ ID NO: 437214 - RNA, 18 nt, Human
gccauggugaaaacuuug

SEQ ID NO: 437215 - RNA, 32 nt, Human
gccauggugcuuuucaggggccuguguguaca

SEQ ID NO: 437216 - RNA, 32 nt, Human
gccauggugugugguuucugggaaccaccaac

SEQ ID NO: 437217 - RNA, 27 nt, Human
gccaugguuccaagcauggaacuacca

SEQ ID NO: 437218 - RNA, 32 nt, Human
gccaugguucggagaccaugugcguugugugc

SEQ ID NO: 437219 - RNA, 32 nt, Human
gccaugguuuggagaccaugugcguugugugc

SEQ ID NO: 437220 - RNA, 32 nt, Human
gccauguaacccgcucggcuccaggcugcgag

SEQ ID NO: 437221 - RNA, 32 nt, Human
gccauguacacgugggagguuggggcugagug

SEQ ID NO: 437222 - RNA, 32 nt, Human
gccauguacauacaguacucuuuuauuuuucu

SEQ ID NO: 437223 - RNA, 32 nt, Human
gccauguacucagaucagucaguugacugaaa

SEQ ID NO: 437224 - RNA, 32 nt, Human
gccauguacugcacugcccuggucgaaugcuc

SEQ ID NO: 437225 - RNA, 24 nt, Human
gccauguaggccaggcugguccca

SEQ ID NO: 437226 - RNA, 32 nt, Human
gccauguagggaggaccagggcagggccaggg

SEQ ID NO: 437227 - RNA, 19 nt, Human
gccaugucaccuggcugcu

SEQ ID NO: 437228 - RNA, 32 nt, Human
gccaugucacugaagagcuggagaccuauaga

SEQ ID NO: 437229 - RNA, 32 nt, Human
gccaugucagugccaggggcacuaggcuggca

SEQ ID NO: 437230 - RNA, 32 nt, Human
gccaugucauaaggaugcucaagcaguccuac

SEQ ID NO: 437231 - RNA, 32 nt, Human
gccauguccacaguuccuugggcugcugaggg

SEQ ID NO: 437232 - RNA, 21 nt, Human
gccaugucccccagccuggca

SEQ ID NO: 437233 - RNA, 32 nt, Human
gccaugucccccagccuggcauggcugcacug

SEQ ID NO: 437234 - RNA, 32 nt, Human
gccauguccguuaucucaucugaucuuuugcu

SEQ ID NO: 437235 - RNA, 28 nt, Human
gccaugucguccauccugccuuucacuc

SEQ ID NO: 437236 - RNA, 32 nt, Human
gccaugucuuggcugggauuacaggcaugagc

SEQ ID NO: 437237 - RNA, 32 nt, Human
gccaugugaaaguggucacucuccugguuaac

SEQ ID NO: 437238 - RNA, 32 nt, Human
gccaugugagccaccgcugccagcacagagcg

SEQ ID NO: 437239 - RNA, 22 nt, Human
gccaugugcugcagacccggag

SEQ ID NO: 437240 - RNA, 32 nt, Human
gccauguggaacugcuggagugcaguggcaug

SEQ ID NO: 437241 - RNA, 32 nt, Human
gccauguggaacugugugugaguuaaaccucu

SEQ ID NO: 437242 - RNA, 22 nt, Human
gccauguggccccaggugccac

SEQ ID NO: 437243 - RNA, 28 nt, Human
gccauguggcuagaaauccuccucacuu

SEQ ID NO: 437244 - RNA, 32 nt, Human
gccauguggcuuugcccagccugcugcaaucc

SEQ ID NO: 437245 - RNA, 25 nt, Human
gccauguggucccaggcuggucuca

SEQ ID NO: 437246 - RNA, 21 nt, Human
gccauguguccugucugugaa

SEQ ID NO: 437247 - RNA, 32 nt, Human
gccauguuaaguggccagcauuucaugaagga

SEQ ID NO: 437248 - RNA, 24 nt, Human
gccauguuacccaggcuggucuca

SEQ ID NO: 437249 - RNA, 32 nt, Human
gccauguuccuggagaagaggagccagccagg

SEQ ID NO: 437250 - RNA, 24 nt, Human
gccauguucgcuaggcuggucuca

SEQ ID NO: 437251 - RNA, 24 nt, Human
gccauguugaccaggcuggucuca

SEQ ID NO: 437252 - RNA, 23 nt, Human
gccauguugacgagacuggucuc

SEQ ID NO: 437253 - RNA, 23 nt, Human
gccauguugcccagacuggucuu

SEQ ID NO: 437254 - RNA, 23 nt, Human
gccauguugcccagacugguuuu

SEQ ID NO: 437255 - RNA, 22 nt, Human
gccauguugcccaggcgaucca

SEQ ID NO: 437256 - RNA, 24 nt, Human
gccauguugcccaggcuaaucuca

SEQ ID NO: 437257 - RNA, 32 nt, Human
gccauguugcccaggcuggaagugucuauguu

SEQ ID NO: 437258 - RNA, 22 nt, Human
gccauguugcccaggcuggucu

SEQ ID NO: 437259 - RNA, 23 nt, Human
gccauguugcccaggcuggucuc

SEQ ID NO: 437260 - RNA, 32 nt, Human
gccauguugcccaggcuggucugaagcugcug

SEQ ID NO: 437261 - RNA, 32 nt, Human
gccauguugcccaggcuggucuugagaacucc

SEQ ID NO: 437262 - RNA, 24 nt, Human
gccauguugcucaggcugaucuca

SEQ ID NO: 437263 - RNA, 24 nt, Human
gccauguugcucaggcuggucuca

SEQ ID NO: 437264 - RNA, 24 nt, Human
gccauguuggccaagcugaucuca

SEQ ID NO: 437265 - RNA, 23 nt, Human
gccauguuggccagacuggucuc

SEQ ID NO: 437266 - RNA, 24 nt, Human
gccauguuggccaggcuggucuca

SEQ ID NO: 437267 - RNA, 24 nt, Human
gccauguuggccggacuggucuua

SEQ ID NO: 437268 - RNA, 32 nt, Human
gccauguuuacaugauuugaugugcaauaggg

SEQ ID NO: 437269 - RNA, 22 nt, Human
gccauguuugcaaacugauuca

SEQ ID NO: 437270 - RNA, 32 nt, Human
gccauuaagaacacuugugagcugagcacggu

SEQ ID NO: 437271 - RNA, 32 nt, Human
gccauuaaggguucacaagaaaaugaagggaa

SEQ ID NO: 437272 - RNA, 18 nt, Human
gccauuacaauccaccuc

SEQ ID NO: 437273 - RNA, 32 nt, Human
gccauuacacuccagccugggugacagagcaa

SEQ ID NO: 437274 - RNA, 32 nt, Human
gccauuacacuccagccugggugacagaguga

SEQ ID NO: 437275 - RNA, 32 nt, Human
gccauuacagccgccucuaccuagaaaaguag

SEQ ID NO: 437276 - RNA, 32 nt, Human
gccauuacuucugcuuucguaucuccucaggc

SEQ ID NO: 437277 - RNA, 30 nt, Human
gccauuagccucucccuucucucugugagg

SEQ ID NO: 437278 - RNA, 31 nt, Human
gccauuaggaaacugucgguuugcuuugauu

SEQ ID NO: 437279 - RNA, 32 nt, Human
gccauuauccuuucucccuccuguauccucag

SEQ ID NO: 437280 - RNA, 32 nt, Human
gccauuaucugggguguggccucugccagcaa

SEQ ID NO: 437281 - RNA, 32 nt, Human
gccauucacagaagcucucaauuucagaugau

SEQ ID NO: 437282 - RNA, 32 nt, Human
gccauucacauauuuucuugggugaaaugucu

SEQ ID NO: 437283 - RNA, 32 nt, Human
gccauucagaccccauuaagaagguuggcuug

SEQ ID NO: 437284 - RNA, 20 nt, Human
gccauucagcccccaagguc

SEQ ID NO: 437285 - RNA, 32 nt, Human
gccauucaggaggccagcugggaagacaaaau

SEQ ID NO: 437286 - RNA, 32 nt, Human
gccauucagugcccuccacauggccuugccac

SEQ ID NO: 437287 - RNA, 32 nt, Human
gccauucaucucuccauugguuucccaaaugu

SEQ ID NO: 437288 - RNA, 22 nt, Human
gccauucauuauuccucaagug

SEQ ID NO: 437289 - RNA, 32 nt, Human
gccauucauucauaaagaucuggauuugcuuu

SEQ ID NO: 437290 - RNA, 32 nt, Human
gccauuccaagucccagaugucccucuucccc

SEQ ID NO: 437291 - RNA, 32 nt, Human
gccauuccacagugcuccccugccucaccgcu

SEQ ID NO: 437292 - RNA, 32 nt, Human
gccauuccauagugcuccccugccucaccacc

SEQ ID NO: 437293 - RNA, 32 nt, Human
gccauuccccacccaucuccucccagaacguc

SEQ ID NO: 437294 - RNA, 32 nt, Human
gccauucccuggaagagacaaguggaucugau

SEQ ID NO: 437295 - RNA, 32 nt, Human
gccauucccuguccuggcccccuucagcaacc

SEQ ID NO: 437296 - RNA, 32 nt, Human
gccauuccuagaaaauguccuacugcccugca

SEQ ID NO: 437297 - RNA, 18 nt, Human
gccauuccugcagcauca

SEQ ID NO: 437298 - RNA, 17 nt, Human
gccauucgcacccagga

SEQ ID NO: 437299 - RNA, 31 nt, Human
gccauucucaauaaacauuugcugaagaaau

SEQ ID NO: 437300 - RNA, 32 nt, Human
gccauucucacacccaccccucugcccaguuu

SEQ ID NO: 437301 - RNA, 32 nt, Human
gccauucuccaccucaguaucugcuuucgggg

SEQ ID NO: 437302 - RNA, 32 nt, Human
gccauucuccugccucagcuacucaggaggcu

SEQ ID NO: 437303 - RNA, 32 nt, Human
gccauucucucacaucccgugcggucaggaag

SEQ ID NO: 437304 - RNA, 32 nt, Human
gccauucugaggaacaucuccaaggaacggga

SEQ ID NO: 437305 - RNA, 32 nt, Human
gccauucugccuuucugacauuuccuugggaa

SEQ ID NO: 437306 - RNA, 32 nt, Human
gccauucugcugccucagccuccugaguagcu

SEQ ID NO: 437307 - RNA, 32 nt, Human
gccauucugggagcuggggaaccuggucucaa

SEQ ID NO: 437308 - RNA, 32 nt, Human
gccauucuuaaucugauggagauuuguuuaua

SEQ ID NO: 437309 - RNA, 32 nt, Human
gccauucuucaucugcucuggacaucucaguc

SEQ ID NO: 437310 - RNA, 32 nt, Human
gccauucuugaagaaagacaaggauaaagaag

SEQ ID NO: 437311 - RNA, 32 nt, Human
gccauucuuucauuccuuuacuuucauaauaa

SEQ ID NO: 437312 - RNA, 16 nt, Human
gccauugaagacuuug

SEQ ID NO: 437313 - RNA, 20 nt, Human
gccauugaauguaaagggga

SEQ ID NO: 437314 - RNA, 32 nt, Human
gccauugagacaccugcaugucugguguuugu

SEQ ID NO: 437315 - RNA, 32 nt, Human
gccauugaggaaguggggccaacagagagguc

SEQ ID NO: 437316 - RNA, 32 nt, Human
gccauugaggguuucagagagccuuuuucuag

SEQ ID NO: 437317 - RNA, 32 nt, Human
gccauugaguagcugggaugacaggcacaugc

SEQ ID NO: 437318 - RNA, 32 nt, Human
gccauugauuauuauuauuccuaaagaaaaug

SEQ ID NO: 437319 - RNA, 32 nt, Human
gccauugauucugccagcggcuccuaaaccgc

SEQ ID NO: 437320 - RNA, 32 nt, Human
gccauugauuguuccaugcacugugcauaccc

SEQ ID NO: 437321 - RNA, 32 nt, Human
gccauugcacaccagucugggugacagagaaa

SEQ ID NO: 437322 - RNA, 32 nt, Human
gccauugcacagcagccugggugacagagcga

SEQ ID NO: 437323 - RNA, 32 nt, Human
gccauugcacuacagccugggugacagagcaa

SEQ ID NO: 437324 - RNA, 32 nt, Human
gccauugcacuccaaccugggugacagaguga

SEQ ID NO: 437325 - RNA, 32 nt, Human
gccauugcacuccacacuccagccugagcaac

SEQ ID NO: 437326 - RNA, 32 nt, Human
gccauugcacuccagccugggugacagaacga

SEQ ID NO: 437327 - RNA, 32 nt, Human
gccauugcacuccagccugggugacagagcaa

SEQ ID NO: 437328 - RNA, 32 nt, Human
gccauugcacuccagccugggugacagagcga

SEQ ID NO: 437329 - RNA, 32 nt, Human
gccauugcacuccagccugggugacagaguaa

SEQ ID NO: 437330 - RNA, 32 nt, Human
gccauugcacuccagccugggugacagaguga

SEQ ID NO: 437331 - RNA, 32 nt, Human
gccauugcacuccagccugggugacagugaga

SEQ ID NO: 437332 - RNA, 32 nt, Human
gccauugcacuccagcuugggugacagaguga

SEQ ID NO: 437333 - RNA, 32 nt, Human
gccauugcacuccagucugggugacagagcaa

SEQ ID NO: 437334 - RNA, 32 nt, Human
gccauugcacucuagccuaggugacagaguga

SEQ ID NO: 437335 - RNA, 32 nt, Human
gccauugcacuucagccugggugacagaguga

SEQ ID NO: 437336 - RNA, 32 nt, Human
gccauugcauuccagccuaggcaacacgagca

SEQ ID NO: 437337 - RNA, 32 nt, Human
gccauugcauuccagccugggcaacaagagcg

SEQ ID NO: 437338 - RNA, 32 nt, Human
gccauugcauuccagccugggugacagagcga

SEQ ID NO: 437339 - RNA, 32 nt, Human
gccauugcgcuccagccuaggugacagagcaa

SEQ ID NO: 437340 - RNA, 15 nt, Human
gccauugcuagggag

SEQ ID NO: 437341 - RNA, 32 nt, Human
gccauugcugcugccucugccucggagaagcc

SEQ ID NO: 437342 - RNA, 32 nt, Human
gccauugcugcugugcagaaggucaguccuac

SEQ ID NO: 437343 - RNA, 21 nt, Human
gccauuggacagccggucuca

SEQ ID NO: 437344 - RNA, 32 nt, Human
gccauuggagagacagcgcagagcagggggcg

SEQ ID NO: 437345 - RNA, 21 nt, Human
gccauuggccagagcccggag

SEQ ID NO: 437346 - RNA, 32 nt, Human
gccauuggcuccuaaaagagcuacuuaugagu

SEQ ID NO: 437347 - RNA, 32 nt, Human
gccauugguucagcacuguccugcugcucccc

SEQ ID NO: 437348 - RNA, 32 nt, Human
gccauuguacuccugccuaggugacagagcaa

SEQ ID NO: 437349 - RNA, 32 nt, Human
gccauuguaugaagccacaaagugggggagaa

SEQ ID NO: 437350 - RNA, 32 nt, Human
gccauugucacagccucauuuguaagcagcac

SEQ ID NO: 437351 - RNA, 32 nt, Human
gccauuguccccagcugaggaccaggugucuc

SEQ ID NO: 437352 - RNA, 32 nt, Human
gccauugucccuugccuagccugggccuaaaa

SEQ ID NO: 437353 - RNA, 32 nt, Human
gccauugucucagccucugccacuucccagac

SEQ ID NO: 437354 - RNA, 32 nt, Human
gccauugugauugucccaucauggcccaccug

SEQ ID NO: 437355 - RNA, 16 nt, Human
gccauuguugagggaa

SEQ ID NO: 437356 - RNA, 32 nt, Human
gccauuguuugauguccugugacugagaaacc

SEQ ID NO: 437357 - RNA, 32 nt, Human
gccauuuaaaguaagcuuugugcuccagauau

SEQ ID NO: 437358 - RNA, 32 nt, Human
gccauuuacagaauagaagaugagaccacuag

SEQ ID NO: 437359 - RNA, 32 nt, Human
gccauuuacuccaaguccucuccccagcuacc

SEQ ID NO: 437360 - RNA, 18 nt, Human
gccauuuacuucaccucu

SEQ ID NO: 437361 - RNA, 21 nt, Human
gccauuuagauuaggaagguu

SEQ ID NO: 437362 - RNA, 32 nt, Human
gccauuucacacucacccuccacccuccccac

SEQ ID NO: 437363 - RNA, 21 nt, Human
gccauuucacauuucaccccu

SEQ ID NO: 437364 - RNA, 32 nt, Human
gccauuucauggcagauauguaagaaaggaaa

SEQ ID NO: 437365 - RNA, 32 nt, Human
gccauuuccacucagcucuuuccagagaauuc

SEQ ID NO: 437366 - RNA, 17 nt, Human
gccauuuccagagggaa

SEQ ID NO: 437367 - RNA, 32 nt, Human
gccauuuccccaccaucuucuccaccaacccc

SEQ ID NO: 437368 - RNA, 32 nt, Human
gccauuuccccagucccuaucucccccauccc

SEQ ID NO: 437369 - RNA, 32 nt, Human
gccauuuccuccucuuguuuucacuccggauu

SEQ ID NO: 437370 - RNA, 32 nt, Human
gccauuuccuucuggggauuccugggcacuga

SEQ ID NO: 437371 - RNA, 32 nt, Human
gccauuucuacugcuacuaccuucucaggcua

SEQ ID NO: 437372 - RNA, 32 nt, Human
gccauuucucaaaugacuacagcugugacacu

SEQ ID NO: 437373 - RNA, 32 nt, Human
gccauuucucacucuggagccuuaauaaacug

SEQ ID NO: 437374 - RNA, 32 nt, Human
gccauuucuccccucucuuccuucaucuccac

SEQ ID NO: 437375 - RNA, 32 nt, Human
gccauuucucugcuuacccuucaccuuuggug

SEQ ID NO: 437376 - RNA, 20 nt, Human
gccauuucugccagagggaa

SEQ ID NO: 437377 - RNA, 21 nt, Human
gccauuucuguguuugaccua

SEQ ID NO: 437378 - RNA, 32 nt, Human
gccauuugaagaaggaggaauuuuagaagagg

SEQ ID NO: 437379 - RNA, 32 nt, Human
gccauuugcugcugccgccaggaccagagcag

SEQ ID NO: 437380 - RNA, 32 nt, Human
gccauuuggacagcaugccaggccacccagga

SEQ ID NO: 437381 - RNA, 32 nt, Human
gccauuugggaggggagcagagccaggccggu

SEQ ID NO: 437382 - RNA, 32 nt, Human
gccauuuggggaggcaggcugggccaaagggu

SEQ ID NO: 437383 - RNA, 32 nt, Human
gccauuuggucaaaguuugcaaaggagucagc

SEQ ID NO: 437384 - RNA, 32 nt, Human
gccauuugucaucugacugucauuagcauagc

SEQ ID NO: 437385 - RNA, 32 nt, Human
gccauuuguggugagaguggaggaggaagagg

SEQ ID NO: 437386 - RNA, 32 nt, Human
gccauuuuaguuguaucacagcagaaugaaua

SEQ ID NO: 437387 - RNA, 32 nt, Human
gccauuuucaauagauuggccauuuuaauguu

SEQ ID NO: 437388 - RNA, 20 nt, Human
gccauuuucccucugcugcc

SEQ ID NO: 437389 - RNA, 32 nt, Human
gccauuuucccugauuuguuugccucaucaac

SEQ ID NO: 437390 - RNA, 32 nt, Human
gccauuuugccuuucugacauuuccuugggaa

SEQ ID NO: 437391 - RNA, 32 nt, Human
gccauuuugucuggcuguggccccuccuucuc

SEQ ID NO: 437392 - RNA, 32 nt, Human
gccauuuuucauuuuaacuuuguuuuuacaug

SEQ ID NO: 437393 - RNA, 32 nt, Human
gccauuuuuccuuucugaaggcaggucucacc

SEQ ID NO: 437394 - RNA, 20 nt, Human
gcccaaaaaauguuugugca

SEQ ID NO: 437395 - RNA, 32 nt, Human
gcccaaaaaggugaaaccccgucucuacugaa

SEQ ID NO: 437396 - RNA, 32 nt, Human
gcccaaaaucuccucaaguugaccucucccgg

SEQ ID NO: 437397 - RNA, 32 nt, Human
gcccaaaaucuccucaaguugaccuguccagg

SEQ ID NO: 437398 - RNA, 32 nt, Human
gcccaaacaucucagccaggaaccugggacuu

SEQ ID NO: 437399 - RNA, 32 nt, Human
gcccaaaccagggggaagcaccagccucagug

SEQ ID NO: 437400 - RNA, 32 nt, Human
gcccaaacccaggaggcagaaguugcaagguu

SEQ ID NO: 437401 - RNA, 20 nt, Human
gcccaaacuggagugcagug

SEQ ID NO: 437402 - RNA, 21 nt, Human
gcccaaacuggagugcagugg

SEQ ID NO: 437403 - RNA, 22 nt, Human
gcccaaacuggagugcaguggc

SEQ ID NO: 437404 - RNA, 32 nt, Human
gcccaaacuucgcauuuuccaagaccacccug

SEQ ID NO: 437405 - RNA, 32 nt, Human
gcccaaacuuggcuuccuagccccagacccau

SEQ ID NO: 437406 - RNA, 22 nt, Human
gcccaaagacaaucuacuuacc

SEQ ID NO: 437407 - RNA, 32 nt, Human
gcccaaagacauccacccagaccucauuauuu

SEQ ID NO: 437408 - RNA, 22 nt, Human
gcccaaagaggugaggagccgg

SEQ ID NO: 437409 - RNA, 32 nt, Human
gcccaaaggcuguccugaaaacccuguggaag

SEQ ID NO: 437410 - RNA, 18 nt, Human
gcccaaagggcagggcca

SEQ ID NO: 437411 - RNA, 21 nt, Human
gcccaaaggugcaggagucag

SEQ ID NO: 437412 - RNA, 23 nt, Human
gcccaaagucagcaagccuccuu

SEQ ID NO: 437413 - RNA, 23 nt, Human
gcccaaaucaugcagccuaucca

SEQ ID NO: 437414 - RNA, 32 nt, Human
gcccaaaucuagagcauugagcacuuuaucuc

SEQ ID NO: 437415 - RNA, 32 nt, Human
gcccaaaugcuggcuggccuugugguccaaau

SEQ ID NO: 437416 - RNA, 32 nt, Human
gcccaaauucuccaaaagauggccucuccuaa

SEQ ID NO: 437417 - RNA, 32 nt, Human
gcccaacaacuuugaacuggccuggggauuuc

SEQ ID NO: 437418 - RNA, 32 nt, Human
gcccaacacagcaacaacagcaagaccauggg

SEQ ID NO: 437419 - RNA, 32 nt, Human
gcccaacacgagguauuauuuuaaagugcaag

SEQ ID NO: 437420 - RNA, 32 nt, Human
gcccaacagcccccuucuccuccuuucccuuc

SEQ ID NO: 437421 - RNA, 32 nt, Human
gcccaacaggcaggugccggaggggaggacag

SEQ ID NO: 437422 - RNA, 19 nt, Human
gcccaacaggcccuuggua

SEQ ID NO: 437423 - RNA, 32 nt, Human
gcccaacaucacaacaucugcucuucggguuc

SEQ ID NO: 437424 - RNA, 32 nt, Human
gcccaacauggcuggagcgcggcggaggugag

SEQ ID NO: 437425 - RNA, 32 nt, Human
gcccaacauggugaaaccccaucuggacuaaa

SEQ ID NO: 437426 - RNA, 32 nt, Human
gcccaacauggugaaaccccguuucuacuaaa

SEQ ID NO: 437427 - RNA, 32 nt, Human
gcccaacauggugaaacccugucucuacgaaa

SEQ ID NO: 437428 - RNA, 32 nt, Human
gcccaacauggugaaaccucgucucuacuaaa

SEQ ID NO: 437429 - RNA, 32 nt, Human
gcccaacauggugaaaccugucucuacuaaaa

SEQ ID NO: 437430 - RNA, 32 nt, Human
gcccaacauguggcaugcaaugaagagaaaau

SEQ ID NO: 437431 - RNA, 20 nt, Human
gcccaaccacaaacaccucc

SEQ ID NO: 437432 - RNA, 32 nt, Human
gcccaaccacaauuuucccuuccuccgccuuc

SEQ ID NO: 437433 - RNA, 32 nt, Human
gcccaaccacuugugucuucugccccuuccca

SEQ ID NO: 437434 - RNA, 22 nt, Human
gcccaaccagcaaagcgccccu

SEQ ID NO: 437435 - RNA, 32 nt, Human
gcccaaccaugccucuguccagccaccugcug

SEQ ID NO: 437436 - RNA, 32 nt, Human
gcccaaccccugcucuugccagcuggccccug

SEQ ID NO: 437437 - RNA, 32 nt, Human
gcccaacccgacugcccuaccagccugcacau

SEQ ID NO: 437438 - RNA, 32 nt, Human
gcccaaccuccccucguuuuugaccuuugucc

SEQ ID NO: 437439 - RNA, 32 nt, Human
gcccaaccugcucuccucuugccacugccucu

SEQ ID NO: 437440 - RNA, 21 nt, Human
gcccaaccuggagugcaaugg

SEQ ID NO: 437441 - RNA, 21 nt, Human
gcccaaccuggagugcagugg

SEQ ID NO: 437442 - RNA, 23 nt, Human
gcccaaccuggagugcaguggug

SEQ ID NO: 437443 - RNA, 22 nt, Human
gcccaacuacucaggaggcuga

SEQ ID NO: 437444 - RNA, 22 nt, Human
gcccaacuacucgggaggcuga

SEQ ID NO: 437445 - RNA, 20 nt, Human
gcccaacuagaguguagugg

SEQ ID NO: 437446 - RNA, 32 nt, Human
gcccaacucaacaacagauugcagccuucuuc

SEQ ID NO: 437447 - RNA, 32 nt, Human
gcccaacuccaggacgccccagcuggcccagc

SEQ ID NO: 437448 - RNA, 32 nt, Human
gcccaacucccagggcucuggaaauggugagg

SEQ ID NO: 437449 - RNA, 32 nt, Human
gcccaacuccucccucuccuugcuccuccucc

SEQ ID NO: 437450 - RNA, 18 nt, Human
gcccaacucuguccggua

SEQ ID NO: 437451 - RNA, 32 nt, Human
gcccaacucuguccgguaucccuuuuccuccc

SEQ ID NO: 437452 - RNA, 32 nt, Human
gcccaagaaugagaagaaugacuaugcaaccu

SEQ ID NO: 437453 - RNA, 32 nt, Human
gcccaagacagaugccccagagcuguuuaugg

SEQ ID NO: 437454 - RNA, 32 nt, Human
gcccaagacagccucagagccugggucuuccc

SEQ ID NO: 437455 - RNA, 28 nt, Human
gcccaagacccggcugccuccuccucuu

SEQ ID NO: 437456 - RNA, 32 nt, Human
gcccaagacuccuguuuuucuauagcccuggc

SEQ ID NO: 437457 - RNA, 32 nt, Human
gcccaagagccaguggcugagcucugagaagg

SEQ ID NO: 437458 - RNA, 32 nt, Human
gcccaagaggagaggaaugggaagagugcccc

SEQ ID NO: 437459 - RNA, 32 nt, Human
gcccaagaggcagagguugcagggucaagauc

SEQ ID NO: 437460 - RNA, 32 nt, Human
gcccaagagguagagguugcagugagccaaga

SEQ ID NO: 437461 - RNA, 32 nt, Human
gcccaagaggucaaggcuucagugagccauga

SEQ ID NO: 437462 - RNA, 32 nt, Human
gcccaagagguggagguuacagugagcagaga

SEQ ID NO: 437463 - RNA, 32 nt, Human
gcccaagagguugaggcugcagugagccauga

SEQ ID NO: 437464 - RNA, 32 nt, Human
gcccaagaguucaagacaauccuggccaacgg

SEQ ID NO: 437465 - RNA, 32 nt, Human
gcccaagaguucgacgcugcagugagcuauga

SEQ ID NO: 437466 - RNA, 32 nt, Human
gcccaagaguuugagaccagccuggacaacau

SEQ ID NO: 437467 - RNA, 32 nt, Human
gcccaagauaaagaaacagaaaagcugacacu

SEQ ID NO: 437468 - RNA, 32 nt, Human
gcccaagauuuggugccugcagccucuugucu

SEQ ID NO: 437469 - RNA, 32 nt, Human
gcccaagcaagggagauaccagccugguuccc

SEQ ID NO: 437470 - RNA, 32 nt, Human
gcccaagcaauggcacgggcagcgggcucuuu

SEQ ID NO: 437471 - RNA, 23 nt, Human
gcccaagcaauucucccaccuca

SEQ ID NO: 437472 - RNA, 32 nt, Human
gcccaagcagagggagcccccuugcccuguuu

SEQ ID NO: 437473 - RNA, 32 nt, Human
gcccaagcaggugggagcuaaggggaaaccga

SEQ ID NO: 437474 - RNA, 32 nt, Human
gcccaagccaagcaucgcauccccugugauuu

SEQ ID NO: 437475 - RNA, 32 nt, Human
gcccaagccaugagcuucuuccaggcucaugu

SEQ ID NO: 437476 - RNA, 32 nt, Human
gcccaagcccaggaguccuagcugaggcugca

SEQ ID NO: 437477 - RNA, 32 nt, Human
gcccaagccccuccccuccacuccccuuccug

SEQ ID NO: 437478 - RNA, 32 nt, Human
gcccaagccugugguaugaugugcacacuugc

SEQ ID NO: 437479 - RNA, 23 nt, Human
gcccaagcuacucagaaggcuga

SEQ ID NO: 437480 - RNA, 32 nt, Human
gcccaagcuagagcuuguggauuccagaccca

SEQ ID NO: 437481 - RNA, 21 nt, Human
gcccaagcuagagugcagugg

SEQ ID NO: 437482 - RNA, 22 nt, Human
gcccaagcuagagugcaguggu

SEQ ID NO: 437483 - RNA, 24 nt, Human
gcccaagcuagagugcaguggugu

SEQ ID NO: 437484 - RNA, 32 nt, Human
gcccaagcuaguuucaaacuccugggcucaag

SEQ ID NO: 437485 - RNA, 22 nt, Human
gcccaagcugccccugacagca

SEQ ID NO: 437486 - RNA, 32 nt, Human
gcccaagcugcccgggagggugggugcagaca

SEQ ID NO: 437487 - RNA, 25 nt, Human
gcccaagcugcuacaaccuuggcca

SEQ ID NO: 437488 - RNA, 21 nt, Human
gcccaagcuggaaugcagugg

SEQ ID NO: 437489 - RNA, 21 nt, Human
gcccaagcuggaaugcggugg

SEQ ID NO: 437490 - RNA, 20 nt, Human
gcccaagcuggagcgcaaug

SEQ ID NO: 437491 - RNA, 21 nt, Human
gcccaagcuggagcgcaaugg

SEQ ID NO: 437492 - RNA, 23 nt, Human
gcccaagcuggaguacaguagug

SEQ ID NO: 437493 - RNA, 32 nt, Human
gcccaagcuggaguacaguagugcaaucucag

SEQ ID NO: 437494 - RNA, 21 nt, Human
gcccaagcuggaguacagugg

SEQ ID NO: 437495 - RNA, 22 nt, Human
gcccaagcuggaguacaguggu

SEQ ID NO: 437496 - RNA, 23 nt, Human
gcccaagcuggaguacaguggug

SEQ ID NO: 437497 - RNA, 22 nt, Human
gcccaagcuggagugaaguggu

SEQ ID NO: 437498 - RNA, 21 nt, Human
gcccaagcuggagugcaaugg

SEQ ID NO: 437499 - RNA, 20 nt, Human
gcccaagcuggagugcagug

SEQ ID NO: 437500 - RNA, 21 nt, Human
gcccaagcuggagugcagugg

SEQ ID NO: 437501 - RNA, 22 nt, Human
gcccaagcuggagugcaguggc

SEQ ID NO: 437502 - RNA, 22 nt, Human
gcccaagcuggaguggcagugg

SEQ ID NO: 437503 - RNA, 32 nt, Human
gcccaagcuggucuggaacuccugggcucaag

SEQ ID NO: 437504 - RNA, 23 nt, Human
gcccaagcuugagggcaguggug

SEQ ID NO: 437505 - RNA, 32 nt, Human
gcccaaggaagacaguuuuuggaaggggcaag

SEQ ID NO: 437506 - RNA, 32 nt, Human
gcccaaggacagcuccuggaggaggccagccc

SEQ ID NO: 437507 - RNA, 32 nt, Human
gcccaaggaccugggagcucugcuccccacuc

SEQ ID NO: 437508 - RNA, 32 nt, Human
gcccaaggagaggacccaggagaggagucugg

SEQ ID NO: 437509 - RNA, 32 nt, Human
gcccaaggagaguucuggaggguucaaaggau

SEQ ID NO: 437510 - RNA, 32 nt, Human
gcccaaggagcagcagcggagcgugcuucgcc

SEQ ID NO: 437511 - RNA, 32 nt, Human
gcccaaggaggaggaagaggaaaacaagacaa

SEQ ID NO: 437512 - RNA, 32 nt, Human
gcccaaggagguggaguggagagugggcucgg

SEQ ID NO: 437513 - RNA, 32 nt, Human
gcccaaggauccuucuuaaggucuuaucucaa

SEQ ID NO: 437514 - RNA, 32 nt, Human
gcccaaggcacugagaccuccacccacugugg

SEQ ID NO: 437515 - RNA, 23 nt, Human
gcccaaggcagcaacaagcucuu

SEQ ID NO: 437516 - RNA, 18 nt, Human
gcccaaggccugcugcug

SEQ ID NO: 437517 - RNA, 21 nt, Human
gcccaagggagcuaagaccag

SEQ ID NO: 437518 - RNA, 32 nt, Human
gcccaagggauuuaaauauaacaaaaugugua

SEQ ID NO: 437519 - RNA, 20 nt, Human
gcccaagggccuggacaccc

SEQ ID NO: 437520 - RNA, 32 nt, Human
gcccaagggcuguuucugccacuugcucuccu

SEQ ID NO: 437521 - RNA, 32 nt, Human
gcccaagggguucaccuugccugcugccuaga

SEQ ID NO: 437522 - RNA, 20 nt, Human
gcccaaggguccagccuccu

SEQ ID NO: 437523 - RNA, 21 nt, Human
gcccaagguagagugcagugg

SEQ ID NO: 437524 - RNA, 24 nt, Human
gcccaagguagagugcaguggcgu

SEQ ID NO: 437525 - RNA, 32 nt, Human
gcccaagguagugggccuacaacuugguuuua

SEQ ID NO: 437526 - RNA, 32 nt, Human
gcccaagguauccaagccuggggaagggcagg

SEQ ID NO: 437527 - RNA, 32 nt, Human
gcccaaggucacaccuaacugggaaaugggac

SEQ ID NO: 437528 - RNA, 32 nt, Human
gcccaaggucccgggaccuggugcaggaagag

SEQ ID NO: 437529 - RNA, 21 nt, Human
gcccaaggucuccagcagagc

SEQ ID NO: 437530 - RNA, 32 nt, Human
gcccaaggugccugugcucccagcagguccaa

SEQ ID NO: 437531 - RNA, 22 nt, Human
gcccaaguaauccgccacccca

SEQ ID NO: 437532 - RNA, 32 nt, Human
gcccaaguauaggcucugcccagaugccauca

SEQ ID NO: 437533 - RNA, 32 nt, Human
gcccaagucaacacccgcagugauucaggguc

SEQ ID NO: 437534 - RNA, 32 nt, Human
gcccaagucagccucauauucugggcggacag

SEQ ID NO: 437535 - RNA, 32 nt, Human
gcccaagucccccacacucagugcagugauga

SEQ ID NO: 437536 - RNA, 32 nt, Human
gcccaagucguccucaagucggccuccccagg

SEQ ID NO: 437537 - RNA, 32 nt, Human
gcccaagucguccucaagucggccuggaagug

SEQ ID NO: 437538 - RNA, 32 nt, Human
gcccaagucguccucaagucggccuggaauua

SEQ ID NO: 437539 - RNA, 32 nt, Human
gcccaagucguccucaaguuggccuccccggg

SEQ ID NO: 437540 - RNA, 32 nt, Human
gcccaagugauacucccaccucugccuuacaa

SEQ ID NO: 437541 - RNA, 32 nt, Human
gcccaagugauacuuucuuuaccgucccguga

SEQ ID NO: 437542 - RNA, 32 nt, Human
gcccaaguggcuguucugggaccauggaagcc

SEQ ID NO: 437543 - RNA, 32 nt, Human
gcccaaguguuucccucucucccucaccaaaa

SEQ ID NO: 437544 - RNA, 32 nt, Human
gcccaaguuccagcguucagacugccugggag

SEQ ID NO: 437545 - RNA, 32 nt, Human
gcccaaguuccaguucaaaccuggucagguug

SEQ ID NO: 437546 - RNA, 32 nt, Human
gcccaaguucuccuggcacugugggcccugga

SEQ ID NO: 437547 - RNA, 21 nt, Human
gcccaaguuggagugcagugg

SEQ ID NO: 437548 - RNA, 32 nt, Human
gcccaauagcccaggcuggagugcaguggcag

SEQ ID NO: 437549 - RNA, 32 nt, Human
gcccaauauggugaaaccccgucucuccugaa

SEQ ID NO: 437550 - RNA, 32 nt, Human
gcccaauauggugaaacccugucucuacuaaa

SEQ ID NO: 437551 - RNA, 32 nt, Human
gcccaaucacuacaaccacuaaccacaacaua

SEQ ID NO: 437552 - RNA, 18 nt, Human
gcccaaucacucugucca

SEQ ID NO: 437553 - RNA, 32 nt, Human
gcccaaucccaggcuccacuccugggcuccau

SEQ ID NO: 437554 - RNA, 32 nt, Human
gcccaaucccagguccaggcucaauccuaggc

SEQ ID NO: 437555 - RNA, 32 nt, Human
gcccaauccuaaaaguuugggcagagggaacc

SEQ ID NO: 437556 - RNA, 32 nt, Human
gcccaaucucgacucugcucuuugccaguuca

SEQ ID NO: 437557 - RNA, 32 nt, Human
gcccaaucucugccuaguuucuggguguggcc

SEQ ID NO: 437558 - RNA, 32 nt, Human
gcccaaucugccaggcuggacugugcuguucc

SEQ ID NO: 437559 - RNA, 20 nt, Human
gcccaaucuucuggguccag

SEQ ID NO: 437560 - RNA, 30 nt, Human
gcccaaugacacuucugccuaggcucgcgc

SEQ ID NO: 437561 - RNA, 32 nt, Human
gcccaaugagccuucuuucugcccuccagauc

SEQ ID NO: 437562 - RNA, 32 nt, Human
gcccaaugccuggucuggagcuggagcuugcc

SEQ ID NO: 437563 - RNA, 32 nt, Human
gcccaaugccuguucucugcagcaaccuuugu

SEQ ID NO: 437564 - RNA, 22 nt, Human
gcccaauggagucucaccaggu

SEQ ID NO: 437565 - RNA, 32 nt, Human
gcccaaugucacggagguaggaaggggcagac

SEQ ID NO: 437566 - RNA, 32 nt, Human
gcccaauuccaggacuuccucacauggcuccu

SEQ ID NO: 437567 - RNA, 32 nt, Human
gcccaauugagagaccuugagaaagaaugaug

SEQ ID NO: 437568 - RNA, 20 nt, Human
gcccacaaacuggagcacag

SEQ ID NO: 437569 - RNA, 32 nt, Human
gcccacaaagucaaggcugcagugagcuguga

SEQ ID NO: 437570 - RNA, 32 nt, Human
gcccacaaccauucuguaccccuuccccagcc

SEQ ID NO: 437571 - RNA, 32 nt, Human
gcccacaauccucgucugaaucauccgaggca

SEQ ID NO: 437572 - RNA, 32 nt, Human
gcccacacacacuccuuccccuugucccuggg

SEQ ID NO: 437573 - RNA, 32 nt, Human
gcccacacacagaaaaacagacacauaaacac

SEQ ID NO: 437574 - RNA, 32 nt, Human
gcccacacaccccacuccagcuccggagcacc

SEQ ID NO: 437575 - RNA, 31 nt, Human
gcccacacacugcauagcaggagggaagcau

SEQ ID NO: 437576 - RNA, 24 nt, Human
gcccacacagagcccaugugcuug

SEQ ID NO: 437577 - RNA, 32 nt, Human
gcccacacagcccacuuguuuggguggggccg

SEQ ID NO: 437578 - RNA, 20 nt, Human
gcccacacagcccaggcagc

SEQ ID NO: 437579 - RNA, 22 nt, Human
gcccacacagcccaggcagcau

SEQ ID NO: 437580 - RNA, 32 nt, Human
gcccacacagcccgagccccuuggggagcagu

SEQ ID NO: 437581 - RNA, 32 nt, Human
gcccacacaucugcuuuggcuuugccggcaau

SEQ ID NO: 437582 - RNA, 32 nt, Human
gcccacaccccgaauccucugcauucaugucc

SEQ ID NO: 437583 - RNA, 24 nt, Human
gcccacacccugcaggacaaggag

SEQ ID NO: 437584 - RNA, 32 nt, Human
gcccacacccuucuagcaccuccugcagcagu

SEQ ID NO: 437585 - RNA, 17 nt, Human
gcccacaccucaccucu

SEQ ID NO: 437586 - RNA, 17 nt, Human
gcccacaccuccaccuc

SEQ ID NO: 437587 - RNA, 27 nt, Human
gcccacaccucccuaccagccuggcca

SEQ ID NO: 437588 - RNA, 32 nt, Human
gcccacaccugagcuccugucugccugaggag

SEQ ID NO: 437589 - RNA, 32 nt, Human
gcccacaccugcaggcaggaugcugucgucaa

SEQ ID NO: 437590 - RNA, 32 nt, Human
gcccacaccuggaaaucacucccucccugcuc

SEQ ID NO: 437591 - RNA, 32 nt, Human
gcccacaccuguaaucccagcacuuugggagg

SEQ ID NO: 437592 - RNA, 32 nt, Human
gcccacaccuguggccuuccucuccuuccugu

SEQ ID NO: 437593 - RNA, 20 nt, Human
gcccacaccuucaccagggc

SEQ ID NO: 437594 - RNA, 32 nt, Human
gcccacaccuucagcagugaaggauucuaaca

SEQ ID NO: 437595 - RNA, 32 nt, Human
gcccacacgagagucggcgaccagccucggcg

SEQ ID NO: 437596 - RNA, 32 nt, Human
gcccacacucaaaggccucucucucagcagag

SEQ ID NO: 437597 - RNA, 32 nt, Human
gcccacacugagugaggaagggaauggaccag

SEQ ID NO: 437598 - RNA, 32 nt, Human
gcccacacugccgcuccagccuuccuggcagg

SEQ ID NO: 437599 - RNA, 32 nt, Human
gcccacacugggacugguagaggaagccggcc

SEQ ID NO: 437600 - RNA, 32 nt, Human
gcccacacuuguaaucccagcacuuugggagg

SEQ ID NO: 437601 - RNA, 32 nt, Human
gcccacagacaggaacagaagagcacagugga

SEQ ID NO: 437602 - RNA, 32 nt, Human
gcccacagagacugagcuuucagucccccuuu

SEQ ID NO: 437603 - RNA, 32 nt, Human
gcccacagagaugagaauagaucauguggaac

SEQ ID NO: 437604 - RNA, 32 nt, Human
gcccacagagggcaggcacucccauccaucca

SEQ ID NO: 437605 - RNA, 32 nt, Human
gcccacagagggcccaggccccugcccagcug

SEQ ID NO: 437606 - RNA, 32 nt, Human
gcccacagagugagcuggaugcugaaacugug

SEQ ID NO: 437607 - RNA, 32 nt, Human
gcccacagaguuuuccugagaugacuguaacu

SEQ ID NO: 437608 - RNA, 32 nt, Human
gcccacagcaggcaaccaaggcugcccccacc

SEQ ID NO: 437609 - RNA, 32 nt, Human
gcccacagccaagguagggucacuaaccaagc

SEQ ID NO: 437610 - RNA, 32 nt, Human
gcccacagccagguacugcucccuucauacuc

SEQ ID NO: 437611 - RNA, 32 nt, Human
gcccacagccccuggucaucugauaucagagc

SEQ ID NO: 437612 - RNA, 32 nt, Human
gcccacagcggcgcccggcacugagcuggaca

SEQ ID NO: 437613 - RNA, 32 nt, Human
gcccacagcgguuuguuccccuucucgggagu

SEQ ID NO: 437614 - RNA, 19 nt, Human
gcccacagcugccgcggug

SEQ ID NO: 437615 - RNA, 32 nt, Human
gcccacagcugccucuggaaagugggccuggg

SEQ ID NO: 437616 - RNA, 32 nt, Human
gcccacagcugugccucacagaugccccgaga

SEQ ID NO: 437617 - RNA, 30 nt, Human
gcccacagcuugccaagaaagaccccaacg

SEQ ID NO: 437618 - RNA, 32 nt, Human
gcccacaggcucagccagaaccucuuggugua

SEQ ID NO: 437619 - RNA, 32 nt, Human
gcccacagggccugguggugauggaccucccc

SEQ ID NO: 437620 - RNA, 21 nt, Human
gcccacagggcgcccuaugga

SEQ ID NO: 437621 - RNA, 32 nt, Human
gcccacagucuucugaguugugcuacaccaau

SEQ ID NO: 437622 - RNA, 18 nt, Human
gcccacagucuugcggug

SEQ ID NO: 437623 - RNA, 32 nt, Human
gcccacaguuuuccuuugcuucucccagagcu

SEQ ID NO: 437624 - RNA, 32 nt, Human
gcccacauacagcaacuuagcgaagcugccgg

SEQ ID NO: 437625 - RNA, 32 nt, Human
gcccacaucccaagagacaggcccagagccua

SEQ ID NO: 437626 - RNA, 32 nt, Human
gcccacaucucgucagcuggugccucagagaa

SEQ ID NO: 437627 - RNA, 32 nt, Human
gcccacaucuguaaucccagcacuuugggagg

SEQ ID NO: 437628 - RNA, 32 nt, Human
gcccacaugcccucugugaugaguggcgucuu

SEQ ID NO: 437629 - RNA, 24 nt, Human
gcccacauugcccugcagggacca

SEQ ID NO: 437630 - RNA, 21 nt, Human
gcccacauuggagugcagugg

SEQ ID NO: 437631 - RNA, 32 nt, Human
gcccacauuggcuggcaguagacauggccgaa

SEQ ID NO: 437632 - RNA, 32 nt, Human
gcccaccaagcccaccuuccagaaacuuggag

SEQ ID NO: 437633 - RNA, 32 nt, Human
gcccaccaaggcagcagacuguuaaucagaca

SEQ ID NO: 437634 - RNA, 32 nt, Human
gcccaccacagcucucucccuguucucugggc

SEQ ID NO: 437635 - RNA, 32 nt, Human
gcccaccacugccaccacccgccgcacgacca

SEQ ID NO: 437636 - RNA, 32 nt, Human
gcccaccacuggccaugcucaccgcccugcuu

SEQ ID NO: 437637 - RNA, 19 nt, Human
gcccaccagaacacacggg

SEQ ID NO: 437638 - RNA, 32 nt, Human
gcccaccagagcuguggagaggggacccuaag

SEQ ID NO: 437639 - RNA, 32 nt, Human
gcccaccagcuggcucugcagcacauugcccu

SEQ ID NO: 437640 - RNA, 32 nt, Human
gcccaccagcuuccaggucucccugaccugcc

SEQ ID NO: 437641 - RNA, 21 nt, Human
gcccaccagcuucuguuccca

SEQ ID NO: 437642 - RNA, 32 nt, Human
gcccaccaggaggaugaaggucuccguggcug

SEQ ID NO: 437643 - RNA, 32 nt, Human
gcccaccaggccacggccgccugcuguacaua

SEQ ID NO: 437644 - RNA, 32 nt, Human
gcccaccaggcggacgcccaggagaaccccug

SEQ ID NO: 437645 - RNA, 18 nt, Human
gcccaccagguccugccu

SEQ ID NO: 437646 - RNA, 21 nt, Human
gcccaccaguccugggcacag

SEQ ID NO: 437647 - RNA, 32 nt, Human
gcccaccaugcuccugagccucccaagagcug

SEQ ID NO: 437648 - RNA, 32 nt, Human
gcccacccagaacagcagggaaauuccaaguc

SEQ ID NO: 437649 - RNA, 32 nt, Human
gcccacccagcagucaguacacaugccugggc

SEQ ID NO: 437650 - RNA, 32 nt, Human
gcccacccagcugccaguaggugcugggcucu

SEQ ID NO: 437651 - RNA, 32 nt, Human
gcccaccccacccucccugggcagggucuuga

SEQ ID NO: 437652 - RNA, 18 nt, Human
gcccaccccacgccgagg

SEQ ID NO: 437653 - RNA, 32 nt, Human
gcccaccccagccaccacugaguccacucgga

SEQ ID NO: 437654 - RNA, 32 nt, Human
gcccaccccagccuggggagaggucgcggcgg

SEQ ID NO: 437655 - RNA, 25 nt, Human
gcccacccccacccugccacuauga

SEQ ID NO: 437656 - RNA, 32 nt, Human
gcccacccccucccugccguaucgaucaccag

SEQ ID NO: 437657 - RNA, 32 nt, Human
gcccacccccucccugccguaucgaucaccau

SEQ ID NO: 437658 - RNA, 32 nt, Human
gcccacccccugcucuugccagcuggccccug

SEQ ID NO: 437659 - RNA, 21 nt, Human
gcccacccccuuuuuuguaua

SEQ ID NO: 437660 - RNA, 32 nt, Human
gcccaccccggcuguaucucaggucugggucc

SEQ ID NO: 437661 - RNA, 32 nt, Human
gcccaccccgggacacagaacuagugagcgcc

SEQ ID NO: 437662 - RNA, 32 nt, Human
gcccaccccucaggguguauagugacauauug

SEQ ID NO: 437663 - RNA, 32 nt, Human
gcccaccccugagucccuugacuuuuguauuc

SEQ ID NO: 437664 - RNA, 18 nt, Human
gcccacccgagccuggag

SEQ ID NO: 437665 - RNA, 32 nt, Human
gcccacccggccaccguucucuucccacuccc

SEQ ID NO: 437666 - RNA, 32 nt, Human
gcccacccguuggaggccgguggagaagcccc

SEQ ID NO: 437667 - RNA, 32 nt, Human
gcccacccuaccugcccugccugccugcugcc

SEQ ID NO: 437668 - RNA, 32 nt, Human
gcccacccucacagggggucucugugugaucu

SEQ ID NO: 437669 - RNA, 32 nt, Human
gcccacccucaggggcgucaggagacacagcc

SEQ ID NO: 437670 - RNA, 32 nt, Human
gcccacccuccaccuuugcccaauuucagaua

SEQ ID NO: 437671 - RNA, 32 nt, Human
gcccacccuccagcuuuuccucaggguguccu

SEQ ID NO: 437672 - RNA, 32 nt, Human
gcccacccugaacuccagcuggcccgcaagcg

SEQ ID NO: 437673 - RNA, 31 nt, Human
gcccacccugcgcgcugucaugcagaggcca

SEQ ID NO: 437674 - RNA, 32 nt, Human
gcccacccugcucuucccucgcccugcaaauu

SEQ ID NO: 437675 - RNA, 22 nt, Human
gcccaccgcaaccucggccucc

SEQ ID NO: 437676 - RNA, 32 nt, Human
gcccaccgcagaggaggggcgauggggguggc

SEQ ID NO: 437677 - RNA, 32 nt, Human
gcccaccgcagcagccucccucccucucagca

SEQ ID NO: 437678 - RNA, 32 nt, Human
gcccaccggacacacccucacuucgggaacag

SEQ ID NO: 437679 - RNA, 32 nt, Human
gcccaccucaagcagucuccccaccccuugag

SEQ ID NO: 437680 - RNA, 32 nt, Human
gcccaccucaccccagcacuuccuaugggacu

SEQ ID NO: 437681 - RNA, 18 nt, Human
gcccaccucacugccaca

SEQ ID NO: 437682 - RNA, 32 nt, Human
gcccaccucaucccuccagccugggaucucac

SEQ ID NO: 437683 - RNA, 32 nt, Human
gcccaccuccacccauucuguuugccccauuu

SEQ ID NO: 437684 - RNA, 32 nt, Human
gcccaccuccaggccucucccaccucaggccc

SEQ ID NO: 437685 - RNA, 32 nt, Human
gcccaccuccccuuuuguuucucaguaacauu

SEQ ID NO: 437686 - RNA, 19 nt, Human
gcccaccuccuccaugccu

SEQ ID NO: 437687 - RNA, 32 nt, Human
gcccaccuccucuuccuucuucucuacaaaag

SEQ ID NO: 437688 - RNA, 19 nt, Human
gcccaccucgcugggcccu

SEQ ID NO: 437689 - RNA, 32 nt, Human
gcccaccucgcugggcccucccuggcgccccg

SEQ ID NO: 437690 - RNA, 21 nt, Human
gcccaccucggccccggaggc

SEQ ID NO: 437691 - RNA, 32 nt, Human
gcccaccucucgggggcgggcucccggcgcua

SEQ ID NO: 437692 - RNA, 32 nt, Human
gcccaccucugccuccacccucacuguguaac

SEQ ID NO: 437693 - RNA, 32 nt, Human
gcccaccucuucucccccaccucccggguccc

SEQ ID NO: 437694 - RNA, 32 nt, Human
gcccaccucuuucucaccguggccuccugggg

SEQ ID NO: 437695 - RNA, 32 nt, Human
gcccaccugcagcccggacgccugccggccag

SEQ ID NO: 437696 - RNA, 32 nt, Human
gcccaccugcccaccugaccacugaccgcccc

SEQ ID NO: 437697 - RNA, 32 nt, Human
gcccaccugccugacccuccacugccccugga

SEQ ID NO: 437698 - RNA, 32 nt, Human
gcccaccugccuggccggccagccagccacuc

SEQ ID NO: 437699 - RNA, 32 nt, Human
gcccaccuggggaucccccaaagucagacaca

SEQ ID NO: 437700 - RNA, 32 nt, Human
gcccaccuggguggcgcguggcuuacgcaacg

SEQ ID NO: 437701 - RNA, 32 nt, Human
gcccaccuguaauccuagcugcucagggggcu

SEQ ID NO: 437702 - RNA, 32 nt, Human
gcccaccuguuuucccagcuacuccggaggcu

SEQ ID NO: 437703 - RNA, 32 nt, Human
gcccaccuucuaggaagccugagguuuauuuc

SEQ ID NO: 437704 - RNA, 32 nt, Human
gcccaccuugcggcccuggcucugagucgcuc

SEQ ID NO: 437705 - RNA, 32 nt, Human
gcccaccuugcguggaaugaaaacgccaaagg

SEQ ID NO: 437706 - RNA, 32 nt, Human
gcccaccuugcuggaaacucaaggaagauucu

SEQ ID NO: 437707 - RNA, 32 nt, Human
gcccaccuuugcagaauaaacucucuccuggg

SEQ ID NO: 437708 - RNA, 25 nt, Human
gcccacgacgcacuggugucugaga

SEQ ID NO: 437709 - RNA, 32 nt, Human
gcccacgagaggccaauggggagcagccagga

SEQ ID NO: 437710 - RNA, 22 nt, Human
gcccacgagcccaggggaccag

SEQ ID NO: 437711 - RNA, 24 nt, Human
gcccacgagugcgccauguuucag

SEQ ID NO: 437712 - RNA, 32 nt, Human
gcccacgaguucaaggcugcagugagucguga

SEQ ID NO: 437713 - RNA, 32 nt, Human
gcccacgcacuuccggccucggacccgcccca

SEQ ID NO: 437714 - RNA, 21 nt, Human
gcccacgcaggagugcagugg

SEQ ID NO: 437715 - RNA, 32 nt, Human
gcccacgcccgcuucuguaucucccucaauaa

SEQ ID NO: 437716 - RNA, 32 nt, Human
gcccacgccucuaaucccagcacuuugggagg

SEQ ID NO: 437717 - RNA, 32 nt, Human
gcccacgccuguaaucccagcacuuugggaga

SEQ ID NO: 437718 - RNA, 32 nt, Human
gcccacgccuguaaucccagcacuuugggagg

SEQ ID NO: 437719 - RNA, 32 nt, Human
gcccacgccuguaaucccagcuacucgggagg

SEQ ID NO: 437720 - RNA, 32 nt, Human
gcccacgccuguaaucccagcuacuuggaagg

SEQ ID NO: 437721 - RNA, 21 nt, Human
gcccacgcucucacugcugcc

SEQ ID NO: 437722 - RNA, 21 nt, Human
gcccacgcuggagugcaaugg

SEQ ID NO: 437723 - RNA, 23 nt, Human
gcccacgcuggagugcaauggug

SEQ ID NO: 437724 - RNA, 20 nt, Human
gcccacgcuggagugcagug

SEQ ID NO: 437725 - RNA, 32 nt, Human
gcccacggagagaaaagaaagggcugagacuu

SEQ ID NO: 437726 - RNA, 32 nt, Human
gcccacggcucagugggcuucacauaccucug

SEQ ID NO: 437727 - RNA, 32 nt, Human
gcccacgggcccccagccccagccccucuccu

SEQ ID NO: 437728 - RNA, 22 nt, Human
gcccacggucaccuggagacag

SEQ ID NO: 437729 - RNA, 32 nt, Human
gcccacggucuuccacuaccagccugggccuc

SEQ ID NO: 437730 - RNA, 32 nt, Human
gcccacgguguggcugggcaugcgugccaagg

SEQ ID NO: 437731 - RNA, 32 nt, Human
gcccacgucuguaaucccugcacuuugggagg

SEQ ID NO: 437732 - RNA, 32 nt, Human
gcccacgugaggcuggagugauguggccacaa

SEQ ID NO: 437733 - RNA, 32 nt, Human
gcccacgugugcccgccaugcccgcgccccac

SEQ ID NO: 437734 - RNA, 32 nt, Human
gcccacuacaaccuccaccuccuggguuugag

SEQ ID NO: 437735 - RNA, 32 nt, Human
gcccacuacuucccagggacucucacaucucg

SEQ ID NO: 437736 - RNA, 32 nt, Human
gcccacuaggcugggguuucugguuuuguuuc

SEQ ID NO: 437737 - RNA, 17 nt, Human
gcccacuauuccacucu

SEQ ID NO: 437738 - RNA, 32 nt, Human
gcccacucaaccugggcagaccgagaggcccg

SEQ ID NO: 437739 - RNA, 32 nt, Human
gcccacucaccccucagacuccugcugcccau

SEQ ID NO: 437740 - RNA, 32 nt, Human
gcccacucaccugguccuguuguuuuacccca

SEQ ID NO: 437741 - RNA, 32 nt, Human
gcccacucacgccuucacuccugggcccggga

SEQ ID NO: 437742 - RNA, 32 nt, Human
gcccacucaggaugcaggcucuccccaggggg

SEQ ID NO: 437743 - RNA, 21 nt, Human
gcccacucaucuauggacuca

SEQ ID NO: 437744 - RNA, 32 nt, Human
gcccacucccacuccauccuguccccaaggac

SEQ ID NO: 437745 - RNA, 32 nt, Human
gcccacucccagccguccucaccagagaugga

SEQ ID NO: 437746 - RNA, 32 nt, Human
gcccacuccccagccagagagggcuugaccaa

SEQ ID NO: 437747 - RNA, 32 nt, Human
gcccacucccccaggagcagcuggcacugaca

SEQ ID NO: 437748 - RNA, 32 nt, Human
gcccacucccccugccuccagcaggccaggaa

SEQ ID NO: 437749 - RNA, 32 nt, Human
gcccacucccugccuaugccucccucuugggg

SEQ ID NO: 437750 - RNA, 32 nt, Human
gcccacuccucauucauaaggugguggugagg

SEQ ID NO: 437751 - RNA, 32 nt, Human
gcccacuccucuccagacuccaccuccccagu

SEQ ID NO: 437752 - RNA, 32 nt, Human
gcccacuccugccucccucaucugugucccga

SEQ ID NO: 437753 - RNA, 32 nt, Human
gcccacucgaugccauggagaaggucaguugc

SEQ ID NO: 437754 - RNA, 21 nt, Human
gcccacucuccauccucccca

SEQ ID NO: 437755 - RNA, 32 nt, Human
gcccacucugcccaccauggacggcguggcug

SEQ ID NO: 437756 - RNA, 32 nt, Human
gcccacucuggucucaaacuccugggcucaac

SEQ ID NO: 437757 - RNA, 32 nt, Human
gcccacucuuucuggguuuuccaagggaaugg

SEQ ID NO: 437758 - RNA, 32 nt, Human
gcccacugaaaccuccaccucccggguucaag

SEQ ID NO: 437759 - RNA, 18 nt, Human
gcccacugaacgcugcag

SEQ ID NO: 437760 - RNA, 25 nt, Human
gcccacugaccauaccucagccccu

SEQ ID NO: 437761 - RNA, 32 nt, Human
gcccacugaccucuccgugccuggugcaggcc

SEQ ID NO: 437762 - RNA, 32 nt, Human
gcccacugcaaccucugccuccuggguucaag

SEQ ID NO: 437763 - RNA, 32 nt, Human
gcccacugcagcccgaguucucuggcucccgg

SEQ ID NO: 437764 - RNA, 32 nt, Human
gcccacugcagcccuccagccucuggucccca

SEQ ID NO: 437765 - RNA, 32 nt, Human
gcccacugcagccuccaacuccugggcucaag

SEQ ID NO: 437766 - RNA, 22 nt, Human
gcccacugcagccuccaccucc

SEQ ID NO: 437767 - RNA, 32 nt, Human
gcccacugccucccuccuuccuggguggagca

SEQ ID NO: 437768 - RNA, 31 nt, Human
gcccacugccucucgguguugccuucauaau

SEQ ID NO: 437769 - RNA, 20 nt, Human
gcccacugccugcccagagc

SEQ ID NO: 437770 - RNA, 32 nt, Human
gcccacugccuugccagucuugccaggugguc

SEQ ID NO: 437771 - RNA, 32 nt, Human
gcccacuggcugcaacaaguaccacugacagg

SEQ ID NO: 437772 - RNA, 32 nt, Human
gcccacugggcccugacugggaguccccugcc

SEQ ID NO: 437773 - RNA, 32 nt, Human
gcccacugggguguguggcagagccaggaccc

SEQ ID NO: 437774 - RNA, 32 nt, Human
gcccacugugaaaccacuagguucuagguccu

SEQ ID NO: 437775 - RNA, 32 nt, Human
gcccacugugguucuggcaccuccagggcuga

SEQ ID NO: 437776 - RNA, 32 nt, Human
gcccacuguguccugaauguuuuuguuauuuu

SEQ ID NO: 437777 - RNA, 16 nt, Human
gcccacugugucuagg

SEQ ID NO: 437778 - RNA, 32 nt, Human
gcccacuuaccaccagguggguguuuaggaca

SEQ ID NO: 437779 - RNA, 32 nt, Human
gcccacuuaguuucuugggagcaacagcacgu

SEQ ID NO: 437780 - RNA, 32 nt, Human
gcccacuucccaagaaucucacuucucagggc

SEQ ID NO: 437781 - RNA, 32 nt, Human
gcccacuucccacucaccuccaccucauugcc

SEQ ID NO: 437782 - RNA, 32 nt, Human
gcccacuucuccuucgcuuuccugagcccuaa

SEQ ID NO: 437783 - RNA, 23 nt, Human
gcccacuucucugcagcccaggc

SEQ ID NO: 437784 - RNA, 32 nt, Human
gcccacuugggacucaagcuggguccugugau

SEQ ID NO: 437785 - RNA, 32 nt, Human
gcccacuuguccccugcugccugcccaaacac

SEQ ID NO: 437786 - RNA, 32 nt, Human
gcccacuugucuuccuggauauuuggggguga

SEQ ID NO: 437787 - RNA, 32 nt, Human
gcccacuuuccagggcugugcuaaggagggaa

SEQ ID NO: 437788 - RNA, 32 nt, Human
gcccacuuuccaguuuggccuuaugcuucaug

SEQ ID NO: 437789 - RNA, 32 nt, Human
gcccacuuuccaguuuggccuuaugcuuuaug

SEQ ID NO: 437790 - RNA, 19 nt, Human
gcccagaaacucuaccuca

SEQ ID NO: 437791 - RNA, 24 nt, Human
gcccagaaaguuccugaagcauca

SEQ ID NO: 437792 - RNA, 22 nt, Human
gcccagaacaacucugaugcca

SEQ ID NO: 437793 - RNA, 32 nt, Human
gcccagaacuucccccagucagccucuccagg

SEQ ID NO: 437794 - RNA, 32 nt, Human
gcccagaacuugccuccagucagccucuccag

SEQ ID NO: 437795 - RNA, 32 nt, Human
gcccagaacuuucuccagucagccucuacaga

SEQ ID NO: 437796 - RNA, 19 nt, Human
gcccagaagacgugcgagu

SEQ ID NO: 437797 - RNA, 32 nt, Human
gcccagaagcucaaggcugcagugagccaagu

SEQ ID NO: 437798 - RNA, 23 nt, Human
gcccagaagcuggugcggccgau

SEQ ID NO: 437799 - RNA, 22 nt, Human
gcccagaagcuguuguggccga

SEQ ID NO: 437800 - RNA, 32 nt, Human
gcccagaagcuugaagcugcagugagcuagga

SEQ ID NO: 437801 - RNA, 32 nt, Human
gcccagaaggcagagguuguagugagcugaga

SEQ ID NO: 437802 - RNA, 32 nt, Human
gcccagaaggucgaggcugcagugagcugaga

SEQ ID NO: 437803 - RNA, 21 nt, Human
gcccagaagguggcaguccca

SEQ ID NO: 437804 - RNA, 32 nt, Human
gcccagaagguugaagcugcagugaguuguga

SEQ ID NO: 437805 - RNA, 32 nt, Human
gcccagaagguugagacugcagugagccacca

SEQ ID NO: 437806 - RNA, 32 nt, Human
gcccagaagucaaaguccagcaggggcaaagg

SEQ ID NO: 437807 - RNA, 32 nt, Human
gcccagaaguucaagacuagccugggcaacau

SEQ ID NO: 437808 - RNA, 32 nt, Human
gcccagaaguucaagggugcagugagcuauga

SEQ ID NO: 437809 - RNA, 32 nt, Human
gcccagaaguucgagguugcagugagccauga

SEQ ID NO: 437810 - RNA, 24 nt, Human
gcccagaaguugcugcagugguuc

SEQ ID NO: 437811 - RNA, 32 nt, Human
gcccagaaguuugagacugcagugagccauga

SEQ ID NO: 437812 - RNA, 32 nt, Human
gcccagaaguuugaggcugcagugagccguca

SEQ ID NO: 437813 - RNA, 32 nt, Human
gcccagaaugaagaaagcaagcaggaguguug

SEQ ID NO: 437814 - RNA, 21 nt, Human
gcccagaaugggaaccucaga

SEQ ID NO: 437815 - RNA, 21 nt, Human
gcccagacacaccuggguccc

SEQ ID NO: 437816 - RNA, 32 nt, Human
gcccagacauacaucccuccucugguaccaca

SEQ ID NO: 437817 - RNA, 17 nt, Human
gcccagaccacccagga

SEQ ID NO: 437818 - RNA, 32 nt, Human
gcccagaccaugggacaaguuccuagggcucc

SEQ ID NO: 437819 - RNA, 18 nt, Human
gcccagacccaagggccc

SEQ ID NO: 437820 - RNA, 20 nt, Human
gcccagacccagggacccuu

SEQ ID NO: 437821 - RNA, 19 nt, Human
gcccagaccccuaugccuu

SEQ ID NO: 437822 - RNA, 32 nt, Human
gcccagacccucccccaggccuaagaggagag

SEQ ID NO: 437823 - RNA, 20 nt, Human
gcccagacccugacaucccu

SEQ ID NO: 437824 - RNA, 20 nt, Human
gcccagacccuguggucccu

SEQ ID NO: 437825 - RNA, 32 nt, Human
gcccagaccgccucucuggaagguguuguagg

SEQ ID NO: 437826 - RNA, 22 nt, Human
gcccagaccgugggagagccag

SEQ ID NO: 437827 - RNA, 21 nt, Human
gcccagaccugggagcuccuu

SEQ ID NO: 437828 - RNA, 18 nt, Human
gcccagacgcccggcgca

SEQ ID NO: 437829 - RNA, 21 nt, Human
gcccagacuagaaugcagugg

SEQ ID NO: 437830 - RNA, 22 nt, Human
gcccagacuagaaugcaguggu

SEQ ID NO: 437831 - RNA, 23 nt, Human
gcccagacuagaaugcaguggug

SEQ ID NO: 437832 - RNA, 20 nt, Human
gcccagacuagagugcaaug

SEQ ID NO: 437833 - RNA, 22 nt, Human
gcccagacuagagugcaauggc

SEQ ID NO: 437834 - RNA, 23 nt, Human
gcccagacuagagugcaguggug

SEQ ID NO: 437835 - RNA, 32 nt, Human
gcccagacucacacaucuuccuccaggucagg

SEQ ID NO: 437836 - RNA, 20 nt, Human
gcccagacugaagugcagug

SEQ ID NO: 437837 - RNA, 21 nt, Human
gcccagacugaagugcagugg

SEQ ID NO: 437838 - RNA, 32 nt, Human
gcccagacugaucuugagcuucugagcuccag

SEQ ID NO: 437839 - RNA, 24 nt, Human
gcccagacuggaagugagaggcau

SEQ ID NO: 437840 - RNA, 24 nt, Human
gcccagacuggaauacaguggugu

SEQ ID NO: 437841 - RNA, 23 nt, Human
gcccagacuggagggcaguggcg

SEQ ID NO: 437842 - RNA, 21 nt, Human
gcccagacuggagugcaaugg

SEQ ID NO: 437843 - RNA, 19 nt, Human
gcccagacuggagugcagu

SEQ ID NO: 437844 - RNA, 21 nt, Human
gcccagacuggagugcaguag

SEQ ID NO: 437845 - RNA, 22 nt, Human
gcccagacuggagugcaguagc

SEQ ID NO: 437846 - RNA, 20 nt, Human
gcccagacuggagugcagug

SEQ ID NO: 437847 - RNA, 21 nt, Human
gcccagacuggagugcagugg

SEQ ID NO: 437848 - RNA, 23 nt, Human
gcccagacuggagugcaguggug

SEQ ID NO: 437849 - RNA, 24 nt, Human
gcccagacuggagugcaguggugu

SEQ ID NO: 437850 - RNA, 21 nt, Human
gcccagacuggagugcugugg

SEQ ID NO: 437851 - RNA, 18 nt, Human
gcccagacuggccagccc

SEQ ID NO: 437852 - RNA, 19 nt, Human
gcccagacuggcucagccc

SEQ ID NO: 437853 - RNA, 32 nt, Human
gcccagacuggucucaaacuccuggguucaag

SEQ ID NO: 437854 - RNA, 32 nt, Human
gcccagacuggucucgaacuccugggcucaaa

SEQ ID NO: 437855 - RNA, 22 nt, Human
gcccagacuguaguacaguggc

SEQ ID NO: 437856 - RNA, 32 nt, Human
gcccagacuguugucaagucggccuguccagg

SEQ ID NO: 437857 - RNA, 22 nt, Human
gcccagagaacagcagagucag

SEQ ID NO: 437858 - RNA, 32 nt, Human
gcccagagacaggggaaggcagccuguccauc

SEQ ID NO: 437859 - RNA, 32 nt, Human
gcccagagaccggagcgcggagaccucagcca

SEQ ID NO: 437860 - RNA, 32 nt, Human
gcccagagaggagcaugucuuccuuuaccucc

SEQ ID NO: 437861 - RNA, 32 nt, Human
gcccagagcagccuggccauauaagggaagga

SEQ ID NO: 437862 - RNA, 22 nt, Human
gcccagagcaggaggcagagcc

SEQ ID NO: 437863 - RNA, 32 nt, Human
gcccagagcagugcacuccagucugcagguac

SEQ ID NO: 437864 - RNA, 18 nt, Human
gcccagagcauccugccu

SEQ ID NO: 437865 - RNA, 20 nt, Human
gcccagagccagaaccaaga

SEQ ID NO: 437866 - RNA, 32 nt, Human
gcccagagcccaaacucagcaguuaugaguug

SEQ ID NO: 437867 - RNA, 21 nt, Human
gcccagagcccagcgcucagg

SEQ ID NO: 437868 - RNA, 21 nt, Human
gcccagagcccagcuccaagg

SEQ ID NO: 437869 - RNA, 26 nt, Human
gcccagagcccuggggugcucaggcg

SEQ ID NO: 437870 - RNA, 32 nt, Human
gcccagagcugacuccugauuuaaccgcuggc

SEQ ID NO: 437871 - RNA, 19 nt, Human
gcccagagcugcugggccc

SEQ ID NO: 437872 - RNA, 21 nt, Human
gcccagagcugcugggucccu

SEQ ID NO: 437873 - RNA, 25 nt, Human
gcccagagcugggaccuggagcacg

SEQ ID NO: 437874 - RNA, 32 nt, Human
gcccagagcugggugaguggggagacaccuca

SEQ ID NO: 437875 - RNA, 32 nt, Human
gcccagagcugguauagccaccagcagagcca

SEQ ID NO: 437876 - RNA, 23 nt, Human
gcccagaggaaucccuguuccca

SEQ ID NO: 437877 - RNA, 22 nt, Human
gcccagaggagcugggagccgg

SEQ ID NO: 437878 - RNA, 19 nt, Human
gcccagaggagggcagcag

SEQ ID NO: 437879 - RNA, 32 nt, Human
gcccagaggcaguggcuggggucccugcaggu

SEQ ID NO: 437880 - RNA, 19 nt, Human
gcccagaggccggggccag

SEQ ID NO: 437881 - RNA, 32 nt, Human
gcccagaggcggagguugcagugagccgagau

SEQ ID NO: 437882 - RNA, 21 nt, Human
gcccagagggcgccaggcuag

SEQ ID NO: 437883 - RNA, 22 nt, Human
gcccagaggguggcaagaacag

SEQ ID NO: 437884 - RNA, 19 nt, Human
gcccagagggugggcgcgg

SEQ ID NO: 437885 - RNA, 32 nt, Human
gcccagagguccaagcuauacugugcaggaca

SEQ ID NO: 437886 - RNA, 32 nt, Human
gcccagaggucccuggcuucaacucgaguccu

SEQ ID NO: 437887 - RNA, 32 nt, Human
gcccagagugaaccguccuuucacacaucugg

SEQ ID NO: 437888 - RNA, 18 nt, Human
gcccagaguguggguccc

SEQ ID NO: 437889 - RNA, 20 nt, Human
gcccagaguuucugccucca

SEQ ID NO: 437890 - RNA, 32 nt, Human
gcccagauagccccacugcacuccagccuggg

SEQ ID NO: 437891 - RNA, 23 nt, Human
gcccagaucacagaucccaugug

SEQ ID NO: 437892 - RNA, 19 nt, Human
gcccagaucauggccgcca

SEQ ID NO: 437893 - RNA, 20 nt, Human
gcccagaucccagccuugag

SEQ ID NO: 437894 - RNA, 32 nt, Human
gcccagaucucuccacaagagcugaggguuuc

SEQ ID NO: 437895 - RNA, 32 nt, Human
gcccagaucucugcacuucucagucccagauc

SEQ ID NO: 437896 - RNA, 32 nt, Human
gcccagaucuguccugcaggauggagccagca

SEQ ID NO: 437897 - RNA, 32 nt, Human
gcccagaugacugucuaaccagaccucagaau

SEQ ID NO: 437898 - RNA, 20 nt, Human
gcccagaugccaagcucccu

SEQ ID NO: 437899 - RNA, 32 nt, Human
gcccagauggagccgaugaggggccgggacac

SEQ ID NO: 437900 - RNA, 32 nt, Human
gcccagauugugccacugcacuccagccuggg

SEQ ID NO: 437901 - RNA, 32 nt, Human
gcccagauugugccacugcauucuagccuggg

SEQ ID NO: 437902 - RNA, 32 nt, Human
gcccagauugugccacugcucuccagccuggg

SEQ ID NO: 437903 - RNA, 32 nt, Human
gcccagauuuguuuguaaagcacuuugacucu

SEQ ID NO: 437904 - RNA, 32 nt, Human
gcccagauuuugguggguuugugccccagcac

SEQ ID NO: 437905 - RNA, 32 nt, Human
gcccagcaaccauggcugaagacuacugggac

SEQ ID NO: 437906 - RNA, 20 nt, Human
gcccagcaagccaggcccuu

SEQ ID NO: 437907 - RNA, 21 nt, Human
gcccagcaaggccagaccaag

SEQ ID NO: 437908 - RNA, 22 nt, Human
gcccagcaaucuucccacccca

SEQ ID NO: 437909 - RNA, 32 nt, Human
gcccagcacacagcaccccucaugcagcuggc

SEQ ID NO: 437910 - RNA, 32 nt, Human
gcccagcacacagugggcaucggguaagaaaa

SEQ ID NO: 437911 - RNA, 32 nt, Human
gcccagcacagggagcagggaguuuucucuag

SEQ ID NO: 437912 - RNA, 32 nt, Human
gcccagcacagugcccugcacacaguagucgc

SEQ ID NO: 437913 - RNA, 32 nt, Human
gcccagcaccacagccuuuccccagccaggag

SEQ ID NO: 437914 - RNA, 32 nt, Human
gcccagcaccacugcccaccuagcuguccugg

SEQ ID NO: 437915 - RNA, 32 nt, Human
gcccagcacccagcaauaacucuaauaauguu

SEQ ID NO: 437916 - RNA, 32 nt, Human
gcccagcaccccaaaucucugccaucacacgg

SEQ ID NO: 437917 - RNA, 18 nt, Human
gcccagcaccgugcacug

SEQ ID NO: 437918 - RNA, 32 nt, Human
gcccagcaccuccucaggccagccuggugcca

SEQ ID NO: 437919 - RNA, 22 nt, Human
gcccagcaccugguguuugcca

SEQ ID NO: 437920 - RNA, 32 nt, Human
gcccagcacuccucugggcugcucucaaacca

SEQ ID NO: 437921 - RNA, 17 nt, Human
gcccagcacuguccagg

SEQ ID NO: 437922 - RNA, 20 nt, Human
gcccagcagacgagacagca

SEQ ID NO: 437923 - RNA, 32 nt, Human
gcccagcagagccaccacccagcaucccaggc

SEQ ID NO: 437924 - RNA, 19 nt, Human
gcccagcagagccuaagca

SEQ ID NO: 437925 - RNA, 32 nt, Human
gcccagcagagggaggcagggcacugccuggc

SEQ ID NO: 437926 - RNA, 32 nt, Human
gcccagcagauggagggccaggaggaggaaga

SEQ ID NO: 437927 - RNA, 32 nt, Human
gcccagcagcacauuccagucacugcccccgc

SEQ ID NO: 437928 - RNA, 32 nt, Human
gcccagcagcagcuggaggaggaggaggagga

SEQ ID NO: 437929 - RNA, 32 nt, Human
gcccagcagcccagccacagaggagccagcga

SEQ ID NO: 437930 - RNA, 32 nt, Human
gcccagcagccucugcucccuccuggggaccc

SEQ ID NO: 437931 - RNA, 32 nt, Human
gcccagcagccugauaggacucuccuagucca

SEQ ID NO: 437932 - RNA, 32 nt, Human
gcccagcagcucaaagaagaaaaagaaggacu

SEQ ID NO: 437933 - RNA, 32 nt, Human
gcccagcagcuuucucuuucagucccauaagg

SEQ ID NO: 437934 - RNA, 32 nt, Human
gcccagcaggaggcagggguagagugauggaa

SEQ ID NO: 437935 - RNA, 32 nt, Human
gcccagcaggcagagguugcagugagcugaga

SEQ ID NO: 437936 - RNA, 32 nt, Human
gcccagcaguagcuggagaggcaggcagaggg

SEQ ID NO: 437937 - RNA, 32 nt, Human
gcccagcagucugccuucauucccucaaggaa

SEQ ID NO: 437938 - RNA, 32 nt, Human
gcccagcagugccucugcucagcuaccugggc

SEQ ID NO: 437939 - RNA, 32 nt, Human
gcccagcaguuggaggcugcagugagcuauga

SEQ ID NO: 437940 - RNA, 32 nt, Human
gcccagcauagcugcagugucacaaagccaug

SEQ ID NO: 437941 - RNA, 32 nt, Human
gcccagcauccagcuggcccgccagggcuucc

SEQ ID NO: 437942 - RNA, 32 nt, Human
gcccagcauccaggcugucuagggccguggga

SEQ ID NO: 437943 - RNA, 18 nt, Human
gcccagcauccgaccgca

SEQ ID NO: 437944 - RNA, 32 nt, Human
gcccagcauccuggggauccagcggauggaca

SEQ ID NO: 437945 - RNA, 32 nt, Human
gcccagccacaaguucucaauucuuaagagac

SEQ ID NO: 437946 - RNA, 32 nt, Human
gcccagccacaucaucuuuaucuccugggauu

SEQ ID NO: 437947 - RNA, 32 nt, Human
gcccagccacauuccugccacccuucuucuuc

SEQ ID NO: 437948 - RNA, 32 nt, Human
gcccagccaccacugccucucagcuuaaacag

SEQ ID NO: 437949 - RNA, 22 nt, Human
gcccagccacucagaaggcuga

SEQ ID NO: 437950 - RNA, 22 nt, Human
gcccagccacucaggaggcuga

SEQ ID NO: 437951 - RNA, 22 nt, Human
gcccagccacucgggaggcuga

SEQ ID NO: 437952 - RNA, 32 nt, Human
gcccagccacucucccuggggccuggugggua

SEQ ID NO: 437953 - RNA, 32 nt, Human
gcccagccacugcacuucaccggaugccgucu

SEQ ID NO: 437954 - RNA, 32 nt, Human
gcccagccagagagcaggugcaggugucaucc

SEQ ID NO: 437955 - RNA, 20 nt, Human
gcccagccagagcucugcug

SEQ ID NO: 437956 - RNA, 19 nt, Human
gcccagccagcagggccag

SEQ ID NO: 437957 - RNA, 32 nt, Human
gcccagccagccagggccgcgaggccgaggcc

SEQ ID NO: 437958 - RNA, 19 nt, Human
gcccagccagcuccagcaa

SEQ ID NO: 437959 - RNA, 32 nt, Human
gcccagccagcugugccggcguuuguuggcua

SEQ ID NO: 437960 - RNA, 32 nt, Human
gcccagccagcugugccggcguuuguuggcug

SEQ ID NO: 437961 - RNA, 20 nt, Human
gcccagccaggccccaggca

SEQ ID NO: 437962 - RNA, 32 nt, Human
gcccagcccacagcuucucccagccugaaacc

SEQ ID NO: 437963 - RNA, 32 nt, Human
gcccagcccagaacaaacacccuucagagccu

SEQ ID NO: 437964 - RNA, 18 nt, Human
gcccagcccagagcacag

SEQ ID NO: 437965 - RNA, 20 nt, Human
gcccagcccagccccaccgg

SEQ ID NO: 437966 - RNA, 25 nt, Human
gcccagcccagcccuacucccuccc

SEQ ID NO: 437967 - RNA, 32 nt, Human
gcccagcccagccugagaaauacccucagcag

SEQ ID NO: 437968 - RNA, 22 nt, Human
gcccagcccagccuggcgacug

SEQ ID NO: 437969 - RNA, 23 nt, Human
gcccagcccagcucaugccuccc

SEQ ID NO: 437970 - RNA, 23 nt, Human
gcccagcccagcugcucugccca

SEQ ID NO: 437971 - RNA, 32 nt, Human
gcccagcccaggaguuugaggcugcaaugagc

SEQ ID NO: 437972 - RNA, 32 nt, Human
gcccagccccaaaccuagacccucuccugaag

SEQ ID NO: 437973 - RNA, 32 nt, Human
gcccagccccaaggaugagcaagacauguggg

SEQ ID NO: 437974 - RNA, 27 nt, Human
gcccagccccaggcccagcagcagcag

SEQ ID NO: 437975 - RNA, 17 nt, Human
gcccagcccccaucggg

SEQ ID NO: 437976 - RNA, 24 nt, Human
gcccagccccgagccccgacagug

SEQ ID NO: 437977 - RNA, 20 nt, Human
gcccagccccgcccucccca

SEQ ID NO: 437978 - RNA, 20 nt, Human
gcccagccccgccucaggga

SEQ ID NO: 437979 - RNA, 18 nt, Human
gcccagccccuacugcug

SEQ ID NO: 437980 - RNA, 20 nt, Human
gcccagccccugcugcucug

SEQ ID NO: 437981 - RNA, 26 nt, Human
gcccagccccugcuuggccccuccca

SEQ ID NO: 437982 - RNA, 18 nt, Human
gcccagccccuguccccu

SEQ ID NO: 437983 - RNA, 22 nt, Human
gcccagcccgcagcccccuccc

SEQ ID NO: 437984 - RNA, 32 nt, Human
gcccagcccucagaaacccuucagugcuacau

SEQ ID NO: 437985 - RNA, 23 nt, Human
gcccagcccucccccugcugcug

SEQ ID NO: 437986 - RNA, 20 nt, Human
gcccagcccugcagggcuga

SEQ ID NO: 437987 - RNA, 32 nt, Human
gcccagcccugccccuugcccccguggcuucc

SEQ ID NO: 437988 - RNA, 32 nt, Human
gcccagcccugccuugcgccacccugcgcugu

SEQ ID NO: 437989 - RNA, 17 nt, Human
gcccagcccugcugcug

SEQ ID NO: 437990 - RNA, 32 nt, Human
gcccagcccuggaagguggaaaaagaaaaguu

SEQ ID NO: 437991 - RNA, 32 nt, Human
gcccagcccuggagggcaggcggccacucccc

SEQ ID NO: 437992 - RNA, 22 nt, Human
gcccagcccugggaaccugcug

SEQ ID NO: 437993 - RNA, 17 nt, Human
gcccagccgcagccgca

SEQ ID NO: 437994 - RNA, 32 nt, Human
gcccagccgcucucccuguccuccuccccuua

SEQ ID NO: 437995 - RNA, 32 nt, Human
gcccagccuauuugucuugccugcuguaucuu

SEQ ID NO: 437996 - RNA, 32 nt, Human
gcccagccuccagguccacggaguggugugga

SEQ ID NO: 437997 - RNA, 32 nt, Human
gcccagccucggccaccaugucccgccagacc

SEQ ID NO: 437998 - RNA, 20 nt, Human
gcccagccucugggccuccc

SEQ ID NO: 437999 - RNA, 32 nt, Human
gcccagccugacugaucccccgugugugacca

SEQ ID NO: 438000 - RNA, 32 nt, Human
gcccagccugcacgucugucccucucugcuuu

SEQ ID NO: 438001 - RNA, 32 nt, Human
gcccagccugccacaccgccuccaggaagcag

SEQ ID NO: 438002 - RNA, 25 nt, Human
gcccagccugccagccgcgcugcug

SEQ ID NO: 438003 - RNA, 32 nt, Human
gcccagccugcccugagcccugaggccagcug

SEQ ID NO: 438004 - RNA, 20 nt, Human
gcccagccuggaguacagug

SEQ ID NO: 438005 - RNA, 20 nt, Human
gcccagccuggagugcagug

SEQ ID NO: 438006 - RNA, 21 nt, Human
gcccagccuggagugcagugg

SEQ ID NO: 438007 - RNA, 22 nt, Human
gcccagccuggagugcaguggc

SEQ ID NO: 438008 - RNA, 32 nt, Human
gcccagccugggagcccagaggguggcaagaa

SEQ ID NO: 438009 - RNA, 20 nt, Human
gcccagccugggcacagcca

SEQ ID NO: 438010 - RNA, 18 nt, Human
gcccagccuguccuggua

SEQ ID NO: 438011 - RNA, 23 nt, Human
gcccagccuucacagcgcuccag

SEQ ID NO: 438012 - RNA, 32 nt, Human
gcccagccuucuguucuauuuaagaacuuuga

SEQ ID NO: 438013 - RNA, 17 nt, Human
gcccagccuugcugcug

SEQ ID NO: 438014 - RNA, 18 nt, Human
gcccagcgacacuggaua

SEQ ID NO: 438015 - RNA, 32 nt, Human
gcccagcgacuuccaaguccucucacagaaga

SEQ ID NO: 438016 - RNA, 21 nt, Human
gcccagcgagaguaccgagga

SEQ ID NO: 438017 - RNA, 32 nt, Human
gcccagcgagaugccagccuuccugucccggg

SEQ ID NO: 438018 - RNA, 32 nt, Human
gcccagcgaggagucccugcaauaagccccug

SEQ ID NO: 438019 - RNA, 32 nt, Human
gcccagcgccccgccuggaguggaugagccuc

SEQ ID NO: 438020 - RNA, 16 nt, Human
gcccagcgccugaggc

SEQ ID NO: 438021 - RNA, 19 nt, Human
gcccagcgcgaguccuccc

SEQ ID NO: 438022 - RNA, 32 nt, Human
gcccagcgcugaggccugacgggccgggcgga

SEQ ID NO: 438023 - RNA, 23 nt, Human
gcccagcgcuggagugcagcgug

SEQ ID NO: 438024 - RNA, 32 nt, Human
gcccagcggagugcccuucugagcagcgggcg

SEQ ID NO: 438025 - RNA, 32 nt, Human
gcccagcggggaagcuagcaccagccugggcc

SEQ ID NO: 438026 - RNA, 20 nt, Human
gcccagcggggcagagccag

SEQ ID NO: 438027 - RNA, 32 nt, Human
gcccagcgugggguuuucagagacaggggcuc

SEQ ID NO: 438028 - RNA, 32 nt, Human
gcccagcguuuaccacugcugucaagccacag

SEQ ID NO: 438029 - RNA, 32 nt, Human
gcccagcuacauuccucagcugccaagcacuc

SEQ ID NO: 438030 - RNA, 22 nt, Human
gcccagcuacccaggaggcuga

SEQ ID NO: 438031 - RNA, 22 nt, Human
gcccagcuacccgggaggcuga

SEQ ID NO: 438032 - RNA, 22 nt, Human
gcccagcuacucaacaggcuga

SEQ ID NO: 438033 - RNA, 22 nt, Human
gcccagcuacucaagaggcuga

SEQ ID NO: 438034 - RNA, 22 nt, Human
gcccagcuacucagcaggcuga

SEQ ID NO: 438035 - RNA, 22 nt, Human
gcccagcuacucaggaagcuga

SEQ ID NO: 438036 - RNA, 19 nt, Human
gcccagcuacucaggaggc

SEQ ID NO: 438037 - RNA, 20 nt, Human
gcccagcuacucaggaggcu

SEQ ID NO: 438038 - RNA, 22 nt, Human
gcccagcuacucaggaggcuga

SEQ ID NO: 438039 - RNA, 22 nt, Human
gcccagcuacucgaaaggcuga

SEQ ID NO: 438040 - RNA, 20 nt, Human
gcccagcuacucgagaggcu

SEQ ID NO: 438041 - RNA, 22 nt, Human
gcccagcuacucgagaggcuga

SEQ ID NO: 438042 - RNA, 20 nt, Human
gcccagcuacucggaaggcu

SEQ ID NO: 438043 - RNA, 22 nt, Human
gcccagcuacucggaaggcuga

SEQ ID NO: 438044 - RNA, 20 nt, Human
gcccagcuacucgggaagcu

SEQ ID NO: 438045 - RNA, 22 nt, Human
gcccagcuacucgggaagcuga

SEQ ID NO: 438046 - RNA, 20 nt, Human
gcccagcuacucgggaggcu

SEQ ID NO: 438047 - RNA, 22 nt, Human
gcccagcuacucgggaggcuga

SEQ ID NO: 438048 - RNA, 32 nt, Human
gcccagcucauuccucacaacggccuucccag

SEQ ID NO: 438049 - RNA, 32 nt, Human
gcccagcucauuuucuccuuucauuuuacaaa

SEQ ID NO: 438050 - RNA, 32 nt, Human
gcccagcuccagggccagcuuggaggagccaa

SEQ ID NO: 438051 - RNA, 32 nt, Human
gcccagcuccgcugcuaucuuugccucacuua

SEQ ID NO: 438052 - RNA, 27 nt, Human
gcccagcuccucaauacuaccuggaaa

SEQ ID NO: 438053 - RNA, 21 nt, Human
gcccagcuccugacacugcug

SEQ ID NO: 438054 - RNA, 32 nt, Human
gcccagcucgucccggccuccaccaagccagc

SEQ ID NO: 438055 - RNA, 24 nt, Human
gcccagcucucucaggauucagca

SEQ ID NO: 438056 - RNA, 32 nt, Human
gcccagcucugcccuucaucccuucagcaccu

SEQ ID NO: 438057 - RNA, 32 nt, Human
gcccagcucuucuucccugcugugucuccagg

SEQ ID NO: 438058 - RNA, 32 nt, Human
gcccagcugaaucuuggcuucuggaccuugac

SEQ ID NO: 438059 - RNA, 22 nt, Human
gcccagcugaccaccccuccca

SEQ ID NO: 438060 - RNA, 32 nt, Human
gcccagcugcagggagcuucuggccugggacc

SEQ ID NO: 438061 - RNA, 19 nt, Human
gcccagcugcccuacccca

SEQ ID NO: 438062 - RNA, 19 nt, Human
gcccagcugccucagagca

SEQ ID NO: 438063 - RNA, 21 nt, Human
gcccagcugcucccaucagca

SEQ ID NO: 438064 - RNA, 32 nt, Human
gcccagcuggagggcccgaggcugcagggugu

SEQ ID NO: 438065 - RNA, 20 nt, Human
gcccagcuggagugcagugg

SEQ ID NO: 438066 - RNA, 23 nt, Human
gcccagcuggagugcaguggcgu

SEQ ID NO: 438067 - RNA, 23 nt, Human
gcccagcuggagugcaguggugu

SEQ ID NO: 438068 - RNA, 20 nt, Human
gcccagcuggccaccuagaa

SEQ ID NO: 438069 - RNA, 32 nt, Human
gcccagcuggccuggcccccagcuucaccucu

SEQ ID NO: 438070 - RNA, 32 nt, Human
gcccagcuggcuuaguggaaguuguccaaccc

SEQ ID NO: 438071 - RNA, 22 nt, Human
gcccagcugggagggcccaggc

SEQ ID NO: 438072 - RNA, 32 nt, Human
gcccagcugggcugccucaggugucaggaagg

SEQ ID NO: 438073 - RNA, 32 nt, Human
gcccagcuggguaaccugcucaaguucaacug

SEQ ID NO: 438074 - RNA, 32 nt, Human
gcccagcuggguuggaucuucucuccauuccc

SEQ ID NO: 438075 - RNA, 21 nt, Human
gcccagcuguccaugcugcug

SEQ ID NO: 438076 - RNA, 18 nt, Human
gcccagcuguccauggcc

SEQ ID NO: 438077 - RNA, 32 nt, Human
gcccagcuucaugugcuagggggcaugauaau

SEQ ID NO: 438078 - RNA, 18 nt, Human
gcccagcuuccugaagca

SEQ ID NO: 438079 - RNA, 23 nt, Human
gcccagcuucuucaagaccuuca

SEQ ID NO: 438080 - RNA, 32 nt, Human
gcccagcuugccaaggugaggggcuggggcau

SEQ ID NO: 438081 - RNA, 32 nt, Human
gcccagcuugccaggcacugagcuagaagccc

SEQ ID NO: 438082 - RNA, 32 nt, Human
gcccagcuugcuggcugucagugcuugaugug

SEQ ID NO: 438083 - RNA, 32 nt, Human
gcccagcuuggcucccccuccuggcuggccuc

SEQ ID NO: 438084 - RNA, 32 nt, Human
gcccagcuuggggcucacgccuguaaucccag

SEQ ID NO: 438085 - RNA, 22 nt, Human
gcccagcuuucccaggggcaca

SEQ ID NO: 438086 - RNA, 19 nt, Human
gcccagcuuugagggcuga

SEQ ID NO: 438087 - RNA, 32 nt, Human
gcccagcuuuugccugcacucuugccugcugc

SEQ ID NO: 438088 - RNA, 32 nt, Human
gcccaggaaacaaguugaaaucccaggaaucu

SEQ ID NO: 438089 - RNA, 32 nt, Human
gcccaggaaauugaggcugcagugagccauga

SEQ ID NO: 438090 - RNA, 24 nt, Human
gcccaggaacaugcccagagccag

SEQ ID NO: 438091 - RNA, 32 nt, Human
gcccaggaacccagacuggacuucagucuccc

SEQ ID NO: 438092 - RNA, 21 nt, Human
gcccaggaaccccagacccag

SEQ ID NO: 438093 - RNA, 32 nt, Human
gcccaggaaccccagacccagggggaggaagg

SEQ ID NO: 438094 - RNA, 32 nt, Human
gcccaggaacuggagccacagagcuggugcug

SEQ ID NO: 438095 - RNA, 32 nt, Human
gcccaggaacugucaucagagcagaaaucaag

SEQ ID NO: 438096 - RNA, 32 nt, Human
gcccaggaagcagagauuccagugaguugaga

SEQ ID NO: 438097 - RNA, 32 nt, Human
gcccaggaagcagagguugcagugagccucga

SEQ ID NO: 438098 - RNA, 19 nt, Human
gcccaggaagccggucagu

SEQ ID NO: 438099 - RNA, 19 nt, Human
gcccaggaagcggaggcug

SEQ ID NO: 438100 - RNA, 32 nt, Human
gcccaggaagcggagguuacagugagcugaua

SEQ ID NO: 438101 - RNA, 32 nt, Human
gcccaggaagcggagguugcaaugagccgaga

SEQ ID NO: 438102 - RNA, 25 nt, Human
gcccaggaagcggagguugugguga

SEQ ID NO: 438103 - RNA, 22 nt, Human
gcccaggaaggacaggagccag

SEQ ID NO: 438104 - RNA, 32 nt, Human
gcccaggaagucaaggcugcagugagcuguga

SEQ ID NO: 438105 - RNA, 32 nt, Human
gcccaggaaguggagguugcagugagcagaga

SEQ ID NO: 438106 - RNA, 32 nt, Human
gcccaggaaguugaggcugcagugagcuguga

SEQ ID NO: 438107 - RNA, 32 nt, Human
gcccaggaaguuugugagccagccuggcccug

SEQ ID NO: 438108 - RNA, 32 nt, Human
gcccaggaauaagaaguauggcuggagacucu

SEQ ID NO: 438109 - RNA, 32 nt, Human
gcccaggaaugcagcugggggccaggccguga

SEQ ID NO: 438110 - RNA, 32 nt, Human
gcccaggaauuggaggcugcagugagcuauga

SEQ ID NO: 438111 - RNA, 32 nt, Human
gcccaggaauuugaggcugcagugagcuauua

SEQ ID NO: 438112 - RNA, 32 nt, Human
gcccaggacacugccuuugcugccuucugucu

SEQ ID NO: 438113 - RNA, 32 nt, Human
gcccaggacagaagccauggcauaugacaaag

SEQ ID NO: 438114 - RNA, 32 nt, Human
gcccaggacagccguuucugcccacacacaca

SEQ ID NO: 438115 - RNA, 23 nt, Human
gcccaggacauggacuggucucu

SEQ ID NO: 438116 - RNA, 22 nt, Human
gcccaggacccccacaguggug

SEQ ID NO: 438117 - RNA, 22 nt, Human
gcccaggaccuccggagcagag

SEQ ID NO: 438118 - RNA, 23 nt, Human
gcccaggaccuuuggccaauccc

SEQ ID NO: 438119 - RNA, 32 nt, Human
gcccaggacgcaugggcucugaugggaagagg

SEQ ID NO: 438120 - RNA, 32 nt, Human
gcccaggacggaggaggagguggugaaacagg

SEQ ID NO: 438121 - RNA, 15 nt, Human
gcccaggacugcagc

SEQ ID NO: 438122 - RNA, 32 nt, Human
gcccaggagacagagguugcagugagccaaga

SEQ ID NO: 438123 - RNA, 20 nt, Human
gcccaggagaccccaccucu

SEQ ID NO: 438124 - RNA, 32 nt, Human
gcccaggagacccuggcccugcccugugcccu

SEQ ID NO: 438125 - RNA, 32 nt, Human
gcccaggagagccagcccucccuguccuccuc

SEQ ID NO: 438126 - RNA, 32 nt, Human
gcccaggagagggaccaggggugcgcccacag

SEQ ID NO: 438127 - RNA, 32 nt, Human
gcccaggagagguggauguuugucugagaaaa

SEQ ID NO: 438128 - RNA, 32 nt, Human
gcccaggagaugcaggcuugcagugagccaug

SEQ ID NO: 438129 - RNA, 25 nt, Human
gcccaggagauggagguugcgguga

SEQ ID NO: 438130 - RNA, 32 nt, Human
gcccaggagauggagguugcggugagugggga

SEQ ID NO: 438131 - RNA, 32 nt, Human
gcccaggagauugaggcugaggcugcacugaa

SEQ ID NO: 438132 - RNA, 32 nt, Human
gcccaggagauugaggcugcagugagcaugau

SEQ ID NO: 438133 - RNA, 32 nt, Human
gcccaggagauugaggcugcagugagccauga

SEQ ID NO: 438134 - RNA, 16 nt, Human
gcccaggagccugggc

SEQ ID NO: 438135 - RNA, 32 nt, Human
gcccaggagcucaagauugcagugagcuauga

SEQ ID NO: 438136 - RNA, 17 nt, Human
gcccaggagcugagggg

SEQ ID NO: 438137 - RNA, 32 nt, Human
gcccaggaggaagggagggcagagggggcugu

SEQ ID NO: 438138 - RNA, 19 nt, Human
gcccaggaggaggaggcug

SEQ ID NO: 438139 - RNA, 32 nt, Human
gcccaggaggaggaggcugcagugagcuaaga

SEQ ID NO: 438140 - RNA, 31 nt, Human
gcccaggaggaggagguggagguugcaguga

SEQ ID NO: 438141 - RNA, 32 nt, Human
gcccaggaggcacaggcugcagugagcagaga

SEQ ID NO: 438142 - RNA, 32 nt, Human
gcccaggaggcagaauuugcagugagcugaga

SEQ ID NO: 438143 - RNA, 32 nt, Human
gcccaggaggcagaggcugcagugagccaugc

SEQ ID NO: 438144 - RNA, 32 nt, Human
gcccaggaggcagaggcugcagugagccgaga

SEQ ID NO: 438145 - RNA, 22 nt, Human
gcccaggaggcagaggucgcag

SEQ ID NO: 438146 - RNA, 22 nt, Human
gcccaggaggcagagguugcag

SEQ ID NO: 438147 - RNA, 32 nt, Human
gcccaggaggcagagguugcaguaagccgaga

SEQ ID NO: 438148 - RNA, 25 nt, Human
gcccaggaggcagagguugcaguga

SEQ ID NO: 438149 - RNA, 32 nt, Human
gcccaggaggcagagguugcagugagccaagg

SEQ ID NO: 438150 - RNA, 32 nt, Human
gcccaggaggcagagguugcagugagcugaga

SEQ ID NO: 438151 - RNA, 32 nt, Human
gcccaggaggcagcuggguugcauggagaggu

SEQ ID NO: 438152 - RNA, 32 nt, Human
gcccaggaggccaagguugcagugggcccaga

SEQ ID NO: 438153 - RNA, 32 nt, Human
gcccaggaggccaagucugcagugagcuaugg

SEQ ID NO: 438154 - RNA, 23 nt, Human
gcccaggaggccuuggauaccag

SEQ ID NO: 438155 - RNA, 24 nt, Human
gcccaggaggcggagauugcagug

SEQ ID NO: 438156 - RNA, 32 nt, Human
gcccaggaggcggagauugcagugagccgaga

SEQ ID NO: 438157 - RNA, 32 nt, Human
gcccaggaggcggagcuugcagugagucgaga

SEQ ID NO: 438158 - RNA, 31 nt, Human
gcccaggaggcggaggcagaggcugcaguga

SEQ ID NO: 438159 - RNA, 24 nt, Human
gcccaggaggcggaggcugcagug

SEQ ID NO: 438160 - RNA, 25 nt, Human
gcccaggaggcggaggcugcaguga

SEQ ID NO: 438161 - RNA, 32 nt, Human
gcccaggaggcggaggcugcagugagcugaga

SEQ ID NO: 438162 - RNA, 24 nt, Human
gcccaggaggcggagguugcagug

SEQ ID NO: 438163 - RNA, 25 nt, Human
gcccaggaggcggagguugcaguga

SEQ ID NO: 438164 - RNA, 32 nt, Human
gcccaggaggcggagguugcagugagcugaga

SEQ ID NO: 438165 - RNA, 24 nt, Human
gcccaggaggcggagguugcggug

SEQ ID NO: 438166 - RNA, 23 nt, Human
gcccaggaggcugaagacaggug

SEQ ID NO: 438167 - RNA, 32 nt, Human
gcccaggaggcugaggcaggagaaucgcuuga

SEQ ID NO: 438168 - RNA, 32 nt, Human
gcccaggaggcugaggcaugagaaucgcuuga

SEQ ID NO: 438169 - RNA, 32 nt, Human
gcccaggaggcuuugagaaagccuucucugug

SEQ ID NO: 438170 - RNA, 32 nt, Human
gcccaggagggaacaggagccugagccagggc

SEQ ID NO: 438171 - RNA, 23 nt, Human
gcccaggagggagugcaguggug

SEQ ID NO: 438172 - RNA, 32 nt, Human
gcccaggaggggccagugggggcuccacucgu

SEQ ID NO: 438173 - RNA, 32 nt, Human
gcccaggaggucaagacugcagugagcuauga

SEQ ID NO: 438174 - RNA, 32 nt, Human
gcccaggaggucaaggcuacagugagccguga

SEQ ID NO: 438175 - RNA, 32 nt, Human
gcccaggaggucaaggcugcagugagccguga

SEQ ID NO: 438176 - RNA, 32 nt, Human
gcccaggaggucaaggcugcagugagcugcac

SEQ ID NO: 438177 - RNA, 32 nt, Human
gcccaggaggucaaggcugcagugagcuguga

SEQ ID NO: 438178 - RNA, 32 nt, Human
gcccaggaggucaaggcugcagugagcuuuga

SEQ ID NO: 438179 - RNA, 32 nt, Human
gcccaggaggucaaggcuucagugagccauga

SEQ ID NO: 438180 - RNA, 32 nt, Human
gcccaggaggucaaggguacagugagccgagg

SEQ ID NO: 438181 - RNA, 32 nt, Human
gcccaggaggucagggcugcagugagccgaga

SEQ ID NO: 438182 - RNA, 30 nt, Human
gcccaggaggucaggucaaggcugcaguga

SEQ ID NO: 438183 - RNA, 32 nt, Human
gcccaggaggucgaggcugcagugagccauga

SEQ ID NO: 438184 - RNA, 32 nt, Human
gcccaggaggucgaggcugcagugagcccuga

SEQ ID NO: 438185 - RNA, 32 nt, Human
gcccaggaggucgaggcugcagugagcuauga

SEQ ID NO: 438186 - RNA, 32 nt, Human
gcccaggaggucgaggcugcagugagcuguga

SEQ ID NO: 438187 - RNA, 32 nt, Human
gcccaggaggucgagguugcagugagcaguaa

SEQ ID NO: 438188 - RNA, 32 nt, Human
gcccaggaggucuaggcugcagugagcuuaug

SEQ ID NO: 438189 - RNA, 22 nt, Human
gcccaggaggugcuggagcuag

SEQ ID NO: 438190 - RNA, 32 nt, Human
gcccaggagguggaaacugcagagagucauga

SEQ ID NO: 438191 - RNA, 32 nt, Human
gcccaggagguggaggcugcaaugagcugaga

SEQ ID NO: 438192 - RNA, 24 nt, Human
gcccaggagguggaggcugcagug

SEQ ID NO: 438193 - RNA, 32 nt, Human
gcccaggagguggaggcugcagugagccaugc

SEQ ID NO: 438194 - RNA, 32 nt, Human
gcccaggagguggagguugcaaugagccgaga

SEQ ID NO: 438195 - RNA, 32 nt, Human
gcccaggagguggagguugcacugagcggaga

SEQ ID NO: 438196 - RNA, 22 nt, Human
gcccaggagguggagguugcag

SEQ ID NO: 438197 - RNA, 24 nt, Human
gcccaggagguggagguugcagug

SEQ ID NO: 438198 - RNA, 32 nt, Human
gcccaggagguggagguugcagugagcagaga

SEQ ID NO: 438199 - RNA, 32 nt, Human
gcccaggagguggagguugcagugagccaaga

SEQ ID NO: 438200 - RNA, 32 nt, Human
gcccaggagguggagguugcagugagccauga

SEQ ID NO: 438201 - RNA, 32 nt, Human
gcccaggagguggagguugcagugagccgaga

SEQ ID NO: 438202 - RNA, 32 nt, Human
gcccaggagguggagguugcagugagcggaga

SEQ ID NO: 438203 - RNA, 32 nt, Human
gcccaggagguggagguugcagugagcugaga

SEQ ID NO: 438204 - RNA, 32 nt, Human
gcccaggagguggagguuucagcgagcugaga

SEQ ID NO: 438205 - RNA, 32 nt, Human
gcccaggaggugguguuggcugcaggguacac

SEQ ID NO: 438206 - RNA, 32 nt, Human
gcccaggagguugagaaugcagugagcuugua

SEQ ID NO: 438207 - RNA, 32 nt, Human
gcccaggagguugaggcugcagugagcagagc

SEQ ID NO: 438208 - RNA, 32 nt, Human
gcccaggagguugaggcugcagugagccauga

SEQ ID NO: 438209 - RNA, 32 nt, Human
gcccaggagguugaggcugcagugagcuauga

SEQ ID NO: 438210 - RNA, 32 nt, Human
gcccaggagguugaggcugcagugagguauga

SEQ ID NO: 438211 - RNA, 32 nt, Human
gcccaggagguugaggcugcagugagguguga

SEQ ID NO: 438212 - RNA, 32 nt, Human
gcccaggagguugaggcugcagugaguucuaa

SEQ ID NO: 438213 - RNA, 32 nt, Human
gcccaggagguugaggucacagugagcuguga

SEQ ID NO: 438214 - RNA, 32 nt, Human
gcccaggagguuguggauacagugaguuauga

SEQ ID NO: 438215 - RNA, 32 nt, Human
gcccaggagguuguggcugcagugagcuguga

SEQ ID NO: 438216 - RNA, 32 nt, Human
gcccaggaguccaggcccccagccccuccucc

SEQ ID NO: 438217 - RNA, 32 nt, Human
gcccaggagucugaggcuucagugaguuauga

SEQ ID NO: 438218 - RNA, 20 nt, Human
gcccaggagugauuugugca

SEQ ID NO: 438219 - RNA, 32 nt, Human
gcccaggaguuagagaccagcccagccugguc

SEQ ID NO: 438220 - RNA, 32 nt, Human
gcccaggaguucaaagcugcagugagucauga

SEQ ID NO: 438221 - RNA, 32 nt, Human
gcccaggaguucaagaccagccuggacaacac

SEQ ID NO: 438222 - RNA, 32 nt, Human
gcccaggaguucaagaccagccuggacaacau

SEQ ID NO: 438223 - RNA, 32 nt, Human
gcccaggaguucaagaccagccuggacagcuu

SEQ ID NO: 438224 - RNA, 32 nt, Human
gcccaggaguucaaggcugcagugagcuauga

SEQ ID NO: 438225 - RNA, 32 nt, Human
gcccaggaguucaaggcuucagugagccauga

SEQ ID NO: 438226 - RNA, 20 nt, Human
gcccaggaguucagggccag

SEQ ID NO: 438227 - RNA, 32 nt, Human
gcccaggaguucagggcugcagugagccuuga

SEQ ID NO: 438228 - RNA, 32 nt, Human
gcccaggaguucagggcugcagugagguacga

SEQ ID NO: 438229 - RNA, 32 nt, Human
gcccaggaguucgagaccagccuggacaacau

SEQ ID NO: 438230 - RNA, 32 nt, Human
gcccaggaguucgagaucagccuggacaauac

SEQ ID NO: 438231 - RNA, 32 nt, Human
gcccaggaguucgaggcugcagugagcuauga

SEQ ID NO: 438232 - RNA, 32 nt, Human
gcccaggaguucgggguuacagugagcugugg

SEQ ID NO: 438233 - RNA, 32 nt, Human
gcccaggaguuggagaccagccuggauaacaa

SEQ ID NO: 438234 - RNA, 32 nt, Human
gcccaggaguuggagaccugccugggcaacau

SEQ ID NO: 438235 - RNA, 32 nt, Human
gcccaggaguuggaggccacagugagcuauga

SEQ ID NO: 438236 - RNA, 32 nt, Human
gcccaggaguuggaggccgcagugagcuguga

SEQ ID NO: 438237 - RNA, 32 nt, Human
gcccaggaguuuaaggcugcagugagcuauga

SEQ ID NO: 438238 - RNA, 32 nt, Human
gcccaggaguuuaaggcugcagugagcuugga

SEQ ID NO: 438239 - RNA, 32 nt, Human
gcccaggaguuugaagcugcagugagcuauga

SEQ ID NO: 438240 - RNA, 32 nt, Human
gcccaggaguuugacaccagcaugggcaauau

SEQ ID NO: 438241 - RNA, 32 nt, Human
gcccaggaguuugagaccagccuggacaacaa

SEQ ID NO: 438242 - RNA, 29 nt, Human
gcccaggaguuugagaguuugagcaguga

SEQ ID NO: 438243 - RNA, 32 nt, Human
gcccaggaguuugaggaugcagugagcuaugg

SEQ ID NO: 438244 - RNA, 32 nt, Human
gcccaggaguuugaggcuacagugagcuguga

SEQ ID NO: 438245 - RNA, 32 nt, Human
gcccaggaguuugaggcuccagugagcuguga

SEQ ID NO: 438246 - RNA, 32 nt, Human
gcccaggaguuugaggcugcagugagccauca

SEQ ID NO: 438247 - RNA, 32 nt, Human
gcccaggaguuugaggcugcagugagccauga

SEQ ID NO: 438248 - RNA, 32 nt, Human
gcccaggaguuugaggcugcagugagcuauga

SEQ ID NO: 438249 - RNA, 32 nt, Human
gcccaggaguuugaggcugcagugagcuauua

SEQ ID NO: 438250 - RNA, 32 nt, Human
gcccaggaguuugaggcugcagugagcuguga

SEQ ID NO: 438251 - RNA, 32 nt, Human
gcccaggaguuugaggcugcagugaguuauga

SEQ ID NO: 438252 - RNA, 32 nt, Human
gcccaggaguuugaggcugcagugaguuaugg

SEQ ID NO: 438253 - RNA, 32 nt, Human
gcccaggaguuugagguugcagugagcugauc

SEQ ID NO: 438254 - RNA, 32 nt, Human
gcccaggaguuugagguugcagugagcuguga

SEQ ID NO: 438255 - RNA, 32 nt, Human
gcccaggaguuugagguuggccuggacaacau

SEQ ID NO: 438256 - RNA, 32 nt, Human
gcccaggaguuugaguccagccuggacgauau

SEQ ID NO: 438257 - RNA, 32 nt, Human
gcccaggaguuuuagacuagccuggacaacua

SEQ ID NO: 438258 - RNA, 22 nt, Human
gcccaggaucaagggugcggug

SEQ ID NO: 438259 - RNA, 32 nt, Human
gcccaggaucccgggaaaggcaggggaggggg

SEQ ID NO: 438260 - RNA, 32 nt, Human
gcccaggauccucagaggaagauggagaggag

SEQ ID NO: 438261 - RNA, 32 nt, Human
gcccaggaugauaggaggcaaugaagucaagg

SEQ ID NO: 438262 - RNA, 32 nt, Human
gcccaggaugcagagguugaagugagccaaga

SEQ ID NO: 438263 - RNA, 32 nt, Human
gcccaggaugcugaaagcagauuucuucuuga

SEQ ID NO: 438264 - RNA, 19 nt, Human
gcccaggauggagugcagu

SEQ ID NO: 438265 - RNA, 20 nt, Human
gcccaggauggagugcagug

SEQ ID NO: 438266 - RNA, 21 nt, Human
gcccaggauggagugcagugg

SEQ ID NO: 438267 - RNA, 22 nt, Human
gcccaggauggagugcaguggc

SEQ ID NO: 438268 - RNA, 23 nt, Human
gcccaggauggagugcaguggug

SEQ ID NO: 438269 - RNA, 21 nt, Human
gcccaggauggccuggugccc

SEQ ID NO: 438270 - RNA, 32 nt, Human
gcccaggauggccuugaacuccugggcucaag

SEQ ID NO: 438271 - RNA, 32 nt, Human
gcccaggauggucggcugccuggggacauugc

SEQ ID NO: 438272 - RNA, 32 nt, Human
gcccaggauggucggcugccuggggacauugu

SEQ ID NO: 438273 - RNA, 32 nt, Human
gcccaggcaaagcguccgggcagcguaggcgg

SEQ ID NO: 438274 - RNA, 21 nt, Human
gcccaggcaagagugcagugg

SEQ ID NO: 438275 - RNA, 22 nt, Human
gcccaggcaagagugcaguggu

SEQ ID NO: 438276 - RNA, 32 nt, Human
gcccaggcacacugcccaccaccccacccccg

SEQ ID NO: 438277 - RNA, 20 nt, Human
gcccaggcaccacccaagcc

SEQ ID NO: 438278 - RNA, 32 nt, Human
gcccaggcacugauuguggcagaggggccacu

SEQ ID NO: 438279 - RNA, 21 nt, Human
gcccaggcacugcaaaccgcc

SEQ ID NO: 438280 - RNA, 32 nt, Human
gcccaggcacugcaaaccgccaccucccuaua

SEQ ID NO: 438281 - RNA, 19 nt, Human
gcccaggcagaagcagcag

SEQ ID NO: 438282 - RNA, 32 nt, Human
gcccaggcagaucucagacuccugggcucaag

SEQ ID NO: 438283 - RNA, 32 nt, Human
gcccaggcagcaaugggguuccugcagcugcu

SEQ ID NO: 438284 - RNA, 32 nt, Human
gcccaggcagcggaauagagugcagugcuugg

SEQ ID NO: 438285 - RNA, 32 nt, Human
gcccaggcagcguggaggggaaggguagggca

SEQ ID NO: 438286 - RNA, 23 nt, Human
gcccaggcaggaguacaguagug

SEQ ID NO: 438287 - RNA, 21 nt, Human
gcccaggcaggaguacagugg

SEQ ID NO: 438288 - RNA, 32 nt, Human
gcccaggcaggcggaggauacccagggugagg

SEQ ID NO: 438289 - RNA, 32 nt, Human
gcccaggcaggcgggucaugaggucaggagau

SEQ ID NO: 438290 - RNA, 18 nt, Human
gcccaggcagggagacag

SEQ ID NO: 438291 - RNA, 21 nt, Human
gcccaggcaguagugcagugg

SEQ ID NO: 438292 - RNA, 21 nt, Human
gcccaggcaugggagaaacag

SEQ ID NO: 438293 - RNA, 20 nt, Human
gcccaggccaagcaaaagca

SEQ ID NO: 438294 - RNA, 22 nt, Human
gcccaggccagaggguagagca

SEQ ID NO: 438295 - RNA, 21 nt, Human
gcccaggccagagugcagugg

SEQ ID NO: 438296 - RNA, 22 nt, Human
gcccaggccaggccugugguca

SEQ ID NO: 438297 - RNA, 32 nt, Human
gcccaggccagucucaaacuccuggccucaug

SEQ ID NO: 438298 - RNA, 18 nt, Human
gcccaggccccaacacag

SEQ ID NO: 438299 - RNA, 17 nt, Human
gcccaggccccacccca

SEQ ID NO: 438300 - RNA, 20 nt, Human
gcccaggccccaggagccag

SEQ ID NO: 438301 - RNA, 32 nt, Human
gcccaggccccguggcccuggagccucaauaa

SEQ ID NO: 438302 - RNA, 32 nt, Human
gcccaggcccgguggaccugccgccaugcagg

SEQ ID NO: 438303 - RNA, 32 nt, Human
gcccaggcccuuggccuuccucuccccugccu

SEQ ID NO: 438304 - RNA, 32 nt, Human
gcccaggccgcagaggaagcugggcacugggu

SEQ ID NO: 438305 - RNA, 32 nt, Human
gcccaggccggaguacaguggcaugucucagc

SEQ ID NO: 438306 - RNA, 21 nt, Human
gcccaggccggagugcaaugg

SEQ ID NO: 438307 - RNA, 23 nt, Human
gcccaggccggagugcaauggca

SEQ ID NO: 438308 - RNA, 20 nt, Human
gcccaggccggcaguggcug

SEQ ID NO: 438309 - RNA, 20 nt, Human
gcccaggccggggaggggug

SEQ ID NO: 438310 - RNA, 20 nt, Human
gcccaggccgggggcggugg

SEQ ID NO: 438311 - RNA, 21 nt, Human
gcccaggccucuaccccagua

SEQ ID NO: 438312 - RNA, 21 nt, Human
gcccaggccugccuguuccca

SEQ ID NO: 438313 - RNA, 25 nt, Human
gcccaggccuggaagacaaaggcgu

SEQ ID NO: 438314 - RNA, 21 nt, Human
gcccaggccugggaugcagug

SEQ ID NO: 438315 - RNA, 24 nt, Human
gcccaggccugggaugcagugaug

SEQ ID NO: 438316 - RNA, 32 nt, Human
gcccaggccuguaaucccaucacuuugggagg

SEQ ID NO: 438317 - RNA, 32 nt, Human
gcccaggccuucacagacccccaaaccggaac

SEQ ID NO: 438318 - RNA, 24 nt, Human
gcccaggcgccaccacugaugcca

SEQ ID NO: 438319 - RNA, 22 nt, Human
gcccaggcgcccgccugacaca

SEQ ID NO: 438320 - RNA, 20 nt, Human
gcccaggcggaguacaaugg

SEQ ID NO: 438321 - RNA, 22 nt, Human
gcccaggcggaguacaauggug

SEQ ID NO: 438322 - RNA, 18 nt, Human
gcccaggcggcagagccg

SEQ ID NO: 438323 - RNA, 20 nt, Human
gcccaggcgggagugcagug

SEQ ID NO: 438324 - RNA, 21 nt, Human
gcccaggcgggagugcagugg

SEQ ID NO: 438325 - RNA, 22 nt, Human
gcccaggcgggagugcaguggc

SEQ ID NO: 438326 - RNA, 21 nt, Human
gcccaggcggggugcgagugg

SEQ ID NO: 438327 - RNA, 32 nt, Human
gcccaggcgguugaggcugcagugagccauga

SEQ ID NO: 438328 - RNA, 22 nt, Human
gcccaggcguuggcagcagggu

SEQ ID NO: 438329 - RNA, 21 nt, Human
gcccaggcuacagugcagugg

SEQ ID NO: 438330 - RNA, 20 nt, Human
gcccaggcuagagcgcaggg

SEQ ID NO: 438331 - RNA, 21 nt, Human
gcccaggcuagaguauagugg

SEQ ID NO: 438332 - RNA, 22 nt, Human
gcccaggcuagaguauaguggu

SEQ ID NO: 438333 - RNA, 24 nt, Human
gcccaggcuagaguauaguggugu

SEQ ID NO: 438334 - RNA, 19 nt, Human
gcccaggcuagagugcaau

SEQ ID NO: 438335 - RNA, 20 nt, Human
gcccaggcuagagugcaaug

SEQ ID NO: 438336 - RNA, 21 nt, Human
gcccaggcuagagugcaaugg

SEQ ID NO: 438337 - RNA, 23 nt, Human
gcccaggcuagagugcaauggca

SEQ ID NO: 438338 - RNA, 23 nt, Human
gcccaggcuagagugcaauggug

SEQ ID NO: 438339 - RNA, 23 nt, Human
gcccaggcuagagugcacuggug

SEQ ID NO: 438340 - RNA, 20 nt, Human
gcccaggcuagagugcagca

SEQ ID NO: 438341 - RNA, 23 nt, Human
gcccaggcuagagugcagcagug

SEQ ID NO: 438342 - RNA, 19 nt, Human
gcccaggcuagagugcagu

SEQ ID NO: 438343 - RNA, 20 nt, Human
gcccaggcuagagugcagug

SEQ ID NO: 438344 - RNA, 21 nt, Human
gcccaggcuagagugcagugg

SEQ ID NO: 438345 - RNA, 22 nt, Human
gcccaggcuagagugcaguggc

SEQ ID NO: 438346 - RNA, 24 nt, Human
gcccaggcuagagugcaguggcgu

SEQ ID NO: 438347 - RNA, 22 nt, Human
gcccaggcuagagugcaguggu

SEQ ID NO: 438348 - RNA, 23 nt, Human
gcccaggcuagagugcaguggug

SEQ ID NO: 438349 - RNA, 22 nt, Human
gcccaggcuagaguggauuggc

SEQ ID NO: 438350 - RNA, 24 nt, Human
gcccaggcuagaguggauuggcgu

SEQ ID NO: 438351 - RNA, 24 nt, Human
gcccaggcuagcaugcaauggugu

SEQ ID NO: 438352 - RNA, 32 nt, Human
gcccaggcuagccucaaacuccugggcuccag

SEQ ID NO: 438353 - RNA, 32 nt, Human
gcccaggcuagucucaaacuccugggcucaag

SEQ ID NO: 438354 - RNA, 32 nt, Human
gcccaggcuagucuccaacuccugggcucaga

SEQ ID NO: 438355 - RNA, 32 nt, Human
gcccaggcuagucuugaacuccugggcucaag

SEQ ID NO: 438356 - RNA, 32 nt, Human
gcccaggcuagucuugaacuccugggcucgaa

SEQ ID NO: 438357 - RNA, 32 nt, Human
gcccaggcuagucuugaacuccuggguucaag

SEQ ID NO: 438358 - RNA, 32 nt, Human
gcccaggcuaguuuugaauuccugggcucaag

SEQ ID NO: 438359 - RNA, 23 nt, Human
gcccaggcuauggggacaaaggc

SEQ ID NO: 438360 - RNA, 32 nt, Human
gcccaggcucaagugauucuccugccugaacc

SEQ ID NO: 438361 - RNA, 32 nt, Human
gcccaggcuccaggaagugccuugggcagugg

SEQ ID NO: 438362 - RNA, 32 nt, Human
gcccaggcuccuacucuccuugcucagucugc

SEQ ID NO: 438363 - RNA, 32 nt, Human
gcccaggcuccuggugugucugcagugcaggu

SEQ ID NO: 438364 - RNA, 32 nt, Human
gcccaggcucugagagccagcccaggggcggc

SEQ ID NO: 438365 - RNA, 18 nt, Human
gcccaggcugaagcucag

SEQ ID NO: 438366 - RNA, 32 nt, Human
gcccaggcugaagugaucucggcucaccacaa

SEQ ID NO: 438367 - RNA, 23 nt, Human
gcccaggcugaagugcaauguug

SEQ ID NO: 438368 - RNA, 24 nt, Human
gcccaggcugaagugcaauguugu

SEQ ID NO: 438369 - RNA, 20 nt, Human
gcccaggcugaagugcagug

SEQ ID NO: 438370 - RNA, 21 nt, Human
gcccaggcugaagugcagugg

SEQ ID NO: 438371 - RNA, 24 nt, Human
gcccaggcugaagugcaguggugu

SEQ ID NO: 438372 - RNA, 24 nt, Human
gcccaggcugaagugcaguguugu

SEQ ID NO: 438373 - RNA, 21 nt, Human
gcccaggcugaagugccaugg

SEQ ID NO: 438374 - RNA, 23 nt, Human
gcccaggcugaagugccauggug

SEQ ID NO: 438375 - RNA, 32 nt, Human
gcccaggcugaaguguagagugcaguggcaug

SEQ ID NO: 438376 - RNA, 21 nt, Human
gcccaggcugaaguguagugg

SEQ ID NO: 438377 - RNA, 32 nt, Human
gcccaggcugaauucagacuccugggcuuaag

SEQ ID NO: 438378 - RNA, 23 nt, Human
gcccaggcugagagcagcagggu

SEQ ID NO: 438379 - RNA, 32 nt, Human
gcccaggcugaggagcuuggcggcgagguauu

SEQ ID NO: 438380 - RNA, 19 nt, Human
gcccaggcugaguacagug

SEQ ID NO: 438381 - RNA, 20 nt, Human
gcccaggcugaguacagugg

SEQ ID NO: 438382 - RNA, 21 nt, Human
gcccaggcugaguacaguggu

SEQ ID NO: 438383 - RNA, 22 nt, Human
gcccaggcugaguacaguggug

SEQ ID NO: 438384 - RNA, 20 nt, Human
gcccaggcugagugugagug

SEQ ID NO: 438385 - RNA, 32 nt, Human
gcccaggcugaucucagauuccugggcugaag

SEQ ID NO: 438386 - RNA, 32 nt, Human
gcccaggcugaucuugaacuccugggcucaag

SEQ ID NO: 438387 - RNA, 32 nt, Human
gcccaggcugcaacccucuguucccaagggca

SEQ ID NO: 438388 - RNA, 32 nt, Human
gcccaggcugcaaccucgaccucccgggcuca

SEQ ID NO: 438389 - RNA, 20 nt, Human
gcccaggcugcaggagccag

SEQ ID NO: 438390 - RNA, 19 nt, Human
gcccaggcugcagugcagu

SEQ ID NO: 438391 - RNA, 20 nt, Human
gcccaggcugcagugcagug

SEQ ID NO: 438392 - RNA, 21 nt, Human
gcccaggcugcagugcagugg

SEQ ID NO: 438393 - RNA, 22 nt, Human
gcccaggcugcagugcaguggc

SEQ ID NO: 438394 - RNA, 23 nt, Human
gcccaggcugcagugcaguggug

SEQ ID NO: 438395 - RNA, 24 nt, Human
gcccaggcugcagugcaguggugu

SEQ ID NO: 438396 - RNA, 32 nt, Human
gcccaggcugcccugcacuccugccucccagc

SEQ ID NO: 438397 - RNA, 32 nt, Human
gcccaggcugccucucaucuccacccacugac

SEQ ID NO: 438398 - RNA, 20 nt, Human
gcccaggcugcuggagccag

SEQ ID NO: 438399 - RNA, 24 nt, Human
gcccaggcugcuggagugccgugg

SEQ ID NO: 438400 - RNA, 21 nt, Human
gcccaggcuggaauacagugg

SEQ ID NO: 438401 - RNA, 24 nt, Human
gcccaggcuggaaugcaauggcgu

SEQ ID NO: 438402 - RNA, 19 nt, Human
gcccaggcuggaaugcagu

SEQ ID NO: 438403 - RNA, 21 nt, Human
gcccaggcuggaaugcaguag

SEQ ID NO: 438404 - RNA, 22 nt, Human
gcccaggcuggaaugcaguagc

SEQ ID NO: 438405 - RNA, 20 nt, Human
gcccaggcuggaaugcagug

SEQ ID NO: 438406 - RNA, 21 nt, Human
gcccaggcuggaaugcagugg

SEQ ID NO: 438407 - RNA, 22 nt, Human
gcccaggcuggaaugcaguggc

SEQ ID NO: 438408 - RNA, 24 nt, Human
gcccaggcuggaaugcaguggcgu

SEQ ID NO: 438409 - RNA, 23 nt, Human
gcccaggcuggaaugcaguggug

SEQ ID NO: 438410 - RNA, 24 nt, Human
gcccaggcuggaaugcaguggugu

SEQ ID NO: 438411 - RNA, 21 nt, Human
gcccaggcuggaaugcuguag

SEQ ID NO: 438412 - RNA, 32 nt, Human
gcccaggcuggaccugaacuccugggcuugag

SEQ ID NO: 438413 - RNA, 32 nt, Human
gcccaggcuggacucaaauuccugggcucaag

SEQ ID NO: 438414 - RNA, 20 nt, Human
gcccaggcuggacuccagca

SEQ ID NO: 438415 - RNA, 32 nt, Human
gcccaggcuggacuccagcacaguggcaugau

SEQ ID NO: 438416 - RNA, 32 nt, Human
gcccaggcuggacugcagcagcgugaucucag

SEQ ID NO: 438417 - RNA, 20 nt, Human
gcccaggcuggacugcagug

SEQ ID NO: 438418 - RNA, 21 nt, Human
gcccaggcuggacugcagugg

SEQ ID NO: 438419 - RNA, 24 nt, Human
gcccaggcuggacugcaguggcgu

SEQ ID NO: 438420 - RNA, 23 nt, Human
gcccaggcuggacugcaguggug

SEQ ID NO: 438421 - RNA, 21 nt, Human
gcccaggcuggagagcagugg

SEQ ID NO: 438422 - RNA, 22 nt, Human
gcccaggcuggagagcaguggc

SEQ ID NO: 438423 - RNA, 23 nt, Human
gcccaggcuggagagcaguggcg

SEQ ID NO: 438424 - RNA, 21 nt, Human
gcccaggcuggagcauagugg

SEQ ID NO: 438425 - RNA, 20 nt, Human
gcccaggcuggagcgaagug

SEQ ID NO: 438426 - RNA, 20 nt, Human
gcccaggcuggagcgcaaug

SEQ ID NO: 438427 - RNA, 21 nt, Human
gcccaggcuggagcgcaaugg

SEQ ID NO: 438428 - RNA, 22 nt, Human
gcccaggcuggagcgcaauggc

SEQ ID NO: 438429 - RNA, 24 nt, Human
gcccaggcuggagcgcaauggcau

SEQ ID NO: 438430 - RNA, 19 nt, Human
gcccaggcuggagcgcagu

SEQ ID NO: 438431 - RNA, 21 nt, Human
gcccaggcuggagcgcagucc

SEQ ID NO: 438432 - RNA, 20 nt, Human
gcccaggcuggagcgcagug

SEQ ID NO: 438433 - RNA, 21 nt, Human
gcccaggcuggagcgcagugg

SEQ ID NO: 438434 - RNA, 23 nt, Human
gcccaggcuggagcgcaguggug

SEQ ID NO: 438435 - RNA, 21 nt, Human
gcccaggcuggagggcaaugg

SEQ ID NO: 438436 - RNA, 23 nt, Human
gcccaggcuggagggcaauggcg

SEQ ID NO: 438437 - RNA, 24 nt, Human
gcccaggcuggagggcaauggcgu

SEQ ID NO: 438438 - RNA, 22 nt, Human
gcccaggcuggagggcaauggu

SEQ ID NO: 438439 - RNA, 23 nt, Human
gcccaggcuggagggcaauggug

SEQ ID NO: 438440 - RNA, 20 nt, Human
gcccaggcuggagggcagug

SEQ ID NO: 438441 - RNA, 24 nt, Human
gcccaggcuggagggcagugacgu

SEQ ID NO: 438442 - RNA, 21 nt, Human
gcccaggcuggagggcagugg

SEQ ID NO: 438443 - RNA, 22 nt, Human
gcccaggcuggagggcaguggc

SEQ ID NO: 438444 - RNA, 23 nt, Human
gcccaggcuggagggcaguggca

SEQ ID NO: 438445 - RNA, 24 nt, Human
gcccaggcuggagggcaguggcgu

SEQ ID NO: 438446 - RNA, 24 nt, Human
gcccaggcuggagguuaauggcau

SEQ ID NO: 438447 - RNA, 19 nt, Human
gcccaggcuggaguacaau

SEQ ID NO: 438448 - RNA, 20 nt, Human
gcccaggcuggaguacaaug

SEQ ID NO: 438449 - RNA, 21 nt, Human
gcccaggcuggaguacaaugg

SEQ ID NO: 438450 - RNA, 24 nt, Human
gcccaggcuggaguacaauggcau

SEQ ID NO: 438451 - RNA, 24 nt, Human
gcccaggcuggaguacaauggcgu

SEQ ID NO: 438452 - RNA, 22 nt, Human
gcccaggcuggaguacaauggu

SEQ ID NO: 438453 - RNA, 23 nt, Human
gcccaggcuggaguacaauggug

SEQ ID NO: 438454 - RNA, 19 nt, Human
gcccaggcuggaguacagu

SEQ ID NO: 438455 - RNA, 20 nt, Human
gcccaggcuggaguacagug

SEQ ID NO: 438456 - RNA, 23 nt, Human
gcccaggcuggaguacagugaug

SEQ ID NO: 438457 - RNA, 24 nt, Human
gcccaggcuggaguacagugaugu

SEQ ID NO: 438458 - RNA, 21 nt, Human
gcccaggcuggaguacagugg

SEQ ID NO: 438459 - RNA, 22 nt, Human
gcccaggcuggaguacaguggc

SEQ ID NO: 438460 - RNA, 22 nt, Human
gcccaggcuggaguacaguggu

SEQ ID NO: 438461 - RNA, 24 nt, Human
gcccaggcuggaguacagugguca

SEQ ID NO: 438462 - RNA, 24 nt, Human
gcccaggcuggaguacaguggugu

SEQ ID NO: 438463 - RNA, 24 nt, Human
gcccaggcuggaguacauuggugu

SEQ ID NO: 438464 - RNA, 32 nt, Human
gcccaggcuggaguauaauggcaugucucgac

SEQ ID NO: 438465 - RNA, 23 nt, Human
gcccaggcuggaguauaguagug

SEQ ID NO: 438466 - RNA, 32 nt, Human
gcccaggcuggaguauaguagugcaguggugu

SEQ ID NO: 438467 - RNA, 24 nt, Human
gcccaggcuggagugaaguggcgu

SEQ ID NO: 438468 - RNA, 21 nt, Human
gcccaggcuggagugaggugg

SEQ ID NO: 438469 - RNA, 25 nt, Human
gcccaggcuggagugagugcagugg

SEQ ID NO: 438470 - RNA, 26 nt, Human
gcccaggcuggagugagugcaguggc

SEQ ID NO: 438471 - RNA, 18 nt, Human
gcccaggcuggagugcaa

SEQ ID NO: 438472 - RNA, 21 nt, Human
gcccaggcuggagugcaacgg

SEQ ID NO: 438473 - RNA, 23 nt, Human
gcccaggcuggagugcaacggca

SEQ ID NO: 438474 - RNA, 22 nt, Human
gcccaggcuggagugcaacggu

SEQ ID NO: 438475 - RNA, 19 nt, Human
gcccaggcuggagugcaau

SEQ ID NO: 438476 - RNA, 21 nt, Human
gcccaggcuggagugcaauag

SEQ ID NO: 438477 - RNA, 23 nt, Human
gcccaggcuggagugcaauagca

SEQ ID NO: 438478 - RNA, 24 nt, Human
gcccaggcuggagugcaauagcau

SEQ ID NO: 438479 - RNA, 20 nt, Human
gcccaggcuggagugcaaug

SEQ ID NO: 438480 - RNA, 22 nt, Human
gcccaggcuggagugcaaugca

SEQ ID NO: 438481 - RNA, 24 nt, Human
gcccaggcuggagugcaaugcugu

SEQ ID NO: 438482 - RNA, 21 nt, Human
gcccaggcuggagugcaaugg

SEQ ID NO: 438483 - RNA, 22 nt, Human
gcccaggcuggagugcaauggc

SEQ ID NO: 438484 - RNA, 23 nt, Human
gcccaggcuggagugcaauggca

SEQ ID NO: 438485 - RNA, 24 nt, Human
gcccaggcuggagugcaauggcau

SEQ ID NO: 438486 - RNA, 24 nt, Human
gcccaggcuggagugcaauggcgu

SEQ ID NO: 438487 - RNA, 22 nt, Human
gcccaggcuggagugcaauggu

SEQ ID NO: 438488 - RNA, 23 nt, Human
gcccaggcuggagugcaauggug

SEQ ID NO: 438489 - RNA, 24 nt, Human
gcccaggcuggagugcaauggugu

SEQ ID NO: 438490 - RNA, 20 nt, Human
gcccaggcuggagugcacug

SEQ ID NO: 438491 - RNA, 21 nt, Human
gcccaggcuggagugcacugg

SEQ ID NO: 438492 - RNA, 24 nt, Human
gcccaggcuggagugcacuggcgu

SEQ ID NO: 438493 - RNA, 18 nt, Human
gcccaggcuggagugcag

SEQ ID NO: 438494 - RNA, 21 nt, Human
gcccaggcuggagugcagagg

SEQ ID NO: 438495 - RNA, 23 nt, Human
gcccaggcuggagugcagaggug

SEQ ID NO: 438496 - RNA, 20 nt, Human
gcccaggcuggagugcagca

SEQ ID NO: 438497 - RNA, 21 nt, Human
gcccaggcuggagugcagcag

SEQ ID NO: 438498 - RNA, 22 nt, Human
gcccaggcuggagugcagcagc

SEQ ID NO: 438499 - RNA, 23 nt, Human
gcccaggcuggagugcagcagca

SEQ ID NO: 438500 - RNA, 23 nt, Human
gcccaggcuggagugcagcgcau

SEQ ID NO: 438501 - RNA, 20 nt, Human
gcccaggcuggagugcaggg

SEQ ID NO: 438502 - RNA, 19 nt, Human
gcccaggcuggagugcagu

SEQ ID NO: 438503 - RNA, 21 nt, Human
gcccaggcuggagugcaguag

SEQ ID NO: 438504 - RNA, 22 nt, Human
gcccaggcuggagugcaguagc

SEQ ID NO: 438505 - RNA, 23 nt, Human
gcccaggcuggagugcaguagca

SEQ ID NO: 438506 - RNA, 22 nt, Human
gcccaggcuggagugcaguagg

SEQ ID NO: 438507 - RNA, 24 nt, Human
gcccaggcuggagugcaguaggca

SEQ ID NO: 438508 - RNA, 32 nt, Human
gcccaggcuggagugcaguagugcagucgugg

SEQ ID NO: 438509 - RNA, 23 nt, Human
gcccaggcuggagugcagucgug

SEQ ID NO: 438510 - RNA, 20 nt, Human
gcccaggcuggagugcagug

SEQ ID NO: 438511 - RNA, 23 nt, Human
gcccaggcuggagugcagugaug

SEQ ID NO: 438512 - RNA, 24 nt, Human
gcccaggcuggagugcagugaugu

SEQ ID NO: 438513 - RNA, 21 nt, Human
gcccaggcuggagugcagugg

SEQ ID NO: 438514 - RNA, 22 nt, Human
gcccaggcuggagugcaguggc

SEQ ID NO: 438515 - RNA, 24 nt, Human
gcccaggcuggagugcaguggcgu

SEQ ID NO: 438516 - RNA, 22 nt, Human
gcccaggcuggagugcaguggu

SEQ ID NO: 438517 - RNA, 23 nt, Human
gcccaggcuggagugcaguggug

SEQ ID NO: 438518 - RNA, 24 nt, Human
gcccaggcuggagugcaguggugu

SEQ ID NO: 438519 - RNA, 20 nt, Human
gcccaggcuggagugcauug

SEQ ID NO: 438520 - RNA, 24 nt, Human
gcccaggcuggagugcauugaugu

SEQ ID NO: 438521 - RNA, 21 nt, Human
gcccaggcuggagugcauugg

SEQ ID NO: 438522 - RNA, 21 nt, Human
gcccaggcuggagugccuugg

SEQ ID NO: 438523 - RNA, 20 nt, Human
gcccaggcuggagugcgaug

SEQ ID NO: 438524 - RNA, 21 nt, Human
gcccaggcuggagugcgaugg

SEQ ID NO: 438525 - RNA, 23 nt, Human
gcccaggcuggagugcgauggca

SEQ ID NO: 438526 - RNA, 23 nt, Human
gcccaggcuggagugcgauggug

SEQ ID NO: 438527 - RNA, 21 nt, Human
gcccaggcuggagugcggugg

SEQ ID NO: 438528 - RNA, 22 nt, Human
gcccaggcuggagugcgguggu

SEQ ID NO: 438529 - RNA, 23 nt, Human
gcccaggcuggagugcgguggug

SEQ ID NO: 438530 - RNA, 19 nt, Human
gcccaggcuggagugcugu

SEQ ID NO: 438531 - RNA, 21 nt, Human
gcccaggcuggagugcugugg

SEQ ID NO: 438532 - RNA, 24 nt, Human
gcccaggcuggagugcuguggcgu

SEQ ID NO: 438533 - RNA, 24 nt, Human
gcccaggcuggaguggaguggcgu

SEQ ID NO: 438534 - RNA, 18 nt, Human
gcccaggcuggaguguag

SEQ ID NO: 438535 - RNA, 23 nt, Human
gcccaggcuggaguguagagaca

SEQ ID NO: 438536 - RNA, 21 nt, Human
gcccaggcuggaguguagugg

SEQ ID NO: 438537 - RNA, 24 nt, Human
gcccaggcuggaguguaguggcgu

SEQ ID NO: 438538 - RNA, 22 nt, Human
gcccaggcuggaguguaguggu

SEQ ID NO: 438539 - RNA, 23 nt, Human
gcccaggcuggaguguaguggug

SEQ ID NO: 438540 - RNA, 24 nt, Human
gcccaggcuggaguguaguggugu

SEQ ID NO: 438541 - RNA, 24 nt, Human
gcccaggcuggagugucguggcgu

SEQ ID NO: 438542 - RNA, 21 nt, Human
gcccaggcuggagugugaugg

SEQ ID NO: 438543 - RNA, 21 nt, Human
gcccaggcuggaguguggugg

SEQ ID NO: 438544 - RNA, 24 nt, Human
gcccaggcuggagugugguggcgu

SEQ ID NO: 438545 - RNA, 21 nt, Human
gcccaggcuggauuacagugg

SEQ ID NO: 438546 - RNA, 21 nt, Human
gcccaggcuggauugcggugg

SEQ ID NO: 438547 - RNA, 32 nt, Human
gcccaggcuggccucaaauuccugggcucaag

SEQ ID NO: 438548 - RNA, 21 nt, Human
gcccaggcuggcgugaagugg

SEQ ID NO: 438549 - RNA, 22 nt, Human
gcccaggcuggcgugaaguggc

SEQ ID NO: 438550 - RNA, 20 nt, Human
gcccaggcuggcgugcagug

SEQ ID NO: 438551 - RNA, 21 nt, Human
gcccaggcuggcgugcagugg

SEQ ID NO: 438552 - RNA, 23 nt, Human
gcccaggcuggcgugcaguggug

SEQ ID NO: 438553 - RNA, 22 nt, Human
gcccaggcugggagggcaaugg

SEQ ID NO: 438554 - RNA, 24 nt, Human
gcccaggcugggagggcaauggca

SEQ ID NO: 438555 - RNA, 21 nt, Human
gcccaggcugggaugcaaugg

SEQ ID NO: 438556 - RNA, 24 nt, Human
gcccaggcugggaugcaauggcau

SEQ ID NO: 438557 - RNA, 32 nt, Human
gcccaggcugggaugcaauggcauggucucag

SEQ ID NO: 438558 - RNA, 20 nt, Human
gcccaggcuggggugcagug

SEQ ID NO: 438559 - RNA, 21 nt, Human
gcccaggcuggggugcagugg

SEQ ID NO: 438560 - RNA, 22 nt, Human
gcccaggcuggggugcaguggc

SEQ ID NO: 438561 - RNA, 32 nt, Human
gcccaggcugggugcaggcucucaucuggucc

SEQ ID NO: 438562 - RNA, 21 nt, Human
gcccaggcuggguugcagugg

SEQ ID NO: 438563 - RNA, 22 nt, Human
gcccaggcuggguugcaguggc

SEQ ID NO: 438564 - RNA, 24 nt, Human
gcccaggcugguaugcagucaugu

SEQ ID NO: 438565 - RNA, 32 nt, Human
gcccaggcuggucgugaacuccugggcucaag

SEQ ID NO: 438566 - RNA, 32 nt, Human
gcccaggcuggucucaaacuccugggcucaag

SEQ ID NO: 438567 - RNA, 32 nt, Human
gcccaggcuggucucaaacuccugggcucagg

SEQ ID NO: 438568 - RNA, 32 nt, Human
gcccaggcuggucucaaauuccugggcccaaa

SEQ ID NO: 438569 - RNA, 32 nt, Human
gcccaggcuggucucaaccuccugggcucaag

SEQ ID NO: 438570 - RNA, 32 nt, Human
gcccaggcuggucucaggcuccugggcucaga

SEQ ID NO: 438571 - RNA, 32 nt, Human
gcccaggcuggucuccaacuccugggcucaag

SEQ ID NO: 438572 - RNA, 32 nt, Human
gcccaggcuggucucgaacuccugggcucaag

SEQ ID NO: 438573 - RNA, 32 nt, Human
gcccaggcuggucucgaacuucugagcucaag

SEQ ID NO: 438574 - RNA, 32 nt, Human
gcccaggcuggucucgaacuucugagcucgag

SEQ ID NO: 438575 - RNA, 32 nt, Human
gcccaggcuggucuuaaacuccugggcucaag

SEQ ID NO: 438576 - RNA, 32 nt, Human
gcccaggcuggucuuaagcuucugagcucaag

SEQ ID NO: 438577 - RNA, 32 nt, Human
gcccaggcuggucuugaacuucugagcucaag

SEQ ID NO: 438578 - RNA, 32 nt, Human
gcccaggcuggucuugacuccugggcucaaac

SEQ ID NO: 438579 - RNA, 24 nt, Human
gcccaggcuggugugcaauggcgu

SEQ ID NO: 438580 - RNA, 22 nt, Human
gcccaggcugguuuugaacucc

SEQ ID NO: 438581 - RNA, 24 nt, Human
gcccaggcuguaguacaauggcau

SEQ ID NO: 438582 - RNA, 20 nt, Human
gcccaggcuguagugcaaug

SEQ ID NO: 438583 - RNA, 21 nt, Human
gcccaggcuguagugcaaugg

SEQ ID NO: 438584 - RNA, 22 nt, Human
gcccaggcuguagugcaauggc

SEQ ID NO: 438585 - RNA, 19 nt, Human
gcccaggcuguagugcagu

SEQ ID NO: 438586 - RNA, 20 nt, Human
gcccaggcuguagugcagug

SEQ ID NO: 438587 - RNA, 21 nt, Human
gcccaggcuguagugcagugg

SEQ ID NO: 438588 - RNA, 22 nt, Human
gcccaggcuguagugcaguggu

SEQ ID NO: 438589 - RNA, 23 nt, Human
gcccaggcuguagugcaguggug

SEQ ID NO: 438590 - RNA, 21 nt, Human
gcccaggcuguguggaaacag

SEQ ID NO: 438591 - RNA, 32 nt, Human
gcccaggcuguucucaaacuccugggcugaag

SEQ ID NO: 438592 - RNA, 32 nt, Human
gcccaggcuguucuucaacuccugggcucaag

SEQ ID NO: 438593 - RNA, 21 nt, Human
gcccaggcuuaacucaugcca

SEQ ID NO: 438594 - RNA, 18 nt, Human
gcccaggcuuccaacucc

SEQ ID NO: 438595 - RNA, 32 nt, Human
gcccaggcuuccucucucucccuuccucucuc

SEQ ID NO: 438596 - RNA, 23 nt, Human
gcccaggcuucucaccacggugu

SEQ ID NO: 438597 - RNA, 20 nt, Human
gcccaggcuugagugcaaug

SEQ ID NO: 438598 - RNA, 23 nt, Human
gcccaggcuugagugcagugaug

SEQ ID NO: 438599 - RNA, 32 nt, Human
gcccagggacacccacacagguggccaucaca

SEQ ID NO: 438600 - RNA, 23 nt, Human
gcccagggaccccugccuucccc

SEQ ID NO: 438601 - RNA, 16 nt, Human
gcccagggacugcagc

SEQ ID NO: 438602 - RNA, 32 nt, Human
gcccagggagaagggacaaggcuuuuaaaaga

SEQ ID NO: 438603 - RNA, 32 nt, Human
gcccagggagagagagggaguggagcccaggg

SEQ ID NO: 438604 - RNA, 20 nt, Human
gcccagggagcaggcagcag

SEQ ID NO: 438605 - RNA, 32 nt, Human
gcccagggagccucaggagcaggaugagucga

SEQ ID NO: 438606 - RNA, 21 nt, Human
gcccagggagccuggcgcuag

SEQ ID NO: 438607 - RNA, 32 nt, Human
gcccagggaggaaaugccuuuaaccggcgugg

SEQ ID NO: 438608 - RNA, 21 nt, Human
gcccagggaggaggaagccag

SEQ ID NO: 438609 - RNA, 32 nt, Human
gcccagggaggcagagguugcuguaaguugag

SEQ ID NO: 438610 - RNA, 21 nt, Human
gcccagggaggccagaaucag

SEQ ID NO: 438611 - RNA, 20 nt, Human
gcccagggaggccgaagcua

SEQ ID NO: 438612 - RNA, 32 nt, Human
gcccagggaggucaaggcugcagugagcaaug

SEQ ID NO: 438613 - RNA, 20 nt, Human
gcccagggaguagcagccag

SEQ ID NO: 438614 - RNA, 21 nt, Human
gcccagggagucccagaggca

SEQ ID NO: 438615 - RNA, 20 nt, Human
gcccagggaguucugcucag

SEQ ID NO: 438616 - RNA, 32 nt, Human
gcccagggauaggaggaggcagaggggugccu

SEQ ID NO: 438617 - RNA, 32 nt, Human
gcccagggaugcaaagguugcagugaguugag

SEQ ID NO: 438618 - RNA, 32 nt, Human
gcccagggcaagcagaggcagcaaugguuggu

SEQ ID NO: 438619 - RNA, 20 nt, Human
gcccagggcacagaugccag

SEQ ID NO: 438620 - RNA, 18 nt, Human
gcccagggcagcucucug

SEQ ID NO: 438621 - RNA, 18 nt, Human
gcccagggccacccagag

SEQ ID NO: 438622 - RNA, 21 nt, Human
gcccagggccacugcacacca

SEQ ID NO: 438623 - RNA, 19 nt, Human
gcccagggccaggagccag

SEQ ID NO: 438624 - RNA, 17 nt, Human
gcccagggcccagagcc

SEQ ID NO: 438625 - RNA, 32 nt, Human
gcccagggcccagcagggggcaguggcaccug

SEQ ID NO: 438626 - RNA, 31 nt, Human
gcccagggccccggugcggccgagcugggaa

SEQ ID NO: 438627 - RNA, 18 nt, Human
gcccagggcccucugccg

SEQ ID NO: 438628 - RNA, 19 nt, Human
gcccagggccggguucccu

SEQ ID NO: 438629 - RNA, 17 nt, Human
gcccagggccuaggggc

SEQ ID NO: 438630 - RNA, 30 nt, Human
gcccagggccucucccuuccugucguucaa

SEQ ID NO: 438631 - RNA, 32 nt, Human
gcccagggccugcccgccagagccgcacaugc

SEQ ID NO: 438632 - RNA, 32 nt, Human
gcccagggccuggcagacuguggcuagaacgg

SEQ ID NO: 438633 - RNA, 21 nt, Human
gcccagggccuugagagccag

SEQ ID NO: 438634 - RNA, 17 nt, Human
gcccagggcgccgggcg

SEQ ID NO: 438635 - RNA, 32 nt, Human
gcccagggcuagaaguugaaacucacuaguaa

SEQ ID NO: 438636 - RNA, 32 nt, Human
gcccagggcucacuguggcucccuucagcggg

SEQ ID NO: 438637 - RNA, 32 nt, Human
gcccagggcucugccaugcccaucuugccuac

SEQ ID NO: 438638 - RNA, 21 nt, Human
gcccagggcuggagugcagug

SEQ ID NO: 438639 - RNA, 22 nt, Human
gcccagggcuggagugcagugg

SEQ ID NO: 438640 - RNA, 23 nt, Human
gcccagggcuggagugcaguggc

SEQ ID NO: 438641 - RNA, 20 nt, Human
gcccagggcugggacagugg

SEQ ID NO: 438642 - RNA, 20 nt, Human
gcccaggggaacggaaacag

SEQ ID NO: 438643 - RNA, 22 nt, Human
gcccaggggaauuaaaagccag

SEQ ID NO: 438644 - RNA, 23 nt, Human
gcccaggggaccagguggaccag

SEQ ID NO: 438645 - RNA, 32 nt, Human
gcccaggggaccccgccccgacccaggggcug

SEQ ID NO: 438646 - RNA, 19 nt, Human
gcccaggggacgagcucag

SEQ ID NO: 438647 - RNA, 20 nt, Human
gcccaggggacuggaggcag

SEQ ID NO: 438648 - RNA, 20 nt, Human
gcccaggggaggugagucag

SEQ ID NO: 438649 - RNA, 19 nt, Human
gcccaggggaguggaccag

SEQ ID NO: 438650 - RNA, 32 nt, Human
gcccaggggcagggagggaggaagggguaacu

SEQ ID NO: 438651 - RNA, 32 nt, Human
gcccaggggccaggccugcuccagguuaaacu

SEQ ID NO: 438652 - RNA, 21 nt, Human
gcccaggggcccuggggucau

SEQ ID NO: 438653 - RNA, 18 nt, Human
gcccagggggaaaggcca

SEQ ID NO: 438654 - RNA, 32 nt, Human
gcccagggggaaccgcgccccgcugaagggcu

SEQ ID NO: 438655 - RNA, 19 nt, Human
gcccagggggaagaugcca

SEQ ID NO: 438656 - RNA, 21 nt, Human
gcccagggggcaaggacacag

SEQ ID NO: 438657 - RNA, 22 nt, Human
gcccagggggcagcagugcuua

SEQ ID NO: 438658 - RNA, 22 nt, Human
gcccagggggccggagggccag

SEQ ID NO: 438659 - RNA, 22 nt, Human
gcccagggggcgugcuguccag

SEQ ID NO: 438660 - RNA, 32 nt, Human
gcccagggggcuuccugaggggagacagagca

SEQ ID NO: 438661 - RNA, 21 nt, Human
gcccagggguguugaggccag

SEQ ID NO: 438662 - RNA, 20 nt, Human
gcccagggguucuagaccag

SEQ ID NO: 438663 - RNA, 32 nt, Human
gcccagggguugcaggcugcagugagcuguga

SEQ ID NO: 438664 - RNA, 20 nt, Human
gcccagggguuugagaccag

SEQ ID NO: 438665 - RNA, 32 nt, Human
gcccagggguuugaggcugcagugagccacag

SEQ ID NO: 438666 - RNA, 32 nt, Human
gcccagggguuugcggcugcagugagcuguga

SEQ ID NO: 438667 - RNA, 23 nt, Human
gcccaggguaggggagggugggg

SEQ ID NO: 438668 - RNA, 32 nt, Human
gcccaggguccugaggccugaccacauggcuc

SEQ ID NO: 438669 - RNA, 19 nt, Human
gcccagggugagcugcagu

SEQ ID NO: 438670 - RNA, 32 nt, Human
gcccagggugcuguugguguccucagaagugc

SEQ ID NO: 438671 - RNA, 20 nt, Human
gcccaggguggagugcagug

SEQ ID NO: 438672 - RNA, 21 nt, Human
gcccaggguggagugcagugg

SEQ ID NO: 438673 - RNA, 22 nt, Human
gcccaggguggagugcaguggc

SEQ ID NO: 438674 - RNA, 24 nt, Human
gcccaggguggagugcaguggcgu

SEQ ID NO: 438675 - RNA, 21 nt, Human
gcccaggguggagugcggugg

SEQ ID NO: 438676 - RNA, 21 nt, Human
gcccaggguggguggccagug

SEQ ID NO: 438677 - RNA, 18 nt, Human
gcccagguaauuugagca

SEQ ID NO: 438678 - RNA, 17 nt, Human
gcccagguacugcagcg

SEQ ID NO: 438679 - RNA, 20 nt, Human
gcccagguacugcuugugca

SEQ ID NO: 438680 - RNA, 32 nt, Human
gcccagguaguuuuauccugugacucaaaggc

SEQ ID NO: 438681 - RNA, 32 nt, Human
gcccaggucaccugccaagaccaagaccagcc

SEQ ID NO: 438682 - RNA, 32 nt, Human
gcccaggucagccucagucugcugugccucca

SEQ ID NO: 438683 - RNA, 32 nt, Human
gcccagguccaaaucacagagcuggggcgaga

SEQ ID NO: 438684 - RNA, 20 nt, Human
gcccagguccagcaccccuu

SEQ ID NO: 438685 - RNA, 17 nt, Human
gcccagguccugcugcc

SEQ ID NO: 438686 - RNA, 20 nt, Human
gcccaggucuguuucaggca

SEQ ID NO: 438687 - RNA, 19 nt, Human
gcccaggugaagaugugca

SEQ ID NO: 438688 - RNA, 32 nt, Human
gcccaggugacagagggagacucucucaaaga

SEQ ID NO: 438689 - RNA, 21 nt, Human
gcccaggugaccuguucagca

SEQ ID NO: 438690 - RNA, 32 nt, Human
gcccaggugagaggaggaagaggggucuggaa

SEQ ID NO: 438691 - RNA, 32 nt, Human
gcccaggugagguucucuaguagguggaaagg

SEQ ID NO: 438692 - RNA, 32 nt, Human
gcccaggugcaacccccagcccaggaggagac

SEQ ID NO: 438693 - RNA, 16 nt, Human
gcccaggugcagagcg

SEQ ID NO: 438694 - RNA, 21 nt, Human
gcccaggugcucacaugcgca

SEQ ID NO: 438695 - RNA, 32 nt, Human
gcccaggugcugacccugccucggguuguguc

SEQ ID NO: 438696 - RNA, 21 nt, Human
gcccaggugcugaccuugcca

SEQ ID NO: 438697 - RNA, 19 nt, Human
gcccaggugcuggcugcca

SEQ ID NO: 438698 - RNA, 18 nt, Human
gcccagguggaaggcgcg

SEQ ID NO: 438699 - RNA, 21 nt, Human
gcccagguggaggugcagugg

SEQ ID NO: 438700 - RNA, 20 nt, Human
gcccagguggcucugcagca

SEQ ID NO: 438701 - RNA, 19 nt, Human
gcccagguggggcuuggca

SEQ ID NO: 438702 - RNA, 21 nt, Human
gcccagguggucccauugcca

SEQ ID NO: 438703 - RNA, 20 nt, Human
gcccagguggugcccgcgca

SEQ ID NO: 438704 - RNA, 17 nt, Human
gcccaggugguggcugc

SEQ ID NO: 438705 - RNA, 21 nt, Human
gcccagguguaaucagagcca

SEQ ID NO: 438706 - RNA, 21 nt, Human
gcccaggugugagucgcugca

SEQ ID NO: 438707 - RNA, 32 nt, Human
gcccagguguucugcaccuugcagccugcaca

SEQ ID NO: 438708 - RNA, 21 nt, Human
gcccagguuagagugcagugg

SEQ ID NO: 438709 - RNA, 20 nt, Human
gcccagguuagguuugggca

SEQ ID NO: 438710 - RNA, 32 nt, Human
gcccagguucaagcgauucucuugccucauuc

SEQ ID NO: 438711 - RNA, 25 nt, Human
gcccagguucuagagugcaguggug

SEQ ID NO: 438712 - RNA, 20 nt, Human
gcccagguuggagugcagug

SEQ ID NO: 438713 - RNA, 21 nt, Human
gcccagguuggagugcagugg

SEQ ID NO: 438714 - RNA, 22 nt, Human
gcccagguuggagugcaguggc

SEQ ID NO: 438715 - RNA, 20 nt, Human
gcccagguuggagugccaug

SEQ ID NO: 438716 - RNA, 21 nt, Human
gcccagguuggagugccaugg

SEQ ID NO: 438717 - RNA, 21 nt, Human
gcccagguuguaaugcagugg

SEQ ID NO: 438718 - RNA, 22 nt, Human
gcccagguuguaaugcaguggc

SEQ ID NO: 438719 - RNA, 18 nt, Human
gcccagguuuacggcggc

SEQ ID NO: 438720 - RNA, 22 nt, Human
gcccaguaaaaucuugauuuca

SEQ ID NO: 438721 - RNA, 32 nt, Human
gcccaguacugagaauggaugggagaggagag

SEQ ID NO: 438722 - RNA, 32 nt, Human
gcccaguacuuugcaugugagcacagacccag

SEQ ID NO: 438723 - RNA, 32 nt, Human
gcccaguagcccuccuggaaucugcugcagug

SEQ ID NO: 438724 - RNA, 32 nt, Human
gcccaguaggucgaggcugcagugagcuguga

SEQ ID NO: 438725 - RNA, 32 nt, Human
gcccaguauaaaugccaccuccuccaugaagc

SEQ ID NO: 438726 - RNA, 32 nt, Human
gcccagucaagccaacccgcagcuucacucac

SEQ ID NO: 438727 - RNA, 32 nt, Human
gcccagucacaguccagcaauuccacaaccac

SEQ ID NO: 438728 - RNA, 32 nt, Human
gcccagucacuacaggacccugagauguccag

SEQ ID NO: 438729 - RNA, 19 nt, Human
gcccaguccacagagccag

SEQ ID NO: 438730 - RNA, 18 nt, Human
gcccaguccaggcugcug

SEQ ID NO: 438731 - RNA, 32 nt, Human
gcccaguccaucagcagugauggaauuugcug

SEQ ID NO: 438732 - RNA, 32 nt, Human
gcccagucccacccucccgcacauaccuggcc

SEQ ID NO: 438733 - RNA, 21 nt, Human
gcccaguccccagcucgccag

SEQ ID NO: 438734 - RNA, 32 nt, Human
gcccaguccccugcgucauucccaccagaggc

SEQ ID NO: 438735 - RNA, 32 nt, Human
gcccagucccgcaguacauccccuguccccuc

SEQ ID NO: 438736 - RNA, 32 nt, Human
gcccagucccguccugcagcagucugccuccu

SEQ ID NO: 438737 - RNA, 32 nt, Human
gcccagucccuucacugcuuuccugccccaag

SEQ ID NO: 438738 - RNA, 18 nt, Human
gcccaguccuuugcugcu

SEQ ID NO: 438739 - RNA, 32 nt, Human
gcccagucuaacucgauucuucccaggggcuc

SEQ ID NO: 438740 - RNA, 32 nt, Human
gcccagucuagucuugaacuccugggcuacag

SEQ ID NO: 438741 - RNA, 32 nt, Human
gcccagucucaaaccaugcagcugaguaacug

SEQ ID NO: 438742 - RNA, 21 nt, Human
gcccagucuccggccccggcc

SEQ ID NO: 438743 - RNA, 32 nt, Human
gcccagucugagcagcagggugaggcagcccu

SEQ ID NO: 438744 - RNA, 21 nt, Human
gcccagucuggagugcagugg

SEQ ID NO: 438745 - RNA, 22 nt, Human
gcccagucuggagugcaguggu

SEQ ID NO: 438746 - RNA, 32 nt, Human
gcccagucuggccuagaacuccuggccucaac

SEQ ID NO: 438747 - RNA, 32 nt, Human
gcccagucugggccgugacucugggugagucg

SEQ ID NO: 438748 - RNA, 32 nt, Human
gcccagucuucagucuccugacuuagagauac

SEQ ID NO: 438749 - RNA, 32 nt, Human
gcccagucuugaguucuugucuuguuaccauu

SEQ ID NO: 438750 - RNA, 32 nt, Human
gcccagucuugucucaaacuccugggcucaag

SEQ ID NO: 438751 - RNA, 20 nt, Human
gcccagugagcagccccagc

SEQ ID NO: 438752 - RNA, 32 nt, Human
gcccagugagccaucccguccccaccacccuc

SEQ ID NO: 438753 - RNA, 32 nt, Human
gcccagugccucucccugacaagccuguaccc

SEQ ID NO: 438754 - RNA, 32 nt, Human
gcccagugccugugcccgucauguaucucacc

SEQ ID NO: 438755 - RNA, 31 nt, Human
gcccagugcgucagugggccugggguuccag

SEQ ID NO: 438756 - RNA, 18 nt, Human
gcccaguggcucuacccc

SEQ ID NO: 438757 - RNA, 32 nt, Human
gcccaguggcucuuuaguuuggcacuugauga

SEQ ID NO: 438758 - RNA, 32 nt, Human
gcccaguggcuggggugggggcugaggggcag

SEQ ID NO: 438759 - RNA, 24 nt, Human
gcccagugggaccccgcacaacau

SEQ ID NO: 438760 - RNA, 32 nt, Human
gcccagugggcagaggccagggagugccucac

SEQ ID NO: 438761 - RNA, 32 nt, Human
gcccagugggucugaaagcucgcuugagaaua

SEQ ID NO: 438762 - RNA, 31 nt, Human
gcccagugggugggaggaaggaugagggccc

SEQ ID NO: 438763 - RNA, 32 nt, Human
gcccagugucacccagggugagugcaaaauaa

SEQ ID NO: 438764 - RNA, 32 nt, Human
gcccagugucuguggccuggcaaguggccacg

SEQ ID NO: 438765 - RNA, 32 nt, Human
gcccagugugugguggcucacaccuguaaccc

SEQ ID NO: 438766 - RNA, 22 nt, Human
gcccaguuacucggaaggcuga

SEQ ID NO: 438767 - RNA, 32 nt, Human
gcccaguucauucuauuagaugacuaaggaaa

SEQ ID NO: 438768 - RNA, 32 nt, Human
gcccaguuccagagguggaaguuacagaagag

SEQ ID NO: 438769 - RNA, 32 nt, Human
gcccaguuccuacccaccuggcuaaggccagu

SEQ ID NO: 438770 - RNA, 19 nt, Human
gcccaguucugaaagcuuu

SEQ ID NO: 438771 - RNA, 23 nt, Human
gcccaguucugggagaggacaga

SEQ ID NO: 438772 - RNA, 32 nt, Human
gcccaguuucaaacuccugaccucaggugauc

SEQ ID NO: 438773 - RNA, 32 nt, Human
gcccaguuucuaccugcaacagacucuucacc

SEQ ID NO: 438774 - RNA, 32 nt, Human
gcccaguuucuucaggcgguggcuccagccag

SEQ ID NO: 438775 - RNA, 32 nt, Human
gcccaguuugagauuuuggagucuccugugau

SEQ ID NO: 438776 - RNA, 32 nt, Human
gcccauagcggaugccuccucaggaauauucu

SEQ ID NO: 438777 - RNA, 32 nt, Human
gcccauagcugguggucaagaugagggagagg

SEQ ID NO: 438778 - RNA, 32 nt, Human
gcccauaggaaagaguagguagguuaugccag

SEQ ID NO: 438779 - RNA, 32 nt, Human
gcccauagggcugaguggggucgggugaggca

SEQ ID NO: 438780 - RNA, 32 nt, Human
gcccauaguacugggaaaugggagcacaguac

SEQ ID NO: 438781 - RNA, 24 nt, Human
gcccauagucccagcuacucagga

SEQ ID NO: 438782 - RNA, 32 nt, Human
gcccauaucuuacucugcuuccaucucucucc

SEQ ID NO: 438783 - RNA, 32 nt, Human
gcccauaugcagggaggagcugcagggagcug

SEQ ID NO: 438784 - RNA, 32 nt, Human
gcccaucaaccagcauuggucccauagggaag

SEQ ID NO: 438785 - RNA, 18 nt, Human
gcccaucaagcuccugcc

SEQ ID NO: 438786 - RNA, 19 nt, Human
gcccaucacacacaauuca

SEQ ID NO: 438787 - RNA, 32 nt, Human
gcccaucagacugcccccagcacacggaaugg

SEQ ID NO: 438788 - RNA, 32 nt, Human
gcccaucaugacauuggguagcauuaacugua

SEQ ID NO: 438789 - RNA, 32 nt, Human
gcccauccagaagaacgggaagcauuuucuuc

SEQ ID NO: 438790 - RNA, 32 nt, Human
gcccauccagcccaggucccaggaucccugca

SEQ ID NO: 438791 - RNA, 32 nt, Human
gcccauccaggagaccaaaggcugcagguguc

SEQ ID NO: 438792 - RNA, 32 nt, Human
gcccaucccacccagggaucgccaccucugcc

SEQ ID NO: 438793 - RNA, 32 nt, Human
gcccaucccagcugcacccuagcucccugcuc

SEQ ID NO: 438794 - RNA, 32 nt, Human
gcccaucccaguccucccuucagcuaacagca

SEQ ID NO: 438795 - RNA, 16 nt, Human
gcccauccccacccca

SEQ ID NO: 438796 - RNA, 32 nt, Human
gcccaucccuggaaggugcuguuauccauggg

SEQ ID NO: 438797 - RNA, 23 nt, Human
gcccauccucaccacugaggcca

SEQ ID NO: 438798 - RNA, 32 nt, Human
gcccauccucugcagaaacagaaaaaucuauc

SEQ ID NO: 438799 - RNA, 32 nt, Human
gcccauccugcucuccuccagccgagggaccc

SEQ ID NO: 438800 - RNA, 32 nt, Human
gcccauccuuucucacccggagggguccaaag

SEQ ID NO: 438801 - RNA, 24 nt, Human
gcccaucgccaccaccuuuuccca

SEQ ID NO: 438802 - RNA, 19 nt, Human
gcccaucuagaggacuuug

SEQ ID NO: 438803 - RNA, 32 nt, Human
gcccaucucacugcauucccuggcugcccgac

SEQ ID NO: 438804 - RNA, 32 nt, Human
gcccaucuccacccuccaaccuggacugcccg

SEQ ID NO: 438805 - RNA, 32 nt, Human
gcccaucuccaccucccgcagugcugggauua

SEQ ID NO: 438806 - RNA, 32 nt, Human
gcccaucucccccugccaggccugugugauca

SEQ ID NO: 438807 - RNA, 32 nt, Human
gcccaucucccugcuuuggucuugccccauca

SEQ ID NO: 438808 - RNA, 32 nt, Human
gcccaucucccuucaagaacccuacggagagu

SEQ ID NO: 438809 - RNA, 32 nt, Human
gcccaucucuaauuauaaaacaugguuuuguu

SEQ ID NO: 438810 - RNA, 32 nt, Human
gcccaucucuccuuuuccaggcugcugaguaa

SEQ ID NO: 438811 - RNA, 32 nt, Human
gcccaucucugcugaccuggguguggcggagg

SEQ ID NO: 438812 - RNA, 32 nt, Human
gcccaucucuucuccaccuucucuccacagaa

SEQ ID NO: 438813 - RNA, 32 nt, Human
gcccaucugagagaugauuuccucuggcccau

SEQ ID NO: 438814 - RNA, 32 nt, Human
gcccaucugccucaacuccucucccuuuuagg

SEQ ID NO: 438815 - RNA, 32 nt, Human
gcccaugaagccagcccugcugccauuugauc

SEQ ID NO: 438816 - RNA, 32 nt, Human
gcccaugacaucaccgucacucugccuaaaag

SEQ ID NO: 438817 - RNA, 32 nt, Human
gcccaugaccucaccugguuccaguaccacuc

SEQ ID NO: 438818 - RNA, 32 nt, Human
gcccaugagagggagaagcggcagcgucuacc

SEQ ID NO: 438819 - RNA, 32 nt, Human
gcccaugagaucaggcugggcccauggugaaa

SEQ ID NO: 438820 - RNA, 32 nt, Human
gcccaugagauugaggcugcagugagcuguga

SEQ ID NO: 438821 - RNA, 32 nt, Human
gcccaugagccccugcuccucagccaggcccg

SEQ ID NO: 438822 - RNA, 32 nt, Human
gcccaugaggcccagguuacagugagccaaga

SEQ ID NO: 438823 - RNA, 32 nt, Human
gcccaugaggggaaagaggaucuuccagcucu

SEQ ID NO: 438824 - RNA, 32 nt, Human
gcccaugagguauuuaaaacagauauuuauga

SEQ ID NO: 438825 - RNA, 32 nt, Human
gcccaugaguucaaggcugcagugagucguga

SEQ ID NO: 438826 - RNA, 23 nt, Human
gcccaugaugauccccgacagca

SEQ ID NO: 438827 - RNA, 32 nt, Human
gcccaugcaacccagauugggguggagcagga

SEQ ID NO: 438828 - RNA, 32 nt, Human
gcccaugcacacacucacaggaggcccgugga

SEQ ID NO: 438829 - RNA, 32 nt, Human
gcccaugcauccauguugguucuuuuaucccc

SEQ ID NO: 438830 - RNA, 32 nt, Human
gcccaugcauccguguugguucuuuuaucccc

SEQ ID NO: 438831 - RNA, 32 nt, Human
gcccaugccagcuccuggguccugggccacag

SEQ ID NO: 438832 - RNA, 32 nt, Human
gcccaugccagucccggaggaaaaagagccag

SEQ ID NO: 438833 - RNA, 32 nt, Human
gcccaugcccagcuaauuuuguauuuuuagua

SEQ ID NO: 438834 - RNA, 32 nt, Human
gcccaugcccuccguccuggcagggcaggcag

SEQ ID NO: 438835 - RNA, 32 nt, Human
gcccaugcccugccgugguggcagcuggggcu

SEQ ID NO: 438836 - RNA, 32 nt, Human
gcccaugccuauaaucccagcacuuugggagg

SEQ ID NO: 438837 - RNA, 32 nt, Human
gcccaugccucucucacucuucauacuccucc

SEQ ID NO: 438838 - RNA, 32 nt, Human
gcccaugccuguaaucccagcacuuugggagg

SEQ ID NO: 438839 - RNA, 32 nt, Human
gcccaugccuguaaucucagcacucugggaga

SEQ ID NO: 438840 - RNA, 32 nt, Human
gcccaugccuguagugccagcauuuugggagg

SEQ ID NO: 438841 - RNA, 19 nt, Human
gcccaugcuacucucugcc

SEQ ID NO: 438842 - RNA, 21 nt, Human
gcccaugcugaggggugggug

SEQ ID NO: 438843 - RNA, 21 nt, Human
gcccaugcuggagggcagugg

SEQ ID NO: 438844 - RNA, 22 nt, Human
gcccaugcuggagggcaguggu

SEQ ID NO: 438845 - RNA, 21 nt, Human
gcccaugcuggagugcaaugg

SEQ ID NO: 438846 - RNA, 20 nt, Human
gcccaugcuggagugcagug

SEQ ID NO: 438847 - RNA, 21 nt, Human
gcccaugcuggagugcagugg

SEQ ID NO: 438848 - RNA, 22 nt, Human
gcccaugcuggagugcaguggc

SEQ ID NO: 438849 - RNA, 21 nt, Human
gcccaugcuggagugcauugg

SEQ ID NO: 438850 - RNA, 32 nt, Human
gcccaugcuggcacugauggaggcugaacugc

SEQ ID NO: 438851 - RNA, 32 nt, Human
gcccaugcuggccucaaacuccugggcucuag

SEQ ID NO: 438852 - RNA, 32 nt, Human
gcccaugcuggucucgaacuccugggcucaag

SEQ ID NO: 438853 - RNA, 32 nt, Human
gcccuugccucuggaagagauccacaggacug

SEQ ID NO: 438854 - RNA, 32 nt, Human
gcccuugccuguagucucagcacuuugggagg

SEQ ID NO: 438855 - RNA, 20 nt, Human
gcccuugccuugccuguagu

SEQ ID NO: 438856 - RNA, 32 nt, Human
gcccuugccuuugagcccccaggaggggaagg

SEQ ID NO: 438857 - RNA, 32 nt, Human
gcccuugccuuuggcccugugagaugcugacc

SEQ ID NO: 438858 - RNA, 32 nt, Human
gcccuugcguaguucacugucuucccacuugu

SEQ ID NO: 438859 - RNA, 32 nt, Human
gcccuugcucucauucagcuguugugugaccc

SEQ ID NO: 438860 - RNA, 32 nt, Human
gcccuugcugggggcuccuuuucugacuacug

SEQ ID NO: 438861 - RNA, 32 nt, Human
gcccuuggaguugccagauggcuggucaaugc

SEQ ID NO: 438862 - RNA, 32 nt, Human
gcccuuggcagggucuaagccaggaaguaaaa

SEQ ID NO: 438863 - RNA, 32 nt, Human
gcccuuggccacagaguauggaaguagcuccg

SEQ ID NO: 438864 - RNA, 32 nt, Human
gcccuuggccugccacccagagccaagagggu

SEQ ID NO: 438865 - RNA, 32 nt, Human
gcccuugggaggaacaacaugagcucaggaag

SEQ ID NO: 438866 - RNA, 18 nt, Human
gcccuugggaggcacuca

SEQ ID NO: 438867 - RNA, 32 nt, Human
gcccuugggaguagcugggugaauggacgaug

SEQ ID NO: 438868 - RNA, 32 nt, Human
gcccuugggccccagccuccugcucaucccuc

SEQ ID NO: 438869 - RNA, 32 nt, Human
gcccuuggggcagaugcagaagcagaagaggg

SEQ ID NO: 438870 - RNA, 17 nt, Human
gcccuuggucugcugcu

SEQ ID NO: 438871 - RNA, 32 nt, Human
gcccuugguucacacuccauuucccaguuucu

SEQ ID NO: 438872 - RNA, 32 nt, Human
gcccuugguugccagcagaauggaauuugcca

SEQ ID NO: 438873 - RNA, 32 nt, Human
gcccuugguuuauuucacuccaguccugaagc

SEQ ID NO: 438874 - RNA, 17 nt, Human
gcccuuguacucaggua

SEQ ID NO: 438875 - RNA, 32 nt, Human
gcccuugucacccaggcuguagugcgguggcg

SEQ ID NO: 438876 - RNA, 32 nt, Human
gcccuuguccugaugccucaaggcuuagagag

SEQ ID NO: 438877 - RNA, 32 nt, Human
gcccuugucuacguuccucaaaugcccacaag

SEQ ID NO: 438878 - RNA, 32 nt, Human
gcccuugucuaggcagaaguggucagaccagg

SEQ ID NO: 438879 - RNA, 17 nt, Human
gcccuugugccagggag

SEQ ID NO: 438880 - RNA, 32 nt, Human
gcccuugugcccugccuccaccgagccagcuu

SEQ ID NO: 438881 - RNA, 32 nt, Human
gcccuuguggucagaggggccucugaagccug

SEQ ID NO: 438882 - RNA, 23 nt, Human
gcccuugugugacccuccccaua

SEQ ID NO: 438883 - RNA, 32 nt, Human
gcccuuguuaugugcuauuuuaaucaguguaa

SEQ ID NO: 438884 - RNA, 32 nt, Human
gcccuuguucugacagcauucuggcugaggcu

SEQ ID NO: 438885 - RNA, 16 nt, Human
gcccuuguugcccagg

SEQ ID NO: 438886 - RNA, 32 nt, Human
gcccuuguugcccaggcuggagugcaauggcg

SEQ ID NO: 438887 - RNA, 32 nt, Human
gcccuuuaacucaacccgcuucccagcacagc

SEQ ID NO: 438888 - RNA, 32 nt, Human
gcccuuuaagacgacaucuccgcgaacgccgg

SEQ ID NO: 438889 - RNA, 32 nt, Human
gcccuuuaagugcaucccgcugugcugacuuu

SEQ ID NO: 438890 - RNA, 32 nt, Human
gcccuuuacagaauggaguguguugaacagga

SEQ ID NO: 438891 - RNA, 21 nt, Human
gcccuuuaccuugggcaccuu

SEQ ID NO: 438892 - RNA, 32 nt, Human
gcccuuuacuacaggacagaaaccacuuaguu

SEQ ID NO: 438893 - RNA, 32 nt, Human
gcccuuuagccauauugaaaacaaauaucuuu

SEQ ID NO: 438894 - RNA, 32 nt, Human
gcccuuuagcccaggagaaugcaguggcauga

SEQ ID NO: 438895 - RNA, 32 nt, Human
gcccuuuauccaguacugaggacccagguggg

SEQ ID NO: 438896 - RNA, 32 nt, Human
gcccuuuaucucuguguuauagugucuguguu

SEQ ID NO: 438897 - RNA, 32 nt, Human
gcccuuuauuuaugcaaaaccaccucagaauc

SEQ ID NO: 438898 - RNA, 32 nt, Human
gcccuuucaaagcaggaggaagaaaaggaaga

SEQ ID NO: 438899 - RNA, 32 nt, Human
gcccuuucaacaguuuugccacugaccggaua

SEQ ID NO: 438900 - RNA, 32 nt, Human
gcccuuucaagccaucagcuccugccucucug

SEQ ID NO: 438901 - RNA, 32 nt, Human
gcccuuucaauccuagcacccacuagauauuu

SEQ ID NO: 438902 - RNA, 32 nt, Human
gcccuuucaccuuuucuuugaauguaguuccc

SEQ ID NO: 438903 - RNA, 32 nt, Human
gcccuuucagccccgcugguguucgcccaccc

SEQ ID NO: 438904 - RNA, 32 nt, Human
gcccuuucagggacuguuaucugcagcuuaag

SEQ ID NO: 438905 - RNA, 32 nt, Human
gcccuuucauaugcuuuucccucuuuuaccau

SEQ ID NO: 438906 - RNA, 32 nt, Human
gcccuuucauucuccaaaccccagccugcaag

SEQ ID NO: 438907 - RNA, 32 nt, Human
gcccuuucauuuccuccccaccccacucccca

SEQ ID NO: 438908 - RNA, 32 nt, Human
gcccuuuccaggggaagagagcaggauggaga

SEQ ID NO: 438909 - RNA, 32 nt, Human
gcccuuucccagagacccagagccccugaccc

SEQ ID NO: 438910 - RNA, 32 nt, Human
gcccuuuccccagccaccuccccagcaagcaa

SEQ ID NO: 438911 - RNA, 32 nt, Human
gcccuuuccucccacggugccaaccaaggcuu

SEQ ID NO: 438912 - RNA, 32 nt, Human
gcccuuuccucccagggcagaccaccuccagg

SEQ ID NO: 438913 - RNA, 32 nt, Human
gcccuuuccugccucagauuucagcuuaaauu

SEQ ID NO: 438914 - RNA, 32 nt, Human
gcccuuucuaaaguggcaucucagcuugaguc

SEQ ID NO: 438915 - RNA, 32 nt, Human
gcccuuucuccccacaagccucuggguuuucc

SEQ ID NO: 438916 - RNA, 32 nt, Human
gcccuuucuccccuccacucauguucccucua

SEQ ID NO: 438917 - RNA, 21 nt, Human
gcccuuucucugugccuucag

SEQ ID NO: 438918 - RNA, 32 nt, Human
gcccuuucugaaccucuggccgucuggaugcu

SEQ ID NO: 438919 - RNA, 32 nt, Human
gcccuuucugccugugucagggccaggaagua

SEQ ID NO: 438920 - RNA, 32 nt, Human
gcccuuugacagcaguuaguugcugacucgga

SEQ ID NO: 438921 - RNA, 24 nt, Human
gcccuuugauucugaaagugggug

SEQ ID NO: 438922 - RNA, 32 nt, Human
gcccuuugcacccacaccucagggacucggug

SEQ ID NO: 438923 - RNA, 32 nt, Human
gcccuuugcaggagaaggagacuugggaggca

SEQ ID NO: 438924 - RNA, 32 nt, Human
gcccuuugccuuucaugcccaugcuugauucu

SEQ ID NO: 438925 - RNA, 32 nt, Human
gcccuuugcuaucugcgcgcaggaugggggug

SEQ ID NO: 438926 - RNA, 21 nt, Human
gcccuuugcuugagggcuccc

SEQ ID NO: 438927 - RNA, 32 nt, Human
gcccuuugggaggccgaaugggcagaucacuu

SEQ ID NO: 438928 - RNA, 32 nt, Human
gcccuuuggguucugcauguguuccuggcagc

SEQ ID NO: 438929 - RNA, 21 nt, Human
gcccuuuguccacuggagcug

SEQ ID NO: 438930 - RNA, 32 nt, Human
gcccuuuguggggagguuagggggaugguaau

SEQ ID NO: 438931 - RNA, 32 nt, Human
gcccuuuguuccuaucuucuaaaggaaaguau

SEQ ID NO: 438932 - RNA, 32 nt, Human
gcccuuuuaagcugcggcuugacaggggccgc

SEQ ID NO: 438933 - RNA, 32 nt, Human
gcccuuuuauaccuccccagacuccuucaaca

SEQ ID NO: 438934 - RNA, 21 nt, Human
gcccuuuuccucuccaccuca

SEQ ID NO: 438935 - RNA, 32 nt, Human
gcccuuuucgcccaggcugaguacaguggugc

SEQ ID NO: 438936 - RNA, 32 nt, Human
gcccuuuucucaaaucauauuucugagagaaa

SEQ ID NO: 438937 - RNA, 32 nt, Human
gcccuuuucucucccuggaaagaaggaagucc

SEQ ID NO: 438938 - RNA, 19 nt, Human
gcccuuuucuucugcugcc

SEQ ID NO: 438939 - RNA, 32 nt, Human
gcccuuuugccuggaaacuauacagagcaggg

SEQ ID NO: 438940 - RNA, 32 nt, Human
gcccuuuugucucugcaaacugccuucuucgg

SEQ ID NO: 438941 - RNA, 32 nt, Human
gcccuuuuuaccccacgggugucugucccccu

SEQ ID NO: 438942 - RNA, 32 nt, Human
gcccuuuuuacucaaaacacaugggcuaguac

SEQ ID NO: 438943 - RNA, 32 nt, Human
gcccuuuuugcaccccagggagcugcugcuga

SEQ ID NO: 438944 - RNA, 32 nt, Human
gccgaaaauacaaggaaaauauacaaaugcaa

SEQ ID NO: 438945 - RNA, 32 nt, Human
gccgaaaccgaugugucuauggugcugcaccu

SEQ ID NO: 438946 - RNA, 32 nt, Human
gccgaaaccgaugugucuauggugcugcaucu

SEQ ID NO: 438947 - RNA, 32 nt, Human
gccgaaagagggguguugggaacucgcggcgc

SEQ ID NO: 438948 - RNA, 32 nt, Human
gccgaaaggaagcacgaaagcggucagagucu

SEQ ID NO: 438949 - RNA, 32 nt, Human
gccgaaagggagcagcggggaaggaggauggc

SEQ ID NO: 438950 - RNA, 32 nt, Human
gccgaaagggccugagagcugcuucuccuucu

SEQ ID NO: 438951 - RNA, 32 nt, Human
gccgaaccaaaguggauuaauuacacgcuuuc

SEQ ID NO: 438952 - RNA, 32 nt, Human
gccgaacgggagcugccgcuuccuucccggcc

SEQ ID NO: 438953 - RNA, 32 nt, Human
gccgaagaaagaggagugaggcaggggagcga

SEQ ID NO: 438954 - RNA, 32 nt, Human
gccgaagaagaaggacagggagcugcagaagc

SEQ ID NO: 438955 - RNA, 32 nt, Human
gccgaagauggcugagaagcagaagcacgacg

SEQ ID NO: 438956 - RNA, 32 nt, Human
gccgaagcaagaacagcacccaaaacaaacga

SEQ ID NO: 438957 - RNA, 24 nt, Human
gccgaagcaggaggaucacuggag

SEQ ID NO: 438958 - RNA, 32 nt, Human
gccgaagccacaccucccgcauggccccuccg

SEQ ID NO: 438959 - RNA, 32 nt, Human
gccgaagccagcugccugcugccucagcaggg

SEQ ID NO: 438960 - RNA, 32 nt, Human
gccgaagcccuugagccgcucgcugccgcugc

SEQ ID NO: 438961 - RNA, 32 nt, Human
gccgaagccgcaccucccgcauggccccuccg

SEQ ID NO: 438962 - RNA, 32 nt, Human
gccgaagccugaggaagcucaucaugagauuc

SEQ ID NO: 438963 - RNA, 21 nt, Human
gccgaagcgccgcgcgugaga

SEQ ID NO: 438964 - RNA, 20 nt, Human
gccgaagcucuuucccgccg

SEQ ID NO: 438965 - RNA, 32 nt, Human
gccgaagcugggggcagcuggggagggugggg

SEQ ID NO: 438966 - RNA, 32 nt, Human
gccgaaggacccugugcugccugugacuuugc

SEQ ID NO: 438967 - RNA, 32 nt, Human
gccgaaggacccugugcugccugugacuuugu

SEQ ID NO: 438968 - RNA, 32 nt, Human
gccgaaggagaaggaggaagaggagaaggcgg

SEQ ID NO: 438969 - RNA, 32 nt, Human
gccgaaggcccaggcuccgggauucacgcaga

SEQ ID NO: 438970 - RNA, 20 nt, Human
gccgaaggcggcagagucag

SEQ ID NO: 438971 - RNA, 24 nt, Human
gccgaagugggaggacugcuugag

SEQ ID NO: 438972 - RNA, 24 nt, Human
gccgaaguggguggaucgcuugag

SEQ ID NO: 438973 - RNA, 32 nt, Human
gccgaauagggaggaggugagaggcuggggug

SEQ ID NO: 438974 - RNA, 32 nt, Human
gccgaaucgcuccugcagcagagccaacaugc

SEQ ID NO: 438975 - RNA, 32 nt, Human
gccgaaucugucagggcccaggguucccagag

SEQ ID NO: 438976 - RNA, 32 nt, Human
gccgaaugaaaguaagcaaagauacugcuaga

SEQ ID NO: 438977 - RNA, 32 nt, Human
gccgaaugggcagaucacuugaggucaggagu

SEQ ID NO: 438978 - RNA, 32 nt, Human
gccgaauuguauccuuuaaagggagcaggggu

SEQ ID NO: 438979 - RNA, 32 nt, Human
gccgacaaccacugcccagcagccucugggac

SEQ ID NO: 438980 - RNA, 32 nt, Human
gccgacaacugcaaguuccuaggcagagggga

SEQ ID NO: 438981 - RNA, 32 nt, Human
gccgacacccgccucuccccacccuuaggcuc

SEQ ID NO: 438982 - RNA, 31 nt, Human
gccgacagaagucacugccuaccucaggguc

SEQ ID NO: 438983 - RNA, 32 nt, Human
gccgacagaccggagcgacagggaguugccau

SEQ ID NO: 438984 - RNA, 32 nt, Human
gccgacagccugaagccagagcaggccgcugu

SEQ ID NO: 438985 - RNA, 32 nt, Human
gccgacagccuugcaggcugggcucagggaca

SEQ ID NO: 438986 - RNA, 32 nt, Human
gccgacagcucuccaauacucagguuaaugcu

SEQ ID NO: 438987 - RNA, 32 nt, Human
gccgacaucacugacuccagggaccagggaca

SEQ ID NO: 438988 - RNA, 20 nt, Human
gccgacaucaugccauugca

SEQ ID NO: 438989 - RNA, 20 nt, Human
gccgacaucgcgccauugca

SEQ ID NO: 438990 - RNA, 32 nt, Human
gccgacauguuuucuuuggccugggugguuua

SEQ ID NO: 438991 - RNA, 32 nt, Human
gccgaccaauggcugcuucauccccgacguug

SEQ ID NO: 438992 - RNA, 32 nt, Human
gccgaccacagcccuccccacugugagccuuc

SEQ ID NO: 438993 - RNA, 32 nt, Human
gccgaccagcacuugggaucugaugggacacg

SEQ ID NO: 438994 - RNA, 32 nt, Human
gccgaccagcuccagucccagguccaauccug

SEQ ID NO: 438995 - RNA, 32 nt, Human
gccgaccccagacagacccaggaauggagagc

SEQ ID NO: 438996 - RNA, 32 nt, Human
gccgacccccucucccugcauggcauccucca

SEQ ID NO: 438997 - RNA, 32 nt, Human
gccgaccccuuggcgggaaccagcacaaagug

SEQ ID NO: 438998 - RNA, 32 nt, Human
gccgacccuccccuccccaccucccccacugc

SEQ ID NO: 438999 - RNA, 32 nt, Human
gccgacccugcggccuccaccaaccccgcggc

SEQ ID NO: 439000 - RNA, 32 nt, Human
gccgaccgugagagcgcacgagcugagucagu

SEQ ID NO: 439001 - RNA, 32 nt, Human
gccgaccucacaccucagcccuugcacccggc

SEQ ID NO: 439002 - RNA, 23 nt, Human
gccgaccuccccgcugcauuugc

SEQ ID NO: 439003 - RNA, 32 nt, Human
gccgaccugcugcagcccguccuggacauccu

SEQ ID NO: 439004 - RNA, 32 nt, Human
gccgaccuugccuaccagcuccuggguguccu

SEQ ID NO: 439005 - RNA, 24 nt, Human
gccgacgcaggaggauugcuugag

SEQ ID NO: 439006 - RNA, 32 nt, Human
gccgacgcagucauugucucagccaggcuggu

SEQ ID NO: 439007 - RNA, 32 nt, Human
gccgacgccagcacgccgucauggcccccgca

SEQ ID NO: 439008 - RNA, 22 nt, Human
gccgacgcgcggcccucggugg

SEQ ID NO: 439009 - RNA, 32 nt, Human
gccgacggcagcgccuugcccagaccuccccu

SEQ ID NO: 439010 - RNA, 32 nt, Human
gccgacgugccacccacccggagccggugagu

SEQ ID NO: 439011 - RNA, 24 nt, Human
gccgacgugggaggguagcuugag

SEQ ID NO: 439012 - RNA, 32 nt, Human
gccgacguggugagugggggcaugcuugggag

SEQ ID NO: 439013 - RNA, 32 nt, Human
gccgacuauguggcgggcaccuguaaucccac

SEQ ID NO: 439014 - RNA, 32 nt, Human
gccgacuccuggcaggaccucagucaaauccg

SEQ ID NO: 439015 - RNA, 32 nt, Human
gccgacuccuucuccccuccuggcagucaggc

SEQ ID NO: 439016 - RNA, 32 nt, Human
gccgacucguucuccccuccuggcagucaggc

SEQ ID NO: 439017 - RNA, 32 nt, Human
gccgacucugcacucuccacccuggcugggau

SEQ ID NO: 439018 - RNA, 32 nt, Human
gccgacuggucggcugugaugaugacauuggu

SEQ ID NO: 439019 - RNA, 32 nt, Human
gccgacuguauacagagguucaucucaaccuc

SEQ ID NO: 439020 - RNA, 21 nt, Human
gccgacuguauuuccugguua

SEQ ID NO: 439021 - RNA, 32 nt, Human
gccgacugugaggaaaagcagagggaauguga

SEQ ID NO: 439022 - RNA, 32 nt, Human
gccgacugugccagucccagccgcccuaccgc

SEQ ID NO: 439023 - RNA, 32 nt, Human
gccgacuuccccuccucuucccucucuccuuc

SEQ ID NO: 439024 - RNA, 32 nt, Human
gccgacuucuccccuuuccccagccucgugcc

SEQ ID NO: 439025 - RNA, 23 nt, Human
gccgagaaacaaaguucccgggg

SEQ ID NO: 439026 - RNA, 21 nt, Human
gccgagaaacggccagugggg

SEQ ID NO: 439027 - RNA, 32 nt, Human
gccgagaacacugcugggcucccagguagcug

SEQ ID NO: 439028 - RNA, 32 nt, Human
gccgagaaccaccacccgccaggcgucuugcg

SEQ ID NO: 439029 - RNA, 32 nt, Human
gccgagaacugcgggugcacugccucagggaa

SEQ ID NO: 439030 - RNA, 32 nt, Human
gccgagaaggaggaggaggagagaggaaagag

SEQ ID NO: 439031 - RNA, 32 nt, Human
gccgagaaugccacugcacuacagccugggcg

SEQ ID NO: 439032 - RNA, 32 nt, Human
gccgagaccaagaggcccucacucugacacca

SEQ ID NO: 439033 - RNA, 32 nt, Human
gccgagacugugcuccagccugggcgacagag

SEQ ID NO: 439034 - RNA, 32 nt, Human
gccgagacuuguuggccgcggagacugcgacc

SEQ ID NO: 439035 - RNA, 32 nt, Human
gccgagagaggcaggcggaucacaaagucagg

SEQ ID NO: 439036 - RNA, 32 nt, Human
gccgagagcaucucccuggaggggcccacggu

SEQ ID NO: 439037 - RNA, 32 nt, Human
gccgagagccacacuuucaaguaaccaggugg

SEQ ID NO: 439038 - RNA, 32 nt, Human
gccgagagccagaccuguuuguccugagaaaa

SEQ ID NO: 439039 - RNA, 32 nt, Human
gccgagagccccgggagagugaagggccgggg

SEQ ID NO: 439040 - RNA, 32 nt, Human
gccgagagcgagaagcagcaggccuugucucu

SEQ ID NO: 439041 - RNA, 32 nt, Human
gccgagaggaagggagggcagcucgggccgaa

SEQ ID NO: 439042 - RNA, 32 nt, Human
gccgagaggagcugggcugaaucuccaggcgu

SEQ ID NO: 439043 - RNA, 32 nt, Human
gccgagaggcaggccgggcaggggugucggac

SEQ ID NO: 439044 - RNA, 18 nt, Human
gccgagaucgcccugcug

SEQ ID NO: 439045 - RNA, 20 nt, Human
gccgagauggcgccauuuca

SEQ ID NO: 439046 - RNA, 32 nt, Human
gccgagaugggacagcaaagaugaugggcucu

SEQ ID NO: 439047 - RNA, 32 nt, Human
gccgagauuaugucacuccagccugggcaaca

SEQ ID NO: 439048 - RNA, 32 nt, Human
gccgagauugcaccccugcacuccaggcuggg

SEQ ID NO: 439049 - RNA, 32 nt, Human
gccgagauugccacugcacuccagccugggca

SEQ ID NO: 439050 - RNA, 32 nt, Human
gccgagauugugcacuccagccuggguaacag

SEQ ID NO: 439051 - RNA, 32 nt, Human
gccgagauugugccacuacacuccagccuggg

SEQ ID NO: 439052 - RNA, 32 nt, Human
gccgagauugugccacugcacaccggccuggg

SEQ ID NO: 439053 - RNA, 32 nt, Human
gccgagauugugccacugcacacuccaaucug

SEQ ID NO: 439054 - RNA, 32 nt, Human
gccgagauugugccacugcacuccaaccuggg

SEQ ID NO: 439055 - RNA, 32 nt, Human
gccgagauugugccacugcacuccagccugga

SEQ ID NO: 439056 - RNA, 32 nt, Human
gccgagauugugccacugcacuccagccuggc

SEQ ID NO: 439057 - RNA, 32 nt, Human
gccgagauugugccacugcacuccagccuggg

SEQ ID NO: 439058 - RNA, 32 nt, Human
gccgagauugugccacugcacuccagcugggu

SEQ ID NO: 439059 - RNA, 32 nt, Human
gccgagauugugccacugcgcuccagccuggg

SEQ ID NO: 439060 - RNA, 32 nt, Human
gccgagauugugccacuguacaccagccuggg

SEQ ID NO: 439061 - RNA, 32 nt, Human
gccgagauugugccacuguacuccagccugga

SEQ ID NO: 439062 - RNA, 32 nt, Human
gccgagauugugccacuguacuccagccuggu

SEQ ID NO: 439063 - RNA, 32 nt, Human
gccgagcacaguggcccaugccuauaauccca

SEQ ID NO: 439064 - RNA, 32 nt, Human
gccgagcacugaggggucgccccgagagaaga

SEQ ID NO: 439065 - RNA, 32 nt, Human
gccgagcagccccugcucccuccuggagaccc

SEQ ID NO: 439066 - RNA, 32 nt, Human
gccgagcagggugcggcggcggcggggcgcuc

SEQ ID NO: 439067 - RNA, 32 nt, Human
gccgagcauggugacucacaucuguaauccca

SEQ ID NO: 439068 - RNA, 32 nt, Human
gccgagccaccugagcccgagccgcgggacac

SEQ ID NO: 439069 - RNA, 20 nt, Human
gccgagcccagcaaaggugg

SEQ ID NO: 439070 - RNA, 18 nt, Human
gccgagccccugcugcug

SEQ ID NO: 439071 - RNA, 20 nt, Human
gccgagcccgagccgccgcc

SEQ ID NO: 439072 - RNA, 20 nt, Human
gccgagcccgagccgcugcc

SEQ ID NO: 439073 - RNA, 32 nt, Human
gccgagcccgcugggagucuagaaagagaaaa

SEQ ID NO: 439074 - RNA, 32 nt, Human
gccgagccgcucacgcccugcccacauugucc

SEQ ID NO: 439075 - RNA, 32 nt, Human
gccgagccggagccauggagggccagagcgug

SEQ ID NO: 439076 - RNA, 32 nt, Human
gccgagccgggagcgggcgucuugccgaggcc

SEQ ID NO: 439077 - RNA, 21 nt, Human
gccgagccgucgccgcagccu

SEQ ID NO: 439078 - RNA, 18 nt, Human
gccgagccucaagaugaa

SEQ ID NO: 439079 - RNA, 32 nt, Human
gccgagccucagcugcuggcauuuccuucugc

SEQ ID NO: 439080 - RNA, 32 nt, Human
gccgagccugacacgcuguccucuccccucgc

SEQ ID NO: 439081 - RNA, 21 nt, Human
gccgagcgccgccgccgccgc

SEQ ID NO: 439082 - RNA, 32 nt, Human
gccgagcggagaggguagagacgggguuucac

SEQ ID NO: 439083 - RNA, 32 nt, Human
gccgagcggagcccaggagagcagagagcgag

SEQ ID NO: 439084 - RNA, 18 nt, Human
gccgagcggagcccaggg

SEQ ID NO: 439085 - RNA, 32 nt, Human
gccgagcggccgcggcggcggcggcgagugcg

SEQ ID NO: 439086 - RNA, 25 nt, Human
gccgagcggccggcgcagcgugaga

SEQ ID NO: 439087 - RNA, 32 nt, Human
gccgagcgggcguccgucgccggagcugcaau

SEQ ID NO: 439088 - RNA, 32 nt, Human
gccgagcggggccggaggcaagagugacuuca

SEQ ID NO: 439089 - RNA, 20 nt, Human
gccgagcguccgccgcugcc

SEQ ID NO: 439090 - RNA, 32 nt, Human
gccgagcucccuccauuccucucccuccgccg

SEQ ID NO: 439091 - RNA, 32 nt, Human
gccgagcucuuccucccugcugugucuacagg

SEQ ID NO: 439092 - RNA, 32 nt, Human
gccgagcugcugccguuucuuccugcacaacg

SEQ ID NO: 439093 - RNA, 20 nt, Human
gccgagcugucgcccgcgcc

SEQ ID NO: 439094 - RNA, 32 nt, Human
gccgagcuuccucugggagggaggaaacaguu

SEQ ID NO: 439095 - RNA, 24 nt, Human
gccgaggaacaugccagggcccag

SEQ ID NO: 439096 - RNA, 32 nt, Human
gccgaggacaucuuacuccugcugcugggccu

SEQ ID NO: 439097 - RNA, 21 nt, Human
gccgaggaccuucugggcccc

SEQ ID NO: 439098 - RNA, 32 nt, Human
gccgaggagacaacuacaaacagacuuugggc

SEQ ID NO: 439099 - RNA, 32 nt, Human
gccgaggaggaagagguugauggcggcggcgg

SEQ ID NO: 439100 - RNA, 32 nt, Human
gccgaggaggaggaggaggaggaggaggaggc

SEQ ID NO: 439101 - RNA, 32 nt, Human
gccgaggaggagggcgcgggaggcggaggaug

SEQ ID NO: 439102 - RNA, 32 nt, Human
gccgaggaggcgccaagagggagcgagggcug

SEQ ID NO: 439103 - RNA, 32 nt, Human
gccgaggaggggcggggaaggucagccagguu

SEQ ID NO: 439104 - RNA, 32 nt, Human
gccgaggaguuugagucugcagugagcuauga

SEQ ID NO: 439105 - RNA, 32 nt, Human
gccgaggauggggaaauccaacagcaaguuga

SEQ ID NO: 439106 - RNA, 23 nt, Human
gccgaggcacgagaaucgcuuga

SEQ ID NO: 439107 - RNA, 32 nt, Human
gccgaggcacuuccaggcuucacucaacucau

SEQ ID NO: 439108 - RNA, 32 nt, Human
gccgaggcagcccagagcagcgggaugagcug

SEQ ID NO: 439109 - RNA, 23 nt, Human
gccgaggcaggaaaaucgcuuga

SEQ ID NO: 439110 - RNA, 24 nt, Human
gccgaggcaggaagaauugcuuga

SEQ ID NO: 439111 - RNA, 24 nt, Human
gccgaggcaggaagacugcuugag

SEQ ID NO: 439112 - RNA, 24 nt, Human
gccgaggcaggaagaucacuugag

SEQ ID NO: 439113 - RNA, 23 nt, Human
gccgaggcaggaagauugcuuga

SEQ ID NO: 439114 - RNA, 23 nt, Human
gccgaggcaggagaaucacuuga

SEQ ID NO: 439115 - RNA, 24 nt, Human
gccgaggcaggagaaucgcuugag

SEQ ID NO: 439116 - RNA, 23 nt, Human
gccgaggcaggagaaucucuuga

SEQ ID NO: 439117 - RNA, 23 nt, Human
gccgaggcaggagaauugcuuga

SEQ ID NO: 439118 - RNA, 24 nt, Human
gccgaggcaggagcaucgcuugag

SEQ ID NO: 439119 - RNA, 24 nt, Human
gccgaggcaggaggaucacuugag

SEQ ID NO: 439120 - RNA, 24 nt, Human
gccgaggcaggcagaucgcuugag

SEQ ID NO: 439121 - RNA, 24 nt, Human
gccgaggcaggcaggucacuugag

SEQ ID NO: 439122 - RNA, 32 nt, Human
gccgaggcaggcggaucacgaggucaggagau

SEQ ID NO: 439123 - RNA, 32 nt, Human
gccgaggcaggcggaucacgaggucaggaguu

SEQ ID NO: 439124 - RNA, 24 nt, Human
gccgaggcaggcggaucacuugag

SEQ ID NO: 439125 - RNA, 32 nt, Human
gccgaggcaggcggaucaugaggucaggagau

SEQ ID NO: 439126 - RNA, 32 nt, Human
gccgaggcaggcggaucaugaggucaggaguu

SEQ ID NO: 439127 - RNA, 32 nt, Human
gccgaggcaggcggaucauguggucaggagau

SEQ ID NO: 439128 - RNA, 32 nt, Human
gccgaggcaggcggaucccgaggucaggagau

SEQ ID NO: 439129 - RNA, 32 nt, Human
gccgaggcaggcggauugccugaggucaggag

SEQ ID NO: 439130 - RNA, 24 nt, Human
gccgaggcagguggaucacuugag

SEQ ID NO: 439131 - RNA, 24 nt, Human
gccgaggcagguggaucgcuugag

SEQ ID NO: 439132 - RNA, 32 nt, Human
gccgaggccaggccgcagcccaggagccgccc

SEQ ID NO: 439133 - RNA, 20 nt, Human
gccgaggccccuccccggcc

SEQ ID NO: 439134 - RNA, 32 nt, Human
gccgaggcccgggggaccagagcgagaagcgg

SEQ ID NO: 439135 - RNA, 32 nt, Human
gccgaggccgcaccacugcacuccagccuggg

SEQ ID NO: 439136 - RNA, 32 nt, Human
gccgaggccgcgguuucccccugggccucccc

SEQ ID NO: 439137 - RNA, 24 nt, Human
gccgaggcgggaagaucacuugag

SEQ ID NO: 439138 - RNA, 24 nt, Human
gccgaggcgggaggaucacuugag

SEQ ID NO: 439139 - RNA, 24 nt, Human
gccgaggcgggcagaucacuugag

SEQ ID NO: 439140 - RNA, 24 nt, Human
gccgaggcgggcggaucacuugag

SEQ ID NO: 439141 - RNA, 24 nt, Human
gccgaggcgggcggaucgcuugag

SEQ ID NO: 439142 - RNA, 32 nt, Human
gccgaggcgggugaucacuugaggucaguagu

SEQ ID NO: 439143 - RNA, 19 nt, Human
gccgaggcggguggaucac

SEQ ID NO: 439144 - RNA, 24 nt, Human
gccgaggcggguggaucacuugag

SEQ ID NO: 439145 - RNA, 24 nt, Human
gccgaggcggguggaucgcuugag

SEQ ID NO: 439146 - RNA, 24 nt, Human
gccgaggcgggugggucaccugag

SEQ ID NO: 439147 - RNA, 21 nt, Human
gccgaggcuggagcacaggga

SEQ ID NO: 439148 - RNA, 20 nt, Human
gccgaggcuggagugcaaug

SEQ ID NO: 439149 - RNA, 21 nt, Human
gccgaggcuggagugcaaugg

SEQ ID NO: 439150 - RNA, 32 nt, Human
gccgaggcuggcccaggcagccgcgcuucgaa

SEQ ID NO: 439151 - RNA, 19 nt, Human
gccgaggcugugcuccaag

SEQ ID NO: 439152 - RNA, 32 nt, Human
gccgagggaaccuggggguggggaggaggggg

SEQ ID NO: 439153 - RNA, 32 nt, Human
gccgagggagugaaccauggacaaguugaaau

SEQ ID NO: 439154 - RNA, 32 nt, Human
gccgagggcccaggcccugugugcggugccca

SEQ ID NO: 439155 - RNA, 32 nt, Human
gccgagggccggagaguggcagauggagagag

SEQ ID NO: 439156 - RNA, 18 nt, Human
gccgagggccucccagca

SEQ ID NO: 439157 - RNA, 32 nt, Human
gccgagggccuuguguaggccauguuccucgg

SEQ ID NO: 439158 - RNA, 32 nt, Human
gccgaggggagagggugaccauggggaaugug

SEQ ID NO: 439159 - RNA, 32 nt, Human
gccgagggggcugugguuagaaggagcaguag

SEQ ID NO: 439160 - RNA, 32 nt, Human
gccgaggggguggggguugcagugagccaaga

SEQ ID NO: 439161 - RNA, 32 nt, Human
gccgaggggugcuucgucucuguuccugagag

SEQ ID NO: 439162 - RNA, 32 nt, Human
gccgagggugcuuuagagaggugguuuuccau

SEQ ID NO: 439163 - RNA, 24 nt, Human
gccgagguagaagaaucgcuugag

SEQ ID NO: 439164 - RNA, 24 nt, Human
gccgagguagguggaucgccugag

SEQ ID NO: 439165 - RNA, 32 nt, Human
gccgagguccaaggcaggaggccauuuacuug

SEQ ID NO: 439166 - RNA, 24 nt, Human
gccgaggugggaggagcgcuugag

SEQ ID NO: 439167 - RNA, 24 nt, Human
gccgaggugggaggaucacuugag

SEQ ID NO: 439168 - RNA, 24 nt, Human
gccgaggugggaggaucgcuugag

SEQ ID NO: 439169 - RNA, 24 nt, Human
gccgaggugggaggauugcuugag

SEQ ID NO: 439170 - RNA, 32 nt, Human
gccgagguggggaccgauaggagaagccggug

SEQ ID NO: 439171 - RNA, 24 nt, Human
gccgagguggguagaucgcuugag

SEQ ID NO: 439172 - RNA, 24 nt, Human
gccgagguggguggaccgcuugag

SEQ ID NO: 439173 - RNA, 32 nt, Human
gccgagguggguggaucacaagguugggagau

SEQ ID NO: 439174 - RNA, 19 nt, Human
gccgagguuugcgcugccg

SEQ ID NO: 439175 - RNA, 32 nt, Human
gccgagguuuuuaaugagauucuuucuauggg

SEQ ID NO: 439176 - RNA, 25 nt, Human
gccgaguaucuuccagccgcugccu

SEQ ID NO: 439177 - RNA, 32 nt, Human
gccgagucacuacugccugccugccugccugc

SEQ ID NO: 439178 - RNA, 32 nt, Human
gccgaguccuugucccuaccuccagcuuccuc

SEQ ID NO: 439179 - RNA, 32 nt, Human
gccgagucggaggggguggcagugagcggcgg

SEQ ID NO: 439180 - RNA, 26 nt, Human
gccgagucucccaugacgcccgagcc

SEQ ID NO: 439181 - RNA, 20 nt, Human
gccgagucuccgacugucug

SEQ ID NO: 439182 - RNA, 32 nt, Human
gccgagucucuuucauacagcacagcaaauga

SEQ ID NO: 439183 - RNA, 32 nt, Human
gccgagucugucucugucaugguagagaccga

SEQ ID NO: 439184 - RNA, 32 nt, Human
gccgagugcaccacugcacuccagccugggca

SEQ ID NO: 439185 - RNA, 32 nt, Human
gccgaguguugcaggcacuccagccuggcgac

SEQ ID NO: 439186 - RNA, 32 nt, Human
gccgaguuuaggagaagagagugagaggagca

SEQ ID NO: 439187 - RNA, 21 nt, Human
gccgaguuucacucuggcugc

SEQ ID NO: 439188 - RNA, 32 nt, Human
gccgaguuuccucugccccuucuugcuggucc

SEQ ID NO: 439189 - RNA, 32 nt, Human
gccgauaaugcauauguccaguucucacuuaa

SEQ ID NO: 439190 - RNA, 22 nt, Human
gccgauaauuuaaacagucucc

SEQ ID NO: 439191 - RNA, 22 nt, Human
gccgauacuggcagccauugca

SEQ ID NO: 439192 - RNA, 20 nt, Human
gccgauaugcagcugggagg

SEQ ID NO: 439193 - RNA, 20 nt, Human
gccgaucacuugaggucagg

SEQ ID NO: 439194 - RNA, 32 nt, Human
gccgauccagccucccuuugcugcagaggagg

SEQ ID NO: 439195 - RNA, 32 nt, Human
gccgaucccaaagccccguggcccugcucuuu

SEQ ID NO: 439196 - RNA, 32 nt, Human
gccgaucguccugggcccgaggaaaagagaga

SEQ ID NO: 439197 - RNA, 32 nt, Human
gccgaucuccccucggaggcuucuuggccaac

SEQ ID NO: 439198 - RNA, 32 nt, Human
gccgaugagacccagacacaggcagaccuggc

SEQ ID NO: 439199 - RNA, 32 nt, Human
gccgauggagcgugguguagcagaacagcuca

SEQ ID NO: 439200 - RNA, 32 nt, Human
gccgauggggcccugagcaggacgugccucuu

SEQ ID NO: 439201 - RNA, 32 nt, Human
gccgauggucaguggaggaagcugacuagccc

SEQ ID NO: 439202 - RNA, 32 nt, Human
gccgaugguuauacagugaagaagacuucacc

SEQ ID NO: 439203 - RNA, 32 nt, Human
gccgauuagggagagagaccaggaaugagugg

SEQ ID NO: 439204 - RNA, 32 nt, Human
gccgauucauuccacgcagcaguauugggggu

SEQ ID NO: 439205 - RNA, 18 nt, Human
gccgauuccuucaugcua

SEQ ID NO: 439206 - RNA, 32 nt, Human
gccgauugcaccacugcacuccagccugggca

SEQ ID NO: 439207 - RNA, 32 nt, Human
gccgauuucaagaacacaucuccuuuucaacc

SEQ ID NO: 439208 - RNA, 32 nt, Human
gccgcaaaaaccagcaaguuuuuauuagggau

SEQ ID NO: 439209 - RNA, 21 nt, Human
gccgcaaccggacggcuacca

SEQ ID NO: 439210 - RNA, 32 nt, Human
gccgcaacucaggucugcagcuggguccugcc

SEQ ID NO: 439211 - RNA, 26 nt, Human
gccgcaacucgcuuguccuuggguca

SEQ ID NO: 439212 - RNA, 21 nt, Human
gccgcaagacgccccagggca

SEQ ID NO: 439213 - RNA, 32 nt, Human
gccgcaagcaacaguuugugguggugaggccg

SEQ ID NO: 439214 - RNA, 32 nt, Human
gccgcaaggaggaggagugccaggcaggggcu

SEQ ID NO: 439215 - RNA, 32 nt, Human
gccgcaagucugcugcagaugaccucaugaac

SEQ ID NO: 439216 - RNA, 17 nt, Human
gccgcaaucucaccucu

SEQ ID NO: 439217 - RNA, 32 nt, Human
gccgcacacacguucgcacgcggcggccggcg

SEQ ID NO: 439218 - RNA, 32 nt, Human
gccgcacacccgccugccuggccgcagguggu

SEQ ID NO: 439219 - RNA, 32 nt, Human
gccgcacagaccucacuaguugugcacaaaua

SEQ ID NO: 439220 - RNA, 17 nt, Human
gccgcacagccaccacc

SEQ ID NO: 439221 - RNA, 32 nt, Human
gccgcacaugcagcacacaggucugcagagug

SEQ ID NO: 439222 - RNA, 32 nt, Human
gccgcaccacugcacuccagccugggugacag

SEQ ID NO: 439223 - RNA, 32 nt, Human
gccgcaccagccgccgcgccccgggccggcgg

SEQ ID NO: 439224 - RNA, 32 nt, Human
gccgcaccaggaugucggacaccgaggagcag

SEQ ID NO: 439225 - RNA, 32 nt, Human
gccgcaccaugagccacgggcccagcccccgg

SEQ ID NO: 439226 - RNA, 32 nt, Human
gccgcaccauuucugucacucacauggaccca

SEQ ID NO: 439227 - RNA, 32 nt, Human
gccgcacccaccgcugccccaggagcagcacg

SEQ ID NO: 439228 - RNA, 20 nt, Human
gccgcaccccggaggagcca

SEQ ID NO: 439229 - RNA, 32 nt, Human
gccgcaccccuucacucuuuccccgccuucuu

SEQ ID NO: 439230 - RNA, 32 nt, Human
gccgcacccgagagcagggacaggugcccgaa

SEQ ID NO: 439231 - RNA, 23 nt, Human
gccgcaccgcccagacuggcuca

SEQ ID NO: 439232 - RNA, 32 nt, Human
gccgcaccgccuauuccagccuuuggagaucc

SEQ ID NO: 439233 - RNA, 16 nt, Human
gccgcaccugccacca

SEQ ID NO: 439234 - RNA, 32 nt, Human
gccgcaccuggugggcccucuucuccacaaag

SEQ ID NO: 439235 - RNA, 32 nt, Human
gccgcacuccagccugcccuucgugaguuucc

SEQ ID NO: 439236 - RNA, 32 nt, Human
gccgcacuggggaccaggaacagggaugaguc

SEQ ID NO: 439237 - RNA, 32 nt, Human
gccgcacugucccaccuggcuuacaggugcug

SEQ ID NO: 439238 - RNA, 26 nt, Human
gccgcagaauccugagccaggugccu

SEQ ID NO: 439239 - RNA, 32 nt, Human
gccgcagacagcaguccuucagaauuaaaaua

SEQ ID NO: 439240 - RNA, 32 nt, Human
gccgcagacccaaagccagcuguggagcugug

SEQ ID NO: 439241 - RNA, 32 nt, Human
gccgcagagcccaggagaugugggcaggagcu

SEQ ID NO: 439242 - RNA, 20 nt, Human
gccgcagagccggggcccag

SEQ ID NO: 439243 - RNA, 32 nt, Human
gccgcagagccugcgaaccccuccugugcuac

SEQ ID NO: 439244 - RNA, 32 nt, Human
gccgcagcacagugcuaaucuauccacaaaac

SEQ ID NO: 439245 - RNA, 32 nt, Human
gccgcagcagccgccaccaguggccgagugag

SEQ ID NO: 439246 - RNA, 32 nt, Human
gccgcagcagucagggucacugugggagcccu

SEQ ID NO: 439247 - RNA, 32 nt, Human
gccgcagcaguggcugaucaucacugaaaaua

SEQ ID NO: 439248 - RNA, 22 nt, Human
gccgcagccaccaccgccgcca

SEQ ID NO: 439249 - RNA, 22 nt, Human
gccgcagccagccccucccgca

SEQ ID NO: 439250 - RNA, 24 nt, Human
gccgcagccaggcggcggccggca

SEQ ID NO: 439251 - RNA, 32 nt, Human
gccgcagccaugagcaugcucgggccucagaa

SEQ ID NO: 439252 - RNA, 17 nt, Human
gccgcagccccauggcc

SEQ ID NO: 439253 - RNA, 32 nt, Human
gccgcagcccugaccuggaaugucuccaccuc

SEQ ID NO: 439254 - RNA, 21 nt, Human
gccgcagccgcagccgccgcc

SEQ ID NO: 439255 - RNA, 32 nt, Human
gccgcagccgcagcuacugugacuucuccgau

SEQ ID NO: 439256 - RNA, 23 nt, Human
gccgcagccgccgccgccgccgc

SEQ ID NO: 439257 - RNA, 32 nt, Human
gccgcagccgccgcgagccuccggacagacgc

SEQ ID NO: 439258 - RNA, 20 nt, Human
gccgcagccgccuccgccac

SEQ ID NO: 439259 - RNA, 29 nt, Human
gccgcagccgcugccgccggagcccggga

SEQ ID NO: 439260 - RNA, 21 nt, Human
gccgcagccugcugggcuacc

SEQ ID NO: 439261 - RNA, 21 nt, Human
gccgcagcgagcgcccggcgg

SEQ ID NO: 439262 - RNA, 32 nt, Human
gccgcagcgaggaggcggcggggaagaagcgc

SEQ ID NO: 439263 - RNA, 22 nt, Human
gccgcagcgcccggcccgggcc

SEQ ID NO: 439264 - RNA, 23 nt, Human
gccgcagcgcccucaggccgcca

SEQ ID NO: 439265 - RNA, 17 nt, Human
gccgcagcggcgcgagg

SEQ ID NO: 439266 - RNA, 25 nt, Human
gccgcagcgugcugcgccucgggcu

SEQ ID NO: 439267 - RNA, 32 nt, Human
gccgcagcucucuccccuucuuaccuccccac

SEQ ID NO: 439268 - RNA, 32 nt, Human
gccgcagcugcaucaaccuccuuuuaccuuua

SEQ ID NO: 439269 - RNA, 32 nt, Human
gccgcagcugccgccucgccgcggccgggccg

SEQ ID NO: 439270 - RNA, 32 nt, Human
gccgcaggaaggcuagccagaggguaauuaca

SEQ ID NO: 439271 - RNA, 32 nt, Human
gccgcaggaccacggcccgcuccccgccgccg

SEQ ID NO: 439272 - RNA, 20 nt, Human
gccgcaggaccccaccaccc

SEQ ID NO: 439273 - RNA, 32 nt, Human
gccgcaggaccugaacgccgcuccagccucca

SEQ ID NO: 439274 - RNA, 32 nt, Human
gccgcaggaggaggaggaggucgucgggggcg

SEQ ID NO: 439275 - RNA, 32 nt, Human
gccgcaggagggcccugugggaugcucugugc

SEQ ID NO: 439276 - RNA, 32 nt, Human
gccgcagggaaugacaccggugcuccuacagc

SEQ ID NO: 439277 - RNA, 32 nt, Human
gccgcagggaggcagggauggcaaggcgugaa

SEQ ID NO: 439278 - RNA, 32 nt, Human
gccgcagggggcccugcacacugaugucagcu

SEQ ID NO: 439279 - RNA, 23 nt, Human
gccgcagucgccgccgccgccgc

SEQ ID NO: 439280 - RNA, 32 nt, Human
gccgcauccaucucaguguggaggacagugac

SEQ ID NO: 439281 - RNA, 32 nt, Human
gccgcaucccucucuaccugccaacauccugu

SEQ ID NO: 439282 - RNA, 32 nt, Human
gccgcaucgcuuguuuccaccuccugggccgg

SEQ ID NO: 439283 - RNA, 26 nt, Human
gccgcaucuagcucugcccugggcua

SEQ ID NO: 439284 - RNA, 32 nt, Human
gccgcaucuccaggacuccuggccuggacuuc

SEQ ID NO: 439285 - RNA, 32 nt, Human
gccgcaugacaacugaaggcaaccuggaaggu

SEQ ID NO: 439286 - RNA, 32 nt, Human
gccgcaugccuguaaucccagcuacuugggug

SEQ ID NO: 439287 - RNA, 32 nt, Human
gccgcaugccuguagucccagcuacucgggag

SEQ ID NO: 439288 - RNA, 30 nt, Human
gccgcaugcucccggagcccagccucuuca

SEQ ID NO: 439289 - RNA, 18 nt, Human
gccgcauuccugcacuca

SEQ ID NO: 439290 - RNA, 32 nt, Human
gccgcauuucuucugcacuuccugucucaucc

SEQ ID NO: 439291 - RNA, 32 nt, Human
gccgccaaagcccagcagcuccgagcggcucc

SEQ ID NO: 439292 - RNA, 32 nt, Human
gccgccacacaguuccagcagagccaggccag

SEQ ID NO: 439293 - RNA, 32 nt, Human
gccgccacacucagugccauggggaagcgggc

SEQ ID NO: 439294 - RNA, 28 nt, Human
gccgccacagccacacagccgccgccac

SEQ ID NO: 439295 - RNA, 23 nt, Human
gccgccacagccgccgccuccac

SEQ ID NO: 439296 - RNA, 32 nt, Human
gccgccacagccgccgccuccaccaccaccac

SEQ ID NO: 439297 - RNA, 23 nt, Human
gccgccacauccuagccaugcuc

SEQ ID NO: 439298 - RNA, 32 nt, Human
gccgccaccagccugcugagccugugcuuccu

SEQ ID NO: 439299 - RNA, 32 nt, Human
gccgccaccaggaaggcggaggacgcaggagc

SEQ ID NO: 439300 - RNA, 32 nt, Human
gccgccaccaugaccaccuccauccgccaguu

SEQ ID NO: 439301 - RNA, 32 nt, Human
gccgccaccaugucucaggaagguguggagcu

SEQ ID NO: 439302 - RNA, 27 nt, Human
gccgccacccagcgccgccgccgccgc

SEQ ID NO: 439303 - RNA, 19 nt, Human
gccgccaccgagccgccgc

SEQ ID NO: 439304 - RNA, 20 nt, Human
gccgccaccgccgccgccgc

SEQ ID NO: 439305 - RNA, 23 nt, Human
gccgccaccgccgccgccgccac

SEQ ID NO: 439306 - RNA, 23 nt, Human
gccgccaccgccgccgccgccgc

SEQ ID NO: 439307 - RNA, 32 nt, Human
gccgccaccgccgccuccgccgcugccucagg

SEQ ID NO: 439308 - RNA, 32 nt, Human
gccgccaccgccgccucugcuuagucgccgcc

SEQ ID NO: 439309 - RNA, 22 nt, Human
gccgccaccgccgcuccgccac

SEQ ID NO: 439310 - RNA, 32 nt, Human
gccgccaccgcgggugugggaaagcgcggacg

SEQ ID NO: 439311 - RNA, 20 nt, Human
gccgccaccgcugccgccgc

SEQ ID NO: 439312 - RNA, 22 nt, Human
gccgccaccggcccaugagccc

SEQ ID NO: 439313 - RNA, 23 nt, Human
gccgccaccggcccgccaugccc

SEQ ID NO: 439314 - RNA, 32 nt, Human
gccgccaccucccuuuccccaagaccagaugu

SEQ ID NO: 439315 - RNA, 20 nt, Human
gccgccaccugcgcccagca

SEQ ID NO: 439316 - RNA, 20 nt, Human
gccgccacggccacaagccc

SEQ ID NO: 439317 - RNA, 32 nt, Human
gccgccacugccugugcuucaugaggaagaug

SEQ ID NO: 439318 - RNA, 32 nt, Human
gccgccacuugcgccucuccagccuccgcagg

SEQ ID NO: 439319 - RNA, 32 nt, Human
gccgccagaccucagagaucucaccagcgggg

SEQ ID NO: 439320 - RNA, 32 nt, Human
gccgccagccccaggagcccagccucuugaga

SEQ ID NO: 439321 - RNA, 32 nt, Human
gccgccagccccuuucucccucugccugacca

SEQ ID NO: 439322 - RNA, 32 nt, Human
gccgccagccucccccggccgugccccucccc

SEQ ID NO: 439323 - RNA, 23 nt, Human
gccgccagcugacaccgccugca

SEQ ID NO: 439324 - RNA, 32 nt, Human
gccgccagcugaccucaccguccaggcggaca

SEQ ID NO: 439325 - RNA, 32 nt, Human
gccgccagcugggugagcauggggcagcccca

SEQ ID NO: 439326 - RNA, 32 nt, Human
gccgccaggcacuccggagcuguccgcuucag

SEQ ID NO: 439327 - RNA, 32 nt, Human
gccgccaggggaaaggaggaacaucccuccca

SEQ ID NO: 439328 - RNA, 32 nt, Human
gccgccaguucugccucaggccgcgcccccuu

SEQ ID NO: 439329 - RNA, 19 nt, Human
gccgccaucaaccgccaca

SEQ ID NO: 439330 - RNA, 32 nt, Human
gccgccauccccaccaucccugaccgcgccug

SEQ ID NO: 439331 - RNA, 32 nt, Human
gccgccaucucucccuuccugccucauuucau

SEQ ID NO: 439332 - RNA, 31 nt, Human
gccgccaugagcugccccgugcccgccugcu

SEQ ID NO: 439333 - RNA, 31 nt, Human
gccgccaugauccugcuggaggugaacaacc

SEQ ID NO: 439334 - RNA, 32 nt, Human
gccgccaugcccaagagaaagacugaagggga

SEQ ID NO: 439335 - RNA, 31 nt, Human
gccgccauggggcugaaggccgcccagaaga

SEQ ID NO: 439336 - RNA, 32 nt, Human
gccgccauugcagcuuguuuucacuugcuuuu

SEQ ID NO: 439337 - RNA, 32 nt, Human
gccgcccacaaacugcugcaugaguggcugcc

SEQ ID NO: 439338 - RNA, 32 nt, Human
gccgcccacccacucccaaaauccgucaguau

SEQ ID NO: 439339 - RNA, 32 nt, Human
gccgcccacgucccacucugcccagccuacac

SEQ ID NO: 439340 - RNA, 19 nt, Human
gccgcccacucccacccca

SEQ ID NO: 439341 - RNA, 32 nt, Human
gccgcccagcaagcugugccuuuugcgccucu

SEQ ID NO: 439342 - RNA, 32 nt, Human
gccgcccagccgcggcucgccagugcgccagu

SEQ ID NO: 439343 - RNA, 32 nt, Human
gccgcccagcuguugugcugggcacagucugg

SEQ ID NO: 439344 - RNA, 20 nt, Human
gccgcccaggccccgcgcuc

SEQ ID NO: 439345 - RNA, 32 nt, Human
gccgcccaggguggguggccagugaggacugg

SEQ ID NO: 439346 - RNA, 32 nt, Human
gccgcccagggugguaucgcccggagcgcggg

SEQ ID NO: 439347 - RNA, 32 nt, Human
gccgcccagugggucaggcacagggagccccg

SEQ ID NO: 439348 - RNA, 19 nt, Human
gccgcccccaagcccagag

SEQ ID NO: 439349 - RNA, 23 nt, Human
gccgcccccgccgccgccgccgc

SEQ ID NO: 439350 - RNA, 32 nt, Human
gccgcccccgggaucaugggcaauggcaugac

SEQ ID NO: 439351 - RNA, 23 nt, Human
gccgcccccgucccgaaggggac

SEQ ID NO: 439352 - RNA, 32 nt, Human
gccgcccccuaaggagccgcacagaccuaggg

SEQ ID NO: 439353 - RNA, 32 nt, Human
gccgcccccugcccccggccuccgacccgagc

SEQ ID NO: 439354 - RNA, 32 nt, Human
gccgcccccugccucucggcucugcucccugc

SEQ ID NO: 439355 - RNA, 21 nt, Human
gccgccccgccaccgccgcca

SEQ ID NO: 439356 - RNA, 19 nt, Human
gccgccccgccgccgccgc

SEQ ID NO: 439357 - RNA, 32 nt, Human
gccgccccgcugcgcccaccuccccggcugcu

SEQ ID NO: 439358 - RNA, 16 nt, Human
gccgccccguccggga

SEQ ID NO: 439359 - RNA, 32 nt, Human
gccgccccucccccaccgccgcucucgcgcca

SEQ ID NO: 439360 - RNA, 32 nt, Human
gccgccccuccccucccacucucgucuccuuc

SEQ ID NO: 439361 - RNA, 20 nt, Human
gccgccccucccgcuugcuc

SEQ ID NO: 439362 - RNA, 32 nt, Human
gccgccccugcagcugcucccuggguggcccc

SEQ ID NO: 439363 - RNA, 32 nt, Human
gccgccccugugcaccuggccaggggaagccc

SEQ ID NO: 439364 - RNA, 32 nt, Human
gccgccccuuucucagccuugcucggcucuuc

SEQ ID NO: 439365 - RNA, 32 nt, Human
gccgcccgaacagccucccagccugggccccc

SEQ ID NO: 439366 - RNA, 22 nt, Human
gccgcccgaccgcgccgagcuc

SEQ ID NO: 439367 - RNA, 22 nt, Human
gccgcccgacuggcucgcgcuc

SEQ ID NO: 439368 - RNA, 21 nt, Human
gccgcccgagccacccugcuc

SEQ ID NO: 439369 - RNA, 22 nt, Human
gccgcccgaggcccgcgcgcuc

SEQ ID NO: 439370 - RNA, 32 nt, Human
gccgcccgcaccuccugaucccuucaagagcc

SEQ ID NO: 439371 - RNA, 20 nt, Human
gccgcccgcaggcucggcuc

SEQ ID NO: 439372 - RNA, 23 nt, Human
gccgcccgccacaccccgcgcuc

SEQ ID NO: 439373 - RNA, 27 nt, Human
gccgcccgcccgcccggcgccgcgcuc

SEQ ID NO: 439374 - RNA, 20 nt, Human
gccgcccgcccgccgggcuc

SEQ ID NO: 439375 - RNA, 22 nt, Human
gccgcccgccgcccgccgccuc

SEQ ID NO: 439376 - RNA, 21 nt, Human
gccgcccgccgccgccgccgc

SEQ ID NO: 439377 - RNA, 18 nt, Human
gccgcccgccgccuggag

SEQ ID NO: 439378 - RNA, 18 nt, Human
gccgcccgccgcucugug

SEQ ID NO: 439379 - RNA, 23 nt, Human
gccgcccgccggcccgccagcuc

SEQ ID NO: 439380 - RNA, 32 nt, Human
gccgcccgccucagcccaacauggcgaugcac

SEQ ID NO: 439381 - RNA, 20 nt, Human
gccgcccgccugccaggcuc

SEQ ID NO: 439382 - RNA, 21 nt, Human
gccgcccgccuuggccuccca

SEQ ID NO: 439383 - RNA, 21 nt, Human
gccgcccgcgagcggcgugcc

SEQ ID NO: 439384 - RNA, 20 nt, Human
gccgcccgcgcccgcuccuc

SEQ ID NO: 439385 - RNA, 21 nt, Human
gccgcccgcgcccgcucguuc

SEQ ID NO: 439386 - RNA, 24 nt, Human
gccgcccgcgccgcccgcgcccuc

SEQ ID NO: 439387 - RNA, 20 nt, Human
gccgcccgcgccgcgucugc

SEQ ID NO: 439388 - RNA, 19 nt, Human
gccgcccgcgcgccgcugu

SEQ ID NO: 439389 - RNA, 20 nt, Human
gccgcccgcgcgcgacucgc

SEQ ID NO: 439390 - RNA, 21 nt, Human
gccgcccgcggcccccggcuc

SEQ ID NO: 439391 - RNA, 21 nt, Human
gccgcccgcggcgccccgagc

SEQ ID NO: 439392 - RNA, 21 nt, Human
gccgcccggagcgccccgcuc

SEQ ID NO: 439393 - RNA, 21 nt, Human
gccgcccggcagcugcugggc

SEQ ID NO: 439394 - RNA, 20 nt, Human
gccgcccggcgcccccagca

SEQ ID NO: 439395 - RNA, 23 nt, Human
gccgcccggcuccacuacagcuc

SEQ ID NO: 439396 - RNA, 21 nt, Human
gccgcccgggaccgccagcuc

SEQ ID NO: 439397 - RNA, 32 nt, Human
gccgcccgggugggacacgccaagcucuucag

SEQ ID NO: 439398 - RNA, 23 nt, Human
gccgcccggugcucggcgcgcuc

SEQ ID NO: 439399 - RNA, 32 nt, Human
gccgcccuacccaccuucaggcagccuauggg

SEQ ID NO: 439400 - RNA, 32 nt, Human
gccgcccucagccugcauuccugugcgcaauc

SEQ ID NO: 439401 - RNA, 32 nt, Human
gccgcccucagcugcaacuccaauggcuacac

SEQ ID NO: 439402 - RNA, 32 nt, Human
gccgcccucaucacaggcugggcauggcuucc

SEQ ID NO: 439403 - RNA, 21 nt, Human
gccgcccuccacauggcgcca

SEQ ID NO: 439404 - RNA, 32 nt, Human
gccgcccuccaucaccugguacaaggacgcag

SEQ ID NO: 439405 - RNA, 32 nt, Human
gccgcccucccaggaccccgagcugcugucgg

SEQ ID NO: 439406 - RNA, 18 nt, Human
gccgcccuccccacggcg

SEQ ID NO: 439407 - RNA, 32 nt, Human
gccgcccuccgcccuccgcuggcuccgaggug

SEQ ID NO: 439408 - RNA, 32 nt, Human
gccgcccuccucccucuccuuccccuccuccc

SEQ ID NO: 439409 - RNA, 32 nt, Human
gccgcccuccuccgcccccacccuccagaagc

SEQ ID NO: 439410 - RNA, 21 nt, Human
gccgcccucgcaccuguacuc

SEQ ID NO: 439411 - RNA, 18 nt, Human
gccgcccucgcccugcac

SEQ ID NO: 439412 - RNA, 32 nt, Human
gccgcccucgcgucuccgcugcagagaagccc

SEQ ID NO: 439413 - RNA, 19 nt, Human
gccgcccucgcuccacgca

SEQ ID NO: 439414 - RNA, 32 nt, Human
gccgcccucuacccucaauccccacuggagau

SEQ ID NO: 439415 - RNA, 32 nt, Human
gccgcccucucagcagcgggcacggguggggc

SEQ ID NO: 439416 - RNA, 32 nt, Human
gccgcccugaccugcuccucuggccauaggcg

SEQ ID NO: 439417 - RNA, 18 nt, Human
gccgcccugaggagcgcc

SEQ ID NO: 439418 - RNA, 32 nt, Human
gccgcccugcagcauguacaccgagugucugc

SEQ ID NO: 439419 - RNA, 23 nt, Human
gccgcccugcagcccccaugccc

SEQ ID NO: 439420 - RNA, 32 nt, Human
gccgcccugcagcgggccaagcaggacauguu

SEQ ID NO: 439421 - RNA, 18 nt, Human
gccgcccugcccgccaga

SEQ ID NO: 439422 - RNA, 32 nt, Human
gccgcccugcccuguccucguggugagucgcu

SEQ ID NO: 439423 - RNA, 32 nt, Human
gccgcccugccuucugcaccuccccggaggcu

SEQ ID NO: 439424 - RNA, 18 nt, Human
gccgcccugcgugcgcug

SEQ ID NO: 439425 - RNA, 22 nt, Human
gccgcccuggacagauggccca

SEQ ID NO: 439426 - RNA, 32 nt, Human
gccgcccugggagcuccccggccgucgccgcg

SEQ ID NO: 439427 - RNA, 32 nt, Human
gccgcccuucuuccccaucucucccccgggcc

SEQ ID NO: 439428 - RNA, 32 nt, Human
gccgcccuugaccuccugcaggccaugugugu

SEQ ID NO: 439429 - RNA, 32 nt, Human
gccgcccuuggcuccugucccugcugcuccuc

SEQ ID NO: 439430 - RNA, 32 nt, Human
gccgcccuuuucuccuuauccuugccagcacu

SEQ ID NO: 439431 - RNA, 20 nt, Human
gccgccgaccgcacgcccgc

SEQ ID NO: 439432 - RNA, 25 nt, Human
gccgccgacgccauccccccgagcc

SEQ ID NO: 439433 - RNA, 32 nt, Human
gccgccgacugcagcccuagcgcccggggcuc

SEQ ID NO: 439434 - RNA, 21 nt, Human
gccgccgaggagaccccgggc

SEQ ID NO: 439435 - RNA, 32 nt, Human
gccgccgcaagcaacaguuugugguggugagg

SEQ ID NO: 439436 - RNA, 32 nt, Human
gccgccgcaccagccucaguggcagaugacac

SEQ ID NO: 439437 - RNA, 32 nt, Human
gccgccgcacccaggacggaggcugcaugccc

SEQ ID NO: 439438 - RNA, 16 nt, Human
gccgccgcacccugca

SEQ ID NO: 439439 - RNA, 26 nt, Human
gccgccgcagccaccaccgccgccac

SEQ ID NO: 439440 - RNA, 20 nt, Human
gccgccgcagcccucggccu

SEQ ID NO: 439441 - RNA, 20 nt, Human
gccgccgcagccgccgccac

SEQ ID NO: 439442 - RNA, 32 nt, Human
gccgccgcagccgccgccgcugggcagaggag

SEQ ID NO: 439443 - RNA, 20 nt, Human
gccgccgcagccgccgcuac

SEQ ID NO: 439444 - RNA, 32 nt, Human
gccgccgcaguccccaggcacuaccuaugaag

SEQ ID NO: 439445 - RNA, 25 nt, Human
gccgccgcagucucagcugcagcug

SEQ ID NO: 439446 - RNA, 19 nt, Human
gccgccgccaacaccccgc

SEQ ID NO: 439447 - RNA, 19 nt, Human
gccgccgccaccaccgcca

SEQ ID NO: 439448 - RNA, 23 nt, Human
gccgccgccaccaccgcugccac

SEQ ID NO: 439449 - RNA, 19 nt, Human
gccgccgccaccacugcca

SEQ ID NO: 439450 - RNA, 27 nt, Human
gccgccgccacccagcgccgccgccgc

SEQ ID NO: 439451 - RNA, 32 nt, Human
gccgccgccaccgccaccaccaccuccaccgc

SEQ ID NO: 439452 - RNA, 23 nt, Human
gccgccgccaccgcccccgccgc

SEQ ID NO: 439453 - RNA, 19 nt, Human
gccgccgccaccgcccgca

SEQ ID NO: 439454 - RNA, 23 nt, Human
gccgccgccaccgccgccgccgc

SEQ ID NO: 439455 - RNA, 25 nt, Human
gccgccgccaccucgcgcccgagcc

SEQ ID NO: 439456 - RNA, 22 nt, Human
gccgccgccacggccaccgccu

SEQ ID NO: 439457 - RNA, 23 nt, Human
gccgccgccagacagccgcccgc

SEQ ID NO: 439458 - RNA, 22 nt, Human
gccgccgccagcccggagccug

SEQ ID NO: 439459 - RNA, 32 nt, Human
gccgccgccagcucccccagacccccuccacc

SEQ ID NO: 439460 - RNA, 22 nt, Human
gccgccgccaggccuccgccug

SEQ ID NO: 439461 - RNA, 18 nt, Human
gccgccgccagggucgcc

SEQ ID NO: 439462 - RNA, 21 nt, Human
gccgccgccauccgccgccgc

SEQ ID NO: 439463 - RNA, 22 nt, Human
gccgccgccauccgccgccgca

SEQ ID NO: 439464 - RNA, 32 nt, Human
gccgccgccaugagcugccccgugcccgccug

SEQ ID NO: 439465 - RNA, 32 nt, Human
gccgccgccaugcagcccuccagccuucugcc

SEQ ID NO: 439466 - RNA, 19 nt, Human
gccgccgcccaccgcccgc

SEQ ID NO: 439467 - RNA, 22 nt, Human
gccgccgccccccagcccugca

SEQ ID NO: 439468 - RNA, 20 nt, Human
gccgccgccccccgcccgga

SEQ ID NO: 439469 - RNA, 21 nt, Human
gccgccgcccccuccccugca

SEQ ID NO: 439470 - RNA, 22 nt, Human
gccgccgccccgagcacccgca

SEQ ID NO: 439471 - RNA, 19 nt, Human
gccgccgccccgccgccgc

SEQ ID NO: 439472 - RNA, 24 nt, Human
gccgccgccccgccgccgcccgca

SEQ ID NO: 439473 - RNA, 20 nt, Human
gccgccgccccggcacccgc

SEQ ID NO: 439474 - RNA, 24 nt, Human
gccgccgccccggcucgccgccgc

SEQ ID NO: 439475 - RNA, 21 nt, Human
gccgccgccccuaccgccgca

SEQ ID NO: 439476 - RNA, 22 nt, Human
gccgccgccccugcacgcccgc

SEQ ID NO: 439477 - RNA, 19 nt, Human
gccgccgcccgccgcccgc

SEQ ID NO: 439478 - RNA, 24 nt, Human
gccgccgcccgccgccgccgccgc

SEQ ID NO: 439479 - RNA, 20 nt, Human
gccgccgcccgccgcgggcc

SEQ ID NO: 439480 - RNA, 25 nt, Human
gccgccgcccgccggcucucgggcu

SEQ ID NO: 439481 - RNA, 22 nt, Human
gccgccgcccgcggagccagca

SEQ ID NO: 439482 - RNA, 25 nt, Human
gccgccgcccgcuccuucucgggcc

SEQ ID NO: 439483 - RNA, 20 nt, Human
gccgccgcccgcugccugca

SEQ ID NO: 439484 - RNA, 21 nt, Human
gccgccgcccggggaccggca

SEQ ID NO: 439485 - RNA, 20 nt, Human
gccgccgcccuccgccccca

SEQ ID NO: 439486 - RNA, 32 nt, Human
gccgccgccgacgcaaccuccagcaccgccgc

SEQ ID NO: 439487 - RNA, 22 nt, Human
gccgccgccgagacagcugcgc

SEQ ID NO: 439488 - RNA, 21 nt, Human
gccgccgccgagcuccgccgc

SEQ ID NO: 439489 - RNA, 19 nt, Human
gccgccgccgagggccugc

SEQ ID NO: 439490 - RNA, 32 nt, Human
gccgccgccgagggcuggaggaagauggaggc

SEQ ID NO: 439491 - RNA, 20 nt, Human
gccgccgccgaggucccgca

SEQ ID NO: 439492 - RNA, 23 nt, Human
gccgccgccgcaccgcgccccac

SEQ ID NO: 439493 - RNA, 20 nt, Human
gccgccgccgcagccgccgc

SEQ ID NO: 439494 - RNA, 21 nt, Human
gccgccgccgcagcgcccuca

SEQ ID NO: 439495 - RNA, 23 nt, Human
gccgccgccgccaccaccgccac

SEQ ID NO: 439496 - RNA, 26 nt, Human
gccgccgccgccaccaccgcugccac

SEQ ID NO: 439497 - RNA, 27 nt, Human
gccgccgccgccacccagcgccgccgc

SEQ ID NO: 439498 - RNA, 20 nt, Human
gccgccgccgccaccgagcc

SEQ ID NO: 439499 - RNA, 19 nt, Human
gccgccgccgccaccgcca

SEQ ID NO: 439500 - RNA, 20 nt, Human
gccgccgccgccaccgccac

SEQ ID NO: 439501 - RNA, 23 nt, Human
gccgccgccgccaccgccgccgc

SEQ ID NO: 439502 - RNA, 26 nt, Human
gccgccgccgccacugccgucgccgc

SEQ ID NO: 439503 - RNA, 18 nt, Human
gccgccgccgccaugccc

SEQ ID NO: 439504 - RNA, 23 nt, Human
gccgccgccgcccaaccgccugc

SEQ ID NO: 439505 - RNA, 22 nt, Human
gccgccgccgcccaccgcccgc

SEQ ID NO: 439506 - RNA, 19 nt, Human
gccgccgccgcccccacca

SEQ ID NO: 439507 - RNA, 19 nt, Human
gccgccgccgcccccgcca

SEQ ID NO: 439508 - RNA, 20 nt, Human
gccgccgccgcccccgccac

SEQ ID NO: 439509 - RNA, 23 nt, Human
gccgccgccgcccccgccgccgc

SEQ ID NO: 439510 - RNA, 27 nt, Human
gccgccgccgccccggcucgccgccgc

SEQ ID NO: 439511 - RNA, 24 nt, Human
gccgccgccgcccgcagcaccgca

SEQ ID NO: 439512 - RNA, 21 nt, Human
gccgccgccgcccgccccgca

SEQ ID NO: 439513 - RNA, 19 nt, Human
gccgccgccgcccgcccgc

SEQ ID NO: 439514 - RNA, 19 nt, Human
gccgccgccgcccgcgaag

SEQ ID NO: 439515 - RNA, 26 nt, Human
gccgccgccgcccgcuccgccgccgc

SEQ ID NO: 439516 - RNA, 19 nt, Human
gccgccgccgcccugccgc

SEQ ID NO: 439517 - RNA, 32 nt, Human
gccgccgccgccgcaaccuccagcaccgccgc

SEQ ID NO: 439518 - RNA, 20 nt, Human
gccgccgccgccgccaccac

SEQ ID NO: 439519 - RNA, 20 nt, Human
gccgccgccgccgccaccgc

SEQ ID NO: 439520 - RNA, 22 nt, Human
gccgccgccgccgccaccgcca

SEQ ID NO: 439521 - RNA, 23 nt, Human
gccgccgccgccgccaccgccgc

SEQ ID NO: 439522 - RNA, 22 nt, Human
gccgccgccgccgccccggcac

SEQ ID NO: 439523 - RNA, 21 nt, Human
gccgccgccgccgcccgccgc

SEQ ID NO: 439524 - RNA, 24 nt, Human
gccgccgccgccgcccgccgccgc

SEQ ID NO: 439525 - RNA, 21 nt, Human
gccgccgccgccgcccgcggc

SEQ ID NO: 439526 - RNA, 29 nt, Human
gccgccgccgccgcccgcuccgccgccgc

SEQ ID NO: 439527 - RNA, 21 nt, Human
gccgccgccgccgcccggcau

SEQ ID NO: 439528 - RNA, 23 nt, Human
gccgccgccgccgccgcagccgc

SEQ ID NO: 439529 - RNA, 18 nt, Human
gccgccgccgccgccgcc

SEQ ID NO: 439530 - RNA, 19 nt, Human
gccgccgccgccgccgcca

SEQ ID NO: 439531 - RNA, 20 nt, Human
gccgccgccgccgccgccac

SEQ ID NO: 439532 - RNA, 20 nt, Human
gccgccgccgccgccgccau

SEQ ID NO: 439533 - RNA, 26 nt, Human
gccgccgccgccgccgcccccgccgc

SEQ ID NO: 439534 - RNA, 20 nt, Human
gccgccgccgccgccgccgc

SEQ ID NO: 439535 - RNA, 22 nt, Human
gccgccgccgccgccgccgcca

SEQ ID NO: 439536 - RNA, 23 nt, Human
gccgccgccgccgccgccgccac

SEQ ID NO: 439537 - RNA, 22 nt, Human
gccgccgccgccgccgccgccg

SEQ ID NO: 439538 - RNA, 23 nt, Human
gccgccgccgccgccgccgccgc

SEQ ID NO: 439539 - RNA, 23 nt, Human
gccgccgccgccgccgccgcugc

SEQ ID NO: 439540 - RNA, 24 nt, Human
gccgccgccgccgccgccggccgc

SEQ ID NO: 439541 - RNA, 22 nt, Human
gccgccgccgccgccgccgucg

SEQ ID NO: 439542 - RNA, 23 nt, Human
gccgccgccgccgccgccguggc

SEQ ID NO: 439543 - RNA, 20 nt, Human
gccgccgccgccgccgcgac

SEQ ID NO: 439544 - RNA, 20 nt, Human
gccgccgccgccgccgcggc

SEQ ID NO: 439545 - RNA, 20 nt, Human
gccgccgccgccgccgcugc

SEQ ID NO: 439546 - RNA, 23 nt, Human
gccgccgccgccgccgcugccgc

SEQ ID NO: 439547 - RNA, 20 nt, Human
gccgccgccgccgccgggcc

SEQ ID NO: 439548 - RNA, 32 nt, Human
gccgccgccgccgccucagccuucgccucagc

SEQ ID NO: 439549 - RNA, 32 nt, Human
gccgccgccgccgccuccgagccgggcagcaa

SEQ ID NO: 439550 - RNA, 20 nt, Human
gccgccgccgccgccuccgc

SEQ ID NO: 439551 - RNA, 23 nt, Human
gccgccgccgccgccuccgccgc

SEQ ID NO: 439552 - RNA, 32 nt, Human
gccgccgccgccgccucgcaacagguccgggc

SEQ ID NO: 439553 - RNA, 32 nt, Human
gccgccgccgccgccucggccgaccagggacc

SEQ ID NO: 439554 - RNA, 23 nt, Human
gccgccgccgccgccucugccgc

SEQ ID NO: 439555 - RNA, 21 nt, Human
gccgccgccgccgccugucac

SEQ ID NO: 439556 - RNA, 19 nt, Human
gccgccgccgccgcgccgc

SEQ ID NO: 439557 - RNA, 21 nt, Human
gccgccgccgccgcuccgcca

SEQ ID NO: 439558 - RNA, 25 nt, Human
gccgccgccgccgcuccucugccac

SEQ ID NO: 439559 - RNA, 20 nt, Human
gccgccgccgccgcugccac

SEQ ID NO: 439560 - RNA, 20 nt, Human
gccgccgccgccuccgagcc

SEQ ID NO: 439561 - RNA, 21 nt, Human
gccgccgccgcgagccgccgc

SEQ ID NO: 439562 - RNA, 17 nt, Human
gccgccgccgcgcagcc

SEQ ID NO: 439563 - RNA, 19 nt, Human
gccgccgccgcgcagcccc

SEQ ID NO: 439564 - RNA, 21 nt, Human
gccgccgccgcgcccgccuca

SEQ ID NO: 439565 - RNA, 20 nt, Human
gccgccgccgcggagccuca

SEQ ID NO: 439566 - RNA, 20 nt, Human
gccgccgccgcggcgcccgc

SEQ ID NO: 439567 - RNA, 20 nt, Human
gccgccgccgcgggaccugc

SEQ ID NO: 439568 - RNA, 25 nt, Human
gccgccgccgcugccaccgccuaca

SEQ ID NO: 439569 - RNA, 23 nt, Human
gccgccgccgcugucgccgccac

SEQ ID NO: 439570 - RNA, 32 nt, Human
gccgccgccgcugucgccgccaccuccucuga

SEQ ID NO: 439571 - RNA, 22 nt, Human
gccgccgccggagccgcgcgca

SEQ ID NO: 439572 - RNA, 21 nt, Human
gccgccgccggagccugucgc

SEQ ID NO: 439573 - RNA, 20 nt, Human
gccgccgccggagcucugua

SEQ ID NO: 439574 - RNA, 21 nt, Human
gccgccgccggcagaccccgc

SEQ ID NO: 439575 - RNA, 22 nt, Human
gccgccgccggcccccggcgcc

SEQ ID NO: 439576 - RNA, 20 nt, Human
gccgccgccggcccgcagcc

SEQ ID NO: 439577 - RNA, 23 nt, Human
gccgccgccggcccgcggagccc

SEQ ID NO: 439578 - RNA, 22 nt, Human
gccgccgccggccgcggcugca

SEQ ID NO: 439579 - RNA, 24 nt, Human
gccgccgccggcucggggagccca

SEQ ID NO: 439580 - RNA, 19 nt, Human
gccgccgccgggccgccgc

SEQ ID NO: 439581 - RNA, 22 nt, Human
gccgccgccggggcccaaugcc

SEQ ID NO: 439582 - RNA, 22 nt, Human
gccgccgccggggcucuuggca

SEQ ID NO: 439583 - RNA, 21 nt, Human
gccgccgccggggcuguaggc

SEQ ID NO: 439584 - RNA, 21 nt, Human
gccgccgccgggggaguccgc

SEQ ID NO: 439585 - RNA, 22 nt, Human
gccgccgccggguugugccuca

SEQ ID NO: 439586 - RNA, 22 nt, Human
gccgccgccguuuucgccugca

SEQ ID NO: 439587 - RNA, 22 nt, Human
gccgccgccuccaccaccacca

SEQ ID NO: 439588 - RNA, 24 nt, Human
gccgccgccucccgcacgcuugca

SEQ ID NO: 439589 - RNA, 31 nt, Human
gccgccgccuccucugggccucgucuccccu

SEQ ID NO: 439590 - RNA, 20 nt, Human
gccgccgccucgcacccgca

SEQ ID NO: 439591 - RNA, 32 nt, Human
gccgccgccucuccagcucacccucacucagc

SEQ ID NO: 439592 - RNA, 18 nt, Human
gccgccgcgaguccagcu

SEQ ID NO: 439593 - RNA, 20 nt, Human
gccgccgcgcagccccucca

SEQ ID NO: 439594 - RNA, 25 nt, Human
gccgccgcgcucgucccuccgggcc

SEQ ID NO: 439595 - RNA, 32 nt, Human
gccgccgcgcugcugggggcugggcaggggca

SEQ ID NO: 439596 - RNA, 32 nt, Human
gccgccgcggacuccggcagcuuuaucgccag

SEQ ID NO: 439597 - RNA, 26 nt, Human
gccgccgcggacuucgcuuugggcca

SEQ ID NO: 439598 - RNA, 18 nt, Human
gccgccgcggccaggccc

SEQ ID NO: 439599 - RNA, 32 nt, Human
gccgccgcggccgccucggggucugggcccag

SEQ ID NO: 439600 - RNA, 32 nt, Human
gccgccgcggcuucagcaccagcgcccggaca

SEQ ID NO: 439601 - RNA, 32 nt, Human
gccgccgcgggaggaggaggagccggagccuc

SEQ ID NO: 439602 - RNA, 23 nt, Human
gccgccgcuaccgccaccgccac

SEQ ID NO: 439603 - RNA, 24 nt, Human
gccgccgcuccgccggcccugggc

SEQ ID NO: 439604 - RNA, 25 nt, Human
gccgccgcucgcucgcucgccggcc

SEQ ID NO: 439605 - RNA, 23 nt, Human
gccgccgcucgggcgccgggcuc

SEQ ID NO: 439606 - RNA, 20 nt, Human
gccgccgcugccgacgccac

SEQ ID NO: 439607 - RNA, 20 nt, Human
gccgccgcugccgccgccac

SEQ ID NO: 439608 - RNA, 20 nt, Human
gccgccgcugccgccgccgc

SEQ ID NO: 439609 - RNA, 26 nt, Human
gccgccgcugccgucgccgccgagcc

SEQ ID NO: 439610 - RNA, 32 nt, Human
gccgccgcugccucugggcccucccagcacac

SEQ ID NO: 439611 - RNA, 32 nt, Human
gccgccgcugcgguggaacagcgcagccgcuu

SEQ ID NO: 439612 - RNA, 20 nt, Human
gccgccgcugcuaccgccac

SEQ ID NO: 439613 - RNA, 32 nt, Human
gccgccgcugcuccuccgccuggccugggccg

SEQ ID NO: 439614 - RNA, 32 nt, Human
gccgccgcugcuggcgccgcaggcuggccccc

SEQ ID NO: 439615 - RNA, 25 nt, Human
gccgccgcugugcucacugauccgc

SEQ ID NO: 439616 - RNA, 32 nt, Human
gccgccggcaugagccacauccagaucccgcc

SEQ ID NO: 439617 - RNA, 22 nt, Human
gccgccggccucccgcacccgc

SEQ ID NO: 439618 - RNA, 21 nt, Human
gccgccggcgcccuuccccgu

SEQ ID NO: 439619 - RNA, 21 nt, Human
gccgccggcgcucaaccacgc

SEQ ID NO: 439620 - RNA, 21 nt, Human
gccgccggcggcccaacccgu

SEQ ID NO: 439621 - RNA, 32 nt, Human
gccgccggcuagcagauucagaccaugccgcu

SEQ ID NO: 439622 - RNA, 19 nt, Human
gccgccgggaccccggccu

SEQ ID NO: 439623 - RNA, 32 nt, Human
gccgccgggauuacaggcgugagccaccaugc

SEQ ID NO: 439624 - RNA, 20 nt, Human
gccgccgggccagccgccac

SEQ ID NO: 439625 - RNA, 32 nt, Human
gccgccggggaagaggaggaggaaggaaagaa

SEQ ID NO: 439626 - RNA, 32 nt, Human
gccgccggucaccgccggccaggcccccugca

SEQ ID NO: 439627 - RNA, 24 nt, Human
gccgccgguccacacccgccccgc

SEQ ID NO: 439628 - RNA, 32 nt, Human
gccgccgguggaggugcccgggcaggugcaga

SEQ ID NO: 439629 - RNA, 20 nt, Human
gccgccgucgccaccgccac

SEQ ID NO: 439630 - RNA, 20 nt, Human
gccgccgucgccgccgccgc

SEQ ID NO: 439631 - RNA, 23 nt, Human
gccgccgucggugucgccgccac

SEQ ID NO: 439632 - RNA, 32 nt, Human
gccgccgucuucuucaccuguucucgggaagg

SEQ ID NO: 439633 - RNA, 31 nt, Human
gccgccgugcccucugggcgguugugaggcu

SEQ ID NO: 439634 - RNA, 32 nt, Human
gccgccguggaguaacacagccagcaguuucc

SEQ ID NO: 439635 - RNA, 32 nt, Human
gccgccgugggugaccugcagagacuuccugc

SEQ ID NO: 439636 - RNA, 32 nt, Human
gccgccguuacccgcucaccagcuacgcggcg

SEQ ID NO: 439637 - RNA, 25 nt, Human
gccgccguucuccuguccucgggcu

SEQ ID NO: 439638 - RNA, 32 nt, Human
gccgccuaagacauugugccacccucaauccg

SEQ ID NO: 439639 - RNA, 32 nt, Human
gccgccuacuccugcaaaugcuugugacagau

SEQ ID NO: 439640 - RNA, 32 nt, Human
gccgccuagaagcagaagcgcaggccagcgag

SEQ ID NO: 439641 - RNA, 32 nt, Human
gccgccucaaccucuccuggguucaggugauc

SEQ ID NO: 439642 - RNA, 23 nt, Human
gccgccucagccgccgccgccgc

SEQ ID NO: 439643 - RNA, 32 nt, Human
gccgccucagccgccucagucgccucaaucuc

SEQ ID NO: 439644 - RNA, 32 nt, Human
gccgccuccaagccccugagguuuccggggac

SEQ ID NO: 439645 - RNA, 20 nt, Human
gccgccuccacgcugugcuc

SEQ ID NO: 439646 - RNA, 32 nt, Human
gccgccuccagccucuccccucuggcaggcgc

SEQ ID NO: 439647 - RNA, 32 nt, Human
gccgccuccagguacagccacagccaggagca

SEQ ID NO: 439648 - RNA, 32 nt, Human
gccgccuccccgaacccagcugccgucaacac

SEQ ID NO: 439649 - RNA, 32 nt, Human
gccgccucccgcccccaaaccccauccccgcg

SEQ ID NO: 439650 - RNA, 23 nt, Human
gccgccucccugcagggccccug

SEQ ID NO: 439651 - RNA, 23 nt, Human
gccgccucccugccaagaaucug

SEQ ID NO: 439652 - RNA, 32 nt, Human
gccgccucccuggagcucugcccagcugucag

SEQ ID NO: 439653 - RNA, 32 nt, Human
gccgccuccgccuucggcgccugcugccuccc

SEQ ID NO: 439654 - RNA, 32 nt, Human
gccgccuccuacggccgacucuggguucccuu

SEQ ID NO: 439655 - RNA, 32 nt, Human
gccgccucgaaucaaccucucuccccaggcau

SEQ ID NO: 439656 - RNA, 24 nt, Human
gccgccucgccugccgccgcgcuc

SEQ ID NO: 439657 - RNA, 32 nt, Human
gccgccucucccggggacaaugugggacugag

SEQ ID NO: 439658 - RNA, 32 nt, Human
gccgccucuccuccucucccgcccgccgccug

SEQ ID NO: 439659 - RNA, 32 nt, Human
gccgccucugacgaggaggagguggaggagga

SEQ ID NO: 439660 - RNA, 32 nt, Human
gccgccucuggacuaucuccccagaccagcag

SEQ ID NO: 439661 - RNA, 32 nt, Human
gccgccucuguggaacccaggcaucaccaagg

SEQ ID NO: 439662 - RNA, 32 nt, Human
gccgccugacgaaauggaaacacacacagaca

SEQ ID NO: 439663 - RNA, 32 nt, Human
gccgccugauuaaauaaugugcugcuaaauau

SEQ ID NO: 439664 - RNA, 32 nt, Human
gccgccugcagucuccucucugggugauugcg

SEQ ID NO: 439665 - RNA, 32 nt, Human
gccgccugcccgggcauccugcucuggcaagc

SEQ ID NO: 439666 - RNA, 21 nt, Human
gccgccugccgccgccgccgc

SEQ ID NO: 439667 - RNA, 21 nt, Human
gccgccugccuuggccuccca

SEQ ID NO: 439668 - RNA, 32 nt, Human
gccgccugcgcgggggagcccagcacagaccg

SEQ ID NO: 439669 - RNA, 29 nt, Human
gccgccuggcugcugccgcugccuccucc

SEQ ID NO: 439670 - RNA, 32 nt, Human
gccgccuggcugcugccgcugccuccuccugg

SEQ ID NO: 439671 - RNA, 21 nt, Human
gccgccugguugccugggcca

SEQ ID NO: 439672 - RNA, 32 nt, Human
gccgccuguagucccagcuacucaggaggcuu

SEQ ID NO: 439673 - RNA, 32 nt, Human
gccgccuguagucccagcuacucgggaggcug

SEQ ID NO: 439674 - RNA, 32 nt, Human
gccgccugugggaacagcuauucucugcacau

SEQ ID NO: 439675 - RNA, 32 nt, Human
gccgccuucagccacguguccucgcuuauaga

SEQ ID NO: 439676 - RNA, 32 nt, Human
gccgccuuccagcucugagucuugggaauguu

SEQ ID NO: 439677 - RNA, 32 nt, Human
gccgccuuccccaucacggaggguccagacug

SEQ ID NO: 439678 - RNA, 32 nt, Human
gccgccuucccccaucucuuccucguccuccu

SEQ ID NO: 439679 - RNA, 16 nt, Human
gccgccuucugcuguc

SEQ ID NO: 439680 - RNA, 32 nt, Human
gccgccuugcugcugcucaaagcugcugccgc

SEQ ID NO: 439681 - RNA, 32 nt, Human
gccgccuuggguaguugaccugccuuuucuga

SEQ ID NO: 439682 - RNA, 32 nt, Human
gccgccuugucgccugcgccccggcugggcuc

SEQ ID NO: 439683 - RNA, 32 nt, Human
gccgcgaagccaugggcagacaggaaguggag

SEQ ID NO: 439684 - RNA, 32 nt, Human
gccgcgaaucucuccagggaaucccgggcagc

SEQ ID NO: 439685 - RNA, 32 nt, Human
gccgcgacucucugcuucucuccagcucucaa

SEQ ID NO: 439686 - RNA, 32 nt, Human
gccgcgacuucuggaucugccuccgagcucag

SEQ ID NO: 439687 - RNA, 25 nt, Human
gccgcgagacccaggccgcccacgg

SEQ ID NO: 439688 - RNA, 32 nt, Human
gccgcgagagucaggaaguuccagaaaguucc

SEQ ID NO: 439689 - RNA, 17 nt, Human
gccgcgaguuccaccuc

SEQ ID NO: 439690 - RNA, 32 nt, Human
gccgcgaucgccgccuccccgccucaggcucc

SEQ ID NO: 439691 - RNA, 32 nt, Human
gccgcgcaaauuuaugguuagauuugucucaa

SEQ ID NO: 439692 - RNA, 19 nt, Human
gccgcgcaccggggcucgg

SEQ ID NO: 439693 - RNA, 32 nt, Human
gccgcgcagagcccgggacaauggggccgcgg

SEQ ID NO: 439694 - RNA, 32 nt, Human
gccgcgcagcagcagcggaagccagaccucgg

SEQ ID NO: 439695 - RNA, 21 nt, Human
gccgcgcagccccggccgcca

SEQ ID NO: 439696 - RNA, 32 nt, Human
gccgcgcaggguggagcguuggaaaaugagaa

SEQ ID NO: 439697 - RNA, 32 nt, Human
gccgcgccaccugcgccucgcccgccgccgcc

SEQ ID NO: 439698 - RNA, 32 nt, Human
gccgcgcccaggaguuggggauguccuacaaa

SEQ ID NO: 439699 - RNA, 32 nt, Human
gccgcgcccccucccccuccagccggguaccc

SEQ ID NO: 439700 - RNA, 21 nt, Human
gccgcgcccgcuccgcuccga

SEQ ID NO: 439701 - RNA, 32 nt, Human
gccgcgcccguggaagugcugcauggggcagg

SEQ ID NO: 439702 - RNA, 19 nt, Human
gccgcgcccuccccgggga

SEQ ID NO: 439703 - RNA, 32 nt, Human
gccgcgcccugagaccguuuaucugcagucaa

SEQ ID NO: 439704 - RNA, 32 nt, Human
gccgcgcccugagcgccuuugucugccgcccg

SEQ ID NO: 439705 - RNA, 20 nt, Human
gccgcgccgcccgcagcccc

SEQ ID NO: 439706 - RNA, 19 nt, Human
gccgcgccgccgccgccac

SEQ ID NO: 439707 - RNA, 32 nt, Human
gccgcgccgcgcccgagccucuugccuucgcg

SEQ ID NO: 439708 - RNA, 20 nt, Human
gccgcgccgcgcugcgcucc

SEQ ID NO: 439709 - RNA, 32 nt, Human
gccgcgccgcugccucugccccggccgccccc

SEQ ID NO: 439710 - RNA, 32 nt, Human
gccgcgccuccuccuccuccugcuccccgccg

SEQ ID NO: 439711 - RNA, 23 nt, Human
gccgcgccuccugcaagccggga

SEQ ID NO: 439712 - RNA, 32 nt, Human
gccgcgcgaccaaugguggaggcugcagccug

SEQ ID NO: 439713 - RNA, 32 nt, Human
gccgcgcgaggguggugggcaucgagguccca

SEQ ID NO: 439714 - RNA, 24 nt, Human
gccgcgcggacuccugccccgagg

SEQ ID NO: 439715 - RNA, 32 nt, Human
gccgcgcgggagagaggccgagauggcagaug

SEQ ID NO: 439716 - RNA, 32 nt, Human
gccgcgcgucccagagagccagccccggccgc

SEQ ID NO: 439717 - RNA, 32 nt, Human
gccgcgcguuccucccagaggggcgucccggc

SEQ ID NO: 439718 - RNA, 20 nt, Human
gccgcgcucccgcccaggga

SEQ ID NO: 439719 - RNA, 25 nt, Human
gccgcgcucccgcucgccccgaccc

SEQ ID NO: 439720 - RNA, 32 nt, Human
gccgcgcuccucggacggcuccggacgcugcu

SEQ ID NO: 439721 - RNA, 23 nt, Human
gccgcgcugccugcagugcgcuc

SEQ ID NO: 439722 - RNA, 17 nt, Human
gccgcgcuguccaggug

SEQ ID NO: 439723 - RNA, 32 nt, Human
gccgcgcuugggaggccaagcuuuaaacaucu

SEQ ID NO: 439724 - RNA, 32 nt, Human
gccgcggaaagaaugcgcgccgcccgugcgcu

SEQ ID NO: 439725 - RNA, 32 nt, Human
gccgcggaacaguugcgucuccaucuggcuac

SEQ ID NO: 439726 - RNA, 32 nt, Human
gccgcggacgagaagaaaagacaggaggccaa

SEQ ID NO: 439727 - RNA, 32 nt, Human
gccgcggacgcaccugggacccugcacagccc

SEQ ID NO: 439728 - RNA, 32 nt, Human
gccgcggacggggcccggagcuugccugccuc

SEQ ID NO: 439729 - RNA, 32 nt, Human
gccgcggaggaagacagcgccgcccgcgcacc

SEQ ID NO: 439730 - RNA, 32 nt, Human
gccgcggaggcagcggcggcagcggcucuccu

SEQ ID NO: 439731 - RNA, 32 nt, Human
gccgcggaucccggccaaggcggaggcugcgg

SEQ ID NO: 439732 - RNA, 32 nt, Human
gccgcggcaaggauggagcuggguugcuggac

SEQ ID NO: 439733 - RNA, 32 nt, Human
gccgcggcagagccagcacagccagcgcgcca

SEQ ID NO: 439734 - RNA, 32 nt, Human
gccgcggccaaagagcuggcuguaaucccgcc

SEQ ID NO: 439735 - RNA, 23 nt, Human
gccgcggccaacagcggcagcaa

SEQ ID NO: 439736 - RNA, 28 nt, Human
gccgcggccacaggucugcauccagcgg

SEQ ID NO: 439737 - RNA, 32 nt, Human
gccgcggccauggagaagcuuagcuccaucaa

SEQ ID NO: 439738 - RNA, 20 nt, Human
gccgcggccgagcagccagc

SEQ ID NO: 439739 - RNA, 32 nt, Human
gccgcggcucgggacguguccagugaucauaa

SEQ ID NO: 439740 - RNA, 32 nt, Human
gccgcggcucugcggagaaaccacgaccaccg

SEQ ID NO: 439741 - RNA, 32 nt, Human
gccgcggcugcacucccaagauggcggcuccu

SEQ ID NO: 439742 - RNA, 32 nt, Human
gccgcgggacccugggcugagcaccgacccag

SEQ ID NO: 439743 - RNA, 32 nt, Human
gccgcgggaggaggaggagccggagccucugc

SEQ ID NO: 439744 - RNA, 32 nt, Human
gccgcgggagggaggccaggaggcccggacca

SEQ ID NO: 439745 - RNA, 19 nt, Human
gccgcgggcacggcugcug

SEQ ID NO: 439746 - RNA, 32 nt, Human
gccgcggggcaggggugcaguggguguuacca

SEQ ID NO: 439747 - RNA, 32 nt, Human
gccgcggggcguccgggucugagccgcagcaa

SEQ ID NO: 439748 - RNA, 32 nt, Human
gccgcggguggaggucggggaugaggcagcag

SEQ ID NO: 439749 - RNA, 32 nt, Human
gccgcggucagcugcccccgagacugugccug

SEQ ID NO: 439750 - RNA, 32 nt, Human
gccgcguaucccccggcuaccugggccgcccc

SEQ ID NO: 439751 - RNA, 27 nt, Human
gccgcguccggcgcugcugcugcgcuc

SEQ ID NO: 439752 - RNA, 32 nt, Human
gccgcgucuccgcuucugcugccugccgggcg

SEQ ID NO: 439753 - RNA, 32 nt, Human
gccgcgugagccugcggggccauggagcgcgc

SEQ ID NO: 439754 - RNA, 32 nt, Human
gccgcgugccuguaaucccagcuacuugggag

SEQ ID NO: 439755 - RNA, 32 nt, Human
gccgcguggcuccgcccugccggcgucugggg

SEQ ID NO: 439756 - RNA, 32 nt, Human
gccgcguuguccaucacuaggacuuuacugcc

SEQ ID NO: 439757 - RNA, 32 nt, Human
gccgcuaacgcccagacgcauggaugcacccc

SEQ ID NO: 439758 - RNA, 32 nt, Human
gccgcuacagaaguccuuacugcggaccaaaa

SEQ ID NO: 439759 - RNA, 32 nt, Human
gccgcuacuagacugcccccggacccugcgau

SEQ ID NO: 439760 - RNA, 32 nt, Human
gccgcuacuuccccaccaaccacaugguacag

SEQ ID NO: 439761 - RNA, 32 nt, Human
gccgcuagaggccugaggaugagcuggaagga

SEQ ID NO: 439762 - RNA, 32 nt, Human
gccgcuauugcucuuuuuaacuucauuugaug

SEQ ID NO: 439763 - RNA, 17 nt, Human
gccgcucaacauccugc

SEQ ID NO: 439764 - RNA, 32 nt, Human
gccgcucagcgccccggcugggcggaggagga

SEQ ID NO: 439765 - RNA, 32 nt, Human
gccgcucaggugucccgagacuccgggcaagg

SEQ ID NO: 439766 - RNA, 27 nt, Human
gccgcucauagagcuugcccuggguca

SEQ ID NO: 439767 - RNA, 16 nt, Human
gccgcucccccggagc

SEQ ID NO: 439768 - RNA, 19 nt, Human
gccgcuccgccgccgccgc

SEQ ID NO: 439769 - RNA, 32 nt, Human
gccgcuccgcuccccugcuccugucugucucg

SEQ ID NO: 439770 - RNA, 32 nt, Human
gccgcuccuccccucuccccacccuccuccuc

SEQ ID NO: 439771 - RNA, 32 nt, Human
gccgcuccucccuugcccucaggccagguccc

SEQ ID NO: 439772 - RNA, 32 nt, Human
gccgcuccugccggcagcuccaaccaugggag

SEQ ID NO: 439773 - RNA, 32 nt, Human
gccgcucgcccaggauggagaggcggguccca

SEQ ID NO: 439774 - RNA, 32 nt, Human
gccgcucgcugccucucgcucgcagcagcggc

SEQ ID NO: 439775 - RNA, 22 nt, Human
gccgcucggccccgccgcgcuc

SEQ ID NO: 439776 - RNA, 32 nt, Human
gccgcucgggacgacuuccucggcugcgcggc

SEQ ID NO: 439777 - RNA, 17 nt, Human
gccgcucggggccgcag

SEQ ID NO: 439778 - RNA, 32 nt, Human
gccgcucucucucacuuuuucuggaacucaug

SEQ ID NO: 439779 - RNA, 18 nt, Human
gccgcucugucuucucuc

SEQ ID NO: 439780 - RNA, 32 nt, Human
gccgcugacgauggaagaacuggagcaaggcc

SEQ ID NO: 439781 - RNA, 32 nt, Human
gccgcugacugccagcuccagccuggccccgg

SEQ ID NO: 439782 - RNA, 32 nt, Human
gccgcugcacacacgcacacggagccaugggg

SEQ ID NO: 439783 - RNA, 32 nt, Human
gccgcugcaccaccacccgagccugggagcca

SEQ ID NO: 439784 - RNA, 32 nt, Human
gccgcugcacgucagcccgcaggccaaggguc

SEQ ID NO: 439785 - RNA, 32 nt, Human
gccgcugcacuccagccugggugacagaguga

SEQ ID NO: 439786 - RNA, 32 nt, Human
gccgcugcagccgccuccuccuccaggcaaac

SEQ ID NO: 439787 - RNA, 32 nt, Human
gccgcugcagccgccuccuccuccaggugcug

SEQ ID NO: 439788 - RNA, 22 nt, Human
gccgcugcagguccccgcuccc

SEQ ID NO: 439789 - RNA, 32 nt, Human
gccgcugcauuccagccugggugacagagcga

SEQ ID NO: 439790 - RNA, 32 nt, Human
gccgcugccaccaucuccucugugccaacucc

SEQ ID NO: 439791 - RNA, 18 nt, Human
gccgcugccagcugccca

SEQ ID NO: 439792 - RNA, 32 nt, Human
gccgcugcccaaccgccagccccagccccgcg

SEQ ID NO: 439793 - RNA, 20 nt, Human
gccgcugccgccgccgccac

SEQ ID NO: 439794 - RNA, 32 nt, Human
gccgcugccgccucagcugcuuuggcccagcc

SEQ ID NO: 439795 - RNA, 32 nt, Human
gccgcugccuccgcgccauggccggccucagc

SEQ ID NO: 439796 - RNA, 32 nt, Human
gccgcugccuucacugaaggcugcagugcugu

SEQ ID NO: 439797 - RNA, 32 nt, Human
gccgcugcgaagggagccgccgccaugucugc

SEQ ID NO: 439798 - RNA, 20 nt, Human
gccgcugcgcugucccggcc

SEQ ID NO: 439799 - RNA, 32 nt, Human
gccgcugcucuucccuucuccucaggaggggg

SEQ ID NO: 439800 - RNA, 32 nt, Human
gccgcugcugcagcagcagcugcucugcagag

SEQ ID NO: 439801 - RNA, 23 nt, Human
gccgcugcugccccgccuugcag

SEQ ID NO: 439802 - RNA, 19 nt, Human
gccgcugcugccggggcuc

SEQ ID NO: 439803 - RNA, 21 nt, Human
gccgcugcugcucuguggcca

SEQ ID NO: 439804 - RNA, 32 nt, Human
gccgcugcugggauggggcucggggccuggga

SEQ ID NO: 439805 - RNA, 30 nt, Human
gccgcuggaagccaccgggccaagggagcu

SEQ ID NO: 439806 - RNA, 32 nt, Human
gccgcuggcgcgccaugaggaaggcgccacgc

SEQ ID NO: 439807 - RNA, 32 nt, Human
gccgcuggcugcagacuggagcugcgcggguc

SEQ ID NO: 439808 - RNA, 21 nt, Human
gccgcugggcgcuccgcgcuc

SEQ ID NO: 439809 - RNA, 22 nt, Human
gccgcuggggccaguugguccc

SEQ ID NO: 439810 - RNA, 22 nt, Human
gccgcugggguccgucuucaca

SEQ ID NO: 439811 - RNA, 32 nt, Human
gccgcugguacccgcccgguaccgcgcgagcc

SEQ ID NO: 439812 - RNA, 32 nt, Human
gccgcuggucccccaccaggcuugggagcccu

SEQ ID NO: 439813 - RNA, 32 nt, Human
gccgcuguacucccugagcuuccccaccccaa

SEQ ID NO: 439814 - RNA, 32 nt, Human
gccgcuguccccaccacugcagccaugaucuc

SEQ ID NO: 439815 - RNA, 32 nt, Human
gccgcuguccuccgggagcggcagcaguagcc

SEQ ID NO: 439816 - RNA, 32 nt, Human
gccgcugugauugccucuaaggaacagcauuc

SEQ ID NO: 439817 - RNA, 32 nt, Human
gccgcuguucaugucuggacuccugggggcgc

SEQ ID NO: 439818 - RNA, 32 nt, Human
gccgcuguuggggauaugguuucuugaagcau

SEQ ID NO: 439819 - RNA, 32 nt, Human
gccgcuuagcagagaagaaagggccugggagg

SEQ ID NO: 439820 - RNA, 32 nt, Human
gccgcuucaucccagacucucuucuagggcuu

SEQ ID NO: 439821 - RNA, 32 nt, Human
gccgcuucccgcaggcaucugagcucugugcc

SEQ ID NO: 439822 - RNA, 32 nt, Human
gccgcuuccugccuccuuccucugugggagca

SEQ ID NO: 439823 - RNA, 32 nt, Human
gccgcuuccugggcuagagacaagcaccagcc

SEQ ID NO: 439824 - RNA, 22 nt, Human
gccgcuucgcgcuguuugcugc

SEQ ID NO: 439825 - RNA, 32 nt, Human
gccgcuucgcgcuguuugcugcgcgggcuuuu

SEQ ID NO: 439826 - RNA, 32 nt, Human
gccgcuucucaaacugggucucagaaaauuuc

SEQ ID NO: 439827 - RNA, 18 nt, Human
gccgcuucuccccacaga

SEQ ID NO: 439828 - RNA, 32 nt, Human
gccgcuucuccccagggucucucaguuuucca

SEQ ID NO: 439829 - RNA, 32 nt, Human
gccgcuucugaccucgcucuggcuccggugcg

SEQ ID NO: 439830 - RNA, 32 nt, Human
gccgcuucugacugcugauucucccguucacg

SEQ ID NO: 439831 - RNA, 32 nt, Human
gccgcuugaacuuggagccacuuugaguuggg

SEQ ID NO: 439832 - RNA, 32 nt, Human
gccgcuugaaugcagcaugcacauucauguaa

SEQ ID NO: 439833 - RNA, 21 nt, Human
gccgcuugcccagccuugagg

SEQ ID NO: 439834 - RNA, 20 nt, Human
gccgcuugcggguuugucgc

SEQ ID NO: 439835 - RNA, 32 nt, Human
gccgcuugcugcagaggauccaguccagaucc

SEQ ID NO: 439836 - RNA, 32 nt, Human
gccgcuuucccccuucaagaugccauuuggag

SEQ ID NO: 439837 - RNA, 32 nt, Human
gccgcuuucucaucagugcccagugcuggguc

SEQ ID NO: 439838 - RNA, 32 nt, Human
gccgcuuugccucugcuucgcccugugcugug

SEQ ID NO: 439839 - RNA, 32 nt, Human
gccgcuuuguucuucgcuucucggcucgaggc

SEQ ID NO: 439840 - RNA, 32 nt, Human
gccggaaagaaaaugcugaccauuggaggugc

SEQ ID NO: 439841 - RNA, 32 nt, Human
gccggaaagaagagaagccugcagaagaacau

SEQ ID NO: 439842 - RNA, 21 nt, Human
gccggaaagacuccccagcaa

SEQ ID NO: 439843 - RNA, 32 nt, Human
gccggaaagaggagcggcaggagggggcgugg

SEQ ID NO: 439844 - RNA, 32 nt, Human
gccggaaagcauuugucucccaccucaucaua

SEQ ID NO: 439845 - RNA, 32 nt, Human
gccggaaccccaguuacccggugaggacgugg

SEQ ID NO: 439846 - RNA, 32 nt, Human
gccggaacgggaggggacuggagggcugcggg

SEQ ID NO: 439847 - RNA, 32 nt, Human
gccggaagcaacucccagccccauaaagaucu

SEQ ID NO: 439848 - RNA, 32 nt, Human
gccggaagccauggcacacuaccccacaaggc

SEQ ID NO: 439849 - RNA, 21 nt, Human
gccggaagcgacuuuccgccg

SEQ ID NO: 439850 - RNA, 22 nt, Human
gccggaagugauccuucccucc

SEQ ID NO: 439851 - RNA, 25 nt, Human
gccggaaucagagccgcgggugaga

SEQ ID NO: 439852 - RNA, 32 nt, Human
gccggacacucucaucagggcccagcagcaac

SEQ ID NO: 439853 - RNA, 32 nt, Human
gccggacaggcgcgcaccgagcgcacucucua

SEQ ID NO: 439854 - RNA, 22 nt, Human
gccggaccaccggccgcagccu

SEQ ID NO: 439855 - RNA, 32 nt, Human
gccggaccccgcccaggcagggagcugcugug

SEQ ID NO: 439856 - RNA, 32 nt, Human
gccggacccucagggcccugaaccgucgcucu

SEQ ID NO: 439857 - RNA, 32 nt, Human
gccggacccuggggccucccaccccagccucc

SEQ ID NO: 439858 - RNA, 32 nt, Human
gccggaccgagugcccugcaguugguaggagu

SEQ ID NO: 439859 - RNA, 20 nt, Human
gccggaccucuuccuuucca

SEQ ID NO: 439860 - RNA, 32 nt, Human
gccggacgcagcagcccucuggcuccagcaug

SEQ ID NO: 439861 - RNA, 32 nt, Human
gccggacgccccuccccuaucuugccgcccgc

SEQ ID NO: 439862 - RNA, 19 nt, Human
gccggacggaguccuuucc

SEQ ID NO: 439863 - RNA, 32 nt, Human
gccggacgggagguggcggagguggcggcgga

SEQ ID NO: 439864 - RNA, 32 nt, Human
gccggacguagcuuucuccuccuggugucauu

SEQ ID NO: 439865 - RNA, 32 nt, Human
gccggacucauuuuccuaaucuuagccacuua

SEQ ID NO: 439866 - RNA, 32 nt, Human
gccggacucuauggggcgggacccugggggag

SEQ ID NO: 439867 - RNA, 21 nt, Human
gccggacugcugccauugccu

SEQ ID NO: 439868 - RNA, 19 nt, Human
gccggacuggcagagccag

SEQ ID NO: 439869 - RNA, 32 nt, Human
gccggacuuacccuuuaaauuauucagaagga

SEQ ID NO: 439870 - RNA, 26 nt, Human
gccggagaaaagggugucggggccac

SEQ ID NO: 439871 - RNA, 32 nt, Human
gccggagaaggcccgugaccagccagaagcac

SEQ ID NO: 439872 - RNA, 19 nt, Human
gccggagaaucgcuugaac

SEQ ID NO: 439873 - RNA, 32 nt, Human
gccggagacagugauugaaaacauuugaaaag

SEQ ID NO: 439874 - RNA, 18 nt, Human
gccggagagacaauggag

SEQ ID NO: 439875 - RNA, 32 nt, Human
gccggagagagcugggugccugccugggaugc

SEQ ID NO: 439876 - RNA, 32 nt, Human
gccggagagauggugggggcagcuccucuucu

SEQ ID NO: 439877 - RNA, 32 nt, Human
gccggagagccccaggcccgagccacgcgguc

SEQ ID NO: 439878 - RNA, 32 nt, Human
gccggagaguugggcucagugcggagcucggc

SEQ ID NO: 439879 - RNA, 32 nt, Human
gccggagcaggccgcaggggaggcaggggaug

SEQ ID NO: 439880 - RNA, 32 nt, Human
gccggagcccaguucuggagagggacaaggag

SEQ ID NO: 439881 - RNA, 32 nt, Human
gccggagccccagcugcagcagcugagaccgc

SEQ ID NO: 439882 - RNA, 32 nt, Human
gccggagcccgggauggggcgagaggcugcgg

SEQ ID NO: 439883 - RNA, 32 nt, Human
gccggagcccuugccagaucucccucccucuc

SEQ ID NO: 439884 - RNA, 32 nt, Human
gccggagcccuugggugaaauuguuaggcgug

SEQ ID NO: 439885 - RNA, 32 nt, Human
gccggagcgggcugggcugggcccgggauggc

SEQ ID NO: 439886 - RNA, 21 nt, Human
gccggagcgucgcggcggaga

SEQ ID NO: 439887 - RNA, 32 nt, Human
gccggaggaaaaagcucgccacccugaagggu

SEQ ID NO: 439888 - RNA, 22 nt, Human
gccggaggacccccacuugaga

SEQ ID NO: 439889 - RNA, 32 nt, Human
gccggaggaggaggaggaggaggaggcaaagu

SEQ ID NO: 439890 - RNA, 32 nt, Human
gccggaggaggcggagguggcgcggcaggagg

SEQ ID NO: 439891 - RNA, 32 nt, Human
gccggaggcaggcaaagaaacaagugaagaaa

SEQ ID NO: 439892 - RNA, 32 nt, Human
gccggaggcuaguggguggcugacccccagca

SEQ ID NO: 439893 - RNA, 32 nt, Human
gccggaggcuuaggggcucuggcagccccagc

SEQ ID NO: 439894 - RNA, 32 nt, Human
gccggagggaggcggaggaaccgguguucgcc

SEQ ID NO: 439895 - RNA, 22 nt, Human
gccggagggcagggcucaggga

SEQ ID NO: 439896 - RNA, 32 nt, Human
gccggagggccgcggcgggcggcggccgaggc

SEQ ID NO: 439897 - RNA, 32 nt, Human
gccggagggggagacccauuccccuaccggag

SEQ ID NO: 439898 - RNA, 19 nt, Human
gccggagguagcagagcca

SEQ ID NO: 439899 - RNA, 32 nt, Human
gccggagguggagcugggcagcuguggagccc

SEQ ID NO: 439900 - RNA, 18 nt, Human
gccggaguagcagagcca

SEQ ID NO: 439901 - RNA, 32 nt, Human
gccggagugcuuccagccaaaacaacaagggc

SEQ ID NO: 439902 - RNA, 32 nt, Human
gccggaguggggcucccagaggagcucucggc

SEQ ID NO: 439903 - RNA, 23 nt, Human
gccggaguugcgagccgcugccu

SEQ ID NO: 439904 - RNA, 32 nt, Human
gccggauacaaacugguauucuguucuggagg

SEQ ID NO: 439905 - RNA, 32 nt, Human
gccggaugagugugggugugauacagccuaca

SEQ ID NO: 439906 - RNA, 32 nt, Human
gccggauggggcagugccgugugcugugacgg

SEQ ID NO: 439907 - RNA, 32 nt, Human
gccggauuugcugauccgucugcuccagcaua

SEQ ID NO: 439908 - RNA, 32 nt, Human
gccggcaaccaccuaguggcccagggaaggcc

SEQ ID NO: 439909 - RNA, 20 nt, Human
gccggcaacucgagauuggg

SEQ ID NO: 439910 - RNA, 21 nt, Human
gccggcaacuucuaccgagag

SEQ ID NO: 439911 - RNA, 20 nt, Human
gccggcaacuuugcugaugg

SEQ ID NO: 439912 - RNA, 32 nt, Human
gccggcacaagagggucgaggagccaggaacc

SEQ ID NO: 439913 - RNA, 32 nt, Human
gccggcaccaccuggacccagcuccaggcggg

SEQ ID NO: 439914 - RNA, 32 nt, Human
gccggcacccaggaugggcgagguggaggccc

SEQ ID NO: 439915 - RNA, 32 nt, Human
gccggcaccccuggcgccugacaugagcccuu

SEQ ID NO: 439916 - RNA, 32 nt, Human
gccggcaccuggugagauuccgucucuagagc

SEQ ID NO: 439917 - RNA, 32 nt, Human
gccggcacuccccggaugcaccaggaaccacc

SEQ ID NO: 439918 - RNA, 17 nt, Human
gccggcagaacugcagc

SEQ ID NO: 439919 - RNA, 17 nt, Human
gccggcagagcaggggg

SEQ ID NO: 439920 - RNA, 18 nt, Human
gccggcagagccgccgag

SEQ ID NO: 439921 - RNA, 21 nt, Human
gccggcagcagcgccucaugg

SEQ ID NO: 439922 - RNA, 21 nt, Human
gccggcagcccccgcccuagg

SEQ ID NO: 439923 - RNA, 32 nt, Human
gccggcagcccccugagggcagcguggagaca

SEQ ID NO: 439924 - RNA, 19 nt, Human
gccggcagcccuuggggac

SEQ ID NO: 439925 - RNA, 32 nt, Human
gccggcagccuggcugaccgugagggccagag

SEQ ID NO: 439926 - RNA, 22 nt, Human
gccggcagcgggccgccucagg

SEQ ID NO: 439927 - RNA, 32 nt, Human
gccggcaggagguggccccugcccucccucug

SEQ ID NO: 439928 - RNA, 32 nt, Human
gccggcaggccucgacccccacccuagggaau

SEQ ID NO: 439929 - RNA, 19 nt, Human
gccggcagggaccgcgagg

SEQ ID NO: 439930 - RNA, 32 nt, Human
gccggcagggagccuggagagccuccuugaug

SEQ ID NO: 439931 - RNA, 32 nt, Human
gccggcaggggcccagcccugccuuccacugu

SEQ ID NO: 439932 - RNA, 20 nt, Human
gccggcaguaagcccagagg

SEQ ID NO: 439933 - RNA, 32 nt, Human
gccggcaguuuccgugggucugugaagagguc

SEQ ID NO: 439934 - RNA, 32 nt, Human
gccggcaucccugcuugcagcugugaaggggg

SEQ ID NO: 439935 - RNA, 25 nt, Human
gccggcauccucgggggccugggga

SEQ ID NO: 439936 - RNA, 32 nt, Human
gccggcauccugagccuccucaugcccuggac

SEQ ID NO: 439937 - RNA, 32 nt, Human
gccggcaucuuucuuucaagagacaccucugg

SEQ ID NO: 439938 - RNA, 22 nt, Human
gccggcauuuggccugcugcug

SEQ ID NO: 439939 - RNA, 32 nt, Human
gccggccacgcgguggacagagcgagggugcc

SEQ ID NO: 439940 - RNA, 19 nt, Human
gccggccacugcucugcuc

SEQ ID NO: 439941 - RNA, 32 nt, Human
gccggccagcagagaagcagagagccagcgcc

SEQ ID NO: 439942 - RNA, 32 nt, Human
gccggccagccuguggaguccucccugagaag

SEQ ID NO: 439943 - RNA, 32 nt, Human
gccggccagcucccaaauggcccauuccaggg

SEQ ID NO: 439944 - RNA, 32 nt, Human
gccggccaggacagcacccacacacggcugcu

SEQ ID NO: 439945 - RNA, 19 nt, Human
gccggccaggcaggggguu

SEQ ID NO: 439946 - RNA, 21 nt, Human
gccggccagggcagcggcagg

SEQ ID NO: 439947 - RNA, 32 nt, Human
gccggccaucaccgcauuuccgcguggacgcc

SEQ ID NO: 439948 - RNA, 32 nt, Human
gccggccaucacugugcacccacacaccacca

SEQ ID NO: 439949 - RNA, 32 nt, Human
gccggccaugcucuccuccucugccagucucc

SEQ ID NO: 439950 - RNA, 32 nt, Human
gccggcccagauaggucugccucugccuucca

SEQ ID NO: 439951 - RNA, 32 nt, Human
gccggcccagccgccgccgcguccggacccuc

SEQ ID NO: 439952 - RNA, 19 nt, Human
gccggcccagccuguccag

SEQ ID NO: 439953 - RNA, 21 nt, Human
gccggccccaccccugcucgc

SEQ ID NO: 439954 - RNA, 30 nt, Human
gccggcccccaccucucccugggggucuca

SEQ ID NO: 439955 - RNA, 18 nt, Human
gccggcccccgccccagg

SEQ ID NO: 439956 - RNA, 32 nt, Human
gccggccccggagucucccacagggaggccau

SEQ ID NO: 439957 - RNA, 32 nt, Human
gccggccccgucuccccauccgucuaguccgc

SEQ ID NO: 439958 - RNA, 22 nt, Human
gccggcccgcucgcuagcucgc

SEQ ID NO: 439959 - RNA, 18 nt, Human
gccggcccggccgcccag

SEQ ID NO: 439960 - RNA, 32 nt, Human
gccggcccucccccugcucugcuucugcgccu

SEQ ID NO: 439961 - RNA, 32 nt, Human
gccggcccucuucccgccucacugaccauccc

SEQ ID NO: 439962 - RNA, 32 nt, Human
gccggcccugcagcugccuucugccccagguu

SEQ ID NO: 439963 - RNA, 32 nt, Human
gccggcccugcucugggcccgugaccugcgug

SEQ ID NO: 439964 - RNA, 21 nt, Human
gccggcccuugauuggggccu

SEQ ID NO: 439965 - RNA, 32 nt, Human
gccggccgccuccccucgcccuccuacucucc

SEQ ID NO: 439966 - RNA, 32 nt, Human
gccggccgcgaagaugccaguggcggugaugg

SEQ ID NO: 439967 - RNA, 21 nt, Human
gccggccgcgcgucccggcca

SEQ ID NO: 439968 - RNA, 32 nt, Human
gccggccgcguccuccgggcauggaaggaggc

SEQ ID NO: 439969 - RNA, 29 nt, Human
gccggccggccgcucucaucccccguaag

SEQ ID NO: 439970 - RNA, 32 nt, Human
gccggccggcgccgcggaaagcagccucgggg

SEQ ID NO: 439971 - RNA, 32 nt, Human
gccggccggcgcucacuugucuucaggaagcu

SEQ ID NO: 439972 - RNA, 32 nt, Human
gccggccgggcugugcggggcgagcggcggcg

SEQ ID NO: 439973 - RNA, 32 nt, Human
gccggccucacacucauucagcagacuggaaa

SEQ ID NO: 439974 - RNA, 32 nt, Human
gccggccucacacucauucagcggacuggaaa

SEQ ID NO: 439975 - RNA, 32 nt, Human
gccggccucaucugcugcacacgcccagggcu

SEQ ID NO: 439976 - RNA, 32 nt, Human
gccggccuccagcccacccacagcuguugcug

SEQ ID NO: 439977 - RNA, 32 nt, Human
gccggccuccagggcgcgcaggcuguuguugu

SEQ ID NO: 439978 - RNA, 20 nt, Human
gccggccucccccgcgccgc

SEQ ID NO: 439979 - RNA, 21 nt, Human
gccggccucccgccagccagc

SEQ ID NO: 439980 - RNA, 32 nt, Human
gccggccucccggcagccuccaccagcccggc

SEQ ID NO: 439981 - RNA, 19 nt, Human
gccggccucccgggccagc

SEQ ID NO: 439982 - RNA, 21 nt, Human
gccggccuccucggccuccca

SEQ ID NO: 439983 - RNA, 20 nt, Human
gccggccucuggccuggcuc

SEQ ID NO: 439984 - RNA, 32 nt, Human
gccggccugccugccugccugccugccugccu

SEQ ID NO: 439985 - RNA, 32 nt, Human
gccggccuggagggggagagggggaggaagaa

SEQ ID NO: 439986 - RNA, 19 nt, Human
gccggccugggcagggggu

SEQ ID NO: 439987 - RNA, 32 nt, Human
gccggccuucuacagaacacagcugguuuccu

SEQ ID NO: 439988 - RNA, 32 nt, Human
gccggcgagcgcgucgccaccaugaagcagcu

SEQ ID NO: 439989 - RNA, 21 nt, Human
gccggcgagucucgccucgag

SEQ ID NO: 439990 - RNA, 32 nt, Human
gccggcgcauucuaccagucucagggaaggac

SEQ ID NO: 439991 - RNA, 32 nt, Human
gccggcgccccuggcucuccagucccacuggg

SEQ ID NO: 439992 - RNA, 22 nt, Human
gccggcgcccgccgccuugagg

SEQ ID NO: 439993 - RNA, 32 nt, Human
gccggcgcccgggagacccaggaggagcccgc

SEQ ID NO: 439994 - RNA, 32 nt, Human
gccggcgccugagugccucugccugaacacug

SEQ ID NO: 439995 - RNA, 32 nt, Human
gccggcgccugcggucccuccuggccccacgg

SEQ ID NO: 439996 - RNA, 32 nt, Human
gccggcgccugcgguuccuccuggccccaagg

SEQ ID NO: 439997 - RNA, 32 nt, Human
gccggcgccuguaaucccagcuacucgggaga

SEQ ID NO: 439998 - RNA, 32 nt, Human
gccggcgccuucaccauggccucggcagagcu

SEQ ID NO: 439999 - RNA, 32 nt, Human
gccggcgccuuguucagggcugguggggcugg

SEQ ID NO: 440000 - RNA, 32 nt, Human
gccggcgcguggacuuccgccuggugaacgag

SEQ ID NO: 440001 - RNA, 32 nt, Human
gccggcgcucggcaaguucucccaggagaaag

SEQ ID NO: 440002 - RNA, 32 nt, Human
gccggcgcucggcaaguucucccaggagaagg

SEQ ID NO: 440003 - RNA, 32 nt, Human
gccggcgcuugagauccaggcaagugaaucca

SEQ ID NO: 440004 - RNA, 19 nt, Human
gccggcggccggccggcug

SEQ ID NO: 440005 - RNA, 32 nt, Human
gccggcgggaacugcuucuccugggccgccca

SEQ ID NO: 440006 - RNA, 32 nt, Human
gccggcggggaggcgggggagguguuuuccag

SEQ ID NO: 440007 - RNA, 32 nt, Human
gccggcggguggccgcucaccaugcccggcaa

SEQ ID NO: 440008 - RNA, 32 nt, Human
gccggcgguggauggggccaggaagcaugcag

SEQ ID NO: 440009 - RNA, 19 nt, Human
gccggcgguggcgcugguu

SEQ ID NO: 440010 - RNA, 32 nt, Human
gccggcguuggaggcccuggggccaagagcgu

SEQ ID NO: 440011 - RNA, 32 nt, Human
gccggcuacucuccucuccacgugcuccccuc

SEQ ID NO: 440012 - RNA, 32 nt, Human
gccggcuagcagccccgggcccugagcucccg

SEQ ID NO: 440013 - RNA, 32 nt, Human
gccggcuagccccgccagccugggcagugagg

SEQ ID NO: 440014 - RNA, 32 nt, Human
gccggcucaagcagccgagacagagcagagug

SEQ ID NO: 440015 - RNA, 20 nt, Human
gccggcucacggaggggcca

SEQ ID NO: 440016 - RNA, 32 nt, Human
gccggcucacugcaaccucugucuucuggguu

SEQ ID NO: 440017 - RNA, 32 nt, Human
gccggcuccaucucagcuucugguuucuaagu

SEQ ID NO: 440018 - RNA, 32 nt, Human
gccggcucccaaaaaccccauguguguacgau

SEQ ID NO: 440019 - RNA, 19 nt, Human
gccggcucccaccccggcc

SEQ ID NO: 440020 - RNA, 32 nt, Human
gccggcucccccacgaggugugaaugacagag

SEQ ID NO: 440021 - RNA, 20 nt, Human
gccggcuccccgaggaccca

SEQ ID NO: 440022 - RNA, 32 nt, Human
gccggcuccucagcuccagccuccaggaaccc

SEQ ID NO: 440023 - RNA, 32 nt, Human
gccggcuccuugcuggcggccaugaagaggca

SEQ ID NO: 440024 - RNA, 32 nt, Human
gccggcucuaccuaucgccaucauggcagccu

SEQ ID NO: 440025 - RNA, 32 nt, Human
gccggcucuccucgcccucuagcagcuuccug

SEQ ID NO: 440026 - RNA, 32 nt, Human
gccggcucugucacggcuucaugagagcgggg

SEQ ID NO: 440027 - RNA, 32 nt, Human
gccggcugcacccagagggagcagugaggcag

SEQ ID NO: 440028 - RNA, 32 nt, Human
gccggcugcauggggugcuguguguuuuucag

SEQ ID NO: 440029 - RNA, 19 nt, Human
gccggcugccacucaggug

SEQ ID NO: 440030 - RNA, 32 nt, Human
gccggcugccagcacuagguccugggcagcuu

SEQ ID NO: 440031 - RNA, 20 nt, Human
gccggcugcccucugcugcc

SEQ ID NO: 440032 - RNA, 32 nt, Human
gccggcugccucucccccuccgagcccguccg

SEQ ID NO: 440033 - RNA, 32 nt, Human
gccggcugcggaccccaucggcagggagagga

SEQ ID NO: 440034 - RNA, 29 nt, Human
gccggcuggcugcuacccgcccgcgccag

SEQ ID NO: 440035 - RNA, 18 nt, Human
gccggcugggcgcagugg

SEQ ID NO: 440036 - RNA, 32 nt, Human
gccggcugggcgguggggguuggugacgcggg

SEQ ID NO: 440037 - RNA, 16 nt, Human
gccggcugggcuccca

SEQ ID NO: 440038 - RNA, 23 nt, Human
gccggcugguuccucucccuuuu

SEQ ID NO: 440039 - RNA, 32 nt, Human
gccggcugugggaccuuccuggcugacuggca

SEQ ID NO: 440040 - RNA, 32 nt, Human
gccggcuguggugacccugccuggugcuggag

SEQ ID NO: 440041 - RNA, 32 nt, Human
gccggcuguguguguucaucagauacaguucu

SEQ ID NO: 440042 - RNA, 32 nt, Human
gccggcuugcugccuguccugccuguccggau

SEQ ID NO: 440043 - RNA, 32 nt, Human
gccgggaaaggcugccccaggccccgcgccua

SEQ ID NO: 440044 - RNA, 32 nt, Human
gccgggaacagagaaguguggggaagagauag

SEQ ID NO: 440045 - RNA, 32 nt, Human
gccgggaacucacgccuccaaucccagacgcu

SEQ ID NO: 440046 - RNA, 32 nt, Human
gccgggaagagagguugagucacccauccccg

SEQ ID NO: 440047 - RNA, 32 nt, Human
gccgggaagagggagacgggcagggcggcgcc

SEQ ID NO: 440048 - RNA, 32 nt, Human
gccgggaagggguuugcagcugcuccgucauc

SEQ ID NO: 440049 - RNA, 32 nt, Human
gccgggaaguuccugggcuuugcuccaaagcu

SEQ ID NO: 440050 - RNA, 32 nt, Human
gccgggacaucaagauauuuuccuucaaauua

SEQ ID NO: 440051 - RNA, 25 nt, Human
gccgggaccacccugguggggccac

SEQ ID NO: 440052 - RNA, 32 nt, Human
gccgggaccagccaggagcugggagccacagg

SEQ ID NO: 440053 - RNA, 17 nt, Human
gccgggaccccaccucu

SEQ ID NO: 440054 - RNA, 32 nt, Human
gccgggacgcgugcaccaugcccuaccugcuc

SEQ ID NO: 440055 - RNA, 32 nt, Human
gccgggacucuugcccacccucagccauggcu

SEQ ID NO: 440056 - RNA, 23 nt, Human
gccgggacugcgugcgggccccg

SEQ ID NO: 440057 - RNA, 32 nt, Human
gccgggacugcucucccugaagaccccuccag

SEQ ID NO: 440058 - RNA, 24 nt, Human
gccgggacuggcgcgcggggacac

SEQ ID NO: 440059 - RNA, 22 nt, Human
gccgggagcccgccccgcuucc

SEQ ID NO: 440060 - RNA, 32 nt, Human
gccgggagcccguucagggccgcgggagugcg

SEQ ID NO: 440061 - RNA, 32 nt, Human
gccgggagccgggaaggagggagcagggcucg

SEQ ID NO: 440062 - RNA, 20 nt, Human
gccgggagcgcggggcucag

SEQ ID NO: 440063 - RNA, 32 nt, Human
gccgggagcggggaacagggagucggggagcc

SEQ ID NO: 440064 - RNA, 32 nt, Human
gccgggagcgggggugacagccugggauuccg

SEQ ID NO: 440065 - RNA, 32 nt, Human
gccgggagcucaccaccucuuauggcagccca

SEQ ID NO: 440066 - RNA, 32 nt, Human
gccgggagcuggguuucucuucccuuuuuauc

SEQ ID NO: 440067 - RNA, 31 nt, Human
gccgggaggaggaggaggagguugcagugag

SEQ ID NO: 440068 - RNA, 25 nt, Human
gccgggaggcagagguugcagugug

SEQ ID NO: 440069 - RNA, 23 nt, Human
gccgggaggccgaggacucggag

SEQ ID NO: 440070 - RNA, 32 nt, Human
gccgggaggcggaaguuguggugagccgagau

SEQ ID NO: 440071 - RNA, 21 nt, Human
gccgggaggcggccgcugccu

SEQ ID NO: 440072 - RNA, 32 nt, Human
gccgggagguggggguugcagugagccgagau

SEQ ID NO: 440073 - RNA, 32 nt, Human
gccgggaguccuuccuguaccgcucagacagc

SEQ ID NO: 440074 - RNA, 21 nt, Human
gccgggcagaccccccucccc

SEQ ID NO: 440075 - RNA, 32 nt, Human
gccgggcagcccccgaaggccgcaucgcaccc

SEQ ID NO: 440076 - RNA, 32 nt, Human
gccgggcagcugagcugguaggaggaccagac

SEQ ID NO: 440077 - RNA, 32 nt, Human
gccgggcaggagcgcccucucccggagcgaga

SEQ ID NO: 440078 - RNA, 32 nt, Human
gccgggcagggcccugcagaagcacaacuccg

SEQ ID NO: 440079 - RNA, 22 nt, Human
gccgggcaggguguggggccau

SEQ ID NO: 440080 - RNA, 32 nt, Human
gccgggccaagagaggauggagggaugggagu

SEQ ID NO: 440081 - RNA, 32 nt, Human
gccgggccaaggacaggcagggagggaggcca

SEQ ID NO: 440082 - RNA, 21 nt, Human
gccgggccacaccucagugcc

SEQ ID NO: 440083 - RNA, 32 nt, Human
gccgggccaccccgcaaccucgcgccucccgu

SEQ ID NO: 440084 - RNA, 23 nt, Human
gccgggccacguugguggggccu

SEQ ID NO: 440085 - RNA, 22 nt, Human
gccgggccagcagccggaugcc

SEQ ID NO: 440086 - RNA, 22 nt, Human
gccgggccaucaccuggccccu

SEQ ID NO: 440087 - RNA, 20 nt, Human
gccgggccaucgggcugggc

SEQ ID NO: 440088 - RNA, 32 nt, Human
gccgggcccacacccuccagucgugcccugca

SEQ ID NO: 440089 - RNA, 18 nt, Human
gccgggcccaucccgccg

SEQ ID NO: 440090 - RNA, 19 nt, Human
gccgggccccagggcucag

SEQ ID NO: 440091 - RNA, 22 nt, Human
gccgggccccugccuugugccu

SEQ ID NO: 440092 - RNA, 32 nt, Human
gccgggccccuggcuggugcuuugggagagag

SEQ ID NO: 440093 - RNA, 25 nt, Human
gccgggcccgaacagacugggccuc

SEQ ID NO: 440094 - RNA, 23 nt, Human
gccgggcccggcuccccgggccu

SEQ ID NO: 440095 - RNA, 32 nt, Human
gccgggcccgggaggagguguagcgcggcgag

SEQ ID NO: 440096 - RNA, 21 nt, Human
gccgggcccugcccuagugcc

SEQ ID NO: 440097 - RNA, 23 nt, Human
gccgggccgaggauucgggugcc

SEQ ID NO: 440098 - RNA, 20 nt, Human
gccgggccgcacuuguggcc

SEQ ID NO: 440099 - RNA, 22 nt, Human
gccgggccgcagagcaugugcu

SEQ ID NO: 440100 - RNA, 22 nt, Human
gccgggccgcgccgccgcugcc

SEQ ID NO: 440101 - RNA, 23 nt, Human
gccgggccgcggacacugucgcc

SEQ ID NO: 440102 - RNA, 20 nt, Human
gccgggccgcggcgggcgcc

SEQ ID NO: 440103 - RNA, 23 nt, Human
gccgggccggggccgcgcugccu

SEQ ID NO: 440104 - RNA, 32 nt, Human
gccgggccggggcugcagccgcagcggccaug

SEQ ID NO: 440105 - RNA, 32 nt, Human
gccgggccgguggcaucuuccuuacuuugucc

SEQ ID NO: 440106 - RNA, 22 nt, Human
gccgggccgguugcuggcaucu

SEQ ID NO: 440107 - RNA, 21 nt, Human
gccgggccuagaccuggugcu

SEQ ID NO: 440108 - RNA, 17 nt, Human
gccgggccugcauccca

SEQ ID NO: 440109 - RNA, 32 nt, Human
gccgggccugccauuugaggcagcgagccucc

SEQ ID NO: 440110 - RNA, 32 nt, Human
gccgggcgcacacacucgcacccgcgcacgca

SEQ ID NO: 440111 - RNA, 21 nt, Human
gccgggcgcggcuggggcccg

SEQ ID NO: 440112 - RNA, 32 nt, Human
gccgggcgcguggcucacgccuguaaucccag

SEQ ID NO: 440113 - RNA, 32 nt, Human
gccgggcgcuccgcgaagaugcagcucaagcc

SEQ ID NO: 440114 - RNA, 32 nt, Human
gccgggcgcugaggacaagggccgcugguagg

SEQ ID NO: 440115 - RNA, 32 nt, Human
gccgggcgcugugccugucacgccggggucug

SEQ ID NO: 440116 - RNA, 32 nt, Human
gccgggcggcaaccuuugcagucgcguuggcu

SEQ ID NO: 440117 - RNA, 32 nt, Human
gccgggcggcagagaaggagggagcggguacg

SEQ ID NO: 440118 - RNA, 32 nt, Human
gccgggcggccauggacuuguacagcaccccg

SEQ ID NO: 440119 - RNA, 22 nt, Human
gccgggcggcgcagccgcuccu

SEQ ID NO: 440120 - RNA, 32 nt, Human
gccgggcguccccacacugaagguccggaaag

SEQ ID NO: 440121 - RNA, 23 nt, Human
gccgggcgucucccgccuccagg

SEQ ID NO: 440122 - RNA, 30 nt, Human
gccgggcguggcugcgugcuccuguagucc

SEQ ID NO: 440123 - RNA, 32 nt, Human
gccgggcguguggcucaugccugugaucccag

SEQ ID NO: 440124 - RNA, 22 nt, Human
gccgggcuaccgucuugugccu

SEQ ID NO: 440125 - RNA, 20 nt, Human
gccgggcucaggccacugcc

SEQ ID NO: 440126 - RNA, 32 nt, Human
gccgggcuccaaggacguguccuuagcggcuc

SEQ ID NO: 440127 - RNA, 32 nt, Human
gccgggcuccgaggcgagaggcugcauggagu

SEQ ID NO: 440128 - RNA, 21 nt, Human
gccgggcuccgcggcgccaga

SEQ ID NO: 440129 - RNA, 32 nt, Human
gccgggcucgggaaguggguuggauggcggca

SEQ ID NO: 440130 - RNA, 32 nt, Human
gccgggcucuacgucccagggagggaggggcg

SEQ ID NO: 440131 - RNA, 32 nt, Human
gccgggcucucggggcaccacagccaugugcu

SEQ ID NO: 440132 - RNA, 32 nt, Human
gccgggcucugaggaccccuggggcccccauc

SEQ ID NO: 440133 - RNA, 21 nt, Human
gccgggcugcccuucgcugcc

SEQ ID NO: 440134 - RNA, 18 nt, Human
gccgggcugcggcuccau

SEQ ID NO: 440135 - RNA, 32 nt, Human
gccgggcugcugauccgccaggcacgguguaa

SEQ ID NO: 440136 - RNA, 32 nt, Human
gccgggcugcugcugcugcugcuccaggugcu

SEQ ID NO: 440137 - RNA, 32 nt, Human
gccgggcuggaagggcggcggcggcuggggga

SEQ ID NO: 440138 - RNA, 32 nt, Human
gccgggcugggcucagccaagcucccacucac

SEQ ID NO: 440139 - RNA, 32 nt, Human
gccgggcuggggguggggaagggaggccgcca

SEQ ID NO: 440140 - RNA, 32 nt, Human
gccgggcuguaaccgucgucuguccgggagcg

SEQ ID NO: 440141 - RNA, 32 nt, Human
gccggggaacaagccacaggagagcgacucag

SEQ ID NO: 440142 - RNA, 22 nt, Human
gccggggaccccgggggccgcg

SEQ ID NO: 440143 - RNA, 32 nt, Human
gccggggagcagaugcgucagauggaggagaa

SEQ ID NO: 440144 - RNA, 32 nt, Human
gccggggaggaagaguagcucgccgaggcgcc

SEQ ID NO: 440145 - RNA, 32 nt, Human
gccggggaggaggaggaggaggaagaggagga

SEQ ID NO: 440146 - RNA, 32 nt, Human
gccggggaggaggggguugcagugagccgaga

SEQ ID NO: 440147 - RNA, 32 nt, Human
gccggggaggcagagguugcagugagccgaga

SEQ ID NO: 440148 - RNA, 32 nt, Human
gccggggaggcucaaguucgccacuuuacuca

SEQ ID NO: 440149 - RNA, 32 nt, Human
gccggggaggcugggagccggcggcaggauua

SEQ ID NO: 440150 - RNA, 32 nt, Human
gccggggagguggaggcugcagugaacugaga

SEQ ID NO: 440151 - RNA, 32 nt, Human
gccggggaggugggcgugugugugcgugccag

SEQ ID NO: 440152 - RNA, 32 nt, Human
gccggggaguuucuuuccugccuucuucuuuu

SEQ ID NO: 440153 - RNA, 32 nt, Human
gccggggauaagagagcaagaaaaugaagcuc

SEQ ID NO: 440154 - RNA, 32 nt, Human
gccggggaucuccaggucccaggcugggcggc

SEQ ID NO: 440155 - RNA, 23 nt, Human
gccggggcaggagaaucgcuuga

SEQ ID NO: 440156 - RNA, 32 nt, Human
gccggggcagggcagaggugaacuugaaguuc

SEQ ID NO: 440157 - RNA, 32 nt, Human
gccggggccauggcgaagcugcugagcugcgu

SEQ ID NO: 440158 - RNA, 22 nt, Human
gccggggcccacuccgauccgc

SEQ ID NO: 440159 - RNA, 32 nt, Human
gccggggcccaggaaggggagggggcgaacgc

SEQ ID NO: 440160 - RNA, 21 nt, Human
gccggggccgcagucuggcca

SEQ ID NO: 440161 - RNA, 20 nt, Human
gccggggccggcggcugcgg

SEQ ID NO: 440162 - RNA, 23 nt, Human
gccggggccggggccgggcgccg

SEQ ID NO: 440163 - RNA, 20 nt, Human
gccggggcgcgccucccccg

SEQ ID NO: 440164 - RNA, 32 nt, Human
gccggggcgcggggcuaugauggugcacugcg

SEQ ID NO: 440165 - RNA, 22 nt, Human
gccggggcuacccgcccugggg

SEQ ID NO: 440166 - RNA, 32 nt, Human
gccggggcuagaggcagauggaagggaggcau

SEQ ID NO: 440167 - RNA, 32 nt, Human
gccggggcucccgagcggcagaaaguuccggc

SEQ ID NO: 440168 - RNA, 32 nt, Human
gccgggggacgcugggcugagcggccggcggc

SEQ ID NO: 440169 - RNA, 32 nt, Human
gccgggggcagggcugccuccagccugcacgc

SEQ ID NO: 440170 - RNA, 32 nt, Human
gccgggggccgcgggagccagcagguggcggg

SEQ ID NO: 440171 - RNA, 32 nt, Human
gccgggggcucaagaccuaccuguugacaguu

SEQ ID NO: 440172 - RNA, 24 nt, Human
gccgggggcuccuugcucggccgg

SEQ ID NO: 440173 - RNA, 32 nt, Human
gccgggggcugcaggucccagggcgggggcug

SEQ ID NO: 440174 - RNA, 32 nt, Human
gccgggggcuggagagugaccguggucugagu

SEQ ID NO: 440175 - RNA, 23 nt, Human
gccgggggcugucagccgcaccu

SEQ ID NO: 440176 - RNA, 32 nt, Human
gccggggguagggggcaggaaaaguggguugu

SEQ ID NO: 440177 - RNA, 32 nt, Human
gccgggguaggcagggggaggagaacgcucac

SEQ ID NO: 440178 - RNA, 19 nt, Human
gccggggucuagcaggggg

SEQ ID NO: 440179 - RNA, 32 nt, Human
gccggggugaaucaucaguccuggggaagaac

SEQ ID NO: 440180 - RNA, 32 nt, Human
gccggggugagguggggaggaggacauggauc

SEQ ID NO: 440181 - RNA, 32 nt, Human
gccggggugauggcgguggagacucugucccc

SEQ ID NO: 440182 - RNA, 18 nt, Human
gccggggugcggagggag

SEQ ID NO: 440183 - RNA, 23 nt, Human
gccgggguugagcuggcaccccg

SEQ ID NO: 440184 - RNA, 32 nt, Human
gccgggguuggaccagucucccgggcauggca

SEQ ID NO: 440185 - RNA, 19 nt, Human
gccggguaccuggacucag

SEQ ID NO: 440186 - RNA, 32 nt, Human
gccggguagagggagacagagucgcacggcug

SEQ ID NO: 440187 - RNA, 32 nt, Human
gccggguaucggguugaaggguccagguagug

SEQ ID NO: 440188 - RNA, 32 nt, Human
gccgggucacaacucacugcagccuggaccuc

SEQ ID NO: 440189 - RNA, 21 nt, Human
gccgggucagggagcgugaga

SEQ ID NO: 440190 - RNA, 21 nt, Human
gccggguccaauuaggggacu

SEQ ID NO: 440191 - RNA, 22 nt, Human
gccggguccccgggacggggug

SEQ ID NO: 440192 - RNA, 18 nt, Human
gccggguccccucgggug

SEQ ID NO: 440193 - RNA, 32 nt, Human
gccgggucccgagccuacagagccgggagcag

SEQ ID NO: 440194 - RNA, 32 nt, Human
gccggguccucccagcccuugccacacagccu

SEQ ID NO: 440195 - RNA, 32 nt, Human
gccgggucuccucuuuucgaaagaaucucauu

SEQ ID NO: 440196 - RNA, 32 nt, Human
gccgggucuggaggggacagcagagacagccc

SEQ ID NO: 440197 - RNA, 32 nt, Human
gccggguggaauagcacuggcuucagcaggcg

SEQ ID NO: 440198 - RNA, 32 nt, Human
gccgggugggaccugggcuguuugcucuugga

SEQ ID NO: 440199 - RNA, 32 nt, Human
gccggguggugacaaggagaaaagccuucuag

SEQ ID NO: 440200 - RNA, 32 nt, Human
gccgggugucagcgaaccccuuucccaaaccu

SEQ ID NO: 440201 - RNA, 23 nt, Human
gccggguuaggaagccacugccu

SEQ ID NO: 440202 - RNA, 32 nt, Human
gccggguucuagucuccuuugcacugagggcc

SEQ ID NO: 440203 - RNA, 32 nt, Human
gccgguacccuuugggaccgcagcuguggcca

SEQ ID NO: 440204 - RNA, 32 nt, Human
gccgguagaauaaggaaggaagggaggcaggg

SEQ ID NO: 440205 - RNA, 24 nt, Human
gccgguagccccagcuacucggga

SEQ ID NO: 440206 - RNA, 32 nt, Human
gccgguagugaagcugaaggaggcagaggacg

SEQ ID NO: 440207 - RNA, 32 nt, Human
gccggucaccagaagccagcaggcguggggug

SEQ ID NO: 440208 - RNA, 25 nt, Human
gccgguccaagcacauggccuccca

SEQ ID NO: 440209 - RNA, 32 nt, Human
gccggucccacuguguucccagcuuccagagu

SEQ ID NO: 440210 - RNA, 32 nt, Human
gccgguccccugggcccacugucguuucucua

SEQ ID NO: 440211 - RNA, 32 nt, Human
gccgguccccugggcccacuguuguuucucua

SEQ ID NO: 440212 - RNA, 24 nt, Human
gccggucggggccaggccaggcca

SEQ ID NO: 440213 - RNA, 24 nt, Human
gccggucucaaacuccugagcuca

SEQ ID NO: 440214 - RNA, 18 nt, Human
gccggucucaggcugcug

SEQ ID NO: 440215 - RNA, 32 nt, Human
gccggucucccagaaggcggagucgaucuccc

SEQ ID NO: 440216 - RNA, 24 nt, Human
gccggucuugaacuccuggacuca

SEQ ID NO: 440217 - RNA, 24 nt, Human
gccggucuugaacuccugggcuca

SEQ ID NO: 440218 - RNA, 32 nt, Human
gccggugcauguuggaaaugggccacagggcu

SEQ ID NO: 440219 - RNA, 32 nt, Human
gccggugccuggggugccuuucccccagccag

SEQ ID NO: 440220 - RNA, 32 nt, Human
gccggugcgguggcucaugccuguaaucccag

SEQ ID NO: 440221 - RNA, 32 nt, Human
gccggugcuaaggggauggggaagaagggaca

SEQ ID NO: 440222 - RNA, 32 nt, Human
gccggugcucaccaagaucaguucaggaucaa

SEQ ID NO: 440223 - RNA, 32 nt, Human
gccggugcugggagagcauuuauuugggagaa

SEQ ID NO: 440224 - RNA, 24 nt, Human
gccggugcuuguugaacuggcagg

SEQ ID NO: 440225 - RNA, 32 nt, Human
gccgguggacagugggcagguggauuugggga

SEQ ID NO: 440226 - RNA, 32 nt, Human
gccgguggcucaccccuguaaucucagcauuu

SEQ ID NO: 440227 - RNA, 32 nt, Human
gccgguggcucaugccuguaaucucagaacuu

SEQ ID NO: 440228 - RNA, 32 nt, Human
gccgguggcugugcgugggggcugagggcuag

SEQ ID NO: 440229 - RNA, 19 nt, Human
gccgguggugcagagccag

SEQ ID NO: 440230 - RNA, 18 nt, Human
gccgguguuuuuccuuga

SEQ ID NO: 440231 - RNA, 32 nt, Human
gccgguucugcuagagcagacaggccuggccc

SEQ ID NO: 440232 - RNA, 32 nt, Human
gccgguucuugaccugguggauguggcugcag

SEQ ID NO: 440233 - RNA, 19 nt, Human
gccgguugagcagggcguu

SEQ ID NO: 440234 - RNA, 21 nt, Human
gccguaacgcacuuucuccca

SEQ ID NO: 440235 - RNA, 18 nt, Human
gccguaagugccacccag

SEQ ID NO: 440236 - RNA, 23 nt, Human
gccguaaucccagcuacucggga

SEQ ID NO: 440237 - RNA, 32 nt, Human
gccguaaucccagcuacucgggaggcuaaggu

SEQ ID NO: 440238 - RNA, 25 nt, Human
gccguacagcuguuugguuugcaua

SEQ ID NO: 440239 - RNA, 32 nt, Human
gccguaccaagugucaccgcagcaagaggggg

SEQ ID NO: 440240 - RNA, 32 nt, Human
gccguacccagccagagaagaaaaagaacagu

SEQ ID NO: 440241 - RNA, 32 nt, Human
gccguacccucacccuuuucagcaaagaauag

SEQ ID NO: 440242 - RNA, 32 nt, Human
gccguaccugcaaguauccagaccuugaaagu

SEQ ID NO: 440243 - RNA, 32 nt, Human
gccguacuaaguugguuucuguuagucuuaac

SEQ ID NO: 440244 - RNA, 32 nt, Human
gccguacucgcacuccagagcccugggaugug

SEQ ID NO: 440245 - RNA, 32 nt, Human
gccguacucugcugguugcgcagccaccucgg

SEQ ID NO: 440246 - RNA, 23 nt, Human
gccguacuuugcuaacugugcuc

SEQ ID NO: 440247 - RNA, 32 nt, Human
gccguagaaaaauauuguguuacuuguuuguu

SEQ ID NO: 440248 - RNA, 32 nt, Human
gccguagagacaaacccccacccugagcccgc

SEQ ID NO: 440249 - RNA, 32 nt, Human
gccguagcauguuacaguucaaacaugucucc

SEQ ID NO: 440250 - RNA, 32 nt, Human
gccguagccagcaggcuucagugcucaccgaa

SEQ ID NO: 440251 - RNA, 32 nt, Human
gccguagccaugaguuucugccggggcuagcc

SEQ ID NO: 440252 - RNA, 32 nt, Human
gccguagcgaaaaggcccaagagggaagucag

SEQ ID NO: 440253 - RNA, 32 nt, Human
gccguagggacccccucacacaccaccgagau

SEQ ID NO: 440254 - RNA, 32 nt, Human
gccguagggucaggggacagcucggcuucagu

SEQ ID NO: 440255 - RNA, 21 nt, Human
gccguagucccagcuacuugg

SEQ ID NO: 440256 - RNA, 22 nt, Human
gccguagucccagcuacuugga

SEQ ID NO: 440257 - RNA, 32 nt, Human
gccguaucucaguucucgcgagguuucgucuu

SEQ ID NO: 440258 - RNA, 32 nt, Human
gccguauggccgaucccucuccucacuguaag

SEQ ID NO: 440259 - RNA, 20 nt, Human
gccguauuuggcacccagaa

SEQ ID NO: 440260 - RNA, 32 nt, Human
gccgucaccaccaucacaaaagcugacgggac

SEQ ID NO: 440261 - RNA, 32 nt, Human
gccgucacccaccagcuuccucaccaggcaag

SEQ ID NO: 440262 - RNA, 32 nt, Human
gccgucagcccggaggaggaggaggaggagga

SEQ ID NO: 440263 - RNA, 32 nt, Human
gccgucagccugaugcauagcgaauuugccca

SEQ ID NO: 440264 - RNA, 24 nt, Human
gccgucaucacagcccacccccag

SEQ ID NO: 440265 - RNA, 32 nt, Human
gccguccacagcccugccucaguggcccagug

SEQ ID NO: 440266 - RNA, 24 nt, Human
gccguccacuggacuccugcgcca

SEQ ID NO: 440267 - RNA, 32 nt, Human
gccguccagccuguccuugguguggggugcuu

SEQ ID NO: 440268 - RNA, 32 nt, Human
gccgucccacccggcacccaccaguccgaugg

SEQ ID NO: 440269 - RNA, 32 nt, Human
gccgucccauuuucaacacaugucucauucua

SEQ ID NO: 440270 - RNA, 32 nt, Human
gccguccccacccugccuccucccugcugcuu

SEQ ID NO: 440271 - RNA, 19 nt, Human
gccguccgccccagccccg

SEQ ID NO: 440272 - RNA, 19 nt, Human
gccguccgccgcugugcca

SEQ ID NO: 440273 - RNA, 19 nt, Human
gccguccgcugcacugcca

SEQ ID NO: 440274 - RNA, 32 nt, Human
gccguccggcgcagcaguuucuagguccccac

SEQ ID NO: 440275 - RNA, 32 nt, Human
gccguccucacaccugugcgcagcccgacccu

SEQ ID NO: 440276 - RNA, 32 nt, Human
gccguccugcagccgccacuccugcgccugcc

SEQ ID NO: 440277 - RNA, 19 nt, Human
gccgucgccaccgccgcca

SEQ ID NO: 440278 - RNA, 21 nt, Human
gccgucgccgccaccgggcca

SEQ ID NO: 440279 - RNA, 20 nt, Human
gccgucgccgccgccgccgc

SEQ ID NO: 440280 - RNA, 32 nt, Human
gccgucgccgcugcaaccuccacuacugcuug

SEQ ID NO: 440281 - RNA, 21 nt, Human
gccgucgcgcgcccgcuuccu

SEQ ID NO: 440282 - RNA, 32 nt, Human
gccgucgcuuaccagagccagaaguuccugcu

SEQ ID NO: 440283 - RNA, 32 nt, Human
gccgucggagcagccccuccucacuucagggg

SEQ ID NO: 440284 - RNA, 19 nt, Human
gccgucgggggcaagggug

SEQ ID NO: 440285 - RNA, 32 nt, Human
gccgucgggggcaaggguggcucggggguggc

SEQ ID NO: 440286 - RNA, 32 nt, Human
gccgucguggccgccucccgcacgccaggccc

SEQ ID NO: 440287 - RNA, 32 nt, Human
gccgucuaugaccaaaggccccugccaggugu

SEQ ID NO: 440288 - RNA, 22 nt, Human
gccgucuaugcaaaugcaugca

SEQ ID NO: 440289 - RNA, 32 nt, Human
gccgucucaaaaacugcaagcuaaucagucag

SEQ ID NO: 440290 - RNA, 32 nt, Human
gccgucucaacaacaggcaucaccugaauauc

SEQ ID NO: 440291 - RNA, 32 nt, Human
gccgucuccaccucagcuccugcucccucugc

SEQ ID NO: 440292 - RNA, 21 nt, Human
gccgucugagagcaucaggga

SEQ ID NO: 440293 - RNA, 19 nt, Human
gccgucugccaccccgcca

SEQ ID NO: 440294 - RNA, 32 nt, Human
gccgucugcgcuccagccuucgccuggcagag

SEQ ID NO: 440295 - RNA, 20 nt, Human
gccgucugugccacccagag

SEQ ID NO: 440296 - RNA, 32 nt, Human
gccgucuuccccuccucccguccucccucgcc

SEQ ID NO: 440297 - RNA, 32 nt, Human
gccgucuuccgcucccccucccggccuuuacu

SEQ ID NO: 440298 - RNA, 32 nt, Human
gccgucuugccucacuuccccuccugucacau

SEQ ID NO: 440299 - RNA, 32 nt, Human
gccgucuuggggccuagcggcgaggcggaccc

SEQ ID NO: 440300 - RNA, 32 nt, Human
gccgugaaaauuacucagcagugcaguuggcu

SEQ ID NO: 440301 - RNA, 32 nt, Human
gccgugaaccacugcacccagccaaugggugu

SEQ ID NO: 440302 - RNA, 21 nt, Human
gccgugacaacaggccaccac

SEQ ID NO: 440303 - RNA, 32 nt, Human
gccgugacagguuuccacaaacuucguggauc

SEQ ID NO: 440304 - RNA, 32 nt, Human
gccgugacuuaggcagaggagugcagaggagg

SEQ ID NO: 440305 - RNA, 32 nt, Human
gccgugacuuucuccuccuggacacuggagcc

SEQ ID NO: 440306 - RNA, 32 nt, Human
gccgugagagugccauccgaaagaagcuaaac

SEQ ID NO: 440307 - RNA, 19 nt, Human
gccgugagcaccgcccagc

SEQ ID NO: 440308 - RNA, 32 nt, Human
gccgugagccaagagcuugugacuggacucca

SEQ ID NO: 440309 - RNA, 32 nt, Human
gccgugagcucucacaggcucagacuaaauca

SEQ ID NO: 440310 - RNA, 32 nt, Human
gccgugaggaggacgugggggcugcaagugga

SEQ ID NO: 440311 - RNA, 32 nt, Human
gccgugaggaugaggacaacuccacccuccuu

SEQ ID NO: 440312 - RNA, 32 nt, Human
gccgugaucucuaugcccgagucucaacccuc

SEQ ID NO: 440313 - RNA, 31 nt, Human
gccgugaugcugucccgaucccgcugugugu

SEQ ID NO: 440314 - RNA, 32 nt, Human
gccgugauguuugacaguagagcugugugaga

SEQ ID NO: 440315 - RNA, 18 nt, Human
gccgugcaccuccaccuc

SEQ ID NO: 440316 - RNA, 32 nt, Human
gccgugcagggugggaggagaagaccaaacga

SEQ ID NO: 440317 - RNA, 32 nt, Human
gccgugcaugguggugcauccuguaaucauag

SEQ ID NO: 440318 - RNA, 32 nt, Human
gccgugcccagccuggcaugcauaugcggugg

SEQ ID NO: 440319 - RNA, 32 nt, Human
gccgugcccgggaauaggaggaggcagcaugc

SEQ ID NO: 440320 - RNA, 19 nt, Human
gccgugccgccgccgccgc

SEQ ID NO: 440321 - RNA, 22 nt, Human
gccgugccggagccgcccaagg

SEQ ID NO: 440322 - RNA, 32 nt, Human
gccgugccugccugcccugccuacugagaaga

SEQ ID NO: 440323 - RNA, 21 nt, Human
gccgugccuggagcacugcag

SEQ ID NO: 440324 - RNA, 32 nt, Human
gccgugccuggggcgacauuucaggcuuuaug

SEQ ID NO: 440325 - RNA, 32 nt, Human
gccgugccugugccuggagggcuggucugcga

SEQ ID NO: 440326 - RNA, 32 nt, Human
gccgugcguucuugcgagccggccugcaggag

SEQ ID NO: 440327 - RNA, 32 nt, Human
gccgugcuagaguccucagggagggagugacc

SEQ ID NO: 440328 - RNA, 32 nt, Human
gccgugcucgaagcguuccuggagcccaagcu

SEQ ID NO: 440329 - RNA, 32 nt, Human
gccgugcucgcgcccuccuccuggccuucuga

SEQ ID NO: 440330 - RNA, 32 nt, Human
gccgugcucucuacccuccacagucacggugc

SEQ ID NO: 440331 - RNA, 32 nt, Human
gccgugcugcuggcgucacuuucuuugauaug

SEQ ID NO: 440332 - RNA, 32 nt, Human
gccguggacacacacccccuuuccaggagggg

SEQ ID NO: 440333 - RNA, 32 nt, Human
gccguggagcuggccucggccucggcaucggg

SEQ ID NO: 440334 - RNA, 32 nt, Human
gccguggaggaugucccgaaaggggccgcgag

SEQ ID NO: 440335 - RNA, 32 nt, Human
gccguggaguaacacagccagcaguuucccuc

SEQ ID NO: 440336 - RNA, 21 nt, Human
gccguggagucagaccggcca

SEQ ID NO: 440337 - RNA, 23 nt, Human
gccguggaguggcggucccuccu

SEQ ID NO: 440338 - RNA, 24 nt, Human
gccguggaguucguaccgcuuccu

SEQ ID NO: 440339 - RNA, 32 nt, Human
gccguggauccugauuccagcugugugagggc

SEQ ID NO: 440340 - RNA, 32 nt, Human
gccguggcagccaccuuccaggagcaggggcu

SEQ ID NO: 440341 - RNA, 32 nt, Human
gccguggccaugggaagauguuccacgcugcc

SEQ ID NO: 440342 - RNA, 32 nt, Human
gccguggcccauaugagucuggcuccggucac

SEQ ID NO: 440343 - RNA, 19 nt, Human
gccguggccccaccuacca

SEQ ID NO: 440344 - RNA, 21 nt, Human
gccguggccggagccgagcgg

SEQ ID NO: 440345 - RNA, 22 nt, Human
gccguggcucacaccuguaauc

SEQ ID NO: 440346 - RNA, 22 nt, Human
gccguggcucacgccuguaauc

SEQ ID NO: 440347 - RNA, 32 nt, Human
gccguggcugccucgugagccucccagagccc

SEQ ID NO: 440348 - RNA, 32 nt, Human
gccgugggaaagcacacuggggaggggucagu

SEQ ID NO: 440349 - RNA, 32 nt, Human
gccgugggaagagaagcacgcccagggggcca

SEQ ID NO: 440350 - RNA, 32 nt, Human
gccgugggagaaacucugggcgggauuacggu

SEQ ID NO: 440351 - RNA, 32 nt, Human
gccgugggcugcagcacugggucugguguccu

SEQ ID NO: 440352 - RNA, 32 nt, Human
gccguggggcaggccaggcccugggagcacuu

SEQ ID NO: 440353 - RNA, 24 nt, Human
gccgugggggccacagccacaccu

SEQ ID NO: 440354 - RNA, 32 nt, Human
gccguggggugaggacggugaggacagggugg

SEQ ID NO: 440355 - RNA, 32 nt, Human
gccguggucucaaggagucagagcagggcugg

SEQ ID NO: 440356 - RNA, 22 nt, Human
gccguggucucaggcacuggag

SEQ ID NO: 440357 - RNA, 32 nt, Human
gccguggugcgaucuuagcucacugcaacccc

SEQ ID NO: 440358 - RNA, 32 nt, Human
gccguggugcugcugguguuuggaguugcagc

SEQ ID NO: 440359 - RNA, 32 nt, Human
gccguguaacacccuuccucugaucgcaccgc

SEQ ID NO: 440360 - RNA, 21 nt, Human
gccguguaccggggcccggag

SEQ ID NO: 440361 - RNA, 21 nt, Human
gccguguaguuuguuuguuga

SEQ ID NO: 440362 - RNA, 32 nt, Human
gccguguauaauguuuucuuuagcaagugugg

SEQ ID NO: 440363 - RNA, 32 nt, Human
gccgugucauccaggcuggagugcgguggugg

SEQ ID NO: 440364 - RNA, 32 nt, Human
gccguguccucucugugucccugcugcugcca

SEQ ID NO: 440365 - RNA, 19 nt, Human
gccguguccuuccgcugcc

SEQ ID NO: 440366 - RNA, 32 nt, Human
gccgugucucaccacauccuggcuccagugug

SEQ ID NO: 440367 - RNA, 32 nt, Human
gccgugucuccaggaccucauggaggcaacag

SEQ ID NO: 440368 - RNA, 20 nt, Human
gccgugucucccucaaagug

SEQ ID NO: 440369 - RNA, 32 nt, Human
gccgugucugggaggcgaggccacgacaggcc

SEQ ID NO: 440370 - RNA, 32 nt, Human
gccgugugaaggagucggagaucagagugagg

SEQ ID NO: 440371 - RNA, 32 nt, Human
gccgugugcucugggcagugguuccuugggca

SEQ ID NO: 440372 - RNA, 32 nt, Human
gccguguggccauccggcucuaccuucagccg

SEQ ID NO: 440373 - RNA, 32 nt, Human
gccgugugugagaggagcaggagugagugugu

SEQ ID NO: 440374 - RNA, 32 nt, Human
gccguguguguucuucucugagcagcuccucc

SEQ ID NO: 440375 - RNA, 32 nt, Human
gccguguuacccaggcuagucacgaacuccug

SEQ ID NO: 440376 - RNA, 32 nt, Human
gccguguugagugaagcucuuggggccagcgu

SEQ ID NO: 440377 - RNA, 24 nt, Human
gccguguuggccagacuggucuca

SEQ ID NO: 440378 - RNA, 32 nt, Human
gccguguugugacuugccggcucugagauugg

SEQ ID NO: 440379 - RNA, 32 nt, Human
gccguguuucagcccugaugggccaagggaag

SEQ ID NO: 440380 - RNA, 32 nt, Human
gccguguuugugacccccuccugcccagcaac

SEQ ID NO: 440381 - RNA, 32 nt, Human
gccguguuugugucccugauuacuugagauua

SEQ ID NO: 440382 - RNA, 32 nt, Human
gccguuagcugcaggugugucuuuccaauaua

SEQ ID NO: 440383 - RNA, 18 nt, Human
gccguuagucacaaggca

SEQ ID NO: 440384 - RNA, 32 nt, Human
gccguuccuccacccgcuccucuuguggccag

SEQ ID NO: 440385 - RNA, 32 nt, Human
gccguuccuccaccucucagccauaucuuuca

SEQ ID NO: 440386 - RNA, 32 nt, Human
gccguugcacagacuguguuuaugacucaacc

SEQ ID NO: 440387 - RNA, 32 nt, Human
gccguugccagccugucucugcgcucgccauu

SEQ ID NO: 440388 - RNA, 32 nt, Human
gccguugcccaggcuggagugcgguggcauga

SEQ ID NO: 440389 - RNA, 32 nt, Human
gccguugcccccagacuuccuccuuuccgugu

SEQ ID NO: 440390 - RNA, 32 nt, Human
gccguugcucaucugcucaugucuguggcugc

SEQ ID NO: 440391 - RNA, 32 nt, Human
gccguugcuuccuauccugggcuuggaagaau

SEQ ID NO: 440392 - RNA, 32 nt, Human
gccguuggcaggcagggaagcaggaaccccac

SEQ ID NO: 440393 - RNA, 32 nt, Human
gccguuggcuuaugccuguaaucccagcacuu

SEQ ID NO: 440394 - RNA, 32 nt, Human
gccguugggacuuugauacccaggaagacuac

SEQ ID NO: 440395 - RNA, 32 nt, Human
gccguuuccgggaggcggagcucagaccccau

SEQ ID NO: 440396 - RNA, 19 nt, Human
gccguuuccugcgagccag

SEQ ID NO: 440397 - RNA, 32 nt, Human
gccguuuccugcuccagcuccagaccuugucu

SEQ ID NO: 440398 - RNA, 17 nt, Human
gccguuuccuucaggug

SEQ ID NO: 440399 - RNA, 32 nt, Human
gccguuuccuugggaacuggagugcaguauga

SEQ ID NO: 440400 - RNA, 17 nt, Human
gccguuucuccuuggua

SEQ ID NO: 440401 - RNA, 18 nt, Human
gccguuugaucuuugaua

SEQ ID NO: 440402 - RNA, 32 nt, Human
gccguuugcuuugccaaaccgacaaaagagag

SEQ ID NO: 440403 - RNA, 32 nt, Human
gccguuuggauggggaagggaaagacugggga

SEQ ID NO: 440404 - RNA, 32 nt, Human
gccguuuuccucauccuuucccucucccaguc

SEQ ID NO: 440405 - RNA, 32 nt, Human
gccguuuuccugcuuugucugccugcacauug

SEQ ID NO: 440406 - RNA, 32 nt, Human
gccuaaaaaguucagaugauggguccuugaac

SEQ ID NO: 440407 - RNA, 24 nt, Human
gccuaaaaucccagcuacucggga

SEQ ID NO: 440408 - RNA, 32 nt, Human
gccuaaagcuuaggcugguguccauguggaac

SEQ ID NO: 440409 - RNA, 32 nt, Human
gccuaaauauagaaaguauuugcucauuggcc

SEQ ID NO: 440410 - RNA, 32 nt, Human
gccuaacaacaguugaaguaaauaugagggaa

SEQ ID NO: 440411 - RNA, 32 nt, Human
gccuaacauggugaaaccccgucuccacuaaa

SEQ ID NO: 440412 - RNA, 32 nt, Human
gccuaaccagagagaggggcgugggagggaga

SEQ ID NO: 440413 - RNA, 32 nt, Human
gccuaaccugccgagaguccaucagccuccau

SEQ ID NO: 440414 - RNA, 25 nt, Human
gccuaaccuuucgccgaauggggca

SEQ ID NO: 440415 - RNA, 32 nt, Human
gccuaacgauuuugaugaaaaguuucccaagc

SEQ ID NO: 440416 - RNA, 18 nt, Human
gccuaacguuugaaccug

SEQ ID NO: 440417 - RNA, 32 nt, Human
gccuaacucaaccccacagacaagcacgcaca

SEQ ID NO: 440418 - RNA, 32 nt, Human
gccuaagagaucaaggcugcagugagccauga

SEQ ID NO: 440419 - RNA, 32 nt, Human
gccuaagagggcagccgccugaaggaacgcga

SEQ ID NO: 440420 - RNA, 32 nt, Human
gccuaagaugaagaggaucggaggcuugucag

SEQ ID NO: 440421 - RNA, 32 nt, Human
gccuaagcaacagcagcccucgcagcccgcca

SEQ ID NO: 440422 - RNA, 32 nt, Human
gccuaagcacagcuuguccugggugaaauguc

SEQ ID NO: 440423 - RNA, 32 nt, Human
gccuaagcacucaggccucccacucaucaacc

SEQ ID NO: 440424 - RNA, 32 nt, Human
gccuaagcccaggaggccaagucugcagugag

SEQ ID NO: 440425 - RNA, 32 nt, Human
gccuaagcuggucucaaacuccugggcucaag

SEQ ID NO: 440426 - RNA, 32 nt, Human
gccuaaggacagugaagucuggagcccaaagu

SEQ ID NO: 440427 - RNA, 32 nt, Human
gccuaaggacuuccaggucagccacccaccgc

SEQ ID NO: 440428 - RNA, 18 nt, Human
gccuaaggccucccagca

SEQ ID NO: 440429 - RNA, 32 nt, Human
gccuaagggaaacuguuggccgcugggcccgc

SEQ ID NO: 440430 - RNA, 32 nt, Human
gccuaagggagugggaaggaaaugggguguuu

SEQ ID NO: 440431 - RNA, 32 nt, Human
gccuaaggugaggcugagcugaaggaaugugg

SEQ ID NO: 440432 - RNA, 22 nt, Human
gccuaagguggagcagauccca

SEQ ID NO: 440433 - RNA, 32 nt, Human
gccuaaguccugcauuaacucaguccaaccau

SEQ ID NO: 440434 - RNA, 32 nt, Human
gccuaagugccacccuccucccuccaagccug

SEQ ID NO: 440435 - RNA, 25 nt, Human
gccuaauaaaggaggucucacaguc

SEQ ID NO: 440436 - RNA, 32 nt, Human
gccuaauaaauacauuucugcuuuauuaaaaa

SEQ ID NO: 440437 - RNA, 32 nt, Human
gccuaauccuugcccgccauguccgggggcuu

SEQ ID NO: 440438 - RNA, 32 nt, Human
gccuaaucuaggacugauggcagaaggguuug

SEQ ID NO: 440439 - RNA, 32 nt, Human
gccuaaugaucugcccaccucugccucccaaa

SEQ ID NO: 440440 - RNA, 32 nt, Human
gccuaaugcccagugggacugaucagacccgg

SEQ ID NO: 440441 - RNA, 32 nt, Human
gccuaauggaggaugagagaccacguggagga

SEQ ID NO: 440442 - RNA, 23 nt, Human
gccuaauuccaguauccuggaaa

SEQ ID NO: 440443 - RNA, 32 nt, Human
gccuaauucuaugccugucuuaauuuucuuuc

SEQ ID NO: 440444 - RNA, 32 nt, Human
gccuaauuuaccaaggaugaauucuuucaauu

SEQ ID NO: 440445 - RNA, 32 nt, Human
gccuaauuuuguaggacuuaaucuguugaaaa

SEQ ID NO: 440446 - RNA, 32 nt, Human
gccuacaagaccuggggcguccuggccagauc

SEQ ID NO: 440447 - RNA, 32 nt, Human
gccuacaaggcccugagggagacugcggaggg

SEQ ID NO: 440448 - RNA, 23 nt, Human
gccuacaaucccagcauuuggga

SEQ ID NO: 440449 - RNA, 19 nt, Human
gccuacaccguucaucagc

SEQ ID NO: 440450 - RNA, 17 nt, Human
gccuacaccuccaccuc

SEQ ID NO: 440451 - RNA, 32 nt, Human
gccuacacugcacccuggcuggcaggggugcu

SEQ ID NO: 440452 - RNA, 32 nt, Human
gccuacagacaguaccugcaggacagccaccu

SEQ ID NO: 440453 - RNA, 32 nt, Human
gccuacagcucccugcaggcugguggccgcuu

SEQ ID NO: 440454 - RNA, 30 nt, Human
gccuacagcuugcagggaguaaagcaggcc

SEQ ID NO: 440455 - RNA, 32 nt, Human
gccuacaggaugaugaaaccccaaggccuugg

SEQ ID NO: 440456 - RNA, 32 nt, Human
gccuacagugauguuuggaaucgaucaugcuu

SEQ ID NO: 440457 - RNA, 32 nt, Human
gccuacaguuauguucagucacacacacauac

SEQ ID NO: 440458 - RNA, 21 nt, Human
gccuacauagaagagugacag

SEQ ID NO: 440459 - RNA, 32 nt, Human
gccuacauauuuuaucuucugaucucacugaa

SEQ ID NO: 440460 - RNA, 32 nt, Human
gccuacaucaagacccaagugaacaaagagcu

SEQ ID NO: 440461 - RNA, 32 nt, Human
gccuacauccguggcagggcucuggacuggug

SEQ ID NO: 440462 - RNA, 21 nt, Human
gccuacaucugccacucagcc

SEQ ID NO: 440463 - RNA, 32 nt, Human
gccuacaugguugaaaccccaucucuacuaaa

SEQ ID NO: 440464 - RNA, 32 nt, Human
gccuacauguucucaugcaugucuaaccugau

SEQ ID NO: 440465 - RNA, 32 nt, Human
gccuacauuaaauaggagcagaucuuguggua

SEQ ID NO: 440466 - RNA, 32 nt, Human
gccuaccaagagaacuguggggaugugggaug

SEQ ID NO: 440467 - RNA, 32 nt, Human
gccuaccacaccuuccugccacugacucccac

SEQ ID NO: 440468 - RNA, 32 nt, Human
gccuaccagaccauugucagaaacacagcugg

SEQ ID NO: 440469 - RNA, 32 nt, Human
gccuaccaggagaaagcaguaggcuuccuuuc

SEQ ID NO: 440470 - RNA, 32 nt, Human
gccuaccauccaggaaaacuugugcuggaauu

SEQ ID NO: 440471 - RNA, 32 nt, Human
gccuacccagaaacagcaggagagagaagaaa

SEQ ID NO: 440472 - RNA, 32 nt, Human
gccuacccagacggcuuguuugcccagggcac

SEQ ID NO: 440473 - RNA, 32 nt, Human
gccuacccaugcagggacugggauucgaggac

SEQ ID NO: 440474 - RNA, 32 nt, Human
gccuacccccacuuuaccgaggccaacagccg

SEQ ID NO: 440475 - RNA, 32 nt, Human
gccuacccccgggagcccagagcccagcucuu

SEQ ID NO: 440476 - RNA, 18 nt, Human
gccuaccccugaacuuug

SEQ ID NO: 440477 - RNA, 32 nt, Human
gccuaccccugccccaugugucccccguuacc

SEQ ID NO: 440478 - RNA, 32 nt, Human
gccuaccccuggcaucagcaucaccugggugu

SEQ ID NO: 440479 - RNA, 32 nt, Human
gccuaccccuuguguuaccucccgccacacac

SEQ ID NO: 440480 - RNA, 32 nt, Human
gccuacccuuucucccgucucagggccuugau

SEQ ID NO: 440481 - RNA, 32 nt, Human
gccuaccuaagaauuugaguagugucuaaaca

SEQ ID NO: 440482 - RNA, 32 nt, Human
gccuaccuccaaguaauuuuaugaggaugaaa

SEQ ID NO: 440483 - RNA, 32 nt, Human
gccuaccucuuccuccacucauuuggguucag

SEQ ID NO: 440484 - RNA, 18 nt, Human
gccuaccugaggagcuuu

SEQ ID NO: 440485 - RNA, 32 nt, Human
gccuaccugcagcuguggcggcugcuccugua

SEQ ID NO: 440486 - RNA, 32 nt, Human
gccuaccugcauaaagaaaauaaaaucuuuua

SEQ ID NO: 440487 - RNA, 32 nt, Human
gccuaccugccauccccaccgcucagcgccuc

SEQ ID NO: 440488 - RNA, 32 nt, Human
gccuaccugccugagccauguucaccugccca

SEQ ID NO: 440489 - RNA, 32 nt, Human
gccuaccugccugccccaggccaugccugccu

SEQ ID NO: 440490 - RNA, 32 nt, Human
gccuaccugcgugaggauuggggccugagcac

SEQ ID NO: 440491 - RNA, 32 nt, Human
gccuaccugcuccaucuaaagcagaaaacucc

SEQ ID NO: 440492 - RNA, 32 nt, Human
gccuaccugcuccccacuccuucuccaagaag

SEQ ID NO: 440493 - RNA, 32 nt, Human
gccuaccugcugucgcccuuguacucgccgaa

SEQ ID NO: 440494 - RNA, 32 nt, Human
gccuacgagccaagaugcucagcuuuauaggu

SEQ ID NO: 440495 - RNA, 23 nt, Human
gccuacgagucaugccaccagcc

SEQ ID NO: 440496 - RNA, 22 nt, Human
gccuacgcaagagggcgggaca

SEQ ID NO: 440497 - RNA, 32 nt, Human
gccuacgcccaccuauggccagucccagagcc

SEQ ID NO: 440498 - RNA, 32 nt, Human
gccuacgcugccucugggcuggcuggccagug

SEQ ID NO: 440499 - RNA, 20 nt, Human
gccuacgcuggagugcagug

SEQ ID NO: 440500 - RNA, 21 nt, Human
gccuacgcuggagugcagugg

SEQ ID NO: 440501 - RNA, 32 nt, Human
gccuacgucugcuccucuccaaucccacacca

SEQ ID NO: 440502 - RNA, 19 nt, Human
gccuacguucccucaggug

SEQ ID NO: 440503 - RNA, 24 nt, Human
gccuacucaaucucucccaccuca

SEQ ID NO: 440504 - RNA, 32 nt, Human
gccuacuccaagaauggaggcuguaggaauau

SEQ ID NO: 440505 - RNA, 18 nt, Human
gccuacucugaaagcuca

SEQ ID NO: 440506 - RNA, 32 nt, Human
gccuacucugcaacucggcuucugagccaggc

SEQ ID NO: 440507 - RNA, 32 nt, Human
gccuacugcacuccagccugggcaacaaagug

SEQ ID NO: 440508 - RNA, 19 nt, Human
gccuacugccucggaucuc

SEQ ID NO: 440509 - RNA, 32 nt, Human
gccuacugggcagagcagcagagcaggcugcc

SEQ ID NO: 440510 - RNA, 32 nt, Human
gccuacuguaaaccccaagaugacauggucca

SEQ ID NO: 440511 - RNA, 17 nt, Human
gccuacuguagacucug

SEQ ID NO: 440512 - RNA, 32 nt, Human
gccuacugucaugagaguggggagacaggcag

SEQ ID NO: 440513 - RNA, 32 nt, Human
gccuacugugugucagugccugagauacaccu

SEQ ID NO: 440514 - RNA, 21 nt, Human
gccuacuguuagguuccuggg

SEQ ID NO: 440515 - RNA, 32 nt, Human
gccuacuucacagaaugauguggaaaucagug

SEQ ID NO: 440516 - RNA, 32 nt, Human
gccuacuuccuuccuguuggauaucauacuuc

SEQ ID NO: 440517 - RNA, 32 nt, Human
gccuacuugucugcucugagggagagugcgug

SEQ ID NO: 440518 - RNA, 32 nt, Human
gccuacuuucugcccggaucucuggcuccuca

SEQ ID NO: 440519 - RNA, 32 nt, Human
gccuacuuucuucuuuguaucucccuccuucc

SEQ ID NO: 440520 - RNA, 32 nt, Human
gccuacuuugagguggaaugccuccgaguuag

SEQ ID NO: 440521 - RNA, 32 nt, Human
gccuacuuugaugguagguuugaaugacgugu

SEQ ID NO: 440522 - RNA, 18 nt, Human
gccuacuuuucuucgaua

SEQ ID NO: 440523 - RNA, 32 nt, Human
gccuagaaaacaaagauucuguguuuuaccaa

SEQ ID NO: 440524 - RNA, 32 nt, Human
gccuagaaacuggaaugugcagauguugcaua

SEQ ID NO: 440525 - RNA, 32 nt, Human
gccuagaaagcccuugccuuccuuccucccac

SEQ ID NO: 440526 - RNA, 32 nt, Human
gccuagaacagggccuggugugcaguaggugc

SEQ ID NO: 440527 - RNA, 32 nt, Human
gccuagaacgcaccuccucugcaugacuaaua

SEQ ID NO: 440528 - RNA, 32 nt, Human
gccuagaagggaagggagagacuuacuuugga

SEQ ID NO: 440529 - RNA, 32 nt, Human
gccuagaagggccugacaugggacccaucugc

SEQ ID NO: 440530 - RNA, 32 nt, Human
gccuagaagguguggaggacucaccacgggca

SEQ ID NO: 440531 - RNA, 32 nt, Human
gccuagaaguuuucccucaucuguaaauguga

SEQ ID NO: 440532 - RNA, 20 nt, Human
gccuagaaucccagcuacuc

SEQ ID NO: 440533 - RNA, 23 nt, Human
gccuagaaucccagcuacucgga

SEQ ID NO: 440534 - RNA, 17 nt, Human
gccuagacauccaccuc

SEQ ID NO: 440535 - RNA, 32 nt, Human
gccuagaccagcagacagagccaggagaggcu

SEQ ID NO: 440536 - RNA, 32 nt, Human
gccuagaccccacaucucccacccucagccaa

SEQ ID NO: 440537 - RNA, 32 nt, Human
gccuagacuagaucccuuacccucucuccagu

SEQ ID NO: 440538 - RNA, 32 nt, Human
gccuagagacacaccucccugcucccuccccc

SEQ ID NO: 440539 - RNA, 32 nt, Human
gccuagagagaagagagggcccucaaauccca

SEQ ID NO: 440540 - RNA, 32 nt, Human
gccuagagauacugccugguguuuugcuuuuu

SEQ ID NO: 440541 - RNA, 32 nt, Human
gccuagagcaguuguaauaugugcaaagucau

SEQ ID NO: 440542 - RNA, 32 nt, Human
gccuagagcugaggagugaggggucagggcuc

SEQ ID NO: 440543 - RNA, 32 nt, Human
gccuagaggagaaaaggcgguccccgccgagu

SEQ ID NO: 440544 - RNA, 32 nt, Human
gccuagaggagcaccaucuacaguugugccau

SEQ ID NO: 440545 - RNA, 32 nt, Human
gccuagaggauguuucaugggaucccagccac

SEQ ID NO: 440546 - RNA, 32 nt, Human
gccuagaucccccaucuccuccuuccagccag

SEQ ID NO: 440547 - RNA, 32 nt, Human
gccuagaugagagagauagagagugaguacau

SEQ ID NO: 440548 - RNA, 32 nt, Human
gccuagauuugaccucuguccugggcuccugg

SEQ ID NO: 440549 - RNA, 32 nt, Human
gccuagcaacuguuuggcagucagagucccac

SEQ ID NO: 440550 - RNA, 32 nt, Human
gccuagcaagcacacccgugguugugaaaaua

SEQ ID NO: 440551 - RNA, 32 nt, Human
gccuagcaagcuccagccccagccgcugaccc

SEQ ID NO: 440552 - RNA, 19 nt, Human
gccuagcaccaguuuuuca

SEQ ID NO: 440553 - RNA, 32 nt, Human
gccuagcaccugcucuuggccuggugagcccc

SEQ ID NO: 440554 - RNA, 32 nt, Human
gccuagccacacugcacuguggccccuuggga

SEQ ID NO: 440555 - RNA, 21 nt, Human
gccuagccaccucccacccca

SEQ ID NO: 440556 - RNA, 32 nt, Human
gccuagcccaaagcaggccucuuugguugcuu

SEQ ID NO: 440557 - RNA, 18 nt, Human
gccuagcccacccugcug

SEQ ID NO: 440558 - RNA, 32 nt, Human
gccuagcccaccugcaggaagagauuuggcug

SEQ ID NO: 440559 - RNA, 16 nt, Human
gccuagccccuuggua

SEQ ID NO: 440560 - RNA, 21 nt, Human
gccuagcccgggagggaccug

SEQ ID NO: 440561 - RNA, 32 nt, Human
gccuagcccuggccuugaccucccaggagcgc

SEQ ID NO: 440562 - RNA, 18 nt, Human
gccuagcccuggggaccu

SEQ ID NO: 440563 - RNA, 32 nt, Human
gccuagccucucccucucccccagcuaguccc

SEQ ID NO: 440564 - RNA, 21 nt, Human
gccuagcgcugugcuaugcuc

SEQ ID NO: 440565 - RNA, 32 nt, Human
gccuagcucacugcuguuccucugcuugcacu

SEQ ID NO: 440566 - RNA, 17 nt, Human
gccuagcucaguucucc

SEQ ID NO: 440567 - RNA, 32 nt, Human
gccuagcucccagggcuuugugcagacggccu

SEQ ID NO: 440568 - RNA, 19 nt, Human
gccuagcugcccccaggga

SEQ ID NO: 440569 - RNA, 32 nt, Human
gccuagcugcugucacauuuuucuuguuuugu

SEQ ID NO: 440570 - RNA, 32 nt, Human
gccuagcuuuuccucccuuugugaaugagggg

SEQ ID NO: 440571 - RNA, 32 nt, Human
gccuaggaaaguuguccccuugaaugucagug

SEQ ID NO: 440572 - RNA, 23 nt, Human
gccuaggaaccagcugccugaga

SEQ ID NO: 440573 - RNA, 32 nt, Human
gccuaggaaccagcugccugagaccagggugc

SEQ ID NO: 440574 - RNA, 32 nt, Human
gccuaggaagaggaauggaacaaguagcaaag

SEQ ID NO: 440575 - RNA, 32 nt, Human
gccuaggaagucgaggcugcagugagcugaga

SEQ ID NO: 440576 - RNA, 23 nt, Human
gccuaggacaguggccugguccc

SEQ ID NO: 440577 - RNA, 32 nt, Human
gccuaggaccuuugugguagcagagucacugc

SEQ ID NO: 440578 - RNA, 32 nt, Human
gccuaggacguugaggcugcagugagcugugu

SEQ ID NO: 440579 - RNA, 32 nt, Human
gccuaggaggcuguaugccagagcucaucucu

SEQ ID NO: 440580 - RNA, 32 nt, Human
gccuaggaggucaaggcugcagugagccauga

SEQ ID NO: 440581 - RNA, 32 nt, Human
gccuaggagguugaggcugcagugagcuauga

SEQ ID NO: 440582 - RNA, 32 nt, Human
gccuaggagguugaggcugcagugagcuguga

SEQ ID NO: 440583 - RNA, 21 nt, Human
gccuaggaugacacuggcccc

SEQ ID NO: 440584 - RNA, 18 nt, Human
gccuaggauggccgcccc

SEQ ID NO: 440585 - RNA, 32 nt, Human
gccuaggcaaaaagagcaagacuccgucucaa

SEQ ID NO: 440586 - RNA, 32 nt, Human
gccuaggcaacagagugagacuuugucucaaa

SEQ ID NO: 440587 - RNA, 32 nt, Human
gccuaggcaacagugagacucuuuguuuuggg

SEQ ID NO: 440588 - RNA, 32 nt, Human
gccuaggcagggcugggaugaggcuuguacaa

SEQ ID NO: 440589 - RNA, 21 nt, Human
gccuaggccagagugcagugg

SEQ ID NO: 440590 - RNA, 31 nt, Human
gccuaggccaugucuccugguucaggaacac

SEQ ID NO: 440591 - RNA, 32 nt, Human
gccuaggccgaacuuccggcucucacugcuag

SEQ ID NO: 440592 - RNA, 32 nt, Human
gccuaggccggucuugaacuccugggcucaag

SEQ ID NO: 440593 - RNA, 32 nt, Human
gccuaggccucauccuccucuuugccagucac

SEQ ID NO: 440594 - RNA, 32 nt, Human
gccuaggcgcggcccgcggagccagacguguu

SEQ ID NO: 440595 - RNA, 20 nt, Human
gccuaggcggaguacagugg

SEQ ID NO: 440596 - RNA, 32 nt, Human
gccuaggcucaagugaucugcccaccucaguc

SEQ ID NO: 440597 - RNA, 21 nt, Human
gccuaggcugaagcacagugg

SEQ ID NO: 440598 - RNA, 23 nt, Human
gccuaggcugaagcacaguggug

SEQ ID NO: 440599 - RNA, 32 nt, Human
gccuaggcugaccuugaacuccugggcucaag

SEQ ID NO: 440600 - RNA, 20 nt, Human
gccuaggcugagugcagugg

SEQ ID NO: 440601 - RNA, 23 nt, Human
gccuaggcugagugcaguggugu

SEQ ID NO: 440602 - RNA, 21 nt, Human
gccuaggcuggaaugcagugg

SEQ ID NO: 440603 - RNA, 21 nt, Human
gccuaggcuggaguacagugg

SEQ ID NO: 440604 - RNA, 23 nt, Human
gccuaggcuggaguacaguggug

SEQ ID NO: 440605 - RNA, 21 nt, Human
gccuaggcuggagugaagugg

SEQ ID NO: 440606 - RNA, 18 nt, Human
gccuaggcuggagugcaa

SEQ ID NO: 440607 - RNA, 24 nt, Human
gccuaggcuggagugcaacagugu

SEQ ID NO: 440608 - RNA, 21 nt, Human
gccuaggcuggagugcaaugg

SEQ ID NO: 440609 - RNA, 23 nt, Human
gccuaggcuggagugcaauggug

SEQ ID NO: 440610 - RNA, 19 nt, Human
gccuaggcuggagugcagu

SEQ ID NO: 440611 - RNA, 20 nt, Human
gccuaggcuggagugcagug

SEQ ID NO: 440612 - RNA, 21 nt, Human
gccuaggcuggagugcagugg

SEQ ID NO: 440613 - RNA, 24 nt, Human
gccuaggcuggagugcaguggcgu

SEQ ID NO: 440614 - RNA, 23 nt, Human
gccuaggcuggagugcaguggug

SEQ ID NO: 440615 - RNA, 24 nt, Human
gccuaggcuggagugcaguggugu

SEQ ID NO: 440616 - RNA, 32 nt, Human
gccuaggcuggucucuaaccacucaagcaaac

SEQ ID NO: 440617 - RNA, 32 nt, Human
gccuagggaccccugcucccagccugcugaga

SEQ ID NO: 440618 - RNA, 32 nt, Human
gccuagggcagaaaggaagugggaauggcgaa

SEQ ID NO: 440619 - RNA, 32 nt, Human
gccuaggggcccugaucgcccaccugccugga

SEQ ID NO: 440620 - RNA, 32 nt, Human
gccuaggggcugggagcugccugcugccauag

SEQ ID NO: 440621 - RNA, 24 nt, Human
gccuagggggcagagggugcagug

SEQ ID NO: 440622 - RNA, 32 nt, Human
gccuagggggcagagggugcaguggcagugug

SEQ ID NO: 440623 - RNA, 32 nt, Human
gccuaggggguggcagcgggcagugcggggcg

SEQ ID NO: 440624 - RNA, 32 nt, Human
gccuaggguggcaggagccagggaggaguggg

SEQ ID NO: 440625 - RNA, 32 nt, Human
gccuagguaacauagugagacccccuaucucu

SEQ ID NO: 440626 - RNA, 32 nt, Human
gccuaggugaagaccuggaaaaggaaggguua

SEQ ID NO: 440627 - RNA, 32 nt, Human
gccuaggugaagccuacuacaagaaugccaag

SEQ ID NO: 440628 - RNA, 22 nt, Human
gccuaggugccuggacccaggg

SEQ ID NO: 440629 - RNA, 32 nt, Human
gccuaggugguucaccuuuccccaauuuguuc

SEQ ID NO: 440630 - RNA, 32 nt, Human
gccuaggugugggcugggcauugccuacacgu

SEQ ID NO: 440631 - RNA, 32 nt, Human
gccuagguuuuaagcaggagaauagcugagaa

SEQ ID NO: 440632 - RNA, 32 nt, Human
gccuaguauuaaaacugauaaaagcaaagcca

SEQ ID NO: 440633 - RNA, 32 nt, Human
gccuagucacuagcccagcaugucaacuuugg

SEQ ID NO: 440634 - RNA, 32 nt, Human
gccuagucaggcuuaugcaaugcaguggauag

SEQ ID NO: 440635 - RNA, 32 nt, Human
gccuagucauuauuugcugucggguuuccagu

SEQ ID NO: 440636 - RNA, 32 nt, Human
gccuagucucaaacuccuggguucaagcaauc

SEQ ID NO: 440637 - RNA, 32 nt, Human
gccuagucuuccucuguugcuguacauauauu

SEQ ID NO: 440638 - RNA, 32 nt, Human
gccuagugacuuuuacacaguugugaagaucc

SEQ ID NO: 440639 - RNA, 32 nt, Human
gccuagugagggcugcaagaccauccugcccg

SEQ ID NO: 440640 - RNA, 32 nt, Human
gccuagugucaucaaccgggagaggaaaaaga

SEQ ID NO: 440641 - RNA, 22 nt, Human
gccuaguucccacaucuggaaa

SEQ ID NO: 440642 - RNA, 32 nt, Human
gccuaguuuugcucugggcaguguugcugaaa

SEQ ID NO: 440643 - RNA, 23 nt, Human
gccuauaaccccagcuauuuggg

SEQ ID NO: 440644 - RNA, 24 nt, Human
gccuauaaccccagcuauuuggga

SEQ ID NO: 440645 - RNA, 32 nt, Human
gccuauaaggaagagagaagcugucuguacuu

SEQ ID NO: 440646 - RNA, 24 nt, Human
gccuauaaucccagcaauuuggga

SEQ ID NO: 440647 - RNA, 20 nt, Human
gccuauaaucccagcacuuu

SEQ ID NO: 440648 - RNA, 23 nt, Human
gccuauaaucccagccacgcggg

SEQ ID NO: 440649 - RNA, 21 nt, Human
gccuauaaucccagcuacuca

SEQ ID NO: 440650 - RNA, 23 nt, Human
gccuauaaucccagcuacucaga

SEQ ID NO: 440651 - RNA, 23 nt, Human
gccuauaaucccagcuacucagg

SEQ ID NO: 440652 - RNA, 24 nt, Human
gccuauaaucccagcuacucagga

SEQ ID NO: 440653 - RNA, 23 nt, Human
gccuauaaucccagcuacucgag

SEQ ID NO: 440654 - RNA, 23 nt, Human
gccuauaaucccagcuacucggg

SEQ ID NO: 440655 - RNA, 24 nt, Human
gccuauaaucccagcuacucggga

SEQ ID NO: 440656 - RNA, 22 nt, Human
gccuauaaucccagcuacuggg

SEQ ID NO: 440657 - RNA, 24 nt, Human
gccuauaaucccagcuacugggga

SEQ ID NO: 440658 - RNA, 23 nt, Human
gccuauaaucccagcuacuuagg

SEQ ID NO: 440659 - RNA, 24 nt, Human
gccuauaaucccagcuacuuagga

SEQ ID NO: 440660 - RNA, 21 nt, Human
gccuauaaucccagcuacuug

SEQ ID NO: 440661 - RNA, 24 nt, Human
gccuauaaucccagcuacuugaga

SEQ ID NO: 440662 - RNA, 23 nt, Human
gccuauaaucccagcuacuuggg

SEQ ID NO: 440663 - RNA, 24 nt, Human
gccuauaaucccagcuacuuggga

SEQ ID NO: 440664 - RNA, 24 nt, Human
gccuauaaucccagcuauucugga

SEQ ID NO: 440665 - RNA, 24 nt, Human
gccuauaaucccagcuauuuggga

SEQ ID NO: 440666 - RNA, 23 nt, Human
gccuauaaucccagcuucuuggg

SEQ ID NO: 440667 - RNA, 24 nt, Human
gccuauaaucccagcuucuuggga

SEQ ID NO: 440668 - RNA, 23 nt, Human
gccuauaaucccagguacucagg

SEQ ID NO: 440669 - RNA, 23 nt, Human
gccuauaaucccagguacuuggg

SEQ ID NO: 440670 - RNA, 24 nt, Human
gccuauaaucccagguacuuggga

SEQ ID NO: 440671 - RNA, 20 nt, Human
gccuauaaucccaguacuuu

SEQ ID NO: 440672 - RNA, 23 nt, Human
gccuauaaucccggcuacucggg

SEQ ID NO: 440673 - RNA, 24 nt, Human
gccuauaaucccggcuacucggga

SEQ ID NO: 440674 - RNA, 23 nt, Human
gccuauaaucucagcuacuuggg

SEQ ID NO: 440675 - RNA, 24 nt, Human
gccuauaaucucagcuacuuggga

SEQ ID NO: 440676 - RNA, 32 nt, Human
gccuauacaagacagugaagugaccucucugu

SEQ ID NO: 440677 - RNA, 21 nt, Human
gccuauaccuucuucacccca

SEQ ID NO: 440678 - RNA, 24 nt, Human
gccuauagccccagcuacuuggga

SEQ ID NO: 440679 - RNA, 24 nt, Human
gccuauagucccaacuacuaggga

SEQ ID NO: 440680 - RNA, 24 nt, Human
gccuauagucccaacuacuuagag

SEQ ID NO: 440681 - RNA, 24 nt, Human
gccuauagucccagcaacuuggga

SEQ ID NO: 440682 - RNA, 24 nt, Human
gccuauagucccagcacuuuggga

SEQ ID NO: 440683 - RNA, 23 nt, Human
gccuauagucccagccacuagga

SEQ ID NO: 440684 - RNA, 24 nt, Human
gccuauagucccagccacucaaga

SEQ ID NO: 440685 - RNA, 23 nt, Human
gccuauagucccagccacuuggg

SEQ ID NO: 440686 - RNA, 24 nt, Human
gccuauagucccagccacuuggga

SEQ ID NO: 440687 - RNA, 23 nt, Human
gccuauagucccagcuacucagg

SEQ ID NO: 440688 - RNA, 24 nt, Human
gccuauagucccagcuacucagga

SEQ ID NO: 440689 - RNA, 24 nt, Human
gccuauagucccagcuacuccaga

SEQ ID NO: 440690 - RNA, 23 nt, Human
gccuauagucccagcuacucggg

SEQ ID NO: 440691 - RNA, 24 nt, Human
gccuauagucccagcuacucggga

SEQ ID NO: 440692 - RNA, 21 nt, Human
gccuauagucccagcuacuug

SEQ ID NO: 440693 - RNA, 24 nt, Human
gccuauagucccagcuacuuggga

SEQ ID NO: 440694 - RNA, 24 nt, Human
gccuauagucccagcuacuugggg

SEQ ID NO: 440695 - RNA, 23 nt, Human
gccuauagucccagcugcucagg

SEQ ID NO: 440696 - RNA, 24 nt, Human
gccuauagucccagcugcucagga

SEQ ID NO: 440697 - RNA, 24 nt, Human
gccuauagucccagcugcugggga

SEQ ID NO: 440698 - RNA, 24 nt, Human
gccuauaguuuuagcuacuuggga

SEQ ID NO: 440699 - RNA, 32 nt, Human
gccuauauccaggacgcacagaagcgccucac

SEQ ID NO: 440700 - RNA, 32 nt, Human
gccuauaucccagcuacugggagguugaagca

SEQ ID NO: 440701 - RNA, 23 nt, Human
gccuauauucuagcuacucagga

SEQ ID NO: 440702 - RNA, 32 nt, Human
gccuauauucuagcuacucaggaggcugagau

SEQ ID NO: 440703 - RNA, 32 nt, Human
gccuauauuuuucauagagcucaugagcauuu

SEQ ID NO: 440704 - RNA, 32 nt, Human
gccuaucacacucuucucacuggcagagugug

SEQ ID NO: 440705 - RNA, 32 nt, Human
gccuaucagaagcagaaggagcagcugcggca

SEQ ID NO: 440706 - RNA, 32 nt, Human
gccuaucaggaagccucuaaaaugggguguag

SEQ ID NO: 440707 - RNA, 32 nt, Human
gccuaucaggagaacccccagaugaucacagu

SEQ ID NO: 440708 - RNA, 32 nt, Human
gccuauccaagugccaggaagggaagcacuac

SEQ ID NO: 440709 - RNA, 17 nt, Human
gccuauccugaauuuug

SEQ ID NO: 440710 - RNA, 32 nt, Human
gccuauccugggaccuccacacuccugguucu

SEQ ID NO: 440711 - RNA, 17 nt, Human
gccuaucuaaaauucug

SEQ ID NO: 440712 - RNA, 32 nt, Human
gccuaucuccauccuccagugugacucaggca

SEQ ID NO: 440713 - RNA, 32 nt, Human
gccuaucugcugaccacaaccuugccacaccu

SEQ ID NO: 440714 - RNA, 32 nt, Human
gccuaucuggaagcuccuggaucugaguucuc

SEQ ID NO: 440715 - RNA, 17 nt, Human
gccuaucuugaacuuug

SEQ ID NO: 440716 - RNA, 32 nt, Human
gccuaugaccauugcaacaaccucucaccauc

SEQ ID NO: 440717 - RNA, 32 nt, Human
gccuaugagaaaagggccaggauagaagagcc

SEQ ID NO: 440718 - RNA, 32 nt, Human
gccuaugagaaaagggccaggauagaagaggu

SEQ ID NO: 440719 - RNA, 32 nt, Human
gccuaugauuuagcuggcaggccagguuuucu

SEQ ID NO: 440720 - RNA, 32 nt, Human
gccuaugcaaguucauuuaagccucagggcug

SEQ ID NO: 440721 - RNA, 16 nt, Human
gccuaugcagcaggug

SEQ ID NO: 440722 - RNA, 22 nt, Human
gccuaugccaagucccuggaaa

SEQ ID NO: 440723 - RNA, 17 nt, Human
gccuaugccaccaggua

SEQ ID NO: 440724 - RNA, 32 nt, Human
gccuaugccacuccaucuggacauuuaaugaa

SEQ ID NO: 440725 - RNA, 27 nt, Human
gccuaugcccugagccauggcugcuga

SEQ ID NO: 440726 - RNA, 32 nt, Human
gccuauggcugaaggcggaggugcagggcagc

SEQ ID NO: 440727 - RNA, 32 nt, Human
gccuaugggaaccaaaagaaucaagcugaacc

SEQ ID NO: 440728 - RNA, 30 nt, Human
gccuaugggggccacagggucccagcagag

SEQ ID NO: 440729 - RNA, 32 nt, Human
gccuaugggucaaaauaaugaaauccaccccu

SEQ ID NO: 440730 - RNA, 24 nt, Human
gccuauggucccagcuacucagga

SEQ ID NO: 440731 - RNA, 32 nt, Human
gccuaugugguguuuggcaaaacaugccccug

SEQ ID NO: 440732 - RNA, 32 nt, Human
gccuauguucucuccuaggcagaccuaucaac

SEQ ID NO: 440733 - RNA, 32 nt, Human
gccuauuaaggagguccaaggggugaguccca

SEQ ID NO: 440734 - RNA, 32 nt, Human
gccuauuaguccaugaagaagcuguauuuauu

SEQ ID NO: 440735 - RNA, 23 nt, Human
gccuauucaguuccuuuguuugg

SEQ ID NO: 440736 - RNA, 20 nt, Human
gccuauucuuucacccucug

SEQ ID NO: 440737 - RNA, 32 nt, Human
gccuauucuuucucccaccauuuugggcugac

SEQ ID NO: 440738 - RNA, 32 nt, Human
gccuauugaaucuuccuugcucuuucauuugc

SEQ ID NO: 440739 - RNA, 32 nt, Human
gccuauuuaauauguacacauauauucacuac

SEQ ID NO: 440740 - RNA, 32 nt, Human
gccuauuucugcuccucucuucucucuuggac

SEQ ID NO: 440741 - RNA, 32 nt, Human
gccuauuugcccacaggcuuugcuucucuccc

SEQ ID NO: 440742 - RNA, 21 nt, Human
gccuauuugucuugccugcug

SEQ ID NO: 440743 - RNA, 20 nt, Human
gccuauuuuagagaacuuug

SEQ ID NO: 440744 - RNA, 32 nt, Human
gccuauuuuggagcuuccccuguuaggaagga

SEQ ID NO: 440745 - RNA, 19 nt, Human
gccuauuuuguuccugcug

SEQ ID NO: 440746 - RNA, 32 nt, Human
gccuauuuuuauaccagcaccaugcaguuuug

SEQ ID NO: 440747 - RNA, 23 nt, Human
gccucaaaaagaguagcuccuug

SEQ ID NO: 440748 - RNA, 32 nt, Human
gccucaaaccgcuccaaauauccacuugcaaa

SEQ ID NO: 440749 - RNA, 32 nt, Human
gccucaaacgaaagaaccagcccagggagcac

SEQ ID NO: 440750 - RNA, 22 nt, Human
gccucaaacucccgaccucagg

SEQ ID NO: 440751 - RNA, 21 nt, Human
gccucaaacuccugggcucaa

SEQ ID NO: 440752 - RNA, 32 nt, Human
gccucaaacuccugggcucaagcaauccuccc

SEQ ID NO: 440753 - RNA, 32 nt, Human
gccucaaacuccugggcucaagcaauccuccu

SEQ ID NO: 440754 - RNA, 32 nt, Human
gccucaaacuccuggguucaaguaacccuccc

SEQ ID NO: 440755 - RNA, 21 nt, Human
gccucaaaggccgccaucuug

SEQ ID NO: 440756 - RNA, 32 nt, Human
gccucaaaguauugagauuacaggcaugagcc

SEQ ID NO: 440757 - RNA, 22 nt, Human
gccucaaaguuguaguaccuca

SEQ ID NO: 440758 - RNA, 21 nt, Human
gccucaaauuccugggcucaa

SEQ ID NO: 440759 - RNA, 32 nt, Human
gccucaacauggagaaaccccaucucuacuaa

SEQ ID NO: 440760 - RNA, 32 nt, Human
gccucaacauggagaaaccccgucucuacuaa

SEQ ID NO: 440761 - RNA, 32 nt, Human
gccucaaccaaggagcagaggggugcggguaa

SEQ ID NO: 440762 - RNA, 32 nt, Human
gccucaaccccuccccugcacugagauuauuu

SEQ ID NO: 440763 - RNA, 32 nt, Human
gccucaaccguagcugcuacagucuccaggca

SEQ ID NO: 440764 - RNA, 32 nt, Human
gccucaaccucccagguucaagcgauucuccu

SEQ ID NO: 440765 - RNA, 32 nt, Human
gccucaaccuccuggguucaagugauucuccc

SEQ ID NO: 440766 - RNA, 32 nt, Human
gccucaaccuggaccugacaccaacuucgccg

SEQ ID NO: 440767 - RNA, 32 nt, Human
gccucaaccuucuggguucaagcgauccuccc

SEQ ID NO: 440768 - RNA, 24 nt, Human
gccucaacguccucaucugucaaa

SEQ ID NO: 440769 - RNA, 22 nt, Human
gccucaacugcugccccaggca

SEQ ID NO: 440770 - RNA, 32 nt, Human
gccucaacuuaggaugggcaacugugucaagu

SEQ ID NO: 440771 - RNA, 32 nt, Human
gccucaacuuccucaucugcaaaaucagagca

SEQ ID NO: 440772 - RNA, 21 nt, Human
gccucaacuuccuggacucaa

SEQ ID NO: 440773 - RNA, 21 nt, Human
gccucaacuuccugggcucaa

SEQ ID NO: 440774 - RNA, 24 nt, Human
gccucaagagauccucucaccuca

SEQ ID NO: 440775 - RNA, 32 nt, Human
gccucaagaggaagauagacaggaggaggagg

SEQ ID NO: 440776 - RNA, 32 nt, Human
gccucaagaggugcacugcggugaccagugga

SEQ ID NO: 440777 - RNA, 24 nt, Human
gccucaagcaacccuccugccuca

SEQ ID NO: 440778 - RNA, 24 nt, Human
gccucaagcaauccacccaccuca

SEQ ID NO: 440779 - RNA, 24 nt, Human
gccucaagcaauccgccuaccuca

SEQ ID NO: 440780 - RNA, 24 nt, Human
gccucaagcaauccucccaccuca

SEQ ID NO: 440781 - RNA, 24 nt, Human
gccucaagcaauccucccaccuua

SEQ ID NO: 440782 - RNA, 24 nt, Human
gccucaagcaauccuccugccuca

SEQ ID NO: 440783 - RNA, 24 nt, Human
gccucaagcaauccuuccaccuca

SEQ ID NO: 440784 - RNA, 21 nt, Human
gccucaagcaguccccaccuc

SEQ ID NO: 440785 - RNA, 24 nt, Human
gccucaagcaguccucccaccuca

SEQ ID NO: 440786 - RNA, 24 nt, Human
gccucaagcaguccucccaccuua

SEQ ID NO: 440787 - RNA, 23 nt, Human
gccucaagcaguccucccacuuc

SEQ ID NO: 440788 - RNA, 22 nt, Human
gccucaagcaguccuccugucu

SEQ ID NO: 440789 - RNA, 32 nt, Human
gccucaagccaagauagugaauuuauaugaag

SEQ ID NO: 440790 - RNA, 24 nt, Human
gccucaagccauccucccaccuca

SEQ ID NO: 440791 - RNA, 23 nt, Human
gccucaagcgauccucccaccuc

SEQ ID NO: 440792 - RNA, 24 nt, Human
gccucaagcgauccucccaccuca

SEQ ID NO: 440793 - RNA, 31 nt, Human
gccucaagcuagagagaaaagagagugcgcu

SEQ ID NO: 440794 - RNA, 23 nt, Human
gccucaagcuggcagccuggcca

SEQ ID NO: 440795 - RNA, 24 nt, Human
gccucaagcuguccucccaucuca

SEQ ID NO: 440796 - RNA, 32 nt, Human
gccucaaggagcagaggaaggggcuggugacc

SEQ ID NO: 440797 - RNA, 31 nt, Human
gccucaaggcacuucuaggaccugccucuuc

SEQ ID NO: 440798 - RNA, 32 nt, Human
gccucaaggcuuuggcaagaucaaaggguugc

SEQ ID NO: 440799 - RNA, 32 nt, Human
gccucaagggagcgaggcgggagggugugugu

SEQ ID NO: 440800 - RNA, 21 nt, Human
gccucaagggcucccagggca

SEQ ID NO: 440801 - RNA, 32 nt, Human
gccucaaguaauccuccugccucagccuccca

SEQ ID NO: 440802 - RNA, 23 nt, Human
gccucaagucauuccccaccuua

SEQ ID NO: 440803 - RNA, 24 nt, Human
gccucaagugauccacccaccuca

SEQ ID NO: 440804 - RNA, 24 nt, Human
gccucaagugauccucccaccuua

SEQ ID NO: 440805 - RNA, 23 nt, Human
gccucaagugauccuccugccuc

SEQ ID NO: 440806 - RNA, 24 nt, Human
gccucaagugauccuccugccuca

SEQ ID NO: 440807 - RNA, 24 nt, Human
gccucaagugauccuccugccuua

SEQ ID NO: 440808 - RNA, 32 nt, Human
gccucaagugaucugccgccucagcuucucaa

SEQ ID NO: 440809 - RNA, 24 nt, Human
gccucaagugauucuccugccuca

SEQ ID NO: 440810 - RNA, 24 nt, Human
gccucaagugguccuccugccuca

SEQ ID NO: 440811 - RNA, 24 nt, Human
gccucaaguguucugcccaccuca

SEQ ID NO: 440812 - RNA, 32 nt, Human
gccucaaucgcuaaguuccacucuccauccuc

SEQ ID NO: 440813 - RNA, 19 nt, Human
gccucaaucucccacccca

SEQ ID NO: 440814 - RNA, 23 nt, Human
gccucaaucucccaucugugaaa

SEQ ID NO: 440815 - RNA, 32 nt, Human
gccucaaugccaccuccccacaccacccaagc

SEQ ID NO: 440816 - RNA, 32 nt, Human
gccucaaugucacuuggcggcgggguggggug

SEQ ID NO: 440817 - RNA, 32 nt, Human
gccucaauguuuacugugccuuuguuuuugcu

SEQ ID NO: 440818 - RNA, 23 nt, Human
gccucaauuuccucaucuugaaa

SEQ ID NO: 440819 - RNA, 24 nt, Human
gccucaauuucuucaucugucaaa

SEQ ID NO: 440820 - RNA, 32 nt, Human
gccucacaacagccuccacaggcacagcucca

SEQ ID NO: 440821 - RNA, 32 nt, Human
gccucacaagaggcuucuuccacggggcuuga

SEQ ID NO: 440822 - RNA, 32 nt, Human
gccucacacagccgaggcgggcucggcgcaca

SEQ ID NO: 440823 - RNA, 32 nt, Human
gccucacacccugucuggcaugccugacuguu

SEQ ID NO: 440824 - RNA, 32 nt, Human
gccucacaccuguaaucccagcacuuuggggg

SEQ ID NO: 440825 - RNA, 32 nt, Human
gccucacaccuguaaucucagcacuuugggug

SEQ ID NO: 440826 - RNA, 32 nt, Human
gccucacaccuguaauuccagcacuuugggag

SEQ ID NO: 440827 - RNA, 32 nt, Human
gccucacacgcagccacuucuucaagagcugc

SEQ ID NO: 440828 - RNA, 32 nt, Human
gccucacagaaaacauuguuccucccuccaca

SEQ ID NO: 440829 - RNA, 22 nt, Human
gccucacagaagagguggggac

SEQ ID NO: 440830 - RNA, 32 nt, Human
gccucacagaguuuagacaugacuagccagcu

SEQ ID NO: 440831 - RNA, 32 nt, Human
gccucacagauguccacaaaaugccuuauuuu

SEQ ID NO: 440832 - RNA, 32 nt, Human
gccucacagcagacucuccacgcccagcuagc

SEQ ID NO: 440833 - RNA, 32 nt, Human
gccucacagcagauucuucacgcccagccucu

SEQ ID NO: 440834 - RNA, 32 nt, Human
gccucacagcagauucuucacgcccagcuucu

SEQ ID NO: 440835 - RNA, 32 nt, Human
gccucacagcggacucuccacgcccagcuagc

SEQ ID NO: 440836 - RNA, 32 nt, Human
gccucacagcugacagcgccagucccaggucc

SEQ ID NO: 440837 - RNA, 32 nt, Human
gccucacaggaaaaaugauccgaagacgaaca

SEQ ID NO: 440838 - RNA, 32 nt, Human
gccucacaggcagacucgcagacggggcagug

SEQ ID NO: 440839 - RNA, 32 nt, Human
gccucacaggcagaguuccagggucagagagc

SEQ ID NO: 440840 - RNA, 32 nt, Human
gccucacaggcgcccgcaaguguucaccacga

SEQ ID NO: 440841 - RNA, 16 nt, Human
gccucacagggaggca

SEQ ID NO: 440842 - RNA, 32 nt, Human
gccucacagucugcaagccugcucacccacug

SEQ ID NO: 440843 - RNA, 32 nt, Human
gccucacagugaccucuccaggcacagcuccu

SEQ ID NO: 440844 - RNA, 32 nt, Human
gccucacaguggacucuccacgcccagcuagc

SEQ ID NO: 440845 - RNA, 32 nt, Human
gccucacaucuguaaucccaacacuuugggag

SEQ ID NO: 440846 - RNA, 32 nt, Human
gccucacaucuguaaucccagcacuuugggag

SEQ ID NO: 440847 - RNA, 32 nt, Human
gccucaccaaaguguugggauuacugguguga

SEQ ID NO: 440848 - RNA, 32 nt, Human
gccucacccaagaagacuggaaagagacauau

SEQ ID NO: 440849 - RNA, 32 nt, Human
gccucacccacugcagggccaggcucucaguc

SEQ ID NO: 440850 - RNA, 32 nt, Human
gccucacccaguagcugggaaauuaggugggg

SEQ ID NO: 440851 - RNA, 32 nt, Human
gccucaccccggcuggagucaugugggccgcu

SEQ ID NO: 440852 - RNA, 32 nt, Human
gccucacccuggggacaugccuguugauaaca

SEQ ID NO: 440853 - RNA, 32 nt, Human
gccucaccgcgaccuggcugagcuucagucau

SEQ ID NO: 440854 - RNA, 32 nt, Human
gccucaccgugccuucagaggcuucuuccugc

SEQ ID NO: 440855 - RNA, 32 nt, Human
gccucaccuaggaagugguaucugagcggaga

SEQ ID NO: 440856 - RNA, 32 nt, Human
gccucaccugcagggcguccccagcuaacacc

SEQ ID NO: 440857 - RNA, 32 nt, Human
gccucaccuguaauccaaguacuuugggaggc

SEQ ID NO: 440858 - RNA, 32 nt, Human
gccucacgcacucuccccuugggacaguagug

SEQ ID NO: 440859 - RNA, 32 nt, Human
gccucacgccuguaaucccagcacuuugggag

SEQ ID NO: 440860 - RNA, 32 nt, Human
gccucacgccugucaucccagcacuuugggag

SEQ ID NO: 440861 - RNA, 32 nt, Human
gccucacgugcagacccugccaugcagaccca

SEQ ID NO: 440862 - RNA, 32 nt, Human
gccucacuacaaccccugccuccuggguuuua

SEQ ID NO: 440863 - RNA, 32 nt, Human
gccucacucauggccuuccuauguuugggaaa

SEQ ID NO: 440864 - RNA, 22 nt, Human
gccucacuccaccuuccuucca

SEQ ID NO: 440865 - RNA, 32 nt, Human
gccucacuccccucagccccugccgaccuuag

SEQ ID NO: 440866 - RNA, 32 nt, Human
gccucacugcaaccuccgccucccagguucaa

SEQ ID NO: 440867 - RNA, 32 nt, Human
gccucacugcaaccuucaccuaccgaguucaa

SEQ ID NO: 440868 - RNA, 32 nt, Human
gccucacugcaacgccugccucucaggcucaa

SEQ ID NO: 440869 - RNA, 32 nt, Human
gccucacugcaacuugcgccucccggguucaa

SEQ ID NO: 440870 - RNA, 32 nt, Human
gccucacugcaagcacugcaugggcaagcuug

SEQ ID NO: 440871 - RNA, 32 nt, Human
gccucacugcauaagggaugggaucagagaac

SEQ ID NO: 440872 - RNA, 32 nt, Human
gccucacuugaccuagucauggcaggacaacu

SEQ ID NO: 440873 - RNA, 32 nt, Human
gccucacuuucuucuagcugagcuuuaaauca

SEQ ID NO: 440874 - RNA, 32 nt, Human
gccucagaaaacagcaggcuguuucucagauc

SEQ ID NO: 440875 - RNA, 19 nt, Human
gccucagaacagaugcaug

SEQ ID NO: 440876 - RNA, 32 nt, Human
gccucagaacccacccucccugggggacccuc

SEQ ID NO: 440877 - RNA, 24 nt, Human
gccucagaagccugcgaccuuggg

SEQ ID NO: 440878 - RNA, 32 nt, Human
gccucagaaguuguugugcaauaaaagguuga

SEQ ID NO: 440879 - RNA, 21 nt, Human
gccucagacaagaacucuggg

SEQ ID NO: 440880 - RNA, 21 nt, Human
gccucagacacaggccccugg

SEQ ID NO: 440881 - RNA, 22 nt, Human
gccucagacacccugccugugg

SEQ ID NO: 440882 - RNA, 23 nt, Human
gccucagaccacacagggugcag

SEQ ID NO: 440883 - RNA, 21 nt, Human
gccucagacgagacccaaggg

SEQ ID NO: 440884 - RNA, 32 nt, Human
gccucagacuccaagcuaggcugaggcucagg

SEQ ID NO: 440885 - RNA, 32 nt, Human
gccucagacuccugaguaucugggaccacagg

SEQ ID NO: 440886 - RNA, 32 nt, Human
gccucagacuccuggguucaagcaauccuccu

SEQ ID NO: 440887 - RNA, 32 nt, Human
gccucagacugucaccccuaccaguucccaag

SEQ ID NO: 440888 - RNA, 32 nt, Human
gccucagagaagauggagucuugcucugucac

SEQ ID NO: 440889 - RNA, 32 nt, Human
gccucagagauguggaggagaagccaggcaga

SEQ ID NO: 440890 - RNA, 23 nt, Human
gccucagagccaacacccgcucg

SEQ ID NO: 440891 - RNA, 32 nt, Human
gccucagagccuguccugccuccgcucccugg

SEQ ID NO: 440892 - RNA, 21 nt, Human
gccucagaggcccgcacaaug

SEQ ID NO: 440893 - RNA, 32 nt, Human
gccucagaguccagauaaagcaguuaacaugu

SEQ ID NO: 440894 - RNA, 32 nt, Human
gccucagauccaggcaggagcacgaggucugg

SEQ ID NO: 440895 - RNA, 32 nt, Human
gccucagauccugucuuuagcaaccagcuaau

SEQ ID NO: 440896 - RNA, 32 nt, Human
gccucagaugacaaaugaggcuaauggacaua

SEQ ID NO: 440897 - RNA, 21 nt, Human
gccucagaugcuggggcccag

SEQ ID NO: 440898 - RNA, 32 nt, Human
gccucagaugggaagaagucagaggaaccaga

SEQ ID NO: 440899 - RNA, 25 nt, Human
gccucagauuuccucaccugugaaa

SEQ ID NO: 440900 - RNA, 32 nt, Human
gccucagcaccacccuccaucccugcccaacc

SEQ ID NO: 440901 - RNA, 32 nt, Human
gccucagcacuccccaaaacaucccauuuugc

SEQ ID NO: 440902 - RNA, 32 nt, Human
gccucagcagaaagguggccuuggacaaaacu

SEQ ID NO: 440903 - RNA, 32 nt, Human
gccucagccaaagccuccagccuuucuccuuu

SEQ ID NO: 440904 - RNA, 32 nt, Human
gccucagccacuuugugcaaaggacugcagag

SEQ ID NO: 440905 - RNA, 32 nt, Human
gccucagccagcccaggauccguccucauuuu

SEQ ID NO: 440906 - RNA, 19 nt, Human
gccucagccaggcccacag

SEQ ID NO: 440907 - RNA, 30 nt, Human
gccucagccccaucucugcuccuguuugaa

SEQ ID NO: 440908 - RNA, 32 nt, Human
gccucagcccggccaaggagguggucagcucc

SEQ ID NO: 440909 - RNA, 18 nt, Human
gccucagcccuucccuga

SEQ ID NO: 440910 - RNA, 21 nt, Human
gccucagccucacccacagca

SEQ ID NO: 440911 - RNA, 32 nt, Human
gccucagccucucuuccuguguggaagcgggg

SEQ ID NO: 440912 - RNA, 19 nt, Human
gccucagccuggcccaggg

SEQ ID NO: 440913 - RNA, 18 nt, Human
gccucagccugugugcug

SEQ ID NO: 440914 - RNA, 22 nt, Human
gccucagccuuacacccaagca

SEQ ID NO: 440915 - RNA, 32 nt, Human
gccucagccuuuaggagcuuuccuuuuuaaaa

SEQ ID NO: 440916 - RNA, 32 nt, Human
gccucagcgaguagcugagacuaccggcgcac

SEQ ID NO: 440917 - RNA, 32 nt, Human
gccucagcggaccacucuucucuccaaggaaa

SEQ ID NO: 440918 - RNA, 23 nt, Human
gccucagcuacucaagaggcuga

SEQ ID NO: 440919 - RNA, 23 nt, Human
gccucagcuacucaggaggcuga

SEQ ID NO: 440920 - RNA, 23 nt, Human
gccucagcuacucgggaggcuga

SEQ ID NO: 440921 - RNA, 32 nt, Human
gccucagcucacuugaggcacccuuuggaucu

SEQ ID NO: 440922 - RNA, 24 nt, Human
gccucagcuccaccaccucccuca

SEQ ID NO: 440923 - RNA, 32 nt, Human
gccucagcuccaccaccucccucacccucccc

SEQ ID NO: 440924 - RNA, 32 nt, Human
gccucagcucuuggugggcccagggacaccca

SEQ ID NO: 440925 - RNA, 32 nt, Human
gccucagcugaaugccuccuguggggaaaggg

SEQ ID NO: 440926 - RNA, 32 nt, Human
gccucagcugggggaaaggcaguucuggugcu

SEQ ID NO: 440927 - RNA, 32 nt, Human
gccucagcugucaccagcacuuuugaccaagu

SEQ ID NO: 440928 - RNA, 32 nt, Human
gccucagcugugggggccucaggcaggucccu

SEQ ID NO: 440929 - RNA, 23 nt, Human
gccucagcuucaccacccuggcu

SEQ ID NO: 440930 - RNA, 32 nt, Human
gccucaggaaagaacuuccccuucccugucuc

SEQ ID NO: 440931 - RNA, 32 nt, Human
gccucaggacccaacucccacaggucagagaa

SEQ ID NO: 440932 - RNA, 32 nt, Human
gccucaggagacaggaggauggcuugagcccu

SEQ ID NO: 440933 - RNA, 32 nt, Human
gccucaggagcaguguggaggaagaugagggc

SEQ ID NO: 440934 - RNA, 32 nt, Human
gccucaggaggcaguggcuuggagcagaggug

SEQ ID NO: 440935 - RNA, 32 nt, Human
gccucaggagggcucugcuccacccacuuggc

SEQ ID NO: 440936 - RNA, 32 nt, Human
gccucaggagguugaggcugcagugagcugug

SEQ ID NO: 440937 - RNA, 32 nt, Human
gccucaggaguggaugcgaucugucucuccug

SEQ ID NO: 440938 - RNA, 32 nt, Human
gccucaggaugaggcagaaggaaggguaaggg

SEQ ID NO: 440939 - RNA, 32 nt, Human
gccucaggcauuuucuacucagcugugaccuu

SEQ ID NO: 440940 - RNA, 32 nt, Human
gccucaggccagggcucaccagcugggguccu

SEQ ID NO: 440941 - RNA, 32 nt, Human
gccucaggcccagacuuggguguuacaggaac

SEQ ID NO: 440942 - RNA, 32 nt, Human
gccucaggcccaggcacugauuguggcagagg

SEQ ID NO: 440943 - RNA, 32 nt, Human
gccucaggcccccagcccuguggcuuccaccu

SEQ ID NO: 440944 - RNA, 32 nt, Human
gccucaggccugaaaccaacaaaagccucaag

SEQ ID NO: 440945 - RNA, 32 nt, Human
gccucaggccuggcaggcagaagcagcugugg

SEQ ID NO: 440946 - RNA, 32 nt, Human
gccucaggcgccuucuacacacugcugcagac

SEQ ID NO: 440947 - RNA, 32 nt, Human
gccucaggcuauacuccagcuggccaaggcug

SEQ ID NO: 440948 - RNA, 23 nt, Human
gccucaggcuccagccccagugg

SEQ ID NO: 440949 - RNA, 24 nt, Human
gccucaggcuucugcagcccaggg

SEQ ID NO: 440950 - RNA, 26 nt, Human
gccucaggcuucugcagcccagggca

SEQ ID NO: 440951 - RNA, 17 nt, Human
gccucagggacugcagc

SEQ ID NO: 440952 - RNA, 32 nt, Human
gccucagggagcuugcauacaugugggccagc

SEQ ID NO: 440953 - RNA, 32 nt, Human
gccucagggauggccuguucagcugcugggug

SEQ ID NO: 440954 - RNA, 32 nt, Human
gccucagggcagcucaccugaccugcacccag

SEQ ID NO: 440955 - RNA, 23 nt, Human
gccucagggccaggaaggacaga

SEQ ID NO: 440956 - RNA, 32 nt, Human
gccucagggccuggcccuccugcaugcuaugc

SEQ ID NO: 440957 - RNA, 32 nt, Human
gccucagggggcuucucacugcauuauccacu

SEQ ID NO: 440958 - RNA, 32 nt, Human
gccucagguagaagaagaaaggugccacuccg

SEQ ID NO: 440959 - RNA, 20 nt, Human
gccucaggucaggccagggc

SEQ ID NO: 440960 - RNA, 19 nt, Human
gccucaggucuggcugcug

SEQ ID NO: 440961 - RNA, 24 nt, Human
gccucaggugauccacccaccuca

SEQ ID NO: 440962 - RNA, 32 nt, Human
gccucaggugugauccgcccgccuccgccucc

SEQ ID NO: 440963 - RNA, 18 nt, Human
gccucaguaccaccagcc

SEQ ID NO: 440964 - RNA, 32 nt, Human
gccucaguaggaaugccaccuuccauaucauc

SEQ ID NO: 440965 - RNA, 32 nt, Human
gccucaguauucucaucugucauggcggccaa

SEQ ID NO: 440966 - RNA, 25 nt, Human
gccucagucccccuuaucugugaaa

SEQ ID NO: 440967 - RNA, 32 nt, Human
gccucaguccucagcacccagcacccagugcu

SEQ ID NO: 440968 - RNA, 32 nt, Human
gccucagucucccaagcagcugggauuguagg

SEQ ID NO: 440969 - RNA, 32 nt, Human
gccucagucucccaaguagcugggguuacagg

SEQ ID NO: 440970 - RNA, 32 nt, Human
gccucagucugcccuugggcucaggccccuag

SEQ ID NO: 440971 - RNA, 32 nt, Human
gccucagucugccgaguagcugggauuacagg

SEQ ID NO: 440972 - RNA, 32 nt, Human
gccucagugaaauaugcauauguauaucauga

SEQ ID NO: 440973 - RNA, 23 nt, Human
gccucaguguucucaucuaugaa

SEQ ID NO: 440974 - RNA, 24 nt, Human
gccucaguguucucaucuaugaaa

SEQ ID NO: 440975 - RNA, 24 nt, Human
gccucaguucgcucaccugugaaa

SEQ ID NO: 440976 - RNA, 32 nt, Human
gccucaguugagccacugugcccagccuuagg

SEQ ID NO: 440977 - RNA, 24 nt, Human
gccucaguuuacucaucugugaag

SEQ ID NO: 440978 - RNA, 18 nt, Human
gccucaguuucaagguaa

SEQ ID NO: 440979 - RNA, 19 nt, Human
gccucaguuuccccaggga

SEQ ID NO: 440980 - RNA, 23 nt, Human
gccucaguuuccccaucuggaaa

SEQ ID NO: 440981 - RNA, 24 nt, Human
gccucaguuucccucuccaugaag

SEQ ID NO: 440982 - RNA, 22 nt, Human
gccucaguuucccucugugaag

SEQ ID NO: 440983 - RNA, 24 nt, Human
gccucaguuuccuaaagugugaaa

SEQ ID NO: 440984 - RNA, 19 nt, Human
gccucaguuuccucaucug

SEQ ID NO: 440985 - RNA, 24 nt, Human
gccucaguuuccucaucugcagaa

SEQ ID NO: 440986 - RNA, 20 nt, Human
gccucaguuuccucaucugu

SEQ ID NO: 440987 - RNA, 24 nt, Human
gccucaguuuccucaucugucaaa

SEQ ID NO: 440988 - RNA, 21 nt, Human
gccucaguuuccucauuuuga

SEQ ID NO: 440989 - RNA, 24 nt, Human
gccucaguuuccugaccuaugaaa

SEQ ID NO: 440990 - RNA, 20 nt, Human
gccucaguuuccuuaucugu

SEQ ID NO: 440991 - RNA, 22 nt, Human
gccucaguuuccuuaugugaaa

SEQ ID NO: 440992 - RNA, 23 nt, Human
gccucaguuucuccccuguggaa

SEQ ID NO: 440993 - RNA, 32 nt, Human
gccucaguuucugcgacuaugaaaauuacuag

SEQ ID NO: 440994 - RNA, 24 nt, Human
gccucaguuugcccaccugugaaa

SEQ ID NO: 440995 - RNA, 24 nt, Human
gccucaguuuucccagcuaugaaa

SEQ ID NO: 440996 - RNA, 20 nt, Human
gccucaguuuucucaucugu

SEQ ID NO: 440997 - RNA, 23 nt, Human
gccucaguuuuuucauccugaaa

SEQ ID NO: 440998 - RNA, 32 nt, Human
gccucauaagggcuggagugcuguggugccau

SEQ ID NO: 440999 - RNA, 32 nt, Human
gccucauacuccugggcucaagcaauccuccu

SEQ ID NO: 441000 - RNA, 19 nt, Human
gccucauauuucuuugaua

SEQ ID NO: 441001 - RNA, 32 nt, Human
gccucaucagacccuucuccaugcacauccuu

SEQ ID NO: 441002 - RNA, 32 nt, Human
gccucaucauuucauuccuuggcuccaaaccu

SEQ ID NO: 441003 - RNA, 32 nt, Human
gccucauccucauugcuucugccuccacguaa

SEQ ID NO: 441004 - RNA, 32 nt, Human
gccucauccuccccaggaccccuguccaggau

SEQ ID NO: 441005 - RNA, 17 nt, Human
gccucauccuguccagg

SEQ ID NO: 441006 - RNA, 32 nt, Human
gccucaucucagcagccugggcucggcauucc

SEQ ID NO: 441007 - RNA, 23 nt, Human
gccucaucuggaaaacggggaca

SEQ ID NO: 441008 - RNA, 32 nt, Human
gccucaucuggcugggaucuccaaggggccuc

SEQ ID NO: 441009 - RNA, 32 nt, Human
gccucaucugugcagaaguggcagcagagagg

SEQ ID NO: 441010 - RNA, 20 nt, Human
gccucaucuuccuacaugaa

SEQ ID NO: 441011 - RNA, 32 nt, Human
gccucaugagccacuucagaccagccaggugu

SEQ ID NO: 441012 - RNA, 20 nt, Human
gccucaugccuauaauccca

SEQ ID NO: 441013 - RNA, 32 nt, Human
gccucaugccuauaaucccagcacuuuggaag

SEQ ID NO: 441014 - RNA, 32 nt, Human
gccucaugccuauaaucccagcacuuugggag

SEQ ID NO: 441015 - RNA, 32 nt, Human
gccucaugccugcaauccuagcacuuugggag

SEQ ID NO: 441016 - RNA, 20 nt, Human
gccucaugccuguaauccca

SEQ ID NO: 441017 - RNA, 32 nt, Human
gccucaugccuguaaucccagcacuuucggag

SEQ ID NO: 441018 - RNA, 32 nt, Human
gccucaugccuguaaucccagcacuuugggag

SEQ ID NO: 441019 - RNA, 32 nt, Human
gccucaugccuguaauccuagcaccuugggag

SEQ ID NO: 441020 - RNA, 32 nt, Human
gccucaugccuguaauuccagcacuuugggag

SEQ ID NO: 441021 - RNA, 32 nt, Human
gccucaugccuguagucccagcacuuuggggg

SEQ ID NO: 441022 - RNA, 30 nt, Human
gccucauggaguguacaaucugcaacgaga

SEQ ID NO: 441023 - RNA, 32 nt, Human
gccucauguggguggucacgggagggugugag

SEQ ID NO: 441024 - RNA, 32 nt, Human
gccucauucaugagcuggucagcguuucgucu

SEQ ID NO: 441025 - RNA, 22 nt, Human
gccucauuccagcgccccaagg

SEQ ID NO: 441026 - RNA, 32 nt, Human
gccucauucccccucugggcccugggcuccau

SEQ ID NO: 441027 - RNA, 32 nt, Human
gccucauuccuugaguuucacucuuccauuac

SEQ ID NO: 441028 - RNA, 32 nt, Human
gccucauucuaauaccuguucuuuggacaguc

SEQ ID NO: 441029 - RNA, 32 nt, Human
gccucauugccaccuccaccugcaggaaggcc

SEQ ID NO: 441030 - RNA, 32 nt, Human
gccucauuuccuccucuccugccugugaaagc

SEQ ID NO: 441031 - RNA, 18 nt, Human
gccuccaaaagcuccagu

SEQ ID NO: 441032 - RNA, 32 nt, Human
gccuccaaagcccauccuugggguucccccuc

SEQ ID NO: 441033 - RNA, 22 nt, Human
gccuccaaagccucccacccca

SEQ ID NO: 441034 - RNA, 32 nt, Human
gccuccaaagccucccaccccaccccacgcac

SEQ ID NO: 441035 - RNA, 32 nt, Human
gccuccaaaguacuaggguuacaggcaugagc

SEQ ID NO: 441036 - RNA, 32 nt, Human
gccuccaaagugcuggauuacaggcugagcua

SEQ ID NO: 441037 - RNA, 32 nt, Human
gccuccaaagugcugggauuacaggcccgagc

SEQ ID NO: 441038 - RNA, 32 nt, Human
gccuccaaagugcugggauuacaggugugagc

SEQ ID NO: 441039 - RNA, 32 nt, Human
gccuccaaagugcugggauugcaggcaugagc

SEQ ID NO: 441040 - RNA, 32 nt, Human
gccuccaaauagcccacauggucuccaugcca

SEQ ID NO: 441041 - RNA, 32 nt, Human
gccuccaaauccuugucucaggccugcaugug

SEQ ID NO: 441042 - RNA, 25 nt, Human
gccuccaaccaggacuuucuucuua

SEQ ID NO: 441043 - RNA, 32 nt, Human
gccuccaaccuucugcccuccugccaaaagau

SEQ ID NO: 441044 - RNA, 32 nt, Human
gccuccaacuagcugggauuacaggcacaagc

SEQ ID NO: 441045 - RNA, 21 nt, Human
gccuccaacuccugggcucaa

SEQ ID NO: 441046 - RNA, 32 nt, Human
gccuccaacuccugggcucaagcaauccaccu

SEQ ID NO: 441047 - RNA, 32 nt, Human
gccuccaacuccugggcucaagcaauccucuc

SEQ ID NO: 441048 - RNA, 32 nt, Human
gccuccaacuccuggguucaagggauccuccc

SEQ ID NO: 441049 - RNA, 32 nt, Human
gccuccaacucucugguucaagcgauucuccu

SEQ ID NO: 441050 - RNA, 32 nt, Human
gccuccaacucuuggguucaagcaacccugcc

SEQ ID NO: 441051 - RNA, 21 nt, Human
gccuccaagcccaagaggcca

SEQ ID NO: 441052 - RNA, 32 nt, Human
gccuccaagggugggccaggccgaagaaccua

SEQ ID NO: 441053 - RNA, 23 nt, Human
gccuccaagguuucacggcuucc

SEQ ID NO: 441054 - RNA, 32 nt, Human
gccuccaaguagcugggacuacaggcgcgugc

SEQ ID NO: 441055 - RNA, 32 nt, Human
gccuccaaguagcugggacuacaggcgugcgc

SEQ ID NO: 441056 - RNA, 32 nt, Human
gccuccaaguagcugggacuauaggcacgcac

SEQ ID NO: 441057 - RNA, 22 nt, Human
gccuccaauccugcuggcuuca

SEQ ID NO: 441058 - RNA, 32 nt, Human
gccuccaaucugauggggaagacauggccccu

SEQ ID NO: 441059 - RNA, 32 nt, Human
gccuccacacggggagcaaccagucagcuaac

SEQ ID NO: 441060 - RNA, 32 nt, Human
gccuccacagagaaaaacagggaagguaacaa

SEQ ID NO: 441061 - RNA, 32 nt, Human
gccuccacagcccagguggccccagaaaaugu

SEQ ID NO: 441062 - RNA, 32 nt, Human
gccuccacaguggauguaggaucccugcuccc

SEQ ID NO: 441063 - RNA, 32 nt, Human
gccuccaccaccacuggccaccaggcuggcgc

SEQ ID NO: 441064 - RNA, 32 nt, Human
gccuccaccagcccggcuccugccucacgcug

SEQ ID NO: 441065 - RNA, 32 nt, Human
gccuccacccacccuccugccucaccccugcg

SEQ ID NO: 441066 - RNA, 32 nt, Human
gccuccacccaccuauucccuuuccuggucac

SEQ ID NO: 441067 - RNA, 22 nt, Human
gccuccacccccaccagcccca

SEQ ID NO: 441068 - RNA, 32 nt, Human
gccuccacccccacuccagccucagcggggcc

SEQ ID NO: 441069 - RNA, 32 nt, Human
gccuccaccuccaggguucaagcgauucuccu

SEQ ID NO: 441070 - RNA, 32 nt, Human
gccuccaccucccagguucaagcaauucuccu

SEQ ID NO: 441071 - RNA, 32 nt, Human
gccuccaccucccagguucaagcaauucucgu

SEQ ID NO: 441072 - RNA, 32 nt, Human
gccuccaccucccagguucaagcgauucuccu

SEQ ID NO: 441073 - RNA, 32 nt, Human
gccuccaccucccaguuucaagcaauucucau

SEQ ID NO: 441074 - RNA, 32 nt, Human
gccuccaccuccccgguucaagugauucuccu

SEQ ID NO: 441075 - RNA, 32 nt, Human
gccuccaccucccggguucaaucaauucuccu

SEQ ID NO: 441076 - RNA, 32 nt, Human
gccuccaccuccuggguucaagcgauucuccu

SEQ ID NO: 441077 - RNA, 18 nt, Human
gccuccaccugcagcccc

SEQ ID NO: 441078 - RNA, 32 nt, Human
gccuccaccugccauggagaaguuuccgcuac

SEQ ID NO: 441079 - RNA, 32 nt, Human
gccuccacgugagagccagcuccgccgugacc

SEQ ID NO: 441080 - RNA, 32 nt, Human
gccuccacgugagagccggcuccgccgugacc

SEQ ID NO: 441081 - RNA, 32 nt, Human
gccuccacguucccucuccucucacccacacc

SEQ ID NO: 441082 - RNA, 32 nt, Human
gccuccacucagcucaauuccaguuuucuggc

SEQ ID NO: 441083 - RNA, 32 nt, Human
gccuccacucagcugcuucucagucaugaacg

SEQ ID NO: 441084 - RNA, 32 nt, Human
gccuccacucagcugcuucucagucaugaaug

SEQ ID NO: 441085 - RNA, 32 nt, Human
gccuccacugaucugaggagauccugugacug

SEQ ID NO: 441086 - RNA, 32 nt, Human
gccuccacugcaacaucuucuccuacgacuac

SEQ ID NO: 441087 - RNA, 32 nt, Human
gccuccacugcaccuucuuagggaagggcaug

SEQ ID NO: 441088 - RNA, 32 nt, Human
gccuccacuggguggagaaaggagacuugccc

SEQ ID NO: 441089 - RNA, 32 nt, Human
gccuccacuucccagguucaagugauucuccu

SEQ ID NO: 441090 - RNA, 32 nt, Human
gccuccacuuccugggcucaagcgauucuccu

SEQ ID NO: 441091 - RNA, 32 nt, Human
gccuccacuuccuggguucacaugauucuccu

SEQ ID NO: 441092 - RNA, 32 nt, Human
gccuccagaaaaggaagcuuuggagagauggg

SEQ ID NO: 441093 - RNA, 32 nt, Human
gccuccagaaccaugcccaggucuccugccuc

SEQ ID NO: 441094 - RNA, 32 nt, Human
gccuccagaagcaggggccuugagaugggagc

SEQ ID NO: 441095 - RNA, 32 nt, Human
gccuccagacacaaucgggccccacucgcaga

SEQ ID NO: 441096 - RNA, 22 nt, Human
gccuccagagcagcccacacca

SEQ ID NO: 441097 - RNA, 32 nt, Human
gccuccagaguacugggauuacaagagcccac

SEQ ID NO: 441098 - RNA, 32 nt, Human
gccuccagauucacacacacaaaagauaccau

SEQ ID NO: 441099 - RNA, 32 nt, Human
gccuccagcacgcugaggaugagcugcuguca

SEQ ID NO: 441100 - RNA, 19 nt, Human
gccuccagcagccguuccc

SEQ ID NO: 441101 - RNA, 21 nt, Human
gccuccagcaugagccugcag

SEQ ID NO: 441102 - RNA, 18 nt, Human
gccuccagccccacccca

SEQ ID NO: 441103 - RNA, 22 nt, Human
gccuccagccccucucuugucu

SEQ ID NO: 441104 - RNA, 32 nt, Human
gccuccagccugaccccagagcagaaccggaa

SEQ ID NO: 441105 - RNA, 32 nt, Human
gccuccagccugagacaucaggggagagccug

SEQ ID NO: 441106 - RNA, 32 nt, Human
gccuccagccugggugaccgagugagacuguu

SEQ ID NO: 441107 - RNA, 22 nt, Human
gccuccagcuccccugccgcag

SEQ ID NO: 441108 - RNA, 32 nt, Human
gccuccagcucccucucggccuggaggccuuc

SEQ ID NO: 441109 - RNA, 32 nt, Human
gccuccagcuccucagaccuccuggguggggu

SEQ ID NO: 441110 - RNA, 32 nt, Human
gccuccagcucucagccaggagguccccaacc

SEQ ID NO: 441111 - RNA, 32 nt, Human
gccuccagcuuggagaugaccugcugcagcuc

SEQ ID NO: 441112 - RNA, 23 nt, Human
gccuccagcuuggucugucuccc

SEQ ID NO: 441113 - RNA, 32 nt, Human
gccuccaggaaaucuugagagccugucuuggc

SEQ ID NO: 441114 - RNA, 32 nt, Human
gccuccaggaaaugcaaucccagagacaccgc

SEQ ID NO: 441115 - RNA, 32 nt, Human
gccuccaggagaauggagagaaagggcuucca

SEQ ID NO: 441116 - RNA, 32 nt, Human
gccuccaggagcagcaauccuaagagugggag

SEQ ID NO: 441117 - RNA, 32 nt, Human
gccuccaggccacauggggcugggcagcuacc

SEQ ID NO: 441118 - RNA, 32 nt, Human
gccuccaggcccauagaaggaggaggcaaccc

SEQ ID NO: 441119 - RNA, 21 nt, Human
gccuccaggcuccacucacca

SEQ ID NO: 441120 - RNA, 23 nt, Human
gccuccaggcucgcccgcccuga

SEQ ID NO: 441121 - RNA, 32 nt, Human
gccuccaggcuucuccuugacgucauuccucu

SEQ ID NO: 441122 - RNA, 21 nt, Human
gccuccaggggcagggccuug

SEQ ID NO: 441123 - RNA, 20 nt, Human
gccuccagguacgccgcagc

SEQ ID NO: 441124 - RNA, 32 nt, Human
gccuccagguauacuaccucagagaucaguga

SEQ ID NO: 441125 - RNA, 21 nt, Human
gccuccagucccccagccccu

SEQ ID NO: 441126 - RNA, 21 nt, Human
gccuccaguccgucucccccu

SEQ ID NO: 441127 - RNA, 21 nt, Human
gccuccaguccuucccuagcc

SEQ ID NO: 441128 - RNA, 32 nt, Human
gccuccagucugggaaagucaccaacccgcag

SEQ ID NO: 441129 - RNA, 21 nt, Human
gccuccagugagaacaggcag

SEQ ID NO: 441130 - RNA, 32 nt, Human
gccuccaguggagaacugggcuugcucagacg

SEQ ID NO: 441131 - RNA, 18 nt, Human
gccuccagugugugcacc

SEQ ID NO: 441132 - RNA, 32 nt, Human
gccuccauagcauugaaggccagccugcaucu

SEQ ID NO: 441133 - RNA, 17 nt, Human
gccuccauccauccaga

SEQ ID NO: 441134 - RNA, 32 nt, Human
gccuccauccccagaagaaacagcccccucug

SEQ ID NO: 441135 - RNA, 32 nt, Human
gccuccauccucuggguucaagcaauucuccu

SEQ ID NO: 441136 - RNA, 32 nt, Human
gccuccaucuggaaaugggaggaugaagaggc

SEQ ID NO: 441137 - RNA, 32 nt, Human
gccuccaugccuggcuaauuuuguauuuuuag

SEQ ID NO: 441138 - RNA, 32 nt, Human
gccuccauggugccucuggaggccucugggcc

SEQ ID NO: 441139 - RNA, 32 nt, Human
gccuccaugucaccacguggugaauggcugcc

SEQ ID NO: 441140 - RNA, 31 nt, Human
gccuccauguuucagcaucuaugucaugggc

SEQ ID NO: 441141 - RNA, 32 nt, Human
gccuccauuuugguguacuuucuuggaagaaa

SEQ ID NO: 441142 - RNA, 32 nt, Human
gccucccaaaauugcugggauuacagguguga

SEQ ID NO: 441143 - RNA, 32 nt, Human
gccucccaaagugccgccgggauuacaggcgu

SEQ ID NO: 441144 - RNA, 32 nt, Human
gccucccaaagugcugagauuauaggcaugag

SEQ ID NO: 441145 - RNA, 32 nt, Human
gccucccaaagugcugcugggauuacaggcgu

SEQ ID NO: 441146 - RNA, 32 nt, Human
gccucccaaagugcuggauuacaggcauaggc

SEQ ID NO: 441147 - RNA, 28 nt, Human
gccucccaaagugcuguauuuucuuauc

SEQ ID NO: 441148 - RNA, 32 nt, Human
gccucccaaauuugcugggauuccaggguuuu

SEQ ID NO: 441149 - RNA, 32 nt, Human
gccucccaacuucuccccaggccaaguauggg

SEQ ID NO: 441150 - RNA, 32 nt, Human
gccucccaacuuggucucacacaacaaaccuc

SEQ ID NO: 441151 - RNA, 26 nt, Human
gccucccaagcaauccucccaccuca

SEQ ID NO: 441152 - RNA, 32 nt, Human
gccucccaagcaauccucccaccucagccucu

SEQ ID NO: 441153 - RNA, 32 nt, Human
gccucccaagccccgcccucagaaagccaagu

SEQ ID NO: 441154 - RNA, 32 nt, Human
gccucccaaggagccaggacuacaggugcaug

SEQ ID NO: 441155 - RNA, 32 nt, Human
gccucccaaggcugggauuacagguaugcacc

SEQ ID NO: 441156 - RNA, 32 nt, Human
gccucccaaguacugggauuacaggugcccac

SEQ ID NO: 441157 - RNA, 32 nt, Human
gccucccaaguagcuggauuacaggugcaugc

SEQ ID NO: 441158 - RNA, 32 nt, Human
gccucccaagugcuaggauuacaggcaucagc

SEQ ID NO: 441159 - RNA, 32 nt, Human
gccucccaagugcugggauuacaggcgcgagc

SEQ ID NO: 441160 - RNA, 32 nt, Human
gccucccaagugcugggauuacaggcgugagc

SEQ ID NO: 441161 - RNA, 32 nt, Human
gccucccaauacucccuucuuccugcccccac

SEQ ID NO: 441162 - RNA, 32 nt, Human
gccucccaauugcuguuucagcagguuuuaaa

SEQ ID NO: 441163 - RNA, 20 nt, Human
gccucccaccaccaccauca

SEQ ID NO: 441164 - RNA, 32 nt, Human
gccucccacccacucuggggguccacaucaag

SEQ ID NO: 441165 - RNA, 32 nt, Human
gccucccacccauguagaacugugaguccauu

SEQ ID NO: 441166 - RNA, 18 nt, Human
gccucccaccccacccca

SEQ ID NO: 441167 - RNA, 32 nt, Human
gccucccacccucccugcaacaacagcccucu

SEQ ID NO: 441168 - RNA, 19 nt, Human
gccucccacuagaccaggc

SEQ ID NO: 441169 - RNA, 32 nt, Human
gccucccacugcaacuuuucagcucagggguu

SEQ ID NO: 441170 - RNA, 32 nt, Human
gccucccacuggcugcugcuuggccccaucuc

SEQ ID NO: 441171 - RNA, 32 nt, Human
gccucccagacccugagcuccagucugcacag

SEQ ID NO: 441172 - RNA, 32 nt, Human
gccucccagauguggaggagugaagccaccau

SEQ ID NO: 441173 - RNA, 32 nt, Human
gccucccagccauguggaacugcuggagugca

SEQ ID NO: 441174 - RNA, 32 nt, Human
gccucccagccauguggaacugugagucaauu

SEQ ID NO: 441175 - RNA, 24 nt, Human
gccucccagcccaacaucuccagc

SEQ ID NO: 441176 - RNA, 22 nt, Human
gccucccagcccagagcccagc

SEQ ID NO: 441177 - RNA, 20 nt, Human
gccucccagcccagcccagc

SEQ ID NO: 441178 - RNA, 22 nt, Human
gccucccagccccggcgcacgc

SEQ ID NO: 441179 - RNA, 23 nt, Human
gccucccagcccgcggcccgagc

SEQ ID NO: 441180 - RNA, 32 nt, Human
gccucccagccucuuucugagggaaaggacaa

SEQ ID NO: 441181 - RNA, 21 nt, Human
gccucccagccuggcugaagc

SEQ ID NO: 441182 - RNA, 19 nt, Human
gccucccagcgccccaacc

SEQ ID NO: 441183 - RNA, 32 nt, Human
gccucccagcuacuuaggaggcugaggcagga

SEQ ID NO: 441184 - RNA, 20 nt, Human
gccucccaggacauguucga

SEQ ID NO: 441185 - RNA, 32 nt, Human
gccucccaggagcagcggggcaguguggggcu

SEQ ID NO: 441186 - RNA, 28 nt, Human
gccucccaggagggagacgcuggggugc

SEQ ID NO: 441187 - RNA, 32 nt, Human
gccucccaggagggagacgcuggggugcaaaa

SEQ ID NO: 441188 - RNA, 19 nt, Human
gccucccaggcccaugccc

SEQ ID NO: 441189 - RNA, 20 nt, Human
gccucccagggcaccaggga

SEQ ID NO: 441190 - RNA, 31 nt, Human
gccucccagguccugggacacuuguaaaucu

SEQ ID NO: 441191 - RNA, 32 nt, Human
gccucccagguggcccgggagcugcagguggg

SEQ ID NO: 441192 - RNA, 32 nt, Human
gccucccaguagcugggauuagaggcaugugc

SEQ ID NO: 441193 - RNA, 32 nt, Human
gccucccaguccgcacaccucucccauccagg

SEQ ID NO: 441194 - RNA, 32 nt, Human
gccucccagugcugggauuauaggugugagcc

SEQ ID NO: 441195 - RNA, 32 nt, Human
gccucccaguuuggugggcaagugggggugau

SEQ ID NO: 441196 - RNA, 32 nt, Human
gccucccauagcugggacuacaggcgcccgcc

SEQ ID NO: 441197 - RNA, 32 nt, Human
gccuccccaaaccaauccuaaugucuuucuuc

SEQ ID NO: 441198 - RNA, 32 nt, Human
gccuccccaaagugcugagauuaggcguuagc

SEQ ID NO: 441199 - RNA, 32 nt, Human
gccuccccaaagugcugggaugacaggcauga

SEQ ID NO: 441200 - RNA, 32 nt, Human
gccuccccaaagugcugggauuacaggcauga

SEQ ID NO: 441201 - RNA, 32 nt, Human
gccuccccaaagugcugggauuacaggcguga

SEQ ID NO: 441202 - RNA, 32 nt, Human
gccuccccaaagugcugggauuacagguacaa

SEQ ID NO: 441203 - RNA, 32 nt, Human
gccuccccaagaggguaguuagggguggggaa

SEQ ID NO: 441204 - RNA, 20 nt, Human
gccuccccaccaccaccagc

SEQ ID NO: 441205 - RNA, 32 nt, Human
gccuccccacugaagaaaaagaugaaaaugau

SEQ ID NO: 441206 - RNA, 32 nt, Human
gccuccccacuuccacucacacccacuauggc

SEQ ID NO: 441207 - RNA, 32 nt, Human
gccuccccagcaccuagguggggccuggggua

SEQ ID NO: 441208 - RNA, 32 nt, Human
gccuccccagccacguggaacugaggcagcug

SEQ ID NO: 441209 - RNA, 32 nt, Human
gccuccccagcccugauauucuugaugucacc

SEQ ID NO: 441210 - RNA, 32 nt, Human
gccuccccagccugugggacugugagucaauu

SEQ ID NO: 441211 - RNA, 32 nt, Human
gccuccccagcugcuccuuaaauucuaagagu

SEQ ID NO: 441212 - RNA, 32 nt, Human
gccuccccagggacucugcccauguucccagg

SEQ ID NO: 441213 - RNA, 25 nt, Human
gccuccccaguuucugggacaccuu

SEQ ID NO: 441214 - RNA, 20 nt, Human
gccucccccacaagccccca

SEQ ID NO: 441215 - RNA, 32 nt, Human
gccucccccacuccacugugcacgguugaguu

SEQ ID NO: 441216 - RNA, 32 nt, Human
gccucccccaguagcugggacuacaggcgcgu

SEQ ID NO: 441217 - RNA, 32 nt, Human
gccucccccgucuccuaaaaggccagcagguc

SEQ ID NO: 441218 - RNA, 32 nt, Human
gccucccccugccucuucggcuguguuuucuc

SEQ ID NO: 441219 - RNA, 32 nt, Human
gccucccccuggaacugggacuggucucgguc

SEQ ID NO: 441220 - RNA, 32 nt, Human
gccucccccuggccagggccaucuccugucac

SEQ ID NO: 441221 - RNA, 32 nt, Human
gccucccccuguauucccccucccagggcagc

SEQ ID NO: 441222 - RNA, 32 nt, Human
gccuccccgcaaaaaguugugccugaggaaca

SEQ ID NO: 441223 - RNA, 32 nt, Human
gccuccccgcgcugccuaccucaggccugggg

SEQ ID NO: 441224 - RNA, 23 nt, Human
gccuccccgguggccagagccag

SEQ ID NO: 441225 - RNA, 32 nt, Human
gccuccccuccaccacuuccuucccugucccu

SEQ ID NO: 441226 - RNA, 32 nt, Human
gccuccccuccaccccugccucuccuccaccc

SEQ ID NO: 441227 - RNA, 32 nt, Human
gccuccccuccacuuccagucuguaccccucc

SEQ ID NO: 441228 - RNA, 32 nt, Human
gccuccccuccagggccuggcaaggcuggcuc

SEQ ID NO: 441229 - RNA, 19 nt, Human
gccuccccuccccacccca

SEQ ID NO: 441230 - RNA, 32 nt, Human
gccuccccuccccucuuugucacuuugguuuc

SEQ ID NO: 441231 - RNA, 32 nt, Human
gccuccccuccucugcuugccaucccucccuc

SEQ ID NO: 441232 - RNA, 32 nt, Human
gccuccccucgaaccgccaagcagaaaccgga

SEQ ID NO: 441233 - RNA, 32 nt, Human
gccuccccucgagguccuggucuuacuuagga

SEQ ID NO: 441234 - RNA, 32 nt, Human
gccuccccucugucucccuccugcucuggcca

SEQ ID NO: 441235 - RNA, 16 nt, Human
gccuccccugccacca

SEQ ID NO: 441236 - RNA, 23 nt, Human
gccuccccugccaccgccgccac

SEQ ID NO: 441237 - RNA, 32 nt, Human
gccuccccugccccugcuccagcuccaucccc

SEQ ID NO: 441238 - RNA, 32 nt, Human
gccuccccugccuccccugccugccuccugcc

SEQ ID NO: 441239 - RNA, 32 nt, Human
gccuccccuggggcuccugaugccaaggggcc

SEQ ID NO: 441240 - RNA, 32 nt, Human
gccuccccuucccaucccaccucccgagccuu

SEQ ID NO: 441241 - RNA, 32 nt, Human
gccuccccuuccccuccucuccccuccuuuuc

SEQ ID NO: 441242 - RNA, 32 nt, Human
gccuccccuugacggacggcuuggggagcggc

SEQ ID NO: 441243 - RNA, 32 nt, Human
gccucccgaaagugcugggauuacagucauga

SEQ ID NO: 441244 - RNA, 32 nt, Human
gccucccgagccaugcugacugugaguuaaua

SEQ ID NO: 441245 - RNA, 32 nt, Human
gccucccgagccuagauccuggcucggaccac

SEQ ID NO: 441246 - RNA, 32 nt, Human
gccucccgaguagcuggaacuauaggucaucu

SEQ ID NO: 441247 - RNA, 18 nt, Human
gccucccgcccgccgcgc

SEQ ID NO: 441248 - RNA, 19 nt, Human
gccucccgcuccgccgcgc

SEQ ID NO: 441249 - RNA, 21 nt, Human
gccucccgcucugggcgagcc

SEQ ID NO: 441250 - RNA, 32 nt, Human
gccucccgcugaaucuuggcucuugucuucuc

SEQ ID NO: 441251 - RNA, 23 nt, Human
gccucccggagugcagaccagag

SEQ ID NO: 441252 - RNA, 32 nt, Human
gccucccgggcacuucuccccaccucggcccc

SEQ ID NO: 441253 - RNA, 22 nt, Human
gccucccggguccaccgcaggu

SEQ ID NO: 441254 - RNA, 21 nt, Human
gccucccgguggacaccagcc

SEQ ID NO: 441255 - RNA, 19 nt, Human
gccucccgugccucugcca

SEQ ID NO: 441256 - RNA, 32 nt, Human
gccucccuaaaauacauaaaaccaagcugugc

SEQ ID NO: 441257 - RNA, 32 nt, Human
gccucccuaaaaugcgcguggaggcagcuggg

SEQ ID NO: 441258 - RNA, 32 nt, Human
gccucccuaaguugcugggauuacagguguga

SEQ ID NO: 441259 - RNA, 32 nt, Human
gccucccuaccauguggaacugugaguccaau

SEQ ID NO: 441260 - RNA, 32 nt, Human
gccucccuagccauggggacugugaguccauu

SEQ ID NO: 441261 - RNA, 15 nt, Human
gccucccuccacccc

SEQ ID NO: 441262 - RNA, 32 nt, Human
gccucccucccuucagcuuccugcugcacaga

SEQ ID NO: 441263 - RNA, 32 nt, Human
gccucccuccuccccuccuacucccuuuucuc

SEQ ID NO: 441264 - RNA, 32 nt, Human
gccucccuccucgccggccucaguuuaccacg

SEQ ID NO: 441265 - RNA, 32 nt, Human
gccucccuccugucuggcuccuggggcccaug

SEQ ID NO: 441266 - RNA, 32 nt, Human
gccucccucgcacacugggaggaggaagccgc

SEQ ID NO: 441267 - RNA, 32 nt, Human
gccucccucuacugcagacccucuaggacugg

SEQ ID NO: 441268 - RNA, 32 nt, Human
gccucccucugacuucugggcgccagauccug

SEQ ID NO: 441269 - RNA, 19 nt, Human
gccucccucugaggcuggu

SEQ ID NO: 441270 - RNA, 16 nt, Human
gccucccucugcugcc

SEQ ID NO: 441271 - RNA, 20 nt, Human
gccucccucuucucuccagg

SEQ ID NO: 441272 - RNA, 20 nt, Human
gccucccugacccuccacac

SEQ ID NO: 441273 - RNA, 32 nt, Human
gccucccugaguagcugggacuacaggcacac

SEQ ID NO: 441274 - RNA, 32 nt, Human
gccucccugagucucgcucuuuugcccaggcu

SEQ ID NO: 441275 - RNA, 32 nt, Human
gccucccugaguggcagggauuacaggaaccc

SEQ ID NO: 441276 - RNA, 19 nt, Human
gccucccugcagccaccag

SEQ ID NO: 441277 - RNA, 32 nt, Human
gccucccugcagccccaucuccuugggcgcca

SEQ ID NO: 441278 - RNA, 32 nt, Human
gccucccugcagcucagcgcagcccagggcuc

SEQ ID NO: 441279 - RNA, 32 nt, Human
gccucccugcagggcugcuccccagcccaaac

SEQ ID NO: 441280 - RNA, 32 nt, Human
gccucccugccccucugcuggcacagccuggg

SEQ ID NO: 441281 - RNA, 32 nt, Human
gccucccugccucacccagcagcgcccacagc

SEQ ID NO: 441282 - RNA, 32 nt, Human
gccucccugccucaucucuauucucauuccac

SEQ ID NO: 441283 - RNA, 32 nt, Human
gccucccugccuccagcccuggcugcaauguc

SEQ ID NO: 441284 - RNA, 32 nt, Human
gccucccugccucuggccauggccugccggug

SEQ ID NO: 441285 - RNA, 32 nt, Human
gccucccugccugcuucgcccuggacucguga

SEQ ID NO: 441286 - RNA, 32 nt, Human
gccucccugccugcuucuggccgccuugaaug

SEQ ID NO: 441287 - RNA, 32 nt, Human
gccucccugcgguccccacccugucuccaagc

SEQ ID NO: 441288 - RNA, 32 nt, Human
gccucccugcugagaauauucucccuuuagca

SEQ ID NO: 441289 - RNA, 21 nt, Human
gccucccuggccggggcucag

SEQ ID NO: 441290 - RNA, 32 nt, Human
gccucccugggccaccuccuaccccuuccugu

SEQ ID NO: 441291 - RNA, 19 nt, Human
gccucccugggccgcuggu

SEQ ID NO: 441292 - RNA, 32 nt, Human
gccucccugucuccagcugccugggcccggaa

SEQ ID NO: 441293 - RNA, 32 nt, Human
gccucccugugccggacuccagccggggcgac

SEQ ID NO: 441294 - RNA, 32 nt, Human
gccucccuucaagccuucaagucuguguagag

SEQ ID NO: 441295 - RNA, 22 nt, Human
gccucccuuccagcucugcagc

SEQ ID NO: 441296 - RNA, 17 nt, Human
gccucccuuccaugccc

SEQ ID NO: 441297 - RNA, 32 nt, Human
gccucccuuccccauucccaugcagcuccuuu

SEQ ID NO: 441298 - RNA, 32 nt, Human
gccucccuucccucagaccucucccucauaau

SEQ ID NO: 441299 - RNA, 32 nt, Human
gccucccuucgcucagcuucuccgcgccccug

SEQ ID NO: 441300 - RNA, 32 nt, Human
gccucccuucuguuuccugggcugcaggggag

SEQ ID NO: 441301 - RNA, 32 nt, Human
gccucccuugcagcucagguuuccuggcuucu

SEQ ID NO: 441302 - RNA, 32 nt, Human
gccucccuugcucucccugaggguggccugcc

SEQ ID NO: 441303 - RNA, 24 nt, Human
gccucccuugggcaucuucaugca

SEQ ID NO: 441304 - RNA, 21 nt, Human
gccucccuugucaccuucccu

SEQ ID NO: 441305 - RNA, 32 nt, Human
gccucccuuuucagagcacagcauuaaaguuu

SEQ ID NO: 441306 - RNA, 32 nt, Human
gccucccuuuucuccucuccccaauccaugcu

SEQ ID NO: 441307 - RNA, 17 nt, Human
gccuccgaaccaugccc

SEQ ID NO: 441308 - RNA, 32 nt, Human
gccuccgaaguagcugggaauuacaggcaccc

SEQ ID NO: 441309 - RNA, 32 nt, Human
gccuccgacuccugcuggcuccaggaaccggc

SEQ ID NO: 441310 - RNA, 32 nt, Human
gccuccgacuggcuggagcugcccccuccagg

SEQ ID NO: 441311 - RNA, 32 nt, Human
gccuccgagauagcugagggaaguucuuugcc

SEQ ID NO: 441312 - RNA, 19 nt, Human
gccuccgagcagcccgcca

SEQ ID NO: 441313 - RNA, 32 nt, Human
gccuccgaguagcugggaccacaggggcccgg

SEQ ID NO: 441314 - RNA, 32 nt, Human
gccuccgaguagcugggacuacaggugcacgc

SEQ ID NO: 441315 - RNA, 32 nt, Human
gccuccgaguagcugggacuacaggugugagu

SEQ ID NO: 441316 - RNA, 32 nt, Human
gccuccgcagaugaggcuacugccucacaaca

SEQ ID NO: 441317 - RNA, 18 nt, Human
gccuccgcauccacaccc

SEQ ID NO: 441318 - RNA, 22 nt, Human
gccuccgccacagccgccgccu

SEQ ID NO: 441319 - RNA, 32 nt, Human
gccuccgccaccuggguucaagcaauucuccu

SEQ ID NO: 441320 - RNA, 19 nt, Human
gccuccgccagcccucccu

SEQ ID NO: 441321 - RNA, 20 nt, Human
gccuccgccccgccaggccc

SEQ ID NO: 441322 - RNA, 18 nt, Human
gccuccgccccgcgcuca

SEQ ID NO: 441323 - RNA, 32 nt, Human
gccuccgcccuccgcccucggacuaucucuug

SEQ ID NO: 441324 - RNA, 20 nt, Human
gccuccgcccuuggggcccu

SEQ ID NO: 441325 - RNA, 16 nt, Human
gccuccgccgccgccc

SEQ ID NO: 441326 - RNA, 18 nt, Human
gccuccgccgccucgccc

SEQ ID NO: 441327 - RNA, 32 nt, Human
gccuccgccgccugcuccaccucgagggacgc

SEQ ID NO: 441328 - RNA, 32 nt, Human
gccuccgccgcucccagucccgccagacccga

SEQ ID NO: 441329 - RNA, 32 nt, Human
gccuccgccucccagguucaagcgauucuccu

SEQ ID NO: 441330 - RNA, 32 nt, Human
gccuccgccucccggguucaagcaauucucau

SEQ ID NO: 441331 - RNA, 32 nt, Human
gccuccgccucccggguucaagcgauucuccc

SEQ ID NO: 441332 - RNA, 32 nt, Human
gccuccgccuccugggcucaagcaauucuccc

SEQ ID NO: 441333 - RNA, 32 nt, Human
gccuccgccuccuggguucaagcaauucuacc

SEQ ID NO: 441334 - RNA, 32 nt, Human
gccuccgccuccuggguucaagugauucuccu

SEQ ID NO: 441335 - RNA, 32 nt, Human
gccuccgccuccuggguucaagugguucuccu

SEQ ID NO: 441336 - RNA, 32 nt, Human
gccuccgccugccucgacuuccccacagcgcu

SEQ ID NO: 441337 - RNA, 32 nt, Human
gccuccgccuucuccccucccgcgagccuccu

SEQ ID NO: 441338 - RNA, 32 nt, Human
gccuccgccuucuggguucaagcaauucuccu

SEQ ID NO: 441339 - RNA, 32 nt, Human
gccuccgccuugcccaaggccacggagggcgu

SEQ ID NO: 441340 - RNA, 17 nt, Human
gccuccgcgccaggccc

SEQ ID NO: 441341 - RNA, 22 nt, Human
gccuccgcgcggccucccgccc

SEQ ID NO: 441342 - RNA, 32 nt, Human
gccuccgcguccacccagcccaggaggaagac

SEQ ID NO: 441343 - RNA, 32 nt, Human
gccuccgcucacugcgugcaccuggcgcugcc

SEQ ID NO: 441344 - RNA, 18 nt, Human
gccuccgcuccagcgccc

SEQ ID NO: 441345 - RNA, 19 nt, Human
gccuccgcucccaacgccc

SEQ ID NO: 441346 - RNA, 17 nt, Human
gccuccgcuccccgccc

SEQ ID NO: 441347 - RNA, 22 nt, Human
gccuccgcucucucggggcacc

SEQ ID NO: 441348 - RNA, 32 nt, Human
gccuccgcuucccugguucaagcgauucucuu

SEQ ID NO: 441349 - RNA, 32 nt, Human
gccuccgcuuccgggguucaagcgauucuccu

SEQ ID NO: 441350 - RNA, 32 nt, Human
gccuccgcuuccuggguucaagcaauucuccc

SEQ ID NO: 441351 - RNA, 32 nt, Human
gccuccgcuuccuggguucaagcgauucuccu

SEQ ID NO: 441352 - RNA, 24 nt, Human
gccuccggaagcagcccuacaaca

SEQ ID NO: 441353 - RNA, 18 nt, Human
gccuccggacagcggcgu

SEQ ID NO: 441354 - RNA, 22 nt, Human
gccuccggaccucgcugcagcg

SEQ ID NO: 441355 - RNA, 20 nt, Human
gccuccggacugucuuccaa

SEQ ID NO: 441356 - RNA, 32 nt, Human
gccuccggagaacugggauuacaggcaugcac

SEQ ID NO: 441357 - RNA, 32 nt, Human
gccuccggagagagcuuggcccugcucacacc

SEQ ID NO: 441358 - RNA, 21 nt, Human
gccuccggcccgcccccggcc

SEQ ID NO: 441359 - RNA, 22 nt, Human
gccuccggcccugccccacaca

SEQ ID NO: 441360 - RNA, 25 nt, Human
gccuccggccgggaggcaccagcuc

SEQ ID NO: 441361 - RNA, 32 nt, Human
gccuccggcucugcgcucaccugcugccuagu

SEQ ID NO: 441362 - RNA, 32 nt, Human
gccuccgggccagacgcgcugcagccuccagc

SEQ ID NO: 441363 - RNA, 22 nt, Human
gccuccggggcaccuucaggca

SEQ ID NO: 441364 - RNA, 32 nt, Human
gccuccggggcuggugcguggccggcagcucg

SEQ ID NO: 441365 - RNA, 19 nt, Human
gccuccguagccgccccgg

SEQ ID NO: 441366 - RNA, 32 nt, Human
gccuccguauuucagacugaaugggggugggg

SEQ ID NO: 441367 - RNA, 19 nt, Human
gccuccgucauccaugccc

SEQ ID NO: 441368 - RNA, 32 nt, Human
gccuccgucucccagguucaagcaguucuccu

SEQ ID NO: 441369 - RNA, 20 nt, Human
gccuccgucuggguaccagc

SEQ ID NO: 441370 - RNA, 32 nt, Human
gccuccgugagcuggugcugccccaggcucca

SEQ ID NO: 441371 - RNA, 32 nt, Human
gccuccguggcuggcccugugcccucugucuu

SEQ ID NO: 441372 - RNA, 24 nt, Human
gccuccguuuccucaacugugaaa

SEQ ID NO: 441373 - RNA, 32 nt, Human
gccuccuaaagugcuggagauuacaggcauga

SEQ ID NO: 441374 - RNA, 32 nt, Human
gccuccuaagugcugggauuacaggcgugaac

SEQ ID NO: 441375 - RNA, 18 nt, Human
gccuccuaccugccccca

SEQ ID NO: 441376 - RNA, 32 nt, Human
gccuccuacuuuuaccuguccaugucuuauac

SEQ ID NO: 441377 - RNA, 32 nt, Human
gccuccuagaggcugagggggcaacgguguga

SEQ ID NO: 441378 - RNA, 32 nt, Human
gccuccuagggagggcggggguuguggugaga

SEQ ID NO: 441379 - RNA, 32 nt, Human
gccuccuaguaccaaaccuacaguggcuuccc

SEQ ID NO: 441380 - RNA, 32 nt, Human
gccuccuaguuucccccuaugaagguucccuu

SEQ ID NO: 441381 - RNA, 32 nt, Human
gccuccucagcccucggcgccgccgccugacc

SEQ ID NO: 441382 - RNA, 32 nt, Human
gccuccucagggcugaagaugccuccauucgc

SEQ ID NO: 441383 - RNA, 20 nt, Human
gccuccuccaagagggcuca

SEQ ID NO: 441384 - RNA, 32 nt, Human
gccuccuccaccuccaccuccaccccgccugg

SEQ ID NO: 441385 - RNA, 32 nt, Human
gccuccuccagccucagggaacuguggaacua

SEQ ID NO: 441386 - RNA, 32 nt, Human
gccuccuccauaccucauugccaucuggcucu

SEQ ID NO: 441387 - RNA, 32 nt, Human
gccuccucccugccaaccuccuccucccugcc

SEQ ID NO: 441388 - RNA, 32 nt, Human
gccuccucccuucccuuccacucuuuaaaguu

SEQ ID NO: 441389 - RNA, 32 nt, Human
gccuccuccuagcuggagugccauggcugggg

SEQ ID NO: 441390 - RNA, 32 nt, Human
gccuccuccuccugccauucucucuccaccua

SEQ ID NO: 441391 - RNA, 32 nt, Human
gccuccuccucuuccuccuccuccugggccgg

SEQ ID NO: 441392 - RNA, 32 nt, Human
gccuccuccucuuccuccuuaucuucuccaac

SEQ ID NO: 441393 - RNA, 32 nt, Human
gccuccuccucuucucucauccuuccuccgac

SEQ ID NO: 441394 - RNA, 32 nt, Human
gccuccuccuuggagcucuguagccaucgugg

SEQ ID NO: 441395 - RNA, 32 nt, Human
gccuccucgcuccugagaccuggcccugccac

SEQ ID NO: 441396 - RNA, 32 nt, Human
gccuccucggccuuggagagcagcggcggcgg

SEQ ID NO: 441397 - RNA, 25 nt, Human
gccuccucuagccaucccuugggga

SEQ ID NO: 441398 - RNA, 32 nt, Human
gccuccucucaccauucucugccauccuccau

SEQ ID NO: 441399 - RNA, 32 nt, Human
gccuccucucaccccugcuccagcccaccaca

SEQ ID NO: 441400 - RNA, 32 nt, Human
gccuccucucggugcgggaccaugaagcugcu

SEQ ID NO: 441401 - RNA, 32 nt, Human
gccuccucucugcuucucccuccuccucagua

SEQ ID NO: 441402 - RNA, 32 nt, Human
gccuccucucugugugugccucugcguucccu

SEQ ID NO: 441403 - RNA, 32 nt, Human
gccuccucugcaccuggacaacucaacuccug

SEQ ID NO: 441404 - RNA, 32 nt, Human
gccuccucugccaccucugccaccuccccuga

SEQ ID NO: 441405 - RNA, 32 nt, Human
gccuccucugcccugcccaccagccugugauu

SEQ ID NO: 441406 - RNA, 32 nt, Human
gccuccucugcgucuccgccuucccugggccg

SEQ ID NO: 441407 - RNA, 32 nt, Human
gccuccucugguguugcaaggaagaggcugaa

SEQ ID NO: 441408 - RNA, 32 nt, Human
gccuccucuucacucuccucugauuagaugaa

SEQ ID NO: 441409 - RNA, 32 nt, Human
gccuccucuuccacugucguccuuccucagag

SEQ ID NO: 441410 - RNA, 32 nt, Human
gccuccucuucccaggggcugccaaguccugg

SEQ ID NO: 441411 - RNA, 32 nt, Human
gccuccucuugcugcuaaucucugcugugaac

SEQ ID NO: 441412 - RNA, 32 nt, Human
gccuccugaaccacuggccccaaccaacccac

SEQ ID NO: 441413 - RNA, 19 nt, Human
gccuccugaaggaaggaag

SEQ ID NO: 441414 - RNA, 32 nt, Human
gccuccugaaguagcuggaacuacagacaugc

SEQ ID NO: 441415 - RNA, 22 nt, Human
gccuccugacaagcgggaggga

SEQ ID NO: 441416 - RNA, 32 nt, Human
gccuccugagagcugggacuacaggcgccugc

SEQ ID NO: 441417 - RNA, 20 nt, Human
gccuccugagcuccaugccc

SEQ ID NO: 441418 - RNA, 32 nt, Human
gccuccugagcuccaugcccaucaggacucua

SEQ ID NO: 441419 - RNA, 32 nt, Human
gccuccugaguagcuggauuacaggcaugugc

SEQ ID NO: 441420 - RNA, 32 nt, Human
gccuccugaguagcuggauuacagggccuggc

SEQ ID NO: 441421 - RNA, 32 nt, Human
gccuccugaguagcugggacuacaagugugua

SEQ ID NO: 441422 - RNA, 32 nt, Human
gccuccugcaccuccucaccucccagccugcc

SEQ ID NO: 441423 - RNA, 18 nt, Human
gccuccugcagaacuuug

SEQ ID NO: 441424 - RNA, 32 nt, Human
gccuccugcagaccuccgccaucugggggcac

SEQ ID NO: 441425 - RNA, 32 nt, Human
gccuccugcagagguaccgccugcugcccccg

SEQ ID NO: 441426 - RNA, 21 nt, Human
gccuccugcaguuucuucucu

SEQ ID NO: 441427 - RNA, 32 nt, Human
gccuccugccacugaggcccugggcagaugcu

SEQ ID NO: 441428 - RNA, 32 nt, Human
gccuccugcccacaauggccucugcugacaag

SEQ ID NO: 441429 - RNA, 32 nt, Human
gccuccugcccagcacaggaaucgguggucuc

SEQ ID NO: 441430 - RNA, 32 nt, Human
gccuccugcccuggcccggcgcugcggcucug

SEQ ID NO: 441431 - RNA, 32 nt, Human
gccuccugcccuugucacuaaucaccaaggag

SEQ ID NO: 441432 - RNA, 32 nt, Human
gccuccugccuccccaucuucucucugcccag

SEQ ID NO: 441433 - RNA, 32 nt, Human
gccuccugccuccccugccugccugggaccca

SEQ ID NO: 441434 - RNA, 21 nt, Human
gccuccugcggacaccagcuc

SEQ ID NO: 441435 - RNA, 32 nt, Human
gccuccugcugggaacagugucccccagagcc

SEQ ID NO: 441436 - RNA, 32 nt, Human
gccuccugcuuggaucucuccugggucucccu

SEQ ID NO: 441437 - RNA, 21 nt, Human
gccuccuggaaacaccagcuc

SEQ ID NO: 441438 - RNA, 32 nt, Human
gccuccuggaggaggaaguggaggccgcugcg

SEQ ID NO: 441439 - RNA, 32 nt, Human
gccuccuggaguuuuauuuuguuuuucugcuu

SEQ ID NO: 441440 - RNA, 19 nt, Human
gccuccuggccccacccca

SEQ ID NO: 441441 - RNA, 32 nt, Human
gccuccuggccuggcccccaccggugcauccg

SEQ ID NO: 441442 - RNA, 32 nt, Human
gccuccuggcugcuucagcagguggauccauu

SEQ ID NO: 441443 - RNA, 29 nt, Human
gccuccuggcugcuuucuccccuuccccc

SEQ ID NO: 441444 - RNA, 32 nt, Human
gccuccuggcugggugcucagugcuuguuucu

SEQ ID NO: 441445 - RNA, 32 nt, Human
gccuccugggaccucagcagggccgaggauca

SEQ ID NO: 441446 - RNA, 32 nt, Human
gccuccugggccaccaguaucaguuccuuccu

SEQ ID NO: 441447 - RNA, 32 nt, Human
gccuccugggcuauuccucuccacccagaagg

SEQ ID NO: 441448 - RNA, 32 nt, Human
gccuccuggggaggggcucgaggagcccacgc

SEQ ID NO: 441449 - RNA, 32 nt, Human
gccuccugguccccucagcucugccucugcag

SEQ ID NO: 441450 - RNA, 32 nt, Human
gccuccuggucuuccugagccugggccuggua

SEQ ID NO: 441451 - RNA, 32 nt, Human
gccuccuguaaucccagcuacuugggaggcug

SEQ ID NO: 441452 - RNA, 32 nt, Human
gccuccuguagcaguagggcccccagccagcg

SEQ ID NO: 441453 - RNA, 32 nt, Human
gccuccuguagggcagugccaggccuugauug

SEQ ID NO: 441454 - RNA, 32 nt, Human
gccuccugucccugccugcucugggugcucau

SEQ ID NO: 441455 - RNA, 32 nt, Human
gccuccugucucucgaaucuuccagagauauc

SEQ ID NO: 441456 - RNA, 32 nt, Human
gccuccugucugcaguggccauccugaggaua

SEQ ID NO: 441457 - RNA, 32 nt, Human
gccuccugugggaggcugaggacugcaagagg

SEQ ID NO: 441458 - RNA, 32 nt, Human
gccuccuguggucucaggcuugcgcuggaccu

SEQ ID NO: 441459 - RNA, 32 nt, Human
gccuccuuaaggaaggugcaagagguuggcag

SEQ ID NO: 441460 - RNA, 32 nt, Human
gccuccuuaguagugggauuacaggugcccgc

SEQ ID NO: 441461 - RNA, 32 nt, Human
gccuccuuaguggugcuugcagucacaggaag

SEQ ID NO: 441462 - RNA, 21 nt, Human
gccuccuucacccuuccugcc

SEQ ID NO: 441463 - RNA, 18 nt, Human
gccuccuucaggcugcug

SEQ ID NO: 441464 - RNA, 32 nt, Human
gccuccuucccaggacccaggucugcugccca

SEQ ID NO: 441465 - RNA, 32 nt, Human
gccuccuucccauggauugcaaaggaacggug

SEQ ID NO: 441466 - RNA, 32 nt, Human
gccuccuucccgcuuuuugaguuacagggagu

SEQ ID NO: 441467 - RNA, 32 nt, Human
gccuccuuccuugaaugcuuucuaagaggggc

SEQ ID NO: 441468 - RNA, 32 nt, Human
gccuccuucgacucggcuccugcccagcuccc

SEQ ID NO: 441469 - RNA, 19 nt, Human
gccuccuucuccccugcca

SEQ ID NO: 441470 - RNA, 32 nt, Human
gccuuuggccuaaaccauuucuagcuauggac

SEQ ID NO: 441471 - RNA, 32 nt, Human
gccuuuggccuuucuccucccaggccuccaca

SEQ ID NO: 441472 - RNA, 32 nt, Human
gccuuugggaaagaucagagaggcagaggugg

SEQ ID NO: 441473 - RNA, 32 nt, Human
gccuuugggaggugaugggguuaugagggugg

SEQ ID NO: 441474 - RNA, 32 nt, Human
gccuuugggaggugguuaggccgugagggugg

SEQ ID NO: 441475 - RNA, 32 nt, Human
gccuuugggcugggggccucucuccuggguca

SEQ ID NO: 441476 - RNA, 32 nt, Human
gccuuuggggcagacuccagacaaggaugucu

SEQ ID NO: 441477 - RNA, 32 nt, Human
gccuuugggugagggacacugguagggaucaa

SEQ ID NO: 441478 - RNA, 32 nt, Human
gccuuuggucccacccccauccccucuauauc

SEQ ID NO: 441479 - RNA, 32 nt, Human
gccuuuggucuccuggaugggccuuugagccu

SEQ ID NO: 441480 - RNA, 32 nt, Human
gccuuugguggagccggggagaggaagggugg

SEQ ID NO: 441481 - RNA, 32 nt, Human
gccuuugguggggaacagaaccuccgcaucgu

SEQ ID NO: 441482 - RNA, 18 nt, Human
gccuuuguaccucaggug

SEQ ID NO: 441483 - RNA, 32 nt, Human
gccuuugucaccgggaccucagccugacccca

SEQ ID NO: 441484 - RNA, 32 nt, Human
gccuuugucaugaguugagaaaaguaguccua

SEQ ID NO: 441485 - RNA, 32 nt, Human
gccuuugucgcccaggcuggagugcaauggcg

SEQ ID NO: 441486 - RNA, 32 nt, Human
gccuuugucucaggagcaaaccagccuuggcu

SEQ ID NO: 441487 - RNA, 32 nt, Human
gccuuugucuccaccugaaacuccugaaaauc

SEQ ID NO: 441488 - RNA, 32 nt, Human
gccuuugucugugguuccuggcaagguggcuu

SEQ ID NO: 441489 - RNA, 32 nt, Human
gccuuugucuugucccucaguggggguucucu

SEQ ID NO: 441490 - RNA, 32 nt, Human
gccuuugugaagccagcagaggcugagaaccu

SEQ ID NO: 441491 - RNA, 23 nt, Human
gccuuugugcucccaccucuucu

SEQ ID NO: 441492 - RNA, 32 nt, Human
gccuuuguggaaaacucgugggugacagugag

SEQ ID NO: 441493 - RNA, 32 nt, Human
gccuuuguggugaauggaggaccacgucuauu

SEQ ID NO: 441494 - RNA, 32 nt, Human
gccuuuguuucugcauuaaaccaauauugauc

SEQ ID NO: 441495 - RNA, 32 nt, Human
gccuuuuagaaaacauggaguugcuccuuugg

SEQ ID NO: 441496 - RNA, 32 nt, Human
gccuuuuagggcaugaggauguugggagaaua

SEQ ID NO: 441497 - RNA, 32 nt, Human
gccuuuuauacugaagaugccaccccaagcag

SEQ ID NO: 441498 - RNA, 32 nt, Human
gccuuuuauuuacuaucccccaccccaucaau

SEQ ID NO: 441499 - RNA, 32 nt, Human
gccuuuuauuuauaaagacacuaagaaaaccc

SEQ ID NO: 441500 - RNA, 25 nt, Human
gccuuuucauugcccgaaaccagag

SEQ ID NO: 441501 - RNA, 32 nt, Human
gccuuuuccagcuggcugcagagaaggggcca

SEQ ID NO: 441502 - RNA, 32 nt, Human
gccuuuuccuccuccucacagaggagaugugu

SEQ ID NO: 441503 - RNA, 32 nt, Human
gccuuuuccuggaggccuuccugggccuucuu

SEQ ID NO: 441504 - RNA, 32 nt, Human
gccuuuucuaggauugcauuucccaagugcua

SEQ ID NO: 441505 - RNA, 32 nt, Human
gccuuuucuucccagggacucuggucauugcu

SEQ ID NO: 441506 - RNA, 32 nt, Human
gccuuuucuuguagguguguccuuuucaaauu

SEQ ID NO: 441507 - RNA, 32 nt, Human
gccuuuugaaaagagaaaaagaaugaaguaac

SEQ ID NO: 441508 - RNA, 32 nt, Human
gccuuuugaacuguacaucucacauguuggga

SEQ ID NO: 441509 - RNA, 32 nt, Human
gccuuuugccccacccccagcauacaaugaug

SEQ ID NO: 441510 - RNA, 19 nt, Human
gccuuuugcuguccuggua

SEQ ID NO: 441511 - RNA, 32 nt, Human
gccuuuuggauggauugucucuaguuacuccc

SEQ ID NO: 441512 - RNA, 32 nt, Human
gccuuuugguacaguguuuucaucucuugguc

SEQ ID NO: 441513 - RNA, 32 nt, Human
gccuuuuguagucuuccaggagacaggugauu

SEQ ID NO: 441514 - RNA, 32 nt, Human
gccuuuugucaaggagucugcaggaauuggcu

SEQ ID NO: 441515 - RNA, 32 nt, Human
gccuuuugucugcuucuacuacuccaucaagg

SEQ ID NO: 441516 - RNA, 32 nt, Human
gccuuuuguugcugccugucaugcucucacuc

SEQ ID NO: 441517 - RNA, 17 nt, Human
gccuuuuuaaagcuuug

SEQ ID NO: 441518 - RNA, 32 nt, Human
gccuuuuuacagccaacuuuucuagaccuguu

SEQ ID NO: 441519 - RNA, 32 nt, Human
gccuuuuuccaaaagaccggcaauaacacuug

SEQ ID NO: 441520 - RNA, 32 nt, Human
gccuuuuucuccuuugcuuucugccaugauua

SEQ ID NO: 441521 - RNA, 32 nt, Human
gccuuuuugacgucccuggcuguugugggcaa

SEQ ID NO: 441522 - RNA, 32 nt, Human
gccuuuuugcagugggaggcgacgguggagga

SEQ ID NO: 441523 - RNA, 32 nt, Human
gcgaaaaagaaaaagaaagaaggggagagggc

SEQ ID NO: 441524 - RNA, 32 nt, Human
gcgaaaacugguuuuucauguguuuuugugcc

SEQ ID NO: 441525 - RNA, 32 nt, Human
gcgaaaagacggaaagaaagaaagaaaacgag

SEQ ID NO: 441526 - RNA, 32 nt, Human
gcgaaaaucuccugugcuuguggaagcaacau

SEQ ID NO: 441527 - RNA, 23 nt, Human
gcgaaacagagugaauggucaac

SEQ ID NO: 441528 - RNA, 32 nt, Human
gcgaaacauugcccucaacagccaccuggcug

SEQ ID NO: 441529 - RNA, 32 nt, Human
gcgaaagaaaucaaacccccaacuucuucggc

SEQ ID NO: 441530 - RNA, 21 nt, Human
gcgaaagccgcagccgagucc

SEQ ID NO: 441531 - RNA, 24 nt, Human
gcgaaagcuggagaagcagcagca

SEQ ID NO: 441532 - RNA, 32 nt, Human
gcgaaaggaaaggccuucacacccucacagag

SEQ ID NO: 441533 - RNA, 22 nt, Human
gcgaaaggagcaggguugcgga

SEQ ID NO: 441534 - RNA, 32 nt, Human
gcgaaaucucagcucacugcaaccuccgccuc

SEQ ID NO: 441535 - RNA, 32 nt, Human
gcgaaaucuuuguacuucugaguucuugcugu

SEQ ID NO: 441536 - RNA, 32 nt, Human
gcgaacaaaugcugggguccuuggggaccagc

SEQ ID NO: 441537 - RNA, 32 nt, Human
gcgaacagccauugcacuccagccugggcaac

SEQ ID NO: 441538 - RNA, 32 nt, Human
gcgaacauggugagacccaucucuacuaaaaa

SEQ ID NO: 441539 - RNA, 32 nt, Human
gcgaaccuauaguagcagcuacuccagaggcu

SEQ ID NO: 441540 - RNA, 32 nt, Human
gcgaaccugaggaggaagaaacggggcuagcg

SEQ ID NO: 441541 - RNA, 32 nt, Human
gcgaaccugccugggcaggcagcucgcgcagg

SEQ ID NO: 441542 - RNA, 32 nt, Human
gcgaaccugccuguaucucacccaugaugcgu

SEQ ID NO: 441543 - RNA, 32 nt, Human
gcgaaccuguucccucuccccacaucccccgc

SEQ ID NO: 441544 - RNA, 32 nt, Human
gcgaacgcagccgccacgccggggccgccgag

SEQ ID NO: 441545 - RNA, 32 nt, Human
gcgaacggcuccaguucaaagccacaugcacc

SEQ ID NO: 441546 - RNA, 32 nt, Human
gcgaacgucuugcuguuguguuuuuauguccc

SEQ ID NO: 441547 - RNA, 32 nt, Human
gcgaacucccagaaggugguggugggcacugu

SEQ ID NO: 441548 - RNA, 32 nt, Human
gcgaacuccccagaggaggagguagugcgagg

SEQ ID NO: 441549 - RNA, 19 nt, Human
gcgaacuccgcggccucgg

SEQ ID NO: 441550 - RNA, 32 nt, Human
gcgaacucucagaaauaaaucacagaugcaua

SEQ ID NO: 441551 - RNA, 32 nt, Human
gcgaacugaguauuuaaugacacuucuagagc

SEQ ID NO: 441552 - RNA, 32 nt, Human
gcgaacugucagccucagccucccagugugcu

SEQ ID NO: 441553 - RNA, 32 nt, Human
gcgaagaagacaugauaaggacaucagggagc

SEQ ID NO: 441554 - RNA, 32 nt, Human
gcgaagaccacgaugaagcccccaacagccac

SEQ ID NO: 441555 - RNA, 24 nt, Human
gcgaagaccccgccugcgcccccg

SEQ ID NO: 441556 - RNA, 32 nt, Human
gcgaagacugcuccugguggccugugcauagg

SEQ ID NO: 441557 - RNA, 32 nt, Human
gcgaagagagaagagacuaucaagaucuccac

SEQ ID NO: 441558 - RNA, 32 nt, Human
gcgaagagagagagcuguaggccagcugccgg

SEQ ID NO: 441559 - RNA, 32 nt, Human
gcgaagagagggcugaacccguccgcugcccg

SEQ ID NO: 441560 - RNA, 32 nt, Human
gcgaagaggaggaggaaggggaggacgauggg

SEQ ID NO: 441561 - RNA, 22 nt, Human
gcgaagcagcgagcugaggcgg

SEQ ID NO: 441562 - RNA, 32 nt, Human
gcgaagcccagaggaggcggcuugggauccuc

SEQ ID NO: 441563 - RNA, 23 nt, Human
gcgaagccgaaaaaggcagcagc

SEQ ID NO: 441564 - RNA, 20 nt, Human
gcgaagccggggguggcggc

SEQ ID NO: 441565 - RNA, 21 nt, Human
gcgaagcggcugcagcggcgg

SEQ ID NO: 441566 - RNA, 22 nt, Human
gcgaagcggcuggagggcggcg

SEQ ID NO: 441567 - RNA, 22 nt, Human
gcgaagcgggaaagcgcggcgg

SEQ ID NO: 441568 - RNA, 32 nt, Human
gcgaagcuuccuccuccucuccagcugguagu

SEQ ID NO: 441569 - RNA, 32 nt, Human
gcgaaggagcgcguagccgagaucaggcguac

SEQ ID NO: 441570 - RNA, 23 nt, Human
gcgaaggagcuggaaaccgagcc

SEQ ID NO: 441571 - RNA, 32 nt, Human
gcgaaggaggaagaggaggaggaggaagaggg

SEQ ID NO: 441572 - RNA, 32 nt, Human
gcgaaggaggcagcgggccgggggcugaggcg

SEQ ID NO: 441573 - RNA, 22 nt, Human
gcgaaggagucgacuccagcga

SEQ ID NO: 441574 - RNA, 24 nt, Human
gcgaaggccagggucccacacucg

SEQ ID NO: 441575 - RNA, 21 nt, Human
gcgaagggcagcggaggagcg

SEQ ID NO: 441576 - RNA, 32 nt, Human
gcgaaggggccgggccccagacugagccugug

SEQ ID NO: 441577 - RNA, 22 nt, Human
gcgaaggggguugcaguagggg

SEQ ID NO: 441578 - RNA, 20 nt, Human
gcgaaggugacggaggagug

SEQ ID NO: 441579 - RNA, 32 nt, Human
gcgaagucuuccagcucagcagugucucguuc

SEQ ID NO: 441580 - RNA, 32 nt, Human
gcgaagugaaggguggcccagguggggccagg

SEQ ID NO: 441581 - RNA, 24 nt, Human
gcgaagugacucacaccugcaauc

SEQ ID NO: 441582 - RNA, 23 nt, Human
gcgaagugcgagagaccccggac

SEQ ID NO: 441583 - RNA, 24 nt, Human
gcgaaguggcccaugccuguaauc

SEQ ID NO: 441584 - RNA, 32 nt, Human
gcgaauagccacugcacuccagccugggcaau

SEQ ID NO: 441585 - RNA, 20 nt, Human
gcgaaucaccugaggucagg

SEQ ID NO: 441586 - RNA, 32 nt, Human
gcgaaucgaguugccaggugucacugaugcua

SEQ ID NO: 441587 - RNA, 32 nt, Human
gcgaaugauguggacaacaagcgcugcuaccu

SEQ ID NO: 441588 - RNA, 32 nt, Human
gcgaaugcccaaccucauaaacuaucugaaac

SEQ ID NO: 441589 - RNA, 32 nt, Human
gcgaaugcccaggacuucaacgcaugcacuuu

SEQ ID NO: 441590 - RNA, 32 nt, Human
gcgaaugcucuaucuccagucugucucugugu

SEQ ID NO: 441591 - RNA, 32 nt, Human
gcgaauggcgugaacccgggaggcggagcuug

SEQ ID NO: 441592 - RNA, 29 nt, Human
gcgaaugggaccggaggcgaggaggacga

SEQ ID NO: 441593 - RNA, 26 nt, Human
gcgaaugggucagagccagaccccgg

SEQ ID NO: 441594 - RNA, 32 nt, Human
gcgaauguccguuuucucucccuucccaccuc

SEQ ID NO: 441595 - RNA, 32 nt, Human
gcgaauuggaaaugcugagcuuccauaaguca

SEQ ID NO: 441596 - RNA, 32 nt, Human
gcgacaaccucagugggcucugcuucugccag

SEQ ID NO: 441597 - RNA, 32 nt, Human
gcgacaaucacugacgccgaagccugcagcca

SEQ ID NO: 441598 - RNA, 32 nt, Human
gcgacacacacguguaacacugcaucggaugc

SEQ ID NO: 441599 - RNA, 32 nt, Human
gcgacaccuugauuuugaccuugugagaccua

SEQ ID NO: 441600 - RNA, 32 nt, Human
gcgacacgagacuggcaccucuacaucugauu

SEQ ID NO: 441601 - RNA, 32 nt, Human
gcgacacugcacuccagccugggcaacagagu

SEQ ID NO: 441602 - RNA, 32 nt, Human
gcgacacugcacuccagccugggugacgguga

SEQ ID NO: 441603 - RNA, 32 nt, Human
gcgacacugcacugcaggcugggcuacaaagc

SEQ ID NO: 441604 - RNA, 32 nt, Human
gcgacacugcgcuccagccugggcaacaagag

SEQ ID NO: 441605 - RNA, 32 nt, Human
gcgacacuggcggccuccgaccucucagaccu

SEQ ID NO: 441606 - RNA, 32 nt, Human
gcgacacuuuacucacagccuggcuugaguca

SEQ ID NO: 441607 - RNA, 32 nt, Human
gcgacacuuugguggggguggguuguuugucg

SEQ ID NO: 441608 - RNA, 32 nt, Human
gcgacagagcccggggaaggaggcagggcaag

SEQ ID NO: 441609 - RNA, 28 nt, Human
gcgacagcacugggaaugacaacuggaa

SEQ ID NO: 441610 - RNA, 18 nt, Human
gcgacagcagcaacagca

SEQ ID NO: 441611 - RNA, 32 nt, Human
gcgacagcuagaugaguguuugaauaacuggg

SEQ ID NO: 441612 - RNA, 32 nt, Human
gcgacaggaaaucucuagguuggugagugcug

SEQ ID NO: 441613 - RNA, 32 nt, Human
gcgacaggaauagaugugguccuuaggagacg

SEQ ID NO: 441614 - RNA, 32 nt, Human
gcgacaggacauggagaaagagcgagagacuc

SEQ ID NO: 441615 - RNA, 32 nt, Human
gcgacaggaggcagggcagacuguggaggaca

SEQ ID NO: 441616 - RNA, 32 nt, Human
gcgacagggaaagcgcgggcgagcgcaggaga

SEQ ID NO: 441617 - RNA, 32 nt, Human
gcgacagggagggucagagggaggccggcugc

SEQ ID NO: 441618 - RNA, 32 nt, Human
gcgacagguggugcagcagagcuggauugcgc

SEQ ID NO: 441619 - RNA, 32 nt, Human
gcgacauaggaaaauaaccaagcacaaaguua

SEQ ID NO: 441620 - RNA, 23 nt, Human
gcgacaucugcccugagcugcuc

SEQ ID NO: 441621 - RNA, 32 nt, Human
gcgacauggcuagggcugguucugccaucuga

SEQ ID NO: 441622 - RNA, 32 nt, Human
gcgacaugggauuuaauuuggcuaaagcaccc

SEQ ID NO: 441623 - RNA, 30 nt, Human
gcgacauguccaccccggcucggcggcgcc

SEQ ID NO: 441624 - RNA, 32 nt, Human
gcgaccaacacagaggagagaaaacaaaaaua

SEQ ID NO: 441625 - RNA, 22 nt, Human
gcgaccaccuggcaggggagcg

SEQ ID NO: 441626 - RNA, 32 nt, Human
gcgaccagccugggcagaauagcaagacccag

SEQ ID NO: 441627 - RNA, 32 nt, Human
gcgaccagccuggucaacauaguggaccccag

SEQ ID NO: 441628 - RNA, 32 nt, Human
gcgaccaggacgucagccagcacugcacagac

SEQ ID NO: 441629 - RNA, 32 nt, Human
gcgaccaggcuggacucgggcugugcaggggc

SEQ ID NO: 441630 - RNA, 32 nt, Human
gcgaccccaauauuuggaaccaggaagcugca

SEQ ID NO: 441631 - RNA, 32 nt, Human
gcgaccccgggaacccugcucaguccugccgg

SEQ ID NO: 441632 - RNA, 32 nt, Human
gcgacccgacauagugagacccugucucuacu

SEQ ID NO: 441633 - RNA, 32 nt, Human
gcgacccguggggcaugcaagccucagugagc

SEQ ID NO: 441634 - RNA, 32 nt, Human
gcgacccucacuggccuggccuugugggggcu

SEQ ID NO: 441635 - RNA, 19 nt, Human
gcgacccugcagcugcucg

SEQ ID NO: 441636 - RNA, 32 nt, Human
gcgacccugcagcugcucgcucugauguaccc

SEQ ID NO: 441637 - RNA, 32 nt, Human
gcgaccgagcccagagagacggagcaaguugc

SEQ ID NO: 441638 - RNA, 32 nt, Human
gcgaccgaggagagaagagagcagagcaauac

SEQ ID NO: 441639 - RNA, 24 nt, Human
gcgaccgcagaccuccccagggug

SEQ ID NO: 441640 - RNA, 24 nt, Human
gcgaccgcagccauucuccagggu

SEQ ID NO: 441641 - RNA, 19 nt, Human
gcgaccgccgcggcugcag

SEQ ID NO: 441642 - RNA, 32 nt, Human
gcgaccgcugcucggccugcugugccacauac

SEQ ID NO: 441643 - RNA, 32 nt, Human
gcgaccggacgcugcgggcggggaagaggaug

SEQ ID NO: 441644 - RNA, 32 nt, Human
gcgaccgggcggacgagguggagccagagucu

SEQ ID NO: 441645 - RNA, 32 nt, Human
gcgaccuaaccccacagguggggaaggacuau

SEQ ID NO: 441646 - RNA, 32 nt, Human
gcgaccuagggcacuaucucccuaccccacgc

SEQ ID NO: 441647 - RNA, 32 nt, Human
gcgaccucaccuucauucuuaggucaauacag

SEQ ID NO: 441648 - RNA, 32 nt, Human
gcgaccucuccaucuucagcuucuucaucuuc

SEQ ID NO: 441649 - RNA, 19 nt, Human
gcgaccuggagcccgggug

SEQ ID NO: 441650 - RNA, 32 nt, Human
gcgaccugggaggcacagggaggggagagaug

SEQ ID NO: 441651 - RNA, 32 nt, Human
gcgaccugggcugggagcagagcugacugaca

SEQ ID NO: 441652 - RNA, 32 nt, Human
gcgaccugggcuguggcugagacaauaaugag

SEQ ID NO: 441653 - RNA, 32 nt, Human
gcgaccuugcaaccucaccuuccugugggugu

SEQ ID NO: 441654 - RNA, 23 nt, Human
gcgaccuuggccggacccagccc

SEQ ID NO: 441655 - RNA, 31 nt, Human
gcgacgacuacgaccacuaggagagcggacg

SEQ ID NO: 441656 - RNA, 32 nt, Human
gcgacgagaaggcugggcucuuccgcuacugc

SEQ ID NO: 441657 - RNA, 32 nt, Human
gcgacgcaggcagaccauggcagaguucuccc

SEQ ID NO: 441658 - RNA, 32 nt, Human
gcgacgccuauuuuguauaaaguuuccgacuc

SEQ ID NO: 441659 - RNA, 32 nt, Human
gcgacgcggcccagaggccaggaacauuccgc

SEQ ID NO: 441660 - RNA, 32 nt, Human
gcgacggagggcagggcccacccugcgguguc

SEQ ID NO: 441661 - RNA, 32 nt, Human
gcgacggauccuccuccucccuuauucccuug

SEQ ID NO: 441662 - RNA, 32 nt, Human
gcgacggggaagcaggaggugugggguugguc

SEQ ID NO: 441663 - RNA, 32 nt, Human
gcgacgucaccgccauggcaggcaucaaagcu

SEQ ID NO: 441664 - RNA, 32 nt, Human
gcgacguccugcuggucucugccaucaucacc

SEQ ID NO: 441665 - RNA, 32 nt, Human
gcgacgugccccagaagugcagccgugaaggc

SEQ ID NO: 441666 - RNA, 32 nt, Human
gcgacguguauuaagcagcgguugugacucau

SEQ ID NO: 441667 - RNA, 32 nt, Human
gcgacgugucccacuguccuggcuccgugggu

SEQ ID NO: 441668 - RNA, 32 nt, Human
gcgacuaccucccuucugacccugcugcuggc

SEQ ID NO: 441669 - RNA, 32 nt, Human
gcgacuagccgggagaccagagaucuagcgac

SEQ ID NO: 441670 - RNA, 32 nt, Human
gcgacuaggagcugagccuucuaccucgacgg

SEQ ID NO: 441671 - RNA, 32 nt, Human
gcgacuagggcuuugagcugggcaguuuuccc

SEQ ID NO: 441672 - RNA, 32 nt, Human
gcgacuccaggugggagugagggagcccagcc

SEQ ID NO: 441673 - RNA, 22 nt, Human
gcgacucccagaagagauagcc

SEQ ID NO: 441674 - RNA, 32 nt, Human
gcgacuccggagcccagcagagcugcgcuuuu

SEQ ID NO: 441675 - RNA, 20 nt, Human
gcgacuccuauggcccagcc

SEQ ID NO: 441676 - RNA, 32 nt, Human
gcgacuccucugagcugaguuugaggccgucc

SEQ ID NO: 441677 - RNA, 32 nt, Human
gcgacuccugcucuugcuucuggaucugcagg

SEQ ID NO: 441678 - RNA, 21 nt, Human
gcgacuccugguacccagacc

SEQ ID NO: 441679 - RNA, 32 nt, Human
gcgacugagaacaccaggaucagauccgugcg

SEQ ID NO: 441680 - RNA, 32 nt, Human
gcgacugcaugguggagagggagcuggggcgc

SEQ ID NO: 441681 - RNA, 32 nt, Human
gcgacugccugggguccuauuuuccacccugc

SEQ ID NO: 441682 - RNA, 32 nt, Human
gcgacugcgccccagacuucugucuuuucagc

SEQ ID NO: 441683 - RNA, 32 nt, Human
gcgacugcgcucaguucucuccucucggaagc

SEQ ID NO: 441684 - RNA, 32 nt, Human
gcgacugcucccggccggaggugcagggagcu

SEQ ID NO: 441685 - RNA, 32 nt, Human
gcgacuggagccagaugugagcugagcccaag

SEQ ID NO: 441686 - RNA, 32 nt, Human
gcgacuggcgccgccucaccgccucccaccgc

SEQ ID NO: 441687 - RNA, 32 nt, Human
gcgacuggggccugagcuggcaaggccaagga

SEQ ID NO: 441688 - RNA, 32 nt, Human
gcgacugggggcccuggcccggcacuguccuc

SEQ ID NO: 441689 - RNA, 32 nt, Human
gcgacugucucagacugggcagggaggcuuug

SEQ ID NO: 441690 - RNA, 32 nt, Human
gcgacugugucaccuaccagacugaguaccgc

SEQ ID NO: 441691 - RNA, 32 nt, Human
gcgacuuacccaggccuuuuugcagugggagg

SEQ ID NO: 441692 - RNA, 32 nt, Human
gcgacuucucaagcuuuugaaugggugagugg

SEQ ID NO: 441693 - RNA, 21 nt, Human
gcgacuucuccagcccagucc

SEQ ID NO: 441694 - RNA, 32 nt, Human
gcgacuugaagaggacgcaggcuuccagagga

SEQ ID NO: 441695 - RNA, 32 nt, Human
gcgagaaaauucaagaaaauaaauguagcugg

SEQ ID NO: 441696 - RNA, 32 nt, Human
gcgagaaacagagaucauaaagagcacguuuu

SEQ ID NO: 441697 - RNA, 32 nt, Human
gcgagaaacuauacacucaguuuuaaagaagc

SEQ ID NO: 441698 - RNA, 23 nt, Human
gcgagaaaggugagcuauuggga

SEQ ID NO: 441699 - RNA, 32 nt, Human
gcgagaagaccggccgagggagagccgaucgc

SEQ ID NO: 441700 - RNA, 18 nt, Human
gcgagaagggcaccagca

SEQ ID NO: 441701 - RNA, 32 nt, Human
gcgagaagggcugcuucccugaagcucccaca

SEQ ID NO: 441702 - RNA, 32 nt, Human
gcgagaagucugggguucagugacacacuucu

SEQ ID NO: 441703 - RNA, 18 nt, Human
gcgagacagcgguggugg

SEQ ID NO: 441704 - RNA, 18 nt, Human
gcgagaccacaggucacc

SEQ ID NO: 441705 - RNA, 32 nt, Human
gcgagaccagagcagucugaaggauuccccac

SEQ ID NO: 441706 - RNA, 32 nt, Human
gcgagaccagccugaccaacauggagaaaccc

SEQ ID NO: 441707 - RNA, 32 nt, Human
gcgagaccauccuggcuaacacggugaaaccc

SEQ ID NO: 441708 - RNA, 32 nt, Human
gcgagacccaggcugggcaaggcgcaguuuca

SEQ ID NO: 441709 - RNA, 20 nt, Human
gcgagacccggggcugggcc

SEQ ID NO: 441710 - RNA, 32 nt, Human
gcgagacccuguaugaauaguaccaaagcauu

SEQ ID NO: 441711 - RNA, 32 nt, Human
gcgagaccugggagggagggguccuccagcag

SEQ ID NO: 441712 - RNA, 32 nt, Human
gcgagacggaguuucgucauguuggccaggcc

SEQ ID NO: 441713 - RNA, 32 nt, Human
gcgagacggcccugaguggaagugucuggcuc

SEQ ID NO: 441714 - RNA, 32 nt, Human
gcgagacucacugcagugucaagaucaccuuu

SEQ ID NO: 441715 - RNA, 18 nt, Human
gcgagacucuugucucaa

SEQ ID NO: 441716 - RNA, 32 nt, Human
gcgagacuucaaggacucaguuugguuccacc

SEQ ID NO: 441717 - RNA, 32 nt, Human
gcgagagaacaucuuccuucucuaccaucacu

SEQ ID NO: 441718 - RNA, 32 nt, Human
gcgagagaggagaagggaaagguggagggcua

SEQ ID NO: 441719 - RNA, 32 nt, Human
gcgagagagggugugagagugaguggcgugcu

SEQ ID NO: 441720 - RNA, 32 nt, Human
gcgagagauggucaggucuggagcucgaccgg

SEQ ID NO: 441721 - RNA, 22 nt, Human
gcgagagcacgcggaggagcgu

SEQ ID NO: 441722 - RNA, 32 nt, Human
gcgagagccagccaacuaccccuucuucccag

SEQ ID NO: 441723 - RNA, 32 nt, Human
gcgagagcccaggagugggcguuucacuuuuc

SEQ ID NO: 441724 - RNA, 32 nt, Human
gcgagagcgagagagccgggaggcagagggag

SEQ ID NO: 441725 - RNA, 32 nt, Human
gcgagagcugccugauggccucuugucaggag

SEQ ID NO: 441726 - RNA, 32 nt, Human
gcgagaggaggcagagggggcgucaggccgcg

SEQ ID NO: 441727 - RNA, 32 nt, Human
gcgagaggagucgggaucugcgcugcagccac

SEQ ID NO: 441728 - RNA, 32 nt, Human
gcgagaggccgagcuugcugcauugcagccgc

SEQ ID NO: 441729 - RNA, 32 nt, Human
gcgagaggcugaggcaggagaauggcgugaac

SEQ ID NO: 441730 - RNA, 21 nt, Human
gcgagagggcgaggccgagcc

SEQ ID NO: 441731 - RNA, 22 nt, Human
gcgagagggggaagaggagcgu

SEQ ID NO: 441732 - RNA, 23 nt, Human
gcgagaggugggaggucagagga

SEQ ID NO: 441733 - RNA, 32 nt, Human
gcgagaguucuaggagagaagcugguccaccc

SEQ ID NO: 441734 - RNA, 32 nt, Human
gcgagauaaccagcccgagucaugcagucuuu

SEQ ID NO: 441735 - RNA, 18 nt, Human
gcgagauccgccccggcc

SEQ ID NO: 441736 - RNA, 32 nt, Human
gcgagaucucagcucacggcaaccuccgccuc

SEQ ID NO: 441737 - RNA, 32 nt, Human
gcgagaucugugcaagucugguuuugguuagg

SEQ ID NO: 441738 - RNA, 23 nt, Human
gcgagaucuuggcauccugugag

SEQ ID NO: 441739 - RNA, 32 nt, Human
gcgagauggagaaggggaaggaaggggcuuug

SEQ ID NO: 441740 - RNA, 30 nt, Human
gcgagauggagacagcccccaagccgggca

SEQ ID NO: 441741 - RNA, 32 nt, Human
gcgagauggagcaggcccaucugccucugccc

SEQ ID NO: 441742 - RNA, 32 nt, Human
gcgagauggaguccccaagaggguggacccug

SEQ ID NO: 441743 - RNA, 32 nt, Human
gcgagaugggaagagaaaacuggccagaggcc

SEQ ID NO: 441744 - RNA, 32 nt, Human
gcgagauguuggguuaggggaggcagauccgg

SEQ ID NO: 441745 - RNA, 22 nt, Human
gcgagcaagccggcaagcgagc

SEQ ID NO: 441746 - RNA, 21 nt, Human
gcgagcaagcugaggccacgu

SEQ ID NO: 441747 - RNA, 32 nt, Human
gcgagcaaggggagagccaguugcgcagagcc

SEQ ID NO: 441748 - RNA, 32 nt, Human
gcgagcacaguggcuccguggaagaugacauc

SEQ ID NO: 441749 - RNA, 32 nt, Human
gcgagcaccagcugacccccaguggaacccug

SEQ ID NO: 441750 - RNA, 32 nt, Human
gcgagcaccuguaaucucagcacuuugggagg

SEQ ID NO: 441751 - RNA, 23 nt, Human
gcgagcaccuguaaugucagcua

SEQ ID NO: 441752 - RNA, 32 nt, Human
gcgagcacugcacaguucgcuucccugaaucg

SEQ ID NO: 441753 - RNA, 17 nt, Human
gcgagcagagggggcgg

SEQ ID NO: 441754 - RNA, 24 nt, Human
gcgagcagaucaccugagguccgg

SEQ ID NO: 441755 - RNA, 32 nt, Human
gcgagcagcaggaagcggaggaggaaaggagc

SEQ ID NO: 441756 - RNA, 32 nt, Human
gcgagcagccuggaacagacccaggcggagga

SEQ ID NO: 441757 - RNA, 32 nt, Human
gcgagcagcguggagcucagugacagcagcag

SEQ ID NO: 441758 - RNA, 32 nt, Human
gcgagcaggugugaaugagcccagggaaggac

SEQ ID NO: 441759 - RNA, 32 nt, Human
gcgagcaugccacuguacuccagccugagcua

SEQ ID NO: 441760 - RNA, 31 nt, Human
gcgagcauggggcgccuggccucgaggccgc

SEQ ID NO: 441761 - RNA, 22 nt, Human
gcgagccaauacgggccgagcc

SEQ ID NO: 441762 - RNA, 32 nt, Human
gcgagccagugccccuggaucuugccucugcu

SEQ ID NO: 441763 - RNA, 32 nt, Human
gcgagccaucuugccagaauucugacagugau

SEQ ID NO: 441764 - RNA, 21 nt, Human
gcgagccccagcgcccuggca

SEQ ID NO: 441765 - RNA, 20 nt, Human
gcgagccccgcgccccggcc

SEQ ID NO: 441766 - RNA, 32 nt, Human
gcgagccccugcacuccauccugcugaccaug

SEQ ID NO: 441767 - RNA, 32 nt, Human
gcgagcccgagcccccgcccccggcuagcccc

SEQ ID NO: 441768 - RNA, 18 nt, Human
gcgagcccuccuacuggg

SEQ ID NO: 441769 - RNA, 32 nt, Human
gcgagcccugcugcccuccagccgggcuucuc

SEQ ID NO: 441770 - RNA, 32 nt, Human
gcgagcccuucggccccucacccuccaggcug

SEQ ID NO: 441771 - RNA, 25 nt, Human
gcgagccgcgggagccgaccccggg

SEQ ID NO: 441772 - RNA, 32 nt, Human
gcgagccggugcugcugcaggcugaggcugcg

SEQ ID NO: 441773 - RNA, 32 nt, Human
gcgagccguccaggucucagugcugugccccc

SEQ ID NO: 441774 - RNA, 23 nt, Human
gcgagccuccaggcccagcaaug

SEQ ID NO: 441775 - RNA, 32 nt, Human
gcgagccuccaggcccagcaaugagggacuug

SEQ ID NO: 441776 - RNA, 32 nt, Human
gcgagccucccguccaggugcuucuggcuuuc

SEQ ID NO: 441777 - RNA, 32 nt, Human
gcgagccuguaauuccagcuacuuggaggcug

SEQ ID NO: 441778 - RNA, 32 nt, Human
gcgagcgaaaagcggggguggggaggaaaggg

SEQ ID NO: 441779 - RNA, 22 nt, Human
gcgagcgagagagcggcgcggg

SEQ ID NO: 441780 - RNA, 32 nt, Human
gcgagcgagaugcccaaccccaaaaacagcaa

SEQ ID NO: 441781 - RNA, 31 nt, Human
gcgagcgaggaagacggaaaagacugccugc

SEQ ID NO: 441782 - RNA, 32 nt, Human
gcgagcgagggagaggagggagagggggaggg

SEQ ID NO: 441783 - RNA, 32 nt, Human
gcgagcgcacacacaugcacaagugcgaagga

SEQ ID NO: 441784 - RNA, 32 nt, Human
gcgagcgccagcuccggccagccugggacagc

SEQ ID NO: 441785 - RNA, 18 nt, Human
gcgagcgcgaggcugcag

SEQ ID NO: 441786 - RNA, 32 nt, Human
gcgagcgcggcgcagcccagcccagcccaguc

SEQ ID NO: 441787 - RNA, 32 nt, Human
gcgagcgcgggggaaggcgaaaaagaaaaaga

SEQ ID NO: 441788 - RNA, 20 nt, Human
gcgagcgcggggggcgagcc

SEQ ID NO: 441789 - RNA, 32 nt, Human
gcgagcgcggucgagaucgccaugccuacccg

SEQ ID NO: 441790 - RNA, 19 nt, Human
gcgagcggcagcgacagca

SEQ ID NO: 441791 - RNA, 21 nt, Human
gcgagcggccagcagagggcg

SEQ ID NO: 441792 - RNA, 32 nt, Human
gcgagcggccuccccucacuuccuccuggugg

SEQ ID NO: 441793 - RNA, 32 nt, Human
gcgagcggcgcuggagggaggaaagcuuccgc

SEQ ID NO: 441794 - RNA, 22 nt, Human
gcgagcggcgggcggaggagcg

SEQ ID NO: 441795 - RNA, 32 nt, Human
gcgagcggcugaggccgccagggcccaaagga

SEQ ID NO: 441796 - RNA, 32 nt, Human
gcgagcgggagcgcggcguccgggaggcggcg

SEQ ID NO: 441797 - RNA, 32 nt, Human
gcgagcgggcggcggaggcggcggcggcggcg

SEQ ID NO: 441798 - RNA, 32 nt, Human
gcgagcggggagguggaggaagcugugcggug

SEQ ID NO: 441799 - RNA, 32 nt, Human
gcgagcguugccgggccagggucaagcggagg

SEQ ID NO: 441800 - RNA, 32 nt, Human
gcgagcuaccgcuucacuuucucccuccugcc

SEQ ID NO: 441801 - RNA, 32 nt, Human
gcgagcuagagaaaucaccaccguuuagacca

SEQ ID NO: 441802 - RNA, 32 nt, Human
gcgagcucugcagaucaggaggcugcggaaga

SEQ ID NO: 441803 - RNA, 32 nt, Human
gcgagcugcagccucuggggccugugaagccc

SEQ ID NO: 441804 - RNA, 19 nt, Human
gcgagcuggagggcugcag

SEQ ID NO: 441805 - RNA, 32 nt, Human
gcgagcuggccacaccugugaggcugcaguga

SEQ ID NO: 441806 - RNA, 32 nt, Human
gcgagcuggccaccuggccacccucuacacgg

SEQ ID NO: 441807 - RNA, 32 nt, Human
gcgagcugggcaccugggagcaccagcugcgg

SEQ ID NO: 441808 - RNA, 32 nt, Human
gcgagcugggccguguguaugugagugccgau

SEQ ID NO: 441809 - RNA, 32 nt, Human
gcgagcuggggcugcacugugcccaugcugcc

SEQ ID NO: 441810 - RNA, 32 nt, Human
gcgagcuucuacuucuaaguguggaccguacu

SEQ ID NO: 441811 - RNA, 32 nt, Human
gcgagcuugguugugauguggggcagccuagc

SEQ ID NO: 441812 - RNA, 32 nt, Human
gcgagcuuuguggagcuccaggaagcaauaua

SEQ ID NO: 441813 - RNA, 32 nt, Human
gcgaggaagauguggcuggaacccugcaccaa

SEQ ID NO: 441814 - RNA, 18 nt, Human
gcgaggaagggccgagcc

SEQ ID NO: 441815 - RNA, 32 nt, Human
gcgaggaaugcaauuccugggcccgcugcugu

SEQ ID NO: 441816 - RNA, 32 nt, Human
gcgaggacagaagucccgccguguggcccuca

SEQ ID NO: 441817 - RNA, 32 nt, Human
gcgaggacaggagcccgucacccaugagcucu

SEQ ID NO: 441818 - RNA, 32 nt, Human
gcgaggaccagaaacaccugcaagaggcacgg

SEQ ID NO: 441819 - RNA, 32 nt, Human
gcgaggacccugcaccuggaugggggucccug

SEQ ID NO: 441820 - RNA, 32 nt, Human
gcgaggaccggccaccccagacuuccuguccc

SEQ ID NO: 441821 - RNA, 20 nt, Human
gcgaggaccggcggaggagc

SEQ ID NO: 441822 - RNA, 32 nt, Human
gcgaggacgugauccgcuucugcuccggcuug

SEQ ID NO: 441823 - RNA, 25 nt, Human
gcgaggacucgagcgcuggcugcag

SEQ ID NO: 441824 - RNA, 32 nt, Human
gcgaggagcaagaaaagaguaacaugggagau

SEQ ID NO: 441825 - RNA, 18 nt, Human
gcgaggagcaggcugcag

SEQ ID NO: 441826 - RNA, 32 nt, Human
gcgaggaggaggcggagguggagcuggcggag

SEQ ID NO: 441827 - RNA, 32 nt, Human
gcgaggaggccgcggcgggcgcagcgggcacc

SEQ ID NO: 441828 - RNA, 19 nt, Human
gcgaggaggccucuugaag

SEQ ID NO: 441829 - RNA, 32 nt, Human
gcgaggaggcuauuuccagacacuuccacccc

SEQ ID NO: 441830 - RNA, 32 nt, Human
gcgaggaggcuucugcacguucugcgugggcc

SEQ ID NO: 441831 - RNA, 20 nt, Human
gcgaggagggagcagcagca

SEQ ID NO: 441832 - RNA, 19 nt, Human
gcgaggaguccccggggag

SEQ ID NO: 441833 - RNA, 31 nt, Human
gcgaggauggccagaccaucucugugcaccc

SEQ ID NO: 441834 - RNA, 32 nt, Human
gcgaggauuuggacuggcagugagaauaagag

SEQ ID NO: 441835 - RNA, 32 nt, Human
gcgaggcaaugcucuagguccuguaggggcug

SEQ ID NO: 441836 - RNA, 32 nt, Human
gcgaggcaggagagaggaggaggagugcggcg

SEQ ID NO: 441837 - RNA, 22 nt, Human
gcgaggcaggcaccggcggcgg

SEQ ID NO: 441838 - RNA, 18 nt, Human
gcgaggcaggcggccggc

SEQ ID NO: 441839 - RNA, 32 nt, Human
gcgaggcagggcccagcccugaaggagaucuc

SEQ ID NO: 441840 - RNA, 32 nt, Human
gcgaggcaugcaugaggccuccagccgguggu

SEQ ID NO: 441841 - RNA, 18 nt, Human
gcgaggccaagaccacca

SEQ ID NO: 441842 - RNA, 18 nt, Human
gcgaggccaaggcugcag

SEQ ID NO: 441843 - RNA, 20 nt, Human
gcgaggccaaggcugcagca

SEQ ID NO: 441844 - RNA, 32 nt, Human
gcgaggccaggagaucaagaccauccugacua

SEQ ID NO: 441845 - RNA, 20 nt, Human
gcgaggccagggagcgaggc

SEQ ID NO: 441846 - RNA, 21 nt, Human
gcgaggccauggcccgagucc

SEQ ID NO: 441847 - RNA, 32 nt, Human
gcgaggcccauguugcugcuguucccuggcgc

SEQ ID NO: 441848 - RNA, 32 nt, Human
gcgaggcccgagagucagaaccugggggagag

SEQ ID NO: 441849 - RNA, 24 nt, Human
gcgaggcccggaggccugagcacc

SEQ ID NO: 441850 - RNA, 32 nt, Human
gcgaggcccgggagcuguguugcggcuccggc

SEQ ID NO: 441851 - RNA, 22 nt, Human
gcgaggcccuggacggcggcgg

SEQ ID NO: 441852 - RNA, 24 nt, Human
gcgaggccgaagccgacggcgcgg

SEQ ID NO: 441853 - RNA, 21 nt, Human
gcgaggccgagacccagcagc

SEQ ID NO: 441854 - RNA, 19 nt, Human
gcgaggccgagcccaggca

SEQ ID NO: 441855 - RNA, 19 nt, Human
gcgaggccgagggcagcgg

SEQ ID NO: 441856 - RNA, 18 nt, Human
gcgaggccgcccgacgca

SEQ ID NO: 441857 - RNA, 32 nt, Human
gcgaggccgcgaccucugccacguggaccgcg

SEQ ID NO: 441858 - RNA, 32 nt, Human
gcgaggccgcgggucccaccucccgggggcgg

SEQ ID NO: 441859 - RNA, 21 nt, Human
gcgaggccggaaaggagacgc

SEQ ID NO: 441860 - RNA, 23 nt, Human
gcgaggccggagggccgcggcgg

SEQ ID NO: 441861 - RNA, 20 nt, Human
gcgaggccggagggggacgc

SEQ ID NO: 441862 - RNA, 21 nt, Human
gcgaggccggcccagcacagc

SEQ ID NO: 441863 - RNA, 19 nt, Human
gcgaggccggcgccgcaca

SEQ ID NO: 441864 - RNA, 32 nt, Human
gcgaggccggcgccgcacacacacauuaacac

SEQ ID NO: 441865 - RNA, 19 nt, Human
gcgaggccgggcccccagc

SEQ ID NO: 441866 - RNA, 20 nt, Human
gcgaggccgggcccgagcag

SEQ ID NO: 441867 - RNA, 20 nt, Human
gcgaggccgggcgccgcagc

SEQ ID NO: 441868 - RNA, 32 nt, Human
gcgaggccggggaggugcuggagcggggccaa

SEQ ID NO: 441869 - RNA, 19 nt, Human
gcgaggccggggcccaggc

SEQ ID NO: 441870 - RNA, 20 nt, Human
gcgaggccgggggccgagag

SEQ ID NO: 441871 - RNA, 32 nt, Human
gcgaggccgucggagaaaacuuaagcguggag

SEQ ID NO: 441872 - RNA, 17 nt, Human
gcgaggccgugaacagc

SEQ ID NO: 441873 - RNA, 32 nt, Human
gcgaggccucaaguagugagggccagucgagc

SEQ ID NO: 441874 - RNA, 32 nt, Human
gcgaggccucauccacaugcaggggacggcgc

SEQ ID NO: 441875 - RNA, 32 nt, Human
gcgaggccucuuccugcugggcucccagacuc

SEQ ID NO: 441876 - RNA, 23 nt, Human
gcgaggccugagaagggugguuc

SEQ ID NO: 441877 - RNA, 20 nt, Human
gcgaggccugcggccagucc

SEQ ID NO: 441878 - RNA, 22 nt, Human
gcgaggccugggggcgcccgcc

SEQ ID NO: 441879 - RNA, 23 nt, Human
gcgaggccuggugguggcggcgg

SEQ ID NO: 441880 - RNA, 18 nt, Human
gcgaggcgaggccgagcc

SEQ ID NO: 441881 - RNA, 32 nt, Human
gcgaggcgcuguccuuucagcaccacaagcuc

SEQ ID NO: 441882 - RNA, 19 nt, Human
gcgaggcggccggcggcgg

SEQ ID NO: 441883 - RNA, 18 nt, Human
gcgaggcggcggcggcgg

SEQ ID NO: 441884 - RNA, 32 nt, Human
gcgaggcggggcacugcagcacacaacgcagg

SEQ ID NO: 441885 - RNA, 32 nt, Human
gcgaggcugccuggcucccuuucucagcagcu

SEQ ID NO: 441886 - RNA, 23 nt, Human
gcgaggcugggggcggccggcgg

SEQ ID NO: 441887 - RNA, 32 nt, Human
gcgaggcuuacuuaauuaagcacuuuguaaug

SEQ ID NO: 441888 - RNA, 22 nt, Human
gcgagggaaguugaggcugcag

SEQ ID NO: 441889 - RNA, 32 nt, Human
gcgagggacacggaguagaagaggcuguccug

SEQ ID NO: 441890 - RNA, 32 nt, Human
gcgagggacaguucaacugaacuucgaaagca

SEQ ID NO: 441891 - RNA, 21 nt, Human
gcgagggaccugacagcagca

SEQ ID NO: 441892 - RNA, 32 nt, Human
gcgagggagaggagggagagggggaggggagg

SEQ ID NO: 441893 - RNA, 32 nt, Human
gcgagggagaggggcggccgcgcggaucacug

SEQ ID NO: 441894 - RNA, 32 nt, Human
gcgagggaggggagggaagggaagggaaggga

SEQ ID NO: 441895 - RNA, 32 nt, Human
gcgagggccacuacacuccagccugggugaca

SEQ ID NO: 441896 - RNA, 25 nt, Human
gcgagggcggcgggggcccgaaccc

SEQ ID NO: 441897 - RNA, 21 nt, Human
gcgagggcucaggacccggag

SEQ ID NO: 441898 - RNA, 19 nt, Human
gcgagggcugcgaggccag

SEQ ID NO: 441899 - RNA, 16 nt, Human
gcgagggcugcggcgc

SEQ ID NO: 441900 - RNA, 21 nt, Human
gcgagggcugugccggugcag

SEQ ID NO: 441901 - RNA, 21 nt, Human
gcgagggcugugcuggugcag

SEQ ID NO: 441902 - RNA, 32 nt, Human
gcgaggggagagagguguggugggcacacaga

SEQ ID NO: 441903 - RNA, 32 nt, Human
gcgaggggagcgcgcuccggugaccucuagcg

SEQ ID NO: 441904 - RNA, 21 nt, Human
gcgaggggauaggccgaguuc

SEQ ID NO: 441905 - RNA, 24 nt, Human
gcgaggggcagauucuagucggga

SEQ ID NO: 441906 - RNA, 32 nt, Human
gcgaggggcugggcucagagggccagggcauc

SEQ ID NO: 441907 - RNA, 32 nt, Human
gcgagggggaauaagagcagggcagcccccug

SEQ ID NO: 441908 - RNA, 22 nt, Human
gcgagggggcccccagcugccu

SEQ ID NO: 441909 - RNA, 32 nt, Human
gcgaggguagccuuggaaauucuuaaaucagg

SEQ ID NO: 441910 - RNA, 32 nt, Human
gcgagggucagccugcugugcccacacacacc

SEQ ID NO: 441911 - RNA, 32 nt, Human
gcgagggucaucuucaucacagaguacguguc

SEQ ID NO: 441912 - RNA, 32 nt, Human
gcgaggguccaauccugcccugcgcuaguccu

SEQ ID NO: 441913 - RNA, 18 nt, Human
gcgagguacuggcugcag

SEQ ID NO: 441914 - RNA, 32 nt, Human
gcgagguaguuucuuugguauucuugcccagg

SEQ ID NO: 441915 - RNA, 23 nt, Human
gcgaggucaccaugccagcuucc

SEQ ID NO: 441916 - RNA, 32 nt, Human
gcgaggucagaaaucacaagccugggcauggc

SEQ ID NO: 441917 - RNA, 32 nt, Human
gcgagguccagaucacugaauucauguuuaca

SEQ ID NO: 441918 - RNA, 20 nt, Human
gcgaggugcagcggcugcgg

SEQ ID NO: 441919 - RNA, 22 nt, Human
gcgaggugcgcgagccgagucc

SEQ ID NO: 441920 - RNA, 32 nt, Human
gcgagguggcgcugcacugggggcugggugcu

SEQ ID NO: 441921 - RNA, 24 nt, Human
gcgagguggcucacaccuguaauc

SEQ ID NO: 441922 - RNA, 24 nt, Human
gcgagguggcucacgccuguaauc

SEQ ID NO: 441923 - RNA, 24 nt, Human
gcgagguggcucaugccugaaauc

SEQ ID NO: 441924 - RNA, 24 nt, Human
gcgagguggcucaugccuguaauc

SEQ ID NO: 441925 - RNA, 23 nt, Human
gcgagguggucaugccuguaauc

SEQ ID NO: 441926 - RNA, 32 nt, Human
gcgaggugucugcccuuuauguuuccacaucu

SEQ ID NO: 441927 - RNA, 32 nt, Human
gcgagguuggggcugccgugagcccagauugc

SEQ ID NO: 441928 - RNA, 32 nt, Human
gcgagguuucuucucaucaccagcucagcuag

SEQ ID NO: 441929 - RNA, 18 nt, Human
gcgaguacaccugcacca

SEQ ID NO: 441930 - RNA, 32 nt, Human
gcgaguaggccucuuccaccagaagcuguucg

SEQ ID NO: 441931 - RNA, 32 nt, Human
gcgaguagggggcggcucuggggaaguggcag

SEQ ID NO: 441932 - RNA, 32 nt, Human
gcgaguaucugucccaggagcccacacagagg

SEQ ID NO: 441933 - RNA, 32 nt, Human
gcgagucaacaucgucuuuaacuacgacaugc

SEQ ID NO: 441934 - RNA, 32 nt, Human
gcgagucacggggagagcagaaagcuuugggc

SEQ ID NO: 441935 - RNA, 32 nt, Human
gcgagucauccaguauagacuauggucgaaga

SEQ ID NO: 441936 - RNA, 32 nt, Human
gcgagucauugcuucucuuaauuuauuuaccu

SEQ ID NO: 441937 - RNA, 32 nt, Human
gcgaguccaccgagcggccucugaggagcagc

SEQ ID NO: 441938 - RNA, 25 nt, Human
gcgaguccauagcugaagaggagcg

SEQ ID NO: 441939 - RNA, 32 nt, Human
gcgagucgccucccccgcccagcuucagcccu

SEQ ID NO: 441940 - RNA, 32 nt, Human
gcgagucggcgguguccaggagggaaggaacg

SEQ ID NO: 441941 - RNA, 22 nt, Human
gcgagucggugagcagcuggga

SEQ ID NO: 441942 - RNA, 32 nt, Human
gcgagucuccuccuucagucuccugguagcug

SEQ ID NO: 441943 - RNA, 32 nt, Human
gcgagucuccugcaguguagggcuacuuuguc

SEQ ID NO: 441944 - RNA, 32 nt, Human
gcgagugacugcaccgagcccgagaagucgcc

SEQ ID NO: 441945 - RNA, 32 nt, Human
gcgagugagcaccagcgauugguucggaagcg

SEQ ID NO: 441946 - RNA, 22 nt, Human
gcgagugaggagcagacccagg

SEQ ID NO: 441947 - RNA, 32 nt, Human
gcgagugaggcagcagcucccagccuuuucag

SEQ ID NO: 441948 - RNA, 32 nt, Human
gcgagugcaugggcuaauuaucaucaaucuuu

SEQ ID NO: 441949 - RNA, 19 nt, Human
gcgagugcuguugguccca

SEQ ID NO: 441950 - RNA, 32 nt, Human
gcgaguggagcgagggagagacggugggaugg

SEQ ID NO: 441951 - RNA, 32 nt, Human
gcgaguggcagucugcccacgcagaggacgca

SEQ ID NO: 441952 - RNA, 31 nt, Human
gcgaguggcuucucugggccggguucguacu

SEQ ID NO: 441953 - RNA, 32 nt, Human
gcgagugggcaggcagcugcgagacagaaccg

SEQ ID NO: 441954 - RNA, 32 nt, Human
gcgagugggugagugaguucaagucagaggag

SEQ ID NO: 441955 - RNA, 32 nt, Human
gcgaguguggaggacccgagacauccuguaaa

SEQ ID NO: 441956 - RNA, 32 nt, Human
gcgagugugugcaagugucugugugcaagugu

SEQ ID NO: 441957 - RNA, 32 nt, Human
gcgagugugugggguuccuccuucccuccuuu

SEQ ID NO: 441958 - RNA, 32 nt, Human
gcgaguucacgccagucuccugccucagccuu

SEQ ID NO: 441959 - RNA, 32 nt, Human
gcgaguuccuccugcauaugaaccgaggggag

SEQ ID NO: 441960 - RNA, 32 nt, Human
gcgaguuggaaaccagucugaccaacguggag

SEQ ID NO: 441961 - RNA, 22 nt, Human
gcgaguuggucggucccggggu

SEQ ID NO: 441962 - RNA, 32 nt, Human
gcgauagauuuagaggaaaggaagcaccgucg

SEQ ID NO: 441963 - RNA, 32 nt, Human
gcgauauacagaugaaaauuugagacuauuua

SEQ ID NO: 441964 - RNA, 32 nt, Human
gcgauaucagggacugugcucaugagggcgga

SEQ ID NO: 441965 - RNA, 32 nt, Human
gcgauauuaaaugccaacuacauggccaagcg

SEQ ID NO: 441966 - RNA, 32 nt, Human
gcgaucacggaucagucagagcagggucagga

SEQ ID NO: 441967 - RNA, 32 nt, Human
gcgaucagcggcuggggcagguuaugguagug

SEQ ID NO: 441968 - RNA, 32 nt, Human
gcgauccaccugucucagccucccagagugcu

SEQ ID NO: 441969 - RNA, 32 nt, Human
gcgauccagacuccuagcuucccaccgaggca

SEQ ID NO: 441970 - RNA, 32 nt, Human
gcgauccagcagagagggcuggagacgggacg

SEQ ID NO: 441971 - RNA, 32 nt, Human
gcgaucccagccgccaccgccgccgcaccagc

SEQ ID NO: 441972 - RNA, 32 nt, Human
gcgaucccuugcugcgggcccggagaucaaac

SEQ ID NO: 441973 - RNA, 32 nt, Human
gcgauccucccaucucagccucccagagugcu

SEQ ID NO: 441974 - RNA, 32 nt, Human
gcgauccucccgccucagccuccagagcaccu

SEQ ID NO: 441975 - RNA, 32 nt, Human
gcgauccuccugccuuagccucccagaguacu

SEQ ID NO: 441976 - RNA, 32 nt, Human
gcgaucgaaggagccuucacguaaaugggucc

SEQ ID NO: 441977 - RNA, 32 nt, Human
gcgaucgccuugaguccagccucugcauaaac

SEQ ID NO: 441978 - RNA, 32 nt, Human
gcgaucucacugcaaccucugccucccgggcu

SEQ ID NO: 441979 - RNA, 32 nt, Human
gcgaucuccacagcagccucugaggccgcccc

SEQ ID NO: 441980 - RNA, 32 nt, Human
gcgaucuccacugcacugcugugggcugaacu

SEQ ID NO: 441981 - RNA, 32 nt, Human
gcgaucugagcacucaggcugaucuagaggaa

SEQ ID NO: 441982 - RNA, 32 nt, Human
gcgaucugccugcuucagccucccagagugcu

SEQ ID NO: 441983 - RNA, 32 nt, Human
gcgaucuggggagcuuguaggcucacuuugcu

SEQ ID NO: 441984 - RNA, 32 nt, Human
gcgaucuucccauguuggcugcccaaagugcu

SEQ ID NO: 441985 - RNA, 32 nt, Human
gcgaugaaaccaggaacucacuuucccgggau

SEQ ID NO: 441986 - RNA, 32 nt, Human
gcgaugaaaguuacagcuaucauguuuauguc

SEQ ID NO: 441987 - RNA, 32 nt, Human
gcgaugaacacccgaaggugggagggaggacu

SEQ ID NO: 441988 - RNA, 31 nt, Human
gcgaugacauuugcucucacagcagaugaca

SEQ ID NO: 441989 - RNA, 28 nt, Human
gcgaugacccugucgccacuucugcugu

SEQ ID NO: 441990 - RNA, 32 nt, Human
gcgaugacucacugcagcacccccucccacuu

SEQ ID NO: 441991 - RNA, 32 nt, Human
gcgaugagaccaguaugaaacggagggccacg

SEQ ID NO: 441992 - RNA, 28 nt, Human
gcgaugauggcagaagagcacacagauc

SEQ ID NO: 441993 - RNA, 32 nt, Human
gcgaugcauuaggaagauccuggaccuagaga

SEQ ID NO: 441994 - RNA, 28 nt, Human
gcgaugccggagcuggcagugcagaagg

SEQ ID NO: 441995 - RNA, 32 nt, Human
gcgaugcuaaguuucucccauagaaagagccg

SEQ ID NO: 441996 - RNA, 32 nt, Human
gcgaugcuaucuccucaacucucccucuucuc

SEQ ID NO: 441997 - RNA, 32 nt, Human
gcgaugcucauaccucagccuccugaguagcu

SEQ ID NO: 441998 - RNA, 32 nt, Human
gcgaugcucggagcugcguccucuguccuggg

SEQ ID NO: 441999 - RNA, 32 nt, Human
gcgaugcugagccaccuccuccgagccuuccu

SEQ ID NO: 442000 - RNA, 28 nt, Human
gcgaugcugccucugcugcgcugcgugc

SEQ ID NO: 442001 - RNA, 32 nt, Human
gcgaugcuugccuugcguucucuccccugaac

SEQ ID NO: 442002 - RNA, 32 nt, Human
gcgauggcaaaguggauaaagccuggucccug

SEQ ID NO: 442003 - RNA, 22 nt, Human
gcgauggcucacgccuguaauc

SEQ ID NO: 442004 - RNA, 32 nt, Human
gcgaugggcugaaggggcuccaggcaacugag

SEQ ID NO: 442005 - RNA, 28 nt, Human
gcgaugggcugcagggcugcgucagggc

SEQ ID NO: 442006 - RNA, 32 nt, Human
gcgauggggaagcucuggagcauuuugugagc

SEQ ID NO: 442007 - RNA, 32 nt, Human
gcgauggggcuauauugaaucucuguaugcac

SEQ ID NO: 442008 - RNA, 32 nt, Human
gcgauggggcugggcccuggccuccuaacggg

SEQ ID NO: 442009 - RNA, 32 nt, Human
gcgauggggguugggugguggagggugggucc

SEQ ID NO: 442010 - RNA, 28 nt, Human
gcgaugguccaucagcucucugccaucc

SEQ ID NO: 442011 - RNA, 31 nt, Human
gcgauggugacuugaccuugccaagaccugu

SEQ ID NO: 442012 - RNA, 32 nt, Human
gcgauggugggaugugucgcaagcaauucacu

SEQ ID NO: 442013 - RNA, 32 nt, Human
gcgauguacagaaucagaaggugguuugacag

SEQ ID NO: 442014 - RNA, 32 nt, Human
gcgauguacuagcugcucacaagccuguuccu

SEQ ID NO: 442015 - RNA, 32 nt, Human
gcgaugucacccucuucgucucccucuucggu

SEQ ID NO: 442016 - RNA, 32 nt, Human
gcgaugugcacuccacccaagccaggcuccca

SEQ ID NO: 442017 - RNA, 32 nt, Human
gcgauuagcuuagugagcuuaccccgccggag

SEQ ID NO: 442018 - RNA, 32 nt, Human
gcgauuauugugaauaaagcgccuacaagugc

SEQ ID NO: 442019 - RNA, 32 nt, Human
gcgauuauugugccucagccuccugaguagcu

SEQ ID NO: 442020 - RNA, 32 nt, Human
gcgauuccagugggguugggcccccuggcgcc

SEQ ID NO: 442021 - RNA, 26 nt, Human
gcgauuccuucgggcgaugcuggggg

SEQ ID NO: 442022 - RNA, 32 nt, Human
gcgauucucaguaggacucacacccacccuac

SEQ ID NO: 442023 - RNA, 32 nt, Human
gcgauucuccacccuuuccccuucuuucgucc

SEQ ID NO: 442024 - RNA, 32 nt, Human
gcgauucuccagccucagccuccugaguagcu

SEQ ID NO: 442025 - RNA, 32 nt, Human
gcgauucuccugccucagccuccugagugggg

SEQ ID NO: 442026 - RNA, 32 nt, Human
gcgauucuccugccucagcuacucgggaggcu

SEQ ID NO: 442027 - RNA, 32 nt, Human
gcgauucuccugucucagccuccuggguagcu

SEQ ID NO: 442028 - RNA, 32 nt, Human
gcgauucugcagccacaaaguugagacuucug

SEQ ID NO: 442029 - RNA, 32 nt, Human
gcgauucugcgcucccggcccugcugcaggcu

SEQ ID NO: 442030 - RNA, 32 nt, Human
gcgauucugucugaccagagccucagggaaau

SEQ ID NO: 442031 - RNA, 32 nt, Human
gcgauucugucuuauaaccuccugggucccau
